United States Patent 10,706,955 (BIOINFORMATIC PROCESSES FOR DETERMINATION OF PEPTIDE BINDING) - sequence listing, part 14

SEQ ID NO: 529423 - protein, 19 aa, Mycobacterium
NEARAQPGNFATADSAEAY

SEQ ID NO: 529424 - protein, 9 aa, Mycobacterium
NEARDEGKR

SEQ ID NO: 529425 - protein, 6 aa, Mycobacterium
NEAREG

SEQ ID NO: 529426 - protein, 10 aa, Mycobacterium
NEARGLDPAL

SEQ ID NO: 529427 - protein, 7 aa, Mycobacterium
NEARTYA

SEQ ID NO: 529428 - protein, 8 aa, Mycobacterium
NEASESDI

SEQ ID NO: 529429 - protein, 7 aa, Mycobacterium
NEASRVP

SEQ ID NO: 529430 - protein, 10 aa, Mycobacterium
NEASSGPEAH

SEQ ID NO: 529431 - protein, 11 aa, Mycobacterium
NEATDGRSGAI

SEQ ID NO: 529432 - protein, 10 aa, Mycobacterium
NEATDGVGGA

SEQ ID NO: 529433 - protein, 5 aa, Mycobacterium
NEATG

SEQ ID NO: 529434 - protein, 9 aa, Mycobacterium
NEATGAETV

SEQ ID NO: 529435 - protein, 11 aa, Mycobacterium
NEATGSPTGFR

SEQ ID NO: 529436 - protein, 10 aa, Mycobacterium
NEATRSRDEL

SEQ ID NO: 529437 - protein, 9 aa, Mycobacterium
NEATRSREE

SEQ ID NO: 529438 - protein, 4 aa, Mycobacterium
NEAV

SEQ ID NO: 529439 - protein, 6 aa, Mycobacterium
NEAVPQ

SEQ ID NO: 529440 - protein, 4 aa, Mycobacterium
NECP

SEQ ID NO: 529441 - protein, 4 aa, Mycobacterium
NECR

SEQ ID NO: 529442 - protein, 4 aa, Mycobacterium
NEDA

SEQ ID NO: 529443 - protein, 8 aa, Mycobacterium
NEDADPSV

SEQ ID NO: 529444 - protein, 5 aa, Mycobacterium
NEDAI

SEQ ID NO: 529445 - protein, 7 aa, Mycobacterium
NEDAQEK

SEQ ID NO: 529446 - protein, 8 aa, Mycobacterium
NEDATEDA

SEQ ID NO: 529447 - protein, 8 aa, Mycobacterium
NEDDQAAL

SEQ ID NO: 529448 - protein, 4 aa, Mycobacterium
NEDE

SEQ ID NO: 529449 - protein, 9 aa, Mycobacterium
NEDEDVSKE

SEQ ID NO: 529450 - protein, 13 aa, Mycobacterium
NEDESARAFRSVR

SEQ ID NO: 529451 - protein, 8 aa, Mycobacterium
NEDETKAV

SEQ ID NO: 529452 - protein, 8 aa, Mycobacterium
NEDGAAGC

SEQ ID NO: 529453 - protein, 6 aa, Mycobacterium
NEDGAH

SEQ ID NO: 529454 - protein, 6 aa, Mycobacterium
NEDGAW

SEQ ID NO: 529455 - protein, 9 aa, Mycobacterium
NEDGDRTSA

SEQ ID NO: 529456 - protein, 10 aa, Mycobacterium
NEDGSNVTKD

SEQ ID NO: 529457 - protein, 6 aa, Mycobacterium
NEDGTF

SEQ ID NO: 529458 - protein, 5 aa, Mycobacterium
NEDGV

SEQ ID NO: 529459 - protein, 6 aa, Mycobacterium
NEDHAG

SEQ ID NO: 529460 - protein, 46 aa, Mycobacterium
NEDKKNDKLDEARTKYSTETLDADSTVALGTDGSFAKAEEGAKKCP

SEQ ID NO: 529461 - protein, 4 aa, Mycobacterium
NEDL

SEQ ID NO: 529462 - protein, 12 aa, Mycobacterium
NEDLPNTTNPDD

SEQ ID NO: 529463 - protein, 5 aa, Mycobacterium
NEDNR

SEQ ID NO: 529464 - protein, 7 aa, Mycobacterium
NEDPGAR

SEQ ID NO: 529465 - protein, 6 aa, Mycobacterium
NEDPNA

SEQ ID NO: 529466 - protein, 4 aa, Mycobacterium
NEDQ

SEQ ID NO: 529467 - protein, 6 aa, Mycobacterium
NEDQGI

SEQ ID NO: 529468 - protein, 13 aa, Mycobacterium
NEDQPESSDDPRV

SEQ ID NO: 529469 - protein, 14 aa, Mycobacterium
NEDQPPGSRDIPDN

SEQ ID NO: 529470 - protein, 15 aa, Mycobacterium
NEDQPTPSDDPRVAS

SEQ ID NO: 529471 - protein, 8 aa, Mycobacterium
NEDQPVDN

SEQ ID NO: 529472 - protein, 8 aa, Mycobacterium
NEDQSVDT

SEQ ID NO: 529473 - protein, 8 aa, Mycobacterium
NEDRPERL

SEQ ID NO: 529474 - protein, 4 aa, Mycobacterium
NEDS

SEQ ID NO: 529475 - protein, 5 aa, Mycobacterium
NEDSE

SEQ ID NO: 529476 - protein, 15 aa, Mycobacterium
NEDSIPTKSYDNAEG

SEQ ID NO: 529477 - protein, 14 aa, Mycobacterium
NEDTDTLDGDDKAA

SEQ ID NO: 529478 - protein, 4 aa, Mycobacterium
NEEA

SEQ ID NO: 529479 - protein, 13 aa, Mycobacterium
NEEAAEARLAQGN

SEQ ID NO: 529480 - protein, 13 aa, Mycobacterium
NEEAAEARLAQGQ

SEQ ID NO: 529481 - protein, 5 aa, Mycobacterium
NEEAN

SEQ ID NO: 529482 - protein, 5 aa, Mycobacterium
NEEDL

SEQ ID NO: 529483 - protein, 8 aa, Mycobacterium
NEEEANEW

SEQ ID NO: 529484 - protein, 7 aa, Mycobacterium
NEEETRA

SEQ ID NO: 529485 - protein, 7 aa, Mycobacterium
NEEETVG

SEQ ID NO: 529486 - protein, 7 aa, Mycobacterium
NEEEWEA

SEQ ID NO: 529487 - protein, 6 aa, Mycobacterium
NEEHEA

SEQ ID NO: 529488 - protein, 7 aa, Mycobacterium
NEEHGAK

SEQ ID NO: 529489 - protein, 10 aa, Mycobacterium
NEENASGGRI

SEQ ID NO: 529490 - protein, 10 aa, Mycobacterium
NEENASGGRV

SEQ ID NO: 529491 - protein, 4 aa, Mycobacterium
NEEP

SEQ ID NO: 529492 - protein, 12 aa, Mycobacterium
NEEQCRKSISEH

SEQ ID NO: 529493 - protein, 6 aa, Mycobacterium
NEEQGI

SEQ ID NO: 529494 - protein, 7 aa, Mycobacterium
NEEQKSK

SEQ ID NO: 529495 - protein, 5 aa, Mycobacterium
NEESM

SEQ ID NO: 529496 - protein, 10 aa, Mycobacterium
NEETHQPTPY

SEQ ID NO: 529497 - protein, 9 aa, Mycobacterium
NEETRSELN

SEQ ID NO: 529498 - protein, 4 aa, Mycobacterium
NEEW

SEQ ID NO: 529499 - protein, 13 aa, Mycobacterium
NEFGPSATRGVGG

SEQ ID NO: 529500 - protein, 21 aa, Mycobacterium
NEFQRTGRGYSAQQATRPQTL

SEQ ID NO: 529501 - protein, 7 aa, Mycobacterium
NEGAARD

SEQ ID NO: 529502 - protein, 9 aa, Mycobacterium
NEGADRTLR

SEQ ID NO: 529503 - protein, 10 aa, Mycobacterium
NEGADSTHSP

SEQ ID NO: 529504 - protein, 14 aa, Mycobacterium
NEGAGKDSVDPRDR

SEQ ID NO: 529505 - protein, 10 aa, Mycobacterium
NEGAPGKGPL

SEQ ID NO: 529506 - protein, 11 aa, Mycobacterium
NEGAPGRGPTL

SEQ ID NO: 529507 - protein, 10 aa, Mycobacterium
NEGAPPGQHY

SEQ ID NO: 529508 - protein, 8 aa, Mycobacterium
NEGAPRDL

SEQ ID NO: 529509 - protein, 6 aa, Mycobacterium
NEGAVS

SEQ ID NO: 529510 - protein, 9 aa, Mycobacterium
NEGDRQAGE

SEQ ID NO: 529511 - protein, 9 aa, Mycobacterium
NEGDRQTGE

SEQ ID NO: 529512 - protein, 24 aa, Mycobacterium
NEGEQQTRAQQRTKSSTSDHAESM

SEQ ID NO: 529513 - protein, 4 aa, Mycobacterium
NEGF

SEQ ID NO: 529514 - protein, 5 aa, Mycobacterium
NEGFG

SEQ ID NO: 529515 - protein, 8 aa, Mycobacterium
NEGGFKPQ

SEQ ID NO: 529516 - protein, 11 aa, Mycobacterium
NEGGGIQVDGN

SEQ ID NO: 529517 - protein, 5 aa, Mycobacterium
NEGGT

SEQ ID NO: 529518 - protein, 9 aa, Mycobacterium
NEGGTDTVT

SEQ ID NO: 529519 - protein, 7 aa, Mycobacterium
NEGLRSR

SEQ ID NO: 529520 - protein, 17 aa, Mycobacterium
NEGNSNTGLANSGNVNT

SEQ ID NO: 529521 - protein, 7 aa, Mycobacterium
NEGPCNQ

SEQ ID NO: 529522 - protein, 7 aa, Mycobacterium
NEGPGFP

SEQ ID NO: 529523 - protein, 4 aa, Mycobacterium
NEGQ

SEQ ID NO: 529524 - protein, 40 aa, Mycobacterium
NEGQAQQDKADAQRSAAKKEAAAEKARGKAKAAEAREKAE

SEQ ID NO: 529525 - protein, 5 aa, Mycobacterium
NEGQG

SEQ ID NO: 529526 - protein, 7 aa, Mycobacterium
NEGQGVR

SEQ ID NO: 529527 - protein, 10 aa, Mycobacterium
NEGRAQLAEA

SEQ ID NO: 529528 - protein, 5 aa, Mycobacterium
NEGRD

SEQ ID NO: 529529 - protein, 5 aa, Mycobacterium
NEGRI

SEQ ID NO: 529530 - protein, 18 aa, Mycobacterium
NEGRVKAAQAEKAAREAA

SEQ ID NO: 529531 - protein, 16 aa, Mycobacterium
NEGRVQAAQRAKDQQK

SEQ ID NO: 529532 - protein, 16 aa, Mycobacterium
NEGRVQAAQRLKEQQG

SEQ ID NO: 529533 - protein, 11 aa, Mycobacterium
NEGSDSTHSPE

SEQ ID NO: 529534 - protein, 9 aa, Mycobacterium
NEGSRAVAE

SEQ ID NO: 529535 - protein, 9 aa, Mycobacterium
NEGTEGAER

SEQ ID NO: 529536 - protein, 11 aa, Mycobacterium
NEGTEGAERAV

SEQ ID NO: 529537 - protein, 13 aa, Mycobacterium
NEGTEGAERAVDG

SEQ ID NO: 529538 - protein, 10 aa, Mycobacterium
NEGTEGAERG

SEQ ID NO: 529539 - protein, 14 aa, Mycobacterium
NEGTEGAQRALTGI

SEQ ID NO: 529540 - protein, 5 aa, Mycobacterium
NEGTK

SEQ ID NO: 529541 - protein, 7 aa, Mycobacterium
NEGVPDD

SEQ ID NO: 529542 - protein, 10 aa, Mycobacterium
NEGVPGDSER

SEQ ID NO: 529543 - protein, 8 aa, Mycobacterium
NEGVPGDV

SEQ ID NO: 529544 - protein, 6 aa, Mycobacterium
NEGVPR

SEQ ID NO: 529545 - protein, 5 aa, Mycobacterium
NEGYD

SEQ ID NO: 529546 - protein, 18 aa, Mycobacterium
NEGYDDMRSGRNIRGLIR

SEQ ID NO: 529547 - protein, 18 aa, Mycobacterium
NEGYEDMRSGKNIRGLVR

SEQ ID NO: 529548 - protein, 7 aa, Mycobacterium
NEGYGGT

SEQ ID NO: 529549 - protein, 9 aa, Mycobacterium
NEGYPNNNF

SEQ ID NO: 529550 - protein, 18 aa, Mycobacterium
NEGYQDMRSGRNIRGLVR

SEQ ID NO: 529551 - protein, 5 aa, Mycobacterium
NEHDE

SEQ ID NO: 529552 - protein, 13 aa, Mycobacterium
NEHDEKRLTSCGR

SEQ ID NO: 529553 - protein, 8 aa, Mycobacterium
NEHDTERI

SEQ ID NO: 529554 - protein, 7 aa, Mycobacterium
NEHERRR

SEQ ID NO: 529555 - protein, 8 aa, Mycobacterium
NEHGGPVR

SEQ ID NO: 529556 - protein, 11 aa, Mycobacterium
NEHGRAGNSHA

SEQ ID NO: 529557 - protein, 12 aa, Mycobacterium
NEHGYGTASMPG

SEQ ID NO: 529558 - protein, 12 aa, Mycobacterium
NEHQGIAPTRNH

SEQ ID NO: 529559 - protein, 5 aa, Mycobacterium
NEHSE

SEQ ID NO: 529560 - protein, 6 aa, Mycobacterium
NEHSEK

SEQ ID NO: 529561 - protein, 11 aa, Mycobacterium
NEHSRTNGAAL

SEQ ID NO: 529562 - protein, 9 aa, Mycobacterium
NEIAEARRG

SEQ ID NO: 529563 - protein, 7 aa, Mycobacterium
NEIARDS

SEQ ID NO: 529564 - protein, 6 aa, Mycobacterium
NEIDGA

SEQ ID NO: 529565 - protein, 9 aa, Mycobacterium
NEIDGRTSY

SEQ ID NO: 529566 - protein, 8 aa, Mycobacterium
NEIPETAL

SEQ ID NO: 529567 - protein, 6 aa, Mycobacterium
NEIRPG

SEQ ID NO: 529568 - protein, 12 aa, Mycobacterium
NEISQQFSGQGS

SEQ ID NO: 529569 - protein, 9 aa, Mycobacterium
NEKAASSGA

SEQ ID NO: 529570 - protein, 6 aa, Mycobacterium
NEKAYP

SEQ ID NO: 529571 - protein, 6 aa, Mycobacterium
NEKHGG

SEQ ID NO: 529572 - protein, 21 aa, Mycobacterium
NEKHNEANGEANRDGESHNRS

SEQ ID NO: 529573 - protein, 20 aa, Mycobacterium
NEKHNEANGENNQDGETYNR

SEQ ID NO: 529574 - protein, 20 aa, Mycobacterium
NEKHNSANGEDNRDGESHNR

SEQ ID NO: 529575 - protein, 4 aa, Mycobacterium
NEKM

SEQ ID NO: 529576 - protein, 6 aa, Mycobacterium
NEKYAR

SEQ ID NO: 529577 - protein, 10 aa, Mycobacterium
NELADSARQL

SEQ ID NO: 529578 - protein, 5 aa, Mycobacterium
NELAP

SEQ ID NO: 529579 - protein, 4 aa, Mycobacterium
NELE

SEQ ID NO: 529580 - protein, 8 aa, Mycobacterium
NELEADGT

SEQ ID NO: 529581 - protein, 5 aa, Mycobacterium
NELGG

SEQ ID NO: 529582 - protein, 7 aa, Mycobacterium
NELGPRG

SEQ ID NO: 529583 - protein, 8 aa, Mycobacterium
NELGPSGI

SEQ ID NO: 529584 - protein, 14 aa, Mycobacterium
NELGQAQAATNTAM

SEQ ID NO: 529585 - protein, 5 aa, Mycobacterium
NELGR

SEQ ID NO: 529586 - protein, 7 aa, Mycobacterium
NELGRTA

SEQ ID NO: 529587 - protein, 6 aa, Mycobacterium
NELNNR

SEQ ID NO: 529588 - protein, 11 aa, Mycobacterium
NELPERTWETR

SEQ ID NO: 529589 - protein, 5 aa, Mycobacterium
NELPH

SEQ ID NO: 529590 - protein, 10 aa, Mycobacterium
NELSGGQQQR

SEQ ID NO: 529591 - protein, 12 aa, Mycobacterium
NELTTPPPVLRA

SEQ ID NO: 529592 - protein, 4 aa, Mycobacterium
NEMP

SEQ ID NO: 529593 - protein, 6 aa, Mycobacterium
NEMPSR

SEQ ID NO: 529594 - protein, 12 aa, Mycobacterium
NENADMGGGPAM

SEQ ID NO: 529595 - protein, 16 aa, Mycobacterium
NENGKSIGGQLSPDGL

SEQ ID NO: 529596 - protein, 11 aa, Mycobacterium
NENGNGRLKTE

SEQ ID NO: 529597 - protein, 8 aa, Mycobacterium
NENGSRRW

SEQ ID NO: 529598 - protein, 5 aa, Mycobacterium
NENHG

SEQ ID NO: 529599 - protein, 4 aa, Mycobacterium
NENI

SEQ ID NO: 529600 - protein, 6 aa, Mycobacterium
NENNRS

SEQ ID NO: 529601 - protein, 4 aa, Mycobacterium
NENR

SEQ ID NO: 529602 - protein, 10 aa, Mycobacterium
NENRAGIEQA

SEQ ID NO: 529603 - protein, 5 aa, Mycobacterium
NEPAA

SEQ ID NO: 529604 - protein, 16 aa, Mycobacterium
NEPADSSASGIHEFPS

SEQ ID NO: 529605 - protein, 14 aa, Mycobacterium
NEPAPDPADLARQA

SEQ ID NO: 529606 - protein, 8 aa, Mycobacterium
NEPAPGAW

SEQ ID NO: 529607 - protein, 9 aa, Mycobacterium
NEPAPGAWS

SEQ ID NO: 529608 - protein, 4 aa, Mycobacterium
NEPD

SEQ ID NO: 529609 - protein, 8 aa, Mycobacterium
NEPDDVKR

SEQ ID NO: 529610 - protein, 7 aa, Mycobacterium
NEPDGDA

SEQ ID NO: 529611 - protein, 12 aa, Mycobacterium
NEPDKPRVHPDD

SEQ ID NO: 529612 - protein, 12 aa, Mycobacterium
NEPDVDQTNGMP

SEQ ID NO: 529613 - protein, 4 aa, Mycobacterium
NEPE

SEQ ID NO: 529614 - protein, 10 aa, Mycobacterium
NEPEPGAWPN

SEQ ID NO: 529615 - protein, 7 aa, Mycobacterium
NEPERDQ

SEQ ID NO: 529616 - protein, 7 aa, Mycobacterium
NEPERYA

SEQ ID NO: 529617 - protein, 6 aa, Mycobacterium
NEPFSS

SEQ ID NO: 529618 - protein, 10 aa, Mycobacterium
NEPGERPELA

SEQ ID NO: 529619 - protein, 16 aa, Mycobacterium
NEPGESAASGTHEFPS

SEQ ID NO: 529620 - protein, 9 aa, Mycobacterium
NEPGRDYTG

SEQ ID NO: 529621 - protein, 8 aa, Mycobacterium
NEPGRTEW

SEQ ID NO: 529622 - protein, 12 aa, Mycobacterium
NEPGSSLASRTR

SEQ ID NO: 529623 - protein, 13 aa, Mycobacterium
NEPGTSFTSTTHR

SEQ ID NO: 529624 - protein, 5 aa, Mycobacterium
NEPGV

SEQ ID NO: 529625 - protein, 16 aa, Mycobacterium
NEPHAGTWGGGGATDW

SEQ ID NO: 529626 - protein, 4 aa, Mycobacterium
NEPI

SEQ ID NO: 529627 - protein, 12 aa, Mycobacterium
NEPLTVSGTGLQ

SEQ ID NO: 529628 - protein, 5 aa, Mycobacterium
NEPMP

SEQ ID NO: 529629 - protein, 12 aa, Mycobacterium
NEPNPVCEFAYW

SEQ ID NO: 529630 - protein, 4 aa, Mycobacterium
NEPP

SEQ ID NO: 529631 - protein, 12 aa, Mycobacterium
NEPPDDARDEIE

SEQ ID NO: 529632 - protein, 14 aa, Mycobacterium
NEPPNGPALPGNEA

SEQ ID NO: 529633 - protein, 4 aa, Mycobacterium
NEPS

SEQ ID NO: 529634 - protein, 16 aa, Mycobacterium
NEPSDSSASGTHEFPS

SEQ ID NO: 529635 - protein, 7 aa, Mycobacterium
NEPSPRE

SEQ ID NO: 529636 - protein, 5 aa, Mycobacterium
NEPTL

SEQ ID NO: 529637 - protein, 7 aa, Mycobacterium
NEPTPQF

SEQ ID NO: 529638 - protein, 16 aa, Mycobacterium
NEPTPVASGDITADPH

SEQ ID NO: 529639 - protein, 13 aa, Mycobacterium
NEPTRDQTDNLPF

SEQ ID NO: 529640 - protein, 9 aa, Mycobacterium
NEPTVTELG

SEQ ID NO: 529641 - protein, 6 aa, Mycobacterium
NEPVGN

SEQ ID NO: 529642 - protein, 4 aa, Mycobacterium
NEQA

SEQ ID NO: 529643 - protein, 6 aa, Mycobacterium
NEQAGP

SEQ ID NO: 529644 - protein, 7 aa, Mycobacterium
NEQAKRG

SEQ ID NO: 529645 - protein, 6 aa, Mycobacterium
NEQART

SEQ ID NO: 529646 - protein, 9 aa, Mycobacterium
NEQATADAF

SEQ ID NO: 529647 - protein, 9 aa, Mycobacterium
NEQATDEAF

SEQ ID NO: 529648 - protein, 9 aa, Mycobacterium
NEQATEEAF

SEQ ID NO: 529649 - protein, 12 aa, Mycobacterium
NEQATLEEAQEN

SEQ ID NO: 529650 - protein, 9 aa, Mycobacterium
NEQATRDAF

SEQ ID NO: 529651 - protein, 4 aa, Mycobacterium
NEQE

SEQ ID NO: 529652 - protein, 6 aa, Mycobacterium
NEQEER

SEQ ID NO: 529653 - protein, 5 aa, Mycobacterium
NEQET

SEQ ID NO: 529654 - protein, 4 aa, Mycobacterium
NEQG

SEQ ID NO: 529655 - protein, 8 aa, Mycobacterium
NEQGEPVP

SEQ ID NO: 529656 - protein, 8 aa, Mycobacterium
NEQGKLTA

SEQ ID NO: 529657 - protein, 5 aa, Mycobacterium
NEQGY

SEQ ID NO: 529658 - protein, 6 aa, Mycobacterium
NEQHPA

SEQ ID NO: 529659 - protein, 4 aa, Mycobacterium
NEQI

SEQ ID NO: 529660 - protein, 7 aa, Mycobacterium
NEQQAID

SEQ ID NO: 529661 - protein, 5 aa, Mycobacterium
NEQQR

SEQ ID NO: 529662 - protein, 7 aa, Mycobacterium
NEQQREG

SEQ ID NO: 529663 - protein, 7 aa, Mycobacterium
NEQRDDI

SEQ ID NO: 529664 - protein, 6 aa, Mycobacterium
NEQRRG

SEQ ID NO: 529665 - protein, 7 aa, Mycobacterium
NEQTHQP

SEQ ID NO: 529666 - protein, 4 aa, Mycobacterium
NEQV

SEQ ID NO: 529667 - protein, 12 aa, Mycobacterium
NEQWSNNATGAV

SEQ ID NO: 529668 - protein, 10 aa, Mycobacterium
NERAGAQGVG

SEQ ID NO: 529669 - protein, 9 aa, Mycobacterium
NERARRISG

SEQ ID NO: 529670 - protein, 4 aa, Mycobacterium
NERC

SEQ ID NO: 529671 - protein, 4 aa, Mycobacterium
NERD

SEQ ID NO: 529672 - protein, 8 aa, Mycobacterium
NERDAGPR

SEQ ID NO: 529673 - protein, 6 aa, Mycobacterium
NERDAV

SEQ ID NO: 529674 - protein, 8 aa, Mycobacterium
NERDGASL

SEQ ID NO: 529675 - protein, 18 aa, Mycobacterium
NERDIEPSAMPGTDGKWR

SEQ ID NO: 529676 - protein, 7 aa, Mycobacterium
NERESEV

SEQ ID NO: 529677 - protein, 15 aa, Mycobacterium
NERHPGGTYSQAGVG

SEQ ID NO: 529678 - protein, 6 aa, Mycobacterium
NERLAA

SEQ ID NO: 529679 - protein, 7 aa, Mycobacterium
NERPAHT

SEQ ID NO: 529680 - protein, 10 aa, Mycobacterium
NERPEHDRDR

SEQ ID NO: 529681 - protein, 9 aa, Mycobacterium
NERPESAAD

SEQ ID NO: 529682 - protein, 14 aa, Mycobacterium
NERPGLANHEPQPT

SEQ ID NO: 529683 - protein, 16 aa, Mycobacterium
NERPGLANHEPQPTAA

SEQ ID NO: 529684 - protein, 16 aa, Mycobacterium
NERPGLANHEPQPTAQ

SEQ ID NO: 529685 - protein, 5 aa, Mycobacterium
NERPL

SEQ ID NO: 529686 - protein, 5 aa, Mycobacterium
NERPQ

SEQ ID NO: 529687 - protein, 7 aa, Mycobacterium
NERPVPP

SEQ ID NO: 529688 - protein, 14 aa, Mycobacterium
NERQWKPDDPAPDL

SEQ ID NO: 529689 - protein, 28 aa, Mycobacterium
NERREEGDLRENGGYHAAREEQGQQEAR

SEQ ID NO: 529690 - protein, 7 aa, Mycobacterium
NERRRLD

SEQ ID NO: 529691 - protein, 7 aa, Mycobacterium
NERSQLQ

SEQ ID NO: 529692 - protein, 11 aa, Mycobacterium
NERSQLQNKTR

SEQ ID NO: 529693 - protein, 7 aa, Mycobacterium
NERSSEV

SEQ ID NO: 529694 - protein, 10 aa, Mycobacterium
NERSTALNKT

SEQ ID NO: 529695 - protein, 12 aa, Mycobacterium
NERTEGDHRANA

SEQ ID NO: 529696 - protein, 5 aa, Mycobacterium
NERTQ

SEQ ID NO: 529697 - protein, 6 aa, Mycobacterium
NERTQQ

SEQ ID NO: 529698 - protein, 11 aa, Mycobacterium
NERVKQNAPAF

SEQ ID NO: 529699 - protein, 9 aa, Mycobacterium
NESAAVGLP

SEQ ID NO: 529700 - protein, 9 aa, Mycobacterium
NESAGNGKI

SEQ ID NO: 529701 - protein, 8 aa, Mycobacterium
NESAPYDR

SEQ ID NO: 529702 - protein, 7 aa, Mycobacterium
NESASAG

SEQ ID NO: 529703 - protein, 12 aa, Mycobacterium
NESASSASSDAP

SEQ ID NO: 529704 - protein, 10 aa, Mycobacterium
NESDATISAT

SEQ ID NO: 529705 - protein, 10 aa, Mycobacterium
NESDGERIGY

SEQ ID NO: 529706 - protein, 8 aa, Mycobacterium
NESDPGVI

SEQ ID NO: 529707 - protein, 6 aa, Mycobacterium
NESDTA

SEQ ID NO: 529708 - protein, 7 aa, Mycobacterium
NESEAQQ

SEQ ID NO: 529709 - protein, 7 aa, Mycobacterium
NESEPSV

SEQ ID NO: 529710 - protein, 8 aa, Mycobacterium
NESGAKTV

SEQ ID NO: 529711 - protein, 6 aa, Mycobacterium
NESGDE

SEQ ID NO: 529712 - protein, 33 aa, Mycobacterium
NESLGGSGSVGGSTAVGGGAHTGVGGGVSTGVG

SEQ ID NO: 529713 - protein, 6 aa, Mycobacterium
NESLSN

SEQ ID NO: 529714 - protein, 6 aa, Mycobacterium
NESQDD

SEQ ID NO: 529715 - protein, 6 aa, Mycobacterium
NESQKQ

SEQ ID NO: 529716 - protein, 7 aa, Mycobacterium
NESQYNS

SEQ ID NO: 529717 - protein, 8 aa, Mycobacterium
NESRPGAA

SEQ ID NO: 529718 - protein, 10 aa, Mycobacterium
NESRYEGTPL

SEQ ID NO: 529719 - protein, 17 aa, Mycobacterium
NESVNSYTAAYDGTDLD

SEQ ID NO: 529720 - protein, 7 aa, Mycobacterium
NETARSA

SEQ ID NO: 529721 - protein, 8 aa, Mycobacterium
NETATSES

SEQ ID NO: 529722 - protein, 6 aa, Mycobacterium
NETDEP

SEQ ID NO: 529723 - protein, 7 aa, Mycobacterium
NETDEPA

SEQ ID NO: 529724 - protein, 9 aa, Mycobacterium
NETDTVPSV

SEQ ID NO: 529725 - protein, 9 aa, Mycobacterium
NETEDEETV

SEQ ID NO: 529726 - protein, 14 aa, Mycobacterium
NETEPGDPSPEVDA

SEQ ID NO: 529727 - protein, 6 aa, Mycobacterium
NETERE

SEQ ID NO: 529728 - protein, 4 aa, Mycobacterium
NETG

SEQ ID NO: 529729 - protein, 17 aa, Mycobacterium
NETGESHQPVDIPNDSP

SEQ ID NO: 529730 - protein, 20 aa, Mycobacterium
NETGGNGQAAVTAETSEEDL

SEQ ID NO: 529731 - protein, 7 aa, Mycobacterium
NETGLDA

SEQ ID NO: 529732 - protein, 6 aa, Mycobacterium
NETGLL

SEQ ID NO: 529733 - protein, 6 aa, Mycobacterium
NETHAE

SEQ ID NO: 529734 - protein, 8 aa, Mycobacterium
NETLREQA

SEQ ID NO: 529735 - protein, 6 aa, Mycobacterium
NETNSV

SEQ ID NO: 529736 - protein, 17 aa, Mycobacterium
NETPPDPARAPEHGQHT

SEQ ID NO: 529737 - protein, 5 aa, Mycobacterium
NETRT

SEQ ID NO: 529738 - protein, 4 aa, Mycobacterium
NETS

SEQ ID NO: 529739 - protein, 11 aa, Mycobacterium
NETSKYNPQYD

SEQ ID NO: 529740 - protein, 6 aa, Mycobacterium
NETSTG

SEQ ID NO: 529741 - protein, 5 aa, Mycobacterium
NETTE

SEQ ID NO: 529742 - protein, 21 aa, Mycobacterium
NETTEQPDGTRIATETGAPVT

SEQ ID NO: 529743 - protein, 7 aa, Mycobacterium
NETTTNL

SEQ ID NO: 529744 - protein, 7 aa, Mycobacterium
NETWNAK

SEQ ID NO: 529745 - protein, 13 aa, Mycobacterium
NEVAQANGYTTGG

SEQ ID NO: 529746 - protein, 5 aa, Mycobacterium
NEVAR

SEQ ID NO: 529747 - protein, 4 aa, Mycobacterium
NEVE

SEQ ID NO: 529748 - protein, 8 aa, Mycobacterium
NEVEPGPL

SEQ ID NO: 529749 - protein, 9 aa, Mycobacterium
NEVGDARAY

SEQ ID NO: 529750 - protein, 6 aa, Mycobacterium
NEVGQE

SEQ ID NO: 529751 - protein, 11 aa, Mycobacterium
NEVPGATDRDR

SEQ ID NO: 529752 - protein, 9 aa, Mycobacterium
NEVPPGAEG

SEQ ID NO: 529753 - protein, 6 aa, Mycobacterium
NEVPRD

SEQ ID NO: 529754 - protein, 6 aa, Mycobacterium
NEVPSR

SEQ ID NO: 529755 - protein, 5 aa, Mycobacterium
NEVRA

SEQ ID NO: 529756 - protein, 4 aa, Mycobacterium
NEVS

SEQ ID NO: 529757 - protein, 20 aa, Mycobacterium
NEVTAPNSEDGVAKVLERWW

SEQ ID NO: 529758 - protein, 5 aa, Mycobacterium
NEVTR

SEQ ID NO: 529759 - protein, 9 aa, Mycobacterium
NEYASAANE

SEQ ID NO: 529760 - protein, 14 aa, Mycobacterium
NEYEDRDGNRRSSL

SEQ ID NO: 529761 - protein, 15 aa, Mycobacterium
NEYPLATSRDLEEAG

SEQ ID NO: 529762 - protein, 9 aa, Mycobacterium
NEYRSAPTD

SEQ ID NO: 529763 - protein, 5 aa, Mycobacterium
NFAEE

SEQ ID NO: 529764 - protein, 5 aa, Mycobacterium
NFAPA

SEQ ID NO: 529765 - protein, 15 aa, Mycobacterium
NFAPSSHTTASTHST

SEQ ID NO: 529766 - protein, 6 aa, Mycobacterium
NFASDG

SEQ ID NO: 529767 - protein, 5 aa, Mycobacterium
NFDAG

SEQ ID NO: 529768 - protein, 16 aa, Mycobacterium
NFDGAGRQLGPLRRTR

SEQ ID NO: 529769 - protein, 7 aa, Mycobacterium
NFDGEAA

SEQ ID NO: 529770 - protein, 6 aa, Mycobacterium
NFDNGA

SEQ ID NO: 529771 - protein, 6 aa, Mycobacterium
NFDPVP

SEQ ID NO: 529772 - protein, 8 aa, Mycobacterium
NFDSPSHR

SEQ ID NO: 529773 - protein, 21 aa, Mycobacterium
NFEDANDAWPRPAARGESGTL

SEQ ID NO: 529774 - protein, 5 aa, Mycobacterium
NFEGG

SEQ ID NO: 529775 - protein, 7 aa, Mycobacterium
NFESGAR

SEQ ID NO: 529776 - protein, 7 aa, Mycobacterium
NFESPSY

SEQ ID NO: 529777 - protein, 5 aa, Mycobacterium
NFETP

SEQ ID NO: 529778 - protein, 8 aa, Mycobacterium
NFETPSHA

SEQ ID NO: 529779 - protein, 9 aa, Mycobacterium
NFGDASGSR

SEQ ID NO: 529780 - protein, 4 aa, Mycobacterium
NFGG

SEQ ID NO: 529781 - protein, 6 aa, Mycobacterium
NFGGAA

SEQ ID NO: 529782 - protein, 7 aa, Mycobacterium
NFGGGRT

SEQ ID NO: 529783 - protein, 19 aa, Mycobacterium
NFGGNNTGAFNSGSGWSNS

SEQ ID NO: 529784 - protein, 12 aa, Mycobacterium
NFGHAQAAGGGL

SEQ ID NO: 529785 - protein, 10 aa, Mycobacterium
NFGHTEAAAG

SEQ ID NO: 529786 - protein, 11 aa, Mycobacterium
NFGHTQSAAGA

SEQ ID NO: 529787 - protein, 12 aa, Mycobacterium
NFGHTQSTSGPL

SEQ ID NO: 529788 - protein, 10 aa, Mycobacterium
NFGPASGRGD

SEQ ID NO: 529789 - protein, 7 aa, Mycobacterium
NFGPRGA

SEQ ID NO: 529790 - protein, 11 aa, Mycobacterium
NFGQTAEEFGH

SEQ ID NO: 529791 - protein, 13 aa, Mycobacterium
NFGSAPELDPGLA

SEQ ID NO: 529792 - protein, 10 aa, Mycobacterium
NFKTQGGLTT

SEQ ID NO: 529793 - protein, 20 aa, Mycobacterium
NFNASGDTTAAGSGTGKRTV

SEQ ID NO: 529794 - protein, 10 aa, Mycobacterium
NFNPDCAQAG

SEQ ID NO: 529795 - protein, 4 aa, Mycobacterium
NFPA

SEQ ID NO: 529796 - protein, 12 aa, Mycobacterium
NFPDDDATSPMD

SEQ ID NO: 529797 - protein, 16 aa, Mycobacterium
NFPSATAPQGVSTPNG

SEQ ID NO: 529798 - protein, 9 aa, Mycobacterium
NFSDGKPHS

SEQ ID NO: 529799 - protein, 4 aa, Mycobacterium
NFSE

SEQ ID NO: 529800 - protein, 7 aa, Mycobacterium
NFSGSGC

SEQ ID NO: 529801 - protein, 8 aa, Mycobacterium
NFSPANVA

SEQ ID NO: 529802 - protein, 6 aa, Mycobacterium
NFSPRT

SEQ ID NO: 529803 - protein, 10 aa, Mycobacterium
NFTAPNPQIE

SEQ ID NO: 529804 - protein, 5 aa, Mycobacterium
NFTDD

SEQ ID NO: 529805 - protein, 7 aa, Mycobacterium
NFTPEPA

SEQ ID NO: 529806 - protein, 9 aa, Mycobacterium
NFTPEPEGF

SEQ ID NO: 529807 - protein, 10 aa, Mycobacterium
NFTPEPTAFA

SEQ ID NO: 529808 - protein, 8 aa, Mycobacterium
NFTPGPRA

SEQ ID NO: 529809 - protein, 9 aa, Mycobacterium
NFTQTSDDE

SEQ ID NO: 529810 - protein, 11 aa, Mycobacterium
NFTRTRNGYDP

SEQ ID NO: 529811 - protein, 10 aa, Mycobacterium
NFTSEPDGFE

SEQ ID NO: 529812 - protein, 10 aa, Mycobacterium
NFTSEPEAFR

SEQ ID NO: 529813 - protein, 12 aa, Mycobacterium
NFTTARTGADRS

SEQ ID NO: 529814 - protein, 6 aa, Mycobacterium
NGAAAA

SEQ ID NO: 529815 - protein, 9 aa, Mycobacterium
NGAAAAGGI

SEQ ID NO: 529816 - protein, 7 aa, Mycobacterium
NGAAAQR

SEQ ID NO: 529817 - protein, 9 aa, Mycobacterium
NGAAARTGD

SEQ ID NO: 529818 - protein, 29 aa, Mycobacterium
NGAAELTDPVRAGGALSEHEVDTTRRRRR

SEQ ID NO: 529819 - protein, 12 aa, Mycobacterium
NGAAEVARHRLD

SEQ ID NO: 529820 - protein, 11 aa, Mycobacterium
NGAAGFGRDPD

SEQ ID NO: 529821 - protein, 12 aa, Mycobacterium
NGAAGGVGGAGG

SEQ ID NO: 529822 - protein, 17 aa, Mycobacterium
NGAAGSVDSATTGPVQP

SEQ ID NO: 529823 - protein, 15 aa, Mycobacterium
NGAAGTAAHPNGGAG

SEQ ID NO: 529824 - protein, 15 aa, Mycobacterium
NGAAGTAANPTGGAG

SEQ ID NO: 529825 - protein, 18 aa, Mycobacterium
NGAAGTPGSGANGQDGGL

SEQ ID NO: 529826 - protein, 9 aa, Mycobacterium
NGAAPGGGL

SEQ ID NO: 529827 - protein, 13 aa, Mycobacterium
NGAAPIPHNDDSV

SEQ ID NO: 529828 - protein, 8 aa, Mycobacterium
NGAAPLSA

SEQ ID NO: 529829 - protein, 12 aa, Mycobacterium
NGAASDQEAPDT

SEQ ID NO: 529830 - protein, 7 aa, Mycobacterium
NGAASRL

SEQ ID NO: 529831 - protein, 7 aa, Mycobacterium
NGAATAK

SEQ ID NO: 529832 - protein, 14 aa, Mycobacterium
NGAATEPDDRPQDE

SEQ ID NO: 529833 - protein, 6 aa, Mycobacterium
NGAAVG

SEQ ID NO: 529834 - protein, 4 aa, Mycobacterium
NGAD

SEQ ID NO: 529835 - protein, 16 aa, Mycobacterium
NGADATTPGQPGGDGG

SEQ ID NO: 529836 - protein, 10 aa, Mycobacterium
NGADDGDELN

SEQ ID NO: 529837 - protein, 7 aa, Mycobacterium
NGADEPA

SEQ ID NO: 529838 - protein, 17 aa, Mycobacterium
NGADGAAGTGADGGAGG

SEQ ID NO: 529839 - protein, 16 aa, Mycobacterium
NGADGAAGTGQAGAAG

SEQ ID NO: 529840 - protein, 16 aa, Mycobacterium
NGADGAAGTGQTGQAG

SEQ ID NO: 529841 - protein, 14 aa, Mycobacterium
NGADGAPGQAGADG

SEQ ID NO: 529842 - protein, 15 aa, Mycobacterium
NGADGAPGQAGGDGG

SEQ ID NO: 529843 - protein, 14 aa, Mycobacterium
NGADGAPGQNGAAG

SEQ ID NO: 529844 - protein, 17 aa, Mycobacterium
NGADGAPGSGANGADGG

SEQ ID NO: 529845 - protein, 19 aa, Mycobacterium
NGADGATVGGIGTPGGAGG

SEQ ID NO: 529846 - protein, 11 aa, Mycobacterium
NGADGGISPYE

SEQ ID NO: 529847 - protein, 14 aa, Mycobacterium
NGADGGPGQAGGAG

SEQ ID NO: 529848 - protein, 19 aa, Mycobacterium
NGADGGTVGGIGQPGGPGG

SEQ ID NO: 529849 - protein, 17 aa, Mycobacterium
NGADGINGTGQSGGDGG

SEQ ID NO: 529850 - protein, 15 aa, Mycobacterium
NGADGTAANPNGGAG

SEQ ID NO: 529851 - protein, 16 aa, Mycobacterium
NGADGTAASPNGGAGG

SEQ ID NO: 529852 - protein, 15 aa, Mycobacterium
NGADGTAPGQAGGAG

SEQ ID NO: 529853 - protein, 16 aa, Mycobacterium
NGADGTAPGQAGGDGG

SEQ ID NO: 529854 - protein, 20 aa, Mycobacterium
NGADGYTNAQGVGTAGKPGG

SEQ ID NO: 529855 - protein, 11 aa, Mycobacterium
NGADHDDASEI

SEQ ID NO: 529856 - protein, 8 aa, Mycobacterium
NGADIDAA

SEQ ID NO: 529857 - protein, 6 aa, Mycobacterium
NGAENQ

SEQ ID NO: 529858 - protein, 7 aa, Mycobacterium
NGAETAA

SEQ ID NO: 529859 - protein, 8 aa, Mycobacterium
NGAEVSSA

SEQ ID NO: 529860 - protein, 4 aa, Mycobacterium
NGAG

SEQ ID NO: 529861 - protein, 20 aa, Mycobacterium
NGAGAGTVPDPYDPSRTHAP

SEQ ID NO: 529862 - protein, 10 aa, Mycobacterium
NGAGGGDGGL

SEQ ID NO: 529863 - protein, 19 aa, Mycobacterium
NGAGIGSDGTPTGQPVVTV

SEQ ID NO: 529864 - protein, 7 aa, Mycobacterium
NGAGKST

SEQ ID NO: 529865 - protein, 6 aa, Mycobacterium
NGAGKT

SEQ ID NO: 529866 - protein, 15 aa, Mycobacterium
NGAGNPKQRDNVPGV

SEQ ID NO: 529867 - protein, 7 aa, Mycobacterium
NGAGPGE

SEQ ID NO: 529868 - protein, 6 aa, Mycobacterium
NGAGRA

SEQ ID NO: 529869 - protein, 6 aa, Mycobacterium
NGAGRG

SEQ ID NO: 529870 - protein, 11 aa, Mycobacterium
NGAGSEGRHEA

SEQ ID NO: 529871 - protein, 9 aa, Mycobacterium
NGAGSGSGF

SEQ ID NO: 529872 - protein, 31 aa, Mycobacterium
NGAGSSASGISIGGAGGAGTAGGYGGSGNYA

SEQ ID NO: 529873 - protein, 29 aa, Mycobacterium
NGAGSSASGSAIGGYGGAGTTGGLGGVGG

SEQ ID NO: 529874 - protein, 30 aa, Mycobacterium
NGAGSSVATGAATGGVGGAGSTGGIGGAGN

SEQ ID NO: 529875 - protein, 7 aa, Mycobacterium
NGAGSTV

SEQ ID NO: 529876 - protein, 8 aa, Mycobacterium
NGAGTGPQ

SEQ ID NO: 529877 - protein, 6 aa, Mycobacterium
NGAGTV

SEQ ID NO: 529878 - protein, 8 aa, Mycobacterium
NGAGVEGI

SEQ ID NO: 529879 - protein, 7 aa, Mycobacterium
NGAITRD

SEQ ID NO: 529880 - protein, 4 aa, Mycobacterium
NGAL

SEQ ID NO: 529881 - protein, 8 aa, Mycobacterium
NGALASPE

SEQ ID NO: 529882 - protein, 15 aa, Mycobacterium
NGALGGKITGAGGGG

SEQ ID NO: 529883 - protein, 4 aa, Mycobacterium
NGAM

SEQ ID NO: 529884 - protein, 17 aa, Mycobacterium
NGANAAPGSGANGGDGG

SEQ ID NO: 529885 - protein, 5 aa, Mycobacterium
NGAND

SEQ ID NO: 529886 - protein, 17 aa, Mycobacterium
NGANGAAGTGANGGDGG

SEQ ID NO: 529887 - protein, 17 aa, Mycobacterium
NGANGAAGTGASGGDGG

SEQ ID NO: 529888 - protein, 17 aa, Mycobacterium
NGANGADGTGAAGGDGG

SEQ ID NO: 529889 - protein, 17 aa, Mycobacterium
NGANGADGTGQNGGDGG

SEQ ID NO: 529890 - protein, 14 aa, Mycobacterium
NGANGAPGADGQAG

SEQ ID NO: 529891 - protein, 17 aa, Mycobacterium
NGANGAPGTGAAGAPGG

SEQ ID NO: 529892 - protein, 16 aa, Mycobacterium
NGANGAPGTGADGGAA

SEQ ID NO: 529893 - protein, 16 aa, Mycobacterium
NGANGAPGTGANGAAG

SEQ ID NO: 529894 - protein, 16 aa, Mycobacterium
NGANGAPGTGANGGAG

SEQ ID NO: 529895 - protein, 17 aa, Mycobacterium
NGANGAPGTGAPGGPGG

SEQ ID NO: 529896 - protein, 15 aa, Mycobacterium
NGANGGPGQPGGPGG

SEQ ID NO: 529897 - protein, 15 aa, Mycobacterium
NGANGTATSPNGGAG

SEQ ID NO: 529898 - protein, 16 aa, Mycobacterium
NGANGTATSPNGGAGG

SEQ ID NO: 529899 - protein, 17 aa, Mycobacterium
NGANGTPGLGTDGAPGG

SEQ ID NO: 529900 - protein, 16 aa, Mycobacterium
NGANGTPGTGADGAAG

SEQ ID NO: 529901 - protein, 17 aa, Mycobacterium
NGANGTPGTGADGAPGG

SEQ ID NO: 529902 - protein, 19 aa, Mycobacterium
NGANGTTVNGVGTPGGDGG

SEQ ID NO: 529903 - protein, 19 aa, Mycobacterium
NGANGTTVNGVGTPGGPGG

SEQ ID NO: 529904 - protein, 17 aa, Mycobacterium
NGANGVDGTGAAGGDGG

SEQ ID NO: 529905 - protein, 9 aa, Mycobacterium
NGAPATTVT

SEQ ID NO: 529906 - protein, 6 aa, Mycobacterium
NGAPAV

SEQ ID NO: 529907 - protein, 8 aa, Mycobacterium
NGAPDEAI

SEQ ID NO: 529908 - protein, 9 aa, Mycobacterium
NGAPDIGPH

SEQ ID NO: 529909 - protein, 17 aa, Mycobacterium
NGAPGATGSGASGSPGG

SEQ ID NO: 529910 - protein, 13 aa, Mycobacterium
NGAPGSGAEPRLT

SEQ ID NO: 529911 - protein, 17 aa, Mycobacterium
NGAPGVAGVNGGAGEAG

SEQ ID NO: 529912 - protein, 42 aa, Mycobacterium
NGAPKPPPGGPAGGPPADGVTETPAPDAATRTRYQPIPVTVE

SEQ ID NO: 529913 - protein, 6 aa, Mycobacterium
NGAPLP

SEQ ID NO: 529914 - protein, 8 aa, Mycobacterium
NGAPPPDI

SEQ ID NO: 529915 - protein, 8 aa, Mycobacterium
NGAPPPQV

SEQ ID NO: 529916 - protein, 6 aa, Mycobacterium
NGAPVD

SEQ ID NO: 529917 - protein, 5 aa, Mycobacterium
NGAQP

SEQ ID NO: 529918 - protein, 20 aa, Mycobacterium
NGAQPHPYEPGDATAPQSVY

SEQ ID NO: 529919 - protein, 6 aa, Mycobacterium
NGAQVR

SEQ ID NO: 529920 - protein, 11 aa, Mycobacterium
NGARALEATAA

SEQ ID NO: 529921 - protein, 7 aa, Mycobacterium
NGAREGL

SEQ ID NO: 529922 - protein, 19 aa, Mycobacterium
NGARGPSPASGRYPQRLPG

SEQ ID NO: 529923 - protein, 7 aa, Mycobacterium
NGARHSG

SEQ ID NO: 529924 - protein, 6 aa, Mycobacterium
NGARPE

SEQ ID NO: 529925 - protein, 6 aa, Mycobacterium
NGARPK

SEQ ID NO: 529926 - protein, 10 aa, Mycobacterium
NGARQVPGRH

SEQ ID NO: 529927 - protein, 6 aa, Mycobacterium
NGARRV

SEQ ID NO: 529928 - protein, 7 aa, Mycobacterium
NGARSTY

SEQ ID NO: 529929 - protein, 13 aa, Mycobacterium
NGASAEGGPTGSV

SEQ ID NO: 529930 - protein, 9 aa, Mycobacterium
NGASAEGTI

SEQ ID NO: 529931 - protein, 9 aa, Mycobacterium
NGASAEGTL

SEQ ID NO: 529932 - protein, 9 aa, Mycobacterium
NGASAEGTV

SEQ ID NO: 529933 - protein, 7 aa, Mycobacterium
NGASASA

SEQ ID NO: 529934 - protein, 17 aa, Mycobacterium
NGASASAIAAGRPVDTS

SEQ ID NO: 529935 - protein, 17 aa, Mycobacterium
NGASASAVAGGKAVDTS

SEQ ID NO: 529936 - protein, 16 aa, Mycobacterium
NGASASAVAGGRPVET

SEQ ID NO: 529937 - protein, 9 aa, Mycobacterium
NGASFTSGK

SEQ ID NO: 529938 - protein, 17 aa, Mycobacterium
NGASGAPGTGQAGGDGG

SEQ ID NO: 529939 - protein, 15 aa, Mycobacterium
NGASGEGGPNGSVNE

SEQ ID NO: 529940 - protein, 9 aa, Mycobacterium
NGASGEGTL

SEQ ID NO: 529941 - protein, 14 aa, Mycobacterium
NGASLRGHNSPDMA

SEQ ID NO: 529942 - protein, 7 aa, Mycobacterium
NGASPAV

SEQ ID NO: 529943 - protein, 4 aa, Mycobacterium
NGAT

SEQ ID NO: 529944 - protein, 6 aa, Mycobacterium
NGATAR

SEQ ID NO: 529945 - protein, 7 aa, Mycobacterium
NGATGDR

SEQ ID NO: 529946 - protein, 40 aa, Mycobacterium
NGATGGSAGLAGGGGDAGVIGNGGAGGSGGKGAAGSTLGG

SEQ ID NO: 529947 - protein, 8 aa, Mycobacterium
NGATISDA

SEQ ID NO: 529948 - protein, 13 aa, Mycobacterium
NGATQTARARHEA

SEQ ID NO: 529949 - protein, 13 aa, Mycobacterium
NGATTSAEVTGGA

SEQ ID NO: 529950 - protein, 11 aa, Mycobacterium
NGAVGGAGGAG

SEQ ID NO: 529951 - protein, 7 aa, Mycobacterium
NGAWGQS

SEQ ID NO: 529952 - protein, 6 aa, Mycobacterium
NGAWSI

SEQ ID NO: 529953 - protein, 5 aa, Mycobacterium
NGAYD

SEQ ID NO: 529954 - protein, 8 aa, Mycobacterium
NGAYGRKQ

SEQ ID NO: 529955 - protein, 8 aa, Mycobacterium
NGAYNQDQ

SEQ ID NO: 529956 - protein, 8 aa, Mycobacterium
NGAYNQQQ

SEQ ID NO: 529957 - protein, 8 aa, Mycobacterium
NGAYNQRQ

SEQ ID NO: 529958 - protein, 7 aa, Mycobacterium
NGAYQRK

SEQ ID NO: 529959 - protein, 9 aa, Mycobacterium
NGCDQTSAQ

SEQ ID NO: 529960 - protein, 6 aa, Mycobacterium
NGCGKS

SEQ ID NO: 529961 - protein, 6 aa, Mycobacterium
NGCGMP

SEQ ID NO: 529962 - protein, 4 aa, Mycobacterium
NGDA

SEQ ID NO: 529963 - protein, 17 aa, Mycobacterium
NGDAANSALGGCRIYLE

SEQ ID NO: 529964 - protein, 5 aa, Mycobacterium
NGDAL

SEQ ID NO: 529965 - protein, 6 aa, Mycobacterium
NGDASE

SEQ ID NO: 529966 - protein, 12 aa, Mycobacterium
NGDAWSAGHSVS

SEQ ID NO: 529967 - protein, 9 aa, Mycobacterium
NGDCGSTRE

SEQ ID NO: 529968 - protein, 6 aa, Mycobacterium
NGDDDT

SEQ ID NO: 529969 - protein, 6 aa, Mycobacterium
NGDEER

SEQ ID NO: 529970 - protein, 11 aa, Mycobacterium
NGDEHDDPIGA

SEQ ID NO: 529971 - protein, 8 aa, Mycobacterium
NGDEIADV

SEQ ID NO: 529972 - protein, 14 aa, Mycobacterium
NGDELAAQARSHPD

SEQ ID NO: 529973 - protein, 14 aa, Mycobacterium
NGDELADQARAHPD

SEQ ID NO: 529974 - protein, 14 aa, Mycobacterium
NGDELAGQARSHPN

SEQ ID NO: 529975 - protein, 15 aa, Mycobacterium
NGDELGDQARANPDA

SEQ ID NO: 529976 - protein, 11 aa, Mycobacterium
NGDELPPGQAG

SEQ ID NO: 529977 - protein, 9 aa, Mycobacterium
NGDERQNSL

SEQ ID NO: 529978 - protein, 6 aa, Mycobacterium
NGDERS

SEQ ID NO: 529979 - protein, 8 aa, Mycobacterium
NGDESDTE

SEQ ID NO: 529980 - protein, 4 aa, Mycobacterium
NGDG

SEQ ID NO: 529981 - protein, 5 aa, Mycobacterium
NGDGA

SEQ ID NO: 529982 - protein, 16 aa, Mycobacterium
NGDGLAPYDPALTPAQ

SEQ ID NO: 529983 - protein, 5 aa, Mycobacterium
NGDGN

SEQ ID NO: 529984 - protein, 11 aa, Mycobacterium
NGDGNVTKRGG

SEQ ID NO: 529985 - protein, 8 aa, Mycobacterium
NGDGPAIE

SEQ ID NO: 529986 - protein, 16 aa, Mycobacterium
NGDGPQAGGFGGRTNP

SEQ ID NO: 529987 - protein, 8 aa, Mycobacterium
NGDGRGGV

SEQ ID NO: 529988 - protein, 13 aa, Mycobacterium
NGDGTDTGLPAEE

SEQ ID NO: 529989 - protein, 6 aa, Mycobacterium
NGDHAG

SEQ ID NO: 529990 - protein, 8 aa, Mycobacterium
NGDINDPF

SEQ ID NO: 529991 - protein, 13 aa, Mycobacterium
NGDINQAQRERTI

SEQ ID NO: 529992 - protein, 13 aa, Mycobacterium
NGDINQSQRERTI

SEQ ID NO: 529993 - protein, 12 aa, Mycobacterium
NGDIPQQQRERT

SEQ ID NO: 529994 - protein, 11 aa, Mycobacterium
NGDITKQNNDV

SEQ ID NO: 529995 - protein, 4 aa, Mycobacterium
NGDL

SEQ ID NO: 529996 - protein, 7 aa, Mycobacterium
NGDPGGV

SEQ ID NO: 529997 - protein, 7 aa, Mycobacterium
NGDPGKG

SEQ ID NO: 529998 - protein, 9 aa, Mycobacterium
NGDPIPITT

SEQ ID NO: 529999 - protein, 10 aa, Mycobacterium
NGDQKLSSNV

SEQ ID NO: 530000 - protein, 8 aa, Mycobacterium
NGDQSDSE

SEQ ID NO: 530001 - protein, 6 aa, Mycobacterium
NGDRAE

SEQ ID NO: 530002 - protein, 9 aa, Mycobacterium
NGDSATARA

SEQ ID NO: 530003 - protein, 9 aa, Mycobacterium
NGDSGKLRA

SEQ ID NO: 530004 - protein, 8 aa, Mycobacterium
NGDSGQAA

SEQ ID NO: 530005 - protein, 5 aa, Mycobacterium
NGDSQ

SEQ ID NO: 530006 - protein, 15 aa, Mycobacterium
NGDSREIVGAGDDSH

SEQ ID NO: 530007 - protein, 8 aa, Mycobacterium
NGDSRSIV

SEQ ID NO: 530008 - protein, 8 aa, Mycobacterium
NGDSRVPT

SEQ ID NO: 530009 - protein, 5 aa, Mycobacterium
NGDTG

SEQ ID NO: 530010 - protein, 9 aa, Mycobacterium
NGDTVTSPA

SEQ ID NO: 530011 - protein, 10 aa, Mycobacterium
NGDVAGPAEL

SEQ ID NO: 530012 - protein, 15 aa, Mycobacterium
NGDVGAKAQALAEAG

SEQ ID NO: 530013 - protein, 9 aa, Mycobacterium
NGDVGAKAR

SEQ ID NO: 530014 - protein, 14 aa, Mycobacterium
NGDVNGDRQGDPSL

SEQ ID NO: 530015 - protein, 5 aa, Mycobacterium
NGDVR

SEQ ID NO: 530016 - protein, 9 aa, Mycobacterium
NGDVRAKAS

SEQ ID NO: 530017 - protein, 82 aa, Mycobacterium
NGDVTGGAAGDGGNGAHGGNGGVGGEASTGGATAVSGSGGNGGNAEAAGGAGGNGGRGGFAQATSSVAGGNGGNGGNGHDTD

SEQ ID NO: 530018 - protein, 16 aa, Mycobacterium
NGDYGPDSAMARSTKR

SEQ ID NO: 530019 - protein, 5 aa, Mycobacterium
NGDYI

SEQ ID NO: 530020 - protein, 10 aa, Mycobacterium
NGEAAGREID

SEQ ID NO: 530021 - protein, 11 aa, Mycobacterium
NGEAAKQTLAQ

SEQ ID NO: 530022 - protein, 8 aa, Mycobacterium
NGEACEAG

SEQ ID NO: 530023 - protein, 5 aa, Mycobacterium
NGEAF

SEQ ID NO: 530024 - protein, 6 aa, Mycobacterium
NGEAGR

SEQ ID NO: 530025 - protein, 5 aa, Mycobacterium
NGEAL

SEQ ID NO: 530026 - protein, 7 aa, Mycobacterium
NGEASQT

SEQ ID NO: 530027 - protein, 4 aa, Mycobacterium
NGEE

SEQ ID NO: 530028 - protein, 10 aa, Mycobacterium
NGEEGEPASF

SEQ ID NO: 530029 - protein, 10 aa, Mycobacterium
NGEEGEPASL

SEQ ID NO: 530030 - protein, 10 aa, Mycobacterium
NGEEGEPASV

SEQ ID NO: 530031 - protein, 10 aa, Mycobacterium
NGEEGEPTSI

SEQ ID NO: 530032 - protein, 15 aa, Mycobacterium
NGEELTDQARANPDA

SEQ ID NO: 530033 - protein, 7 aa, Mycobacterium
NGEEREI

SEQ ID NO: 530034 - protein, 7 aa, Mycobacterium
NGEFPGR

SEQ ID NO: 530035 - protein, 4 aa, Mycobacterium
NGEG

SEQ ID NO: 530036 - protein, 23 aa, Mycobacterium
NGEGAYDDGVETTTRLAQILLAP

SEQ ID NO: 530037 - protein, 23 aa, Mycobacterium
NGEGGYDDGVETTTRLAQILLAP

SEQ ID NO: 530038 - protein, 8 aa, Mycobacterium
NGEGPVET

SEQ ID NO: 530039 - protein, 9 aa, Mycobacterium
NGEKINSES

SEQ ID NO: 530040 - protein, 4 aa, Mycobacterium
NGEL

SEQ ID NO: 530041 - protein, 15 aa, Mycobacterium
NGELGATGTDTATSA

SEQ ID NO: 530042 - protein, 9 aa, Mycobacterium
NGELKQHSR

SEQ ID NO: 530043 - protein, 6 aa, Mycobacterium
NGELNA

SEQ ID NO: 530044 - protein, 11 aa, Mycobacterium
NGENDGTGADV

SEQ ID NO: 530045 - protein, 7 aa, Mycobacterium
NGEPAPV

SEQ ID NO: 530046 - protein, 7 aa, Mycobacterium
NGEPCRP

SEQ ID NO: 530047 - protein, 8 aa, Mycobacterium
NGEPEATV

SEQ ID NO: 530048 - protein, 8 aa, Mycobacterium
NGEPELNS

SEQ ID NO: 530049 - protein, 6 aa, Mycobacterium
NGEPFT

SEQ ID NO: 530050 - protein, 8 aa, Mycobacterium
NGEPGESV

SEQ ID NO: 530051 - protein, 10 aa, Mycobacterium
NGEPGTGQHV

SEQ ID NO: 530052 - protein, 8 aa, Mycobacterium
NGEPIGAS

SEQ ID NO: 530053 - protein, 6 aa, Mycobacterium
NGEPLD

SEQ ID NO: 530054 - protein, 5 aa, Mycobacterium
NGEPQ

SEQ ID NO: 530055 - protein, 6 aa, Mycobacterium
NGEPQG

SEQ ID NO: 530056 - protein, 11 aa, Mycobacterium
NGEPRQESHSS

SEQ ID NO: 530057 - protein, 6 aa, Mycobacterium
NGEPVA

SEQ ID NO: 530058 - protein, 15 aa, Mycobacterium
NGEPVGPADLDDAEE

SEQ ID NO: 530059 - protein, 9 aa, Mycobacterium
NGEPYSKTH

SEQ ID NO: 530060 - protein, 6 aa, Mycobacterium
NGEQLE

SEQ ID NO: 530061 - protein, 23 aa, Mycobacterium
NGEQRSQYDEDRPAPDRQRDSAM

SEQ ID NO: 530062 - protein, 17 aa, Mycobacterium
NGEQSWPGSGPAPVKPF

SEQ ID NO: 530063 - protein, 5 aa, Mycobacterium
NGEQV

SEQ ID NO: 530064 - protein, 34 aa, Mycobacterium
NGERRRIADPPTGSVPAAKVRGSAAAAPPTEPTC

SEQ ID NO: 530065 - protein, 5 aa, Mycobacterium
NGERV

SEQ ID NO: 530066 - protein, 4 aa, Mycobacterium
NGES

SEQ ID NO: 530067 - protein, 5 aa, Mycobacterium
NGESG

SEQ ID NO: 530068 - protein, 6 aa, Mycobacterium
NGESGL

SEQ ID NO: 530069 - protein, 11 aa, Mycobacterium
NGESIATGQVP

SEQ ID NO: 530070 - protein, 10 aa, Mycobacterium
NGESIEDHRS

SEQ ID NO: 530071 - protein, 9 aa, Mycobacterium
NGESKRIEQ

SEQ ID NO: 530072 - protein, 8 aa, Mycobacterium
NGESMADH

SEQ ID NO: 530073 - protein, 8 aa, Mycobacterium
NGESPVPP

SEQ ID NO: 530074 - protein, 11 aa, Mycobacterium
NGESVDDHRKR

SEQ ID NO: 530075 - protein, 9 aa, Mycobacterium
NGETADGAP

SEQ ID NO: 530076 - protein, 17 aa, Mycobacterium
NGETARVPDHVIALRRD

SEQ ID NO: 530077 - protein, 22 aa, Mycobacterium
NGETLQEARNAAGGRVAEGVTS

SEQ ID NO: 530078 - protein, 7 aa, Mycobacterium
NGETNYG

SEQ ID NO: 530079 - protein, 17 aa, Mycobacterium
NGETPIAEALAGQRARR

SEQ ID NO: 530080 - protein, 7 aa, Mycobacterium
NGETVEG

SEQ ID NO: 530081 - protein, 11 aa, Mycobacterium
NGEVPSTGEPF

SEQ ID NO: 530082 - protein, 7 aa, Mycobacterium
NGEYGRA

SEQ ID NO: 530083 - protein, 4 aa, Mycobacterium
NGFD

SEQ ID NO: 530084 - protein, 14 aa, Mycobacterium
NGFDATATDLSAPT

SEQ ID NO: 530085 - protein, 6 aa, Mycobacterium
NGFDDG

SEQ ID NO: 530086 - protein, 14 aa, Mycobacterium
NGFDPTAVRMVVTR

SEQ ID NO: 530087 - protein, 14 aa, Mycobacterium
NGFDPTPVRMVVES

SEQ ID NO: 530088 - protein, 5 aa, Mycobacterium
NGFGK

SEQ ID NO: 530089 - protein, 13 aa, Mycobacterium
NGFHKPDDARRAF

SEQ ID NO: 530090 - protein, 14 aa, Mycobacterium
NGFHKPDDARRAFD

SEQ ID NO: 530091 - protein, 59 aa, Mycobacterium
NGFNTDSVQPPRSITGDDLKPGAGPSLAEPRMGGAGLNAGATHTDQNLSAPNAPGPRVN

SEQ ID NO: 530092 - protein, 10 aa, Mycobacterium
NGFPGTSATF

SEQ ID NO: 530093 - protein, 11 aa, Mycobacterium
NGFPVEQQRRQ

SEQ ID NO: 530094 - protein, 4 aa, Mycobacterium
NGFS

SEQ ID NO: 530095 - protein, 5 aa, Mycobacterium
NGFSE

SEQ ID NO: 530096 - protein, 6 aa, Mycobacterium
NGFSEK

SEQ ID NO: 530097 - protein, 17 aa, Mycobacterium
NGGAAAASLGSGRQRPG

SEQ ID NO: 530098 - protein, 17 aa, Mycobacterium
NGGAADGDDVDGRPQEE

SEQ ID NO: 530099 - protein, 49 aa, Mycobacterium
NGGAANVGVGNGGGGNMGFGNSGTENTGSFNSGGDNGPNGGNTGSFNSG

SEQ ID NO: 530100 - protein, 8 aa, Mycobacterium
NGGADRHP

SEQ ID NO: 530101 - protein, 21 aa, Mycobacterium
NGGADRNRASAPDGLATDVPD

SEQ ID NO: 530102 - protein, 8 aa, Mycobacterium
NGGAETGE

SEQ ID NO: 530103 - protein, 47 aa, Mycobacterium
NGGAGFNNGATAGAAGGNGGNAGLIGNGGAGGNGGAGAAGGTGGNGG

SEQ ID NO: 530104 - protein, 25 aa, Mycobacterium
NGGAGGAGATGGGNTGGIGGDGGNA

SEQ ID NO: 530105 - protein, 32 aa, Mycobacterium
NGGAGGAGGAGAPGPVSFNGNNGGNGGNGGAA

SEQ ID NO: 530106 - protein, 13 aa, Mycobacterium
NGGAGGAGGAGTA

SEQ ID NO: 530107 - protein, 15 aa, Mycobacterium
NGGAGGAGGASAIPL

SEQ ID NO: 530108 - protein, 33 aa, Mycobacterium
NGGAGGAGGASGAGIGGDSLGGSGGNGGNGGIS

SEQ ID NO: 530109 - protein, 12 aa, Mycobacterium
NGGAGGAGGESF

SEQ ID NO: 530110 - protein, 31 aa, Mycobacterium
NGGAGGAGGHGGGGPGMGGDGGDGGDGGRAQ

SEQ ID NO: 530111 - protein, 10 aa, Mycobacterium
NGGAGGAGGL

SEQ ID NO: 530112 - protein, 58 aa, Mycobacterium
NGGAGGAGGLGGLGGVGGAGATGADAANPTTTGQAGGDGGNGGAGGAGGDGGGGGKSG

SEQ ID NO: 530113 - protein, 10 aa, Mycobacterium
NGGAGGAGGS

SEQ ID NO: 530114 - protein, 27 aa, Mycobacterium
NGGAGGAGGTSGNGGGTGGAGGAAGSG

SEQ ID NO: 530115 - protein, 19 aa, Mycobacterium
NGGAGGAGGVGANGGGGGN

SEQ ID NO: 530116 - protein, 33 aa, Mycobacterium
NGGAGGAGGVGGAGIGTGGLGSNGGNGGTGGIG

SEQ ID NO: 530117 - protein, 25 aa, Mycobacterium
NGGAGGAGGVGGAGVSGGVGGTGGN

SEQ ID NO: 530118 - protein, 51 aa, Mycobacterium
NGGAGGAGTATHTAGGNGGDAGLIGNGGAGGAGFNAGNGAAGGAGGAGGHG

SEQ ID NO: 530119 - protein, 35 aa, Mycobacterium
NGGAGGDGGAGGASQEFGDSGGNGGNGGAGGASGA

SEQ ID NO: 530120 - protein, 40 aa, Mycobacterium
NGGAGGDGGAGGEGGDSSGGAASAGGDGGAGGAGGAGANG

SEQ ID NO: 530121 - protein, 38 aa, Mycobacterium
NGGAGGDGGATGTPGTYSDGTGTGSVYQTSDGGGGGDG

SEQ ID NO: 530122 - protein, 20 aa, Mycobacterium
NGGAGGDSSSMGNSGNGGNA

SEQ ID NO: 530123 - protein, 24 aa, Mycobacterium
NGGAGGGGGDGINVGGKGGAGGAA

SEQ ID NO: 530124 - protein, 22 aa, Mycobacterium
NGGAGGGGTAAHPAGGNGGAAG

SEQ ID NO: 530125 - protein, 21 aa, Mycobacterium
NGGAGGHGGAGGAGGIGGNGG

SEQ ID NO: 530126 - protein, 28 aa, Mycobacterium
NGGAGGHGGPGVAGVNGGNAGQGGHGGN

SEQ ID NO: 530127 - protein, 76 aa, Mycobacterium
NGGAGGIGGAGGVVGSSEGGVDGGVGGSGGSGGATGLLGNGGAGGTGGQGGDGGRGFDGSLGAGGAGGTGAVGGSG

SEQ ID NO: 530128 - protein, 31 aa, Mycobacterium
NGGAGGIGGIGASGSFGAPSGQGGNGGIGGA

SEQ ID NO: 530129 - protein, 35 aa, Mycobacterium
NGGAGGIGGTGGSGGAGAPGGIGGGGGGGGIGTAT

SEQ ID NO: 530130 - protein, 36 aa, Mycobacterium
NGGAGGIGGTGGSGLDGPDSGAAGGAGGSGGSGGAA

SEQ ID NO: 530131 - protein, 21 aa, Mycobacterium
NGGAGGIGGTSAGSGGAGGAG

SEQ ID NO: 530132 - protein, 19 aa, Mycobacterium
NGGAGGMGGTGSTAGAGGS

SEQ ID NO: 530133 - protein, 33 aa, Mycobacterium
NGGAGGNAGDGGVGGTGFDGGDGGVGGQGGSSG

SEQ ID NO: 530134 - protein, 15 aa, Mycobacterium
NGGAGGNGATGGTGF

SEQ ID NO: 530135 - protein, 20 aa, Mycobacterium
NGGAGGNGFSNASGGLGGQA

SEQ ID NO: 530136 - protein, 11 aa, Mycobacterium
NGGAGGNGGDA

SEQ ID NO: 530137 - protein, 19 aa, Mycobacterium
NGGAGGNGGQGGDAGANGF

SEQ ID NO: 530138 - protein, 22 aa, Mycobacterium
NGGAGGNGGTASTGGAGGGGGA

SEQ ID NO: 530139 - protein, 28 aa, Mycobacterium
NGGAGGPGGAGGNAGLIGNGGAGGSGAA

SEQ ID NO: 530140 - protein, 15 aa, Mycobacterium
NGGAGGQGGAGAAAV

SEQ ID NO: 530141 - protein, 101 aa, Mycobacterium
NGGAGGQGGTGMAGTDGTNPTPTGTAGTGASGTPFSGDGHAGSGHTGDNGAPGENGGTGGTGGEATGAGGIGGTGGNGGAAGSGGANGGDGGVGGAATDTF

SEQ ID NO: 530142 - protein, 45 aa, Mycobacterium
NGGAGGSGAAGGNGGAGGAAGLVGNGGAGGAGGNNAAGGSGGAGG

SEQ ID NO: 530143 - protein, 21 aa, Mycobacterium
NGGAGGSGAAGQAGGAGGAAG

SEQ ID NO: 530144 - protein, 43 aa, Mycobacterium
NGGAGGSGAAGQAGGAGGAAGLIGSGGAGGIGGTGAAGGKGGN

SEQ ID NO: 530145 - protein, 21 aa, Mycobacterium
NGGAGGSGAAGQAGGDGGAAG

SEQ ID NO: 530146 - protein, 23 aa, Mycobacterium
NGGAGGSGAAGSGQNGGAGGAAG

SEQ ID NO: 530147 - protein, 21 aa, Mycobacterium
NGGAGGSGADGQNGGAGGNAG

SEQ ID NO: 530148 - protein, 22 aa, Mycobacterium
NGGAGGSGAPGMPGGNGGDAGL

SEQ ID NO: 530149 - protein, 20 aa, Mycobacterium
NGGAGGSGAPGQSGGTGGAA

SEQ ID NO: 530150 - protein, 22 aa, Mycobacterium
NGGAGGSGASGQAGGAGGAAGL

SEQ ID NO: 530151 - protein, 23 aa, Mycobacterium
NGGAGGSGATGLTGGAGGNGGAA

SEQ ID NO: 530152 - protein, 27 aa, Mycobacterium
NGGAGGSGAVNGLGTGQAGGNGGAAGL

SEQ ID NO: 530153 - protein, 33 aa, Mycobacterium
NGGAGGSGGAGGAGIGTGGFGGSGGNGGTGGIG

SEQ ID NO: 530154 - protein, 25 aa, Mycobacterium
NGGAGGSGGMSGSGTGLPGGNGGAG

SEQ ID NO: 530155 - protein, 38 aa, Mycobacterium
NGGAGGSGGQGGNGGSAIETGNGGAAGAGGTGGAGGHG

SEQ ID NO: 530156 - protein, 23 aa, Mycobacterium
NGGAGGSGGTAHPTGGRGGNAGL

SEQ ID NO: 530157 - protein, 23 aa, Mycobacterium
NGGAGGSGGTGQNGGNGGPAGLF

SEQ ID NO: 530158 - protein, 26 aa, Mycobacterium
NGGAGGSGTPGTASVAGGNGGNGGAG

SEQ ID NO: 530159 - protein, 27 aa, Mycobacterium
NGGAGGSGTPPGLGSAGGTGGTGGAAG

SEQ ID NO: 530160 - protein, 24 aa, Mycobacterium
NGGAGGSGTSSTTADGGKGGSGGA

SEQ ID NO: 530161 - protein, 23 aa, Mycobacterium
NGGAGGTGAQGATGGGAGGTGGN

SEQ ID NO: 530162 - protein, 25 aa, Mycobacterium
NGGAGGTGGFGETGGEGGAGGGAGW

SEQ ID NO: 530163 - protein, 78 aa, Mycobacterium
NGGAGGTGGVGGSGGTGAAGGAGGTGGDGGTATGNFDPTGTAAQGQEGGDGGSGADSTGIGGNGGNGGVGGNGGNGGR

SEQ ID NO: 530164 - protein, 23 aa, Mycobacterium
NGGAGGTGSAANPDGGNGGAAGL

SEQ ID NO: 530165 - protein, 80 aa, Mycobacterium
NGGAGGVGGTGGTGGGGGTGTVAGGINGISGDGGSGGAGGPGGNAQTIGNGGDGGNGGDGGVGANPGTGGIGAAGGTGGT

SEQ ID NO: 530166 - protein, 23 aa, Mycobacterium
NGGAGGVGGVGATGLAGGTGGAA

SEQ ID NO: 530167 - protein, 9 aa, Mycobacterium
NGGAGYTST

SEQ ID NO: 530168 - protein, 7 aa, Mycobacterium
NGGANDG

SEQ ID NO: 530169 - protein, 6 aa, Mycobacterium
NGGAPE

SEQ ID NO: 530170 - protein, 8 aa, Mycobacterium
NGGARPHT

SEQ ID NO: 530171 - protein, 24 aa, Mycobacterium
NGGARRIDGDQTDTERSAINGGKA

SEQ ID NO: 530172 - protein, 8 aa, Mycobacterium
NGGARRNP

SEQ ID NO: 530173 - protein, 13 aa, Mycobacterium
NGGASRPDGIAKQ

SEQ ID NO: 530174 - protein, 5 aa, Mycobacterium
NGGAV

SEQ ID NO: 530175 - protein, 4 aa, Mycobacterium
NGGD

SEQ ID NO: 530176 - protein, 8 aa, Mycobacterium
NGGDERYP

SEQ ID NO: 530177 - protein, 35 aa, Mycobacterium
NGGDGADGTAPGQAGGRGGDAGFIGSGGKGGRGTD

SEQ ID NO: 530178 - protein, 26 aa, Mycobacterium
NGGDGGAGAAATIGNAAGNGGAGGNA

SEQ ID NO: 530179 - protein, 50 aa, Mycobacterium
NGGDGGAGAAGQAGGRGGDAGLIGTGGAGGAGGAGGAGGNGGAGGAGGRG

SEQ ID NO: 530180 - protein, 71 aa, Mycobacterium
NGGDGGAGGDGGVGGTGGIGGAGGNGGVGGDGSSSGTGAGGSGGDATDGGTGGDGGSGGGFGTGGAGGTGG

SEQ ID NO: 530181 - protein, 25 aa, Mycobacterium
NGGDGGAGGIGTAGLAGSGGTGGSA

SEQ ID NO: 530182 - protein, 32 aa, Mycobacterium
NGGDGGDGGAGGAGGTGGSAGTGGAGGNGGNA

SEQ ID NO: 530183 - protein, 25 aa, Mycobacterium
NGGDGGDGGNSFQGNGGDGGIGGNA

SEQ ID NO: 530184 - protein, 27 aa, Mycobacterium
NGGDGGDGGNSLASLAGAGGAAGNAGL

SEQ ID NO: 530185 - protein, 38 aa, Mycobacterium
NGGDGGHGGTGGGGGRGINGADGGHGGDGGTGGAAGSA

SEQ ID NO: 530186 - protein, 83 aa, Mycobacterium
NGGDGGNSGSGGTFESAGGSVLSGAQGGGFAASAGNGGNSGLFGNGGSGGNGGNGGLGQAASGDDSQGGIGGDGAQGGNGGKA

SEQ ID NO: 530187 - protein, 22 aa, Mycobacterium
NGGDGGSGASGQIGGTGGSAGL

SEQ ID NO: 530188 - protein, 35 aa, Mycobacterium
NGGDGGSGGAGGTGGTGGAGGAGAAGGAGGNGSTQ

SEQ ID NO: 530189 - protein, 21 aa, Mycobacterium
NGGDGGSGTPGTATSPAGGRW

SEQ ID NO: 530190 - protein, 19 aa, Mycobacterium
NGGDGGTGGGTGTDGLGGT

SEQ ID NO: 530191 - protein, 7 aa, Mycobacterium
NGGDTPA

SEQ ID NO: 530192 - protein, 5 aa, Mycobacterium
NGGEA

SEQ ID NO: 530193 - protein, 6 aa, Mycobacterium
NGGEPR

SEQ ID NO: 530194 - protein, 14 aa, Mycobacterium
NGGEPTDPSTTVEG

SEQ ID NO: 530195 - protein, 7 aa, Mycobacterium
NGGEPVD

SEQ ID NO: 530196 - protein, 4 aa, Mycobacterium
NGGF

SEQ ID NO: 530197 - protein, 6 aa, Mycobacterium
NGGFDA

SEQ ID NO: 530198 - protein, 6 aa, Mycobacterium
NGGFEL

SEQ ID NO: 530199 - protein, 4 aa, Mycobacterium
NGGG

SEQ ID NO: 530200 - protein, 7 aa, Mycobacterium
NGGGGAK

SEQ ID NO: 530201 - protein, 8 aa, Mycobacterium
NGGGGAKY

SEQ ID NO: 530202 - protein, 67 aa, Mycobacterium
NGGGGGAGGIGGGGGTGAVGGTGGAGGAGGDSEFAGGNGNTGGDGGTGGTGGAGGDGGNGGAGGAGG

SEQ ID NO: 530203 - protein, 10 aa, Mycobacterium
NGGGGGDAGL

SEQ ID NO: 530204 - protein, 11 aa, Mycobacterium
NGGGGGTGGFG

SEQ ID NO: 530205 - protein, 14 aa, Mycobacterium
NGGGGGVGGVGGVG

SEQ ID NO: 530206 - protein, 7 aa, Mycobacterium
NGGGKTT

SEQ ID NO: 530207 - protein, 7 aa, Mycobacterium
NGGGLGQ

SEQ ID NO: 530208 - protein, 9 aa, Mycobacterium
NGGGLNPAA

SEQ ID NO: 530209 - protein, 7 aa, Mycobacterium
NGGGNDG

SEQ ID NO: 530210 - protein, 8 aa, Mycobacterium
NGGGPGEL

SEQ ID NO: 530211 - protein, 16 aa, Mycobacterium
NGGGRRTSSSGSATTC

SEQ ID NO: 530212 - protein, 13 aa, Mycobacterium
NGGGSRPDGIAKQ

SEQ ID NO: 530213 - protein, 14 aa, Mycobacterium
NGGGSRPDGIAKQE

SEQ ID NO: 530214 - protein, 6 aa, Mycobacterium
NGGGTV

SEQ ID NO: 530215 - protein, 6 aa, Mycobacterium
NGGGVL

SEQ ID NO: 530216 - protein, 12 aa, Mycobacterium
NGGGYTSAKHAQ

SEQ ID NO: 530217 - protein, 33 aa, Mycobacterium
NGGHGGNGGDGGTTGIARGDNGGDGGNGGNGGW

SEQ ID NO: 530218 - protein, 41 aa, Mycobacterium
NGGHGGTGGAGGTLSGIGGHGGAGGLGQVSGGAGGDGGNGG

SEQ ID NO: 530219 - protein, 34 aa, Mycobacterium
NGGHGGTGGTGSAAGGPGGSGGAGGTGGAGGHGG

SEQ ID NO: 530220 - protein, 9 aa, Mycobacterium
NGGHLQPST

SEQ ID NO: 530221 - protein, 6 aa, Mycobacterium
NGGHST

SEQ ID NO: 530222 - protein, 7 aa, Mycobacterium
NGGIASK

SEQ ID NO: 530223 - protein, 22 aa, Mycobacterium
NGGIGGDGGVAANGGAGGQGGL

SEQ ID NO: 530224 - protein, 20 aa, Mycobacterium
NGGIGGQGGAGGIGGAGGSA

SEQ ID NO: 530225 - protein, 15 aa, Mycobacterium
NGGILSEQTALILEG

SEQ ID NO: 530226 - protein, 12 aa, Mycobacterium
NGGKLPGVPDDE

SEQ ID NO: 530227 - protein, 6 aa, Mycobacterium
NGGKSD

SEQ ID NO: 530228 - protein, 6 aa, Mycobacterium
NGGKSS

SEQ ID NO: 530229 - protein, 22 aa, Mycobacterium
NGGKYNPAAPFGGYKKSGVGRE

SEQ ID NO: 530230 - protein, 5 aa, Mycobacterium
NGGLA

SEQ ID NO: 530231 - protein, 14 aa, Mycobacterium
NGGLDDRRSSNGYL

SEQ ID NO: 530232 - protein, 26 aa, Mycobacterium
NGGLGGGGGSGSINNGGNGGSGGTGG

SEQ ID NO: 530233 - protein, 4 aa, Mycobacterium
NGGM

SEQ ID NO: 530234 - protein, 20 aa, Mycobacterium
NGGMGGAGGAGAAGGAGGTG

SEQ ID NO: 530235 - protein, 11 aa, Mycobacterium
NGGNAGIGGAG

SEQ ID NO: 530236 - protein, 23 aa, Mycobacterium
NGGNAGTGGAGPSNGGNGVGGTG

SEQ ID NO: 530237 - protein, 22 aa, Mycobacterium
NGGNAGTGGTGLSTGSTGAGGI

SEQ ID NO: 530238 - protein, 23 aa, Mycobacterium
NGGNAGVGGASTTNGGTGVGGTG

SEQ ID NO: 530239 - protein, 23 aa, Mycobacterium
NGGNAGVGGTGPAAGATGVGGTS

SEQ ID NO: 530240 - protein, 26 aa, Mycobacterium
NGGNGAAGAIEQHGAGAVGGAGGAAG

SEQ ID NO: 530241 - protein, 22 aa, Mycobacterium
NGGNGAAGDFGQAGGGGGSAGL

SEQ ID NO: 530242 - protein, 22 aa, Mycobacterium
NGGNGAMGGTGPTVGATGAGGM

SEQ ID NO: 530243 - protein, 24 aa, Mycobacterium
NGGNGANGGNTGAPGTLSGGGTGT

SEQ ID NO: 530244 - protein, 23 aa, Mycobacterium
NGGNGAPGANPGVAGGAGGAAGL

SEQ ID NO: 530245 - protein, 21 aa, Mycobacterium
NGGNGAPGAVGQAGGAGGAAG

SEQ ID NO: 530246 - protein, 45 aa, Mycobacterium
NGGNGAPGTNQGVAGGNGGSAGLIGNGGAGGLGGPGGAGGAGGHG

SEQ ID NO: 530247 - protein, 24 aa, Mycobacterium
NGGNGASGAPGQAGGAGGDAGLIG

SEQ ID NO: 530248 - protein, 47 aa, Mycobacterium
NGGNGFSPTTAGAPGGNGGSAGLIGNGGAGGSGGAGAAGGVGGNGGG

SEQ ID NO: 530249 - protein, 23 aa, Mycobacterium
NGGNGFSQTTAGVAGGSGGAAGL

SEQ ID NO: 530250 - protein, 24 aa, Mycobacterium
NGGNGGAGAGSDQGGTGGTGGTGG

SEQ ID NO: 530251 - protein, 27 aa, Mycobacterium
NGGNGGAGGHGFGAGTPGKGGGGGTAG

SEQ ID NO: 530252 - protein, 11 aa, Mycobacterium
NGGNGGAGGVG

SEQ ID NO: 530253 - protein, 24 aa, Mycobacterium
NGGNGGASTNLGAVGGAGGSAGLI

SEQ ID NO: 530254 - protein, 20 aa, Mycobacterium
NGGNGGHATAAGSTPGTGGL

SEQ ID NO: 530255 - protein, 8 aa, Mycobacterium
NGGNGGIG

SEQ ID NO: 530256 - protein, 23 aa, Mycobacterium
NGGNGGIGGAGPTPGGNGIGGTS

SEQ ID NO: 530257 - protein, 10 aa, Mycobacterium
NGGNGGMGGM

SEQ ID NO: 530258 - protein, 11 aa, Mycobacterium
NGGNGGMGGTA

SEQ ID NO: 530259 - protein, 24 aa, Mycobacterium
NGGNGGNAGSGGTSGFEGVAGQGG

SEQ ID NO: 530260 - protein, 21 aa, Mycobacterium
NGGNGGNAGSGGVGPGIAGAA

SEQ ID NO: 530261 - protein, 35 aa, Mycobacterium
NGGNGGNAGTGPTTGAGGTGGTGGNLLGVNGFDGL

SEQ ID NO: 530262 - protein, 38 aa, Mycobacterium
NGGNGGNGAAGATAGTDGKGGAGGTGGTLLGEDGLNGL

SEQ ID NO: 530263 - protein, 51 aa, Mycobacterium
NGGNGGNGGAGQAGGGGGSAGLLGNGGNGGNGGPGIPGGPGPAGGNGGNGG

SEQ ID NO: 530264 - protein, 27 aa, Mycobacterium
NGGNGGNGGAVVTGGTPGGGGNGGTGG

SEQ ID NO: 530265 - protein, 17 aa, Mycobacterium
NGGNGGNGGDGGTRPKG

SEQ ID NO: 530266 - protein, 26 aa, Mycobacterium
NGGNGGNGGNGGNVGTGTPGAGGSGG

SEQ ID NO: 530267 - protein, 19 aa, Mycobacterium
NGGNGGNGGPDQPGGAGGC

SEQ ID NO: 530268 - protein, 27 aa, Mycobacterium
NGGNGGNGGTDGTGAPTGSPGAGGTGG

SEQ ID NO: 530269 - protein, 10 aa, Mycobacterium
NGGNGGNGGV

SEQ ID NO: 530270 - protein, 17 aa, Mycobacterium
NGGNGGNTGNGGTFQAS

SEQ ID NO: 530271 - protein, 55 aa, Mycobacterium
NGGNGGSGAAGQAGGNGGSAGLLGNGGAGGAGGAGASGAAGDSGLTGGNGGIGGA

SEQ ID NO: 530272 - protein, 56 aa, Mycobacterium
NGGNGGSGAAGQAGGNGGSAGLLGNGGNGGAGGAGAAGASGVSGQAGGSGGMGGSG

SEQ ID NO: 530273 - protein, 19 aa, Mycobacterium
NGGNGGSGAAGQTGGDGGV

SEQ ID NO: 530274 - protein, 20 aa, Mycobacterium
NGGNGGSGAAGQVGGTGGAA

SEQ ID NO: 530275 - protein, 22 aa, Mycobacterium
NGGNGGSGAPGGNGGAGGSAGL

SEQ ID NO: 530276 - protein, 35 aa, Mycobacterium
NGGNGGSGAPGLPGGRGGDAGLVGNGGQGGAGGNA

SEQ ID NO: 530277 - protein, 22 aa, Mycobacterium
NGGNGGSGAPGQAGGAGGSAGL

SEQ ID NO: 530278 - protein, 23 aa, Mycobacterium
NGGNGGSGAPGQRGGDGGDAGLL

SEQ ID NO: 530279 - protein, 22 aa, Mycobacterium
NGGNGGSGATGQVGGSGGAAGL

SEQ ID NO: 530280 - protein, 36 aa, Mycobacterium
NGGNGGSGAVGQNGGNGGSAGLWGNGGNGAPGGAGA

SEQ ID NO: 530281 - protein, 21 aa, Mycobacterium
NGGNGGSGGLAQAGGNGGAAG

SEQ ID NO: 530282 - protein, 52 aa, Mycobacterium
NGGNGGSGGPGQLGGNGGSAGLIGNGGAGGAGGPGTPPRWSAKPAGRAAAAG

SEQ ID NO: 530283 - protein, 20 aa, Mycobacterium
NGGNGGSGGVGQAGGAGGAA

SEQ ID NO: 530284 - protein, 22 aa, Mycobacterium
NGGNGGSGGVGQNGGSGGSAGL

SEQ ID NO: 530285 - protein, 19 aa, Mycobacterium
NGGNGGSGLAGQAGGVGGA

SEQ ID NO: 530286 - protein, 22 aa, Mycobacterium
NGGNGGTGAAGQAGGNGGAAGL

SEQ ID NO: 530287 - protein, 23 aa, Mycobacterium
NGGNGGTSTNAATAGGAGGSAGL

SEQ ID NO: 530288 - protein, 23 aa, Mycobacterium
NGGNGGTSTTAGVAGGDGGAAGL

SEQ ID NO: 530289 - protein, 11 aa, Mycobacterium
NGGNGGVGGIG

SEQ ID NO: 530290 - protein, 22 aa, Mycobacterium
NGGNGGVGGVGETPGGDGGGGI

SEQ ID NO: 530291 - protein, 44 aa, Mycobacterium
NGGNGWNSTTGGAAGGNGGDAGLLGNGGTGGSGGALAPGGTGGV

SEQ ID NO: 530292 - protein, 23 aa, Mycobacterium
NGGNGYSETTAGVAGGAGGAAGL

SEQ ID NO: 530293 - protein, 48 aa, Mycobacterium
NGGNGYSFTSGGLQNGGSGGSAGLIGNGGNGGNGFLGGTGGAGGSGGW

SEQ ID NO: 530294 - protein, 35 aa, Mycobacterium
NGGNGYSFTSGGTQSGGTGGSAGLIGNGGNGGNGF

SEQ ID NO: 530295 - protein, 46 aa, Mycobacterium
NGGNGYSQTASGVPGGAGGPAGLIGNGGAGGTGGTGAPGGAGGNGG

SEQ ID NO: 530296 - protein, 35 aa, Mycobacterium
NGGNGYSQTDGGLAGGKGGNAGLIGNGGAGGNGGD

SEQ ID NO: 530297 - protein, 23 aa, Mycobacterium
NGGNGYSQTTPGLTGGTGGTAGL

SEQ ID NO: 530298 - protein, 5 aa, Mycobacterium
NGGNH

SEQ ID NO: 530299 - protein, 13 aa, Mycobacterium
NGGNPGSGGDGGS

SEQ ID NO: 530300 - protein, 7 aa, Mycobacterium
NGGNRTV

SEQ ID NO: 530301 - protein, 31 aa, Mycobacterium
NGGNSGDVGLSGAGTPGLPGNGGLLIGTIGN

SEQ ID NO: 530302 - protein, 4 aa, Mycobacterium
NGGP

SEQ ID NO: 530303 - protein, 7 aa, Mycobacterium
NGGPCRG

SEQ ID NO: 530304 - protein, 5 aa, Mycobacterium
NGGPL

SEQ ID NO: 530305 - protein, 6 aa, Mycobacterium
NGGPPI

SEQ ID NO: 530306 - protein, 6 aa, Mycobacterium
NGGPSV

SEQ ID NO: 530307 - protein, 15 aa, Mycobacterium
NGGPVKPSDKPPRPF

SEQ ID NO: 530308 - protein, 27 aa, Mycobacterium
NGGRGGAGGDGANLAGGGNGGNGGDTR

SEQ ID NO: 530309 - protein, 21 aa, Mycobacterium
NGGRGGDGVAGQAGGRGGSAG

SEQ ID NO: 530310 - protein, 12 aa, Mycobacterium
NGGRGGDSTAVG

SEQ ID NO: 530311 - protein, 43 aa, Mycobacterium
NGGRGGDSTLAGVSGGGGGDAGLIGNGGAGGTGGNGGSGGLGG

SEQ ID NO: 530312 - protein, 7 aa, Mycobacterium
NGGRIDG

SEQ ID NO: 530313 - protein, 178 aa, Mycobacterium
NGGRPTPVQPPQPRPDSVAPTSPVTANGDPRDRGVPARTEDEERRDPWGAGEQPNAQGGGAPSGGEPQQPQTPQEAPVSPPVAEQPPQATQQSGQQESSPAGGQQGGGQQGGAPGGSPGGSPGGGSPGGGMPTTGKGTEPRLPTDPSLKPAAAGGGSSGGGGGGGGVPAGPLQPAVGA

SEQ ID NO: 530314 - protein, 4 aa, Mycobacterium
NGGS

SEQ ID NO: 530315 - protein, 17 aa, Mycobacterium
NGGSGAAGQNGENGGAA

SEQ ID NO: 530316 - protein, 43 aa, Mycobacterium
NGGSGGAGGAGGMGGNGGNGVGNPGDGGDGGGGGAGASGGDGG

SEQ ID NO: 530317 - protein, 10 aa, Mycobacterium
NGGSGGAGGW

SEQ ID NO: 530318 - protein, 49 aa, Mycobacterium
NGGSGGDGGVGGTGGTGGAGGSGAGGGVGGDGSSRGGIGGNGGSGANSM

SEQ ID NO: 530319 - protein, 39 aa, Mycobacterium
NGGSGGLGGVGGQATGATTSSDLGGVGGAGGNGGSGAHG

SEQ ID NO: 530320 - protein, 17 aa, Mycobacterium
NGGSGGQGGLAGTADPV

SEQ ID NO: 530321 - protein, 31 aa, Mycobacterium
NGGSGGQGGTGLAGADGVNYSNGTAGPGAWG

SEQ ID NO: 530322 - protein, 21 aa, Mycobacterium
NGGSGGSGAAGQAGGAGGAAG

SEQ ID NO: 530323 - protein, 20 aa, Mycobacterium
NGGSGGSGAAGSVGGNGGAA

SEQ ID NO: 530324 - protein, 20 aa, Mycobacterium
NGGSGGSGAPGHDGGNGGAA

SEQ ID NO: 530325 - protein, 22 aa, Mycobacterium
NGGSGGSGAPGKPGGNGGSAGL

SEQ ID NO: 530326 - protein, 8 aa, Mycobacterium
NGGSGWNS

SEQ ID NO: 530327 - protein, 7 aa, Mycobacterium
NGGSNDV

SEQ ID NO: 530328 - protein, 7 aa, Mycobacterium
NGGSRST

SEQ ID NO: 530329 - protein, 11 aa, Mycobacterium
NGGSSGNSIET

SEQ ID NO: 530330 - protein, 6 aa, Mycobacterium
NGGSST

SEQ ID NO: 530331 - protein, 10 aa, Mycobacterium
NGGSTGNSLE

SEQ ID NO: 530332 - protein, 11 aa, Mycobacterium
NGGTAKREIDA

SEQ ID NO: 530333 - protein, 7 aa, Mycobacterium
NGGTAQL

SEQ ID NO: 530334 - protein, 7 aa, Mycobacterium
NGGTEAV

SEQ ID NO: 530335 - protein, 13 aa, Mycobacterium
NGGTGGAAGDLAS

SEQ ID NO: 530336 - protein, 23 aa, Mycobacterium
NGGTGGAGGAGGTGGVGGQVNAE

SEQ ID NO: 530337 - protein, 23 aa, Mycobacterium
NGGTGGISTRAGVPGGAGGAAGL

SEQ ID NO: 530338 - protein, 21 aa, Mycobacterium
NGGTGGNGGLSGNGAAGGTGG

SEQ ID NO: 530339 - protein, 9 aa, Mycobacterium
NGGTGGPGG

SEQ ID NO: 530340 - protein, 30 aa, Mycobacterium
NGGTGGRGGLGASATSFAGGSGGAGGAGGV

SEQ ID NO: 530341 - protein, 45 aa, Mycobacterium
NGGTGGSGAPGQNGGAGGNAGLLGSGGTGGVGGAGATGGTGGTGG

SEQ ID NO: 530342 - protein, 19 aa, Mycobacterium
NGGTGGSGLGGGGNGGNAV

SEQ ID NO: 530343 - protein, 25 aa, Mycobacterium
NGGTGGTGGVGTGNIAGGAGGFGGS

SEQ ID NO: 530344 - protein, 30 aa, Mycobacterium
NGGTGGVGGTGGMGGAGAAGGTGGDGGNAG

SEQ ID NO: 530345 - protein, 9 aa, Mycobacterium
NGGTRDPIA

SEQ ID NO: 530346 - protein, 9 aa, Mycobacterium
NGGTRLAEG

SEQ ID NO: 530347 - protein, 7 aa, Mycobacterium
NGGTVDG

SEQ ID NO: 530348 - protein, 14 aa, Mycobacterium
NGGTYGGVESRNRQ

SEQ ID NO: 530349 - protein, 4 aa, Mycobacterium
NGGV

SEQ ID NO: 530350 - protein, 7 aa, Mycobacterium
NGGVGEA

SEQ ID NO: 530351 - protein, 67 aa, Mycobacterium
NGGVGGAGGVGAFGSGGTGGNGGAGGAVGNGGAGGDAGSSGNLSPAGGGKGGNAKLVGNGGDGGAGV

SEQ ID NO: 530352 - protein, 23 aa, Mycobacterium
NGGVGGDGQYGTTSSAGGIGGNG

SEQ ID NO: 530353 - protein, 56 aa, Mycobacterium
NGGVGGTGGTSRFGGLGGNGGVGGKAGLIGNGGDGGAGGNSGSATGTGGNGGAGGS

SEQ ID NO: 530354 - protein, 21 aa, Mycobacterium
NGGVGGVGGVGAGDGGAGGRA

SEQ ID NO: 530355 - protein, 6 aa, Mycobacterium
NGGVPS

SEQ ID NO: 530356 - protein, 13 aa, Mycobacterium
NGGVSRSVHPTRA

SEQ ID NO: 530357 - protein, 5 aa, Mycobacterium
NGGWQ

SEQ ID NO: 530358 - protein, 5 aa, Mycobacterium
NGGWS

SEQ ID NO: 530359 - protein, 6 aa, Mycobacterium
NGGYGA

SEQ ID NO: 530360 - protein, 7 aa, Mycobacterium
NGGYGTV

SEQ ID NO: 530361 - protein, 6 aa, Mycobacterium
NGGYNT

SEQ ID NO: 530362 - protein, 14 aa, Mycobacterium
NGHATAAPVAPLPA

SEQ ID NO: 530363 - protein, 11 aa, Mycobacterium
NGHATVDESSR

SEQ ID NO: 530364 - protein, 9 aa, Mycobacterium
NGHEASGRS

SEQ ID NO: 530365 - protein, 6 aa, Mycobacterium
NGHEPI

SEQ ID NO: 530366 - protein, 12 aa, Mycobacterium
NGHGEKPAIPPE

SEQ ID NO: 530367 - protein, 6 aa, Mycobacterium
NGHGRE

SEQ ID NO: 530368 - protein, 5 aa, Mycobacterium
NGHNA

SEQ ID NO: 530369 - protein, 10 aa, Mycobacterium
NGHNSTAPAA

SEQ ID NO: 530370 - protein, 22 aa, Mycobacterium
NGHNVSARGRIPADVIDAFHAA

SEQ ID NO: 530371 - protein, 22 aa, Mycobacterium
NGHNVSTRGRIPADVIDAFHAA

SEQ ID NO: 530372 - protein, 6 aa, Mycobacterium
NGHPGA

SEQ ID NO: 530373 - protein, 6 aa, Mycobacterium
NGHPGY

SEQ ID NO: 530374 - protein, 4 aa, Mycobacterium
NGHQ

SEQ ID NO: 530375 - protein, 7 aa, Mycobacterium
NGHRAGN

SEQ ID NO: 530376 - protein, 8 aa, Mycobacterium
NGHRGGSA

SEQ ID NO: 530377 - protein, 4 aa, Mycobacterium
NGHT

SEQ ID NO: 530378 - protein, 6 aa, Mycobacterium
NGHTTA

SEQ ID NO: 530379 - protein, 4 aa, Mycobacterium
NGIE

SEQ ID NO: 530380 - protein, 7 aa, Mycobacterium
NGIEPSE

SEQ ID NO: 530381 - protein, 8 aa, Mycobacterium
NGIGNRSL

SEQ ID NO: 530382 - protein, 9 aa, Mycobacterium
NGIGQSDAA

SEQ ID NO: 530383 - protein, 5 aa, Mycobacterium
NGIGR

SEQ ID NO: 530384 - protein, 4 aa, Mycobacterium
NGIP

SEQ ID NO: 530385 - protein, 9 aa, Mycobacterium
NGIPASASS

SEQ ID NO: 530386 - protein, 6 aa, Mycobacterium
NGIPTT

SEQ ID NO: 530387 - protein, 5 aa, Mycobacterium
NGIPY

SEQ ID NO: 530388 - protein, 4 aa, Mycobacterium
NGIT

SEQ ID NO: 530389 - protein, 9 aa, Mycobacterium
NGKAGQDKG

SEQ ID NO: 530390 - protein, 5 aa, Mycobacterium
NGKDL

SEQ ID NO: 530391 - protein, 4 aa, Mycobacterium
NGKE

SEQ ID NO: 530392 - protein, 5 aa, Mycobacterium
NGKEL

SEQ ID NO: 530393 - protein, 6 aa, Mycobacterium
NGKELE

SEQ ID NO: 530394 - protein, 8 aa, Mycobacterium
NGKFGGTF

SEQ ID NO: 530395 - protein, 6 aa, Mycobacterium
NGKGAF

SEQ ID NO: 530396 - protein, 7 aa, Mycobacterium
NGKGGQP

SEQ ID NO: 530397 - protein, 8 aa, Mycobacterium
NGKGGQPV

SEQ ID NO: 530398 - protein, 8 aa, Mycobacterium
NGKGQKKL

SEQ ID NO: 530399 - protein, 9 aa, Mycobacterium
NGKGQKKLR

SEQ ID NO: 530400 - protein, 5 aa, Mycobacterium
NGKGR

SEQ ID NO: 530401 - protein, 12 aa, Mycobacterium
NGKLPRNTAAWI

SEQ ID NO: 530402 - protein, 7 aa, Mycobacterium
NGKPIRE

SEQ ID NO: 530403 - protein, 8 aa, Mycobacterium
NGKPIREA

SEQ ID NO: 530404 - protein, 8 aa, Mycobacterium
NGKPITGR

SEQ ID NO: 530405 - protein, 15 aa, Mycobacterium
NGKPVEEAKKRPEFT

SEQ ID NO: 530406 - protein, 6 aa, Mycobacterium
NGKRAG

SEQ ID NO: 530407 - protein, 8 aa, Mycobacterium
NGKRATTH

SEQ ID NO: 530408 - protein, 9 aa, Mycobacterium
NGKSAQPQF

SEQ ID NO: 530409 - protein, 9 aa, Mycobacterium
NGKSCAGGV

SEQ ID NO: 530410 - protein, 9 aa, Mycobacterium
NGKSPQAQR

SEQ ID NO: 530411 - protein, 14 aa, Mycobacterium
NGLAPAAVDDDGPS

SEQ ID NO: 530412 - protein, 7 aa, Mycobacterium
NGLAPAE

SEQ ID NO: 530413 - protein, 8 aa, Mycobacterium
NGLARGGL

SEQ ID NO: 530414 - protein, 8 aa, Mycobacterium
NGLDGTGV

SEQ ID NO: 530415 - protein, 6 aa, Mycobacterium
NGLDPH

SEQ ID NO: 530416 - protein, 5 aa, Mycobacterium
NGLEP

SEQ ID NO: 530417 - protein, 21 aa, Mycobacterium
NGLEPSPVSPGLGRDSETGQV

SEQ ID NO: 530418 - protein, 8 aa, Mycobacterium
NGLETQED

SEQ ID NO: 530419 - protein, 6 aa, Mycobacterium
NGLGDR

SEQ ID NO: 530420 - protein, 14 aa, Mycobacterium
NGLGGEAYRTSPLD

SEQ ID NO: 530421 - protein, 12 aa, Mycobacterium
NGLGNSGNINTG

SEQ ID NO: 530422 - protein, 28 aa, Mycobacterium
NGLGTISTSLSGSRGSRAVRAGRYSPGL

SEQ ID NO: 530423 - protein, 4 aa, Mycobacterium
NGLH

SEQ ID NO: 530424 - protein, 4 aa, Mycobacterium
NGLN

SEQ ID NO: 530425 - protein, 5 aa, Mycobacterium
NGLNG

SEQ ID NO: 530426 - protein, 44 aa, Mycobacterium
NGLNGAAAGGLGPEAAAAGASMGGMGAAGGGGGGLLSGSSALSS

SEQ ID NO: 530427 - protein, 16 aa, Mycobacterium
NGLNQKSAELRESAAT

SEQ ID NO: 530428 - protein, 29 aa, Mycobacterium
NGLNRTAEGLPSESEIAARAQDGRGLTRP

SEQ ID NO: 530429 - protein, 6 aa, Mycobacterium
NGLPAD

SEQ ID NO: 530430 - protein, 7 aa, Mycobacterium
NGLPADS

SEQ ID NO: 530431 - protein, 6 aa, Mycobacterium
NGLPEG

SEQ ID NO: 530432 - protein, 6 aa, Mycobacterium
NGLPPE

SEQ ID NO: 530433 - protein, 6 aa, Mycobacterium
NGLPQL

SEQ ID NO: 530434 - protein, 6 aa, Mycobacterium
NGLPTR

SEQ ID NO: 530435 - protein, 4 aa, Mycobacterium
NGLR

SEQ ID NO: 530436 - protein, 9 aa, Mycobacterium
NGLRGQVTA

SEQ ID NO: 530437 - protein, 14 aa, Mycobacterium
NGLRGTPNSAHYTA

SEQ ID NO: 530438 - protein, 9 aa, Mycobacterium
NGLRRGDAI

SEQ ID NO: 530439 - protein, 8 aa, Mycobacterium
NGLSNLGD

SEQ ID NO: 530440 - protein, 17 aa, Mycobacterium
NGLTGAPAAAATQGEGS

SEQ ID NO: 530441 - protein, 8 aa, Mycobacterium
NGLTQQTR

SEQ ID NO: 530442 - protein, 9 aa, Mycobacterium
NGLTRRDVA

SEQ ID NO: 530443 - protein, 9 aa, Mycobacterium
NGMDPPEHT

SEQ ID NO: 530444 - protein, 9 aa, Mycobacterium
NGMGSRLDP

SEQ ID NO: 530445 - protein, 6 aa, Mycobacterium
NGMPEE

SEQ ID NO: 530446 - protein, 20 aa, Mycobacterium
NGMSTGAPAAAGANSISAGA

SEQ ID NO: 530447 - protein, 5 aa, Mycobacterium
NGMTG

SEQ ID NO: 530448 - protein, 8 aa, Mycobacterium
NGMTPIPT

SEQ ID NO: 530449 - protein, 6 aa, Mycobacterium
NGMTYG

SEQ ID NO: 530450 - protein, 23 aa, Mycobacterium
NGNAAAAATTTNVASAAADEVST

SEQ ID NO: 530451 - protein, 8 aa, Mycobacterium
NGNAPDSL

SEQ ID NO: 530452 - protein, 7 aa, Mycobacterium
NGNCYRS

SEQ ID NO: 530453 - protein, 14 aa, Mycobacterium
NGNDTSGFQNHGDF

SEQ ID NO: 530454 - protein, 5 aa, Mycobacterium
NGNEY

SEQ ID NO: 530455 - protein, 4 aa, Mycobacterium
NGNF

SEQ ID NO: 530456 - protein, 29 aa, Mycobacterium
NGNFGGGNIGPGNVGDGNNGSTNLGSGNL

SEQ ID NO: 530457 - protein, 17 aa, Mycobacterium
NGNGDDAVAEESLSNNQ

SEQ ID NO: 530458 - protein, 14 aa, Mycobacterium
NGNGGRAGEPAGYK

SEQ ID NO: 530459 - protein, 16 aa, Mycobacterium
NGNGSTHPDHDEDERV

SEQ ID NO: 530460 - protein, 4 aa, Mycobacterium
NGNI

SEQ ID NO: 530461 - protein, 45 aa, Mycobacterium
NGNIGNGNAGSGNTGNANGGSGNTGDGNLGSGNVGNTNLGSGNGS

SEQ ID NO: 530462 - protein, 18 aa, Mycobacterium
NGNIGNTNFGSGNNGNLN

SEQ ID NO: 530463 - protein, 4 aa, Mycobacterium
NGNK

SEQ ID NO: 530464 - protein, 15 aa, Mycobacterium
NGNKFSNKELGKGEA

SEQ ID NO: 530465 - protein, 5 aa, Mycobacterium
NGNKI

SEQ ID NO: 530466 - protein, 9 aa, Mycobacterium
NGNLTGDAV

SEQ ID NO: 530467 - protein, 10 aa, Mycobacterium
NGNNDPATAS

SEQ ID NO: 530468 - protein, 15 aa, Mycobacterium
NGNPAPLTAGPSPAA

SEQ ID NO: 530469 - protein, 6 aa, Mycobacterium
NGNPDF

SEQ ID NO: 530470 - protein, 11 aa, Mycobacterium
NGNPEGKSHRE

SEQ ID NO: 530471 - protein, 7 aa, Mycobacterium
NGNPEQL

SEQ ID NO: 530472 - protein, 23 aa, Mycobacterium
NGNPIDGGPMGADGSTGNNHTQE

SEQ ID NO: 530473 - protein, 8 aa, Mycobacterium
NGNQEQRD

SEQ ID NO: 530474 - protein, 5 aa, Mycobacterium
NGNQV

SEQ ID NO: 530475 - protein, 4 aa, Mycobacterium
NGNR

SEQ ID NO: 530476 - protein, 13 aa, Mycobacterium
NGNRGPGASPQGV

SEQ ID NO: 530477 - protein, 5 aa, Mycobacterium
NGNRW

SEQ ID NO: 530478 - protein, 5 aa, Mycobacterium
NGNSF

SEQ ID NO: 530479 - protein, 17 aa, Mycobacterium
NGNSSNGDQPAAFDVDK

SEQ ID NO: 530480 - protein, 4 aa, Mycobacterium
NGNT

SEQ ID NO: 530481 - protein, 28 aa, Mycobacterium
NGNVGDYNLGSGNLGSENVGSSNIGSGN

SEQ ID NO: 530482 - protein, 5 aa, Mycobacterium
NGPAE

SEQ ID NO: 530483 - protein, 19 aa, Mycobacterium
NGPAKEAHAGERANPVSTG

SEQ ID NO: 530484 - protein, 7 aa, Mycobacterium
NGPALSF

SEQ ID NO: 530485 - protein, 9 aa, Mycobacterium
NGPAPDGYP

SEQ ID NO: 530486 - protein, 9 aa, Mycobacterium
NGPAPVGYD

SEQ ID NO: 530487 - protein, 7 aa, Mycobacterium
NGPATLD

SEQ ID NO: 530488 - protein, 7 aa, Mycobacterium
NGPAYGG

SEQ ID NO: 530489 - protein, 9 aa, Mycobacterium
NGPCWSPDG

SEQ ID NO: 530490 - protein, 6 aa, Mycobacterium
NGPDAA

SEQ ID NO: 530491 - protein, 11 aa, Mycobacterium
NGPDNLPSREQ

SEQ ID NO: 530492 - protein, 5 aa, Mycobacterium
NGPDV

SEQ ID NO: 530493 - protein, 9 aa, Mycobacterium
NGPDYDLSQ

SEQ ID NO: 530494 - protein, 6 aa, Mycobacterium
NGPELT

SEQ ID NO: 530495 - protein, 5 aa, Mycobacterium
NGPEM

SEQ ID NO: 530496 - protein, 5 aa, Mycobacterium
NGPFS

SEQ ID NO: 530497 - protein, 4 aa, Mycobacterium
NGPG

SEQ ID NO: 530498 - protein, 6 aa, Mycobacterium
NGPGHT

SEQ ID NO: 530499 - protein, 8 aa, Mycobacterium
NGPGPDTL

SEQ ID NO: 530500 - protein, 6 aa, Mycobacterium
NGPGPT

SEQ ID NO: 530501 - protein, 6 aa, Mycobacterium
NGPGRS

SEQ ID NO: 530502 - protein, 6 aa, Mycobacterium
NGPGRT

SEQ ID NO: 530503 - protein, 8 aa, Mycobacterium
NGPGTDRC

SEQ ID NO: 530504 - protein, 8 aa, Mycobacterium
NGPGTGYD

SEQ ID NO: 530505 - protein, 9 aa, Mycobacterium
NGPHLPERH

SEQ ID NO: 530506 - protein, 4 aa, Mycobacterium
NGPI

SEQ ID NO: 530507 - protein, 14 aa, Mycobacterium
NGPIEGTSNFGVFR

SEQ ID NO: 530508 - protein, 5 aa, Mycobacterium
NGPIG

SEQ ID NO: 530509 - protein, 6 aa, Mycobacterium
NGPIPR

SEQ ID NO: 530510 - protein, 8 aa, Mycobacterium
NGPISPDK

SEQ ID NO: 530511 - protein, 6 aa, Mycobacterium
NGPKAW

SEQ ID NO: 530512 - protein, 7 aa, Mycobacterium
NGPKMAG

SEQ ID NO: 530513 - protein, 5 aa, Mycobacterium
NGPLA

SEQ ID NO: 530514 - protein, 5 aa, Mycobacterium
NGPLE

SEQ ID NO: 530515 - protein, 6 aa, Mycobacterium
NGPLSA

SEQ ID NO: 530516 - protein, 4 aa, Mycobacterium
NGPM

SEQ ID NO: 530517 - protein, 12 aa, Mycobacterium
NGPMREDSPVRP

SEQ ID NO: 530518 - protein, 7 aa, Mycobacterium
NGPNGGS

SEQ ID NO: 530519 - protein, 9 aa, Mycobacterium
NGPNPREAT

SEQ ID NO: 530520 - protein, 8 aa, Mycobacterium
NGPNPRQA

SEQ ID NO: 530521 - protein, 5 aa, Mycobacterium
NGPPH

SEQ ID NO: 530522 - protein, 4 aa, Mycobacterium
NGPR

SEQ ID NO: 530523 - protein, 18 aa, Mycobacterium
NGPRAAALPPSGTGEGRQ

SEQ ID NO: 530524 - protein, 5 aa, Mycobacterium
NGPRL

SEQ ID NO: 530525 - protein, 13 aa, Mycobacterium
NGPRPAKATAGAC

SEQ ID NO: 530526 - protein, 5 aa, Mycobacterium
NGPRS

SEQ ID NO: 530527 - protein, 5 aa, Mycobacterium
NGPSA

SEQ ID NO: 530528 - protein, 6 aa, Mycobacterium
NGPSAV

SEQ ID NO: 530529 - protein, 7 aa, Mycobacterium
NGPSDQP

SEQ ID NO: 530530 - protein, 8 aa, Mycobacterium
NGPSFCSG

SEQ ID NO: 530531 - protein, 15 aa, Mycobacterium
NGPSGALPLANGPEE

SEQ ID NO: 530532 - protein, 7 aa, Mycobacterium
NGPSGGQ

SEQ ID NO: 530533 - protein, 6 aa, Mycobacterium
NGPSPV

SEQ ID NO: 530534 - protein, 13 aa, Mycobacterium
NGPTDPVKGPDPW

SEQ ID NO: 530535 - protein, 15 aa, Mycobacterium
NGPTGEQHVAYLKRP

SEQ ID NO: 530536 - protein, 5 aa, Mycobacterium
NGPTH

SEQ ID NO: 530537 - protein, 7 aa, Mycobacterium
NGPTNEP

SEQ ID NO: 530538 - protein, 8 aa, Mycobacterium
NGPTPDIS

SEQ ID NO: 530539 - protein, 9 aa, Mycobacterium
NGPTPGVTD

SEQ ID NO: 530540 - protein, 5 aa, Mycobacterium
NGPTQ

SEQ ID NO: 530541 - protein, 6 aa, Mycobacterium
NGPTQA

SEQ ID NO: 530542 - protein, 12 aa, Mycobacterium
NGPVRGVDDGRV

SEQ ID NO: 530543 - protein, 4 aa, Mycobacterium
NGQA

SEQ ID NO: 530544 - protein, 5 aa, Mycobacterium
NGQAA

SEQ ID NO: 530545 - protein, 8 aa, Mycobacterium
NGQDPAAV

SEQ ID NO: 530546 - protein, 4 aa, Mycobacterium
NGQE

SEQ ID NO: 530547 - protein, 8 aa, Mycobacterium
NGQERQNA

SEQ ID NO: 530548 - protein, 12 aa, Mycobacterium
NGQFGENLTTRD

SEQ ID NO: 530549 - protein, 9 aa, Mycobacterium
NGQGEDVVS

SEQ ID NO: 530550 - protein, 5 aa, Mycobacterium
NGQGG

SEQ ID NO: 530551 - protein, 5 aa, Mycobacterium
NGQGV

SEQ ID NO: 530552 - protein, 24 aa, Mycobacterium
NGQHSTGQTDTGGNGGRGGDGGTF

SEQ ID NO: 530553 - protein, 5 aa, Mycobacterium
NGQLG

SEQ ID NO: 530554 - protein, 12 aa, Mycobacterium
NGQLPSADNPGY

SEQ ID NO: 530555 - protein, 11 aa, Mycobacterium
NGQLSPGLPAP

SEQ ID NO: 530556 - protein, 10 aa, Mycobacterium
NGQNTRHAER

SEQ ID NO: 530557 - protein, 12 aa, Mycobacterium
NGQNTRHAERYR

SEQ ID NO: 530558 - protein, 11 aa, Mycobacterium
NGQNTRQAEQY

SEQ ID NO: 530559 - protein, 5 aa, Mycobacterium
NGQPE

SEQ ID NO: 530560 - protein, 6 aa, Mycobacterium
NGQPGA

SEQ ID NO: 530561 - protein, 14 aa, Mycobacterium
NGQPGGSGGAGGDA

SEQ ID NO: 530562 - protein, 9 aa, Mycobacterium
NGQPGYGEG

SEQ ID NO: 530563 - protein, 7 aa, Mycobacterium
NGQPHPA

SEQ ID NO: 530564 - protein, 7 aa, Mycobacterium
NGQPLTP

SEQ ID NO: 530565 - protein, 7 aa, Mycobacterium
NGQPVQA

SEQ ID NO: 530566 - protein, 15 aa, Mycobacterium
NGQRAGISEDDQQRW

SEQ ID NO: 530567 - protein, 8 aa, Mycobacterium
NGQRRTLA

SEQ ID NO: 530568 - protein, 8 aa, Mycobacterium
NGQSFCSG

SEQ ID NO: 530569 - protein, 10 aa, Mycobacterium
NGQTGLPSAG

SEQ ID NO: 530570 - protein, 12 aa, Mycobacterium
NGQTGVSCAPRD

SEQ ID NO: 530571 - protein, 10 aa, Mycobacterium
NGQYDNDQDA

SEQ ID NO: 530572 - protein, 4 aa, Mycobacterium
NGRA

SEQ ID NO: 530573 - protein, 13 aa, Mycobacterium
NGRADVAPATRSR

SEQ ID NO: 530574 - protein, 4 aa, Mycobacterium
NGRD

SEQ ID NO: 530575 - protein, 5 aa, Mycobacterium
NGRDN

SEQ ID NO: 530576 - protein, 10 aa, Mycobacterium
NGRDSNAQRL

SEQ ID NO: 530577 - protein, 4 aa, Mycobacterium
NGRE

SEQ ID NO: 530578 - protein, 13 aa, Mycobacterium
NGRERMTTPVPKR

SEQ ID NO: 530579 - protein, 10 aa, Mycobacterium
NGRFNEPPPA

SEQ ID NO: 530580 - protein, 4 aa, Mycobacterium
NGRG

SEQ ID NO: 530581 - protein, 5 aa, Mycobacterium
NGRGG

SEQ ID NO: 530582 - protein, 12 aa, Mycobacterium
NGRGIPANTARC

SEQ ID NO: 530583 - protein, 5 aa, Mycobacterium
NGRGQ

SEQ ID NO: 530584 - protein, 4 aa, Mycobacterium
NGRH

SEQ ID NO: 530585 - protein, 4 aa, Mycobacterium
NGRI

SEQ ID NO: 530586 - protein, 4 aa, Mycobacterium
NGRK

SEQ ID NO: 530587 - protein, 17 aa, Mycobacterium
NGRLDETAPPAGAPPAT

SEQ ID NO: 530588 - protein, 9 aa, Mycobacterium
NGRLGGTFG

SEQ ID NO: 530589 - protein, 9 aa, Mycobacterium
NGRNATSNN

SEQ ID NO: 530590 - protein, 5 aa, Mycobacterium
NGRNP

SEQ ID NO: 530591 - protein, 4 aa, Mycobacterium
NGRP

SEQ ID NO: 530592 - protein, 8 aa, Mycobacterium
NGRPARER

SEQ ID NO: 530593 - protein, 7 aa, Mycobacterium
NGRPGPV

SEQ ID NO: 530594 - protein, 10 aa, Mycobacterium
NGRPITETKA

SEQ ID NO: 530595 - protein, 9 aa, Mycobacterium
NGRPRRAGV

SEQ ID NO: 530596 - protein, 11 aa, Mycobacterium
NGRPTSDAVEG

SEQ ID NO: 530597 - protein, 14 aa, Mycobacterium
NGRPVPGPDVDAGP

SEQ ID NO: 530598 - protein, 15 aa, Mycobacterium
NGRRDGTTVCLDYRC

SEQ ID NO: 530599 - protein, 8 aa, Mycobacterium
NGRRIPGS

SEQ ID NO: 530600 - protein, 7 aa, Mycobacterium
NGRRPQA

SEQ ID NO: 530601 - protein, 19 aa, Mycobacterium
NGRRRTRCYSPASAEGAEA

SEQ ID NO: 530602 - protein, 8 aa, Mycobacterium
NGRRSAQS

SEQ ID NO: 530603 - protein, 11 aa, Mycobacterium
NGRRSDGDGPV

SEQ ID NO: 530604 - protein, 9 aa, Mycobacterium
NGRRSSESL

SEQ ID NO: 530605 - protein, 8 aa, Mycobacterium
NGRRTDQG

SEQ ID NO: 530606 - protein, 6 aa, Mycobacterium
NGRSAA

SEQ ID NO: 530607 - protein, 6 aa, Mycobacterium
NGRSAH

SEQ ID NO: 530608 - protein, 14 aa, Mycobacterium
NGRSFASKQGGPQI

SEQ ID NO: 530609 - protein, 8 aa, Mycobacterium
NGRSGDHR

SEQ ID NO: 530610 - protein, 6 aa, Mycobacterium
NGRSGY

SEQ ID NO: 530611 - protein, 8 aa, Mycobacterium
NGRSSPYA

SEQ ID NO: 530612 - protein, 11 aa, Mycobacterium
NGRSYDPTTGA

SEQ ID NO: 530613 - protein, 4 aa, Mycobacterium
NGRT

SEQ ID NO: 530614 - protein, 11 aa, Mycobacterium
NGRTASRVDET

SEQ ID NO: 530615 - protein, 5 aa, Mycobacterium
NGRTP

SEQ ID NO: 530616 - protein, 9 aa, Mycobacterium
NGRTVDSPH

SEQ ID NO: 530617 - protein, 4 aa, Mycobacterium
NGRV

SEQ ID NO: 530618 - protein, 5 aa, Mycobacterium
NGRVG

SEQ ID NO: 530619 - protein, 8 aa, Mycobacterium
NGRVHPPA

SEQ ID NO: 530620 - protein, 4 aa, Mycobacterium
NGRY

SEQ ID NO: 530621 - protein, 13 aa, Mycobacterium
NGSACTSQKYEPS

SEQ ID NO: 530622 - protein, 7 aa, Mycobacterium
NGSAGAG

SEQ ID NO: 530623 - protein, 18 aa, Mycobacterium
NGSAGAYAAADAASASSL

SEQ ID NO: 530624 - protein, 11 aa, Mycobacterium
NGSAGGAGGNA

SEQ ID NO: 530625 - protein, 9 aa, Mycobacterium
NGSALTAKS

SEQ ID NO: 530626 - protein, 17 aa, Mycobacterium
NGSASSVAAASESLNSN

SEQ ID NO: 530627 - protein, 4 aa, Mycobacterium
NGSC

SEQ ID NO: 530628 - protein, 10 aa, Mycobacterium
NGSDADTVRV

SEQ ID NO: 530629 - protein, 6 aa, Mycobacterium
NGSEAA

SEQ ID NO: 530630 - protein, 16 aa, Mycobacterium
NGSEAGLPRGSEPGVT

SEQ ID NO: 530631 - protein, 8 aa, Mycobacterium
NGSEPISA

SEQ ID NO: 530632 - protein, 7 aa, Mycobacterium
NGSEPVS

SEQ ID NO: 530633 - protein, 8 aa, Mycobacterium
NGSEPVSI

SEQ ID NO: 530634 - protein, 16 aa, Mycobacterium
NGSESGPSRESEPGVT

SEQ ID NO: 530635 - protein, 5 aa, Mycobacterium
NGSFD

SEQ ID NO: 530636 - protein, 7 aa, Mycobacterium
NGSFGTR

SEQ ID NO: 530637 - protein, 4 aa, Mycobacterium
NGSG

SEQ ID NO: 530638 - protein, 7 aa, Mycobacterium
NGSGGFE

SEQ ID NO: 530639 - protein, 7 aa, Mycobacterium
NGSGGSR

SEQ ID NO: 530640 - protein, 5 aa, Mycobacterium
NGSGI

SEQ ID NO: 530641 - protein, 15 aa, Mycobacterium
NGSGIPDGNTRHSGL

SEQ ID NO: 530642 - protein, 6 aa, Mycobacterium
NGSGIQ

SEQ ID NO: 530643 - protein, 16 aa, Mycobacterium
NGSGKPTQRDGAPGVR

SEQ ID NO: 530644 - protein, 7 aa, Mycobacterium
NGSGKST

SEQ ID NO: 530645 - protein, 7 aa, Mycobacterium
NGSGKTT

SEQ ID NO: 530646 - protein, 16 aa, Mycobacterium
NGSGNPKQRDGRPGVR

SEQ ID NO: 530647 - protein, 7 aa, Mycobacterium
NGSGPEL

SEQ ID NO: 530648 - protein, 6 aa, Mycobacterium
NGSGRW

SEQ ID NO: 530649 - protein, 6 aa, Mycobacterium
NGSGVA

SEQ ID NO: 530650 - protein, 7 aa, Mycobacterium
NGSGVSV

SEQ ID NO: 530651 - protein, 6 aa, Mycobacterium
NGSGVT

SEQ ID NO: 530652 - protein, 8 aa, Mycobacterium
NGSIGAGG

SEQ ID NO: 530653 - protein, 4 aa, Mycobacterium
NGSL

SEQ ID NO: 530654 - protein, 6 aa, Mycobacterium
NGSLGH

SEQ ID NO: 530655 - protein, 14 aa, Mycobacterium
NGSLTGYGGGLDRK

SEQ ID NO: 530656 - protein, 12 aa, Mycobacterium
NGSLTGYGGGLE

SEQ ID NO: 530657 - protein, 4 aa, Mycobacterium
NGSM

SEQ ID NO: 530658 - protein, 5 aa, Mycobacterium
NGSNE

SEQ ID NO: 530659 - protein, 18 aa, Mycobacterium
NGSNFGTNAPGGEAFPGP

SEQ ID NO: 530660 - protein, 5 aa, Mycobacterium
NGSPA

SEQ ID NO: 530661 - protein, 15 aa, Mycobacterium
NGSPAYPRSEEEIRA

SEQ ID NO: 530662 - protein, 5 aa, Mycobacterium
NGSPE

SEQ ID NO: 530663 - protein, 9 aa, Mycobacterium
NGSPEDATA

SEQ ID NO: 530664 - protein, 13 aa, Mycobacterium
NGSPEPLSGEDIS

SEQ ID NO: 530665 - protein, 8 aa, Mycobacterium
NGSPGVNT

SEQ ID NO: 530666 - protein, 7 aa, Mycobacterium
NGSPGVS

SEQ ID NO: 530667 - protein, 9 aa, Mycobacterium
NGSPRAMET

SEQ ID NO: 530668 - protein, 8 aa, Mycobacterium
NGSPRATG

SEQ ID NO: 530669 - protein, 6 aa, Mycobacterium
NGSPSG

SEQ ID NO: 530670 - protein, 14 aa, Mycobacterium
NGSPSIRPATRRRV

SEQ ID NO: 530671 - protein, 8 aa, Mycobacterium
NGSQIPRE

SEQ ID NO: 530672 - protein, 8 aa, Mycobacterium
NGSQRAAG

SEQ ID NO: 530673 - protein, 5 aa, Mycobacterium
NGSSA

SEQ ID NO: 530674 - protein, 11 aa, Mycobacterium
NGSSATHAGGG

SEQ ID NO: 530675 - protein, 8 aa, Mycobacterium
NGSSDRTL

SEQ ID NO: 530676 - protein, 12 aa, Mycobacterium
NGSSGEGQNGTI

SEQ ID NO: 530677 - protein, 7 aa, Mycobacterium
NGSSRFD

SEQ ID NO: 530678 - protein, 4 aa, Mycobacterium
NGST

SEQ ID NO: 530679 - protein, 16 aa, Mycobacterium
NGSTDGAPEEAVERHP

SEQ ID NO: 530680 - protein, 12 aa, Mycobacterium
NGSTDGTPEAAV

SEQ ID NO: 530681 - protein, 16 aa, Mycobacterium
NGSTDGTPEEAEQRYP

SEQ ID NO: 530682 - protein, 12 aa, Mycobacterium
NGSTDGTPQAAV

SEQ ID NO: 530683 - protein, 5 aa, Mycobacterium
NGSTG

SEQ ID NO: 530684 - protein, 8 aa, Mycobacterium
NGSTTGDR

SEQ ID NO: 530685 - protein, 9 aa, Mycobacterium
NGSVAGPVQ

SEQ ID NO: 530686 - protein, 9 aa, Mycobacterium
NGSVSLSSQ

SEQ ID NO: 530687 - protein, 14 aa, Mycobacterium
NGSWGEVDPAEVER

SEQ ID NO: 530688 - protein, 9 aa, Mycobacterium
NGSYADYPR

SEQ ID NO: 530689 - protein, 8 aa, Mycobacterium
NGSYNTGG

SEQ ID NO: 530690 - protein, 4 aa, Mycobacterium
NGTA

SEQ ID NO: 530691 - protein, 6 aa, Mycobacterium
NGTAAG

SEQ ID NO: 530692 - protein, 8 aa, Mycobacterium
NGTAAGAG

SEQ ID NO: 530693 - protein, 9 aa, Mycobacterium
NGTAAGAGA

SEQ ID NO: 530694 - protein, 14 aa, Mycobacterium
NGTAGADGKATGSA

SEQ ID NO: 530695 - protein, 26 aa, Mycobacterium
NGTAKDLKGVGDVRGKTGEAEFAGGS

SEQ ID NO: 530696 - protein, 7 aa, Mycobacterium
NGTAKEI

SEQ ID NO: 530697 - protein, 9 aa, Mycobacterium
NGTANGKAA

SEQ ID NO: 530698 - protein, 6 aa, Mycobacterium
NGTAQA

SEQ ID NO: 530699 - protein, 6 aa, Mycobacterium
NGTAQV

SEQ ID NO: 530700 - protein, 11 aa, Mycobacterium
NGTASRETDTL

SEQ ID NO: 530701 - protein, 8 aa, Mycobacterium
NGTDEQKK

SEQ ID NO: 530702 - protein, 13 aa, Mycobacterium
NGTDERVDEAYDD

SEQ ID NO: 530703 - protein, 7 aa, Mycobacterium
NGTDGEI

SEQ ID NO: 530704 - protein, 7 aa, Mycobacterium
NGTDGNI

SEQ ID NO: 530705 - protein, 6 aa, Mycobacterium
NGTDKI

SEQ ID NO: 530706 - protein, 14 aa, Mycobacterium
NGTDPSTHRAGTPT

SEQ ID NO: 530707 - protein, 8 aa, Mycobacterium
NGTDSLNV

SEQ ID NO: 530708 - protein, 4 aa, Mycobacterium
NGTE

SEQ ID NO: 530709 - protein, 14 aa, Mycobacterium
NGTEAQKAIKTAEQ

SEQ ID NO: 530710 - protein, 5 aa, Mycobacterium
NGTEE

SEQ ID NO: 530711 - protein, 5 aa, Mycobacterium
NGTEF

SEQ ID NO: 530712 - protein, 6 aa, Mycobacterium
NGTEYG

SEQ ID NO: 530713 - protein, 7 aa, Mycobacterium
NGTGKTS

SEQ ID NO: 530714 - protein, 7 aa, Mycobacterium
NGTGSLN

SEQ ID NO: 530715 - protein, 4 aa, Mycobacterium
NGTH

SEQ ID NO: 530716 - protein, 10 aa, Mycobacterium
NGTHNPRPGV

SEQ ID NO: 530717 - protein, 12 aa, Mycobacterium
NGTIPGDAPFGG

SEQ ID NO: 530718 - protein, 7 aa, Mycobacterium
NGTLDHD

SEQ ID NO: 530719 - protein, 6 aa, Mycobacterium
NGTLNG

SEQ ID NO: 530720 - protein, 5 aa, Mycobacterium
NGTLR

SEQ ID NO: 530721 - protein, 4 aa, Mycobacterium
NGTM

SEQ ID NO: 530722 - protein, 5 aa, Mycobacterium
NGTNG

SEQ ID NO: 530723 - protein, 17 aa, Mycobacterium
NGTPAPAGSGADGTPGG

SEQ ID NO: 530724 - protein, 6 aa, Mycobacterium
NGTPGF

SEQ ID NO: 530725 - protein, 7 aa, Mycobacterium
NGTPGVS

SEQ ID NO: 530726 - protein, 7 aa, Mycobacterium
NGTPIDA

SEQ ID NO: 530727 - protein, 7 aa, Mycobacterium
NGTPIEG

SEQ ID NO: 530728 - protein, 8 aa, Mycobacterium
NGTPPPEV

SEQ ID NO: 530729 - protein, 7 aa, Mycobacterium
NGTPRTK

SEQ ID NO: 530730 - protein, 10 aa, Mycobacterium
NGTPSELGGA

SEQ ID NO: 530731 - protein, 11 aa, Mycobacterium
NGTPSELGGAN

SEQ ID NO: 530732 - protein, 5 aa, Mycobacterium
NGTPV

SEQ ID NO: 530733 - protein, 7 aa, Mycobacterium
NGTPVDA

SEQ ID NO: 530734 - protein, 7 aa, Mycobacterium
NGTPYGL

SEQ ID NO: 530735 - protein, 4 aa, Mycobacterium
NGTQ

SEQ ID NO: 530736 - protein, 8 aa, Mycobacterium
NGTQQERD

SEQ ID NO: 530737 - protein, 6 aa, Mycobacterium
NGTQQG

SEQ ID NO: 530738 - protein, 4 aa, Mycobacterium
NGTR

SEQ ID NO: 530739 - protein, 5 aa, Mycobacterium
NGTRL

SEQ ID NO: 530740 - protein, 7 aa, Mycobacterium
NGTSLDD

SEQ ID NO: 530741 - protein, 9 aa, Mycobacterium
NGTSPDEAI

SEQ ID NO: 530742 - protein, 8 aa, Mycobacterium
NGTSPENL

SEQ ID NO: 530743 - protein, 7 aa, Mycobacterium
NGTSYGG

SEQ ID NO: 530744 - protein, 8 aa, Mycobacterium
NGTTAGLN

SEQ ID NO: 530745 - protein, 5 aa, Mycobacterium
NGTTR

SEQ ID NO: 530746 - protein, 6 aa, Mycobacterium
NGTTRR

SEQ ID NO: 530747 - protein, 11 aa, Mycobacterium
NGTVSRTVRDT

SEQ ID NO: 530748 - protein, 5 aa, Mycobacterium
NGTVT

SEQ ID NO: 530749 - protein, 5 aa, Mycobacterium
NGTWS

SEQ ID NO: 530750 - protein, 6 aa, Mycobacterium
NGVAED

SEQ ID NO: 530751 - protein, 6 aa, Mycobacterium
NGVAGR

SEQ ID NO: 530752 - protein, 10 aa, Mycobacterium
NGVANDSDDD

SEQ ID NO: 530753 - protein, 10 aa, Mycobacterium
NGVANDSDED

SEQ ID NO: 530754 - protein, 14 aa, Mycobacterium
NGVAPGYAHRSGLT

SEQ ID NO: 530755 - protein, 8 aa, Mycobacterium
NGVASGDA

SEQ ID NO: 530756 - protein, 7 aa, Mycobacterium
NGVATAR

SEQ ID NO: 530757 - protein, 5 aa, Mycobacterium
NGVDD

SEQ ID NO: 530758 - protein, 6 aa, Mycobacterium
NGVDED

SEQ ID NO: 530759 - protein, 7 aa, Mycobacterium
NGVDPAP

SEQ ID NO: 530760 - protein, 4 aa, Mycobacterium
NGVE

SEQ ID NO: 530761 - protein, 18 aa, Mycobacterium
NGVERKDYNSLGSRRGNH

SEQ ID NO: 530762 - protein, 4 aa, Mycobacterium
NGVG

SEQ ID NO: 530763 - protein, 17 aa, Mycobacterium
NGVGDKHDSPPQASKRG

SEQ ID NO: 530764 - protein, 9 aa, Mycobacterium
NGVGKSSVV

SEQ ID NO: 530765 - protein, 12 aa, Mycobacterium
NGVGLPRGDEPE

SEQ ID NO: 530766 - protein, 6 aa, Mycobacterium
NGVKQQ

SEQ ID NO: 530767 - protein, 10 aa, Mycobacterium
NGVNGGVGSA

SEQ ID NO: 530768 - protein, 11 aa, Mycobacterium
NGVNGGVGSAV

SEQ ID NO: 530769 - protein, 10 aa, Mycobacterium
NGVPAPDGTV

SEQ ID NO: 530770 - protein, 14 aa, Mycobacterium
NGVPSGDWPPYRGP

SEQ ID NO: 530771 - protein, 22 aa, Mycobacterium
NGVPTAARPGKLVRGRQSAPVP

SEQ ID NO: 530772 - protein, 22 aa, Mycobacterium
NGVPTAARPGKLVRGRRSAPVP

SEQ ID NO: 530773 - protein, 20 aa, Mycobacterium
NGVPTAARPGRLVRGRQSAP

SEQ ID NO: 530774 - protein, 12 aa, Mycobacterium
NGVPTDARPGKL

SEQ ID NO: 530775 - protein, 13 aa, Mycobacterium
NGVRRGADAPLRG

SEQ ID NO: 530776 - protein, 19 aa, Mycobacterium
NGVSQEGIAAGAGQAGKIG

SEQ ID NO: 530777 - protein, 7 aa, Mycobacterium
NGVTRDE

SEQ ID NO: 530778 - protein, 6 aa, Mycobacterium
NGVTRE

SEQ ID NO: 530779 - protein, 12 aa, Mycobacterium
NGVVGDGTTTAT

SEQ ID NO: 530780 - protein, 4 aa, Mycobacterium
NGWD

SEQ ID NO: 530781 - protein, 4 aa, Mycobacterium
NGWE

SEQ ID NO: 530782 - protein, 5 aa, Mycobacterium
NGWPA

SEQ ID NO: 530783 - protein, 11 aa, Mycobacterium
NGWPESDEDTF

SEQ ID NO: 530784 - protein, 9 aa, Mycobacterium
NGWSPDKAE

SEQ ID NO: 530785 - protein, 13 aa, Mycobacterium
NGWTGADDKAQAR

SEQ ID NO: 530786 - protein, 10 aa, Mycobacterium
NGYADGLQKS

SEQ ID NO: 530787 - protein, 19 aa, Mycobacterium
NGYATEEDTLAGGPRVDSE

SEQ ID NO: 530788 - protein, 11 aa, Mycobacterium
NGYDETTTDQI

SEQ ID NO: 530789 - protein, 8 aa, Mycobacterium
NGYGNSKW

SEQ ID NO: 530790 - protein, 14 aa, Mycobacterium
NGYPASTPEDLAET

SEQ ID NO: 530791 - protein, 5 aa, Mycobacterium
NGYPG

SEQ ID NO: 530792 - protein, 10 aa, Mycobacterium
NGYPPALPED

SEQ ID NO: 530793 - protein, 5 aa, Mycobacterium
NGYQP

SEQ ID NO: 530794 - protein, 8 aa, Mycobacterium
NGYRDTTM

SEQ ID NO: 530795 - protein, 4 aa, Mycobacterium
NGYS

SEQ ID NO: 530796 - protein, 6 aa, Mycobacterium
NGYSDT

SEQ ID NO: 530797 - protein, 4 aa, Mycobacterium
NGYT

SEQ ID NO: 530798 - protein, 8 aa, Mycobacterium
NGYTATAT

SEQ ID NO: 530799 - protein, 8 aa, Mycobacterium
NGYTGDAT

SEQ ID NO: 530800 - protein, 6 aa, Mycobacterium
NGYTPI

SEQ ID NO: 530801 - protein, 6 aa, Mycobacterium
NGYTQS

SEQ ID NO: 530802 - protein, 6 aa, Mycobacterium
NGYTRD

SEQ ID NO: 530803 - protein, 6 aa, Mycobacterium
NGYTRE

SEQ ID NO: 530804 - protein, 9 aa, Mycobacterium
NGYVEDSGM

SEQ ID NO: 530805 - protein, 5 aa, Mycobacterium
NGYVT

SEQ ID NO: 530806 - protein, 6 aa, Mycobacterium
NHAEGA

SEQ ID NO: 530807 - protein, 4 aa, Mycobacterium
NHAG

SEQ ID NO: 530808 - protein, 14 aa, Mycobacterium
NHAGPQSVSQQAGA

SEQ ID NO: 530809 - protein, 6 aa, Mycobacterium
NHAPGG

SEQ ID NO: 530810 - protein, 7 aa, Mycobacterium
NHAPHGR

SEQ ID NO: 530811 - protein, 7 aa, Mycobacterium
NHAPRRN

SEQ ID NO: 530812 - protein, 5 aa, Mycobacterium
NHAQR

SEQ ID NO: 530813 - protein, 4 aa, Mycobacterium
NHAR

SEQ ID NO: 530814 - protein, 16 aa, Mycobacterium
NHARGAASRIRGNSAS

SEQ ID NO: 530815 - protein, 10 aa, Mycobacterium
NHDAPEARAA

SEQ ID NO: 530816 - protein, 4 aa, Mycobacterium
NHDG

SEQ ID NO: 530817 - protein, 7 aa, Mycobacterium
NHDGGRD

SEQ ID NO: 530818 - protein, 6 aa, Mycobacterium
NHDNAT

SEQ ID NO: 530819 - protein, 6 aa, Mycobacterium
NHDPLD

SEQ ID NO: 530820 - protein, 6 aa, Mycobacterium
NHDPVS

SEQ ID NO: 530821 - protein, 5 aa, Mycobacterium
NHDQA

SEQ ID NO: 530822 - protein, 7 aa, Mycobacterium
NHDQIGE

SEQ ID NO: 530823 - protein, 9 aa, Mycobacterium
NHDRSGLHE

SEQ ID NO: 530824 - protein, 13 aa, Mycobacterium
NHDSHEGAADSTI

SEQ ID NO: 530825 - protein, 5 aa, Mycobacterium
NHDSP

SEQ ID NO: 530826 - protein, 11 aa, Mycobacterium
NHDVEGAAAHG

SEQ ID NO: 530827 - protein, 7 aa, Mycobacterium
NHEDSPG

SEQ ID NO: 530828 - protein, 4 aa, Mycobacterium
NHEP

SEQ ID NO: 530829 - protein, 14 aa, Mycobacterium
NHEPESAEQAEQDV

SEQ ID NO: 530830 - protein, 7 aa, Mycobacterium
NHEPRKR

SEQ ID NO: 530831 - protein, 7 aa, Mycobacterium
NHEPRRN

SEQ ID NO: 530832 - protein, 6 aa, Mycobacterium
NHFPTP

SEQ ID NO: 530833 - protein, 11 aa, Mycobacterium
NHGAAASMTGT

SEQ ID NO: 530834 - protein, 8 aa, Mycobacterium
NHGAGATA

SEQ ID NO: 530835 - protein, 5 aa, Mycobacterium
NHGAR

SEQ ID NO: 530836 - protein, 5 aa, Mycobacterium
NHGGD

SEQ ID NO: 530837 - protein, 9 aa, Mycobacterium
NHGGSPIDT

SEQ ID NO: 530838 - protein, 6 aa, Mycobacterium
NHGGTK

SEQ ID NO: 530839 - protein, 6 aa, Mycobacterium
NHGNNN

SEQ ID NO: 530840 - protein, 5 aa, Mycobacterium
NHGPD

SEQ ID NO: 530841 - protein, 7 aa, Mycobacterium
NHGRRER

SEQ ID NO: 530842 - protein, 10 aa, Mycobacterium
NHGTDGAGRP

SEQ ID NO: 530843 - protein, 11 aa, Mycobacterium
NHGTDPKTRGR

SEQ ID NO: 530844 - protein, 4 aa, Mycobacterium
NHHS

SEQ ID NO: 530845 - protein, 21 aa, Mycobacterium
NHIGPATAAAQLPAKRLPVGI

SEQ ID NO: 530846 - protein, 11 aa, Mycobacterium
NHKNADEALRS

SEQ ID NO: 530847 - protein, 14 aa, Mycobacterium
NHLAGPPDDPRIPD

SEQ ID NO: 530848 - protein, 15 aa, Mycobacterium
NHLAGPPDDSRIPDE

SEQ ID NO: 530849 - protein, 9 aa, Mycobacterium
NHLGDRDEH

SEQ ID NO: 530850 - protein, 10 aa, Mycobacterium
NHLGQNTPAI

SEQ ID NO: 530851 - protein, 8 aa, Mycobacterium
NHNGGGKP

SEQ ID NO: 530852 - protein, 6 aa, Mycobacterium
NHNGRQ

SEQ ID NO: 530853 - protein, 12 aa, Mycobacterium
NHNMTSRQARRR

SEQ ID NO: 530854 - protein, 14 aa, Mycobacterium
NHPAPETKLDDTID

SEQ ID NO: 530855 - protein, 9 aa, Mycobacterium
NHPAPHTNL

SEQ ID NO: 530856 - protein, 7 aa, Mycobacterium
NHPAPRD

SEQ ID NO: 530857 - protein, 6 aa, Mycobacterium
NHPAQL

SEQ ID NO: 530858 - protein, 8 aa, Mycobacterium
NHPDARPI

SEQ ID NO: 530859 - protein, 7 aa, Mycobacterium
NHPDERW

SEQ ID NO: 530860 - protein, 8 aa, Mycobacterium
NHPDERWP

SEQ ID NO: 530861 - protein, 8 aa, Mycobacterium
NHPDGEAE

SEQ ID NO: 530862 - protein, 7 aa, Mycobacterium
NHPDQRR

SEQ ID NO: 530863 - protein, 22 aa, Mycobacterium
NHPDRNPGNKSAEDRYKAVSEA

SEQ ID NO: 530864 - protein, 38 aa, Mycobacterium
NHPDRNPGNQAAEDRYKAVSEAKDVLSDPAKRKEYDET

SEQ ID NO: 530865 - protein, 38 aa, Mycobacterium
NHPDRNPGNSAAEERYKEASEAKEVLTDPAKRKEYDET

SEQ ID NO: 530866 - protein, 4 aa, Mycobacterium
NHPE

SEQ ID NO: 530867 - protein, 6 aa, Mycobacterium
NHPEQS

SEQ ID NO: 530868 - protein, 5 aa, Mycobacterium
NHPET

SEQ ID NO: 530869 - protein, 7 aa, Mycobacterium
NHPGGPE

SEQ ID NO: 530870 - protein, 7 aa, Mycobacterium
NHPGTSQ

SEQ ID NO: 530871 - protein, 10 aa, Mycobacterium
NHPHDQPDDH

SEQ ID NO: 530872 - protein, 4 aa, Mycobacterium
NHPI

SEQ ID NO: 530873 - protein, 14 aa, Mycobacterium
NHPLAGGSGPSVGA

SEQ ID NO: 530874 - protein, 15 aa, Mycobacterium
NHPLAGGSGPTTGAG

SEQ ID NO: 530875 - protein, 8 aa, Mycobacterium
NHPNGEAD

SEQ ID NO: 530876 - protein, 9 aa, Mycobacterium
NHPRSAELP

SEQ ID NO: 530877 - protein, 6 aa, Mycobacterium
NHPRYA

SEQ ID NO: 530878 - protein, 7 aa, Mycobacterium
NHPRYAS

SEQ ID NO: 530879 - protein, 9 aa, Mycobacterium
NHPSGMDGA

SEQ ID NO: 530880 - protein, 14 aa, Mycobacterium
NHPVDPPATPEEGY

SEQ ID NO: 530881 - protein, 4 aa, Mycobacterium
NHPW

SEQ ID NO: 530882 - protein, 6 aa, Mycobacterium
NHQASE

SEQ ID NO: 530883 - protein, 23 aa, Mycobacterium
NHQNADQQSAMNNAGAPAFPPTA

SEQ ID NO: 530884 - protein, 7 aa, Mycobacterium
NHQPGGH

SEQ ID NO: 530885 - protein, 13 aa, Mycobacterium
NHQRPQRDSQGLR

SEQ ID NO: 530886 - protein, 7 aa, Mycobacterium
NHRDSPR

SEQ ID NO: 530887 - protein, 4 aa, Mycobacterium
NHRG

SEQ ID NO: 530888 - protein, 6 aa, Mycobacterium
NHRGGT

SEQ ID NO: 530889 - protein, 7 aa, Mycobacterium
NHRGGTL

SEQ ID NO: 530890 - protein, 16 aa, Mycobacterium
NHRGGTVLGPSASPLG

SEQ ID NO: 530891 - protein, 7 aa, Mycobacterium
NHRGTRG

SEQ ID NO: 530892 - protein, 6 aa, Mycobacterium
NHRKGD

SEQ ID NO: 530893 - protein, 6 aa, Mycobacterium
NHRNAD

SEQ ID NO: 530894 - protein, 5 aa, Mycobacterium
NHRPD

SEQ ID NO: 530895 - protein, 5 aa, Mycobacterium
NHRPE

SEQ ID NO: 530896 - protein, 7 aa, Mycobacterium
NHRPNEL

SEQ ID NO: 530897 - protein, 10 aa, Mycobacterium
NHRTDEYGGT

SEQ ID NO: 530898 - protein, 11 aa, Mycobacterium
NHRTPGSAVSA

SEQ ID NO: 530899 - protein, 13 aa, Mycobacterium
NHSALNDADDKLA

SEQ ID NO: 530900 - protein, 9 aa, Mycobacterium
NHSATTGYD

SEQ ID NO: 530901 - protein, 6 aa, Mycobacterium
NHSGAG

SEQ ID NO: 530902 - protein, 7 aa, Mycobacterium
NHSGGGL

SEQ ID NO: 530903 - protein, 5 aa, Mycobacterium
NHSGV

SEQ ID NO: 530904 - protein, 5 aa, Mycobacterium
NHSQA

SEQ ID NO: 530905 - protein, 5 aa, Mycobacterium
NHSTG

SEQ ID NO: 530906 - protein, 18 aa, Mycobacterium
NHTAPAEPADQLVTVGDL

SEQ ID NO: 530907 - protein, 43 aa, Mycobacterium
NHTDTTPQHPEKQVRQSPGKAATAPATKATTPSGATLEVTGGD

SEQ ID NO: 530908 - protein, 7 aa, Mycobacterium
NHTERNE

SEQ ID NO: 530909 - protein, 7 aa, Mycobacterium
NHTGISP

SEQ ID NO: 530910 - protein, 10 aa, Mycobacterium
NHTQLGDPVK

SEQ ID NO: 530911 - protein, 5 aa, Mycobacterium
NHTSD

SEQ ID NO: 530912 - protein, 6 aa, Mycobacterium
NHTSSE

SEQ ID NO: 530913 - protein, 7 aa, Mycobacterium
NHTSSQH

SEQ ID NO: 530914 - protein, 7 aa, Mycobacterium
NHVPAPP

SEQ ID NO: 530915 - protein, 5 aa, Mycobacterium
NHVQA

SEQ ID NO: 530916 - protein, 6 aa, Mycobacterium
NHVRAD

SEQ ID NO: 530917 - protein, 6 aa, Mycobacterium
NHYGTS

SEQ ID NO: 530918 - protein, 7 aa, Mycobacterium
NHYPDDI

SEQ ID NO: 530919 - protein, 7 aa, Mycobacterium
NHYPTDI

SEQ ID NO: 530920 - protein, 7 aa, Mycobacterium
NIAAKTA

SEQ ID NO: 530921 - protein, 20 aa, Mycobacterium
NIAAPGGTTWEATPRTRRST

SEQ ID NO: 530922 - protein, 10 aa, Mycobacterium
NIADGKTVHP

SEQ ID NO: 530923 - protein, 12 aa, Mycobacterium
NIAGGDETLPYT

SEQ ID NO: 530924 - protein, 12 aa, Mycobacterium
NIAGGDETMPYT

SEQ ID NO: 530925 - protein, 6 aa, Mycobacterium
NIAGTD

SEQ ID NO: 530926 - protein, 11 aa, Mycobacterium
NIAGTGGAGGA

SEQ ID NO: 530927 - protein, 5 aa, Mycobacterium
NIAQE

SEQ ID NO: 530928 - protein, 12 aa, Mycobacterium
NIARSRDIAPGR

SEQ ID NO: 530929 - protein, 6 aa, Mycobacterium
NIATNA

SEQ ID NO: 530930 - protein, 12 aa, Mycobacterium
NIATRSERTGFY

SEQ ID NO: 530931 - protein, 10 aa, Mycobacterium
NIDADGANYE

SEQ ID NO: 530932 - protein, 14 aa, Mycobacterium
NIDAKSLKKGQTVR

SEQ ID NO: 530933 - protein, 4 aa, Mycobacterium
NIDG

SEQ ID NO: 530934 - protein, 12 aa, Mycobacterium
NIDGKGASYGTH

SEQ ID NO: 530935 - protein, 8 aa, Mycobacterium
NIDPGDDI

SEQ ID NO: 530936 - protein, 5 aa, Mycobacterium
NIDSS

SEQ ID NO: 530937 - protein, 7 aa, Mycobacterium
NIDTNRS

SEQ ID NO: 530938 - protein, 6 aa, Mycobacterium
NIEEGG

SEQ ID NO: 530939 - protein, 21 aa, Mycobacterium
NIEESNDRVAATESFDTPTGH

SEQ ID NO: 530940 - protein, 6 aa, Mycobacterium
NIEGAR

SEQ ID NO: 530941 - protein, 6 aa, Mycobacterium
NIEGKP

SEQ ID NO: 530942 - protein, 14 aa, Mycobacterium
NIEGPAVATDERGR

SEQ ID NO: 530943 - protein, 5 aa, Mycobacterium
NIEGS

SEQ ID NO: 530944 - protein, 7 aa, Mycobacterium
NIENGGS

SEQ ID NO: 530945 - protein, 13 aa, Mycobacterium
NIEPDQGAQDKAA

SEQ ID NO: 530946 - protein, 13 aa, Mycobacterium
NIEPSDPDLQTTA

SEQ ID NO: 530947 - protein, 11 aa, Mycobacterium
NIERGASYAVE

SEQ ID NO: 530948 - protein, 4 aa, Mycobacterium
NIGA

SEQ ID NO: 530949 - protein, 5 aa, Mycobacterium
NIGAG

SEQ ID NO: 530950 - protein, 7 aa, Mycobacterium
NIGDSAR

SEQ ID NO: 530951 - protein, 5 aa, Mycobacterium
NIGDT

SEQ ID NO: 530952 - protein, 7 aa, Mycobacterium
NIGEEKR

SEQ ID NO: 530953 - protein, 12 aa, Mycobacterium
NIGESARRRGDD

SEQ ID NO: 530954 - protein, 7 aa, Mycobacterium
NIGESSE

SEQ ID NO: 530955 - protein, 5 aa, Mycobacterium
NIGEY

SEQ ID NO: 530956 - protein, 17 aa, Mycobacterium
NIGGGNNGNNNLGAGNY

SEQ ID NO: 530957 - protein, 6 aa, Mycobacterium
NIGGGQ

SEQ ID NO: 530958 - protein, 9 aa, Mycobacterium
NIGGNGNVG

SEQ ID NO: 530959 - protein, 5 aa, Mycobacterium
NIGGY

SEQ ID NO: 530960 - protein, 12 aa, Mycobacterium
NIGHSESAAGTV

SEQ ID NO: 530961 - protein, 13 aa, Mycobacterium
NIGHTGAAAGAAG

SEQ ID NO: 530962 - protein, 10 aa, Mycobacterium
NIGHTGPASG

SEQ ID NO: 530963 - protein, 10 aa, Mycobacterium
NIGHTQAAAG

SEQ ID NO: 530964 - protein, 12 aa, Mycobacterium
NIGNDNIGNGNV

SEQ ID NO: 530965 - protein, 14 aa, Mycobacterium
NIGNSAVTSSVAEE

SEQ ID NO: 530966 - protein, 18 aa, Mycobacterium
NIGNSNTGIANSGNVDTG

SEQ ID NO: 530967 - protein, 4 aa, Mycobacterium
NIGP

SEQ ID NO: 530968 - protein, 8 aa, Mycobacterium
NIGPEPAA

SEQ ID NO: 530969 - protein, 6 aa, Mycobacterium
NIGPET

SEQ ID NO: 530970 - protein, 7 aa, Mycobacterium
NIGPGNL

SEQ ID NO: 530971 - protein, 6 aa, Mycobacterium
NIGPNT

SEQ ID NO: 530972 - protein, 9 aa, Mycobacterium
NIGPTPEAV

SEQ ID NO: 530973 - protein, 20 aa, Mycobacterium
NIGPVEQDGHADERRPRSKP

SEQ ID NO: 530974 - protein, 4 aa, Mycobacterium
NIGS

SEQ ID NO: 530975 - protein, 31 aa, Mycobacterium
NIGSGNLGSGNTGNANFGSGNNGNLNFGDGN

SEQ ID NO: 530976 - protein, 8 aa, Mycobacterium
NIGSGNVG

SEQ ID NO: 530977 - protein, 11 aa, Mycobacterium
NIGSQQSGLAN

SEQ ID NO: 530978 - protein, 5 aa, Mycobacterium
NIGSY

SEQ ID NO: 530979 - protein, 14 aa, Mycobacterium
NIGTLTDDAGSPID

SEQ ID NO: 530980 - protein, 9 aa, Mycobacterium
NIGTRSGGA

SEQ ID NO: 530981 - protein, 7 aa, Mycobacterium
NIIGRGQ

SEQ ID NO: 530982 - protein, 6 aa, Mycobacterium
NIKGPG

SEQ ID NO: 530983 - protein, 4 aa, Mycobacterium
NIKP

SEQ ID NO: 530984 - protein, 9 aa, Mycobacterium
NIKSSDPAT

SEQ ID NO: 530985 - protein, 6 aa, Mycobacterium
NILPPR

SEQ ID NO: 530986 - protein, 6 aa, Mycobacterium
NIMPPP

SEQ ID NO: 530987 - protein, 7 aa, Mycobacterium
NIPATGG

SEQ ID NO: 530988 - protein, 23 aa, Mycobacterium
NIPCGSDSAPSSRTRAPTPTPGL

SEQ ID NO: 530989 - protein, 4 aa, Mycobacterium
NIPD

SEQ ID NO: 530990 - protein, 18 aa, Mycobacterium
NIPDADEHTSQDATSAGV

SEQ ID NO: 530991 - protein, 7 aa, Mycobacterium
NIPERGG

SEQ ID NO: 530992 - protein, 5 aa, Mycobacterium
NIPGY

SEQ ID NO: 530993 - protein, 10 aa, Mycobacterium
NIPHPNEPGA

SEQ ID NO: 530994 - protein, 9 aa, Mycobacterium
NIPKGEYGA

SEQ ID NO: 530995 - protein, 12 aa, Mycobacterium
NIPKSAGGPGCT

SEQ ID NO: 530996 - protein, 37 aa, Mycobacterium
NIPPERYSQSNGTPGPDQTTMSTGDAGKRVACGVIGA

SEQ ID NO: 530997 - protein, 6 aa, Mycobacterium
NIPPGA

SEQ ID NO: 530998 - protein, 13 aa, Mycobacterium
NIPPPPARPEVPQ

SEQ ID NO: 530999 - protein, 9 aa, Mycobacterium
NIPPSGIET

SEQ ID NO: 531000 - protein, 5 aa, Mycobacterium
NIPQE

SEQ ID NO: 531001 - protein, 4 aa, Mycobacterium
NIPS

SEQ ID NO: 531002 - protein, 9 aa, Mycobacterium
NIPSSGPAI

SEQ ID NO: 531003 - protein, 4 aa, Mycobacterium
NIPT

SEQ ID NO: 531004 - protein, 4 aa, Mycobacterium
NIPV

SEQ ID NO: 531005 - protein, 14 aa, Mycobacterium
NIQAQPPADGVPPA

SEQ ID NO: 531006 - protein, 24 aa, Mycobacterium
NIRECGGGDGAAARVGRLVHDDRD

SEQ ID NO: 531007 - protein, 4 aa, Mycobacterium
NIRP

SEQ ID NO: 531008 - protein, 6 aa, Mycobacterium
NIRPDC

SEQ ID NO: 531009 - protein, 6 aa, Mycobacterium
NIRPDI

SEQ ID NO: 531010 - protein, 11 aa, Mycobacterium
NISEKERRERE

SEQ ID NO: 531011 - protein, 17 aa, Mycobacterium
NISGNDALDALAQPTVF

SEQ ID NO: 531012 - protein, 5 aa, Mycobacterium
NISGQ

SEQ ID NO: 531013 - protein, 6 aa, Mycobacterium
NISPGD

SEQ ID NO: 531014 - protein, 7 aa, Mycobacterium
NISRGNA

SEQ ID NO: 531015 - protein, 4 aa, Mycobacterium
NISS

SEQ ID NO: 531016 - protein, 5 aa, Mycobacterium
NITAE

SEQ ID NO: 531017 - protein, 10 aa, Mycobacterium
NITAGDTGPW

SEQ ID NO: 531018 - protein, 12 aa, Mycobacterium
NITDDQARACAA

SEQ ID NO: 531019 - protein, 14 aa, Mycobacterium
NITDDQARACAQTG

SEQ ID NO: 531020 - protein, 5 aa, Mycobacterium
NITES

SEQ ID NO: 531021 - protein, 8 aa, Mycobacterium
NITGAGPV

SEQ ID NO: 531022 - protein, 7 aa, Mycobacterium
NITGDDG

SEQ ID NO: 531023 - protein, 5 aa, Mycobacterium
NITGR

SEQ ID NO: 531024 - protein, 4 aa, Mycobacterium
NITH

SEQ ID NO: 531025 - protein, 5 aa, Mycobacterium
NITPE

SEQ ID NO: 531026 - protein, 5 aa, Mycobacterium
NITPQ

SEQ ID NO: 531027 - protein, 14 aa, Mycobacterium
NITQHEEARRRRSR

SEQ ID NO: 531028 - protein, 6 aa, Mycobacterium
NITRTG

SEQ ID NO: 531029 - protein, 6 aa, Mycobacterium
NITSGG

SEQ ID NO: 531030 - protein, 4 aa, Mycobacterium
NITT

SEQ ID NO: 531031 - protein, 9 aa, Mycobacterium
NITTRAGSI

SEQ ID NO: 531032 - protein, 9 aa, Mycobacterium
NIVGRGQDA

SEQ ID NO: 531033 - protein, 7 aa, Mycobacterium
NIYPTAD

SEQ ID NO: 531034 - protein, 7 aa, Mycobacterium
NIYSPEV

SEQ ID NO: 531035 - protein, 28 aa, Mycobacterium
NKAAAAVSKSVTDSLKPVTGTVKPVTKD

SEQ ID NO: 531036 - protein, 19 aa, Mycobacterium
NKAADEAAERERREEEAYA

SEQ ID NO: 531037 - protein, 21 aa, Mycobacterium
NKAADHDMENAAGIDNQGEPI

SEQ ID NO: 531038 - protein, 13 aa, Mycobacterium
NKAADNAGRPAPR

SEQ ID NO: 531039 - protein, 10 aa, Mycobacterium
NKAASRAEAV

SEQ ID NO: 531040 - protein, 13 aa, Mycobacterium
NKADKGEDPQAAE

SEQ ID NO: 531041 - protein, 13 aa, Mycobacterium
NKADLDDAGFSDD

SEQ ID NO: 531042 - protein, 12 aa, Mycobacterium
NKAETKAKYGDE

SEQ ID NO: 531043 - protein, 11 aa, Mycobacterium
NKAETKARYGE

SEQ ID NO: 531044 - protein, 11 aa, Mycobacterium
NKAETKERYGD

SEQ ID NO: 531045 - protein, 21 aa, Mycobacterium
NKAGGANVNQLTSSEPDDVES

SEQ ID NO: 531046 - protein, 7 aa, Mycobacterium
NKAGLKP

SEQ ID NO: 531047 - protein, 9 aa, Mycobacterium
NKAIPPDRL

SEQ ID NO: 531048 - protein, 8 aa, Mycobacterium
NKAKRELG

SEQ ID NO: 531049 - protein, 10 aa, Mycobacterium
NKAKTSTAPA

SEQ ID NO: 531050 - protein, 5 aa, Mycobacterium
NKALN

SEQ ID NO: 531051 - protein, 4 aa, Mycobacterium
NKAR

SEQ ID NO: 531052 - protein, 9 aa, Mycobacterium
NKARGEAVA

SEQ ID NO: 531053 - protein, 26 aa, Mycobacterium
NKATEGLDEETKRKVLSTNAKNFFGM

SEQ ID NO: 531054 - protein, 8 aa, Mycobacterium
NKAVEANY

SEQ ID NO: 531055 - protein, 6 aa, Mycobacterium
NKCGAQ

SEQ ID NO: 531056 - protein, 16 aa, Mycobacterium
NKDDEYQRSADEGDSM

SEQ ID NO: 531057 - protein, 29 aa, Mycobacterium
NKDGKPNYVTDSAASATGWTTGTKTYNGA

SEQ ID NO: 531058 - protein, 9 aa, Mycobacterium
NKDGTPTGG

SEQ ID NO: 531059 - protein, 8 aa, Mycobacterium
NKDNGRIR

SEQ ID NO: 531060 - protein, 6 aa, Mycobacterium
NKDRTT

SEQ ID NO: 531061 - protein, 8 aa, Mycobacterium
NKDSPAAA

SEQ ID NO: 531062 - protein, 10 aa, Mycobacterium
NKDVTKRTAV

SEQ ID NO: 531063 - protein, 21 aa, Mycobacterium
NKEAAEDAKAKLEAAGASVTV

SEQ ID NO: 531064 - protein, 8 aa, Mycobacterium
NKEITGKP

SEQ ID NO: 531065 - protein, 11 aa, Mycobacterium
NKENPVERASA

SEQ ID NO: 531066 - protein, 7 aa, Mycobacterium
NKEQGKI

SEQ ID NO: 531067 - protein, 8 aa, Mycobacterium
NKETKLDN

SEQ ID NO: 531068 - protein, 7 aa, Mycobacterium
NKETREP

SEQ ID NO: 531069 - protein, 7 aa, Mycobacterium
NKFDRSR

SEQ ID NO: 531070 - protein, 20 aa, Mycobacterium
NKFSGSAREAITAAGGSATE

SEQ ID NO: 531071 - protein, 10 aa, Mycobacterium
NKGALSESAA

SEQ ID NO: 531072 - protein, 18 aa, Mycobacterium
NKGDGNIGFGNGGPANLS

SEQ ID NO: 531073 - protein, 13 aa, Mycobacterium
NKGEADPRPALGS

SEQ ID NO: 531074 - protein, 10 aa, Mycobacterium
NKGEKMSKSI

SEQ ID NO: 531075 - protein, 19 aa, Mycobacterium
NKGESGRNGPNPDTFDYVP

SEQ ID NO: 531076 - protein, 7 aa, Mycobacterium
NKGHGID

SEQ ID NO: 531077 - protein, 6 aa, Mycobacterium
NKGPDD

SEQ ID NO: 531078 - protein, 7 aa, Mycobacterium
NKGQPGR

SEQ ID NO: 531079 - protein, 8 aa, Mycobacterium
NKGQWTEP

SEQ ID NO: 531080 - protein, 5 aa, Mycobacterium
NKGRG

SEQ ID NO: 531081 - protein, 9 aa, Mycobacterium
NKGRPDHHD

SEQ ID NO: 531082 - protein, 10 aa, Mycobacterium
NKGRTGAPRA

SEQ ID NO: 531083 - protein, 8 aa, Mycobacterium
NKGTDRTR

SEQ ID NO: 531084 - protein, 11 aa, Mycobacterium
NKGVKSTGSAA

SEQ ID NO: 531085 - protein, 5 aa, Mycobacterium
NKGVQ

SEQ ID NO: 531086 - protein, 4 aa, Mycobacterium
NKHE

SEQ ID NO: 531087 - protein, 10 aa, Mycobacterium
NKHFQPSDSQ

SEQ ID NO: 531088 - protein, 8 aa, Mycobacterium
NKHGVRTD

SEQ ID NO: 531089 - protein, 6 aa, Mycobacterium
NKHKPS

SEQ ID NO: 531090 - protein, 6 aa, Mycobacterium
NKHRVT

SEQ ID NO: 531091 - protein, 4 aa, Mycobacterium
NKHY

SEQ ID NO: 531092 - protein, 5 aa, Mycobacterium
NKHYG

SEQ ID NO: 531093 - protein, 9 aa, Mycobacterium
NKIAANPAD

SEQ ID NO: 531094 - protein, 13 aa, Mycobacterium
NKIGRREEPRDLD

SEQ ID NO: 531095 - protein, 20 aa, Mycobacterium
NKIPNSKEASISKAKAGRMA

SEQ ID NO: 531096 - protein, 19 aa, Mycobacterium
NKIPNSKEASMSKAKAGRM

SEQ ID NO: 531097 - protein, 4 aa, Mycobacterium
NKKG

SEQ ID NO: 531098 - protein, 6 aa, Mycobacterium
NKKGVT

SEQ ID NO: 531099 - protein, 9 aa, Mycobacterium
NKKTEDPDL

SEQ ID NO: 531100 - protein, 4 aa, Mycobacterium
NKLP

SEQ ID NO: 531101 - protein, 4 aa, Mycobacterium
NKNE

SEQ ID NO: 531102 - protein, 9 aa, Mycobacterium
NKNGLAGKS

SEQ ID NO: 531103 - protein, 9 aa, Mycobacterium
NKNYAKSKL

SEQ ID NO: 531104 - protein, 24 aa, Mycobacterium
NKPADGMSKSAGGREWRVGHQLDR

SEQ ID NO: 531105 - protein, 6 aa, Mycobacterium
NKPAEL

SEQ ID NO: 531106 - protein, 14 aa, Mycobacterium
NKPAEPRPRDDAGI

SEQ ID NO: 531107 - protein, 5 aa, Mycobacterium
NKPAV

SEQ ID NO: 531108 - protein, 10 aa, Mycobacterium
NKPDDTAQTF

SEQ ID NO: 531109 - protein, 7 aa, Mycobacterium
NKPDQGV

SEQ ID NO: 531110 - protein, 9 aa, Mycobacterium
NKPDTETLK

SEQ ID NO: 531111 - protein, 6 aa, Mycobacterium
NKPEGV

SEQ ID NO: 531112 - protein, 5 aa, Mycobacterium
NKPFG

SEQ ID NO: 531113 - protein, 6 aa, Mycobacterium
NKPGRN

SEQ ID NO: 531114 - protein, 5 aa, Mycobacterium
NKPHA

SEQ ID NO: 531115 - protein, 13 aa, Mycobacterium
NKPHGAKPSTVYP

SEQ ID NO: 531116 - protein, 12 aa, Mycobacterium
NKPHGERPSAVY

SEQ ID NO: 531117 - protein, 13 aa, Mycobacterium
NKPHGERPSTVYP

SEQ ID NO: 531118 - protein, 14 aa, Mycobacterium
NKPHGERPSTVYPQ

SEQ ID NO: 531119 - protein, 17 aa, Mycobacterium
NKPHGSRPSKVYPNDKL

SEQ ID NO: 531120 - protein, 19 aa, Mycobacterium
NKPHGTRPSTVYPQDKLPD

SEQ ID NO: 531121 - protein, 8 aa, Mycobacterium
NKPHRQDR

SEQ ID NO: 531122 - protein, 6 aa, Mycobacterium
NKPIDL

SEQ ID NO: 531123 - protein, 12 aa, Mycobacterium
NKPKSSENPREP

SEQ ID NO: 531124 - protein, 8 aa, Mycobacterium
NKPLTETA

SEQ ID NO: 531125 - protein, 9 aa, Mycobacterium
NKPLTPDDL

SEQ ID NO: 531126 - protein, 12 aa, Mycobacterium
NKPNPGGDPGGM

SEQ ID NO: 531127 - protein, 4 aa, Mycobacterium
NKPP

SEQ ID NO: 531128 - protein, 7 aa, Mycobacterium
NKPPAKK

SEQ ID NO: 531129 - protein, 8 aa, Mycobacterium
NKPPTNPV

SEQ ID NO: 531130 - protein, 8 aa, Mycobacterium
NKPSNADV

SEQ ID NO: 531131 - protein, 14 aa, Mycobacterium
NKPVTESLYPSSPE

SEQ ID NO: 531132 - protein, 13 aa, Mycobacterium
NKPYTDSLPQMPE

SEQ ID NO: 531133 - protein, 7 aa, Mycobacterium
NKQARTE

SEQ ID NO: 531134 - protein, 4 aa, Mycobacterium
NKQG

SEQ ID NO: 531135 - protein, 5 aa, Mycobacterium
NKQGW

SEQ ID NO: 531136 - protein, 6 aa, Mycobacterium
NKQIDV

SEQ ID NO: 531137 - protein, 4 aa, Mycobacterium
NKQR

SEQ ID NO: 531138 - protein, 6 aa, Mycobacterium
NKQYEQ

SEQ ID NO: 531139 - protein, 4 aa, Mycobacterium
NKRA

SEQ ID NO: 531140 - protein, 5 aa, Mycobacterium
NKRAG

SEQ ID NO: 531141 - protein, 18 aa, Mycobacterium
NKRAPGDQFSDGSYDPSV

SEQ ID NO: 531142 - protein, 4 aa, Mycobacterium
NKRD

SEQ ID NO: 531143 - protein, 12 aa, Mycobacterium
NKRDTDDMGKRA

SEQ ID NO: 531144 - protein, 13 aa, Mycobacterium
NKRERAKADRRDQ

SEQ ID NO: 531145 - protein, 10 aa, Mycobacterium
NKRERSDTFD

SEQ ID NO: 531146 - protein, 10 aa, Mycobacterium
NKRGQDIGPT

SEQ ID NO: 531147 - protein, 6 aa, Mycobacterium
NKRLND

SEQ ID NO: 531148 - protein, 5 aa, Mycobacterium
NKRPE

SEQ ID NO: 531149 - protein, 6 aa, Mycobacterium
NKRPEA

SEQ ID NO: 531150 - protein, 7 aa, Mycobacterium
NKRPRSV

SEQ ID NO: 531151 - protein, 13 aa, Mycobacterium
NKRRHELSPTVRA

SEQ ID NO: 531152 - protein, 17 aa, Mycobacterium
NKRSLTLDSTTEAGAEI

SEQ ID NO: 531153 - protein, 17 aa, Mycobacterium
NKRSLTLDTTTAEGREV

SEQ ID NO: 531154 - protein, 5 aa, Mycobacterium
NKRTG

SEQ ID NO: 531155 - protein, 7 aa, Mycobacterium
NKRYEIS

SEQ ID NO: 531156 - protein, 8 aa, Mycobacterium
NKRYQEAS

SEQ ID NO: 531157 - protein, 17 aa, Mycobacterium
NKRYSGERDLAQPYGAT

SEQ ID NO: 531158 - protein, 10 aa, Mycobacterium
NKSAARAAAV

SEQ ID NO: 531159 - protein, 6 aa, Mycobacterium
NKSALA

SEQ ID NO: 531160 - protein, 11 aa, Mycobacterium
NKSATPSGPGY

SEQ ID NO: 531161 - protein, 9 aa, Mycobacterium
NKSCSQQTV

SEQ ID NO: 531162 - protein, 7 aa, Mycobacterium
NKSDDVL

SEQ ID NO: 531163 - protein, 10 aa, Mycobacterium
NKSDGTQDEI

SEQ ID NO: 531164 - protein, 13 aa, Mycobacterium
NKSEKSEDPAAAE

SEQ ID NO: 531165 - protein, 4 aa, Mycobacterium
NKSG

SEQ ID NO: 531166 - protein, 14 aa, Mycobacterium
NKSKALYQQSLCAT

SEQ ID NO: 531167 - protein, 8 aa, Mycobacterium
NKSTDNTA

SEQ ID NO: 531168 - protein, 12 aa, Mycobacterium
NKSTLGTSQATI

SEQ ID NO: 531169 - protein, 11 aa, Mycobacterium
NKSVKKDGTES

SEQ ID NO: 531170 - protein, 5 aa, Mycobacterium
NKTAH

SEQ ID NO: 531171 - protein, 13 aa, Mycobacterium
NKTDKAEDPKAAE

SEQ ID NO: 531172 - protein, 4 aa, Mycobacterium
NKTE

SEQ ID NO: 531173 - protein, 29 aa, Mycobacterium
NKTEDKGSQAESSEQRGAGSLSEESTGTW

SEQ ID NO: 531174 - protein, 8 aa, Mycobacterium
NKTEPYSG

SEQ ID NO: 531175 - protein, 7 aa, Mycobacterium
NKTERYS

SEQ ID NO: 531176 - protein, 8 aa, Mycobacterium
NKTFHPSG

SEQ ID NO: 531177 - protein, 10 aa, Mycobacterium
NKTGSTDGFG

SEQ ID NO: 531178 - protein, 23 aa, Mycobacterium
NKTGYHKRQGHRQRLTVLKVTGI

SEQ ID NO: 531179 - protein, 7 aa, Mycobacterium
NKTIDPV

SEQ ID NO: 531180 - protein, 4 aa, Mycobacterium
NKTL

SEQ ID NO: 531181 - protein, 10 aa, Mycobacterium
NKTLGGPLGP

SEQ ID NO: 531182 - protein, 8 aa, Mycobacterium
NKTNGVTP

SEQ ID NO: 531183 - protein, 9 aa, Mycobacterium
NKTPQGIDT

SEQ ID NO: 531184 - protein, 8 aa, Mycobacterium
NKTPRREA

SEQ ID NO: 531185 - protein, 9 aa, Mycobacterium
NKTSERPYR

SEQ ID NO: 531186 - protein, 7 aa, Mycobacterium
NKTSIDK

SEQ ID NO: 531187 - protein, 6 aa, Mycobacterium
NKVDDY

SEQ ID NO: 531188 - protein, 7 aa, Mycobacterium
NKVEEGR

SEQ ID NO: 531189 - protein, 7 aa, Mycobacterium
NKVPAAS

SEQ ID NO: 531190 - protein, 5 aa, Mycobacterium
NKVPG

SEQ ID NO: 531191 - protein, 8 aa, Mycobacterium
NKVPGARA

SEQ ID NO: 531192 - protein, 7 aa, Mycobacterium
NKVPGAS

SEQ ID NO: 531193 - protein, 6 aa, Mycobacterium
NKVPNA

SEQ ID NO: 531194 - protein, 15 aa, Mycobacterium
NKVPPSINYTGPNPY

SEQ ID NO: 531195 - protein, 9 aa, Mycobacterium
NKVPRTPRL

SEQ ID NO: 531196 - protein, 6 aa, Mycobacterium
NKVQSG

SEQ ID NO: 531197 - protein, 6 aa, Mycobacterium
NKYPDR

SEQ ID NO: 531198 - protein, 4 aa, Mycobacterium
NLAA

SEQ ID NO: 531199 - protein, 10 aa, Mycobacterium
NLAADPDRPL

SEQ ID NO: 531200 - protein, 6 aa, Mycobacterium
NLAAGP

SEQ ID NO: 531201 - protein, 6 aa, Mycobacterium
NLADQT

SEQ ID NO: 531202 - protein, 5 aa, Mycobacterium
NLADR

SEQ ID NO: 531203 - protein, 11 aa, Mycobacterium
NLAEAGSAREV

SEQ ID NO: 531204 - protein, 5 aa, Mycobacterium
NLAEQ

SEQ ID NO: 531205 - protein, 27 aa, Mycobacterium
NLAERPAAADLAREAEELAAGQTRRAA

SEQ ID NO: 531206 - protein, 12 aa, Mycobacterium
NLAGDDGHGDID

SEQ ID NO: 531207 - protein, 6 aa, Mycobacterium
NLAGRT

SEQ ID NO: 531208 - protein, 8 aa, Mycobacterium
NLAGSPEI

SEQ ID NO: 531209 - protein, 8 aa, Mycobacterium
NLAGSQPL

SEQ ID NO: 531210 - protein, 17 aa, Mycobacterium
NLANGEDNRDGESHNRS

SEQ ID NO: 531211 - protein, 7 aa, Mycobacterium
NLANGGG

SEQ ID NO: 531212 - protein, 5 aa, Mycobacterium
NLAPE

SEQ ID NO: 531213 - protein, 8 aa, Mycobacterium
NLAPSESI

SEQ ID NO: 531214 - protein, 7 aa, Mycobacterium
NLARPGD

SEQ ID NO: 531215 - protein, 8 aa, Mycobacterium
NLASGGSG

SEQ ID NO: 531216 - protein, 7 aa, Mycobacterium
NLASHGD

SEQ ID NO: 531217 - protein, 8 aa, Mycobacterium
NLDAGKEA

SEQ ID NO: 531218 - protein, 5 aa, Mycobacterium
NLDDA

SEQ ID NO: 531219 - protein, 21 aa, Mycobacterium
NLDEAAKTAVTARVQNNGQSC

SEQ ID NO: 531220 - protein, 12 aa, Mycobacterium
NLDEGEPYSLPG

SEQ ID NO: 531221 - protein, 5 aa, Mycobacterium
NLDEH

SEQ ID NO: 531222 - protein, 11 aa, Mycobacterium
NLDESGEYSLP

SEQ ID NO: 531223 - protein, 12 aa, Mycobacterium
NLDGAANADDIR

SEQ ID NO: 531224 - protein, 7 aa, Mycobacterium
NLDGDDG

SEQ ID NO: 531225 - protein, 9 aa, Mycobacterium
NLDGGAGKL

SEQ ID NO: 531226 - protein, 4 aa, Mycobacterium
NLDK

SEQ ID NO: 531227 - protein, 10 aa, Mycobacterium
NLDKAARAAT

SEQ ID NO: 531228 - protein, 9 aa, Mycobacterium
NLDPDAAQA

SEQ ID NO: 531229 - protein, 7 aa, Mycobacterium
NLDPDDV

SEQ ID NO: 531230 - protein, 10 aa, Mycobacterium
NLDPDGPLAE

SEQ ID NO: 531231 - protein, 5 aa, Mycobacterium
NLDPE

SEQ ID NO: 531232 - protein, 6 aa, Mycobacterium
NLDPEA

SEQ ID NO: 531233 - protein, 6 aa, Mycobacterium
NLDPND

SEQ ID NO: 531234 - protein, 6 aa, Mycobacterium
NLDPPW

SEQ ID NO: 531235 - protein, 9 aa, Mycobacterium
NLDSDQPIG

SEQ ID NO: 531236 - protein, 6 aa, Mycobacterium
NLDSSR

SEQ ID NO: 531237 - protein, 4 aa, Mycobacterium
NLDT

SEQ ID NO: 531238 - protein, 8 aa, Mycobacterium
NLDTRPAF

SEQ ID NO: 531239 - protein, 9 aa, Mycobacterium
NLEAGGGNV

SEQ ID NO: 531240 - protein, 6 aa, Mycobacterium
NLEEPS

SEQ ID NO: 531241 - protein, 20 aa, Mycobacterium
NLEKSARNEPLTRPRPGHAD

SEQ ID NO: 531242 - protein, 9 aa, Mycobacterium
NLENNSLDT

SEQ ID NO: 531243 - protein, 6 aa, Mycobacterium
NLERLS

SEQ ID NO: 531244 - protein, 8 aa, Mycobacterium
NLESAGGS

SEQ ID NO: 531245 - protein, 7 aa, Mycobacterium
NLESGAR

SEQ ID NO: 531246 - protein, 7 aa, Mycobacterium
NLGAESR

SEQ ID NO: 531247 - protein, 16 aa, Mycobacterium
NLGAGNVTVTGDPAQF

SEQ ID NO: 531248 - protein, 7 aa, Mycobacterium
NLGDAAG

SEQ ID NO: 531249 - protein, 12 aa, Mycobacterium
NLGDEPRYRPSA

SEQ ID NO: 531250 - protein, 9 aa, Mycobacterium
NLGDPDVRE

SEQ ID NO: 531251 - protein, 5 aa, Mycobacterium
NLGDR

SEQ ID NO: 531252 - protein, 13 aa, Mycobacterium
NLGDSSVGLANAG

SEQ ID NO: 531253 - protein, 6 aa, Mycobacterium
NLGDTK

SEQ ID NO: 531254 - protein, 4 aa, Mycobacterium
NLGE

SEQ ID NO: 531255 - protein, 5 aa, Mycobacterium
NLGEA

SEQ ID NO: 531256 - protein, 8 aa, Mycobacterium
NLGEAAGT

SEQ ID NO: 531257 - protein, 7 aa, Mycobacterium
NLGEGRR

SEQ ID NO: 531258 - protein, 8 aa, Mycobacterium
NLGGARTN

SEQ ID NO: 531259 - protein, 9 aa, Mycobacterium
NLGGGAGHL

SEQ ID NO: 531260 - protein, 5 aa, Mycobacterium
NLGGR

SEQ ID NO: 531261 - protein, 8 aa, Mycobacterium
NLGHTEAA

SEQ ID NO: 531262 - protein, 11 aa, Mycobacterium
NLGNGNTGNLN

SEQ ID NO: 531263 - protein, 16 aa, Mycobacterium
NLGNSNLGIGSTGNHD

SEQ ID NO: 531264 - protein, 16 aa, Mycobacterium
NLGPEPHDSLLYAKIL

SEQ ID NO: 531265 - protein, 8 aa, Mycobacterium
NLGPGEQA

SEQ ID NO: 531266 - protein, 11 aa, Mycobacterium
NLGPLSANRTG

SEQ ID NO: 531267 - protein, 7 aa, Mycobacterium
NLGRATE

SEQ ID NO: 531268 - protein, 8 aa, Mycobacterium
NLGRDAAE

SEQ ID NO: 531269 - protein, 5 aa, Mycobacterium
NLGRK

SEQ ID NO: 531270 - protein, 6 aa, Mycobacterium
NLGRPG

SEQ ID NO: 531271 - protein, 6 aa, Mycobacterium
NLGRPS

SEQ ID NO: 531272 - protein, 14 aa, Mycobacterium
NLGRSDDDPAPRTL

SEQ ID NO: 531273 - protein, 13 aa, Mycobacterium
NLGRSDPDPAPRT

SEQ ID NO: 531274 - protein, 5 aa, Mycobacterium
NLGSN

SEQ ID NO: 531275 - protein, 6 aa, Mycobacterium
NLGSSG

SEQ ID NO: 531276 - protein, 21 aa, Mycobacterium
NLGSVGPNSGFGHTGANNSGF

SEQ ID NO: 531277 - protein, 5 aa, Mycobacterium
NLGTE

SEQ ID NO: 531278 - protein, 7 aa, Mycobacterium
NLGTERH

SEQ ID NO: 531279 - protein, 8 aa, Mycobacterium
NLGTERHH

SEQ ID NO: 531280 - protein, 8 aa, Mycobacterium
NLGTQRHH

SEQ ID NO: 531281 - protein, 7 aa, Mycobacterium
NLGYGSA

SEQ ID NO: 531282 - protein, 6 aa, Mycobacterium
NLGYGT

SEQ ID NO: 531283 - protein, 11 aa, Mycobacterium
NLGYPPPHSRT

SEQ ID NO: 531284 - protein, 8 aa, Mycobacterium
NLHPTGGH

SEQ ID NO: 531285 - protein, 9 aa, Mycobacterium
NLHQGGTIR

SEQ ID NO: 531286 - protein, 10 aa, Mycobacterium
NLHRGARDGL

SEQ ID NO: 531287 - protein, 7 aa, Mycobacterium
NLHTRGS

SEQ ID NO: 531288 - protein, 4 aa, Mycobacterium
NLKE

SEQ ID NO: 531289 - protein, 4 aa, Mycobacterium
NLKP

SEQ ID NO: 531290 - protein, 7 aa, Mycobacterium
NLNDAGT

SEQ ID NO: 531291 - protein, 8 aa, Mycobacterium
NLNGTATA

SEQ ID NO: 531292 - protein, 13 aa, Mycobacterium
NLNPAQAHGSGDV

SEQ ID NO: 531293 - protein, 9 aa, Mycobacterium
NLNPRTGER

SEQ ID NO: 531294 - protein, 6 aa, Mycobacterium
NLNSEP

SEQ ID NO: 531295 - protein, 6 aa, Mycobacterium
NLNSTA

SEQ ID NO: 531296 - protein, 57 aa, Mycobacterium
NLNTSIASSATQAGPNSGFGNTGTGLSGFNNSGVDTSGIQNAQYETTKTLPPPAPPI

SEQ ID NO: 531297 - protein, 6 aa, Mycobacterium
NLPADG

SEQ ID NO: 531298 - protein, 9 aa, Mycobacterium
NLPAESTVE

SEQ ID NO: 531299 - protein, 9 aa, Mycobacterium
NLPATDADE

SEQ ID NO: 531300 - protein, 17 aa, Mycobacterium
NLPDAADPSLNTIRVLA

SEQ ID NO: 531301 - protein, 23 aa, Mycobacterium
NLPDGHPDALNDDTRPRKLRPGD

SEQ ID NO: 531302 - protein, 16 aa, Mycobacterium
NLPDPADPQMGSIRVM

SEQ ID NO: 531303 - protein, 9 aa, Mycobacterium
NLPDRSGDG

SEQ ID NO: 531304 - protein, 5 aa, Mycobacterium
NLPDT

SEQ ID NO: 531305 - protein, 8 aa, Mycobacterium
NLPDTPSV

SEQ ID NO: 531306 - protein, 11 aa, Mycobacterium
NLPEATQAEAG

SEQ ID NO: 531307 - protein, 11 aa, Mycobacterium
NLPEEDRRRLR

SEQ ID NO: 531308 - protein, 19 aa, Mycobacterium
NLPEGASTQNLSLDGQGRV

SEQ ID NO: 531309 - protein, 5 aa, Mycobacterium
NLPES

SEQ ID NO: 531310 - protein, 9 aa, Mycobacterium
NLPESPLTA

SEQ ID NO: 531311 - protein, 7 aa, Mycobacterium
NLPETAS

SEQ ID NO: 531312 - protein, 6 aa, Mycobacterium
NLPETG

SEQ ID NO: 531313 - protein, 9 aa, Mycobacterium
NLPETTAEN

SEQ ID NO: 531314 - protein, 28 aa, Mycobacterium
NLPGSAGLDAGLANSASYATGGTATLSS

SEQ ID NO: 531315 - protein, 7 aa, Mycobacterium
NLPGSTE

SEQ ID NO: 531316 - protein, 13 aa, Mycobacterium
NLPGTSPETRERV

SEQ ID NO: 531317 - protein, 18 aa, Mycobacterium
NLPGYQGQGGAGSASTLG

SEQ ID NO: 531318 - protein, 8 aa, Mycobacterium
NLPKGPEC

SEQ ID NO: 531319 - protein, 8 aa, Mycobacterium
NLPKSETR

SEQ ID NO: 531320 - protein, 8 aa, Mycobacterium
NLPKSGGA

SEQ ID NO: 531321 - protein, 4 aa, Mycobacterium
NLPP

SEQ ID NO: 531322 - protein, 6 aa, Mycobacterium
NLPPAT

SEQ ID NO: 531323 - protein, 8 aa, Mycobacterium
NLPPDSGL

SEQ ID NO: 531324 - protein, 9 aa, Mycobacterium
NLPPDTGLD

SEQ ID NO: 531325 - protein, 5 aa, Mycobacterium
NLPPE

SEQ ID NO: 531326 - protein, 6 aa, Mycobacterium
NLPPET

SEQ ID NO: 531327 - protein, 18 aa, Mycobacterium
NLPPGPDHLRNTAPRPGS

SEQ ID NO: 531328 - protein, 13 aa, Mycobacterium
NLPPLPGRCGPAS

SEQ ID NO: 531329 - protein, 13 aa, Mycobacterium
NLPPQQDEPHPNR

SEQ ID NO: 531330 - protein, 8 aa, Mycobacterium
NLPPRGLE

SEQ ID NO: 531331 - protein, 4 aa, Mycobacterium
NLPQ

SEQ ID NO: 531332 - protein, 12 aa, Mycobacterium
NLPRQQKGLHSK

SEQ ID NO: 531333 - protein, 7 aa, Mycobacterium
NLPRTGG

SEQ ID NO: 531334 - protein, 5 aa, Mycobacterium
NLPSQ

SEQ ID NO: 531335 - protein, 10 aa, Mycobacterium
NLPSRHEGGE

SEQ ID NO: 531336 - protein, 12 aa, Mycobacterium
NLPSRPASYDAE

SEQ ID NO: 531337 - protein, 10 aa, Mycobacterium
NLPSRRADGQ

SEQ ID NO: 531338 - protein, 11 aa, Mycobacterium
NLPSRREGGDL

SEQ ID NO: 531339 - protein, 18 aa, Mycobacterium
NLPSSLSSVGTLDSGTAG

SEQ ID NO: 531340 - protein, 7 aa, Mycobacterium
NLPTEGG

SEQ ID NO: 531341 - protein, 13 aa, Mycobacterium
NLPTPEEAAAAEA

SEQ ID NO: 531342 - protein, 7 aa, Mycobacterium
NLPTSGG

SEQ ID NO: 531343 - protein, 8 aa, Mycobacterium
NLPTTATN

SEQ ID NO: 531344 - protein, 18 aa, Mycobacterium
NLPTTPWATNAEGRGPAW

SEQ ID NO: 531345 - protein, 5 aa, Mycobacterium
NLQAE

SEQ ID NO: 531346 - protein, 5 aa, Mycobacterium
NLQDH

SEQ ID NO: 531347 - protein, 9 aa, Mycobacterium
NLQDNSLDT

SEQ ID NO: 531348 - protein, 11 aa, Mycobacterium
NLQGASGRKLG

SEQ ID NO: 531349 - protein, 12 aa, Mycobacterium
NLQGNSGRKLGD

SEQ ID NO: 531350 - protein, 10 aa, Mycobacterium
NLQGNSGRKV

SEQ ID NO: 531351 - protein, 11 aa, Mycobacterium
NLQGNSGRRLG

SEQ ID NO: 531352 - protein, 8 aa, Mycobacterium
NLQGNSLD

SEQ ID NO: 531353 - protein, 13 aa, Mycobacterium
NLQPSSDETPGYQ

SEQ ID NO: 531354 - protein, 6 aa, Mycobacterium
NLQQQA

SEQ ID NO: 531355 - protein, 7 aa, Mycobacterium
NLQRDAD

SEQ ID NO: 531356 - protein, 5 aa, Mycobacterium
NLQRE

SEQ ID NO: 531357 - protein, 7 aa, Mycobacterium
NLQREPE

SEQ ID NO: 531358 - protein, 11 aa, Mycobacterium
NLQRTTQTIAD

SEQ ID NO: 531359 - protein, 4 aa, Mycobacterium
NLQS

SEQ ID NO: 531360 - protein, 6 aa, Mycobacterium
NLQSEE

SEQ ID NO: 531361 - protein, 8 aa, Mycobacterium
NLQSQGNE

SEQ ID NO: 531362 - protein, 11 aa, Mycobacterium
NLRADSSAEKL

SEQ ID NO: 531363 - protein, 10 aa, Mycobacterium
NLRADSSVEK

SEQ ID NO: 531364 - protein, 7 aa, Mycobacterium
NLRDPRQ

SEQ ID NO: 531365 - protein, 6 aa, Mycobacterium
NLRDQA

SEQ ID NO: 531366 - protein, 11 aa, Mycobacterium
NLRDREPDEVP

SEQ ID NO: 531367 - protein, 7 aa, Mycobacterium
NLRNSST

SEQ ID NO: 531368 - protein, 10 aa, Mycobacterium
NLRPEGRNGP

SEQ ID NO: 531369 - protein, 7 aa, Mycobacterium
NLRPGDR

SEQ ID NO: 531370 - protein, 6 aa, Mycobacterium
NLRPGN

SEQ ID NO: 531371 - protein, 8 aa, Mycobacterium
NLRPNSSV

SEQ ID NO: 531372 - protein, 9 aa, Mycobacterium
NLRPNSSVE

SEQ ID NO: 531373 - protein, 5 aa, Mycobacterium
NLRRR

SEQ ID NO: 531374 - protein, 4 aa, Mycobacterium
NLRT

SEQ ID NO: 531375 - protein, 16 aa, Mycobacterium
NLSAADAGPRPVPTSA

SEQ ID NO: 531376 - protein, 5 aa, Mycobacterium
NLSAK

SEQ ID NO: 531377 - protein, 5 aa, Mycobacterium
NLSAN

SEQ ID NO: 531378 - protein, 5 aa, Mycobacterium
NLSAS

SEQ ID NO: 531379 - protein, 6 aa, Mycobacterium
NLSDNG

SEQ ID NO: 531380 - protein, 5 aa, Mycobacterium
NLSEE

SEQ ID NO: 531381 - protein, 16 aa, Mycobacterium
NLSEPPLPQGDSALTS

SEQ ID NO: 531382 - protein, 10 aa, Mycobacterium
NLSEPQYNTM

SEQ ID NO: 531383 - protein, 10 aa, Mycobacterium
NLSESARALE

SEQ ID NO: 531384 - protein, 17 aa, Mycobacterium
NLSETPPSGGTSTGSAL

SEQ ID NO: 531385 - protein, 7 aa, Mycobacterium
NLSETST

SEQ ID NO: 531386 - protein, 5 aa, Mycobacterium
NLSGE

SEQ ID NO: 531387 - protein, 5 aa, Mycobacterium
NLSGI

SEQ ID NO: 531388 - protein, 8 aa, Mycobacterium
NLSGLPPT

SEQ ID NO: 531389 - protein, 5 aa, Mycobacterium
NLSGS

SEQ ID NO: 531390 - protein, 8 aa, Mycobacterium
NLSKSLAK

SEQ ID NO: 531391 - protein, 9 aa, Mycobacterium
NLSKSLAKD

SEQ ID NO: 531392 - protein, 8 aa, Mycobacterium
NLSNAKGD

SEQ ID NO: 531393 - protein, 13 aa, Mycobacterium
NLSPDDRATVYTS

SEQ ID NO: 531394 - protein, 6 aa, Mycobacterium
NLSPEE

SEQ ID NO: 531395 - protein, 10 aa, Mycobacterium
NLSPGAVPTL

SEQ ID NO: 531396 - protein, 24 aa, Mycobacterium
NLSPGGNGLRNLGSNGQQRPGPTY

SEQ ID NO: 531397 - protein, 6 aa, Mycobacterium
NLSPTD

SEQ ID NO: 531398 - protein, 4 aa, Mycobacterium
NLSS

SEQ ID NO: 531399 - protein, 9 aa, Mycobacterium
NLSSRRRGL

SEQ ID NO: 531400 - protein, 8 aa, Mycobacterium
NLSSSEIA

SEQ ID NO: 531401 - protein, 13 aa, Mycobacterium
NLSVSATAPPEAV

SEQ ID NO: 531402 - protein, 4 aa, Mycobacterium
NLTA

SEQ ID NO: 531403 - protein, 7 aa, Mycobacterium
NLTAEPR

SEQ ID NO: 531404 - protein, 10 aa, Mycobacterium
NLTDAERAGL

SEQ ID NO: 531405 - protein, 10 aa, Mycobacterium
NLTDAERDGL

SEQ ID NO: 531406 - protein, 7 aa, Mycobacterium
NLTDDLS

SEQ ID NO: 531407 - protein, 9 aa, Mycobacterium
NLTEGGAAM

SEQ ID NO: 531408 - protein, 6 aa, Mycobacterium
NLTEQG

SEQ ID NO: 531409 - protein, 5 aa, Mycobacterium
NLTER

SEQ ID NO: 531410 - protein, 7 aa, Mycobacterium
NLTESAG

SEQ ID NO: 531411 - protein, 17 aa, Mycobacterium
NLTGDPRRWPNDRGNSG

SEQ ID NO: 531412 - protein, 16 aa, Mycobacterium
NLTGDPRRWPNDYGNS

SEQ ID NO: 531413 - protein, 10 aa, Mycobacterium
NLTGHAKGGA

SEQ ID NO: 531414 - protein, 12 aa, Mycobacterium
NLTGNRATAVEG

SEQ ID NO: 531415 - protein, 13 aa, Mycobacterium
NLTGRANAKTVPL

SEQ ID NO: 531416 - protein, 5 aa, Mycobacterium
NLTGT

SEQ ID NO: 531417 - protein, 38 aa, Mycobacterium
NLTGTDASGNTTQTTVTVDDKTKYTKQTSANTEAIAPG

SEQ ID NO: 531418 - protein, 7 aa, Mycobacterium
NLTGTRR

SEQ ID NO: 531419 - protein, 4 aa, Mycobacterium
NLTP

SEQ ID NO: 531420 - protein, 5 aa, Mycobacterium
NLTPA

SEQ ID NO: 531421 - protein, 8 aa, Mycobacterium
NLTPAPRA

SEQ ID NO: 531422 - protein, 5 aa, Mycobacterium
NLTPG

SEQ ID NO: 531423 - protein, 7 aa, Mycobacterium
NLTPGQR

SEQ ID NO: 531424 - protein, 8 aa, Mycobacterium
NLTPPRTI

SEQ ID NO: 531425 - protein, 9 aa, Mycobacterium
NLTRDPDQL

SEQ ID NO: 531426 - protein, 6 aa, Mycobacterium
NLVGSS

SEQ ID NO: 531427 - protein, 13 aa, Mycobacterium
NLVPTDPAEGSVD

SEQ ID NO: 531428 - protein, 16 aa, Mycobacterium
NLYPGDPNGGGSGRKS

SEQ ID NO: 531429 - protein, 7 aa, Mycobacterium
NLYSKQD

SEQ ID NO: 531430 - protein, 18 aa, Mycobacterium
NMADGDRLAASSRSPEIM

SEQ ID NO: 531431 - protein, 6 aa, Mycobacterium
NMAETT

SEQ ID NO: 531432 - protein, 6 aa, Mycobacterium
NMARSG

SEQ ID NO: 531433 - protein, 21 aa, Mycobacterium
NMDAPPPSEDFGRQPPQDLAA

SEQ ID NO: 531434 - protein, 8 aa, Mycobacterium
NMENNSLD

SEQ ID NO: 531435 - protein, 10 aa, Mycobacterium
NMGDGQTGLF

SEQ ID NO: 531436 - protein, 8 aa, Mycobacterium
NMGGTDPR

SEQ ID NO: 531437 - protein, 10 aa, Mycobacterium
NMGHSQAAAG

SEQ ID NO: 531438 - protein, 11 aa, Mycobacterium
NMGNQRAASRL

SEQ ID NO: 531439 - protein, 6 aa, Mycobacterium
NMPCSP

SEQ ID NO: 531440 - protein, 6 aa, Mycobacterium
NMPQSA

SEQ ID NO: 531441 - protein, 28 aa, Mycobacterium
NMPRDPRATPIVTEPEQAVPIPGHPDAA

SEQ ID NO: 531442 - protein, 13 aa, Mycobacterium
NMPSGTAQRPGDV

SEQ ID NO: 531443 - protein, 5 aa, Mycobacterium
NMPVE

SEQ ID NO: 531444 - protein, 10 aa, Mycobacterium
NMQPNADEPV

SEQ ID NO: 531445 - protein, 5 aa, Mycobacterium
NMRTG

SEQ ID NO: 531446 - protein, 9 aa, Mycobacterium
NMSKPDKVT

SEQ ID NO: 531447 - protein, 8 aa, Mycobacterium
NMSTDGTW

SEQ ID NO: 531448 - protein, 8 aa, Mycobacterium
NMTNSGDM

SEQ ID NO: 531449 - protein, 4 aa, Mycobacterium
NNAA

SEQ ID NO: 531450 - protein, 6 aa, Mycobacterium
NNAADV

SEQ ID NO: 531451 - protein, 10 aa, Mycobacterium
NNAAKTTIAP

SEQ ID NO: 531452 - protein, 13 aa, Mycobacterium
NNAANGLNTHTEA

SEQ ID NO: 531453 - protein, 8 aa, Mycobacterium
NNADDALA

SEQ ID NO: 531454 - protein, 5 aa, Mycobacterium
NNADN

SEQ ID NO: 531455 - protein, 8 aa, Mycobacterium
NNADTLAS

SEQ ID NO: 531456 - protein, 6 aa, Mycobacterium
NNAEEA

SEQ ID NO: 531457 - protein, 10 aa, Mycobacterium
NNAERPFSRD

SEQ ID NO: 531458 - protein, 8 aa, Mycobacterium
NNAERTLA

SEQ ID NO: 531459 - protein, 8 aa, Mycobacterium
NNAGDRRQ

SEQ ID NO: 531460 - protein, 5 aa, Mycobacterium
NNAGE

SEQ ID NO: 531461 - protein, 8 aa, Mycobacterium
NNAGGAPF

SEQ ID NO: 531462 - protein, 10 aa, Mycobacterium
NNAGNGDTGL

SEQ ID NO: 531463 - protein, 22 aa, Mycobacterium
NNAKSERKPRVGSTQRRLPNKA

SEQ ID NO: 531464 - protein, 6 aa, Mycobacterium
NNAKVA

SEQ ID NO: 531465 - protein, 19 aa, Mycobacterium
NNANRAGSGCLDRTDGGLT

SEQ ID NO: 531466 - protein, 20 aa, Mycobacterium
NNANRLTSPMRRRPDGTYEE

SEQ ID NO: 531467 - protein, 25 aa, Mycobacterium
NNANRYDSYQRRTSRPIPIFALTPA

SEQ ID NO: 531468 - protein, 9 aa, Mycobacterium
NNAPQHRRH

SEQ ID NO: 531469 - protein, 8 aa, Mycobacterium
NNAPVDPP

SEQ ID NO: 531470 - protein, 17 aa, Mycobacterium
NNARAKAEAKQGTASPV

SEQ ID NO: 531471 - protein, 16 aa, Mycobacterium
NNARAKASAGQGTSTS

SEQ ID NO: 531472 - protein, 5 aa, Mycobacterium
NNARV

SEQ ID NO: 531473 - protein, 9 aa, Mycobacterium
NNASANTQN

SEQ ID NO: 531474 - protein, 7 aa, Mycobacterium
NNASKDP

SEQ ID NO: 531475 - protein, 10 aa, Mycobacterium
NNASRSAPEV

SEQ ID NO: 531476 - protein, 10 aa, Mycobacterium
NNCSTGSTAL

SEQ ID NO: 531477 - protein, 5 aa, Mycobacterium
NNDAD

SEQ ID NO: 531478 - protein, 5 aa, Mycobacterium
NNDAQ

SEQ ID NO: 531479 - protein, 8 aa, Mycobacterium
NNDDDTVS

SEQ ID NO: 531480 - protein, 9 aa, Mycobacterium
NNDDEIGRT

SEQ ID NO: 531481 - protein, 7 aa, Mycobacterium
NNDEAAA

SEQ ID NO: 531482 - protein, 7 aa, Mycobacterium
NNDEAVR

SEQ ID NO: 531483 - protein, 7 aa, Mycobacterium
NNDGDLP

SEQ ID NO: 531484 - protein, 7 aa, Mycobacterium
NNDGPAL

SEQ ID NO: 531485 - protein, 8 aa, Mycobacterium
NNDGPALR

SEQ ID NO: 531486 - protein, 8 aa, Mycobacterium
NNDGPDLR

SEQ ID NO: 531487 - protein, 7 aa, Mycobacterium
NNDGTYD

SEQ ID NO: 531488 - protein, 7 aa, Mycobacterium
NNDKDKH

SEQ ID NO: 531489 - protein, 11 aa, Mycobacterium
NNDQSTPVPSC

SEQ ID NO: 531490 - protein, 4 aa, Mycobacterium
NNDS

SEQ ID NO: 531491 - protein, 8 aa, Mycobacterium
NNDTDRDV

SEQ ID NO: 531492 - protein, 6 aa, Mycobacterium
NNDTTL

SEQ ID NO: 531493 - protein, 8 aa, Mycobacterium
NNDTVGAA

SEQ ID NO: 531494 - protein, 10 aa, Mycobacterium
NNDYTSSVAR

SEQ ID NO: 531495 - protein, 10 aa, Mycobacterium
NNEERPFSRD

SEQ ID NO: 531496 - protein, 15 aa, Mycobacterium
NNEGGGPGAAEGEGI

SEQ ID NO: 531497 - protein, 8 aa, Mycobacterium
NNERAYDK

SEQ ID NO: 531498 - protein, 7 aa, Mycobacterium
NNERAYQ

SEQ ID NO: 531499 - protein, 6 aa, Mycobacterium
NNEVGK

SEQ ID NO: 531500 - protein, 12 aa, Mycobacterium
NNEVPGATERDH

SEQ ID NO: 531501 - protein, 13 aa, Mycobacterium
NNEVPGATERDHG

SEQ ID NO: 531502 - protein, 12 aa, Mycobacterium
NNFDPTRRSGRV

SEQ ID NO: 531503 - protein, 7 aa, Mycobacterium
NNFEPHT

SEQ ID NO: 531504 - protein, 7 aa, Mycobacterium
NNFGSGN

SEQ ID NO: 531505 - protein, 15 aa, Mycobacterium
NNFSPSQVTQFLLLA

SEQ ID NO: 531506 - protein, 8 aa, Mycobacterium
NNGAGNVG

SEQ ID NO: 531507 - protein, 22 aa, Mycobacterium
NNGANRNFPSTCATTPREYLAR

SEQ ID NO: 531508 - protein, 14 aa, Mycobacterium
NNGARQYDGSQVPL

SEQ ID NO: 531509 - protein, 6 aa, Mycobacterium
NNGAST

SEQ ID NO: 531510 - protein, 7 aa, Mycobacterium
NNGDFAG

SEQ ID NO: 531511 - protein, 10 aa, Mycobacterium
NNGESATAIS

SEQ ID NO: 531512 - protein, 13 aa, Mycobacterium
NNGEVVAEGRSDA

SEQ ID NO: 531513 - protein, 7 aa, Mycobacterium
NNGFSEK

SEQ ID NO: 531514 - protein, 7 aa, Mycobacterium
NNGHGRW

SEQ ID NO: 531515 - protein, 11 aa, Mycobacterium
NNGHPEDAVSR

SEQ ID NO: 531516 - protein, 4 aa, Mycobacterium
NNGI

SEQ ID NO: 531517 - protein, 5 aa, Mycobacterium
NNGKD

SEQ ID NO: 531518 - protein, 12 aa, Mycobacterium
NNGKSATAISIP

SEQ ID NO: 531519 - protein, 7 aa, Mycobacterium
NNGLTAS

SEQ ID NO: 531520 - protein, 7 aa, Mycobacterium
NNGPAEL

SEQ ID NO: 531521 - protein, 12 aa, Mycobacterium
NNGPAGTGSPVN

SEQ ID NO: 531522 - protein, 5 aa, Mycobacterium
NNGPL

SEQ ID NO: 531523 - protein, 19 aa, Mycobacterium
NNGPSAVLGPTSQTAPGVV

SEQ ID NO: 531524 - protein, 8 aa, Mycobacterium
NNGQTVAR

SEQ ID NO: 531525 - protein, 9 aa, Mycobacterium
NNGRDTSSA

SEQ ID NO: 531526 - protein, 6 aa, Mycobacterium
NNGRPG

SEQ ID NO: 531527 - protein, 36 aa, Mycobacterium
NNGTATGTATGGNGGNGGNGDADGHRGGKGGDGGEA

SEQ ID NO: 531528 - protein, 7 aa, Mycobacterium
NNGTGNF

SEQ ID NO: 531529 - protein, 6 aa, Mycobacterium
NNGTMP

SEQ ID NO: 531530 - protein, 6 aa, Mycobacterium
NNGTQT

SEQ ID NO: 531531 - protein, 10 aa, Mycobacterium
NNGTSATAIS

SEQ ID NO: 531532 - protein, 4 aa, Mycobacterium
NNGV

SEQ ID NO: 531533 - protein, 18 aa, Mycobacterium
NNGVGNSGIGNVGDGNAG

SEQ ID NO: 531534 - protein, 5 aa, Mycobacterium
NNHND

SEQ ID NO: 531535 - protein, 18 aa, Mycobacterium
NNHRTDSNGFSIKDQLRG

SEQ ID NO: 531536 - protein, 6 aa, Mycobacterium
NNIAKD

SEQ ID NO: 531537 - protein, 6 aa, Mycobacterium
NNIGPA

SEQ ID NO: 531538 - protein, 8 aa, Mycobacterium
NNIPSGAF

SEQ ID NO: 531539 - protein, 6 aa, Mycobacterium
NNIPTQ

SEQ ID NO: 531540 - protein, 20 aa, Mycobacterium
NNKLNGAARRSVAPTSPAVP

SEQ ID NO: 531541 - protein, 10 aa, Mycobacterium
NNKPQQVQDA

SEQ ID NO: 531542 - protein, 9 aa, Mycobacterium
NNKQSARNF

SEQ ID NO: 531543 - protein, 7 aa, Mycobacterium
NNKVRIP

SEQ ID NO: 531544 - protein, 7 aa, Mycobacterium
NNLGDSK

SEQ ID NO: 531545 - protein, 10 aa, Mycobacterium
NNLGSPDEYA

SEQ ID NO: 531546 - protein, 7 aa, Mycobacterium
NNLHGRG

SEQ ID NO: 531547 - protein, 10 aa, Mycobacterium
NNLPESDSPQ

SEQ ID NO: 531548 - protein, 8 aa, Mycobacterium
NNLPSGAF

SEQ ID NO: 531549 - protein, 6 aa, Mycobacterium
NNLSRP

SEQ ID NO: 531550 - protein, 4 aa, Mycobacterium
NNNA

SEQ ID NO: 531551 - protein, 7 aa, Mycobacterium
NNNGGFP

SEQ ID NO: 531552 - protein, 8 aa, Mycobacterium
NNNGSLPE

SEQ ID NO: 531553 - protein, 7 aa, Mycobacterium
NNNGTFP

SEQ ID NO: 531554 - protein, 7 aa, Mycobacterium
NNNNGRQ

SEQ ID NO: 531555 - protein, 7 aa, Mycobacterium
NNNQNRY

SEQ ID NO: 531556 - protein, 11 aa, Mycobacterium
NNNRSHATAGG

SEQ ID NO: 531557 - protein, 7 aa, Mycobacterium
NNNSRSL

SEQ ID NO: 531558 - protein, 5 aa, Mycobacterium
NNNTA

SEQ ID NO: 531559 - protein, 15 aa, Mycobacterium
NNNTAAGASAVGTGN

SEQ ID NO: 531560 - protein, 4 aa, Mycobacterium
NNNV

SEQ ID NO: 531561 - protein, 16 aa, Mycobacterium
NNPAAAISRAASDLRE

SEQ ID NO: 531562 - protein, 10 aa, Mycobacterium
NNPAAATARA

SEQ ID NO: 531563 - protein, 10 aa, Mycobacterium
NNPAAATVRA

SEQ ID NO: 531564 - protein, 13 aa, Mycobacterium
NNPADARPLADAA

SEQ ID NO: 531565 - protein, 13 aa, Mycobacterium
NNPADARPLPGAA

SEQ ID NO: 531566 - protein, 10 aa, Mycobacterium
NNPAGATARA

SEQ ID NO: 531567 - protein, 8 aa, Mycobacterium
NNPAKRVG

SEQ ID NO: 531568 - protein, 7 aa, Mycobacterium
NNPANSV

SEQ ID NO: 531569 - protein, 10 aa, Mycobacterium
NNPAQRNSYD

SEQ ID NO: 531570 - protein, 10 aa, Mycobacterium
NNPDATTMPK

SEQ ID NO: 531571 - protein, 10 aa, Mycobacterium
NNPDGATEVA

SEQ ID NO: 531572 - protein, 7 aa, Mycobacterium
NNPDGSL

SEQ ID NO: 531573 - protein, 10 aa, Mycobacterium
NNPDNQGPNL

SEQ ID NO: 531574 - protein, 5 aa, Mycobacterium
NNPDQ

SEQ ID NO: 531575 - protein, 6 aa, Mycobacterium
NNPEGL

SEQ ID NO: 531576 - protein, 13 aa, Mycobacterium
NNPEQRNSYDASM

SEQ ID NO: 531577 - protein, 7 aa, Mycobacterium
NNPGLTI

SEQ ID NO: 531578 - protein, 6 aa, Mycobacterium
NNPGNH

SEQ ID NO: 531579 - protein, 8 aa, Mycobacterium
NNPGPQIR

SEQ ID NO: 531580 - protein, 15 aa, Mycobacterium
NNPHAPRRPRSTEVA

SEQ ID NO: 531581 - protein, 10 aa, Mycobacterium
NNPKQRNSYD

SEQ ID NO: 531582 - protein, 12 aa, Mycobacterium
NNPKQRNSYDAA

SEQ ID NO: 531583 - protein, 12 aa, Mycobacterium
NNPLPRRRRLGN

SEQ ID NO: 531584 - protein, 5 aa, Mycobacterium
NNPME

SEQ ID NO: 531585 - protein, 6 aa, Mycobacterium
NNPNGG

SEQ ID NO: 531586 - protein, 10 aa, Mycobacterium
NNPPGPEPLP

SEQ ID NO: 531587 - protein, 5 aa, Mycobacterium
NNPRR

SEQ ID NO: 531588 - protein, 7 aa, Mycobacterium
NNPSPRI

SEQ ID NO: 531589 - protein, 18 aa, Mycobacterium
NNPSTQLRPRDPDPDSRA

SEQ ID NO: 531590 - protein, 9 aa, Mycobacterium
NNPTRRNAY

SEQ ID NO: 531591 - protein, 8 aa, Mycobacterium
NNPTSSPY

SEQ ID NO: 531592 - protein, 6 aa, Mycobacterium
NNPVAR

SEQ ID NO: 531593 - protein, 20 aa, Mycobacterium
NNPVEAARAHREKRAPRWDP

SEQ ID NO: 531594 - protein, 8 aa, Mycobacterium
NNPYGNGT

SEQ ID NO: 531595 - protein, 12 aa, Mycobacterium
NNPYRDKIAESG

SEQ ID NO: 531596 - protein, 6 aa, Mycobacterium
NNQAAH

SEQ ID NO: 531597 - protein, 10 aa, Mycobacterium
NNQAGASAGI

SEQ ID NO: 531598 - protein, 68 aa, Mycobacterium
NNQGGNGGNGANGSGPGGAGGAGGDGGASTAGGAATGGKGGHGGNGAASDLSGGNGGAAGAGGNGGNA

SEQ ID NO: 531599 - protein, 20 aa, Mycobacterium
NNQPAPHGDYPDQASGPQRT

SEQ ID NO: 531600 - protein, 7 aa, Mycobacterium
NNQRDGF

SEQ ID NO: 531601 - protein, 7 aa, Mycobacterium
NNQSGVD

SEQ ID NO: 531602 - protein, 5 aa, Mycobacterium
NNREM

SEQ ID NO: 531603 - protein, 19 aa, Mycobacterium
NNRFTRKRSGTGGGTKSTD

SEQ ID NO: 531604 - protein, 10 aa, Mycobacterium
NNRGKKSVSV

SEQ ID NO: 531605 - protein, 9 aa, Mycobacterium
NNRGKKSVT

SEQ ID NO: 531606 - protein, 8 aa, Mycobacterium
NNRPAETE

SEQ ID NO: 531607 - protein, 8 aa, Mycobacterium
NNRPEGAR

SEQ ID NO: 531608 - protein, 12 aa, Mycobacterium
NNRPHDLVVVPV

SEQ ID NO: 531609 - protein, 8 aa, Mycobacterium
NNRPRKSL

SEQ ID NO: 531610 - protein, 8 aa, Mycobacterium
NNRPRPTL

SEQ ID NO: 531611 - protein, 12 aa, Mycobacterium
NNRPTRPGSIDR

SEQ ID NO: 531612 - protein, 12 aa, Mycobacterium
NNRRGPAPLDRG

SEQ ID NO: 531613 - protein, 9 aa, Mycobacterium
NNRSTVSGG

SEQ ID NO: 531614 - protein, 10 aa, Mycobacterium
NNRVEAEAKR

SEQ ID NO: 531615 - protein, 10 aa, Mycobacterium
NNRVNGENTF

SEQ ID NO: 531616 - protein, 5 aa, Mycobacterium
NNRVR

SEQ ID NO: 531617 - protein, 7 aa, Mycobacterium
NNSAQVE

SEQ ID NO: 531618 - protein, 10 aa, Mycobacterium
NNSASSVSSA

SEQ ID NO: 531619 - protein, 5 aa, Mycobacterium
NNSAV

SEQ ID NO: 531620 - protein, 7 aa, Mycobacterium
NNSDGFP

SEQ ID NO: 531621 - protein, 4 aa, Mycobacterium
NNSG

SEQ ID NO: 531622 - protein, 10 aa, Mycobacterium
NNSGPGAEAV

SEQ ID NO: 531623 - protein, 6 aa, Mycobacterium
NNSLGA

SEQ ID NO: 531624 - protein, 7 aa, Mycobacterium
NNSNARE

SEQ ID NO: 531625 - protein, 7 aa, Mycobacterium
NNSNPAA

SEQ ID NO: 531626 - protein, 7 aa, Mycobacterium
NNSPRFT

SEQ ID NO: 531627 - protein, 15 aa, Mycobacterium
NNSRRARAARRRKRR

SEQ ID NO: 531628 - protein, 11 aa, Mycobacterium
NNSSEINPDQA

SEQ ID NO: 531629 - protein, 7 aa, Mycobacterium
NNSSRAI

SEQ ID NO: 531630 - protein, 7 aa, Mycobacterium
NNSSRAL

SEQ ID NO: 531631 - protein, 7 aa, Mycobacterium
NNSSRSF

SEQ ID NO: 531632 - protein, 9 aa, Mycobacterium
NNSTDDTAA

SEQ ID NO: 531633 - protein, 14 aa, Mycobacterium
NNSTDDTAGVAARH

SEQ ID NO: 531634 - protein, 9 aa, Mycobacterium
NNSTDGTAA

SEQ ID NO: 531635 - protein, 15 aa, Mycobacterium
NNSTDNTAAVAGRHG

SEQ ID NO: 531636 - protein, 11 aa, Mycobacterium
NNSTDRTAEVA

SEQ ID NO: 531637 - protein, 6 aa, Mycobacterium
NNSTVR

SEQ ID NO: 531638 - protein, 7 aa, Mycobacterium
NNSTYGL

SEQ ID NO: 531639 - protein, 7 aa, Mycobacterium
NNTAGRD

SEQ ID NO: 531640 - protein, 12 aa, Mycobacterium
NNTASASAIGAG

SEQ ID NO: 531641 - protein, 11 aa, Mycobacterium
NNTAWSSRYER

SEQ ID NO: 531642 - protein, 7 aa, Mycobacterium
NNTEARI

SEQ ID NO: 531643 - protein, 6 aa, Mycobacterium
NNTELG

SEQ ID NO: 531644 - protein, 6 aa, Mycobacterium
NNTESG

SEQ ID NO: 531645 - protein, 6 aa, Mycobacterium
NNTGGA

SEQ ID NO: 531646 - protein, 8 aa, Mycobacterium
NNTGSAKT

SEQ ID NO: 531647 - protein, 8 aa, Mycobacterium
NNTISASS

SEQ ID NO: 531648 - protein, 27 aa, Mycobacterium
NNTKRGTDGEPPADASNPRNDNKSGQI

SEQ ID NO: 531649 - protein, 4 aa, Mycobacterium
NNTP

SEQ ID NO: 531650 - protein, 5 aa, Mycobacterium
NNTPL

SEQ ID NO: 531651 - protein, 5 aa, Mycobacterium
NNTPV

SEQ ID NO: 531652 - protein, 7 aa, Mycobacterium
NNTPVNT

SEQ ID NO: 531653 - protein, 5 aa, Mycobacterium
NNTRE

SEQ ID NO: 531654 - protein, 8 aa, Mycobacterium
NNTRSARY

SEQ ID NO: 531655 - protein, 7 aa, Mycobacterium
NNTSRDS

SEQ ID NO: 531656 - protein, 7 aa, Mycobacterium
NNTSTVS

SEQ ID NO: 531657 - protein, 6 aa, Mycobacterium
NNTSYG

SEQ ID NO: 531658 - protein, 4 aa, Mycobacterium
NNVA

SEQ ID NO: 531659 - protein, 4 aa, Mycobacterium
NNVH

SEQ ID NO: 531660 - protein, 8 aa, Mycobacterium
NNVPSGAF

SEQ ID NO: 531661 - protein, 20 aa, Mycobacterium
NNVPVASPVQDAGANAQNGA

SEQ ID NO: 531662 - protein, 5 aa, Mycobacterium
NNWQD

SEQ ID NO: 531663 - protein, 9 aa, Mycobacterium
NNYAGTIGR

SEQ ID NO: 531664 - protein, 15 aa, Mycobacterium
NNYEGQEQASQQILC

SEQ ID NO: 531665 - protein, 6 aa, Mycobacterium
NNYSGI

SEQ ID NO: 531666 - protein, 7 aa, Mycobacterium
NPAAAEL

SEQ ID NO: 531667 - protein, 6 aa, Mycobacterium
NPAAAL

SEQ ID NO: 531668 - protein, 7 aa, Mycobacterium
NPAAARA

SEQ ID NO: 531669 - protein, 10 aa, Mycobacterium
NPAAGDPEGY

SEQ ID NO: 531670 - protein, 16 aa, Mycobacterium
NPAALGDGIRAGQRVG

SEQ ID NO: 531671 - protein, 8 aa, Mycobacterium
NPAAMGDG

SEQ ID NO: 531672 - protein, 9 aa, Mycobacterium
NPAARANFS

SEQ ID NO: 531673 - protein, 6 aa, Mycobacterium
NPAATT

SEQ ID NO: 531674 - protein, 5 aa, Mycobacterium
NPADA

SEQ ID NO: 531675 - protein, 8 aa, Mycobacterium
NPADAKTV

SEQ ID NO: 531676 - protein, 8 aa, Mycobacterium
NPADATES

SEQ ID NO: 531677 - protein, 6 aa, Mycobacterium
NPADAV

SEQ ID NO: 531678 - protein, 8 aa, Mycobacterium
NPADDSAF

SEQ ID NO: 531679 - protein, 9 aa, Mycobacterium
NPADGGRAP

SEQ ID NO: 531680 - protein, 9 aa, Mycobacterium
NPADGGRDV

SEQ ID NO: 531681 - protein, 29 aa, Mycobacterium
NPADPEPCTAGTPTQAQIDNDQRSLAQRQ

SEQ ID NO: 531682 - protein, 29 aa, Mycobacterium
NPADPEPCTYGTPTQAQIDNDQRSLAQRQ

SEQ ID NO: 531683 - protein, 6 aa, Mycobacterium
NPADPP

SEQ ID NO: 531684 - protein, 8 aa, Mycobacterium
NPADTSSV

SEQ ID NO: 531685 - protein, 5 aa, Mycobacterium
NPADY

SEQ ID NO: 531686 - protein, 4 aa, Mycobacterium
NPAE

SEQ ID NO: 531687 - protein, 5 aa, Mycobacterium
NPAEA

SEQ ID NO: 531688 - protein, 8 aa, Mycobacterium
NPAEAKTV

SEQ ID NO: 531689 - protein, 21 aa, Mycobacterium
NPAEFRTATADPADDPTPQVP

SEQ ID NO: 531690 - protein, 19 aa, Mycobacterium
NPAEGWAGAAAETCAEAQR

SEQ ID NO: 531691 - protein, 7 aa, Mycobacterium
NPAEPPS

SEQ ID NO: 531692 - protein, 14 aa, Mycobacterium
NPAEQSRRVARGTA

SEQ ID NO: 531693 - protein, 13 aa, Mycobacterium
NPAETDGAAKLYD

SEQ ID NO: 531694 - protein, 4 aa, Mycobacterium
NPAF

SEQ ID NO: 531695 - protein, 13 aa, Mycobacterium
NPAGATISDGSAL

SEQ ID NO: 531696 - protein, 9 aa, Mycobacterium
NPAGDPRRA

SEQ ID NO: 531697 - protein, 8 aa, Mycobacterium
NPAGDRPL

SEQ ID NO: 531698 - protein, 7 aa, Mycobacterium
NPAGFSS

SEQ ID NO: 531699 - protein, 8 aa, Mycobacterium
NPAGNRPL

SEQ ID NO: 531700 - protein, 7 aa, Mycobacterium
NPAGPRI

SEQ ID NO: 531701 - protein, 11 aa, Mycobacterium
NPAGPTTPIGP

SEQ ID NO: 531702 - protein, 7 aa, Mycobacterium
NPAGRAT

SEQ ID NO: 531703 - protein, 13 aa, Mycobacterium
NPAGWTGAKGAPT

SEQ ID NO: 531704 - protein, 4 aa, Mycobacterium
NPAI

SEQ ID NO: 531705 - protein, 5 aa, Mycobacterium
NPAIN

SEQ ID NO: 531706 - protein, 6 aa, Mycobacterium
NPAKGL

SEQ ID NO: 531707 - protein, 9 aa, Mycobacterium
NPAKNSSAE

SEQ ID NO: 531708 - protein, 6 aa, Mycobacterium
NPAKTI

SEQ ID NO: 531709 - protein, 9 aa, Mycobacterium
NPAKTLAAR

SEQ ID NO: 531710 - protein, 6 aa, Mycobacterium
NPALPT

SEQ ID NO: 531711 - protein, 6 aa, Mycobacterium
NPALTA

SEQ ID NO: 531712 - protein, 4 aa, Mycobacterium
NPAN

SEQ ID NO: 531713 - protein, 7 aa, Mycobacterium
NPANADT

SEQ ID NO: 531714 - protein, 5 aa, Mycobacterium
NPANG

SEQ ID NO: 531715 - protein, 7 aa, Mycobacterium
NPANGEP

SEQ ID NO: 531716 - protein, 25 aa, Mycobacterium
NPANIGGQRDGWAPRGVYVNNFVFV

SEQ ID NO: 531717 - protein, 8 aa, Mycobacterium
NPANSDTV

SEQ ID NO: 531718 - protein, 7 aa, Mycobacterium
NPANTNA

SEQ ID NO: 531719 - protein, 12 aa, Mycobacterium
NPAPQLRSGGLG

SEQ ID NO: 531720 - protein, 8 aa, Mycobacterium
NPAPRPAD

SEQ ID NO: 531721 - protein, 238 aa, Mycobacterium
NPAPSNRLDAPSNPGGPEAPVRPPEPPGPTTHNPGGTRPPGGGDGPPPESPHRPVGPADPGPTRGDAPPPHTPSTPEPSHPGSSSVGEPGIRGNPEPSHTPPSVDHTPQHAPEPATPAAQNDAPHTSAESNSTPTHQPSTSDAPASTHSPTQHIGGSVGGEHSAISSDSNIGSAEHHRPVTDESRNWADEQAHRPAEQQPAHNAAAEQPVTHDRNSAETNESREPAYSSAVNGPQPAM

SEQ ID NO: 531722 - protein, 10 aa, Mycobacterium
NPAPSPGDEL

SEQ ID NO: 531723 - protein, 7 aa, Mycobacterium
NPAPTAG

SEQ ID NO: 531724 - protein, 6 aa, Mycobacterium
NPAPYT

SEQ ID NO: 531725 - protein, 9 aa, Mycobacterium
NPAPYTANQ

SEQ ID NO: 531726 - protein, 7 aa, Mycobacterium
NPAQRQK

SEQ ID NO: 531727 - protein, 19 aa, Mycobacterium
NPARCGPAGHGDDASTRDS

SEQ ID NO: 531728 - protein, 15 aa, Mycobacterium
NPARIGQAALLKPHL

SEQ ID NO: 531729 - protein, 8 aa, Mycobacterium
NPARPGDI

SEQ ID NO: 531730 - protein, 6 aa, Mycobacterium
NPARPL

SEQ ID NO: 531731 - protein, 8 aa, Mycobacterium
NPARRARY

SEQ ID NO: 531732 - protein, 5 aa, Mycobacterium
NPARS

SEQ ID NO: 531733 - protein, 14 aa, Mycobacterium
NPARVARGAPDLGE

SEQ ID NO: 531734 - protein, 9 aa, Mycobacterium
NPASGEAAR

SEQ ID NO: 531735 - protein, 12 aa, Mycobacterium
NPASHQDDSHSE

SEQ ID NO: 531736 - protein, 13 aa, Mycobacterium
NPASHQEDSFSPE

SEQ ID NO: 531737 - protein, 15 aa, Mycobacterium
NPASHQQDSHSDGLL

SEQ ID NO: 531738 - protein, 9 aa, Mycobacterium
NPASKSRTW

SEQ ID NO: 531739 - protein, 5 aa, Mycobacterium
NPASL

SEQ ID NO: 531740 - protein, 10 aa, Mycobacterium
NPASLSDPAA

SEQ ID NO: 531741 - protein, 11 aa, Mycobacterium
NPASLSDPSEM

SEQ ID NO: 531742 - protein, 8 aa, Mycobacterium
NPASLTGQ

SEQ ID NO: 531743 - protein, 6 aa, Mycobacterium
NPATDG

SEQ ID NO: 531744 - protein, 11 aa, Mycobacterium
NPATDSPHAAG

SEQ ID NO: 531745 - protein, 11 aa, Mycobacterium
NPATDSPQAAA

SEQ ID NO: 531746 - protein, 6 aa, Mycobacterium
NPATEE

SEQ ID NO: 531747 - protein, 11 aa, Mycobacterium
NPATEEPLGEV

SEQ ID NO: 531748 - protein, 19 aa, Mycobacterium
NPATEEPLGEVADASKEDM

SEQ ID NO: 531749 - protein, 19 aa, Mycobacterium
NPATEESLGEVADASKEDM

SEQ ID NO: 531750 - protein, 8 aa, Mycobacterium
NPATEETL

SEQ ID NO: 531751 - protein, 8 aa, Mycobacterium
NPATERPF

SEQ ID NO: 531752 - protein, 11 aa, Mycobacterium
NPATGEAARKL

SEQ ID NO: 531753 - protein, 15 aa, Mycobacterium
NPATGEAARKLHDDA

SEQ ID NO: 531754 - protein, 8 aa, Mycobacterium
NPATGESV

SEQ ID NO: 531755 - protein, 8 aa, Mycobacterium
NPATGETV

SEQ ID NO: 531756 - protein, 7 aa, Mycobacterium
NPATGQP

SEQ ID NO: 531757 - protein, 5 aa, Mycobacterium
NPATI

SEQ ID NO: 531758 - protein, 7 aa, Mycobacterium
NPATITG

SEQ ID NO: 531759 - protein, 9 aa, Mycobacterium
NPATLGDPA

SEQ ID NO: 531760 - protein, 9 aa, Mycobacterium
NPATLGPQM

SEQ ID NO: 531761 - protein, 10 aa, Mycobacterium
NPATLSDPAA

SEQ ID NO: 531762 - protein, 9 aa, Mycobacterium
NPATLTDPA

SEQ ID NO: 531763 - protein, 6 aa, Mycobacterium
NPATMG

SEQ ID NO: 531764 - protein, 13 aa, Mycobacterium
NPATPRPTNGPRA

SEQ ID NO: 531765 - protein, 18 aa, Mycobacterium
NPATQLRPRDPDPDSPAA

SEQ ID NO: 531766 - protein, 7 aa, Mycobacterium
NPATVTG

SEQ ID NO: 531767 - protein, 7 aa, Mycobacterium
NPAVPQD

SEQ ID NO: 531768 - protein, 6 aa, Mycobacterium
NPAVRD

SEQ ID NO: 531769 - protein, 7 aa, Mycobacterium
NPAVRTE

SEQ ID NO: 531770 - protein, 10 aa, Mycobacterium
NPAYGSDRQS

SEQ ID NO: 531771 - protein, 13 aa, Mycobacterium
NPCSRRTAPPMGK

SEQ ID NO: 531772 - protein, 20 aa, Mycobacterium
NPCSRRTAPPMGTQKPYVAT

SEQ ID NO: 531773 - protein, 5 aa, Mycobacterium
NPDAA

SEQ ID NO: 531774 - protein, 7 aa, Mycobacterium
NPDADLR

SEQ ID NO: 531775 - protein, 12 aa, Mycobacterium
NPDALADGGYRL

SEQ ID NO: 531776 - protein, 9 aa, Mycobacterium
NPDAPKHKG

SEQ ID NO: 531777 - protein, 17 aa, Mycobacterium
NPDAPLYADPQTTAQLG

SEQ ID NO: 531778 - protein, 9 aa, Mycobacterium
NPDAPTRDQ

SEQ ID NO: 531779 - protein, 7 aa, Mycobacterium
NPDARRA

SEQ ID NO: 531780 - protein, 8 aa, Mycobacterium
NPDATAEA

SEQ ID NO: 531781 - protein, 9 aa, Mycobacterium
NPDATRATL

SEQ ID NO: 531782 - protein, 13 aa, Mycobacterium
NPDAVPGQKAAKT

SEQ ID NO: 531783 - protein, 5 aa, Mycobacterium
NPDAW

SEQ ID NO: 531784 - protein, 15 aa, Mycobacterium
NPDCPAKIDDGRATS

SEQ ID NO: 531785 - protein, 9 aa, Mycobacterium
NPDCPKPRT

SEQ ID NO: 531786 - protein, 14 aa, Mycobacterium
NPDCTAKVDDGRGS

SEQ ID NO: 531787 - protein, 13 aa, Mycobacterium
NPDDEVNGRPHGM

SEQ ID NO: 531788 - protein, 6 aa, Mycobacterium
NPDDLD

SEQ ID NO: 531789 - protein, 8 aa, Mycobacterium
NPDDPGTA

SEQ ID NO: 531790 - protein, 9 aa, Mycobacterium
NPDDPGTSI

SEQ ID NO: 531791 - protein, 6 aa, Mycobacterium
NPDDSF

SEQ ID NO: 531792 - protein, 6 aa, Mycobacterium
NPDEAV

SEQ ID NO: 531793 - protein, 6 aa, Mycobacterium
NPDEDL

SEQ ID NO: 531794 - protein, 9 aa, Mycobacterium
NPDEDLSTG

SEQ ID NO: 531795 - protein, 10 aa, Mycobacterium
NPDENGDWRR

SEQ ID NO: 531796 - protein, 6 aa, Mycobacterium
NPDENS

SEQ ID NO: 531797 - protein, 5 aa, Mycobacterium
NPDEW

SEQ ID NO: 531798 - protein, 4 aa, Mycobacterium
NPDF

SEQ ID NO: 531799 - protein, 6 aa, Mycobacterium
NPDFSP

SEQ ID NO: 531800 - protein, 8 aa, Mycobacterium
NPDFTPGE

SEQ ID NO: 531801 - protein, 6 aa, Mycobacterium
NPDGEA

SEQ ID NO: 531802 - protein, 5 aa, Mycobacterium
NPDGF

SEQ ID NO: 531803 - protein, 5 aa, Mycobacterium
NPDGG

SEQ ID NO: 531804 - protein, 9 aa, Mycobacterium
NPDGKSRRE

SEQ ID NO: 531805 - protein, 9 aa, Mycobacterium
NPDGPPPAK

SEQ ID NO: 531806 - protein, 5 aa, Mycobacterium
NPDGS

SEQ ID NO: 531807 - protein, 8 aa, Mycobacterium
NPDGSDTW

SEQ ID NO: 531808 - protein, 8 aa, Mycobacterium
NPDGSPQA

SEQ ID NO: 531809 - protein, 8 aa, Mycobacterium
NPDGSPQV

SEQ ID NO: 531810 - protein, 15 aa, Mycobacterium
NPDGSSQLSRTTPDI

SEQ ID NO: 531811 - protein, 14 aa, Mycobacterium
NPDGTGGDLKRSNR

SEQ ID NO: 531812 - protein, 6 aa, Mycobacterium
NPDGTQ

SEQ ID NO: 531813 - protein, 22 aa, Mycobacterium
NPDGTQRIEDTGPYGRERQRTL

SEQ ID NO: 531814 - protein, 4 aa, Mycobacterium
NPDH

SEQ ID NO: 531815 - protein, 18 aa, Mycobacterium
NPDHAGDVAATGAEPVTA

SEQ ID NO: 531816 - protein, 14 aa, Mycobacterium
NPDHARPHPESTTA

SEQ ID NO: 531817 - protein, 18 aa, Mycobacterium
NPDHRDDIAATGATPVQA

SEQ ID NO: 531818 - protein, 16 aa, Mycobacterium
NPDHSDDVAATGATPV

SEQ ID NO: 531819 - protein, 5 aa, Mycobacterium
NPDHV

SEQ ID NO: 531820 - protein, 4 aa, Mycobacterium
NPDK

SEQ ID NO: 531821 - protein, 5 aa, Mycobacterium
NPDKF

SEQ ID NO: 531822 - protein, 12 aa, Mycobacterium
NPDKFSGTPLRE

SEQ ID NO: 531823 - protein, 16 aa, Mycobacterium
NPDKFTGSPLGTAVRR

SEQ ID NO: 531824 - protein, 6 aa, Mycobacterium
NPDKLA

SEQ ID NO: 531825 - protein, 15 aa, Mycobacterium
NPDKLAALDGPRVIT

SEQ ID NO: 531826 - protein, 5 aa, Mycobacterium
NPDLP

SEQ ID NO: 531827 - protein, 14 aa, Mycobacterium
NPDLTGLQQQADSY

SEQ ID NO: 531828 - protein, 6 aa, Mycobacterium
NPDMAD

SEQ ID NO: 531829 - protein, 7 aa, Mycobacterium
NPDMADE

SEQ ID NO: 531830 - protein, 12 aa, Mycobacterium
NPDNPNQPPYSP

SEQ ID NO: 531831 - protein, 9 aa, Mycobacterium
NPDPANDTV

SEQ ID NO: 531832 - protein, 12 aa, Mycobacterium
NPDPARSEEDLE

SEQ ID NO: 531833 - protein, 10 aa, Mycobacterium
NPDPDVPGTC

SEQ ID NO: 531834 - protein, 6 aa, Mycobacterium
NPDPEI

SEQ ID NO: 531835 - protein, 12 aa, Mycobacterium
NPDPEIHPDAAR

SEQ ID NO: 531836 - protein, 13 aa, Mycobacterium
NPDPEIHPDAARK

SEQ ID NO: 531837 - protein, 5 aa, Mycobacterium
NPDPM

SEQ ID NO: 531838 - protein, 5 aa, Mycobacterium
NPDPW

SEQ ID NO: 531839 - protein, 5 aa, Mycobacterium
NPDQA

SEQ ID NO: 531840 - protein, 5 aa, Mycobacterium
NPDQL

SEQ ID NO: 531841 - protein, 6 aa, Mycobacterium
NPDQLG

SEQ ID NO: 531842 - protein, 7 aa, Mycobacterium
NPDQLTP

SEQ ID NO: 531843 - protein, 6 aa, Mycobacterium
NPDRLA

SEQ ID NO: 531844 - protein, 19 aa, Mycobacterium
NPDRPETIHPDDEASARRM

SEQ ID NO: 531845 - protein, 10 aa, Mycobacterium
NPDRRHGAER

SEQ ID NO: 531846 - protein, 6 aa, Mycobacterium
NPDRSE

SEQ ID NO: 531847 - protein, 16 aa, Mycobacterium
NPDRTGGNSHCQAPAI

SEQ ID NO: 531848 - protein, 8 aa, Mycobacterium
NPDRVPPE

SEQ ID NO: 531849 - protein, 9 aa, Mycobacterium
NPDSALDPR

SEQ ID NO: 531850 - protein, 5 aa, Mycobacterium
NPDSF

SEQ ID NO: 531851 - protein, 9 aa, Mycobacterium
NPDSIEDKN

SEQ ID NO: 531852 - protein, 6 aa, Mycobacterium
NPDSIT

SEQ ID NO: 531853 - protein, 10 aa, Mycobacterium
NPDTDLSTGR

SEQ ID NO: 531854 - protein, 30 aa, Mycobacterium
NPDTKTASTSESENPAIPSPKPKSGAPLRN

SEQ ID NO: 531855 - protein, 4 aa, Mycobacterium
NPDV

SEQ ID NO: 531856 - protein, 12 aa, Mycobacterium
NPDVRSTSELTG

SEQ ID NO: 531857 - protein, 18 aa, Mycobacterium
NPDVTGPSAEGPLPATGS

SEQ ID NO: 531858 - protein, 8 aa, Mycobacterium
NPDWSRTQ

SEQ ID NO: 531859 - protein, 7 aa, Mycobacterium
NPDYARN

SEQ ID NO: 531860 - protein, 4 aa, Mycobacterium
NPEA

SEQ ID NO: 531861 - protein, 6 aa, Mycobacterium
NPEAAN

SEQ ID NO: 531862 - protein, 8 aa, Mycobacterium
NPEAGPLH

SEQ ID NO: 531863 - protein, 7 aa, Mycobacterium
NPEAHTH

SEQ ID NO: 531864 - protein, 6 aa, Mycobacterium
NPEALA

SEQ ID NO: 531865 - protein, 11 aa, Mycobacterium
NPEANKEARKF

SEQ ID NO: 531866 - protein, 14 aa, Mycobacterium
NPEARDRVAAKRSE

SEQ ID NO: 531867 - protein, 9 aa, Mycobacterium
NPEATAATL

SEQ ID NO: 531868 - protein, 12 aa, Mycobacterium
NPEATAATLTPD

SEQ ID NO: 531869 - protein, 8 aa, Mycobacterium
NPEATADA

SEQ ID NO: 531870 - protein, 14 aa, Mycobacterium
NPEATQSPAGMPRG

SEQ ID NO: 531871 - protein, 7 aa, Mycobacterium
NPECAPA

SEQ ID NO: 531872 - protein, 9 aa, Mycobacterium
NPECPKPRT

SEQ ID NO: 531873 - protein, 5 aa, Mycobacterium
NPECT

SEQ ID NO: 531874 - protein, 7 aa, Mycobacterium
NPEDEQK

SEQ ID NO: 531875 - protein, 9 aa, Mycobacterium
NPEDPRGAV

SEQ ID NO: 531876 - protein, 6 aa, Mycobacterium
NPEEFS

SEQ ID NO: 531877 - protein, 4 aa, Mycobacterium
NPEF

SEQ ID NO: 531878 - protein, 5 aa, Mycobacterium
NPEFT

SEQ ID NO: 531879 - protein, 7 aa, Mycobacterium
NPEGFDP

SEQ ID NO: 531880 - protein, 8 aa, Mycobacterium
NPEGPLDD

SEQ ID NO: 531881 - protein, 21 aa, Mycobacterium
NPEGSLVGKQPPANPAPARPL

SEQ ID NO: 531882 - protein, 4 aa, Mycobacterium
NPEH

SEQ ID NO: 531883 - protein, 4 aa, Mycobacterium
NPEI

SEQ ID NO: 531884 - protein, 10 aa, Mycobacterium
NPEIEEGKGF

SEQ ID NO: 531885 - protein, 8 aa, Mycobacterium
NPEKGNAA

SEQ ID NO: 531886 - protein, 5 aa, Mycobacterium
NPELR

SEQ ID NO: 531887 - protein, 8 aa, Mycobacterium
NPENERRM

SEQ ID NO: 531888 - protein, 6 aa, Mycobacterium
NPENGY

SEQ ID NO: 531889 - protein, 10 aa, Mycobacterium
NPENPDAAGW

SEQ ID NO: 531890 - protein, 14 aa, Mycobacterium
NPENWTKTYPGSAH

SEQ ID NO: 531891 - protein, 5 aa, Mycobacterium
NPEPA

SEQ ID NO: 531892 - protein, 65 aa, Mycobacterium
NPEPAQSAPADNQQVATAPPPEPVRPAAEPVRPATKPAGAAGAGNGSPAAAPTKAAAPPPAEGDE

SEQ ID NO: 531893 - protein, 5 aa, Mycobacterium
NPEPE

SEQ ID NO: 531894 - protein, 10 aa, Mycobacterium
NPEPPARYPS

SEQ ID NO: 531895 - protein, 7 aa, Mycobacterium
NPEPPEC

SEQ ID NO: 531896 - protein, 35 aa, Mycobacterium
NPEPTGEPPSSAPATGDGQPAASAPQAKPAPAAQP

SEQ ID NO: 531897 - protein, 10 aa, Mycobacterium
NPEPTPLSGS

SEQ ID NO: 531898 - protein, 15 aa, Mycobacterium
NPEPTPLSSSATVTL

SEQ ID NO: 531899 - protein, 8 aa, Mycobacterium
NPEPTSGL

SEQ ID NO: 531900 - protein, 5 aa, Mycobacterium
NPEPV

SEQ ID NO: 531901 - protein, 4 aa, Mycobacterium
NPEQ

SEQ ID NO: 531902 - protein, 11 aa, Mycobacterium
NPERHQELDGS

SEQ ID NO: 531903 - protein, 6 aa, Mycobacterium
NPERIT

SEQ ID NO: 531904 - protein, 9 aa, Mycobacterium
NPERRQVGT

SEQ ID NO: 531905 - protein, 10 aa, Mycobacterium
NPERRQVGTQ

SEQ ID NO: 531906 - protein, 23 aa, Mycobacterium
NPERTPLSDSATVSLRETASEAL

SEQ ID NO: 531907 - protein, 12 aa, Mycobacterium
NPESARHDDPEH

SEQ ID NO: 531908 - protein, 6 aa, Mycobacterium
NPESIT

SEQ ID NO: 531909 - protein, 6 aa, Mycobacterium
NPESLT

SEQ ID NO: 531910 - protein, 10 aa, Mycobacterium
NPESPDDAGW

SEQ ID NO: 531911 - protein, 17 aa, Mycobacterium
NPESREPLSPYGTSNAA

SEQ ID NO: 531912 - protein, 8 aa, Mycobacterium
NPESRTYD

SEQ ID NO: 531913 - protein, 76 aa, Mycobacterium
NPESTQEATEPAVEKPAVAPAKPAAAPAKPAPAPAPAKPAAGPPAAGNGSPAAAPSAKPAAAPAKAPAPPPAEGDE

SEQ ID NO: 531914 - protein, 6 aa, Mycobacterium
NPETGE

SEQ ID NO: 531915 - protein, 9 aa, Mycobacterium
NPETGHEQM

SEQ ID NO: 531916 - protein, 5 aa, Mycobacterium
NPETT

SEQ ID NO: 531917 - protein, 10 aa, Mycobacterium
NPEVEVPADP

SEQ ID NO: 531918 - protein, 9 aa, Mycobacterium
NPEVTLQDG

SEQ ID NO: 531919 - protein, 8 aa, Mycobacterium
NPEWNAPD

SEQ ID NO: 531920 - protein, 8 aa, Mycobacterium
NPEWQAPD

SEQ ID NO: 531921 - protein, 20 aa, Mycobacterium
NPEWQERAREESARLGDGPL

SEQ ID NO: 531922 - protein, 21 aa, Mycobacterium
NPEWQERAREESARLGDGPLD

SEQ ID NO: 531923 - protein, 71 aa, Mycobacterium
NPEYGDGGAGGNGGNGSSGGDGGSGGTGGRSGAGIYNKGGTGGVGGDGGNGTNGAGGKGGSGGNGGRGADA

SEQ ID NO: 531924 - protein, 8 aa, Mycobacterium
NPEYPDQT

SEQ ID NO: 531925 - protein, 6 aa, Mycobacterium
NPEYPP

SEQ ID NO: 531926 - protein, 18 aa, Mycobacterium
NPFAGGAEQIPGGGSGIQ

SEQ ID NO: 531927 - protein, 6 aa, Mycobacterium
NPFDDE

SEQ ID NO: 531928 - protein, 9 aa, Mycobacterium
NPFNTPAAE

SEQ ID NO: 531929 - protein, 6 aa, Mycobacterium
NPFPPL

SEQ ID NO: 531930 - protein, 6 aa, Mycobacterium
NPFPRT

SEQ ID NO: 531931 - protein, 7 aa, Mycobacterium
NPFSGKG

SEQ ID NO: 531932 - protein, 4 aa, Mycobacterium
NPFT

SEQ ID NO: 531933 - protein, 6 aa, Mycobacterium
NPFTGA

SEQ ID NO: 531934 - protein, 4 aa, Mycobacterium
NPFV

SEQ ID NO: 531935 - protein, 7 aa, Mycobacterium
NPGAAAH

SEQ ID NO: 531936 - protein, 9 aa, Mycobacterium
NPGAAMPDD

SEQ ID NO: 531937 - protein, 6 aa, Mycobacterium
NPGADV

SEQ ID NO: 531938 - protein, 6 aa, Mycobacterium
NPGARA

SEQ ID NO: 531939 - protein, 19 aa, Mycobacterium
NPGARQEQADTIAEWASKR

SEQ ID NO: 531940 - protein, 4 aa, Mycobacterium
NPGD

SEQ ID NO: 531941 - protein, 21 aa, Mycobacterium
NPGDDSLTGSIRGNRGRTYTT

SEQ ID NO: 531942 - protein, 11 aa, Mycobacterium
NPGDGPHAYTA

SEQ ID NO: 531943 - protein, 6 aa, Mycobacterium
NPGDID

SEQ ID NO: 531944 - protein, 7 aa, Mycobacterium
NPGDLER

SEQ ID NO: 531945 - protein, 10 aa, Mycobacterium
NPGDPTPTVG

SEQ ID NO: 531946 - protein, 7 aa, Mycobacterium
NPGDPWA

SEQ ID NO: 531947 - protein, 10 aa, Mycobacterium
NPGDSPEQKL

SEQ ID NO: 531948 - protein, 6 aa, Mycobacterium
NPGDSV

SEQ ID NO: 531949 - protein, 9 aa, Mycobacterium
NPGDTYART

SEQ ID NO: 531950 - protein, 15 aa, Mycobacterium
NPGDVLADEGPGAAR

SEQ ID NO: 531951 - protein, 7 aa, Mycobacterium
NPGDVTA

SEQ ID NO: 531952 - protein, 11 aa, Mycobacterium
NPGEAKNTYGT

SEQ ID NO: 531953 - protein, 6 aa, Mycobacterium
NPGEIT

SEQ ID NO: 531954 - protein, 5 aa, Mycobacterium
NPGEL

SEQ ID NO: 531955 - protein, 9 aa, Mycobacterium
NPGENYART

SEQ ID NO: 531956 - protein, 8 aa, Mycobacterium
NPGESKTA

SEQ ID NO: 531957 - protein, 11 aa, Mycobacterium
NPGESREEAEL

SEQ ID NO: 531958 - protein, 11 aa, Mycobacterium
NPGEVAAGTIP

SEQ ID NO: 531959 - protein, 9 aa, Mycobacterium
NPGEVADGA

SEQ ID NO: 531960 - protein, 4 aa, Mycobacterium
NPGF

SEQ ID NO: 531961 - protein, 7 aa, Mycobacterium
NPGFDHG

SEQ ID NO: 531962 - protein, 8 aa, Mycobacterium
NPGFDPGN

SEQ ID NO: 531963 - protein, 11 aa, Mycobacterium
NPGFNDPRQPE

SEQ ID NO: 531964 - protein, 6 aa, Mycobacterium
NPGGAG

SEQ ID NO: 531965 - protein, 8 aa, Mycobacterium
NPGGGYPD

SEQ ID NO: 531966 - protein, 11 aa, Mycobacterium
NPGGPDERTHI

SEQ ID NO: 531967 - protein, 9 aa, Mycobacterium
NPGGPGGSA

SEQ ID NO: 531968 - protein, 9 aa, Mycobacterium
NPGGPGISG

SEQ ID NO: 531969 - protein, 20 aa, Mycobacterium
NPGGRALGTPPTTATAGAHA

SEQ ID NO: 531970 - protein, 15 aa, Mycobacterium
NPGGTNEEFAKGNLK

SEQ ID NO: 531971 - protein, 5 aa, Mycobacterium
NPGGY

SEQ ID NO: 531972 - protein, 17 aa, Mycobacterium
NPGGYGNNGWASVACAV

SEQ ID NO: 531973 - protein, 6 aa, Mycobacterium
NPGHDV

SEQ ID NO: 531974 - protein, 8 aa, Mycobacterium
NPGHGGSL

SEQ ID NO: 531975 - protein, 8 aa, Mycobacterium
NPGHPAPA

SEQ ID NO: 531976 - protein, 5 aa, Mycobacterium
NPGHV

SEQ ID NO: 531977 - protein, 4 aa, Mycobacterium
NPGI

SEQ ID NO: 531978 - protein, 14 aa, Mycobacterium
NPGIEADSPGGPTM

SEQ ID NO: 531979 - protein, 15 aa, Mycobacterium
NPGISAAEAAADLGV

SEQ ID NO: 531980 - protein, 7 aa, Mycobacterium
NPGITEQ

SEQ ID NO: 531981 - protein, 5 aa, Mycobacterium
NPGKA

SEQ ID NO: 531982 - protein, 13 aa, Mycobacterium
NPGKDDDGNPIDY

SEQ ID NO: 531983 - protein, 14 aa, Mycobacterium
NPGKDDDGNPIDYA

SEQ ID NO: 531984 - protein, 10 aa, Mycobacterium
NPGKDDEGNI

SEQ ID NO: 531985 - protein, 18 aa, Mycobacterium
NPGKGDDGNPIDYSSTSM

SEQ ID NO: 531986 - protein, 8 aa, Mycobacterium
NPGKGGSI

SEQ ID NO: 531987 - protein, 11 aa, Mycobacterium
NPGKRTSGTGP

SEQ ID NO: 531988 - protein, 5 aa, Mycobacterium
NPGLA

SEQ ID NO: 531989 - protein, 17 aa, Mycobacterium
NPGLGQAEANAAAWEQG

SEQ ID NO: 531990 - protein, 6 aa, Mycobacterium
NPGLQQ

SEQ ID NO: 531991 - protein, 18 aa, Mycobacterium
NPGNRFDTPLSSTGAFAG

SEQ ID NO: 531992 - protein, 12 aa, Mycobacterium
NPGNRFNTPLST

SEQ ID NO: 531993 - protein, 17 aa, Mycobacterium
NPGNYNTGLANSGDVNT

SEQ ID NO: 531994 - protein, 18 aa, Mycobacterium
NPGNYNTGLANSGDVNTG

SEQ ID NO: 531995 - protein, 5 aa, Mycobacterium
NPGPE

SEQ ID NO: 531996 - protein, 8 aa, Mycobacterium
NPGPEETP

SEQ ID NO: 531997 - protein, 5 aa, Mycobacterium
NPGPF

SEQ ID NO: 531998 - protein, 7 aa, Mycobacterium
NPGPGDT

SEQ ID NO: 531999 - protein, 7 aa, Mycobacterium
NPGPGWG

SEQ ID NO: 532000 - protein, 5 aa, Mycobacterium
NPGPH

SEQ ID NO: 532001 - protein, 9 aa, Mycobacterium
NPGPPTGLG

SEQ ID NO: 532002 - protein, 9 aa, Mycobacterium
NPGPQYATT

SEQ ID NO: 532003 - protein, 11 aa, Mycobacterium
NPGPSAEELRQ

SEQ ID NO: 532004 - protein, 7 aa, Mycobacterium
NPGPTDT

SEQ ID NO: 532005 - protein, 9 aa, Mycobacterium
NPGPTYAKT

SEQ ID NO: 532006 - protein, 7 aa, Mycobacterium
NPGPVAA

SEQ ID NO: 532007 - protein, 7 aa, Mycobacterium
NPGPVQT

SEQ ID NO: 532008 - protein, 8 aa, Mycobacterium
NPGQGGTI

SEQ ID NO: 532009 - protein, 9 aa, Mycobacterium
NPGQSDERV

SEQ ID NO: 532010 - protein, 15 aa, Mycobacterium
NPGQSRDEREQDDLQ

SEQ ID NO: 532011 - protein, 12 aa, Mycobacterium
NPGQSVDPKADG

SEQ ID NO: 532012 - protein, 18 aa, Mycobacterium
NPGQTRTAMSDGGQPPEA

SEQ ID NO: 532013 - protein, 6 aa, Mycobacterium
NPGREV

SEQ ID NO: 532014 - protein, 6 aa, Mycobacterium
NPGRRG

SEQ ID NO: 532015 - protein, 9 aa, Mycobacterium
NPGRSSYQA

SEQ ID NO: 532016 - protein, 5 aa, Mycobacterium
NPGRY

SEQ ID NO: 532017 - protein, 4 aa, Mycobacterium
NPGS

SEQ ID NO: 532018 - protein, 6 aa, Mycobacterium
NPGSDG

SEQ ID NO: 532019 - protein, 9 aa, Mycobacterium
NPGSDPVAA

SEQ ID NO: 532020 - protein, 9 aa, Mycobacterium
NPGTALPAE

SEQ ID NO: 532021 - protein, 8 aa, Mycobacterium
NPGTEATA

SEQ ID NO: 532022 - protein, 11 aa, Mycobacterium
NPGTGEAARKL

SEQ ID NO: 532023 - protein, 7 aa, Mycobacterium
NPGTGFE

SEQ ID NO: 532024 - protein, 5 aa, Mycobacterium
NPGTS

SEQ ID NO: 532025 - protein, 6 aa, Mycobacterium
NPGTSL

SEQ ID NO: 532026 - protein, 9 aa, Mycobacterium
NPGTTSQER

SEQ ID NO: 532027 - protein, 11 aa, Mycobacterium
NPGTVDAQGVA

SEQ ID NO: 532028 - protein, 4 aa, Mycobacterium
NPGV

SEQ ID NO: 532029 - protein, 5 aa, Mycobacterium
NPGVA

SEQ ID NO: 532030 - protein, 6 aa, Mycobacterium
NPGVAK

SEQ ID NO: 532031 - protein, 7 aa, Mycobacterium
NPGVDKS

SEQ ID NO: 532032 - protein, 5 aa, Mycobacterium
NPGVG

SEQ ID NO: 532033 - protein, 6 aa, Mycobacterium
NPGVPG

SEQ ID NO: 532034 - protein, 6 aa, Mycobacterium
NPGVRD

SEQ ID NO: 532035 - protein, 12 aa, Mycobacterium
NPGVTSEFPEPT

SEQ ID NO: 532036 - protein, 4 aa, Mycobacterium
NPGY

SEQ ID NO: 532037 - protein, 6 aa, Mycobacterium
NPGYAA

SEQ ID NO: 532038 - protein, 7 aa, Mycobacterium
NPHADTE

SEQ ID NO: 532039 - protein, 5 aa, Mycobacterium
NPHDP

SEQ ID NO: 532040 - protein, 5 aa, Mycobacterium
NPHGD

SEQ ID NO: 532041 - protein, 6 aa, Mycobacterium
NPHGDR

SEQ ID NO: 532042 - protein, 5 aa, Mycobacterium
NPHGV

SEQ ID NO: 532043 - protein, 13 aa, Mycobacterium
NPHHPEPEAHAAQ

SEQ ID NO: 532044 - protein, 8 aa, Mycobacterium
NPHPPTEA

SEQ ID NO: 532045 - protein, 4 aa, Mycobacterium
NPHQ

SEQ ID NO: 532046 - protein, 13 aa, Mycobacterium
NPHRARKPRSVET

SEQ ID NO: 532047 - protein, 12 aa, Mycobacterium
NPHRPKPTDLDG

SEQ ID NO: 532048 - protein, 13 aa, Mycobacterium
NPHRPRPSDLDGL

SEQ ID NO: 532049 - protein, 4 aa, Mycobacterium
NPHT

SEQ ID NO: 532050 - protein, 5 aa, Mycobacterium
NPHTG

SEQ ID NO: 532051 - protein, 7 aa, Mycobacterium
NPIAEKS

SEQ ID NO: 532052 - protein, 6 aa, Mycobacterium
NPIENE

SEQ ID NO: 532053 - protein, 5 aa, Mycobacterium
NPIEQ

SEQ ID NO: 532054 - protein, 14 aa, Mycobacterium
NPIPATQAPTTHRN

SEQ ID NO: 532055 - protein, 10 aa, Mycobacterium
NPIPPATLPD

SEQ ID NO: 532056 - protein, 4 aa, Mycobacterium
NPIS

SEQ ID NO: 532057 - protein, 10 aa, Mycobacterium
NPITGDNEPF

SEQ ID NO: 532058 - protein, 7 aa, Mycobacterium
NPITPEE

SEQ ID NO: 532059 - protein, 6 aa, Mycobacterium
NPKADV

SEQ ID NO: 532060 - protein, 5 aa, Mycobacterium
NPKAQ

SEQ ID NO: 532061 - protein, 8 aa, Mycobacterium
NPKATAEA

SEQ ID NO: 532062 - protein, 8 aa, Mycobacterium
NPKAVASE

SEQ ID NO: 532063 - protein, 5 aa, Mycobacterium
NPKCS

SEQ ID NO: 532064 - protein, 5 aa, Mycobacterium
NPKDG

SEQ ID NO: 532065 - protein, 10 aa, Mycobacterium
NPKEANDSRC

SEQ ID NO: 532066 - protein, 5 aa, Mycobacterium
NPKEI

SEQ ID NO: 532067 - protein, 8 aa, Mycobacterium
NPKGTVQA

SEQ ID NO: 532068 - protein, 14 aa, Mycobacterium
NPKHERTKAFLSKV

SEQ ID NO: 532069 - protein, 14 aa, Mycobacterium
NPKHPRLQDFLSKV

SEQ ID NO: 532070 - protein, 12 aa, Mycobacterium
NPKIEGNETVDG

SEQ ID NO: 532071 - protein, 5 aa, Mycobacterium
NPKNL

SEQ ID NO: 532072 - protein, 4 aa, Mycobacterium
NPKP

SEQ ID NO: 532073 - protein, 13 aa, Mycobacterium
NPKPAAQAAAPAV

SEQ ID NO: 532074 - protein, 5 aa, Mycobacterium
NPKPC

SEQ ID NO: 532075 - protein, 8 aa, Mycobacterium
NPKPGDEF

SEQ ID NO: 532076 - protein, 10 aa, Mycobacterium
NPKQPDSNRI

SEQ ID NO: 532077 - protein, 14 aa, Mycobacterium
NPKSAAAAAAPAVD

SEQ ID NO: 532078 - protein, 16 aa, Mycobacterium
NPKSERAKDFLGKILG

SEQ ID NO: 532079 - protein, 16 aa, Mycobacterium
NPKSERAKDFLGKILH

SEQ ID NO: 532080 - protein, 15 aa, Mycobacterium
NPKSGRWNPDASARA

SEQ ID NO: 532081 - protein, 6 aa, Mycobacterium
NPKTAR

SEQ ID NO: 532082 - protein, 7 aa, Mycobacterium
NPKVASD

SEQ ID NO: 532083 - protein, 5 aa, Mycobacterium
NPKVG

SEQ ID NO: 532084 - protein, 10 aa, Mycobacterium
NPKVTFQTRS

SEQ ID NO: 532085 - protein, 4 aa, Mycobacterium
NPLA

SEQ ID NO: 532086 - protein, 11 aa, Mycobacterium
NPLADADSKIR

SEQ ID NO: 532087 - protein, 6 aa, Mycobacterium
NPLDDP

SEQ ID NO: 532088 - protein, 6 aa, Mycobacterium
NPLEDP

SEQ ID NO: 532089 - protein, 6 aa, Mycobacterium
NPLEGE

SEQ ID NO: 532090 - protein, 8 aa, Mycobacterium
NPLEPTRS

SEQ ID NO: 532091 - protein, 8 aa, Mycobacterium
NPLETDEL

SEQ ID NO: 532092 - protein, 6 aa, Mycobacterium
NPLGGT

SEQ ID NO: 532093 - protein, 6 aa, Mycobacterium
NPLGTA

SEQ ID NO: 532094 - protein, 8 aa, Mycobacterium
NPLGTDAP

SEQ ID NO: 532095 - protein, 21 aa, Mycobacterium
NPLGTDAPEHELHDRRVLTGG

SEQ ID NO: 532096 - protein, 10 aa, Mycobacterium
NPLGTEAPDH

SEQ ID NO: 532097 - protein, 6 aa, Mycobacterium
NPLPGG

SEQ ID NO: 532098 - protein, 7 aa, Mycobacterium
NPLPGNG

SEQ ID NO: 532099 - protein, 5 aa, Mycobacterium
NPLPR

SEQ ID NO: 532100 - protein, 6 aa, Mycobacterium
NPLQPD

SEQ ID NO: 532101 - protein, 4 aa, Mycobacterium
NPLR

SEQ ID NO: 532102 - protein, 13 aa, Mycobacterium
NPLRGQNNVQGSC

SEQ ID NO: 532103 - protein, 6 aa, Mycobacterium
NPLSDS

SEQ ID NO: 532104 - protein, 8 aa, Mycobacterium
NPLSGHGA

SEQ ID NO: 532105 - protein, 6 aa, Mycobacterium
NPLSSD

SEQ ID NO: 532106 - protein, 8 aa, Mycobacterium
NPLTGEQT

SEQ ID NO: 532107 - protein, 33 aa, Mycobacterium
NPLTGPSAVTNPAGIAGQAAAVGQAAGSVPQTG

SEQ ID NO: 532108 - protein, 6 aa, Mycobacterium
NPLTPE

SEQ ID NO: 532109 - protein, 6 aa, Mycobacterium
NPLTSL

SEQ ID NO: 532110 - protein, 7 aa, Mycobacterium
NPMGTEQ

SEQ ID NO: 532111 - protein, 4 aa, Mycobacterium
NPNA

SEQ ID NO: 532112 - protein, 8 aa, Mycobacterium
NPNAPPKL

SEQ ID NO: 532113 - protein, 10 aa, Mycobacterium
NPNAPTGKET

SEQ ID NO: 532114 - protein, 4 aa, Mycobacterium
NPNE

SEQ ID NO: 532115 - protein, 5 aa, Mycobacterium
NPNGI

SEQ ID NO: 532116 - protein, 12 aa, Mycobacterium
NPNGSTNVGDTV

SEQ ID NO: 532117 - protein, 9 aa, Mycobacterium
NPNLANNTE

SEQ ID NO: 532118 - protein, 9 aa, Mycobacterium
NPNNPTGDS

SEQ ID NO: 532119 - protein, 6 aa, Mycobacterium
NPNPAV

SEQ ID NO: 532120 - protein, 8 aa, Mycobacterium
NPNPELPV

SEQ ID NO: 532121 - protein, 8 aa, Mycobacterium
NPNPGLPV

SEQ ID NO: 532122 - protein, 12 aa, Mycobacterium
NPNPYTGSPQGI

SEQ ID NO: 532123 - protein, 8 aa, Mycobacterium
NPNRPNGG

SEQ ID NO: 532124 - protein, 8 aa, Mycobacterium
NPNRRARQ

SEQ ID NO: 532125 - protein, 6 aa, Mycobacterium
NPNSPW

SEQ ID NO: 532126 - protein, 5 aa, Mycobacterium
NPNTG

SEQ ID NO: 532127 - protein, 14 aa, Mycobacterium
NPNWSRTFPKGREV

SEQ ID NO: 532128 - protein, 4 aa, Mycobacterium
NPNY

SEQ ID NO: 532129 - protein, 9 aa, Mycobacterium
NPPADDSSA

SEQ ID NO: 532130 - protein, 6 aa, Mycobacterium
NPPADL

SEQ ID NO: 532131 - protein, 7 aa, Mycobacterium
NPPADRG

SEQ ID NO: 532132 - protein, 25 aa, Mycobacterium
NPPAELAEGARRAAASCPALAIKIE

SEQ ID NO: 532133 - protein, 25 aa, Mycobacterium
NPPAGQPQGQTTSAMNAAGVMSAVT

SEQ ID NO: 532134 - protein, 8 aa, Mycobacterium
NPPAGSQQ

SEQ ID NO: 532135 - protein, 18 aa, Mycobacterium
NPPALLTPGTRVQFREVT

SEQ ID NO: 532136 - protein, 7 aa, Mycobacterium
NPPAPFE

SEQ ID NO: 532137 - protein, 16 aa, Mycobacterium
NPPAVTGDAAADRDAF

SEQ ID NO: 532138 - protein, 6 aa, Mycobacterium
NPPAWY

SEQ ID NO: 532139 - protein, 10 aa, Mycobacterium
NPPDPAQDSL

SEQ ID NO: 532140 - protein, 6 aa, Mycobacterium
NPPDRP

SEQ ID NO: 532141 - protein, 7 aa, Mycobacterium
NPPDRPW

SEQ ID NO: 532142 - protein, 9 aa, Mycobacterium
NPPDVSGLG

SEQ ID NO: 532143 - protein, 11 aa, Mycobacterium
NPPEASAPGSL

SEQ ID NO: 532144 - protein, 12 aa, Mycobacterium
NPPEPLELPGPM

SEQ ID NO: 532145 - protein, 7 aa, Mycobacterium
NPPERLN

SEQ ID NO: 532146 - protein, 7 aa, Mycobacterium
NPPERLT

SEQ ID NO: 532147 - protein, 11 aa, Mycobacterium
NPPEVGAPGSL

SEQ ID NO: 532148 - protein, 4 aa, Mycobacterium
NPPF

SEQ ID NO: 532149 - protein, 5 aa, Mycobacterium
NPPFD

SEQ ID NO: 532150 - protein, 8 aa, Mycobacterium
NPPFGRKS

SEQ ID NO: 532151 - protein, 14 aa, Mycobacterium
NPPGAVSAVTGDGS

SEQ ID NO: 532152 - protein, 10 aa, Mycobacterium
NPPGNPKASF

SEQ ID NO: 532153 - protein, 17 aa, Mycobacterium
NPPGPAYGDTISGTNLA

SEQ ID NO: 532154 - protein, 18 aa, Mycobacterium
NPPGPAYGDTISGTNLAG

SEQ ID NO: 532155 - protein, 9 aa, Mycobacterium
NPPGPRSEN

SEQ ID NO: 532156 - protein, 7 aa, Mycobacterium
NPPGSGL

SEQ ID NO: 532157 - protein, 17 aa, Mycobacterium
NPPGSQARRARGPRALG

SEQ ID NO: 532158 - protein, 15 aa, Mycobacterium
NPPGSRAGGPRALQS

SEQ ID NO: 532159 - protein, 10 aa, Mycobacterium
NPPGSTASGW

SEQ ID NO: 532160 - protein, 10 aa, Mycobacterium
NPPGSTATGL

SEQ ID NO: 532161 - protein, 13 aa, Mycobacterium
NPPGTAPSQATGL

SEQ ID NO: 532162 - protein, 13 aa, Mycobacterium
NPPGTSGERAEDD

SEQ ID NO: 532163 - protein, 6 aa, Mycobacterium
NPPGTV

SEQ ID NO: 532164 - protein, 4 aa, Mycobacterium
NPPI

SEQ ID NO: 532165 - protein, 9 aa, Mycobacterium
NPPIDKRDR

SEQ ID NO: 532166 - protein, 4 aa, Mycobacterium
NPPL

SEQ ID NO: 532167 - protein, 8 aa, Mycobacterium
NPPLREAS

SEQ ID NO: 532168 - protein, 12 aa, Mycobacterium
NPPLRRPSGPKA

SEQ ID NO: 532169 - protein, 15 aa, Mycobacterium
NPPNEQQPRPAVPEQ

SEQ ID NO: 532170 - protein, 7 aa, Mycobacterium
NPPPPLS

SEQ ID NO: 532171 - protein, 8 aa, Mycobacterium
NPPPRPDR

SEQ ID NO: 532172 - protein, 7 aa, Mycobacterium
NPPPYDE

SEQ ID NO: 532173 - protein, 6 aa, Mycobacterium
NPPQRL

SEQ ID NO: 532174 - protein, 6 aa, Mycobacterium
NPPRAL

SEQ ID NO: 532175 - protein, 10 aa, Mycobacterium
NPPRSPSRNH

SEQ ID NO: 532176 - protein, 15 aa, Mycobacterium
NPPSMQRGDINDPKL

SEQ ID NO: 532177 - protein, 7 aa, Mycobacterium
NPPSPSQ

SEQ ID NO: 532178 - protein, 6 aa, Mycobacterium
NPPSRD

SEQ ID NO: 532179 - protein, 7 aa, Mycobacterium
NPPSSAR

SEQ ID NO: 532180 - protein, 6 aa, Mycobacterium
NPPSTV

SEQ ID NO: 532181 - protein, 4 aa, Mycobacterium
NPPT

SEQ ID NO: 532182 - protein, 18 aa, Mycobacterium
NPPTDTTPATNPPTPTPH

SEQ ID NO: 532183 - protein, 18 aa, Mycobacterium
NPPTDTTPATNPTTPTPH

SEQ ID NO: 532184 - protein, 15 aa, Mycobacterium
NPPTRAAAKISPDGT

SEQ ID NO: 532185 - protein, 14 aa, Mycobacterium
NPPTSDEISQLKPG

SEQ ID NO: 532186 - protein, 14 aa, Mycobacterium
NPPVGVGRQFSCEP

SEQ ID NO: 532187 - protein, 12 aa, Mycobacterium
NPPVQPVAGPPG

SEQ ID NO: 532188 - protein, 7 aa, Mycobacterium
NPPYDPW

SEQ ID NO: 532189 - protein, 16 aa, Mycobacterium
NPPYLGKKQRTAAQTE

SEQ ID NO: 532190 - protein, 6 aa, Mycobacterium
NPPYVP

SEQ ID NO: 532191 - protein, 5 aa, Mycobacterium
NPPYY

SEQ ID NO: 532192 - protein, 5 aa, Mycobacterium
NPQAA

SEQ ID NO: 532193 - protein, 5 aa, Mycobacterium
NPQAL

SEQ ID NO: 532194 - protein, 15 aa, Mycobacterium
NPQAPTVRSTVVRGA

SEQ ID NO: 532195 - protein, 7 aa, Mycobacterium
NPQAQRA

SEQ ID NO: 532196 - protein, 7 aa, Mycobacterium
NPQARTY

SEQ ID NO: 532197 - protein, 4 aa, Mycobacterium
NPQE

SEQ ID NO: 532198 - protein, 10 aa, Mycobacterium
NPQETDLSDR

SEQ ID NO: 532199 - protein, 12 aa, Mycobacterium
NPQFEAPRHVNR

SEQ ID NO: 532200 - protein, 5 aa, Mycobacterium
NPQGR

SEQ ID NO: 532201 - protein, 6 aa, Mycobacterium
NPQGSV

SEQ ID NO: 532202 - protein, 6 aa, Mycobacterium
NPQGTV

SEQ ID NO: 532203 - protein, 4 aa, Mycobacterium
NPQH

SEQ ID NO: 532204 - protein, 6 aa, Mycobacterium
NPQHEY

SEQ ID NO: 532205 - protein, 10 aa, Mycobacterium
NPQHGLSGTT

SEQ ID NO: 532206 - protein, 9 aa, Mycobacterium
NPQHPPEHP

SEQ ID NO: 532207 - protein, 7 aa, Mycobacterium
NPQHPYT

SEQ ID NO: 532208 - protein, 8 aa, Mycobacterium
NPQIDEAA

SEQ ID NO: 532209 - protein, 5 aa, Mycobacterium
NPQLT

SEQ ID NO: 532210 - protein, 6 aa, Mycobacterium
NPQPEA

SEQ ID NO: 532211 - protein, 9 aa, Mycobacterium
NPQQPDTSC

SEQ ID NO: 532212 - protein, 6 aa, Mycobacterium
NPQQRQ

SEQ ID NO: 532213 - protein, 4 aa, Mycobacterium
NPQR

SEQ ID NO: 532214 - protein, 7 aa, Mycobacterium
NPQRDLP

SEQ ID NO: 532215 - protein, 11 aa, Mycobacterium
NPQRSAGRDGL

SEQ ID NO: 532216 - protein, 6 aa, Mycobacterium
NPQRTQ

SEQ ID NO: 532217 - protein, 8 aa, Mycobacterium
NPQSAEGI

SEQ ID NO: 532218 - protein, 8 aa, Mycobacterium
NPQSPINT

SEQ ID NO: 532219 - protein, 10 aa, Mycobacterium
NPQSSTPEEV

SEQ ID NO: 532220 - protein, 16 aa, Mycobacterium
NPQTDRAKDFLGKILH

SEQ ID NO: 532221 - protein, 9 aa, Mycobacterium
NPQTGAGTI

SEQ ID NO: 532222 - protein, 11 aa, Mycobacterium
NPQVESYRGRN

SEQ ID NO: 532223 - protein, 6 aa, Mycobacterium
NPQVQA

SEQ ID NO: 532224 - protein, 8 aa, Mycobacterium
NPQWQSPD

SEQ ID NO: 532225 - protein, 5 aa, Mycobacterium
NPQWV

SEQ ID NO: 532226 - protein, 4 aa, Mycobacterium
NPRA

SEQ ID NO: 532227 - protein, 5 aa, Mycobacterium
NPRAD

SEQ ID NO: 532228 - protein, 5 aa, Mycobacterium
NPRAE

SEQ ID NO: 532229 - protein, 5 aa, Mycobacterium
NPRAL

SEQ ID NO: 532230 - protein, 5 aa, Mycobacterium
NPRAR

SEQ ID NO: 532231 - protein, 6 aa, Mycobacterium
NPRATS

SEQ ID NO: 532232 - protein, 4 aa, Mycobacterium
NPRD

SEQ ID NO: 532233 - protein, 7 aa, Mycobacterium
NPRDDYT

SEQ ID NO: 532234 - protein, 4 aa, Mycobacterium
NPRE

SEQ ID NO: 532235 - protein, 5 aa, Mycobacterium
NPREA

SEQ ID NO: 532236 - protein, 15 aa, Mycobacterium
NPRFPSPLSKAGNVR

SEQ ID NO: 532237 - protein, 6 aa, Mycobacterium
NPRFSP

SEQ ID NO: 532238 - protein, 5 aa, Mycobacterium
NPRGA

SEQ ID NO: 532239 - protein, 18 aa, Mycobacterium
NPRGGPLPPVDAGGYAGA

SEQ ID NO: 532240 - protein, 20 aa, Mycobacterium
NPRGGVPDMPTPATPPDPTW

SEQ ID NO: 532241 - protein, 5 aa, Mycobacterium
NPRGL

SEQ ID NO: 532242 - protein, 13 aa, Mycobacterium
NPRHGASGPGRDI

SEQ ID NO: 532243 - protein, 13 aa, Mycobacterium
NPRIAGPAPWKPM

SEQ ID NO: 532244 - protein, 10 aa, Mycobacterium
NPRIEESAAT

SEQ ID NO: 532245 - protein, 25 aa, Mycobacterium
NPRKPRGKHDAETENHRGELLAQLG

SEQ ID NO: 532246 - protein, 8 aa, Mycobacterium
NPRLGDRI

SEQ ID NO: 532247 - protein, 6 aa, Mycobacterium
NPRLGP

SEQ ID NO: 532248 - protein, 5 aa, Mycobacterium
NPRLQ

SEQ ID NO: 532249 - protein, 15 aa, Mycobacterium
NPRMRTDATPGQGDD

SEQ ID NO: 532250 - protein, 10 aa, Mycobacterium
NPRNAGRLDQ

SEQ ID NO: 532251 - protein, 6 aa, Mycobacterium
NPRPED

SEQ ID NO: 532252 - protein, 6 aa, Mycobacterium
NPRPSE

SEQ ID NO: 532253 - protein, 11 aa, Mycobacterium
NPRPTNPAGKM

SEQ ID NO: 532254 - protein, 4 aa, Mycobacterium
NPRQ

SEQ ID NO: 532255 - protein, 12 aa, Mycobacterium
NPRQPRGITTRR

SEQ ID NO: 532256 - protein, 9 aa, Mycobacterium
NPRRAPKLA

SEQ ID NO: 532257 - protein, 9 aa, Mycobacterium
NPRRASGRE

SEQ ID NO: 532258 - protein, 8 aa, Mycobacterium
NPRRGADS

SEQ ID NO: 532259 - protein, 19 aa, Mycobacterium
NPRRGHSALGGRPPVSRLA

SEQ ID NO: 532260 - protein, 15 aa, Mycobacterium
NPRRQLSSLSDLDRL

SEQ ID NO: 532261 - protein, 4 aa, Mycobacterium
NPRS

SEQ ID NO: 532262 - protein, 9 aa, Mycobacterium
NPRSDVSYT

SEQ ID NO: 532263 - protein, 4 aa, Mycobacterium
NPRT

SEQ ID NO: 532264 - protein, 9 aa, Mycobacterium
NPRTAGPVP

SEQ ID NO: 532265 - protein, 7 aa, Mycobacterium
NPRTGDR

SEQ ID NO: 532266 - protein, 19 aa, Mycobacterium
NPRTGKERELSAARAARSK

SEQ ID NO: 532267 - protein, 12 aa, Mycobacterium
NPRTGKTAATVS

SEQ ID NO: 532268 - protein, 8 aa, Mycobacterium
NPRTGKTV

SEQ ID NO: 532269 - protein, 6 aa, Mycobacterium
NPRTGY

SEQ ID NO: 532270 - protein, 4 aa, Mycobacterium
NPRV

SEQ ID NO: 532271 - protein, 8 aa, Mycobacterium
NPRVDSPW

SEQ ID NO: 532272 - protein, 5 aa, Mycobacterium
NPRVG

SEQ ID NO: 532273 - protein, 8 aa, Mycobacterium
NPSAAARR

SEQ ID NO: 532274 - protein, 12 aa, Mycobacterium
NPSAAGGSEPTF

SEQ ID NO: 532275 - protein, 9 aa, Mycobacterium
NPSAPPPSL

SEQ ID NO: 532276 - protein, 7 aa, Mycobacterium
NPSAPVS

SEQ ID NO: 532277 - protein, 9 aa, Mycobacterium
NPSASQGSM

SEQ ID NO: 532278 - protein, 6 aa, Mycobacterium
NPSDQQ

SEQ ID NO: 532279 - protein, 9 aa, Mycobacterium
NPSDWPEGK

SEQ ID NO: 532280 - protein, 7 aa, Mycobacterium
NPSEAKT

SEQ ID NO: 532281 - protein, 8 aa, Mycobacterium
NPSEAKTV

SEQ ID NO: 532282 - protein, 5 aa, Mycobacterium
NPSGA

SEQ ID NO: 532283 - protein, 15 aa, Mycobacterium
NPSGGPLAGAPATAT

SEQ ID NO: 532284 - protein, 20 aa, Mycobacterium
NPSGLPWQEPDEASESLGRT

SEQ ID NO: 532285 - protein, 8 aa, Mycobacterium
NPSGPAAV

SEQ ID NO: 532286 - protein, 12 aa, Mycobacterium
NPSGQRPAETAL

SEQ ID NO: 532287 - protein, 7 aa, Mycobacterium
NPSGRLA

SEQ ID NO: 532288 - protein, 12 aa, Mycobacterium
NPSGTSAGRSAV

SEQ ID NO: 532289 - protein, 5 aa, Mycobacterium
NPSGV

SEQ ID NO: 532290 - protein, 5 aa, Mycobacterium
NPSIT

SEQ ID NO: 532291 - protein, 8 aa, Mycobacterium
NPSNSLQK

SEQ ID NO: 532292 - protein, 14 aa, Mycobacterium
NPSNWTKTYPGSAH

SEQ ID NO: 532293 - protein, 8 aa, Mycobacterium
NPSPAAAL

SEQ ID NO: 532294 - protein, 11 aa, Mycobacterium
NPSPASPARRA

SEQ ID NO: 532295 - protein, 6 aa, Mycobacterium
NPSPEE

SEQ ID NO: 532296 - protein, 5 aa, Mycobacterium
NPSPH

SEQ ID NO: 532297 - protein, 24 aa, Mycobacterium
NPSPKRQFSSDQARARVDRGPGRW

SEQ ID NO: 532298 - protein, 16 aa, Mycobacterium
NPSPPDVTVSVHQGRQ

SEQ ID NO: 532299 - protein, 17 aa, Mycobacterium
NPSPPEVTVSVRRGEEP

SEQ ID NO: 532300 - protein, 11 aa, Mycobacterium
NPSPPPPTAYG

SEQ ID NO: 532301 - protein, 13 aa, Mycobacterium
NPSPSGALDRRHP

SEQ ID NO: 532302 - protein, 4 aa, Mycobacterium
NPSQ

SEQ ID NO: 532303 - protein, 17 aa, Mycobacterium
NPSQLEKVRENPDLTAG

SEQ ID NO: 532304 - protein, 9 aa, Mycobacterium
NPSRDISSL

SEQ ID NO: 532305 - protein, 12 aa, Mycobacterium
NPSRGDERTKAD

SEQ ID NO: 532306 - protein, 11 aa, Mycobacterium
NPSRGDERTRA

SEQ ID NO: 532307 - protein, 10 aa, Mycobacterium
NPSRLGDEEL

SEQ ID NO: 532308 - protein, 10 aa, Mycobacterium
NPSRLSDDEL

SEQ ID NO: 532309 - protein, 10 aa, Mycobacterium
NPSRLSEDDL

SEQ ID NO: 532310 - protein, 7 aa, Mycobacterium
NPSRRNE

SEQ ID NO: 532311 - protein, 15 aa, Mycobacterium
NPSSYDGDLTDQGAA

SEQ ID NO: 532312 - protein, 9 aa, Mycobacterium
NPSTGEVQS

SEQ ID NO: 532313 - protein, 7 aa, Mycobacterium
NPSTVGP

SEQ ID NO: 532314 - protein, 6 aa, Mycobacterium
NPSVAV

SEQ ID NO: 532315 - protein, 31 aa, Mycobacterium
NPSVEETSTGAPGAVKVGTPKGSVTQLSDGS

SEQ ID NO: 532316 - protein, 12 aa, Mycobacterium
NPSVPDDDVTPE

SEQ ID NO: 532317 - protein, 25 aa, Mycobacterium
NPSVTVQDGDTVIEGTAREVEGDER

SEQ ID NO: 532318 - protein, 4 aa, Mycobacterium
NPTA

SEQ ID NO: 532319 - protein, 7 aa, Mycobacterium
NPTAGEA

SEQ ID NO: 532320 - protein, 12 aa, Mycobacterium
NPTAGLKSQPVD

SEQ ID NO: 532321 - protein, 8 aa, Mycobacterium
NPTAPKEH

SEQ ID NO: 532322 - protein, 8 aa, Mycobacterium
NPTATAEA

SEQ ID NO: 532323 - protein, 4 aa, Mycobacterium
NPTD

SEQ ID NO: 532324 - protein, 7 aa, Mycobacterium
NPTDGHP

SEQ ID NO: 532325 - protein, 7 aa, Mycobacterium
NPTDKPV

SEQ ID NO: 532326 - protein, 8 aa, Mycobacterium
NPTDPAAF

SEQ ID NO: 532327 - protein, 10 aa, Mycobacterium
NPTDRDQDAE

SEQ ID NO: 532328 - protein, 13 aa, Mycobacterium
NPTFPAPELNNPT

SEQ ID NO: 532329 - protein, 14 aa, Mycobacterium
NPTGASLTPQRRDE

SEQ ID NO: 532330 - protein, 38 aa, Mycobacterium
NPTGATIGDGVATGTITDDDTVVTPGTGGVNSGNPGDA

SEQ ID NO: 532331 - protein, 9 aa, Mycobacterium
NPTGATYST

SEQ ID NO: 532332 - protein, 8 aa, Mycobacterium
NPTGGAVD

SEQ ID NO: 532333 - protein, 6 aa, Mycobacterium
NPTGGN

SEQ ID NO: 532334 - protein, 11 aa, Mycobacterium
NPTGNRPAEAA

SEQ ID NO: 532335 - protein, 6 aa, Mycobacterium
NPTGPG

SEQ ID NO: 532336 - protein, 7 aa, Mycobacterium
NPTGPRP

SEQ ID NO: 532337 - protein, 11 aa, Mycobacterium
NPTGQRPAEAA

SEQ ID NO: 532338 - protein, 12 aa, Mycobacterium
NPTGQRPAETAL

SEQ ID NO: 532339 - protein, 12 aa, Mycobacterium
NPTGRMATPQEV

SEQ ID NO: 532340 - protein, 8 aa, Mycobacterium
NPTGSTYS

SEQ ID NO: 532341 - protein, 12 aa, Mycobacterium
NPTGTADHGPDL

SEQ ID NO: 532342 - protein, 6 aa, Mycobacterium
NPTGTF

SEQ ID NO: 532343 - protein, 12 aa, Mycobacterium
NPTGVVPKGPDL

SEQ ID NO: 532344 - protein, 16 aa, Mycobacterium
NPTHERTQRFLHAVLD

SEQ ID NO: 532345 - protein, 7 aa, Mycobacterium
NPTIEGR

SEQ ID NO: 532346 - protein, 11 aa, Mycobacterium
NPTIPQPTRYT

SEQ ID NO: 532347 - protein, 6 aa, Mycobacterium
NPTKKG

SEQ ID NO: 532348 - protein, 5 aa, Mycobacterium
NPTNG

SEQ ID NO: 532349 - protein, 7 aa, Mycobacterium
NPTNPTA

SEQ ID NO: 532350 - protein, 8 aa, Mycobacterium
NPTNPTGV

SEQ ID NO: 532351 - protein, 12 aa, Mycobacterium
NPTNSGAAGSPY

SEQ ID NO: 532352 - protein, 11 aa, Mycobacterium
NPTPGAPDGPW

SEQ ID NO: 532353 - protein, 7 aa, Mycobacterium
NPTPGLT

SEQ ID NO: 532354 - protein, 17 aa, Mycobacterium
NPTPGSEWDASPKAAER

SEQ ID NO: 532355 - protein, 16 aa, Mycobacterium
NPTPGSEWDASPKAVE

SEQ ID NO: 532356 - protein, 18 aa, Mycobacterium
NPTPGSEWDASPKPAERE

SEQ ID NO: 532357 - protein, 16 aa, Mycobacterium
NPTPGSEWDASPKPVE

SEQ ID NO: 532358 - protein, 17 aa, Mycobacterium
NPTPGSQWDASPKPVER

SEQ ID NO: 532359 - protein, 5 aa, Mycobacterium
NPTPQ

SEQ ID NO: 532360 - protein, 24 aa, Mycobacterium
NPTPRGRATSQRDNRETQRAATVV

SEQ ID NO: 532361 - protein, 6 aa, Mycobacterium
NPTPVT

SEQ ID NO: 532362 - protein, 8 aa, Mycobacterium
NPTPVTGQ

SEQ ID NO: 532363 - protein, 6 aa, Mycobacterium
NPTQRE

SEQ ID NO: 532364 - protein, 12 aa, Mycobacterium
NPTQVVPKGPDL

SEQ ID NO: 532365 - protein, 4 aa, Mycobacterium
NPTR

SEQ ID NO: 532366 - protein, 8 aa, Mycobacterium
NPTRGAAE

SEQ ID NO: 532367 - protein, 8 aa, Mycobacterium
NPTRGPAE

SEQ ID NO: 532368 - protein, 6 aa, Mycobacterium
NPTRGS

SEQ ID NO: 532369 - protein, 8 aa, Mycobacterium
NPTRGTAD

SEQ ID NO: 532370 - protein, 5 aa, Mycobacterium
NPTRH

SEQ ID NO: 532371 - protein, 7 aa, Mycobacterium
NPTRPDL

SEQ ID NO: 532372 - protein, 14 aa, Mycobacterium
NPTRRGDALRRDAD

SEQ ID NO: 532373 - protein, 8 aa, Mycobacterium
NPTRRGEA

SEQ ID NO: 532374 - protein, 8 aa, Mycobacterium
NPTRRPSW

SEQ ID NO: 532375 - protein, 5 aa, Mycobacterium
NPTRS

SEQ ID NO: 532376 - protein, 5 aa, Mycobacterium
NPTRV

SEQ ID NO: 532377 - protein, 12 aa, Mycobacterium
NPTSRAEAHPAE

SEQ ID NO: 532378 - protein, 6 aa, Mycobacterium
NPTSRE

SEQ ID NO: 532379 - protein, 8 aa, Mycobacterium
NPTTGCDR

SEQ ID NO: 532380 - protein, 13 aa, Mycobacterium
NPTVKSAINTAAR

SEQ ID NO: 532381 - protein, 12 aa, Mycobacterium
NPTVKSAINTGV

SEQ ID NO: 532382 - protein, 8 aa, Mycobacterium
NPTVKSGI

SEQ ID NO: 532383 - protein, 9 aa, Mycobacterium
NPTVKSGIN

SEQ ID NO: 532384 - protein, 16 aa, Mycobacterium
NPTVTSVAGEYGKTPA

SEQ ID NO: 532385 - protein, 7 aa, Mycobacterium
NPVAKRS

SEQ ID NO: 532386 - protein, 5 aa, Mycobacterium
NPVAR

SEQ ID NO: 532387 - protein, 16 aa, Mycobacterium
NPVATGDGIRAGQRIG

SEQ ID NO: 532388 - protein, 13 aa, Mycobacterium
NPVATPATVAPDA

SEQ ID NO: 532389 - protein, 4 aa, Mycobacterium
NPVD

SEQ ID NO: 532390 - protein, 6 aa, Mycobacterium
NPVDEW

SEQ ID NO: 532391 - protein, 8 aa, Mycobacterium
NPVDPDTL

SEQ ID NO: 532392 - protein, 10 aa, Mycobacterium
NPVDQEGTYA

SEQ ID NO: 532393 - protein, 16 aa, Mycobacterium
NPVDQEGTYPLSEAQT

SEQ ID NO: 532394 - protein, 17 aa, Mycobacterium
NPVDQEGTYPLSEAQTD

SEQ ID NO: 532395 - protein, 7 aa, Mycobacterium
NPVEEWA

SEQ ID NO: 532396 - protein, 26 aa, Mycobacterium
NPVGAGHTITSSARATASGVAESVGA

SEQ ID NO: 532397 - protein, 9 aa, Mycobacterium
NPVGAPEFA

SEQ ID NO: 532398 - protein, 6 aa, Mycobacterium
NPVHPT

SEQ ID NO: 532399 - protein, 5 aa, Mycobacterium
NPVLP

SEQ ID NO: 532400 - protein, 9 aa, Mycobacterium
NPVPEPKPF

SEQ ID NO: 532401 - protein, 5 aa, Mycobacterium
NPVPI

SEQ ID NO: 532402 - protein, 5 aa, Mycobacterium
NPVPL

SEQ ID NO: 532403 - protein, 6 aa, Mycobacterium
NPVPPG

SEQ ID NO: 532404 - protein, 8 aa, Mycobacterium
NPVPPISA

SEQ ID NO: 532405 - protein, 18 aa, Mycobacterium
NPVPWSRPAESDLLPPEL

SEQ ID NO: 532406 - protein, 10 aa, Mycobacterium
NPVRTTGGKI

SEQ ID NO: 532407 - protein, 5 aa, Mycobacterium
NPVRV

SEQ ID NO: 532408 - protein, 7 aa, Mycobacterium
NPVSNPA

SEQ ID NO: 532409 - protein, 4 aa, Mycobacterium
NPVT

SEQ ID NO: 532410 - protein, 13 aa, Mycobacterium
NPVTAHKAGTVTG

SEQ ID NO: 532411 - protein, 12 aa, Mycobacterium
NPVTAHKDGTIT

SEQ ID NO: 532412 - protein, 10 aa, Mycobacterium
NPVTGADEPF

SEQ ID NO: 532413 - protein, 10 aa, Mycobacterium
NPVTGDDEPF

SEQ ID NO: 532414 - protein, 6 aa, Mycobacterium
NPVTGE

SEQ ID NO: 532415 - protein, 5 aa, Mycobacterium
NPVTN

SEQ ID NO: 532416 - protein, 9 aa, Mycobacterium
NPVTPDPFA

SEQ ID NO: 532417 - protein, 18 aa, Mycobacterium
NPWDTEYSAGASSSGSGA

SEQ ID NO: 532418 - protein, 19 aa, Mycobacterium
NPWDTTKTAGGSSGGSAAA

SEQ ID NO: 532419 - protein, 20 aa, Mycobacterium
NPWGSDVTPGGSSGGSAAAV

SEQ ID NO: 532420 - protein, 16 aa, Mycobacterium
NPWHGRPASATLALPP

SEQ ID NO: 532421 - protein, 15 aa, Mycobacterium
NPWRGPPVPYDTPVT

SEQ ID NO: 532422 - protein, 4 aa, Mycobacterium
NPWT

SEQ ID NO: 532423 - protein, 5 aa, Mycobacterium
NPWTY

SEQ ID NO: 532424 - protein, 10 aa, Mycobacterium
NPYADKPRLD

SEQ ID NO: 532425 - protein, 9 aa, Mycobacterium
NPYATGPAR

SEQ ID NO: 532426 - protein, 9 aa, Mycobacterium
NPYDKSDTV

SEQ ID NO: 532427 - protein, 9 aa, Mycobacterium
NPYDVGAEG

SEQ ID NO: 532428 - protein, 4 aa, Mycobacterium
NPYG

SEQ ID NO: 532429 - protein, 11 aa, Mycobacterium
NPYGPPDWQPR

SEQ ID NO: 532430 - protein, 12 aa, Mycobacterium
NPYGPPDWQPRQ

SEQ ID NO: 532431 - protein, 4 aa, Mycobacterium
NPYP

SEQ ID NO: 532432 - protein, 12 aa, Mycobacterium
NPYPETAPADRP

SEQ ID NO: 532433 - protein, 11 aa, Mycobacterium
NPYPETAPAQR

SEQ ID NO: 532434 - protein, 12 aa, Mycobacterium
NPYPETAPPGRP

SEQ ID NO: 532435 - protein, 13 aa, Mycobacterium
NPYPETAPPQRKP

SEQ ID NO: 532436 - protein, 15 aa, Mycobacterium
NPYPLGATYDGAGTN

SEQ ID NO: 532437 - protein, 7 aa, Mycobacterium
NQAAAKG

SEQ ID NO: 532438 - protein, 7 aa, Mycobacterium
NQAAEAA

SEQ ID NO: 532439 - protein, 12 aa, Mycobacterium
NQAALPPPGPRQ

SEQ ID NO: 532440 - protein, 16 aa, Mycobacterium
NQAANKKSALALALNK

SEQ ID NO: 532441 - protein, 16 aa, Mycobacterium
NQAANKKSALAQALNK

SEQ ID NO: 532442 - protein, 16 aa, Mycobacterium
NQAANKKSALARALNK

SEQ ID NO: 532443 - protein, 17 aa, Mycobacterium
NQAANKKSALARALNKL

SEQ ID NO: 532444 - protein, 17 aa, Mycobacterium
NQAANKKSALARTLNKL

SEQ ID NO: 532445 - protein, 16 aa, Mycobacterium
NQAANRKSALARALNK

SEQ ID NO: 532446 - protein, 7 aa, Mycobacterium
NQADEGR

SEQ ID NO: 532447 - protein, 9 aa, Mycobacterium
NQADELKDE

SEQ ID NO: 532448 - protein, 6 aa, Mycobacterium
NQADRD

SEQ ID NO: 532449 - protein, 4 aa, Mycobacterium
NQAE

SEQ ID NO: 532450 - protein, 6 aa, Mycobacterium
NQAERR

SEQ ID NO: 532451 - protein, 5 aa, Mycobacterium
NQAGY

SEQ ID NO: 532452 - protein, 5 aa, Mycobacterium
NQAIG

SEQ ID NO: 532453 - protein, 12 aa, Mycobacterium
NQANGIDPQPLR

SEQ ID NO: 532454 - protein, 10 aa, Mycobacterium
NQANYAASKA

SEQ ID NO: 532455 - protein, 9 aa, Mycobacterium
NQAPERPRQ

SEQ ID NO: 532456 - protein, 7 aa, Mycobacterium
NQAPGTL

SEQ ID NO: 532457 - protein, 14 aa, Mycobacterium
NQAPPLENYNPATS

SEQ ID NO: 532458 - protein, 6 aa, Mycobacterium
NQARPE

SEQ ID NO: 532459 - protein, 11 aa, Mycobacterium
NQASDASGHQQ

SEQ ID NO: 532460 - protein, 6 aa, Mycobacterium
NQASTN

SEQ ID NO: 532461 - protein, 5 aa, Mycobacterium
NQATI

SEQ ID NO: 532462 - protein, 21 aa, Mycobacterium
NQATTAAKDKGNGMKSPSRQA

SEQ ID NO: 532463 - protein, 4 aa, Mycobacterium
NQAV

SEQ ID NO: 532464 - protein, 6 aa, Mycobacterium
NQAVEA

SEQ ID NO: 532465 - protein, 5 aa, Mycobacterium
NQAVS

SEQ ID NO: 532466 - protein, 11 aa, Mycobacterium
NQDAEKAGDWK

SEQ ID NO: 532467 - protein, 18 aa, Mycobacterium
NQDDYNAGNFGAYQASVV

SEQ ID NO: 532468 - protein, 9 aa, Mycobacterium
NQDGQYSLT

SEQ ID NO: 532469 - protein, 5 aa, Mycobacterium
NQDHR

SEQ ID NO: 532470 - protein, 4 aa, Mycobacterium
NQDK

SEQ ID NO: 532471 - protein, 9 aa, Mycobacterium
NQDKHGTAY

SEQ ID NO: 532472 - protein, 4 aa, Mycobacterium
NQDL

SEQ ID NO: 532473 - protein, 6 aa, Mycobacterium
NQDPEI

SEQ ID NO: 532474 - protein, 7 aa, Mycobacterium
NQDSDPR

SEQ ID NO: 532475 - protein, 5 aa, Mycobacterium
NQDSG

SEQ ID NO: 532476 - protein, 7 aa, Mycobacterium
NQDTTFG

SEQ ID NO: 532477 - protein, 6 aa, Mycobacterium
NQDVEL

SEQ ID NO: 532478 - protein, 9 aa, Mycobacterium
NQDVSQRGV

SEQ ID NO: 532479 - protein, 5 aa, Mycobacterium
NQEFG

SEQ ID NO: 532480 - protein, 4 aa, Mycobacterium
NQEL

SEQ ID NO: 532481 - protein, 6 aa, Mycobacterium
NQEQAG

SEQ ID NO: 532482 - protein, 4 aa, Mycobacterium
NQER

SEQ ID NO: 532483 - protein, 6 aa, Mycobacterium
NQESRV

SEQ ID NO: 532484 - protein, 19 aa, Mycobacterium
NQETLEKAAAEVAERTGRR

SEQ ID NO: 532485 - protein, 7 aa, Mycobacterium
NQGAEST

SEQ ID NO: 532486 - protein, 8 aa, Mycobacterium
NQGARTAV

SEQ ID NO: 532487 - protein, 24 aa, Mycobacterium
NQGDIDKQSITGATATATHGTGAR

SEQ ID NO: 532488 - protein, 12 aa, Mycobacterium
NQGDNQAGILGQ

SEQ ID NO: 532489 - protein, 4 aa, Mycobacterium
NQGG

SEQ ID NO: 532490 - protein, 7 aa, Mycobacterium
NQGHTAD

SEQ ID NO: 532491 - protein, 23 aa, Mycobacterium
NQGLATGLGDEGGFAPDVAGTKA

SEQ ID NO: 532492 - protein, 7 aa, Mycobacterium
NQGPDRD

SEQ ID NO: 532493 - protein, 7 aa, Mycobacterium
NQGPDRE

SEQ ID NO: 532494 - protein, 6 aa, Mycobacterium
NQGPVG

SEQ ID NO: 532495 - protein, 8 aa, Mycobacterium
NQGRTSRY

SEQ ID NO: 532496 - protein, 9 aa, Mycobacterium
NQGSTVEQA

SEQ ID NO: 532497 - protein, 7 aa, Mycobacterium
NQGWRGS

SEQ ID NO: 532498 - protein, 6 aa, Mycobacterium
NQGYDD

SEQ ID NO: 532499 - protein, 19 aa, Mycobacterium
NQGYQDLRDGKNIRGVIVH

SEQ ID NO: 532500 - protein, 12 aa, Mycobacterium
NQHARNESEVGG

SEQ ID NO: 532501 - protein, 6 aa, Mycobacterium
NQHAYS

SEQ ID NO: 532502 - protein, 5 aa, Mycobacterium
NQHGP

SEQ ID NO: 532503 - protein, 6 aa, Mycobacterium
NQHGPD

SEQ ID NO: 532504 - protein, 6 aa, Mycobacterium
NQHGPS

SEQ ID NO: 532505 - protein, 7 aa, Mycobacterium
NQHGPSS

SEQ ID NO: 532506 - protein, 6 aa, Mycobacterium
NQHGPT

SEQ ID NO: 532507 - protein, 7 aa, Mycobacterium
NQHGPTS

SEQ ID NO: 532508 - protein, 5 aa, Mycobacterium
NQHQT

SEQ ID NO: 532509 - protein, 6 aa, Mycobacterium
NQHSQI

SEQ ID NO: 532510 - protein, 4 aa, Mycobacterium
NQIE

SEQ ID NO: 532511 - protein, 6 aa, Mycobacterium
NQIGDG

SEQ ID NO: 532512 - protein, 5 aa, Mycobacterium
NQIPA

SEQ ID NO: 532513 - protein, 8 aa, Mycobacterium
NQIPPGMS

SEQ ID NO: 532514 - protein, 12 aa, Mycobacterium
NQIRDGNDNRVH

SEQ ID NO: 532515 - protein, 9 aa, Mycobacterium
NQIRSRGAE

SEQ ID NO: 532516 - protein, 6 aa, Mycobacterium
NQKGGE

SEQ ID NO: 532517 - protein, 12 aa, Mycobacterium
NQKGSDDTPLED

SEQ ID NO: 532518 - protein, 11 aa, Mycobacterium
NQKGSPDTPLE

SEQ ID NO: 532519 - protein, 4 aa, Mycobacterium
NQLE

SEQ ID NO: 532520 - protein, 6 aa, Mycobacterium
NQLKSK

SEQ ID NO: 532521 - protein, 6 aa, Mycobacterium
NQLKTK

SEQ ID NO: 532522 - protein, 4 aa, Mycobacterium
NQLP

SEQ ID NO: 532523 - protein, 7 aa, Mycobacterium
NQLPPGS

SEQ ID NO: 532524 - protein, 5 aa, Mycobacterium
NQLRD

SEQ ID NO: 532525 - protein, 6 aa, Mycobacterium
NQLRES

SEQ ID NO: 532526 - protein, 12 aa, Mycobacterium
NQLSDDADDLEV

SEQ ID NO: 532527 - protein, 10 aa, Mycobacterium
NQLSGGQRQR

SEQ ID NO: 532528 - protein, 13 aa, Mycobacterium
NQLSTGDIDADEA

SEQ ID NO: 532529 - protein, 14 aa, Mycobacterium
NQNANTAMGTAQAG

SEQ ID NO: 532530 - protein, 16 aa, Mycobacterium
NQNDVRGTKAKASLDR

SEQ ID NO: 532531 - protein, 6 aa, Mycobacterium
NQNGTV

SEQ ID NO: 532532 - protein, 5 aa, Mycobacterium
NQNHG

SEQ ID NO: 532533 - protein, 8 aa, Mycobacterium
NQNNQPVS

SEQ ID NO: 532534 - protein, 10 aa, Mycobacterium
NQNPGTTKHG

SEQ ID NO: 532535 - protein, 6 aa, Mycobacterium
NQNPIG

SEQ ID NO: 532536 - protein, 13 aa, Mycobacterium
NQPAAVVKVATAA

SEQ ID NO: 532537 - protein, 17 aa, Mycobacterium
NQPALEEAATRVETYTD

SEQ ID NO: 532538 - protein, 7 aa, Mycobacterium
NQPAWEA

SEQ ID NO: 532539 - protein, 7 aa, Mycobacterium
NQPDATA

SEQ ID NO: 532540 - protein, 6 aa, Mycobacterium
NQPDID

SEQ ID NO: 532541 - protein, 7 aa, Mycobacterium
NQPDVAE

SEQ ID NO: 532542 - protein, 6 aa, Mycobacterium
NQPEGT

SEQ ID NO: 532543 - protein, 11 aa, Mycobacterium
NQPFLPPPGPR

SEQ ID NO: 532544 - protein, 6 aa, Mycobacterium
NQPGGA

SEQ ID NO: 532545 - protein, 10 aa, Mycobacterium
NQPGLATDAH

SEQ ID NO: 532546 - protein, 6 aa, Mycobacterium
NQPGTV

SEQ ID NO: 532547 - protein, 6 aa, Mycobacterium
NQPHGA

SEQ ID NO: 532548 - protein, 14 aa, Mycobacterium
NQPHGPRPSTVYPQ

SEQ ID NO: 532549 - protein, 5 aa, Mycobacterium
NQPNR

SEQ ID NO: 532550 - protein, 4 aa, Mycobacterium
NQPP

SEQ ID NO: 532551 - protein, 7 aa, Mycobacterium
NQPPLPA

SEQ ID NO: 532552 - protein, 30 aa, Mycobacterium
NQPRADTGHDGSSGLQGETGSSGTKRVRER

SEQ ID NO: 532553 - protein, 7 aa, Mycobacterium
NQPRPDN

SEQ ID NO: 532554 - protein, 9 aa, Mycobacterium
NQPRREMAE

SEQ ID NO: 532555 - protein, 13 aa, Mycobacterium
NQPSAAIESPGGD

SEQ ID NO: 532556 - protein, 20 aa, Mycobacterium
NQPSIPRTEAQRRSRLEGTT

SEQ ID NO: 532557 - protein, 5 aa, Mycobacterium
NQPSM

SEQ ID NO: 532558 - protein, 16 aa, Mycobacterium
NQPSQTVDPAGPLTQA

SEQ ID NO: 532559 - protein, 5 aa, Mycobacterium
NQPSV

SEQ ID NO: 532560 - protein, 5 aa, Mycobacterium
NQPTQ

SEQ ID NO: 532561 - protein, 14 aa, Mycobacterium
NQPTSVDAADGLRA

SEQ ID NO: 532562 - protein, 14 aa, Mycobacterium
NQPTSVDAADGLRT

SEQ ID NO: 532563 - protein, 14 aa, Mycobacterium
NQPTSVDSADGLRA

SEQ ID NO: 532564 - protein, 7 aa, Mycobacterium
NQPTTGM

SEQ ID NO: 532565 - protein, 19 aa, Mycobacterium
NQPTTRITSVGSTNFSGGL

SEQ ID NO: 532566 - protein, 7 aa, Mycobacterium
NQPWSES

SEQ ID NO: 532567 - protein, 9 aa, Mycobacterium
NQQAPLTSS

SEQ ID NO: 532568 - protein, 11 aa, Mycobacterium
NQQFDSAEGSM

SEQ ID NO: 532569 - protein, 11 aa, Mycobacterium
NQQQLSAPQEI

SEQ ID NO: 532570 - protein, 8 aa, Mycobacterium
NQQTGRAA

SEQ ID NO: 532571 - protein, 18 aa, Mycobacterium
NQQTREPLAPYGGSSPAM

SEQ ID NO: 532572 - protein, 7 aa, Mycobacterium
NQQVGAE

SEQ ID NO: 532573 - protein, 8 aa, Mycobacterium
NQRELSAS

SEQ ID NO: 532574 - protein, 5 aa, Mycobacterium
NQRET

SEQ ID NO: 532575 - protein, 4 aa, Mycobacterium
NQRF

SEQ ID NO: 532576 - protein, 6 aa, Mycobacterium
NQRGGL

SEQ ID NO: 532577 - protein, 6 aa, Mycobacterium
NQRGNE

SEQ ID NO: 532578 - protein, 13 aa, Mycobacterium
NQRGYSPGARPVG

SEQ ID NO: 532579 - protein, 13 aa, Mycobacterium
NQRHRANGGRQAG

SEQ ID NO: 532580 - protein, 9 aa, Mycobacterium
NQRNGGYTV

SEQ ID NO: 532581 - protein, 8 aa, Mycobacterium
NQRRPSQE

SEQ ID NO: 532582 - protein, 15 aa, Mycobacterium
NQRRREAAATETAAA

SEQ ID NO: 532583 - protein, 10 aa, Mycobacterium
NQRSEELNTA

SEQ ID NO: 532584 - protein, 9 aa, Mycobacterium
NQRSEGVDR

SEQ ID NO: 532585 - protein, 10 aa, Mycobacterium
NQRTEDPSVE

SEQ ID NO: 532586 - protein, 9 aa, Mycobacterium
NQRVEPDEI

SEQ ID NO: 532587 - protein, 5 aa, Mycobacterium
NQSAV

SEQ ID NO: 532588 - protein, 31 aa, Mycobacterium
NQSCPPPTTTRRPPRGDRRNRQKTCHATDFP

SEQ ID NO: 532589 - protein, 11 aa, Mycobacterium
NQSFDAAEGSM

SEQ ID NO: 532590 - protein, 12 aa, Mycobacterium
NQSFDQGRHTEA

SEQ ID NO: 532591 - protein, 10 aa, Mycobacterium
NQSGPAAANG

SEQ ID NO: 532592 - protein, 8 aa, Mycobacterium
NQSGPGLG

SEQ ID NO: 532593 - protein, 8 aa, Mycobacterium
NQSGREDL

SEQ ID NO: 532594 - protein, 6 aa, Mycobacterium
NQSGRT

SEQ ID NO: 532595 - protein, 7 aa, Mycobacterium
NQSGSFG

SEQ ID NO: 532596 - protein, 6 aa, Mycobacterium
NQSGVA

SEQ ID NO: 532597 - protein, 7 aa, Mycobacterium
NQSHTAT

SEQ ID NO: 532598 - protein, 6 aa, Mycobacterium
NQSLGT

SEQ ID NO: 532599 - protein, 16 aa, Mycobacterium
NQSPAAYSKAAAEAGF

SEQ ID NO: 532600 - protein, 10 aa, Mycobacterium
NQSPEEGRRR

SEQ ID NO: 532601 - protein, 16 aa, Mycobacterium
NQSPTAYSKAAAEAGF

SEQ ID NO: 532602 - protein, 16 aa, Mycobacterium
NQSPTAYSKAAAQAGF

SEQ ID NO: 532603 - protein, 17 aa, Mycobacterium
NQSPTAYSRAAAEAGFE

SEQ ID NO: 532604 - protein, 13 aa, Mycobacterium
NQSPYPPGGPIPR

SEQ ID NO: 532605 - protein, 5 aa, Mycobacterium
NQSVV

SEQ ID NO: 532606 - protein, 23 aa, Mycobacterium
NQTDKEWRTAADGPHKRSRASDL

SEQ ID NO: 532607 - protein, 10 aa, Mycobacterium
NQTEEAGRRR

SEQ ID NO: 532608 - protein, 7 aa, Mycobacterium
NQTEGSA

SEQ ID NO: 532609 - protein, 5 aa, Mycobacterium
NQTEL

SEQ ID NO: 532610 - protein, 6 aa, Mycobacterium
NQTGAQ

SEQ ID NO: 532611 - protein, 9 aa, Mycobacterium
NQTGETEDV

SEQ ID NO: 532612 - protein, 8 aa, Mycobacterium
NQTGLPPE

SEQ ID NO: 532613 - protein, 5 aa, Mycobacterium
NQTGS

SEQ ID NO: 532614 - protein, 7 aa, Mycobacterium
NQTGSTA

SEQ ID NO: 532615 - protein, 9 aa, Mycobacterium
NQTGSTPIL

SEQ ID NO: 532616 - protein, 7 aa, Mycobacterium
NQTGTTA

SEQ ID NO: 532617 - protein, 9 aa, Mycobacterium
NQTGTTPIL

SEQ ID NO: 532618 - protein, 5 aa, Mycobacterium
NQTID

SEQ ID NO: 532619 - protein, 15 aa, Mycobacterium
NQTLAEGDRPEPALR

SEQ ID NO: 532620 - protein, 5 aa, Mycobacterium
NQTNT

SEQ ID NO: 532621 - protein, 9 aa, Mycobacterium
NQTPASARE

SEQ ID NO: 532622 - protein, 8 aa, Mycobacterium
NQTPDGAA

SEQ ID NO: 532623 - protein, 7 aa, Mycobacterium
NQTPESA

SEQ ID NO: 532624 - protein, 8 aa, Mycobacterium
NQTPESAR

SEQ ID NO: 532625 - protein, 9 aa, Mycobacterium
NQTPESARE

SEQ ID NO: 532626 - protein, 9 aa, Mycobacterium
NQTPSSARD

SEQ ID NO: 532627 - protein, 4 aa, Mycobacterium
NQTQ

SEQ ID NO: 532628 - protein, 7 aa, Mycobacterium
NQTTARA

SEQ ID NO: 532629 - protein, 9 aa, Mycobacterium
NQTTPDLDT

SEQ ID NO: 532630 - protein, 4 aa, Mycobacterium
NQVD

SEQ ID NO: 532631 - protein, 5 aa, Mycobacterium
NQVGG

SEQ ID NO: 532632 - protein, 11 aa, Mycobacterium
NQVKSGVPFTD

SEQ ID NO: 532633 - protein, 5 aa, Mycobacterium
NQVRG

SEQ ID NO: 532634 - protein, 8 aa, Mycobacterium
NQVRPENR

SEQ ID NO: 532635 - protein, 7 aa, Mycobacterium
NQVSARR

SEQ ID NO: 532636 - protein, 5 aa, Mycobacterium
NQVSR

SEQ ID NO: 532637 - protein, 6 aa, Mycobacterium
NQVSRL

SEQ ID NO: 532638 - protein, 4 aa, Mycobacterium
NQWP

SEQ ID NO: 532639 - protein, 4 aa, Mycobacterium
NQYA

SEQ ID NO: 532640 - protein, 17 aa, Mycobacterium
NQYAPPPPYPASDPYEP

SEQ ID NO: 532641 - protein, 13 aa, Mycobacterium
NQYPPGDMSVWNW

SEQ ID NO: 532642 - protein, 7 aa, Mycobacterium
NQYPPGI

SEQ ID NO: 532643 - protein, 7 aa, Mycobacterium
NQYPPGL

SEQ ID NO: 532644 - protein, 8 aa, Mycobacterium
NQYPPGLG

SEQ ID NO: 532645 - protein, 9 aa, Mycobacterium
NQYQSNPPR

SEQ ID NO: 532646 - protein, 5 aa, Mycobacterium
NQYTR

SEQ ID NO: 532647 - protein, 11 aa, Mycobacterium
NRAAASAIDPP

SEQ ID NO: 532648 - protein, 5 aa, Mycobacterium
NRAAD

SEQ ID NO: 532649 - protein, 7 aa, Mycobacterium
NRAAGSL

SEQ ID NO: 532650 - protein, 8 aa, Mycobacterium
NRAAQAAS

SEQ ID NO: 532651 - protein, 11 aa, Mycobacterium
NRAASPSAARA

SEQ ID NO: 532652 - protein, 10 aa, Mycobacterium
NRAASPSTAR

SEQ ID NO: 532653 - protein, 16 aa, Mycobacterium
NRAATATGDKAAALPP

SEQ ID NO: 532654 - protein, 8 aa, Mycobacterium
NRADERWP

SEQ ID NO: 532655 - protein, 7 aa, Mycobacterium
NRADGSP

SEQ ID NO: 532656 - protein, 7 aa, Mycobacterium
NRADNRV

SEQ ID NO: 532657 - protein, 12 aa, Mycobacterium
NRADQRGKARAT

SEQ ID NO: 532658 - protein, 5 aa, Mycobacterium
NRADT

SEQ ID NO: 532659 - protein, 5 aa, Mycobacterium
NRADV

SEQ ID NO: 532660 - protein, 8 aa, Mycobacterium
NRAEAARD

SEQ ID NO: 532661 - protein, 10 aa, Mycobacterium
NRAEGKKHPW

SEQ ID NO: 532662 - protein, 14 aa, Mycobacterium
NRAEPDLKSGRGGL

SEQ ID NO: 532663 - protein, 7 aa, Mycobacterium
NRAEPGS

SEQ ID NO: 532664 - protein, 9 aa, Mycobacterium
NRAEQAYEA

SEQ ID NO: 532665 - protein, 7 aa, Mycobacterium
NRAETQQ

SEQ ID NO: 532666 - protein, 7 aa, Mycobacterium
NRAGAAH

SEQ ID NO: 532667 - protein, 16 aa, Mycobacterium
NRAGATTPAPQRRKPI

SEQ ID NO: 532668 - protein, 7 aa, Mycobacterium
NRAGPLT

SEQ ID NO: 532669 - protein, 9 aa, Mycobacterium
NRAGRDKAR

SEQ ID NO: 532670 - protein, 14 aa, Mycobacterium
NRAGTSTPTPPRRK

SEQ ID NO: 532671 - protein, 5 aa, Mycobacterium
NRAGV

SEQ ID NO: 532672 - protein, 10 aa, Mycobacterium
NRAKRNNPGV

SEQ ID NO: 532673 - protein, 6 aa, Mycobacterium
NRALSA

SEQ ID NO: 532674 - protein, 12 aa, Mycobacterium
NRANAANTESAG

SEQ ID NO: 532675 - protein, 10 aa, Mycobacterium
NRANARSGTV

SEQ ID NO: 532676 - protein, 7 aa, Mycobacterium
NRANPYP

SEQ ID NO: 532677 - protein, 12 aa, Mycobacterium
NRANQRGKLKPA

SEQ ID NO: 532678 - protein, 8 aa, Mycobacterium
NRAPAKVQ

SEQ ID NO: 532679 - protein, 8 aa, Mycobacterium
NRAPARVP

SEQ ID NO: 532680 - protein, 16 aa, Mycobacterium
NRAPDGGHIKDAPAGV

SEQ ID NO: 532681 - protein, 8 aa, Mycobacterium
NRAPGGDV

SEQ ID NO: 532682 - protein, 9 aa, Mycobacterium
NRAPTPSEL

SEQ ID NO: 532683 - protein, 6 aa, Mycobacterium
NRAQTA

SEQ ID NO: 532684 - protein, 17 aa, Mycobacterium
NRARDRLRRESARPAKE

SEQ ID NO: 532685 - protein, 8 aa, Mycobacterium
NRARGEAV

SEQ ID NO: 532686 - protein, 7 aa, Mycobacterium
NRARPAP

SEQ ID NO: 532687 - protein, 18 aa, Mycobacterium
NRARQLAEAAKDTVGAAR

SEQ ID NO: 532688 - protein, 6 aa, Mycobacterium
NRARTL

SEQ ID NO: 532689 - protein, 8 aa, Mycobacterium
NRASGAEI

SEQ ID NO: 532690 - protein, 6 aa, Mycobacterium
NRASTL

SEQ ID NO: 532691 - protein, 6 aa, Mycobacterium
NRATAS

SEQ ID NO: 532692 - protein, 16 aa, Mycobacterium
NRATERYGPSCAGAPP

SEQ ID NO: 532693 - protein, 19 aa, Mycobacterium
NRATLEDQGLRDVADDAAA

SEQ ID NO: 532694 - protein, 11 aa, Mycobacterium
NRATRYSEVDR

SEQ ID NO: 532695 - protein, 11 aa, Mycobacterium
NRAVKEDAAQG

SEQ ID NO: 532696 - protein, 7 aa, Mycobacterium
NRAVPAG

SEQ ID NO: 532697 - protein, 11 aa, Mycobacterium
NRAYSDGDRDG

SEQ ID NO: 532698 - protein, 8 aa, Mycobacterium
NRCEPKDA

SEQ ID NO: 532699 - protein, 7 aa, Mycobacterium
NRCKGGN

SEQ ID NO: 532700 - protein, 8 aa, Mycobacterium
NRCPPTTF

SEQ ID NO: 532701 - protein, 8 aa, Mycobacterium
NRCRSDDT

SEQ ID NO: 532702 - protein, 8 aa, Mycobacterium
NRDAPGNQ

SEQ ID NO: 532703 - protein, 9 aa, Mycobacterium
NRDAPRAPE

SEQ ID NO: 532704 - protein, 12 aa, Mycobacterium
NRDAQGGRLKSA

SEQ ID NO: 532705 - protein, 12 aa, Mycobacterium
NRDAQRGRLKTA

SEQ ID NO: 532706 - protein, 20 aa, Mycobacterium
NRDARKFADPNSFRPDRQNV

SEQ ID NO: 532707 - protein, 5 aa, Mycobacterium
NRDDA

SEQ ID NO: 532708 - protein, 11 aa, Mycobacterium
NRDDEVFPEPD

SEQ ID NO: 532709 - protein, 13 aa, Mycobacterium
NRDDPGDDSGNVT

SEQ ID NO: 532710 - protein, 9 aa, Mycobacterium
NRDDPPYQG

SEQ ID NO: 532711 - protein, 5 aa, Mycobacterium
NRDDR

SEQ ID NO: 532712 - protein, 11 aa, Mycobacterium
NRDDSDEISTN

SEQ ID NO: 532713 - protein, 8 aa, Mycobacterium
NRDDTSAF

SEQ ID NO: 532714 - protein, 5 aa, Mycobacterium
NRDED

SEQ ID NO: 532715 - protein, 6 aa, Mycobacterium
NRDEDV

SEQ ID NO: 532716 - protein, 7 aa, Mycobacterium
NRDEDVF

SEQ ID NO: 532717 - protein, 5 aa, Mycobacterium
NRDEE

SEQ ID NO: 532718 - protein, 7 aa, Mycobacterium
NRDEEKF

SEQ ID NO: 532719 - protein, 6 aa, Mycobacterium
NRDEEV

SEQ ID NO: 532720 - protein, 6 aa, Mycobacterium
NRDEHA

SEQ ID NO: 532721 - protein, 5 aa, Mycobacterium
NRDEK

SEQ ID NO: 532722 - protein, 10 aa, Mycobacterium
NRDERHFDEP

SEQ ID NO: 532723 - protein, 11 aa, Mycobacterium
NRDERRYRDPD

SEQ ID NO: 532724 - protein, 8 aa, Mycobacterium
NRDESKFA

SEQ ID NO: 532725 - protein, 6 aa, Mycobacterium
NRDGAF

SEQ ID NO: 532726 - protein, 10 aa, Mycobacterium
NRDGEHTTTD

SEQ ID NO: 532727 - protein, 9 aa, Mycobacterium
NRDGEIPDA

SEQ ID NO: 532728 - protein, 10 aa, Mycobacterium
NRDGKPVTSA

SEQ ID NO: 532729 - protein, 10 aa, Mycobacterium
NRDGQHTTTD

SEQ ID NO: 532730 - protein, 11 aa, Mycobacterium
NRDGQPVTSAA

SEQ ID NO: 532731 - protein, 12 aa, Mycobacterium
NRDGTDEHSGDD

SEQ ID NO: 532732 - protein, 8 aa, Mycobacterium
NRDGVSVE

SEQ ID NO: 532733 - protein, 6 aa, Mycobacterium
NRDHPE

SEQ ID NO: 532734 - protein, 11 aa, Mycobacterium
NRDHRQFPPDG

SEQ ID NO: 532735 - protein, 10 aa, Mycobacterium
NRDHRRFAPD

SEQ ID NO: 532736 - protein, 11 aa, Mycobacterium
NRDHRRFPPNG

SEQ ID NO: 532737 - protein, 5 aa, Mycobacterium
NRDLA

SEQ ID NO: 532738 - protein, 6 aa, Mycobacterium
NRDLKR

SEQ ID NO: 532739 - protein, 10 aa, Mycobacterium
NRDNTVSASL

SEQ ID NO: 532740 - protein, 11 aa, Mycobacterium
NRDNVADPDGR

SEQ ID NO: 532741 - protein, 5 aa, Mycobacterium
NRDPA

SEQ ID NO: 532742 - protein, 6 aa, Mycobacterium
NRDPAI

SEQ ID NO: 532743 - protein, 6 aa, Mycobacterium
NRDPAQ

SEQ ID NO: 532744 - protein, 8 aa, Mycobacterium
NRDPAQFK

SEQ ID NO: 532745 - protein, 6 aa, Mycobacterium
NRDPAV

SEQ ID NO: 532746 - protein, 12 aa, Mycobacterium
NRDPLGLGAPSR

SEQ ID NO: 532747 - protein, 10 aa, Mycobacterium
NRDPLRYRDP

SEQ ID NO: 532748 - protein, 8 aa, Mycobacterium
NRDPNGDL

SEQ ID NO: 532749 - protein, 5 aa, Mycobacterium
NRDPR

SEQ ID NO: 532750 - protein, 11 aa, Mycobacterium
NRDPRKFPEPD

SEQ ID NO: 532751 - protein, 9 aa, Mycobacterium
NRDPRQFNS

SEQ ID NO: 532752 - protein, 17 aa, Mycobacterium
NRDPRRFDNPDRFDPLR

SEQ ID NO: 532753 - protein, 12 aa, Mycobacterium
NRDPRRFDNPNR

SEQ ID NO: 532754 - protein, 10 aa, Mycobacterium
NRDPRRYHDP

SEQ ID NO: 532755 - protein, 10 aa, Mycobacterium
NRDPRRYTDP

SEQ ID NO: 532756 - protein, 15 aa, Mycobacterium
NRDPRRYTDPDTYDI

SEQ ID NO: 532757 - protein, 14 aa, Mycobacterium
NRDPRRYTDPDTYN

SEQ ID NO: 532758 - protein, 10 aa, Mycobacterium
NRDPSHFDAP

SEQ ID NO: 532759 - protein, 9 aa, Mycobacterium
NRDPSRFEN

SEQ ID NO: 532760 - protein, 7 aa, Mycobacterium
NRDPTHF

SEQ ID NO: 532761 - protein, 6 aa, Mycobacterium
NRDPVQ

SEQ ID NO: 532762 - protein, 25 aa, Mycobacterium
NRDQKTDGDNREQHHTDTGADTGTV

SEQ ID NO: 532763 - protein, 4 aa, Mycobacterium
NRDR

SEQ ID NO: 532764 - protein, 14 aa, Mycobacterium
NRDRDLSPAPELGA

SEQ ID NO: 532765 - protein, 11 aa, Mycobacterium
NRDRSRDPHAD

SEQ ID NO: 532766 - protein, 9 aa, Mycobacterium
NRDRTNDQV

SEQ ID NO: 532767 - protein, 5 aa, Mycobacterium
NRDSH

SEQ ID NO: 532768 - protein, 18 aa, Mycobacterium
NRDSQCPAELRNRRTRAA

SEQ ID NO: 532769 - protein, 5 aa, Mycobacterium
NRDSR

SEQ ID NO: 532770 - protein, 4 aa, Mycobacterium
NRDT

SEQ ID NO: 532771 - protein, 10 aa, Mycobacterium
NRDTAASGRP

SEQ ID NO: 532772 - protein, 10 aa, Mycobacterium
NRDTEDTIGY

SEQ ID NO: 532773 - protein, 9 aa, Mycobacterium
NRDTGRFEN

SEQ ID NO: 532774 - protein, 5 aa, Mycobacterium
NRDTL

SEQ ID NO: 532775 - protein, 12 aa, Mycobacterium
NRDTQRGRLKTA

SEQ ID NO: 532776 - protein, 4 aa, Mycobacterium
NREA

SEQ ID NO: 532777 - protein, 6 aa, Mycobacterium
NREAAE

SEQ ID NO: 532778 - protein, 8 aa, Mycobacterium
NREAAQRA

SEQ ID NO: 532779 - protein, 11 aa, Mycobacterium
NREAEKAGDWK

SEQ ID NO: 532780 - protein, 12 aa, Mycobacterium
NREAQRGRLKPA

SEQ ID NO: 532781 - protein, 8 aa, Mycobacterium
NREDPPYQ

SEQ ID NO: 532782 - protein, 5 aa, Mycobacterium
NREEP

SEQ ID NO: 532783 - protein, 7 aa, Mycobacterium
NREEPRK

SEQ ID NO: 532784 - protein, 10 aa, Mycobacterium
NREGGVGPVA

SEQ ID NO: 532785 - protein, 13 aa, Mycobacterium
NREGKADAKTRQG

SEQ ID NO: 532786 - protein, 8 aa, Mycobacterium
NREGLPEQ

SEQ ID NO: 532787 - protein, 6 aa, Mycobacterium
NREGLS

SEQ ID NO: 532788 - protein, 7 aa, Mycobacterium
NREGLSA

SEQ ID NO: 532789 - protein, 8 aa, Mycobacterium
NREGQPAF

SEQ ID NO: 532790 - protein, 15 aa, Mycobacterium
NREINTRNVKKDDPR

SEQ ID NO: 532791 - protein, 7 aa, Mycobacterium
NRELRPD

SEQ ID NO: 532792 - protein, 7 aa, Mycobacterium
NRELTTA

SEQ ID NO: 532793 - protein, 17 aa, Mycobacterium
NRENGAHPINDSPQVQG

SEQ ID NO: 532794 - protein, 6 aa, Mycobacterium
NREPEL

SEQ ID NO: 532795 - protein, 19 aa, Mycobacterium
NREPLNANEELKKAGNPLD

SEQ ID NO: 532796 - protein, 19 aa, Mycobacterium
NREPLNDTEQIKHDDGPLN

SEQ ID NO: 532797 - protein, 7 aa, Mycobacterium
NREQERM

SEQ ID NO: 532798 - protein, 7 aa, Mycobacterium
NREQPIP

SEQ ID NO: 532799 - protein, 6 aa, Mycobacterium
NRESER

SEQ ID NO: 532800 - protein, 5 aa, Mycobacterium
NRETM

SEQ ID NO: 532801 - protein, 23 aa, Mycobacterium
NRFDGTPADVADDRELMHLYLGG

SEQ ID NO: 532802 - protein, 17 aa, Mycobacterium
NRFSDSGEQPAQPTPFT

SEQ ID NO: 532803 - protein, 4 aa, Mycobacterium
NRGA

SEQ ID NO: 532804 - protein, 7 aa, Mycobacterium
NRGAAPE

SEQ ID NO: 532805 - protein, 10 aa, Mycobacterium
NRGAEAADRP

SEQ ID NO: 532806 - protein, 15 aa, Mycobacterium
NRGAEGEKALATSGS

SEQ ID NO: 532807 - protein, 16 aa, Mycobacterium
NRGAGASDVPKATSAY

SEQ ID NO: 532808 - protein, 13 aa, Mycobacterium
NRGAGKSSNPKSF

SEQ ID NO: 532809 - protein, 19 aa, Mycobacterium
NRGAPSHTQNMGFALEVPD

SEQ ID NO: 532810 - protein, 10 aa, Mycobacterium
NRGAPTPGFG

SEQ ID NO: 532811 - protein, 4 aa, Mycobacterium
NRGD

SEQ ID NO: 532812 - protein, 6 aa, Mycobacterium
NRGDEM

SEQ ID NO: 532813 - protein, 9 aa, Mycobacterium
NRGDLSADD

SEQ ID NO: 532814 - protein, 8 aa, Mycobacterium
NRGDNAGS

SEQ ID NO: 532815 - protein, 5 aa, Mycobacterium
NRGDR

SEQ ID NO: 532816 - protein, 12 aa, Mycobacterium
NRGDRGAASELA

SEQ ID NO: 532817 - protein, 7 aa, Mycobacterium
NRGDRYG

SEQ ID NO: 532818 - protein, 13 aa, Mycobacterium
NRGDSSDDSGGHV

SEQ ID NO: 532819 - protein, 6 aa, Mycobacterium
NRGDWA

SEQ ID NO: 532820 - protein, 4 aa, Mycobacterium
NRGE

SEQ ID NO: 532821 - protein, 4 aa, Mycobacterium
NRGG

SEQ ID NO: 532822 - protein, 11 aa, Mycobacterium
NRGGALAETTY

SEQ ID NO: 532823 - protein, 8 aa, Mycobacterium
NRGGAPWN

SEQ ID NO: 532824 - protein, 7 aa, Mycobacterium
NRGGDAW

SEQ ID NO: 532825 - protein, 8 aa, Mycobacterium
NRGGDRRL

SEQ ID NO: 532826 - protein, 14 aa, Mycobacterium
NRGGEGDKEAARNK

SEQ ID NO: 532827 - protein, 10 aa, Mycobacterium
NRGGEKFSAR

SEQ ID NO: 532828 - protein, 10 aa, Mycobacterium
NRGGEKINAE

SEQ ID NO: 532829 - protein, 5 aa, Mycobacterium
NRGGR

SEQ ID NO: 532830 - protein, 6 aa, Mycobacterium
NRGGRT

SEQ ID NO: 532831 - protein, 10 aa, Mycobacterium
NRGIRPESKF

SEQ ID NO: 532832 - protein, 7 aa, Mycobacterium
NRGKKSI

SEQ ID NO: 532833 - protein, 7 aa, Mycobacterium
NRGKRSI

SEQ ID NO: 532834 - protein, 6 aa, Mycobacterium
NRGLGS

SEQ ID NO: 532835 - protein, 10 aa, Mycobacterium
NRGNPAGRAD

SEQ ID NO: 532836 - protein, 5 aa, Mycobacterium
NRGNR

SEQ ID NO: 532837 - protein, 9 aa, Mycobacterium
NRGPDSGAG

SEQ ID NO: 532838 - protein, 17 aa, Mycobacterium
NRGPEQRTDKRPQVSDL

SEQ ID NO: 532839 - protein, 26 aa, Mycobacterium
NRGPEQRTDKRPQVSDLRESGSLEQD

SEQ ID NO: 532840 - protein, 25 aa, Mycobacterium
NRGPEQRVDKTPQLSDLRESGNLEQ

SEQ ID NO: 532841 - protein, 7 aa, Mycobacterium
NRGPRPA

SEQ ID NO: 532842 - protein, 14 aa, Mycobacterium
NRGPVGKIQPPSLP

SEQ ID NO: 532843 - protein, 8 aa, Mycobacterium
NRGQATTA

SEQ ID NO: 532844 - protein, 10 aa, Mycobacterium
NRGQDAADTI

SEQ ID NO: 532845 - protein, 10 aa, Mycobacterium
NRGQDPAETI

SEQ ID NO: 532846 - protein, 7 aa, Mycobacterium
NRGQRKG

SEQ ID NO: 532847 - protein, 7 aa, Mycobacterium
NRGRPNV

SEQ ID NO: 532848 - protein, 9 aa, Mycobacterium
NRGRTAGPT

SEQ ID NO: 532849 - protein, 12 aa, Mycobacterium
NRGSARAAHRDA

SEQ ID NO: 532850 - protein, 13 aa, Mycobacterium
NRGSGKADDARKL

SEQ ID NO: 532851 - protein, 7 aa, Mycobacterium
NRGSHAE

SEQ ID NO: 532852 - protein, 8 aa, Mycobacterium
NRGSPTAN

SEQ ID NO: 532853 - protein, 4 aa, Mycobacterium
NRGT

SEQ ID NO: 532854 - protein, 7 aa, Mycobacterium
NRGTATA

SEQ ID NO: 532855 - protein, 8 aa, Mycobacterium
NRGTATTA

SEQ ID NO: 532856 - protein, 10 aa, Mycobacterium
NRGTDAAGRP

SEQ ID NO: 532857 - protein, 7 aa, Mycobacterium
NRGTDAL

SEQ ID NO: 532858 - protein, 10 aa, Mycobacterium
NRGTDPQDYD

SEQ ID NO: 532859 - protein, 9 aa, Mycobacterium
NRGTGGEVQ

SEQ ID NO: 532860 - protein, 8 aa, Mycobacterium
NRGTIGGS

SEQ ID NO: 532861 - protein, 7 aa, Mycobacterium
NRGTTTD

SEQ ID NO: 532862 - protein, 8 aa, Mycobacterium
NRGWSAAE

SEQ ID NO: 532863 - protein, 8 aa, Mycobacterium
NRHGQTRT

SEQ ID NO: 532864 - protein, 10 aa, Mycobacterium
NRHGRSEAAR

SEQ ID NO: 532865 - protein, 9 aa, Mycobacterium
NRHPDGDWS

SEQ ID NO: 532866 - protein, 6 aa, Mycobacterium
NRHPEL

SEQ ID NO: 532867 - protein, 6 aa, Mycobacterium
NRHPPP

SEQ ID NO: 532868 - protein, 7 aa, Mycobacterium
NRHPSIA

SEQ ID NO: 532869 - protein, 5 aa, Mycobacterium
NRHPV

SEQ ID NO: 532870 - protein, 4 aa, Mycobacterium
NRHR

SEQ ID NO: 532871 - protein, 5 aa, Mycobacterium
NRHRG

SEQ ID NO: 532872 - protein, 8 aa, Mycobacterium
NRHRGARG

SEQ ID NO: 532873 - protein, 15 aa, Mycobacterium
NRHRGTPQPLDDQTT

SEQ ID NO: 532874 - protein, 9 aa, Mycobacterium
NRHRPRSTF

SEQ ID NO: 532875 - protein, 12 aa, Mycobacterium
NRHTGGLETYRR

SEQ ID NO: 532876 - protein, 7 aa, Mycobacterium
NRIATAR

SEQ ID NO: 532877 - protein, 6 aa, Mycobacterium
NRIDGP

SEQ ID NO: 532878 - protein, 6 aa, Mycobacterium
NRIENP

SEQ ID NO: 532879 - protein, 12 aa, Mycobacterium
NRIGAESGEFGD

SEQ ID NO: 532880 - protein, 17 aa, Mycobacterium
NRIGGRVNTTRDWGPPL

SEQ ID NO: 532881 - protein, 8 aa, Mycobacterium
NRIGRARA

SEQ ID NO: 532882 - protein, 12 aa, Mycobacterium
NRIGTESEEFGD

SEQ ID NO: 532883 - protein, 7 aa, Mycobacterium
NRINPGD

SEQ ID NO: 532884 - protein, 21 aa, Mycobacterium
NRIPNSKEASMGKAKAARVAS

SEQ ID NO: 532885 - protein, 7 aa, Mycobacterium
NRIPPGS

SEQ ID NO: 532886 - protein, 7 aa, Mycobacterium
NRIQDPA

SEQ ID NO: 532887 - protein, 4 aa, Mycobacterium
NRIS

SEQ ID NO: 532888 - protein, 7 aa, Mycobacterium
NRISPDA

SEQ ID NO: 532889 - protein, 5 aa, Mycobacterium
NRKAS

SEQ ID NO: 532890 - protein, 11 aa, Mycobacterium
NRKDKAAEAIP

SEQ ID NO: 532891 - protein, 19 aa, Mycobacterium
NRKGRNNNPISEPGEVGSP

SEQ ID NO: 532892 - protein, 19 aa, Mycobacterium
NRKKAADKGSGEDRKANVN

SEQ ID NO: 532893 - protein, 12 aa, Mycobacterium
NRKLDKAASKGV

SEQ ID NO: 532894 - protein, 5 aa, Mycobacterium
NRKND

SEQ ID NO: 532895 - protein, 8 aa, Mycobacterium
NRKNPEEG

SEQ ID NO: 532896 - protein, 5 aa, Mycobacterium
NRKTE

SEQ ID NO: 532897 - protein, 4 aa, Mycobacterium
NRKW

SEQ ID NO: 532898 - protein, 4 aa, Mycobacterium
NRLD

SEQ ID NO: 532899 - protein, 15 aa, Mycobacterium
NRLEADAGLADGGYR

SEQ ID NO: 532900 - protein, 14 aa, Mycobacterium
NRLEHDAGEAWRRG

SEQ ID NO: 532901 - protein, 7 aa, Mycobacterium
NRLGGET

SEQ ID NO: 532902 - protein, 10 aa, Mycobacterium
NRLGRRGAKW

SEQ ID NO: 532903 - protein, 31 aa, Mycobacterium
NRLGSDPKNTNYAGGNTSAKGTDTDPVTGQP

SEQ ID NO: 532904 - protein, 9 aa, Mycobacterium
NRLPGKTGD

SEQ ID NO: 532905 - protein, 15 aa, Mycobacterium
NRLPGRHEDAARGAE

SEQ ID NO: 532906 - protein, 6 aa, Mycobacterium
NRLPGV

SEQ ID NO: 532907 - protein, 11 aa, Mycobacterium
NRLPSPGSRRN

SEQ ID NO: 532908 - protein, 9 aa, Mycobacterium
NRLRSKDSE

SEQ ID NO: 532909 - protein, 9 aa, Mycobacterium
NRLSTGDID

SEQ ID NO: 532910 - protein, 8 aa, Mycobacterium
NRLTPAQR

SEQ ID NO: 532911 - protein, 12 aa, Mycobacterium
NRMTEPTAQAEL

SEQ ID NO: 532912 - protein, 5 aa, Mycobacterium
NRNAV

SEQ ID NO: 532913 - protein, 6 aa, Mycobacterium
NRNDDA

SEQ ID NO: 532914 - protein, 6 aa, Mycobacterium
NRNDTI

SEQ ID NO: 532915 - protein, 4 aa, Mycobacterium
NRNF

SEQ ID NO: 532916 - protein, 8 aa, Mycobacterium
NRNFEGRI

SEQ ID NO: 532917 - protein, 7 aa, Mycobacterium
NRNGGRR

SEQ ID NO: 532918 - protein, 16 aa, Mycobacterium
NRNGTTPPAAPRRKPI

SEQ ID NO: 532919 - protein, 4 aa, Mycobacterium
NRNI

SEQ ID NO: 532920 - protein, 8 aa, Mycobacterium
NRNKKSVT

SEQ ID NO: 532921 - protein, 6 aa, Mycobacterium
NRNKQS

SEQ ID NO: 532922 - protein, 6 aa, Mycobacterium
NRNKRS

SEQ ID NO: 532923 - protein, 4 aa, Mycobacterium
NRNP

SEQ ID NO: 532924 - protein, 7 aa, Mycobacterium
NRNPTSD

SEQ ID NO: 532925 - protein, 4 aa, Mycobacterium
NRNQ

SEQ ID NO: 532926 - protein, 10 aa, Mycobacterium
NRNQGTLEES

SEQ ID NO: 532927 - protein, 9 aa, Mycobacterium
NRNQIRERA

SEQ ID NO: 532928 - protein, 7 aa, Mycobacterium
NRNQRHR

SEQ ID NO: 532929 - protein, 10 aa, Mycobacterium
NRNQRPTSRM

SEQ ID NO: 532930 - protein, 13 aa, Mycobacterium
NRNSEGRNNFDNP

SEQ ID NO: 532931 - protein, 4 aa, Mycobacterium
NRNT

SEQ ID NO: 532932 - protein, 4 aa, Mycobacterium
NRPA

SEQ ID NO: 532933 - protein, 25 aa, Mycobacterium
NRPAPPPPVPPPARPAARLGADNEA

SEQ ID NO: 532934 - protein, 7 aa, Mycobacterium
NRPAVTD

SEQ ID NO: 532935 - protein, 10 aa, Mycobacterium
NRPDADSDTV

SEQ ID NO: 532936 - protein, 5 aa, Mycobacterium
NRPDG

SEQ ID NO: 532937 - protein, 8 aa, Mycobacterium
NRPDHPDG

SEQ ID NO: 532938 - protein, 8 aa, Mycobacterium
NRPDPTPA

SEQ ID NO: 532939 - protein, 6 aa, Mycobacterium
NRPDQL

SEQ ID NO: 532940 - protein, 6 aa, Mycobacterium
NRPDRL

SEQ ID NO: 532941 - protein, 9 aa, Mycobacterium
NRPDSLNSL

SEQ ID NO: 532942 - protein, 9 aa, Mycobacterium
NRPDSPRPR

SEQ ID NO: 532943 - protein, 12 aa, Mycobacterium
NRPDTGSDAEYS

SEQ ID NO: 532944 - protein, 4 aa, Mycobacterium
NRPE

SEQ ID NO: 532945 - protein, 12 aa, Mycobacterium
NRPEATAETITD

SEQ ID NO: 532946 - protein, 7 aa, Mycobacterium
NRPEGLD

SEQ ID NO: 532947 - protein, 7 aa, Mycobacterium
NRPEGLG

SEQ ID NO: 532948 - protein, 9 aa, Mycobacterium
NRPEKGNAI

SEQ ID NO: 532949 - protein, 7 aa, Mycobacterium
NRPEQGN

SEQ ID NO: 532950 - protein, 6 aa, Mycobacterium
NRPERF

SEQ ID NO: 532951 - protein, 7 aa, Mycobacterium
NRPESLN

SEQ ID NO: 532952 - protein, 5 aa, Mycobacterium
NRPFD

SEQ ID NO: 532953 - protein, 9 aa, Mycobacterium
NRPFTSEDQ

SEQ ID NO: 532954 - protein, 4 aa, Mycobacterium
NRPG

SEQ ID NO: 532955 - protein, 9 aa, Mycobacterium
NRPGEPLPV

SEQ ID NO: 532956 - protein, 10 aa, Mycobacterium
NRPGGPGDEY

SEQ ID NO: 532957 - protein, 7 aa, Mycobacterium
NRPGGSV

SEQ ID NO: 532958 - protein, 13 aa, Mycobacterium
NRPGMSGDSTSWE

SEQ ID NO: 532959 - protein, 6 aa, Mycobacterium
NRPGQL

SEQ ID NO: 532960 - protein, 10 aa, Mycobacterium
NRPGRAVSTE

SEQ ID NO: 532961 - protein, 9 aa, Mycobacterium
NRPGSRNAL

SEQ ID NO: 532962 - protein, 5 aa, Mycobacterium
NRPGV

SEQ ID NO: 532963 - protein, 12 aa, Mycobacterium
NRPGVGDRGERA

SEQ ID NO: 532964 - protein, 9 aa, Mycobacterium
NRPGVRENT

SEQ ID NO: 532965 - protein, 13 aa, Mycobacterium
NRPGVRENTRAEV

SEQ ID NO: 532966 - protein, 11 aa, Mycobacterium
NRPIPTPPTLG

SEQ ID NO: 532967 - protein, 18 aa, Mycobacterium
NRPKNAKVATNQQGGPMQ

SEQ ID NO: 532968 - protein, 14 aa, Mycobacterium
NRPKPKARARRKVS

SEQ ID NO: 532969 - protein, 13 aa, Mycobacterium
NRPKVGPRREEAQ

SEQ ID NO: 532970 - protein, 5 aa, Mycobacterium
NRPMT

SEQ ID NO: 532971 - protein, 9 aa, Mycobacterium
NRPNIPDFD

SEQ ID NO: 532972 - protein, 7 aa, Mycobacterium
NRPNIPE

SEQ ID NO: 532973 - protein, 9 aa, Mycobacterium
NRPPASPPR

SEQ ID NO: 532974 - protein, 10 aa, Mycobacterium
NRPPAYGTLP

SEQ ID NO: 532975 - protein, 6 aa, Mycobacterium
NRPPEP

SEQ ID NO: 532976 - protein, 9 aa, Mycobacterium
NRPPKERPR

SEQ ID NO: 532977 - protein, 5 aa, Mycobacterium
NRPPR

SEQ ID NO: 532978 - protein, 7 aa, Mycobacterium
NRPPTPH

SEQ ID NO: 532979 - protein, 6 aa, Mycobacterium
NRPQRE

SEQ ID NO: 532980 - protein, 9 aa, Mycobacterium
NRPQSRNAL

SEQ ID NO: 532981 - protein, 11 aa, Mycobacterium
NRPQSRNALSA

SEQ ID NO: 532982 - protein, 4 aa, Mycobacterium
NRPR

SEQ ID NO: 532983 - protein, 9 aa, Mycobacterium
NRPRASVDP

SEQ ID NO: 532984 - protein, 14 aa, Mycobacterium
NRPRHTLEDRSPAE

SEQ ID NO: 532985 - protein, 18 aa, Mycobacterium
NRPSETVTLSRPQDGITA

SEQ ID NO: 532986 - protein, 6 aa, Mycobacterium
NRPSGA

SEQ ID NO: 532987 - protein, 19 aa, Mycobacterium
NRPSGPPSASSADKDRAGI

SEQ ID NO: 532988 - protein, 19 aa, Mycobacterium
NRPTDGDRSRSARNNRATY

SEQ ID NO: 532989 - protein, 7 aa, Mycobacterium
NRPTHYR

SEQ ID NO: 532990 - protein, 5 aa, Mycobacterium
NRPTM

SEQ ID NO: 532991 - protein, 6 aa, Mycobacterium
NRPTTG

SEQ ID NO: 532992 - protein, 14 aa, Mycobacterium
NRPTTKFEGKAHTV

SEQ ID NO: 532993 - protein, 6 aa, Mycobacterium
NRPVSG

SEQ ID NO: 532994 - protein, 17 aa, Mycobacterium
NRPVSGYYNGHDTGVDA

SEQ ID NO: 532995 - protein, 12 aa, Mycobacterium
NRPYPGDHPVQQ

SEQ ID NO: 532996 - protein, 6 aa, Mycobacterium
NRQAAQ

SEQ ID NO: 532997 - protein, 4 aa, Mycobacterium
NRQD

SEQ ID NO: 532998 - protein, 10 aa, Mycobacterium
NRQDGAASYE

SEQ ID NO: 532999 - protein, 11 aa, Mycobacterium
NRQDGAASYEE

SEQ ID NO: 533000 - protein, 13 aa, Mycobacterium
NRQHENNGQRQAG

SEQ ID NO: 533001 - protein, 8 aa, Mycobacterium
NRQPEAEE

SEQ ID NO: 533002 - protein, 21 aa, Mycobacterium
NRQPETGESQGPIRRLLGRIG

SEQ ID NO: 533003 - protein, 10 aa, Mycobacterium
NRQPLNGTYP

SEQ ID NO: 533004 - protein, 11 aa, Mycobacterium
NRQPLNGTYPE

SEQ ID NO: 533005 - protein, 9 aa, Mycobacterium
NRQPPRAPE

SEQ ID NO: 533006 - protein, 8 aa, Mycobacterium
NRQPRADG

SEQ ID NO: 533007 - protein, 11 aa, Mycobacterium
NRQPSAEVMTR

SEQ ID NO: 533008 - protein, 4 aa, Mycobacterium
NRQR

SEQ ID NO: 533009 - protein, 13 aa, Mycobacterium
NRQRHGRGERITE

SEQ ID NO: 533010 - protein, 6 aa, Mycobacterium
NRQRSV

SEQ ID NO: 533011 - protein, 5 aa, Mycobacterium
NRQSG

SEQ ID NO: 533012 - protein, 17 aa, Mycobacterium
NRQSHPAGATPFAVASA

SEQ ID NO: 533013 - protein, 4 aa, Mycobacterium
NRQV

SEQ ID NO: 533014 - protein, 10 aa, Mycobacterium
NRRAGSQGVG

SEQ ID NO: 533015 - protein, 12 aa, Mycobacterium
NRRATDSSTVPD

SEQ ID NO: 533016 - protein, 9 aa, Mycobacterium
NRRATQSKA

SEQ ID NO: 533017 - protein, 5 aa, Mycobacterium
NRRDD

SEQ ID NO: 533018 - protein, 15 aa, Mycobacterium
NRRDDAGVDEQDAAA

SEQ ID NO: 533019 - protein, 10 aa, Mycobacterium
NRRDLTAGQA

SEQ ID NO: 533020 - protein, 6 aa, Mycobacterium
NRREAR

SEQ ID NO: 533021 - protein, 9 aa, Mycobacterium
NRREPPLAA

SEQ ID NO: 533022 - protein, 5 aa, Mycobacterium
NRRFD

SEQ ID NO: 533023 - protein, 17 aa, Mycobacterium
NRRGEPAPKTTAWGKTS

SEQ ID NO: 533024 - protein, 6 aa, Mycobacterium
NRRGGR

SEQ ID NO: 533025 - protein, 10 aa, Mycobacterium
NRRGNATRES

SEQ ID NO: 533026 - protein, 6 aa, Mycobacterium
NRRGQN

SEQ ID NO: 533027 - protein, 7 aa, Mycobacterium
NRRGRAA

SEQ ID NO: 533028 - protein, 10 aa, Mycobacterium
NRRGRDKARG

SEQ ID NO: 533029 - protein, 7 aa, Mycobacterium
NRRGRDV

SEQ ID NO: 533030 - protein, 8 aa, Mycobacterium
NRRGRPAR

SEQ ID NO: 533031 - protein, 17 aa, Mycobacterium
NRRGSAAGDRQDDPTPI

SEQ ID NO: 533032 - protein, 12 aa, Mycobacterium
NRRHHRGSAESF

SEQ ID NO: 533033 - protein, 11 aa, Mycobacterium
NRRHHRTTAES

SEQ ID NO: 533034 - protein, 4 aa, Mycobacterium
NRRK

SEQ ID NO: 533035 - protein, 7 aa, Mycobacterium
NRRPAPG

SEQ ID NO: 533036 - protein, 6 aa, Mycobacterium
NRRPAR

SEQ ID NO: 533037 - protein, 8 aa, Mycobacterium
NRRPPAGG

SEQ ID NO: 533038 - protein, 6 aa, Mycobacterium
NRRPPC

SEQ ID NO: 533039 - protein, 9 aa, Mycobacterium
NRRPPDPNQ

SEQ ID NO: 533040 - protein, 10 aa, Mycobacterium
NRRPPEPAGE

SEQ ID NO: 533041 - protein, 6 aa, Mycobacterium
NRRPPR

SEQ ID NO: 533042 - protein, 8 aa, Mycobacterium
NRRPRGSY

SEQ ID NO: 533043 - protein, 8 aa, Mycobacterium
NRRPTGER

SEQ ID NO: 533044 - protein, 11 aa, Mycobacterium
NRRQAKTRADE

SEQ ID NO: 533045 - protein, 6 aa, Mycobacterium
NRRQAR

SEQ ID NO: 533046 - protein, 6 aa, Mycobacterium
NRRQTK

SEQ ID NO: 533047 - protein, 7 aa, Mycobacterium
NRRRART

SEQ ID NO: 533048 - protein, 12 aa, Mycobacterium
NRRRERGLPSPT

SEQ ID NO: 533049 - protein, 10 aa, Mycobacterium
NRRRTLTAKD

SEQ ID NO: 533050 - protein, 9 aa, Mycobacterium
NRRSAATPS

SEQ ID NO: 533051 - protein, 9 aa, Mycobacterium
NRRSAPPVG

SEQ ID NO: 533052 - protein, 11 aa, Mycobacterium
NRRSESATDTT

SEQ ID NO: 533053 - protein, 7 aa, Mycobacterium
NRRSGGD

SEQ ID NO: 533054 - protein, 10 aa, Mycobacterium
NRRSPPGIQT

SEQ ID NO: 533055 - protein, 8 aa, Mycobacterium
NRRSRDVA

SEQ ID NO: 533056 - protein, 18 aa, Mycobacterium
NRRSRDVPEVRSTHAGGG

SEQ ID NO: 533057 - protein, 22 aa, Mycobacterium
NRRSTARVTGSIPGAPASLTGD

SEQ ID NO: 533058 - protein, 8 aa, Mycobacterium
NRRTAADY

SEQ ID NO: 533059 - protein, 7 aa, Mycobacterium
NRRTDRR

SEQ ID NO: 533060 - protein, 8 aa, Mycobacterium
NRRTGNNF

SEQ ID NO: 533061 - protein, 8 aa, Mycobacterium
NRRTTSDT

SEQ ID NO: 533062 - protein, 7 aa, Mycobacterium
NRRYQEA

SEQ ID NO: 533063 - protein, 18 aa, Mycobacterium
NRSAEGDDIARPVSRGLD

SEQ ID NO: 533064 - protein, 8 aa, Mycobacterium
NRSAPAAA

SEQ ID NO: 533065 - protein, 15 aa, Mycobacterium
NRSDASTPTPPRRKP

SEQ ID NO: 533066 - protein, 13 aa, Mycobacterium
NRSDSTTSPPGIS

SEQ ID NO: 533067 - protein, 5 aa, Mycobacterium
NRSDV

SEQ ID NO: 533068 - protein, 5 aa, Mycobacterium
NRSEA

SEQ ID NO: 533069 - protein, 6 aa, Mycobacterium
NRSKRS

SEQ ID NO: 533070 - protein, 22 aa, Mycobacterium
NRSLQPTKGTRAEQAVRRSAKT

SEQ ID NO: 533071 - protein, 5 aa, Mycobacterium
NRSLS

SEQ ID NO: 533072 - protein, 4 aa, Mycobacterium
NRSN

SEQ ID NO: 533073 - protein, 9 aa, Mycobacterium
NRSPAKAAQ

SEQ ID NO: 533074 - protein, 9 aa, Mycobacterium
NRSPDGAVE

SEQ ID NO: 533075 - protein, 12 aa, Mycobacterium
NRSPDGELTPAD

SEQ ID NO: 533076 - protein, 6 aa, Mycobacterium
NRSPLP

SEQ ID NO: 533077 - protein, 16 aa, Mycobacterium
NRSQDDPLTLSTGNAA

SEQ ID NO: 533078 - protein, 4 aa, Mycobacterium
NRSR

SEQ ID NO: 533079 - protein, 5 aa, Mycobacterium
NRSRR

SEQ ID NO: 533080 - protein, 8 aa, Mycobacterium
NRSRTRAA

SEQ ID NO: 533081 - protein, 26 aa, Mycobacterium
NRSSAPDEPVAASRPRIPSARERAGA

SEQ ID NO: 533082 - protein, 7 aa, Mycobacterium
NRSSGGL

SEQ ID NO: 533083 - protein, 6 aa, Mycobacterium
NRSSLG

SEQ ID NO: 533084 - protein, 6 aa, Mycobacterium
NRSTVA

SEQ ID NO: 533085 - protein, 4 aa, Mycobacterium
NRSV

SEQ ID NO: 533086 - protein, 26 aa, Mycobacterium
NRSYDAKALNPYRRQHSGVESKKGQW

SEQ ID NO: 533087 - protein, 5 aa, Mycobacterium
NRTAD

SEQ ID NO: 533088 - protein, 8 aa, Mycobacterium
NRTAGASL

SEQ ID NO: 533089 - protein, 6 aa, Mycobacterium
NRTAQG

SEQ ID NO: 533090 - protein, 11 aa, Mycobacterium
NRTARDPRPTA

SEQ ID NO: 533091 - protein, 7 aa, Mycobacterium
NRTATDL

SEQ ID NO: 533092 - protein, 9 aa, Mycobacterium
NRTDGTQTE

SEQ ID NO: 533093 - protein, 10 aa, Mycobacterium
NRTDRPGHLT

SEQ ID NO: 533094 - protein, 5 aa, Mycobacterium
NRTEE

SEQ ID NO: 533095 - protein, 8 aa, Mycobacterium
NRTEGFSG

SEQ ID NO: 533096 - protein, 16 aa, Mycobacterium
NRTELGRQMDSLRDGP

SEQ ID NO: 533097 - protein, 9 aa, Mycobacterium
NRTETATDY

SEQ ID NO: 533098 - protein, 4 aa, Mycobacterium
NRTG

SEQ ID NO: 533099 - protein, 9 aa, Mycobacterium
NRTGETEDV

SEQ ID NO: 533100 - protein, 12 aa, Mycobacterium
NRTGLQHQAQSG

SEQ ID NO: 533101 - protein, 12 aa, Mycobacterium
NRTGSRPRLTDD

SEQ ID NO: 533102 - protein, 6 aa, Mycobacterium
NRTGTV

SEQ ID NO: 533103 - protein, 7 aa, Mycobacterium
NRTHPSA

SEQ ID NO: 533104 - protein, 13 aa, Mycobacterium
NRTKSHGQRQAGH

SEQ ID NO: 533105 - protein, 11 aa, Mycobacterium
NRTLDKEPRWR

SEQ ID NO: 533106 - protein, 4 aa, Mycobacterium
NRTN

SEQ ID NO: 533107 - protein, 8 aa, Mycobacterium
NRTPAALA

SEQ ID NO: 533108 - protein, 6 aa, Mycobacterium
NRTPGA

SEQ ID NO: 533109 - protein, 13 aa, Mycobacterium
NRTPNRGPGAEGA

SEQ ID NO: 533110 - protein, 10 aa, Mycobacterium
NRTPPKTQSA

SEQ ID NO: 533111 - protein, 12 aa, Mycobacterium
NRTPSLASCSSA

SEQ ID NO: 533112 - protein, 8 aa, Mycobacterium
NRTRGPLT

SEQ ID NO: 533113 - protein, 12 aa, Mycobacterium
NRTRKQLKQARR

SEQ ID NO: 533114 - protein, 5 aa, Mycobacterium
NRTRY

SEQ ID NO: 533115 - protein, 13 aa, Mycobacterium
NRTSGPRRPAGGA

SEQ ID NO: 533116 - protein, 8 aa, Mycobacterium
NRTSTAER

SEQ ID NO: 533117 - protein, 13 aa, Mycobacterium
NRTSTYPSTEQTL

SEQ ID NO: 533118 - protein, 14 aa, Mycobacterium
NRTTEAGPGEPGSV

SEQ ID NO: 533119 - protein, 8 aa, Mycobacterium
NRTTQAGL

SEQ ID NO: 533120 - protein, 12 aa, Mycobacterium
NRTTTGNTRPGQ

SEQ ID NO: 533121 - protein, 10 aa, Mycobacterium
NRTVGDPDAK

SEQ ID NO: 533122 - protein, 6 aa, Mycobacterium
NRTVNA

SEQ ID NO: 533123 - protein, 17 aa, Mycobacterium
NRTYGLDTERGETMQPQ

SEQ ID NO: 533124 - protein, 9 aa, Mycobacterium
NRVGARGAQ

SEQ ID NO: 533125 - protein, 9 aa, Mycobacterium
NRVGARSAD

SEQ ID NO: 533126 - protein, 8 aa, Mycobacterium
NRVGGTWR

SEQ ID NO: 533127 - protein, 12 aa, Mycobacterium
NRVKDGDATAHP

SEQ ID NO: 533128 - protein, 5 aa, Mycobacterium
NRVPN

SEQ ID NO: 533129 - protein, 7 aa, Mycobacterium
NRVPPGS

SEQ ID NO: 533130 - protein, 4 aa, Mycobacterium
NRVQ

SEQ ID NO: 533131 - protein, 9 aa, Mycobacterium
NRVRGGGAQ

SEQ ID NO: 533132 - protein, 4 aa, Mycobacterium
NRVT

SEQ ID NO: 533133 - protein, 21 aa, Mycobacterium
NRWRRPASENRGYSPPKSESL

SEQ ID NO: 533134 - protein, 4 aa, Mycobacterium
NRYA

SEQ ID NO: 533135 - protein, 8 aa, Mycobacterium
NRYAESEH

SEQ ID NO: 533136 - protein, 9 aa, Mycobacterium
NRYAPAARR

SEQ ID NO: 533137 - protein, 6 aa, Mycobacterium
NRYATA

SEQ ID NO: 533138 - protein, 5 aa, Mycobacterium
NRYGA

SEQ ID NO: 533139 - protein, 8 aa, Mycobacterium
NRYGRTRS

SEQ ID NO: 533140 - protein, 7 aa, Mycobacterium
NRYGSGY

SEQ ID NO: 533141 - protein, 17 aa, Mycobacterium
NRYGYSPPGHRQGRGVD

SEQ ID NO: 533142 - protein, 7 aa, Mycobacterium
NRYNEIS

SEQ ID NO: 533143 - protein, 5 aa, Mycobacterium
NRYPD

SEQ ID NO: 533144 - protein, 7 aa, Mycobacterium
NRYPDNG

SEQ ID NO: 533145 - protein, 15 aa, Mycobacterium
NRYPPPPPYPAPDPF

SEQ ID NO: 533146 - protein, 5 aa, Mycobacterium
NRYRN

SEQ ID NO: 533147 - protein, 4 aa, Mycobacterium
NSAA

SEQ ID NO: 533148 - protein, 10 aa, Mycobacterium
NSAAADLSPA

SEQ ID NO: 533149 - protein, 15 aa, Mycobacterium
NSAAPPATPEDLAET

SEQ ID NO: 533150 - protein, 8 aa, Mycobacterium
NSAAPSVA

SEQ ID NO: 533151 - protein, 8 aa, Mycobacterium
NSAAPSVD

SEQ ID NO: 533152 - protein, 11 aa, Mycobacterium
NSAATLTRPDA

SEQ ID NO: 533153 - protein, 6 aa, Mycobacterium
NSADED

SEQ ID NO: 533154 - protein, 12 aa, Mycobacterium
NSADGADGAIDP

SEQ ID NO: 533155 - protein, 11 aa, Mycobacterium
NSADPPPGPRA

SEQ ID NO: 533156 - protein, 8 aa, Mycobacterium
NSADRTTL

SEQ ID NO: 533157 - protein, 6 aa, Mycobacterium
NSADSA

SEQ ID NO: 533158 - protein, 6 aa, Mycobacterium
NSAEED

SEQ ID NO: 533159 - protein, 11 aa, Mycobacterium
NSAEPPPGPRA

SEQ ID NO: 533160 - protein, 7 aa, Mycobacterium
NSAETDA

SEQ ID NO: 533161 - protein, 9 aa, Mycobacterium
NSAGITTTS

SEQ ID NO: 533162 - protein, 14 aa, Mycobacterium
NSAGKLGPHPYPAG

SEQ ID NO: 533163 - protein, 15 aa, Mycobacterium
NSAGKPGLSVGPGNA

SEQ ID NO: 533164 - protein, 10 aa, Mycobacterium
NSAGPGSPVA

SEQ ID NO: 533165 - protein, 8 aa, Mycobacterium
NSAGTQSG

SEQ ID NO: 533166 - protein, 4 aa, Mycobacterium
NSAI

SEQ ID NO: 533167 - protein, 4 aa, Mycobacterium
NSAK

SEQ ID NO: 533168 - protein, 6 aa, Mycobacterium
NSAKPY

SEQ ID NO: 533169 - protein, 4 aa, Mycobacterium
NSAL

SEQ ID NO: 533170 - protein, 15 aa, Mycobacterium
NSALPGSALSRNPAV

SEQ ID NO: 533171 - protein, 4 aa, Mycobacterium
NSAM

SEQ ID NO: 533172 - protein, 12 aa, Mycobacterium
NSANTAGQEGRE

SEQ ID NO: 533173 - protein, 8 aa, Mycobacterium
NSAPGSRI

SEQ ID NO: 533174 - protein, 8 aa, Mycobacterium
NSAPGVNT

SEQ ID NO: 533175 - protein, 7 aa, Mycobacterium
NSAPLRP

SEQ ID NO: 533176 - protein, 6 aa, Mycobacterium
NSAPSH

SEQ ID NO: 533177 - protein, 8 aa, Mycobacterium
NSAPSLPS

SEQ ID NO: 533178 - protein, 16 aa, Mycobacterium
NSAQLQAEHDAQPKVA

SEQ ID NO: 533179 - protein, 5 aa, Mycobacterium
NSARD

SEQ ID NO: 533180 - protein, 7 aa, Mycobacterium
NSARSQL

SEQ ID NO: 533181 - protein, 8 aa, Mycobacterium
NSARTPAG

SEQ ID NO: 533182 - protein, 15 aa, Mycobacterium
NSASADPAEGQAPKP

SEQ ID NO: 533183 - protein, 12 aa, Mycobacterium
NSASKSKAVADS

SEQ ID NO: 533184 - protein, 13 aa, Mycobacterium
NSASKSKAVADSE

SEQ ID NO: 533185 - protein, 13 aa, Mycobacterium
NSASTYPTTEQTL

SEQ ID NO: 533186 - protein, 5 aa, Mycobacterium
NSATA

SEQ ID NO: 533187 - protein, 27 aa, Mycobacterium
NSATGWPRRGSPNTRSATTAAAIPEAR

SEQ ID NO: 533188 - protein, 8 aa, Mycobacterium
NSATKAGI

SEQ ID NO: 533189 - protein, 9 aa, Mycobacterium
NSATKAGVK

SEQ ID NO: 533190 - protein, 14 aa, Mycobacterium
NSATKELRASGDPD

SEQ ID NO: 533191 - protein, 7 aa, Mycobacterium
NSATQAG

SEQ ID NO: 533192 - protein, 14 aa, Mycobacterium
NSATQSSAGSARQT

SEQ ID NO: 533193 - protein, 4 aa, Mycobacterium
NSAV

SEQ ID NO: 533194 - protein, 13 aa, Mycobacterium
NSAVGASYGSILT

SEQ ID NO: 533195 - protein, 11 aa, Mycobacterium
NSCGSSAQAYG

SEQ ID NO: 533196 - protein, 6 aa, Mycobacterium
NSDAAL

SEQ ID NO: 533197 - protein, 8 aa, Mycobacterium
NSDAAPMA

SEQ ID NO: 533198 - protein, 6 aa, Mycobacterium
NSDAAR

SEQ ID NO: 533199 - protein, 11 aa, Mycobacterium
NSDAFDEPRVG

SEQ ID NO: 533200 - protein, 10 aa, Mycobacterium
NSDAKRKAAG

SEQ ID NO: 533201 - protein, 7 aa, Mycobacterium
NSDAPAI

SEQ ID NO: 533202 - protein, 5 aa, Mycobacterium
NSDDR

SEQ ID NO: 533203 - protein, 11 aa, Mycobacterium
NSDEENLTPQE

SEQ ID NO: 533204 - protein, 6 aa, Mycobacterium
NSDEER

SEQ ID NO: 533205 - protein, 5 aa, Mycobacterium
NSDGE

SEQ ID NO: 533206 - protein, 5 aa, Mycobacterium
NSDGG

SEQ ID NO: 533207 - protein, 16 aa, Mycobacterium
NSDGKEIAGEIGPDGV

SEQ ID NO: 533208 - protein, 5 aa, Mycobacterium
NSDGR

SEQ ID NO: 533209 - protein, 13 aa, Mycobacterium
NSDGRPVSGGADA

SEQ ID NO: 533210 - protein, 6 aa, Mycobacterium
NSDGRR

SEQ ID NO: 533211 - protein, 5 aa, Mycobacterium
NSDHG

SEQ ID NO: 533212 - protein, 10 aa, Mycobacterium
NSDLEGTPQL

SEQ ID NO: 533213 - protein, 7 aa, Mycobacterium
NSDNALP

SEQ ID NO: 533214 - protein, 6 aa, Mycobacterium
NSDNPA

SEQ ID NO: 533215 - protein, 8 aa, Mycobacterium
NSDPDEAD

SEQ ID NO: 533216 - protein, 8 aa, Mycobacterium
NSDPDVND

SEQ ID NO: 533217 - protein, 5 aa, Mycobacterium
NSDPG

SEQ ID NO: 533218 - protein, 18 aa, Mycobacterium
NSDPPSQAAFNANSSQYL

SEQ ID NO: 533219 - protein, 7 aa, Mycobacterium
NSDPYGD

SEQ ID NO: 533220 - protein, 13 aa, Mycobacterium
NSDQSEGGEQDGL

SEQ ID NO: 533221 - protein, 8 aa, Mycobacterium
NSDQSPGI

SEQ ID NO: 533222 - protein, 5 aa, Mycobacterium
NSDRA

SEQ ID NO: 533223 - protein, 5 aa, Mycobacterium
NSDRY

SEQ ID NO: 533224 - protein, 8 aa, Mycobacterium
NSDSGYER

SEQ ID NO: 533225 - protein, 9 aa, Mycobacterium
NSDTTKTAL

SEQ ID NO: 533226 - protein, 6 aa, Mycobacterium
NSDVQA

SEQ ID NO: 533227 - protein, 8 aa, Mycobacterium
NSDVSPPI

SEQ ID NO: 533228 - protein, 4 aa, Mycobacterium
NSEA

SEQ ID NO: 533229 - protein, 13 aa, Mycobacterium
NSEALSNANGVSM

SEQ ID NO: 533230 - protein, 7 aa, Mycobacterium
NSEAPAI

SEQ ID NO: 533231 - protein, 14 aa, Mycobacterium
NSEAPTAVGSDVAG

SEQ ID NO: 533232 - protein, 17 aa, Mycobacterium
NSEATEAAVEELGGSEV

SEQ ID NO: 533233 - protein, 6 aa, Mycobacterium
NSEATQ

SEQ ID NO: 533234 - protein, 4 aa, Mycobacterium
NSED

SEQ ID NO: 533235 - protein, 8 aa, Mycobacterium
NSEGGAAL

SEQ ID NO: 533236 - protein, 5 aa, Mycobacterium
NSEGL

SEQ ID NO: 533237 - protein, 8 aa, Mycobacterium
NSEGSQLA

SEQ ID NO: 533238 - protein, 16 aa, Mycobacterium
NSEHDRMRASSDVDAR

SEQ ID NO: 533239 - protein, 7 aa, Mycobacterium
NSEHGSL

SEQ ID NO: 533240 - protein, 6 aa, Mycobacterium
NSEKQA

SEQ ID NO: 533241 - protein, 6 aa, Mycobacterium
NSEMQV

SEQ ID NO: 533242 - protein, 7 aa, Mycobacterium
NSEPADM

SEQ ID NO: 533243 - protein, 8 aa, Mycobacterium
NSEPATAR

SEQ ID NO: 533244 - protein, 9 aa, Mycobacterium
NSEPGPGPL

SEQ ID NO: 533245 - protein, 15 aa, Mycobacterium
NSEPLGDEEAIDRSG

SEQ ID NO: 533246 - protein, 10 aa, Mycobacterium
NSEPTAPTEC

SEQ ID NO: 533247 - protein, 8 aa, Mycobacterium
NSEQAAAV

SEQ ID NO: 533248 - protein, 5 aa, Mycobacterium
NSERD

SEQ ID NO: 533249 - protein, 38 aa, Mycobacterium
NSERHAARARRAEARADAGRRHPSSLTNGAPVHDPAET

SEQ ID NO: 533250 - protein, 8 aa, Mycobacterium
NSERIRGA

SEQ ID NO: 533251 - protein, 11 aa, Mycobacterium
NSERRKDRAQV

SEQ ID NO: 533252 - protein, 13 aa, Mycobacterium
NSESDLRALAQLQ

SEQ ID NO: 533253 - protein, 10 aa, Mycobacterium
NSETGEESRL

SEQ ID NO: 533254 - protein, 6 aa, Mycobacterium
NSETGL

SEQ ID NO: 533255 - protein, 15 aa, Mycobacterium
NSETGRTWGKTEPGW

SEQ ID NO: 533256 - protein, 5 aa, Mycobacterium
NSETR

SEQ ID NO: 533257 - protein, 5 aa, Mycobacterium
NSEVT

SEQ ID NO: 533258 - protein, 9 aa, Mycobacterium
NSEYGKANR

SEQ ID NO: 533259 - protein, 6 aa, Mycobacterium
NSFAEA

SEQ ID NO: 533260 - protein, 12 aa, Mycobacterium
NSFDPSMSPPGK

SEQ ID NO: 533261 - protein, 12 aa, Mycobacterium
NSFEAQAARDGL

SEQ ID NO: 533262 - protein, 8 aa, Mycobacterium
NSFEGHRT

SEQ ID NO: 533263 - protein, 17 aa, Mycobacterium
NSFGGPHADPEAAGDGG

SEQ ID NO: 533264 - protein, 27 aa, Mycobacterium
NSFPGSSGTGGDPGGTGGNGGAGGSGG

SEQ ID NO: 533265 - protein, 13 aa, Mycobacterium
NSFSSDGKTWQGD

SEQ ID NO: 533266 - protein, 6 aa, Mycobacterium
NSFTGT

SEQ ID NO: 533267 - protein, 6 aa, Mycobacterium
NSFTKA

SEQ ID NO: 533268 - protein, 5 aa, Mycobacterium
NSGAA

SEQ ID NO: 533269 - protein, 10 aa, Mycobacterium
NSGAGNSGFF

SEQ ID NO: 533270 - protein, 9 aa, Mycobacterium
NSGAGNTGL

SEQ ID NO: 533271 - protein, 16 aa, Mycobacterium
NSGAHNTGAFNAGGYN

SEQ ID NO: 533272 - protein, 10 aa, Mycobacterium
NSGAIDTGFG

SEQ ID NO: 533273 - protein, 9 aa, Mycobacterium
NSGANNSGF

SEQ ID NO: 533274 - protein, 6 aa, Mycobacterium
NSGASL

SEQ ID NO: 533275 - protein, 11 aa, Mycobacterium
NSGATAVVEGT

SEQ ID NO: 533276 - protein, 13 aa, Mycobacterium
NSGATSGATTQKG

SEQ ID NO: 533277 - protein, 4 aa, Mycobacterium
NSGD

SEQ ID NO: 533278 - protein, 5 aa, Mycobacterium
NSGDG

SEQ ID NO: 533279 - protein, 44 aa, Mycobacterium
NSGDGGRNSGWVNSGDGGQNSGLHNTGDTSSGGFNTGSGQSGFF

SEQ ID NO: 533280 - protein, 7 aa, Mycobacterium
NSGDGLS

SEQ ID NO: 533281 - protein, 19 aa, Mycobacterium
NSGDGSASGFGNGGGSNSG

SEQ ID NO: 533282 - protein, 12 aa, Mycobacterium
NSGDGSSSGFGN

SEQ ID NO: 533283 - protein, 10 aa, Mycobacterium
NSGDGSVSGF

SEQ ID NO: 533284 - protein, 6 aa, Mycobacterium
NSGDNG

SEQ ID NO: 533285 - protein, 8 aa, Mycobacterium
NSGDPSWP

SEQ ID NO: 533286 - protein, 29 aa, Mycobacterium
NSGDSNTGYAGSGNYNTGGFNSGASNTGF

SEQ ID NO: 533287 - protein, 6 aa, Mycobacterium
NSGDTE

SEQ ID NO: 533288 - protein, 7 aa, Mycobacterium
NSGDYNT

SEQ ID NO: 533289 - protein, 6 aa, Mycobacterium
NSGEEL

SEQ ID NO: 533290 - protein, 10 aa, Mycobacterium
NSGEGSASGF

SEQ ID NO: 533291 - protein, 10 aa, Mycobacterium
NSGEGSTSGF

SEQ ID NO: 533292 - protein, 7 aa, Mycobacterium
NSGERWD

SEQ ID NO: 533293 - protein, 8 aa, Mycobacterium
NSGEWDGE

SEQ ID NO: 533294 - protein, 4 aa, Mycobacterium
NSGG

SEQ ID NO: 533295 - protein, 9 aa, Mycobacterium
NSGGAGEVA

SEQ ID NO: 533296 - protein, 10 aa, Mycobacterium
NSGGGGASGL

SEQ ID NO: 533297 - protein, 6 aa, Mycobacterium
NSGGGS

SEQ ID NO: 533298 - protein, 17 aa, Mycobacterium
NSGGKTAEAAAHQNAGL

SEQ ID NO: 533299 - protein, 17 aa, Mycobacterium
NSGGNVFGSGNRANATI

SEQ ID NO: 533300 - protein, 9 aa, Mycobacterium
NSGGPYPSH

SEQ ID NO: 533301 - protein, 9 aa, Mycobacterium
NSGGSATFI

SEQ ID NO: 533302 - protein, 12 aa, Mycobacterium
NSGGSSATTNTG

SEQ ID NO: 533303 - protein, 5 aa, Mycobacterium
NSGGT

SEQ ID NO: 533304 - protein, 8 aa, Mycobacterium
NSGGTGSL

SEQ ID NO: 533305 - protein, 11 aa, Mycobacterium
NSGGVPARAVS

SEQ ID NO: 533306 - protein, 8 aa, Mycobacterium
NSGHPIGN

SEQ ID NO: 533307 - protein, 7 aa, Mycobacterium
NSGHSTL

SEQ ID NO: 533308 - protein, 10 aa, Mycobacterium
NSGINPDDLA

SEQ ID NO: 533309 - protein, 14 aa, Mycobacterium
NSGINPGSTAGTEG

SEQ ID NO: 533310 - protein, 7 aa, Mycobacterium
NSGLRNY

SEQ ID NO: 533311 - protein, 13 aa, Mycobacterium
NSGNDNTGIGNSG

SEQ ID NO: 533312 - protein, 9 aa, Mycobacterium
NSGNHNSGW

SEQ ID NO: 533313 - protein, 53 aa, Mycobacterium
NSGNNDPGLRNTTVREPVSGAPVLPGSGIPKSTFYPSREPADPGTGIKLPVRS

SEQ ID NO: 533314 - protein, 7 aa, Mycobacterium
NSGNSPL

SEQ ID NO: 533315 - protein, 6 aa, Mycobacterium
NSGNTI

SEQ ID NO: 533316 - protein, 8 aa, Mycobacterium
NSGNTNTG

SEQ ID NO: 533317 - protein, 15 aa, Mycobacterium
NSGNTNTGFGNGGSV

SEQ ID NO: 533318 - protein, 7 aa, Mycobacterium
NSGPAIA

SEQ ID NO: 533319 - protein, 10 aa, Mycobacterium
NSGPGAGSGF

SEQ ID NO: 533320 - protein, 10 aa, Mycobacterium
NSGPGGVSGF

SEQ ID NO: 533321 - protein, 9 aa, Mycobacterium
NSGPGPEPL

SEQ ID NO: 533322 - protein, 6 aa, Mycobacterium
NSGPGT

SEQ ID NO: 533323 - protein, 5 aa, Mycobacterium
NSGPL

SEQ ID NO: 533324 - protein, 9 aa, Mycobacterium
NSGPLPDEI

SEQ ID NO: 533325 - protein, 9 aa, Mycobacterium
NSGPLPEEI

SEQ ID NO: 533326 - protein, 9 aa, Mycobacterium
NSGPLPEEV

SEQ ID NO: 533327 - protein, 4 aa, Mycobacterium
NSGQ

SEQ ID NO: 533328 - protein, 6 aa, Mycobacterium
NSGQDC

SEQ ID NO: 533329 - protein, 12 aa, Mycobacterium
NSGQKDAATAQT

SEQ ID NO: 533330 - protein, 4 aa, Mycobacterium
NSGR

SEQ ID NO: 533331 - protein, 11 aa, Mycobacterium
NSGRAWPPGGQ

SEQ ID NO: 533332 - protein, 5 aa, Mycobacterium
NSGRF

SEQ ID NO: 533333 - protein, 25 aa, Mycobacterium
NSGRGAAARRSASQRADSASRHPSV

SEQ ID NO: 533334 - protein, 4 aa, Mycobacterium
NSGS

SEQ ID NO: 533335 - protein, 9 aa, Mycobacterium
NSGSAGELV

SEQ ID NO: 533336 - protein, 8 aa, Mycobacterium
NSGSERSN

SEQ ID NO: 533337 - protein, 8 aa, Mycobacterium
NSGSGGFN

SEQ ID NO: 533338 - protein, 16 aa, Mycobacterium
NSGSGNIGIGNSGTNN

SEQ ID NO: 533339 - protein, 9 aa, Mycobacterium
NSGSGNSGF

SEQ ID NO: 533340 - protein, 20 aa, Mycobacterium
NSGSGNSGLFNSGNDNSGFF

SEQ ID NO: 533341 - protein, 19 aa, Mycobacterium
NSGSGNTGFGNSGNTNTGF

SEQ ID NO: 533342 - protein, 16 aa, Mycobacterium
NSGSGNTGIFNSGSNN

SEQ ID NO: 533343 - protein, 16 aa, Mycobacterium
NSGSGNVGIGNSGTNN

SEQ ID NO: 533344 - protein, 8 aa, Mycobacterium
NSGSKPPF

SEQ ID NO: 533345 - protein, 12 aa, Mycobacterium
NSGSLASDEAQD

SEQ ID NO: 533346 - protein, 18 aa, Mycobacterium
NSGSLNTGIGNTGSTNTG

SEQ ID NO: 533347 - protein, 8 aa, Mycobacterium
NSGSPEDL

SEQ ID NO: 533348 - protein, 8 aa, Mycobacterium
NSGSPEEL

SEQ ID NO: 533349 - protein, 8 aa, Mycobacterium
NSGSSGTV

SEQ ID NO: 533350 - protein, 11 aa, Mycobacterium
NSGSTIESNDA

SEQ ID NO: 533351 - protein, 9 aa, Mycobacterium
NSGTANSGV

SEQ ID NO: 533352 - protein, 16 aa, Mycobacterium
NSGTAQSGIGNSGTNF

SEQ ID NO: 533353 - protein, 17 aa, Mycobacterium
NSGTDTSGFQNSTGGAY

SEQ ID NO: 533354 - protein, 8 aa, Mycobacterium
NSGTEATM

SEQ ID NO: 533355 - protein, 8 aa, Mycobacterium
NSGTGNFG

SEQ ID NO: 533356 - protein, 9 aa, Mycobacterium
NSGTGNSGF

SEQ ID NO: 533357 - protein, 9 aa, Mycobacterium
NSGTGNTGI

SEQ ID NO: 533358 - protein, 12 aa, Mycobacterium
NSGTGNTGVGNA

SEQ ID NO: 533359 - protein, 5 aa, Mycobacterium
NSGTN

SEQ ID NO: 533360 - protein, 9 aa, Mycobacterium
NSGTNLPAT

SEQ ID NO: 533361 - protein, 9 aa, Mycobacterium
NSGTNNTGL

SEQ ID NO: 533362 - protein, 11 aa, Mycobacterium
NSGTPIPSNVT

SEQ ID NO: 533363 - protein, 8 aa, Mycobacterium
NSGTPSRA

SEQ ID NO: 533364 - protein, 8 aa, Mycobacterium
NSGTSLPA

SEQ ID NO: 533365 - protein, 17 aa, Mycobacterium
NSGTSPTAPHRRNWPDA

SEQ ID NO: 533366 - protein, 8 aa, Mycobacterium
NSGTTIPQ

SEQ ID NO: 533367 - protein, 4 aa, Mycobacterium
NSGV

SEQ ID NO: 533368 - protein, 7 aa, Mycobacterium
NSGVEES

SEQ ID NO: 533369 - protein, 10 aa, Mycobacterium
NSGVQAVNGG

SEQ ID NO: 533370 - protein, 5 aa, Mycobacterium
NSGVR

SEQ ID NO: 533371 - protein, 6 aa, Mycobacterium
NSGVRA

SEQ ID NO: 533372 - protein, 4 aa, Mycobacterium
NSHD

SEQ ID NO: 533373 - protein, 5 aa, Mycobacterium
NSHEA

SEQ ID NO: 533374 - protein, 11 aa, Mycobacterium
NSHGRNGDGDT

SEQ ID NO: 533375 - protein, 24 aa, Mycobacterium
NSHNKGEGGGARVEAGYAARGEAW

SEQ ID NO: 533376 - protein, 4 aa, Mycobacterium
NSHP

SEQ ID NO: 533377 - protein, 6 aa, Mycobacterium
NSHPAA

SEQ ID NO: 533378 - protein, 10 aa, Mycobacterium
NSIEATAAQI

SEQ ID NO: 533379 - protein, 11 aa, Mycobacterium
NSILPEDRQKA

SEQ ID NO: 533380 - protein, 11 aa, Mycobacterium
NSIPEGPPVGT

SEQ ID NO: 533381 - protein, 11 aa, Mycobacterium
NSISAAPSNRV

SEQ ID NO: 533382 - protein, 7 aa, Mycobacterium
NSISPGV

SEQ ID NO: 533383 - protein, 10 aa, Mycobacterium
NSIVPARTPR

SEQ ID NO: 533384 - protein, 7 aa, Mycobacterium
NSKAQAA

SEQ ID NO: 533385 - protein, 7 aa, Mycobacterium
NSKGDEM

SEQ ID NO: 533386 - protein, 10 aa, Mycobacterium
NSKGSGALGA

SEQ ID NO: 533387 - protein, 8 aa, Mycobacterium
NSKHNPLH

SEQ ID NO: 533388 - protein, 10 aa, Mycobacterium
NSKPAAEEVA

SEQ ID NO: 533389 - protein, 8 aa, Mycobacterium
NSKPAVRR

SEQ ID NO: 533390 - protein, 13 aa, Mycobacterium
NSKTPGMATTDSD

SEQ ID NO: 533391 - protein, 6 aa, Mycobacterium
NSKVDS

SEQ ID NO: 533392 - protein, 8 aa, Mycobacterium
NSLANPHH

SEQ ID NO: 533393 - protein, 6 aa, Mycobacterium
NSLAPY

SEQ ID NO: 533394 - protein, 15 aa, Mycobacterium
NSLAQQSRRNPDGTG

SEQ ID NO: 533395 - protein, 4 aa, Mycobacterium
NSLD

SEQ ID NO: 533396 - protein, 9 aa, Mycobacterium
NSLDPATVE

SEQ ID NO: 533397 - protein, 6 aa, Mycobacterium
NSLDPE

SEQ ID NO: 533398 - protein, 7 aa, Mycobacterium
NSLDTSA

SEQ ID NO: 533399 - protein, 9 aa, Mycobacterium
NSLEEQMEA

SEQ ID NO: 533400 - protein, 8 aa, Mycobacterium
NSLGGGTA

SEQ ID NO: 533401 - protein, 8 aa, Mycobacterium
NSLGKHVS

SEQ ID NO: 533402 - protein, 7 aa, Mycobacterium
NSLGNHV

SEQ ID NO: 533403 - protein, 13 aa, Mycobacterium
NSLHRSKADESYQ

SEQ ID NO: 533404 - protein, 4 aa, Mycobacterium
NSLP

SEQ ID NO: 533405 - protein, 4 aa, Mycobacterium
NSLQ

SEQ ID NO: 533406 - protein, 9 aa, Mycobacterium
NSLQDGPIG

SEQ ID NO: 533407 - protein, 4 aa, Mycobacterium
NSLR

SEQ ID NO: 533408 - protein, 6 aa, Mycobacterium
NSLRAR

SEQ ID NO: 533409 - protein, 9 aa, Mycobacterium
NSLRHSGAT

SEQ ID NO: 533410 - protein, 54 aa, Mycobacterium
NSLSDRPAALDEAREAQARAAEQARAAAAKQARREHAEGRERGKAAATGPGRAA

SEQ ID NO: 533411 - protein, 54 aa, Mycobacterium
NSLSDRPAALDEAREAQARATEQARAAAANQARREHAEGRARGKAAATGPGRTA

SEQ ID NO: 533412 - protein, 7 aa, Mycobacterium
NSLSEDD

SEQ ID NO: 533413 - protein, 6 aa, Mycobacterium
NSLSRP

SEQ ID NO: 533414 - protein, 5 aa, Mycobacterium
NSLTA

SEQ ID NO: 533415 - protein, 6 aa, Mycobacterium
NSLTES

SEQ ID NO: 533416 - protein, 6 aa, Mycobacterium
NSLYTD

SEQ ID NO: 533417 - protein, 5 aa, Mycobacterium
NSMSS

SEQ ID NO: 533418 - protein, 13 aa, Mycobacterium
NSMTTNGLSTSRS

SEQ ID NO: 533419 - protein, 8 aa, Mycobacterium
NSMTTNGV

SEQ ID NO: 533420 - protein, 18 aa, Mycobacterium
NSNAEAEQTLSHARNEAD

SEQ ID NO: 533421 - protein, 6 aa, Mycobacterium
NSNETI

SEQ ID NO: 533422 - protein, 5 aa, Mycobacterium
NSNGD

SEQ ID NO: 533423 - protein, 6 aa, Mycobacterium
NSNGDG

SEQ ID NO: 533424 - protein, 9 aa, Mycobacterium
NSNGQSVAQ

SEQ ID NO: 533425 - protein, 15 aa, Mycobacterium
NSNMDGSLNTAATET

SEQ ID NO: 533426 - protein, 8 aa, Mycobacterium
NSNPNAGI

SEQ ID NO: 533427 - protein, 6 aa, Mycobacterium
NSPAEK

SEQ ID NO: 533428 - protein, 9 aa, Mycobacterium
NSPAIAATE

SEQ ID NO: 533429 - protein, 20 aa, Mycobacterium
NSPATTRQQQTLATSGASYP

SEQ ID NO: 533430 - protein, 10 aa, Mycobacterium
NSPDAVAPHG

SEQ ID NO: 533431 - protein, 12 aa, Mycobacterium
NSPDCEWKDRRS

SEQ ID NO: 533432 - protein, 8 aa, Mycobacterium
NSPDGYRT

SEQ ID NO: 533433 - protein, 8 aa, Mycobacterium
NSPDPFDS

SEQ ID NO: 533434 - protein, 14 aa, Mycobacterium
NSPEAARRAAADGI

SEQ ID NO: 533435 - protein, 7 aa, Mycobacterium
NSPECGA

SEQ ID NO: 533436 - protein, 11 aa, Mycobacterium
NSPEDRQAIAE

SEQ ID NO: 533437 - protein, 7 aa, Mycobacterium
NSPEGRA

SEQ ID NO: 533438 - protein, 8 aa, Mycobacterium
NSPEKFTD

SEQ ID NO: 533439 - protein, 10 aa, Mycobacterium
NSPETLAPHG

SEQ ID NO: 533440 - protein, 4 aa, Mycobacterium
NSPG

SEQ ID NO: 533441 - protein, 7 aa, Mycobacterium
NSPGAAA

SEQ ID NO: 533442 - protein, 7 aa, Mycobacterium
NSPGART

SEQ ID NO: 533443 - protein, 14 aa, Mycobacterium
NSPGASALQGLTAQ

SEQ ID NO: 533444 - protein, 6 aa, Mycobacterium
NSPGFE

SEQ ID NO: 533445 - protein, 10 aa, Mycobacterium
NSPGGSVTAS

SEQ ID NO: 533446 - protein, 5 aa, Mycobacterium
NSPGL

SEQ ID NO: 533447 - protein, 5 aa, Mycobacterium
NSPGQ

SEQ ID NO: 533448 - protein, 6 aa, Mycobacterium
NSPGRL

SEQ ID NO: 533449 - protein, 6 aa, Mycobacterium
NSPGSM

SEQ ID NO: 533450 - protein, 13 aa, Mycobacterium
NSPGTIDAGYRGE

SEQ ID NO: 533451 - protein, 17 aa, Mycobacterium
NSPGTPMTTEPVQGGPV

SEQ ID NO: 533452 - protein, 6 aa, Mycobacterium
NSPGWR

SEQ ID NO: 533453 - protein, 14 aa, Mycobacterium
NSPHHQGATPLENA

SEQ ID NO: 533454 - protein, 4 aa, Mycobacterium
NSPI

SEQ ID NO: 533455 - protein, 7 aa, Mycobacterium
NSPIGNN

SEQ ID NO: 533456 - protein, 10 aa, Mycobacterium
NSPIKDGKKT

SEQ ID NO: 533457 - protein, 6 aa, Mycobacterium
NSPIPL

SEQ ID NO: 533458 - protein, 10 aa, Mycobacterium
NSPKNSLPQD

SEQ ID NO: 533459 - protein, 4 aa, Mycobacterium
NSPL

SEQ ID NO: 533460 - protein, 10 aa, Mycobacterium
NSPLDGKAAE

SEQ ID NO: 533461 - protein, 5 aa, Mycobacterium
NSPMG

SEQ ID NO: 533462 - protein, 52 aa, Mycobacterium
NSPNIAGGSQPAKQPKPKEGEGEGEDPLKGGNQKGGGPNGGKPGPSGHADDP

SEQ ID NO: 533463 - protein, 15 aa, Mycobacterium
NSPPNPDGPTALQNS

SEQ ID NO: 533464 - protein, 16 aa, Mycobacterium
NSPPNPDGPTALQSSG

SEQ ID NO: 533465 - protein, 6 aa, Mycobacterium
NSPPPL

SEQ ID NO: 533466 - protein, 12 aa, Mycobacterium
NSPQAGSGTPEQ

SEQ ID NO: 533467 - protein, 6 aa, Mycobacterium
NSPQSP

SEQ ID NO: 533468 - protein, 8 aa, Mycobacterium
NSPRAKAY

SEQ ID NO: 533469 - protein, 14 aa, Mycobacterium
NSPRPQSALPADDQ

SEQ ID NO: 533470 - protein, 6 aa, Mycobacterium
NSPRQT

SEQ ID NO: 533471 - protein, 6 aa, Mycobacterium
NSPRTY

SEQ ID NO: 533472 - protein, 4 aa, Mycobacterium
NSPS

SEQ ID NO: 533473 - protein, 9 aa, Mycobacterium
NSPSGQAYR

SEQ ID NO: 533474 - protein, 15 aa, Mycobacterium
NSPSGVGTVVFNYPP

SEQ ID NO: 533475 - protein, 9 aa, Mycobacterium
NSPSNPGPL

SEQ ID NO: 533476 - protein, 13 aa, Mycobacterium
NSPSSKDAAEETV

SEQ ID NO: 533477 - protein, 15 aa, Mycobacterium
NSPSSVAVSGETGAV

SEQ ID NO: 533478 - protein, 8 aa, Mycobacterium
NSPTAGLA

SEQ ID NO: 533479 - protein, 6 aa, Mycobacterium
NSPTFD

SEQ ID NO: 533480 - protein, 15 aa, Mycobacterium
NSPTLVAGQTLIAPI

SEQ ID NO: 533481 - protein, 6 aa, Mycobacterium
NSPTPA

SEQ ID NO: 533482 - protein, 6 aa, Mycobacterium
NSPTYR

SEQ ID NO: 533483 - protein, 4 aa, Mycobacterium
NSPV

SEQ ID NO: 533484 - protein, 6 aa, Mycobacterium
NSPVAT

SEQ ID NO: 533485 - protein, 7 aa, Mycobacterium
NSPVDGY

SEQ ID NO: 533486 - protein, 10 aa, Mycobacterium
NSPVGNGENV

SEQ ID NO: 533487 - protein, 8 aa, Mycobacterium
NSPYGNGT

SEQ ID NO: 533488 - protein, 8 aa, Mycobacterium
NSQARQGI

SEQ ID NO: 533489 - protein, 4 aa, Mycobacterium
NSQD

SEQ ID NO: 533490 - protein, 5 aa, Mycobacterium
NSQER

SEQ ID NO: 533491 - protein, 4 aa, Mycobacterium
NSQF

SEQ ID NO: 533492 - protein, 13 aa, Mycobacterium
NSQGDSPFRPSTH

SEQ ID NO: 533493 - protein, 16 aa, Mycobacterium
NSQGGKPKDGSDLPRL

SEQ ID NO: 533494 - protein, 11 aa, Mycobacterium
NSQGPDALQTR

SEQ ID NO: 533495 - protein, 5 aa, Mycobacterium
NSQGT

SEQ ID NO: 533496 - protein, 6 aa, Mycobacterium
NSQGYS

SEQ ID NO: 533497 - protein, 7 aa, Mycobacterium
NSQGYSR

SEQ ID NO: 533498 - protein, 4 aa, Mycobacterium
NSQL

SEQ ID NO: 533499 - protein, 5 aa, Mycobacterium
NSQLR

SEQ ID NO: 533500 - protein, 5 aa, Mycobacterium
NSQNY

SEQ ID NO: 533501 - protein, 10 aa, Mycobacterium
NSQPSNGCPV

SEQ ID NO: 533502 - protein, 15 aa, Mycobacterium
NSQRGRGRLRHYSNC

SEQ ID NO: 533503 - protein, 4 aa, Mycobacterium
NSQS

SEQ ID NO: 533504 - protein, 7 aa, Mycobacterium
NSQYGGE

SEQ ID NO: 533505 - protein, 6 aa, Mycobacterium
NSQYGL

SEQ ID NO: 533506 - protein, 8 aa, Mycobacterium
NSRALAEA

SEQ ID NO: 533507 - protein, 24 aa, Mycobacterium
NSRALPGGGDMGAPSRGSQDQRSV

SEQ ID NO: 533508 - protein, 14 aa, Mycobacterium
NSRASVRSDPEKSV

SEQ ID NO: 533509 - protein, 4 aa, Mycobacterium
NSRG

SEQ ID NO: 533510 - protein, 6 aa, Mycobacterium
NSRGAD

SEQ ID NO: 533511 - protein, 6 aa, Mycobacterium
NSRGER

SEQ ID NO: 533512 - protein, 8 aa, Mycobacterium
NSRGTTRV

SEQ ID NO: 533513 - protein, 15 aa, Mycobacterium
NSRHGLQNPNARYRK

SEQ ID NO: 533514 - protein, 5 aa, Mycobacterium
NSRHT

SEQ ID NO: 533515 - protein, 4 aa, Mycobacterium
NSRP

SEQ ID NO: 533516 - protein, 11 aa, Mycobacterium
NSRPERRDPPR

SEQ ID NO: 533517 - protein, 11 aa, Mycobacterium
NSRPERRDPPT

SEQ ID NO: 533518 - protein, 15 aa, Mycobacterium
NSRPHAARPPDRPIP

SEQ ID NO: 533519 - protein, 5 aa, Mycobacterium
NSRPL

SEQ ID NO: 533520 - protein, 12 aa, Mycobacterium
NSRPTRAEASDV

SEQ ID NO: 533521 - protein, 6 aa, Mycobacterium
NSRPVE

SEQ ID NO: 533522 - protein, 18 aa, Mycobacterium
NSRQPGRQIPIGYRTATI

SEQ ID NO: 533523 - protein, 10 aa, Mycobacterium
NSRRAPAYDG

SEQ ID NO: 533524 - protein, 11 aa, Mycobacterium
NSRRENPTDDL

SEQ ID NO: 533525 - protein, 6 aa, Mycobacterium
NSRRGQ

SEQ ID NO: 533526 - protein, 5 aa, Mycobacterium
NSRSD

SEQ ID NO: 533527 - protein, 12 aa, Mycobacterium
NSRSDDAVVPPE

SEQ ID NO: 533528 - protein, 8 aa, Mycobacterium
NSRSGDTR

SEQ ID NO: 533529 - protein, 8 aa, Mycobacterium
NSRSKYRP

SEQ ID NO: 533530 - protein, 21 aa, Mycobacterium
NSRSTTTSAARPSVATTPCSP

SEQ ID NO: 533531 - protein, 4 aa, Mycobacterium
NSRT

SEQ ID NO: 533532 - protein, 7 aa, Mycobacterium
NSRTADV

SEQ ID NO: 533533 - protein, 6 aa, Mycobacterium
NSRTAL

SEQ ID NO: 533534 - protein, 7 aa, Mycobacterium
NSRTRAA

SEQ ID NO: 533535 - protein, 7 aa, Mycobacterium
NSRTRAV

SEQ ID NO: 533536 - protein, 4 aa, Mycobacterium
NSRV

SEQ ID NO: 533537 - protein, 7 aa, Mycobacterium
NSRVPSA

SEQ ID NO: 533538 - protein, 8 aa, Mycobacterium
NSRVRSEQ

SEQ ID NO: 533539 - protein, 20 aa, Mycobacterium
NSSADTVGNSVNDALSQPLK

SEQ ID NO: 533540 - protein, 21 aa, Mycobacterium
NSSAPAAPGVSAGLGEAASVG

SEQ ID NO: 533541 - protein, 12 aa, Mycobacterium
NSSASKSKVIAD

SEQ ID NO: 533542 - protein, 7 aa, Mycobacterium
NSSATAY

SEQ ID NO: 533543 - protein, 9 aa, Mycobacterium
NSSATMARP

SEQ ID NO: 533544 - protein, 23 aa, Mycobacterium
NSSATPADVESANGSCPSRRAAA

SEQ ID NO: 533545 - protein, 45 aa, Mycobacterium
NSSDDNSGFGNSSSGGHNSGAANSGSGGYNAGFGNSNTGGGSTGY

SEQ ID NO: 533546 - protein, 9 aa, Mycobacterium
NSSDPQRIG

SEQ ID NO: 533547 - protein, 6 aa, Mycobacterium
NSSDVY

SEQ ID NO: 533548 - protein, 9 aa, Mycobacterium
NSSEIPERD

SEQ ID NO: 533549 - protein, 6 aa, Mycobacterium
NSSETL

SEQ ID NO: 533550 - protein, 6 aa, Mycobacterium
NSSEVP

SEQ ID NO: 533551 - protein, 13 aa, Mycobacterium
NSSGGTYQAGEAQ

SEQ ID NO: 533552 - protein, 23 aa, Mycobacterium
NSSGLRQTKAGRPKSDEKTRTLG

SEQ ID NO: 533553 - protein, 8 aa, Mycobacterium
NSSGVTAR

SEQ ID NO: 533554 - protein, 7 aa, Mycobacterium
NSSHSTL

SEQ ID NO: 533555 - protein, 8 aa, Mycobacterium
NSSPAFTP

SEQ ID NO: 533556 - protein, 14 aa, Mycobacterium
NSSPEPLPVQPSPD

SEQ ID NO: 533557 - protein, 5 aa, Mycobacterium
NSSPV

SEQ ID NO: 533558 - protein, 10 aa, Mycobacterium
NSSQGGGSKD

SEQ ID NO: 533559 - protein, 7 aa, Mycobacterium
NSSSFPS

SEQ ID NO: 533560 - protein, 11 aa, Mycobacterium
NSSTADLPTAA

SEQ ID NO: 533561 - protein, 9 aa, Mycobacterium
NSSTKGIDG

SEQ ID NO: 533562 - protein, 5 aa, Mycobacterium
NSSVP

SEQ ID NO: 533563 - protein, 8 aa, Mycobacterium
NSSVTAEE

SEQ ID NO: 533564 - protein, 11 aa, Mycobacterium
NSSYTGTAIPA

SEQ ID NO: 533565 - protein, 8 aa, Mycobacterium
NSTAALGN

SEQ ID NO: 533566 - protein, 25 aa, Mycobacterium
NSTADASTTAAKRSDRVSNEAQRRR

SEQ ID NO: 533567 - protein, 6 aa, Mycobacterium
NSTAER

SEQ ID NO: 533568 - protein, 9 aa, Mycobacterium
NSTAGGAYV

SEQ ID NO: 533569 - protein, 11 aa, Mycobacterium
NSTAIAATEAE

SEQ ID NO: 533570 - protein, 5 aa, Mycobacterium
NSTAL

SEQ ID NO: 533571 - protein, 14 aa, Mycobacterium
NSTAPPPYAITPPP

SEQ ID NO: 533572 - protein, 8 aa, Mycobacterium
NSTASRWQ

SEQ ID NO: 533573 - protein, 6 aa, Mycobacterium
NSTDIA

SEQ ID NO: 533574 - protein, 5 aa, Mycobacterium
NSTDR

SEQ ID NO: 533575 - protein, 12 aa, Mycobacterium
NSTDRGRLAPGQ

SEQ ID NO: 533576 - protein, 10 aa, Mycobacterium
NSTEGEPGLQ

SEQ ID NO: 533577 - protein, 6 aa, Mycobacterium
NSTEGY

SEQ ID NO: 533578 - protein, 6 aa, Mycobacterium
NSTEID

SEQ ID NO: 533579 - protein, 16 aa, Mycobacterium
NSTENSGGGDDRAAQE

SEQ ID NO: 533580 - protein, 6 aa, Mycobacterium
NSTEPV

SEQ ID NO: 533581 - protein, 12 aa, Mycobacterium
NSTERDRARERL

SEQ ID NO: 533582 - protein, 6 aa, Mycobacterium
NSTETV

SEQ ID NO: 533583 - protein, 6 aa, Mycobacterium
NSTGGL

SEQ ID NO: 533584 - protein, 17 aa, Mycobacterium
NSTGGNYKKNDGSADWM

SEQ ID NO: 533585 - protein, 8 aa, Mycobacterium
NSTGGSGL

SEQ ID NO: 533586 - protein, 21 aa, Mycobacterium
NSTHDSTEYYTDAGPGTPGRA

SEQ ID NO: 533587 - protein, 9 aa, Mycobacterium
NSTIGTGTK

SEQ ID NO: 533588 - protein, 4 aa, Mycobacterium
NSTL

SEQ ID NO: 533589 - protein, 4 aa, Mycobacterium
NSTM

SEQ ID NO: 533590 - protein, 12 aa, Mycobacterium
NSTNGTTVNNAP

SEQ ID NO: 533591 - protein, 6 aa, Mycobacterium
NSTPEK

SEQ ID NO: 533592 - protein, 4 aa, Mycobacterium
NSTQ

SEQ ID NO: 533593 - protein, 7 aa, Mycobacterium
NSTQNCR

SEQ ID NO: 533594 - protein, 16 aa, Mycobacterium
NSTTEASAAAIESDGS

SEQ ID NO: 533595 - protein, 12 aa, Mycobacterium
NSTTLSNRDGVS

SEQ ID NO: 533596 - protein, 8 aa, Mycobacterium
NSTTMEPH

SEQ ID NO: 533597 - protein, 10 aa, Mycobacterium
NSTTNPSSGL

SEQ ID NO: 533598 - protein, 11 aa, Mycobacterium
NSTVDPADRQR

SEQ ID NO: 533599 - protein, 9 aa, Mycobacterium
NSTVGRGTK

SEQ ID NO: 533600 - protein, 5 aa, Mycobacterium
NSTVK

SEQ ID NO: 533601 - protein, 15 aa, Mycobacterium
NSTYGHDISRRGSTT

SEQ ID NO: 533602 - protein, 8 aa, Mycobacterium
NSVAPAGQ

SEQ ID NO: 533603 - protein, 11 aa, Mycobacterium
NSVARKSATRY

SEQ ID NO: 533604 - protein, 7 aa, Mycobacterium
NSVASGR

SEQ ID NO: 533605 - protein, 8 aa, Mycobacterium
NSVDDEGM

SEQ ID NO: 533606 - protein, 5 aa, Mycobacterium
NSVDK

SEQ ID NO: 533607 - protein, 7 aa, Mycobacterium
NSVDNAG

SEQ ID NO: 533608 - protein, 8 aa, Mycobacterium
NSVDRDEL

SEQ ID NO: 533609 - protein, 5 aa, Mycobacterium
NSVGL

SEQ ID NO: 533610 - protein, 13 aa, Mycobacterium
NSVGPDGLEGEFD

SEQ ID NO: 533611 - protein, 9 aa, Mycobacterium
NSVGPDGRQ

SEQ ID NO: 533612 - protein, 6 aa, Mycobacterium
NSVGPQ

SEQ ID NO: 533613 - protein, 5 aa, Mycobacterium
NSVGQ

SEQ ID NO: 533614 - protein, 5 aa, Mycobacterium
NSVKD

SEQ ID NO: 533615 - protein, 9 aa, Mycobacterium
NSVNQTAMN

SEQ ID NO: 533616 - protein, 4 aa, Mycobacterium
NSVP

SEQ ID NO: 533617 - protein, 14 aa, Mycobacterium
NSVPDASDPAEPGA

SEQ ID NO: 533618 - protein, 8 aa, Mycobacterium
NSVRSQGE

SEQ ID NO: 533619 - protein, 8 aa, Mycobacterium
NSVSERDN

SEQ ID NO: 533620 - protein, 7 aa, Mycobacterium
NSVTAAA

SEQ ID NO: 533621 - protein, 10 aa, Mycobacterium
NSVTGPLDDR

SEQ ID NO: 533622 - protein, 6 aa, Mycobacterium
NSVTLS

SEQ ID NO: 533623 - protein, 4 aa, Mycobacterium
NSYE

SEQ ID NO: 533624 - protein, 6 aa, Mycobacterium
NSYGGA

SEQ ID NO: 533625 - protein, 6 aa, Mycobacterium
NSYGGS

SEQ ID NO: 533626 - protein, 6 aa, Mycobacterium
NSYGPY

SEQ ID NO: 533627 - protein, 7 aa, Mycobacterium
NSYGTGY

SEQ ID NO: 533628 - protein, 6 aa, Mycobacterium
NSYGTL

SEQ ID NO: 533629 - protein, 17 aa, Mycobacterium
NSYITGQSITIDGGFLC

SEQ ID NO: 533630 - protein, 5 aa, Mycobacterium
NSYMT

SEQ ID NO: 533631 - protein, 15 aa, Mycobacterium
NSYNTDTVTTGDHDG

SEQ ID NO: 533632 - protein, 6 aa, Mycobacterium
NSYPAG

SEQ ID NO: 533633 - protein, 6 aa, Mycobacterium
NSYRAA

SEQ ID NO: 533634 - protein, 7 aa, Mycobacterium
NSYRAKS

SEQ ID NO: 533635 - protein, 9 aa, Mycobacterium
NSYRAKSVD

SEQ ID NO: 533636 - protein, 5 aa, Mycobacterium
NSYTN

SEQ ID NO: 533637 - protein, 10 aa, Mycobacterium
NSYVSAEAAT

SEQ ID NO: 533638 - protein, 8 aa, Mycobacterium
NTAAEQPR

SEQ ID NO: 533639 - protein, 5 aa, Mycobacterium
NTAAK

SEQ ID NO: 533640 - protein, 5 aa, Mycobacterium
NTAAN

SEQ ID NO: 533641 - protein, 18 aa, Mycobacterium
NTAANAFGATYPGAGATI

SEQ ID NO: 533642 - protein, 19 aa, Mycobacterium
NTAANTFGASYPGAGATIG

SEQ ID NO: 533643 - protein, 9 aa, Mycobacterium
NTADGGVAG

SEQ ID NO: 533644 - protein, 7 aa, Mycobacterium
NTADPAH

SEQ ID NO: 533645 - protein, 10 aa, Mycobacterium
NTADQEDADR

SEQ ID NO: 533646 - protein, 9 aa, Mycobacterium
NTADVSPGD

SEQ ID NO: 533647 - protein, 7 aa, Mycobacterium
NTAEGGI

SEQ ID NO: 533648 - protein, 8 aa, Mycobacterium
NTAEGGVA

SEQ ID NO: 533649 - protein, 8 aa, Mycobacterium
NTAELDAE

SEQ ID NO: 533650 - protein, 5 aa, Mycobacterium
NTAEQ

SEQ ID NO: 533651 - protein, 13 aa, Mycobacterium
NTAEQNAANDGKG

SEQ ID NO: 533652 - protein, 14 aa, Mycobacterium
NTAEQNARNDGKGK

SEQ ID NO: 533653 - protein, 14 aa, Mycobacterium
NTAEQNAVNDGKGA

SEQ ID NO: 533654 - protein, 14 aa, Mycobacterium
NTAEQNAVNDGKGR

SEQ ID NO: 533655 - protein, 7 aa, Mycobacterium
NTAETAD

SEQ ID NO: 533656 - protein, 4 aa, Mycobacterium
NTAG

SEQ ID NO: 533657 - protein, 8 aa, Mycobacterium
NTAGGQLS

SEQ ID NO: 533658 - protein, 11 aa, Mycobacterium
NTAGPTGRSYE

SEQ ID NO: 533659 - protein, 5 aa, Mycobacterium
NTAGV

SEQ ID NO: 533660 - protein, 4 aa, Mycobacterium
NTAH

SEQ ID NO: 533661 - protein, 10 aa, Mycobacterium
NTAKGGVQAL

SEQ ID NO: 533662 - protein, 11 aa, Mycobacterium
NTAKGSVSARI

SEQ ID NO: 533663 - protein, 12 aa, Mycobacterium
NTAKPGRAPTGM

SEQ ID NO: 533664 - protein, 9 aa, Mycobacterium
NTALEPATT

SEQ ID NO: 533665 - protein, 24 aa, Mycobacterium
NTANRQGKRKRTRTGYGKRKSTKR

SEQ ID NO: 533666 - protein, 8 aa, Mycobacterium
NTANVSPG

SEQ ID NO: 533667 - protein, 6 aa, Mycobacterium
NTAPDF

SEQ ID NO: 533668 - protein, 9 aa, Mycobacterium
NTAPIAESE

SEQ ID NO: 533669 - protein, 6 aa, Mycobacterium
NTAPPI

SEQ ID NO: 533670 - protein, 7 aa, Mycobacterium
NTAPSRY

SEQ ID NO: 533671 - protein, 4 aa, Mycobacterium
NTAQ

SEQ ID NO: 533672 - protein, 6 aa, Mycobacterium
NTAQTN

SEQ ID NO: 533673 - protein, 4 aa, Mycobacterium
NTAR

SEQ ID NO: 533674 - protein, 5 aa, Mycobacterium
NTARA

SEQ ID NO: 533675 - protein, 9 aa, Mycobacterium
NTARASKAT

SEQ ID NO: 533676 - protein, 7 aa, Mycobacterium
NTARPHQ

SEQ ID NO: 533677 - protein, 13 aa, Mycobacterium
NTARSGKFSSDRA

SEQ ID NO: 533678 - protein, 4 aa, Mycobacterium
NTAS

SEQ ID NO: 533679 - protein, 9 aa, Mycobacterium
NTASDGAEA

SEQ ID NO: 533680 - protein, 25 aa, Mycobacterium
NTASDSGVTLPNPGQGNYGAAKAGI

SEQ ID NO: 533681 - protein, 24 aa, Mycobacterium
NTASGSGLTVPNAGQANYGAAKAG

SEQ ID NO: 533682 - protein, 8 aa, Mycobacterium
NTASPGAL

SEQ ID NO: 533683 - protein, 5 aa, Mycobacterium
NTAST

SEQ ID NO: 533684 - protein, 8 aa, Mycobacterium
NTASTKSA

SEQ ID NO: 533685 - protein, 6 aa, Mycobacterium
NTASTN

SEQ ID NO: 533686 - protein, 4 aa, Mycobacterium
NTAT

SEQ ID NO: 533687 - protein, 10 aa, Mycobacterium
NTATAAVAAG

SEQ ID NO: 533688 - protein, 6 aa, Mycobacterium
NTATFA

SEQ ID NO: 533689 - protein, 7 aa, Mycobacterium
NTATFAD

SEQ ID NO: 533690 - protein, 17 aa, Mycobacterium
NTAVNDGGTTAHPARDA

SEQ ID NO: 533691 - protein, 15 aa, Mycobacterium
NTAVSTDPDSSQSHD

SEQ ID NO: 533692 - protein, 4 aa, Mycobacterium
NTDA

SEQ ID NO: 533693 - protein, 9 aa, Mycobacterium
NTDAAAAIA

SEQ ID NO: 533694 - protein, 13 aa, Mycobacterium
NTDAKRKAAAQLE

SEQ ID NO: 533695 - protein, 13 aa, Mycobacterium
NTDAMDNSAGVDC

SEQ ID NO: 533696 - protein, 27 aa, Mycobacterium
NTDANQLSNAVTTDTPDAKTNASAGAL

SEQ ID NO: 533697 - protein, 8 aa, Mycobacterium
NTDAPRNR

SEQ ID NO: 533698 - protein, 8 aa, Mycobacterium
NTDASDVQ

SEQ ID NO: 533699 - protein, 9 aa, Mycobacterium
NTDASPFDE

SEQ ID NO: 533700 - protein, 14 aa, Mycobacterium
NTDDPDFDSDPTIA

SEQ ID NO: 533701 - protein, 15 aa, Mycobacterium
NTDDPDFDSDPTVAN

SEQ ID NO: 533702 - protein, 7 aa, Mycobacterium
NTDDSVE

SEQ ID NO: 533703 - protein, 5 aa, Mycobacterium
NTDGA

SEQ ID NO: 533704 - protein, 15 aa, Mycobacterium
NTDGDEMGGTLGRRT

SEQ ID NO: 533705 - protein, 9 aa, Mycobacterium
NTDGEAAEH

SEQ ID NO: 533706 - protein, 9 aa, Mycobacterium
NTDGPGQFR

SEQ ID NO: 533707 - protein, 5 aa, Mycobacterium
NTDGR

SEQ ID NO: 533708 - protein, 12 aa, Mycobacterium
NTDKGAQAAARI

SEQ ID NO: 533709 - protein, 9 aa, Mycobacterium
NTDKGHAAA

SEQ ID NO: 533710 - protein, 20 aa, Mycobacterium
NTDKGRRPSWNAAAPGSVAE

SEQ ID NO: 533711 - protein, 9 aa, Mycobacterium
NTDPASVGD

SEQ ID NO: 533712 - protein, 7 aa, Mycobacterium
NTDPNAY

SEQ ID NO: 533713 - protein, 6 aa, Mycobacterium
NTDPYG

SEQ ID NO: 533714 - protein, 9 aa, Mycobacterium
NTDRRNPGA

SEQ ID NO: 533715 - protein, 8 aa, Mycobacterium
NTDSAELS

SEQ ID NO: 533716 - protein, 9 aa, Mycobacterium
NTDSSDVRL

SEQ ID NO: 533717 - protein, 6 aa, Mycobacterium
NTDTAK

SEQ ID NO: 533718 - protein, 9 aa, Mycobacterium
NTDTDPALT

SEQ ID NO: 533719 - protein, 6 aa, Mycobacterium
NTDTGQ

SEQ ID NO: 533720 - protein, 4 aa, Mycobacterium
NTEA

SEQ ID NO: 533721 - protein, 9 aa, Mycobacterium
NTEAADTRP

SEQ ID NO: 533722 - protein, 14 aa, Mycobacterium
NTEADGSSKAKYTL

SEQ ID NO: 533723 - protein, 9 aa, Mycobacterium
NTEAHAAAP

SEQ ID NO: 533724 - protein, 5 aa, Mycobacterium
NTEAL

SEQ ID NO: 533725 - protein, 4 aa, Mycobacterium
NTEE

SEQ ID NO: 533726 - protein, 8 aa, Mycobacterium
NTEEEQEL

SEQ ID NO: 533727 - protein, 6 aa, Mycobacterium
NTEERR

SEQ ID NO: 533728 - protein, 4 aa, Mycobacterium
NTEF

SEQ ID NO: 533729 - protein, 4 aa, Mycobacterium
NTEG

SEQ ID NO: 533730 - protein, 9 aa, Mycobacterium
NTEGEYSPI

SEQ ID NO: 533731 - protein, 10 aa, Mycobacterium
NTEGEYSSIG

SEQ ID NO: 533732 - protein, 9 aa, Mycobacterium
NTEGMSEPA

SEQ ID NO: 533733 - protein, 8 aa, Mycobacterium
NTEHTHGL

SEQ ID NO: 533734 - protein, 9 aa, Mycobacterium
NTEKGEAVA

SEQ ID NO: 533735 - protein, 19 aa, Mycobacterium
NTEKGNAAQASIKGSTEVR

SEQ ID NO: 533736 - protein, 4 aa, Mycobacterium
NTEL

SEQ ID NO: 533737 - protein, 6 aa, Mycobacterium
NTELQN

SEQ ID NO: 533738 - protein, 5 aa, Mycobacterium
NTENV

SEQ ID NO: 533739 - protein, 4 aa, Mycobacterium
NTEP

SEQ ID NO: 533740 - protein, 6 aa, Mycobacterium
NTEPAR

SEQ ID NO: 533741 - protein, 5 aa, Mycobacterium
NTEPH

SEQ ID NO: 533742 - protein, 5 aa, Mycobacterium
NTEPV

SEQ ID NO: 533743 - protein, 4 aa, Mycobacterium
NTEQ

SEQ ID NO: 533744 - protein, 4 aa, Mycobacterium
NTER

SEQ ID NO: 533745 - protein, 8 aa, Mycobacterium
NTERPHQS

SEQ ID NO: 533746 - protein, 9 aa, Mycobacterium
NTESAGSRP

SEQ ID NO: 533747 - protein, 7 aa, Mycobacterium
NTESEAD

SEQ ID NO: 533748 - protein, 8 aa, Mycobacterium
NTESGTPN

SEQ ID NO: 533749 - protein, 5 aa, Mycobacterium
NTESL

SEQ ID NO: 533750 - protein, 8 aa, Mycobacterium
NTETAEKV

SEQ ID NO: 533751 - protein, 6 aa, Mycobacterium
NTETQQ

SEQ ID NO: 533752 - protein, 8 aa, Mycobacterium
NTFDPGQH

SEQ ID NO: 533753 - protein, 5 aa, Mycobacterium
NTFPA

SEQ ID NO: 533754 - protein, 14 aa, Mycobacterium
NTFTKAGGEQKVGR

SEQ ID NO: 533755 - protein, 14 aa, Mycobacterium
NTGADSSGIGNSPV

SEQ ID NO: 533756 - protein, 9 aa, Mycobacterium
NTGAGNRKA

SEQ ID NO: 533757 - protein, 12 aa, Mycobacterium
NTGAIAATEAQY

SEQ ID NO: 533758 - protein, 9 aa, Mycobacterium
NTGAPPAEL

SEQ ID NO: 533759 - protein, 7 aa, Mycobacterium
NTGASRD

SEQ ID NO: 533760 - protein, 8 aa, Mycobacterium
NTGATQWS

SEQ ID NO: 533761 - protein, 9 aa, Mycobacterium
NTGAVTRDD

SEQ ID NO: 533762 - protein, 4 aa, Mycobacterium
NTGD

SEQ ID NO: 533763 - protein, 10 aa, Mycobacterium
NTGDGSVSGF

SEQ ID NO: 533764 - protein, 8 aa, Mycobacterium
NTGDNQSG

SEQ ID NO: 533765 - protein, 8 aa, Mycobacterium
NTGDPDDL

SEQ ID NO: 533766 - protein, 5 aa, Mycobacterium
NTGDR

SEQ ID NO: 533767 - protein, 8 aa, Mycobacterium
NTGDRPIQ

SEQ ID NO: 533768 - protein, 10 aa, Mycobacterium
NTGDRSGADV

SEQ ID NO: 533769 - protein, 7 aa, Mycobacterium
NTGEEFT

SEQ ID NO: 533770 - protein, 6 aa, Mycobacterium
NTGEKT

SEQ ID NO: 533771 - protein, 11 aa, Mycobacterium
NTGEPRADLPI

SEQ ID NO: 533772 - protein, 10 aa, Mycobacterium
NTGEPVGRNR

SEQ ID NO: 533773 - protein, 15 aa, Mycobacterium
NTGEVVSNGSNKPFP

SEQ ID NO: 533774 - protein, 7 aa, Mycobacterium
NTGFAPA

SEQ ID NO: 533775 - protein, 8 aa, Mycobacterium
NTGFGNGG

SEQ ID NO: 533776 - protein, 10 aa, Mycobacterium
NTGGFNSGSM

SEQ ID NO: 533777 - protein, 6 aa, Mycobacterium
NTGGGV

SEQ ID NO: 533778 - protein, 9 aa, Mycobacterium
NTGGITRDD

SEQ ID NO: 533779 - protein, 9 aa, Mycobacterium
NTGGVTRDD

SEQ ID NO: 533780 - protein, 10 aa, Mycobacterium
NTGGVTRDDS

SEQ ID NO: 533781 - protein, 20 aa, Mycobacterium
NTGHDGGAGTVHANSPAEVP

SEQ ID NO: 533782 - protein, 34 aa, Mycobacterium
NTGIANAGSINTGSYNTGANNTGSFNPGNANTGL

SEQ ID NO: 533783 - protein, 10 aa, Mycobacterium
NTGIANPGNF

SEQ ID NO: 533784 - protein, 45 aa, Mycobacterium
NTGIANSGSDNAGVGNSGSDNSGVQNSGTFSSGGFNTGDSQSGFF

SEQ ID NO: 533785 - protein, 6 aa, Mycobacterium
NTGIGN

SEQ ID NO: 533786 - protein, 6 aa, Mycobacterium
NTGIGY

SEQ ID NO: 533787 - protein, 14 aa, Mycobacterium
NTGINDGGTSAHPM

SEQ ID NO: 533788 - protein, 4 aa, Mycobacterium
NTGK

SEQ ID NO: 533789 - protein, 15 aa, Mycobacterium
NTGKAHGAALGDEEV

SEQ ID NO: 533790 - protein, 12 aa, Mycobacterium
NTGLGNSGNINT

SEQ ID NO: 533791 - protein, 8 aa, Mycobacterium
NTGMANSA

SEQ ID NO: 533792 - protein, 6 aa, Mycobacterium
NTGNFG

SEQ ID NO: 533793 - protein, 6 aa, Mycobacterium
NTGNHA

SEQ ID NO: 533794 - protein, 8 aa, Mycobacterium
NTGPALSD

SEQ ID NO: 533795 - protein, 13 aa, Mycobacterium
NTGPGYHETGLLR

SEQ ID NO: 533796 - protein, 9 aa, Mycobacterium
NTGPLPDEI

SEQ ID NO: 533797 - protein, 9 aa, Mycobacterium
NTGPLPEEI

SEQ ID NO: 533798 - protein, 6 aa, Mycobacterium
NTGQEF

SEQ ID NO: 533799 - protein, 8 aa, Mycobacterium
NTGQRLAD

SEQ ID NO: 533800 - protein, 9 aa, Mycobacterium
NTGRAAPRD

SEQ ID NO: 533801 - protein, 14 aa, Mycobacterium
NTGRDTSKGRAIAR

SEQ ID NO: 533802 - protein, 6 aa, Mycobacterium
NTGRFS

SEQ ID NO: 533803 - protein, 8 aa, Mycobacterium
NTGRFSPE

SEQ ID NO: 533804 - protein, 9 aa, Mycobacterium
NTGRFSPET

SEQ ID NO: 533805 - protein, 10 aa, Mycobacterium
NTGRHGSPAA

SEQ ID NO: 533806 - protein, 10 aa, Mycobacterium
NTGRSARVDD

SEQ ID NO: 533807 - protein, 6 aa, Mycobacterium
NTGSGN

SEQ ID NO: 533808 - protein, 16 aa, Mycobacterium
NTGSGNIGIGNSGNNN

SEQ ID NO: 533809 - protein, 16 aa, Mycobacterium
NTGSGNIGIGNSGSNN

SEQ ID NO: 533810 - protein, 19 aa, Mycobacterium
NTGSGTASGFGNTGGNNSG

SEQ ID NO: 533811 - protein, 11 aa, Mycobacterium
NTGSNTTNPGH

SEQ ID NO: 533812 - protein, 9 aa, Mycobacterium
NTGSQDDLV

SEQ ID NO: 533813 - protein, 9 aa, Mycobacterium
NTGSTASLG

SEQ ID NO: 533814 - protein, 6 aa, Mycobacterium
NTGSTN

SEQ ID NO: 533815 - protein, 7 aa, Mycobacterium
NTGSVAG

SEQ ID NO: 533816 - protein, 4 aa, Mycobacterium
NTGT

SEQ ID NO: 533817 - protein, 8 aa, Mycobacterium
NTGTAEAV

SEQ ID NO: 533818 - protein, 9 aa, Mycobacterium
NTGTDNSGF

SEQ ID NO: 533819 - protein, 39 aa, Mycobacterium
NTGTDNSGFGQSGTLNSGWGNSGSNSSGSNHTGNDQSGF

SEQ ID NO: 533820 - protein, 6 aa, Mycobacterium
NTGTDS

SEQ ID NO: 533821 - protein, 11 aa, Mycobacterium
NTGTGCVPTSS

SEQ ID NO: 533822 - protein, 42 aa, Mycobacterium
NTGTGNSGIRGTGDYNSGFANRGTYNSGADSAGHEAGMTSNS

SEQ ID NO: 533823 - protein, 7 aa, Mycobacterium
NTGTGPA

SEQ ID NO: 533824 - protein, 9 aa, Mycobacterium
NTGTIPSKT

SEQ ID NO: 533825 - protein, 16 aa, Mycobacterium
NTGTNNMGFGNSGNNN

SEQ ID NO: 533826 - protein, 19 aa, Mycobacterium
NTGTSGDALNAASEKWRQG

SEQ ID NO: 533827 - protein, 15 aa, Mycobacterium
NTGTSPTAPHRQNWP

SEQ ID NO: 533828 - protein, 18 aa, Mycobacterium
NTGTSPTAPHRQNWPDAQ

SEQ ID NO: 533829 - protein, 6 aa, Mycobacterium
NTGTTT

SEQ ID NO: 533830 - protein, 4 aa, Mycobacterium
NTGV

SEQ ID NO: 533831 - protein, 16 aa, Mycobacterium
NTGVNHGGTTAHPARD

SEQ ID NO: 533832 - protein, 20 aa, Mycobacterium
NTGVPTTDQPQKGKDFTSDQ

SEQ ID NO: 533833 - protein, 5 aa, Mycobacterium
NTGVS

SEQ ID NO: 533834 - protein, 16 aa, Mycobacterium
NTHEQSKKGPRAPKHT

SEQ ID NO: 533835 - protein, 25 aa, Mycobacterium
NTHGAKVQAAGNNMATTDTSIGSSW

SEQ ID NO: 533836 - protein, 8 aa, Mycobacterium
NTHPPRGV

SEQ ID NO: 533837 - protein, 18 aa, Mycobacterium
NTHPSGRYRHSMTMRRVK

SEQ ID NO: 533838 - protein, 7 aa, Mycobacterium
NTHPSSR

SEQ ID NO: 533839 - protein, 5 aa, Mycobacterium
NTHQP

SEQ ID NO: 533840 - protein, 10 aa, Mycobacterium
NTHRKRATTL

SEQ ID NO: 533841 - protein, 5 aa, Mycobacterium
NTHRN

SEQ ID NO: 533842 - protein, 6 aa, Mycobacterium
NTHSAG

SEQ ID NO: 533843 - protein, 12 aa, Mycobacterium
NTHSTPRAAAAA

SEQ ID NO: 533844 - protein, 10 aa, Mycobacterium
NTIDASGVGT

SEQ ID NO: 533845 - protein, 9 aa, Mycobacterium
NTIEGGTSE

SEQ ID NO: 533846 - protein, 4 aa, Mycobacterium
NTIG

SEQ ID NO: 533847 - protein, 5 aa, Mycobacterium
NTINY

SEQ ID NO: 533848 - protein, 17 aa, Mycobacterium
NTKATLEPVNPPKPPAA

SEQ ID NO: 533849 - protein, 12 aa, Mycobacterium
NTKGKSEDPAAA

SEQ ID NO: 533850 - protein, 5 aa, Mycobacterium
NTKGS

SEQ ID NO: 533851 - protein, 10 aa, Mycobacterium
NTKKGRRPAW

SEQ ID NO: 533852 - protein, 17 aa, Mycobacterium
NTKPPDPSVFDSAPASG

SEQ ID NO: 533853 - protein, 5 aa, Mycobacterium
NTKRG

SEQ ID NO: 533854 - protein, 4 aa, Mycobacterium
NTLA

SEQ ID NO: 533855 - protein, 10 aa, Mycobacterium
NTLANGANTF

SEQ ID NO: 533856 - protein, 7 aa, Mycobacterium
NTLARRG

SEQ ID NO: 533857 - protein, 4 aa, Mycobacterium
NTLD

SEQ ID NO: 533858 - protein, 5 aa, Mycobacterium
NTLDP

SEQ ID NO: 533859 - protein, 12 aa, Mycobacterium
NTLEATQTQIGT

SEQ ID NO: 533860 - protein, 14 aa, Mycobacterium
NTLGQNSPAIEAAQ

SEQ ID NO: 533861 - protein, 12 aa, Mycobacterium
NTLNELNEAAAS

SEQ ID NO: 533862 - protein, 21 aa, Mycobacterium
NTLQRGQAALTGPIARGDAAA

SEQ ID NO: 533863 - protein, 6 aa, Mycobacterium
NTLSQD

SEQ ID NO: 533864 - protein, 5 aa, Mycobacterium
NTLSS

SEQ ID NO: 533865 - protein, 6 aa, Mycobacterium
NTLSSY

SEQ ID NO: 533866 - protein, 17 aa, Mycobacterium
NTLTPQAPGGYDPGGAD

SEQ ID NO: 533867 - protein, 18 aa, Mycobacterium
NTLTPSAPGGYDPTGAPA

SEQ ID NO: 533868 - protein, 19 aa, Mycobacterium
NTMAAPSGTVYPGGGNPIG

SEQ ID NO: 533869 - protein, 10 aa, Mycobacterium
NTNDTNPTTR

SEQ ID NO: 533870 - protein, 7 aa, Mycobacterium
NTNKRGL

SEQ ID NO: 533871 - protein, 7 aa, Mycobacterium
NTNPGVT

SEQ ID NO: 533872 - protein, 11 aa, Mycobacterium
NTNPSAGSAIQ

SEQ ID NO: 533873 - protein, 6 aa, Mycobacterium
NTNPVT

SEQ ID NO: 533874 - protein, 16 aa, Mycobacterium
NTNRARAKGGGRQVPV

SEQ ID NO: 533875 - protein, 6 aa, Mycobacterium
NTNRTI

SEQ ID NO: 533876 - protein, 6 aa, Mycobacterium
NTNSRF

SEQ ID NO: 533877 - protein, 14 aa, Mycobacterium
NTPAEETTAAGPFE

SEQ ID NO: 533878 - protein, 8 aa, Mycobacterium
NTPAGDQG

SEQ ID NO: 533879 - protein, 7 aa, Mycobacterium
NTPAIAA

SEQ ID NO: 533880 - protein, 8 aa, Mycobacterium
NTPAIAAT

SEQ ID NO: 533881 - protein, 12 aa, Mycobacterium
NTPAIAATESEY

SEQ ID NO: 533882 - protein, 7 aa, Mycobacterium
NTPAIAS

SEQ ID NO: 533883 - protein, 7 aa, Mycobacterium
NTPAIAT

SEQ ID NO: 533884 - protein, 12 aa, Mycobacterium
NTPAIATTEAEY

SEQ ID NO: 533885 - protein, 5 aa, Mycobacterium
NTPAL

SEQ ID NO: 533886 - protein, 6 aa, Mycobacterium
NTPAMT

SEQ ID NO: 533887 - protein, 9 aa, Mycobacterium
NTPAQALTG

SEQ ID NO: 533888 - protein, 8 aa, Mycobacterium
NTPASYPA

SEQ ID NO: 533889 - protein, 8 aa, Mycobacterium
NTPATSQT

SEQ ID NO: 533890 - protein, 6 aa, Mycobacterium
NTPAVG

SEQ ID NO: 533891 - protein, 9 aa, Mycobacterium
NTPDGEQKI

SEQ ID NO: 533892 - protein, 8 aa, Mycobacterium
NTPDSGVP

SEQ ID NO: 533893 - protein, 5 aa, Mycobacterium
NTPDV

SEQ ID NO: 533894 - protein, 9 aa, Mycobacterium
NTPEGGRPL

SEQ ID NO: 533895 - protein, 6 aa, Mycobacterium
NTPEQA

SEQ ID NO: 533896 - protein, 5 aa, Mycobacterium
NTPET

SEQ ID NO: 533897 - protein, 5 aa, Mycobacterium
NTPFA

SEQ ID NO: 533898 - protein, 7 aa, Mycobacterium
NTPGAVR

SEQ ID NO: 533899 - protein, 6 aa, Mycobacterium
NTPGCT

SEQ ID NO: 533900 - protein, 8 aa, Mycobacterium
NTPGKRTD

SEQ ID NO: 533901 - protein, 7 aa, Mycobacterium
NTPGPDL

SEQ ID NO: 533902 - protein, 9 aa, Mycobacterium
NTPGRNADA

SEQ ID NO: 533903 - protein, 7 aa, Mycobacterium
NTPGSAL

SEQ ID NO: 533904 - protein, 12 aa, Mycobacterium
NTPGTVDAGYRG

SEQ ID NO: 533905 - protein, 6 aa, Mycobacterium
NTPIEE

SEQ ID NO: 533906 - protein, 5 aa, Mycobacterium
NTPIP

SEQ ID NO: 533907 - protein, 7 aa, Mycobacterium
NTPKSRE

SEQ ID NO: 533908 - protein, 8 aa, Mycobacterium
NTPNPQEL

SEQ ID NO: 533909 - protein, 9 aa, Mycobacterium
NTPPGREEL

SEQ ID NO: 533910 - protein, 8 aa, Mycobacterium
NTPPGTYT

SEQ ID NO: 533911 - protein, 10 aa, Mycobacterium
NTPPQPGQMR

SEQ ID NO: 533912 - protein, 6 aa, Mycobacterium
NTPPSH

SEQ ID NO: 533913 - protein, 7 aa, Mycobacterium
NTPQRQA

SEQ ID NO: 533914 - protein, 12 aa, Mycobacterium
NTPQSEHPAFPP

SEQ ID NO: 533915 - protein, 4 aa, Mycobacterium
NTPS

SEQ ID NO: 533916 - protein, 13 aa, Mycobacterium
NTPSANGSGVPTI

SEQ ID NO: 533917 - protein, 46 aa, Mycobacterium
NTPSDLPVPPRPASRTASSPTGSDFAGSSSARSARTASSPAGSDCV

SEQ ID NO: 533918 - protein, 9 aa, Mycobacterium
NTPSEEPKG

SEQ ID NO: 533919 - protein, 12 aa, Mycobacterium
NTPSGDGPDIPF

SEQ ID NO: 533920 - protein, 8 aa, Mycobacterium
NTPSGDKA

SEQ ID NO: 533921 - protein, 8 aa, Mycobacterium
NTPSGEDI

SEQ ID NO: 533922 - protein, 5 aa, Mycobacterium
NTPTL

SEQ ID NO: 533923 - protein, 5 aa, Mycobacterium
NTPTN

SEQ ID NO: 533924 - protein, 5 aa, Mycobacterium
NTPTQ

SEQ ID NO: 533925 - protein, 6 aa, Mycobacterium
NTPTQA

SEQ ID NO: 533926 - protein, 4 aa, Mycobacterium
NTPV

SEQ ID NO: 533927 - protein, 6 aa, Mycobacterium
NTPVAG

SEQ ID NO: 533928 - protein, 7 aa, Mycobacterium
NTPVDDG

SEQ ID NO: 533929 - protein, 14 aa, Mycobacterium
NTPWPTDGRHPRRA

SEQ ID NO: 533930 - protein, 11 aa, Mycobacterium
NTQDETDRQRN

SEQ ID NO: 533931 - protein, 6 aa, Mycobacterium
NTQETL

SEQ ID NO: 533932 - protein, 4 aa, Mycobacterium
NTQF

SEQ ID NO: 533933 - protein, 7 aa, Mycobacterium
NTQGAGP

SEQ ID NO: 533934 - protein, 9 aa, Mycobacterium
NTQGAGPFA

SEQ ID NO: 533935 - protein, 9 aa, Mycobacterium
NTQGTGMGG

SEQ ID NO: 533936 - protein, 6 aa, Mycobacterium
NTQGYS

SEQ ID NO: 533937 - protein, 4 aa, Mycobacterium
NTQN

SEQ ID NO: 533938 - protein, 18 aa, Mycobacterium
NTQPAAGPNGPSKAKYTI

SEQ ID NO: 533939 - protein, 23 aa, Mycobacterium
NTQPEGTSKAKYKLADGTAERVH

SEQ ID NO: 533940 - protein, 9 aa, Mycobacterium
NTQPTISSI

SEQ ID NO: 533941 - protein, 6 aa, Mycobacterium
NTQRRG

SEQ ID NO: 533942 - protein, 6 aa, Mycobacterium
NTQRRR

SEQ ID NO: 533943 - protein, 10 aa, Mycobacterium
NTQTGQRDEV

SEQ ID NO: 533944 - protein, 9 aa, Mycobacterium
NTQTRGARR

SEQ ID NO: 533945 - protein, 6 aa, Mycobacterium
NTQTRL

SEQ ID NO: 533946 - protein, 6 aa, Mycobacterium
NTQVSH

SEQ ID NO: 533947 - protein, 10 aa, Mycobacterium
NTRAGAQGVG

SEQ ID NO: 533948 - protein, 10 aa, Mycobacterium
NTRAKTTAVA

SEQ ID NO: 533949 - protein, 22 aa, Mycobacterium
NTRALPAPEYQDADQYRAPANA

SEQ ID NO: 533950 - protein, 12 aa, Mycobacterium
NTRARSNEGSGI

SEQ ID NO: 533951 - protein, 6 aa, Mycobacterium
NTRATG

SEQ ID NO: 533952 - protein, 4 aa, Mycobacterium
NTRD

SEQ ID NO: 533953 - protein, 9 aa, Mycobacterium
NTRDGDEAL

SEQ ID NO: 533954 - protein, 13 aa, Mycobacterium
NTRDGEGAAAGVD

SEQ ID NO: 533955 - protein, 12 aa, Mycobacterium
NTREERTKTRGR

SEQ ID NO: 533956 - protein, 9 aa, Mycobacterium
NTREPNEQV

SEQ ID NO: 533957 - protein, 16 aa, Mycobacterium
NTRGQGRTNKAVTGTL

SEQ ID NO: 533958 - protein, 7 aa, Mycobacterium
NTRGTGW

SEQ ID NO: 533959 - protein, 9 aa, Mycobacterium
NTRHGLTGT

SEQ ID NO: 533960 - protein, 6 aa, Mycobacterium
NTRIGQ

SEQ ID NO: 533961 - protein, 9 aa, Mycobacterium
NTRKPPSDL

SEQ ID NO: 533962 - protein, 6 aa, Mycobacterium
NTRPAT

SEQ ID NO: 533963 - protein, 14 aa, Mycobacterium
NTRPGSDAEKALSA

SEQ ID NO: 533964 - protein, 8 aa, Mycobacterium
NTRPPARY

SEQ ID NO: 533965 - protein, 8 aa, Mycobacterium
NTRPPRGV

SEQ ID NO: 533966 - protein, 4 aa, Mycobacterium
NTRQ

SEQ ID NO: 533967 - protein, 15 aa, Mycobacterium
NTRQGRRLDGETSRG

SEQ ID NO: 533968 - protein, 15 aa, Mycobacterium
NTRQGRRLDGETSRS

SEQ ID NO: 533969 - protein, 7 aa, Mycobacterium
NTRREND

SEQ ID NO: 533970 - protein, 7 aa, Mycobacterium
NTRRGEG

SEQ ID NO: 533971 - protein, 6 aa, Mycobacterium
NTRRGI

SEQ ID NO: 533972 - protein, 5 aa, Mycobacterium
NTRSA

SEQ ID NO: 533973 - protein, 8 aa, Mycobacterium
NTRSCPAQ

SEQ ID NO: 533974 - protein, 8 aa, Mycobacterium
NTRSCPGQ

SEQ ID NO: 533975 - protein, 10 aa, Mycobacterium
NTRSGGVARN

SEQ ID NO: 533976 - protein, 8 aa, Mycobacterium
NTRSRRAQ

SEQ ID NO: 533977 - protein, 9 aa, Mycobacterium
NTRSRRAQW

SEQ ID NO: 533978 - protein, 15 aa, Mycobacterium
NTRSRRAQWKAEKTE

SEQ ID NO: 533979 - protein, 15 aa, Mycobacterium
NTRSRRAQWKATKTE

SEQ ID NO: 533980 - protein, 14 aa, Mycobacterium
NTRSRRSQWKATAT

SEQ ID NO: 533981 - protein, 13 aa, Mycobacterium
NTRSRRSQWKATK

SEQ ID NO: 533982 - protein, 15 aa, Mycobacterium
NTRSRRSQWKATSTE

SEQ ID NO: 533983 - protein, 5 aa, Mycobacterium
NTRTR

SEQ ID NO: 533984 - protein, 7 aa, Mycobacterium
NTRTTEL

SEQ ID NO: 533985 - protein, 6 aa, Mycobacterium
NTRYPR

SEQ ID NO: 533986 - protein, 9 aa, Mycobacterium
NTSAAGGFA

SEQ ID NO: 533987 - protein, 8 aa, Mycobacterium
NTSAARAR

SEQ ID NO: 533988 - protein, 12 aa, Mycobacterium
NTSAEAIDPDKA

SEQ ID NO: 533989 - protein, 20 aa, Mycobacterium
NTSAGSYQATETANTAATAL

SEQ ID NO: 533990 - protein, 7 aa, Mycobacterium
NTSAGYR

SEQ ID NO: 533991 - protein, 10 aa, Mycobacterium
NTSALEGTFT

SEQ ID NO: 533992 - protein, 17 aa, Mycobacterium
NTSANSYASAEANAAKT

SEQ ID NO: 533993 - protein, 6 aa, Mycobacterium
NTSAPV

SEQ ID NO: 533994 - protein, 12 aa, Mycobacterium
NTSARGEAVGDS

SEQ ID NO: 533995 - protein, 13 aa, Mycobacterium
NTSASDAFAPNIR

SEQ ID NO: 533996 - protein, 12 aa, Mycobacterium
NTSAWTTRYETG

SEQ ID NO: 533997 - protein, 5 aa, Mycobacterium
NTSED

SEQ ID NO: 533998 - protein, 4 aa, Mycobacterium
NTSG

SEQ ID NO: 533999 - protein, 13 aa, Mycobacterium
NTSGEESKYGLAP

SEQ ID NO: 534000 - protein, 6 aa, Mycobacterium
NTSGEG

SEQ ID NO: 534001 - protein, 7 aa, Mycobacterium
NTSGPQV

SEQ ID NO: 534002 - protein, 16 aa, Mycobacterium
NTSGTARDRDPGAPVE

SEQ ID NO: 534003 - protein, 10 aa, Mycobacterium
NTSGVQDAPD

SEQ ID NO: 534004 - protein, 5 aa, Mycobacterium
NTSID

SEQ ID NO: 534005 - protein, 5 aa, Mycobacterium
NTSIE

SEQ ID NO: 534006 - protein, 21 aa, Mycobacterium
NTSKGEAAAQQMTGPNAGPVE

SEQ ID NO: 534007 - protein, 10 aa, Mycobacterium
NTSLASGSAP

SEQ ID NO: 534008 - protein, 6 aa, Mycobacterium
NTSLSR

SEQ ID NO: 534009 - protein, 7 aa, Mycobacterium
NTSPEAA

SEQ ID NO: 534010 - protein, 9 aa, Mycobacterium
NTSPRGRAG

SEQ ID NO: 534011 - protein, 6 aa, Mycobacterium
NTSRPP

SEQ ID NO: 534012 - protein, 8 aa, Mycobacterium
NTSRPSTI

SEQ ID NO: 534013 - protein, 10 aa, Mycobacterium
NTSRRAARSD

SEQ ID NO: 534014 - protein, 15 aa, Mycobacterium
NTSSAAEPRAKLSRR

SEQ ID NO: 534015 - protein, 11 aa, Mycobacterium
NTSSARQRVAQ

SEQ ID NO: 534016 - protein, 7 aa, Mycobacterium
NTSSAYA

SEQ ID NO: 534017 - protein, 8 aa, Mycobacterium
NTSSAYAK

SEQ ID NO: 534018 - protein, 23 aa, Mycobacterium
NTSSGAGLQGSVGQANYSAAKAG

SEQ ID NO: 534019 - protein, 24 aa, Mycobacterium
NTSSGAGLQGSVGQANYSAAKAGI

SEQ ID NO: 534020 - protein, 7 aa, Mycobacterium
NTSSNLN

SEQ ID NO: 534021 - protein, 5 aa, Mycobacterium
NTSSR

SEQ ID NO: 534022 - protein, 4 aa, Mycobacterium
NTST

SEQ ID NO: 534023 - protein, 6 aa, Mycobacterium
NTSVER

SEQ ID NO: 534024 - protein, 4 aa, Mycobacterium
NTTA

SEQ ID NO: 534025 - protein, 18 aa, Mycobacterium
NTTAGLDQKTSEAEKGQA

SEQ ID NO: 534026 - protein, 6 aa, Mycobacterium
NTTARA

SEQ ID NO: 534027 - protein, 12 aa, Mycobacterium
NTTASRQRVAQY

SEQ ID NO: 534028 - protein, 52 aa, Mycobacterium
NTTATVPTDTPGTTVPTSTTGTTVTSQSTAHPTGPASTTGTTITTDSAVTAN

SEQ ID NO: 534029 - protein, 4 aa, Mycobacterium
NTTD

SEQ ID NO: 534030 - protein, 10 aa, Mycobacterium
NTTDLPPIPQ

SEQ ID NO: 534031 - protein, 5 aa, Mycobacterium
NTTDS

SEQ ID NO: 534032 - protein, 8 aa, Mycobacterium
NTTDSATV

SEQ ID NO: 534033 - protein, 6 aa, Mycobacterium
NTTGNL

SEQ ID NO: 534034 - protein, 6 aa, Mycobacterium
NTTGQA

SEQ ID NO: 534035 - protein, 28 aa, Mycobacterium
NTTISRDGLKTPGAADLGAGGISGPPVA

SEQ ID NO: 534036 - protein, 16 aa, Mycobacterium
NTTISRQGLRTPGVDE

SEQ ID NO: 534037 - protein, 18 aa, Mycobacterium
NTTKGLDQKSTDEEKGRA

SEQ ID NO: 534038 - protein, 11 aa, Mycobacterium
NTTKGRRPTWN

SEQ ID NO: 534039 - protein, 16 aa, Mycobacterium
NTTNTNVGFGNSGHGN

SEQ ID NO: 534040 - protein, 13 aa, Mycobacterium
NTTPEAVDPDKAF

SEQ ID NO: 534041 - protein, 18 aa, Mycobacterium
NTTQSDGHLREGYAWRML

SEQ ID NO: 534042 - protein, 16 aa, Mycobacterium
NTTSQRQEPARVHYRH

SEQ ID NO: 534043 - protein, 13 aa, Mycobacterium
NTTTAPDEKQQAK

SEQ ID NO: 534044 - protein, 6 aa, Mycobacterium
NTTTPL

SEQ ID NO: 534045 - protein, 9 aa, Mycobacterium
NTTTRTRSQ

SEQ ID NO: 534046 - protein, 4 aa, Mycobacterium
NTTV

SEQ ID NO: 534047 - protein, 6 aa, Mycobacterium
NTTVSR

SEQ ID NO: 534048 - protein, 7 aa, Mycobacterium
NTTYDPA

SEQ ID NO: 534049 - protein, 11 aa, Mycobacterium
NTVAKGHSSAI

SEQ ID NO: 534050 - protein, 5 aa, Mycobacterium
NTVDG

SEQ ID NO: 534051 - protein, 11 aa, Mycobacterium
NTVDGTPVSQL

SEQ ID NO: 534052 - protein, 8 aa, Mycobacterium
NTVGPANP

SEQ ID NO: 534053 - protein, 13 aa, Mycobacterium
NTVLSGPAKDLES

SEQ ID NO: 534054 - protein, 6 aa, Mycobacterium
NTVPGP

SEQ ID NO: 534055 - protein, 10 aa, Mycobacterium
NTVRGDDGAV

SEQ ID NO: 534056 - protein, 9 aa, Mycobacterium
NTVSGASTA

SEQ ID NO: 534057 - protein, 12 aa, Mycobacterium
NTVSTDSGYKTR

SEQ ID NO: 534058 - protein, 11 aa, Mycobacterium
NTVTGQASELP

SEQ ID NO: 534059 - protein, 8 aa, Mycobacterium
NTWERNGG

SEQ ID NO: 534060 - protein, 11 aa, Mycobacterium
NTYADNSSMID

SEQ ID NO: 534061 - protein, 5 aa, Mycobacterium
NTYGE

SEQ ID NO: 534062 - protein, 8 aa, Mycobacterium
NTYPGKAE

SEQ ID NO: 534063 - protein, 13 aa, Mycobacterium
NTYPPGDMSVWNW

SEQ ID NO: 534064 - protein, 4 aa, Mycobacterium
NTYT

SEQ ID NO: 534065 - protein, 10 aa, Mycobacterium
NTYTDGSSER

SEQ ID NO: 534066 - protein, 13 aa, Mycobacterium
NTYTNTDKTLGEQ

SEQ ID NO: 534067 - protein, 12 aa, Mycobacterium
NVADDGSAEQLA

SEQ ID NO: 534068 - protein, 13 aa, Mycobacterium
NVADDSSAERLAG

SEQ ID NO: 534069 - protein, 8 aa, Mycobacterium
NVADGGRP

SEQ ID NO: 534070 - protein, 6 aa, Mycobacterium
NVADNG

SEQ ID NO: 534071 - protein, 14 aa, Mycobacterium
NVAEARELAMALSV

SEQ ID NO: 534072 - protein, 5 aa, Mycobacterium
NVAGD

SEQ ID NO: 534073 - protein, 6 aa, Mycobacterium
NVAGDP

SEQ ID NO: 534074 - protein, 11 aa, Mycobacterium
NVAGGKPPAAV

SEQ ID NO: 534075 - protein, 8 aa, Mycobacterium
NVAPESAA

SEQ ID NO: 534076 - protein, 5 aa, Mycobacterium
NVAPG

SEQ ID NO: 534077 - protein, 11 aa, Mycobacterium
NVAPSKGRPEQ

SEQ ID NO: 534078 - protein, 15 aa, Mycobacterium
NVARRSKSDVLIVHT

SEQ ID NO: 534079 - protein, 5 aa, Mycobacterium
NVASG

SEQ ID NO: 534080 - protein, 5 aa, Mycobacterium
NVASI

SEQ ID NO: 534081 - protein, 13 aa, Mycobacterium
NVASQTRAVGERA

SEQ ID NO: 534082 - protein, 4 aa, Mycobacterium
NVAT

SEQ ID NO: 534083 - protein, 7 aa, Mycobacterium
NVATRAA

SEQ ID NO: 534084 - protein, 6 aa, Mycobacterium
NVATTQ

SEQ ID NO: 534085 - protein, 6 aa, Mycobacterium
NVDDPV

SEQ ID NO: 534086 - protein, 6 aa, Mycobacterium
NVDDTK

SEQ ID NO: 534087 - protein, 13 aa, Mycobacterium
NVDGAESDEAGAY

SEQ ID NO: 534088 - protein, 12 aa, Mycobacterium
NVDGGLDRAAEE

SEQ ID NO: 534089 - protein, 12 aa, Mycobacterium
NVDGKGASYGTH

SEQ ID NO: 534090 - protein, 6 aa, Mycobacterium
NVDPDQ

SEQ ID NO: 534091 - protein, 8 aa, Mycobacterium
NVDPPRSF

SEQ ID NO: 534092 - protein, 5 aa, Mycobacterium
NVDRS

SEQ ID NO: 534093 - protein, 4 aa, Mycobacterium
NVDT

SEQ ID NO: 534094 - protein, 17 aa, Mycobacterium
NVDTGLGAGLAGKAQIG

SEQ ID NO: 534095 - protein, 7 aa, Mycobacterium
NVEDPAQ

SEQ ID NO: 534096 - protein, 8 aa, Mycobacterium
NVEEGGRP

SEQ ID NO: 534097 - protein, 9 aa, Mycobacterium
NVEGAQQAY

SEQ ID NO: 534098 - protein, 12 aa, Mycobacterium
NVEGGNKELEQL

SEQ ID NO: 534099 - protein, 16 aa, Mycobacterium
NVEPAGSSVHTPAGRW

SEQ ID NO: 534100 - protein, 9 aa, Mycobacterium
NVEPPELRD

SEQ ID NO: 534101 - protein, 10 aa, Mycobacterium
NVEPPTPSKL

SEQ ID NO: 534102 - protein, 8 aa, Mycobacterium
NVEQNSRV

SEQ ID NO: 534103 - protein, 13 aa, Mycobacterium
NVERGREQALEDA

SEQ ID NO: 534104 - protein, 7 aa, Mycobacterium
NVESGYS

SEQ ID NO: 534105 - protein, 15 aa, Mycobacterium
NVESRGAHRPGGDDR

SEQ ID NO: 534106 - protein, 12 aa, Mycobacterium
NVETNARLEDSG

SEQ ID NO: 534107 - protein, 15 aa, Mycobacterium
NVGAKADEQLRSGAS

SEQ ID NO: 534108 - protein, 8 aa, Mycobacterium
NVGDAAGA

SEQ ID NO: 534109 - protein, 7 aa, Mycobacterium
NVGDGVD

SEQ ID NO: 534110 - protein, 7 aa, Mycobacterium
NVGDQIE

SEQ ID NO: 534111 - protein, 5 aa, Mycobacterium
NVGEF

SEQ ID NO: 534112 - protein, 11 aa, Mycobacterium
NVGESPKVTHR

SEQ ID NO: 534113 - protein, 4 aa, Mycobacterium
NVGG

SEQ ID NO: 534114 - protein, 7 aa, Mycobacterium
NVGGGAY

SEQ ID NO: 534115 - protein, 6 aa, Mycobacterium
NVGGTA

SEQ ID NO: 534116 - protein, 6 aa, Mycobacterium
NVGGTE

SEQ ID NO: 534117 - protein, 12 aa, Mycobacterium
NVGGTGIPRPDS

SEQ ID NO: 534118 - protein, 8 aa, Mycobacterium
NVGKSSVR

SEQ ID NO: 534119 - protein, 7 aa, Mycobacterium
NVGLGGD

SEQ ID NO: 534120 - protein, 8 aa, Mycobacterium
NVGLGNAG

SEQ ID NO: 534121 - protein, 7 aa, Mycobacterium
NVGNNNV

SEQ ID NO: 534122 - protein, 6 aa, Mycobacterium
NVGNTN

SEQ ID NO: 534123 - protein, 14 aa, Mycobacterium
NVGPEPEGAPMEQQ

SEQ ID NO: 534124 - protein, 6 aa, Mycobacterium
NVGPTV

SEQ ID NO: 534125 - protein, 4 aa, Mycobacterium
NVGQ

SEQ ID NO: 534126 - protein, 18 aa, Mycobacterium
NVGRAPAVTGSDTPVPGW

SEQ ID NO: 534127 - protein, 7 aa, Mycobacterium
NVGRASE

SEQ ID NO: 534128 - protein, 24 aa, Mycobacterium
NVGRDTDPVDPDFGRGASAYDGYW

SEQ ID NO: 534129 - protein, 6 aa, Mycobacterium
NVGRGY

SEQ ID NO: 534130 - protein, 5 aa, Mycobacterium
NVGRR

SEQ ID NO: 534131 - protein, 9 aa, Mycobacterium
NVGRRGEGM

SEQ ID NO: 534132 - protein, 4 aa, Mycobacterium
NVGS

SEQ ID NO: 534133 - protein, 5 aa, Mycobacterium
NVGSD

SEQ ID NO: 534134 - protein, 6 aa, Mycobacterium
NVGSDD

SEQ ID NO: 534135 - protein, 9 aa, Mycobacterium
NVGSGNFGD

SEQ ID NO: 534136 - protein, 8 aa, Mycobacterium
NVGSGNIG

SEQ ID NO: 534137 - protein, 4 aa, Mycobacterium
NVGT

SEQ ID NO: 534138 - protein, 12 aa, Mycobacterium
NVGTATKSASRL

SEQ ID NO: 534139 - protein, 6 aa, Mycobacterium
NVGTGN

SEQ ID NO: 534140 - protein, 6 aa, Mycobacterium
NVGTSN

SEQ ID NO: 534141 - protein, 6 aa, Mycobacterium
NVHPSQ

SEQ ID NO: 534142 - protein, 4 aa, Mycobacterium
NVIP

SEQ ID NO: 534143 - protein, 10 aa, Mycobacterium
NVITGSRPVN

SEQ ID NO: 534144 - protein, 4 aa, Mycobacterium
NVLP

SEQ ID NO: 534145 - protein, 6 aa, Mycobacterium
NVLPSR

SEQ ID NO: 534146 - protein, 15 aa, Mycobacterium
NVLPSSTNPTRPHTV

SEQ ID NO: 534147 - protein, 15 aa, Mycobacterium
NVMPSSTNPTRPHTV

SEQ ID NO: 534148 - protein, 5 aa, Mycobacterium
NVNDR

SEQ ID NO: 534149 - protein, 6 aa, Mycobacterium
NVNDRP

SEQ ID NO: 534150 - protein, 5 aa, Mycobacterium
NVNGG

SEQ ID NO: 534151 - protein, 8 aa, Mycobacterium
NVNGGATA

SEQ ID NO: 534152 - protein, 6 aa, Mycobacterium
NVNGGS

SEQ ID NO: 534153 - protein, 8 aa, Mycobacterium
NVNGSSLA

SEQ ID NO: 534154 - protein, 10 aa, Mycobacterium
NVNGSSLAAG

SEQ ID NO: 534155 - protein, 5 aa, Mycobacterium
NVNNG

SEQ ID NO: 534156 - protein, 19 aa, Mycobacterium
NVNTGLGATTDTGLTNSGF

SEQ ID NO: 534157 - protein, 28 aa, Mycobacterium
NVNTGVGGTGTHSGNSGFGNSGTGNSGF

SEQ ID NO: 534158 - protein, 6 aa, Mycobacterium
NVPADY

SEQ ID NO: 534159 - protein, 19 aa, Mycobacterium
NVPAPVADRRPLPPRHPHQ

SEQ ID NO: 534160 - protein, 16 aa, Mycobacterium
NVPDAADPSLQTIRVL

SEQ ID NO: 534161 - protein, 12 aa, Mycobacterium
NVPDPKIEQPTD

SEQ ID NO: 534162 - protein, 8 aa, Mycobacterium
NVPEEERA

SEQ ID NO: 534163 - protein, 7 aa, Mycobacterium
NVPERGG

SEQ ID NO: 534164 - protein, 19 aa, Mycobacterium
NVPESGFTDPDRVQRQRED

SEQ ID NO: 534165 - protein, 12 aa, Mycobacterium
NVPEYQREDNTI

SEQ ID NO: 534166 - protein, 7 aa, Mycobacterium
NVPGAAR

SEQ ID NO: 534167 - protein, 6 aa, Mycobacterium
NVPGAE

SEQ ID NO: 534168 - protein, 10 aa, Mycobacterium
NVPGAGFTDP

SEQ ID NO: 534169 - protein, 6 aa, Mycobacterium
NVPGLN

SEQ ID NO: 534170 - protein, 7 aa, Mycobacterium
NVPGLNA

SEQ ID NO: 534171 - protein, 6 aa, Mycobacterium
NVPGPF

SEQ ID NO: 534172 - protein, 8 aa, Mycobacterium
NVPGPKET

SEQ ID NO: 534173 - protein, 9 aa, Mycobacterium
NVPGPPLTA

SEQ ID NO: 534174 - protein, 7 aa, Mycobacterium
NVPGPPM

SEQ ID NO: 534175 - protein, 7 aa, Mycobacterium
NVPGPQH

SEQ ID NO: 534176 - protein, 9 aa, Mycobacterium
NVPGPRAEQ

SEQ ID NO: 534177 - protein, 11 aa, Mycobacterium
NVPGPREHGRV

SEQ ID NO: 534178 - protein, 11 aa, Mycobacterium
NVPGPRERARV

SEQ ID NO: 534179 - protein, 9 aa, Mycobacterium
NVPGPRERG

SEQ ID NO: 534180 - protein, 16 aa, Mycobacterium
NVPGPRERGKVGGATV

SEQ ID NO: 534181 - protein, 9 aa, Mycobacterium
NVPGPRGRQ

SEQ ID NO: 534182 - protein, 7 aa, Mycobacterium
NVPGPRH

SEQ ID NO: 534183 - protein, 8 aa, Mycobacterium
NVPGPRQP

SEQ ID NO: 534184 - protein, 17 aa, Mycobacterium
NVPGPRQRGHVGGAPVS

SEQ ID NO: 534185 - protein, 9 aa, Mycobacterium
NVPGPRREQ

SEQ ID NO: 534186 - protein, 9 aa, Mycobacterium
NVPGPRSRQ

SEQ ID NO: 534187 - protein, 8 aa, Mycobacterium
NVPGPSDE

SEQ ID NO: 534188 - protein, 5 aa, Mycobacterium
NVPGS

SEQ ID NO: 534189 - protein, 7 aa, Mycobacterium
NVPPAEA

SEQ ID NO: 534190 - protein, 19 aa, Mycobacterium
NVPPPGSNPLVAPYRWDQG

SEQ ID NO: 534191 - protein, 13 aa, Mycobacterium
NVPPPPTPAVPSP

SEQ ID NO: 534192 - protein, 7 aa, Mycobacterium
NVPPRKP

SEQ ID NO: 534193 - protein, 7 aa, Mycobacterium
NVPPSGG

SEQ ID NO: 534194 - protein, 4 aa, Mycobacterium
NVPQ

SEQ ID NO: 534195 - protein, 9 aa, Mycobacterium
NVPQEAPEA

SEQ ID NO: 534196 - protein, 11 aa, Mycobacterium
NVPRGSGISRA

SEQ ID NO: 534197 - protein, 10 aa, Mycobacterium
NVPRTPQGRP

SEQ ID NO: 534198 - protein, 36 aa, Mycobacterium
NVPTKQDASTPPTPPARRGRAARRTADGVILLEGVH

SEQ ID NO: 534199 - protein, 6 aa, Mycobacterium
NVQAQQ

SEQ ID NO: 534200 - protein, 8 aa, Mycobacterium
NVQETQDA

SEQ ID NO: 534201 - protein, 8 aa, Mycobacterium
NVQGDERD

SEQ ID NO: 534202 - protein, 9 aa, Mycobacterium
NVQNPSGNL

SEQ ID NO: 534203 - protein, 8 aa, Mycobacterium
NVQPVPAK

SEQ ID NO: 534204 - protein, 13 aa, Mycobacterium
NVRAKEHSGSLGP

SEQ ID NO: 534205 - protein, 7 aa, Mycobacterium
NVRDDAA

SEQ ID NO: 534206 - protein, 11 aa, Mycobacterium
NVREAEAGGIT

SEQ ID NO: 534207 - protein, 10 aa, Mycobacterium
NVREGEAGGI

SEQ ID NO: 534208 - protein, 8 aa, Mycobacterium
NVRGSGGF

SEQ ID NO: 534209 - protein, 6 aa, Mycobacterium
NVRPAS

SEQ ID NO: 534210 - protein, 7 aa, Mycobacterium
NVRPGDT

SEQ ID NO: 534211 - protein, 14 aa, Mycobacterium
NVRPSLSADPDLTR

SEQ ID NO: 534212 - protein, 5 aa, Mycobacterium
NVRRE

SEQ ID NO: 534213 - protein, 6 aa, Mycobacterium
NVRRGS

SEQ ID NO: 534214 - protein, 7 aa, Mycobacterium
NVRRGSL

SEQ ID NO: 534215 - protein, 8 aa, Mycobacterium
NVRRPDGS

SEQ ID NO: 534216 - protein, 6 aa, Mycobacterium
NVRSAP

SEQ ID NO: 534217 - protein, 10 aa, Mycobacterium
NVRSGEIEGT

SEQ ID NO: 534218 - protein, 5 aa, Mycobacterium
NVRTR

SEQ ID NO: 534219 - protein, 20 aa, Mycobacterium
NVRTRTGKGASRQARRDGKV

SEQ ID NO: 534220 - protein, 8 aa, Mycobacterium
NVSATEPA

SEQ ID NO: 534221 - protein, 4 aa, Mycobacterium
NVSE

SEQ ID NO: 534222 - protein, 17 aa, Mycobacterium
NVSGNDALDALAQPTVI

SEQ ID NO: 534223 - protein, 7 aa, Mycobacterium
NVSGSAV

SEQ ID NO: 534224 - protein, 10 aa, Mycobacterium
NVSGSGTERT

SEQ ID NO: 534225 - protein, 7 aa, Mycobacterium
NVSHDDR

SEQ ID NO: 534226 - protein, 10 aa, Mycobacterium
NVSPGTVTAL

SEQ ID NO: 534227 - protein, 10 aa, Mycobacterium
NVSRAGREGT

SEQ ID NO: 534228 - protein, 26 aa, Mycobacterium
NVSRSAGSYTTGGPRWSTSYDQSASD

SEQ ID NO: 534229 - protein, 8 aa, Mycobacterium
NVSRTGGA

SEQ ID NO: 534230 - protein, 12 aa, Mycobacterium
NVSVNTATGGIE

SEQ ID NO: 534231 - protein, 4 aa, Mycobacterium
NVTA

SEQ ID NO: 534232 - protein, 4 aa, Mycobacterium
NVTD

SEQ ID NO: 534233 - protein, 11 aa, Mycobacterium
NVTDTDGAAAT

SEQ ID NO: 534234 - protein, 5 aa, Mycobacterium
NVTED

SEQ ID NO: 534235 - protein, 6 aa, Mycobacterium
NVTEGD

SEQ ID NO: 534236 - protein, 17 aa, Mycobacterium
NVTEQDLASEPALPETL

SEQ ID NO: 534237 - protein, 7 aa, Mycobacterium
NVTGEPA

SEQ ID NO: 534238 - protein, 17 aa, Mycobacterium
NVTPEAGPGFGDAVAAP

SEQ ID NO: 534239 - protein, 6 aa, Mycobacterium
NVTPQA

SEQ ID NO: 534240 - protein, 4 aa, Mycobacterium
NVTS

SEQ ID NO: 534241 - protein, 52 aa, Mycobacterium
NVTSPQSAALGQAPETPATAPEEPSAPAAEVKEETESTGATANTKDGNKFTP

SEQ ID NO: 534242 - protein, 4 aa, Mycobacterium
NVTT

SEQ ID NO: 534243 - protein, 7 aa, Mycobacterium
NVTTGLG

SEQ ID NO: 534244 - protein, 9 aa, Mycobacterium
NVTTGLGAH

SEQ ID NO: 534245 - protein, 39 aa, Mycobacterium
NVTVGSETRGGTGGAGGTGGQSTAAGPGKGGGGGGGGGG

SEQ ID NO: 534246 - protein, 5 aa, Mycobacterium
NVVAT

SEQ ID NO: 534247 - protein, 4 aa, Mycobacterium
NVVD

SEQ ID NO: 534248 - protein, 8 aa, Mycobacterium
NVVGSSPG

SEQ ID NO: 534249 - protein, 4 aa, Mycobacterium
NVYP

SEQ ID NO: 534250 - protein, 5 aa, Mycobacterium
NVYPA

SEQ ID NO: 534251 - protein, 7 aa, Mycobacterium
NWASASS

SEQ ID NO: 534252 - protein, 11 aa, Mycobacterium
NWDSTAQELNN

SEQ ID NO: 534253 - protein, 10 aa, Mycobacterium
NWEANEPAEL

SEQ ID NO: 534254 - protein, 7 aa, Mycobacterium
NWERSGW

SEQ ID NO: 534255 - protein, 10 aa, Mycobacterium
NWETGDPKKQ

SEQ ID NO: 534256 - protein, 9 aa, Mycobacterium
NWGRASAEV

SEQ ID NO: 534257 - protein, 9 aa, Mycobacterium
NWGTGTPRR

SEQ ID NO: 534258 - protein, 5 aa, Mycobacterium
NWGTS

SEQ ID NO: 534259 - protein, 43 aa, Mycobacterium
NWKGDPNATLSGQSIPDLGPGQGESAPETSPAPPAPPVEGDPV

SEQ ID NO: 534260 - protein, 7 aa, Mycobacterium
NWKRSAE

SEQ ID NO: 534261 - protein, 8 aa, Mycobacterium
NWKRSTEE

SEQ ID NO: 534262 - protein, 4 aa, Mycobacterium
NWNT

SEQ ID NO: 534263 - protein, 17 aa, Mycobacterium
NWPQRREDPQSSGPQTL

SEQ ID NO: 534264 - protein, 5 aa, Mycobacterium
NWRDD

SEQ ID NO: 534265 - protein, 10 aa, Mycobacterium
NWRDEGRRSL

SEQ ID NO: 534266 - protein, 8 aa, Mycobacterium
NWRNDSDL

SEQ ID NO: 534267 - protein, 6 aa, Mycobacterium
NWRRPA

SEQ ID NO: 534268 - protein, 6 aa, Mycobacterium
NWRSGD

SEQ ID NO: 534269 - protein, 13 aa, Mycobacterium
NWSASKNGRRQGR

SEQ ID NO: 534270 - protein, 23 aa, Mycobacterium
NWSGPREPEPTPADGVATGPSFA

SEQ ID NO: 534271 - protein, 4 aa, Mycobacterium
NWSN

SEQ ID NO: 534272 - protein, 10 aa, Mycobacterium
NWSNGVPDAD

SEQ ID NO: 534273 - protein, 5 aa, Mycobacterium
NWSPE

SEQ ID NO: 534274 - protein, 5 aa, Mycobacterium
NWSSQ

SEQ ID NO: 534275 - protein, 15 aa, Mycobacterium
NWTTPKGSPHAGGAV

SEQ ID NO: 534276 - protein, 5 aa, Mycobacterium
NYAAQ

SEQ ID NO: 534277 - protein, 11 aa, Mycobacterium
NYADSPAPVPD

SEQ ID NO: 534278 - protein, 4 aa, Mycobacterium
NYAE

SEQ ID NO: 534279 - protein, 5 aa, Mycobacterium
NYAEQ

SEQ ID NO: 534280 - protein, 15 aa, Mycobacterium
NYAGADTVVRPTEPA

SEQ ID NO: 534281 - protein, 4 aa, Mycobacterium
NYAT

SEQ ID NO: 534282 - protein, 14 aa, Mycobacterium
NYATSPAYTDDERA

SEQ ID NO: 534283 - protein, 11 aa, Mycobacterium
NYDANANEAIR

SEQ ID NO: 534284 - protein, 5 aa, Mycobacterium
NYDEP

SEQ ID NO: 534285 - protein, 9 aa, Mycobacterium
NYDGPGYTV

SEQ ID NO: 534286 - protein, 6 aa, Mycobacterium
NYDGSW

SEQ ID NO: 534287 - protein, 9 aa, Mycobacterium
NYDPSAGSP

SEQ ID NO: 534288 - protein, 7 aa, Mycobacterium
NYDTTQI

SEQ ID NO: 534289 - protein, 14 aa, Mycobacterium
NYEATKDLPAATGE

SEQ ID NO: 534290 - protein, 13 aa, Mycobacterium
NYEATKDLPVATG

SEQ ID NO: 534291 - protein, 5 aa, Mycobacterium
NYEEG

SEQ ID NO: 534292 - protein, 7 aa, Mycobacterium
NYEGDDV

SEQ ID NO: 534293 - protein, 22 aa, Mycobacterium
NYFSPDSPFGGYKQSGIGREMG

SEQ ID NO: 534294 - protein, 23 aa, Mycobacterium
NYFSPDSPFGGYKQSGIGREMGT

SEQ ID NO: 534295 - protein, 7 aa, Mycobacterium
NYGAKGI

SEQ ID NO: 534296 - protein, 6 aa, Mycobacterium
NYGDTA

SEQ ID NO: 534297 - protein, 5 aa, Mycobacterium
NYGEL

SEQ ID NO: 534298 - protein, 9 aa, Mycobacterium
NYGETTEAF

SEQ ID NO: 534299 - protein, 10 aa, Mycobacterium
NYGETTEAFG

SEQ ID NO: 534300 - protein, 35 aa, Mycobacterium
NYGNSNVGAGNGNAALGVPGSSYPGASSYNVGAGN

SEQ ID NO: 534301 - protein, 8 aa, Mycobacterium
NYGPGDPN

SEQ ID NO: 534302 - protein, 11 aa, Mycobacterium
NYGPGDPNLAH

SEQ ID NO: 534303 - protein, 16 aa, Mycobacterium
NYGPGDPNLAHTRGEH

SEQ ID NO: 534304 - protein, 7 aa, Mycobacterium
NYGPPAT

SEQ ID NO: 534305 - protein, 13 aa, Mycobacterium
NYGPPYGSAEENF

SEQ ID NO: 534306 - protein, 13 aa, Mycobacterium
NYGPTPTADDVEA

SEQ ID NO: 534307 - protein, 4 aa, Mycobacterium
NYGQ

SEQ ID NO: 534308 - protein, 8 aa, Mycobacterium
NYGQSEAP

SEQ ID NO: 534309 - protein, 8 aa, Mycobacterium
NYGRNAQR

SEQ ID NO: 534310 - protein, 10 aa, Mycobacterium
NYGSAVPERD

SEQ ID NO: 534311 - protein, 12 aa, Mycobacterium
NYGTGSASGSAC

SEQ ID NO: 534312 - protein, 8 aa, Mycobacterium
NYGVPDNE

SEQ ID NO: 534313 - protein, 24 aa, Mycobacterium
NYNAGSFNAGNSNTSFGNSGDVNT

SEQ ID NO: 534314 - protein, 5 aa, Mycobacterium
NYNPW

SEQ ID NO: 534315 - protein, 5 aa, Mycobacterium
NYPAD

SEQ ID NO: 534316 - protein, 5 aa, Mycobacterium
NYPDE

SEQ ID NO: 534317 - protein, 7 aa, Mycobacterium
NYPDGRP

SEQ ID NO: 534318 - protein, 15 aa, Mycobacterium
NYPDYPAERVRTDSG

SEQ ID NO: 534319 - protein, 4 aa, Mycobacterium
NYPG

SEQ ID NO: 534320 - protein, 8 aa, Mycobacterium
NYPGDRPA

SEQ ID NO: 534321 - protein, 7 aa, Mycobacterium
NYPGRPR

SEQ ID NO: 534322 - protein, 21 aa, Mycobacterium
NYPKMPGEPKRVQPSRDTDRK

SEQ ID NO: 534323 - protein, 4 aa, Mycobacterium
NYPP

SEQ ID NO: 534324 - protein, 10 aa, Mycobacterium
NYPPAPARPA

SEQ ID NO: 534325 - protein, 6 aa, Mycobacterium
NYPPEI

SEQ ID NO: 534326 - protein, 9 aa, Mycobacterium
NYPPEPARP

SEQ ID NO: 534327 - protein, 6 aa, Mycobacterium
NYPSAS

SEQ ID NO: 534328 - protein, 4 aa, Mycobacterium
NYQG

SEQ ID NO: 534329 - protein, 6 aa, Mycobacterium
NYQGSE

SEQ ID NO: 534330 - protein, 8 aa, Mycobacterium
NYQPAMTN

SEQ ID NO: 534331 - protein, 11 aa, Mycobacterium
NYQPGEPRGTD

SEQ ID NO: 534332 - protein, 20 aa, Mycobacterium
NYQPPKDLAPPPGTVIGPDG

SEQ ID NO: 534333 - protein, 5 aa, Mycobacterium
NYQPV

SEQ ID NO: 534334 - protein, 9 aa, Mycobacterium
NYQRPPREL

SEQ ID NO: 534335 - protein, 6 aa, Mycobacterium
NYRGSM

SEQ ID NO: 534336 - protein, 9 aa, Mycobacterium
NYRPTPEAN

SEQ ID NO: 534337 - protein, 9 aa, Mycobacterium
NYRQPEGAN

SEQ ID NO: 534338 - protein, 10 aa, Mycobacterium
NYRTPDDGRR

SEQ ID NO: 534339 - protein, 4 aa, Mycobacterium
NYSD

SEQ ID NO: 534340 - protein, 10 aa, Mycobacterium
NYSGGSLRGS

SEQ ID NO: 534341 - protein, 5 aa, Mycobacterium
NYSGI

SEQ ID NO: 534342 - protein, 6 aa, Mycobacterium
NYSGRG

SEQ ID NO: 534343 - protein, 11 aa, Mycobacterium
NYSISSSPLVS

SEQ ID NO: 534344 - protein, 6 aa, Mycobacterium
NYSPRT

SEQ ID NO: 534345 - protein, 14 aa, Mycobacterium
NYSTELPLAQGVHF

SEQ ID NO: 534346 - protein, 45 aa, Mycobacterium
NYTGNGSGAGISEFNGNQTDFGGSDSPLSKDEAAAAQQRCGGSPA

SEQ ID NO: 534347 - protein, 14 aa, Mycobacterium
NYTPNGSGAGIGQF

SEQ ID NO: 534348 - protein, 10 aa, Mycobacterium
NYTTPGGQHG

SEQ ID NO: 534349 - protein, 10 aa, Mycobacterium
NYTVGSGAKV

SEQ ID NO: 534350 - protein, 17 aa, Mycobacterium
NYVPPEPKAPPPPGFSE

SEQ ID NO: 534351 - protein, 9 aa, Mycobacterium
NYYPRSGQE

SEQ ID NO: 534352 - protein, 5 aa, Mycobacterium
PAAAA

SEQ ID NO: 534353 - protein, 15 aa, Mycobacterium
PAAAAADPGITNGRI

SEQ ID NO: 534354 - protein, 6 aa, Mycobacterium
PAAAAH

SEQ ID NO: 534355 - protein, 6 aa, Mycobacterium
PAAAAL

SEQ ID NO: 534356 - protein, 10 aa, Mycobacterium
PAAAAPAQEF

SEQ ID NO: 534357 - protein, 9 aa, Mycobacterium
PAAAAQQAG

SEQ ID NO: 534358 - protein, 43 aa, Mycobacterium
PAAAAQQGGAAAVAGAAPLAGPAAVSAARNTGPRWRAPQPGLR

SEQ ID NO: 534359 - protein, 8 aa, Mycobacterium
PAAAAQVQ

SEQ ID NO: 534360 - protein, 8 aa, Mycobacterium
PAAAARAR

SEQ ID NO: 534361 - protein, 10 aa, Mycobacterium
PAAAARGPED

SEQ ID NO: 534362 - protein, 7 aa, Mycobacterium
PAAAARS

SEQ ID NO: 534363 - protein, 15 aa, Mycobacterium
PAAAARYAANPAQAI

SEQ ID NO: 534364 - protein, 8 aa, Mycobacterium
PAAAATRL

SEQ ID NO: 534365 - protein, 9 aa, Mycobacterium
PAAADAEQP

SEQ ID NO: 534366 - protein, 9 aa, Mycobacterium
PAAADAERP

SEQ ID NO: 534367 - protein, 20 aa, Mycobacterium
PAAADESDAVRAKSTPTDPV

SEQ ID NO: 534368 - protein, 10 aa, Mycobacterium
PAAADSTDDE

SEQ ID NO: 534369 - protein, 10 aa, Mycobacterium
PAAADSTEDE

SEQ ID NO: 534370 - protein, 8 aa, Mycobacterium
PAAADTYY

SEQ ID NO: 534371 - protein, 5 aa, Mycobacterium
PAAAE

SEQ ID NO: 534372 - protein, 9 aa, Mycobacterium
PAAAEAERP

SEQ ID NO: 534373 - protein, 8 aa, Mycobacterium
PAAAEPDQ

SEQ ID NO: 534374 - protein, 7 aa, Mycobacterium
PAAAESH

SEQ ID NO: 534375 - protein, 10 aa, Mycobacterium
PAAAEVGDRG

SEQ ID NO: 534376 - protein, 21 aa, Mycobacterium
PAAAGDVSAPHEHEGTGPRAL

SEQ ID NO: 534377 - protein, 10 aa, Mycobacterium
PAAAGEASAL

SEQ ID NO: 534378 - protein, 10 aa, Mycobacterium
PAAAGGVEPS

SEQ ID NO: 534379 - protein, 14 aa, Mycobacterium
PAAAGVPGIPGGTV

SEQ ID NO: 534380 - protein, 11 aa, Mycobacterium
PAAANGTPRCP

SEQ ID NO: 534381 - protein, 7 aa, Mycobacterium
PAAANKG

SEQ ID NO: 534382 - protein, 14 aa, Mycobacterium
PAAAPARHTTAMSS

SEQ ID NO: 534383 - protein, 7 aa, Mycobacterium
PAAAPEA

SEQ ID NO: 534384 - protein, 7 aa, Mycobacterium
PAAAPGV

SEQ ID NO: 534385 - protein, 10 aa, Mycobacterium
PAAAPLPAPR

SEQ ID NO: 534386 - protein, 7 aa, Mycobacterium
PAAAPRI

SEQ ID NO: 534387 - protein, 7 aa, Mycobacterium
PAAAPTE

SEQ ID NO: 534388 - protein, 28 aa, Mycobacterium
PAAAPVSPASPAPAPVSAPHTASPVEAQ

SEQ ID NO: 534389 - protein, 6 aa, Mycobacterium
PAAAPY

SEQ ID NO: 534390 - protein, 5 aa, Mycobacterium
PAAAQ

SEQ ID NO: 534391 - protein, 10 aa, Mycobacterium
PAAAQAPVPA

SEQ ID NO: 534392 - protein, 9 aa, Mycobacterium
PAAAQDNDN

SEQ ID NO: 534393 - protein, 16 aa, Mycobacterium
PAAAQHRARAARDRLT

SEQ ID NO: 534394 - protein, 10 aa, Mycobacterium
PAAAQQHHPN

SEQ ID NO: 534395 - protein, 8 aa, Mycobacterium
PAAAQTDE

SEQ ID NO: 534396 - protein, 10 aa, Mycobacterium
PAAAQVQREH

SEQ ID NO: 534397 - protein, 12 aa, Mycobacterium
PAAARAAAAAEE

SEQ ID NO: 534398 - protein, 15 aa, Mycobacterium
PAAARAAAAATPEGT

SEQ ID NO: 534399 - protein, 11 aa, Mycobacterium
PAAARDDRARP

SEQ ID NO: 534400 - protein, 8 aa, Mycobacterium
PAAARTAP

SEQ ID NO: 534401 - protein, 13 aa, Mycobacterium
PAAASGGPGPGGV

SEQ ID NO: 534402 - protein, 16 aa, Mycobacterium
PAAASPDDAAVEAAAE

SEQ ID NO: 534403 - protein, 9 aa, Mycobacterium
PAAASREFA

SEQ ID NO: 534404 - protein, 13 aa, Mycobacterium
PAAASRRPRGAPR

SEQ ID NO: 534405 - protein, 9 aa, Mycobacterium
PAAATDPRM

SEQ ID NO: 534406 - protein, 14 aa, Mycobacterium
PAAATSALDQRKNA

SEQ ID NO: 534407 - protein, 19 aa, Mycobacterium
PAAAVEPVTTPSVEGSEET

SEQ ID NO: 534408 - protein, 26 aa, Mycobacterium
PAAAVPATTPTKPEPPTPTRPATSST

SEQ ID NO: 534409 - protein, 13 aa, Mycobacterium
PAACPSITQGEYR

SEQ ID NO: 534410 - protein, 8 aa, Mycobacterium
PAADAADL

SEQ ID NO: 534411 - protein, 8 aa, Mycobacterium
PAADAEER

SEQ ID NO: 534412 - protein, 11 aa, Mycobacterium
PAADDGRTPHR

SEQ ID NO: 534413 - protein, 8 aa, Mycobacterium
PAADDTRR

SEQ ID NO: 534414 - protein, 10 aa, Mycobacterium
PAADEPRPLL

SEQ ID NO: 534415 - protein, 6 aa, Mycobacterium
PAADEV

SEQ ID NO: 534416 - protein, 5 aa, Mycobacterium
PAADG

SEQ ID NO: 534417 - protein, 16 aa, Mycobacterium
PAADGAATRPQTPTEV

SEQ ID NO: 534418 - protein, 6 aa, Mycobacterium
PAADGL

SEQ ID NO: 534419 - protein, 6 aa, Mycobacterium
PAADGY

SEQ ID NO: 534420 - protein, 5 aa, Mycobacterium
PAADL

SEQ ID NO: 534421 - protein, 5 aa, Mycobacterium
PAADN

SEQ ID NO: 534422 - protein, 9 aa, Mycobacterium
PAADPERYA

SEQ ID NO: 534423 - protein, 10 aa, Mycobacterium
PAADPGNGGR

SEQ ID NO: 534424 - protein, 8 aa, Mycobacterium
PAADPVSL

SEQ ID NO: 534425 - protein, 8 aa, Mycobacterium
PAADPVSM

SEQ ID NO: 534426 - protein, 7 aa, Mycobacterium
PAADQET

SEQ ID NO: 534427 - protein, 9 aa, Mycobacterium
PAADRDQDR

SEQ ID NO: 534428 - protein, 20 aa, Mycobacterium
PAADSADDAEVEAAAERVAG

SEQ ID NO: 534429 - protein, 5 aa, Mycobacterium
PAADV

SEQ ID NO: 534430 - protein, 13 aa, Mycobacterium
PAAEAAAAHPPAV

SEQ ID NO: 534431 - protein, 12 aa, Mycobacterium
PAAEAAPGDGAD

SEQ ID NO: 534432 - protein, 7 aa, Mycobacterium
PAAEAVN

SEQ ID NO: 534433 - protein, 13 aa, Mycobacterium
PAAEELAEDRAAQ

SEQ ID NO: 534434 - protein, 7 aa, Mycobacterium
PAAEERH

SEQ ID NO: 534435 - protein, 9 aa, Mycobacterium
PAAEGRRAE

SEQ ID NO: 534436 - protein, 8 aa, Mycobacterium
PAAEGVST

SEQ ID NO: 534437 - protein, 8 aa, Mycobacterium
PAAEHQFS

SEQ ID NO: 534438 - protein, 7 aa, Mycobacterium
PAAELPR

SEQ ID NO: 534439 - protein, 10 aa, Mycobacterium
PAAELSLTGS

SEQ ID NO: 534440 - protein, 5 aa, Mycobacterium
PAAEP

SEQ ID NO: 534441 - protein, 9 aa, Mycobacterium
PAAEPDSTV

SEQ ID NO: 534442 - protein, 41 aa, Mycobacterium
PAAEPEPEPPPVKNPAPGGEPQTPAYTNPAVPNPAETENPQ

SEQ ID NO: 534443 - protein, 6 aa, Mycobacterium
PAAEPF

SEQ ID NO: 534444 - protein, 9 aa, Mycobacterium
PAAEPLEAQ

SEQ ID NO: 534445 - protein, 21 aa, Mycobacterium
PAAEPPALTPRRPLSEVLRLR

SEQ ID NO: 534446 - protein, 8 aa, Mycobacterium
PAAEPSPL

SEQ ID NO: 534447 - protein, 10 aa, Mycobacterium
PAAEQEPSAD

SEQ ID NO: 534448 - protein, 7 aa, Mycobacterium
PAAEQPW

SEQ ID NO: 534449 - protein, 18 aa, Mycobacterium
PAAERLDAATSAGEGAAA

SEQ ID NO: 534450 - protein, 15 aa, Mycobacterium
PAAERQATVGYSVAS

SEQ ID NO: 534451 - protein, 12 aa, Mycobacterium
PAAESSGTGAGT

SEQ ID NO: 534452 - protein, 9 aa, Mycobacterium
PAAETDSTM

SEQ ID NO: 534453 - protein, 5 aa, Mycobacterium
PAAEV

SEQ ID NO: 534454 - protein, 4 aa, Mycobacterium
PAAF

SEQ ID NO: 534455 - protein, 7 aa, Mycobacterium
PAAFATA

SEQ ID NO: 534456 - protein, 5 aa, Mycobacterium
PAAGA

SEQ ID NO: 534457 - protein, 6 aa, Mycobacterium
PAAGAD

SEQ ID NO: 534458 - protein, 5 aa, Mycobacterium
PAAGD

SEQ ID NO: 534459 - protein, 8 aa, Mycobacterium
PAAGDHTA

SEQ ID NO: 534460 - protein, 10 aa, Mycobacterium
PAAGDPPRVR

SEQ ID NO: 534461 - protein, 7 aa, Mycobacterium
PAAGEDV

SEQ ID NO: 534462 - protein, 46 aa, Mycobacterium
PAAGERARTAPPAGIRGRPRPRRPRCPRSRPGTPAANSAAPATRCS

SEQ ID NO: 534463 - protein, 9 aa, Mycobacterium
PAAGGADAP

SEQ ID NO: 534464 - protein, 7 aa, Mycobacterium
PAAGGED

SEQ ID NO: 534465 - protein, 7 aa, Mycobacterium
PAAGGKF

SEQ ID NO: 534466 - protein, 7 aa, Mycobacterium
PAAGGLD

SEQ ID NO: 534467 - protein, 15 aa, Mycobacterium
PAAGGRPRRHETEPL

SEQ ID NO: 534468 - protein, 14 aa, Mycobacterium
PAAGHGDRRGEIAE

SEQ ID NO: 534469 - protein, 5 aa, Mycobacterium
PAAGK

SEQ ID NO: 534470 - protein, 15 aa, Mycobacterium
PAAGLPPLRGSLPRS

SEQ ID NO: 534471 - protein, 8 aa, Mycobacterium
PAAGPDDE

SEQ ID NO: 534472 - protein, 9 aa, Mycobacterium
PAAGPGREE

SEQ ID NO: 534473 - protein, 24 aa, Mycobacterium
PAAGPSAAPRQPPAGTPLSDRERE

SEQ ID NO: 534474 - protein, 5 aa, Mycobacterium
PAAGQ

SEQ ID NO: 534475 - protein, 12 aa, Mycobacterium
PAAGRELTHDDG

SEQ ID NO: 534476 - protein, 17 aa, Mycobacterium
PAAGRGANSSGAAAARY

SEQ ID NO: 534477 - protein, 10 aa, Mycobacterium
PAAGSHDERV

SEQ ID NO: 534478 - protein, 6 aa, Mycobacterium
PAAGSS

SEQ ID NO: 534479 - protein, 6 aa, Mycobacterium
PAAGTS

SEQ ID NO: 534480 - protein, 11 aa, Mycobacterium
PAAGVAPAGIG

SEQ ID NO: 534481 - protein, 18 aa, Mycobacterium
PAAGVKDGAYDVATGRPV

SEQ ID NO: 534482 - protein, 9 aa, Mycobacterium
PAAGVRTDA

SEQ ID NO: 534483 - protein, 6 aa, Mycobacterium
PAAGYA

SEQ ID NO: 534484 - protein, 7 aa, Mycobacterium
PAAHASD

SEQ ID NO: 534485 - protein, 6 aa, Mycobacterium
PAAHIG

SEQ ID NO: 534486 - protein, 6 aa, Mycobacterium
PAAHVG

SEQ ID NO: 534487 - protein, 6 aa, Mycobacterium
PAAIGG

SEQ ID NO: 534488 - protein, 8 aa, Mycobacterium
PAAITSGT

SEQ ID NO: 534489 - protein, 4 aa, Mycobacterium
PAAK

SEQ ID NO: 534490 - protein, 8 aa, Mycobacterium
PAAKGHTR

SEQ ID NO: 534491 - protein, 5 aa, Mycobacterium
PAAKH

SEQ ID NO: 534492 - protein, 10 aa, Mycobacterium
PAAKPATAVS

SEQ ID NO: 534493 - protein, 7 aa, Mycobacterium
PAAKTYA

SEQ ID NO: 534494 - protein, 15 aa, Mycobacterium
PAALATASAPPTSRA

SEQ ID NO: 534495 - protein, 14 aa, Mycobacterium
PAALGPARSMAAAE

SEQ ID NO: 534496 - protein, 13 aa, Mycobacterium
PAALSGGEKQRVA

SEQ ID NO: 534497 - protein, 6 aa, Mycobacterium
PAALSP

SEQ ID NO: 534498 - protein, 5 aa, Mycobacterium
PAALT

SEQ ID NO: 534499 - protein, 27 aa, Mycobacterium
PAALTRPRVSATASGPFEAPATPTERA

SEQ ID NO: 534500 - protein, 8 aa, Mycobacterium
PAAMTSPA

SEQ ID NO: 534501 - protein, 4 aa, Mycobacterium
PAAN

SEQ ID NO: 534502 - protein, 9 aa, Mycobacterium
PAANASVDR

SEQ ID NO: 534503 - protein, 10 aa, Mycobacterium
PAANPTITDT

SEQ ID NO: 534504 - protein, 8 aa, Mycobacterium
PAANSSDP

SEQ ID NO: 534505 - protein, 13 aa, Mycobacterium
PAAPADAAPGPFT

SEQ ID NO: 534506 - protein, 8 aa, Mycobacterium
PAAPAGAP

SEQ ID NO: 534507 - protein, 8 aa, Mycobacterium
PAAPAPDD

SEQ ID NO: 534508 - protein, 8 aa, Mycobacterium
PAAPAQGI

SEQ ID NO: 534509 - protein, 6 aa, Mycobacterium
PAAPAR

SEQ ID NO: 534510 - protein, 6 aa, Mycobacterium
PAAPAT

SEQ ID NO: 534511 - protein, 14 aa, Mycobacterium
PAAPDADEAATYPA

SEQ ID NO: 534512 - protein, 8 aa, Mycobacterium
PAAPDPGG

SEQ ID NO: 534513 - protein, 6 aa, Mycobacterium
PAAPDT

SEQ ID NO: 534514 - protein, 11 aa, Mycobacterium
PAAPETAGLGT

SEQ ID NO: 534515 - protein, 15 aa, Mycobacterium
PAAPEVPQPSRLEGY

SEQ ID NO: 534516 - protein, 27 aa, Mycobacterium
PAAPGTATPLDDDGGALRASGARSLAG

SEQ ID NO: 534517 - protein, 9 aa, Mycobacterium
PAAPGVASG

SEQ ID NO: 534518 - protein, 8 aa, Mycobacterium
PAAPGVSP

SEQ ID NO: 534519 - protein, 9 aa, Mycobacterium
PAAPHRRPG

SEQ ID NO: 534520 - protein, 6 aa, Mycobacterium
PAAPKH

SEQ ID NO: 534521 - protein, 8 aa, Mycobacterium
PAAPLDGS

SEQ ID NO: 534522 - protein, 9 aa, Mycobacterium
PAAPLTRGS

SEQ ID NO: 534523 - protein, 7 aa, Mycobacterium
PAAPMHS

SEQ ID NO: 534524 - protein, 8 aa, Mycobacterium
PAAPNRSG

SEQ ID NO: 534525 - protein, 22 aa, Mycobacterium
PAAPPEEDFGRQPPQDVAAEQS

SEQ ID NO: 534526 - protein, 13 aa, Mycobacterium
PAAPPGALGRPAH

SEQ ID NO: 534527 - protein, 38 aa, Mycobacterium
PAAPPGPDSHPPRPPSPPSPPFRARSDRRRGWPRGSVW

SEQ ID NO: 534528 - protein, 10 aa, Mycobacterium
PAAPPPLPEP

SEQ ID NO: 534529 - protein, 8 aa, Mycobacterium
PAAPPREI

SEQ ID NO: 534530 - protein, 8 aa, Mycobacterium
PAAPPREV

SEQ ID NO: 534531 - protein, 7 aa, Mycobacterium
PAAPPVE

SEQ ID NO: 534532 - protein, 30 aa, Mycobacterium
PAAPPVPPEPPMPPTPPWPPVPASAAPAVP

SEQ ID NO: 534533 - protein, 5 aa, Mycobacterium
PAAPQ

SEQ ID NO: 534534 - protein, 5 aa, Mycobacterium
PAAPT

SEQ ID NO: 534535 - protein, 8 aa, Mycobacterium
PAAPTAAE

SEQ ID NO: 534536 - protein, 14 aa, Mycobacterium
PAAPTALEAPAGDI

SEQ ID NO: 534537 - protein, 7 aa, Mycobacterium
PAAPTGE

SEQ ID NO: 534538 - protein, 7 aa, Mycobacterium
PAAPTQK

SEQ ID NO: 534539 - protein, 7 aa, Mycobacterium
PAAPTQL

SEQ ID NO: 534540 - protein, 14 aa, Mycobacterium
PAAPTTFNAKPGQR

SEQ ID NO: 534541 - protein, 14 aa, Mycobacterium
PAAPTTFSAKPGQR

SEQ ID NO: 534542 - protein, 4 aa, Mycobacterium
PAAQ

SEQ ID NO: 534543 - protein, 23 aa, Mycobacterium
PAAQADSSDPGHDPGYDNGGVPT

SEQ ID NO: 534544 - protein, 8 aa, Mycobacterium
PAAQAREA

SEQ ID NO: 534545 - protein, 7 aa, Mycobacterium
PAAQASI

SEQ ID NO: 534546 - protein, 6 aa, Mycobacterium
PAAQDL

SEQ ID NO: 534547 - protein, 6 aa, Mycobacterium
PAAQEA

SEQ ID NO: 534548 - protein, 6 aa, Mycobacterium
PAAQGA

SEQ ID NO: 534549 - protein, 8 aa, Mycobacterium
PAAQGGET

SEQ ID NO: 534550 - protein, 7 aa, Mycobacterium
PAAQGRG

SEQ ID NO: 534551 - protein, 8 aa, Mycobacterium
PAAQGRGL

SEQ ID NO: 534552 - protein, 9 aa, Mycobacterium
PAAQGRGLG

SEQ ID NO: 534553 - protein, 6 aa, Mycobacterium
PAAQPD

SEQ ID NO: 534554 - protein, 8 aa, Mycobacterium
PAAQPDSP

SEQ ID NO: 534555 - protein, 18 aa, Mycobacterium
PAAQQAPARGTLSTHDPR

SEQ ID NO: 534556 - protein, 11 aa, Mycobacterium
PAAQRAQAQAA

SEQ ID NO: 534557 - protein, 21 aa, Mycobacterium
PAAQSRRKTIATAEDGTEYQA

SEQ ID NO: 534558 - protein, 8 aa, Mycobacterium
PAAQTRAA

SEQ ID NO: 534559 - protein, 5 aa, Mycobacterium
PAARA

SEQ ID NO: 534560 - protein, 7 aa, Mycobacterium
PAARAAL

SEQ ID NO: 534561 - protein, 7 aa, Mycobacterium
PAARDSA

SEQ ID NO: 534562 - protein, 5 aa, Mycobacterium
PAARG

SEQ ID NO: 534563 - protein, 8 aa, Mycobacterium
PAARGATG

SEQ ID NO: 534564 - protein, 11 aa, Mycobacterium
PAARMGKPSEI

SEQ ID NO: 534565 - protein, 7 aa, Mycobacterium
PAARNAL

SEQ ID NO: 534566 - protein, 7 aa, Mycobacterium
PAARPHE

SEQ ID NO: 534567 - protein, 8 aa, Mycobacterium
PAARPMNG

SEQ ID NO: 534568 - protein, 14 aa, Mycobacterium
PAARPSESSATTAA

SEQ ID NO: 534569 - protein, 6 aa, Mycobacterium
PAARRG

SEQ ID NO: 534570 - protein, 6 aa, Mycobacterium
PAARRN

SEQ ID NO: 534571 - protein, 6 aa, Mycobacterium
PAARRR

SEQ ID NO: 534572 - protein, 10 aa, Mycobacterium
PAARSGFGPF

SEQ ID NO: 534573 - protein, 9 aa, Mycobacterium
PAARSGTRG

SEQ ID NO: 534574 - protein, 14 aa, Mycobacterium
PAARSPQSQDSATT

SEQ ID NO: 534575 - protein, 24 aa, Mycobacterium
PAARSPQSQDSATTHIGFRCVENL

SEQ ID NO: 534576 - protein, 22 aa, Mycobacterium
PAARSPQSQDSSTTHIGFRCVV

SEQ ID NO: 534577 - protein, 23 aa, Mycobacterium
PAARSPQSQDTATTHIGFRCVAD

SEQ ID NO: 534578 - protein, 22 aa, Mycobacterium
PAARSSQSQDSATTHIGFRCVA

SEQ ID NO: 534579 - protein, 14 aa, Mycobacterium
PAARTATAQNLQDD

SEQ ID NO: 534580 - protein, 8 aa, Mycobacterium
PAARTSTV

SEQ ID NO: 534581 - protein, 10 aa, Mycobacterium
PAASAGEQCR

SEQ ID NO: 534582 - protein, 9 aa, Mycobacterium
PAASAQDAH

SEQ ID NO: 534583 - protein, 10 aa, Mycobacterium
PAASDGRDVD

SEQ ID NO: 534584 - protein, 13 aa, Mycobacterium
PAASGGDGTGSIR

SEQ ID NO: 534585 - protein, 9 aa, Mycobacterium
PAASGRNYE

SEQ ID NO: 534586 - protein, 16 aa, Mycobacterium
PAASHREYSANQHAYT

SEQ ID NO: 534587 - protein, 8 aa, Mycobacterium
PAASLPGV

SEQ ID NO: 534588 - protein, 13 aa, Mycobacterium
PAASPADPHCAGG

SEQ ID NO: 534589 - protein, 10 aa, Mycobacterium
PAASPAVRNG

SEQ ID NO: 534590 - protein, 9 aa, Mycobacterium
PAASPDPRA

SEQ ID NO: 534591 - protein, 14 aa, Mycobacterium
PAASPRGFRSGGSE

SEQ ID NO: 534592 - protein, 15 aa, Mycobacterium
PAASPTAQKRARTAV

SEQ ID NO: 534593 - protein, 18 aa, Mycobacterium
PAASPVLSGGQKGPHPIQ

SEQ ID NO: 534594 - protein, 7 aa, Mycobacterium
PAASRAD

SEQ ID NO: 534595 - protein, 10 aa, Mycobacterium
PAASRLSRKA

SEQ ID NO: 534596 - protein, 12 aa, Mycobacterium
PAASSSATDDLA

SEQ ID NO: 534597 - protein, 6 aa, Mycobacterium
PAASTR

SEQ ID NO: 534598 - protein, 8 aa, Mycobacterium
PAASVGEQ

SEQ ID NO: 534599 - protein, 10 aa, Mycobacterium
PAASYRPGEA

SEQ ID NO: 534600 - protein, 5 aa, Mycobacterium
PAATA

SEQ ID NO: 534601 - protein, 7 aa, Mycobacterium
PAATADH

SEQ ID NO: 534602 - protein, 8 aa, Mycobacterium
PAATAEFD

SEQ ID NO: 534603 - protein, 6 aa, Mycobacterium
PAATAI

SEQ ID NO: 534604 - protein, 10 aa, Mycobacterium
PAATAPVEEL

SEQ ID NO: 534605 - protein, 5 aa, Mycobacterium
PAATD

SEQ ID NO: 534606 - protein, 12 aa, Mycobacterium
PAATDQDVRRAE

SEQ ID NO: 534607 - protein, 7 aa, Mycobacterium
PAATGAE

SEQ ID NO: 534608 - protein, 8 aa, Mycobacterium
PAATGETP

SEQ ID NO: 534609 - protein, 11 aa, Mycobacterium
PAATGSARQCA

SEQ ID NO: 534610 - protein, 7 aa, Mycobacterium
PAATGTI

SEQ ID NO: 534611 - protein, 12 aa, Mycobacterium
PAATHNAEAARQ

SEQ ID NO: 534612 - protein, 6 aa, Mycobacterium
PAATKA

SEQ ID NO: 534613 - protein, 7 aa, Mycobacterium
PAATKAD

SEQ ID NO: 534614 - protein, 14 aa, Mycobacterium
PAATKSSPQRIAER

SEQ ID NO: 534615 - protein, 7 aa, Mycobacterium
PAATPEA

SEQ ID NO: 534616 - protein, 10 aa, Mycobacterium
PAATPEDLNE

SEQ ID NO: 534617 - protein, 8 aa, Mycobacterium
PAATPNSA

SEQ ID NO: 534618 - protein, 9 aa, Mycobacterium
PAATPPHRA

SEQ ID NO: 534619 - protein, 17 aa, Mycobacterium
PAATPWKGRNKPHRGDR

SEQ ID NO: 534620 - protein, 8 aa, Mycobacterium
PAATQRQV

SEQ ID NO: 534621 - protein, 10 aa, Mycobacterium
PAATRTQRAR

SEQ ID NO: 534622 - protein, 9 aa, Mycobacterium
PAATRTRDA

SEQ ID NO: 534623 - protein, 17 aa, Mycobacterium
PAATRTTGTASPAAAAQ

SEQ ID NO: 534624 - protein, 6 aa, Mycobacterium
PAATSF

SEQ ID NO: 534625 - protein, 9 aa, Mycobacterium
PAATSPQGA

SEQ ID NO: 534626 - protein, 7 aa, Mycobacterium
PAATTPA

SEQ ID NO: 534627 - protein, 11 aa, Mycobacterium
PAATVEERSAD

SEQ ID NO: 534628 - protein, 18 aa, Mycobacterium
PAAVEQAQAELSANGAAV

SEQ ID NO: 534629 - protein, 5 aa, Mycobacterium
PAAVG

SEQ ID NO: 534630 - protein, 7 aa, Mycobacterium
PAAVGAA

SEQ ID NO: 534631 - protein, 8 aa, Mycobacterium
PAAVGAAS

SEQ ID NO: 534632 - protein, 12 aa, Mycobacterium
PAAVGPGVVPPA

SEQ ID NO: 534633 - protein, 9 aa, Mycobacterium
PAAVPGFRS

SEQ ID NO: 534634 - protein, 14 aa, Mycobacterium
PAAVPQEQALKPAL

SEQ ID NO: 534635 - protein, 8 aa, Mycobacterium
PAAVPSGV

SEQ ID NO: 534636 - protein, 7 aa, Mycobacterium
PAAVRTP

SEQ ID NO: 534637 - protein, 29 aa, Mycobacterium
PAAVSPTGAAKDTQEQQDPRSQSGRHLTT

SEQ ID NO: 534638 - protein, 5 aa, Mycobacterium
PAAYR

SEQ ID NO: 534639 - protein, 5 aa, Mycobacterium
PAAYT

SEQ ID NO: 534640 - protein, 7 aa, Mycobacterium
PACDGDE

SEQ ID NO: 534641 - protein, 5 aa, Mycobacterium
PACGT

SEQ ID NO: 534642 - protein, 23 aa, Mycobacterium
PACGTDGLTPCGPGSVANGAGTL

SEQ ID NO: 534643 - protein, 5 aa, Mycobacterium
PACRS

SEQ ID NO: 534644 - protein, 4 aa, Mycobacterium
PACS

SEQ ID NO: 534645 - protein, 10 aa, Mycobacterium
PADAAPADDN

SEQ ID NO: 534646 - protein, 6 aa, Mycobacterium
PADAAV

SEQ ID NO: 534647 - protein, 10 aa, Mycobacterium
PADADEAARG

SEQ ID NO: 534648 - protein, 10 aa, Mycobacterium
PADADGTPVA

SEQ ID NO: 534649 - protein, 7 aa, Mycobacterium
PADAEAL

SEQ ID NO: 534650 - protein, 13 aa, Mycobacterium
PADAEARAADGPL

SEQ ID NO: 534651 - protein, 8 aa, Mycobacterium
PADAGVSG

SEQ ID NO: 534652 - protein, 9 aa, Mycobacterium
PADANETAH

SEQ ID NO: 534653 - protein, 7 aa, Mycobacterium
PADANVS

SEQ ID NO: 534654 - protein, 7 aa, Mycobacterium
PADAPAA

SEQ ID NO: 534655 - protein, 8 aa, Mycobacterium
PADAPDRQ

SEQ ID NO: 534656 - protein, 8 aa, Mycobacterium
PADAPERQ

SEQ ID NO: 534657 - protein, 8 aa, Mycobacterium
PADAPGAL

SEQ ID NO: 534658 - protein, 19 aa, Mycobacterium
PADAPLPQTPDRNLPPLDT

SEQ ID NO: 534659 - protein, 8 aa, Mycobacterium
PADAPNAV

SEQ ID NO: 534660 - protein, 21 aa, Mycobacterium
PADAPNPSGAERPCRPPALAD

SEQ ID NO: 534661 - protein, 13 aa, Mycobacterium
PADAPPEAGYVPS

SEQ ID NO: 534662 - protein, 9 aa, Mycobacterium
PADAPVAPE

SEQ ID NO: 534663 - protein, 5 aa, Mycobacterium
PADAR

SEQ ID NO: 534664 - protein, 10 aa, Mycobacterium
PADARDYGTG

SEQ ID NO: 534665 - protein, 8 aa, Mycobacterium
PADASALD

SEQ ID NO: 534666 - protein, 16 aa, Mycobacterium
PADASSTAFEPDPIRA

SEQ ID NO: 534667 - protein, 5 aa, Mycobacterium
PADAT

SEQ ID NO: 534668 - protein, 10 aa, Mycobacterium
PADATATASM

SEQ ID NO: 534669 - protein, 10 aa, Mycobacterium
PADATDPVAA

SEQ ID NO: 534670 - protein, 8 aa, Mycobacterium
PADATRAA

SEQ ID NO: 534671 - protein, 5 aa, Mycobacterium
PADDA

SEQ ID NO: 534672 - protein, 17 aa, Mycobacterium
PADDATAAGDVAVGSGA

SEQ ID NO: 534673 - protein, 9 aa, Mycobacterium
PADDDAPPM

SEQ ID NO: 534674 - protein, 14 aa, Mycobacterium
PADDDERNEKQARE

SEQ ID NO: 534675 - protein, 7 aa, Mycobacterium
PADDGAE

SEQ ID NO: 534676 - protein, 32 aa, Mycobacterium
PADDGRRAAARGGGGQSGPGGPVSGAYGRPRA

SEQ ID NO: 534677 - protein, 13 aa, Mycobacterium
PADDLSAAGPADG

SEQ ID NO: 534678 - protein, 5 aa, Mycobacterium
PADDP

SEQ ID NO: 534679 - protein, 10 aa, Mycobacterium
PADDPAGFGP

SEQ ID NO: 534680 - protein, 10 aa, Mycobacterium
PADDPHQSAA

SEQ ID NO: 534681 - protein, 10 aa, Mycobacterium
PADDPPPISE

SEQ ID NO: 534682 - protein, 7 aa, Mycobacterium
PADDSAV

SEQ ID NO: 534683 - protein, 10 aa, Mycobacterium
PADDTARHDE

SEQ ID NO: 534684 - protein, 5 aa, Mycobacterium
PADDV

SEQ ID NO: 534685 - protein, 10 aa, Mycobacterium
PADEAPESFA

SEQ ID NO: 534686 - protein, 6 aa, Mycobacterium
PADEDV

SEQ ID NO: 534687 - protein, 8 aa, Mycobacterium
PADEGPGH

SEQ ID NO: 534688 - protein, 16 aa, Mycobacterium
PADEHARAGSAGLTDQ

SEQ ID NO: 534689 - protein, 7 aa, Mycobacterium
PADEHRR

SEQ ID NO: 534690 - protein, 8 aa, Mycobacterium
PADEHRRA

SEQ ID NO: 534691 - protein, 6 aa, Mycobacterium
PADEKN

SEQ ID NO: 534692 - protein, 15 aa, Mycobacterium
PADEPATSASDRGAA

SEQ ID NO: 534693 - protein, 20 aa, Mycobacterium
PADEPLNDAGRRQAETAGPI

SEQ ID NO: 534694 - protein, 9 aa, Mycobacterium
PADETPRTA

SEQ ID NO: 534695 - protein, 8 aa, Mycobacterium
PADEVGNN

SEQ ID NO: 534696 - protein, 5 aa, Mycobacterium
PADFA

SEQ ID NO: 534697 - protein, 16 aa, Mycobacterium
PADFGDTAPINDSDEE

SEQ ID NO: 534698 - protein, 18 aa, Mycobacterium
PADGAGPARSRDAPPSRI

SEQ ID NO: 534699 - protein, 6 aa, Mycobacterium
PADGDW

SEQ ID NO: 534700 - protein, 12 aa, Mycobacterium
PADGEFPGSDPD

SEQ ID NO: 534701 - protein, 7 aa, Mycobacterium
PADGGRD

SEQ ID NO: 534702 - protein, 7 aa, Mycobacterium
PADGGRF

SEQ ID NO: 534703 - protein, 6 aa, Mycobacterium
PADGGS

SEQ ID NO: 534704 - protein, 9 aa, Mycobacterium
PADGPGSQA

SEQ ID NO: 534705 - protein, 8 aa, Mycobacterium
PADGPLGD

SEQ ID NO: 534706 - protein, 8 aa, Mycobacterium
PADGPLPH

SEQ ID NO: 534707 - protein, 8 aa, Mycobacterium
PADGSATG

SEQ ID NO: 534708 - protein, 9 aa, Mycobacterium
PADGSQEGE

SEQ ID NO: 534709 - protein, 17 aa, Mycobacterium
PADGSYPSGTAAYEKRN

SEQ ID NO: 534710 - protein, 10 aa, Mycobacterium
PADGTESGHL

SEQ ID NO: 534711 - protein, 5 aa, Mycobacterium
PADGV

SEQ ID NO: 534712 - protein, 6 aa, Mycobacterium
PADGYH

SEQ ID NO: 534713 - protein, 7 aa, Mycobacterium
PADHAGP

SEQ ID NO: 534714 - protein, 6 aa, Mycobacterium
PADHPD

SEQ ID NO: 534715 - protein, 11 aa, Mycobacterium
PADHSKATREL

SEQ ID NO: 534716 - protein, 12 aa, Mycobacterium
PADIGRAISSPA

SEQ ID NO: 534717 - protein, 12 aa, Mycobacterium
PADISTATLNDT

SEQ ID NO: 534718 - protein, 11 aa, Mycobacterium
PADISTATLNE

SEQ ID NO: 534719 - protein, 7 aa, Mycobacterium
PADKRQY

SEQ ID NO: 534720 - protein, 54 aa, Mycobacterium
PADLAPAPADLAPAPADLAPAPADLAPAPADLPPAPADLAPAPEAIPAAPEAPA

SEQ ID NO: 534721 - protein, 6 aa, Mycobacterium
PADLEQ

SEQ ID NO: 534722 - protein, 10 aa, Mycobacterium
PADLGSSGNV

SEQ ID NO: 534723 - protein, 11 aa, Mycobacterium
PADLGTAEGVT

SEQ ID NO: 534724 - protein, 10 aa, Mycobacterium
PADLNRPAGS

SEQ ID NO: 534725 - protein, 6 aa, Mycobacterium
PADLPK

SEQ ID NO: 534726 - protein, 14 aa, Mycobacterium
PADLRAEETTQVGT

SEQ ID NO: 534727 - protein, 4 aa, Mycobacterium
PADN

SEQ ID NO: 534728 - protein, 5 aa, Mycobacterium
PADNG

SEQ ID NO: 534729 - protein, 10 aa, Mycobacterium
PADNGPYDGK

SEQ ID NO: 534730 - protein, 6 aa, Mycobacterium
PADNPV

SEQ ID NO: 534731 - protein, 5 aa, Mycobacterium
PADPA

SEQ ID NO: 534732 - protein, 10 aa, Mycobacterium
PADPAARAAA

SEQ ID NO: 534733 - protein, 7 aa, Mycobacterium
PADPADP

SEQ ID NO: 534734 - protein, 8 aa, Mycobacterium
PADPADPH

SEQ ID NO: 534735 - protein, 6 aa, Mycobacterium
PADPAE

SEQ ID NO: 534736 - protein, 12 aa, Mycobacterium
PADPAGAGDSMT

SEQ ID NO: 534737 - protein, 17 aa, Mycobacterium
PADPASVPAGNTNGATV

SEQ ID NO: 534738 - protein, 15 aa, Mycobacterium
PADPAYLETGGGAES

SEQ ID NO: 534739 - protein, 11 aa, Mycobacterium
PADPDAAEPAI

SEQ ID NO: 534740 - protein, 13 aa, Mycobacterium
PADPDAKPRPLGK

SEQ ID NO: 534741 - protein, 10 aa, Mycobacterium
PADPDASAAE

SEQ ID NO: 534742 - protein, 7 aa, Mycobacterium
PADPDEQ

SEQ ID NO: 534743 - protein, 6 aa, Mycobacterium
PADPDQ

SEQ ID NO: 534744 - protein, 29 aa, Mycobacterium
PADPEPAGADALSGPAEAVSATTPEIDPP

SEQ ID NO: 534745 - protein, 8 aa, Mycobacterium
PADPFRRP

SEQ ID NO: 534746 - protein, 8 aa, Mycobacterium
PADPHETQ

SEQ ID NO: 534747 - protein, 9 aa, Mycobacterium
PADPHRRPS

SEQ ID NO: 534748 - protein, 9 aa, Mycobacterium
PADPPATRQ

SEQ ID NO: 534749 - protein, 18 aa, Mycobacterium
PADPPFAASQTGTFTGTP

SEQ ID NO: 534750 - protein, 6 aa, Mycobacterium
PADPPH

SEQ ID NO: 534751 - protein, 12 aa, Mycobacterium
PADPPPLPEPLP

SEQ ID NO: 534752 - protein, 9 aa, Mycobacterium
PADPPSLTI

SEQ ID NO: 534753 - protein, 103 aa, Mycobacterium
PADPPVPPSPPSPTAWAAPPLPPLPPLPPLPRGSGVAPPAPPAPPPPPAPNSHPPTPPAPPAPPLPPAKDVAEAPSPPRPPVPPLPTSQPPAPPAPPLPPVLG

SEQ ID NO: 534754 - protein, 5 aa, Mycobacterium
PADPQ

SEQ ID NO: 534755 - protein, 15 aa, Mycobacterium
PADPRAPARSTGGDC

SEQ ID NO: 534756 - protein, 7 aa, Mycobacterium
PADPRDA

SEQ ID NO: 534757 - protein, 6 aa, Mycobacterium
PADPRI

SEQ ID NO: 534758 - protein, 14 aa, Mycobacterium
PADPRSKTQRRADA

SEQ ID NO: 534759 - protein, 14 aa, Mycobacterium
PADPRTMDQRRADA

SEQ ID NO: 534760 - protein, 10 aa, Mycobacterium
PADPSWPDQA

SEQ ID NO: 534761 - protein, 31 aa, Mycobacterium
PADPTPLSPRAGQSGQAHDRHHAPADSWGRT

SEQ ID NO: 534762 - protein, 10 aa, Mycobacterium
PADPTWPDQA

SEQ ID NO: 534763 - protein, 9 aa, Mycobacterium
PADPVRNGQ

SEQ ID NO: 534764 - protein, 8 aa, Mycobacterium
PADQCPSG

SEQ ID NO: 534765 - protein, 9 aa, Mycobacterium
PADQKSDPA

SEQ ID NO: 534766 - protein, 24 aa, Mycobacterium
PADQQDRVREAAQSCPEQAIVITD

SEQ ID NO: 534767 - protein, 5 aa, Mycobacterium
PADQR

SEQ ID NO: 534768 - protein, 8 aa, Mycobacterium
PADQRDPA

SEQ ID NO: 534769 - protein, 14 aa, Mycobacterium
PADQSTATAGATYP

SEQ ID NO: 534770 - protein, 8 aa, Mycobacterium
PADRATDG

SEQ ID NO: 534771 - protein, 9 aa, Mycobacterium
PADRATDGA

SEQ ID NO: 534772 - protein, 14 aa, Mycobacterium
PADRDGEQDRVDPR

SEQ ID NO: 534773 - protein, 13 aa, Mycobacterium
PADRDGYRKRAEQ

SEQ ID NO: 534774 - protein, 10 aa, Mycobacterium
PADRGTGLGK

SEQ ID NO: 534775 - protein, 25 aa, Mycobacterium
PADRPLAPVRTPNRRPFSEVVHHGR

SEQ ID NO: 534776 - protein, 25 aa, Mycobacterium
PADRPLRPIRTPNRRPFSEVVHHGR

SEQ ID NO: 534777 - protein, 6 aa, Mycobacterium
PADRPT

SEQ ID NO: 534778 - protein, 6 aa, Mycobacterium
PADRPY

SEQ ID NO: 534779 - protein, 7 aa, Mycobacterium
PADRRDY

SEQ ID NO: 534780 - protein, 11 aa, Mycobacterium
PADRSAPGRSY

SEQ ID NO: 534781 - protein, 7 aa, Mycobacterium
PADRSRL

SEQ ID NO: 534782 - protein, 7 aa, Mycobacterium
PADRVTD

SEQ ID NO: 534783 - protein, 10 aa, Mycobacterium
PADRYAAGSL

SEQ ID NO: 534784 - protein, 7 aa, Mycobacterium
PADSARE

SEQ ID NO: 534785 - protein, 5 aa, Mycobacterium
PADSE

SEQ ID NO: 534786 - protein, 5 aa, Mycobacterium
PADSG

SEQ ID NO: 534787 - protein, 17 aa, Mycobacterium
PADSLPSDPDWSGAPAE

SEQ ID NO: 534788 - protein, 7 aa, Mycobacterium
PADSMGR

SEQ ID NO: 534789 - protein, 13 aa, Mycobacterium
PADSNGYGHTAGD

SEQ ID NO: 534790 - protein, 7 aa, Mycobacterium
PADSPGV

SEQ ID NO: 534791 - protein, 16 aa, Mycobacterium
PADSPKAVPQVSAGTI

SEQ ID NO: 534792 - protein, 11 aa, Mycobacterium
PADSPNAVAQV

SEQ ID NO: 534793 - protein, 6 aa, Mycobacterium
PADSVT

SEQ ID NO: 534794 - protein, 5 aa, Mycobacterium
PADTD

SEQ ID NO: 534795 - protein, 11 aa, Mycobacterium
PADTDLPSGTR

SEQ ID NO: 534796 - protein, 11 aa, Mycobacterium
PADTDMPESAW

SEQ ID NO: 534797 - protein, 8 aa, Mycobacterium
PADTDVDG

SEQ ID NO: 534798 - protein, 5 aa, Mycobacterium
PADTF

SEQ ID NO: 534799 - protein, 9 aa, Mycobacterium
PADTGRDKL

SEQ ID NO: 534800 - protein, 6 aa, Mycobacterium
PADTIY

SEQ ID NO: 534801 - protein, 11 aa, Mycobacterium
PADTKRRGASV

SEQ ID NO: 534802 - protein, 47 aa, Mycobacterium
PADTPAYKKGAAQQHVSGERRSEATARSASSGPKLAELSDEDGRAGA

SEQ ID NO: 534803 - protein, 8 aa, Mycobacterium
PADTPGLR

SEQ ID NO: 534804 - protein, 10 aa, Mycobacterium
PADTPGMANA

SEQ ID NO: 534805 - protein, 15 aa, Mycobacterium
PADTPNRRSQLKSDR

SEQ ID NO: 534806 - protein, 20 aa, Mycobacterium
PADTPTSPSRETPSVRPLQT

SEQ ID NO: 534807 - protein, 23 aa, Mycobacterium
PADTPTTTTTSPTEPPPQCKPED

SEQ ID NO: 534808 - protein, 7 aa, Mycobacterium
PADTRDA

SEQ ID NO: 534809 - protein, 7 aa, Mycobacterium
PADTRTD

SEQ ID NO: 534810 - protein, 14 aa, Mycobacterium
PADTRTVSVEERRR

SEQ ID NO: 534811 - protein, 7 aa, Mycobacterium
PADTSGR

SEQ ID NO: 534812 - protein, 7 aa, Mycobacterium
PADVAAE

SEQ ID NO: 534813 - protein, 15 aa, Mycobacterium
PADVDPPERPTPGPL

SEQ ID NO: 534814 - protein, 5 aa, Mycobacterium
PADVE

SEQ ID NO: 534815 - protein, 11 aa, Mycobacterium
PADVERGGQGM

SEQ ID NO: 534816 - protein, 6 aa, Mycobacterium
PADVPD

SEQ ID NO: 534817 - protein, 6 aa, Mycobacterium
PADVQR

SEQ ID NO: 534818 - protein, 5 aa, Mycobacterium
PADVR

SEQ ID NO: 534819 - protein, 5 aa, Mycobacterium
PADWS

SEQ ID NO: 534820 - protein, 9 aa, Mycobacterium
PADYDAGTI

SEQ ID NO: 534821 - protein, 99 aa, Mycobacterium
PAEAAAAVGPPRASQPKRRATDQEGQQSVTARSGARRRQRTRGGKPVTGHPAPGPANEAAAEPGSASGSSSPSSNAGNTRRRRRRRKPACVPDSATASA

SEQ ID NO: 534822 - protein, 11 aa, Mycobacterium
PAEAAAPYARS

SEQ ID NO: 534823 - protein, 5 aa, Mycobacterium
PAEAF

SEQ ID NO: 534824 - protein, 5 aa, Mycobacterium
PAEAG

SEQ ID NO: 534825 - protein, 38 aa, Mycobacterium
PAEAGGAIGTPKKPQGQRRKTERDGQKTERSGRSRSGA

SEQ ID NO: 534826 - protein, 7 aa, Mycobacterium
PAEAGGD

SEQ ID NO: 534827 - protein, 6 aa, Mycobacterium
PAEAKR

SEQ ID NO: 534828 - protein, 14 aa, Mycobacterium
PAEAKRPGTGQTLG

SEQ ID NO: 534829 - protein, 5 aa, Mycobacterium
PAEAM

SEQ ID NO: 534830 - protein, 7 aa, Mycobacterium
PAEAPER

SEQ ID NO: 534831 - protein, 8 aa, Mycobacterium
PAEAPGEI

SEQ ID NO: 534832 - protein, 7 aa, Mycobacterium
PAEAPGF

SEQ ID NO: 534833 - protein, 10 aa, Mycobacterium
PAEAPHGGES

SEQ ID NO: 534834 - protein, 124 aa, Mycobacterium
PAEAPKPVAESTQDSEGKKAENGAAPREGRGERRRNQNQNQNQPAEGERKQNGSRDNADNAESSGRDGGSSGQNSDNQNQDTNQNQGNRGDDGEGRGRRGRRTRERRRGRDRNNNEGGETELRE

SEQ ID NO: 534835 - protein, 7 aa, Mycobacterium
PAEAPSF

SEQ ID NO: 534836 - protein, 11 aa, Mycobacterium
PAEARTGREAI

SEQ ID NO: 534837 - protein, 7 aa, Mycobacterium
PAEATPL

SEQ ID NO: 534838 - protein, 4 aa, Mycobacterium
PAED

SEQ ID NO: 534839 - protein, 10 aa, Mycobacterium
PAEDPAGFGP

SEQ ID NO: 534840 - protein, 9 aa, Mycobacterium
PAEDTDDGD

SEQ ID NO: 534841 - protein, 9 aa, Mycobacterium
PAEDTPASA

SEQ ID NO: 534842 - protein, 5 aa, Mycobacterium
PAEDV

SEQ ID NO: 534843 - protein, 4 aa, Mycobacterium
PAEE

SEQ ID NO: 534844 - protein, 5 aa, Mycobacterium
PAEEA

SEQ ID NO: 534845 - protein, 14 aa, Mycobacterium
PAEEELAGDREHQQ

SEQ ID NO: 534846 - protein, 8 aa, Mycobacterium
PAEEFGGG

SEQ ID NO: 534847 - protein, 9 aa, Mycobacterium
PAEEGTQVT

SEQ ID NO: 534848 - protein, 24 aa, Mycobacterium
PAEEIAAETAATAERVYRLSESCR

SEQ ID NO: 534849 - protein, 8 aa, Mycobacterium
PAEELGGG

SEQ ID NO: 534850 - protein, 8 aa, Mycobacterium
PAEEQRTL

SEQ ID NO: 534851 - protein, 18 aa, Mycobacterium
PAEESPYDAVPAKQRGLT

SEQ ID NO: 534852 - protein, 7 aa, Mycobacterium
PAEEVDP

SEQ ID NO: 534853 - protein, 5 aa, Mycobacterium
PAEFA

SEQ ID NO: 534854 - protein, 5 aa, Mycobacterium
PAEFQ

SEQ ID NO: 534855 - protein, 5 aa, Mycobacterium
PAEGA

SEQ ID NO: 534856 - protein, 10 aa, Mycobacterium
PAEGADVPSP

SEQ ID NO: 534857 - protein, 10 aa, Mycobacterium
PAEGAGTETV

SEQ ID NO: 534858 - protein, 9 aa, Mycobacterium
PAEGDDPAM

SEQ ID NO: 534859 - protein, 16 aa, Mycobacterium
PAEGEDPAWTLYAWEA

SEQ ID NO: 534860 - protein, 10 aa, Mycobacterium
PAEGFTPSAS

SEQ ID NO: 534861 - protein, 12 aa, Mycobacterium
PAEGGSNAAVAA

SEQ ID NO: 534862 - protein, 9 aa, Mycobacterium
PAEGGSNTA

SEQ ID NO: 534863 - protein, 10 aa, Mycobacterium
PAEGGSNTAV

SEQ ID NO: 534864 - protein, 6 aa, Mycobacterium
PAEGGV

SEQ ID NO: 534865 - protein, 12 aa, Mycobacterium
PAEGLTPSEQKV

SEQ ID NO: 534866 - protein, 7 aa, Mycobacterium
PAEGPAR

SEQ ID NO: 534867 - protein, 8 aa, Mycobacterium
PAEGRNLP

SEQ ID NO: 534868 - protein, 7 aa, Mycobacterium
PAEGSGE

SEQ ID NO: 534869 - protein, 7 aa, Mycobacterium
PAEGSNT

SEQ ID NO: 534870 - protein, 7 aa, Mycobacterium
PAEGTAA

SEQ ID NO: 534871 - protein, 7 aa, Mycobacterium
PAEGTSA

SEQ ID NO: 534872 - protein, 5 aa, Mycobacterium
PAEGW

SEQ ID NO: 534873 - protein, 4 aa, Mycobacterium
PAEH

SEQ ID NO: 534874 - protein, 25 aa, Mycobacterium
PAEHPAAGPEHDSSGVEVQPPPRGK

SEQ ID NO: 534875 - protein, 25 aa, Mycobacterium
PAEHPAAGPEHESGGVAVAPPARGN

SEQ ID NO: 534876 - protein, 6 aa, Mycobacterium
PAEHPG

SEQ ID NO: 534877 - protein, 32 aa, Mycobacterium
PAEHPYGSAGVGSKYQGQRGPTPSRSYQNFIN

SEQ ID NO: 534878 - protein, 33 aa, Mycobacterium
PAEHPYGSSGVGSKYQGQRGPTPSRSYVNFIRS

SEQ ID NO: 534879 - protein, 33 aa, Mycobacterium
PAEHPYGSSQVGSKYQGQRGPTPSRSYQNFIRT

SEQ ID NO: 534880 - protein, 33 aa, Mycobacterium
PAEHPYGSSRVGSKYQGQRGPTPSRSYQNFISS

SEQ ID NO: 534881 - protein, 8 aa, Mycobacterium
PAEHTDSG

SEQ ID NO: 534882 - protein, 12 aa, Mycobacterium
PAEIDDPVAGHR

SEQ ID NO: 534883 - protein, 5 aa, Mycobacterium
PAEIE

SEQ ID NO: 534884 - protein, 9 aa, Mycobacterium
PAEIGKNRH

SEQ ID NO: 534885 - protein, 11 aa, Mycobacterium
PAEIGKNRNAD

SEQ ID NO: 534886 - protein, 12 aa, Mycobacterium
PAEIGKNRNADV

SEQ ID NO: 534887 - protein, 9 aa, Mycobacterium
PAEIPAPPE

SEQ ID NO: 534888 - protein, 12 aa, Mycobacterium
PAEISDPSGQVA

SEQ ID NO: 534889 - protein, 10 aa, Mycobacterium
PAEISEKDLT

SEQ ID NO: 534890 - protein, 11 aa, Mycobacterium
PAEKATADRER

SEQ ID NO: 534891 - protein, 7 aa, Mycobacterium
PAEKEAW

SEQ ID NO: 534892 - protein, 7 aa, Mycobacterium
PAEKRQV

SEQ ID NO: 534893 - protein, 11 aa, Mycobacterium
PAEKSSRGRRR

SEQ ID NO: 534894 - protein, 11 aa, Mycobacterium
PAEKSTRGNQR

SEQ ID NO: 534895 - protein, 4 aa, Mycobacterium
PAEL

SEQ ID NO: 534896 - protein, 11 aa, Mycobacterium
PAELAGLNNKG

SEQ ID NO: 534897 - protein, 5 aa, Mycobacterium
PAELP

SEQ ID NO: 534898 - protein, 20 aa, Mycobacterium
PAELSDAERAALTADDVPLD

SEQ ID NO: 534899 - protein, 7 aa, Mycobacterium
PAELSTN

SEQ ID NO: 534900 - protein, 8 aa, Mycobacterium
PAEMEPEE

SEQ ID NO: 534901 - protein, 16 aa, Mycobacterium
PAEMEPKPNEVDEDEL

SEQ ID NO: 534902 - protein, 17 aa, Mycobacterium
PAEMEPKPNEVDEDELR

SEQ ID NO: 534903 - protein, 9 aa, Mycobacterium
PAENNPGTD

SEQ ID NO: 534904 - protein, 10 aa, Mycobacterium
PAENTASGPT

SEQ ID NO: 534905 - protein, 7 aa, Mycobacterium
PAEPAAR

SEQ ID NO: 534906 - protein, 11 aa, Mycobacterium
PAEPADADELP

SEQ ID NO: 534907 - protein, 14 aa, Mycobacterium
PAEPADGTPTPDEL

SEQ ID NO: 534908 - protein, 16 aa, Mycobacterium
PAEPAPDPLAPPPGPL

SEQ ID NO: 534909 - protein, 10 aa, Mycobacterium
PAEPASATRC

SEQ ID NO: 534910 - protein, 6 aa, Mycobacterium
PAEPDA

SEQ ID NO: 534911 - protein, 10 aa, Mycobacterium
PAEPEGTDGT

SEQ ID NO: 534912 - protein, 8 aa, Mycobacterium
PAEPEPVA

SEQ ID NO: 534913 - protein, 10 aa, Mycobacterium
PAEPEPVSDI

SEQ ID NO: 534914 - protein, 7 aa, Mycobacterium
PAEPERA

SEQ ID NO: 534915 - protein, 7 aa, Mycobacterium
PAEPGGY

SEQ ID NO: 534916 - protein, 7 aa, Mycobacterium
PAEPGHV

SEQ ID NO: 534917 - protein, 7 aa, Mycobacterium
PAEPGVA

SEQ ID NO: 534918 - protein, 5 aa, Mycobacterium
PAEPH

SEQ ID NO: 534919 - protein, 27 aa, Mycobacterium
PAEPPGGAPRPPVPPAARDGCARMPAA

SEQ ID NO: 534920 - protein, 10 aa, Mycobacterium
PAEPQPVTDI

SEQ ID NO: 534921 - protein, 7 aa, Mycobacterium
PAEPQTI

SEQ ID NO: 534922 - protein, 7 aa, Mycobacterium
PAEPSGR

SEQ ID NO: 534923 - protein, 9 aa, Mycobacterium
PAEPTESGV

SEQ ID NO: 534924 - protein, 8 aa, Mycobacterium
PAEPTTAF

SEQ ID NO: 534925 - protein, 5 aa, Mycobacterium
PAEPY

SEQ ID NO: 534926 - protein, 7 aa, Mycobacterium
PAEQGGR

SEQ ID NO: 534927 - protein, 6 aa, Mycobacterium
PAEQRT

SEQ ID NO: 534928 - protein, 7 aa, Mycobacterium
PAEQRVS

SEQ ID NO: 534929 - protein, 7 aa, Mycobacterium
PAEQTPL

SEQ ID NO: 534930 - protein, 8 aa, Mycobacterium
PAERAGAA

SEQ ID NO: 534931 - protein, 7 aa, Mycobacterium
PAERERV

SEQ ID NO: 534932 - protein, 9 aa, Mycobacterium
PAERGTGLG

SEQ ID NO: 534933 - protein, 10 aa, Mycobacterium
PAERGTGLGK

SEQ ID NO: 534934 - protein, 5 aa, Mycobacterium
PAERM

SEQ ID NO: 534935 - protein, 6 aa, Mycobacterium
PAERQA

SEQ ID NO: 534936 - protein, 10 aa, Mycobacterium
PAERRPTGPA

SEQ ID NO: 534937 - protein, 11 aa, Mycobacterium
PAERRRAEGAV

SEQ ID NO: 534938 - protein, 5 aa, Mycobacterium
PAERS

SEQ ID NO: 534939 - protein, 7 aa, Mycobacterium
PAERTYA

SEQ ID NO: 534940 - protein, 14 aa, Mycobacterium
PAERYPDAKARDAR

SEQ ID NO: 534941 - protein, 6 aa, Mycobacterium
PAESAE

SEQ ID NO: 534942 - protein, 31 aa, Mycobacterium
PAESAEDPASAATPEAPASCKNPRRFHPCRI

SEQ ID NO: 534943 - protein, 10 aa, Mycobacterium
PAESKAAIGQ

SEQ ID NO: 534944 - protein, 7 aa, Mycobacterium
PAESPGD

SEQ ID NO: 534945 - protein, 6 aa, Mycobacterium
PAESPR

SEQ ID NO: 534946 - protein, 7 aa, Mycobacterium
PAESPRL

SEQ ID NO: 534947 - protein, 10 aa, Mycobacterium
PAESTLNGPL

SEQ ID NO: 534948 - protein, 4 aa, Mycobacterium
PAET

SEQ ID NO: 534949 - protein, 5 aa, Mycobacterium
PAETA

SEQ ID NO: 534950 - protein, 6 aa, Mycobacterium
PAETAA

SEQ ID NO: 534951 - protein, 7 aa, Mycobacterium
PAETAAA

SEQ ID NO: 534952 - protein, 11 aa, Mycobacterium
PAETAAPDRRR

SEQ ID NO: 534953 - protein, 24 aa, Mycobacterium
PAETDEDRADLKNRAARLARAGEP

SEQ ID NO: 534954 - protein, 8 aa, Mycobacterium
PAETGAWG

SEQ ID NO: 534955 - protein, 8 aa, Mycobacterium
PAETGPAP

SEQ ID NO: 534956 - protein, 79 aa, Mycobacterium
PAETPPAAVPHGGEPGAPPTGPPHPPDGTPPLDGAPPGAGDSAPHGPGDGGPHGPVDGDTNDPSGHGPHDPGPDDGSDH

SEQ ID NO: 534957 - protein, 11 aa, Mycobacterium
PAETTNGEPYA

SEQ ID NO: 534958 - protein, 7 aa, Mycobacterium
PAETTRA

SEQ ID NO: 534959 - protein, 12 aa, Mycobacterium
PAETVEVTERPE

SEQ ID NO: 534960 - protein, 7 aa, Mycobacterium
PAETVQV

SEQ ID NO: 534961 - protein, 6 aa, Mycobacterium
PAEVAA

SEQ ID NO: 534962 - protein, 12 aa, Mycobacterium
PAEVANERQQAG

SEQ ID NO: 534963 - protein, 12 aa, Mycobacterium
PAEVGTNDFAAK

SEQ ID NO: 534964 - protein, 22 aa, Mycobacterium
PAEVPAAEVEPSEQSDSSETID

SEQ ID NO: 534965 - protein, 14 aa, Mycobacterium
PAEVPDREAAAVPG

SEQ ID NO: 534966 - protein, 13 aa, Mycobacterium
PAEVRSSGWSTDP

SEQ ID NO: 534967 - protein, 8 aa, Mycobacterium
PAEVRTKT

SEQ ID NO: 534968 - protein, 7 aa, Mycobacterium
PAEVSTP

SEQ ID NO: 534969 - protein, 10 aa, Mycobacterium
PAEVTDGKAR

SEQ ID NO: 534970 - protein, 7 aa, Mycobacterium
PAEYSGY

SEQ ID NO: 534971 - protein, 15 aa, Mycobacterium
PAEYSTDAPADAEEG

SEQ ID NO: 534972 - protein, 4 aa, Mycobacterium
PAFA

SEQ ID NO: 534973 - protein, 4 aa, Mycobacterium
PAFC

SEQ ID NO: 534974 - protein, 5 aa, Mycobacterium
PAFDY

SEQ ID NO: 534975 - protein, 4 aa, Mycobacterium
PAFE

SEQ ID NO: 534976 - protein, 11 aa, Mycobacterium
PAFEHDPERAA

SEQ ID NO: 534977 - protein, 12 aa, Mycobacterium
PAFESQENASLT

SEQ ID NO: 534978 - protein, 6 aa, Mycobacterium
PAFGGR

SEQ ID NO: 534979 - protein, 8 aa, Mycobacterium
PAFGPGDT

SEQ ID NO: 534980 - protein, 11 aa, Mycobacterium
PAFGQGETPKS

SEQ ID NO: 534981 - protein, 18 aa, Mycobacterium
PAFGSDSAAVSTTATLDG

SEQ ID NO: 534982 - protein, 12 aa, Mycobacterium
PAFGTAPGVTEQ

SEQ ID NO: 534983 - protein, 7 aa, Mycobacterium
PAFGTED

SEQ ID NO: 534984 - protein, 5 aa, Mycobacterium
PAFKE

SEQ ID NO: 534985 - protein, 11 aa, Mycobacterium
PAFNETELEAQ

SEQ ID NO: 534986 - protein, 21 aa, Mycobacterium
PAFNTGSPWGYTPKGGTGVPT

SEQ ID NO: 534987 - protein, 14 aa, Mycobacterium
PAFPETKIDGEDYR

SEQ ID NO: 534988 - protein, 6 aa, Mycobacterium
PAFPRA

SEQ ID NO: 534989 - protein, 7 aa, Mycobacterium
PAFPRAK

SEQ ID NO: 534990 - protein, 5 aa, Mycobacterium
PAFPT

SEQ ID NO: 534991 - protein, 4 aa, Mycobacterium
PAFQ

SEQ ID NO: 534992 - protein, 6 aa, Mycobacterium
PAFQPE

SEQ ID NO: 534993 - protein, 21 aa, Mycobacterium
PAFRKDGTITAGSASQISDGA

SEQ ID NO: 534994 - protein, 5 aa, Mycobacterium
PAFRS

SEQ ID NO: 534995 - protein, 9 aa, Mycobacterium
PAFSAGGDL

SEQ ID NO: 534996 - protein, 11 aa, Mycobacterium
PAFSEQDPARF

SEQ ID NO: 534997 - protein, 10 aa, Mycobacterium
PAFSPDSRRR

SEQ ID NO: 534998 - protein, 4 aa, Mycobacterium
PAFT

SEQ ID NO: 534999 - protein, 5 aa, Mycobacterium
PAFTA

SEQ ID NO: 535000 - protein, 5 aa, Mycobacterium
PAFTE

SEQ ID NO: 535001 - protein, 6 aa, Mycobacterium
PAFTGD

SEQ ID NO: 535002 - protein, 14 aa, Mycobacterium
PAFTPPKDLQPGEY

SEQ ID NO: 535003 - protein, 7 aa, Mycobacterium
PAFTPQR

SEQ ID NO: 535004 - protein, 14 aa, Mycobacterium
PAGAAKSAGSPAHR

SEQ ID NO: 535005 - protein, 7 aa, Mycobacterium
PAGAAMD

SEQ ID NO: 535006 - protein, 14 aa, Mycobacterium
PAGAASDQSDHSDH

SEQ ID NO: 535007 - protein, 5 aa, Mycobacterium
PAGAD

SEQ ID NO: 535008 - protein, 11 aa, Mycobacterium
PAGADAGSTLA

SEQ ID NO: 535009 - protein, 6 aa, Mycobacterium
PAGADE

SEQ ID NO: 535010 - protein, 13 aa, Mycobacterium
PAGADEDSIEATY

SEQ ID NO: 535011 - protein, 11 aa, Mycobacterium
PAGADEVSAQA

SEQ ID NO: 535012 - protein, 13 aa, Mycobacterium
PAGADEVSTQAAT

SEQ ID NO: 535013 - protein, 13 aa, Mycobacterium
PAGADHAAPPTDR

SEQ ID NO: 535014 - protein, 11 aa, Mycobacterium
PAGADQPPHRA

SEQ ID NO: 535015 - protein, 12 aa, Mycobacterium
PAGADSTGRPGN

SEQ ID NO: 535016 - protein, 11 aa, Mycobacterium
PAGADVPSPMA

SEQ ID NO: 535017 - protein, 5 aa, Mycobacterium
PAGAE

SEQ ID NO: 535018 - protein, 6 aa, Mycobacterium
PAGAEA

SEQ ID NO: 535019 - protein, 10 aa, Mycobacterium
PAGAELTSAP

SEQ ID NO: 535020 - protein, 5 aa, Mycobacterium
PAGAG

SEQ ID NO: 535021 - protein, 35 aa, Mycobacterium
PAGAGATSAPAPEAPAAPEAPAAPRATTSARAEAK

SEQ ID NO: 535022 - protein, 8 aa, Mycobacterium
PAGAGEAD

SEQ ID NO: 535023 - protein, 11 aa, Mycobacterium
PAGAGLRSTGI

SEQ ID NO: 535024 - protein, 8 aa, Mycobacterium
PAGAGPEL

SEQ ID NO: 535025 - protein, 9 aa, Mycobacterium
PAGAGPELE

SEQ ID NO: 535026 - protein, 9 aa, Mycobacterium
PAGAGPPAH

SEQ ID NO: 535027 - protein, 7 aa, Mycobacterium
PAGAGQK

SEQ ID NO: 535028 - protein, 7 aa, Mycobacterium
PAGAGRE

SEQ ID NO: 535029 - protein, 9 aa, Mycobacterium
PAGAGRGVA

SEQ ID NO: 535030 - protein, 21 aa, Mycobacterium
PAGAGTAQQPAHQHDGGRRDR

SEQ ID NO: 535031 - protein, 27 aa, Mycobacterium
PAGAGTGTTTTSTTHATHGTGATGASV

SEQ ID NO: 535032 - protein, 11 aa, Mycobacterium
PAGAGVDPVTA

SEQ ID NO: 535033 - protein, 6 aa, Mycobacterium
PAGAGY

SEQ ID NO: 535034 - protein, 5 aa, Mycobacterium
PAGAH

SEQ ID NO: 535035 - protein, 5 aa, Mycobacterium
PAGAI

SEQ ID NO: 535036 - protein, 11 aa, Mycobacterium
PAGAKSTCGHK

SEQ ID NO: 535037 - protein, 10 aa, Mycobacterium
PAGALDSPRA

SEQ ID NO: 535038 - protein, 11 aa, Mycobacterium
PAGAPAPALGE

SEQ ID NO: 535039 - protein, 21 aa, Mycobacterium
PAGAPARQESSKRTRAASPRR

SEQ ID NO: 535040 - protein, 7 aa, Mycobacterium
PAGAPEL

SEQ ID NO: 535041 - protein, 7 aa, Mycobacterium
PAGAPGA

SEQ ID NO: 535042 - protein, 7 aa, Mycobacterium
PAGAPLP

SEQ ID NO: 535043 - protein, 11 aa, Mycobacterium
PAGARRRHAAS

SEQ ID NO: 535044 - protein, 6 aa, Mycobacterium
PAGAST

SEQ ID NO: 535045 - protein, 12 aa, Mycobacterium
PAGASTAACGCS

SEQ ID NO: 535046 - protein, 6 aa, Mycobacterium
PAGASV

SEQ ID NO: 535047 - protein, 5 aa, Mycobacterium
PAGAT

SEQ ID NO: 535048 - protein, 10 aa, Mycobacterium
PAGATAARES

SEQ ID NO: 535049 - protein, 7 aa, Mycobacterium
PAGATEA

SEQ ID NO: 535050 - protein, 15 aa, Mycobacterium
PAGATEGATNREIET

SEQ ID NO: 535051 - protein, 11 aa, Mycobacterium
PAGATHVSSST

SEQ ID NO: 535052 - protein, 9 aa, Mycobacterium
PAGATPLDV

SEQ ID NO: 535053 - protein, 9 aa, Mycobacterium
PAGATTPPL

SEQ ID NO: 535054 - protein, 16 aa, Mycobacterium
PAGATWTDTGWAGRSV

SEQ ID NO: 535055 - protein, 4 aa, Mycobacterium
PAGD

SEQ ID NO: 535056 - protein, 7 aa, Mycobacterium
PAGDAGQ

SEQ ID NO: 535057 - protein, 6 aa, Mycobacterium
PAGDAS

SEQ ID NO: 535058 - protein, 8 aa, Mycobacterium
PAGDATLR

SEQ ID NO: 535059 - protein, 6 aa, Mycobacterium
PAGDDE

SEQ ID NO: 535060 - protein, 10 aa, Mycobacterium
PAGDEPGGAR

SEQ ID NO: 535061 - protein, 7 aa, Mycobacterium
PAGDEVS

SEQ ID NO: 535062 - protein, 7 aa, Mycobacterium
PAGDGAV

SEQ ID NO: 535063 - protein, 13 aa, Mycobacterium
PAGDGHFQGSTVP

SEQ ID NO: 535064 - protein, 7 aa, Mycobacterium
PAGDGRV

SEQ ID NO: 535065 - protein, 8 aa, Mycobacterium
PAGDGRVK

SEQ ID NO: 535066 - protein, 6 aa, Mycobacterium
PAGDHT

SEQ ID NO: 535067 - protein, 5 aa, Mycobacterium
PAGDI

SEQ ID NO: 535068 - protein, 13 aa, Mycobacterium
PAGDPTNGRREIT

SEQ ID NO: 535069 - protein, 21 aa, Mycobacterium
PAGDPVGADEDLAEDGADARA

SEQ ID NO: 535070 - protein, 8 aa, Mycobacterium
PAGDQPRD

SEQ ID NO: 535071 - protein, 9 aa, Mycobacterium
PAGDSKALA

SEQ ID NO: 535072 - protein, 5 aa, Mycobacterium
PAGDT

SEQ ID NO: 535073 - protein, 9 aa, Mycobacterium
PAGDTPVTG

SEQ ID NO: 535074 - protein, 6 aa, Mycobacterium
PAGDTV

SEQ ID NO: 535075 - protein, 16 aa, Mycobacterium
PAGEASSGVAPAEPAK

SEQ ID NO: 535076 - protein, 6 aa, Mycobacterium
PAGEAV

SEQ ID NO: 535077 - protein, 8 aa, Mycobacterium
PAGEEISG

SEQ ID NO: 535078 - protein, 6 aa, Mycobacterium
PAGEGP

SEQ ID NO: 535079 - protein, 7 aa, Mycobacterium
PAGEGRT

SEQ ID NO: 535080 - protein, 7 aa, Mycobacterium
PAGEHTR

SEQ ID NO: 535081 - protein, 21 aa, Mycobacterium
PAGEIPPPTPRRLLRDVLEFR

SEQ ID NO: 535082 - protein, 8 aa, Mycobacterium
PAGEPAEL

SEQ ID NO: 535083 - protein, 8 aa, Mycobacterium
PAGEPTDA

SEQ ID NO: 535084 - protein, 7 aa, Mycobacterium
PAGEPTL

SEQ ID NO: 535085 - protein, 6 aa, Mycobacterium
PAGERL

SEQ ID NO: 535086 - protein, 18 aa, Mycobacterium
PAGESAASLKLDGTETYD

SEQ ID NO: 535087 - protein, 38 aa, Mycobacterium
PAGETVEQAADRLSTLDSATRARVEAEARAAEARAKEV

SEQ ID NO: 535088 - protein, 8 aa, Mycobacterium
PAGEVPQA

SEQ ID NO: 535089 - protein, 4 aa, Mycobacterium
PAGF

SEQ ID NO: 535090 - protein, 7 aa, Mycobacterium
PAGFANG

SEQ ID NO: 535091 - protein, 6 aa, Mycobacterium
PAGFAP

SEQ ID NO: 535092 - protein, 14 aa, Mycobacterium
PAGFAPGEKTVYTN

SEQ ID NO: 535093 - protein, 31 aa, Mycobacterium
PAGFGDGQDAPPSDPRITGPAGPPQHEQNTY

SEQ ID NO: 535094 - protein, 7 aa, Mycobacterium
PAGFSNG

SEQ ID NO: 535095 - protein, 15 aa, Mycobacterium
PAGGAEPSAGTVGHR

SEQ ID NO: 535096 - protein, 8 aa, Mycobacterium
PAGGAVTN

SEQ ID NO: 535097 - protein, 12 aa, Mycobacterium
PAGGDHGDDEIP

SEQ ID NO: 535098 - protein, 8 aa, Mycobacterium
PAGGDYDP

SEQ ID NO: 535099 - protein, 7 aa, Mycobacterium
PAGGEIR

SEQ ID NO: 535100 - protein, 9 aa, Mycobacterium
PAGGEPPEQ

SEQ ID NO: 535101 - protein, 7 aa, Mycobacterium
PAGGFGT

SEQ ID NO: 535102 - protein, 11 aa, Mycobacterium
PAGGGNPRAGA

SEQ ID NO: 535103 - protein, 6 aa, Mycobacterium
PAGGGP

SEQ ID NO: 535104 - protein, 8 aa, Mycobacterium
PAGGGPAP

SEQ ID NO: 535105 - protein, 8 aa, Mycobacterium
PAGGGTPT

SEQ ID NO: 535106 - protein, 5 aa, Mycobacterium
PAGGI

SEQ ID NO: 535107 - protein, 14 aa, Mycobacterium
PAGGLTNPLTGAPT

SEQ ID NO: 535108 - protein, 41 aa, Mycobacterium
PAGGPDGARPDRKYTERRRADHKHSDHKRSEAKRPKRAPKK

SEQ ID NO: 535109 - protein, 13 aa, Mycobacterium
PAGGPVDHGTADH

SEQ ID NO: 535110 - protein, 6 aa, Mycobacterium
PAGGQT

SEQ ID NO: 535111 - protein, 6 aa, Mycobacterium
PAGGRG

SEQ ID NO: 535112 - protein, 14 aa, Mycobacterium
PAGGRRLDQSADGY

SEQ ID NO: 535113 - protein, 13 aa, Mycobacterium
PAGGRRLDQTAEG

SEQ ID NO: 535114 - protein, 7 aa, Mycobacterium
PAGGSGI

SEQ ID NO: 535115 - protein, 5 aa, Mycobacterium
PAGGT

SEQ ID NO: 535116 - protein, 19 aa, Mycobacterium
PAGGTGGGATPAADGGVSA

SEQ ID NO: 535117 - protein, 8 aa, Mycobacterium
PAGGTPEK

SEQ ID NO: 535118 - protein, 7 aa, Mycobacterium
PAGGTQS

SEQ ID NO: 535119 - protein, 7 aa, Mycobacterium
PAGGTSF

SEQ ID NO: 535120 - protein, 18 aa, Mycobacterium
PAGGTSGSGQVNGGINPG

SEQ ID NO: 535121 - protein, 7 aa, Mycobacterium
PAGGYDD

SEQ ID NO: 535122 - protein, 6 aa, Mycobacterium
PAGGYE

SEQ ID NO: 535123 - protein, 4 aa, Mycobacterium
PAGH

SEQ ID NO: 535124 - protein, 14 aa, Mycobacterium
PAGHEPDYGNDPPP

SEQ ID NO: 535125 - protein, 8 aa, Mycobacterium
PAGHGINN

SEQ ID NO: 535126 - protein, 6 aa, Mycobacterium
PAGHQT

SEQ ID NO: 535127 - protein, 11 aa, Mycobacterium
PAGHRDPDAAA

SEQ ID NO: 535128 - protein, 12 aa, Mycobacterium
PAGHRDPESAAE

SEQ ID NO: 535129 - protein, 7 aa, Mycobacterium
PAGHSAA

SEQ ID NO: 535130 - protein, 9 aa, Mycobacterium
PAGHTPENR

SEQ ID NO: 535131 - protein, 5 aa, Mycobacterium
PAGIA

SEQ ID NO: 535132 - protein, 9 aa, Mycobacterium
PAGKQVRVE

SEQ ID NO: 535133 - protein, 5 aa, Mycobacterium
PAGKR

SEQ ID NO: 535134 - protein, 10 aa, Mycobacterium
PAGKRGPRRR

SEQ ID NO: 535135 - protein, 5 aa, Mycobacterium
PAGKW

SEQ ID NO: 535136 - protein, 5 aa, Mycobacterium
PAGLD

SEQ ID NO: 535137 - protein, 11 aa, Mycobacterium
PAGLDSMGRPG

SEQ ID NO: 535138 - protein, 5 aa, Mycobacterium
PAGLE

SEQ ID NO: 535139 - protein, 15 aa, Mycobacterium
PAGLLGGSGYQNYGG

SEQ ID NO: 535140 - protein, 35 aa, Mycobacterium
PAGLPEDAPLSRKRATYRPPGDGRAPRPSAARSVP

SEQ ID NO: 535141 - protein, 9 aa, Mycobacterium
PAGLPTWQS

SEQ ID NO: 535142 - protein, 5 aa, Mycobacterium
PAGLT

SEQ ID NO: 535143 - protein, 14 aa, Mycobacterium
PAGLTRSADPVRRP

SEQ ID NO: 535144 - protein, 11 aa, Mycobacterium
PAGMDEKMTGK

SEQ ID NO: 535145 - protein, 5 aa, Mycobacterium
PAGMT

SEQ ID NO: 535146 - protein, 11 aa, Mycobacterium
PAGNDLSDDEV

SEQ ID NO: 535147 - protein, 8 aa, Mycobacterium
PAGNEVAR

SEQ ID NO: 535148 - protein, 5 aa, Mycobacterium
PAGNF

SEQ ID NO: 535149 - protein, 7 aa, Mycobacterium
PAGNRDP

SEQ ID NO: 535150 - protein, 9 aa, Mycobacterium
PAGNRDPEF

SEQ ID NO: 535151 - protein, 6 aa, Mycobacterium
PAGNRF

SEQ ID NO: 535152 - protein, 8 aa, Mycobacterium
PAGNRTTL

SEQ ID NO: 535153 - protein, 16 aa, Mycobacterium
PAGNVKPDKANAGDKI

SEQ ID NO: 535154 - protein, 13 aa, Mycobacterium
PAGPAEGETNRRI

SEQ ID NO: 535155 - protein, 12 aa, Mycobacterium
PAGPAGSPDGSR

SEQ ID NO: 535156 - protein, 8 aa, Mycobacterium
PAGPANES

SEQ ID NO: 535157 - protein, 7 aa, Mycobacterium
PAGPAPL

SEQ ID NO: 535158 - protein, 6 aa, Mycobacterium
PAGPAQ

SEQ ID NO: 535159 - protein, 8 aa, Mycobacterium
PAGPDART

SEQ ID NO: 535160 - protein, 28 aa, Mycobacterium
PAGPDARTEVRAPLDASGPDGNNTVPAE

SEQ ID NO: 535161 - protein, 24 aa, Mycobacterium
PAGPDARTEVRAPLDNATDGVPDD

SEQ ID NO: 535162 - protein, 7 aa, Mycobacterium
PAGPDIE

SEQ ID NO: 535163 - protein, 9 aa, Mycobacterium
PAGPDTRTE

SEQ ID NO: 535164 - protein, 5 aa, Mycobacterium
PAGPE

SEQ ID NO: 535165 - protein, 8 aa, Mycobacterium
PAGPEGGD

SEQ ID NO: 535166 - protein, 6 aa, Mycobacterium
PAGPEL

SEQ ID NO: 535167 - protein, 6 aa, Mycobacterium
PAGPGP

SEQ ID NO: 535168 - protein, 7 aa, Mycobacterium
PAGPGPW

SEQ ID NO: 535169 - protein, 7 aa, Mycobacterium
PAGPGPY

SEQ ID NO: 535170 - protein, 9 aa, Mycobacterium
PAGPGSSVT

SEQ ID NO: 535171 - protein, 6 aa, Mycobacterium
PAGPHD

SEQ ID NO: 535172 - protein, 7 aa, Mycobacterium
PAGPLQA

SEQ ID NO: 535173 - protein, 12 aa, Mycobacterium
PAGPNQRDSGPN

SEQ ID NO: 535174 - protein, 7 aa, Mycobacterium
PAGPNWP

SEQ ID NO: 535175 - protein, 5 aa, Mycobacterium
PAGPP

SEQ ID NO: 535176 - protein, 8 aa, Mycobacterium
PAGPPTDA

SEQ ID NO: 535177 - protein, 9 aa, Mycobacterium
PAGPSASPV

SEQ ID NO: 535178 - protein, 5 aa, Mycobacterium
PAGPV

SEQ ID NO: 535179 - protein, 14 aa, Mycobacterium
PAGPWESERRNAPI

SEQ ID NO: 535180 - protein, 12 aa, Mycobacterium
PAGPYQRDRGPS

SEQ ID NO: 535181 - protein, 4 aa, Mycobacterium
PAGQ

SEQ ID NO: 535182 - protein, 14 aa, Mycobacterium
PAGQAGPVPAAPAE

SEQ ID NO: 535183 - protein, 22 aa, Mycobacterium
PAGQDADGNNTEAVASGWQTPA

SEQ ID NO: 535184 - protein, 10 aa, Mycobacterium
PAGQDVPDGW

SEQ ID NO: 535185 - protein, 10 aa, Mycobacterium
PAGQGLPIPS

SEQ ID NO: 535186 - protein, 10 aa, Mycobacterium
PAGQGTGLGK

SEQ ID NO: 535187 - protein, 5 aa, Mycobacterium
PAGQH

SEQ ID NO: 535188 - protein, 18 aa, Mycobacterium
PAGQNDRGVSLVEQHPFE

SEQ ID NO: 535189 - protein, 6 aa, Mycobacterium
PAGQPI

SEQ ID NO: 535190 - protein, 10 aa, Mycobacterium
PAGQQPARRL

SEQ ID NO: 535191 - protein, 13 aa, Mycobacterium
PAGQRDNAPSTTQ

SEQ ID NO: 535192 - protein, 9 aa, Mycobacterium
PAGQRRPLR

SEQ ID NO: 535193 - protein, 8 aa, Mycobacterium
PAGQRTTV

SEQ ID NO: 535194 - protein, 11 aa, Mycobacterium
PAGQRYSTVPG

SEQ ID NO: 535195 - protein, 5 aa, Mycobacterium
PAGQV

SEQ ID NO: 535196 - protein, 5 aa, Mycobacterium
PAGRA

SEQ ID NO: 535197 - protein, 10 aa, Mycobacterium
PAGRADDPDI

SEQ ID NO: 535198 - protein, 11 aa, Mycobacterium
PAGREAADRAE

SEQ ID NO: 535199 - protein, 16 aa, Mycobacterium
PAGREQELREGEAAKV

SEQ ID NO: 535200 - protein, 13 aa, Mycobacterium
PAGRFARSGLAPA

SEQ ID NO: 535201 - protein, 8 aa, Mycobacterium
PAGRGPYS

SEQ ID NO: 535202 - protein, 6 aa, Mycobacterium
PAGRGR

SEQ ID NO: 535203 - protein, 10 aa, Mycobacterium
PAGRGTGLGK

SEQ ID NO: 535204 - protein, 19 aa, Mycobacterium
PAGRKLNASQIEWSAYAEK

SEQ ID NO: 535205 - protein, 5 aa, Mycobacterium
PAGRL

SEQ ID NO: 535206 - protein, 11 aa, Mycobacterium
PAGRLGSGDDV

SEQ ID NO: 535207 - protein, 6 aa, Mycobacterium
PAGRPD

SEQ ID NO: 535208 - protein, 10 aa, Mycobacterium
PAGRPGVAGT

SEQ ID NO: 535209 - protein, 6 aa, Mycobacterium
PAGRPT

SEQ ID NO: 535210 - protein, 10 aa, Mycobacterium
PAGRQEGGRR

SEQ ID NO: 535211 - protein, 5 aa, Mycobacterium
PAGRR

SEQ ID NO: 535212 - protein, 6 aa, Mycobacterium
PAGRRQ

SEQ ID NO: 535213 - protein, 8 aa, Mycobacterium
PAGRRRFR

SEQ ID NO: 535214 - protein, 5 aa, Mycobacterium
PAGRV

SEQ ID NO: 535215 - protein, 6 aa, Mycobacterium
PAGRVA

SEQ ID NO: 535216 - protein, 10 aa, Mycobacterium
PAGRYSQTGI

SEQ ID NO: 535217 - protein, 10 aa, Mycobacterium
PAGSAPEPAL

SEQ ID NO: 535218 - protein, 10 aa, Mycobacterium
PAGSARSSLS

SEQ ID NO: 535219 - protein, 10 aa, Mycobacterium
PAGSDDPSLP

SEQ ID NO: 535220 - protein, 8 aa, Mycobacterium
PAGSDGDD

SEQ ID NO: 535221 - protein, 10 aa, Mycobacterium
PAGSDGDGLP

SEQ ID NO: 535222 - protein, 9 aa, Mycobacterium
PAGSDGTGL

SEQ ID NO: 535223 - protein, 11 aa, Mycobacterium
PAGSDRQSELP

SEQ ID NO: 535224 - protein, 5 aa, Mycobacterium
PAGSG

SEQ ID NO: 535225 - protein, 12 aa, Mycobacterium
PAGSGPGGGGLG

SEQ ID NO: 535226 - protein, 8 aa, Mycobacterium
PAGSGPQH

SEQ ID NO: 535227 - protein, 6 aa, Mycobacterium
PAGSLT

SEQ ID NO: 535228 - protein, 19 aa, Mycobacterium
PAGSNGSPVGAGAGAGTVE

SEQ ID NO: 535229 - protein, 8 aa, Mycobacterium
PAGSNNPI

SEQ ID NO: 535230 - protein, 10 aa, Mycobacterium
PAGSPAPAEL

SEQ ID NO: 535231 - protein, 8 aa, Mycobacterium
PAGSPDER

SEQ ID NO: 535232 - protein, 5 aa, Mycobacterium
PAGSQ

SEQ ID NO: 535233 - protein, 9 aa, Mycobacterium
PAGSQSDEL

SEQ ID NO: 535234 - protein, 11 aa, Mycobacterium
PAGSSAHTDHG

SEQ ID NO: 535235 - protein, 7 aa, Mycobacterium
PAGSSQL

SEQ ID NO: 535236 - protein, 10 aa, Mycobacterium
PAGSSTSMPG

SEQ ID NO: 535237 - protein, 9 aa, Mycobacterium
PAGSSVDAT

SEQ ID NO: 535238 - protein, 5 aa, Mycobacterium
PAGST

SEQ ID NO: 535239 - protein, 13 aa, Mycobacterium
PAGSTDKFGPGLT

SEQ ID NO: 535240 - protein, 11 aa, Mycobacterium
PAGSTDQFGPG

SEQ ID NO: 535241 - protein, 12 aa, Mycobacterium
PAGSTEQFGPDL

SEQ ID NO: 535242 - protein, 9 aa, Mycobacterium
PAGSTTPPL

SEQ ID NO: 535243 - protein, 10 aa, Mycobacterium
PAGSTTPSEL

SEQ ID NO: 535244 - protein, 8 aa, Mycobacterium
PAGSTTPV

SEQ ID NO: 535245 - protein, 6 aa, Mycobacterium
PAGSVG

SEQ ID NO: 535246 - protein, 7 aa, Mycobacterium
PAGSVGE

SEQ ID NO: 535247 - protein, 6 aa, Mycobacterium
PAGSVT

SEQ ID NO: 535248 - protein, 7 aa, Mycobacterium
PAGSYTL

SEQ ID NO: 535249 - protein, 5 aa, Mycobacterium
PAGTA

SEQ ID NO: 535250 - protein, 9 aa, Mycobacterium
PAGTAGDAQ

SEQ ID NO: 535251 - protein, 13 aa, Mycobacterium
PAGTAGENDAASL

SEQ ID NO: 535252 - protein, 9 aa, Mycobacterium
PAGTAGSLS

SEQ ID NO: 535253 - protein, 10 aa, Mycobacterium
PAGTDGWSEE

SEQ ID NO: 535254 - protein, 7 aa, Mycobacterium
PAGTDIT

SEQ ID NO: 535255 - protein, 11 aa, Mycobacterium
PAGTEGGATQL

SEQ ID NO: 535256 - protein, 12 aa, Mycobacterium
PAGTEGPDAERL

SEQ ID NO: 535257 - protein, 12 aa, Mycobacterium
PAGTEPNESSSP

SEQ ID NO: 535258 - protein, 27 aa, Mycobacterium
PAGTGEPSATAEALPARQSGNRGRSKK

SEQ ID NO: 535259 - protein, 9 aa, Mycobacterium
PAGTGNDHA

SEQ ID NO: 535260 - protein, 7 aa, Mycobacterium
PAGTGTR

SEQ ID NO: 535261 - protein, 8 aa, Mycobacterium
PAGTGVGI

SEQ ID NO: 535262 - protein, 10 aa, Mycobacterium
PAGTGWTTDP

SEQ ID NO: 535263 - protein, 5 aa, Mycobacterium
PAGTH

SEQ ID NO: 535264 - protein, 5 aa, Mycobacterium
PAGTL

SEQ ID NO: 535265 - protein, 28 aa, Mycobacterium
PAGTNGKFARPPQHTSKEAAPQIPADQV

SEQ ID NO: 535266 - protein, 17 aa, Mycobacterium
PAGTPAPPLSPADADLG

SEQ ID NO: 535267 - protein, 9 aa, Mycobacterium
PAGTPESRV

SEQ ID NO: 535268 - protein, 9 aa, Mycobacterium
PAGTPTGTA

SEQ ID NO: 535269 - protein, 7 aa, Mycobacterium
PAGTPTT

SEQ ID NO: 535270 - protein, 7 aa, Mycobacterium
PAGTQLQ

SEQ ID NO: 535271 - protein, 8 aa, Mycobacterium
PAGTRATI

SEQ ID NO: 535272 - protein, 18 aa, Mycobacterium
PAGTRGLDQAEALSPTGQ

SEQ ID NO: 535273 - protein, 21 aa, Mycobacterium
PAGTTAAAAIGEAGLPRRGAP

SEQ ID NO: 535274 - protein, 11 aa, Mycobacterium
PAGTTAAAAVR

SEQ ID NO: 535275 - protein, 11 aa, Mycobacterium
PAGTTAGAAVR

SEQ ID NO: 535276 - protein, 11 aa, Mycobacterium
PAGTTAGTAVR

SEQ ID NO: 535277 - protein, 18 aa, Mycobacterium
PAGTTEAKALATDAADHE

SEQ ID NO: 535278 - protein, 6 aa, Mycobacterium
PAGTTH

SEQ ID NO: 535279 - protein, 10 aa, Mycobacterium
PAGTTSDGAQ

SEQ ID NO: 535280 - protein, 7 aa, Mycobacterium
PAGTTVG

SEQ ID NO: 535281 - protein, 12 aa, Mycobacterium
PAGTTYTTTPGS

SEQ ID NO: 535282 - protein, 7 aa, Mycobacterium
PAGVAQG

SEQ ID NO: 535283 - protein, 7 aa, Mycobacterium
PAGVDPA

SEQ ID NO: 535284 - protein, 15 aa, Mycobacterium
PAGVGDGSASGFPGD

SEQ ID NO: 535285 - protein, 14 aa, Mycobacterium
PAGVGDGSGLPGDA

SEQ ID NO: 535286 - protein, 20 aa, Mycobacterium
PAGVGESRRLPGSGAGPSPD

SEQ ID NO: 535287 - protein, 12 aa, Mycobacterium
PAGVGTAVANGG

SEQ ID NO: 535288 - protein, 5 aa, Mycobacterium
PAGVN

SEQ ID NO: 535289 - protein, 8 aa, Mycobacterium
PAGVPRGT

SEQ ID NO: 535290 - protein, 7 aa, Mycobacterium
PAGVSAD

SEQ ID NO: 535291 - protein, 6 aa, Mycobacterium
PAGVSG

SEQ ID NO: 535292 - protein, 7 aa, Mycobacterium
PAGVTGD

SEQ ID NO: 535293 - protein, 20 aa, Mycobacterium
PAGWPSRPTYSGWAGSPEIA

SEQ ID NO: 535294 - protein, 14 aa, Mycobacterium
PAGWRADNTDIDGV

SEQ ID NO: 535295 - protein, 15 aa, Mycobacterium
PAGWRADNTDIDGVS

SEQ ID NO: 535296 - protein, 8 aa, Mycobacterium
PAGYGKTT

SEQ ID NO: 535297 - protein, 7 aa, Mycobacterium
PAGYGSS

SEQ ID NO: 535298 - protein, 15 aa, Mycobacterium
PAGYGSSTVVPDGGY

SEQ ID NO: 535299 - protein, 7 aa, Mycobacterium
PAGYPFT

SEQ ID NO: 535300 - protein, 8 aa, Mycobacterium
PAGYSDSE

SEQ ID NO: 535301 - protein, 5 aa, Mycobacterium
PAGYT

SEQ ID NO: 535302 - protein, 6 aa, Mycobacterium
PAHAAT

SEQ ID NO: 535303 - protein, 6 aa, Mycobacterium
PAHDAD

SEQ ID NO: 535304 - protein, 12 aa, Mycobacterium
PAHDGPRGGITD

SEQ ID NO: 535305 - protein, 14 aa, Mycobacterium
PAHDGTTVHLSARI

SEQ ID NO: 535306 - protein, 7 aa, Mycobacterium
PAHDPIA

SEQ ID NO: 535307 - protein, 8 aa, Mycobacterium
PAHDPNSI

SEQ ID NO: 535308 - protein, 13 aa, Mycobacterium
PAHDRGSSHGGSR

SEQ ID NO: 535309 - protein, 4 aa, Mycobacterium
PAHE

SEQ ID NO: 535310 - protein, 6 aa, Mycobacterium
PAHEDD

SEQ ID NO: 535311 - protein, 9 aa, Mycobacterium
PAHEQTRAG

SEQ ID NO: 535312 - protein, 12 aa, Mycobacterium
PAHESPEDYERD

SEQ ID NO: 535313 - protein, 7 aa, Mycobacterium
PAHGADA

SEQ ID NO: 535314 - protein, 17 aa, Mycobacterium
PAHGAGSACGKNLSTER

SEQ ID NO: 535315 - protein, 13 aa, Mycobacterium
PAHGESDGASGTI

SEQ ID NO: 535316 - protein, 4 aa, Mycobacterium
PAHH

SEQ ID NO: 535317 - protein, 5 aa, Mycobacterium
PAHKN

SEQ ID NO: 535318 - protein, 7 aa, Mycobacterium
PAHKTEP

SEQ ID NO: 535319 - protein, 4 aa, Mycobacterium
PAHP

SEQ ID NO: 535320 - protein, 5 aa, Mycobacterium
PAHPA

SEQ ID NO: 535321 - protein, 20 aa, Mycobacterium
PAHPATSKIKKGPDATTDPA

SEQ ID NO: 535322 - protein, 5 aa, Mycobacterium
PAHPD

SEQ ID NO: 535323 - protein, 6 aa, Mycobacterium
PAHPDA

SEQ ID NO: 535324 - protein, 9 aa, Mycobacterium
PAHPDEPWE

SEQ ID NO: 535325 - protein, 7 aa, Mycobacterium
PAHPDRA

SEQ ID NO: 535326 - protein, 7 aa, Mycobacterium
PAHPDSR

SEQ ID NO: 535327 - protein, 11 aa, Mycobacterium
PAHPGRDGTGI

SEQ ID NO: 535328 - protein, 8 aa, Mycobacterium
PAHPMSTA

SEQ ID NO: 535329 - protein, 13 aa, Mycobacterium
PAHPPDYGNDPPP

SEQ ID NO: 535330 - protein, 6 aa, Mycobacterium
PAHPPG

SEQ ID NO: 535331 - protein, 8 aa, Mycobacterium
PAHPQTTE

SEQ ID NO: 535332 - protein, 6 aa, Mycobacterium
PAHPTG

SEQ ID NO: 535333 - protein, 7 aa, Mycobacterium
PAHPTGE

SEQ ID NO: 535334 - protein, 10 aa, Mycobacterium
PAHPTQGEGP

SEQ ID NO: 535335 - protein, 7 aa, Mycobacterium
PAHPYTK

SEQ ID NO: 535336 - protein, 4 aa, Mycobacterium
PAHQ

SEQ ID NO: 535337 - protein, 8 aa, Mycobacterium
PAHRGQGV

SEQ ID NO: 535338 - protein, 75 aa, Mycobacterium
PAHRPAPRSRRRTAGRSPTPAPRRGPAPSPAPRPRSRRAPSSSAAPASTGRHRRPSPPRTARPGGIRASPARRPF

SEQ ID NO: 535339 - protein, 14 aa, Mycobacterium
PAHRSAEARDFGRG

SEQ ID NO: 535340 - protein, 5 aa, Mycobacterium
PAHSA

SEQ ID NO: 535341 - protein, 24 aa, Mycobacterium
PAHSNAAAAHDVAEGRADAGVSTR

SEQ ID NO: 535342 - protein, 8 aa, Mycobacterium
PAHSPGEH

SEQ ID NO: 535343 - protein, 9 aa, Mycobacterium
PAHSPKPVA

SEQ ID NO: 535344 - protein, 9 aa, Mycobacterium
PAHSTEEEY

SEQ ID NO: 535345 - protein, 4 aa, Mycobacterium
PAHT

SEQ ID NO: 535346 - protein, 8 aa, Mycobacterium
PAHTPLDG

SEQ ID NO: 535347 - protein, 8 aa, Mycobacterium
PAHTPVDG

SEQ ID NO: 535348 - protein, 5 aa, Mycobacterium
PAHTV

SEQ ID NO: 535349 - protein, 7 aa, Mycobacterium
PAHVQSA

SEQ ID NO: 535350 - protein, 12 aa, Mycobacterium
PAIAAPGGVAAQ

SEQ ID NO: 535351 - protein, 6 aa, Mycobacterium
PAIADD

SEQ ID NO: 535352 - protein, 6 aa, Mycobacterium
PAIAGE

SEQ ID NO: 535353 - protein, 9 aa, Mycobacterium
PAIAPPGEC

SEQ ID NO: 535354 - protein, 9 aa, Mycobacterium
PAIDGARSA

SEQ ID NO: 535355 - protein, 16 aa, Mycobacterium
PAIDNDERKEGTRPPI

SEQ ID NO: 535356 - protein, 14 aa, Mycobacterium
PAIDTDGDGVPDGV

SEQ ID NO: 535357 - protein, 4 aa, Mycobacterium
PAIE

SEQ ID NO: 535358 - protein, 9 aa, Mycobacterium
PAIEPPGEC

SEQ ID NO: 535359 - protein, 4 aa, Mycobacterium
PAIG

SEQ ID NO: 535360 - protein, 8 aa, Mycobacterium
PAIGAASP

SEQ ID NO: 535361 - protein, 14 aa, Mycobacterium
PAIGAEASTSLPVP

SEQ ID NO: 535362 - protein, 14 aa, Mycobacterium
PAIGGTGPATGSGL

SEQ ID NO: 535363 - protein, 12 aa, Mycobacterium
PAIGRDTATTAT

SEQ ID NO: 535364 - protein, 17 aa, Mycobacterium
PAIIGDGAAKKSSPQVP

SEQ ID NO: 535365 - protein, 7 aa, Mycobacterium
PAINSGG

SEQ ID NO: 535366 - protein, 4 aa, Mycobacterium
PAIP

SEQ ID NO: 535367 - protein, 7 aa, Mycobacterium
PAIPAPA

SEQ ID NO: 535368 - protein, 6 aa, Mycobacterium
PAIPDR

SEQ ID NO: 535369 - protein, 7 aa, Mycobacterium
PAIPKEV

SEQ ID NO: 535370 - protein, 13 aa, Mycobacterium
PAIRADATEDADA

SEQ ID NO: 535371 - protein, 23 aa, Mycobacterium
PAIRPKTAAEEQQAVTDYQPDGD

SEQ ID NO: 535372 - protein, 6 aa, Mycobacterium
PAISGE

SEQ ID NO: 535373 - protein, 12 aa, Mycobacterium
PAITEATAGSGF

SEQ ID NO: 535374 - protein, 18 aa, Mycobacterium
PAITGKPSGDDLRERKAT

SEQ ID NO: 535375 - protein, 6 aa, Mycobacterium
PAITPG

SEQ ID NO: 535376 - protein, 8 aa, Mycobacterium
PAKAAEYG

SEQ ID NO: 535377 - protein, 12 aa, Mycobacterium
PAKAEDSVTEQA

SEQ ID NO: 535378 - protein, 5 aa, Mycobacterium
PAKAL

SEQ ID NO: 535379 - protein, 8 aa, Mycobacterium
PAKANLPA

SEQ ID NO: 535380 - protein, 8 aa, Mycobacterium
PAKARDGE

SEQ ID NO: 535381 - protein, 8 aa, Mycobacterium
PAKDASPL

SEQ ID NO: 535382 - protein, 8 aa, Mycobacterium
PAKDGVDV

SEQ ID NO: 535383 - protein, 15 aa, Mycobacterium
PAKEAAAELARSAGE

SEQ ID NO: 535384 - protein, 7 aa, Mycobacterium
PAKEGEE

SEQ ID NO: 535385 - protein, 8 aa, Mycobacterium
PAKEGSPL

SEQ ID NO: 535386 - protein, 7 aa, Mycobacterium
PAKENAD

SEQ ID NO: 535387 - protein, 5 aa, Mycobacterium
PAKFG

SEQ ID NO: 535388 - protein, 9 aa, Mycobacterium
PAKGKGGAL

SEQ ID NO: 535389 - protein, 5 aa, Mycobacterium
PAKID

SEQ ID NO: 535390 - protein, 10 aa, Mycobacterium
PAKISDEDAL

SEQ ID NO: 535391 - protein, 6 aa, Mycobacterium
PAKKLT

SEQ ID NO: 535392 - protein, 4 aa, Mycobacterium
PAKL

SEQ ID NO: 535393 - protein, 7 aa, Mycobacterium
PAKLGAK

SEQ ID NO: 535394 - protein, 7 aa, Mycobacterium
PAKLQTT

SEQ ID NO: 535395 - protein, 6 aa, Mycobacterium
PAKLTS

SEQ ID NO: 535396 - protein, 8 aa, Mycobacterium
PAKNDGTT

SEQ ID NO: 535397 - protein, 4 aa, Mycobacterium
PAKP

SEQ ID NO: 535398 - protein, 56 aa, Mycobacterium
PAKPAPRAHAVQPNSRHRSGVSSPDHSRRQPISRPARAPSARPRRRREGYPQPAPA

SEQ ID NO: 535399 - protein, 9 aa, Mycobacterium
PAKPGPATV

SEQ ID NO: 535400 - protein, 12 aa, Mycobacterium
PAKPLGPIEQED

SEQ ID NO: 535401 - protein, 11 aa, Mycobacterium
PAKPPSAQTDA

SEQ ID NO: 535402 - protein, 8 aa, Mycobacterium
PAKPTDRA

SEQ ID NO: 535403 - protein, 30 aa, Mycobacterium
PAKPTGKRVGGDDGKPLTAAARAKRQTTAL

SEQ ID NO: 535404 - protein, 6 aa, Mycobacterium
PAKPVA

SEQ ID NO: 535405 - protein, 7 aa, Mycobacterium
PAKPVAE

SEQ ID NO: 535406 - protein, 6 aa, Mycobacterium
PAKPVD

SEQ ID NO: 535407 - protein, 6 aa, Mycobacterium
PAKQVN

SEQ ID NO: 535408 - protein, 7 aa, Mycobacterium
PAKRDKL

SEQ ID NO: 535409 - protein, 23 aa, Mycobacterium
PAKRGESSADRDGNGPHAAAGET

SEQ ID NO: 535410 - protein, 87 aa, Mycobacterium
PAKRPAAKAANGSAPAKRAAKTTARSTKSDAAEPAKKTRAKGAEAKGRGTKAAKGGPADPDALDSDGAVEDLDNEPDLEAEPGEDLD

SEQ ID NO: 535411 - protein, 63 aa, Mycobacterium
PAKRSAAKAAHGAAAPAKRAAKAPARTAKPEADAEAGAKKPRAAKAPSGRGTKAAKGAPAGAD

SEQ ID NO: 535412 - protein, 4 aa, Mycobacterium
PAKS

SEQ ID NO: 535413 - protein, 10 aa, Mycobacterium
PAKSDADVAR

SEQ ID NO: 535414 - protein, 8 aa, Mycobacterium
PAKSGIGG

SEQ ID NO: 535415 - protein, 8 aa, Mycobacterium
PAKSGVGG

SEQ ID NO: 535416 - protein, 7 aa, Mycobacterium
PAKSGVR

SEQ ID NO: 535417 - protein, 8 aa, Mycobacterium
PAKSGVRR

SEQ ID NO: 535418 - protein, 8 aa, Mycobacterium
PAKTASVV

SEQ ID NO: 535419 - protein, 12 aa, Mycobacterium
PAKTGQGRSRTA

SEQ ID NO: 535420 - protein, 11 aa, Mycobacterium
PAKVGKDAGEL

SEQ ID NO: 535421 - protein, 14 aa, Mycobacterium
PAKVKGPVAGTPAE

SEQ ID NO: 535422 - protein, 10 aa, Mycobacterium
PAKVRTKTLG

SEQ ID NO: 535423 - protein, 4 aa, Mycobacterium
PALA

SEQ ID NO: 535424 - protein, 6 aa, Mycobacterium
PALADA

SEQ ID NO: 535425 - protein, 12 aa, Mycobacterium
PALADPDDPANW

SEQ ID NO: 535426 - protein, 7 aa, Mycobacterium
PALAETQ

SEQ ID NO: 535427 - protein, 6 aa, Mycobacterium
PALAGG

SEQ ID NO: 535428 - protein, 8 aa, Mycobacterium
PALANRDW

SEQ ID NO: 535429 - protein, 8 aa, Mycobacterium
PALANSNG

SEQ ID NO: 535430 - protein, 5 aa, Mycobacterium
PALAS

SEQ ID NO: 535431 - protein, 7 aa, Mycobacterium
PALATGK

SEQ ID NO: 535432 - protein, 4 aa, Mycobacterium
PALD

SEQ ID NO: 535433 - protein, 13 aa, Mycobacterium
PALDAGAKSRSDF

SEQ ID NO: 535434 - protein, 8 aa, Mycobacterium
PALDASPM

SEQ ID NO: 535435 - protein, 25 aa, Mycobacterium
PALDDGEPTGATAGRALRRGPDGSV

SEQ ID NO: 535436 - protein, 5 aa, Mycobacterium
PALDK

SEQ ID NO: 535437 - protein, 11 aa, Mycobacterium
PALDPDGWQKA

SEQ ID NO: 535438 - protein, 8 aa, Mycobacterium
PALDPHAR

SEQ ID NO: 535439 - protein, 8 aa, Mycobacterium
PALDPKDV

SEQ ID NO: 535440 - protein, 10 aa, Mycobacterium
PALEDPTTGL

SEQ ID NO: 535441 - protein, 25 aa, Mycobacterium
PALEKERVKPKPSGDHSRGTKQGPV

SEQ ID NO: 535442 - protein, 5 aa, Mycobacterium
PALEP

SEQ ID NO: 535443 - protein, 5 aa, Mycobacterium
PALER

SEQ ID NO: 535444 - protein, 15 aa, Mycobacterium
PALGAKRKTKHHGEV

SEQ ID NO: 535445 - protein, 12 aa, Mycobacterium
PALGDDDAARDA

SEQ ID NO: 535446 - protein, 8 aa, Mycobacterium
PALGPSGQ

SEQ ID NO: 535447 - protein, 14 aa, Mycobacterium
PALGQERKTKHHGN

SEQ ID NO: 535448 - protein, 6 aa, Mycobacterium
PALGRG

SEQ ID NO: 535449 - protein, 7 aa, Mycobacterium
PALGSAK

SEQ ID NO: 535450 - protein, 8 aa, Mycobacterium
PALGTGKE

SEQ ID NO: 535451 - protein, 8 aa, Mycobacterium
PALGTGKQ

SEQ ID NO: 535452 - protein, 15 aa, Mycobacterium
PALGTRDDYDQQGPA

SEQ ID NO: 535453 - protein, 6 aa, Mycobacterium
PALGTS

SEQ ID NO: 535454 - protein, 11 aa, Mycobacterium
PALGVPSGDGL

SEQ ID NO: 535455 - protein, 4 aa, Mycobacterium
PALK

SEQ ID NO: 535456 - protein, 5 aa, Mycobacterium
PALKR

SEQ ID NO: 535457 - protein, 16 aa, Mycobacterium
PALLGDDSAPNPSETA

SEQ ID NO: 535458 - protein, 17 aa, Mycobacterium
PALLGDDSAPNPSETTL

SEQ ID NO: 535459 - protein, 13 aa, Mycobacterium
PALLSSDPDHPEV

SEQ ID NO: 535460 - protein, 7 aa, Mycobacterium
PALPANS

SEQ ID NO: 535461 - protein, 11 aa, Mycobacterium
PALPDETGTLP

SEQ ID NO: 535462 - protein, 29 aa, Mycobacterium
PALPDGEAPMPGGSSPAPQMAPTTPGIPN

SEQ ID NO: 535463 - protein, 8 aa, Mycobacterium
PALPDGMA

SEQ ID NO: 535464 - protein, 8 aa, Mycobacterium
PALPDGTI

SEQ ID NO: 535465 - protein, 14 aa, Mycobacterium
PALPDREPLPRPDI

SEQ ID NO: 535466 - protein, 8 aa, Mycobacterium
PALPEETG

SEQ ID NO: 535467 - protein, 8 aa, Mycobacterium
PALPGGSR

SEQ ID NO: 535468 - protein, 10 aa, Mycobacterium
PALPGSEEVR

SEQ ID NO: 535469 - protein, 5 aa, Mycobacterium
PALPP

SEQ ID NO: 535470 - protein, 18 aa, Mycobacterium
PALPPGRAGLAGTSVEVP

SEQ ID NO: 535471 - protein, 17 aa, Mycobacterium
PALPPSLEADGLGGPAR

SEQ ID NO: 535472 - protein, 5 aa, Mycobacterium
PALPR

SEQ ID NO: 535473 - protein, 8 aa, Mycobacterium
PALPRDRG

SEQ ID NO: 535474 - protein, 7 aa, Mycobacterium
PALPRRS

SEQ ID NO: 535475 - protein, 18 aa, Mycobacterium
PALPSPPRGYTPAPPPHW

SEQ ID NO: 535476 - protein, 4 aa, Mycobacterium
PALQ

SEQ ID NO: 535477 - protein, 9 aa, Mycobacterium
PALRESERP

SEQ ID NO: 535478 - protein, 5 aa, Mycobacterium
PALRQ

SEQ ID NO: 535479 - protein, 8 aa, Mycobacterium
PALSNSAG

SEQ ID NO: 535480 - protein, 11 aa, Mycobacterium
PALSPSRAGDF

SEQ ID NO: 535481 - protein, 7 aa, Mycobacterium
PALSPTD

SEQ ID NO: 535482 - protein, 8 aa, Mycobacterium
PALSTGYG

SEQ ID NO: 535483 - protein, 4 aa, Mycobacterium
PALT

SEQ ID NO: 535484 - protein, 16 aa, Mycobacterium
PALTARLPDGSLADHQ

SEQ ID NO: 535485 - protein, 5 aa, Mycobacterium
PALTD

SEQ ID NO: 535486 - protein, 8 aa, Mycobacterium
PALTDTDI

SEQ ID NO: 535487 - protein, 5 aa, Mycobacterium
PALTE

SEQ ID NO: 535488 - protein, 17 aa, Mycobacterium
PALTEESYAKSPKRARQ

SEQ ID NO: 535489 - protein, 5 aa, Mycobacterium
PALTG

SEQ ID NO: 535490 - protein, 6 aa, Mycobacterium
PALTPD

SEQ ID NO: 535491 - protein, 5 aa, Mycobacterium
PAMAD

SEQ ID NO: 535492 - protein, 5 aa, Mycobacterium
PAMAG

SEQ ID NO: 535493 - protein, 12 aa, Mycobacterium
PAMAPPGKHAAS

SEQ ID NO: 535494 - protein, 12 aa, Mycobacterium
PAMDSARSASAT

SEQ ID NO: 535495 - protein, 21 aa, Mycobacterium
PAMPGNHRPPSDKPSYYISVL

SEQ ID NO: 535496 - protein, 6 aa, Mycobacterium
PAMPGQ

SEQ ID NO: 535497 - protein, 5 aa, Mycobacterium
PAMPL

SEQ ID NO: 535498 - protein, 8 aa, Mycobacterium
PANAPDYA

SEQ ID NO: 535499 - protein, 14 aa, Mycobacterium
PANATDLSGLPPAY

SEQ ID NO: 535500 - protein, 8 aa, Mycobacterium
PANDAAKA

SEQ ID NO: 535501 - protein, 21 aa, Mycobacterium
PANDDYHNSANAGSNDASAHI

SEQ ID NO: 535502 - protein, 10 aa, Mycobacterium
PANDEEASAR

SEQ ID NO: 535503 - protein, 18 aa, Mycobacterium
PANELPTAQDSDSHNTSP

SEQ ID NO: 535504 - protein, 6 aa, Mycobacterium
PANGPA

SEQ ID NO: 535505 - protein, 8 aa, Mycobacterium
PANHPKDA

SEQ ID NO: 535506 - protein, 4 aa, Mycobacterium
PANI

SEQ ID NO: 535507 - protein, 6 aa, Mycobacterium
PANIRP

SEQ ID NO: 535508 - protein, 4 aa, Mycobacterium
PANL

SEQ ID NO: 535509 - protein, 5 aa, Mycobacterium
PANLG

SEQ ID NO: 535510 - protein, 4 aa, Mycobacterium
PANM

SEQ ID NO: 535511 - protein, 5 aa, Mycobacterium
PANNP

SEQ ID NO: 535512 - protein, 15 aa, Mycobacterium
PANNRPLQPDHERDW

SEQ ID NO: 535513 - protein, 10 aa, Mycobacterium
PANPNQPPYS

SEQ ID NO: 535514 - protein, 6 aa, Mycobacterium
PANPTY

SEQ ID NO: 535515 - protein, 5 aa, Mycobacterium
PANQN

SEQ ID NO: 535516 - protein, 7 aa, Mycobacterium
PANRADP

SEQ ID NO: 535517 - protein, 5 aa, Mycobacterium
PANRP

SEQ ID NO: 535518 - protein, 8 aa, Mycobacterium
PANRPDPY

SEQ ID NO: 535519 - protein, 7 aa, Mycobacterium
PANSPAM

SEQ ID NO: 535520 - protein, 11 aa, Mycobacterium
PANSRVDTRVD

SEQ ID NO: 535521 - protein, 8 aa, Mycobacterium
PANTANTS

SEQ ID NO: 535522 - protein, 10 aa, Mycobacterium
PANTDDGRSV

SEQ ID NO: 535523 - protein, 5 aa, Mycobacterium
PANTH

SEQ ID NO: 535524 - protein, 7 aa, Mycobacterium
PANTPME

SEQ ID NO: 535525 - protein, 5 aa, Mycobacterium
PANVA

SEQ ID NO: 535526 - protein, 6 aa, Mycobacterium
PANVAG

SEQ ID NO: 535527 - protein, 8 aa, Mycobacterium
PANVEGTR

SEQ ID NO: 535528 - protein, 7 aa, Mycobacterium
PANVSRR

SEQ ID NO: 535529 - protein, 18 aa, Mycobacterium
PANVSRRAKTDVLIVHTT

SEQ ID NO: 535530 - protein, 7 aa, Mycobacterium
PANVTGL

SEQ ID NO: 535531 - protein, 12 aa, Mycobacterium
PANYPKDAVSPL

SEQ ID NO: 535532 - protein, 5 aa, Mycobacterium
PAPAA

SEQ ID NO: 535533 - protein, 9 aa, Mycobacterium
PAPAAADAV

SEQ ID NO: 535534 - protein, 12 aa, Mycobacterium
PAPAAATSRGGM

SEQ ID NO: 535535 - protein, 12 aa, Mycobacterium
PAPAASGSVSRC

SEQ ID NO: 535536 - protein, 15 aa, Mycobacterium
PAPADSSTSTDTYGN

SEQ ID NO: 535537 - protein, 5 aa, Mycobacterium
PAPAE

SEQ ID NO: 535538 - protein, 6 aa, Mycobacterium
PAPAEA

SEQ ID NO: 535539 - protein, 13 aa, Mycobacterium
PAPAEGERNPLRD

SEQ ID NO: 535540 - protein, 26 aa, Mycobacterium
PAPAENATKITAREPAVAGDRPELSE

SEQ ID NO: 535541 - protein, 26 aa, Mycobacterium
PAPAENATKITSREPAVAGDRPELTE

SEQ ID NO: 535542 - protein, 26 aa, Mycobacterium
PAPAENATKVTSRQPVVGGDRPELTE

SEQ ID NO: 535543 - protein, 12 aa, Mycobacterium
PAPAHPLNQPRT

SEQ ID NO: 535544 - protein, 6 aa, Mycobacterium
PAPAIG

SEQ ID NO: 535545 - protein, 12 aa, Mycobacterium
PAPALGDDTDSV

SEQ ID NO: 535546 - protein, 12 aa, Mycobacterium
PAPAPAGPLPPF

SEQ ID NO: 535547 - protein, 30 aa, Mycobacterium
PAPAPQSADEALPPSPALSQLSTTRDSIAT

SEQ ID NO: 535548 - protein, 16 aa, Mycobacterium
PAPAPRTRSRPAIGPV

SEQ ID NO: 535549 - protein, 6 aa, Mycobacterium
PAPAPY

SEQ ID NO: 535550 - protein, 13 aa, Mycobacterium
PAPAQDAEPDGLP

SEQ ID NO: 535551 - protein, 7 aa, Mycobacterium
PAPAQGA

SEQ ID NO: 535552 - protein, 7 aa, Mycobacterium
PAPAQPL

SEQ ID NO: 535553 - protein, 5 aa, Mycobacterium
PAPAR

SEQ ID NO: 535554 - protein, 10 aa, Mycobacterium
PAPASARSAR

SEQ ID NO: 535555 - protein, 13 aa, Mycobacterium
PAPASPPTDDELA

SEQ ID NO: 535556 - protein, 7 aa, Mycobacterium
PAPASTY

SEQ ID NO: 535557 - protein, 8 aa, Mycobacterium
PAPATDSD

SEQ ID NO: 535558 - protein, 6 aa, Mycobacterium
PAPATH

SEQ ID NO: 535559 - protein, 6 aa, Mycobacterium
PAPATL

SEQ ID NO: 535560 - protein, 6 aa, Mycobacterium
PAPATS

SEQ ID NO: 535561 - protein, 4 aa, Mycobacterium
PAPD

SEQ ID NO: 535562 - protein, 6 aa, Mycobacterium
PAPDAA

SEQ ID NO: 535563 - protein, 7 aa, Mycobacterium
PAPDAPL

SEQ ID NO: 535564 - protein, 15 aa, Mycobacterium
PAPDARPRRHHPDPL

SEQ ID NO: 535565 - protein, 7 aa, Mycobacterium
PAPDGGP

SEQ ID NO: 535566 - protein, 10 aa, Mycobacterium
PAPDGSGYTS

SEQ ID NO: 535567 - protein, 5 aa, Mycobacterium
PAPDL

SEQ ID NO: 535568 - protein, 8 aa, Mycobacterium
PAPDLAPP

SEQ ID NO: 535569 - protein, 14 aa, Mycobacterium
PAPDNPAPELPGGA

SEQ ID NO: 535570 - protein, 8 aa, Mycobacterium
PAPDPGPL

SEQ ID NO: 535571 - protein, 9 aa, Mycobacterium
PAPDPHSSV

SEQ ID NO: 535572 - protein, 6 aa, Mycobacterium
PAPDQV

SEQ ID NO: 535573 - protein, 5 aa, Mycobacterium
PAPDR

SEQ ID NO: 535574 - protein, 16 aa, Mycobacterium
PAPDRLEHDADEAWRR

SEQ ID NO: 535575 - protein, 7 aa, Mycobacterium
PAPDRNE

SEQ ID NO: 535576 - protein, 8 aa, Mycobacterium
PAPDSMTA

SEQ ID NO: 535577 - protein, 6 aa, Mycobacterium
PAPDTA

SEQ ID NO: 535578 - protein, 11 aa, Mycobacterium
PAPDYQGGDDY

SEQ ID NO: 535579 - protein, 19 aa, Mycobacterium
PAPDYSSGDYHAPQTPTEE

SEQ ID NO: 535580 - protein, 6 aa, Mycobacterium
PAPEAN

SEQ ID NO: 535581 - protein, 5 aa, Mycobacterium
PAPED

SEQ ID NO: 535582 - protein, 9 aa, Mycobacterium
PAPEDPPAV

SEQ ID NO: 535583 - protein, 7 aa, Mycobacterium
PAPEDSY

SEQ ID NO: 535584 - protein, 10 aa, Mycobacterium
PAPEDTSPTA

SEQ ID NO: 535585 - protein, 10 aa, Mycobacterium
PAPEEPDFTE

SEQ ID NO: 535586 - protein, 12 aa, Mycobacterium
PAPEKRAKSAQI

SEQ ID NO: 535587 - protein, 14 aa, Mycobacterium
PAPELASTASVGGC

SEQ ID NO: 535588 - protein, 10 aa, Mycobacterium
PAPEPADGEA

SEQ ID NO: 535589 - protein, 7 aa, Mycobacterium
PAPEPLA

SEQ ID NO: 535590 - protein, 22 aa, Mycobacterium
PAPERSPAESTIASPTHGPYGE

SEQ ID NO: 535591 - protein, 11 aa, Mycobacterium
PAPESEEARDR

SEQ ID NO: 535592 - protein, 12 aa, Mycobacterium
PAPESSLNGPVT

SEQ ID NO: 535593 - protein, 8 aa, Mycobacterium
PAPETPFT

SEQ ID NO: 535594 - protein, 19 aa, Mycobacterium
PAPEVATGVKPSDVADNAA

SEQ ID NO: 535595 - protein, 8 aa, Mycobacterium
PAPEVESA

SEQ ID NO: 535596 - protein, 5 aa, Mycobacterium
PAPFA

SEQ ID NO: 535597 - protein, 13 aa, Mycobacterium
PAPFAGGVGSGAH

SEQ ID NO: 535598 - protein, 9 aa, Mycobacterium
PAPFTGQER

SEQ ID NO: 535599 - protein, 5 aa, Mycobacterium
PAPGA

SEQ ID NO: 535600 - protein, 7 aa, Mycobacterium
PAPGADA

SEQ ID NO: 535601 - protein, 9 aa, Mycobacterium
PAPGARPTY

SEQ ID NO: 535602 - protein, 9 aa, Mycobacterium
PAPGDARTI

SEQ ID NO: 535603 - protein, 10 aa, Mycobacterium
PAPGDDRQLA

SEQ ID NO: 535604 - protein, 13 aa, Mycobacterium
PAPGDFAVGDHHH

SEQ ID NO: 535605 - protein, 9 aa, Mycobacterium
PAPGDGRTF

SEQ ID NO: 535606 - protein, 12 aa, Mycobacterium
PAPGDGRTFAED

SEQ ID NO: 535607 - protein, 23 aa, Mycobacterium
PAPGDGRTFAEDTELDGTRFKEG

SEQ ID NO: 535608 - protein, 10 aa, Mycobacterium
PAPGDGRTFS

SEQ ID NO: 535609 - protein, 11 aa, Mycobacterium
PAPGDGRTFSD

SEQ ID NO: 535610 - protein, 11 aa, Mycobacterium
PAPGDGRTFSE

SEQ ID NO: 535611 - protein, 9 aa, Mycobacterium
PAPGDGRTL

SEQ ID NO: 535612 - protein, 6 aa, Mycobacterium
PAPGDH

SEQ ID NO: 535613 - protein, 11 aa, Mycobacterium
PAPGDVPADPE

SEQ ID NO: 535614 - protein, 12 aa, Mycobacterium
PAPGEEAKSAFA

SEQ ID NO: 535615 - protein, 10 aa, Mycobacterium
PAPGEFTAED

SEQ ID NO: 535616 - protein, 35 aa, Mycobacterium
PAPGEKTKKTRVGRGEGSKGKTAGRGTKGTKARKN

SEQ ID NO: 535617 - protein, 8 aa, Mycobacterium
PAPGEPKR

SEQ ID NO: 535618 - protein, 8 aa, Mycobacterium
PAPGGKAE

SEQ ID NO: 535619 - protein, 13 aa, Mycobacterium
PAPGGLALPPASP

SEQ ID NO: 535620 - protein, 8 aa, Mycobacterium
PAPGGRAE

SEQ ID NO: 535621 - protein, 9 aa, Mycobacterium
PAPGGRREL

SEQ ID NO: 535622 - protein, 8 aa, Mycobacterium
PAPGGSRE

SEQ ID NO: 535623 - protein, 10 aa, Mycobacterium
PAPGHDDDDP

SEQ ID NO: 535624 - protein, 5 aa, Mycobacterium
PAPGL

SEQ ID NO: 535625 - protein, 7 aa, Mycobacterium
PAPGLPE

SEQ ID NO: 535626 - protein, 7 aa, Mycobacterium
PAPGPLS

SEQ ID NO: 535627 - protein, 18 aa, Mycobacterium
PAPGPVTRYDTPSGPGVR

SEQ ID NO: 535628 - protein, 12 aa, Mycobacterium
PAPGQADEDAVS

SEQ ID NO: 535629 - protein, 20 aa, Mycobacterium
PAPGRDGSTGPGDDQRASQH

SEQ ID NO: 535630 - protein, 12 aa, Mycobacterium
PAPGRDGVGAAT

SEQ ID NO: 535631 - protein, 13 aa, Mycobacterium
PAPGREGTSPAAL

SEQ ID NO: 535632 - protein, 14 aa, Mycobacterium
PAPGRENPTVTPIP

SEQ ID NO: 535633 - protein, 13 aa, Mycobacterium
PAPGRRGGQRRYD

SEQ ID NO: 535634 - protein, 9 aa, Mycobacterium
PAPGSTTAH

SEQ ID NO: 535635 - protein, 11 aa, Mycobacterium
PAPGSVLDPGQ

SEQ ID NO: 535636 - protein, 6 aa, Mycobacterium
PAPGYP

SEQ ID NO: 535637 - protein, 12 aa, Mycobacterium
PAPHGRGASPAE

SEQ ID NO: 535638 - protein, 8 aa, Mycobacterium
PAPHPTGK

SEQ ID NO: 535639 - protein, 9 aa, Mycobacterium
PAPHSDGVQ

SEQ ID NO: 535640 - protein, 9 aa, Mycobacterium
PAPHSRTPI

SEQ ID NO: 535641 - protein, 9 aa, Mycobacterium
PAPHTRTPI

SEQ ID NO: 535642 - protein, 4 aa, Mycobacterium
PAPI

SEQ ID NO: 535643 - protein, 5 aa, Mycobacterium
PAPIE

SEQ ID NO: 535644 - protein, 5 aa, Mycobacterium
PAPIH

SEQ ID NO: 535645 - protein, 12 aa, Mycobacterium
PAPIRTHSGEQI

SEQ ID NO: 535646 - protein, 19 aa, Mycobacterium
PAPKGTTPRQRTTRARTAS

SEQ ID NO: 535647 - protein, 7 aa, Mycobacterium
PAPKQMP

SEQ ID NO: 535648 - protein, 7 aa, Mycobacterium
PAPKRQY

SEQ ID NO: 535649 - protein, 4 aa, Mycobacterium
PAPL

SEQ ID NO: 535650 - protein, 6 aa, Mycobacterium
PAPLAH

SEQ ID NO: 535651 - protein, 17 aa, Mycobacterium
PAPLAQTAGTAAIDSAD

SEQ ID NO: 535652 - protein, 12 aa, Mycobacterium
PAPLLPEERKTT

SEQ ID NO: 535653 - protein, 9 aa, Mycobacterium
PAPLPEGVS

SEQ ID NO: 535654 - protein, 7 aa, Mycobacterium
PAPLPRG

SEQ ID NO: 535655 - protein, 6 aa, Mycobacterium
PAPLRT

SEQ ID NO: 535656 - protein, 5 aa, Mycobacterium
PAPLS

SEQ ID NO: 535657 - protein, 7 aa, Mycobacterium
PAPLSRN

SEQ ID NO: 535658 - protein, 12 aa, Mycobacterium
PAPMPPSEGSLR

SEQ ID NO: 535659 - protein, 15 aa, Mycobacterium
PAPMRSPRGRQRPGR

SEQ ID NO: 535660 - protein, 7 aa, Mycobacterium
PAPNAAR

SEQ ID NO: 535661 - protein, 24 aa, Mycobacterium
PAPNKMNTGGVHGSALGADEVAAT

SEQ ID NO: 535662 - protein, 22 aa, Mycobacterium
PAPNKMNTGGVHGSALGDDEVA

SEQ ID NO: 535663 - protein, 8 aa, Mycobacterium
PAPNLDPQ

SEQ ID NO: 535664 - protein, 7 aa, Mycobacterium
PAPNLPA

SEQ ID NO: 535665 - protein, 8 aa, Mycobacterium
PAPNLPEE

SEQ ID NO: 535666 - protein, 8 aa, Mycobacterium
PAPNLPGE

SEQ ID NO: 535667 - protein, 9 aa, Mycobacterium
PAPNLPPEL

SEQ ID NO: 535668 - protein, 8 aa, Mycobacterium
PAPNLSDE

SEQ ID NO: 535669 - protein, 12 aa, Mycobacterium
PAPNLSDTQRQR

SEQ ID NO: 535670 - protein, 20 aa, Mycobacterium
PAPNPPATTRDEAQPKNNID

SEQ ID NO: 535671 - protein, 4 aa, Mycobacterium
PAPP

SEQ ID NO: 535672 - protein, 11 aa, Mycobacterium
PAPPAAGPVGA

SEQ ID NO: 535673 - protein, 13 aa, Mycobacterium
PAPPAPEAPPALG

SEQ ID NO: 535674 - protein, 9 aa, Mycobacterium
PAPPAPMTK

SEQ ID NO: 535675 - protein, 7 aa, Mycobacterium
PAPPDAV

SEQ ID NO: 535676 - protein, 15 aa, Mycobacterium
PAPPDRAPDTCPAGT

SEQ ID NO: 535677 - protein, 7 aa, Mycobacterium
PAPPELR

SEQ ID NO: 535678 - protein, 28 aa, Mycobacterium
PAPPEPVEAEKPKRGAKKVEGPKPRTGS

SEQ ID NO: 535679 - protein, 7 aa, Mycobacterium
PAPPESA

SEQ ID NO: 535680 - protein, 18 aa, Mycobacterium
PAPPFDCGTPERADQATL

SEQ ID NO: 535681 - protein, 8 aa, Mycobacterium
PAPPGGEF

SEQ ID NO: 535682 - protein, 7 aa, Mycobacterium
PAPPLPA

SEQ ID NO: 535683 - protein, 17 aa, Mycobacterium
PAPPLPNATLRPRPAPG

SEQ ID NO: 535684 - protein, 8 aa, Mycobacterium
PAPPPHAV

SEQ ID NO: 535685 - protein, 8 aa, Mycobacterium
PAPPPPVL

SEQ ID NO: 535686 - protein, 20 aa, Mycobacterium
PAPPPQRPGRGTSEPGTDQP

SEQ ID NO: 535687 - protein, 8 aa, Mycobacterium
PAPPQAQA

SEQ ID NO: 535688 - protein, 17 aa, Mycobacterium
PAPPQLAQTAGTATIDS

SEQ ID NO: 535689 - protein, 13 aa, Mycobacterium
PAPPQPKPVREEA

SEQ ID NO: 535690 - protein, 6 aa, Mycobacterium
PAPPQV

SEQ ID NO: 535691 - protein, 12 aa, Mycobacterium
PAPPSPSTIRSR

SEQ ID NO: 535692 - protein, 32 aa, Mycobacterium
PAPPVPPTPPNSTGVSAGTPGSPAPGTPGSTL

SEQ ID NO: 535693 - protein, 19 aa, Mycobacterium
PAPPVPPVPPVPPVPPWPP

SEQ ID NO: 535694 - protein, 10 aa, Mycobacterium
PAPQAAPGTV

SEQ ID NO: 535695 - protein, 9 aa, Mycobacterium
PAPQAGPGQ

SEQ ID NO: 535696 - protein, 12 aa, Mycobacterium
PAPQGDPDAPAR

SEQ ID NO: 535697 - protein, 16 aa, Mycobacterium
PAPQGWEGTAPGTPLR

SEQ ID NO: 535698 - protein, 6 aa, Mycobacterium
PAPQPG

SEQ ID NO: 535699 - protein, 19 aa, Mycobacterium
PAPQPSEGPVLPIAFGKAL

SEQ ID NO: 535700 - protein, 7 aa, Mycobacterium
PAPQRNQ

SEQ ID NO: 535701 - protein, 9 aa, Mycobacterium
PAPQRVPNN

SEQ ID NO: 535702 - protein, 4 aa, Mycobacterium
PAPR

SEQ ID NO: 535703 - protein, 12 aa, Mycobacterium
PAPRDAEARDEL

SEQ ID NO: 535704 - protein, 12 aa, Mycobacterium
PAPRDPEERDRL

SEQ ID NO: 535705 - protein, 15 aa, Mycobacterium
PAPRDPGPAPSPVEQ

SEQ ID NO: 535706 - protein, 7 aa, Mycobacterium
PAPRELG

SEQ ID NO: 535707 - protein, 12 aa, Mycobacterium
PAPRQLPAPDAV

SEQ ID NO: 535708 - protein, 8 aa, Mycobacterium
PAPRTHRR

SEQ ID NO: 535709 - protein, 18 aa, Mycobacterium
PAPRTPESVAGWDRVLTT

SEQ ID NO: 535710 - protein, 6 aa, Mycobacterium
PAPRVS

SEQ ID NO: 535711 - protein, 16 aa, Mycobacterium
PAPRVTANHRGGRRTN

SEQ ID NO: 535712 - protein, 8 aa, Mycobacterium
PAPRYAGT

SEQ ID NO: 535713 - protein, 9 aa, Mycobacterium
PAPSAADVA

SEQ ID NO: 535714 - protein, 7 aa, Mycobacterium
PAPSDWT

SEQ ID NO: 535715 - protein, 10 aa, Mycobacterium
PAPSEMTTEE

SEQ ID NO: 535716 - protein, 7 aa, Mycobacterium
PAPSGAH

SEQ ID NO: 535717 - protein, 8 aa, Mycobacterium
PAPSGAPT

SEQ ID NO: 535718 - protein, 16 aa, Mycobacterium
PAPSGDAGADENARGP

SEQ ID NO: 535719 - protein, 8 aa, Mycobacterium
PAPSGPIV

SEQ ID NO: 535720 - protein, 6 aa, Mycobacterium
PAPSGW

SEQ ID NO: 535721 - protein, 5 aa, Mycobacterium
PAPSH

SEQ ID NO: 535722 - protein, 16 aa, Mycobacterium
PAPSIRDASGGERARE

SEQ ID NO: 535723 - protein, 5 aa, Mycobacterium
PAPSL

SEQ ID NO: 535724 - protein, 8 aa, Mycobacterium
PAPSPAPF

SEQ ID NO: 535725 - protein, 19 aa, Mycobacterium
PAPSPPPPGPPPPPAPEPP

SEQ ID NO: 535726 - protein, 7 aa, Mycobacterium
PAPSRAE

SEQ ID NO: 535727 - protein, 14 aa, Mycobacterium
PAPSRESVPSLEER

SEQ ID NO: 535728 - protein, 8 aa, Mycobacterium
PAPSSGGI

SEQ ID NO: 535729 - protein, 7 aa, Mycobacterium
PAPSSRW

SEQ ID NO: 535730 - protein, 13 aa, Mycobacterium
PAPSSTGGDPRSV

SEQ ID NO: 535731 - protein, 6 aa, Mycobacterium
PAPSSY

SEQ ID NO: 535732 - protein, 5 aa, Mycobacterium
PAPSV

SEQ ID NO: 535733 - protein, 9 aa, Mycobacterium
PAPSVGGAT

SEQ ID NO: 535734 - protein, 11 aa, Mycobacterium
PAPTADGDNTF

SEQ ID NO: 535735 - protein, 9 aa, Mycobacterium
PAPTASAEE

SEQ ID NO: 535736 - protein, 47 aa, Mycobacterium
PAPTCTPAATNNAAISGDTPRAPAPLPGVTTSSPANSANGTEDIAAS

SEQ ID NO: 535737 - protein, 6 aa, Mycobacterium
PAPTDR

SEQ ID NO: 535738 - protein, 5 aa, Mycobacterium
PAPTF

SEQ ID NO: 535739 - protein, 13 aa, Mycobacterium
PAPTGAVGWITGH

SEQ ID NO: 535740 - protein, 13 aa, Mycobacterium
PAPTGSVDPAGLG

SEQ ID NO: 535741 - protein, 5 aa, Mycobacterium
PAPTI

SEQ ID NO: 535742 - protein, 16 aa, Mycobacterium
PAPTIKDAAGGPNARK

SEQ ID NO: 535743 - protein, 24 aa, Mycobacterium
PAPTKMNTGGVHGSALGADEVAAT

SEQ ID NO: 535744 - protein, 14 aa, Mycobacterium
PAPTLAPRRKTRQL

SEQ ID NO: 535745 - protein, 12 aa, Mycobacterium
PAPTPHATKEQV

SEQ ID NO: 535746 - protein, 8 aa, Mycobacterium
PAPTPQNA

SEQ ID NO: 535747 - protein, 12 aa, Mycobacterium
PAPTPRPSVPVG

SEQ ID NO: 535748 - protein, 8 aa, Mycobacterium
PAPTPRRG

SEQ ID NO: 535749 - protein, 6 aa, Mycobacterium
PAPTRK

SEQ ID NO: 535750 - protein, 6 aa, Mycobacterium
PAPTRL

SEQ ID NO: 535751 - protein, 10 aa, Mycobacterium
PAPTSASRRV

SEQ ID NO: 535752 - protein, 8 aa, Mycobacterium
PAPTTAER

SEQ ID NO: 535753 - protein, 16 aa, Mycobacterium
PAPTTTKGDLAAETRR

SEQ ID NO: 535754 - protein, 7 aa, Mycobacterium
PAPTTVR

SEQ ID NO: 535755 - protein, 6 aa, Mycobacterium
PAPTVR

SEQ ID NO: 535756 - protein, 7 aa, Mycobacterium
PAPTYHT

SEQ ID NO: 535757 - protein, 12 aa, Mycobacterium
PAPVGGNRGGPF

SEQ ID NO: 535758 - protein, 33 aa, Mycobacterium
PAPVGRTAAPGADVDDEPRWSAAESKPKPVDQG

SEQ ID NO: 535759 - protein, 18 aa, Mycobacterium
PAPVGTSRSKGRSDEYQS

SEQ ID NO: 535760 - protein, 5 aa, Mycobacterium
PAPVP

SEQ ID NO: 535761 - protein, 7 aa, Mycobacterium
PAPVPPA

SEQ ID NO: 535762 - protein, 31 aa, Mycobacterium
PAPVPTPVPGDVPGDNPGKDRPGKDRPGHSP

SEQ ID NO: 535763 - protein, 7 aa, Mycobacterium
PAPVSGR

SEQ ID NO: 535764 - protein, 12 aa, Mycobacterium
PAPVTTPGDPTQ

SEQ ID NO: 535765 - protein, 12 aa, Mycobacterium
PAPVYASATIAS

SEQ ID NO: 535766 - protein, 10 aa, Mycobacterium
PAPYADDSKE

SEQ ID NO: 535767 - protein, 5 aa, Mycobacterium
PAPYD

SEQ ID NO: 535768 - protein, 8 aa, Mycobacterium
PAPYRQAT

SEQ ID NO: 535769 - protein, 18 aa, Mycobacterium
PAQAAKIAEAGHARVTQD

SEQ ID NO: 535770 - protein, 22 aa, Mycobacterium
PAQAATGAAAASTGVSGHPVGS

SEQ ID NO: 535771 - protein, 7 aa, Mycobacterium
PAQAEEW

SEQ ID NO: 535772 - protein, 26 aa, Mycobacterium
PAQAENATRITKREPAVAGDRPELTE

SEQ ID NO: 535773 - protein, 5 aa, Mycobacterium
PAQAK

SEQ ID NO: 535774 - protein, 9 aa, Mycobacterium
PAQAKRQIA

SEQ ID NO: 535775 - protein, 8 aa, Mycobacterium
PAQAPTTR

SEQ ID NO: 535776 - protein, 8 aa, Mycobacterium
PAQAQSNS

SEQ ID NO: 535777 - protein, 7 aa, Mycobacterium
PAQARAE

SEQ ID NO: 535778 - protein, 8 aa, Mycobacterium
PAQARATR

SEQ ID NO: 535779 - protein, 10 aa, Mycobacterium
PAQASSAKLT

SEQ ID NO: 535780 - protein, 4 aa, Mycobacterium
PAQC

SEQ ID NO: 535781 - protein, 8 aa, Mycobacterium
PAQDDAVR

SEQ ID NO: 535782 - protein, 5 aa, Mycobacterium
PAQDE

SEQ ID NO: 535783 - protein, 13 aa, Mycobacterium
PAQDGGQTVARDP

SEQ ID NO: 535784 - protein, 6 aa, Mycobacterium
PAQDLA

SEQ ID NO: 535785 - protein, 10 aa, Mycobacterium
PAQDPDDLRR

SEQ ID NO: 535786 - protein, 8 aa, Mycobacterium
PAQDTPYG

SEQ ID NO: 535787 - protein, 4 aa, Mycobacterium
PAQE

SEQ ID NO: 535788 - protein, 23 aa, Mycobacterium
PAQEPQEPALTARTAHPAGTTNA

SEQ ID NO: 535789 - protein, 10 aa, Mycobacterium
PAQERGDALR

SEQ ID NO: 535790 - protein, 13 aa, Mycobacterium
PAQERPVSRGDDD

SEQ ID NO: 535791 - protein, 5 aa, Mycobacterium
PAQGF

SEQ ID NO: 535792 - protein, 8 aa, Mycobacterium
PAQGLSDD

SEQ ID NO: 535793 - protein, 8 aa, Mycobacterium
PAQGLSDE

SEQ ID NO: 535794 - protein, 9 aa, Mycobacterium
PAQGLSGEV

SEQ ID NO: 535795 - protein, 6 aa, Mycobacterium
PAQGRL

SEQ ID NO: 535796 - protein, 7 aa, Mycobacterium
PAQGSCP

SEQ ID NO: 535797 - protein, 18 aa, Mycobacterium
PAQGSDRGSSQTAGVAES

SEQ ID NO: 535798 - protein, 6 aa, Mycobacterium
PAQHAA

SEQ ID NO: 535799 - protein, 33 aa, Mycobacterium
PAQHPYGSSQVGSKYQGQRGPTPSKSYQNFVKS

SEQ ID NO: 535800 - protein, 16 aa, Mycobacterium
PAQHQDPANVGRREDG

SEQ ID NO: 535801 - protein, 7 aa, Mycobacterium
PAQIADQ

SEQ ID NO: 535802 - protein, 17 aa, Mycobacterium
PAQLDAARGQIAQRDHR

SEQ ID NO: 535803 - protein, 7 aa, Mycobacterium
PAQLGPS

SEQ ID NO: 535804 - protein, 9 aa, Mycobacterium
PAQLPGDDR

SEQ ID NO: 535805 - protein, 7 aa, Mycobacterium
PAQLPQA

SEQ ID NO: 535806 - protein, 10 aa, Mycobacterium
PAQPAELYPG

SEQ ID NO: 535807 - protein, 5 aa, Mycobacterium
PAQPE

SEQ ID NO: 535808 - protein, 11 aa, Mycobacterium
PAQPEDTGSDM

SEQ ID NO: 535809 - protein, 22 aa, Mycobacterium
PAQPEPSAPHQAPAPGAGQEPI

SEQ ID NO: 535810 - protein, 9 aa, Mycobacterium
PAQPGGDQP

SEQ ID NO: 535811 - protein, 7 aa, Mycobacterium
PAQPGVA

SEQ ID NO: 535812 - protein, 8 aa, Mycobacterium
PAQPHDPD

SEQ ID NO: 535813 - protein, 8 aa, Mycobacterium
PAQPQRHG

SEQ ID NO: 535814 - protein, 7 aa, Mycobacterium
PAQPRPY

SEQ ID NO: 535815 - protein, 6 aa, Mycobacterium
PAQPVS

SEQ ID NO: 535816 - protein, 8 aa, Mycobacterium
PAQQAAQS

SEQ ID NO: 535817 - protein, 11 aa, Mycobacterium
PAQQGPARAPS

SEQ ID NO: 535818 - protein, 5 aa, Mycobacterium
PAQQP

SEQ ID NO: 535819 - protein, 10 aa, Mycobacterium
PAQQPRWDGN

SEQ ID NO: 535820 - protein, 10 aa, Mycobacterium
PAQQPTSVAI

SEQ ID NO: 535821 - protein, 13 aa, Mycobacterium
PAQQQQQAPDTAG

SEQ ID NO: 535822 - protein, 5 aa, Mycobacterium
PAQQR

SEQ ID NO: 535823 - protein, 4 aa, Mycobacterium
PAQR

SEQ ID NO: 535824 - protein, 7 aa, Mycobacterium
PAQRDRA

SEQ ID NO: 535825 - protein, 21 aa, Mycobacterium
PAQRDTKDTRDDSSLAADTDR

SEQ ID NO: 535826 - protein, 5 aa, Mycobacterium
PAQRP

SEQ ID NO: 535827 - protein, 15 aa, Mycobacterium
PAQRPPRRGDPVPGQ

SEQ ID NO: 535828 - protein, 8 aa, Mycobacterium
PAQRQDEL

SEQ ID NO: 535829 - protein, 10 aa, Mycobacterium
PAQRRPTGPP

SEQ ID NO: 535830 - protein, 4 aa, Mycobacterium
PAQS

SEQ ID NO: 535831 - protein, 9 aa, Mycobacterium
PAQSAGGAT

SEQ ID NO: 535832 - protein, 10 aa, Mycobacterium
PAQSGGGEAL

SEQ ID NO: 535833 - protein, 7 aa, Mycobacterium
PAQSPGT

SEQ ID NO: 535834 - protein, 9 aa, Mycobacterium
PAQSRASGV

SEQ ID NO: 535835 - protein, 6 aa, Mycobacterium
PAQTHA

SEQ ID NO: 535836 - protein, 7 aa, Mycobacterium
PAQTRAA

SEQ ID NO: 535837 - protein, 11 aa, Mycobacterium
PAQVGDADDGA

SEQ ID NO: 535838 - protein, 6 aa, Mycobacterium
PAQVPG

SEQ ID NO: 535839 - protein, 12 aa, Mycobacterium
PAQVQAAPEQPR

SEQ ID NO: 535840 - protein, 5 aa, Mycobacterium
PAQVS

SEQ ID NO: 535841 - protein, 18 aa, Mycobacterium
PAQVSTAKIKKTADSPPV

SEQ ID NO: 535842 - protein, 8 aa, Mycobacterium
PAQWSTRG

SEQ ID NO: 535843 - protein, 20 aa, Mycobacterium
PAQYRNRYPRELSGGQQQRV

SEQ ID NO: 535844 - protein, 5 aa, Mycobacterium
PARAD

SEQ ID NO: 535845 - protein, 7 aa, Mycobacterium
PARADVT

SEQ ID NO: 535846 - protein, 8 aa, Mycobacterium
PARAGAPT

SEQ ID NO: 535847 - protein, 10 aa, Mycobacterium
PARAGASGEL

SEQ ID NO: 535848 - protein, 8 aa, Mycobacterium
PARAGNAA

SEQ ID NO: 535849 - protein, 8 aa, Mycobacterium
PARAGSSF

SEQ ID NO: 535850 - protein, 7 aa, Mycobacterium
PARAGTQ

SEQ ID NO: 535851 - protein, 9 aa, Mycobacterium
PARALTGSR

SEQ ID NO: 535852 - protein, 5 aa, Mycobacterium
PARAP

SEQ ID NO: 535853 - protein, 9 aa, Mycobacterium
PARAPHGGE

SEQ ID NO: 535854 - protein, 10 aa, Mycobacterium
PARAPHGGES

SEQ ID NO: 535855 - protein, 7 aa, Mycobacterium
PARARPG

SEQ ID NO: 535856 - protein, 8 aa, Mycobacterium
PARATTAE

SEQ ID NO: 535857 - protein, 7 aa, Mycobacterium
PARDDYD

SEQ ID NO: 535858 - protein, 8 aa, Mycobacterium
PARDEGGR

SEQ ID NO: 535859 - protein, 7 aa, Mycobacterium
PARDGAR

SEQ ID NO: 535860 - protein, 9 aa, Mycobacterium
PARDGPGSP

SEQ ID NO: 535861 - protein, 20 aa, Mycobacterium
PARDGQVRHASDNRDEPARA

SEQ ID NO: 535862 - protein, 6 aa, Mycobacterium
PARDGR

SEQ ID NO: 535863 - protein, 5 aa, Mycobacterium
PARDK

SEQ ID NO: 535864 - protein, 5 aa, Mycobacterium
PARDP

SEQ ID NO: 535865 - protein, 8 aa, Mycobacterium
PARDPGPL

SEQ ID NO: 535866 - protein, 8 aa, Mycobacterium
PARDPGPM

SEQ ID NO: 535867 - protein, 5 aa, Mycobacterium
PARDS

SEQ ID NO: 535868 - protein, 6 aa, Mycobacterium
PAREAK

SEQ ID NO: 535869 - protein, 8 aa, Mycobacterium
PAREGETA

SEQ ID NO: 535870 - protein, 14 aa, Mycobacterium
PAREPAADSPTEIK

SEQ ID NO: 535871 - protein, 11 aa, Mycobacterium
PAREPGTGTGE

SEQ ID NO: 535872 - protein, 5 aa, Mycobacterium
PAREQ

SEQ ID NO: 535873 - protein, 5 aa, Mycobacterium
PARER

SEQ ID NO: 535874 - protein, 6 aa, Mycobacterium
PARERR

SEQ ID NO: 535875 - protein, 6 aa, Mycobacterium
PARESV

SEQ ID NO: 535876 - protein, 7 aa, Mycobacterium
PAREYTG

SEQ ID NO: 535877 - protein, 7 aa, Mycobacterium
PARFAGQ

SEQ ID NO: 535878 - protein, 19 aa, Mycobacterium
PARFAGSAYGPGNAMSFEK

SEQ ID NO: 535879 - protein, 7 aa, Mycobacterium
PARFTST

SEQ ID NO: 535880 - protein, 4 aa, Mycobacterium
PARG

SEQ ID NO: 535881 - protein, 5 aa, Mycobacterium
PARGA

SEQ ID NO: 535882 - protein, 22 aa, Mycobacterium
PARGDGQPIAPPGFSESETPRF

SEQ ID NO: 535883 - protein, 7 aa, Mycobacterium
PARGDYD

SEQ ID NO: 535884 - protein, 6 aa, Mycobacterium
PARGEN

SEQ ID NO: 535885 - protein, 6 aa, Mycobacterium
PARGGT

SEQ ID NO: 535886 - protein, 5 aa, Mycobacterium
PARGK

SEQ ID NO: 535887 - protein, 8 aa, Mycobacterium
PARGPGRP

SEQ ID NO: 535888 - protein, 16 aa, Mycobacterium
PARGTAYRQAVEARAT

SEQ ID NO: 535889 - protein, 8 aa, Mycobacterium
PARGTIGE

SEQ ID NO: 535890 - protein, 19 aa, Mycobacterium
PARGTTPRVEGLGGPDNPV

SEQ ID NO: 535891 - protein, 24 aa, Mycobacterium
PARGTTYAAADENADGRSASTIAG

SEQ ID NO: 535892 - protein, 13 aa, Mycobacterium
PARHADHDAPPLT

SEQ ID NO: 535893 - protein, 11 aa, Mycobacterium
PARHKDTEPGD

SEQ ID NO: 535894 - protein, 6 aa, Mycobacterium
PARHTG

SEQ ID NO: 535895 - protein, 4 aa, Mycobacterium
PARL

SEQ ID NO: 535896 - protein, 7 aa, Mycobacterium
PARLPEI

SEQ ID NO: 535897 - protein, 12 aa, Mycobacterium
PARLSAGQRTAD

SEQ ID NO: 535898 - protein, 4 aa, Mycobacterium
PARM

SEQ ID NO: 535899 - protein, 4 aa, Mycobacterium
PARN

SEQ ID NO: 535900 - protein, 8 aa, Mycobacterium
PARNAETL

SEQ ID NO: 535901 - protein, 8 aa, Mycobacterium
PARNGPWK

SEQ ID NO: 535902 - protein, 7 aa, Mycobacterium
PARNPGT

SEQ ID NO: 535903 - protein, 23 aa, Mycobacterium
PARNPWNPQHTPGGSSGGSGAAV

SEQ ID NO: 535904 - protein, 12 aa, Mycobacterium
PARNRKDRKEAA

SEQ ID NO: 535905 - protein, 7 aa, Mycobacterium
PARPDQR

SEQ ID NO: 535906 - protein, 5 aa, Mycobacterium
PARPG

SEQ ID NO: 535907 - protein, 6 aa, Mycobacterium
PARPLS

SEQ ID NO: 535908 - protein, 8 aa, Mycobacterium
PARPLSKM

SEQ ID NO: 535909 - protein, 7 aa, Mycobacterium
PARPNAD

SEQ ID NO: 535910 - protein, 8 aa, Mycobacterium
PARPNEPE

SEQ ID NO: 535911 - protein, 14 aa, Mycobacterium
PARPPARTGADRTS

SEQ ID NO: 535912 - protein, 24 aa, Mycobacterium
PARPPGPSASPSPPVPALPPSPIS

SEQ ID NO: 535913 - protein, 5 aa, Mycobacterium
PARPR

SEQ ID NO: 535914 - protein, 6 aa, Mycobacterium
PARPSL

SEQ ID NO: 535915 - protein, 7 aa, Mycobacterium
PARPSVA

SEQ ID NO: 535916 - protein, 9 aa, Mycobacterium
PARPTPTIG

SEQ ID NO: 535917 - protein, 6 aa, Mycobacterium
PARPVD

SEQ ID NO: 535918 - protein, 6 aa, Mycobacterium
PARPVG

SEQ ID NO: 535919 - protein, 8 aa, Mycobacterium
PARPVTDA

SEQ ID NO: 535920 - protein, 10 aa, Mycobacterium
PARQGAPVRR

SEQ ID NO: 535921 - protein, 7 aa, Mycobacterium
PARQGFR

SEQ ID NO: 535922 - protein, 6 aa, Mycobacterium
PARQGR

SEQ ID NO: 535923 - protein, 7 aa, Mycobacterium
PARQNDE

SEQ ID NO: 535924 - protein, 18 aa, Mycobacterium
PARQPEHCGAATAGTAQD

SEQ ID NO: 535925 - protein, 22 aa, Mycobacterium
PARQPSWDGNGNLASSPPGQRV

SEQ ID NO: 535926 - protein, 23 aa, Mycobacterium
PARQREWDGNENLAEAAAGQRAH

SEQ ID NO: 535927 - protein, 18 aa, Mycobacterium
PARQRTPVGDLSGGERRR

SEQ ID NO: 535928 - protein, 10 aa, Mycobacterium
PARQSVPSSG

SEQ ID NO: 535929 - protein, 12 aa, Mycobacterium
PARRAAITRSGV

SEQ ID NO: 535930 - protein, 27 aa, Mycobacterium
PARRERGVQRAGRHEGLPGPGRRREDH

SEQ ID NO: 535931 - protein, 11 aa, Mycobacterium
PARRGAEPEEV

SEQ ID NO: 535932 - protein, 9 aa, Mycobacterium
PARRGGGRR

SEQ ID NO: 535933 - protein, 5 aa, Mycobacterium
PARRL

SEQ ID NO: 535934 - protein, 6 aa, Mycobacterium
PARRLT

SEQ ID NO: 535935 - protein, 8 aa, Mycobacterium
PARRPGLG

SEQ ID NO: 535936 - protein, 11 aa, Mycobacterium
PARRPKGPNAL

SEQ ID NO: 535937 - protein, 10 aa, Mycobacterium
PARRPRGGID

SEQ ID NO: 535938 - protein, 14 aa, Mycobacterium
PARRQPPKTVPPLR

SEQ ID NO: 535939 - protein, 7 aa, Mycobacterium
PARRRPV

SEQ ID NO: 535940 - protein, 11 aa, Mycobacterium
PARRSAAPKVD

SEQ ID NO: 535941 - protein, 20 aa, Mycobacterium
PARRSGGVRAGAVPAGSPVP

SEQ ID NO: 535942 - protein, 51 aa, Mycobacterium
PARRTAPAPSGPAVRPGRGRRAAAPAAKRRPPRPSAGGTRCPGPAPPTAAG

SEQ ID NO: 535943 - protein, 7 aa, Mycobacterium
PARSALP

SEQ ID NO: 535944 - protein, 6 aa, Mycobacterium
PARSAQ

SEQ ID NO: 535945 - protein, 14 aa, Mycobacterium
PARSDGGTRRYSAD

SEQ ID NO: 535946 - protein, 13 aa, Mycobacterium
PARSEGGTRRYSA

SEQ ID NO: 535947 - protein, 7 aa, Mycobacterium
PARSEPY

SEQ ID NO: 535948 - protein, 9 aa, Mycobacterium
PARSGPLKT

SEQ ID NO: 535949 - protein, 8 aa, Mycobacterium
PARSGPWK

SEQ ID NO: 535950 - protein, 11 aa, Mycobacterium
PARSGSSAGPA

SEQ ID NO: 535951 - protein, 19 aa, Mycobacterium
PARSLDQQAQDVIDLLELR

SEQ ID NO: 535952 - protein, 12 aa, Mycobacterium
PARSQASASTKS

SEQ ID NO: 535953 - protein, 8 aa, Mycobacterium
PARSRDAH

SEQ ID NO: 535954 - protein, 14 aa, Mycobacterium
PARSSRCGESILTT

SEQ ID NO: 535955 - protein, 26 aa, Mycobacterium
PARSTRSRPGPRSPSGSPRTWCPRRS

SEQ ID NO: 535956 - protein, 14 aa, Mycobacterium
PARSVEPAATDAGG

SEQ ID NO: 535957 - protein, 13 aa, Mycobacterium
PARSVGGTPHAQS

SEQ ID NO: 535958 - protein, 7 aa, Mycobacterium
PARTAAE

SEQ ID NO: 535959 - protein, 6 aa, Mycobacterium
PARTAD

SEQ ID NO: 535960 - protein, 7 aa, Mycobacterium
PARTAGR

SEQ ID NO: 535961 - protein, 12 aa, Mycobacterium
PARTAKAAATRA

SEQ ID NO: 535962 - protein, 13 aa, Mycobacterium
PARTDAADPDPNA

SEQ ID NO: 535963 - protein, 14 aa, Mycobacterium
PARTGDKLTHSDQA

SEQ ID NO: 535964 - protein, 14 aa, Mycobacterium
PARTGEKLAHSEQA

SEQ ID NO: 535965 - protein, 8 aa, Mycobacterium
PARTGRPW

SEQ ID NO: 535966 - protein, 10 aa, Mycobacterium
PARTGRSTAE

SEQ ID NO: 535967 - protein, 9 aa, Mycobacterium
PARTTGGVT

SEQ ID NO: 535968 - protein, 5 aa, Mycobacterium
PARVD

SEQ ID NO: 535969 - protein, 31 aa, Mycobacterium
PARVGATPSLGEDDDESPWRRDESESEPALD

SEQ ID NO: 535970 - protein, 11 aa, Mycobacterium
PARVGTVQPEI

SEQ ID NO: 535971 - protein, 13 aa, Mycobacterium
PARVPRPTRAGEW

SEQ ID NO: 535972 - protein, 25 aa, Mycobacterium
PARVTGRNVPSDAKAPYDPERADHA

SEQ ID NO: 535973 - protein, 23 aa, Mycobacterium
PARVTGRNVPSEGKAPYDPERAD

SEQ ID NO: 535974 - protein, 24 aa, Mycobacterium
PARVTGRNVSSEAKAPYDPERADR

SEQ ID NO: 535975 - protein, 20 aa, Mycobacterium
PARYSEAVTASDVKPLGQPE

SEQ ID NO: 535976 - protein, 11 aa, Mycobacterium
PARYTANPSVA

SEQ ID NO: 535977 - protein, 103 aa, Mycobacterium
PASAAAAAAQNPAAGSAAAGAAAGAAAATPVGNNGNLQLGGGNTGDSNLGSGNIGNANLGSGNTGNANLGGGNIGNANLGSGNKGNINVGNGNFGSANFGDGN

SEQ ID NO: 535978 - protein, 27 aa, Mycobacterium
PASADGYAGAISTAQPSAREPVRDPLA

SEQ ID NO: 535979 - protein, 7 aa, Mycobacterium
PASAEDR

SEQ ID NO: 535980 - protein, 9 aa, Mycobacterium
PASAEGSGE

SEQ ID NO: 535981 - protein, 15 aa, Mycobacterium
PASAEPGKQTRQPGG

SEQ ID NO: 535982 - protein, 12 aa, Mycobacterium
PASAHTPGTPEW

SEQ ID NO: 535983 - protein, 7 aa, Mycobacterium
PASAIAT

SEQ ID NO: 535984 - protein, 9 aa, Mycobacterium
PASAKPRVR

SEQ ID NO: 535985 - protein, 9 aa, Mycobacterium
PASAPARGL

SEQ ID NO: 535986 - protein, 23 aa, Mycobacterium
PASAPASKHTTHPSTPQAAEAAP

SEQ ID NO: 535987 - protein, 20 aa, Mycobacterium
PASAPIEAPAAEAQVRADDR

SEQ ID NO: 535988 - protein, 8 aa, Mycobacterium
PASAQLPE

SEQ ID NO: 535989 - protein, 5 aa, Mycobacterium
PASAR

SEQ ID NO: 535990 - protein, 9 aa, Mycobacterium
PASARQPAV

SEQ ID NO: 535991 - protein, 5 aa, Mycobacterium
PASAS

SEQ ID NO: 535992 - protein, 10 aa, Mycobacterium
PASASDEADQ

SEQ ID NO: 535993 - protein, 7 aa, Mycobacterium
PASASMA

SEQ ID NO: 535994 - protein, 12 aa, Mycobacterium
PASATMAAASAP

SEQ ID NO: 535995 - protein, 16 aa, Mycobacterium
PASAWPGETGRLTGER

SEQ ID NO: 535996 - protein, 7 aa, Mycobacterium
PASAYHT

SEQ ID NO: 535997 - protein, 4 aa, Mycobacterium
PASD

SEQ ID NO: 535998 - protein, 11 aa, Mycobacterium
PASDADEERLA

SEQ ID NO: 535999 - protein, 8 aa, Mycobacterium
PASDDRCE

SEQ ID NO: 536000 - protein, 10 aa, Mycobacterium
PASDEEASRR

SEQ ID NO: 536001 - protein, 9 aa, Mycobacterium
PASDERSET

SEQ ID NO: 536002 - protein, 8 aa, Mycobacterium
PASDNWDT

SEQ ID NO: 536003 - protein, 7 aa, Mycobacterium
PASDPAY

SEQ ID NO: 536004 - protein, 9 aa, Mycobacterium
PASDQWDTG

SEQ ID NO: 536005 - protein, 10 aa, Mycobacterium
PASDQWDTGV

SEQ ID NO: 536006 - protein, 16 aa, Mycobacterium
PASDRDGSTAAPERSR

SEQ ID NO: 536007 - protein, 8 aa, Mycobacterium
PASDRNRF

SEQ ID NO: 536008 - protein, 4 aa, Mycobacterium
PASE

SEQ ID NO: 536009 - protein, 8 aa, Mycobacterium
PASEAETL

SEQ ID NO: 536010 - protein, 5 aa, Mycobacterium
PASEE

SEQ ID NO: 536011 - protein, 7 aa, Mycobacterium
PASEGVN

SEQ ID NO: 536012 - protein, 8 aa, Mycobacterium
PASEHPHG

SEQ ID NO: 536013 - protein, 10 aa, Mycobacterium
PASEPEPPTE

SEQ ID NO: 536014 - protein, 15 aa, Mycobacterium
PASEPRIQRGRRGPV

SEQ ID NO: 536015 - protein, 8 aa, Mycobacterium
PASERQRV

SEQ ID NO: 536016 - protein, 7 aa, Mycobacterium
PASESMA

SEQ ID NO: 536017 - protein, 10 aa, Mycobacterium
PASESMAAKA

SEQ ID NO: 536018 - protein, 11 aa, Mycobacterium
PASFDTPGRAG

SEQ ID NO: 536019 - protein, 14 aa, Mycobacterium
PASFRRGRASRRGR

SEQ ID NO: 536020 - protein, 9 aa, Mycobacterium
PASGAFDPD

SEQ ID NO: 536021 - protein, 15 aa, Mycobacterium
PASGAHPYRRDEPPL

SEQ ID NO: 536022 - protein, 12 aa, Mycobacterium
PASGAPARSSWE

SEQ ID NO: 536023 - protein, 10 aa, Mycobacterium
PASGDGTGQR

SEQ ID NO: 536024 - protein, 11 aa, Mycobacterium
PASGDSGTALG

SEQ ID NO: 536025 - protein, 9 aa, Mycobacterium
PASGEARSL

SEQ ID NO: 536026 - protein, 5 aa, Mycobacterium
PASGG

SEQ ID NO: 536027 - protein, 10 aa, Mycobacterium
PASGGGNGAR

SEQ ID NO: 536028 - protein, 14 aa, Mycobacterium
PASGGNGGNATTTV

SEQ ID NO: 536029 - protein, 8 aa, Mycobacterium
PASGKSTI

SEQ ID NO: 536030 - protein, 8 aa, Mycobacterium
PASGKTTL

SEQ ID NO: 536031 - protein, 5 aa, Mycobacterium
PASGL

SEQ ID NO: 536032 - protein, 8 aa, Mycobacterium
PASGPGTI

SEQ ID NO: 536033 - protein, 9 aa, Mycobacterium
PASGPGTIA

SEQ ID NO: 536034 - protein, 15 aa, Mycobacterium
PASGPGTIAGLPARS

SEQ ID NO: 536035 - protein, 33 aa, Mycobacterium
PASGPPTGRSLAGTATPPNRESGAAADAIASAE

SEQ ID NO: 536036 - protein, 5 aa, Mycobacterium
PASGQ

SEQ ID NO: 536037 - protein, 5 aa, Mycobacterium
PASGR

SEQ ID NO: 536038 - protein, 22 aa, Mycobacterium
PASGRLTGADTGPGRLPEAEEI

SEQ ID NO: 536039 - protein, 5 aa, Mycobacterium
PASGS

SEQ ID NO: 536040 - protein, 11 aa, Mycobacterium
PASGSGKTTVA

SEQ ID NO: 536041 - protein, 12 aa, Mycobacterium
PASGSGKTTVAT

SEQ ID NO: 536042 - protein, 10 aa, Mycobacterium
PASGSGTGAQ

SEQ ID NO: 536043 - protein, 8 aa, Mycobacterium
PASGTTKA

SEQ ID NO: 536044 - protein, 11 aa, Mycobacterium
PASHGGDPADA

SEQ ID NO: 536045 - protein, 4 aa, Mycobacterium
PASI

SEQ ID NO: 536046 - protein, 13 aa, Mycobacterium
PASIESESPVSGH

SEQ ID NO: 536047 - protein, 13 aa, Mycobacterium
PASKADSTWTTTG

SEQ ID NO: 536048 - protein, 5 aa, Mycobacterium
PASKT

SEQ ID NO: 536049 - protein, 10 aa, Mycobacterium
PASLTDPSEM

SEQ ID NO: 536050 - protein, 7 aa, Mycobacterium
PASLTPA

SEQ ID NO: 536051 - protein, 15 aa, Mycobacterium
PASMGKPKFPTPRGT

SEQ ID NO: 536052 - protein, 6 aa, Mycobacterium
PASMPT

SEQ ID NO: 536053 - protein, 6 aa, Mycobacterium
PASMTP

SEQ ID NO: 536054 - protein, 9 aa, Mycobacterium
PASNAVTGN

SEQ ID NO: 536055 - protein, 18 aa, Mycobacterium
PASNTRTDEYGGSFSGRA

SEQ ID NO: 536056 - protein, 4 aa, Mycobacterium
PASP

SEQ ID NO: 536057 - protein, 5 aa, Mycobacterium
PASPA

SEQ ID NO: 536058 - protein, 9 aa, Mycobacterium
PASPAPPAE

SEQ ID NO: 536059 - protein, 11 aa, Mycobacterium
PASPDAQDSLP

SEQ ID NO: 536060 - protein, 8 aa, Mycobacterium
PASPDFPT

SEQ ID NO: 536061 - protein, 8 aa, Mycobacterium
PASPDPEG

SEQ ID NO: 536062 - protein, 6 aa, Mycobacterium
PASPEA

SEQ ID NO: 536063 - protein, 7 aa, Mycobacterium
PASPEFS

SEQ ID NO: 536064 - protein, 9 aa, Mycobacterium
PASPETREA

SEQ ID NO: 536065 - protein, 8 aa, Mycobacterium
PASPGADD

SEQ ID NO: 536066 - protein, 7 aa, Mycobacterium
PASPGPH

SEQ ID NO: 536067 - protein, 12 aa, Mycobacterium
PASPGWPSMSAN

SEQ ID NO: 536068 - protein, 12 aa, Mycobacterium
PASPGWPSTSAN

SEQ ID NO: 536069 - protein, 9 aa, Mycobacterium
PASPLRSTG

SEQ ID NO: 536070 - protein, 6 aa, Mycobacterium
PASPPG

SEQ ID NO: 536071 - protein, 16 aa, Mycobacterium
PASPPSAEEVLNLATS

SEQ ID NO: 536072 - protein, 7 aa, Mycobacterium
PASPQRD

SEQ ID NO: 536073 - protein, 8 aa, Mycobacterium
PASPRGVR

SEQ ID NO: 536074 - protein, 16 aa, Mycobacterium
PASPRLRSPQEGTATL

SEQ ID NO: 536075 - protein, 10 aa, Mycobacterium
PASPSRPNRR

SEQ ID NO: 536076 - protein, 14 aa, Mycobacterium
PASPTDVLGEPGDG

SEQ ID NO: 536077 - protein, 17 aa, Mycobacterium
PASPTLTYPPATPEDLS

SEQ ID NO: 536078 - protein, 13 aa, Mycobacterium
PASPTPPAEGSLR

SEQ ID NO: 536079 - protein, 5 aa, Mycobacterium
PASQQ

SEQ ID NO: 536080 - protein, 10 aa, Mycobacterium
PASQSSDGAF

SEQ ID NO: 536081 - protein, 19 aa, Mycobacterium
PASRAYYQRKRNQGKRPIP

SEQ ID NO: 536082 - protein, 8 aa, Mycobacterium
PASRERDL

SEQ ID NO: 536083 - protein, 14 aa, Mycobacterium
PASRETPYPGGGEL

SEQ ID NO: 536084 - protein, 7 aa, Mycobacterium
PASRPAA

SEQ ID NO: 536085 - protein, 9 aa, Mycobacterium
PASRPADIA

SEQ ID NO: 536086 - protein, 9 aa, Mycobacterium
PASRPASIA

SEQ ID NO: 536087 - protein, 9 aa, Mycobacterium
PASRPATVR

SEQ ID NO: 536088 - protein, 10 aa, Mycobacterium
PASRPPGRAT

SEQ ID NO: 536089 - protein, 8 aa, Mycobacterium
PASRPREL

SEQ ID NO: 536090 - protein, 7 aa, Mycobacterium
PASRTRT

SEQ ID NO: 536091 - protein, 68 aa, Mycobacterium
PASSGGAASGSMKAGSGGFSGGGFGGGSGGGHGGGFGGGHGGGGGGGHSVPDGSYSNTGAPSLRPSGP

SEQ ID NO: 536092 - protein, 9 aa, Mycobacterium
PASSLRGES

SEQ ID NO: 536093 - protein, 8 aa, Mycobacterium
PASSPGAR

SEQ ID NO: 536094 - protein, 6 aa, Mycobacterium
PASSRD

SEQ ID NO: 536095 - protein, 5 aa, Mycobacterium
PASST

SEQ ID NO: 536096 - protein, 7 aa, Mycobacterium
PASTGKT

SEQ ID NO: 536097 - protein, 21 aa, Mycobacterium
PASTHQTNRENDTFPLTDYTF

SEQ ID NO: 536098 - protein, 8 aa, Mycobacterium
PASTIADA

SEQ ID NO: 536099 - protein, 9 aa, Mycobacterium
PASTKTTVT

SEQ ID NO: 536100 - protein, 7 aa, Mycobacterium
PASTPDA

SEQ ID NO: 536101 - protein, 8 aa, Mycobacterium
PASTPELK

SEQ ID NO: 536102 - protein, 9 aa, Mycobacterium
PASTQMANA

SEQ ID NO: 536103 - protein, 10 aa, Mycobacterium
PASTSGDAEA

SEQ ID NO: 536104 - protein, 20 aa, Mycobacterium
PASTVGGTVARQTGAAQAAG

SEQ ID NO: 536105 - protein, 31 aa, Mycobacterium
PASVAAPEDNVSSDAASDTAEDTAEDEANKG

SEQ ID NO: 536106 - protein, 11 aa, Mycobacterium
PASVAEDFTRP

SEQ ID NO: 536107 - protein, 10 aa, Mycobacterium
PASVDAADRE

SEQ ID NO: 536108 - protein, 8 aa, Mycobacterium
PASVDSDA

SEQ ID NO: 536109 - protein, 5 aa, Mycobacterium
PASVE

SEQ ID NO: 536110 - protein, 5 aa, Mycobacterium
PASVG

SEQ ID NO: 536111 - protein, 8 aa, Mycobacterium
PASVPSKA

SEQ ID NO: 536112 - protein, 10 aa, Mycobacterium
PASWDRPSDL

SEQ ID NO: 536113 - protein, 5 aa, Mycobacterium
PASYD

SEQ ID NO: 536114 - protein, 10 aa, Mycobacterium
PASYGAGGLG

SEQ ID NO: 536115 - protein, 7 aa, Mycobacterium
PASYKRG

SEQ ID NO: 536116 - protein, 5 aa, Mycobacterium
PASYT

SEQ ID NO: 536117 - protein, 9 aa, Mycobacterium
PATAAGERL

SEQ ID NO: 536118 - protein, 10 aa, Mycobacterium
PATAAGERLE

SEQ ID NO: 536119 - protein, 14 aa, Mycobacterium
PATAAGQLAPRQKR

SEQ ID NO: 536120 - protein, 10 aa, Mycobacterium
PATAANDRLE

SEQ ID NO: 536121 - protein, 31 aa, Mycobacterium
PATAAVTSAPPGAGWTATPPSAMTGSGPAGL

SEQ ID NO: 536122 - protein, 7 aa, Mycobacterium
PATADTR

SEQ ID NO: 536123 - protein, 5 aa, Mycobacterium
PATAG

SEQ ID NO: 536124 - protein, 13 aa, Mycobacterium
PATAGAGETPPHE

SEQ ID NO: 536125 - protein, 6 aa, Mycobacterium
PATAHD

SEQ ID NO: 536126 - protein, 13 aa, Mycobacterium
PATAQSMPTSSTP

SEQ ID NO: 536127 - protein, 5 aa, Mycobacterium
PATAR

SEQ ID NO: 536128 - protein, 14 aa, Mycobacterium
PATARATAAATTPE

SEQ ID NO: 536129 - protein, 12 aa, Mycobacterium
PATARATAAAVT

SEQ ID NO: 536130 - protein, 7 aa, Mycobacterium
PATATRE

SEQ ID NO: 536131 - protein, 14 aa, Mycobacterium
PATAWGSSGDTTLQ

SEQ ID NO: 536132 - protein, 5 aa, Mycobacterium
PATCA

SEQ ID NO: 536133 - protein, 10 aa, Mycobacterium
PATDGPASVA

SEQ ID NO: 536134 - protein, 5 aa, Mycobacterium
PATDL

SEQ ID NO: 536135 - protein, 5 aa, Mycobacterium
PATDP

SEQ ID NO: 536136 - protein, 6 aa, Mycobacterium
PATDPG

SEQ ID NO: 536137 - protein, 8 aa, Mycobacterium
PATDPSVR

SEQ ID NO: 536138 - protein, 7 aa, Mycobacterium
PATDQWA

SEQ ID NO: 536139 - protein, 5 aa, Mycobacterium
PATDR

SEQ ID NO: 536140 - protein, 11 aa, Mycobacterium
PATDRTLTTHD

SEQ ID NO: 536141 - protein, 19 aa, Mycobacterium
PATDSGDAVRTKTTPTDPV

SEQ ID NO: 536142 - protein, 13 aa, Mycobacterium
PATDSLTESTSRE

SEQ ID NO: 536143 - protein, 6 aa, Mycobacterium
PATDTA

SEQ ID NO: 536144 - protein, 12 aa, Mycobacterium
PATDTSPATTKA

SEQ ID NO: 536145 - protein, 4 aa, Mycobacterium
PATE

SEQ ID NO: 536146 - protein, 16 aa, Mycobacterium
PATEAETIVRTAAEEL

SEQ ID NO: 536147 - protein, 21 aa, Mycobacterium
PATEEAIGSVPEAGLKATRAA

SEQ ID NO: 536148 - protein, 17 aa, Mycobacterium
PATEENLGEVSDASKAD

SEQ ID NO: 536149 - protein, 18 aa, Mycobacterium
PATEGTHRHGVGYLCSAR

SEQ ID NO: 536150 - protein, 7 aa, Mycobacterium
PATEIDT

SEQ ID NO: 536151 - protein, 5 aa, Mycobacterium
PATEP

SEQ ID NO: 536152 - protein, 6 aa, Mycobacterium
PATEPL

SEQ ID NO: 536153 - protein, 6 aa, Mycobacterium
PATEQA

SEQ ID NO: 536154 - protein, 18 aa, Mycobacterium
PATERGMNADRLRAALGL

SEQ ID NO: 536155 - protein, 10 aa, Mycobacterium
PATESATDAG

SEQ ID NO: 536156 - protein, 11 aa, Mycobacterium
PATETGGAAGA

SEQ ID NO: 536157 - protein, 8 aa, Mycobacterium
PATETGQR

SEQ ID NO: 536158 - protein, 11 aa, Mycobacterium
PATETGRRGTR

SEQ ID NO: 536159 - protein, 7 aa, Mycobacterium
PATETLE

SEQ ID NO: 536160 - protein, 9 aa, Mycobacterium
PATETQAVD

SEQ ID NO: 536161 - protein, 7 aa, Mycobacterium
PATETTA

SEQ ID NO: 536162 - protein, 4 aa, Mycobacterium
PATF

SEQ ID NO: 536163 - protein, 6 aa, Mycobacterium
PATFSP

SEQ ID NO: 536164 - protein, 27 aa, Mycobacterium
PATGAPRPPSPRGSGGVADFAAYRRRR

SEQ ID NO: 536165 - protein, 7 aa, Mycobacterium
PATGARI

SEQ ID NO: 536166 - protein, 12 aa, Mycobacterium
PATGAVTGEPDV

SEQ ID NO: 536167 - protein, 6 aa, Mycobacterium
PATGDA

SEQ ID NO: 536168 - protein, 13 aa, Mycobacterium
PATGDVVGQAPEC

SEQ ID NO: 536169 - protein, 7 aa, Mycobacterium
PATGECR

SEQ ID NO: 536170 - protein, 8 aa, Mycobacterium
PATGEFSP

SEQ ID NO: 536171 - protein, 18 aa, Mycobacterium
PATGEKVGQAPLATKADV

SEQ ID NO: 536172 - protein, 12 aa, Mycobacterium
PATGFGSYDTPV

SEQ ID NO: 536173 - protein, 9 aa, Mycobacterium
PATGGERSI

SEQ ID NO: 536174 - protein, 44 aa, Mycobacterium
PATGGNQTGSAGIGVGAGSAGNAAPTRVPEAAAPPAAEVEAAAP

SEQ ID NO: 536175 - protein, 10 aa, Mycobacterium
PATGKSVSEY

SEQ ID NO: 536176 - protein, 6 aa, Mycobacterium
PATGLD

SEQ ID NO: 536177 - protein, 5 aa, Mycobacterium
PATGM

SEQ ID NO: 536178 - protein, 7 aa, Mycobacterium
PATGQKV

SEQ ID NO: 536179 - protein, 6 aa, Mycobacterium
PATGRG

SEQ ID NO: 536180 - protein, 8 aa, Mycobacterium
PATGRGCA

SEQ ID NO: 536181 - protein, 13 aa, Mycobacterium
PATGSVNKSGAEL

SEQ ID NO: 536182 - protein, 10 aa, Mycobacterium
PATGTMDPET

SEQ ID NO: 536183 - protein, 8 aa, Mycobacterium
PATGTTKA

SEQ ID NO: 536184 - protein, 9 aa, Mycobacterium
PATHPNRDK

SEQ ID NO: 536185 - protein, 6 aa, Mycobacterium
PATIAA

SEQ ID NO: 536186 - protein, 8 aa, Mycobacterium
PATIRTET

SEQ ID NO: 536187 - protein, 13 aa, Mycobacterium
PATISYRNDGTGI

SEQ ID NO: 536188 - protein, 12 aa, Mycobacterium
PATKAALGDHDE

SEQ ID NO: 536189 - protein, 9 aa, Mycobacterium
PATKADLGE

SEQ ID NO: 536190 - protein, 11 aa, Mycobacterium
PATKGPSTEIE

SEQ ID NO: 536191 - protein, 7 aa, Mycobacterium
PATLPES

SEQ ID NO: 536192 - protein, 7 aa, Mycobacterium
PATLPGG

SEQ ID NO: 536193 - protein, 8 aa, Mycobacterium
PATLPSPP

SEQ ID NO: 536194 - protein, 14 aa, Mycobacterium
PATLSGTSAVRNSG

SEQ ID NO: 536195 - protein, 4 aa, Mycobacterium
PATM

SEQ ID NO: 536196 - protein, 4 aa, Mycobacterium
PATN

SEQ ID NO: 536197 - protein, 20 aa, Mycobacterium
PATNGPSGIRPNAPDPTGTV

SEQ ID NO: 536198 - protein, 18 aa, Mycobacterium
PATNLRDDEYGGSLEDRS

SEQ ID NO: 536199 - protein, 5 aa, Mycobacterium
PATNT

SEQ ID NO: 536200 - protein, 4 aa, Mycobacterium
PATP

SEQ ID NO: 536201 - protein, 9 aa, Mycobacterium
PATPARRSG

SEQ ID NO: 536202 - protein, 6 aa, Mycobacterium
PATPAT

SEQ ID NO: 536203 - protein, 10 aa, Mycobacterium
PATPDDPARF

SEQ ID NO: 536204 - protein, 7 aa, Mycobacterium
PATPEPV

SEQ ID NO: 536205 - protein, 18 aa, Mycobacterium
PATPGVPTASGCGDDCLP

SEQ ID NO: 536206 - protein, 7 aa, Mycobacterium
PATPNIE

SEQ ID NO: 536207 - protein, 7 aa, Mycobacterium
PATPPNI

SEQ ID NO: 536208 - protein, 6 aa, Mycobacterium
PATPRD

SEQ ID NO: 536209 - protein, 8 aa, Mycobacterium
PATPVPGV

SEQ ID NO: 536210 - protein, 18 aa, Mycobacterium
PATPVPVTTGSGSRSAVD

SEQ ID NO: 536211 - protein, 6 aa, Mycobacterium
PATQET

SEQ ID NO: 536212 - protein, 8 aa, Mycobacterium
PATQLERD

SEQ ID NO: 536213 - protein, 7 aa, Mycobacterium
PATQNLD

SEQ ID NO: 536214 - protein, 7 aa, Mycobacterium
PATQQDD

SEQ ID NO: 536215 - protein, 21 aa, Mycobacterium
PATQSGAGSVTPLATDSTPAA

SEQ ID NO: 536216 - protein, 7 aa, Mycobacterium
PATQTPL

SEQ ID NO: 536217 - protein, 5 aa, Mycobacterium
PATQV

SEQ ID NO: 536218 - protein, 4 aa, Mycobacterium
PATR

SEQ ID NO: 536219 - protein, 10 aa, Mycobacterium
PATRAAAADV

SEQ ID NO: 536220 - protein, 9 aa, Mycobacterium
PATRADPYP

SEQ ID NO: 536221 - protein, 11 aa, Mycobacterium
PATRATTAEEL

SEQ ID NO: 536222 - protein, 12 aa, Mycobacterium
PATRDETDDGHE

SEQ ID NO: 536223 - protein, 16 aa, Mycobacterium
PATRHGVEPRENGSRA

SEQ ID NO: 536224 - protein, 19 aa, Mycobacterium
PATRKRSPGWRRDSSGRRL

SEQ ID NO: 536225 - protein, 19 aa, Mycobacterium
PATRNVTAEGYADAAKRAA

SEQ ID NO: 536226 - protein, 6 aa, Mycobacterium
PATRNY

SEQ ID NO: 536227 - protein, 13 aa, Mycobacterium
PATRPATKDAPAI

SEQ ID NO: 536228 - protein, 7 aa, Mycobacterium
PATRPLQ

SEQ ID NO: 536229 - protein, 7 aa, Mycobacterium
PATRPMD

SEQ ID NO: 536230 - protein, 10 aa, Mycobacterium
PATRQVTNTQ

SEQ ID NO: 536231 - protein, 25 aa, Mycobacterium
PATRRALPAPRVGGPSEPARTDTEK

SEQ ID NO: 536232 - protein, 13 aa, Mycobacterium
PATRSRFSAAARR

SEQ ID NO: 536233 - protein, 18 aa, Mycobacterium
PATSAGASSSGLLSRPSV

SEQ ID NO: 536234 - protein, 6 aa, Mycobacterium
PATSAV

SEQ ID NO: 536235 - protein, 9 aa, Mycobacterium
PATSDGAGD

SEQ ID NO: 536236 - protein, 18 aa, Mycobacterium
PATSFEEISGGDQATADR

SEQ ID NO: 536237 - protein, 10 aa, Mycobacterium
PATSGLPTTG

SEQ ID NO: 536238 - protein, 8 aa, Mycobacterium
PATSGPYE

SEQ ID NO: 536239 - protein, 5 aa, Mycobacterium
PATSP

SEQ ID NO: 536240 - protein, 21 aa, Mycobacterium
PATSPQMVSSPAKTPKARTGF

SEQ ID NO: 536241 - protein, 6 aa, Mycobacterium
PATSRS

SEQ ID NO: 536242 - protein, 28 aa, Mycobacterium
PATSSSTASSSTTVEPPPSTSTSSVTVT

SEQ ID NO: 536243 - protein, 7 aa, Mycobacterium
PATTAAG

SEQ ID NO: 536244 - protein, 6 aa, Mycobacterium
PATTAF

SEQ ID NO: 536245 - protein, 8 aa, Mycobacterium
PATTDEDI

SEQ ID NO: 536246 - protein, 19 aa, Mycobacterium
PATTDFPRAADGISDAGSH

SEQ ID NO: 536247 - protein, 6 aa, Mycobacterium
PATTGH

SEQ ID NO: 536248 - protein, 5 aa, Mycobacterium
PATTI

SEQ ID NO: 536249 - protein, 8 aa, Mycobacterium
PATTPART

SEQ ID NO: 536250 - protein, 9 aa, Mycobacterium
PATTPDDET

SEQ ID NO: 536251 - protein, 14 aa, Mycobacterium
PATTPDGPDPVRAT

SEQ ID NO: 536252 - protein, 8 aa, Mycobacterium
PATTPGVA

SEQ ID NO: 536253 - protein, 15 aa, Mycobacterium
PATTTHRAMGPEGRA

SEQ ID NO: 536254 - protein, 5 aa, Mycobacterium
PATTY

SEQ ID NO: 536255 - protein, 7 aa, Mycobacterium
PATVATS

SEQ ID NO: 536256 - protein, 5 aa, Mycobacterium
PATVG

SEQ ID NO: 536257 - protein, 6 aa, Mycobacterium
PATVSE

SEQ ID NO: 536258 - protein, 7 aa, Mycobacterium
PATVTAA

SEQ ID NO: 536259 - protein, 18 aa, Mycobacterium
PATVTAEEGARRPRVAAP

SEQ ID NO: 536260 - protein, 4 aa, Mycobacterium
PATW

SEQ ID NO: 536261 - protein, 11 aa, Mycobacterium
PATWDGLPGSA

SEQ ID NO: 536262 - protein, 5 aa, Mycobacterium
PAVAA

SEQ ID NO: 536263 - protein, 17 aa, Mycobacterium
PAVAAQPSTALPAPAAD

SEQ ID NO: 536264 - protein, 7 aa, Mycobacterium
PAVAEEA

SEQ ID NO: 536265 - protein, 8 aa, Mycobacterium
PAVAPGQE

SEQ ID NO: 536266 - protein, 8 aa, Mycobacterium
PAVAQDPY

SEQ ID NO: 536267 - protein, 7 aa, Mycobacterium
PAVASGS

SEQ ID NO: 536268 - protein, 15 aa, Mycobacterium
PAVASRPGDLQARSD

SEQ ID NO: 536269 - protein, 19 aa, Mycobacterium
PAVASSDARNIETTISRDG

SEQ ID NO: 536270 - protein, 7 aa, Mycobacterium
PAVATGR

SEQ ID NO: 536271 - protein, 7 aa, Mycobacterium
PAVCPGT

SEQ ID NO: 536272 - protein, 5 aa, Mycobacterium
PAVDA

SEQ ID NO: 536273 - protein, 9 aa, Mycobacterium
PAVDDNGRL

SEQ ID NO: 536274 - protein, 14 aa, Mycobacterium
PAVDGPPAQRDPKV

SEQ ID NO: 536275 - protein, 25 aa, Mycobacterium
PAVDGRGGGKADTAQGSGKDPAGID

SEQ ID NO: 536276 - protein, 5 aa, Mycobacterium
PAVDP

SEQ ID NO: 536277 - protein, 11 aa, Mycobacterium
PAVDPGVVTGP

SEQ ID NO: 536278 - protein, 18 aa, Mycobacterium
PAVDSQPSTALPNPAPEN

SEQ ID NO: 536279 - protein, 4 aa, Mycobacterium
PAVE

SEQ ID NO: 536280 - protein, 5 aa, Mycobacterium
PAVEE

SEQ ID NO: 536281 - protein, 5 aa, Mycobacterium
PAVEG

SEQ ID NO: 536282 - protein, 16 aa, Mycobacterium
PAVESAPKRKRNKEVV

SEQ ID NO: 536283 - protein, 8 aa, Mycobacterium
PAVGAPLD

SEQ ID NO: 536284 - protein, 6 aa, Mycobacterium
PAVGEN

SEQ ID NO: 536285 - protein, 18 aa, Mycobacterium
PAVGEQPSTALPGPAPEN

SEQ ID NO: 536286 - protein, 11 aa, Mycobacterium
PAVGGKANEAV

SEQ ID NO: 536287 - protein, 6 aa, Mycobacterium
PAVGKP

SEQ ID NO: 536288 - protein, 8 aa, Mycobacterium
PAVGNAES

SEQ ID NO: 536289 - protein, 9 aa, Mycobacterium
PAVGSPAPA

SEQ ID NO: 536290 - protein, 12 aa, Mycobacterium
PAVGSSAPGFTL

SEQ ID NO: 536291 - protein, 17 aa, Mycobacterium
PAVGTPATTEPVEDPRR

SEQ ID NO: 536292 - protein, 9 aa, Mycobacterium
PAVHGGEHA

SEQ ID NO: 536293 - protein, 17 aa, Mycobacterium
PAVLPDPRSPRQPDGVH

SEQ ID NO: 536294 - protein, 5 aa, Mycobacterium
PAVPA

SEQ ID NO: 536295 - protein, 8 aa, Mycobacterium
PAVPAAAT

SEQ ID NO: 536296 - protein, 20 aa, Mycobacterium
PAVPAGAAEAATGAAGAAHP

SEQ ID NO: 536297 - protein, 6 aa, Mycobacterium
PAVPAK

SEQ ID NO: 536298 - protein, 19 aa, Mycobacterium
PAVPASGRALPAKVTAKGK

SEQ ID NO: 536299 - protein, 19 aa, Mycobacterium
PAVPDGVDPATVPKPLAPD

SEQ ID NO: 536300 - protein, 8 aa, Mycobacterium
PAVPDPAR

SEQ ID NO: 536301 - protein, 14 aa, Mycobacterium
PAVPDRVGLCRRNI

SEQ ID NO: 536302 - protein, 7 aa, Mycobacterium
PAVPEQE

SEQ ID NO: 536303 - protein, 17 aa, Mycobacterium
PAVPPPPAVQSGPDTSL

SEQ ID NO: 536304 - protein, 10 aa, Mycobacterium
PAVPSEDPLG

SEQ ID NO: 536305 - protein, 4 aa, Mycobacterium
PAVQ

SEQ ID NO: 536306 - protein, 6 aa, Mycobacterium
PAVQEQ

SEQ ID NO: 536307 - protein, 4 aa, Mycobacterium
PAVR

SEQ ID NO: 536308 - protein, 7 aa, Mycobacterium
PAVRSPK

SEQ ID NO: 536309 - protein, 5 aa, Mycobacterium
PAVRT

SEQ ID NO: 536310 - protein, 5 aa, Mycobacterium
PAVSA

SEQ ID NO: 536311 - protein, 7 aa, Mycobacterium
PAVSAKK

SEQ ID NO: 536312 - protein, 19 aa, Mycobacterium
PAVSAKKVKSAQTDSDREI

SEQ ID NO: 536313 - protein, 13 aa, Mycobacterium
PAVSAQNDTTLPV

SEQ ID NO: 536314 - protein, 6 aa, Mycobacterium
PAVSDD

SEQ ID NO: 536315 - protein, 18 aa, Mycobacterium
PAVSGGVQAYGSRGTRAD

SEQ ID NO: 536316 - protein, 18 aa, Mycobacterium
PAVSGPVNLTGPAPVTNA

SEQ ID NO: 536317 - protein, 9 aa, Mycobacterium
PAVSSESGT

SEQ ID NO: 536318 - protein, 17 aa, Mycobacterium
PAVTAQPETPLAPPAAD

SEQ ID NO: 536319 - protein, 12 aa, Mycobacterium
PAVTDEDAGVAA

SEQ ID NO: 536320 - protein, 8 aa, Mycobacterium
PAVTDGYR

SEQ ID NO: 536321 - protein, 7 aa, Mycobacterium
PAVTEES

SEQ ID NO: 536322 - protein, 6 aa, Mycobacterium
PAVTGD

SEQ ID NO: 536323 - protein, 16 aa, Mycobacterium
PAVTGKPSGDDLRSGK

SEQ ID NO: 536324 - protein, 5 aa, Mycobacterium
PAVTP

SEQ ID NO: 536325 - protein, 10 aa, Mycobacterium
PAVTPESTAM

SEQ ID NO: 536326 - protein, 6 aa, Mycobacterium
PAVTPG

SEQ ID NO: 536327 - protein, 4 aa, Mycobacterium
PAWP

SEQ ID NO: 536328 - protein, 9 aa, Mycobacterium
PAWPQTSPE

SEQ ID NO: 536329 - protein, 11 aa, Mycobacterium
PAYAPGKTVPG

SEQ ID NO: 536330 - protein, 8 aa, Mycobacterium
PAYATSSG

SEQ ID NO: 536331 - protein, 15 aa, Mycobacterium
PAYDGPAGTRTDQDV

SEQ ID NO: 536332 - protein, 10 aa, Mycobacterium
PAYDSGDVTA

SEQ ID NO: 536333 - protein, 7 aa, Mycobacterium
PAYGARP

SEQ ID NO: 536334 - protein, 18 aa, Mycobacterium
PAYGPGDVTATPPPPGEF

SEQ ID NO: 536335 - protein, 18 aa, Mycobacterium
PAYGYEPGSEAHSAQGAT

SEQ ID NO: 536336 - protein, 21 aa, Mycobacterium
PAYNSGGPWGYTPKGGTGVPT

SEQ ID NO: 536337 - protein, 21 aa, Mycobacterium
PAYNTGGPWGYTPKGGTGVPA

SEQ ID NO: 536338 - protein, 22 aa, Mycobacterium
PAYNTGSAWGYTPKGATGVPTR

SEQ ID NO: 536339 - protein, 6 aa, Mycobacterium
PAYPQD

SEQ ID NO: 536340 - protein, 5 aa, Mycobacterium
PAYQA

SEQ ID NO: 536341 - protein, 12 aa, Mycobacterium
PAYQDSTGAGAL

SEQ ID NO: 536342 - protein, 7 aa, Mycobacterium
PAYQGRG

SEQ ID NO: 536343 - protein, 8 aa, Mycobacterium
PAYQGRGI

SEQ ID NO: 536344 - protein, 9 aa, Mycobacterium
PAYQKQGLG

SEQ ID NO: 536345 - protein, 20 aa, Mycobacterium
PAYQPGSDPVRTRTELEDAF

SEQ ID NO: 536346 - protein, 6 aa, Mycobacterium
PAYRAE

SEQ ID NO: 536347 - protein, 10 aa, Mycobacterium
PAYRDPRGPA

SEQ ID NO: 536348 - protein, 7 aa, Mycobacterium
PAYRGPD

SEQ ID NO: 536349 - protein, 7 aa, Mycobacterium
PAYRPEA

SEQ ID NO: 536350 - protein, 4 aa, Mycobacterium
PAYS

SEQ ID NO: 536351 - protein, 8 aa, Mycobacterium
PAYSSSKA

SEQ ID NO: 536352 - protein, 6 aa, Mycobacterium
PAYTAP

SEQ ID NO: 536353 - protein, 5 aa, Mycobacterium
PAYTP

SEQ ID NO: 536354 - protein, 8 aa, Mycobacterium
PAYTPAGL

SEQ ID NO: 536355 - protein, 15 aa, Mycobacterium
PAYTPAGLAAATDAT

SEQ ID NO: 536356 - protein, 11 aa, Mycobacterium
PAYTPGRNVPG

SEQ ID NO: 536357 - protein, 10 aa, Mycobacterium
PAYTPGRTVP

SEQ ID NO: 536358 - protein, 7 aa, Mycobacterium
PAYTSQR

SEQ ID NO: 536359 - protein, 32 aa, Mycobacterium
PCAATESGIAGHDDQITDYSPDGVRERAEAAR

SEQ ID NO: 536360 - protein, 13 aa, Mycobacterium
PCAGASDGGGSIR

SEQ ID NO: 536361 - protein, 11 aa, Mycobacterium
PCAGRDSDHVP

SEQ ID NO: 536362 - protein, 15 aa, Mycobacterium
PCANRDPGHLDSPSF

SEQ ID NO: 536363 - protein, 8 aa, Mycobacterium
PCAPADPA

SEQ ID NO: 536364 - protein, 10 aa, Mycobacterium
PCAPANPRDC

SEQ ID NO: 536365 - protein, 14 aa, Mycobacterium
PCAPGRGTATAKAT

SEQ ID NO: 536366 - protein, 7 aa, Mycobacterium
PCAPPNP

SEQ ID NO: 536367 - protein, 12 aa, Mycobacterium
PCDADQAAHAAQ

SEQ ID NO: 536368 - protein, 9 aa, Mycobacterium
PCDDERNAA

SEQ ID NO: 536369 - protein, 7 aa, Mycobacterium
PCEGQER

SEQ ID NO: 536370 - protein, 12 aa, Mycobacterium
PCEGTSAKTLTT

SEQ ID NO: 536371 - protein, 4 aa, Mycobacterium
PCEQ

SEQ ID NO: 536372 - protein, 6 aa, Mycobacterium
PCEQQG

SEQ ID NO: 536373 - protein, 9 aa, Mycobacterium
PCESEPDRE

SEQ ID NO: 536374 - protein, 8 aa, Mycobacterium
PCGNRARA

SEQ ID NO: 536375 - protein, 28 aa, Mycobacterium
PCGTPPTTTPPPTTPPPTTPPPVTPPPP

SEQ ID NO: 536376 - protein, 7 aa, Mycobacterium
PCHSTGQ

SEQ ID NO: 536377 - protein, 4 aa, Mycobacterium
PCLT

SEQ ID NO: 536378 - protein, 4 aa, Mycobacterium
PCNG

SEQ ID NO: 536379 - protein, 5 aa, Mycobacterium
PCPAA

SEQ ID NO: 536380 - protein, 17 aa, Mycobacterium
PCPAGGTTRLRGNTESR

SEQ ID NO: 536381 - protein, 7 aa, Mycobacterium
PCPDGGP

SEQ ID NO: 536382 - protein, 4 aa, Mycobacterium
PCPE

SEQ ID NO: 536383 - protein, 7 aa, Mycobacterium
PCPEDAG

SEQ ID NO: 536384 - protein, 5 aa, Mycobacterium
PCPGT

SEQ ID NO: 536385 - protein, 4 aa, Mycobacterium
PCPP

SEQ ID NO: 536386 - protein, 16 aa, Mycobacterium
PCPSARHAPTRATRGR

SEQ ID NO: 536387 - protein, 4 aa, Mycobacterium
PCQP

SEQ ID NO: 536388 - protein, 11 aa, Mycobacterium
PCQPPSSDIHS

SEQ ID NO: 536389 - protein, 5 aa, Mycobacterium
PCQQP

SEQ ID NO: 536390 - protein, 12 aa, Mycobacterium
PCRDTKADDSYD

SEQ ID NO: 536391 - protein, 11 aa, Mycobacterium
PCRGQSPERRA

SEQ ID NO: 536392 - protein, 9 aa, Mycobacterium
PCSDPPLSP

SEQ ID NO: 536393 - protein, 5 aa, Mycobacterium
PCSPA

SEQ ID NO: 536394 - protein, 4 aa, Mycobacterium
PCSR

SEQ ID NO: 536395 - protein, 5 aa, Mycobacterium
PCTAG

SEQ ID NO: 536396 - protein, 8 aa, Mycobacterium
PCTATPAG

SEQ ID NO: 536397 - protein, 6 aa, Mycobacterium
PCTDDS

SEQ ID NO: 536398 - protein, 21 aa, Mycobacterium
PCTGPVARSGKSSGHATSEAQ

SEQ ID NO: 536399 - protein, 41 aa, Mycobacterium
PCTSDTGTAGKCARRASATVASQSTGTAGSAGTASTPLPQK

SEQ ID NO: 536400 - protein, 24 aa, Mycobacterium
PCVDGTPSQAAIDRDTRSAAQRGH

SEQ ID NO: 536401 - protein, 4 aa, Mycobacterium
PDAA

SEQ ID NO: 536402 - protein, 5 aa, Mycobacterium
PDAAA

SEQ ID NO: 536403 - protein, 10 aa, Mycobacterium
PDAAAADVDR

SEQ ID NO: 536404 - protein, 8 aa, Mycobacterium
PDAAADAE

SEQ ID NO: 536405 - protein, 7 aa, Mycobacterium
PDAAAGR

SEQ ID NO: 536406 - protein, 18 aa, Mycobacterium
PDAAAGTAGVDLTNSAAG

SEQ ID NO: 536407 - protein, 10 aa, Mycobacterium
PDAAANAEWR

SEQ ID NO: 536408 - protein, 8 aa, Mycobacterium
PDAAAQGR

SEQ ID NO: 536409 - protein, 15 aa, Mycobacterium
PDAAAVANPDGPPDA

SEQ ID NO: 536410 - protein, 10 aa, Mycobacterium
PDAADPDTLR

SEQ ID NO: 536411 - protein, 8 aa, Mycobacterium
PDAADPTV

SEQ ID NO: 536412 - protein, 9 aa, Mycobacterium
PDAADTTTD

SEQ ID NO: 536413 - protein, 9 aa, Mycobacterium
PDAAEDVKQ

SEQ ID NO: 536414 - protein, 7 aa, Mycobacterium
PDAAGPL

SEQ ID NO: 536415 - protein, 9 aa, Mycobacterium
PDAAGSVNG

SEQ ID NO: 536416 - protein, 12 aa, Mycobacterium
PDAAKGSAEGAG

SEQ ID NO: 536417 - protein, 5 aa, Mycobacterium
PDAAL

SEQ ID NO: 536418 - protein, 11 aa, Mycobacterium
PDAANTYNNPI

SEQ ID NO: 536419 - protein, 5 aa, Mycobacterium
PDAAP

SEQ ID NO: 536420 - protein, 10 aa, Mycobacterium
PDAAPGTSPF

SEQ ID NO: 536421 - protein, 6 aa, Mycobacterium
PDAAPK

SEQ ID NO: 536422 - protein, 6 aa, Mycobacterium
PDAAPL

SEQ ID NO: 536423 - protein, 7 aa, Mycobacterium
PDAARAI

SEQ ID NO: 536424 - protein, 17 aa, Mycobacterium
PDAARERRRRADDEREI

SEQ ID NO: 536425 - protein, 13 aa, Mycobacterium
PDAARNAGNPTTF

SEQ ID NO: 536426 - protein, 10 aa, Mycobacterium
PDAASAAAKV

SEQ ID NO: 536427 - protein, 8 aa, Mycobacterium
PDAASDAA

SEQ ID NO: 536428 - protein, 15 aa, Mycobacterium
PDAATAKRLRNDRGA

SEQ ID NO: 536429 - protein, 6 aa, Mycobacterium
PDAATR

SEQ ID NO: 536430 - protein, 7 aa, Mycobacterium
PDAATRK

SEQ ID NO: 536431 - protein, 18 aa, Mycobacterium
PDAAVGRHGKPQPSPVAR

SEQ ID NO: 536432 - protein, 10 aa, Mycobacterium
PDAAVGSAGT

SEQ ID NO: 536433 - protein, 5 aa, Mycobacterium
PDAAY

SEQ ID NO: 536434 - protein, 4 aa, Mycobacterium
PDAC

SEQ ID NO: 536435 - protein, 15 aa, Mycobacterium
PDACPDTADKAEAIA

SEQ ID NO: 536436 - protein, 14 aa, Mycobacterium
PDACRRRSAAGHVT

SEQ ID NO: 536437 - protein, 5 aa, Mycobacterium
PDADA

SEQ ID NO: 536438 - protein, 6 aa, Mycobacterium
PDADAA

SEQ ID NO: 536439 - protein, 36 aa, Mycobacterium
PDADAESAEAPPAVESAEAESGAGPAAASDAVSELK

SEQ ID NO: 536440 - protein, 9 aa, Mycobacterium
PDADAMDRT

SEQ ID NO: 536441 - protein, 6 aa, Mycobacterium
PDADDA

SEQ ID NO: 536442 - protein, 14 aa, Mycobacterium
PDADDADDAGGAVR

SEQ ID NO: 536443 - protein, 21 aa, Mycobacterium
PDADDGSAYAPEGRPGGKEWT

SEQ ID NO: 536444 - protein, 6 aa, Mycobacterium
PDADDP

SEQ ID NO: 536445 - protein, 7 aa, Mycobacterium
PDADEPL

SEQ ID NO: 536446 - protein, 7 aa, Mycobacterium
PDADGEK

SEQ ID NO: 536447 - protein, 15 aa, Mycobacterium
PDADGKKVSLADYKG

SEQ ID NO: 536448 - protein, 8 aa, Mycobacterium
PDADHSGT

SEQ ID NO: 536449 - protein, 6 aa, Mycobacterium
PDADPE

SEQ ID NO: 536450 - protein, 7 aa, Mycobacterium
PDADPQQ

SEQ ID NO: 536451 - protein, 5 aa, Mycobacterium
PDADR

SEQ ID NO: 536452 - protein, 6 aa, Mycobacterium
PDADRG

SEQ ID NO: 536453 - protein, 11 aa, Mycobacterium
PDADRSEEGIE

SEQ ID NO: 536454 - protein, 7 aa, Mycobacterium
PDAEAET

SEQ ID NO: 536455 - protein, 8 aa, Mycobacterium
PDAEAGKD

SEQ ID NO: 536456 - protein, 9 aa, Mycobacterium
PDAEAGKEL

SEQ ID NO: 536457 - protein, 9 aa, Mycobacterium
PDAEATPAY

SEQ ID NO: 536458 - protein, 5 aa, Mycobacterium
PDAED

SEQ ID NO: 536459 - protein, 9 aa, Mycobacterium
PDAEDGKDL

SEQ ID NO: 536460 - protein, 5 aa, Mycobacterium
PDAEE

SEQ ID NO: 536461 - protein, 9 aa, Mycobacterium
PDAEGGKEL

SEQ ID NO: 536462 - protein, 13 aa, Mycobacterium
PDAELEGATPDGV

SEQ ID NO: 536463 - protein, 8 aa, Mycobacterium
PDAEPAHR

SEQ ID NO: 536464 - protein, 9 aa, Mycobacterium
PDAEPGTSP

SEQ ID NO: 536465 - protein, 10 aa, Mycobacterium
PDAEPGTSPF

SEQ ID NO: 536466 - protein, 6 aa, Mycobacterium
PDAEPL

SEQ ID NO: 536467 - protein, 12 aa, Mycobacterium
PDAESAARARQD

SEQ ID NO: 536468 - protein, 7 aa, Mycobacterium
PDAESLE

SEQ ID NO: 536469 - protein, 21 aa, Mycobacterium
PDAETPQAAPQSESEPGPDVT

SEQ ID NO: 536470 - protein, 8 aa, Mycobacterium
PDAETQAA

SEQ ID NO: 536471 - protein, 5 aa, Mycobacterium
PDAEY

SEQ ID NO: 536472 - protein, 4 aa, Mycobacterium
PDAF

SEQ ID NO: 536473 - protein, 20 aa, Mycobacterium
PDAGADGVGPRIPEAAGGWS

SEQ ID NO: 536474 - protein, 9 aa, Mycobacterium
PDAGAPPDV

SEQ ID NO: 536475 - protein, 9 aa, Mycobacterium
PDAGAPPEV

SEQ ID NO: 536476 - protein, 5 aa, Mycobacterium
PDAGD

SEQ ID NO: 536477 - protein, 11 aa, Mycobacterium
PDAGEEAARQA

SEQ ID NO: 536478 - protein, 10 aa, Mycobacterium
PDAGELSDDP

SEQ ID NO: 536479 - protein, 19 aa, Mycobacterium
PDAGESPGQLTEQLPPAAA

SEQ ID NO: 536480 - protein, 7 aa, Mycobacterium
PDAGISG

SEQ ID NO: 536481 - protein, 11 aa, Mycobacterium
PDAGKPGHPPF

SEQ ID NO: 536482 - protein, 7 aa, Mycobacterium
PDAGLDA

SEQ ID NO: 536483 - protein, 7 aa, Mycobacterium
PDAGLPE

SEQ ID NO: 536484 - protein, 8 aa, Mycobacterium
PDAGLSEK

SEQ ID NO: 536485 - protein, 14 aa, Mycobacterium
PDAGMGDETLDPDR

SEQ ID NO: 536486 - protein, 5 aa, Mycobacterium
PDAGP

SEQ ID NO: 536487 - protein, 7 aa, Mycobacterium
PDAGPAQ

SEQ ID NO: 536488 - protein, 24 aa, Mycobacterium
PDAGPELEKPPTGTAIGNAPSDAG

SEQ ID NO: 536489 - protein, 10 aa, Mycobacterium
PDAGPTPPPI

SEQ ID NO: 536490 - protein, 5 aa, Mycobacterium
PDAGR

SEQ ID NO: 536491 - protein, 6 aa, Mycobacterium
PDAGRI

SEQ ID NO: 536492 - protein, 7 aa, Mycobacterium
PDAGTVT

SEQ ID NO: 536493 - protein, 10 aa, Mycobacterium
PDAGVPEAEA

SEQ ID NO: 536494 - protein, 8 aa, Mycobacterium
PDAGWSRT

SEQ ID NO: 536495 - protein, 12 aa, Mycobacterium
PDAHAQETEDVN

SEQ ID NO: 536496 - protein, 5 aa, Mycobacterium
PDAIN

SEQ ID NO: 536497 - protein, 13 aa, Mycobacterium
PDAIPNDSENFDE

SEQ ID NO: 536498 - protein, 4 aa, Mycobacterium
PDAK

SEQ ID NO: 536499 - protein, 7 aa, Mycobacterium
PDAKLGL

SEQ ID NO: 536500 - protein, 6 aa, Mycobacterium
PDAKPP

SEQ ID NO: 536501 - protein, 4 aa, Mycobacterium
PDAL

SEQ ID NO: 536502 - protein, 12 aa, Mycobacterium
PDALASPSWVDS

SEQ ID NO: 536503 - protein, 8 aa, Mycobacterium
PDALDEDA

SEQ ID NO: 536504 - protein, 6 aa, Mycobacterium
PDALGA

SEQ ID NO: 536505 - protein, 5 aa, Mycobacterium
PDALP

SEQ ID NO: 536506 - protein, 13 aa, Mycobacterium
PDALPSVGRRGYE

SEQ ID NO: 536507 - protein, 27 aa, Mycobacterium
PDALPVGGAQAAGIASPQWAQSSAPRY

SEQ ID NO: 536508 - protein, 9 aa, Mycobacterium
PDALTERNP

SEQ ID NO: 536509 - protein, 15 aa, Mycobacterium
PDANDHRAAGGLPSG

SEQ ID NO: 536510 - protein, 6 aa, Mycobacterium
PDANGM

SEQ ID NO: 536511 - protein, 9 aa, Mycobacterium
PDANRAALD

SEQ ID NO: 536512 - protein, 10 aa, Mycobacterium
PDANSDDPED

SEQ ID NO: 536513 - protein, 4 aa, Mycobacterium
PDAP

SEQ ID NO: 536514 - protein, 9 aa, Mycobacterium
PDAPARAQA

SEQ ID NO: 536515 - protein, 5 aa, Mycobacterium
PDAPE

SEQ ID NO: 536516 - protein, 9 aa, Mycobacterium
PDAPEDEAL

SEQ ID NO: 536517 - protein, 7 aa, Mycobacterium
PDAPGAR

SEQ ID NO: 536518 - protein, 17 aa, Mycobacterium
PDAPGTPVEHRPETTEA

SEQ ID NO: 536519 - protein, 5 aa, Mycobacterium
PDAPH

SEQ ID NO: 536520 - protein, 5 aa, Mycobacterium
PDAPI

SEQ ID NO: 536521 - protein, 7 aa, Mycobacterium
PDAPKHR

SEQ ID NO: 536522 - protein, 6 aa, Mycobacterium
PDAPKL

SEQ ID NO: 536523 - protein, 8 aa, Mycobacterium
PDAPLDQK

SEQ ID NO: 536524 - protein, 10 aa, Mycobacterium
PDAPLGAQTH

SEQ ID NO: 536525 - protein, 6 aa, Mycobacterium
PDAPLT

SEQ ID NO: 536526 - protein, 12 aa, Mycobacterium
PDAPMPFNNPAS

SEQ ID NO: 536527 - protein, 5 aa, Mycobacterium
PDAPP

SEQ ID NO: 536528 - protein, 9 aa, Mycobacterium
PDAPPKNPR

SEQ ID NO: 536529 - protein, 8 aa, Mycobacterium
PDAPPPDL

SEQ ID NO: 536530 - protein, 5 aa, Mycobacterium
PDAPR

SEQ ID NO: 536531 - protein, 7 aa, Mycobacterium
PDAPRIG

SEQ ID NO: 536532 - protein, 7 aa, Mycobacterium
PDAPTAS

SEQ ID NO: 536533 - protein, 18 aa, Mycobacterium
PDAPTITAEDVARALEKD

SEQ ID NO: 536534 - protein, 6 aa, Mycobacterium
PDAPTL

SEQ ID NO: 536535 - protein, 11 aa, Mycobacterium
PDAPTPGPTRR

SEQ ID NO: 536536 - protein, 6 aa, Mycobacterium
PDAPVA

SEQ ID NO: 536537 - protein, 21 aa, Mycobacterium
PDAPVTEGDATAYDANERAVT

SEQ ID NO: 536538 - protein, 8 aa, Mycobacterium
PDAQIGAS

SEQ ID NO: 536539 - protein, 9 aa, Mycobacterium
PDAQNAQSR

SEQ ID NO: 536540 - protein, 7 aa, Mycobacterium
PDAQRQA

SEQ ID NO: 536541 - protein, 4 aa, Mycobacterium
PDAR

SEQ ID NO: 536542 - protein, 6 aa, Mycobacterium
PDARAG

SEQ ID NO: 536543 - protein, 14 aa, Mycobacterium
PDARASVAAQRRET

SEQ ID NO: 536544 - protein, 7 aa, Mycobacterium
PDARDRA

SEQ ID NO: 536545 - protein, 8 aa, Mycobacterium
PDARERVA

SEQ ID NO: 536546 - protein, 7 aa, Mycobacterium
PDARLGE

SEQ ID NO: 536547 - protein, 16 aa, Mycobacterium
PDARPGEAATMLRYTA

SEQ ID NO: 536548 - protein, 6 aa, Mycobacterium
PDARPI

SEQ ID NO: 536549 - protein, 6 aa, Mycobacterium
PDARPP

SEQ ID NO: 536550 - protein, 6 aa, Mycobacterium
PDARPT

SEQ ID NO: 536551 - protein, 6 aa, Mycobacterium
PDARRN

SEQ ID NO: 536552 - protein, 7 aa, Mycobacterium
PDARSAL

SEQ ID NO: 536553 - protein, 10 aa, Mycobacterium
PDARSDNPED

SEQ ID NO: 536554 - protein, 10 aa, Mycobacterium
PDARSSEPVQ

SEQ ID NO: 536555 - protein, 5 aa, Mycobacterium
PDART

SEQ ID NO: 536556 - protein, 9 aa, Mycobacterium
PDASAKDRA

SEQ ID NO: 536557 - protein, 9 aa, Mycobacterium
PDASDKELA

SEQ ID NO: 536558 - protein, 10 aa, Mycobacterium
PDASDPRPAV

SEQ ID NO: 536559 - protein, 12 aa, Mycobacterium
PDASDQSAQRTL

SEQ ID NO: 536560 - protein, 10 aa, Mycobacterium
PDASEKELAT

SEQ ID NO: 536561 - protein, 11 aa, Mycobacterium
PDASEKERAAI

SEQ ID NO: 536562 - protein, 7 aa, Mycobacterium
PDASEPV

SEQ ID NO: 536563 - protein, 6 aa, Mycobacterium
PDASGI

SEQ ID NO: 536564 - protein, 11 aa, Mycobacterium
PDASGNVGDRA

SEQ ID NO: 536565 - protein, 9 aa, Mycobacterium
PDASGYRDR

SEQ ID NO: 536566 - protein, 8 aa, Mycobacterium
PDASLDDK

SEQ ID NO: 536567 - protein, 9 aa, Mycobacterium
PDASSDDDL

SEQ ID NO: 536568 - protein, 6 aa, Mycobacterium
PDASYV

SEQ ID NO: 536569 - protein, 5 aa, Mycobacterium
PDATA

SEQ ID NO: 536570 - protein, 27 aa, Mycobacterium
PDATAAGPAAAATIAAPAPIGSAGDLR

SEQ ID NO: 536571 - protein, 10 aa, Mycobacterium
PDATAEALDG

SEQ ID NO: 536572 - protein, 7 aa, Mycobacterium
PDATARR

SEQ ID NO: 536573 - protein, 14 aa, Mycobacterium
PDATDSHGSFSTGG

SEQ ID NO: 536574 - protein, 8 aa, Mycobacterium
PDATGLTR

SEQ ID NO: 536575 - protein, 7 aa, Mycobacterium
PDATITE

SEQ ID NO: 536576 - protein, 5 aa, Mycobacterium
PDATL

SEQ ID NO: 536577 - protein, 8 aa, Mycobacterium
PDATLDDK

SEQ ID NO: 536578 - protein, 12 aa, Mycobacterium
PDATLEEAQENK

SEQ ID NO: 536579 - protein, 8 aa, Mycobacterium
PDATNSAI

SEQ ID NO: 536580 - protein, 9 aa, Mycobacterium
PDATPGTPE

SEQ ID NO: 536581 - protein, 9 aa, Mycobacterium
PDATPKELT

SEQ ID NO: 536582 - protein, 5 aa, Mycobacterium
PDATR

SEQ ID NO: 536583 - protein, 7 aa, Mycobacterium
PDATTDA

SEQ ID NO: 536584 - protein, 8 aa, Mycobacterium
PDAVAGSA

SEQ ID NO: 536585 - protein, 10 aa, Mycobacterium
PDAVGDGPSS

SEQ ID NO: 536586 - protein, 13 aa, Mycobacterium
PDAVKRTRSSSRG

SEQ ID NO: 536587 - protein, 5 aa, Mycobacterium
PDAVP

SEQ ID NO: 536588 - protein, 7 aa, Mycobacterium
PDAVPQA

SEQ ID NO: 536589 - protein, 14 aa, Mycobacterium
PDAVRADQRSGTYL

SEQ ID NO: 536590 - protein, 14 aa, Mycobacterium
PDAVRKQRALTRDG

SEQ ID NO: 536591 - protein, 5 aa, Mycobacterium
PDAVT

SEQ ID NO: 536592 - protein, 13 aa, Mycobacterium
PDAWGDEDKRVAD

SEQ ID NO: 536593 - protein, 9 aa, Mycobacterium
PDAYDPPAH

SEQ ID NO: 536594 - protein, 6 aa, Mycobacterium
PDAYPG

SEQ ID NO: 536595 - protein, 5 aa, Mycobacterium
PDAYY

SEQ ID NO: 536596 - protein, 6 aa, Mycobacterium
PDCDPQ

SEQ ID NO: 536597 - protein, 17 aa, Mycobacterium
PDCGENSYRGSGKLTGK

SEQ ID NO: 536598 - protein, 14 aa, Mycobacterium
PDCGENTYQGSGKL

SEQ ID NO: 536599 - protein, 17 aa, Mycobacterium
PDCGENTYRGAGKLTGK

SEQ ID NO: 536600 - protein, 7 aa, Mycobacterium
PDCGPNR

SEQ ID NO: 536601 - protein, 9 aa, Mycobacterium
PDCGTGFGT

SEQ ID NO: 536602 - protein, 10 aa, Mycobacterium
PDCNPGSSFT

SEQ ID NO: 536603 - protein, 7 aa, Mycobacterium
PDCPTGE

SEQ ID NO: 536604 - protein, 13 aa, Mycobacterium
PDCSDLNGPHERM

SEQ ID NO: 536605 - protein, 10 aa, Mycobacterium
PDCSGRDTAD

SEQ ID NO: 536606 - protein, 4 aa, Mycobacterium
PDCT

SEQ ID NO: 536607 - protein, 7 aa, Mycobacterium
PDCTPPR

SEQ ID NO: 536608 - protein, 5 aa, Mycobacterium
PDDAA

SEQ ID NO: 536609 - protein, 12 aa, Mycobacterium
PDDAAAAAAAEL

SEQ ID NO: 536610 - protein, 5 aa, Mycobacterium
PDDAD

SEQ ID NO: 536611 - protein, 12 aa, Mycobacterium
PDDADAGRRDED

SEQ ID NO: 536612 - protein, 6 aa, Mycobacterium
PDDADG

SEQ ID NO: 536613 - protein, 13 aa, Mycobacterium
PDDADHPTFALRP

SEQ ID NO: 536614 - protein, 8 aa, Mycobacterium
PDDADPVT

SEQ ID NO: 536615 - protein, 14 aa, Mycobacterium
PDDADSEPSPPLNK

SEQ ID NO: 536616 - protein, 15 aa, Mycobacterium
PDDADVQRAVPARPA

SEQ ID NO: 536617 - protein, 10 aa, Mycobacterium
PDDAEGSELR

SEQ ID NO: 536618 - protein, 7 aa, Mycobacterium
PDDAEKK

SEQ ID NO: 536619 - protein, 13 aa, Mycobacterium
PDDAESQARAERA

SEQ ID NO: 536620 - protein, 13 aa, Mycobacterium
PDDAGDGVNAPMR

SEQ ID NO: 536621 - protein, 14 aa, Mycobacterium
PDDANSEPSPPLGK

SEQ ID NO: 536622 - protein, 8 aa, Mycobacterium
PDDAPAEL

SEQ ID NO: 536623 - protein, 6 aa, Mycobacterium
PDDAPL

SEQ ID NO: 536624 - protein, 9 aa, Mycobacterium
PDDARDDDV

SEQ ID NO: 536625 - protein, 7 aa, Mycobacterium
PDDAREI

SEQ ID NO: 536626 - protein, 8 aa, Mycobacterium
PDDARLGP

SEQ ID NO: 536627 - protein, 8 aa, Mycobacterium
PDDASLDA

SEQ ID NO: 536628 - protein, 6 aa, Mycobacterium
PDDASS

SEQ ID NO: 536629 - protein, 5 aa, Mycobacterium
PDDAT

SEQ ID NO: 536630 - protein, 8 aa, Mycobacterium
PDDATAPQ

SEQ ID NO: 536631 - protein, 10 aa, Mycobacterium
PDDATDPASI

SEQ ID NO: 536632 - protein, 5 aa, Mycobacterium
PDDAV

SEQ ID NO: 536633 - protein, 13 aa, Mycobacterium
PDDCPPGSIGKGF

SEQ ID NO: 536634 - protein, 16 aa, Mycobacterium
PDDCTVPSAADVMHSG

SEQ ID NO: 536635 - protein, 10 aa, Mycobacterium
PDDDDKASKY

SEQ ID NO: 536636 - protein, 14 aa, Mycobacterium
PDDDDSAGSDVADS

SEQ ID NO: 536637 - protein, 9 aa, Mycobacterium
PDDDELRAH

SEQ ID NO: 536638 - protein, 8 aa, Mycobacterium
PDDDEVKR

SEQ ID NO: 536639 - protein, 9 aa, Mycobacterium
PDDDGPAAD

SEQ ID NO: 536640 - protein, 6 aa, Mycobacterium
PDDDLG

SEQ ID NO: 536641 - protein, 7 aa, Mycobacterium
PDDDLGQ

SEQ ID NO: 536642 - protein, 10 aa, Mycobacterium
PDDDNKRKFR

SEQ ID NO: 536643 - protein, 7 aa, Mycobacterium
PDDDPHI

SEQ ID NO: 536644 - protein, 8 aa, Mycobacterium
PDDDPRTT

SEQ ID NO: 536645 - protein, 8 aa, Mycobacterium
PDDDTAPH

SEQ ID NO: 536646 - protein, 8 aa, Mycobacterium
PDDDWGAY

SEQ ID NO: 536647 - protein, 8 aa, Mycobacterium
PDDEAAAR

SEQ ID NO: 536648 - protein, 7 aa, Mycobacterium
PDDEEAE

SEQ ID NO: 536649 - protein, 5 aa, Mycobacterium
PDDEF

SEQ ID NO: 536650 - protein, 13 aa, Mycobacterium
PDDEGDPGIPPER

SEQ ID NO: 536651 - protein, 7 aa, Mycobacterium
PDDEGGT

SEQ ID NO: 536652 - protein, 9 aa, Mycobacterium
PDDEKRATL

SEQ ID NO: 536653 - protein, 7 aa, Mycobacterium
PDDELGS

SEQ ID NO: 536654 - protein, 8 aa, Mycobacterium
PDDELGSN

SEQ ID NO: 536655 - protein, 5 aa, Mycobacterium
PDDEN

SEQ ID NO: 536656 - protein, 21 aa, Mycobacterium
PDDENPCVDGDPDSDAARHDV

SEQ ID NO: 536657 - protein, 5 aa, Mycobacterium
PDDER

SEQ ID NO: 536658 - protein, 14 aa, Mycobacterium
PDDERGARRRERER

SEQ ID NO: 536659 - protein, 5 aa, Mycobacterium
PDDES

SEQ ID NO: 536660 - protein, 10 aa, Mycobacterium
PDDESLGTGA

SEQ ID NO: 536661 - protein, 11 aa, Mycobacterium
PDDESLSNGAT

SEQ ID NO: 536662 - protein, 8 aa, Mycobacterium
PDDETEHE

SEQ ID NO: 536663 - protein, 8 aa, Mycobacterium
PDDETGIT

SEQ ID NO: 536664 - protein, 9 aa, Mycobacterium
PDDETLTTG

SEQ ID NO: 536665 - protein, 11 aa, Mycobacterium
PDDETLTTGGT

SEQ ID NO: 536666 - protein, 8 aa, Mycobacterium
PDDFADPD

SEQ ID NO: 536667 - protein, 8 aa, Mycobacterium
PDDFQDPK

SEQ ID NO: 536668 - protein, 6 aa, Mycobacterium
PDDFST

SEQ ID NO: 536669 - protein, 11 aa, Mycobacterium
PDDGAASAARR

SEQ ID NO: 536670 - protein, 10 aa, Mycobacterium
PDDGDKLTDG

SEQ ID NO: 536671 - protein, 5 aa, Mycobacterium
PDDGG

SEQ ID NO: 536672 - protein, 6 aa, Mycobacterium
PDDGGI

SEQ ID NO: 536673 - protein, 9 aa, Mycobacterium
PDDGGTRIT

SEQ ID NO: 536674 - protein, 6 aa, Mycobacterium
PDDGGV

SEQ ID NO: 536675 - protein, 8 aa, Mycobacterium
PDDGHAAR

SEQ ID NO: 536676 - protein, 17 aa, Mycobacterium
PDDGHGHRRTRRRPAKG

SEQ ID NO: 536677 - protein, 7 aa, Mycobacterium
PDDGPIA

SEQ ID NO: 536678 - protein, 6 aa, Mycobacterium
PDDGPV

SEQ ID NO: 536679 - protein, 5 aa, Mycobacterium
PDDGR

SEQ ID NO: 536680 - protein, 6 aa, Mycobacterium
PDDGRL

SEQ ID NO: 536681 - protein, 6 aa, Mycobacterium
PDDGSA

SEQ ID NO: 536682 - protein, 7 aa, Mycobacterium
PDDGSKD

SEQ ID NO: 536683 - protein, 15 aa, Mycobacterium
PDDGTAPIPADDAGY

SEQ ID NO: 536684 - protein, 8 aa, Mycobacterium
PDDGTETF

SEQ ID NO: 536685 - protein, 10 aa, Mycobacterium
PDDGTGEESR

SEQ ID NO: 536686 - protein, 6 aa, Mycobacterium
PDDGTK

SEQ ID NO: 536687 - protein, 13 aa, Mycobacterium
PDDHDAPDAPYAK

SEQ ID NO: 536688 - protein, 13 aa, Mycobacterium
PDDHPQSAATARS

SEQ ID NO: 536689 - protein, 16 aa, Mycobacterium
PDDHRAAHGASAAPVA

SEQ ID NO: 536690 - protein, 18 aa, Mycobacterium
PDDHRAALASDDPGVTRR

SEQ ID NO: 536691 - protein, 15 aa, Mycobacterium
PDDHRAAQSAAAAGL

SEQ ID NO: 536692 - protein, 15 aa, Mycobacterium
PDDHRASLSASDAAL

SEQ ID NO: 536693 - protein, 14 aa, Mycobacterium
PDDIPTAGKMEGRS

SEQ ID NO: 536694 - protein, 6 aa, Mycobacterium
PDDKWG

SEQ ID NO: 536695 - protein, 6 aa, Mycobacterium
PDDLAD

SEQ ID NO: 536696 - protein, 6 aa, Mycobacterium
PDDLNA

SEQ ID NO: 536697 - protein, 7 aa, Mycobacterium
PDDLPYA

SEQ ID NO: 536698 - protein, 5 aa, Mycobacterium
PDDLS

SEQ ID NO: 536699 - protein, 5 aa, Mycobacterium
PDDLT

SEQ ID NO: 536700 - protein, 4 aa, Mycobacterium
PDDM

SEQ ID NO: 536701 - protein, 5 aa, Mycobacterium
PDDMR

SEQ ID NO: 536702 - protein, 8 aa, Mycobacterium
PDDNDDEA

SEQ ID NO: 536703 - protein, 10 aa, Mycobacterium
PDDNEVPRGE

SEQ ID NO: 536704 - protein, 15 aa, Mycobacterium
PDDNGADHENSARAL

SEQ ID NO: 536705 - protein, 10 aa, Mycobacterium
PDDNPPPMSE

SEQ ID NO: 536706 - protein, 8 aa, Mycobacterium
PDDPAGVR

SEQ ID NO: 536707 - protein, 9 aa, Mycobacterium
PDDPATQVG

SEQ ID NO: 536708 - protein, 5 aa, Mycobacterium
PDDPD

SEQ ID NO: 536709 - protein, 8 aa, Mycobacterium
PDDPDLPV

SEQ ID NO: 536710 - protein, 17 aa, Mycobacterium
PDDPDRAAFSTFVTAQR

SEQ ID NO: 536711 - protein, 9 aa, Mycobacterium
PDDPDRDRQ

SEQ ID NO: 536712 - protein, 14 aa, Mycobacterium
PDDPDTPYASSEQL

SEQ ID NO: 536713 - protein, 7 aa, Mycobacterium
PDDPEMR

SEQ ID NO: 536714 - protein, 11 aa, Mycobacterium
PDDPETPYATS

SEQ ID NO: 536715 - protein, 10 aa, Mycobacterium
PDDPGRDDAV

SEQ ID NO: 536716 - protein, 7 aa, Mycobacterium
PDDPQQF

SEQ ID NO: 536717 - protein, 8 aa, Mycobacterium
PDDPRVSP

SEQ ID NO: 536718 - protein, 10 aa, Mycobacterium
PDDPRWPPIP

SEQ ID NO: 536719 - protein, 10 aa, Mycobacterium
PDDPSGPLTL

SEQ ID NO: 536720 - protein, 6 aa, Mycobacterium
PDDPSM

SEQ ID NO: 536721 - protein, 11 aa, Mycobacterium
PDDPVDPSGIK

SEQ ID NO: 536722 - protein, 10 aa, Mycobacterium
PDDPVGGRPA

SEQ ID NO: 536723 - protein, 5 aa, Mycobacterium
PDDQA

SEQ ID NO: 536724 - protein, 9 aa, Mycobacterium
PDDQPARKR

SEQ ID NO: 536725 - protein, 8 aa, Mycobacterium
PDDQQAEV

SEQ ID NO: 536726 - protein, 7 aa, Mycobacterium
PDDQRRG

SEQ ID NO: 536727 - protein, 7 aa, Mycobacterium
PDDQTPL

SEQ ID NO: 536728 - protein, 10 aa, Mycobacterium
PDDRAAEAVS

SEQ ID NO: 536729 - protein, 12 aa, Mycobacterium
PDDRDEEGSTCM

SEQ ID NO: 536730 - protein, 5 aa, Mycobacterium
PDDRI

SEQ ID NO: 536731 - protein, 6 aa, Mycobacterium
PDDRRN

SEQ ID NO: 536732 - protein, 8 aa, Mycobacterium
PDDRTGER

SEQ ID NO: 536733 - protein, 8 aa, Mycobacterium
PDDRTKAL

SEQ ID NO: 536734 - protein, 10 aa, Mycobacterium
PDDRYATGSP

SEQ ID NO: 536735 - protein, 7 aa, Mycobacterium
PDDSATV

SEQ ID NO: 536736 - protein, 8 aa, Mycobacterium
PDDSGETA

SEQ ID NO: 536737 - protein, 5 aa, Mycobacterium
PDDSP

SEQ ID NO: 536738 - protein, 16 aa, Mycobacterium
PDDSPKAVAQAGAGQI

SEQ ID NO: 536739 - protein, 7 aa, Mycobacterium
PDDSTEQ

SEQ ID NO: 536740 - protein, 8 aa, Mycobacterium
PDDSVSDA

SEQ ID NO: 536741 - protein, 4 aa, Mycobacterium
PDDT

SEQ ID NO: 536742 - protein, 8 aa, Mycobacterium
PDDTEGAA

SEQ ID NO: 536743 - protein, 35 aa, Mycobacterium
PDDTGITNAAPGGVGGAHSPGVRPAGHRVRDPARH

SEQ ID NO: 536744 - protein, 7 aa, Mycobacterium
PDDTRRA

SEQ ID NO: 536745 - protein, 14 aa, Mycobacterium
PDDTSGQDAPHEST

SEQ ID NO: 536746 - protein, 7 aa, Mycobacterium
PDDTTVG

SEQ ID NO: 536747 - protein, 7 aa, Mycobacterium
PDDVDAA

SEQ ID NO: 536748 - protein, 10 aa, Mycobacterium
PDDVEDAAAE

SEQ ID NO: 536749 - protein, 14 aa, Mycobacterium
PDDVPDDVSTEVRQ

SEQ ID NO: 536750 - protein, 10 aa, Mycobacterium
PDDVPEEIST

SEQ ID NO: 536751 - protein, 9 aa, Mycobacterium
PDDVPEELS

SEQ ID NO: 536752 - protein, 10 aa, Mycobacterium
PDDVSALGNA

SEQ ID NO: 536753 - protein, 21 aa, Mycobacterium
PDDVSTSVSVNSNAEGSPITP

SEQ ID NO: 536754 - protein, 4 aa, Mycobacterium
PDDW

SEQ ID NO: 536755 - protein, 6 aa, Mycobacterium
PDDWDS

SEQ ID NO: 536756 - protein, 4 aa, Mycobacterium
PDDY

SEQ ID NO: 536757 - protein, 12 aa, Mycobacterium
PDEAAAAAAAGL

SEQ ID NO: 536758 - protein, 12 aa, Mycobacterium
PDEAAAAAATEL

SEQ ID NO: 536759 - protein, 15 aa, Mycobacterium
PDEAAALGDELKNVT

SEQ ID NO: 536760 - protein, 15 aa, Mycobacterium
PDEAAALGDELKSVT

SEQ ID NO: 536761 - protein, 12 aa, Mycobacterium
PDEAAGMQRPRS

SEQ ID NO: 536762 - protein, 14 aa, Mycobacterium
PDEAAPEGYEQDPD

SEQ ID NO: 536763 - protein, 15 aa, Mycobacterium
PDEAAVRRARDAVSA

SEQ ID NO: 536764 - protein, 6 aa, Mycobacterium
PDEADE

SEQ ID NO: 536765 - protein, 26 aa, Mycobacterium
PDEAGPPISGPATYPDDVTESLRADA

SEQ ID NO: 536766 - protein, 11 aa, Mycobacterium
PDEAGYPTPLP

SEQ ID NO: 536767 - protein, 10 aa, Mycobacterium
PDEAKAGELA

SEQ ID NO: 536768 - protein, 5 aa, Mycobacterium
PDEAQ

SEQ ID NO: 536769 - protein, 5 aa, Mycobacterium
PDEAR

SEQ ID NO: 536770 - protein, 9 aa, Mycobacterium
PDEARAAWA

SEQ ID NO: 536771 - protein, 23 aa, Mycobacterium
PDEARAGRESIERAAAQAGRRID

SEQ ID NO: 536772 - protein, 10 aa, Mycobacterium
PDEARSPGAP

SEQ ID NO: 536773 - protein, 12 aa, Mycobacterium
PDEASPGQPDAA

SEQ ID NO: 536774 - protein, 10 aa, Mycobacterium
PDEDAANATS

SEQ ID NO: 536775 - protein, 8 aa, Mycobacterium
PDEDHSGT

SEQ ID NO: 536776 - protein, 6 aa, Mycobacterium
PDEDLG

SEQ ID NO: 536777 - protein, 8 aa, Mycobacterium
PDEDQWTP

SEQ ID NO: 536778 - protein, 10 aa, Mycobacterium
PDEDRGKFDG

SEQ ID NO: 536779 - protein, 6 aa, Mycobacterium
PDEDRP

SEQ ID NO: 536780 - protein, 7 aa, Mycobacterium
PDEDSAR

SEQ ID NO: 536781 - protein, 9 aa, Mycobacterium
PDEDSLSEH

SEQ ID NO: 536782 - protein, 13 aa, Mycobacterium
PDEDSLVAAAIRP

SEQ ID NO: 536783 - protein, 5 aa, Mycobacterium
PDEEA

SEQ ID NO: 536784 - protein, 7 aa, Mycobacterium
PDEEHPP

SEQ ID NO: 536785 - protein, 5 aa, Mycobacterium
PDEEL

SEQ ID NO: 536786 - protein, 7 aa, Mycobacterium
PDEELDN

SEQ ID NO: 536787 - protein, 14 aa, Mycobacterium
PDEELDSPGPGQAI

SEQ ID NO: 536788 - protein, 7 aa, Mycobacterium
PDEELPD

SEQ ID NO: 536789 - protein, 6 aa, Mycobacterium
PDEERA

SEQ ID NO: 536790 - protein, 8 aa, Mycobacterium
PDEERNRA

SEQ ID NO: 536791 - protein, 4 aa, Mycobacterium
PDEF

SEQ ID NO: 536792 - protein, 5 aa, Mycobacterium
PDEFG

SEQ ID NO: 536793 - protein, 7 aa, Mycobacterium
PDEFTTH

SEQ ID NO: 536794 - protein, 6 aa, Mycobacterium
PDEGAE

SEQ ID NO: 536795 - protein, 5 aa, Mycobacterium
PDEGE

SEQ ID NO: 536796 - protein, 20 aa, Mycobacterium
PDEGESVESLGGHPGVQGSP

SEQ ID NO: 536797 - protein, 5 aa, Mycobacterium
PDEGF

SEQ ID NO: 536798 - protein, 10 aa, Mycobacterium
PDEGGVPAQH

SEQ ID NO: 536799 - protein, 5 aa, Mycobacterium
PDEHA

SEQ ID NO: 536800 - protein, 7 aa, Mycobacterium
PDEHPLD

SEQ ID NO: 536801 - protein, 8 aa, Mycobacterium
PDEHPLDR

SEQ ID NO: 536802 - protein, 6 aa, Mycobacterium
PDEHTP

SEQ ID NO: 536803 - protein, 8 aa, Mycobacterium
PDEIEKGS

SEQ ID NO: 536804 - protein, 4 aa, Mycobacterium
PDEK

SEQ ID NO: 536805 - protein, 8 aa, Mycobacterium
PDEKDPTC

SEQ ID NO: 536806 - protein, 8 aa, Mycobacterium
PDEKGPTC

SEQ ID NO: 536807 - protein, 10 aa, Mycobacterium
PDEKTARDAL

SEQ ID NO: 536808 - protein, 5 aa, Mycobacterium
PDEKV

SEQ ID NO: 536809 - protein, 7 aa, Mycobacterium
PDEKWGE

SEQ ID NO: 536810 - protein, 7 aa, Mycobacterium
PDEKYGE

SEQ ID NO: 536811 - protein, 10 aa, Mycobacterium
PDELAAEPNA

SEQ ID NO: 536812 - protein, 6 aa, Mycobacterium
PDELPA

SEQ ID NO: 536813 - protein, 21 aa, Mycobacterium
PDELPPPPEDPGPVDDLEISN

SEQ ID NO: 536814 - protein, 9 aa, Mycobacterium
PDELPSAAE

SEQ ID NO: 536815 - protein, 8 aa, Mycobacterium
PDELRARN

SEQ ID NO: 536816 - protein, 6 aa, Mycobacterium
PDELTP

SEQ ID NO: 536817 - protein, 6 aa, Mycobacterium
PDENHE

SEQ ID NO: 536818 - protein, 7 aa, Mycobacterium
PDENTEG

SEQ ID NO: 536819 - protein, 4 aa, Mycobacterium
PDEP

SEQ ID NO: 536820 - protein, 5 aa, Mycobacterium
PDEPD

SEQ ID NO: 536821 - protein, 8 aa, Mycobacterium
PDEPDATT

SEQ ID NO: 536822 - protein, 9 aa, Mycobacterium
PDEPDATTM

SEQ ID NO: 536823 - protein, 6 aa, Mycobacterium
PDEPEA

SEQ ID NO: 536824 - protein, 8 aa, Mycobacterium
PDEPGAAV

SEQ ID NO: 536825 - protein, 13 aa, Mycobacterium
PDEPGDPGIPPER

SEQ ID NO: 536826 - protein, 8 aa, Mycobacterium
PDEPGGPV

SEQ ID NO: 536827 - protein, 6 aa, Mycobacterium
PDEPGL

SEQ ID NO: 536828 - protein, 5 aa, Mycobacterium
PDEPK

SEQ ID NO: 536829 - protein, 6 aa, Mycobacterium
PDEQFG

SEQ ID NO: 536830 - protein, 5 aa, Mycobacterium
PDEQH

SEQ ID NO: 536831 - protein, 6 aa, Mycobacterium
PDEQLD

SEQ ID NO: 536832 - protein, 7 aa, Mycobacterium
PDEQLDN

SEQ ID NO: 536833 - protein, 6 aa, Mycobacterium
PDEQRA

SEQ ID NO: 536834 - protein, 7 aa, Mycobacterium
PDEQRAA

SEQ ID NO: 536835 - protein, 8 aa, Mycobacterium
PDEQRGAV

SEQ ID NO: 536836 - protein, 8 aa, Mycobacterium
PDEQRNAL

SEQ ID NO: 536837 - protein, 5 aa, Mycobacterium
PDERL

SEQ ID NO: 536838 - protein, 17 aa, Mycobacterium
PDERPDQGQGGAGAATL

SEQ ID NO: 536839 - protein, 7 aa, Mycobacterium
PDERTAV

SEQ ID NO: 536840 - protein, 6 aa, Mycobacterium
PDERTL

SEQ ID NO: 536841 - protein, 12 aa, Mycobacterium
PDESAAAAATEL

SEQ ID NO: 536842 - protein, 7 aa, Mycobacterium
PDESGPV

SEQ ID NO: 536843 - protein, 6 aa, Mycobacterium
PDESGS

SEQ ID NO: 536844 - protein, 5 aa, Mycobacterium
PDETA

SEQ ID NO: 536845 - protein, 8 aa, Mycobacterium
PDETAKTF

SEQ ID NO: 536846 - protein, 9 aa, Mycobacterium
PDETAPERP

SEQ ID NO: 536847 - protein, 7 aa, Mycobacterium
PDETARN

SEQ ID NO: 536848 - protein, 9 aa, Mycobacterium
PDETASNRL

SEQ ID NO: 536849 - protein, 7 aa, Mycobacterium
PDETATD

SEQ ID NO: 536850 - protein, 6 aa, Mycobacterium
PDETAV

SEQ ID NO: 536851 - protein, 5 aa, Mycobacterium
PDETV

SEQ ID NO: 536852 - protein, 13 aa, Mycobacterium
PDEVAADAARQLG

SEQ ID NO: 536853 - protein, 7 aa, Mycobacterium
PDEVAAG

SEQ ID NO: 536854 - protein, 6 aa, Mycobacterium
PDEVAE

SEQ ID NO: 536855 - protein, 8 aa, Mycobacterium
PDEVEPRR

SEQ ID NO: 536856 - protein, 5 aa, Mycobacterium
PDEVG

SEQ ID NO: 536857 - protein, 5 aa, Mycobacterium
PDEVN

SEQ ID NO: 536858 - protein, 8 aa, Mycobacterium
PDEVPEET

SEQ ID NO: 536859 - protein, 6 aa, Mycobacterium
PDEVPI

SEQ ID NO: 536860 - protein, 7 aa, Mycobacterium
PDEVPPQ

SEQ ID NO: 536861 - protein, 6 aa, Mycobacterium
PDEVRG

SEQ ID NO: 536862 - protein, 9 aa, Mycobacterium
PDEYGEPYR

SEQ ID NO: 536863 - protein, 4 aa, Mycobacterium
PDFA

SEQ ID NO: 536864 - protein, 6 aa, Mycobacterium
PDFAEG

SEQ ID NO: 536865 - protein, 5 aa, Mycobacterium
PDFAP

SEQ ID NO: 536866 - protein, 8 aa, Mycobacterium
PDFDPAGK

SEQ ID NO: 536867 - protein, 10 aa, Mycobacterium
PDFELPDGTR

SEQ ID NO: 536868 - protein, 10 aa, Mycobacterium
PDFGSAAAPL

SEQ ID NO: 536869 - protein, 19 aa, Mycobacterium
PDFGSNPAGMRTRARRDGS

SEQ ID NO: 536870 - protein, 23 aa, Mycobacterium
PDFGSNPAGMRTRGKRDGSGENA

SEQ ID NO: 536871 - protein, 19 aa, Mycobacterium
PDFGSNPGGMRTHARRDGS

SEQ ID NO: 536872 - protein, 19 aa, Mycobacterium
PDFGSNPGGMRTRARRDGK

SEQ ID NO: 536873 - protein, 19 aa, Mycobacterium
PDFGSNPSGMRTTARRDGS

SEQ ID NO: 536874 - protein, 39 aa, Mycobacterium
PDFPATPAGGAEGAAALGGAREVAADSDAGNPALDPQEL

SEQ ID NO: 536875 - protein, 5 aa, Mycobacterium
PDFPG

SEQ ID NO: 536876 - protein, 4 aa, Mycobacterium
PDFR

SEQ ID NO: 536877 - protein, 6 aa, Mycobacterium
PDFRAG

SEQ ID NO: 536878 - protein, 8 aa, Mycobacterium
PDFRPGDT

SEQ ID NO: 536879 - protein, 8 aa, Mycobacterium
PDFRSPEQ

SEQ ID NO: 536880 - protein, 5 aa, Mycobacterium
PDFRT

SEQ ID NO: 536881 - protein, 5 aa, Mycobacterium
PDFSG

SEQ ID NO: 536882 - protein, 5 aa, Mycobacterium
PDGAA

SEQ ID NO: 536883 - protein, 7 aa, Mycobacterium
PDGAAQT

SEQ ID NO: 536884 - protein, 8 aa, Mycobacterium
PDGAEAWD

SEQ ID NO: 536885 - protein, 8 aa, Mycobacterium
PDGAEGPW

SEQ ID NO: 536886 - protein, 17 aa, Mycobacterium
PDGAGYQRSQADHTYGY

SEQ ID NO: 536887 - protein, 8 aa, Mycobacterium
PDGAGYTS

SEQ ID NO: 536888 - protein, 21 aa, Mycobacterium
PDGAKPEVTVESGVDSTGMSS

SEQ ID NO: 536889 - protein, 11 aa, Mycobacterium
PDGAPAEPGVD

SEQ ID NO: 536890 - protein, 8 aa, Mycobacterium
PDGAPAGE

SEQ ID NO: 536891 - protein, 7 aa, Mycobacterium
PDGARQI

SEQ ID NO: 536892 - protein, 9 aa, Mycobacterium
PDGARTVRG

SEQ ID NO: 536893 - protein, 9 aa, Mycobacterium
PDGASEAVV

SEQ ID NO: 536894 - protein, 14 aa, Mycobacterium
PDGATVTDRPAQLT

SEQ ID NO: 536895 - protein, 7 aa, Mycobacterium
PDGAYGV

SEQ ID NO: 536896 - protein, 4 aa, Mycobacterium
PDGD

SEQ ID NO: 536897 - protein, 10 aa, Mycobacterium
PDGDACTCGG

SEQ ID NO: 536898 - protein, 15 aa, Mycobacterium
PDGDDDELLPSGGPV

SEQ ID NO: 536899 - protein, 10 aa, Mycobacterium
PDGDDPRRDI

SEQ ID NO: 536900 - protein, 8 aa, Mycobacterium
PDGDEAWN

SEQ ID NO: 536901 - protein, 5 aa, Mycobacterium
PDGDG

SEQ ID NO: 536902 - protein, 5 aa, Mycobacterium
PDGDI

SEQ ID NO: 536903 - protein, 7 aa, Mycobacterium
PDGDPEM

SEQ ID NO: 536904 - protein, 6 aa, Mycobacterium
PDGDPQ

SEQ ID NO: 536905 - protein, 7 aa, Mycobacterium
PDGDRAG

SEQ ID NO: 536906 - protein, 6 aa, Mycobacterium
PDGDTM

SEQ ID NO: 536907 - protein, 8 aa, Mycobacterium
PDGDTRAS

SEQ ID NO: 536908 - protein, 8 aa, Mycobacterium
PDGDYANE

SEQ ID NO: 536909 - protein, 7 aa, Mycobacterium
PDGDYAT

SEQ ID NO: 536910 - protein, 48 aa, Mycobacterium
PDGEFDSGIRKRRRGRTRGPVRHDSAQVTDGIDTTADEVPSTESASRH

SEQ ID NO: 536911 - protein, 6 aa, Mycobacterium
PDGEIE

SEQ ID NO: 536912 - protein, 14 aa, Mycobacterium
PDGEKTPGKTVADP

SEQ ID NO: 536913 - protein, 14 aa, Mycobacterium
PDGEKTPGKTVPDP

SEQ ID NO: 536914 - protein, 9 aa, Mycobacterium
PDGELPDNL

SEQ ID NO: 536915 - protein, 5 aa, Mycobacterium
PDGEP

SEQ ID NO: 536916 - protein, 14 aa, Mycobacterium
PDGEPRTATADGSL

SEQ ID NO: 536917 - protein, 7 aa, Mycobacterium
PDGERAG

SEQ ID NO: 536918 - protein, 7 aa, Mycobacterium
PDGESIG

SEQ ID NO: 536919 - protein, 6 aa, Mycobacterium
PDGEVG

SEQ ID NO: 536920 - protein, 8 aa, Mycobacterium
PDGEVTAQ

SEQ ID NO: 536921 - protein, 5 aa, Mycobacterium
PDGFA

SEQ ID NO: 536922 - protein, 8 aa, Mycobacterium
PDGFAPDP

SEQ ID NO: 536923 - protein, 8 aa, Mycobacterium
PDGFEPDP

SEQ ID NO: 536924 - protein, 8 aa, Mycobacterium
PDGFSGHP

SEQ ID NO: 536925 - protein, 5 aa, Mycobacterium
PDGFT

SEQ ID NO: 536926 - protein, 7 aa, Mycobacterium
PDGGAEG

SEQ ID NO: 536927 - protein, 6 aa, Mycobacterium
PDGGAP

SEQ ID NO: 536928 - protein, 14 aa, Mycobacterium
PDGGARITVGSRAS

SEQ ID NO: 536929 - protein, 10 aa, Mycobacterium
PDGGDGSRSV

SEQ ID NO: 536930 - protein, 6 aa, Mycobacterium
PDGGEK

SEQ ID NO: 536931 - protein, 8 aa, Mycobacterium
PDGGEPQC

SEQ ID NO: 536932 - protein, 12 aa, Mycobacterium
PDGGIEAVRPGE

SEQ ID NO: 536933 - protein, 10 aa, Mycobacterium
PDGGIQENEA

SEQ ID NO: 536934 - protein, 14 aa, Mycobacterium
PDGGMSVAAAPRKR

SEQ ID NO: 536935 - protein, 14 aa, Mycobacterium
PDGGPSMWAMWRAP

SEQ ID NO: 536936 - protein, 6 aa, Mycobacterium
PDGGQV

SEQ ID NO: 536937 - protein, 10 aa, Mycobacterium
PDGGRTTRDG

SEQ ID NO: 536938 - protein, 8 aa, Mycobacterium
PDGGSSAL

SEQ ID NO: 536939 - protein, 5 aa, Mycobacterium
PDGGT

SEQ ID NO: 536940 - protein, 10 aa, Mycobacterium
PDGGTDDIPG

SEQ ID NO: 536941 - protein, 7 aa, Mycobacterium
PDGGTRA

SEQ ID NO: 536942 - protein, 6 aa, Mycobacterium
PDGGTV

SEQ ID NO: 536943 - protein, 22 aa, Mycobacterium
PDGGVDSASGALEHDTDGSGAA

SEQ ID NO: 536944 - protein, 7 aa, Mycobacterium
PDGGVPE

SEQ ID NO: 536945 - protein, 7 aa, Mycobacterium
PDGGVPQ

SEQ ID NO: 536946 - protein, 6 aa, Mycobacterium
PDGGWT

SEQ ID NO: 536947 - protein, 16 aa, Mycobacterium
PDGHCRSYSDEANGTL

SEQ ID NO: 536948 - protein, 15 aa, Mycobacterium
PDGHGSYWDDPSSDA

SEQ ID NO: 536949 - protein, 7 aa, Mycobacterium
PDGHREA

SEQ ID NO: 536950 - protein, 4 aa, Mycobacterium
PDGI

SEQ ID NO: 536951 - protein, 5 aa, Mycobacterium
PDGID

SEQ ID NO: 536952 - protein, 9 aa, Mycobacterium
PDGIEGATS

SEQ ID NO: 536953 - protein, 11 aa, Mycobacterium
PDGIGETRGYP

SEQ ID NO: 536954 - protein, 17 aa, Mycobacterium
PDGIGGSAAEVYAALQK

SEQ ID NO: 536955 - protein, 4 aa, Mycobacterium
PDGK

SEQ ID NO: 536956 - protein, 8 aa, Mycobacterium
PDGKEPQW

SEQ ID NO: 536957 - protein, 12 aa, Mycobacterium
PDGKSAKDLGLD

SEQ ID NO: 536958 - protein, 8 aa, Mycobacterium
PDGKTQVT

SEQ ID NO: 536959 - protein, 6 aa, Mycobacterium
PDGKVT

SEQ ID NO: 536960 - protein, 4 aa, Mycobacterium
PDGL

SEQ ID NO: 536961 - protein, 5 aa, Mycobacterium
PDGLD

SEQ ID NO: 536962 - protein, 7 aa, Mycobacterium
PDGLEST

SEQ ID NO: 536963 - protein, 16 aa, Mycobacterium
PDGLGGSAAELAARTA

SEQ ID NO: 536964 - protein, 5 aa, Mycobacterium
PDGLN

SEQ ID NO: 536965 - protein, 6 aa, Mycobacterium
PDGLPA

SEQ ID NO: 536966 - protein, 7 aa, Mycobacterium
PDGLSDP

SEQ ID NO: 536967 - protein, 8 aa, Mycobacterium
PDGLSDPA

SEQ ID NO: 536968 - protein, 5 aa, Mycobacterium
PDGLT

SEQ ID NO: 536969 - protein, 4 aa, Mycobacterium
PDGM

SEQ ID NO: 536970 - protein, 6 aa, Mycobacterium
PDGMST

SEQ ID NO: 536971 - protein, 12 aa, Mycobacterium
PDGNELPPGQPG

SEQ ID NO: 536972 - protein, 10 aa, Mycobacterium
PDGNGAQATA

SEQ ID NO: 536973 - protein, 8 aa, Mycobacterium
PDGNGITD

SEQ ID NO: 536974 - protein, 8 aa, Mycobacterium
PDGNTTTD

SEQ ID NO: 536975 - protein, 4 aa, Mycobacterium
PDGP

SEQ ID NO: 536976 - protein, 10 aa, Mycobacterium
PDGPAARNGA

SEQ ID NO: 536977 - protein, 10 aa, Mycobacterium
PDGPAGLAGG

SEQ ID NO: 536978 - protein, 11 aa, Mycobacterium
PDGPDDPQIPA

SEQ ID NO: 536979 - protein, 7 aa, Mycobacterium
PDGPDGP

SEQ ID NO: 536980 - protein, 7 aa, Mycobacterium
PDGPERI

SEQ ID NO: 536981 - protein, 9 aa, Mycobacterium
PDGPESQVP

SEQ ID NO: 536982 - protein, 6 aa, Mycobacterium
PDGPGQ

SEQ ID NO: 536983 - protein, 7 aa, Mycobacterium
PDGPGRA

SEQ ID NO: 536984 - protein, 6 aa, Mycobacterium
PDGPID

SEQ ID NO: 536985 - protein, 8 aa, Mycobacterium
PDGPKAAR

SEQ ID NO: 536986 - protein, 6 aa, Mycobacterium
PDGPNR

SEQ ID NO: 536987 - protein, 8 aa, Mycobacterium
PDGPPDSR

SEQ ID NO: 536988 - protein, 10 aa, Mycobacterium
PDGPPRTGRF

SEQ ID NO: 536989 - protein, 20 aa, Mycobacterium
PDGPPRTGRFGPAPVGPATG

SEQ ID NO: 536990 - protein, 5 aa, Mycobacterium
PDGPQ

SEQ ID NO: 536991 - protein, 5 aa, Mycobacterium
PDGPS

SEQ ID NO: 536992 - protein, 8 aa, Mycobacterium
PDGPSAYA

SEQ ID NO: 536993 - protein, 7 aa, Mycobacterium
PDGPSFT

SEQ ID NO: 536994 - protein, 10 aa, Mycobacterium
PDGPTPQVAN

SEQ ID NO: 536995 - protein, 12 aa, Mycobacterium
PDGPVPAKKDMP

SEQ ID NO: 536996 - protein, 5 aa, Mycobacterium
PDGPY

SEQ ID NO: 536997 - protein, 6 aa, Mycobacterium
PDGQGG

SEQ ID NO: 536998 - protein, 23 aa, Mycobacterium
PDGQHHGTKSLKSIADASQAISG

SEQ ID NO: 536999 - protein, 8 aa, Mycobacterium
PDGQQPPL

SEQ ID NO: 537000 - protein, 14 aa, Mycobacterium
PDGQRVTKRSEDSR

SEQ ID NO: 537001 - protein, 15 aa, Mycobacterium
PDGQWTAAPHDGHNV

SEQ ID NO: 537002 - protein, 15 aa, Mycobacterium
PDGQWTASPQEGRTV

SEQ ID NO: 537003 - protein, 16 aa, Mycobacterium
PDGRALTGPVGPRRGE

SEQ ID NO: 537004 - protein, 8 aa, Mycobacterium
PDGRDYKN

SEQ ID NO: 537005 - protein, 5 aa, Mycobacterium
PDGRF

SEQ ID NO: 537006 - protein, 29 aa, Mycobacterium
PDGRGGSAADLNRRGSAADLASIDQKGTT

SEQ ID NO: 537007 - protein, 15 aa, Mycobacterium
PDGRHSDEDRARRRG

SEQ ID NO: 537008 - protein, 11 aa, Mycobacterium
PDGRISAGGAT

SEQ ID NO: 537009 - protein, 7 aa, Mycobacterium
PDGRITT

SEQ ID NO: 537010 - protein, 5 aa, Mycobacterium
PDGRK

SEQ ID NO: 537011 - protein, 6 aa, Mycobacterium
PDGRLS

SEQ ID NO: 537012 - protein, 5 aa, Mycobacterium
PDGRM

SEQ ID NO: 537013 - protein, 5 aa, Mycobacterium
PDGRP

SEQ ID NO: 537014 - protein, 9 aa, Mycobacterium
PDGRPFRDP

SEQ ID NO: 537015 - protein, 9 aa, Mycobacterium
PDGRPFRDT

SEQ ID NO: 537016 - protein, 11 aa, Mycobacterium
PDGRPGPRKDT

SEQ ID NO: 537017 - protein, 5 aa, Mycobacterium
PDGRR

SEQ ID NO: 537018 - protein, 7 aa, Mycobacterium
PDGRRTV

SEQ ID NO: 537019 - protein, 13 aa, Mycobacterium
PDGRSDTVAASTT

SEQ ID NO: 537020 - protein, 7 aa, Mycobacterium
PDGRTSI

SEQ ID NO: 537021 - protein, 7 aa, Mycobacterium
PDGRVAS

SEQ ID NO: 537022 - protein, 5 aa, Mycobacterium
PDGRY

SEQ ID NO: 537023 - protein, 15 aa, Mycobacterium
PDGRYSDEDRARRRG

SEQ ID NO: 537024 - protein, 7 aa, Mycobacterium
PDGSAFS

SEQ ID NO: 537025 - protein, 8 aa, Mycobacterium
PDGSALSD

SEQ ID NO: 537026 - protein, 19 aa, Mycobacterium
PDGSALTNPSLAQVKAKLG

SEQ ID NO: 537027 - protein, 5 aa, Mycobacterium
PDGSC

SEQ ID NO: 537028 - protein, 8 aa, Mycobacterium
PDGSDAWD

SEQ ID NO: 537029 - protein, 12 aa, Mycobacterium
PDGSDDPRIPPE

SEQ ID NO: 537030 - protein, 5 aa, Mycobacterium
PDGSE

SEQ ID NO: 537031 - protein, 7 aa, Mycobacterium
PDGSEAS

SEQ ID NO: 537032 - protein, 16 aa, Mycobacterium
PDGSEMTDEDWDAGYA

SEQ ID NO: 537033 - protein, 7 aa, Mycobacterium
PDGSGCG

SEQ ID NO: 537034 - protein, 8 aa, Mycobacterium
PDGSGITD

SEQ ID NO: 537035 - protein, 7 aa, Mycobacterium
PDGSGRW

SEQ ID NO: 537036 - protein, 8 aa, Mycobacterium
PDGSGYNF

SEQ ID NO: 537037 - protein, 8 aa, Mycobacterium
PDGSKPTI

SEQ ID NO: 537038 - protein, 6 aa, Mycobacterium
PDGSLD

SEQ ID NO: 537039 - protein, 10 aa, Mycobacterium
PDGSPGARKD

SEQ ID NO: 537040 - protein, 8 aa, Mycobacterium
PDGSPLDD

SEQ ID NO: 537041 - protein, 10 aa, Mycobacterium
PDGSPSWSDP

SEQ ID NO: 537042 - protein, 14 aa, Mycobacterium
PDGSPVTATTAQHA

SEQ ID NO: 537043 - protein, 6 aa, Mycobacterium
PDGSRL

SEQ ID NO: 537044 - protein, 7 aa, Mycobacterium
PDGSRNR

SEQ ID NO: 537045 - protein, 12 aa, Mycobacterium
PDGSSPEASGLT

SEQ ID NO: 537046 - protein, 6 aa, Mycobacterium
PDGSTA

SEQ ID NO: 537047 - protein, 8 aa, Mycobacterium
PDGSTQSM

SEQ ID NO: 537048 - protein, 14 aa, Mycobacterium
PDGSTTWKRSPGGL

SEQ ID NO: 537049 - protein, 8 aa, Mycobacterium
PDGSVAQT

SEQ ID NO: 537050 - protein, 8 aa, Mycobacterium
PDGSVETE

SEQ ID NO: 537051 - protein, 8 aa, Mycobacterium
PDGSVRPA

SEQ ID NO: 537052 - protein, 13 aa, Mycobacterium
PDGSVTGSVSGGC

SEQ ID NO: 537053 - protein, 8 aa, Mycobacterium
PDGSVTPG

SEQ ID NO: 537054 - protein, 21 aa, Mycobacterium
PDGSWTDTLSGATASGPTSAA

SEQ ID NO: 537055 - protein, 8 aa, Mycobacterium
PDGTAFPT

SEQ ID NO: 537056 - protein, 6 aa, Mycobacterium
PDGTAG

SEQ ID NO: 537057 - protein, 18 aa, Mycobacterium
PDGTCTEPTNVKAGGGAC

SEQ ID NO: 537058 - protein, 7 aa, Mycobacterium
PDGTDTV

SEQ ID NO: 537059 - protein, 6 aa, Mycobacterium
PDGTER

SEQ ID NO: 537060 - protein, 15 aa, Mycobacterium
PDGTFTDEDRARRRG

SEQ ID NO: 537061 - protein, 16 aa, Mycobacterium
PDGTFTDEDRARRRGL

SEQ ID NO: 537062 - protein, 5 aa, Mycobacterium
PDGTI

SEQ ID NO: 537063 - protein, 16 aa, Mycobacterium
PDGTKAPGKTVPDPYF

SEQ ID NO: 537064 - protein, 25 aa, Mycobacterium
PDGTKAPGKTVPDPYFGGAGPARTG

SEQ ID NO: 537065 - protein, 15 aa, Mycobacterium
PDGTKTPGKTVPDPY

SEQ ID NO: 537066 - protein, 15 aa, Mycobacterium
PDGTLPVTTPKAEPL

SEQ ID NO: 537067 - protein, 8 aa, Mycobacterium
PDGTNGGP

SEQ ID NO: 537068 - protein, 5 aa, Mycobacterium
PDGTP

SEQ ID NO: 537069 - protein, 9 aa, Mycobacterium
PDGTPGARK

SEQ ID NO: 537070 - protein, 11 aa, Mycobacterium
PDGTPGIERGA

SEQ ID NO: 537071 - protein, 11 aa, Mycobacterium
PDGTPKAVGTR

SEQ ID NO: 537072 - protein, 9 aa, Mycobacterium
PDGTPTEFA

SEQ ID NO: 537073 - protein, 6 aa, Mycobacterium
PDGTPV

SEQ ID NO: 537074 - protein, 13 aa, Mycobacterium
PDGTQQTMAAPGR

SEQ ID NO: 537075 - protein, 20 aa, Mycobacterium
PDGTRCDPRRPSIGEAVPVV

SEQ ID NO: 537076 - protein, 8 aa, Mycobacterium
PDGTREPR

SEQ ID NO: 537077 - protein, 6 aa, Mycobacterium
PDGTRL

SEQ ID NO: 537078 - protein, 8 aa, Mycobacterium
PDGTRQPR

SEQ ID NO: 537079 - protein, 7 aa, Mycobacterium
PDGTRSE

SEQ ID NO: 537080 - protein, 14 aa, Mycobacterium
PDGTRSWKRSPGGL

SEQ ID NO: 537081 - protein, 7 aa, Mycobacterium
PDGTRTR

SEQ ID NO: 537082 - protein, 10 aa, Mycobacterium
PDGTRYQHDA

SEQ ID NO: 537083 - protein, 9 aa, Mycobacterium
PDGTSADVS

SEQ ID NO: 537084 - protein, 8 aa, Mycobacterium
PDGTSLDE

SEQ ID NO: 537085 - protein, 7 aa, Mycobacterium
PDGTTAV

SEQ ID NO: 537086 - protein, 9 aa, Mycobacterium
PDGTTCGSS

SEQ ID NO: 537087 - protein, 12 aa, Mycobacterium
PDGTTPSPGDVA

SEQ ID NO: 537088 - protein, 9 aa, Mycobacterium
PDGTTQEQP

SEQ ID NO: 537089 - protein, 13 aa, Mycobacterium
PDGTVAGSVSGGC

SEQ ID NO: 537090 - protein, 9 aa, Mycobacterium
PDGTVDDAA

SEQ ID NO: 537091 - protein, 13 aa, Mycobacterium
PDGTVDDADRACA

SEQ ID NO: 537092 - protein, 13 aa, Mycobacterium
PDGTVSGSVSGGC

SEQ ID NO: 537093 - protein, 7 aa, Mycobacterium
PDGTVYP

SEQ ID NO: 537094 - protein, 5 aa, Mycobacterium
PDGTW

SEQ ID NO: 537095 - protein, 5 aa, Mycobacterium
PDGTY

SEQ ID NO: 537096 - protein, 5 aa, Mycobacterium
PDGVA

SEQ ID NO: 537097 - protein, 7 aa, Mycobacterium
PDGVANY

SEQ ID NO: 537098 - protein, 7 aa, Mycobacterium
PDGVAPG

SEQ ID NO: 537099 - protein, 31 aa, Mycobacterium
PDGVATTTAGRIAERAATEATALTPEDAANR

SEQ ID NO: 537100 - protein, 5 aa, Mycobacterium
PDGVD

SEQ ID NO: 537101 - protein, 8 aa, Mycobacterium
PDGVDEDD

SEQ ID NO: 537102 - protein, 7 aa, Mycobacterium
PDGVDPA

SEQ ID NO: 537103 - protein, 5 aa, Mycobacterium
PDGVG

SEQ ID NO: 537104 - protein, 9 aa, Mycobacterium
PDGVGKSTL

SEQ ID NO: 537105 - protein, 8 aa, Mycobacterium
PDGVGQAT

SEQ ID NO: 537106 - protein, 5 aa, Mycobacterium
PDGVK

SEQ ID NO: 537107 - protein, 15 aa, Mycobacterium
PDGVPGISAPAAIPG

SEQ ID NO: 537108 - protein, 15 aa, Mycobacterium
PDGVPGLTAPAAIPG

SEQ ID NO: 537109 - protein, 6 aa, Mycobacterium
PDGVRT

SEQ ID NO: 537110 - protein, 6 aa, Mycobacterium
PDGVSA

SEQ ID NO: 537111 - protein, 8 aa, Mycobacterium
PDGVSSDV

SEQ ID NO: 537112 - protein, 6 aa, Mycobacterium
PDGVTH

SEQ ID NO: 537113 - protein, 8 aa, Mycobacterium
PDGYDPPR

SEQ ID NO: 537114 - protein, 14 aa, Mycobacterium
PDGYDRDSPRAGEA

SEQ ID NO: 537115 - protein, 7 aa, Mycobacterium
PDGYYKT

SEQ ID NO: 537116 - protein, 6 aa, Mycobacterium
PDHAAD

SEQ ID NO: 537117 - protein, 12 aa, Mycobacterium
PDHADGPSKHDL

SEQ ID NO: 537118 - protein, 9 aa, Mycobacterium
PDHADTTRL

SEQ ID NO: 537119 - protein, 5 aa, Mycobacterium
PDHAE

SEQ ID NO: 537120 - protein, 12 aa, Mycobacterium
PDHAEKARAQVR

SEQ ID NO: 537121 - protein, 23 aa, Mycobacterium
PDHAREDVQRSIDASTGDQKNQL

SEQ ID NO: 537122 - protein, 4 aa, Mycobacterium
PDHD

SEQ ID NO: 537123 - protein, 8 aa, Mycobacterium
PDHEGTTG

SEQ ID NO: 537124 - protein, 18 aa, Mycobacterium
PDHGGAERELPNHGSSTG

SEQ ID NO: 537125 - protein, 6 aa, Mycobacterium
PDHGGC

SEQ ID NO: 537126 - protein, 10 aa, Mycobacterium
PDHPEPGLAE

SEQ ID NO: 537127 - protein, 5 aa, Mycobacterium
PDHPR

SEQ ID NO: 537128 - protein, 10 aa, Mycobacterium
PDHPSDDEAV

SEQ ID NO: 537129 - protein, 20 aa, Mycobacterium
PDHPWRRADGRDRVQGRVKD

SEQ ID NO: 537130 - protein, 4 aa, Mycobacterium
PDHQ

SEQ ID NO: 537131 - protein, 9 aa, Mycobacterium
PDHRDQRRE

SEQ ID NO: 537132 - protein, 7 aa, Mycobacterium
PDHRDTY

SEQ ID NO: 537133 - protein, 7 aa, Mycobacterium
PDHRETY

SEQ ID NO: 537134 - protein, 5 aa, Mycobacterium
PDHTD

SEQ ID NO: 537135 - protein, 8 aa, Mycobacterium
PDHTPGEH

SEQ ID NO: 537136 - protein, 4 aa, Mycobacterium
PDHV

SEQ ID NO: 537137 - protein, 5 aa, Mycobacterium
PDHVD

SEQ ID NO: 537138 - protein, 15 aa, Mycobacterium
PDHVEAESPGTDGGL

SEQ ID NO: 537139 - protein, 14 aa, Mycobacterium
PDHYGGNSSEEYAA

SEQ ID NO: 537140 - protein, 4 aa, Mycobacterium
PDIA

SEQ ID NO: 537141 - protein, 14 aa, Mycobacterium
PDIAEGLSEGESAL

SEQ ID NO: 537142 - protein, 8 aa, Mycobacterium
PDIAPGSV

SEQ ID NO: 537143 - protein, 7 aa, Mycobacterium
PDIDAGK

SEQ ID NO: 537144 - protein, 16 aa, Mycobacterium
PDIDSSTISPLEDGRP

SEQ ID NO: 537145 - protein, 4 aa, Mycobacterium
PDIE

SEQ ID NO: 537146 - protein, 9 aa, Mycobacterium
PDIEQSYNT

SEQ ID NO: 537147 - protein, 5 aa, Mycobacterium
PDIGG

SEQ ID NO: 537148 - protein, 6 aa, Mycobacterium
PDIGGA

SEQ ID NO: 537149 - protein, 11 aa, Mycobacterium
PDINSNQAVPS

SEQ ID NO: 537150 - protein, 5 aa, Mycobacterium
PDIPA

SEQ ID NO: 537151 - protein, 17 aa, Mycobacterium
PDIPETGTETQAPSGDK

SEQ ID NO: 537152 - protein, 5 aa, Mycobacterium
PDIPG

SEQ ID NO: 537153 - protein, 4 aa, Mycobacterium
PDIQ

SEQ ID NO: 537154 - protein, 11 aa, Mycobacterium
PDIQQQVRDNP

SEQ ID NO: 537155 - protein, 12 aa, Mycobacterium
PDIQRQVRDDPD

SEQ ID NO: 537156 - protein, 5 aa, Mycobacterium
PDIQS

SEQ ID NO: 537157 - protein, 23 aa, Mycobacterium
PDIRPKSLRDRQATGRILTSNHS

SEQ ID NO: 537158 - protein, 11 aa, Mycobacterium
PDISKQDAESI

SEQ ID NO: 537159 - protein, 5 aa, Mycobacterium
PDITA

SEQ ID NO: 537160 - protein, 7 aa, Mycobacterium
PDKAKLA

SEQ ID NO: 537161 - protein, 7 aa, Mycobacterium
PDKASVA

SEQ ID NO: 537162 - protein, 9 aa, Mycobacterium
PDKDDAVRE

SEQ ID NO: 537163 - protein, 8 aa, Mycobacterium
PDKDHPLS

SEQ ID NO: 537164 - protein, 5 aa, Mycobacterium
PDKDK

SEQ ID NO: 537165 - protein, 9 aa, Mycobacterium
PDKDPHKAA

SEQ ID NO: 537166 - protein, 7 aa, Mycobacterium
PDKEVTS

SEQ ID NO: 537167 - protein, 18 aa, Mycobacterium
PDKFDPDRFSEPRNEHKR

SEQ ID NO: 537168 - protein, 13 aa, Mycobacterium
PDKFSGSPLRDLV

SEQ ID NO: 537169 - protein, 14 aa, Mycobacterium
PDKFTGSPLRATPA

SEQ ID NO: 537170 - protein, 6 aa, Mycobacterium
PDKHPN

SEQ ID NO: 537171 - protein, 25 aa, Mycobacterium
PDKIGRDAGELAGAAPNGVKATGTV

SEQ ID NO: 537172 - protein, 9 aa, Mycobacterium
PDKKGTVTE

SEQ ID NO: 537173 - protein, 14 aa, Mycobacterium
PDKLATAEITRHIS

SEQ ID NO: 537174 - protein, 7 aa, Mycobacterium
PDKLRRS

SEQ ID NO: 537175 - protein, 19 aa, Mycobacterium
PDKLSQANAAARIGPQPGP

SEQ ID NO: 537176 - protein, 7 aa, Mycobacterium
PDKLTGK

SEQ ID NO: 537177 - protein, 8 aa, Mycobacterium
PDKPEAEV

SEQ ID NO: 537178 - protein, 7 aa, Mycobacterium
PDKPESA

SEQ ID NO: 537179 - protein, 8 aa, Mycobacterium
PDKPGLDA

SEQ ID NO: 537180 - protein, 8 aa, Mycobacterium
PDKPIKKF

SEQ ID NO: 537181 - protein, 17 aa, Mycobacterium
PDKPLKTDGSAQPVPIP

SEQ ID NO: 537182 - protein, 10 aa, Mycobacterium
PDKPPAAQVD

SEQ ID NO: 537183 - protein, 5 aa, Mycobacterium
PDKPV

SEQ ID NO: 537184 - protein, 6 aa, Mycobacterium
PDKRAA

SEQ ID NO: 537185 - protein, 8 aa, Mycobacterium
PDKRDEVR

SEQ ID NO: 537186 - protein, 4 aa, Mycobacterium
PDKS

SEQ ID NO: 537187 - protein, 7 aa, Mycobacterium
PDKSAAP

SEQ ID NO: 537188 - protein, 8 aa, Mycobacterium
PDKSEAEV

SEQ ID NO: 537189 - protein, 8 aa, Mycobacterium
PDKSESEV

SEQ ID NO: 537190 - protein, 10 aa, Mycobacterium
PDKSTSDVSM

SEQ ID NO: 537191 - protein, 6 aa, Mycobacterium
PDKTFE

SEQ ID NO: 537192 - protein, 7 aa, Mycobacterium
PDKTPEL

SEQ ID NO: 537193 - protein, 4 aa, Mycobacterium
PDKV

SEQ ID NO: 537194 - protein, 11 aa, Mycobacterium
PDKVGADAGEL

SEQ ID NO: 537195 - protein, 9 aa, Mycobacterium
PDLAATEQT

SEQ ID NO: 537196 - protein, 5 aa, Mycobacterium
PDLAD

SEQ ID NO: 537197 - protein, 8 aa, Mycobacterium
PDLADDAN

SEQ ID NO: 537198 - protein, 17 aa, Mycobacterium
PDLADDPRFATNSDRCA

SEQ ID NO: 537199 - protein, 16 aa, Mycobacterium
PDLADSLKKGATIGGR

SEQ ID NO: 537200 - protein, 9 aa, Mycobacterium
PDLAEADAR

SEQ ID NO: 537201 - protein, 7 aa, Mycobacterium
PDLAGRG

SEQ ID NO: 537202 - protein, 11 aa, Mycobacterium
PDLAPPGKHAA

SEQ ID NO: 537203 - protein, 11 aa, Mycobacterium
PDLAPPQRIPR

SEQ ID NO: 537204 - protein, 5 aa, Mycobacterium
PDLAQ

SEQ ID NO: 537205 - protein, 11 aa, Mycobacterium
PDLARRGRGGV

SEQ ID NO: 537206 - protein, 10 aa, Mycobacterium
PDLARRGRGT

SEQ ID NO: 537207 - protein, 10 aa, Mycobacterium
PDLDDAARSA

SEQ ID NO: 537208 - protein, 8 aa, Mycobacterium
PDLDDDEL

SEQ ID NO: 537209 - protein, 10 aa, Mycobacterium
PDLDGRADPG

SEQ ID NO: 537210 - protein, 6 aa, Mycobacterium
PDLDHP

SEQ ID NO: 537211 - protein, 6 aa, Mycobacterium
PDLDPG

SEQ ID NO: 537212 - protein, 10 aa, Mycobacterium
PDLDPNNLPA

SEQ ID NO: 537213 - protein, 12 aa, Mycobacterium
PDLDRPPTRAEF

SEQ ID NO: 537214 - protein, 6 aa, Mycobacterium
PDLEAA

SEQ ID NO: 537215 - protein, 16 aa, Mycobacterium
PDLEATAQIIRAAVQA

SEQ ID NO: 537216 - protein, 11 aa, Mycobacterium
PDLEPDTKTGL

SEQ ID NO: 537217 - protein, 5 aa, Mycobacterium
PDLER

SEQ ID NO: 537218 - protein, 13 aa, Mycobacterium
PDLESTGKPERLR

SEQ ID NO: 537219 - protein, 4 aa, Mycobacterium
PDLG

SEQ ID NO: 537220 - protein, 11 aa, Mycobacterium
PDLGAGPVSGP

SEQ ID NO: 537221 - protein, 29 aa, Mycobacterium
PDLGDCPDTRASGRHRRDDRATGWRRRPR

SEQ ID NO: 537222 - protein, 16 aa, Mycobacterium
PDLGDPVAGSDAGLPG

SEQ ID NO: 537223 - protein, 5 aa, Mycobacterium
PDLGE

SEQ ID NO: 537224 - protein, 16 aa, Mycobacterium
PDLGEMPAGLNPAKCD

SEQ ID NO: 537225 - protein, 14 aa, Mycobacterium
PDLGGRRKPPVDPV

SEQ ID NO: 537226 - protein, 13 aa, Mycobacterium
PDLGGTATTTALG

SEQ ID NO: 537227 - protein, 10 aa, Mycobacterium
PDLGHTRAAS

SEQ ID NO: 537228 - protein, 15 aa, Mycobacterium
PDLGKAVEEGVRANS

SEQ ID NO: 537229 - protein, 5 aa, Mycobacterium
PDLGP

SEQ ID NO: 537230 - protein, 16 aa, Mycobacterium
PDLGPMPEGLNPAKCD

SEQ ID NO: 537231 - protein, 7 aa, Mycobacterium
PDLGPSA

SEQ ID NO: 537232 - protein, 18 aa, Mycobacterium
PDLGRQPAEGTEVPESGA

SEQ ID NO: 537233 - protein, 12 aa, Mycobacterium
PDLGRSAGIRAA

SEQ ID NO: 537234 - protein, 16 aa, Mycobacterium
PDLGRTPADLSGLPKV

SEQ ID NO: 537235 - protein, 8 aa, Mycobacterium
PDLGRYGS

SEQ ID NO: 537236 - protein, 7 aa, Mycobacterium
PDLHTPE

SEQ ID NO: 537237 - protein, 4 aa, Mycobacterium
PDLN

SEQ ID NO: 537238 - protein, 10 aa, Mycobacterium
PDLNESKAFD

SEQ ID NO: 537239 - protein, 7 aa, Mycobacterium
PDLNRAG

SEQ ID NO: 537240 - protein, 7 aa, Mycobacterium
PDLPADE

SEQ ID NO: 537241 - protein, 8 aa, Mycobacterium
PDLPPELE

SEQ ID NO: 537242 - protein, 6 aa, Mycobacterium
PDLQKA

SEQ ID NO: 537243 - protein, 8 aa, Mycobacterium
PDLQPERN

SEQ ID NO: 537244 - protein, 6 aa, Mycobacterium
PDLQRA

SEQ ID NO: 537245 - protein, 7 aa, Mycobacterium
PDLRQPA

SEQ ID NO: 537246 - protein, 12 aa, Mycobacterium
PDLRQSVASNTA

SEQ ID NO: 537247 - protein, 8 aa, Mycobacterium
PDLRRSND

SEQ ID NO: 537248 - protein, 5 aa, Mycobacterium
PDLSA

SEQ ID NO: 537249 - protein, 10 aa, Mycobacterium
PDLSDGAAAL

SEQ ID NO: 537250 - protein, 7 aa, Mycobacterium
PDLSGGR

SEQ ID NO: 537251 - protein, 8 aa, Mycobacterium
PDLSNSTP

SEQ ID NO: 537252 - protein, 12 aa, Mycobacterium
PDLTGPNAADLD

SEQ ID NO: 537253 - protein, 7 aa, Mycobacterium
PDLTPAQ

SEQ ID NO: 537254 - protein, 8 aa, Mycobacterium
PDLTPDEH

SEQ ID NO: 537255 - protein, 8 aa, Mycobacterium
PDLTPEQI

SEQ ID NO: 537256 - protein, 7 aa, Mycobacterium
PDLTPGP

SEQ ID NO: 537257 - protein, 9 aa, Mycobacterium
PDMDPRGQR

SEQ ID NO: 537258 - protein, 9 aa, Mycobacterium
PDMEPANES

SEQ ID NO: 537259 - protein, 9 aa, Mycobacterium
PDMEPGEES

SEQ ID NO: 537260 - protein, 8 aa, Mycobacterium
PDMEPGNE

SEQ ID NO: 537261 - protein, 6 aa, Mycobacterium
PDMGQF

SEQ ID NO: 537262 - protein, 10 aa, Mycobacterium
PDMPDTSSAV

SEQ ID NO: 537263 - protein, 12 aa, Mycobacterium
PDMPGGPPQSHR

SEQ ID NO: 537264 - protein, 6 aa, Mycobacterium
PDMRDD

SEQ ID NO: 537265 - protein, 12 aa, Mycobacterium
PDMSPGKEPNPC

SEQ ID NO: 537266 - protein, 13 aa, Mycobacterium
PDMSTSPDYPSTP

SEQ ID NO: 537267 - protein, 5 aa, Mycobacterium
PDNAV

SEQ ID NO: 537268 - protein, 4 aa, Mycobacterium
PDNE

SEQ ID NO: 537269 - protein, 8 aa, Mycobacterium
PDNEDSHG

SEQ ID NO: 537270 - protein, 9 aa, Mycobacterium
PDNGPDDLS

SEQ ID NO: 537271 - protein, 13 aa, Mycobacterium
PDNGPYDESAARR

SEQ ID NO: 537272 - protein, 4 aa, Mycobacterium
PDNH

SEQ ID NO: 537273 - protein, 4 aa, Mycobacterium
PDNP

SEQ ID NO: 537274 - protein, 6 aa, Mycobacterium
PDNPAY

SEQ ID NO: 537275 - protein, 8 aa, Mycobacterium
PDNPDSIV

SEQ ID NO: 537276 - protein, 16 aa, Mycobacterium
PDNPHDPQSTGTANLT

SEQ ID NO: 537277 - protein, 10 aa, Mycobacterium
PDNPHQPPYT

SEQ ID NO: 537278 - protein, 10 aa, Mycobacterium
PDNPITETGV

SEQ ID NO: 537279 - protein, 16 aa, Mycobacterium
PDNPKDPQATGTSNLA

SEQ ID NO: 537280 - protein, 10 aa, Mycobacterium
PDNPNQPPYS

SEQ ID NO: 537281 - protein, 10 aa, Mycobacterium
PDNPPAGSVD

SEQ ID NO: 537282 - protein, 12 aa, Mycobacterium
PDNPPGEPRADR

SEQ ID NO: 537283 - protein, 7 aa, Mycobacterium
PDNPSLT

SEQ ID NO: 537284 - protein, 6 aa, Mycobacterium
PDNPSM

SEQ ID NO: 537285 - protein, 5 aa, Mycobacterium
PDNPY

SEQ ID NO: 537286 - protein, 6 aa, Mycobacterium
PDNQTL

SEQ ID NO: 537287 - protein, 4 aa, Mycobacterium
PDNR

SEQ ID NO: 537288 - protein, 7 aa, Mycobacterium
PDNRGLK

SEQ ID NO: 537289 - protein, 20 aa, Mycobacterium
PDNTRAYPSLAPLPDGHVVW

SEQ ID NO: 537290 - protein, 9 aa, Mycobacterium
PDNTTGTLP

SEQ ID NO: 537291 - protein, 6 aa, Mycobacterium
PDNTYM

SEQ ID NO: 537292 - protein, 16 aa, Mycobacterium
PDNVAGGMGGAPPDEE

SEQ ID NO: 537293 - protein, 15 aa, Mycobacterium
PDNVAGGMGGMPPDE

SEQ ID NO: 537294 - protein, 11 aa, Mycobacterium
PDNVQGAAGPF

SEQ ID NO: 537295 - protein, 12 aa, Mycobacterium
PDNVQGASGPFD

SEQ ID NO: 537296 - protein, 12 aa, Mycobacterium
PDPAAMDPDQPF

SEQ ID NO: 537297 - protein, 9 aa, Mycobacterium
PDPADGGRA

SEQ ID NO: 537298 - protein, 8 aa, Mycobacterium
PDPADGRR

SEQ ID NO: 537299 - protein, 9 aa, Mycobacterium
PDPADPGAL

SEQ ID NO: 537300 - protein, 9 aa, Mycobacterium
PDPADRGRV

SEQ ID NO: 537301 - protein, 5 aa, Mycobacterium
PDPAE

SEQ ID NO: 537302 - protein, 26 aa, Mycobacterium
PDPAEPAGGTIPPGRPGGRSWTHTPP

SEQ ID NO: 537303 - protein, 16 aa, Mycobacterium
PDPAGDPDSDPKKDKV

SEQ ID NO: 537304 - protein, 7 aa, Mycobacterium
PDPAGLP

SEQ ID NO: 537305 - protein, 7 aa, Mycobacterium
PDPAGQA

SEQ ID NO: 537306 - protein, 8 aa, Mycobacterium
PDPAGQAL

SEQ ID NO: 537307 - protein, 9 aa, Mycobacterium
PDPAGQPLD

SEQ ID NO: 537308 - protein, 9 aa, Mycobacterium
PDPAGQPLP

SEQ ID NO: 537309 - protein, 17 aa, Mycobacterium
PDPAGTRAGGAPARYGE

SEQ ID NO: 537310 - protein, 5 aa, Mycobacterium
PDPAL

SEQ ID NO: 537311 - protein, 23 aa, Mycobacterium
PDPALAKDKQAVPPSNQRGPERA

SEQ ID NO: 537312 - protein, 7 aa, Mycobacterium
PDPALDG

SEQ ID NO: 537313 - protein, 14 aa, Mycobacterium
PDPALDGANPALTT

SEQ ID NO: 537314 - protein, 12 aa, Mycobacterium
PDPAPGETNPLR

SEQ ID NO: 537315 - protein, 6 aa, Mycobacterium
PDPAPS

SEQ ID NO: 537316 - protein, 9 aa, Mycobacterium
PDPAQRPRL

SEQ ID NO: 537317 - protein, 25 aa, Mycobacterium
PDPAQRRDPLASPAWDQATDDLSGI

SEQ ID NO: 537318 - protein, 6 aa, Mycobacterium
PDPARV

SEQ ID NO: 537319 - protein, 21 aa, Mycobacterium
PDPASSKQAQSGSSQTGTARV

SEQ ID NO: 537320 - protein, 5 aa, Mycobacterium
PDPAT

SEQ ID NO: 537321 - protein, 7 aa, Mycobacterium
PDPATGY

SEQ ID NO: 537322 - protein, 8 aa, Mycobacterium
PDPATLEP

SEQ ID NO: 537323 - protein, 6 aa, Mycobacterium
PDPAVG

SEQ ID NO: 537324 - protein, 11 aa, Mycobacterium
PDPCQSPQSEL

SEQ ID NO: 537325 - protein, 7 aa, Mycobacterium
PDPDAAM

SEQ ID NO: 537326 - protein, 12 aa, Mycobacterium
PDPDALGKTYTR

SEQ ID NO: 537327 - protein, 6 aa, Mycobacterium
PDPDAR

SEQ ID NO: 537328 - protein, 8 aa, Mycobacterium
PDPDEAWS

SEQ ID NO: 537329 - protein, 7 aa, Mycobacterium
PDPDFAG

SEQ ID NO: 537330 - protein, 7 aa, Mycobacterium
PDPDGDE

SEQ ID NO: 537331 - protein, 8 aa, Mycobacterium
PDPDGDEV

SEQ ID NO: 537332 - protein, 10 aa, Mycobacterium
PDPDGERAGY

SEQ ID NO: 537333 - protein, 9 aa, Mycobacterium
PDPDGSGRL

SEQ ID NO: 537334 - protein, 8 aa, Mycobacterium
PDPDHPDE

SEQ ID NO: 537335 - protein, 8 aa, Mycobacterium
PDPDKPAN

SEQ ID NO: 537336 - protein, 5 aa, Mycobacterium
PDPDN

SEQ ID NO: 537337 - protein, 12 aa, Mycobacterium
PDPDPAASHAER

SEQ ID NO: 537338 - protein, 10 aa, Mycobacterium
PDPDPAASWE

SEQ ID NO: 537339 - protein, 7 aa, Mycobacterium
PDPDPGC

SEQ ID NO: 537340 - protein, 11 aa, Mycobacterium
PDPDQAGGSQT

SEQ ID NO: 537341 - protein, 11 aa, Mycobacterium
PDPDRKAQKRR

SEQ ID NO: 537342 - protein, 7 aa, Mycobacterium
PDPDSGF

SEQ ID NO: 537343 - protein, 8 aa, Mycobacterium
PDPDSPLR

SEQ ID NO: 537344 - protein, 7 aa, Mycobacterium
PDPDVPG

SEQ ID NO: 537345 - protein, 4 aa, Mycobacterium
PDPE

SEQ ID NO: 537346 - protein, 8 aa, Mycobacterium
PDPEAMPR

SEQ ID NO: 537347 - protein, 6 aa, Mycobacterium
PDPEHV

SEQ ID NO: 537348 - protein, 7 aa, Mycobacterium
PDPENAY

SEQ ID NO: 537349 - protein, 21 aa, Mycobacterium
PDPEPHGAVTPPGRPEGRPWT

SEQ ID NO: 537350 - protein, 23 aa, Mycobacterium
PDPEPHGGVVPPGRPDGKPWTYT

SEQ ID NO: 537351 - protein, 6 aa, Mycobacterium
PDPEPL

SEQ ID NO: 537352 - protein, 21 aa, Mycobacterium
PDPEPRGAAIPPGRPGGRPWT

SEQ ID NO: 537353 - protein, 12 aa, Mycobacterium
PDPERATDTDYR

SEQ ID NO: 537354 - protein, 6 aa, Mycobacterium
PDPERR

SEQ ID NO: 537355 - protein, 7 aa, Mycobacterium
PDPESLA

SEQ ID NO: 537356 - protein, 5 aa, Mycobacterium
PDPET

SEQ ID NO: 537357 - protein, 8 aa, Mycobacterium
PDPEWGET

SEQ ID NO: 537358 - protein, 7 aa, Mycobacterium
PDPFESR

SEQ ID NO: 537359 - protein, 12 aa, Mycobacterium
PDPFGDDPKAFG

SEQ ID NO: 537360 - protein, 12 aa, Mycobacterium
PDPGACESAPRI

SEQ ID NO: 537361 - protein, 8 aa, Mycobacterium
PDPGADPV

SEQ ID NO: 537362 - protein, 9 aa, Mycobacterium
PDPGADPVE

SEQ ID NO: 537363 - protein, 7 aa, Mycobacterium
PDPGAPR

SEQ ID NO: 537364 - protein, 10 aa, Mycobacterium
PDPGDGAQAA

SEQ ID NO: 537365 - protein, 6 aa, Mycobacterium
PDPGEL

SEQ ID NO: 537366 - protein, 8 aa, Mycobacterium
PDPGFTGT

SEQ ID NO: 537367 - protein, 9 aa, Mycobacterium
PDPGNPRHR

SEQ ID NO: 537368 - protein, 9 aa, Mycobacterium
PDPGPSTSD

SEQ ID NO: 537369 - protein, 9 aa, Mycobacterium
PDPGPTGTT

SEQ ID NO: 537370 - protein, 6 aa, Mycobacterium
PDPGPV

SEQ ID NO: 537371 - protein, 9 aa, Mycobacterium
PDPGSADGI

SEQ ID NO: 537372 - protein, 5 aa, Mycobacterium
PDPGV

SEQ ID NO: 537373 - protein, 7 aa, Mycobacterium
PDPGVAA

SEQ ID NO: 537374 - protein, 5 aa, Mycobacterium
PDPHA

SEQ ID NO: 537375 - protein, 5 aa, Mycobacterium
PDPHP

SEQ ID NO: 537376 - protein, 8 aa, Mycobacterium
PDPHTPWN

SEQ ID NO: 537377 - protein, 12 aa, Mycobacterium
PDPINPQKSGAA

SEQ ID NO: 537378 - protein, 10 aa, Mycobacterium
PDPKDGGRPP

SEQ ID NO: 537379 - protein, 11 aa, Mycobacterium
PDPKDGGRPPY

SEQ ID NO: 537380 - protein, 8 aa, Mycobacterium
PDPKKRLR

SEQ ID NO: 537381 - protein, 7 aa, Mycobacterium
PDPKRRM

SEQ ID NO: 537382 - protein, 7 aa, Mycobacterium
PDPKYSS

SEQ ID NO: 537383 - protein, 16 aa, Mycobacterium
PDPKYSSATSAGGQVQ

SEQ ID NO: 537384 - protein, 8 aa, Mycobacterium
PDPLPPVT

SEQ ID NO: 537385 - protein, 5 aa, Mycobacterium
PDPLS

SEQ ID NO: 537386 - protein, 4 aa, Mycobacterium
PDPN

SEQ ID NO: 537387 - protein, 10 aa, Mycobacterium
PDPNAPEAQA

SEQ ID NO: 537388 - protein, 10 aa, Mycobacterium
PDPNAPEVQK

SEQ ID NO: 537389 - protein, 11 aa, Mycobacterium
PDPNDPDENQA

SEQ ID NO: 537390 - protein, 10 aa, Mycobacterium
PDPNGERAGH

SEQ ID NO: 537391 - protein, 11 aa, Mycobacterium
PDPNGERAGHA

SEQ ID NO: 537392 - protein, 10 aa, Mycobacterium
PDPNGERAGY

SEQ ID NO: 537393 - protein, 8 aa, Mycobacterium
PDPNPRTL

SEQ ID NO: 537394 - protein, 10 aa, Mycobacterium
PDPNSGDLGQ

SEQ ID NO: 537395 - protein, 4 aa, Mycobacterium
PDPP

SEQ ID NO: 537396 - protein, 8 aa, Mycobacterium
PDPPASWG

SEQ ID NO: 537397 - protein, 7 aa, Mycobacterium
PDPPAVA

SEQ ID NO: 537398 - protein, 8 aa, Mycobacterium
PDPPDSWG

SEQ ID NO: 537399 - protein, 7 aa, Mycobacterium
PDPPGGL

SEQ ID NO: 537400 - protein, 6 aa, Mycobacterium
PDPPGQ

SEQ ID NO: 537401 - protein, 10 aa, Mycobacterium
PDPPGRTRFG

SEQ ID NO: 537402 - protein, 7 aa, Mycobacterium
PDPPLGQ

SEQ ID NO: 537403 - protein, 12 aa, Mycobacterium
PDPPNDLTGIVG

SEQ ID NO: 537404 - protein, 29 aa, Mycobacterium
PDPPPDQRERHPRNERKERPERRRSGGAF

SEQ ID NO: 537405 - protein, 9 aa, Mycobacterium
PDPPPESLP

SEQ ID NO: 537406 - protein, 6 aa, Mycobacterium
PDPPPF

SEQ ID NO: 537407 - protein, 8 aa, Mycobacterium
PDPPPGQR

SEQ ID NO: 537408 - protein, 10 aa, Mycobacterium
PDPPQPNTQG

SEQ ID NO: 537409 - protein, 9 aa, Mycobacterium
PDPPRAPRR

SEQ ID NO: 537410 - protein, 8 aa, Mycobacterium
PDPPRAQR

SEQ ID NO: 537411 - protein, 29 aa, Mycobacterium
PDPPREPRHERGERPDRGPRGERPRTPGL

SEQ ID NO: 537412 - protein, 8 aa, Mycobacterium
PDPPRHQI

SEQ ID NO: 537413 - protein, 9 aa, Mycobacterium
PDPPVQAPR

SEQ ID NO: 537414 - protein, 8 aa, Mycobacterium
PDPPYGQG

SEQ ID NO: 537415 - protein, 13 aa, Mycobacterium
PDPQGPQTVPGDS

SEQ ID NO: 537416 - protein, 4 aa, Mycobacterium
PDPR

SEQ ID NO: 537417 - protein, 8 aa, Mycobacterium
PDPRAELA

SEQ ID NO: 537418 - protein, 9 aa, Mycobacterium
PDPRAPATG

SEQ ID NO: 537419 - protein, 15 aa, Mycobacterium
PDPRLQGANPALSTL

SEQ ID NO: 537420 - protein, 7 aa, Mycobacterium
PDPRLTA

SEQ ID NO: 537421 - protein, 5 aa, Mycobacterium
PDPRQ

SEQ ID NO: 537422 - protein, 7 aa, Mycobacterium
PDPRQIP

SEQ ID NO: 537423 - protein, 5 aa, Mycobacterium
PDPRR

SEQ ID NO: 537424 - protein, 9 aa, Mycobacterium
PDPRRPQRT

SEQ ID NO: 537425 - protein, 7 aa, Mycobacterium
PDPRTGE

SEQ ID NO: 537426 - protein, 9 aa, Mycobacterium
PDPRTGERA

SEQ ID NO: 537427 - protein, 6 aa, Mycobacterium
PDPRYG

SEQ ID NO: 537428 - protein, 17 aa, Mycobacterium
PDPSDFPALPGQIPEKE

SEQ ID NO: 537429 - protein, 7 aa, Mycobacterium
PDPSDGY

SEQ ID NO: 537430 - protein, 9 aa, Mycobacterium
PDPSGPGRV

SEQ ID NO: 537431 - protein, 22 aa, Mycobacterium
PDPSIATDESGTRHRSAERAAI

SEQ ID NO: 537432 - protein, 10 aa, Mycobacterium
PDPSPAASDI

SEQ ID NO: 537433 - protein, 25 aa, Mycobacterium
PDPSPAPPAAAPMADAPRHRYDAAA

SEQ ID NO: 537434 - protein, 11 aa, Mycobacterium
PDPSTQAAYRE

SEQ ID NO: 537435 - protein, 8 aa, Mycobacterium
PDPTDGQG

SEQ ID NO: 537436 - protein, 7 aa, Mycobacterium
PDPTNRF

SEQ ID NO: 537437 - protein, 9 aa, Mycobacterium
PDPTPGKNK

SEQ ID NO: 537438 - protein, 11 aa, Mycobacterium
PDPTPRGSAPA

SEQ ID NO: 537439 - protein, 7 aa, Mycobacterium
PDPTRDT

SEQ ID NO: 537440 - protein, 8 aa, Mycobacterium
PDPTSEQL

SEQ ID NO: 537441 - protein, 6 aa, Mycobacterium
PDPTTA

SEQ ID NO: 537442 - protein, 10 aa, Mycobacterium
PDPTTPEAQK

SEQ ID NO: 537443 - protein, 6 aa, Mycobacterium
PDPTVG

SEQ ID NO: 537444 - protein, 7 aa, Mycobacterium
PDPTVPT

SEQ ID NO: 537445 - protein, 6 aa, Mycobacterium
PDPVDA

SEQ ID NO: 537446 - protein, 28 aa, Mycobacterium
PDPVDPESLADSAARNAPLTRPRPGHAD

SEQ ID NO: 537447 - protein, 27 aa, Mycobacterium
PDPVDPGELADSARNAPLTRPRPGHAD

SEQ ID NO: 537448 - protein, 9 aa, Mycobacterium
PDPVETSSG

SEQ ID NO: 537449 - protein, 12 aa, Mycobacterium
PDPVKPIEKVTV

SEQ ID NO: 537450 - protein, 6 aa, Mycobacterium
PDPVNV

SEQ ID NO: 537451 - protein, 8 aa, Mycobacterium
PDPVPAPG

SEQ ID NO: 537452 - protein, 7 aa, Mycobacterium
PDPVPLD

SEQ ID NO: 537453 - protein, 5 aa, Mycobacterium
PDPVR

SEQ ID NO: 537454 - protein, 7 aa, Mycobacterium
PDPVSEL

SEQ ID NO: 537455 - protein, 10 aa, Mycobacterium
PDPVTHHQEP

SEQ ID NO: 537456 - protein, 5 aa, Mycobacterium
PDPVV

SEQ ID NO: 537457 - protein, 5 aa, Mycobacterium
PDPVY

SEQ ID NO: 537458 - protein, 6 aa, Mycobacterium
PDPYGR

SEQ ID NO: 537459 - protein, 6 aa, Mycobacterium
PDPYLT

SEQ ID NO: 537460 - protein, 4 aa, Mycobacterium
PDQA

SEQ ID NO: 537461 - protein, 5 aa, Mycobacterium
PDQAE

SEQ ID NO: 537462 - protein, 8 aa, Mycobacterium
PDQAQFNP

SEQ ID NO: 537463 - protein, 4 aa, Mycobacterium
PDQC

SEQ ID NO: 537464 - protein, 8 aa, Mycobacterium
PDQDAPAV

SEQ ID NO: 537465 - protein, 10 aa, Mycobacterium
PDQDDPASFG

SEQ ID NO: 537466 - protein, 11 aa, Mycobacterium
PDQDPDAADAR

SEQ ID NO: 537467 - protein, 5 aa, Mycobacterium
PDQDV

SEQ ID NO: 537468 - protein, 4 aa, Mycobacterium
PDQE

SEQ ID NO: 537469 - protein, 6 aa, Mycobacterium
PDQESL

SEQ ID NO: 537470 - protein, 8 aa, Mycobacterium
PDQGDISG

SEQ ID NO: 537471 - protein, 8 aa, Mycobacterium
PDQGFGPD

SEQ ID NO: 537472 - protein, 12 aa, Mycobacterium
PDQGRPIAVGEP

SEQ ID NO: 537473 - protein, 7 aa, Mycobacterium
PDQHGNP

SEQ ID NO: 537474 - protein, 5 aa, Mycobacterium
PDQIA

SEQ ID NO: 537475 - protein, 6 aa, Mycobacterium
PDQIAQ

SEQ ID NO: 537476 - protein, 5 aa, Mycobacterium
PDQIG

SEQ ID NO: 537477 - protein, 8 aa, Mycobacterium
PDQKARSR

SEQ ID NO: 537478 - protein, 4 aa, Mycobacterium
PDQL

SEQ ID NO: 537479 - protein, 6 aa, Mycobacterium
PDQLAS

SEQ ID NO: 537480 - protein, 6 aa, Mycobacterium
PDQLGP

SEQ ID NO: 537481 - protein, 11 aa, Mycobacterium
PDQLGSGDIAD

SEQ ID NO: 537482 - protein, 13 aa, Mycobacterium
PDQLPRHPWIYRP

SEQ ID NO: 537483 - protein, 5 aa, Mycobacterium
PDQLR

SEQ ID NO: 537484 - protein, 10 aa, Mycobacterium
PDQLSGGQAQ

SEQ ID NO: 537485 - protein, 29 aa, Mycobacterium
PDQLSPGERCASTSNRNFEGRQGKGGRTH

SEQ ID NO: 537486 - protein, 29 aa, Mycobacterium
PDQLSPGQRCASTSNRNFEGRQGKGGRTH

SEQ ID NO: 537487 - protein, 8 aa, Mycobacterium
PDQNEGPL

SEQ ID NO: 537488 - protein, 5 aa, Mycobacterium
PDQPA

SEQ ID NO: 537489 - protein, 13 aa, Mycobacterium
PDQPDAIAETGGW

SEQ ID NO: 537490 - protein, 7 aa, Mycobacterium
PDQPGPA

SEQ ID NO: 537491 - protein, 7 aa, Mycobacterium
PDQPGRV

SEQ ID NO: 537492 - protein, 13 aa, Mycobacterium
PDQPHQHERDGHG

SEQ ID NO: 537493 - protein, 6 aa, Mycobacterium
PDQPIA

SEQ ID NO: 537494 - protein, 8 aa, Mycobacterium
PDQPKNYQ

SEQ ID NO: 537495 - protein, 32 aa, Mycobacterium
PDQPTTQLPPQAESTSPDDQPESDGGDAPTRA

SEQ ID NO: 537496 - protein, 5 aa, Mycobacterium
PDQPW

SEQ ID NO: 537497 - protein, 7 aa, Mycobacterium
PDQQDTA

SEQ ID NO: 537498 - protein, 4 aa, Mycobacterium
PDQR

SEQ ID NO: 537499 - protein, 7 aa, Mycobacterium
PDQRAEF

SEQ ID NO: 537500 - protein, 8 aa, Mycobacterium
PDQRAEFE

SEQ ID NO: 537501 - protein, 5 aa, Mycobacterium
PDQRG

SEQ ID NO: 537502 - protein, 6 aa, Mycobacterium
PDQRGL

SEQ ID NO: 537503 - protein, 10 aa, Mycobacterium
PDQRKTKRAL

SEQ ID NO: 537504 - protein, 17 aa, Mycobacterium
PDQRPDQGQGGAGAATL

SEQ ID NO: 537505 - protein, 17 aa, Mycobacterium
PDQRPDQGQGGAGEATL

SEQ ID NO: 537506 - protein, 5 aa, Mycobacterium
PDQRT

SEQ ID NO: 537507 - protein, 6 aa, Mycobacterium
PDQRYG

SEQ ID NO: 537508 - protein, 83 aa, Mycobacterium
PDQSPAPSDDDGDSDDGGLGPVNGHTPPESTPARQDSAGAASDPAPPAVSNDLQEEPAAVDPEAARRSEDVAAAAAAQAHRRQ

SEQ ID NO: 537509 - protein, 4 aa, Mycobacterium
PDQT

SEQ ID NO: 537510 - protein, 19 aa, Mycobacterium
PDQTGAECENPGVICGSTA

SEQ ID NO: 537511 - protein, 10 aa, Mycobacterium
PDQTGSPRKL

SEQ ID NO: 537512 - protein, 10 aa, Mycobacterium
PDQTGTPRKL

SEQ ID NO: 537513 - protein, 10 aa, Mycobacterium
PDQTGTPRQL

SEQ ID NO: 537514 - protein, 10 aa, Mycobacterium
PDQTGTSRSL

SEQ ID NO: 537515 - protein, 10 aa, Mycobacterium
PDQTGTTRTL

SEQ ID NO: 537516 - protein, 11 aa, Mycobacterium
PDQTVADASYR

SEQ ID NO: 537517 - protein, 10 aa, Mycobacterium
PDQTVAEQDQ

SEQ ID NO: 537518 - protein, 7 aa, Mycobacterium
PDQTYYP

SEQ ID NO: 537519 - protein, 4 aa, Mycobacterium
PDQV

SEQ ID NO: 537520 - protein, 5 aa, Mycobacterium
PDQWD

SEQ ID NO: 537521 - protein, 12 aa, Mycobacterium
PDQYNNPDNVEA

SEQ ID NO: 537522 - protein, 10 aa, Mycobacterium
PDRAAGRQRR

SEQ ID NO: 537523 - protein, 19 aa, Mycobacterium
PDRAATGRAQRLPAAAGGW

SEQ ID NO: 537524 - protein, 5 aa, Mycobacterium
PDRAD

SEQ ID NO: 537525 - protein, 8 aa, Mycobacterium
PDRAEGDL

SEQ ID NO: 537526 - protein, 7 aa, Mycobacterium
PDRAEKH

SEQ ID NO: 537527 - protein, 8 aa, Mycobacterium
PDRAGDPV

SEQ ID NO: 537528 - protein, 7 aa, Mycobacterium
PDRAHDT

SEQ ID NO: 537529 - protein, 5 aa, Mycobacterium
PDRAK

SEQ ID NO: 537530 - protein, 13 aa, Mycobacterium
PDRALDADRVRTA

SEQ ID NO: 537531 - protein, 13 aa, Mycobacterium
PDRALRDDPRGPL

SEQ ID NO: 537532 - protein, 7 aa, Mycobacterium
PDRANAR

SEQ ID NO: 537533 - protein, 6 aa, Mycobacterium
PDRART

SEQ ID NO: 537534 - protein, 5 aa, Mycobacterium
PDRAW

SEQ ID NO: 537535 - protein, 8 aa, Mycobacterium
PDRDAAQA

SEQ ID NO: 537536 - protein, 7 aa, Mycobacterium
PDRDAVA

SEQ ID NO: 537537 - protein, 5 aa, Mycobacterium
PDRDD

SEQ ID NO: 537538 - protein, 6 aa, Mycobacterium
PDRDEA

SEQ ID NO: 537539 - protein, 19 aa, Mycobacterium
PDRDGGPIPAGRPGGAPWT

SEQ ID NO: 537540 - protein, 8 aa, Mycobacterium
PDRDPQSC

SEQ ID NO: 537541 - protein, 8 aa, Mycobacterium
PDRDPRSC

SEQ ID NO: 537542 - protein, 6 aa, Mycobacterium
PDRDTA

SEQ ID NO: 537543 - protein, 10 aa, Mycobacterium
PDRDTAVKRA

SEQ ID NO: 537544 - protein, 8 aa, Mycobacterium
PDRDVPRT

SEQ ID NO: 537545 - protein, 7 aa, Mycobacterium
PDRDWDG

SEQ ID NO: 537546 - protein, 13 aa, Mycobacterium
PDREALTRLITKQ

SEQ ID NO: 537547 - protein, 6 aa, Mycobacterium
PDREAY

SEQ ID NO: 537548 - protein, 8 aa, Mycobacterium
PDREDSHG

SEQ ID NO: 537549 - protein, 6 aa, Mycobacterium
PDREEQ

SEQ ID NO: 537550 - protein, 8 aa, Mycobacterium
PDREHHRG

SEQ ID NO: 537551 - protein, 9 aa, Mycobacterium
PDREKHAAL

SEQ ID NO: 537552 - protein, 7 aa, Mycobacterium
PDRELDP

SEQ ID NO: 537553 - protein, 15 aa, Mycobacterium
PDREPLSPKSVRPLQ

SEQ ID NO: 537554 - protein, 9 aa, Mycobacterium
PDREPQRTA

SEQ ID NO: 537555 - protein, 8 aa, Mycobacterium
PDREPSSC

SEQ ID NO: 537556 - protein, 6 aa, Mycobacterium
PDRESA

SEQ ID NO: 537557 - protein, 12 aa, Mycobacterium
PDREVDNAASAG

SEQ ID NO: 537558 - protein, 17 aa, Mycobacterium
PDRFAARDGGFGDGRGG

SEQ ID NO: 537559 - protein, 6 aa, Mycobacterium
PDRFDD

SEQ ID NO: 537560 - protein, 8 aa, Mycobacterium
PDRFDPDR

SEQ ID NO: 537561 - protein, 8 aa, Mycobacterium
PDRFDPSR

SEQ ID NO: 537562 - protein, 5 aa, Mycobacterium
PDRFP

SEQ ID NO: 537563 - protein, 8 aa, Mycobacterium
PDRGADLD

SEQ ID NO: 537564 - protein, 8 aa, Mycobacterium
PDRGPERA

SEQ ID NO: 537565 - protein, 23 aa, Mycobacterium
PDRGPRREGAGKPSGKYKPHRKV

SEQ ID NO: 537566 - protein, 5 aa, Mycobacterium
PDRGY

SEQ ID NO: 537567 - protein, 4 aa, Mycobacterium
PDRH

SEQ ID NO: 537568 - protein, 5 aa, Mycobacterium
PDRHA

SEQ ID NO: 537569 - protein, 9 aa, Mycobacterium
PDRHAERDP

SEQ ID NO: 537570 - protein, 5 aa, Mycobacterium
PDRHR

SEQ ID NO: 537571 - protein, 6 aa, Mycobacterium
PDRIPQ

SEQ ID NO: 537572 - protein, 5 aa, Mycobacterium
PDRIS

SEQ ID NO: 537573 - protein, 6 aa, Mycobacterium
PDRKRR

SEQ ID NO: 537574 - protein, 9 aa, Mycobacterium
PDRMASERT

SEQ ID NO: 537575 - protein, 5 aa, Mycobacterium
PDRMN

SEQ ID NO: 537576 - protein, 14 aa, Mycobacterium
PDRNAGFSKATPGR

SEQ ID NO: 537577 - protein, 8 aa, Mycobacterium
PDRNPFEP

SEQ ID NO: 537578 - protein, 6 aa, Mycobacterium
PDRNTP

SEQ ID NO: 537579 - protein, 15 aa, Mycobacterium
PDRNVRRDQRDADSL

SEQ ID NO: 537580 - protein, 11 aa, Mycobacterium
PDRPADEVGPI

SEQ ID NO: 537581 - protein, 24 aa, Mycobacterium
PDRPADKAYKARRNDGGKPRRKRL

SEQ ID NO: 537582 - protein, 6 aa, Mycobacterium
PDRPDQ

SEQ ID NO: 537583 - protein, 7 aa, Mycobacterium
PDRPEDE

SEQ ID NO: 537584 - protein, 6 aa, Mycobacterium
PDRPGA

SEQ ID NO: 537585 - protein, 13 aa, Mycobacterium
PDRPGALAPGAGE

SEQ ID NO: 537586 - protein, 7 aa, Mycobacterium
PDRPGGL

SEQ ID NO: 537587 - protein, 9 aa, Mycobacterium
PDRPGQARS

SEQ ID NO: 537588 - protein, 6 aa, Mycobacterium
PDRPHQ

SEQ ID NO: 537589 - protein, 14 aa, Mycobacterium
PDRPKVSEAAVEDA

SEQ ID NO: 537590 - protein, 13 aa, Mycobacterium
PDRPLTSDDIPQL

SEQ ID NO: 537591 - protein, 10 aa, Mycobacterium
PDRPNNYNPI

SEQ ID NO: 537592 - protein, 8 aa, Mycobacterium
PDRPNSDE

SEQ ID NO: 537593 - protein, 6 aa, Mycobacterium
PDRPPV

SEQ ID NO: 537594 - protein, 8 aa, Mycobacterium
PDRPSRAR

SEQ ID NO: 537595 - protein, 5 aa, Mycobacterium
PDRPT

SEQ ID NO: 537596 - protein, 8 aa, Mycobacterium
PDRPTGDT

SEQ ID NO: 537597 - protein, 7 aa, Mycobacterium
PDRPTGV

SEQ ID NO: 537598 - protein, 24 aa, Mycobacterium
PDRPTTQLPAGETAGDSGEAPTRA

SEQ ID NO: 537599 - protein, 6 aa, Mycobacterium
PDRPYS

SEQ ID NO: 537600 - protein, 6 aa, Mycobacterium
PDRQRH

SEQ ID NO: 537601 - protein, 7 aa, Mycobacterium
PDRRDPR

SEQ ID NO: 537602 - protein, 9 aa, Mycobacterium
PDRRGQRHA

SEQ ID NO: 537603 - protein, 13 aa, Mycobacterium
PDRRPVTASNSAY

SEQ ID NO: 537604 - protein, 21 aa, Mycobacterium
PDRRQRAVGQPRTRRHRHQQP

SEQ ID NO: 537605 - protein, 5 aa, Mycobacterium
PDRRR

SEQ ID NO: 537606 - protein, 7 aa, Mycobacterium
PDRRRGE

SEQ ID NO: 537607 - protein, 8 aa, Mycobacterium
PDRRRNAT

SEQ ID NO: 537608 - protein, 5 aa, Mycobacterium
PDRRV

SEQ ID NO: 537609 - protein, 7 aa, Mycobacterium
PDRRYPG

SEQ ID NO: 537610 - protein, 8 aa, Mycobacterium
PDRRYTRG

SEQ ID NO: 537611 - protein, 21 aa, Mycobacterium
PDRSASKPRGRDSGKPRRKHT

SEQ ID NO: 537612 - protein, 5 aa, Mycobacterium
PDRSG

SEQ ID NO: 537613 - protein, 7 aa, Mycobacterium
PDRSPEQ

SEQ ID NO: 537614 - protein, 7 aa, Mycobacterium
PDRSQLA

SEQ ID NO: 537615 - protein, 6 aa, Mycobacterium
PDRSTV

SEQ ID NO: 537616 - protein, 6 aa, Mycobacterium
PDRSVP

SEQ ID NO: 537617 - protein, 19 aa, Mycobacterium
PDRTAGVEYPQGAAQKRLT

SEQ ID NO: 537618 - protein, 5 aa, Mycobacterium
PDRTG

SEQ ID NO: 537619 - protein, 7 aa, Mycobacterium
PDRTGRI

SEQ ID NO: 537620 - protein, 20 aa, Mycobacterium
PDRTGWASDQRDRGAGYAAA

SEQ ID NO: 537621 - protein, 17 aa, Mycobacterium
PDRTLTEDDASAARDAA

SEQ ID NO: 537622 - protein, 17 aa, Mycobacterium
PDRTLTEDDATAAREAA

SEQ ID NO: 537623 - protein, 8 aa, Mycobacterium
PDRTPRSC

SEQ ID NO: 537624 - protein, 19 aa, Mycobacterium
PDRTPYDPYSIGDPNAGVH

SEQ ID NO: 537625 - protein, 5 aa, Mycobacterium
PDRTS

SEQ ID NO: 537626 - protein, 5 aa, Mycobacterium
PDRTW

SEQ ID NO: 537627 - protein, 5 aa, Mycobacterium
PDRTY

SEQ ID NO: 537628 - protein, 15 aa, Mycobacterium
PDRVPGISSPEAIPG

SEQ ID NO: 537629 - protein, 15 aa, Mycobacterium
PDRVPGISSPGAIPG

SEQ ID NO: 537630 - protein, 10 aa, Mycobacterium
PDRVRDTPIS

SEQ ID NO: 537631 - protein, 5 aa, Mycobacterium
PDRVT

SEQ ID NO: 537632 - protein, 8 aa, Mycobacterium
PDRVTRDA

SEQ ID NO: 537633 - protein, 8 aa, Mycobacterium
PDRVTRDS

SEQ ID NO: 537634 - protein, 5 aa, Mycobacterium
PDRYD

SEQ ID NO: 537635 - protein, 16 aa, Mycobacterium
PDRYDGVAGAHRIDLN

SEQ ID NO: 537636 - protein, 16 aa, Mycobacterium
PDRYDGVKGAHRIDLS

SEQ ID NO: 537637 - protein, 16 aa, Mycobacterium
PDRYDGVRGAHRIDLT

SEQ ID NO: 537638 - protein, 7 aa, Mycobacterium
PDRYPIE

SEQ ID NO: 537639 - protein, 8 aa, Mycobacterium
PDSAAAQG

SEQ ID NO: 537640 - protein, 39 aa, Mycobacterium
PDSAAARGLAPAEPRPASTAGPGLPERRPKRPARSRRGV

SEQ ID NO: 537641 - protein, 39 aa, Mycobacterium
PDSAAARGLAPEPAAAPPPRRKPRRPARAVTGGIRTPRP

SEQ ID NO: 537642 - protein, 27 aa, Mycobacterium
PDSAAARGLPSAPAAPPRRKPKRPLRA

SEQ ID NO: 537643 - protein, 6 aa, Mycobacterium
PDSAAL

SEQ ID NO: 537644 - protein, 10 aa, Mycobacterium
PDSADANGDR

SEQ ID NO: 537645 - protein, 11 aa, Mycobacterium
PDSADGSVRPG

SEQ ID NO: 537646 - protein, 12 aa, Mycobacterium
PDSAEAVAAQDV

SEQ ID NO: 537647 - protein, 13 aa, Mycobacterium
PDSAELPGARGLS

SEQ ID NO: 537648 - protein, 9 aa, Mycobacterium
PDSAGEQFS

SEQ ID NO: 537649 - protein, 6 aa, Mycobacterium
PDSAGG

SEQ ID NO: 537650 - protein, 8 aa, Mycobacterium
PDSALTAT

SEQ ID NO: 537651 - protein, 9 aa, Mycobacterium
PDSANQPYD

SEQ ID NO: 537652 - protein, 5 aa, Mycobacterium
PDSAR

SEQ ID NO: 537653 - protein, 8 aa, Mycobacterium
PDSARISE

SEQ ID NO: 537654 - protein, 13 aa, Mycobacterium
PDSARLPGATSLG

SEQ ID NO: 537655 - protein, 6 aa, Mycobacterium
PDSAVG

SEQ ID NO: 537656 - protein, 5 aa, Mycobacterium
PDSDA

SEQ ID NO: 537657 - protein, 8 aa, Mycobacterium
PDSDKPAN

SEQ ID NO: 537658 - protein, 10 aa, Mycobacterium
PDSDLAEAAR

SEQ ID NO: 537659 - protein, 5 aa, Mycobacterium
PDSDN

SEQ ID NO: 537660 - protein, 8 aa, Mycobacterium
PDSDNAAY

SEQ ID NO: 537661 - protein, 7 aa, Mycobacterium
PDSDNQA

SEQ ID NO: 537662 - protein, 8 aa, Mycobacterium
PDSDNQGY

SEQ ID NO: 537663 - protein, 8 aa, Mycobacterium
PDSDNTAY

SEQ ID NO: 537664 - protein, 7 aa, Mycobacterium
PDSDRDG

SEQ ID NO: 537665 - protein, 31 aa, Mycobacterium
PDSEAADAGPVPGPGDLSRDVRPMSSTRKFE

SEQ ID NO: 537666 - protein, 9 aa, Mycobacterium
PDSEAHASI

SEQ ID NO: 537667 - protein, 8 aa, Mycobacterium
PDSEGGTA

SEQ ID NO: 537668 - protein, 12 aa, Mycobacterium
PDSEHPHGLPDK

SEQ ID NO: 537669 - protein, 9 aa, Mycobacterium
PDSEKEATV

SEQ ID NO: 537670 - protein, 6 aa, Mycobacterium
PDSEPL

SEQ ID NO: 537671 - protein, 9 aa, Mycobacterium
PDSEQPAVR

SEQ ID NO: 537672 - protein, 5 aa, Mycobacterium
PDSER

SEQ ID NO: 537673 - protein, 8 aa, Mycobacterium
PDSERHAV

SEQ ID NO: 537674 - protein, 5 aa, Mycobacterium
PDSET

SEQ ID NO: 537675 - protein, 13 aa, Mycobacterium
PDSETEATTEEDE

SEQ ID NO: 537676 - protein, 7 aa, Mycobacterium
PDSGAEG

SEQ ID NO: 537677 - protein, 14 aa, Mycobacterium
PDSGDRDENSGVEG

SEQ ID NO: 537678 - protein, 8 aa, Mycobacterium
PDSGETCS

SEQ ID NO: 537679 - protein, 6 aa, Mycobacterium
PDSGGE

SEQ ID NO: 537680 - protein, 5 aa, Mycobacterium
PDSGI

SEQ ID NO: 537681 - protein, 8 aa, Mycobacterium
PDSGLDPV

SEQ ID NO: 537682 - protein, 12 aa, Mycobacterium
PDSGMSRATGNI

SEQ ID NO: 537683 - protein, 18 aa, Mycobacterium
PDSGNTGPNTLPIGFTPA

SEQ ID NO: 537684 - protein, 16 aa, Mycobacterium
PDSGQGPAAESDSGSD

SEQ ID NO: 537685 - protein, 7 aa, Mycobacterium
PDSGRVR

SEQ ID NO: 537686 - protein, 10 aa, Mycobacterium
PDSGSAPETR

SEQ ID NO: 537687 - protein, 7 aa, Mycobacterium
PDSGSIE

SEQ ID NO: 537688 - protein, 12 aa, Mycobacterium
PDSGSKPAAPYA

SEQ ID NO: 537689 - protein, 7 aa, Mycobacterium
PDSGSVA

SEQ ID NO: 537690 - protein, 10 aa, Mycobacterium
PDSGVSTNDF

SEQ ID NO: 537691 - protein, 13 aa, Mycobacterium
PDSHPQSAAAARS

SEQ ID NO: 537692 - protein, 12 aa, Mycobacterium
PDSHPQSAATAR

SEQ ID NO: 537693 - protein, 13 aa, Mycobacterium
PDSHPQSAGAARS

SEQ ID NO: 537694 - protein, 5 aa, Mycobacterium
PDSIE

SEQ ID NO: 537695 - protein, 8 aa, Mycobacterium
PDSISDDA

SEQ ID NO: 537696 - protein, 5 aa, Mycobacterium
PDSIV

SEQ ID NO: 537697 - protein, 29 aa, Mycobacterium
PDSKAARGLEPVDDRRDLSTSRRRPRAAK

SEQ ID NO: 537698 - protein, 15 aa, Mycobacterium
PDSKYSSSPNPGGQV

SEQ ID NO: 537699 - protein, 8 aa, Mycobacterium
PDSLAGKE

SEQ ID NO: 537700 - protein, 12 aa, Mycobacterium
PDSLDPTDNEQV

SEQ ID NO: 537701 - protein, 7 aa, Mycobacterium
PDSNRVE

SEQ ID NO: 537702 - protein, 7 aa, Mycobacterium
PDSPATV

SEQ ID NO: 537703 - protein, 8 aa, Mycobacterium
PDSPDDAE

SEQ ID NO: 537704 - protein, 7 aa, Mycobacterium
PDSPEEL

SEQ ID NO: 537705 - protein, 5 aa, Mycobacterium
PDSPF

SEQ ID NO: 537706 - protein, 23 aa, Mycobacterium
PDSPHAVETEDQHGYERERRRRH

SEQ ID NO: 537707 - protein, 13 aa, Mycobacterium
PDSPIGKTDAAGI

SEQ ID NO: 537708 - protein, 13 aa, Mycobacterium
PDSPIGSTDKAGI

SEQ ID NO: 537709 - protein, 10 aa, Mycobacterium
PDSPKPPPQR

SEQ ID NO: 537710 - protein, 13 aa, Mycobacterium
PDSPLPVDAGTRA

SEQ ID NO: 537711 - protein, 13 aa, Mycobacterium
PDSPLRSRADAEA

SEQ ID NO: 537712 - protein, 7 aa, Mycobacterium
PDSPPHR

SEQ ID NO: 537713 - protein, 6 aa, Mycobacterium
PDSPSI

SEQ ID NO: 537714 - protein, 6 aa, Mycobacterium
PDSPSV

SEQ ID NO: 537715 - protein, 8 aa, Mycobacterium
PDSPTFGR

SEQ ID NO: 537716 - protein, 7 aa, Mycobacterium
PDSPTQL

SEQ ID NO: 537717 - protein, 5 aa, Mycobacterium
PDSPV

SEQ ID NO: 537718 - protein, 10 aa, Mycobacterium
PDSQGEPRDE

SEQ ID NO: 537719 - protein, 4 aa, Mycobacterium
PDSR

SEQ ID NO: 537720 - protein, 6 aa, Mycobacterium
PDSRAF

SEQ ID NO: 537721 - protein, 9 aa, Mycobacterium
PDSRAKQRA

SEQ ID NO: 537722 - protein, 28 aa, Mycobacterium
PDSRDSRDGRGRRDSGRGGGRDGDKSNY

SEQ ID NO: 537723 - protein, 10 aa, Mycobacterium
PDSRHSSVTN

SEQ ID NO: 537724 - protein, 5 aa, Mycobacterium
PDSRQ

SEQ ID NO: 537725 - protein, 9 aa, Mycobacterium
PDSRTRDLS

SEQ ID NO: 537726 - protein, 12 aa, Mycobacterium
PDSRYDDAAAFF

SEQ ID NO: 537727 - protein, 9 aa, Mycobacterium
PDSSPERAQ

SEQ ID NO: 537728 - protein, 9 aa, Mycobacterium
PDSSSDTAG

SEQ ID NO: 537729 - protein, 4 aa, Mycobacterium
PDST

SEQ ID NO: 537730 - protein, 8 aa, Mycobacterium
PDSTDRFR

SEQ ID NO: 537731 - protein, 7 aa, Mycobacterium
PDSTGPA

SEQ ID NO: 537732 - protein, 5 aa, Mycobacterium
PDSTI

SEQ ID NO: 537733 - protein, 5 aa, Mycobacterium
PDSTK

SEQ ID NO: 537734 - protein, 8 aa, Mycobacterium
PDSTLAGR

SEQ ID NO: 537735 - protein, 27 aa, Mycobacterium
PDSTTDETTESDELPRVGRERGTDTVD

SEQ ID NO: 537736 - protein, 14 aa, Mycobacterium
PDSTTEATTEEGEV

SEQ ID NO: 537737 - protein, 9 aa, Mycobacterium
PDSTVDADG

SEQ ID NO: 537738 - protein, 7 aa, Mycobacterium
PDSTYVR

SEQ ID NO: 537739 - protein, 8 aa, Mycobacterium
PDSTYVRK

SEQ ID NO: 537740 - protein, 5 aa, Mycobacterium
PDSVG

SEQ ID NO: 537741 - protein, 5 aa, Mycobacterium
PDSVP

SEQ ID NO: 537742 - protein, 11 aa, Mycobacterium
PDSVQGAAGPF

SEQ ID NO: 537743 - protein, 5 aa, Mycobacterium
PDSVS

SEQ ID NO: 537744 - protein, 13 aa, Mycobacterium
PDSVSDEVSTDIR

SEQ ID NO: 537745 - protein, 12 aa, Mycobacterium
PDSVSKPVGPYA

SEQ ID NO: 537746 - protein, 4 aa, Mycobacterium
PDSW

SEQ ID NO: 537747 - protein, 11 aa, Mycobacterium
PDSYTPAPGGV

SEQ ID NO: 537748 - protein, 7 aa, Mycobacterium
PDTAGLA

SEQ ID NO: 537749 - protein, 10 aa, Mycobacterium
PDTAGLAADS

SEQ ID NO: 537750 - protein, 6 aa, Mycobacterium
PDTAHP

SEQ ID NO: 537751 - protein, 8 aa, Mycobacterium
PDTAPAEL

SEQ ID NO: 537752 - protein, 9 aa, Mycobacterium
PDTAPGESP

SEQ ID NO: 537753 - protein, 8 aa, Mycobacterium
PDTAPMPE

SEQ ID NO: 537754 - protein, 6 aa, Mycobacterium
PDTAPN

SEQ ID NO: 537755 - protein, 7 aa, Mycobacterium
PDTAPPL

SEQ ID NO: 537756 - protein, 6 aa, Mycobacterium
PDTAPR

SEQ ID NO: 537757 - protein, 29 aa, Mycobacterium
PDTASAESGESEARAAGRASRFREETRSE

SEQ ID NO: 537758 - protein, 11 aa, Mycobacterium
PDTASELPDGQ

SEQ ID NO: 537759 - protein, 11 aa, Mycobacterium
PDTATAEDVAS

SEQ ID NO: 537760 - protein, 8 aa, Mycobacterium
PDTAVTAT

SEQ ID NO: 537761 - protein, 9 aa, Mycobacterium
PDTDAGRDA

SEQ ID NO: 537762 - protein, 10 aa, Mycobacterium
PDTDANDAHR

SEQ ID NO: 537763 - protein, 8 aa, Mycobacterium
PDTDDVDS

SEQ ID NO: 537764 - protein, 7 aa, Mycobacterium
PDTDPRG

SEQ ID NO: 537765 - protein, 11 aa, Mycobacterium
PDTDPVAAATG

SEQ ID NO: 537766 - protein, 6 aa, Mycobacterium
PDTDSL

SEQ ID NO: 537767 - protein, 5 aa, Mycobacterium
PDTDY

SEQ ID NO: 537768 - protein, 12 aa, Mycobacterium
PDTEHPHGLPDR

SEQ ID NO: 537769 - protein, 5 aa, Mycobacterium
PDTEI

SEQ ID NO: 537770 - protein, 8 aa, Mycobacterium
PDTEPLDT

SEQ ID NO: 537771 - protein, 10 aa, Mycobacterium
PDTEYDEQGR

SEQ ID NO: 537772 - protein, 4 aa, Mycobacterium
PDTG

SEQ ID NO: 537773 - protein, 11 aa, Mycobacterium
PDTGAELPDGE

SEQ ID NO: 537774 - protein, 5 aa, Mycobacterium
PDTGD

SEQ ID NO: 537775 - protein, 13 aa, Mycobacterium
PDTGERVPYGQTG

SEQ ID NO: 537776 - protein, 5 aa, Mycobacterium
PDTGG

SEQ ID NO: 537777 - protein, 5 aa, Mycobacterium
PDTGI

SEQ ID NO: 537778 - protein, 7 aa, Mycobacterium
PDTGQSQ

SEQ ID NO: 537779 - protein, 14 aa, Mycobacterium
PDTGQVLPDGSEGE

SEQ ID NO: 537780 - protein, 12 aa, Mycobacterium
PDTGRPVPVGAP

SEQ ID NO: 537781 - protein, 7 aa, Mycobacterium
PDTGRTN

SEQ ID NO: 537782 - protein, 10 aa, Mycobacterium
PDTGSLEGDL

SEQ ID NO: 537783 - protein, 5 aa, Mycobacterium
PDTGT

SEQ ID NO: 537784 - protein, 11 aa, Mycobacterium
PDTGTELADGR

SEQ ID NO: 537785 - protein, 11 aa, Mycobacterium
PDTGTELRDGE

SEQ ID NO: 537786 - protein, 16 aa, Mycobacterium
PDTGTVTRLTDDDHTY

SEQ ID NO: 537787 - protein, 7 aa, Mycobacterium
PDTGVSR

SEQ ID NO: 537788 - protein, 7 aa, Mycobacterium
PDTGWHK

SEQ ID NO: 537789 - protein, 5 aa, Mycobacterium
PDTHA

SEQ ID NO: 537790 - protein, 6 aa, Mycobacterium
PDTHPD

SEQ ID NO: 537791 - protein, 11 aa, Mycobacterium
PDTHPQSVASA

SEQ ID NO: 537792 - protein, 7 aa, Mycobacterium
PDTHPRT

SEQ ID NO: 537793 - protein, 4 aa, Mycobacterium
PDTI

SEQ ID NO: 537794 - protein, 6 aa, Mycobacterium
PDTLGG

SEQ ID NO: 537795 - protein, 13 aa, Mycobacterium
PDTLGPQRERAGW

SEQ ID NO: 537796 - protein, 6 aa, Mycobacterium
PDTLTD

SEQ ID NO: 537797 - protein, 7 aa, Mycobacterium
PDTNGYE

SEQ ID NO: 537798 - protein, 4 aa, Mycobacterium
PDTP

SEQ ID NO: 537799 - protein, 5 aa, Mycobacterium
PDTPA

SEQ ID NO: 537800 - protein, 8 aa, Mycobacterium
PDTPDDDT

SEQ ID NO: 537801 - protein, 5 aa, Mycobacterium
PDTPF

SEQ ID NO: 537802 - protein, 6 aa, Mycobacterium
PDTPFR

SEQ ID NO: 537803 - protein, 5 aa, Mycobacterium
PDTPN

SEQ ID NO: 537804 - protein, 6 aa, Mycobacterium
PDTPNV

SEQ ID NO: 537805 - protein, 6 aa, Mycobacterium
PDTPPE

SEQ ID NO: 537806 - protein, 12 aa, Mycobacterium
PDTPPGEPPAER

SEQ ID NO: 537807 - protein, 11 aa, Mycobacterium
PDTPPGGVPAD

SEQ ID NO: 537808 - protein, 6 aa, Mycobacterium
PDTPPR

SEQ ID NO: 537809 - protein, 13 aa, Mycobacterium
PDTPRGEPPADRV

SEQ ID NO: 537810 - protein, 15 aa, Mycobacterium
PDTPRGQAPAATEYA

SEQ ID NO: 537811 - protein, 13 aa, Mycobacterium
PDTPRGQPPADRI

SEQ ID NO: 537812 - protein, 5 aa, Mycobacterium
PDTPV

SEQ ID NO: 537813 - protein, 6 aa, Mycobacterium
PDTPVV

SEQ ID NO: 537814 - protein, 24 aa, Mycobacterium
PDTQPAPSDFGYTPDGEPDPAAAK

SEQ ID NO: 537815 - protein, 8 aa, Mycobacterium
PDTRDAVR

SEQ ID NO: 537816 - protein, 12 aa, Mycobacterium
PDTRDVDPVPWG

SEQ ID NO: 537817 - protein, 5 aa, Mycobacterium
PDTRF

SEQ ID NO: 537818 - protein, 5 aa, Mycobacterium
PDTRI

SEQ ID NO: 537819 - protein, 16 aa, Mycobacterium
PDTRPDQGQGGAGAAT

SEQ ID NO: 537820 - protein, 7 aa, Mycobacterium
PDTRRRT

SEQ ID NO: 537821 - protein, 5 aa, Mycobacterium
PDTRT

SEQ ID NO: 537822 - protein, 13 aa, Mycobacterium
PDTRTERPAGTTG

SEQ ID NO: 537823 - protein, 12 aa, Mycobacterium
PDTRTETREGTV

SEQ ID NO: 537824 - protein, 7 aa, Mycobacterium
PDTRYER

SEQ ID NO: 537825 - protein, 4 aa, Mycobacterium
PDTS

SEQ ID NO: 537826 - protein, 7 aa, Mycobacterium
PDTSAAL

SEQ ID NO: 537827 - protein, 10 aa, Mycobacterium
PDTSADKTAS

SEQ ID NO: 537828 - protein, 5 aa, Mycobacterium
PDTSE

SEQ ID NO: 537829 - protein, 9 aa, Mycobacterium
PDTSQSATL

SEQ ID NO: 537830 - protein, 5 aa, Mycobacterium
PDTST

SEQ ID NO: 537831 - protein, 4 aa, Mycobacterium
PDTT

SEQ ID NO: 537832 - protein, 9 aa, Mycobacterium
PDTTASNEG

SEQ ID NO: 537833 - protein, 6 aa, Mycobacterium
PDTTGS

SEQ ID NO: 537834 - protein, 7 aa, Mycobacterium
PDTTHSA

SEQ ID NO: 537835 - protein, 5 aa, Mycobacterium
PDTTK

SEQ ID NO: 537836 - protein, 6 aa, Mycobacterium
PDTTLT

SEQ ID NO: 537837 - protein, 12 aa, Mycobacterium
PDTTPAQRRNRA

SEQ ID NO: 537838 - protein, 8 aa, Mycobacterium
PDTTTLAE

SEQ ID NO: 537839 - protein, 4 aa, Mycobacterium
PDTV

SEQ ID NO: 537840 - protein, 5 aa, Mycobacterium
PDTVA

SEQ ID NO: 537841 - protein, 7 aa, Mycobacterium
PDTVDTT

SEQ ID NO: 537842 - protein, 12 aa, Mycobacterium
PDTVNVSGSGCS

SEQ ID NO: 537843 - protein, 5 aa, Mycobacterium
PDVAA

SEQ ID NO: 537844 - protein, 6 aa, Mycobacterium
PDVAAG

SEQ ID NO: 537845 - protein, 14 aa, Mycobacterium
PDVAAPPAAPGKPR

SEQ ID NO: 537846 - protein, 6 aa, Mycobacterium
PDVAAS

SEQ ID NO: 537847 - protein, 14 aa, Mycobacterium
PDVAGPADANHSPM

SEQ ID NO: 537848 - protein, 8 aa, Mycobacterium
PDVAGTPA

SEQ ID NO: 537849 - protein, 8 aa, Mycobacterium
PDVAGTQT

SEQ ID NO: 537850 - protein, 16 aa, Mycobacterium
PDVAPEARPVQTYGGS

SEQ ID NO: 537851 - protein, 4 aa, Mycobacterium
PDVD

SEQ ID NO: 537852 - protein, 5 aa, Mycobacterium
PDVDE

SEQ ID NO: 537853 - protein, 6 aa, Mycobacterium
PDVDEA

SEQ ID NO: 537854 - protein, 5 aa, Mycobacterium
PDVDK

SEQ ID NO: 537855 - protein, 14 aa, Mycobacterium
PDVDSPGKVDDDPE

SEQ ID NO: 537856 - protein, 26 aa, Mycobacterium
PDVEGESEARASGRAAKFREETRGER

SEQ ID NO: 537857 - protein, 5 aa, Mycobacterium
PDVEQ

SEQ ID NO: 537858 - protein, 11 aa, Mycobacterium
PDVEREASRQL

SEQ ID NO: 537859 - protein, 7 aa, Mycobacterium
PDVGELD

SEQ ID NO: 537860 - protein, 29 aa, Mycobacterium
PDVGEQSGRQALDDARSCTDGDVASASRS

SEQ ID NO: 537861 - protein, 7 aa, Mycobacterium
PDVGETR

SEQ ID NO: 537862 - protein, 9 aa, Mycobacterium
PDVGGSGLT

SEQ ID NO: 537863 - protein, 5 aa, Mycobacterium
PDVGP

SEQ ID NO: 537864 - protein, 24 aa, Mycobacterium
PDVGSDPARLAATATPVEDGKAYE

SEQ ID NO: 537865 - protein, 24 aa, Mycobacterium
PDVGSDPARLASTATPIDDGQAYE

SEQ ID NO: 537866 - protein, 23 aa, Mycobacterium
PDVGSDPARLASTATPIDGGQAY

SEQ ID NO: 537867 - protein, 6 aa, Mycobacterium
PDVGSY

SEQ ID NO: 537868 - protein, 4 aa, Mycobacterium
PDVK

SEQ ID NO: 537869 - protein, 21 aa, Mycobacterium
PDVKASRADIEQQVREGTLTP

SEQ ID NO: 537870 - protein, 4 aa, Mycobacterium
PDVL

SEQ ID NO: 537871 - protein, 6 aa, Mycobacterium
PDVNES

SEQ ID NO: 537872 - protein, 9 aa, Mycobacterium
PDVNESEHN

SEQ ID NO: 537873 - protein, 7 aa, Mycobacterium
PDVNESG

SEQ ID NO: 537874 - protein, 5 aa, Mycobacterium
PDVNN

SEQ ID NO: 537875 - protein, 11 aa, Mycobacterium
PDVNPDEEAQH

SEQ ID NO: 537876 - protein, 12 aa, Mycobacterium
PDVNPDEGAQAK

SEQ ID NO: 537877 - protein, 12 aa, Mycobacterium
PDVNPDEGAQAR

SEQ ID NO: 537878 - protein, 14 aa, Mycobacterium
PDVNPDRPAAGRDE

SEQ ID NO: 537879 - protein, 4 aa, Mycobacterium
PDVP

SEQ ID NO: 537880 - protein, 8 aa, Mycobacterium
PDVPAPDV

SEQ ID NO: 537881 - protein, 13 aa, Mycobacterium
PDVPAPDVDPTRN

SEQ ID NO: 537882 - protein, 6 aa, Mycobacterium
PDVPDG

SEQ ID NO: 537883 - protein, 7 aa, Mycobacterium
PDVPDPT

SEQ ID NO: 537884 - protein, 14 aa, Mycobacterium
PDVPGADATSRGLP

SEQ ID NO: 537885 - protein, 15 aa, Mycobacterium
PDVPGGEAGAEGLPP

SEQ ID NO: 537886 - protein, 7 aa, Mycobacterium
PDVPGRQ

SEQ ID NO: 537887 - protein, 8 aa, Mycobacterium
PDVPPDEL

SEQ ID NO: 537888 - protein, 5 aa, Mycobacterium
PDVPR

SEQ ID NO: 537889 - protein, 14 aa, Mycobacterium
PDVPWSTDADGGPA

SEQ ID NO: 537890 - protein, 5 aa, Mycobacterium
PDVQE

SEQ ID NO: 537891 - protein, 35 aa, Mycobacterium
PDVQPDDYLGPTQLTGARGPVARAPRSKEARDPKL

SEQ ID NO: 537892 - protein, 11 aa, Mycobacterium
PDVQRQVRERP

SEQ ID NO: 537893 - protein, 8 aa, Mycobacterium
PDVRTDPR

SEQ ID NO: 537894 - protein, 4 aa, Mycobacterium
PDVS

SEQ ID NO: 537895 - protein, 6 aa, Mycobacterium
PDVSAE

SEQ ID NO: 537896 - protein, 7 aa, Mycobacterium
PDVSSPH

SEQ ID NO: 537897 - protein, 8 aa, Mycobacterium
PDVSSPRM

SEQ ID NO: 537898 - protein, 8 aa, Mycobacterium
PDVSSTTN

SEQ ID NO: 537899 - protein, 11 aa, Mycobacterium
PDVTPIGPAGA

SEQ ID NO: 537900 - protein, 7 aa, Mycobacterium
PDVTPPR

SEQ ID NO: 537901 - protein, 10 aa, Mycobacterium
PDVYEQPNRF

SEQ ID NO: 537902 - protein, 9 aa, Mycobacterium
PDWDSSATD

SEQ ID NO: 537903 - protein, 14 aa, Mycobacterium
PDWDTGGLSVSAGN

SEQ ID NO: 537904 - protein, 4 aa, Mycobacterium
PDWG

SEQ ID NO: 537905 - protein, 20 aa, Mycobacterium
PDWGGPRDDEPVASTQGAGR

SEQ ID NO: 537906 - protein, 13 aa, Mycobacterium
PDWPQPASGGGSY

SEQ ID NO: 537907 - protein, 13 aa, Mycobacterium
PDWPQPDQGAGDH

SEQ ID NO: 537908 - protein, 9 aa, Mycobacterium
PDWPQPGST

SEQ ID NO: 537909 - protein, 17 aa, Mycobacterium
PDWPQSTAVGKTAVSSS

SEQ ID NO: 537910 - protein, 6 aa, Mycobacterium
PDWPTG

SEQ ID NO: 537911 - protein, 10 aa, Mycobacterium
PDWPTGTPPV

SEQ ID NO: 537912 - protein, 9 aa, Mycobacterium
PDWSPGDKA

SEQ ID NO: 537913 - protein, 4 aa, Mycobacterium
PDWT

SEQ ID NO: 537914 - protein, 8 aa, Mycobacterium
PDWTPGEA

SEQ ID NO: 537915 - protein, 8 aa, Mycobacterium
PDWTTPDR

SEQ ID NO: 537916 - protein, 7 aa, Mycobacterium
PDYAAGN

SEQ ID NO: 537917 - protein, 9 aa, Mycobacterium
PDYANLPRK

SEQ ID NO: 537918 - protein, 11 aa, Mycobacterium
PDYAQAQGNPT

SEQ ID NO: 537919 - protein, 88 aa, Mycobacterium
PDYDTTDEPAKTTKGKGKQDDKDGGETSGESGESGNSGVNSGAGGGTASGGMQGTATPASATGNAGGQLSGAGQQQGAGQGQQGMDPS

SEQ ID NO: 537920 - protein, 5 aa, Mycobacterium
PDYEA

SEQ ID NO: 537921 - protein, 8 aa, Mycobacterium
PDYENEDS

SEQ ID NO: 537922 - protein, 8 aa, Mycobacterium
PDYFPPDS

SEQ ID NO: 537923 - protein, 4 aa, Mycobacterium
PDYG

SEQ ID NO: 537924 - protein, 6 aa, Mycobacterium
PDYGAA

SEQ ID NO: 537925 - protein, 10 aa, Mycobacterium
PDYGPGRRLA

SEQ ID NO: 537926 - protein, 10 aa, Mycobacterium
PDYGSLPEDE

SEQ ID NO: 537927 - protein, 22 aa, Mycobacterium
PDYKPELPGGKPAGGRSLNAKP

SEQ ID NO: 537928 - protein, 8 aa, Mycobacterium
PDYKRGKD

SEQ ID NO: 537929 - protein, 5 aa, Mycobacterium
PDYPA

SEQ ID NO: 537930 - protein, 6 aa, Mycobacterium
PDYPFG

SEQ ID NO: 537931 - protein, 6 aa, Mycobacterium
PDYPRG

SEQ ID NO: 537932 - protein, 4 aa, Mycobacterium
PDYQ

SEQ ID NO: 537933 - protein, 17 aa, Mycobacterium
PDYRPAPRLGEHGDVLN

SEQ ID NO: 537934 - protein, 11 aa, Mycobacterium
PEAAAAARDRQ

SEQ ID NO: 537935 - protein, 16 aa, Mycobacterium
PEAAAAGAAAVANQGA

SEQ ID NO: 537936 - protein, 12 aa, Mycobacterium
PEAAAGGPLSRV

SEQ ID NO: 537937 - protein, 10 aa, Mycobacterium
PEAAAGPRDA

SEQ ID NO: 537938 - protein, 7 aa, Mycobacterium
PEAAARA

SEQ ID NO: 537939 - protein, 8 aa, Mycobacterium
PEAADDPR

SEQ ID NO: 537940 - protein, 13 aa, Mycobacterium
PEAAEKQVRKAQR

SEQ ID NO: 537941 - protein, 12 aa, Mycobacterium
PEAAELGEVDRS

SEQ ID NO: 537942 - protein, 7 aa, Mycobacterium
PEAAEQA

SEQ ID NO: 537943 - protein, 11 aa, Mycobacterium
PEAAERPEGEL

SEQ ID NO: 537944 - protein, 12 aa, Mycobacterium
PEAAESAAALTS

SEQ ID NO: 537945 - protein, 10 aa, Mycobacterium
PEAAGGPHDA

SEQ ID NO: 537946 - protein, 5 aa, Mycobacterium
PEAAN

SEQ ID NO: 537947 - protein, 11 aa, Mycobacterium
PEAAPGPNTGP

SEQ ID NO: 537948 - protein, 5 aa, Mycobacterium
PEAAR

SEQ ID NO: 537949 - protein, 5 aa, Mycobacterium
PEAAS

SEQ ID NO: 537950 - protein, 7 aa, Mycobacterium
PEAASDD

SEQ ID NO: 537951 - protein, 10 aa, Mycobacterium
PEAASESSNM

SEQ ID NO: 537952 - protein, 14 aa, Mycobacterium
PEAAVTAGAAQQSA

SEQ ID NO: 537953 - protein, 12 aa, Mycobacterium
PEAAVTDPTKLQ

SEQ ID NO: 537954 - protein, 10 aa, Mycobacterium
PEADADGRPV

SEQ ID NO: 537955 - protein, 7 aa, Mycobacterium
PEADADQ

SEQ ID NO: 537956 - protein, 9 aa, Mycobacterium
PEADEPVSA

SEQ ID NO: 537957 - protein, 21 aa, Mycobacterium
PEADGAEKASADTGGYNKVRG

SEQ ID NO: 537958 - protein, 11 aa, Mycobacterium
PEADGGAGGTL

SEQ ID NO: 537959 - protein, 21 aa, Mycobacterium
PEADGGDPLPPAPARSRSPLA

SEQ ID NO: 537960 - protein, 14 aa, Mycobacterium
PEADQQVQGDLTGP

SEQ ID NO: 537961 - protein, 5 aa, Mycobacterium
PEADR

SEQ ID NO: 537962 - protein, 7 aa, Mycobacterium
PEADRER

SEQ ID NO: 537963 - protein, 7 aa, Mycobacterium
PEADVAQ

SEQ ID NO: 537964 - protein, 40 aa, Mycobacterium
PEAEAAAAGAGAAEAAAGAAPAALGGAGPIGAGLGNASAL

SEQ ID NO: 537965 - protein, 7 aa, Mycobacterium
PEAEAAL

SEQ ID NO: 537966 - protein, 5 aa, Mycobacterium
PEAED

SEQ ID NO: 537967 - protein, 12 aa, Mycobacterium
PEAELEGASADG

SEQ ID NO: 537968 - protein, 12 aa, Mycobacterium
PEAELEGATSDR

SEQ ID NO: 537969 - protein, 9 aa, Mycobacterium
PEAELRRGR

SEQ ID NO: 537970 - protein, 7 aa, Mycobacterium
PEAEPRR

SEQ ID NO: 537971 - protein, 14 aa, Mycobacterium
PEAERRYNDEISTD

SEQ ID NO: 537972 - protein, 11 aa, Mycobacterium
PEAERRYNDQL

SEQ ID NO: 537973 - protein, 18 aa, Mycobacterium
PEAERSASRLERYRRIGL

SEQ ID NO: 537974 - protein, 10 aa, Mycobacterium
PEAFGSDAER

SEQ ID NO: 537975 - protein, 8 aa, Mycobacterium
PEAFPSDP

SEQ ID NO: 537976 - protein, 9 aa, Mycobacterium
PEAFTEKER

SEQ ID NO: 537977 - protein, 13 aa, Mycobacterium
PEAGGAKVLQGKE

SEQ ID NO: 537978 - protein, 7 aa, Mycobacterium
PEAGHVS

SEQ ID NO: 537979 - protein, 6 aa, Mycobacterium
PEAGNA

SEQ ID NO: 537980 - protein, 9 aa, Mycobacterium
PEAGPPIGN

SEQ ID NO: 537981 - protein, 8 aa, Mycobacterium
PEAGSVDA

SEQ ID NO: 537982 - protein, 11 aa, Mycobacterium
PEAGSVDAAER

SEQ ID NO: 537983 - protein, 5 aa, Mycobacterium
PEAGV

SEQ ID NO: 537984 - protein, 5 aa, Mycobacterium
PEAHE

SEQ ID NO: 537985 - protein, 6 aa, Mycobacterium
PEAHGA

SEQ ID NO: 537986 - protein, 8 aa, Mycobacterium
PEAHKDPA

SEQ ID NO: 537987 - protein, 10 aa, Mycobacterium
PEAHTEYRKP

SEQ ID NO: 537988 - protein, 11 aa, Mycobacterium
PEAHTEYRKPY

SEQ ID NO: 537989 - protein, 4 aa, Mycobacterium
PEAI

SEQ ID NO: 537990 - protein, 9 aa, Mycobacterium
PEAIDPDKA

SEQ ID NO: 537991 - protein, 5 aa, Mycobacterium
PEAIG

SEQ ID NO: 537992 - protein, 5 aa, Mycobacterium
PEAIN

SEQ ID NO: 537993 - protein, 5 aa, Mycobacterium
PEAIP

SEQ ID NO: 537994 - protein, 12 aa, Mycobacterium
PEAISSEAKERR

SEQ ID NO: 537995 - protein, 7 aa, Mycobacterium
PEAKGVK

SEQ ID NO: 537996 - protein, 11 aa, Mycobacterium
PEAKPAATGLE

SEQ ID NO: 537997 - protein, 8 aa, Mycobacterium
PEAKPGIS

SEQ ID NO: 537998 - protein, 11 aa, Mycobacterium
PEAKSQVGWDD

SEQ ID NO: 537999 - protein, 5 aa, Mycobacterium
PEALG

SEQ ID NO: 538000 - protein, 6 aa, Mycobacterium
PEALGP

SEQ ID NO: 538001 - protein, 5 aa, Mycobacterium
PEALN

SEQ ID NO: 538002 - protein, 4 aa, Mycobacterium
PEAN

SEQ ID NO: 538003 - protein, 13 aa, Mycobacterium
PEANAARLQSSAR

SEQ ID NO: 538004 - protein, 11 aa, Mycobacterium
PEANGEEGIRS

SEQ ID NO: 538005 - protein, 5 aa, Mycobacterium
PEANR

SEQ ID NO: 538006 - protein, 4 aa, Mycobacterium
PEAP

SEQ ID NO: 538007 - protein, 8 aa, Mycobacterium
PEAPAEAP

SEQ ID NO: 538008 - protein, 8 aa, Mycobacterium
PEAPATEP

SEQ ID NO: 538009 - protein, 17 aa, Mycobacterium
PEAPFGRDPQGRAYTEQ

SEQ ID NO: 538010 - protein, 5 aa, Mycobacterium
PEAPG

SEQ ID NO: 538011 - protein, 9 aa, Mycobacterium
PEAPGDRNA

SEQ ID NO: 538012 - protein, 9 aa, Mycobacterium
PEAPGRDTA

SEQ ID NO: 538013 - protein, 5 aa, Mycobacterium
PEAPL

SEQ ID NO: 538014 - protein, 8 aa, Mycobacterium
PEAPLAAA

SEQ ID NO: 538015 - protein, 22 aa, Mycobacterium
PEAPLAATTNRQQLKVDEKAKD

SEQ ID NO: 538016 - protein, 22 aa, Mycobacterium
PEAPLADKKDRQKLALGEEGMP

SEQ ID NO: 538017 - protein, 23 aa, Mycobacterium
PEAPLADNKDRQKLALGEEGMPG

SEQ ID NO: 538018 - protein, 22 aa, Mycobacterium
PEAPLSEAKDRQKLALGEEGMP

SEQ ID NO: 538019 - protein, 10 aa, Mycobacterium
PEAPLTGGYA

SEQ ID NO: 538020 - protein, 11 aa, Mycobacterium
PEAPPVTPRGA

SEQ ID NO: 538021 - protein, 7 aa, Mycobacterium
PEAPQWD

SEQ ID NO: 538022 - protein, 7 aa, Mycobacterium
PEAPRID

SEQ ID NO: 538023 - protein, 8 aa, Mycobacterium
PEAPSHRP

SEQ ID NO: 538024 - protein, 5 aa, Mycobacterium
PEAPT

SEQ ID NO: 538025 - protein, 14 aa, Mycobacterium
PEAPTNPTADHRGA

SEQ ID NO: 538026 - protein, 7 aa, Mycobacterium
PEAQNHR

SEQ ID NO: 538027 - protein, 7 aa, Mycobacterium
PEAQRVG

SEQ ID NO: 538028 - protein, 11 aa, Mycobacterium
PEAQVSVPDDN

SEQ ID NO: 538029 - protein, 7 aa, Mycobacterium
PEARDRL

SEQ ID NO: 538030 - protein, 15 aa, Mycobacterium
PEARERVAAKRSEAV

SEQ ID NO: 538031 - protein, 11 aa, Mycobacterium
PEARERVEAKR

SEQ ID NO: 538032 - protein, 5 aa, Mycobacterium
PEARN

SEQ ID NO: 538033 - protein, 13 aa, Mycobacterium
PEARNAVNGPTAA

SEQ ID NO: 538034 - protein, 5 aa, Mycobacterium
PEARQ

SEQ ID NO: 538035 - protein, 12 aa, Mycobacterium
PEARRAARDAGF

SEQ ID NO: 538036 - protein, 15 aa, Mycobacterium
PEARRGASFEANGEG

SEQ ID NO: 538037 - protein, 10 aa, Mycobacterium
PEASDKELAT

SEQ ID NO: 538038 - protein, 8 aa, Mycobacterium
PEASEKEL

SEQ ID NO: 538039 - protein, 8 aa, Mycobacterium
PEASLDPT

SEQ ID NO: 538040 - protein, 17 aa, Mycobacterium
PEASRADAVAERYGATT

SEQ ID NO: 538041 - protein, 7 aa, Mycobacterium
PEASRSI

SEQ ID NO: 538042 - protein, 5 aa, Mycobacterium
PEATA

SEQ ID NO: 538043 - protein, 6 aa, Mycobacterium
PEATAA

SEQ ID NO: 538044 - protein, 10 aa, Mycobacterium
PEATDAAIEA

SEQ ID NO: 538045 - protein, 13 aa, Mycobacterium
PEATDAKPVGKEE

SEQ ID NO: 538046 - protein, 8 aa, Mycobacterium
PEATEEAL

SEQ ID NO: 538047 - protein, 8 aa, Mycobacterium
PEATGATT

SEQ ID NO: 538048 - protein, 10 aa, Mycobacterium
PEATHRSQRR

SEQ ID NO: 538049 - protein, 8 aa, Mycobacterium
PEATPEDV

SEQ ID NO: 538050 - protein, 8 aa, Mycobacterium
PEATPSDV

SEQ ID NO: 538051 - protein, 14 aa, Mycobacterium
PEATRDARDDVNDA

SEQ ID NO: 538052 - protein, 7 aa, Mycobacterium
PEATTAD

SEQ ID NO: 538053 - protein, 4 aa, Mycobacterium
PEAV

SEQ ID NO: 538054 - protein, 5 aa, Mycobacterium
PEAVG

SEQ ID NO: 538055 - protein, 5 aa, Mycobacterium
PEAVR

SEQ ID NO: 538056 - protein, 6 aa, Mycobacterium
PEAVRT

SEQ ID NO: 538057 - protein, 20 aa, Mycobacterium
PEAYPADRARAIEPKAGCAT

SEQ ID NO: 538058 - protein, 12 aa, Mycobacterium
PECGSDAAALRT

SEQ ID NO: 538059 - protein, 7 aa, Mycobacterium
PECPRGP

SEQ ID NO: 538060 - protein, 5 aa, Mycobacterium
PECTG

SEQ ID NO: 538061 - protein, 5 aa, Mycobacterium
PECTQ

SEQ ID NO: 538062 - protein, 14 aa, Mycobacterium
PEDAAEYIGFDLTA

SEQ ID NO: 538063 - protein, 7 aa, Mycobacterium
PEDAEDE

SEQ ID NO: 538064 - protein, 8 aa, Mycobacterium
PEDAEGTE

SEQ ID NO: 538065 - protein, 7 aa, Mycobacterium
PEDAEND

SEQ ID NO: 538066 - protein, 6 aa, Mycobacterium
PEDAGP

SEQ ID NO: 538067 - protein, 8 aa, Mycobacterium
PEDAPAGQ

SEQ ID NO: 538068 - protein, 21 aa, Mycobacterium
PEDDDHPYRTGPWRPQTTEWD

SEQ ID NO: 538069 - protein, 5 aa, Mycobacterium
PEDDH

SEQ ID NO: 538070 - protein, 5 aa, Mycobacterium
PEDDI

SEQ ID NO: 538071 - protein, 5 aa, Mycobacterium
PEDDK

SEQ ID NO: 538072 - protein, 8 aa, Mycobacterium
PEDDPRQR

SEQ ID NO: 538073 - protein, 6 aa, Mycobacterium
PEDDRA

SEQ ID NO: 538074 - protein, 6 aa, Mycobacterium
PEDDRY

SEQ ID NO: 538075 - protein, 7 aa, Mycobacterium
PEDDTLS

SEQ ID NO: 538076 - protein, 4 aa, Mycobacterium
PEDE

SEQ ID NO: 538077 - protein, 15 aa, Mycobacterium
PEDEDARAAEEVASQ

SEQ ID NO: 538078 - protein, 6 aa, Mycobacterium
PEDEDM

SEQ ID NO: 538079 - protein, 6 aa, Mycobacterium
PEDEPV

SEQ ID NO: 538080 - protein, 10 aa, Mycobacterium
PEDERDEAAH

SEQ ID NO: 538081 - protein, 7 aa, Mycobacterium
PEDERNR

SEQ ID NO: 538082 - protein, 5 aa, Mycobacterium
PEDES

SEQ ID NO: 538083 - protein, 8 aa, Mycobacterium
PEDFEAEP

SEQ ID NO: 538084 - protein, 22 aa, Mycobacterium
PEDFPDPDAFRPDRYNKPEQAD

SEQ ID NO: 538085 - protein, 22 aa, Mycobacterium
PEDFPDPDTFDPDRYDKPRQED

SEQ ID NO: 538086 - protein, 7 aa, Mycobacterium
PEDFPGP

SEQ ID NO: 538087 - protein, 8 aa, Mycobacterium
PEDFQDPK

SEQ ID NO: 538088 - protein, 8 aa, Mycobacterium
PEDGDAQP

SEQ ID NO: 538089 - protein, 10 aa, Mycobacterium
PEDGIEPGTR

SEQ ID NO: 538090 - protein, 8 aa, Mycobacterium
PEDGRRAV

SEQ ID NO: 538091 - protein, 4 aa, Mycobacterium
PEDI

SEQ ID NO: 538092 - protein, 7 aa, Mycobacterium
PEDIGSR

SEQ ID NO: 538093 - protein, 7 aa, Mycobacterium
PEDIPAG

SEQ ID NO: 538094 - protein, 5 aa, Mycobacterium
PEDIS

SEQ ID NO: 538095 - protein, 4 aa, Mycobacterium
PEDL

SEQ ID NO: 538096 - protein, 5 aa, Mycobacterium
PEDLD

SEQ ID NO: 538097 - protein, 8 aa, Mycobacterium
PEDLEETK

SEQ ID NO: 538098 - protein, 10 aa, Mycobacterium
PEDLNSAEYR

SEQ ID NO: 538099 - protein, 8 aa, Mycobacterium
PEDLRARN

SEQ ID NO: 538100 - protein, 4 aa, Mycobacterium
PEDN

SEQ ID NO: 538101 - protein, 4 aa, Mycobacterium
PEDP

SEQ ID NO: 538102 - protein, 8 aa, Mycobacterium
PEDPDGTE

SEQ ID NO: 538103 - protein, 6 aa, Mycobacterium
PEDPEQ

SEQ ID NO: 538104 - protein, 5 aa, Mycobacterium
PEDPF

SEQ ID NO: 538105 - protein, 9 aa, Mycobacterium
PEDPGMHTT

SEQ ID NO: 538106 - protein, 7 aa, Mycobacterium
PEDPNAH

SEQ ID NO: 538107 - protein, 7 aa, Mycobacterium
PEDPRDI

SEQ ID NO: 538108 - protein, 5 aa, Mycobacterium
PEDPV

SEQ ID NO: 538109 - protein, 8 aa, Mycobacterium
PEDQQRET

SEQ ID NO: 538110 - protein, 10 aa, Mycobacterium
PEDQRPPQEE

SEQ ID NO: 538111 - protein, 9 aa, Mycobacterium
PEDQRVPDN

SEQ ID NO: 538112 - protein, 9 aa, Mycobacterium
PEDQVGEDG

SEQ ID NO: 538113 - protein, 8 aa, Mycobacterium
PEDREDEL

SEQ ID NO: 538114 - protein, 11 aa, Mycobacterium
PEDRGELTDGR

SEQ ID NO: 538115 - protein, 11 aa, Mycobacterium
PEDRGGAGGSI

SEQ ID NO: 538116 - protein, 8 aa, Mycobacterium
PEDRGYGH

SEQ ID NO: 538117 - protein, 5 aa, Mycobacterium
PEDRI

SEQ ID NO: 538118 - protein, 8 aa, Mycobacterium
PEDRKNQG

SEQ ID NO: 538119 - protein, 8 aa, Mycobacterium
PEDRKSQG

SEQ ID NO: 538120 - protein, 10 aa, Mycobacterium
PEDRPASIYT

SEQ ID NO: 538121 - protein, 8 aa, Mycobacterium
PEDRPPLK

SEQ ID NO: 538122 - protein, 8 aa, Mycobacterium
PEDRRTYS

SEQ ID NO: 538123 - protein, 4 aa, Mycobacterium
PEDS

SEQ ID NO: 538124 - protein, 9 aa, Mycobacterium
PEDSDEQPQ

SEQ ID NO: 538125 - protein, 9 aa, Mycobacterium
PEDSEEDER

SEQ ID NO: 538126 - protein, 8 aa, Mycobacterium
PEDSEFKT

SEQ ID NO: 538127 - protein, 7 aa, Mycobacterium
PEDSEPV

SEQ ID NO: 538128 - protein, 6 aa, Mycobacterium
PEDSER

SEQ ID NO: 538129 - protein, 6 aa, Mycobacterium
PEDSSA

SEQ ID NO: 538130 - protein, 4 aa, Mycobacterium
PEDT

SEQ ID NO: 538131 - protein, 10 aa, Mycobacterium
PEDTADTAAS

SEQ ID NO: 538132 - protein, 12 aa, Mycobacterium
PEDTARASTMEA

SEQ ID NO: 538133 - protein, 10 aa, Mycobacterium
PEDTDGPEAD

SEQ ID NO: 538134 - protein, 12 aa, Mycobacterium
PEDTENPAPSEM

SEQ ID NO: 538135 - protein, 5 aa, Mycobacterium
PEDTF

SEQ ID NO: 538136 - protein, 6 aa, Mycobacterium
PEDTPL

SEQ ID NO: 538137 - protein, 8 aa, Mycobacterium
PEDTPRDA

SEQ ID NO: 538138 - protein, 8 aa, Mycobacterium
PEDTRLGP

SEQ ID NO: 538139 - protein, 5 aa, Mycobacterium
PEDVA

SEQ ID NO: 538140 - protein, 7 aa, Mycobacterium
PEDVDGD

SEQ ID NO: 538141 - protein, 7 aa, Mycobacterium
PEDVDRE

SEQ ID NO: 538142 - protein, 7 aa, Mycobacterium
PEDVGRD

SEQ ID NO: 538143 - protein, 5 aa, Mycobacterium
PEDVK

SEQ ID NO: 538144 - protein, 8 aa, Mycobacterium
PEDVPPND

SEQ ID NO: 538145 - protein, 5 aa, Mycobacterium
PEDVS

SEQ ID NO: 538146 - protein, 4 aa, Mycobacterium
PEDY

SEQ ID NO: 538147 - protein, 12 aa, Mycobacterium
PEDYKATEVTPG

SEQ ID NO: 538148 - protein, 12 aa, Mycobacterium
PEDYRASEVTPG

SEQ ID NO: 538149 - protein, 4 aa, Mycobacterium
PEEA

SEQ ID NO: 538150 - protein, 15 aa, Mycobacterium
PEEAAALGDELKGVT

SEQ ID NO: 538151 - protein, 15 aa, Mycobacterium
PEEAAAMETDRHNEA

SEQ ID NO: 538152 - protein, 7 aa, Mycobacterium
PEEADAG

SEQ ID NO: 538153 - protein, 15 aa, Mycobacterium
PEEAEAMKSDRHNEA

SEQ ID NO: 538154 - protein, 7 aa, Mycobacterium
PEEAKAM

SEQ ID NO: 538155 - protein, 7 aa, Mycobacterium
PEEAPQA

SEQ ID NO: 538156 - protein, 25 aa, Mycobacterium
PEEARASLGKQVPHPSRLGSPDEYG

SEQ ID NO: 538157 - protein, 5 aa, Mycobacterium
PEEAT

SEQ ID NO: 538158 - protein, 4 aa, Mycobacterium
PEED

SEQ ID NO: 538159 - protein, 8 aa, Mycobacterium
PEEDEQRG

SEQ ID NO: 538160 - protein, 8 aa, Mycobacterium
PEEDFTAK

SEQ ID NO: 538161 - protein, 21 aa, Mycobacterium
PEEDGGAANNLPEPPAPQRPL

SEQ ID NO: 538162 - protein, 5 aa, Mycobacterium
PEEDH

SEQ ID NO: 538163 - protein, 7 aa, Mycobacterium
PEEDHAE

SEQ ID NO: 538164 - protein, 6 aa, Mycobacterium
PEEDHD

SEQ ID NO: 538165 - protein, 6 aa, Mycobacterium
PEEDHK

SEQ ID NO: 538166 - protein, 9 aa, Mycobacterium
PEEDPGPEI

SEQ ID NO: 538167 - protein, 11 aa, Mycobacterium
PEEDQEAARDF

SEQ ID NO: 538168 - protein, 31 aa, Mycobacterium
PEEDQEKIRDHGNAQMRTEAGKPMKAAEEGL

SEQ ID NO: 538169 - protein, 27 aa, Mycobacterium
PEEDQEYIRDRGNAQLRTEPGKPMSAA

SEQ ID NO: 538170 - protein, 5 aa, Mycobacterium
PEEDR

SEQ ID NO: 538171 - protein, 6 aa, Mycobacterium
PEEDRA

SEQ ID NO: 538172 - protein, 8 aa, Mycobacterium
PEEDRAQF

SEQ ID NO: 538173 - protein, 7 aa, Mycobacterium
PEEDRPE

SEQ ID NO: 538174 - protein, 6 aa, Mycobacterium
PEEDRQ

SEQ ID NO: 538175 - protein, 8 aa, Mycobacterium
PEEDRTQF

SEQ ID NO: 538176 - protein, 15 aa, Mycobacterium
PEEDSRVTSTAVAQP

SEQ ID NO: 538177 - protein, 7 aa, Mycobacterium
PEEDYPQ

SEQ ID NO: 538178 - protein, 4 aa, Mycobacterium
PEEE

SEQ ID NO: 538179 - protein, 7 aa, Mycobacterium
PEEEHNR

SEQ ID NO: 538180 - protein, 8 aa, Mycobacterium
PEEERGPM

SEQ ID NO: 538181 - protein, 11 aa, Mycobacterium
PEEFADPSYDK

SEQ ID NO: 538182 - protein, 19 aa, Mycobacterium
PEEGDPEQQAATILDYWLS

SEQ ID NO: 538183 - protein, 15 aa, Mycobacterium
PEEGQEQIRRRTDQN

SEQ ID NO: 538184 - protein, 5 aa, Mycobacterium
PEEGR

SEQ ID NO: 538185 - protein, 5 aa, Mycobacterium
PEEHD

SEQ ID NO: 538186 - protein, 11 aa, Mycobacterium
PEEHHAPRRAA

SEQ ID NO: 538187 - protein, 6 aa, Mycobacterium
PEEKAA

SEQ ID NO: 538188 - protein, 9 aa, Mycobacterium
PEELESGNN

SEQ ID NO: 538189 - protein, 8 aa, Mycobacterium
PEELGGAL

SEQ ID NO: 538190 - protein, 8 aa, Mycobacterium
PEELNSTT

SEQ ID NO: 538191 - protein, 8 aa, Mycobacterium
PEELPGAA

SEQ ID NO: 538192 - protein, 7 aa, Mycobacterium
PEELRPN

SEQ ID NO: 538193 - protein, 14 aa, Mycobacterium
PEENQKTLTEADRA

SEQ ID NO: 538194 - protein, 43 aa, Mycobacterium
PEEPCDPPPEPAATVAAPEPPAPPPPAEPVPAAEPASDEQTPC

SEQ ID NO: 538195 - protein, 14 aa, Mycobacterium
PEEPDAEADSSKDE

SEQ ID NO: 538196 - protein, 13 aa, Mycobacterium
PEEPDRARMRAET

SEQ ID NO: 538197 - protein, 8 aa, Mycobacterium
PEEPGGRK

SEQ ID NO: 538198 - protein, 6 aa, Mycobacterium
PEEPLP

SEQ ID NO: 538199 - protein, 11 aa, Mycobacterium
PEEPPVTPRGA

SEQ ID NO: 538200 - protein, 7 aa, Mycobacterium
PEEQPEE

SEQ ID NO: 538201 - protein, 5 aa, Mycobacterium
PEEQR

SEQ ID NO: 538202 - protein, 7 aa, Mycobacterium
PEEQRGA

SEQ ID NO: 538203 - protein, 11 aa, Mycobacterium
PEERDEIPSAM

SEQ ID NO: 538204 - protein, 10 aa, Mycobacterium
PEERRTADGR

SEQ ID NO: 538205 - protein, 7 aa, Mycobacterium
PEERSHT

SEQ ID NO: 538206 - protein, 7 aa, Mycobacterium
PEERTAS

SEQ ID NO: 538207 - protein, 18 aa, Mycobacterium
PEESAESAEGADTAESPL

SEQ ID NO: 538208 - protein, 11 aa, Mycobacterium
PEESGGAGGSI

SEQ ID NO: 538209 - protein, 4 aa, Mycobacterium
PEET

SEQ ID NO: 538210 - protein, 10 aa, Mycobacterium
PEETDEEELS

SEQ ID NO: 538211 - protein, 8 aa, Mycobacterium
PEETDEQE

SEQ ID NO: 538212 - protein, 12 aa, Mycobacterium
PEETMTAAGPYD

SEQ ID NO: 538213 - protein, 5 aa, Mycobacterium
PEETR

SEQ ID NO: 538214 - protein, 5 aa, Mycobacterium
PEEVA

SEQ ID NO: 538215 - protein, 11 aa, Mycobacterium
PEEVARQAADN

SEQ ID NO: 538216 - protein, 6 aa, Mycobacterium
PEEVER

SEQ ID NO: 538217 - protein, 13 aa, Mycobacterium
PEEVGGDGGDGAD

SEQ ID NO: 538218 - protein, 5 aa, Mycobacterium
PEEVN

SEQ ID NO: 538219 - protein, 5 aa, Mycobacterium
PEEVP

SEQ ID NO: 538220 - protein, 17 aa, Mycobacterium
PEEVTSVDTDDEELEGP

SEQ ID NO: 538221 - protein, 17 aa, Mycobacterium
PEEYQAAGAPFDGRGAQ

SEQ ID NO: 538222 - protein, 5 aa, Mycobacterium
PEEYT

SEQ ID NO: 538223 - protein, 10 aa, Mycobacterium
PEFARKGGFD

SEQ ID NO: 538224 - protein, 14 aa, Mycobacterium
PEFDDTDGTSRGTV

SEQ ID NO: 538225 - protein, 5 aa, Mycobacterium
PEFDG

SEQ ID NO: 538226 - protein, 18 aa, Mycobacterium
PEFDGRTPREEAITHGSG

SEQ ID NO: 538227 - protein, 5 aa, Mycobacterium
PEFDR

SEQ ID NO: 538228 - protein, 6 aa, Mycobacterium
PEFEPP

SEQ ID NO: 538229 - protein, 7 aa, Mycobacterium
PEFGAED

SEQ ID NO: 538230 - protein, 5 aa, Mycobacterium
PEFGG

SEQ ID NO: 538231 - protein, 10 aa, Mycobacterium
PEFGTGSSRE

SEQ ID NO: 538232 - protein, 13 aa, Mycobacterium
PEFGVEGGPIANE

SEQ ID NO: 538233 - protein, 7 aa, Mycobacterium
PEFNPGA

SEQ ID NO: 538234 - protein, 10 aa, Mycobacterium
PEFNPQAPVG

SEQ ID NO: 538235 - protein, 5 aa, Mycobacterium
PEFPD

SEQ ID NO: 538236 - protein, 9 aa, Mycobacterium
PEFQQATQD

SEQ ID NO: 538237 - protein, 11 aa, Mycobacterium
PEFRGAPGYEG

SEQ ID NO: 538238 - protein, 5 aa, Mycobacterium
PEFSG

SEQ ID NO: 538239 - protein, 8 aa, Mycobacterium
PEFSSRAD

SEQ ID NO: 538240 - protein, 4 aa, Mycobacterium
PEFT

SEQ ID NO: 538241 - protein, 7 aa, Mycobacterium
PEFTASA

SEQ ID NO: 538242 - protein, 4 aa, Mycobacterium
PEGA

SEQ ID NO: 538243 - protein, 5 aa, Mycobacterium
PEGAA

SEQ ID NO: 538244 - protein, 8 aa, Mycobacterium
PEGADLRG

SEQ ID NO: 538245 - protein, 5 aa, Mycobacterium
PEGAE

SEQ ID NO: 538246 - protein, 8 aa, Mycobacterium
PEGAEAWD

SEQ ID NO: 538247 - protein, 6 aa, Mycobacterium
PEGAEI

SEQ ID NO: 538248 - protein, 5 aa, Mycobacterium
PEGAG

SEQ ID NO: 538249 - protein, 9 aa, Mycobacterium
PEGAGPELE

SEQ ID NO: 538250 - protein, 11 aa, Mycobacterium
PEGANSKAEGL

SEQ ID NO: 538251 - protein, 11 aa, Mycobacterium
PEGAPDSSRGV

SEQ ID NO: 538252 - protein, 10 aa, Mycobacterium
PEGAPDTTRG

SEQ ID NO: 538253 - protein, 9 aa, Mycobacterium
PEGAPRPVV

SEQ ID NO: 538254 - protein, 5 aa, Mycobacterium
PEGAQ

SEQ ID NO: 538255 - protein, 23 aa, Mycobacterium
PEGAREQAAGVAAASGVPASSTS

SEQ ID NO: 538256 - protein, 9 aa, Mycobacterium
PEGASAPGQ

SEQ ID NO: 538257 - protein, 11 aa, Mycobacterium
PEGASSKAEGL

SEQ ID NO: 538258 - protein, 11 aa, Mycobacterium
PEGATSKAEGL

SEQ ID NO: 538259 - protein, 12 aa, Mycobacterium
PEGATSKAEGLT

SEQ ID NO: 538260 - protein, 5 aa, Mycobacterium
PEGDE

SEQ ID NO: 538261 - protein, 7 aa, Mycobacterium
PEGDKTR

SEQ ID NO: 538262 - protein, 7 aa, Mycobacterium
PEGDREE

SEQ ID NO: 538263 - protein, 7 aa, Mycobacterium
PEGDRPR

SEQ ID NO: 538264 - protein, 6 aa, Mycobacterium
PEGDTM

SEQ ID NO: 538265 - protein, 4 aa, Mycobacterium
PEGE

SEQ ID NO: 538266 - protein, 8 aa, Mycobacterium
PEGEDQDS

SEQ ID NO: 538267 - protein, 8 aa, Mycobacterium
PEGEGFDS

SEQ ID NO: 538268 - protein, 7 aa, Mycobacterium
PEGEPRF

SEQ ID NO: 538269 - protein, 10 aa, Mycobacterium
PEGEREKVAH

SEQ ID NO: 538270 - protein, 10 aa, Mycobacterium
PEGERPPQEE

SEQ ID NO: 538271 - protein, 16 aa, Mycobacterium
PEGESAASLKLDGTET

SEQ ID NO: 538272 - protein, 13 aa, Mycobacterium
PEGESASSLGLDG

SEQ ID NO: 538273 - protein, 7 aa, Mycobacterium
PEGETRG

SEQ ID NO: 538274 - protein, 10 aa, Mycobacterium
PEGEYGEPEE

SEQ ID NO: 538275 - protein, 4 aa, Mycobacterium
PEGF

SEQ ID NO: 538276 - protein, 26 aa, Mycobacterium
PEGFAPDPACTAAARERAEATGGSVT

SEQ ID NO: 538277 - protein, 5 aa, Mycobacterium
PEGFD

SEQ ID NO: 538278 - protein, 7 aa, Mycobacterium
PEGFDSL

SEQ ID NO: 538279 - protein, 5 aa, Mycobacterium
PEGFE

SEQ ID NO: 538280 - protein, 4 aa, Mycobacterium
PEGG

SEQ ID NO: 538281 - protein, 8 aa, Mycobacterium
PEGGAPPF

SEQ ID NO: 538282 - protein, 5 aa, Mycobacterium
PEGGQ

SEQ ID NO: 538283 - protein, 5 aa, Mycobacterium
PEGGS

SEQ ID NO: 538284 - protein, 10 aa, Mycobacterium
PEGGSGGGTV

SEQ ID NO: 538285 - protein, 8 aa, Mycobacterium
PEGGVADE

SEQ ID NO: 538286 - protein, 4 aa, Mycobacterium
PEGH

SEQ ID NO: 538287 - protein, 6 aa, Mycobacterium
PEGIGE

SEQ ID NO: 538288 - protein, 8 aa, Mycobacterium
PEGIPDHA

SEQ ID NO: 538289 - protein, 7 aa, Mycobacterium
PEGKAKA

SEQ ID NO: 538290 - protein, 7 aa, Mycobacterium
PEGKDVK

SEQ ID NO: 538291 - protein, 5 aa, Mycobacterium
PEGKE

SEQ ID NO: 538292 - protein, 8 aa, Mycobacterium
PEGKRNDQ

SEQ ID NO: 538293 - protein, 12 aa, Mycobacterium
PEGKSAKELGLD

SEQ ID NO: 538294 - protein, 6 aa, Mycobacterium
PEGLAQ

SEQ ID NO: 538295 - protein, 6 aa, Mycobacterium
PEGLDK

SEQ ID NO: 538296 - protein, 6 aa, Mycobacterium
PEGLDS

SEQ ID NO: 538297 - protein, 7 aa, Mycobacterium
PEGLEGG

SEQ ID NO: 538298 - protein, 12 aa, Mycobacterium
PEGLSKTGHRNL

SEQ ID NO: 538299 - protein, 4 aa, Mycobacterium
PEGN

SEQ ID NO: 538300 - protein, 12 aa, Mycobacterium
PEGNEFCILAAE

SEQ ID NO: 538301 - protein, 7 aa, Mycobacterium
PEGPDDS

SEQ ID NO: 538302 - protein, 12 aa, Mycobacterium
PEGPDLRVQPGD

SEQ ID NO: 538303 - protein, 11 aa, Mycobacterium
PEGPEAQWQRS

SEQ ID NO: 538304 - protein, 12 aa, Mycobacterium
PEGPEGKPDPLA

SEQ ID NO: 538305 - protein, 12 aa, Mycobacterium
PEGPEGKPDPVA

SEQ ID NO: 538306 - protein, 12 aa, Mycobacterium
PEGPEGQPDPLA

SEQ ID NO: 538307 - protein, 25 aa, Mycobacterium
PEGPGRELASTEITETSPDADEHRR

SEQ ID NO: 538308 - protein, 11 aa, Mycobacterium
PEGPNGNPDPL

SEQ ID NO: 538309 - protein, 14 aa, Mycobacterium
PEGPNGNPDPQASA

SEQ ID NO: 538310 - protein, 8 aa, Mycobacterium
PEGPPGLP

SEQ ID NO: 538311 - protein, 9 aa, Mycobacterium
PEGPPGSSR

SEQ ID NO: 538312 - protein, 21 aa, Mycobacterium
PEGPPRTERFGPTPVQPAAGS

SEQ ID NO: 538313 - protein, 5 aa, Mycobacterium
PEGPQ

SEQ ID NO: 538314 - protein, 7 aa, Mycobacterium
PEGPQSE

SEQ ID NO: 538315 - protein, 6 aa, Mycobacterium
PEGPSG

SEQ ID NO: 538316 - protein, 7 aa, Mycobacterium
PEGPVRR

SEQ ID NO: 538317 - protein, 8 aa, Mycobacterium
PEGPVSGP

SEQ ID NO: 538318 - protein, 6 aa, Mycobacterium
PEGQAA

SEQ ID NO: 538319 - protein, 15 aa, Mycobacterium
PEGQAGWDAPTPAAG

SEQ ID NO: 538320 - protein, 5 aa, Mycobacterium
PEGQC

SEQ ID NO: 538321 - protein, 15 aa, Mycobacterium
PEGQRADGENTESDR

SEQ ID NO: 538322 - protein, 18 aa, Mycobacterium
PEGQRADGENTESDRADW

SEQ ID NO: 538323 - protein, 22 aa, Mycobacterium
PEGQRADGENTESDRAGWTTPQ

SEQ ID NO: 538324 - protein, 13 aa, Mycobacterium
PEGQSGDETIQGA

SEQ ID NO: 538325 - protein, 17 aa, Mycobacterium
PEGQTADSLGLTGEETV

SEQ ID NO: 538326 - protein, 13 aa, Mycobacterium
PEGQWRPDANRSR

SEQ ID NO: 538327 - protein, 9 aa, Mycobacterium
PEGRAAAGG

SEQ ID NO: 538328 - protein, 13 aa, Mycobacterium
PEGRALPSYPPGS

SEQ ID NO: 538329 - protein, 30 aa, Mycobacterium
PEGRDSRDSREGRGRRDGGRGGRDSDKSNY

SEQ ID NO: 538330 - protein, 10 aa, Mycobacterium
PEGRGLPPVS

SEQ ID NO: 538331 - protein, 17 aa, Mycobacterium
PEGRPVDGGARYPRPDA

SEQ ID NO: 538332 - protein, 7 aa, Mycobacterium
PEGRTEY

SEQ ID NO: 538333 - protein, 6 aa, Mycobacterium
PEGRVV

SEQ ID NO: 538334 - protein, 10 aa, Mycobacterium
PEGSAGIERT

SEQ ID NO: 538335 - protein, 9 aa, Mycobacterium
PEGSAPATE

SEQ ID NO: 538336 - protein, 10 aa, Mycobacterium
PEGSAPDPAL

SEQ ID NO: 538337 - protein, 22 aa, Mycobacterium
PEGSAPPAELTPPTIEGYGEGK

SEQ ID NO: 538338 - protein, 5 aa, Mycobacterium
PEGSD

SEQ ID NO: 538339 - protein, 9 aa, Mycobacterium
PEGSDAWDG

SEQ ID NO: 538340 - protein, 9 aa, Mycobacterium
PEGSDDELA

SEQ ID NO: 538341 - protein, 51 aa, Mycobacterium
PEGSPPKAINTDGGDGEVGEGCGSGAGDRAVAGELPAAADLGNGAGLSGAA

SEQ ID NO: 538342 - protein, 12 aa, Mycobacterium
PEGSPREDEPHD

SEQ ID NO: 538343 - protein, 18 aa, Mycobacterium
PEGSPVLSGGQKGPHPIQ

SEQ ID NO: 538344 - protein, 8 aa, Mycobacterium
PEGSRADW

SEQ ID NO: 538345 - protein, 6 aa, Mycobacterium
PEGSTA

SEQ ID NO: 538346 - protein, 5 aa, Mycobacterium
PEGSW

SEQ ID NO: 538347 - protein, 4 aa, Mycobacterium
PEGT

SEQ ID NO: 538348 - protein, 18 aa, Mycobacterium
PEGTAADSVDTSLENESR

SEQ ID NO: 538349 - protein, 5 aa, Mycobacterium
PEGTD

SEQ ID NO: 538350 - protein, 10 aa, Mycobacterium
PEGTDGWDED

SEQ ID NO: 538351 - protein, 9 aa, Mycobacterium
PEGTEGWTE

SEQ ID NO: 538352 - protein, 7 aa, Mycobacterium
PEGTESD

SEQ ID NO: 538353 - protein, 6 aa, Mycobacterium
PEGTFT

SEQ ID NO: 538354 - protein, 6 aa, Mycobacterium
PEGTHS

SEQ ID NO: 538355 - protein, 7 aa, Mycobacterium
PEGTPRQ

SEQ ID NO: 538356 - protein, 12 aa, Mycobacterium
PEGTRSPDGRLY

SEQ ID NO: 538357 - protein, 7 aa, Mycobacterium
PEGTSDS

SEQ ID NO: 538358 - protein, 8 aa, Mycobacterium
PEGTTRQA

SEQ ID NO: 538359 - protein, 5 aa, Mycobacterium
PEGTV

SEQ ID NO: 538360 - protein, 8 aa, Mycobacterium
PEGTVKSR

SEQ ID NO: 538361 - protein, 15 aa, Mycobacterium
PEGTVKSRCSRARTK

SEQ ID NO: 538362 - protein, 19 aa, Mycobacterium
PEGVAAGDYTTSAEDKPAI

SEQ ID NO: 538363 - protein, 12 aa, Mycobacterium
PEGVGKTSLARS

SEQ ID NO: 538364 - protein, 9 aa, Mycobacterium
PEGVPGPDR

SEQ ID NO: 538365 - protein, 18 aa, Mycobacterium
PEGVPPAARKPEPKLPVP

SEQ ID NO: 538366 - protein, 7 aa, Mycobacterium
PEGVSED

SEQ ID NO: 538367 - protein, 5 aa, Mycobacterium
PEGVT

SEQ ID NO: 538368 - protein, 4 aa, Mycobacterium
PEHA

SEQ ID NO: 538369 - protein, 14 aa, Mycobacterium
PEHAADVKAAGAEP

SEQ ID NO: 538370 - protein, 5 aa, Mycobacterium
PEHAP

SEQ ID NO: 538371 - protein, 14 aa, Mycobacterium
PEHAPAFARRGGRT

SEQ ID NO: 538372 - protein, 7 aa, Mycobacterium
PEHAPDF

SEQ ID NO: 538373 - protein, 15 aa, Mycobacterium
PEHAPGFARRPPGAT

SEQ ID NO: 538374 - protein, 10 aa, Mycobacterium
PEHAPKPRSL

SEQ ID NO: 538375 - protein, 5 aa, Mycobacterium
PEHAT

SEQ ID NO: 538376 - protein, 5 aa, Mycobacterium
PEHDK

SEQ ID NO: 538377 - protein, 8 aa, Mycobacterium
PEHDPALT

SEQ ID NO: 538378 - protein, 6 aa, Mycobacterium
PEHDSA

SEQ ID NO: 538379 - protein, 10 aa, Mycobacterium
PEHERYKEAA

SEQ ID NO: 538380 - protein, 14 aa, Mycobacterium
PEHFPPDGGAKPLL

SEQ ID NO: 538381 - protein, 7 aa, Mycobacterium
PEHGAAE

SEQ ID NO: 538382 - protein, 45 aa, Mycobacterium
PEHGDQPQDAQRARDAEPTHDGRQARGDRTTEDQEQDHRHHRDRK

SEQ ID NO: 538383 - protein, 15 aa, Mycobacterium
PEHGYTVDDEDDDDP

SEQ ID NO: 538384 - protein, 13 aa, Mycobacterium
PEHKAPAAAEDAY

SEQ ID NO: 538385 - protein, 10 aa, Mycobacterium
PEHKAPAAAQ

SEQ ID NO: 538386 - protein, 5 aa, Mycobacterium
PEHLA

SEQ ID NO: 538387 - protein, 4 aa, Mycobacterium
PEHP

SEQ ID NO: 538388 - protein, 7 aa, Mycobacterium
PEHPAPA

SEQ ID NO: 538389 - protein, 9 aa, Mycobacterium
PEHPAPAAA

SEQ ID NO: 538390 - protein, 9 aa, Mycobacterium
PEHPAPAAI

SEQ ID NO: 538391 - protein, 10 aa, Mycobacterium
PEHPAPAAVE

SEQ ID NO: 538392 - protein, 11 aa, Mycobacterium
PEHPDAADEPR

SEQ ID NO: 538393 - protein, 6 aa, Mycobacterium
PEHPGH

SEQ ID NO: 538394 - protein, 19 aa, Mycobacterium
PEHPHAAQKPVPYEIKQVA

SEQ ID NO: 538395 - protein, 5 aa, Mycobacterium
PEHPI

SEQ ID NO: 538396 - protein, 8 aa, Mycobacterium
PEHPYPGA

SEQ ID NO: 538397 - protein, 5 aa, Mycobacterium
PEHQD

SEQ ID NO: 538398 - protein, 5 aa, Mycobacterium
PEHQR

SEQ ID NO: 538399 - protein, 12 aa, Mycobacterium
PEHQRDGAYDTL

SEQ ID NO: 538400 - protein, 21 aa, Mycobacterium
PEHQRSAKQAFSEASIAPSRT

SEQ ID NO: 538401 - protein, 14 aa, Mycobacterium
PEHSELSPRLVGTA

SEQ ID NO: 538402 - protein, 5 aa, Mycobacterium
PEHSR

SEQ ID NO: 538403 - protein, 5 aa, Mycobacterium
PEHST

SEQ ID NO: 538404 - protein, 4 aa, Mycobacterium
PEHT

SEQ ID NO: 538405 - protein, 6 aa, Mycobacterium
PEHTDR

SEQ ID NO: 538406 - protein, 6 aa, Mycobacterium
PEHTEK

SEQ ID NO: 538407 - protein, 12 aa, Mycobacterium
PEHTPTAPALSA

SEQ ID NO: 538408 - protein, 4 aa, Mycobacterium
PEHW

SEQ ID NO: 538409 - protein, 4 aa, Mycobacterium
PEIA

SEQ ID NO: 538410 - protein, 10 aa, Mycobacterium
PEIADASQRR

SEQ ID NO: 538411 - protein, 6 aa, Mycobacterium
PEIAEE

SEQ ID NO: 538412 - protein, 13 aa, Mycobacterium
PEIAERDSRPRER

SEQ ID NO: 538413 - protein, 8 aa, Mycobacterium
PEIAGGKA

SEQ ID NO: 538414 - protein, 9 aa, Mycobacterium
PEIANTSPG

SEQ ID NO: 538415 - protein, 12 aa, Mycobacterium
PEIATGEPNTAT

SEQ ID NO: 538416 - protein, 5 aa, Mycobacterium
PEIDP

SEQ ID NO: 538417 - protein, 17 aa, Mycobacterium
PEIDPNQHSCGSISPHG

SEQ ID NO: 538418 - protein, 5 aa, Mycobacterium
PEIGD

SEQ ID NO: 538419 - protein, 11 aa, Mycobacterium
PEIGGITRSPE

SEQ ID NO: 538420 - protein, 11 aa, Mycobacterium
PEIKATATQAI

SEQ ID NO: 538421 - protein, 4 aa, Mycobacterium
PEIN

SEQ ID NO: 538422 - protein, 9 aa, Mycobacterium
PEINTEKGF

SEQ ID NO: 538423 - protein, 7 aa, Mycobacterium
PEIPRDR

SEQ ID NO: 538424 - protein, 8 aa, Mycobacterium
PEIQDDPY

SEQ ID NO: 538425 - protein, 9 aa, Mycobacterium
PEIQHGSPP

SEQ ID NO: 538426 - protein, 9 aa, Mycobacterium
PEISGESNR

SEQ ID NO: 538427 - protein, 5 aa, Mycobacterium
PEITA

SEQ ID NO: 538428 - protein, 11 aa, Mycobacterium
PEITRTDEGHP

SEQ ID NO: 538429 - protein, 4 aa, Mycobacterium
PEKA

SEQ ID NO: 538430 - protein, 10 aa, Mycobacterium
PEKAGRDAGE

SEQ ID NO: 538431 - protein, 8 aa, Mycobacterium
PEKAGRDV

SEQ ID NO: 538432 - protein, 11 aa, Mycobacterium
PEKAKTGPFGG

SEQ ID NO: 538433 - protein, 5 aa, Mycobacterium
PEKAP

SEQ ID NO: 538434 - protein, 13 aa, Mycobacterium
PEKDAPRVATGMP

SEQ ID NO: 538435 - protein, 17 aa, Mycobacterium
PEKDGRDAGELAGGEPI

SEQ ID NO: 538436 - protein, 8 aa, Mycobacterium
PEKDHDAV

SEQ ID NO: 538437 - protein, 5 aa, Mycobacterium
PEKEI

SEQ ID NO: 538438 - protein, 7 aa, Mycobacterium
PEKFDPA

SEQ ID NO: 538439 - protein, 13 aa, Mycobacterium
PEKFTGSPLRREQ

SEQ ID NO: 538440 - protein, 7 aa, Mycobacterium
PEKGAVD

SEQ ID NO: 538441 - protein, 13 aa, Mycobacterium
PEKGQVDPTGVGD

SEQ ID NO: 538442 - protein, 10 aa, Mycobacterium
PEKGTWRTDS

SEQ ID NO: 538443 - protein, 12 aa, Mycobacterium
PEKGTWRTDSKN

SEQ ID NO: 538444 - protein, 11 aa, Mycobacterium
PEKLAREPLRG

SEQ ID NO: 538445 - protein, 10 aa, Mycobacterium
PEKNPPPPEV

SEQ ID NO: 538446 - protein, 10 aa, Mycobacterium
PEKPDDHDNP

SEQ ID NO: 538447 - protein, 8 aa, Mycobacterium
PEKPHDGP

SEQ ID NO: 538448 - protein, 8 aa, Mycobacterium
PEKTAGAV

SEQ ID NO: 538449 - protein, 10 aa, Mycobacterium
PEKTDPRTYY

SEQ ID NO: 538450 - protein, 7 aa, Mycobacterium
PEKTPEL

SEQ ID NO: 538451 - protein, 10 aa, Mycobacterium
PEKVADHTGV

SEQ ID NO: 538452 - protein, 11 aa, Mycobacterium
PEKVGKDAGEL

SEQ ID NO: 538453 - protein, 9 aa, Mycobacterium
PEKVGRDAG

SEQ ID NO: 538454 - protein, 10 aa, Mycobacterium
PEKVGRDAGE

SEQ ID NO: 538455 - protein, 11 aa, Mycobacterium
PEKVGRDAGEI

SEQ ID NO: 538456 - protein, 8 aa, Mycobacterium
PEKVGRDV

SEQ ID NO: 538457 - protein, 6 aa, Mycobacterium
PEKYPN

SEQ ID NO: 538458 - protein, 4 aa, Mycobacterium
PELA

SEQ ID NO: 538459 - protein, 8 aa, Mycobacterium
PELADDPR

SEQ ID NO: 538460 - protein, 9 aa, Mycobacterium
PELAETDAR

SEQ ID NO: 538461 - protein, 8 aa, Mycobacterium
PELAGEAG

SEQ ID NO: 538462 - protein, 10 aa, Mycobacterium
PELAGEAGVR

SEQ ID NO: 538463 - protein, 10 aa, Mycobacterium
PELAPDAPTA

SEQ ID NO: 538464 - protein, 17 aa, Mycobacterium
PELARQRDQLLSELAKE

SEQ ID NO: 538465 - protein, 11 aa, Mycobacterium
PELARRGRGTP

SEQ ID NO: 538466 - protein, 17 aa, Mycobacterium
PELATQPGGPPPPPDAE

SEQ ID NO: 538467 - protein, 4 aa, Mycobacterium
PELC

SEQ ID NO: 538468 - protein, 12 aa, Mycobacterium
PELDDAEQRRAA

SEQ ID NO: 538469 - protein, 11 aa, Mycobacterium
PELDEAESRLR

SEQ ID NO: 538470 - protein, 9 aa, Mycobacterium
PELDEDTAR

SEQ ID NO: 538471 - protein, 10 aa, Mycobacterium
PELDSSVDSV

SEQ ID NO: 538472 - protein, 12 aa, Mycobacterium
PELEPESLDEEP

SEQ ID NO: 538473 - protein, 6 aa, Mycobacterium
PELEPK

SEQ ID NO: 538474 - protein, 9 aa, Mycobacterium
PELGADTDD

SEQ ID NO: 538475 - protein, 7 aa, Mycobacterium
PELGAHT

SEQ ID NO: 538476 - protein, 16 aa, Mycobacterium
PELGELPSGLNPAKCD

SEQ ID NO: 538477 - protein, 10 aa, Mycobacterium
PELGERAASA

SEQ ID NO: 538478 - protein, 14 aa, Mycobacterium
PELGGGLSNSEYAP

SEQ ID NO: 538479 - protein, 6 aa, Mycobacterium
PELGGQ

SEQ ID NO: 538480 - protein, 9 aa, Mycobacterium
PELGGQGYG

SEQ ID NO: 538481 - protein, 7 aa, Mycobacterium
PELGPMG

SEQ ID NO: 538482 - protein, 10 aa, Mycobacterium
PELGPTDDGI

SEQ ID NO: 538483 - protein, 5 aa, Mycobacterium
PELGR

SEQ ID NO: 538484 - protein, 6 aa, Mycobacterium
PELGSE

SEQ ID NO: 538485 - protein, 7 aa, Mycobacterium
PELGTGP

SEQ ID NO: 538486 - protein, 18 aa, Mycobacterium
PELGTGPVSFGDSTSPEF

SEQ ID NO: 538487 - protein, 16 aa, Mycobacterium
PELHSNPDEARKAGRR

SEQ ID NO: 538488 - protein, 5 aa, Mycobacterium
PELIG

SEQ ID NO: 538489 - protein, 8 aa, Mycobacterium
PELKAENH

SEQ ID NO: 538490 - protein, 9 aa, Mycobacterium
PELKKKGGS

SEQ ID NO: 538491 - protein, 9 aa, Mycobacterium
PELNATKRR

SEQ ID NO: 538492 - protein, 7 aa, Mycobacterium
PELPEDA

SEQ ID NO: 538493 - protein, 23 aa, Mycobacterium
PELPGGQPAGGRSLGPAAFEPSR

SEQ ID NO: 538494 - protein, 8 aa, Mycobacterium
PELPGGSR

SEQ ID NO: 538495 - protein, 8 aa, Mycobacterium
PELPGPLS

SEQ ID NO: 538496 - protein, 8 aa, Mycobacterium
PELPGRET

SEQ ID NO: 538497 - protein, 7 aa, Mycobacterium
PELPHSG

SEQ ID NO: 538498 - protein, 5 aa, Mycobacterium
PELPP

SEQ ID NO: 538499 - protein, 6 aa, Mycobacterium
PELPPE

SEQ ID NO: 538500 - protein, 16 aa, Mycobacterium
PELPPGRPVSSAPFGS

SEQ ID NO: 538501 - protein, 11 aa, Mycobacterium
PELPPHGYDDK

SEQ ID NO: 538502 - protein, 7 aa, Mycobacterium
PELPTPW

SEQ ID NO: 538503 - protein, 9 aa, Mycobacterium
PELPTSDTE

SEQ ID NO: 538504 - protein, 4 aa, Mycobacterium
PELR

SEQ ID NO: 538505 - protein, 5 aa, Mycobacterium
PELRE

SEQ ID NO: 538506 - protein, 9 aa, Mycobacterium
PELRGARPE

SEQ ID NO: 538507 - protein, 5 aa, Mycobacterium
PELRQ

SEQ ID NO: 538508 - protein, 11 aa, Mycobacterium
PELRSGRSARE

SEQ ID NO: 538509 - protein, 13 aa, Mycobacterium
PELRTPDSPTQLV

SEQ ID NO: 538510 - protein, 5 aa, Mycobacterium
PELSA

SEQ ID NO: 538511 - protein, 6 aa, Mycobacterium
PELSGK

SEQ ID NO: 538512 - protein, 14 aa, Mycobacterium
PELSGWPRSPGWTG

SEQ ID NO: 538513 - protein, 4 aa, Mycobacterium
PELT

SEQ ID NO: 538514 - protein, 5 aa, Mycobacterium
PELTA

SEQ ID NO: 538515 - protein, 6 aa, Mycobacterium
PELTAP

SEQ ID NO: 538516 - protein, 6 aa, Mycobacterium
PELTEN

SEQ ID NO: 538517 - protein, 7 aa, Mycobacterium
PELTGDH

SEQ ID NO: 538518 - protein, 5 aa, Mycobacterium
PELTP

SEQ ID NO: 538519 - protein, 5 aa, Mycobacterium
PEMAR

SEQ ID NO: 538520 - protein, 7 aa, Mycobacterium
PEMDSQR

SEQ ID NO: 538521 - protein, 8 aa, Mycobacterium
PEMKSTGE

SEQ ID NO: 538522 - protein, 5 aa, Mycobacterium
PEMQQ

SEQ ID NO: 538523 - protein, 4 aa, Mycobacterium
PEMS

SEQ ID NO: 538524 - protein, 6 aa, Mycobacterium
PEMSGQ

SEQ ID NO: 538525 - protein, 19 aa, Mycobacterium
PENADARGPGRDEEHQARL

SEQ ID NO: 538526 - protein, 8 aa, Mycobacterium
PENAEDWE

SEQ ID NO: 538527 - protein, 6 aa, Mycobacterium
PENAGV

SEQ ID NO: 538528 - protein, 7 aa, Mycobacterium
PENAQEA

SEQ ID NO: 538529 - protein, 8 aa, Mycobacterium
PENDFPPK

SEQ ID NO: 538530 - protein, 6 aa, Mycobacterium
PENDQL

SEQ ID NO: 538531 - protein, 11 aa, Mycobacterium
PENEADDPKSR

SEQ ID NO: 538532 - protein, 8 aa, Mycobacterium
PENEFASE

SEQ ID NO: 538533 - protein, 6 aa, Mycobacterium
PENGPL

SEQ ID NO: 538534 - protein, 13 aa, Mycobacterium
PENGRTGYEPGVA

SEQ ID NO: 538535 - protein, 13 aa, Mycobacterium
PENGRYDDVSPST

SEQ ID NO: 538536 - protein, 7 aa, Mycobacterium
PENHSGL

SEQ ID NO: 538537 - protein, 4 aa, Mycobacterium
PENI

SEQ ID NO: 538538 - protein, 5 aa, Mycobacterium
PENKA

SEQ ID NO: 538539 - protein, 11 aa, Mycobacterium
PENKGESIPAD

SEQ ID NO: 538540 - protein, 10 aa, Mycobacterium
PENKGEVIPP

SEQ ID NO: 538541 - protein, 11 aa, Mycobacterium
PENNGTISSSL

SEQ ID NO: 538542 - protein, 9 aa, Mycobacterium
PENNPHSAD

SEQ ID NO: 538543 - protein, 4 aa, Mycobacterium
PENP

SEQ ID NO: 538544 - protein, 13 aa, Mycobacterium
PENPAASPAAAAR

SEQ ID NO: 538545 - protein, 9 aa, Mycobacterium
PENPADTFG

SEQ ID NO: 538546 - protein, 7 aa, Mycobacterium
PENPCPA

SEQ ID NO: 538547 - protein, 5 aa, Mycobacterium
PENPE

SEQ ID NO: 538548 - protein, 9 aa, Mycobacterium
PENPRTTEG

SEQ ID NO: 538549 - protein, 5 aa, Mycobacterium
PENPS

SEQ ID NO: 538550 - protein, 7 aa, Mycobacterium
PENPSNV

SEQ ID NO: 538551 - protein, 5 aa, Mycobacterium
PENPV

SEQ ID NO: 538552 - protein, 8 aa, Mycobacterium
PENPWPAA

SEQ ID NO: 538553 - protein, 4 aa, Mycobacterium
PENR

SEQ ID NO: 538554 - protein, 16 aa, Mycobacterium
PENSPHNSIDTSEANR

SEQ ID NO: 538555 - protein, 7 aa, Mycobacterium
PENSPHP

SEQ ID NO: 538556 - protein, 4 aa, Mycobacterium
PENT

SEQ ID NO: 538557 - protein, 9 aa, Mycobacterium
PENTSGSDI

SEQ ID NO: 538558 - protein, 10 aa, Mycobacterium
PENTSGSDLR

SEQ ID NO: 538559 - protein, 13 aa, Mycobacterium
PENVEKVGADNFR

SEQ ID NO: 538560 - protein, 5 aa, Mycobacterium
PENVP

SEQ ID NO: 538561 - protein, 5 aa, Mycobacterium
PEPAA

SEQ ID NO: 538562 - protein, 26 aa, Mycobacterium
PEPAAESGEPAKKAKKSTAAKPRTGS

SEQ ID NO: 538563 - protein, 8 aa, Mycobacterium
PEPAAPAL

SEQ ID NO: 538564 - protein, 5 aa, Mycobacterium
PEPAE

SEQ ID NO: 538565 - protein, 5 aa, Mycobacterium
PEPAH

SEQ ID NO: 538566 - protein, 5 aa, Mycobacterium
PEPAK

SEQ ID NO: 538567 - protein, 5 aa, Mycobacterium
PEPAP

SEQ ID NO: 538568 - protein, 9 aa, Mycobacterium
PEPASGKAT

SEQ ID NO: 538569 - protein, 8 aa, Mycobacterium
PEPATAEA

SEQ ID NO: 538570 - protein, 11 aa, Mycobacterium
PEPAVRTGEHL

SEQ ID NO: 538571 - protein, 6 aa, Mycobacterium
PEPDAG

SEQ ID NO: 538572 - protein, 8 aa, Mycobacterium
PEPDDEEA

SEQ ID NO: 538573 - protein, 7 aa, Mycobacterium
PEPDDIE

SEQ ID NO: 538574 - protein, 6 aa, Mycobacterium
PEPDGF

SEQ ID NO: 538575 - protein, 6 aa, Mycobacterium
PEPDGL

SEQ ID NO: 538576 - protein, 17 aa, Mycobacterium
PEPDHAKARIGIRWHTG

SEQ ID NO: 538577 - protein, 9 aa, Mycobacterium
PEPDNPDQL

SEQ ID NO: 538578 - protein, 6 aa, Mycobacterium
PEPDRL

SEQ ID NO: 538579 - protein, 16 aa, Mycobacterium
PEPDTDEFRGRSEYPD

SEQ ID NO: 538580 - protein, 9 aa, Mycobacterium
PEPDTPPSW

SEQ ID NO: 538581 - protein, 7 aa, Mycobacterium
PEPDVTA

SEQ ID NO: 538582 - protein, 4 aa, Mycobacterium
PEPE

SEQ ID NO: 538583 - protein, 31 aa, Mycobacterium
PEPEDGGDDGTAGTPAKKGKKPTGPKPRTGS

SEQ ID NO: 538584 - protein, 8 aa, Mycobacterium
PEPEDYGD

SEQ ID NO: 538585 - protein, 9 aa, Mycobacterium
PEPEPGKAT

SEQ ID NO: 538586 - protein, 5 aa, Mycobacterium
PEPEQ

SEQ ID NO: 538587 - protein, 6 aa, Mycobacterium
PEPEQS

SEQ ID NO: 538588 - protein, 9 aa, Mycobacterium
PEPESGKST

SEQ ID NO: 538589 - protein, 6 aa, Mycobacterium
PEPESL

SEQ ID NO: 538590 - protein, 9 aa, Mycobacterium
PEPETGKST

SEQ ID NO: 538591 - protein, 7 aa, Mycobacterium
PEPETLQ

SEQ ID NO: 538592 - protein, 5 aa, Mycobacterium
PEPEW

SEQ ID NO: 538593 - protein, 7 aa, Mycobacterium
PEPGAAD

SEQ ID NO: 538594 - protein, 14 aa, Mycobacterium
PEPGADDQRRAGDR

SEQ ID NO: 538595 - protein, 8 aa, Mycobacterium
PEPGADPV

SEQ ID NO: 538596 - protein, 7 aa, Mycobacterium
PEPGAVD

SEQ ID NO: 538597 - protein, 8 aa, Mycobacterium
PEPGDNPL

SEQ ID NO: 538598 - protein, 8 aa, Mycobacterium
PEPGEPKR

SEQ ID NO: 538599 - protein, 10 aa, Mycobacterium
PEPGETAGFS

SEQ ID NO: 538600 - protein, 7 aa, Mycobacterium
PEPGGEV

SEQ ID NO: 538601 - protein, 6 aa, Mycobacterium
PEPGGL

SEQ ID NO: 538602 - protein, 7 aa, Mycobacterium
PEPGGTR

SEQ ID NO: 538603 - protein, 5 aa, Mycobacterium
PEPGP

SEQ ID NO: 538604 - protein, 26 aa, Mycobacterium
PEPGPEYAQQTRNAAAACPAMAIHIE

SEQ ID NO: 538605 - protein, 7 aa, Mycobacterium
PEPGPGE

SEQ ID NO: 538606 - protein, 6 aa, Mycobacterium
PEPGQP

SEQ ID NO: 538607 - protein, 5 aa, Mycobacterium
PEPGR

SEQ ID NO: 538608 - protein, 7 aa, Mycobacterium
PEPGREQ

SEQ ID NO: 538609 - protein, 6 aa, Mycobacterium
PEPGSF

SEQ ID NO: 538610 - protein, 9 aa, Mycobacterium
PEPGSVQAG

SEQ ID NO: 538611 - protein, 6 aa, Mycobacterium
PEPGTA

SEQ ID NO: 538612 - protein, 6 aa, Mycobacterium
PEPGTT

SEQ ID NO: 538613 - protein, 5 aa, Mycobacterium
PEPGY

SEQ ID NO: 538614 - protein, 14 aa, Mycobacterium
PEPHGAGNANSGFR

SEQ ID NO: 538615 - protein, 7 aa, Mycobacterium
PEPHRKR

SEQ ID NO: 538616 - protein, 5 aa, Mycobacterium
PEPID

SEQ ID NO: 538617 - protein, 5 aa, Mycobacterium
PEPKP

SEQ ID NO: 538618 - protein, 9 aa, Mycobacterium
PEPKPDDPR

SEQ ID NO: 538619 - protein, 16 aa, Mycobacterium
PEPKSPQLAETATTRS

SEQ ID NO: 538620 - protein, 9 aa, Mycobacterium
PEPLEGQPL

SEQ ID NO: 538621 - protein, 10 aa, Mycobacterium
PEPLEGQPLD

SEQ ID NO: 538622 - protein, 5 aa, Mycobacterium
PEPLP

SEQ ID NO: 538623 - protein, 8 aa, Mycobacterium
PEPLPADG

SEQ ID NO: 538624 - protein, 8 aa, Mycobacterium
PEPLPDSD

SEQ ID NO: 538625 - protein, 10 aa, Mycobacterium
PEPLPPAPGS

SEQ ID NO: 538626 - protein, 10 aa, Mycobacterium
PEPLQGQPLD

SEQ ID NO: 538627 - protein, 5 aa, Mycobacterium
PEPLR

SEQ ID NO: 538628 - protein, 11 aa, Mycobacterium
PEPLRTDPKAF

SEQ ID NO: 538629 - protein, 7 aa, Mycobacterium
PEPMPAP

SEQ ID NO: 538630 - protein, 14 aa, Mycobacterium
PEPNLASRLDKGGL

SEQ ID NO: 538631 - protein, 6 aa, Mycobacterium
PEPNPG

SEQ ID NO: 538632 - protein, 6 aa, Mycobacterium
PEPNTI

SEQ ID NO: 538633 - protein, 29 aa, Mycobacterium
PEPPAPEAGTEAPAKKTKKATGPKPRSGS

SEQ ID NO: 538634 - protein, 11 aa, Mycobacterium
PEPPAPLQNTP

SEQ ID NO: 538635 - protein, 5 aa, Mycobacterium
PEPPD

SEQ ID NO: 538636 - protein, 28 aa, Mycobacterium
PEPPDDGEAGATAKKGKKPTGPKPRTGS

SEQ ID NO: 538637 - protein, 15 aa, Mycobacterium
PEPPDDIAPIGPGHP

SEQ ID NO: 538638 - protein, 15 aa, Mycobacterium
PEPPDDVAPIGPGHP

SEQ ID NO: 538639 - protein, 13 aa, Mycobacterium
PEPPDDVTPIGPS

SEQ ID NO: 538640 - protein, 10 aa, Mycobacterium
PEPPEADRER

SEQ ID NO: 538641 - protein, 7 aa, Mycobacterium
PEPPFDA

SEQ ID NO: 538642 - protein, 13 aa, Mycobacterium
PEPPIEAPPGPAL

SEQ ID NO: 538643 - protein, 18 aa, Mycobacterium
PEPPLPADSSSQDCDPTA

SEQ ID NO: 538644 - protein, 7 aa, Mycobacterium
PEPPLSA

SEQ ID NO: 538645 - protein, 27 aa, Mycobacterium
PEPPPERRERRTERRDRPEKPRSTRPF

SEQ ID NO: 538646 - protein, 30 aa, Mycobacterium
PEPPPERRSETKKPASDQHAEKRRNGPALS

SEQ ID NO: 538647 - protein, 30 aa, Mycobacterium
PEPPPGDDDGGATPAKKGKKPTGPKPRTGS

SEQ ID NO: 538648 - protein, 14 aa, Mycobacterium
PEPPPGLEPIGPGH

SEQ ID NO: 538649 - protein, 27 aa, Mycobacterium
PEPPRERRERHDDHRERAEKPRQSRPF

SEQ ID NO: 538650 - protein, 5 aa, Mycobacterium
PEPPS

SEQ ID NO: 538651 - protein, 21 aa, Mycobacterium
PEPPYGQGAAAAAGGAQAMID

SEQ ID NO: 538652 - protein, 4 aa, Mycobacterium
PEPQ

SEQ ID NO: 538653 - protein, 6 aa, Mycobacterium
PEPQLP

SEQ ID NO: 538654 - protein, 13 aa, Mycobacterium
PEPQNGGTELRPI

SEQ ID NO: 538655 - protein, 9 aa, Mycobacterium
PEPQPYPAP

SEQ ID NO: 538656 - protein, 8 aa, Mycobacterium
PEPQPYSA

SEQ ID NO: 538657 - protein, 8 aa, Mycobacterium
PEPQRDPV

SEQ ID NO: 538658 - protein, 31 aa, Mycobacterium
PEPQTTPARRTRRTKKDENEEPEPPDPQATA

SEQ ID NO: 538659 - protein, 4 aa, Mycobacterium
PEPR

SEQ ID NO: 538660 - protein, 13 aa, Mycobacterium
PEPREADIDRSGL

SEQ ID NO: 538661 - protein, 5 aa, Mycobacterium
PEPRL

SEQ ID NO: 538662 - protein, 14 aa, Mycobacterium
PEPRLAAQARAAAD

SEQ ID NO: 538663 - protein, 12 aa, Mycobacterium
PEPRPAPDDTVG

SEQ ID NO: 538664 - protein, 10 aa, Mycobacterium
PEPRPPQEET

SEQ ID NO: 538665 - protein, 12 aa, Mycobacterium
PEPRPRETHGPA

SEQ ID NO: 538666 - protein, 23 aa, Mycobacterium
PEPRPRPADASEIPSATAESKAM

SEQ ID NO: 538667 - protein, 10 aa, Mycobacterium
PEPRRPKTER

SEQ ID NO: 538668 - protein, 6 aa, Mycobacterium
PEPSAL

SEQ ID NO: 538669 - protein, 12 aa, Mycobacterium
PEPSGFAPDTVA

SEQ ID NO: 538670 - protein, 8 aa, Mycobacterium
PEPSPAPF

SEQ ID NO: 538671 - protein, 8 aa, Mycobacterium
PEPSTGEL

SEQ ID NO: 538672 - protein, 9 aa, Mycobacterium
PEPSWSTST

SEQ ID NO: 538673 - protein, 5 aa, Mycobacterium
PEPTA

SEQ ID NO: 538674 - protein, 8 aa, Mycobacterium
PEPTASAA

SEQ ID NO: 538675 - protein, 9 aa, Mycobacterium
PEPTASSAF

SEQ ID NO: 538676 - protein, 6 aa, Mycobacterium
PEPTDY

SEQ ID NO: 538677 - protein, 8 aa, Mycobacterium
PEPTFDAP

SEQ ID NO: 538678 - protein, 11 aa, Mycobacterium
PEPTGIAATDD

SEQ ID NO: 538679 - protein, 8 aa, Mycobacterium
PEPTGIRQ

SEQ ID NO: 538680 - protein, 7 aa, Mycobacterium
PEPTGLD

SEQ ID NO: 538681 - protein, 9 aa, Mycobacterium
PEPTGLDEA

SEQ ID NO: 538682 - protein, 13 aa, Mycobacterium
PEPTGLDEQTLAD

SEQ ID NO: 538683 - protein, 8 aa, Mycobacterium
PEPTPLSR

SEQ ID NO: 538684 - protein, 14 aa, Mycobacterium
PEPTRRGGQRRYDD

SEQ ID NO: 538685 - protein, 5 aa, Mycobacterium
PEPTT

SEQ ID NO: 538686 - protein, 12 aa, Mycobacterium
PEPTTAATGAAR

SEQ ID NO: 538687 - protein, 10 aa, Mycobacterium
PEPTTPKPAI

SEQ ID NO: 538688 - protein, 7 aa, Mycobacterium
PEPTTTF

SEQ ID NO: 538689 - protein, 8 aa, Mycobacterium
PEPVDPDE

SEQ ID NO: 538690 - protein, 7 aa, Mycobacterium
PEPVPEA

SEQ ID NO: 538691 - protein, 8 aa, Mycobacterium
PEPVPGPG

SEQ ID NO: 538692 - protein, 6 aa, Mycobacterium
PEPVSE

SEQ ID NO: 538693 - protein, 5 aa, Mycobacterium
PEPVY

SEQ ID NO: 538694 - protein, 10 aa, Mycobacterium
PEPWTEKPAR

SEQ ID NO: 538695 - protein, 4 aa, Mycobacterium
PEPY

SEQ ID NO: 538696 - protein, 8 aa, Mycobacterium
PEPYAHDS

SEQ ID NO: 538697 - protein, 6 aa, Mycobacterium
PEPYAS

SEQ ID NO: 538698 - protein, 6 aa, Mycobacterium
PEPYSG

SEQ ID NO: 538699 - protein, 7 aa, Mycobacterium
PEPYSTR

SEQ ID NO: 538700 - protein, 4 aa, Mycobacterium
PEQA

SEQ ID NO: 538701 - protein, 7 aa, Mycobacterium
PEQAAAL

SEQ ID NO: 538702 - protein, 14 aa, Mycobacterium
PEQADDSDNTLTRG

SEQ ID NO: 538703 - protein, 5 aa, Mycobacterium
PEQAG

SEQ ID NO: 538704 - protein, 6 aa, Mycobacterium
PEQAGE

SEQ ID NO: 538705 - protein, 11 aa, Mycobacterium
PEQAKIAEDAG

SEQ ID NO: 538706 - protein, 11 aa, Mycobacterium
PEQAKIAEGAG

SEQ ID NO: 538707 - protein, 8 aa, Mycobacterium
PEQAQQSL

SEQ ID NO: 538708 - protein, 8 aa, Mycobacterium
PEQARAPG

SEQ ID NO: 538709 - protein, 11 aa, Mycobacterium
PEQARIAEGAG

SEQ ID NO: 538710 - protein, 7 aa, Mycobacterium
PEQATLD

SEQ ID NO: 538711 - protein, 7 aa, Mycobacterium
PEQATNA

SEQ ID NO: 538712 - protein, 5 aa, Mycobacterium
PEQAV

SEQ ID NO: 538713 - protein, 15 aa, Mycobacterium
PEQAYGPAGGGHRLS

SEQ ID NO: 538714 - protein, 10 aa, Mycobacterium
PEQAYYSKDH

SEQ ID NO: 538715 - protein, 17 aa, Mycobacterium
PEQCESAGMEGRMGSAS

SEQ ID NO: 538716 - protein, 20 aa, Mycobacterium
PEQDDNDRVRNRYRDGNVKA

SEQ ID NO: 538717 - protein, 6 aa, Mycobacterium
PEQDRG

SEQ ID NO: 538718 - protein, 8 aa, Mycobacterium
PEQDRTQF

SEQ ID NO: 538719 - protein, 6 aa, Mycobacterium
PEQFPD

SEQ ID NO: 538720 - protein, 6 aa, Mycobacterium
PEQGGW

SEQ ID NO: 538721 - protein, 8 aa, Mycobacterium
PEQGNPAA

SEQ ID NO: 538722 - protein, 13 aa, Mycobacterium
PEQGWARDTPAAG

SEQ ID NO: 538723 - protein, 8 aa, Mycobacterium
PEQHGGGG

SEQ ID NO: 538724 - protein, 13 aa, Mycobacterium
PEQHIPPDVDTSG

SEQ ID NO: 538725 - protein, 14 aa, Mycobacterium
PEQIADRDAGRPVQ

SEQ ID NO: 538726 - protein, 16 aa, Mycobacterium
PEQLRPTGLGAATQLD

SEQ ID NO: 538727 - protein, 7 aa, Mycobacterium
PEQLTGA

SEQ ID NO: 538728 - protein, 7 aa, Mycobacterium
PEQPPSL

SEQ ID NO: 538729 - protein, 21 aa, Mycobacterium
PEQPPTDSPRNEQSQQQQKAT

SEQ ID NO: 538730 - protein, 14 aa, Mycobacterium
PEQPQQADSGDKPT

SEQ ID NO: 538731 - protein, 36 aa, Mycobacterium
PEQPTTQIPPQTSSAPAQQDAGEPQPESGGDAPTRA

SEQ ID NO: 538732 - protein, 5 aa, Mycobacterium
PEQPW

SEQ ID NO: 538733 - protein, 10 aa, Mycobacterium
PEQQATTPAY

SEQ ID NO: 538734 - protein, 5 aa, Mycobacterium
PEQQR

SEQ ID NO: 538735 - protein, 8 aa, Mycobacterium
PEQQRAAD

SEQ ID NO: 538736 - protein, 5 aa, Mycobacterium
PEQRA

SEQ ID NO: 538737 - protein, 15 aa, Mycobacterium
PEQRAAVAGAARSAL

SEQ ID NO: 538738 - protein, 11 aa, Mycobacterium
PEQREAQPPVD

SEQ ID NO: 538739 - protein, 9 aa, Mycobacterium
PEQRGAGLG

SEQ ID NO: 538740 - protein, 5 aa, Mycobacterium
PEQRH

SEQ ID NO: 538741 - protein, 6 aa, Mycobacterium
PEQRNA

SEQ ID NO: 538742 - protein, 9 aa, Mycobacterium
PEQRNASGY

SEQ ID NO: 538743 - protein, 6 aa, Mycobacterium
PEQRRL

SEQ ID NO: 538744 - protein, 7 aa, Mycobacterium
PEQRTGR

SEQ ID NO: 538745 - protein, 4 aa, Mycobacterium
PEQS

SEQ ID NO: 538746 - protein, 7 aa, Mycobacterium
PEQSAQL

SEQ ID NO: 538747 - protein, 6 aa, Mycobacterium
PEQSRT

SEQ ID NO: 538748 - protein, 4 aa, Mycobacterium
PEQT

SEQ ID NO: 538749 - protein, 7 aa, Mycobacterium
PEQTDRF

SEQ ID NO: 538750 - protein, 8 aa, Mycobacterium
PEQTTSAI

SEQ ID NO: 538751 - protein, 11 aa, Mycobacterium
PEQTVAQQDEL

SEQ ID NO: 538752 - protein, 20 aa, Mycobacterium
PEQVAGTRRTGKTEGTVRTR

SEQ ID NO: 538753 - protein, 5 aa, Mycobacterium
PEQVD

SEQ ID NO: 538754 - protein, 7 aa, Mycobacterium
PEQWSTP

SEQ ID NO: 538755 - protein, 9 aa, Mycobacterium
PEQYGGVGT

SEQ ID NO: 538756 - protein, 6 aa, Mycobacterium
PERAAA

SEQ ID NO: 538757 - protein, 11 aa, Mycobacterium
PERAASGPFGT

SEQ ID NO: 538758 - protein, 12 aa, Mycobacterium
PERADDADNQLA

SEQ ID NO: 538759 - protein, 5 aa, Mycobacterium
PERAE

SEQ ID NO: 538760 - protein, 13 aa, Mycobacterium
PERAERLTDEYPS

SEQ ID NO: 538761 - protein, 6 aa, Mycobacterium
PERAGN

SEQ ID NO: 538762 - protein, 8 aa, Mycobacterium
PERAGTED

SEQ ID NO: 538763 - protein, 10 aa, Mycobacterium
PERAHTNQNY

SEQ ID NO: 538764 - protein, 8 aa, Mycobacterium
PERANVGN

SEQ ID NO: 538765 - protein, 23 aa, Mycobacterium
PERAQRRDRLASPAWGNNADDIA

SEQ ID NO: 538766 - protein, 6 aa, Mycobacterium
PERARE

SEQ ID NO: 538767 - protein, 6 aa, Mycobacterium
PERARQ

SEQ ID NO: 538768 - protein, 10 aa, Mycobacterium
PERASDGQIY

SEQ ID NO: 538769 - protein, 7 aa, Mycobacterium
PERATGP

SEQ ID NO: 538770 - protein, 11 aa, Mycobacterium
PERAVAPGTPE

SEQ ID NO: 538771 - protein, 8 aa, Mycobacterium
PERDDAAT

SEQ ID NO: 538772 - protein, 11 aa, Mycobacterium
PERDDDADNPL

SEQ ID NO: 538773 - protein, 11 aa, Mycobacterium
PERDDDDENPL

SEQ ID NO: 538774 - protein, 5 aa, Mycobacterium
PERDE

SEQ ID NO: 538775 - protein, 6 aa, Mycobacterium
PERDGA

SEQ ID NO: 538776 - protein, 12 aa, Mycobacterium
PERDGKRPGGIE

SEQ ID NO: 538777 - protein, 9 aa, Mycobacterium
PERDGPPDI

SEQ ID NO: 538778 - protein, 6 aa, Mycobacterium
PERDGT

SEQ ID NO: 538779 - protein, 5 aa, Mycobacterium
PERDP

SEQ ID NO: 538780 - protein, 10 aa, Mycobacterium
PERDPSTGRY

SEQ ID NO: 538781 - protein, 5 aa, Mycobacterium
PERDR

SEQ ID NO: 538782 - protein, 17 aa, Mycobacterium
PERDSTPPPEPPSEPQW

SEQ ID NO: 538783 - protein, 9 aa, Mycobacterium
PERDSYRAT

SEQ ID NO: 538784 - protein, 11 aa, Mycobacterium
PERERAAKRLG

SEQ ID NO: 538785 - protein, 12 aa, Mycobacterium
PERERAAKRLGP

SEQ ID NO: 538786 - protein, 13 aa, Mycobacterium
PERERPKGKDSIQ

SEQ ID NO: 538787 - protein, 18 aa, Mycobacterium
PERFDPSRFDEPRREDQH

SEQ ID NO: 538788 - protein, 11 aa, Mycobacterium
PERFGDTTVTP

SEQ ID NO: 538789 - protein, 14 aa, Mycobacterium
PERFRTTASDGRTP

SEQ ID NO: 538790 - protein, 5 aa, Mycobacterium
PERFT

SEQ ID NO: 538791 - protein, 4 aa, Mycobacterium
PERG

SEQ ID NO: 538792 - protein, 7 aa, Mycobacterium
PERGAAG

SEQ ID NO: 538793 - protein, 11 aa, Mycobacterium
PERGATAGELP

SEQ ID NO: 538794 - protein, 19 aa, Mycobacterium
PERGDWPTGIPEDERPSYS

SEQ ID NO: 538795 - protein, 5 aa, Mycobacterium
PERGE

SEQ ID NO: 538796 - protein, 15 aa, Mycobacterium
PERGTGGAPLFAPAG

SEQ ID NO: 538797 - protein, 4 aa, Mycobacterium
PERH

SEQ ID NO: 538798 - protein, 5 aa, Mycobacterium
PERIP

SEQ ID NO: 538799 - protein, 10 aa, Mycobacterium
PERKPPPAEV

SEQ ID NO: 538800 - protein, 11 aa, Mycobacterium
PERKPPPPDVT

SEQ ID NO: 538801 - protein, 13 aa, Mycobacterium
PERLEDGIERGAG

SEQ ID NO: 538802 - protein, 13 aa, Mycobacterium
PERLEDGIQRGAA

SEQ ID NO: 538803 - protein, 6 aa, Mycobacterium
PERNGS

SEQ ID NO: 538804 - protein, 6 aa, Mycobacterium
PERNYQ

SEQ ID NO: 538805 - protein, 9 aa, Mycobacterium
PERPDDADN

SEQ ID NO: 538806 - protein, 12 aa, Mycobacterium
PERPGLAETSNR

SEQ ID NO: 538807 - protein, 10 aa, Mycobacterium
PERPGNKRVD

SEQ ID NO: 538808 - protein, 10 aa, Mycobacterium
PERPLDDRRE

SEQ ID NO: 538809 - protein, 8 aa, Mycobacterium
PERPSAPD

SEQ ID NO: 538810 - protein, 6 aa, Mycobacterium
PERPSQ

SEQ ID NO: 538811 - protein, 6 aa, Mycobacterium
PERPTA

SEQ ID NO: 538812 - protein, 17 aa, Mycobacterium
PERPTKAKTLTLPGPDA

SEQ ID NO: 538813 - protein, 7 aa, Mycobacterium
PERPTRD

SEQ ID NO: 538814 - protein, 4 aa, Mycobacterium
PERQ

SEQ ID NO: 538815 - protein, 6 aa, Mycobacterium
PERQHR

SEQ ID NO: 538816 - protein, 6 aa, Mycobacterium
PERQRP

SEQ ID NO: 538817 - protein, 6 aa, Mycobacterium
PERQRQ

SEQ ID NO: 538818 - protein, 7 aa, Mycobacterium
PERQSAR

SEQ ID NO: 538819 - protein, 9 aa, Mycobacterium
PERQSSEEL

SEQ ID NO: 538820 - protein, 4 aa, Mycobacterium
PERR

SEQ ID NO: 538821 - protein, 5 aa, Mycobacterium
PERRA

SEQ ID NO: 538822 - protein, 22 aa, Mycobacterium
PERREALTSSGDGEVGTGTAYR

SEQ ID NO: 538823 - protein, 22 aa, Mycobacterium
PERREALTSSGGGEVGTGTAYR

SEQ ID NO: 538824 - protein, 5 aa, Mycobacterium
PERRG

SEQ ID NO: 538825 - protein, 6 aa, Mycobacterium
PERRQD

SEQ ID NO: 538826 - protein, 8 aa, Mycobacterium
PERRTKAK

SEQ ID NO: 538827 - protein, 14 aa, Mycobacterium
PERRTKAKALKLPG

SEQ ID NO: 538828 - protein, 11 aa, Mycobacterium
PERRVSDGQHQ

SEQ ID NO: 538829 - protein, 5 aa, Mycobacterium
PERSA

SEQ ID NO: 538830 - protein, 11 aa, Mycobacterium
PERSADEMAGR

SEQ ID NO: 538831 - protein, 8 aa, Mycobacterium
PERSEGDL

SEQ ID NO: 538832 - protein, 5 aa, Mycobacterium
PERSR

SEQ ID NO: 538833 - protein, 5 aa, Mycobacterium
PERTA

SEQ ID NO: 538834 - protein, 8 aa, Mycobacterium
PERTEAGP

SEQ ID NO: 538835 - protein, 9 aa, Mycobacterium
PERTSGSDI

SEQ ID NO: 538836 - protein, 5 aa, Mycobacterium
PERTV

SEQ ID NO: 538837 - protein, 10 aa, Mycobacterium
PERTVAEQDE

SEQ ID NO: 538838 - protein, 5 aa, Mycobacterium
PERVQ

SEQ ID NO: 538839 - protein, 9 aa, Mycobacterium
PERVRDTPL

SEQ ID NO: 538840 - protein, 4 aa, Mycobacterium
PERY

SEQ ID NO: 538841 - protein, 17 aa, Mycobacterium
PERYAATQQRRTPEPTL

SEQ ID NO: 538842 - protein, 17 aa, Mycobacterium
PERYAATQQRRTPEQTL

SEQ ID NO: 538843 - protein, 20 aa, Mycobacterium
PERYTEERRAQRRARGEQMR

SEQ ID NO: 538844 - protein, 5 aa, Mycobacterium
PESAA

SEQ ID NO: 538845 - protein, 7 aa, Mycobacterium
PESAEEP

SEQ ID NO: 538846 - protein, 6 aa, Mycobacterium
PESAGG

SEQ ID NO: 538847 - protein, 11 aa, Mycobacterium
PESAGGAGGNL

SEQ ID NO: 538848 - protein, 7 aa, Mycobacterium
PESAKRA

SEQ ID NO: 538849 - protein, 10 aa, Mycobacterium
PESAQEPPRR

SEQ ID NO: 538850 - protein, 10 aa, Mycobacterium
PESARQGEQV

SEQ ID NO: 538851 - protein, 6 aa, Mycobacterium
PESARR

SEQ ID NO: 538852 - protein, 11 aa, Mycobacterium
PESARTARDAM

SEQ ID NO: 538853 - protein, 10 aa, Mycobacterium
PESASATMPI

SEQ ID NO: 538854 - protein, 12 aa, Mycobacterium
PESASPSVLNKA

SEQ ID NO: 538855 - protein, 13 aa, Mycobacterium
PESDARIPQAGNH

SEQ ID NO: 538856 - protein, 8 aa, Mycobacterium
PESDHEEF

SEQ ID NO: 538857 - protein, 8 aa, Mycobacterium
PESDPHIP

SEQ ID NO: 538858 - protein, 8 aa, Mycobacterium
PESDRARI

SEQ ID NO: 538859 - protein, 7 aa, Mycobacterium
PESDRPR

SEQ ID NO: 538860 - protein, 7 aa, Mycobacterium
PESDRQQ

SEQ ID NO: 538861 - protein, 7 aa, Mycobacterium
PESDSRG

SEQ ID NO: 538862 - protein, 5 aa, Mycobacterium
PESDV

SEQ ID NO: 538863 - protein, 8 aa, Mycobacterium
PESEHPHG

SEQ ID NO: 538864 - protein, 11 aa, Mycobacterium
PESEHPHGLPD

SEQ ID NO: 538865 - protein, 10 aa, Mycobacterium
PESEHPHGLS

SEQ ID NO: 538866 - protein, 8 aa, Mycobacterium
PESEPAAW

SEQ ID NO: 538867 - protein, 8 aa, Mycobacterium
PESEPTAT

SEQ ID NO: 538868 - protein, 8 aa, Mycobacterium
PESERERM

SEQ ID NO: 538869 - protein, 4 aa, Mycobacterium
PESF

SEQ ID NO: 538870 - protein, 5 aa, Mycobacterium
PESGA

SEQ ID NO: 538871 - protein, 7 aa, Mycobacterium
PESGADM

SEQ ID NO: 538872 - protein, 9 aa, Mycobacterium
PESGAPDTV

SEQ ID NO: 538873 - protein, 8 aa, Mycobacterium
PESGAPRS

SEQ ID NO: 538874 - protein, 7 aa, Mycobacterium
PESGAPV

SEQ ID NO: 538875 - protein, 10 aa, Mycobacterium
PESGAPVPDY

SEQ ID NO: 538876 - protein, 6 aa, Mycobacterium
PESGAY

SEQ ID NO: 538877 - protein, 10 aa, Mycobacterium
PESGEFDPDA

SEQ ID NO: 538878 - protein, 6 aa, Mycobacterium
PESGGT

SEQ ID NO: 538879 - protein, 5 aa, Mycobacterium
PESGH

SEQ ID NO: 538880 - protein, 6 aa, Mycobacterium
PESGPL

SEQ ID NO: 538881 - protein, 14 aa, Mycobacterium
PESGPYRLSDGPSL

SEQ ID NO: 538882 - protein, 8 aa, Mycobacterium
PESGQPLQ

SEQ ID NO: 538883 - protein, 6 aa, Mycobacterium
PESGRA

SEQ ID NO: 538884 - protein, 10 aa, Mycobacterium
PESGSGTGAR

SEQ ID NO: 538885 - protein, 8 aa, Mycobacterium
PESGSPQS

SEQ ID NO: 538886 - protein, 11 aa, Mycobacterium
PESGTECPDGT

SEQ ID NO: 538887 - protein, 9 aa, Mycobacterium
PESGTLPEP

SEQ ID NO: 538888 - protein, 13 aa, Mycobacterium
PESGTPAAVGYAQ

SEQ ID NO: 538889 - protein, 18 aa, Mycobacterium
PESGTPAAVGYAQESGIP

SEQ ID NO: 538890 - protein, 19 aa, Mycobacterium
PESGTPAAVGYAQESGIPF

SEQ ID NO: 538891 - protein, 20 aa, Mycobacterium
PESGTPAAVGYAQGSGIPYG

SEQ ID NO: 538892 - protein, 5 aa, Mycobacterium
PESIT

SEQ ID NO: 538893 - protein, 11 aa, Mycobacterium
PESKPYAEFRT

SEQ ID NO: 538894 - protein, 4 aa, Mycobacterium
PESL

SEQ ID NO: 538895 - protein, 27 aa, Mycobacterium
PESLGTPPGGAADEMGKPGGPGVPGSA

SEQ ID NO: 538896 - protein, 7 aa, Mycobacterium
PESLNSV

SEQ ID NO: 538897 - protein, 6 aa, Mycobacterium
PESLPE

SEQ ID NO: 538898 - protein, 5 aa, Mycobacterium
PESLQ

SEQ ID NO: 538899 - protein, 6 aa, Mycobacterium
PESLST

SEQ ID NO: 538900 - protein, 39 aa, Mycobacterium
PESMPDPASDGAPRRTQTQSQTRESPQEQQLLQQQRRAK

SEQ ID NO: 538901 - protein, 8 aa, Mycobacterium
PESNVGYT

SEQ ID NO: 538902 - protein, 5 aa, Mycobacterium
PESPA

SEQ ID NO: 538903 - protein, 6 aa, Mycobacterium
PESPLT

SEQ ID NO: 538904 - protein, 7 aa, Mycobacterium
PESPRNV

SEQ ID NO: 538905 - protein, 13 aa, Mycobacterium
PESPVGKTDRAGI

SEQ ID NO: 538906 - protein, 10 aa, Mycobacterium
PESRAERCQD

SEQ ID NO: 538907 - protein, 7 aa, Mycobacterium
PESRERD

SEQ ID NO: 538908 - protein, 7 aa, Mycobacterium
PESREVT

SEQ ID NO: 538909 - protein, 8 aa, Mycobacterium
PESRGQVT

SEQ ID NO: 538910 - protein, 6 aa, Mycobacterium
PESRGR

SEQ ID NO: 538911 - protein, 10 aa, Mycobacterium
PESRPASSIA

SEQ ID NO: 538912 - protein, 6 aa, Mycobacterium
PESRSA

SEQ ID NO: 538913 - protein, 11 aa, Mycobacterium
PESRTALGEGR

SEQ ID NO: 538914 - protein, 8 aa, Mycobacterium
PESRTASI

SEQ ID NO: 538915 - protein, 12 aa, Mycobacterium
PESRYDDAAAFF

SEQ ID NO: 538916 - protein, 20 aa, Mycobacterium
PESSEAADASPTLTQPAIPS

SEQ ID NO: 538917 - protein, 10 aa, Mycobacterium
PESSGADLAA

SEQ ID NO: 538918 - protein, 21 aa, Mycobacterium
PESSGEITLTSPDPLAKPRID

SEQ ID NO: 538919 - protein, 7 aa, Mycobacterium
PESSSCS

SEQ ID NO: 538920 - protein, 10 aa, Mycobacterium
PESSTEAVGR

SEQ ID NO: 538921 - protein, 4 aa, Mycobacterium
PEST

SEQ ID NO: 538922 - protein, 14 aa, Mycobacterium
PESTAFKARIAVQP

SEQ ID NO: 538923 - protein, 19 aa, Mycobacterium
PESTDITANYTREDDGSLR

SEQ ID NO: 538924 - protein, 8 aa, Mycobacterium
PESTDPAP

SEQ ID NO: 538925 - protein, 7 aa, Mycobacterium
PESTQPL

SEQ ID NO: 538926 - protein, 5 aa, Mycobacterium
PESVD

SEQ ID NO: 538927 - protein, 9 aa, Mycobacterium
PESVEAGGN

SEQ ID NO: 538928 - protein, 7 aa, Mycobacterium
PESVEDP

SEQ ID NO: 538929 - protein, 7 aa, Mycobacterium
PESVEGA

SEQ ID NO: 538930 - protein, 13 aa, Mycobacterium
PESVGGGGGDGAD

SEQ ID NO: 538931 - protein, 7 aa, Mycobacterium
PESVGPE

SEQ ID NO: 538932 - protein, 8 aa, Mycobacterium
PESWQEDP

SEQ ID NO: 538933 - protein, 5 aa, Mycobacterium
PESYT

SEQ ID NO: 538934 - protein, 9 aa, Mycobacterium
PETAAPGAD

SEQ ID NO: 538935 - protein, 6 aa, Mycobacterium
PETAIA

SEQ ID NO: 538936 - protein, 18 aa, Mycobacterium
PETCGGKSTTPRSLGGTP

SEQ ID NO: 538937 - protein, 4 aa, Mycobacterium
PETD

SEQ ID NO: 538938 - protein, 11 aa, Mycobacterium
PETDADSTLGS

SEQ ID NO: 538939 - protein, 12 aa, Mycobacterium
PETEGLSVIGVA

SEQ ID NO: 538940 - protein, 12 aa, Mycobacterium
PETEGLSVVGVA

SEQ ID NO: 538941 - protein, 5 aa, Mycobacterium
PETEQ

SEQ ID NO: 538942 - protein, 6 aa, Mycobacterium
PETERQ

SEQ ID NO: 538943 - protein, 7 aa, Mycobacterium
PETETTT

SEQ ID NO: 538944 - protein, 10 aa, Mycobacterium
PETGAQPVTG

SEQ ID NO: 538945 - protein, 6 aa, Mycobacterium
PETGEK

SEQ ID NO: 538946 - protein, 10 aa, Mycobacterium
PETGEQCPPG

SEQ ID NO: 538947 - protein, 7 aa, Mycobacterium
PETGERT

SEQ ID NO: 538948 - protein, 10 aa, Mycobacterium
PETGETGPES

SEQ ID NO: 538949 - protein, 11 aa, Mycobacterium
PETGGARPGGV

SEQ ID NO: 538950 - protein, 11 aa, Mycobacterium
PETGHPVGPDR

SEQ ID NO: 538951 - protein, 14 aa, Mycobacterium
PETGLATSVPGPGW

SEQ ID NO: 538952 - protein, 15 aa, Mycobacterium
PETGLPTKASGTSWT

SEQ ID NO: 538953 - protein, 6 aa, Mycobacterium
PETGNK

SEQ ID NO: 538954 - protein, 24 aa, Mycobacterium
PETGPETGPETSPETSPETSEEFG

SEQ ID NO: 538955 - protein, 8 aa, Mycobacterium
PETGPPQS

SEQ ID NO: 538956 - protein, 5 aa, Mycobacterium
PETGQ

SEQ ID NO: 538957 - protein, 8 aa, Mycobacterium
PETGQQCP

SEQ ID NO: 538958 - protein, 4 aa, Mycobacterium
PETH

SEQ ID NO: 538959 - protein, 5 aa, Mycobacterium
PETHT

SEQ ID NO: 538960 - protein, 35 aa, Mycobacterium
PETIEARTDPWDPASAPSRLEAETARDAEKASQYL

SEQ ID NO: 538961 - protein, 31 aa, Mycobacterium
PETIEARTNPWDPDSAPTRAETEAARHAEEA

SEQ ID NO: 538962 - protein, 10 aa, Mycobacterium
PETITPGTAL

SEQ ID NO: 538963 - protein, 7 aa, Mycobacterium
PETLEKG

SEQ ID NO: 538964 - protein, 8 aa, Mycobacterium
PETLGGEP

SEQ ID NO: 538965 - protein, 11 aa, Mycobacterium
PETMGNTDGVP

SEQ ID NO: 538966 - protein, 5 aa, Mycobacterium
PETNE

SEQ ID NO: 538967 - protein, 9 aa, Mycobacterium
PETPATTPD

SEQ ID NO: 538968 - protein, 5 aa, Mycobacterium
PETPD

SEQ ID NO: 538969 - protein, 24 aa, Mycobacterium
PETPDGDANEPGPSGDDIDSLSPD

SEQ ID NO: 538970 - protein, 7 aa, Mycobacterium
PETPGHA

SEQ ID NO: 538971 - protein, 7 aa, Mycobacterium
PETPGHR

SEQ ID NO: 538972 - protein, 5 aa, Mycobacterium
PETPK

SEQ ID NO: 538973 - protein, 5 aa, Mycobacterium
PETPN

SEQ ID NO: 538974 - protein, 11 aa, Mycobacterium
PETPPVTPRGA

SEQ ID NO: 538975 - protein, 7 aa, Mycobacterium
PETPQSA

SEQ ID NO: 538976 - protein, 5 aa, Mycobacterium
PETPS

SEQ ID NO: 538977 - protein, 11 aa, Mycobacterium
PETPTAPPVAR

SEQ ID NO: 538978 - protein, 13 aa, Mycobacterium
PETPTAPPVNARP

SEQ ID NO: 538979 - protein, 6 aa, Mycobacterium
PETPYS

SEQ ID NO: 538980 - protein, 6 aa, Mycobacterium
PETQGV

SEQ ID NO: 538981 - protein, 7 aa, Mycobacterium
PETRAKA

SEQ ID NO: 538982 - protein, 5 aa, Mycobacterium
PETRT

SEQ ID NO: 538983 - protein, 11 aa, Mycobacterium
PETRTRQTAER

SEQ ID NO: 538984 - protein, 7 aa, Mycobacterium
PETSPGD

SEQ ID NO: 538985 - protein, 10 aa, Mycobacterium
PETSTLPYTS

SEQ ID NO: 538986 - protein, 6 aa, Mycobacterium
PETTAQ

SEQ ID NO: 538987 - protein, 5 aa, Mycobacterium
PETTP

SEQ ID NO: 538988 - protein, 6 aa, Mycobacterium
PETTPE

SEQ ID NO: 538989 - protein, 5 aa, Mycobacterium
PETTR

SEQ ID NO: 538990 - protein, 4 aa, Mycobacterium
PETY

SEQ ID NO: 538991 - protein, 15 aa, Mycobacterium
PEVAAPADANPSPMP

SEQ ID NO: 538992 - protein, 6 aa, Mycobacterium
PEVAER

SEQ ID NO: 538993 - protein, 5 aa, Mycobacterium
PEVAG

SEQ ID NO: 538994 - protein, 5 aa, Mycobacterium
PEVAR

SEQ ID NO: 538995 - protein, 9 aa, Mycobacterium
PEVDADDIR

SEQ ID NO: 538996 - protein, 11 aa, Mycobacterium
PEVDDQREAFE

SEQ ID NO: 538997 - protein, 11 aa, Mycobacterium
PEVDEQREALQ

SEQ ID NO: 538998 - protein, 7 aa, Mycobacterium
PEVDTDD

SEQ ID NO: 538999 - protein, 13 aa, Mycobacterium
PEVETGEISPQTC

SEQ ID NO: 539000 - protein, 9 aa, Mycobacterium
PEVGDDGRE

SEQ ID NO: 539001 - protein, 8 aa, Mycobacterium
PEVGGGIP

SEQ ID NO: 539002 - protein, 5 aa, Mycobacterium
PEVGS

SEQ ID NO: 539003 - protein, 6 aa, Mycobacterium
PEVGTA

SEQ ID NO: 539004 - protein, 4 aa, Mycobacterium
PEVP

SEQ ID NO: 539005 - protein, 29 aa, Mycobacterium
PEVPDEPSGSGASGSTSAPPGRGDKPVTH

SEQ ID NO: 539006 - protein, 5 aa, Mycobacterium
PEVPG

SEQ ID NO: 539007 - protein, 5 aa, Mycobacterium
PEVPK

SEQ ID NO: 539008 - protein, 10 aa, Mycobacterium
PEVPPQPGKG

SEQ ID NO: 539009 - protein, 11 aa, Mycobacterium
PEVPPQPGKGE

SEQ ID NO: 539010 - protein, 5 aa, Mycobacterium
PEVPT

SEQ ID NO: 539011 - protein, 6 aa, Mycobacterium
PEVPTV

SEQ ID NO: 539012 - protein, 8 aa, Mycobacterium
PEVPVDPD

SEQ ID NO: 539013 - protein, 4 aa, Mycobacterium
PEVR

SEQ ID NO: 539014 - protein, 5 aa, Mycobacterium
PEVRD

SEQ ID NO: 539015 - protein, 18 aa, Mycobacterium
PEVSAYRRSPRAPAPGAS

SEQ ID NO: 539016 - protein, 18 aa, Mycobacterium
PEVSAYRRSPRAPVPGAS

SEQ ID NO: 539017 - protein, 11 aa, Mycobacterium
PEVSSQSGTEL

SEQ ID NO: 539018 - protein, 16 aa, Mycobacterium
PEVTGADGKRRQKRER

SEQ ID NO: 539019 - protein, 8 aa, Mycobacterium
PEVTNPRE

SEQ ID NO: 539020 - protein, 7 aa, Mycobacterium
PEVTPDD

SEQ ID NO: 539021 - protein, 15 aa, Mycobacterium
PEVTSPASRDGEPVQ

SEQ ID NO: 539022 - protein, 10 aa, Mycobacterium
PEWDDPTGVP

SEQ ID NO: 539023 - protein, 16 aa, Mycobacterium
PEWDRPGDSVTNDHEF

SEQ ID NO: 539024 - protein, 5 aa, Mycobacterium
PEWKR

SEQ ID NO: 539025 - protein, 5 aa, Mycobacterium
PEWQE

SEQ ID NO: 539026 - protein, 4 aa, Mycobacterium
PEWS

SEQ ID NO: 539027 - protein, 5 aa, Mycobacterium
PEWSE

SEQ ID NO: 539028 - protein, 9 aa, Mycobacterium
PEYAETPDD

SEQ ID NO: 539029 - protein, 5 aa, Mycobacterium
PEYAG

SEQ ID NO: 539030 - protein, 11 aa, Mycobacterium
PEYAQSQGNPT

SEQ ID NO: 539031 - protein, 4 aa, Mycobacterium
PEYG

SEQ ID NO: 539032 - protein, 12 aa, Mycobacterium
PEYGPASPGPGF

SEQ ID NO: 539033 - protein, 6 aa, Mycobacterium
PEYKGK

SEQ ID NO: 539034 - protein, 5 aa, Mycobacterium
PEYKR

SEQ ID NO: 539035 - protein, 18 aa, Mycobacterium
PEYNDGKSSTPTALGGTP

SEQ ID NO: 539036 - protein, 4 aa, Mycobacterium
PEYP

SEQ ID NO: 539037 - protein, 7 aa, Mycobacterium
PEYPLGQ

SEQ ID NO: 539038 - protein, 6 aa, Mycobacterium
PEYPPD

SEQ ID NO: 539039 - protein, 10 aa, Mycobacterium
PEYPPPAQFD

SEQ ID NO: 539040 - protein, 22 aa, Mycobacterium
PEYQREDNKINTDATQRPSDLE

SEQ ID NO: 539041 - protein, 5 aa, Mycobacterium
PEYRG

SEQ ID NO: 539042 - protein, 11 aa, Mycobacterium
PEYSAPECTDP

SEQ ID NO: 539043 - protein, 8 aa, Mycobacterium
PEYSDDGW

SEQ ID NO: 539044 - protein, 5 aa, Mycobacterium
PEYVR

SEQ ID NO: 539045 - protein, 6 aa, Mycobacterium
PFAAPT

SEQ ID NO: 539046 - protein, 12 aa, Mycobacterium
PFAASAPRIREP

SEQ ID NO: 539047 - protein, 13 aa, Mycobacterium
PFAGGAAHATDDA

SEQ ID NO: 539048 - protein, 6 aa, Mycobacterium
PFAGPE

SEQ ID NO: 539049 - protein, 5 aa, Mycobacterium
PFANG

SEQ ID NO: 539050 - protein, 4 aa, Mycobacterium
PFAP

SEQ ID NO: 539051 - protein, 11 aa, Mycobacterium
PFAPASDTPGL

SEQ ID NO: 539052 - protein, 13 aa, Mycobacterium
PFAPDDITASRPI

SEQ ID NO: 539053 - protein, 13 aa, Mycobacterium
PFAPEDITASRPI

SEQ ID NO: 539054 - protein, 6 aa, Mycobacterium
PFAPET

SEQ ID NO: 539055 - protein, 7 aa, Mycobacterium
PFAPPPG

SEQ ID NO: 539056 - protein, 7 aa, Mycobacterium
PFAPPPK

SEQ ID NO: 539057 - protein, 21 aa, Mycobacterium
PFAPPPKTSTPDASSKQAAAV

SEQ ID NO: 539058 - protein, 14 aa, Mycobacterium
PFAPPPPPPAPAPF

SEQ ID NO: 539059 - protein, 36 aa, Mycobacterium
PFAPPPQTTNPAGAPEQAASVGQATATAAGAQATRL

SEQ ID NO: 539060 - protein, 37 aa, Mycobacterium
PFAPPPRSTNPAGTAGQAAAVAQATGGSVATNTESAL

SEQ ID NO: 539061 - protein, 7 aa, Mycobacterium
PFAPSGR

SEQ ID NO: 539062 - protein, 5 aa, Mycobacterium
PFARG

SEQ ID NO: 539063 - protein, 12 aa, Mycobacterium
PFASGKTLSEGQ

SEQ ID NO: 539064 - protein, 5 aa, Mycobacterium
PFASP

SEQ ID NO: 539065 - protein, 12 aa, Mycobacterium
PFATAGKLSAGQ

SEQ ID NO: 539066 - protein, 12 aa, Mycobacterium
PFATAGKLSEKQ

SEQ ID NO: 539067 - protein, 13 aa, Mycobacterium
PFATAGKLTDEQL

SEQ ID NO: 539068 - protein, 4 aa, Mycobacterium
PFDA

SEQ ID NO: 539069 - protein, 10 aa, Mycobacterium
PFDAEHPGVD

SEQ ID NO: 539070 - protein, 7 aa, Mycobacterium
PFDGASA

SEQ ID NO: 539071 - protein, 4 aa, Mycobacterium
PFDP

SEQ ID NO: 539072 - protein, 8 aa, Mycobacterium
PFDPAAQG

SEQ ID NO: 539073 - protein, 14 aa, Mycobacterium
PFDPAASTVFGEVS

SEQ ID NO: 539074 - protein, 7 aa, Mycobacterium
PFDPRKR

SEQ ID NO: 539075 - protein, 16 aa, Mycobacterium
PFDPVGDRAKAMADEH

SEQ ID NO: 539076 - protein, 19 aa, Mycobacterium
PFDQRGDHRTVDRADQGAH

SEQ ID NO: 539077 - protein, 9 aa, Mycobacterium
PFDSGGWNQ

SEQ ID NO: 539078 - protein, 17 aa, Mycobacterium
PFDSPPSDTAPSGLATQ

SEQ ID NO: 539079 - protein, 5 aa, Mycobacterium
PFDTP

SEQ ID NO: 539080 - protein, 7 aa, Mycobacterium
PFEDYPA

SEQ ID NO: 539081 - protein, 5 aa, Mycobacterium
PFEGQ

SEQ ID NO: 539082 - protein, 10 aa, Mycobacterium
PFEKQTKEDI

SEQ ID NO: 539083 - protein, 9 aa, Mycobacterium
PFEKQTKEQ

SEQ ID NO: 539084 - protein, 11 aa, Mycobacterium
PFEPTERDGRL

SEQ ID NO: 539085 - protein, 11 aa, Mycobacterium
PFEPTERGGRL

SEQ ID NO: 539086 - protein, 11 aa, Mycobacterium
PFFGPDGARAF

SEQ ID NO: 539087 - protein, 7 aa, Mycobacterium
PFGATSA

SEQ ID NO: 539088 - protein, 4 aa, Mycobacterium
PFGD

SEQ ID NO: 539089 - protein, 12 aa, Mycobacterium
PFGDPVPSHGTE

SEQ ID NO: 539090 - protein, 9 aa, Mycobacterium
PFGDRSDAG

SEQ ID NO: 539091 - protein, 10 aa, Mycobacterium
PFGDTKDGKQ

SEQ ID NO: 539092 - protein, 5 aa, Mycobacterium
PFGES

SEQ ID NO: 539093 - protein, 18 aa, Mycobacterium
PFGGIKSSGLGRELGPEG

SEQ ID NO: 539094 - protein, 8 aa, Mycobacterium
PFGGNAPR

SEQ ID NO: 539095 - protein, 5 aa, Mycobacterium
PFGGP

SEQ ID NO: 539096 - protein, 17 aa, Mycobacterium
PFGGVGDSGIGREGGTF

SEQ ID NO: 539097 - protein, 12 aa, Mycobacterium
PFGGYKQSGIGR

SEQ ID NO: 539098 - protein, 13 aa, Mycobacterium
PFGGYKRSGNGRE

SEQ ID NO: 539099 - protein, 5 aa, Mycobacterium
PFGHS

SEQ ID NO: 539100 - protein, 10 aa, Mycobacterium
PFGNPNFTGR

SEQ ID NO: 539101 - protein, 7 aa, Mycobacterium
PFGPEES

SEQ ID NO: 539102 - protein, 7 aa, Mycobacterium
PFGPGAP

SEQ ID NO: 539103 - protein, 4 aa, Mycobacterium
PFGQ

SEQ ID NO: 539104 - protein, 5 aa, Mycobacterium
PFGRG

SEQ ID NO: 539105 - protein, 12 aa, Mycobacterium
PFGRGSSRWDPL

SEQ ID NO: 539106 - protein, 5 aa, Mycobacterium
PFGSA

SEQ ID NO: 539107 - protein, 7 aa, Mycobacterium
PFGSGDP

SEQ ID NO: 539108 - protein, 8 aa, Mycobacterium
PFGSGGRL

SEQ ID NO: 539109 - protein, 5 aa, Mycobacterium
PFGSY

SEQ ID NO: 539110 - protein, 4 aa, Mycobacterium
PFGT

SEQ ID NO: 539111 - protein, 14 aa, Mycobacterium
PFGTDGAVDDGGAE

SEQ ID NO: 539112 - protein, 6 aa, Mycobacterium
PFGTEI

SEQ ID NO: 539113 - protein, 10 aa, Mycobacterium
PFGTRRDERV

SEQ ID NO: 539114 - protein, 21 aa, Mycobacterium
PFHPEPDVQPVTDALTSKDPM

SEQ ID NO: 539115 - protein, 7 aa, Mycobacterium
PFKKAAS

SEQ ID NO: 539116 - protein, 10 aa, Mycobacterium
PFKPDGSLDI

SEQ ID NO: 539117 - protein, 6 aa, Mycobacterium
PFKTEA

SEQ ID NO: 539118 - protein, 9 aa, Mycobacterium
PFLPPPAPR

SEQ ID NO: 539119 - protein, 6 aa, Mycobacterium
PFNATA

SEQ ID NO: 539120 - protein, 7 aa, Mycobacterium
PFNPGGR

SEQ ID NO: 539121 - protein, 7 aa, Mycobacterium
PFNTPAA

SEQ ID NO: 539122 - protein, 4 aa, Mycobacterium
PFPA

SEQ ID NO: 539123 - protein, 5 aa, Mycobacterium
PFPDP

SEQ ID NO: 539124 - protein, 8 aa, Mycobacterium
PFPDPGTP

SEQ ID NO: 539125 - protein, 5 aa, Mycobacterium
PFPED

SEQ ID NO: 539126 - protein, 12 aa, Mycobacterium
PFPEPKPAELPG

SEQ ID NO: 539127 - protein, 10 aa, Mycobacterium
PFPGGPLGAR

SEQ ID NO: 539128 - protein, 6 aa, Mycobacterium
PFPGPG

SEQ ID NO: 539129 - protein, 34 aa, Mycobacterium
PFPGPQQHTNPAGLPAQGAAVSKAAASSEEGSQS

SEQ ID NO: 539130 - protein, 4 aa, Mycobacterium
PFPH

SEQ ID NO: 539131 - protein, 24 aa, Mycobacterium
PFPPAAATSPPPSVETPPPPPKLP

SEQ ID NO: 539132 - protein, 4 aa, Mycobacterium
PFPR

SEQ ID NO: 539133 - protein, 5 aa, Mycobacterium
PFPRG

SEQ ID NO: 539134 - protein, 10 aa, Mycobacterium
PFPSGVQTAE

SEQ ID NO: 539135 - protein, 5 aa, Mycobacterium
PFPSP

SEQ ID NO: 539136 - protein, 7 aa, Mycobacterium
PFPSPAQ

SEQ ID NO: 539137 - protein, 4 aa, Mycobacterium
PFPT

SEQ ID NO: 539138 - protein, 6 aa, Mycobacterium
PFPTDR

SEQ ID NO: 539139 - protein, 20 aa, Mycobacterium
PFPTGPRPDVTRADDHEYAQ

SEQ ID NO: 539140 - protein, 21 aa, Mycobacterium
PFPTGPRPDVTRADDHEYAQQ

SEQ ID NO: 539141 - protein, 4 aa, Mycobacterium
PFPY

SEQ ID NO: 539142 - protein, 6 aa, Mycobacterium
PFQGNQ

SEQ ID NO: 539143 - protein, 10 aa, Mycobacterium
PFQGSTAEEL

SEQ ID NO: 539144 - protein, 4 aa, Mycobacterium
PFQP

SEQ ID NO: 539145 - protein, 6 aa, Mycobacterium
PFQSAA

SEQ ID NO: 539146 - protein, 23 aa, Mycobacterium
PFQSGTGSIDANGKADLPTIRFE

SEQ ID NO: 539147 - protein, 10 aa, Mycobacterium
PFRAPEADEL

SEQ ID NO: 539148 - protein, 13 aa, Mycobacterium
PFRDGETDGAAAA

SEQ ID NO: 539149 - protein, 4 aa, Mycobacterium
PFRP

SEQ ID NO: 539150 - protein, 13 aa, Mycobacterium
PFRPDRRWGGDNT

SEQ ID NO: 539151 - protein, 11 aa, Mycobacterium
PFRPGRDVGED

SEQ ID NO: 539152 - protein, 13 aa, Mycobacterium
PFRPGRDVGEDEF

SEQ ID NO: 539153 - protein, 13 aa, Mycobacterium
PFRRNTPELSRRD

SEQ ID NO: 539154 - protein, 14 aa, Mycobacterium
PFRSPTALPVTFDA

SEQ ID NO: 539155 - protein, 5 aa, Mycobacterium
PFSAA

SEQ ID NO: 539156 - protein, 11 aa, Mycobacterium
PFSAGAADTAT

SEQ ID NO: 539157 - protein, 6 aa, Mycobacterium
PFSEDN

SEQ ID NO: 539158 - protein, 8 aa, Mycobacterium
PFSGPGTG

SEQ ID NO: 539159 - protein, 5 aa, Mycobacterium
PFSGT

SEQ ID NO: 539160 - protein, 5 aa, Mycobacterium
PFSNH

SEQ ID NO: 539161 - protein, 34 aa, Mycobacterium
PFSPPPNVTDPAGVASQSSAVAQAETLTATHSSL

SEQ ID NO: 539162 - protein, 9 aa, Mycobacterium
PFSQTTRES

SEQ ID NO: 539163 - protein, 5 aa, Mycobacterium
PFSRG

SEQ ID NO: 539164 - protein, 6 aa, Mycobacterium
PFSSGE

SEQ ID NO: 539165 - protein, 4 aa, Mycobacterium
PFST

SEQ ID NO: 539166 - protein, 4 aa, Mycobacterium
PFSV

SEQ ID NO: 539167 - protein, 4 aa, Mycobacterium
PFSY

SEQ ID NO: 539168 - protein, 4 aa, Mycobacterium
PFTA

SEQ ID NO: 539169 - protein, 10 aa, Mycobacterium
PFTAAGQTYD

SEQ ID NO: 539170 - protein, 6 aa, Mycobacterium
PFTAAT

SEQ ID NO: 539171 - protein, 12 aa, Mycobacterium
PFTAPTHDPSLD

SEQ ID NO: 539172 - protein, 5 aa, Mycobacterium
PFTAT

SEQ ID NO: 539173 - protein, 11 aa, Mycobacterium
PFTDPDPARKL

SEQ ID NO: 539174 - protein, 16 aa, Mycobacterium
PFTDTDPARKLKHRNA

SEQ ID NO: 539175 - protein, 10 aa, Mycobacterium
PFTEGYPQEA

SEQ ID NO: 539176 - protein, 35 aa, Mycobacterium
PFTEPPATTNPSAAAAQSAAVAPAAGTAAASDITT

SEQ ID NO: 539177 - protein, 7 aa, Mycobacterium
PFTGGGY

SEQ ID NO: 539178 - protein, 17 aa, Mycobacterium
PFTGTGTITNPATGAVA

SEQ ID NO: 539179 - protein, 4 aa, Mycobacterium
PFTP

SEQ ID NO: 539180 - protein, 13 aa, Mycobacterium
PFTPAAQSQWDDY

SEQ ID NO: 539181 - protein, 18 aa, Mycobacterium
PFTPEATQPHTGIDPDTV

SEQ ID NO: 539182 - protein, 21 aa, Mycobacterium
PFTPPGPATNPGGVAGQAAAV

SEQ ID NO: 539183 - protein, 16 aa, Mycobacterium
PFTPPPSDAGARADSW

SEQ ID NO: 539184 - protein, 7 aa, Mycobacterium
PFTPPPT

SEQ ID NO: 539185 - protein, 6 aa, Mycobacterium
PFTPQN

SEQ ID NO: 539186 - protein, 5 aa, Mycobacterium
PFTQG

SEQ ID NO: 539187 - protein, 16 aa, Mycobacterium
PFTSPPATTTGTEALS

SEQ ID NO: 539188 - protein, 10 aa, Mycobacterium
PFTSPPPITD

SEQ ID NO: 539189 - protein, 34 aa, Mycobacterium
PFTSPQQTTNPAGLGAQSAAVANSTANVAADSGN

SEQ ID NO: 539190 - protein, 12 aa, Mycobacterium
PFTTAGKLTDAQ

SEQ ID NO: 539191 - protein, 5 aa, Mycobacterium
PFTTT

SEQ ID NO: 539192 - protein, 17 aa, Mycobacterium
PFYEPPEGYEHARPGTV

SEQ ID NO: 539193 - protein, 4 aa, Mycobacterium
PFYQ

SEQ ID NO: 539194 - protein, 5 aa, Mycobacterium
PGAAA

SEQ ID NO: 539195 - protein, 8 aa, Mycobacterium
PGAADAEH

SEQ ID NO: 539196 - protein, 7 aa, Mycobacterium
PGAADPE

SEQ ID NO: 539197 - protein, 9 aa, Mycobacterium
PGAAEGRGL

SEQ ID NO: 539198 - protein, 10 aa, Mycobacterium
PGAAFPPATM

SEQ ID NO: 539199 - protein, 5 aa, Mycobacterium
PGAAG

SEQ ID NO: 539200 - protein, 8 aa, Mycobacterium
PGAAGGRG

SEQ ID NO: 539201 - protein, 9 aa, Mycobacterium
PGAAGQPHA

SEQ ID NO: 539202 - protein, 10 aa, Mycobacterium
PGAAITSDRA

SEQ ID NO: 539203 - protein, 5 aa, Mycobacterium
PGAAL

SEQ ID NO: 539204 - protein, 6 aa, Mycobacterium
PGAAPK

SEQ ID NO: 539205 - protein, 10 aa, Mycobacterium
PGAAPRTSTY

SEQ ID NO: 539206 - protein, 5 aa, Mycobacterium
PGAAQ

SEQ ID NO: 539207 - protein, 7 aa, Mycobacterium
PGAAQEI

SEQ ID NO: 539208 - protein, 9 aa, Mycobacterium
PGAAQGRGL

SEQ ID NO: 539209 - protein, 18 aa, Mycobacterium
PGAARDRRRAFRHRLRRS

SEQ ID NO: 539210 - protein, 10 aa, Mycobacterium
PGAAREPEEI

SEQ ID NO: 539211 - protein, 10 aa, Mycobacterium
PGAARQQRDV

SEQ ID NO: 539212 - protein, 6 aa, Mycobacterium
PGAARS

SEQ ID NO: 539213 - protein, 8 aa, Mycobacterium
PGAARSLG

SEQ ID NO: 539214 - protein, 9 aa, Mycobacterium
PGADAAAPE

SEQ ID NO: 539215 - protein, 9 aa, Mycobacterium
PGADADEPE

SEQ ID NO: 539216 - protein, 10 aa, Mycobacterium
PGADAEPAPK

SEQ ID NO: 539217 - protein, 8 aa, Mycobacterium
PGADDPAG

SEQ ID NO: 539218 - protein, 26 aa, Mycobacterium
PGADDVSPGTQPPDTQGGGPTTGRIQ

SEQ ID NO: 539219 - protein, 5 aa, Mycobacterium
PGADE

SEQ ID NO: 539220 - protein, 5 aa, Mycobacterium
PGADF

SEQ ID NO: 539221 - protein, 5 aa, Mycobacterium
PGADG

SEQ ID NO: 539222 - protein, 6 aa, Mycobacterium
PGADGD

SEQ ID NO: 539223 - protein, 7 aa, Mycobacterium
PGADGPA

SEQ ID NO: 539224 - protein, 7 aa, Mycobacterium
PGADGRA

SEQ ID NO: 539225 - protein, 9 aa, Mycobacterium
PGADGRVTG

SEQ ID NO: 539226 - protein, 5 aa, Mycobacterium
PGADI

SEQ ID NO: 539227 - protein, 10 aa, Mycobacterium
PGADKGTQKR

SEQ ID NO: 539228 - protein, 7 aa, Mycobacterium
PGADLDE

SEQ ID NO: 539229 - protein, 9 aa, Mycobacterium
PGADPDADP

SEQ ID NO: 539230 - protein, 10 aa, Mycobacterium
PGADPTGPAS

SEQ ID NO: 539231 - protein, 9 aa, Mycobacterium
PGADRGTQK

SEQ ID NO: 539232 - protein, 11 aa, Mycobacterium
PGADTPSDDEL

SEQ ID NO: 539233 - protein, 5 aa, Mycobacterium
PGADY

SEQ ID NO: 539234 - protein, 5 aa, Mycobacterium
PGAEA

SEQ ID NO: 539235 - protein, 8 aa, Mycobacterium
PGAECTEG

SEQ ID NO: 539236 - protein, 7 aa, Mycobacterium
PGAEGFS

SEQ ID NO: 539237 - protein, 8 aa, Mycobacterium
PGAEGFSE

SEQ ID NO: 539238 - protein, 7 aa, Mycobacterium
PGAEGMA

SEQ ID NO: 539239 - protein, 5 aa, Mycobacterium
PGAEL

SEQ ID NO: 539240 - protein, 11 aa, Mycobacterium
PGAELTGGQYG

SEQ ID NO: 539241 - protein, 5 aa, Mycobacterium
PGAEN

SEQ ID NO: 539242 - protein, 5 aa, Mycobacterium
PGAEP

SEQ ID NO: 539243 - protein, 9 aa, Mycobacterium
PGAEPGSAQ

SEQ ID NO: 539244 - protein, 6 aa, Mycobacterium
PGAEPL

SEQ ID NO: 539245 - protein, 8 aa, Mycobacterium
PGAEPMRT

SEQ ID NO: 539246 - protein, 10 aa, Mycobacterium
PGAEQEKNGI

SEQ ID NO: 539247 - protein, 7 aa, Mycobacterium
PGAESEL

SEQ ID NO: 539248 - protein, 8 aa, Mycobacterium
PGAESPRE

SEQ ID NO: 539249 - protein, 13 aa, Mycobacterium
PGAESSASEAEPE

SEQ ID NO: 539250 - protein, 5 aa, Mycobacterium
PGAET

SEQ ID NO: 539251 - protein, 5 aa, Mycobacterium
PGAGA

SEQ ID NO: 539252 - protein, 10 aa, Mycobacterium
PGAGATPDAL

SEQ ID NO: 539253 - protein, 8 aa, Mycobacterium
PGAGCTED

SEQ ID NO: 539254 - protein, 8 aa, Mycobacterium
PGAGEHGG

SEQ ID NO: 539255 - protein, 9 aa, Mycobacterium
PGAGEHGGS

SEQ ID NO: 539256 - protein, 10 aa, Mycobacterium
PGAGEPAPLR

SEQ ID NO: 539257 - protein, 5 aa, Mycobacterium
PGAGG

SEQ ID NO: 539258 - protein, 9 aa, Mycobacterium
PGAGGPGDF

SEQ ID NO: 539259 - protein, 8 aa, Mycobacterium
PGAGGRAG

SEQ ID NO: 539260 - protein, 12 aa, Mycobacterium
PGAGGSAPRTQP

SEQ ID NO: 539261 - protein, 11 aa, Mycobacterium
PGAGGTAPRTP

SEQ ID NO: 539262 - protein, 5 aa, Mycobacterium
PGAGH

SEQ ID NO: 539263 - protein, 8 aa, Mycobacterium
PGAGHDGG

SEQ ID NO: 539264 - protein, 11 aa, Mycobacterium
PGAGHEPGYPD

SEQ ID NO: 539265 - protein, 5 aa, Mycobacterium
PGAGK

SEQ ID NO: 539266 - protein, 12 aa, Mycobacterium
PGAGKPGHSPFP

SEQ ID NO: 539267 - protein, 11 aa, Mycobacterium
PGAGPGRGAGD

SEQ ID NO: 539268 - protein, 6 aa, Mycobacterium
PGAGPL

SEQ ID NO: 539269 - protein, 16 aa, Mycobacterium
PGAGPPPQFESADEYD

SEQ ID NO: 539270 - protein, 22 aa, Mycobacterium
PGAGPQRSDGSDSEEDDSSPRT

SEQ ID NO: 539271 - protein, 25 aa, Mycobacterium
PGAGRAAPPAIGRSGAAGAGAPPCA

SEQ ID NO: 539272 - protein, 7 aa, Mycobacterium
PGAGRAT

SEQ ID NO: 539273 - protein, 9 aa, Mycobacterium
PGAGSAPTY

SEQ ID NO: 539274 - protein, 7 aa, Mycobacterium
PGAGSGL

SEQ ID NO: 539275 - protein, 5 aa, Mycobacterium
PGAGT

SEQ ID NO: 539276 - protein, 7 aa, Mycobacterium
PGAGTAH

SEQ ID NO: 539277 - protein, 7 aa, Mycobacterium
PGAGTAK

SEQ ID NO: 539278 - protein, 6 aa, Mycobacterium
PGAGTC

SEQ ID NO: 539279 - protein, 9 aa, Mycobacterium
PGAGTEDAG

SEQ ID NO: 539280 - protein, 11 aa, Mycobacterium
PGAGTRSDPDL

SEQ ID NO: 539281 - protein, 14 aa, Mycobacterium
PGAGVDRPILNAPV

SEQ ID NO: 539282 - protein, 6 aa, Mycobacterium
PGAGVT

SEQ ID NO: 539283 - protein, 10 aa, Mycobacterium
PGAHGGTVTA

SEQ ID NO: 539284 - protein, 9 aa, Mycobacterium
PGAHITDED

SEQ ID NO: 539285 - protein, 9 aa, Mycobacterium
PGAHTASSA

SEQ ID NO: 539286 - protein, 4 aa, Mycobacterium
PGAI

SEQ ID NO: 539287 - protein, 7 aa, Mycobacterium
PGAIETP

SEQ ID NO: 539288 - protein, 14 aa, Mycobacterium
PGAISSQHGHTGDH

SEQ ID NO: 539289 - protein, 17 aa, Mycobacterium
PGAKAGASHAEHSGKDQ

SEQ ID NO: 539290 - protein, 9 aa, Mycobacterium
PGAKAPSLV

SEQ ID NO: 539291 - protein, 16 aa, Mycobacterium
PGAKKAADVPQDLDPS

SEQ ID NO: 539292 - protein, 11 aa, Mycobacterium
PGAKPNTDNVT

SEQ ID NO: 539293 - protein, 8 aa, Mycobacterium
PGAKTGPR

SEQ ID NO: 539294 - protein, 8 aa, Mycobacterium
PGAKTVTA

SEQ ID NO: 539295 - protein, 9 aa, Mycobacterium
PGALDPRHT

SEQ ID NO: 539296 - protein, 8 aa, Mycobacterium
PGALPEGT

SEQ ID NO: 539297 - protein, 7 aa, Mycobacterium
PGALPGA

SEQ ID NO: 539298 - protein, 15 aa, Mycobacterium
PGALPGVSEEKNGII

SEQ ID NO: 539299 - protein, 14 aa, Mycobacterium
PGALPTDSLADPDL

SEQ ID NO: 539300 - protein, 13 aa, Mycobacterium
PGALPTESLAAPD

SEQ ID NO: 539301 - protein, 44 aa, Mycobacterium
PGAMGGAATGVSAVSATEVSAVGASGGGGAASLGSAGMPATSFT

SEQ ID NO: 539302 - protein, 15 aa, Mycobacterium
PGAMPGVAEEKGGII

SEQ ID NO: 539303 - protein, 5 aa, Mycobacterium
PGAMT

SEQ ID NO: 539304 - protein, 11 aa, Mycobacterium
PGANGAVKAAT

SEQ ID NO: 539305 - protein, 11 aa, Mycobacterium
PGANGEPTAQD

SEQ ID NO: 539306 - protein, 7 aa, Mycobacterium
PGANGQL

SEQ ID NO: 539307 - protein, 7 aa, Mycobacterium
PGANGRF

SEQ ID NO: 539308 - protein, 7 aa, Mycobacterium
PGANGRL

SEQ ID NO: 539309 - protein, 7 aa, Mycobacterium
PGAPAAG

SEQ ID NO: 539310 - protein, 6 aa, Mycobacterium
PGAPAS

SEQ ID NO: 539311 - protein, 8 aa, Mycobacterium
PGAPDPES

SEQ ID NO: 539312 - protein, 10 aa, Mycobacterium
PGAPDTADSD

SEQ ID NO: 539313 - protein, 6 aa, Mycobacterium
PGAPEE

SEQ ID NO: 539314 - protein, 7 aa, Mycobacterium
PGAPEEL

SEQ ID NO: 539315 - protein, 21 aa, Mycobacterium
PGAPFGGYKNSGIGRECGPEG

SEQ ID NO: 539316 - protein, 7 aa, Mycobacterium
PGAPGAG

SEQ ID NO: 539317 - protein, 18 aa, Mycobacterium
PGAPGGPESWDDDGDPVR

SEQ ID NO: 539318 - protein, 11 aa, Mycobacterium
PGAPGQAGNTG

SEQ ID NO: 539319 - protein, 7 aa, Mycobacterium
PGAPGVS

SEQ ID NO: 539320 - protein, 6 aa, Mycobacterium
PGAPIS

SEQ ID NO: 539321 - protein, 5 aa, Mycobacterium
PGAPK

SEQ ID NO: 539322 - protein, 6 aa, Mycobacterium
PGAPKL

SEQ ID NO: 539323 - protein, 7 aa, Mycobacterium
PGAPNPE

SEQ ID NO: 539324 - protein, 8 aa, Mycobacterium
PGAPPALT

SEQ ID NO: 539325 - protein, 8 aa, Mycobacterium
PGAPPEIG

SEQ ID NO: 539326 - protein, 7 aa, Mycobacterium
PGAPPEL

SEQ ID NO: 539327 - protein, 7 aa, Mycobacterium
PGAPPSL

SEQ ID NO: 539328 - protein, 9 aa, Mycobacterium
PGAPPSLAG

SEQ ID NO: 539329 - protein, 10 aa, Mycobacterium
PGAPPSLAGL

SEQ ID NO: 539330 - protein, 10 aa, Mycobacterium
PGAPPSLAGM

SEQ ID NO: 539331 - protein, 14 aa, Mycobacterium
PGAPPSVTNLPPGC

SEQ ID NO: 539332 - protein, 19 aa, Mycobacterium
PGAPPTGAARALVDIAALV

SEQ ID NO: 539333 - protein, 15 aa, Mycobacterium
PGAPRIEPGGDEAPV

SEQ ID NO: 539334 - protein, 19 aa, Mycobacterium
PGAPRPDRAPALTATGRFF

SEQ ID NO: 539335 - protein, 5 aa, Mycobacterium
PGAPS

SEQ ID NO: 539336 - protein, 7 aa, Mycobacterium
PGAPTEA

SEQ ID NO: 539337 - protein, 6 aa, Mycobacterium
PGAPTP

SEQ ID NO: 539338 - protein, 10 aa, Mycobacterium
PGAPVPTGRK

SEQ ID NO: 539339 - protein, 10 aa, Mycobacterium
PGAPVPTGRR

SEQ ID NO: 539340 - protein, 11 aa, Mycobacterium
PGAPVPTGRTV

SEQ ID NO: 539341 - protein, 6 aa, Mycobacterium
PGAQDQ

SEQ ID NO: 539342 - protein, 24 aa, Mycobacterium
PGAQEAGITVTSRQNEVSTPSVTD

SEQ ID NO: 539343 - protein, 8 aa, Mycobacterium
PGAQGYSE

SEQ ID NO: 539344 - protein, 6 aa, Mycobacterium
PGAQLD

SEQ ID NO: 539345 - protein, 7 aa, Mycobacterium
PGAQLDE

SEQ ID NO: 539346 - protein, 8 aa, Mycobacterium
PGAQLGEA

SEQ ID NO: 539347 - protein, 7 aa, Mycobacterium
PGAQPEP

SEQ ID NO: 539348 - protein, 10 aa, Mycobacterium
PGAQPRPDLD

SEQ ID NO: 539349 - protein, 24 aa, Mycobacterium
PGAQPSAEDFGYTADGKPDPAAAK

SEQ ID NO: 539350 - protein, 5 aa, Mycobacterium
PGAQS

SEQ ID NO: 539351 - protein, 9 aa, Mycobacterium
PGAQSPRES

SEQ ID NO: 539352 - protein, 6 aa, Mycobacterium
PGAQTA

SEQ ID NO: 539353 - protein, 7 aa, Mycobacterium
PGAQVGP

SEQ ID NO: 539354 - protein, 10 aa, Mycobacterium
PGARERTAAR

SEQ ID NO: 539355 - protein, 9 aa, Mycobacterium
PGARGCTTE

SEQ ID NO: 539356 - protein, 10 aa, Mycobacterium
PGARGGADTV

SEQ ID NO: 539357 - protein, 7 aa, Mycobacterium
PGARHRP

SEQ ID NO: 539358 - protein, 10 aa, Mycobacterium
PGARPNSDNA

SEQ ID NO: 539359 - protein, 12 aa, Mycobacterium
PGARQGLTQRES

SEQ ID NO: 539360 - protein, 5 aa, Mycobacterium
PGARR

SEQ ID NO: 539361 - protein, 7 aa, Mycobacterium
PGARRQI

SEQ ID NO: 539362 - protein, 18 aa, Mycobacterium
PGARRQIPTEARAYAEQN

SEQ ID NO: 539363 - protein, 7 aa, Mycobacterium
PGARRQV

SEQ ID NO: 539364 - protein, 11 aa, Mycobacterium
PGARRTGAAPW

SEQ ID NO: 539365 - protein, 7 aa, Mycobacterium
PGARTTI

SEQ ID NO: 539366 - protein, 7 aa, Mycobacterium
PGARYVT

SEQ ID NO: 539367 - protein, 4 aa, Mycobacterium
PGAS

SEQ ID NO: 539368 - protein, 8 aa, Mycobacterium
PGASDTAR

SEQ ID NO: 539369 - protein, 5 aa, Mycobacterium
PGASG

SEQ ID NO: 539370 - protein, 11 aa, Mycobacterium
PGASGEPTAQD

SEQ ID NO: 539371 - protein, 12 aa, Mycobacterium
PGASGSKARPPQ

SEQ ID NO: 539372 - protein, 7 aa, Mycobacterium
PGASGTL

SEQ ID NO: 539373 - protein, 5 aa, Mycobacterium
PGASL

SEQ ID NO: 539374 - protein, 7 aa, Mycobacterium
PGASNSD

SEQ ID NO: 539375 - protein, 11 aa, Mycobacterium
PGASPNSDNEV

SEQ ID NO: 539376 - protein, 40 aa, Mycobacterium
PGASPQRSPRQRPRKRATPAPTVAASAPAPAHGATAAPRH

SEQ ID NO: 539377 - protein, 8 aa, Mycobacterium
PGASQAAQ

SEQ ID NO: 539378 - protein, 8 aa, Mycobacterium
PGASSDRG

SEQ ID NO: 539379 - protein, 6 aa, Mycobacterium
PGASSV

SEQ ID NO: 539380 - protein, 7 aa, Mycobacterium
PGASTDR

SEQ ID NO: 539381 - protein, 5 aa, Mycobacterium
PGATA

SEQ ID NO: 539382 - protein, 10 aa, Mycobacterium
PGATASPEEL

SEQ ID NO: 539383 - protein, 12 aa, Mycobacterium
PGATDGGGEAEL

SEQ ID NO: 539384 - protein, 7 aa, Mycobacterium
PGATERD

SEQ ID NO: 539385 - protein, 6 aa, Mycobacterium
PGATGA

SEQ ID NO: 539386 - protein, 8 aa, Mycobacterium
PGATGTQR

SEQ ID NO: 539387 - protein, 6 aa, Mycobacterium
PGATIG

SEQ ID NO: 539388 - protein, 8 aa, Mycobacterium
PGATITGA

SEQ ID NO: 539389 - protein, 11 aa, Mycobacterium
PGATPQFGQGT

SEQ ID NO: 539390 - protein, 6 aa, Mycobacterium
PGATTD

SEQ ID NO: 539391 - protein, 7 aa, Mycobacterium
PGATTQP

SEQ ID NO: 539392 - protein, 16 aa, Mycobacterium
PGATTTLGDDQGLADT

SEQ ID NO: 539393 - protein, 15 aa, Mycobacterium
PGAVDADRQDRGELD

SEQ ID NO: 539394 - protein, 7 aa, Mycobacterium
PGAVDPD

SEQ ID NO: 539395 - protein, 14 aa, Mycobacterium
PGAVDSDSGRAVEE

SEQ ID NO: 539396 - protein, 11 aa, Mycobacterium
PGAVNTPMGTG

SEQ ID NO: 539397 - protein, 14 aa, Mycobacterium
PGAVQGPDGLADDI

SEQ ID NO: 539398 - protein, 19 aa, Mycobacterium
PGAVSSGASSLGSGAAPGL

SEQ ID NO: 539399 - protein, 6 aa, Mycobacterium
PGAYDG

SEQ ID NO: 539400 - protein, 8 aa, Mycobacterium
PGCDRPAA

SEQ ID NO: 539401 - protein, 9 aa, Mycobacterium
PGCDRPATQ

SEQ ID NO: 539402 - protein, 13 aa, Mycobacterium
PGCPNAAAAKQTV

SEQ ID NO: 539403 - protein, 4 aa, Mycobacterium
PGCT

SEQ ID NO: 539404 - protein, 7 aa, Mycobacterium
PGCTWTN

SEQ ID NO: 539405 - protein, 7 aa, Mycobacterium
PGDAAAG

SEQ ID NO: 539406 - protein, 15 aa, Mycobacterium
PGDAAVSSAALPAGQ

SEQ ID NO: 539407 - protein, 5 aa, Mycobacterium
PGDAD

SEQ ID NO: 539408 - protein, 8 aa, Mycobacterium
PGDADKIA

SEQ ID NO: 539409 - protein, 20 aa, Mycobacterium
PGDADQKINVRPTGAPNWPT

SEQ ID NO: 539410 - protein, 10 aa, Mycobacterium
PGDADTAGHD

SEQ ID NO: 539411 - protein, 16 aa, Mycobacterium
PGDAERFKSSGSFSRE

SEQ ID NO: 539412 - protein, 15 aa, Mycobacterium
PGDAERSQSSGTFSR

SEQ ID NO: 539413 - protein, 9 aa, Mycobacterium
PGDAKDDEV

SEQ ID NO: 539414 - protein, 9 aa, Mycobacterium
PGDALPTEQ

SEQ ID NO: 539415 - protein, 7 aa, Mycobacterium
PGDAPEF

SEQ ID NO: 539416 - protein, 8 aa, Mycobacterium
PGDAPGLG

SEQ ID NO: 539417 - protein, 10 aa, Mycobacterium
PGDAPTSSSR

SEQ ID NO: 539418 - protein, 5 aa, Mycobacterium
PGDAQ

SEQ ID NO: 539419 - protein, 9 aa, Mycobacterium
PGDATDPDS

SEQ ID NO: 539420 - protein, 14 aa, Mycobacterium
PGDAVGTDPRPGPD

SEQ ID NO: 539421 - protein, 5 aa, Mycobacterium
PGDCG

SEQ ID NO: 539422 - protein, 10 aa, Mycobacterium
PGDDDAESAL

SEQ ID NO: 539423 - protein, 8 aa, Mycobacterium
PGDDDPAA

SEQ ID NO: 539424 - protein, 8 aa, Mycobacterium
PGDDFEPS

SEQ ID NO: 539425 - protein, 11 aa, Mycobacterium
PGDDGEPTAQD

SEQ ID NO: 539426 - protein, 7 aa, Mycobacterium
PGDDGTV

SEQ ID NO: 539427 - protein, 9 aa, Mycobacterium
PGDDPASEA

SEQ ID NO: 539428 - protein, 7 aa, Mycobacterium
PGDDPGA

SEQ ID NO: 539429 - protein, 11 aa, Mycobacterium
PGDDSDVPQGK

SEQ ID NO: 539430 - protein, 11 aa, Mycobacterium
PGDDSPVPEGK

SEQ ID NO: 539431 - protein, 17 aa, Mycobacterium
PGDDYRDPEGVDTRNYG

SEQ ID NO: 539432 - protein, 17 aa, Mycobacterium
PGDDYRDSEGTDTRNYG

SEQ ID NO: 539433 - protein, 8 aa, Mycobacterium
PGDELEQY

SEQ ID NO: 539434 - protein, 7 aa, Mycobacterium
PGDEPQF

SEQ ID NO: 539435 - protein, 11 aa, Mycobacterium
PGDEPQRDTTL

SEQ ID NO: 539436 - protein, 7 aa, Mycobacterium
PGDEPTF

SEQ ID NO: 539437 - protein, 17 aa, Mycobacterium
PGDEQEPVPEATGDQEP

SEQ ID NO: 539438 - protein, 5 aa, Mycobacterium
PGDEV

SEQ ID NO: 539439 - protein, 4 aa, Mycobacterium
PGDF

SEQ ID NO: 539440 - protein, 5 aa, Mycobacterium
PGDFP

SEQ ID NO: 539441 - protein, 5 aa, Mycobacterium
PGDFS

SEQ ID NO: 539442 - protein, 7 aa, Mycobacterium
PGDGAEA

SEQ ID NO: 539443 - protein, 8 aa, Mycobacterium
PGDGAEAM

SEQ ID NO: 539444 - protein, 6 aa, Mycobacterium
PGDGAL

SEQ ID NO: 539445 - protein, 5 aa, Mycobacterium
PGDGD

SEQ ID NO: 539446 - protein, 5 aa, Mycobacterium
PGDGE

SEQ ID NO: 539447 - protein, 8 aa, Mycobacterium
PGDGERAL

SEQ ID NO: 539448 - protein, 27 aa, Mycobacterium
PGDGGDGPAWSRKRQPYEPPPRERGRS

SEQ ID NO: 539449 - protein, 9 aa, Mycobacterium
PGDGGEPEV

SEQ ID NO: 539450 - protein, 8 aa, Mycobacterium
PGDGGPYV

SEQ ID NO: 539451 - protein, 9 aa, Mycobacterium
PGDGHAKAA

SEQ ID NO: 539452 - protein, 7 aa, Mycobacterium
PGDGHTL

SEQ ID NO: 539453 - protein, 5 aa, Mycobacterium
PGDGI

SEQ ID NO: 539454 - protein, 10 aa, Mycobacterium
PGDGPDKGTY

SEQ ID NO: 539455 - protein, 9 aa, Mycobacterium
PGDGPDRGT

SEQ ID NO: 539456 - protein, 16 aa, Mycobacterium
PGDGREALEHSAERGW

SEQ ID NO: 539457 - protein, 6 aa, Mycobacterium
PGDGRI

SEQ ID NO: 539458 - protein, 17 aa, Mycobacterium
PGDGSNVNAPGAPADPY

SEQ ID NO: 539459 - protein, 17 aa, Mycobacterium
PGDGSNVNAPGASEDPY

SEQ ID NO: 539460 - protein, 14 aa, Mycobacterium
PGDGSTGLASGMTP

SEQ ID NO: 539461 - protein, 5 aa, Mycobacterium
PGDGV

SEQ ID NO: 539462 - protein, 7 aa, Mycobacterium
PGDGVGQ

SEQ ID NO: 539463 - protein, 10 aa, Mycobacterium
PGDHADPTLQ

SEQ ID NO: 539464 - protein, 8 aa, Mycobacterium
PGDHAGNR

SEQ ID NO: 539465 - protein, 6 aa, Mycobacterium
PGDIPN

SEQ ID NO: 539466 - protein, 9 aa, Mycobacterium
PGDKEVGGV

SEQ ID NO: 539467 - protein, 7 aa, Mycobacterium
PGDKEVN

SEQ ID NO: 539468 - protein, 19 aa, Mycobacterium
PGDLAKAAEGDVDADSVRS

SEQ ID NO: 539469 - protein, 5 aa, Mycobacterium
PGDLE

SEQ ID NO: 539470 - protein, 13 aa, Mycobacterium
PGDLGTKGGVRTD

SEQ ID NO: 539471 - protein, 14 aa, Mycobacterium
PGDLGTKGGVRTDV

SEQ ID NO: 539472 - protein, 9 aa, Mycobacterium
PGDLNTPDE

SEQ ID NO: 539473 - protein, 10 aa, Mycobacterium
PGDLRSEGAQ

SEQ ID NO: 539474 - protein, 4 aa, Mycobacterium
PGDM

SEQ ID NO: 539475 - protein, 16 aa, Mycobacterium
PGDPAAEEELAAGEKA

SEQ ID NO: 539476 - protein, 10 aa, Mycobacterium
PGDPAREGAE

SEQ ID NO: 539477 - protein, 7 aa, Mycobacterium
PGDPAVP

SEQ ID NO: 539478 - protein, 8 aa, Mycobacterium
PGDPDLSI

SEQ ID NO: 539479 - protein, 10 aa, Mycobacterium
PGDPDPDTGI

SEQ ID NO: 539480 - protein, 9 aa, Mycobacterium
PGDPDPHTG

SEQ ID NO: 539481 - protein, 13 aa, Mycobacterium
PGDPDQDPGRGRR

SEQ ID NO: 539482 - protein, 9 aa, Mycobacterium
PGDPDTEAE

SEQ ID NO: 539483 - protein, 15 aa, Mycobacterium
PGDPEQDAPGDNLPF

SEQ ID NO: 539484 - protein, 6 aa, Mycobacterium
PGDPGD

SEQ ID NO: 539485 - protein, 7 aa, Mycobacterium
PGDPGLI

SEQ ID NO: 539486 - protein, 9 aa, Mycobacterium
PGDPGPIGG

SEQ ID NO: 539487 - protein, 15 aa, Mycobacterium
PGDPGPKVSDGAAVE

SEQ ID NO: 539488 - protein, 10 aa, Mycobacterium
PGDPGRDAAV

SEQ ID NO: 539489 - protein, 5 aa, Mycobacterium
PGDPI

SEQ ID NO: 539490 - protein, 22 aa, Mycobacterium
PGDPILGEEGGGPADSSAAAAD

SEQ ID NO: 539491 - protein, 12 aa, Mycobacterium
PGDPISGDPTWN

SEQ ID NO: 539492 - protein, 10 aa, Mycobacterium
PGDPPATRQA

SEQ ID NO: 539493 - protein, 8 aa, Mycobacterium
PGDPPGPA

SEQ ID NO: 539494 - protein, 10 aa, Mycobacterium
PGDPPPARAA

SEQ ID NO: 539495 - protein, 9 aa, Mycobacterium
PGDPQDPAT

SEQ ID NO: 539496 - protein, 7 aa, Mycobacterium
PGDPQEL

SEQ ID NO: 539497 - protein, 10 aa, Mycobacterium
PGDPQGAQIG

SEQ ID NO: 539498 - protein, 9 aa, Mycobacterium
PGDPSRDID

SEQ ID NO: 539499 - protein, 4 aa, Mycobacterium
PGDQ

SEQ ID NO: 539500 - protein, 6 aa, Mycobacterium
PGDQEV

SEQ ID NO: 539501 - protein, 19 aa, Mycobacterium
PGDQGGGWEPSEGDEIAND

SEQ ID NO: 539502 - protein, 6 aa, Mycobacterium
PGDQQM

SEQ ID NO: 539503 - protein, 8 aa, Mycobacterium
PGDQTAAA

SEQ ID NO: 539504 - protein, 5 aa, Mycobacterium
PGDQV

SEQ ID NO: 539505 - protein, 13 aa, Mycobacterium
PGDRADAVASVFA

SEQ ID NO: 539506 - protein, 11 aa, Mycobacterium
PGDRARHRADG

SEQ ID NO: 539507 - protein, 11 aa, Mycobacterium
PGDRASLERDG

SEQ ID NO: 539508 - protein, 9 aa, Mycobacterium
PGDRATDGA

SEQ ID NO: 539509 - protein, 9 aa, Mycobacterium
PGDRATLNS

SEQ ID NO: 539510 - protein, 6 aa, Mycobacterium
PGDRDG

SEQ ID NO: 539511 - protein, 9 aa, Mycobacterium
PGDREIDEK

SEQ ID NO: 539512 - protein, 10 aa, Mycobacterium
PGDREVDDKR

SEQ ID NO: 539513 - protein, 10 aa, Mycobacterium
PGDREVDEKR

SEQ ID NO: 539514 - protein, 5 aa, Mycobacterium
PGDRL

SEQ ID NO: 539515 - protein, 11 aa, Mycobacterium
PGDRPRPPIAD

SEQ ID NO: 539516 - protein, 9 aa, Mycobacterium
PGDRQQART

SEQ ID NO: 539517 - protein, 9 aa, Mycobacterium
PGDRRAARA

SEQ ID NO: 539518 - protein, 12 aa, Mycobacterium
PGDRRDEDATAI

SEQ ID NO: 539519 - protein, 4 aa, Mycobacterium
PGDS

SEQ ID NO: 539520 - protein, 5 aa, Mycobacterium
PGDSA

SEQ ID NO: 539521 - protein, 6 aa, Mycobacterium
PGDSAV

SEQ ID NO: 539522 - protein, 9 aa, Mycobacterium
PGDSDAEAE

SEQ ID NO: 539523 - protein, 8 aa, Mycobacterium
PGDSGSAV

SEQ ID NO: 539524 - protein, 14 aa, Mycobacterium
PGDSLDAEARPGPD

SEQ ID NO: 539525 - protein, 12 aa, Mycobacterium
PGDSPAEPRYVP

SEQ ID NO: 539526 - protein, 7 aa, Mycobacterium
PGDSQRL

SEQ ID NO: 539527 - protein, 5 aa, Mycobacterium
PGDSR

SEQ ID NO: 539528 - protein, 10 aa, Mycobacterium
PGDTELSPVN

SEQ ID NO: 539529 - protein, 7 aa, Mycobacterium
PGDTERT

SEQ ID NO: 539530 - protein, 5 aa, Mycobacterium
PGDTI

SEQ ID NO: 539531 - protein, 9 aa, Mycobacterium
PGDTLPEGS

SEQ ID NO: 539532 - protein, 8 aa, Mycobacterium
PGDTPFPE

SEQ ID NO: 539533 - protein, 6 aa, Mycobacterium
PGDTVT

SEQ ID NO: 539534 - protein, 7 aa, Mycobacterium
PGDVAGY

SEQ ID NO: 539535 - protein, 5 aa, Mycobacterium
PGDVD

SEQ ID NO: 539536 - protein, 6 aa, Mycobacterium
PGDVDG

SEQ ID NO: 539537 - protein, 5 aa, Mycobacterium
PGDVE

SEQ ID NO: 539538 - protein, 11 aa, Mycobacterium
PGDVPPFQRGG

SEQ ID NO: 539539 - protein, 5 aa, Mycobacterium
PGEAA

SEQ ID NO: 539540 - protein, 9 aa, Mycobacterium
PGEAAAARS

SEQ ID NO: 539541 - protein, 5 aa, Mycobacterium
PGEAD

SEQ ID NO: 539542 - protein, 10 aa, Mycobacterium
PGEAKNTYGT

SEQ ID NO: 539543 - protein, 5 aa, Mycobacterium
PGEAP

SEQ ID NO: 539544 - protein, 7 aa, Mycobacterium
PGEAPGF

SEQ ID NO: 539545 - protein, 6 aa, Mycobacterium
PGEATA

SEQ ID NO: 539546 - protein, 4 aa, Mycobacterium
PGED

SEQ ID NO: 539547 - protein, 8 aa, Mycobacterium
PGEDCTED

SEQ ID NO: 539548 - protein, 10 aa, Mycobacterium
PGEDDGDQAA

SEQ ID NO: 539549 - protein, 10 aa, Mycobacterium
PGEDGLGESQ

SEQ ID NO: 539550 - protein, 9 aa, Mycobacterium
PGEDGRVTG

SEQ ID NO: 539551 - protein, 5 aa, Mycobacterium
PGEDL

SEQ ID NO: 539552 - protein, 12 aa, Mycobacterium
PGEDPTAKFDEA

SEQ ID NO: 539553 - protein, 13 aa, Mycobacterium
PGEDREARAARRA

SEQ ID NO: 539554 - protein, 8 aa, Mycobacterium
PGEDSTEV

SEQ ID NO: 539555 - protein, 5 aa, Mycobacterium
PGEDT

SEQ ID NO: 539556 - protein, 8 aa, Mycobacterium
PGEEGGAA

SEQ ID NO: 539557 - protein, 8 aa, Mycobacterium
PGEELEAK

SEQ ID NO: 539558 - protein, 20 aa, Mycobacterium
PGEEPIVPRPDPTAQQEPGA

SEQ ID NO: 539559 - protein, 5 aa, Mycobacterium
PGEEV

SEQ ID NO: 539560 - protein, 6 aa, Mycobacterium
PGEEYD

SEQ ID NO: 539561 - protein, 4 aa, Mycobacterium
PGEF

SEQ ID NO: 539562 - protein, 10 aa, Mycobacterium
PGEFAEDGDI

SEQ ID NO: 539563 - protein, 7 aa, Mycobacterium
PGEGFAP

SEQ ID NO: 539564 - protein, 26 aa, Mycobacterium
PGEGGRGGSGGDGGTGGDGGDGGNGR

SEQ ID NO: 539565 - protein, 6 aa, Mycobacterium
PGEGHN

SEQ ID NO: 539566 - protein, 10 aa, Mycobacterium
PGEGPEAGAR

SEQ ID NO: 539567 - protein, 6 aa, Mycobacterium
PGEGSA

SEQ ID NO: 539568 - protein, 6 aa, Mycobacterium
PGEGVG

SEQ ID NO: 539569 - protein, 6 aa, Mycobacterium
PGEGVT

SEQ ID NO: 539570 - protein, 4 aa, Mycobacterium
PGEH

SEQ ID NO: 539571 - protein, 12 aa, Mycobacterium
PGEHGSTFGGNP

SEQ ID NO: 539572 - protein, 9 aa, Mycobacterium
PGEHNGTFR

SEQ ID NO: 539573 - protein, 10 aa, Mycobacterium
PGEHNGTFRG

SEQ ID NO: 539574 - protein, 4 aa, Mycobacterium
PGEI

SEQ ID NO: 539575 - protein, 9 aa, Mycobacterium
PGEKGTTGE

SEQ ID NO: 539576 - protein, 11 aa, Mycobacterium
PGEKTRHQRGV

SEQ ID NO: 539577 - protein, 5 aa, Mycobacterium
PGEKV

SEQ ID NO: 539578 - protein, 16 aa, Mycobacterium
PGEKVPRAGSGHDADP

SEQ ID NO: 539579 - protein, 8 aa, Mycobacterium
PGELEPGV

SEQ ID NO: 539580 - protein, 7 aa, Mycobacterium
PGELGDH

SEQ ID NO: 539581 - protein, 10 aa, Mycobacterium
PGELGEDRAD

SEQ ID NO: 539582 - protein, 11 aa, Mycobacterium
PGELGEERDDV

SEQ ID NO: 539583 - protein, 11 aa, Mycobacterium
PGELGEQRDDV

SEQ ID NO: 539584 - protein, 10 aa, Mycobacterium
PGELGEQREA

SEQ ID NO: 539585 - protein, 7 aa, Mycobacterium
PGELPAV

SEQ ID NO: 539586 - protein, 15 aa, Mycobacterium
PGELPEGAPPPKAFG

SEQ ID NO: 539587 - protein, 22 aa, Mycobacterium
PGELTAATAKAAYDEAGVGPAD

SEQ ID NO: 539588 - protein, 7 aa, Mycobacterium
PGELTDG

SEQ ID NO: 539589 - protein, 5 aa, Mycobacterium
PGENA

SEQ ID NO: 539590 - protein, 27 aa, Mycobacterium
PGENDENSIDSPQSRWPEGGNGTARPS

SEQ ID NO: 539591 - protein, 5 aa, Mycobacterium
PGENN

SEQ ID NO: 539592 - protein, 4 aa, Mycobacterium
PGEP

SEQ ID NO: 539593 - protein, 23 aa, Mycobacterium
PGEPAAAPPAPRKLSYTGAATTL

SEQ ID NO: 539594 - protein, 6 aa, Mycobacterium
PGEPDT

SEQ ID NO: 539595 - protein, 8 aa, Mycobacterium
PGEPGFSD

SEQ ID NO: 539596 - protein, 7 aa, Mycobacterium
PGEPGHV

SEQ ID NO: 539597 - protein, 14 aa, Mycobacterium
PGEPIDQSKEGMRA

SEQ ID NO: 539598 - protein, 5 aa, Mycobacterium
PGEPL

SEQ ID NO: 539599 - protein, 5 aa, Mycobacterium
PGEPP

SEQ ID NO: 539600 - protein, 8 aa, Mycobacterium
PGEPPEAA

SEQ ID NO: 539601 - protein, 10 aa, Mycobacterium
PGEPPRDESE

SEQ ID NO: 539602 - protein, 8 aa, Mycobacterium
PGEPPYVR

SEQ ID NO: 539603 - protein, 17 aa, Mycobacterium
PGEPRVDTGIPWRETRR

SEQ ID NO: 539604 - protein, 7 aa, Mycobacterium
PGEPSRV

SEQ ID NO: 539605 - protein, 5 aa, Mycobacterium
PGEPW

SEQ ID NO: 539606 - protein, 6 aa, Mycobacterium
PGEPWR

SEQ ID NO: 539607 - protein, 15 aa, Mycobacterium
PGEQDEMAHEPTDEP

SEQ ID NO: 539608 - protein, 5 aa, Mycobacterium
PGEQE

SEQ ID NO: 539609 - protein, 12 aa, Mycobacterium
PGEQLDASDTGA

SEQ ID NO: 539610 - protein, 10 aa, Mycobacterium
PGEQPLGEAE

SEQ ID NO: 539611 - protein, 29 aa, Mycobacterium
PGERADGGESIAAPEDELASRRKDRARKI

SEQ ID NO: 539612 - protein, 29 aa, Mycobacterium
PGERADGGESIAEPEDELASRRKHRDRKI

SEQ ID NO: 539613 - protein, 7 aa, Mycobacterium
PGERGEE

SEQ ID NO: 539614 - protein, 6 aa, Mycobacterium
PGERLT

SEQ ID NO: 539615 - protein, 9 aa, Mycobacterium
PGERRNIDT

SEQ ID NO: 539616 - protein, 8 aa, Mycobacterium
PGERTEDF

SEQ ID NO: 539617 - protein, 6 aa, Mycobacterium
PGERTG

SEQ ID NO: 539618 - protein, 8 aa, Mycobacterium
PGESAQNV

SEQ ID NO: 539619 - protein, 14 aa, Mycobacterium
PGESARPGSPMPPH

SEQ ID NO: 539620 - protein, 8 aa, Mycobacterium
PGESDDGR

SEQ ID NO: 539621 - protein, 16 aa, Mycobacterium
PGESDGSCGRGEPQAG

SEQ ID NO: 539622 - protein, 15 aa, Mycobacterium
PGESEISGTYHGKGE

SEQ ID NO: 539623 - protein, 5 aa, Mycobacterium
PGESG

SEQ ID NO: 539624 - protein, 8 aa, Mycobacterium
PGESGLST

SEQ ID NO: 539625 - protein, 10 aa, Mycobacterium
PGESLPPERE

SEQ ID NO: 539626 - protein, 15 aa, Mycobacterium
PGESQDDVLGASTGL

SEQ ID NO: 539627 - protein, 5 aa, Mycobacterium
PGESR

SEQ ID NO: 539628 - protein, 19 aa, Mycobacterium
PGESRAPTIRTFADLVGGH

SEQ ID NO: 539629 - protein, 5 aa, Mycobacterium
PGESW

SEQ ID NO: 539630 - protein, 5 aa, Mycobacterium
PGETA

SEQ ID NO: 539631 - protein, 6 aa, Mycobacterium
PGETAL

SEQ ID NO: 539632 - protein, 7 aa, Mycobacterium
PGETAQL

SEQ ID NO: 539633 - protein, 10 aa, Mycobacterium
PGETASPTEL

SEQ ID NO: 539634 - protein, 5 aa, Mycobacterium
PGETE

SEQ ID NO: 539635 - protein, 9 aa, Mycobacterium
PGETEEDFQ

SEQ ID NO: 539636 - protein, 7 aa, Mycobacterium
PGETEQD

SEQ ID NO: 539637 - protein, 5 aa, Mycobacterium
PGETK

SEQ ID NO: 539638 - protein, 9 aa, Mycobacterium
PGETPVPNK

SEQ ID NO: 539639 - protein, 11 aa, Mycobacterium
PGETSDIPPAE

SEQ ID NO: 539640 - protein, 8 aa, Mycobacterium
PGETVGES

SEQ ID NO: 539641 - protein, 4 aa, Mycobacterium
PGEV

SEQ ID NO: 539642 - protein, 6 aa, Mycobacterium
PGEVEM

SEQ ID NO: 539643 - protein, 19 aa, Mycobacterium
PGEVNRATSTMTEPSGKGV

SEQ ID NO: 539644 - protein, 9 aa, Mycobacterium
PGEVNTYTP

SEQ ID NO: 539645 - protein, 5 aa, Mycobacterium
PGEVP

SEQ ID NO: 539646 - protein, 15 aa, Mycobacterium
PGEVPSDSPGTTPSV

SEQ ID NO: 539647 - protein, 10 aa, Mycobacterium
PGEVRPSDLS

SEQ ID NO: 539648 - protein, 8 aa, Mycobacterium
PGEWTSEP

SEQ ID NO: 539649 - protein, 4 aa, Mycobacterium
PGEY

SEQ ID NO: 539650 - protein, 16 aa, Mycobacterium
PGEYTQLTGRAGRRGI

SEQ ID NO: 539651 - protein, 4 aa, Mycobacterium
PGFA

SEQ ID NO: 539652 - protein, 12 aa, Mycobacterium
PGFAPPRAAGHA

SEQ ID NO: 539653 - protein, 12 aa, Mycobacterium
PGFAPPTAVGHT

SEQ ID NO: 539654 - protein, 7 aa, Mycobacterium
PGFAPSA

SEQ ID NO: 539655 - protein, 5 aa, Mycobacterium
PGFDG

SEQ ID NO: 539656 - protein, 7 aa, Mycobacterium
PGFDPAA

SEQ ID NO: 539657 - protein, 12 aa, Mycobacterium
PGFDQPGNPGMG

SEQ ID NO: 539658 - protein, 7 aa, Mycobacterium
PGFEDDP

SEQ ID NO: 539659 - protein, 9 aa, Mycobacterium
PGFEPQPGD

SEQ ID NO: 539660 - protein, 6 aa, Mycobacterium
PGFGDQ

SEQ ID NO: 539661 - protein, 11 aa, Mycobacterium
PGFGEYQERTD

SEQ ID NO: 539662 - protein, 21 aa, Mycobacterium
PGFGEYQQRTDRVIPVFELMT

SEQ ID NO: 539663 - protein, 7 aa, Mycobacterium
PGFGGGE

SEQ ID NO: 539664 - protein, 14 aa, Mycobacterium
PGFGNSTGSPSSGF

SEQ ID NO: 539665 - protein, 7 aa, Mycobacterium
PGFGNSV

SEQ ID NO: 539666 - protein, 12 aa, Mycobacterium
PGFGNTTTSYSS

SEQ ID NO: 539667 - protein, 5 aa, Mycobacterium
PGFGP

SEQ ID NO: 539668 - protein, 12 aa, Mycobacterium
PGFGPGFGPGFG

SEQ ID NO: 539669 - protein, 12 aa, Mycobacterium
PGFGSELVLLRW

SEQ ID NO: 539670 - protein, 4 aa, Mycobacterium
PGFH

SEQ ID NO: 539671 - protein, 6 aa, Mycobacterium
PGFHGQ

SEQ ID NO: 539672 - protein, 5 aa, Mycobacterium
PGFPE

SEQ ID NO: 539673 - protein, 14 aa, Mycobacterium
PGFQKTGSASSPRD

SEQ ID NO: 539674 - protein, 8 aa, Mycobacterium
PGFQPSTP

SEQ ID NO: 539675 - protein, 8 aa, Mycobacterium
PGFQPTTP

SEQ ID NO: 539676 - protein, 4 aa, Mycobacterium
PGFR

SEQ ID NO: 539677 - protein, 6 aa, Mycobacterium
PGFRGA

SEQ ID NO: 539678 - protein, 21 aa, Mycobacterium
PGFRGTQGKLPGDTGASAAQM

SEQ ID NO: 539679 - protein, 11 aa, Mycobacterium
PGFRPPTAIGH

SEQ ID NO: 539680 - protein, 10 aa, Mycobacterium
PGFSGERQAY

SEQ ID NO: 539681 - protein, 7 aa, Mycobacterium
PGFSPDT

SEQ ID NO: 539682 - protein, 7 aa, Mycobacterium
PGFSPTT

SEQ ID NO: 539683 - protein, 17 aa, Mycobacterium
PGFSRGEPLPITPEAGV

SEQ ID NO: 539684 - protein, 5 aa, Mycobacterium
PGFSS

SEQ ID NO: 539685 - protein, 7 aa, Mycobacterium
PGFTATE

SEQ ID NO: 539686 - protein, 10 aa, Mycobacterium
PGFTEPDPSY

SEQ ID NO: 539687 - protein, 13 aa, Mycobacterium
PGFTPPSAAGHTG

SEQ ID NO: 539688 - protein, 13 aa, Mycobacterium
PGFTSTAPPGDGQ

SEQ ID NO: 539689 - protein, 13 aa, Mycobacterium
PGFTTTAPPGDGQ

SEQ ID NO: 539690 - protein, 21 aa, Mycobacterium
PGGAAPEVSVESGVDSTGMSS

SEQ ID NO: 539691 - protein, 7 aa, Mycobacterium
PGGAAVD

SEQ ID NO: 539692 - protein, 11 aa, Mycobacterium
PGGADQPRRTL

SEQ ID NO: 539693 - protein, 9 aa, Mycobacterium
PGGADSPDG

SEQ ID NO: 539694 - protein, 6 aa, Mycobacterium
PGGADV

SEQ ID NO: 539695 - protein, 15 aa, Mycobacterium
PGGAETGRALTNNPD

SEQ ID NO: 539696 - protein, 5 aa, Mycobacterium
PGGAG

SEQ ID NO: 539697 - protein, 10 aa, Mycobacterium
PGGAGCHGGP

SEQ ID NO: 539698 - protein, 26 aa, Mycobacterium
PGGAGGDGGAGFSGADGGAGGNGGAG

SEQ ID NO: 539699 - protein, 10 aa, Mycobacterium
PGGALTAQQV

SEQ ID NO: 539700 - protein, 8 aa, Mycobacterium
PGGAPIPQ

SEQ ID NO: 539701 - protein, 6 aa, Mycobacterium
PGGAQD

SEQ ID NO: 539702 - protein, 5 aa, Mycobacterium
PGGAR

SEQ ID NO: 539703 - protein, 9 aa, Mycobacterium
PGGATDPDS

SEQ ID NO: 539704 - protein, 5 aa, Mycobacterium
PGGCA

SEQ ID NO: 539705 - protein, 6 aa, Mycobacterium
PGGCEG

SEQ ID NO: 539706 - protein, 6 aa, Mycobacterium
PGGCGR

SEQ ID NO: 539707 - protein, 5 aa, Mycobacterium
PGGCT

SEQ ID NO: 539708 - protein, 14 aa, Mycobacterium
PGGDDLDGNIEGPD

SEQ ID NO: 539709 - protein, 9 aa, Mycobacterium
PGGDEATRR

SEQ ID NO: 539710 - protein, 5 aa, Mycobacterium
PGGDG

SEQ ID NO: 539711 - protein, 11 aa, Mycobacterium
PGGDGAVRQPA

SEQ ID NO: 539712 - protein, 8 aa, Mycobacterium
PGGDGGNA

SEQ ID NO: 539713 - protein, 10 aa, Mycobacterium
PGGDHEKAAG

SEQ ID NO: 539714 - protein, 11 aa, Mycobacterium
PGGDPARLAPV

SEQ ID NO: 539715 - protein, 7 aa, Mycobacterium
PGGDPAV

SEQ ID NO: 539716 - protein, 10 aa, Mycobacterium
PGGDPGRLAP

SEQ ID NO: 539717 - protein, 7 aa, Mycobacterium
PGGDQRD

SEQ ID NO: 539718 - protein, 8 aa, Mycobacterium
PGGDRTSQ

SEQ ID NO: 539719 - protein, 6 aa, Mycobacterium
PGGDVN

SEQ ID NO: 539720 - protein, 5 aa, Mycobacterium
PGGEA

SEQ ID NO: 539721 - protein, 6 aa, Mycobacterium
PGGEDA

SEQ ID NO: 539722 - protein, 7 aa, Mycobacterium
PGGEDEI

SEQ ID NO: 539723 - protein, 5 aa, Mycobacterium
PGGEL

SEQ ID NO: 539724 - protein, 7 aa, Mycobacterium
PGGEPIP

SEQ ID NO: 539725 - protein, 7 aa, Mycobacterium
PGGEPTR

SEQ ID NO: 539726 - protein, 9 aa, Mycobacterium
PGGESAEGV

SEQ ID NO: 539727 - protein, 8 aa, Mycobacterium
PGGESTTI

SEQ ID NO: 539728 - protein, 14 aa, Mycobacterium
PGGESVQQVTERAD

SEQ ID NO: 539729 - protein, 5 aa, Mycobacterium
PGGEY

SEQ ID NO: 539730 - protein, 18 aa, Mycobacterium
PGGFGPARPAPQDATPTA

SEQ ID NO: 539731 - protein, 13 aa, Mycobacterium
PGGGAEMDVSDSE

SEQ ID NO: 539732 - protein, 9 aa, Mycobacterium
PGGGELGVD

SEQ ID NO: 539733 - protein, 13 aa, Mycobacterium
PGGGGIDAARADA

SEQ ID NO: 539734 - protein, 8 aa, Mycobacterium
PGGGGTQR

SEQ ID NO: 539735 - protein, 9 aa, Mycobacterium
PGGGGTQRL

SEQ ID NO: 539736 - protein, 7 aa, Mycobacterium
PGGGGTV

SEQ ID NO: 539737 - protein, 11 aa, Mycobacterium
PGGGGVDAARD

SEQ ID NO: 539738 - protein, 13 aa, Mycobacterium
PGGGGVDAARSDA

SEQ ID NO: 539739 - protein, 11 aa, Mycobacterium
PGGGRLGAEGA

SEQ ID NO: 539740 - protein, 12 aa, Mycobacterium
PGGGSRQPLTTA

SEQ ID NO: 539741 - protein, 8 aa, Mycobacterium
PGGGSSQR

SEQ ID NO: 539742 - protein, 5 aa, Mycobacterium
PGGHF

SEQ ID NO: 539743 - protein, 7 aa, Mycobacterium
PGGHGPM

SEQ ID NO: 539744 - protein, 7 aa, Mycobacterium
PGGHTED

SEQ ID NO: 539745 - protein, 4 aa, Mycobacterium
PGGI

SEQ ID NO: 539746 - protein, 8 aa, Mycobacterium
PGGIESPD

SEQ ID NO: 539747 - protein, 8 aa, Mycobacterium
PGGIGTTA

SEQ ID NO: 539748 - protein, 5 aa, Mycobacterium
PGGIR

SEQ ID NO: 539749 - protein, 7 aa, Mycobacterium
PGGKSEL

SEQ ID NO: 539750 - protein, 11 aa, Mycobacterium
PGGKTRKGGAC

SEQ ID NO: 539751 - protein, 6 aa, Mycobacterium
PGGLAY

SEQ ID NO: 539752 - protein, 5 aa, Mycobacterium
PGGLD

SEQ ID NO: 539753 - protein, 8 aa, Mycobacterium
PGGLDPEA

SEQ ID NO: 539754 - protein, 5 aa, Mycobacterium
PGGLG

SEQ ID NO: 539755 - protein, 17 aa, Mycobacterium
PGGLGPPGTIGSAGTPN

SEQ ID NO: 539756 - protein, 9 aa, Mycobacterium
PGGLSSSSV

SEQ ID NO: 539757 - protein, 6 aa, Mycobacterium
PGGLST

SEQ ID NO: 539758 - protein, 11 aa, Mycobacterium
PGGLTNDAGTG

SEQ ID NO: 539759 - protein, 4 aa, Mycobacterium
PGGN

SEQ ID NO: 539760 - protein, 16 aa, Mycobacterium
PGGNGGPDGSGAAYGS

SEQ ID NO: 539761 - protein, 5 aa, Mycobacterium
PGGNI

SEQ ID NO: 539762 - protein, 6 aa, Mycobacterium
PGGNPK

SEQ ID NO: 539763 - protein, 4 aa, Mycobacterium
PGGP

SEQ ID NO: 539764 - protein, 5 aa, Mycobacterium
PGGPA

SEQ ID NO: 539765 - protein, 11 aa, Mycobacterium
PGGPAGLAGGT

SEQ ID NO: 539766 - protein, 11 aa, Mycobacterium
PGGPDTQAPHP

SEQ ID NO: 539767 - protein, 7 aa, Mycobacterium
PGGPEIG

SEQ ID NO: 539768 - protein, 16 aa, Mycobacterium
PGGPETGQALTANPNL

SEQ ID NO: 539769 - protein, 15 aa, Mycobacterium
PGGPETGRALTDNPA

SEQ ID NO: 539770 - protein, 18 aa, Mycobacterium
PGGPGDPVLSNGRPSPSI

SEQ ID NO: 539771 - protein, 7 aa, Mycobacterium
PGGPGGV

SEQ ID NO: 539772 - protein, 13 aa, Mycobacterium
PGGPGSSAAARDE

SEQ ID NO: 539773 - protein, 11 aa, Mycobacterium
PGGPGTTMAAR

SEQ ID NO: 539774 - protein, 17 aa, Mycobacterium
PGGPGYLNTSATPSSGF

SEQ ID NO: 539775 - protein, 5 aa, Mycobacterium
PGGPK

SEQ ID NO: 539776 - protein, 11 aa, Mycobacterium
PGGPLSAEQVG

SEQ ID NO: 539777 - protein, 8 aa, Mycobacterium
PGGPLTAE

SEQ ID NO: 539778 - protein, 10 aa, Mycobacterium
PGGPLTAEQV

SEQ ID NO: 539779 - protein, 7 aa, Mycobacterium
PGGPPVD

SEQ ID NO: 539780 - protein, 7 aa, Mycobacterium
PGGPSVG

SEQ ID NO: 539781 - protein, 6 aa, Mycobacterium
PGGPTA

SEQ ID NO: 539782 - protein, 14 aa, Mycobacterium
PGGPVTEESGRGDG

SEQ ID NO: 539783 - protein, 13 aa, Mycobacterium
PGGQDFSESNDHV

SEQ ID NO: 539784 - protein, 17 aa, Mycobacterium
PGGQDYRDPEGLDTRNY

SEQ ID NO: 539785 - protein, 8 aa, Mycobacterium
PGGQGDDV

SEQ ID NO: 539786 - protein, 8 aa, Mycobacterium
PGGQQASI

SEQ ID NO: 539787 - protein, 9 aa, Mycobacterium
PGGQRASAQ

SEQ ID NO: 539788 - protein, 319 aa, Mycobacterium
PGGQTGGDGSTGGTGGTGGAGGSGGAMAGKGGDGGAGGMGGGGGVGGNGSNGDHGVSGGNVNGGTGGDGGKGGSGGQGGNGGAAGKALAASYADGAEGAGGAGGMGGTGGLAGNGGDGADAAAGSAGTGGNGGHGGNNGAGGAGGKGGTGLTTGADGATGSRLTAGGNGGDGGDGGSAATAGAKGGAGGVGGDGGLYGNGGKGGNGGAGGNGAAGSNASGAGATGGTGLMGGTGGSGGAGGEGGALAGNGGQGGSGGSGGIGGTGGQGGGGSAGGAGVAGVQDGAGGAGGGGGLGGSGGAGGAGGVGGIGGQAHAGGAF

SEQ ID NO: 539789 - protein, 6 aa, Mycobacterium
PGGQTQ

SEQ ID NO: 539790 - protein, 5 aa, Mycobacterium
PGGRA

SEQ ID NO: 539791 - protein, 10 aa, Mycobacterium
PGGRAPKPGE

SEQ ID NO: 539792 - protein, 11 aa, Mycobacterium
PGGRAPKPGER

SEQ ID NO: 539793 - protein, 7 aa, Mycobacterium
PGGRAVD

SEQ ID NO: 539794 - protein, 12 aa, Mycobacterium
PGGRAYDEPPVN

SEQ ID NO: 539795 - protein, 12 aa, Mycobacterium
PGGRFSKDIPGL

SEQ ID NO: 539796 - protein, 13 aa, Mycobacterium
PGGRLRSDEDMTT

SEQ ID NO: 539797 - protein, 6 aa, Mycobacterium
PGGRMT

SEQ ID NO: 539798 - protein, 12 aa, Mycobacterium
PGGRPGDPDSDD

SEQ ID NO: 539799 - protein, 14 aa, Mycobacterium
PGGRPVDDADARAE

SEQ ID NO: 539800 - protein, 10 aa, Mycobacterium
PGGRTPRLPE

SEQ ID NO: 539801 - protein, 18 aa, Mycobacterium
PGGRTREAKPVPGIPPGS

SEQ ID NO: 539802 - protein, 13 aa, Mycobacterium
PGGRVDPGETVEE

SEQ ID NO: 539803 - protein, 6 aa, Mycobacterium
PGGRVH

SEQ ID NO: 539804 - protein, 15 aa, Mycobacterium
PGGRVRADEDLPSSI

SEQ ID NO: 539805 - protein, 9 aa, Mycobacterium
PGGSAPGQA

SEQ ID NO: 539806 - protein, 11 aa, Mycobacterium
PGGSDTDLPRR

SEQ ID NO: 539807 - protein, 5 aa, Mycobacterium
PGGSF

SEQ ID NO: 539808 - protein, 24 aa, Mycobacterium
PGGSGGAGGATFSGTGGVGGAGGH

SEQ ID NO: 539809 - protein, 16 aa, Mycobacterium
PGGSGGTVVHTTSWWH

SEQ ID NO: 539810 - protein, 7 aa, Mycobacterium
PGGSGVA

SEQ ID NO: 539811 - protein, 5 aa, Mycobacterium
PGGSL

SEQ ID NO: 539812 - protein, 8 aa, Mycobacterium
PGGSLTGS

SEQ ID NO: 539813 - protein, 5 aa, Mycobacterium
PGGSM

SEQ ID NO: 539814 - protein, 8 aa, Mycobacterium
PGGSPNTL

SEQ ID NO: 539815 - protein, 6 aa, Mycobacterium
PGGSQH

SEQ ID NO: 539816 - protein, 11 aa, Mycobacterium
PGGSRTAQEVA

SEQ ID NO: 539817 - protein, 7 aa, Mycobacterium
PGGSRVP

SEQ ID NO: 539818 - protein, 8 aa, Mycobacterium
PGGSSTPL

SEQ ID NO: 539819 - protein, 5 aa, Mycobacterium
PGGSV

SEQ ID NO: 539820 - protein, 10 aa, Mycobacterium
PGGSVPGEEN

SEQ ID NO: 539821 - protein, 12 aa, Mycobacterium
PGGSVRDAEVTA

SEQ ID NO: 539822 - protein, 17 aa, Mycobacterium
PGGSVRDDEVTAAAANA

SEQ ID NO: 539823 - protein, 17 aa, Mycobacterium
PGGSVRDDEVTAAATNA

SEQ ID NO: 539824 - protein, 17 aa, Mycobacterium
PGGSVRDEEVTAAAAKA

SEQ ID NO: 539825 - protein, 9 aa, Mycobacterium
PGGTAHGNT

SEQ ID NO: 539826 - protein, 7 aa, Mycobacterium
PGGTDVG

SEQ ID NO: 539827 - protein, 9 aa, Mycobacterium
PGGTGGFGD

SEQ ID NO: 539828 - protein, 10 aa, Mycobacterium
PGGTGGFGDK

SEQ ID NO: 539829 - protein, 7 aa, Mycobacterium
PGGTGRS

SEQ ID NO: 539830 - protein, 10 aa, Mycobacterium
PGGTPLPEQS

SEQ ID NO: 539831 - protein, 30 aa, Mycobacterium
PGGTPRPKPGPYRSPERGRSPQGVSEAERF

SEQ ID NO: 539832 - protein, 32 aa, Mycobacterium
PGGTQADRDAQAIPLPGRRARRGVGTATPGRP

SEQ ID NO: 539833 - protein, 8 aa, Mycobacterium
PGGTRSSY

SEQ ID NO: 539834 - protein, 7 aa, Mycobacterium
PGGTVRS

SEQ ID NO: 539835 - protein, 5 aa, Mycobacterium
PGGVA

SEQ ID NO: 539836 - protein, 9 aa, Mycobacterium
PGGVDSPDD

SEQ ID NO: 539837 - protein, 9 aa, Mycobacterium
PGGVDSPES

SEQ ID NO: 539838 - protein, 9 aa, Mycobacterium
PGGVDSPKK

SEQ ID NO: 539839 - protein, 5 aa, Mycobacterium
PGGVG

SEQ ID NO: 539840 - protein, 9 aa, Mycobacterium
PGGVNSPED

SEQ ID NO: 539841 - protein, 16 aa, Mycobacterium
PGGVRTTTESDSPALA

SEQ ID NO: 539842 - protein, 8 aa, Mycobacterium
PGGVSSPA

SEQ ID NO: 539843 - protein, 4 aa, Mycobacterium
PGGY

SEQ ID NO: 539844 - protein, 9 aa, Mycobacterium
PGGYADPNW

SEQ ID NO: 539845 - protein, 7 aa, Mycobacterium
PGGYAES

SEQ ID NO: 539846 - protein, 6 aa, Mycobacterium
PGGYQV

SEQ ID NO: 539847 - protein, 9 aa, Mycobacterium
PGHADFSED

SEQ ID NO: 539848 - protein, 7 aa, Mycobacterium
PGHAEAG

SEQ ID NO: 539849 - protein, 8 aa, Mycobacterium
PGHAGPVP

SEQ ID NO: 539850 - protein, 13 aa, Mycobacterium
PGHAPSGLGFRPD

SEQ ID NO: 539851 - protein, 5 aa, Mycobacterium
PGHDA

SEQ ID NO: 539852 - protein, 19 aa, Mycobacterium
PGHDDGGAQPLPVESTPAA

SEQ ID NO: 539853 - protein, 7 aa, Mycobacterium
PGHDDPD

SEQ ID NO: 539854 - protein, 17 aa, Mycobacterium
PGHDRSAHTDYESHDQA

SEQ ID NO: 539855 - protein, 5 aa, Mycobacterium
PGHED

SEQ ID NO: 539856 - protein, 5 aa, Mycobacterium
PGHEE

SEQ ID NO: 539857 - protein, 7 aa, Mycobacterium
PGHEPQA

SEQ ID NO: 539858 - protein, 5 aa, Mycobacterium
PGHEY

SEQ ID NO: 539859 - protein, 5 aa, Mycobacterium
PGHFG

SEQ ID NO: 539860 - protein, 5 aa, Mycobacterium
PGHGA

SEQ ID NO: 539861 - protein, 23 aa, Mycobacterium
PGHGDDTTLGAERPSLAEWRERG

SEQ ID NO: 539862 - protein, 23 aa, Mycobacterium
PGHGDDTTLGSERPHLAEWRKRG

SEQ ID NO: 539863 - protein, 23 aa, Mycobacterium
PGHGDDTTLGTERPHLGEWRERG

SEQ ID NO: 539864 - protein, 8 aa, Mycobacterium
PGHGDDTV

SEQ ID NO: 539865 - protein, 13 aa, Mycobacterium
PGHGDSPTATSPF

SEQ ID NO: 539866 - protein, 7 aa, Mycobacterium
PGHGEHT

SEQ ID NO: 539867 - protein, 45 aa, Mycobacterium
PGHGGAGGVGGNAGLIGNGGNGGAGGITSAAGSTGGNGGDGGDAR

SEQ ID NO: 539868 - protein, 5 aa, Mycobacterium
PGHGH

SEQ ID NO: 539869 - protein, 11 aa, Mycobacterium
PGHGNKPGDLA

SEQ ID NO: 539870 - protein, 5 aa, Mycobacterium
PGHGP

SEQ ID NO: 539871 - protein, 8 aa, Mycobacterium
PGHGPDLP

SEQ ID NO: 539872 - protein, 8 aa, Mycobacterium
PGHGPEDV

SEQ ID NO: 539873 - protein, 7 aa, Mycobacterium
PGHGPEL

SEQ ID NO: 539874 - protein, 8 aa, Mycobacterium
PGHGPELS

SEQ ID NO: 539875 - protein, 6 aa, Mycobacterium
PGHGPR

SEQ ID NO: 539876 - protein, 5 aa, Mycobacterium
PGHGR

SEQ ID NO: 539877 - protein, 23 aa, Mycobacterium
PGHGRSQWREDGDYGPKLNAETV

SEQ ID NO: 539878 - protein, 6 aa, Mycobacterium
PGHGVP

SEQ ID NO: 539879 - protein, 4 aa, Mycobacterium
PGHH

SEQ ID NO: 539880 - protein, 9 aa, Mycobacterium
PGHHAETER

SEQ ID NO: 539881 - protein, 7 aa, Mycobacterium
PGHKPGQ

SEQ ID NO: 539882 - protein, 8 aa, Mycobacterium
PGHKPGQY

SEQ ID NO: 539883 - protein, 38 aa, Mycobacterium
PGHNGANDSSINNQVPDGRGGTKSCQTSGTATDGGYPE

SEQ ID NO: 539884 - protein, 7 aa, Mycobacterium
PGHPECG

SEQ ID NO: 539885 - protein, 17 aa, Mycobacterium
PGHPKFEPADSEVKTND

SEQ ID NO: 539886 - protein, 15 aa, Mycobacterium
PGHPLSGKKRVPATA

SEQ ID NO: 539887 - protein, 8 aa, Mycobacterium
PGHPRKDA

SEQ ID NO: 539888 - protein, 8 aa, Mycobacterium
PGHPVSGE

SEQ ID NO: 539889 - protein, 7 aa, Mycobacterium
PGHQPGQ

SEQ ID NO: 539890 - protein, 4 aa, Mycobacterium
PGHR

SEQ ID NO: 539891 - protein, 8 aa, Mycobacterium
PGHRNSRA

SEQ ID NO: 539892 - protein, 5 aa, Mycobacterium
PGHRR

SEQ ID NO: 539893 - protein, 5 aa, Mycobacterium
PGHSE

SEQ ID NO: 539894 - protein, 6 aa, Mycobacterium
PGHSER

SEQ ID NO: 539895 - protein, 6 aa, Mycobacterium
PGHTAD

SEQ ID NO: 539896 - protein, 15 aa, Mycobacterium
PGHTEDMADKPRDEM

SEQ ID NO: 539897 - protein, 9 aa, Mycobacterium
PGHTGKGAD

SEQ ID NO: 539898 - protein, 6 aa, Mycobacterium
PGHTGT

SEQ ID NO: 539899 - protein, 6 aa, Mycobacterium
PGHTNG

SEQ ID NO: 539900 - protein, 13 aa, Mycobacterium
PGHTPQDIGSGTG

SEQ ID NO: 539901 - protein, 7 aa, Mycobacterium
PGHTSGH

SEQ ID NO: 539902 - protein, 4 aa, Mycobacterium
PGHV

SEQ ID NO: 539903 - protein, 5 aa, Mycobacterium
PGHVQ

SEQ ID NO: 539904 - protein, 5 aa, Mycobacterium
PGIAE

SEQ ID NO: 539905 - protein, 23 aa, Mycobacterium
PGIAGSAPVSVPPGLGTPATTGQ

SEQ ID NO: 539906 - protein, 12 aa, Mycobacterium
PGIARKRRGKGF

SEQ ID NO: 539907 - protein, 5 aa, Mycobacterium
PGIAS

SEQ ID NO: 539908 - protein, 5 aa, Mycobacterium
PGIDP

SEQ ID NO: 539909 - protein, 7 aa, Mycobacterium
PGIDSGR

SEQ ID NO: 539910 - protein, 4 aa, Mycobacterium
PGIE

SEQ ID NO: 539911 - protein, 10 aa, Mycobacterium
PGIEASTPQQ

SEQ ID NO: 539912 - protein, 6 aa, Mycobacterium
PGIEQG

SEQ ID NO: 539913 - protein, 5 aa, Mycobacterium
PGIES

SEQ ID NO: 539914 - protein, 7 aa, Mycobacterium
PGIESGR

SEQ ID NO: 539915 - protein, 4 aa, Mycobacterium
PGIG

SEQ ID NO: 539916 - protein, 7 aa, Mycobacterium
PGIGASD

SEQ ID NO: 539917 - protein, 7 aa, Mycobacterium
PGIGATS

SEQ ID NO: 539918 - protein, 10 aa, Mycobacterium
PGIGATSAGT

SEQ ID NO: 539919 - protein, 7 aa, Mycobacterium
PGIGKSR

SEQ ID NO: 539920 - protein, 10 aa, Mycobacterium
PGIGQGSGQW

SEQ ID NO: 539921 - protein, 5 aa, Mycobacterium
PGIGT

SEQ ID NO: 539922 - protein, 11 aa, Mycobacterium
PGIGYSSDGGM

SEQ ID NO: 539923 - protein, 4 aa, Mycobacterium
PGIK

SEQ ID NO: 539924 - protein, 5 aa, Mycobacterium
PGINP

SEQ ID NO: 539925 - protein, 11 aa, Mycobacterium
PGINSAAAGTL

SEQ ID NO: 539926 - protein, 8 aa, Mycobacterium
PGIPDPDP

SEQ ID NO: 539927 - protein, 15 aa, Mycobacterium
PGIPGHQRAGGGVPR

SEQ ID NO: 539928 - protein, 30 aa, Mycobacterium
PGIPHNTDGRIGNPLGGLPSATDPDNIPGV

SEQ ID NO: 539929 - protein, 5 aa, Mycobacterium
PGIPN

SEQ ID NO: 539930 - protein, 6 aa, Mycobacterium
PGIPNT

SEQ ID NO: 539931 - protein, 5 aa, Mycobacterium
PGIPT

SEQ ID NO: 539932 - protein, 5 aa, Mycobacterium
PGIPV

SEQ ID NO: 539933 - protein, 4 aa, Mycobacterium
PGIQ

SEQ ID NO: 539934 - protein, 6 aa, Mycobacterium
PGIQEP

SEQ ID NO: 539935 - protein, 5 aa, Mycobacterium
PGIRA

SEQ ID NO: 539936 - protein, 5 aa, Mycobacterium
PGISP

SEQ ID NO: 539937 - protein, 7 aa, Mycobacterium
PGISPAE

SEQ ID NO: 539938 - protein, 8 aa, Mycobacterium
PGISPAEA

SEQ ID NO: 539939 - protein, 8 aa, Mycobacterium
PGISQGNL

SEQ ID NO: 539940 - protein, 5 aa, Mycobacterium
PGIST

SEQ ID NO: 539941 - protein, 16 aa, Mycobacterium
PGISTAEEAFSGGRQD

SEQ ID NO: 539942 - protein, 5 aa, Mycobacterium
PGISV

SEQ ID NO: 539943 - protein, 4 aa, Mycobacterium
PGKA

SEQ ID NO: 539944 - protein, 13 aa, Mycobacterium
PGKAKLTDGTEKE

SEQ ID NO: 539945 - protein, 14 aa, Mycobacterium
PGKAKRNLPGAPSA

SEQ ID NO: 539946 - protein, 11 aa, Mycobacterium
PGKAQGPRRAG

SEQ ID NO: 539947 - protein, 7 aa, Mycobacterium
PGKASQQ

SEQ ID NO: 539948 - protein, 12 aa, Mycobacterium
PGKDAARIEGSK

SEQ ID NO: 539949 - protein, 13 aa, Mycobacterium
PGKDAARIEGSKA

SEQ ID NO: 539950 - protein, 6 aa, Mycobacterium
PGKDSH

SEQ ID NO: 539951 - protein, 7 aa, Mycobacterium
PGKEEFN

SEQ ID NO: 539952 - protein, 7 aa, Mycobacterium
PGKEPWE

SEQ ID NO: 539953 - protein, 10 aa, Mycobacterium
PGKERVRDKA

SEQ ID NO: 539954 - protein, 7 aa, Mycobacterium
PGKESHP

SEQ ID NO: 539955 - protein, 7 aa, Mycobacterium
PGKGFAS

SEQ ID NO: 539956 - protein, 8 aa, Mycobacterium
PGKGIERG

SEQ ID NO: 539957 - protein, 8 aa, Mycobacterium
PGKGTQPV

SEQ ID NO: 539958 - protein, 5 aa, Mycobacterium
PGKGV

SEQ ID NO: 539959 - protein, 17 aa, Mycobacterium
PGKHAPRQRVNAGAARP

SEQ ID NO: 539960 - protein, 14 aa, Mycobacterium
PGKKTKKSKLPGDV

SEQ ID NO: 539961 - protein, 8 aa, Mycobacterium
PGKNDTEF

SEQ ID NO: 539962 - protein, 7 aa, Mycobacterium
PGKPAGA

SEQ ID NO: 539963 - protein, 7 aa, Mycobacterium
PGKPPRH

SEQ ID NO: 539964 - protein, 5 aa, Mycobacterium
PGKPV

SEQ ID NO: 539965 - protein, 6 aa, Mycobacterium
PGKPVT

SEQ ID NO: 539966 - protein, 5 aa, Mycobacterium
PGKPW

SEQ ID NO: 539967 - protein, 7 aa, Mycobacterium
PGKRAPS

SEQ ID NO: 539968 - protein, 7 aa, Mycobacterium
PGKRAPT

SEQ ID NO: 539969 - protein, 10 aa, Mycobacterium
PGKRGRPGTV

SEQ ID NO: 539970 - protein, 23 aa, Mycobacterium
PGKSAAAGAAQRDQDPLTPAARD

SEQ ID NO: 539971 - protein, 17 aa, Mycobacterium
PGKTARLTYDSGDGAAA

SEQ ID NO: 539972 - protein, 8 aa, Mycobacterium
PGKVTGRT

SEQ ID NO: 539973 - protein, 7 aa, Mycobacterium
PGLAARA

SEQ ID NO: 539974 - protein, 11 aa, Mycobacterium
PGLADAGQKIS

SEQ ID NO: 539975 - protein, 9 aa, Mycobacterium
PGLADDNNL

SEQ ID NO: 539976 - protein, 6 aa, Mycobacterium
PGLAEA

SEQ ID NO: 539977 - protein, 12 aa, Mycobacterium
PGLAGAERDEVA

SEQ ID NO: 539978 - protein, 29 aa, Mycobacterium
PGLAGTPAAPPAPGSPAPAGQPTTTNTSG

SEQ ID NO: 539979 - protein, 12 aa, Mycobacterium
PGLASAQREEVA

SEQ ID NO: 539980 - protein, 5 aa, Mycobacterium
PGLDE

SEQ ID NO: 539981 - protein, 14 aa, Mycobacterium
PGLDGIENPDQTVS

SEQ ID NO: 539982 - protein, 5 aa, Mycobacterium
PGLDP

SEQ ID NO: 539983 - protein, 6 aa, Mycobacterium
PGLDPD

SEQ ID NO: 539984 - protein, 8 aa, Mycobacterium
PGLDRRSR

SEQ ID NO: 539985 - protein, 7 aa, Mycobacterium
PGLDRSG

SEQ ID NO: 539986 - protein, 12 aa, Mycobacterium
PGLDSAERDEVA

SEQ ID NO: 539987 - protein, 10 aa, Mycobacterium
PGLDTYETAE

SEQ ID NO: 539988 - protein, 12 aa, Mycobacterium
PGLERAEREEVA

SEQ ID NO: 539989 - protein, 12 aa, Mycobacterium
PGLESAQREEVA

SEQ ID NO: 539990 - protein, 8 aa, Mycobacterium
PGLGDPQA

SEQ ID NO: 539991 - protein, 7 aa, Mycobacterium
PGLGEAR

SEQ ID NO: 539992 - protein, 6 aa, Mycobacterium
PGLGEH

SEQ ID NO: 539993 - protein, 7 aa, Mycobacterium
PGLGEHR

SEQ ID NO: 539994 - protein, 6 aa, Mycobacterium
PGLGES

SEQ ID NO: 539995 - protein, 7 aa, Mycobacterium
PGLGESV

SEQ ID NO: 539996 - protein, 8 aa, Mycobacterium
PGLGKSTV

SEQ ID NO: 539997 - protein, 8 aa, Mycobacterium
PGLGPDDV

SEQ ID NO: 539998 - protein, 14 aa, Mycobacterium
PGLGPLPKDALGGG

SEQ ID NO: 539999 - protein, 7 aa, Mycobacterium
PGLGRTA

SEQ ID NO: 540000 - protein, 10 aa, Mycobacterium
PGLGTDDAGA

SEQ ID NO: 540001 - protein, 8 aa, Mycobacterium
PGLGVRPA

SEQ ID NO: 540002 - protein, 9 aa, Mycobacterium
PGLGVRPAK

SEQ ID NO: 540003 - protein, 10 aa, Mycobacterium
PGLGVRPSDE

SEQ ID NO: 540004 - protein, 10 aa, Mycobacterium
PGLGVRPSKR

SEQ ID NO: 540005 - protein, 10 aa, Mycobacterium
PGLGVRPSNE

SEQ ID NO: 540006 - protein, 10 aa, Mycobacterium
PGLGVRPSRQ

SEQ ID NO: 540007 - protein, 6 aa, Mycobacterium
PGLKGT

SEQ ID NO: 540008 - protein, 4 aa, Mycobacterium
PGLL

SEQ ID NO: 540009 - protein, 7 aa, Mycobacterium
PGLNSVG

SEQ ID NO: 540010 - protein, 9 aa, Mycobacterium
PGLNSVGPQ

SEQ ID NO: 540011 - protein, 5 aa, Mycobacterium
PGLPD

SEQ ID NO: 540012 - protein, 8 aa, Mycobacterium
PGLPDNPA

SEQ ID NO: 540013 - protein, 10 aa, Mycobacterium
PGLPEDPAHA

SEQ ID NO: 540014 - protein, 6 aa, Mycobacterium
PGLPEP

SEQ ID NO: 540015 - protein, 6 aa, Mycobacterium
PGLPGE

SEQ ID NO: 540016 - protein, 10 aa, Mycobacterium
PGLPGGENGV

SEQ ID NO: 540017 - protein, 8 aa, Mycobacterium
PGLPGQRS

SEQ ID NO: 540018 - protein, 10 aa, Mycobacterium
PGLPGQRSVL

SEQ ID NO: 540019 - protein, 8 aa, Mycobacterium
PGLPGRAR

SEQ ID NO: 540020 - protein, 6 aa, Mycobacterium
PGLPPA

SEQ ID NO: 540021 - protein, 13 aa, Mycobacterium
PGLPPAGDPTELN

SEQ ID NO: 540022 - protein, 7 aa, Mycobacterium
PGLPPLS

SEQ ID NO: 540023 - protein, 5 aa, Mycobacterium
PGLPS

SEQ ID NO: 540024 - protein, 12 aa, Mycobacterium
PGLPSDPSYSVA

SEQ ID NO: 540025 - protein, 8 aa, Mycobacterium
PGLPSPPE

SEQ ID NO: 540026 - protein, 5 aa, Mycobacterium
PGLPT

SEQ ID NO: 540027 - protein, 13 aa, Mycobacterium
PGLPTEDPQPPCD

SEQ ID NO: 540028 - protein, 13 aa, Mycobacterium
PGLPTGATSPMPG

SEQ ID NO: 540029 - protein, 10 aa, Mycobacterium
PGLPTQPLQG

SEQ ID NO: 540030 - protein, 17 aa, Mycobacterium
PGLQTQRQQLRAELDRI

SEQ ID NO: 540031 - protein, 4 aa, Mycobacterium
PGLR

SEQ ID NO: 540032 - protein, 8 aa, Mycobacterium
PGLRNDSA

SEQ ID NO: 540033 - protein, 10 aa, Mycobacterium
PGLRSGGSIA

SEQ ID NO: 540034 - protein, 4 aa, Mycobacterium
PGLS

SEQ ID NO: 540035 - protein, 5 aa, Mycobacterium
PGLSD

SEQ ID NO: 540036 - protein, 8 aa, Mycobacterium
PGLSDADD

SEQ ID NO: 540037 - protein, 7 aa, Mycobacterium
PGLSEAD

SEQ ID NO: 540038 - protein, 34 aa, Mycobacterium
PGLSNGGAENAGYENSGDYNAGSRSAGNRNAGDF

SEQ ID NO: 540039 - protein, 20 aa, Mycobacterium
PGLSPADAAGTWSPRRTYEP

SEQ ID NO: 540040 - protein, 8 aa, Mycobacterium
PGLSPGWQ

SEQ ID NO: 540041 - protein, 11 aa, Mycobacterium
PGLSSDDRAAI

SEQ ID NO: 540042 - protein, 9 aa, Mycobacterium
PGLSTPGVP

SEQ ID NO: 540043 - protein, 11 aa, Mycobacterium
PGLTAAAGADA

SEQ ID NO: 540044 - protein, 5 aa, Mycobacterium
PGLTE

SEQ ID NO: 540045 - protein, 10 aa, Mycobacterium
PGLTLSDGEF

SEQ ID NO: 540046 - protein, 10 aa, Mycobacterium
PGLTRTPGTA

SEQ ID NO: 540047 - protein, 4 aa, Mycobacterium
PGMA

SEQ ID NO: 540048 - protein, 36 aa, Mycobacterium
PGMCDPRDESPMTEGEPDSAAAERDTRTSAQRNHDG

SEQ ID NO: 540049 - protein, 32 aa, Mycobacterium
PGMCNPDDEQPCTSGTPSQAQIDGDHRSLAQR

SEQ ID NO: 540050 - protein, 4 aa, Mycobacterium
PGME

SEQ ID NO: 540051 - protein, 8 aa, Mycobacterium
PGMEDDPE

SEQ ID NO: 540052 - protein, 9 aa, Mycobacterium
PGMEEGYAA

SEQ ID NO: 540053 - protein, 10 aa, Mycobacterium
PGMETGYGAA

SEQ ID NO: 540054 - protein, 32 aa, Mycobacterium
PGMGAPPHAMAPGATDEDYYRGTVSPSAEADA

SEQ ID NO: 540055 - protein, 10 aa, Mycobacterium
PGMGRAETPV

SEQ ID NO: 540056 - protein, 68 aa, Mycobacterium
PGMGSAGAAGTSAGSGAAGTTNVGGNGEGANVAGGDNAGGASGGPVGGETTNVVNSSTSAGLAQADPM

SEQ ID NO: 540057 - protein, 15 aa, Mycobacterium
PGMLPGSRSEKTGVL

SEQ ID NO: 540058 - protein, 14 aa, Mycobacterium
PGMLPGSRSERSGV

SEQ ID NO: 540059 - protein, 4 aa, Mycobacterium
PGMN

SEQ ID NO: 540060 - protein, 11 aa, Mycobacterium
PGMPDDDTERA

SEQ ID NO: 540061 - protein, 7 aa, Mycobacterium
PGMPDYP

SEQ ID NO: 540062 - protein, 14 aa, Mycobacterium
PGMPERKAVGRRQA

SEQ ID NO: 540063 - protein, 16 aa, Mycobacterium
PGMPERKAVSRRQARV

SEQ ID NO: 540064 - protein, 7 aa, Mycobacterium
PGMPPPP

SEQ ID NO: 540065 - protein, 5 aa, Mycobacterium
PGMPQ

SEQ ID NO: 540066 - protein, 6 aa, Mycobacterium
PGMPQG

SEQ ID NO: 540067 - protein, 14 aa, Mycobacterium
PGMPQGAGTWEGGT

SEQ ID NO: 540068 - protein, 11 aa, Mycobacterium
PGMPQGSGVVG

SEQ ID NO: 540069 - protein, 7 aa, Mycobacterium
PGMPQGV

SEQ ID NO: 540070 - protein, 10 aa, Mycobacterium
PGMPRDTPYS

SEQ ID NO: 540071 - protein, 5 aa, Mycobacterium
PGMPT

SEQ ID NO: 540072 - protein, 7 aa, Mycobacterium
PGMPTDG

SEQ ID NO: 540073 - protein, 4 aa, Mycobacterium
PGMQ

SEQ ID NO: 540074 - protein, 4 aa, Mycobacterium
PGMR

SEQ ID NO: 540075 - protein, 9 aa, Mycobacterium
PGMRADDGR

SEQ ID NO: 540076 - protein, 4 aa, Mycobacterium
PGMS

SEQ ID NO: 540077 - protein, 8 aa, Mycobacterium
PGMSNSEL

SEQ ID NO: 540078 - protein, 5 aa, Mycobacterium
PGMSS

SEQ ID NO: 540079 - protein, 7 aa, Mycobacterium
PGMSSQR

SEQ ID NO: 540080 - protein, 7 aa, Mycobacterium
PGMTAPP

SEQ ID NO: 540081 - protein, 6 aa, Mycobacterium
PGMTDR

SEQ ID NO: 540082 - protein, 6 aa, Mycobacterium
PGMTSQ

SEQ ID NO: 540083 - protein, 11 aa, Mycobacterium
PGNAAELPEGQ

SEQ ID NO: 540084 - protein, 10 aa, Mycobacterium
PGNAAPEVTV

SEQ ID NO: 540085 - protein, 7 aa, Mycobacterium
PGNAAVA

SEQ ID NO: 540086 - protein, 10 aa, Mycobacterium
PGNAAVAEEQ

SEQ ID NO: 540087 - protein, 10 aa, Mycobacterium
PGNAGTAAVA

SEQ ID NO: 540088 - protein, 9 aa, Mycobacterium
PGNAGTARL

SEQ ID NO: 540089 - protein, 10 aa, Mycobacterium
PGNAGTARLA

SEQ ID NO: 540090 - protein, 11 aa, Mycobacterium
PGNAGTARVAE

SEQ ID NO: 540091 - protein, 8 aa, Mycobacterium
PGNARISR

SEQ ID NO: 540092 - protein, 9 aa, Mycobacterium
PGNDGRVTG

SEQ ID NO: 540093 - protein, 6 aa, Mycobacterium
PGNDLG

SEQ ID NO: 540094 - protein, 8 aa, Mycobacterium
PGNDNTCQ

SEQ ID NO: 540095 - protein, 7 aa, Mycobacterium
PGNDPGE

SEQ ID NO: 540096 - protein, 8 aa, Mycobacterium
PGNDPQRL

SEQ ID NO: 540097 - protein, 6 aa, Mycobacterium
PGNDTD

SEQ ID NO: 540098 - protein, 7 aa, Mycobacterium
PGNDYAA

SEQ ID NO: 540099 - protein, 8 aa, Mycobacterium
PGNDYAGD

SEQ ID NO: 540100 - protein, 8 aa, Mycobacterium
PGNEYAGD

SEQ ID NO: 540101 - protein, 9 aa, Mycobacterium
PGNEYAGDD

SEQ ID NO: 540102 - protein, 10 aa, Mycobacterium
PGNGDDTHAV

SEQ ID NO: 540103 - protein, 10 aa, Mycobacterium
PGNGEDTHAV

SEQ ID NO: 540104 - protein, 18 aa, Mycobacterium
PGNGGAGGSAGAGGAGGL

SEQ ID NO: 540105 - protein, 165 aa, Mycobacterium
PGNGGNGGTGGHGYDADSDPSARFGASGGKGGTGGNGGSYGNGGTGGAGGNSALGGGAGGDGGTGGKSGLFGGTGGTGGTGGNATGAGSGGNGGTGGASQHEGPGDAIGGIGGKGGIGYSGGGNGGTGGAAINNGTGDAIGGAGGAGGIAQMSGGSSGSGGGGGI

SEQ ID NO: 540106 - protein, 6 aa, Mycobacterium
PGNGNF

SEQ ID NO: 540107 - protein, 8 aa, Mycobacterium
PGNGVSHP

SEQ ID NO: 540108 - protein, 5 aa, Mycobacterium
PGNHH

SEQ ID NO: 540109 - protein, 5 aa, Mycobacterium
PGNIP

SEQ ID NO: 540110 - protein, 8 aa, Mycobacterium
PGNKAPLS

SEQ ID NO: 540111 - protein, 11 aa, Mycobacterium
PGNKPQKSSKI

SEQ ID NO: 540112 - protein, 15 aa, Mycobacterium
PGNKPRALEKAKSLP

SEQ ID NO: 540113 - protein, 16 aa, Mycobacterium
PGNKPRALEKGKSLPA

SEQ ID NO: 540114 - protein, 8 aa, Mycobacterium
PGNLDDDA

SEQ ID NO: 540115 - protein, 9 aa, Mycobacterium
PGNLSGAAR

SEQ ID NO: 540116 - protein, 6 aa, Mycobacterium
PGNNRV

SEQ ID NO: 540117 - protein, 4 aa, Mycobacterium
PGNP

SEQ ID NO: 540118 - protein, 8 aa, Mycobacterium
PGNPAVAA

SEQ ID NO: 540119 - protein, 6 aa, Mycobacterium
PGNPDY

SEQ ID NO: 540120 - protein, 6 aa, Mycobacterium
PGNPEL

SEQ ID NO: 540121 - protein, 7 aa, Mycobacterium
PGNPNEP

SEQ ID NO: 540122 - protein, 9 aa, Mycobacterium
PGNPPATRQ

SEQ ID NO: 540123 - protein, 6 aa, Mycobacterium
PGNPSA

SEQ ID NO: 540124 - protein, 10 aa, Mycobacterium
PGNQMRGPGH

SEQ ID NO: 540125 - protein, 6 aa, Mycobacterium
PGNRAP

SEQ ID NO: 540126 - protein, 10 aa, Mycobacterium
PGNRIDQATA

SEQ ID NO: 540127 - protein, 8 aa, Mycobacterium
PGNRPSTT

SEQ ID NO: 540128 - protein, 10 aa, Mycobacterium
PGNSNDPHAV

SEQ ID NO: 540129 - protein, 8 aa, Mycobacterium
PGNSPDTL

SEQ ID NO: 540130 - protein, 7 aa, Mycobacterium
PGNSVKD

SEQ ID NO: 540131 - protein, 13 aa, Mycobacterium
PGNTERAAAALGS

SEQ ID NO: 540132 - protein, 15 aa, Mycobacterium
PGNVAGVDAGREAWT

SEQ ID NO: 540133 - protein, 5 aa, Mycobacterium
PGNVT

SEQ ID NO: 540134 - protein, 8 aa, Mycobacterium
PGNYDPDL

SEQ ID NO: 540135 - protein, 8 aa, Mycobacterium
PGNYDPEK

SEQ ID NO: 540136 - protein, 4 aa, Mycobacterium
PGPA

SEQ ID NO: 540137 - protein, 5 aa, Mycobacterium
PGPAA

SEQ ID NO: 540138 - protein, 18 aa, Mycobacterium
PGPAADELAAQARAEAEE

SEQ ID NO: 540139 - protein, 11 aa, Mycobacterium
PGPAAGSEDDG

SEQ ID NO: 540140 - protein, 6 aa, Mycobacterium
PGPAAQ

SEQ ID NO: 540141 - protein, 8 aa, Mycobacterium
PGPAGAKE

SEQ ID NO: 540142 - protein, 6 aa, Mycobacterium
PGPAGM

SEQ ID NO: 540143 - protein, 10 aa, Mycobacterium
PGPAGNGDAA

SEQ ID NO: 540144 - protein, 7 aa, Mycobacterium
PGPAGPQ

SEQ ID NO: 540145 - protein, 17 aa, Mycobacterium
PGPAHQHRAAAPTLGQH

SEQ ID NO: 540146 - protein, 8 aa, Mycobacterium
PGPANKTL

SEQ ID NO: 540147 - protein, 9 aa, Mycobacterium
PGPARARTR

SEQ ID NO: 540148 - protein, 6 aa, Mycobacterium
PGPARS

SEQ ID NO: 540149 - protein, 6 aa, Mycobacterium
PGPASL

SEQ ID NO: 540150 - protein, 5 aa, Mycobacterium
PGPAT

SEQ ID NO: 540151 - protein, 12 aa, Mycobacterium
PGPATAMSDDAH

SEQ ID NO: 540152 - protein, 10 aa, Mycobacterium
PGPATSSASA

SEQ ID NO: 540153 - protein, 12 aa, Mycobacterium
PGPDAPDVDGRH

SEQ ID NO: 540154 - protein, 15 aa, Mycobacterium
PGPDASPGSAPAADI

SEQ ID NO: 540155 - protein, 13 aa, Mycobacterium
PGPDGDGTPSDLP

SEQ ID NO: 540156 - protein, 11 aa, Mycobacterium
PGPDGETEVNQ

SEQ ID NO: 540157 - protein, 9 aa, Mycobacterium
PGPDGIRAG

SEQ ID NO: 540158 - protein, 10 aa, Mycobacterium
PGPDGRSGHT

SEQ ID NO: 540159 - protein, 7 aa, Mycobacterium
PGPDMDK

SEQ ID NO: 540160 - protein, 7 aa, Mycobacterium
PGPDPEA

SEQ ID NO: 540161 - protein, 5 aa, Mycobacterium
PGPDR

SEQ ID NO: 540162 - protein, 9 aa, Mycobacterium
PGPDRQSHR

SEQ ID NO: 540163 - protein, 9 aa, Mycobacterium
PGPDSAPTY

SEQ ID NO: 540164 - protein, 5 aa, Mycobacterium
PGPDV

SEQ ID NO: 540165 - protein, 4 aa, Mycobacterium
PGPE

SEQ ID NO: 540166 - protein, 7 aa, Mycobacterium
PGPEAPE

SEQ ID NO: 540167 - protein, 12 aa, Mycobacterium
PGPEDGSEPVPI

SEQ ID NO: 540168 - protein, 12 aa, Mycobacterium
PGPEDGTEPVPI

SEQ ID NO: 540169 - protein, 10 aa, Mycobacterium
PGPEGDASAG

SEQ ID NO: 540170 - protein, 18 aa, Mycobacterium
PGPEGDPYVSDPAPTKRE

SEQ ID NO: 540171 - protein, 9 aa, Mycobacterium
PGPEGMPGA

SEQ ID NO: 540172 - protein, 18 aa, Mycobacterium
PGPEGNPYVSDPAPSKRE

SEQ ID NO: 540173 - protein, 31 aa, Mycobacterium
PGPEHGRRELPAEDPESLPQTGPPGPAPSLP

SEQ ID NO: 540174 - protein, 16 aa, Mycobacterium
PGPFGKTLDRNWGCAE

SEQ ID NO: 540175 - protein, 4 aa, Mycobacterium
PGPG

SEQ ID NO: 540176 - protein, 9 aa, Mycobacterium
PGPGDPTAI

SEQ ID NO: 540177 - protein, 6 aa, Mycobacterium
PGPGEF

SEQ ID NO: 540178 - protein, 7 aa, Mycobacterium
PGPGGSE

SEQ ID NO: 540179 - protein, 5 aa, Mycobacterium
PGPGI

SEQ ID NO: 540180 - protein, 21 aa, Mycobacterium
PGPGIPPMTTPPWDTKAPKEN

SEQ ID NO: 540181 - protein, 6 aa, Mycobacterium
PGPGLT

SEQ ID NO: 540182 - protein, 7 aa, Mycobacterium
PGPGLTV

SEQ ID NO: 540183 - protein, 7 aa, Mycobacterium
PGPGPVV

SEQ ID NO: 540184 - protein, 5 aa, Mycobacterium
PGPGQ

SEQ ID NO: 540185 - protein, 10 aa, Mycobacterium
PGPGQTARTT

SEQ ID NO: 540186 - protein, 18 aa, Mycobacterium
PGPGRGADRAVGRPAECR

SEQ ID NO: 540187 - protein, 18 aa, Mycobacterium
PGPGSEPGESRIYQPGDD

SEQ ID NO: 540188 - protein, 19 aa, Mycobacterium
PGPGSEPGESRLYQPGDDV

SEQ ID NO: 540189 - protein, 18 aa, Mycobacterium
PGPGSEPGESRMYEPGDD

SEQ ID NO: 540190 - protein, 19 aa, Mycobacterium
PGPGSEPGESRVYQPGDDV

SEQ ID NO: 540191 - protein, 7 aa, Mycobacterium
PGPGSVV

SEQ ID NO: 540192 - protein, 19 aa, Mycobacterium
PGPGTEPGESRLYQPGDDV

SEQ ID NO: 540193 - protein, 5 aa, Mycobacterium
PGPGV

SEQ ID NO: 540194 - protein, 7 aa, Mycobacterium
PGPGVAR

SEQ ID NO: 540195 - protein, 12 aa, Mycobacterium
PGPGVATGDPDV

SEQ ID NO: 540196 - protein, 22 aa, Mycobacterium
PGPGVGGYKGAGEGGAIGSPPA

SEQ ID NO: 540197 - protein, 6 aa, Mycobacterium
PGPGWG

SEQ ID NO: 540198 - protein, 4 aa, Mycobacterium
PGPH

SEQ ID NO: 540199 - protein, 12 aa, Mycobacterium
PGPHGKDPMPSL

SEQ ID NO: 540200 - protein, 10 aa, Mycobacterium
PGPHRRTQRS

SEQ ID NO: 540201 - protein, 6 aa, Mycobacterium
PGPHTP

SEQ ID NO: 540202 - protein, 8 aa, Mycobacterium
PGPHYETP

SEQ ID NO: 540203 - protein, 4 aa, Mycobacterium
PGPI

SEQ ID NO: 540204 - protein, 20 aa, Mycobacterium
PGPIAAKASQYSGKSPSIPY

SEQ ID NO: 540205 - protein, 16 aa, Mycobacterium
PGPIDTEANRTTTPKE

SEQ ID NO: 540206 - protein, 15 aa, Mycobacterium
PGPIDTEATRTVTPG

SEQ ID NO: 540207 - protein, 7 aa, Mycobacterium
PGPIETP

SEQ ID NO: 540208 - protein, 9 aa, Mycobacterium
PGPIPFGPP

SEQ ID NO: 540209 - protein, 5 aa, Mycobacterium
PGPIQ

SEQ ID NO: 540210 - protein, 7 aa, Mycobacterium
PGPISQE

SEQ ID NO: 540211 - protein, 5 aa, Mycobacterium
PGPLA

SEQ ID NO: 540212 - protein, 12 aa, Mycobacterium
PGPLADTADSCR

SEQ ID NO: 540213 - protein, 9 aa, Mycobacterium
PGPLDVAEG

SEQ ID NO: 540214 - protein, 5 aa, Mycobacterium
PGPLH

SEQ ID NO: 540215 - protein, 11 aa, Mycobacterium
PGPLRSGQRGY

SEQ ID NO: 540216 - protein, 11 aa, Mycobacterium
PGPLSRAEEDR

SEQ ID NO: 540217 - protein, 5 aa, Mycobacterium
PGPLT

SEQ ID NO: 540218 - protein, 21 aa, Mycobacterium
PGPMGQNAHNDYADRKNGRQA

SEQ ID NO: 540219 - protein, 8 aa, Mycobacterium
PGPMQGGL

SEQ ID NO: 540220 - protein, 9 aa, Mycobacterium
PGPNAAQLR

SEQ ID NO: 540221 - protein, 7 aa, Mycobacterium
PGPNAAV

SEQ ID NO: 540222 - protein, 10 aa, Mycobacterium
PGPNAAVKAA

SEQ ID NO: 540223 - protein, 12 aa, Mycobacterium
PGPNDGSVPVPV

SEQ ID NO: 540224 - protein, 17 aa, Mycobacterium
PGPNDGTPPEPADNGGY

SEQ ID NO: 540225 - protein, 6 aa, Mycobacterium
PGPNGP

SEQ ID NO: 540226 - protein, 6 aa, Mycobacterium
PGPPEC

SEQ ID NO: 540227 - protein, 6 aa, Mycobacterium
PGPPGR

SEQ ID NO: 540228 - protein, 14 aa, Mycobacterium
PGPPPKRTGSDRTS

SEQ ID NO: 540229 - protein, 13 aa, Mycobacterium
PGPPPPRTGTDRT

SEQ ID NO: 540230 - protein, 18 aa, Mycobacterium
PGPQLASDDDLQQAAREL

SEQ ID NO: 540231 - protein, 9 aa, Mycobacterium
PGPQLPETS

SEQ ID NO: 540232 - protein, 6 aa, Mycobacterium
PGPQTE

SEQ ID NO: 540233 - protein, 7 aa, Mycobacterium
PGPRAAA

SEQ ID NO: 540234 - protein, 18 aa, Mycobacterium
PGPRHTPATEQPRGRRKT

SEQ ID NO: 540235 - protein, 8 aa, Mycobacterium
PGPRPPRC

SEQ ID NO: 540236 - protein, 6 aa, Mycobacterium
PGPRQT

SEQ ID NO: 540237 - protein, 21 aa, Mycobacterium
PGPRRDESIREREAAAGGLTD

SEQ ID NO: 540238 - protein, 20 aa, Mycobacterium
PGPRREESVRDREKAAGRIT

SEQ ID NO: 540239 - protein, 7 aa, Mycobacterium
PGPRTDA

SEQ ID NO: 540240 - protein, 8 aa, Mycobacterium
PGPRTSSV

SEQ ID NO: 540241 - protein, 9 aa, Mycobacterium
PGPRTSTVT

SEQ ID NO: 540242 - protein, 4 aa, Mycobacterium
PGPS

SEQ ID NO: 540243 - protein, 10 aa, Mycobacterium
PGPSAPDNAP

SEQ ID NO: 540244 - protein, 6 aa, Mycobacterium
PGPSAV

SEQ ID NO: 540245 - protein, 5 aa, Mycobacterium
PGPSI

SEQ ID NO: 540246 - protein, 9 aa, Mycobacterium
PGPSNKTLA

SEQ ID NO: 540247 - protein, 7 aa, Mycobacterium
PGPSSAS

SEQ ID NO: 540248 - protein, 9 aa, Mycobacterium
PGPSTQPNV

SEQ ID NO: 540249 - protein, 6 aa, Mycobacterium
PGPTDT

SEQ ID NO: 540250 - protein, 7 aa, Mycobacterium
PGPTDTN

SEQ ID NO: 540251 - protein, 15 aa, Mycobacterium
PGPTENPGDANLEPA

SEQ ID NO: 540252 - protein, 15 aa, Mycobacterium
PGPTGEQHVAYLKRA

SEQ ID NO: 540253 - protein, 15 aa, Mycobacterium
PGPTGEQHVAYLKRS

SEQ ID NO: 540254 - protein, 14 aa, Mycobacterium
PGPTGETSEVPAPD

SEQ ID NO: 540255 - protein, 5 aa, Mycobacterium
PGPTL

SEQ ID NO: 540256 - protein, 6 aa, Mycobacterium
PGPTVA

SEQ ID NO: 540257 - protein, 7 aa, Mycobacterium
PGPVATT

SEQ ID NO: 540258 - protein, 6 aa, Mycobacterium
PGPVDQ

SEQ ID NO: 540259 - protein, 7 aa, Mycobacterium
PGPVETP

SEQ ID NO: 540260 - protein, 9 aa, Mycobacterium
PGPVETPGL

SEQ ID NO: 540261 - protein, 6 aa, Mycobacterium
PGPVNG

SEQ ID NO: 540262 - protein, 15 aa, Mycobacterium
PGPVRTDLPADTEAS

SEQ ID NO: 540263 - protein, 15 aa, Mycobacterium
PGPVRTELPDPDEQS

SEQ ID NO: 540264 - protein, 15 aa, Mycobacterium
PGPVRTELPDPSEQS

SEQ ID NO: 540265 - protein, 6 aa, Mycobacterium
PGPVTE

SEQ ID NO: 540266 - protein, 6 aa, Mycobacterium
PGPVTG

SEQ ID NO: 540267 - protein, 11 aa, Mycobacterium
PGPVTSSASAG

SEQ ID NO: 540268 - protein, 14 aa, Mycobacterium
PGPWGGPRDGEELQ

SEQ ID NO: 540269 - protein, 14 aa, Mycobacterium
PGPYPGYSTVKPRS

SEQ ID NO: 540270 - protein, 44 aa, Mycobacterium
PGQAAAVTTGEKAQGQQAGLQTPSPSGPVQPGQMPGQQPVGPSV

SEQ ID NO: 540271 - protein, 5 aa, Mycobacterium
PGQAG

SEQ ID NO: 540272 - protein, 7 aa, Mycobacterium
PGQAGAR

SEQ ID NO: 540273 - protein, 8 aa, Mycobacterium
PGQAGATA

SEQ ID NO: 540274 - protein, 21 aa, Mycobacterium
PGQAGGAGTTIPADTAGTTRA

SEQ ID NO: 540275 - protein, 8 aa, Mycobacterium
PGQAGGRA

SEQ ID NO: 540276 - protein, 11 aa, Mycobacterium
PGQAPPLGAEG

SEQ ID NO: 540277 - protein, 8 aa, Mycobacterium
PGQARKAD

SEQ ID NO: 540278 - protein, 4 aa, Mycobacterium
PGQD

SEQ ID NO: 540279 - protein, 8 aa, Mycobacterium
PGQDAIGG

SEQ ID NO: 540280 - protein, 24 aa, Mycobacterium
PGQDGGGGGIGGSGGEGGAGGMGG

SEQ ID NO: 540281 - protein, 6 aa, Mycobacterium
PGQEEQ

SEQ ID NO: 540282 - protein, 12 aa, Mycobacterium
PGQELDKQPSEQ

SEQ ID NO: 540283 - protein, 9 aa, Mycobacterium
PGQELEGKN

SEQ ID NO: 540284 - protein, 7 aa, Mycobacterium
PGQERWR

SEQ ID NO: 540285 - protein, 8 aa, Mycobacterium
PGQFGGAS

SEQ ID NO: 540286 - protein, 6 aa, Mycobacterium
PGQGGW

SEQ ID NO: 540287 - protein, 10 aa, Mycobacterium
PGQGNQWPSM

SEQ ID NO: 540288 - protein, 4 aa, Mycobacterium
PGQH

SEQ ID NO: 540289 - protein, 14 aa, Mycobacterium
PGQHRGPVGTPVPQ

SEQ ID NO: 540290 - protein, 8 aa, Mycobacterium
PGQLRPRP

SEQ ID NO: 540291 - protein, 6 aa, Mycobacterium
PGQLTS

SEQ ID NO: 540292 - protein, 10 aa, Mycobacterium
PGQPADQGLQ

SEQ ID NO: 540293 - protein, 7 aa, Mycobacterium
PGQPAEQ

SEQ ID NO: 540294 - protein, 13 aa, Mycobacterium
PGQPESSSSTDSL

SEQ ID NO: 540295 - protein, 5 aa, Mycobacterium
PGQPG

SEQ ID NO: 540296 - protein, 8 aa, Mycobacterium
PGQPLPDL

SEQ ID NO: 540297 - protein, 8 aa, Mycobacterium
PGQPLPEV

SEQ ID NO: 540298 - protein, 8 aa, Mycobacterium
PGQPLPPL

SEQ ID NO: 540299 - protein, 5 aa, Mycobacterium
PGQPV

SEQ ID NO: 540300 - protein, 4 aa, Mycobacterium
PGQQ

SEQ ID NO: 540301 - protein, 6 aa, Mycobacterium
PGQQGG

SEQ ID NO: 540302 - protein, 7 aa, Mycobacterium
PGQQGGP

SEQ ID NO: 540303 - protein, 5 aa, Mycobacterium
PGQQP

SEQ ID NO: 540304 - protein, 5 aa, Mycobacterium
PGQQV

SEQ ID NO: 540305 - protein, 5 aa, Mycobacterium
PGQRA

SEQ ID NO: 540306 - protein, 9 aa, Mycobacterium
PGQRCPSHE

SEQ ID NO: 540307 - protein, 19 aa, Mycobacterium
PGQRDNTNFVPESSRRARA

SEQ ID NO: 540308 - protein, 31 aa, Mycobacterium
PGQRRPSAELTTKAAQQGDSWTVSGRKNPVL

SEQ ID NO: 540309 - protein, 10 aa, Mycobacterium
PGQRRTTSVG

SEQ ID NO: 540310 - protein, 7 aa, Mycobacterium
PGQRSGV

SEQ ID NO: 540311 - protein, 18 aa, Mycobacterium
PGQRSPAATVSTRAVQQG

SEQ ID NO: 540312 - protein, 9 aa, Mycobacterium
PGQRSSGIT

SEQ ID NO: 540313 - protein, 8 aa, Mycobacterium
PGQRVDEG

SEQ ID NO: 540314 - protein, 5 aa, Mycobacterium
PGQRY

SEQ ID NO: 540315 - protein, 18 aa, Mycobacterium
PGQRYGAAEALPANDLAL

SEQ ID NO: 540316 - protein, 37 aa, Mycobacterium
PGQSATGGNGGMGGRGGDGVAAGLAGDGGNGGVGGRG

SEQ ID NO: 540317 - protein, 9 aa, Mycobacterium
PGQSAYNSA

SEQ ID NO: 540318 - protein, 9 aa, Mycobacterium
PGQSCKQVT

SEQ ID NO: 540319 - protein, 5 aa, Mycobacterium
PGQSV

SEQ ID NO: 540320 - protein, 6 aa, Mycobacterium
PGQTAT

SEQ ID NO: 540321 - protein, 9 aa, Mycobacterium
PGQTDAATE

SEQ ID NO: 540322 - protein, 5 aa, Mycobacterium
PGQTG

SEQ ID NO: 540323 - protein, 13 aa, Mycobacterium
PGQTLGNGTGRLG

SEQ ID NO: 540324 - protein, 15 aa, Mycobacterium
PGQTRTESKTAQFEA

SEQ ID NO: 540325 - protein, 8 aa, Mycobacterium
PGQVATPI

SEQ ID NO: 540326 - protein, 5 aa, Mycobacterium
PGQVR

SEQ ID NO: 540327 - protein, 17 aa, Mycobacterium
PGQVSASAPAAAPAGPD

SEQ ID NO: 540328 - protein, 9 aa, Mycobacterium
PGQVSDGQL

SEQ ID NO: 540329 - protein, 4 aa, Mycobacterium
PGQW

SEQ ID NO: 540330 - protein, 5 aa, Mycobacterium
PGQYA

SEQ ID NO: 540331 - protein, 5 aa, Mycobacterium
PGQYD

SEQ ID NO: 540332 - protein, 16 aa, Mycobacterium
PGRAADCRAPDARELA

SEQ ID NO: 540333 - protein, 16 aa, Mycobacterium
PGRAADCRAPNPRELA

SEQ ID NO: 540334 - protein, 13 aa, Mycobacterium
PGRAADGTDPDWD

SEQ ID NO: 540335 - protein, 5 aa, Mycobacterium
PGRAD

SEQ ID NO: 540336 - protein, 13 aa, Mycobacterium
PGRADAHTESVTS

SEQ ID NO: 540337 - protein, 8 aa, Mycobacterium
PGRADERI

SEQ ID NO: 540338 - protein, 15 aa, Mycobacterium
PGRADEVRAAAKERG

SEQ ID NO: 540339 - protein, 6 aa, Mycobacterium
PGRAIP

SEQ ID NO: 540340 - protein, 10 aa, Mycobacterium
PGRCEPGTGE

SEQ ID NO: 540341 - protein, 11 aa, Mycobacterium
PGRCEPGTGEI

SEQ ID NO: 540342 - protein, 5 aa, Mycobacterium
PGRCR

SEQ ID NO: 540343 - protein, 7 aa, Mycobacterium
PGRDAAK

SEQ ID NO: 540344 - protein, 10 aa, Mycobacterium
PGRDDADERA

SEQ ID NO: 540345 - protein, 10 aa, Mycobacterium
PGRDDFGGES

SEQ ID NO: 540346 - protein, 11 aa, Mycobacterium
PGRDDFPGASF

SEQ ID NO: 540347 - protein, 10 aa, Mycobacterium
PGRDEADERA

SEQ ID NO: 540348 - protein, 5 aa, Mycobacterium
PGRDF

SEQ ID NO: 540349 - protein, 15 aa, Mycobacterium
PGRDGAIARNDYRNV

SEQ ID NO: 540350 - protein, 6 aa, Mycobacterium
PGRDGI

SEQ ID NO: 540351 - protein, 9 aa, Mycobacterium
PGRDGRVTG

SEQ ID NO: 540352 - protein, 14 aa, Mycobacterium
PGRDPYHPNARQQR

SEQ ID NO: 540353 - protein, 11 aa, Mycobacterium
PGRDPYHPNER

SEQ ID NO: 540354 - protein, 14 aa, Mycobacterium
PGRDPYHPNPRQQR

SEQ ID NO: 540355 - protein, 7 aa, Mycobacterium
PGREATR

SEQ ID NO: 540356 - protein, 16 aa, Mycobacterium
PGREDRISEQLPSSLG

SEQ ID NO: 540357 - protein, 8 aa, Mycobacterium
PGREEVPA

SEQ ID NO: 540358 - protein, 9 aa, Mycobacterium
PGREGFPGA

SEQ ID NO: 540359 - protein, 6 aa, Mycobacterium
PGREPA

SEQ ID NO: 540360 - protein, 6 aa, Mycobacterium
PGREPV

SEQ ID NO: 540361 - protein, 20 aa, Mycobacterium
PGRFGSADLPAASTENERTS

SEQ ID NO: 540362 - protein, 5 aa, Mycobacterium
PGRGA

SEQ ID NO: 540363 - protein, 6 aa, Mycobacterium
PGRGAD

SEQ ID NO: 540364 - protein, 24 aa, Mycobacterium
PGRGDAAERRRKGRDLRTRRDSSM

SEQ ID NO: 540365 - protein, 19 aa, Mycobacterium
PGRGDAYPAQLSGGQQQRV

SEQ ID NO: 540366 - protein, 8 aa, Mycobacterium
PGRGEPKR

SEQ ID NO: 540367 - protein, 14 aa, Mycobacterium
PGRGESTAATVGPL

SEQ ID NO: 540368 - protein, 7 aa, Mycobacterium
PGRGGAD

SEQ ID NO: 540369 - protein, 8 aa, Mycobacterium
PGRGGADH

SEQ ID NO: 540370 - protein, 6 aa, Mycobacterium
PGRGGG

SEQ ID NO: 540371 - protein, 8 aa, Mycobacterium
PGRGGSDR

SEQ ID NO: 540372 - protein, 8 aa, Mycobacterium
PGRGGTDL

SEQ ID NO: 540373 - protein, 17 aa, Mycobacterium
PGRGITPMGPTAGEPMH

SEQ ID NO: 540374 - protein, 11 aa, Mycobacterium
PGRGLTPMGPA

SEQ ID NO: 540375 - protein, 16 aa, Mycobacterium
PGRGLTPSGPASGEAM

SEQ ID NO: 540376 - protein, 6 aa, Mycobacterium
PGRGMS

SEQ ID NO: 540377 - protein, 6 aa, Mycobacterium
PGRGPH

SEQ ID NO: 540378 - protein, 6 aa, Mycobacterium
PGRGPL

SEQ ID NO: 540379 - protein, 7 aa, Mycobacterium
PGRGPWQ

SEQ ID NO: 540380 - protein, 8 aa, Mycobacterium
PGRGPYPL

SEQ ID NO: 540381 - protein, 8 aa, Mycobacterium
PGRGPYSN

SEQ ID NO: 540382 - protein, 13 aa, Mycobacterium
PGRGSYAGDRGRR

SEQ ID NO: 540383 - protein, 9 aa, Mycobacterium
PGRGTEPTA

SEQ ID NO: 540384 - protein, 8 aa, Mycobacterium
PGRGTQPV

SEQ ID NO: 540385 - protein, 22 aa, Mycobacterium
PGRGWSPLDPTVTATPVDSGYR

SEQ ID NO: 540386 - protein, 10 aa, Mycobacterium
PGRHADPDSI

SEQ ID NO: 540387 - protein, 8 aa, Mycobacterium
PGRHPTST

SEQ ID NO: 540388 - protein, 11 aa, Mycobacterium
PGRKADTDAAA

SEQ ID NO: 540389 - protein, 11 aa, Mycobacterium
PGRKFSESDEF

SEQ ID NO: 540390 - protein, 15 aa, Mycobacterium
PGRKSGIPRSTPVTP

SEQ ID NO: 540391 - protein, 14 aa, Mycobacterium
PGRKTGKPRTTPVT

SEQ ID NO: 540392 - protein, 11 aa, Mycobacterium
PGRLGRRGRLD

SEQ ID NO: 540393 - protein, 4 aa, Mycobacterium
PGRM

SEQ ID NO: 540394 - protein, 7 aa, Mycobacterium
PGRMSSD

SEQ ID NO: 540395 - protein, 8 aa, Mycobacterium
PGRNADAV

SEQ ID NO: 540396 - protein, 7 aa, Mycobacterium
PGRNDDE

SEQ ID NO: 540397 - protein, 11 aa, Mycobacterium
PGRPAPLHPNE

SEQ ID NO: 540398 - protein, 7 aa, Mycobacterium
PGRPHGD

SEQ ID NO: 540399 - protein, 5 aa, Mycobacterium
PGRPP

SEQ ID NO: 540400 - protein, 13 aa, Mycobacterium
PGRPPARTGADRT

SEQ ID NO: 540401 - protein, 8 aa, Mycobacterium
PGRPPLDA

SEQ ID NO: 540402 - protein, 10 aa, Mycobacterium
PGRPPRRGDE

SEQ ID NO: 540403 - protein, 10 aa, Mycobacterium
PGRPPRTGAT

SEQ ID NO: 540404 - protein, 9 aa, Mycobacterium
PGRPPTRRT

SEQ ID NO: 540405 - protein, 6 aa, Mycobacterium
PGRPRE

SEQ ID NO: 540406 - protein, 20 aa, Mycobacterium
PGRPSLVGTRGADGKPYAAL

SEQ ID NO: 540407 - protein, 6 aa, Mycobacterium
PGRPTV

SEQ ID NO: 540408 - protein, 4 aa, Mycobacterium
PGRQ

SEQ ID NO: 540409 - protein, 18 aa, Mycobacterium
PGRQANPLATKHQPVAPS

SEQ ID NO: 540410 - protein, 10 aa, Mycobacterium
PGRQDRAAEP

SEQ ID NO: 540411 - protein, 11 aa, Mycobacterium
PGRQTERTAGD

SEQ ID NO: 540412 - protein, 4 aa, Mycobacterium
PGRR

SEQ ID NO: 540413 - protein, 5 aa, Mycobacterium
PGRRA

SEQ ID NO: 540414 - protein, 13 aa, Mycobacterium
PGRRADGRDPDWD

SEQ ID NO: 540415 - protein, 6 aa, Mycobacterium
PGRRAR

SEQ ID NO: 540416 - protein, 9 aa, Mycobacterium
PGRRDGGAP

SEQ ID NO: 540417 - protein, 7 aa, Mycobacterium
PGRRGGR

SEQ ID NO: 540418 - protein, 7 aa, Mycobacterium
PGRRGGT

SEQ ID NO: 540419 - protein, 14 aa, Mycobacterium
PGRRQPPKSLPPLR

SEQ ID NO: 540420 - protein, 8 aa, Mycobacterium
PGRRRRSG

SEQ ID NO: 540421 - protein, 5 aa, Mycobacterium
PGRRT

SEQ ID NO: 540422 - protein, 30 aa, Mycobacterium
PGRRTPAAGLDTKAVAQGDSWTVSGRKNPV

SEQ ID NO: 540423 - protein, 8 aa, Mycobacterium
PGRSAAEV

SEQ ID NO: 540424 - protein, 19 aa, Mycobacterium
PGRSADASGANAKPDTGAL

SEQ ID NO: 540425 - protein, 6 aa, Mycobacterium
PGRSGL

SEQ ID NO: 540426 - protein, 8 aa, Mycobacterium
PGRSGLST

SEQ ID NO: 540427 - protein, 12 aa, Mycobacterium
PGRSIQDGTGAV

SEQ ID NO: 540428 - protein, 10 aa, Mycobacterium
PGRSPRSADV

SEQ ID NO: 540429 - protein, 16 aa, Mycobacterium
PGRSVSAGHRRGARER

SEQ ID NO: 540430 - protein, 5 aa, Mycobacterium
PGRTA

SEQ ID NO: 540431 - protein, 18 aa, Mycobacterium
PGRTAGADARDAPTTGPL

SEQ ID NO: 540432 - protein, 13 aa, Mycobacterium
PGRTDALQESTDV

SEQ ID NO: 540433 - protein, 13 aa, Mycobacterium
PGRTDATQESTDV

SEQ ID NO: 540434 - protein, 8 aa, Mycobacterium
PGRTEADV

SEQ ID NO: 540435 - protein, 22 aa, Mycobacterium
PGRTESSETSATAPIPDPTPIV

SEQ ID NO: 540436 - protein, 7 aa, Mycobacterium
PGRTITE

SEQ ID NO: 540437 - protein, 7 aa, Mycobacterium
PGRTKTE

SEQ ID NO: 540438 - protein, 6 aa, Mycobacterium
PGRTPP

SEQ ID NO: 540439 - protein, 11 aa, Mycobacterium
PGRTPTGAPSV

SEQ ID NO: 540440 - protein, 8 aa, Mycobacterium
PGRTTADV

SEQ ID NO: 540441 - protein, 5 aa, Mycobacterium
PGRTV

SEQ ID NO: 540442 - protein, 7 aa, Mycobacterium
PGRTVTE

SEQ ID NO: 540443 - protein, 4 aa, Mycobacterium
PGRV

SEQ ID NO: 540444 - protein, 16 aa, Mycobacterium
PGRYDGVANAHRIDLH

SEQ ID NO: 540445 - protein, 12 aa, Mycobacterium
PGRYRRGPATPA

SEQ ID NO: 540446 - protein, 11 aa, Mycobacterium
PGRYRRGPRAP

SEQ ID NO: 540447 - protein, 4 aa, Mycobacterium
PGSA

SEQ ID NO: 540448 - protein, 5 aa, Mycobacterium
PGSAA

SEQ ID NO: 540449 - protein, 13 aa, Mycobacterium
PGSAAAAEQSLRA

SEQ ID NO: 540450 - protein, 22 aa, Mycobacterium
PGSAAPPATDRRRDGFARQSGQ

SEQ ID NO: 540451 - protein, 6 aa, Mycobacterium
PGSAAV

SEQ ID NO: 540452 - protein, 8 aa, Mycobacterium
PGSADANG

SEQ ID NO: 540453 - protein, 9 aa, Mycobacterium
PGSAGGVRD

SEQ ID NO: 540454 - protein, 6 aa, Mycobacterium
PGSAGL

SEQ ID NO: 540455 - protein, 7 aa, Mycobacterium
PGSAGNL

SEQ ID NO: 540456 - protein, 7 aa, Mycobacterium
PGSAGSL

SEQ ID NO: 540457 - protein, 24 aa, Mycobacterium
PGSAIENGGSVEFTPTATGDGTEV

SEQ ID NO: 540458 - protein, 9 aa, Mycobacterium
PGSAKLTGD

SEQ ID NO: 540459 - protein, 5 aa, Mycobacterium
PGSAP

SEQ ID NO: 540460 - protein, 18 aa, Mycobacterium
PGSAPAVEDGYTAVTGSM

SEQ ID NO: 540461 - protein, 5 aa, Mycobacterium
PGSAR

SEQ ID NO: 540462 - protein, 9 aa, Mycobacterium
PGSASGDTV

SEQ ID NO: 540463 - protein, 19 aa, Mycobacterium
PGSASQPQSEKRPPPAPNW

SEQ ID NO: 540464 - protein, 6 aa, Mycobacterium
PGSATA

SEQ ID NO: 540465 - protein, 7 aa, Mycobacterium
PGSATMD

SEQ ID NO: 540466 - protein, 9 aa, Mycobacterium
PGSATSTRE

SEQ ID NO: 540467 - protein, 13 aa, Mycobacterium
PGSCGHANYSREQ

SEQ ID NO: 540468 - protein, 9 aa, Mycobacterium
PGSDADEAQ

SEQ ID NO: 540469 - protein, 11 aa, Mycobacterium
PGSDDLAQTAA

SEQ ID NO: 540470 - protein, 9 aa, Mycobacterium
PGSDELTPT

SEQ ID NO: 540471 - protein, 10 aa, Mycobacterium
PGSDENGYAA

SEQ ID NO: 540472 - protein, 7 aa, Mycobacterium
PGSDGPY

SEQ ID NO: 540473 - protein, 7 aa, Mycobacterium
PGSDGSL

SEQ ID NO: 540474 - protein, 6 aa, Mycobacterium
PGSDHR

SEQ ID NO: 540475 - protein, 6 aa, Mycobacterium
PGSDID

SEQ ID NO: 540476 - protein, 12 aa, Mycobacterium
PGSDPHEGSGIP

SEQ ID NO: 540477 - protein, 12 aa, Mycobacterium
PGSDPHESSGIP

SEQ ID NO: 540478 - protein, 7 aa, Mycobacterium
PGSDRRS

SEQ ID NO: 540479 - protein, 7 aa, Mycobacterium
PGSDRTS

SEQ ID NO: 540480 - protein, 10 aa, Mycobacterium
PGSDSDSSSR

SEQ ID NO: 540481 - protein, 9 aa, Mycobacterium
PGSDTDEAA

SEQ ID NO: 540482 - protein, 7 aa, Mycobacterium
PGSDTDG

SEQ ID NO: 540483 - protein, 7 aa, Mycobacterium
PGSEAPA

SEQ ID NO: 540484 - protein, 11 aa, Mycobacterium
PGSEAPQTPEA

SEQ ID NO: 540485 - protein, 7 aa, Mycobacterium
PGSEEKL

SEQ ID NO: 540486 - protein, 5 aa, Mycobacterium
PGSEL

SEQ ID NO: 540487 - protein, 7 aa, Mycobacterium
PGSENAL

SEQ ID NO: 540488 - protein, 8 aa, Mycobacterium
PGSEPNPL

SEQ ID NO: 540489 - protein, 5 aa, Mycobacterium
PGSEQ

SEQ ID NO: 540490 - protein, 7 aa, Mycobacterium
PGSESYE

SEQ ID NO: 540491 - protein, 8 aa, Mycobacterium
PGSETLGA

SEQ ID NO: 540492 - protein, 11 aa, Mycobacterium
PGSEYLTPTTK

SEQ ID NO: 540493 - protein, 22 aa, Mycobacterium
PGSFAGRYPEGNTGRTAAGLTT

SEQ ID NO: 540494 - protein, 4 aa, Mycobacterium
PGSG

SEQ ID NO: 540495 - protein, 14 aa, Mycobacterium
PGSGAAMANGQAQV

SEQ ID NO: 540496 - protein, 8 aa, Mycobacterium
PGSGATVD

SEQ ID NO: 540497 - protein, 9 aa, Mycobacterium
PGSGDVTAF

SEQ ID NO: 540498 - protein, 47 aa, Mycobacterium
PGSGEGTADGGSNPEGHDGGADGTASGEGTADGGSNPEGHDGGADGT

SEQ ID NO: 540499 - protein, 7 aa, Mycobacterium
PGSGESV

SEQ ID NO: 540500 - protein, 10 aa, Mycobacterium
PGSGKSTIGR

SEQ ID NO: 540501 - protein, 7 aa, Mycobacterium
PGSGLTA

SEQ ID NO: 540502 - protein, 6 aa, Mycobacterium
PGSGPM

SEQ ID NO: 540503 - protein, 7 aa, Mycobacterium
PGSHGGL

SEQ ID NO: 540504 - protein, 6 aa, Mycobacterium
PGSHGI

SEQ ID NO: 540505 - protein, 5 aa, Mycobacterium
PGSIA

SEQ ID NO: 540506 - protein, 14 aa, Mycobacterium
PGSIAREPRGHGGF

SEQ ID NO: 540507 - protein, 5 aa, Mycobacterium
PGSIE

SEQ ID NO: 540508 - protein, 7 aa, Mycobacterium
PGSIKPN

SEQ ID NO: 540509 - protein, 18 aa, Mycobacterium
PGSIKSGITDATGGYIPQ

SEQ ID NO: 540510 - protein, 12 aa, Mycobacterium
PGSIPTTTSGKI

SEQ ID NO: 540511 - protein, 14 aa, Mycobacterium
PGSIPTTTSGKVRR

SEQ ID NO: 540512 - protein, 27 aa, Mycobacterium
PGSISSGMTDGTGASRQSVGPGLPEDA

SEQ ID NO: 540513 - protein, 10 aa, Mycobacterium
PGSKAHGARY

SEQ ID NO: 540514 - protein, 8 aa, Mycobacterium
PGSKEARI

SEQ ID NO: 540515 - protein, 39 aa, Mycobacterium
PGSKTARTRVGRGEGSKGKTAGRGTKGTKARKNVPATFE

SEQ ID NO: 540516 - protein, 34 aa, Mycobacterium
PGSKTERTRVGRGEGSKGKTAGRGTKGTKARKNV

SEQ ID NO: 540517 - protein, 39 aa, Mycobacterium
PGSKTPRTRVGRGEGSKGKTAGRGTKGTKARKQVPTTFE

SEQ ID NO: 540518 - protein, 12 aa, Mycobacterium
PGSKYDSATTRS

SEQ ID NO: 540519 - protein, 5 aa, Mycobacterium
PGSLG

SEQ ID NO: 540520 - protein, 11 aa, Mycobacterium
PGSLGAPRPRF

SEQ ID NO: 540521 - protein, 26 aa, Mycobacterium
PGSLPSGSTGGAGGDGGDGGDGGPGS

SEQ ID NO: 540522 - protein, 14 aa, Mycobacterium
PGSLPTTTSGKIRR

SEQ ID NO: 540523 - protein, 16 aa, Mycobacterium
PGSLTGRYPEGNTGRV

SEQ ID NO: 540524 - protein, 16 aa, Mycobacterium
PGSLTGRYPVGNTGRV

SEQ ID NO: 540525 - protein, 7 aa, Mycobacterium
PGSNGSL

SEQ ID NO: 540526 - protein, 10 aa, Mycobacterium
PGSNHTKAAG

SEQ ID NO: 540527 - protein, 8 aa, Mycobacterium
PGSNPFGA

SEQ ID NO: 540528 - protein, 10 aa, Mycobacterium
PGSNTTVTQV

SEQ ID NO: 540529 - protein, 5 aa, Mycobacterium
PGSPE

SEQ ID NO: 540530 - protein, 8 aa, Mycobacterium
PGSPEYGD

SEQ ID NO: 540531 - protein, 11 aa, Mycobacterium
PGSPFGEHRPN

SEQ ID NO: 540532 - protein, 10 aa, Mycobacterium
PGSPGGVKDG

SEQ ID NO: 540533 - protein, 8 aa, Mycobacterium
PGSPGSPT

SEQ ID NO: 540534 - protein, 9 aa, Mycobacterium
PGSPNRGMF

SEQ ID NO: 540535 - protein, 9 aa, Mycobacterium
PGSPPNRAV

SEQ ID NO: 540536 - protein, 5 aa, Mycobacterium
PGSPQ

SEQ ID NO: 540537 - protein, 10 aa, Mycobacterium
PGSPTDRRRA

SEQ ID NO: 540538 - protein, 7 aa, Mycobacterium
PGSPTNL

SEQ ID NO: 540539 - protein, 5 aa, Mycobacterium
PGSQD

SEQ ID NO: 540540 - protein, 5 aa, Mycobacterium
PGSQQ

SEQ ID NO: 540541 - protein, 5 aa, Mycobacterium
PGSQR

SEQ ID NO: 540542 - protein, 5 aa, Mycobacterium
PGSRF

SEQ ID NO: 540543 - protein, 6 aa, Mycobacterium
PGSRFD

SEQ ID NO: 540544 - protein, 7 aa, Mycobacterium
PGSRFDT

SEQ ID NO: 540545 - protein, 10 aa, Mycobacterium
PGSRIATGAL

SEQ ID NO: 540546 - protein, 10 aa, Mycobacterium
PGSRKGGATL

SEQ ID NO: 540547 - protein, 16 aa, Mycobacterium
PGSRKGPLVEEGPNGE

SEQ ID NO: 540548 - protein, 10 aa, Mycobacterium
PGSRLGTERE

SEQ ID NO: 540549 - protein, 11 aa, Mycobacterium
PGSRRDPEIGR

SEQ ID NO: 540550 - protein, 6 aa, Mycobacterium
PGSRSA

SEQ ID NO: 540551 - protein, 12 aa, Mycobacterium
PGSRTASSGRLA

SEQ ID NO: 540552 - protein, 14 aa, Mycobacterium
PGSSDNKIGKPQNV

SEQ ID NO: 540553 - protein, 10 aa, Mycobacterium
PGSSGPGPTL

SEQ ID NO: 540554 - protein, 14 aa, Mycobacterium
PGSSKTAAAAADGS

SEQ ID NO: 540555 - protein, 8 aa, Mycobacterium
PGSSPDLG

SEQ ID NO: 540556 - protein, 5 aa, Mycobacterium
PGSTA

SEQ ID NO: 540557 - protein, 10 aa, Mycobacterium
PGSTAGTSRL

SEQ ID NO: 540558 - protein, 6 aa, Mycobacterium
PGSTDA

SEQ ID NO: 540559 - protein, 5 aa, Mycobacterium
PGSTP

SEQ ID NO: 540560 - protein, 8 aa, Mycobacterium
PGSTPSLR

SEQ ID NO: 540561 - protein, 17 aa, Mycobacterium
PGSTTHGARYAGDAIER

SEQ ID NO: 540562 - protein, 4 aa, Mycobacterium
PGSV

SEQ ID NO: 540563 - protein, 14 aa, Mycobacterium
PGSVEAVPADGAGE

SEQ ID NO: 540564 - protein, 56 aa, Mycobacterium
PGSVEDAPMAASAGTALAPSPPASAAAPAAPASAPAPTASGTAPAPPSPPPVGDPG

SEQ ID NO: 540565 - protein, 13 aa, Mycobacterium
PGSVGKPSAPYAQ

SEQ ID NO: 540566 - protein, 8 aa, Mycobacterium
PGSVGRPM

SEQ ID NO: 540567 - protein, 5 aa, Mycobacterium
PGSVI

SEQ ID NO: 540568 - protein, 15 aa, Mycobacterium
PGSVTEQAHRADESV

SEQ ID NO: 540569 - protein, 12 aa, Mycobacterium
PGSVTKPSPPYA

SEQ ID NO: 540570 - protein, 4 aa, Mycobacterium
PGSY

SEQ ID NO: 540571 - protein, 9 aa, Mycobacterium
PGSYDPDND

SEQ ID NO: 540572 - protein, 7 aa, Mycobacterium
PGSYNTG

SEQ ID NO: 540573 - protein, 8 aa, Mycobacterium
PGSYRPTL

SEQ ID NO: 540574 - protein, 6 aa, Mycobacterium
PGTAAQ

SEQ ID NO: 540575 - protein, 8 aa, Mycobacterium
PGTAATEN

SEQ ID NO: 540576 - protein, 7 aa, Mycobacterium
PGTAEEV

SEQ ID NO: 540577 - protein, 12 aa, Mycobacterium
PGTAEPGADGAG

SEQ ID NO: 540578 - protein, 10 aa, Mycobacterium
PGTAEPGAGA

SEQ ID NO: 540579 - protein, 12 aa, Mycobacterium
PGTAEPGAPAAD

SEQ ID NO: 540580 - protein, 12 aa, Mycobacterium
PGTAEPGTPAAG

SEQ ID NO: 540581 - protein, 17 aa, Mycobacterium
PGTAESGSTGTTAGVSV

SEQ ID NO: 540582 - protein, 5 aa, Mycobacterium
PGTAG

SEQ ID NO: 540583 - protein, 9 aa, Mycobacterium
PGTAGAQGF

SEQ ID NO: 540584 - protein, 20 aa, Mycobacterium
PGTAGHGGDGGAGGGGGATT

SEQ ID NO: 540585 - protein, 14 aa, Mycobacterium
PGTAGIGNSGGGLN

SEQ ID NO: 540586 - protein, 7 aa, Mycobacterium
PGTAKRT

SEQ ID NO: 540587 - protein, 10 aa, Mycobacterium
PGTAKRTVSL

SEQ ID NO: 540588 - protein, 5 aa, Mycobacterium
PGTAL

SEQ ID NO: 540589 - protein, 10 aa, Mycobacterium
PGTALDGDEP

SEQ ID NO: 540590 - protein, 20 aa, Mycobacterium
PGTALPAPTGVFPRYQTTRD

SEQ ID NO: 540591 - protein, 11 aa, Mycobacterium
PGTANGPSRIG

SEQ ID NO: 540592 - protein, 15 aa, Mycobacterium
PGTANPLPEGSPQDV

SEQ ID NO: 540593 - protein, 10 aa, Mycobacterium
PGTANRGNAT

SEQ ID NO: 540594 - protein, 9 aa, Mycobacterium
PGTAPADTY

SEQ ID NO: 540595 - protein, 10 aa, Mycobacterium
PGTAQPGAAA

SEQ ID NO: 540596 - protein, 5 aa, Mycobacterium
PGTAR

SEQ ID NO: 540597 - protein, 9 aa, Mycobacterium
PGTARGPAD

SEQ ID NO: 540598 - protein, 6 aa, Mycobacterium
PGTARI

SEQ ID NO: 540599 - protein, 9 aa, Mycobacterium
PGTASSLDA

SEQ ID NO: 540600 - protein, 9 aa, Mycobacterium
PGTATPGWA

SEQ ID NO: 540601 - protein, 17 aa, Mycobacterium
PGTDADYEKQERPGGEV

SEQ ID NO: 540602 - protein, 12 aa, Mycobacterium
PGTDAIDPEAEA

SEQ ID NO: 540603 - protein, 7 aa, Mycobacterium
PGTDEHR

SEQ ID NO: 540604 - protein, 6 aa, Mycobacterium
PGTDEL

SEQ ID NO: 540605 - protein, 9 aa, Mycobacterium
PGTDEWSPH

SEQ ID NO: 540606 - protein, 5 aa, Mycobacterium
PGTDF

SEQ ID NO: 540607 - protein, 8 aa, Mycobacterium
PGTDFTPA

SEQ ID NO: 540608 - protein, 8 aa, Mycobacterium
PGTDGRAG

SEQ ID NO: 540609 - protein, 6 aa, Mycobacterium
PGTDIT

SEQ ID NO: 540610 - protein, 16 aa, Mycobacterium
PGTDLTDPAAAQADDV

SEQ ID NO: 540611 - protein, 8 aa, Mycobacterium
PGTDPDAV

SEQ ID NO: 540612 - protein, 11 aa, Mycobacterium
PGTDPDRGDYA

SEQ ID NO: 540613 - protein, 7 aa, Mycobacterium
PGTDPML

SEQ ID NO: 540614 - protein, 10 aa, Mycobacterium
PGTDQTRSYS

SEQ ID NO: 540615 - protein, 9 aa, Mycobacterium
PGTDSPNRE

SEQ ID NO: 540616 - protein, 10 aa, Mycobacterium
PGTDSYDAAL

SEQ ID NO: 540617 - protein, 6 aa, Mycobacterium
PGTDTY

SEQ ID NO: 540618 - protein, 4 aa, Mycobacterium
PGTE

SEQ ID NO: 540619 - protein, 5 aa, Mycobacterium
PGTEL

SEQ ID NO: 540620 - protein, 8 aa, Mycobacterium
PGTEPETI

SEQ ID NO: 540621 - protein, 7 aa, Mycobacterium
PGTEQEY

SEQ ID NO: 540622 - protein, 4 aa, Mycobacterium
PGTF

SEQ ID NO: 540623 - protein, 5 aa, Mycobacterium
PGTFG

SEQ ID NO: 540624 - protein, 13 aa, Mycobacterium
PGTFPAEFAAPAA

SEQ ID NO: 540625 - protein, 4 aa, Mycobacterium
PGTG

SEQ ID NO: 540626 - protein, 5 aa, Mycobacterium
PGTGA

SEQ ID NO: 540627 - protein, 8 aa, Mycobacterium
PGTGADEL

SEQ ID NO: 540628 - protein, 11 aa, Mycobacterium
PGTGDAVQAAK

SEQ ID NO: 540629 - protein, 12 aa, Mycobacterium
PGTGDAVQAAKA

SEQ ID NO: 540630 - protein, 10 aa, Mycobacterium
PGTGDLKPDL

SEQ ID NO: 540631 - protein, 5 aa, Mycobacterium
PGTGE

SEQ ID NO: 540632 - protein, 9 aa, Mycobacterium
PGTGESTDA

SEQ ID NO: 540633 - protein, 10 aa, Mycobacterium
PGTGGSPTSV

SEQ ID NO: 540634 - protein, 19 aa, Mycobacterium
PGTGHTQGSYPLPAATGYP

SEQ ID NO: 540635 - protein, 5 aa, Mycobacterium
PGTGI

SEQ ID NO: 540636 - protein, 5 aa, Mycobacterium
PGTGL

SEQ ID NO: 540637 - protein, 7 aa, Mycobacterium
PGTGLSP

SEQ ID NO: 540638 - protein, 8 aa, Mycobacterium
PGTGLSPD

SEQ ID NO: 540639 - protein, 7 aa, Mycobacterium
PGTGNDV

SEQ ID NO: 540640 - protein, 17 aa, Mycobacterium
PGTGNTGIANAGDYNTG

SEQ ID NO: 540641 - protein, 8 aa, Mycobacterium
PGTGPAEI

SEQ ID NO: 540642 - protein, 11 aa, Mycobacterium
PGTGPRSPAAT

SEQ ID NO: 540643 - protein, 7 aa, Mycobacterium
PGTGQDL

SEQ ID NO: 540644 - protein, 9 aa, Mycobacterium
PGTGSDDDF

SEQ ID NO: 540645 - protein, 9 aa, Mycobacterium
PGTGSDDDY

SEQ ID NO: 540646 - protein, 7 aa, Mycobacterium
PGTGSSV

SEQ ID NO: 540647 - protein, 8 aa, Mycobacterium
PGTGSSVA

SEQ ID NO: 540648 - protein, 6 aa, Mycobacterium
PGTGTA

SEQ ID NO: 540649 - protein, 7 aa, Mycobacterium
PGTGTAH

SEQ ID NO: 540650 - protein, 4 aa, Mycobacterium
PGTH

SEQ ID NO: 540651 - protein, 4 aa, Mycobacterium
PGTI

SEQ ID NO: 540652 - protein, 5 aa, Mycobacterium
PGTIG

SEQ ID NO: 540653 - protein, 15 aa, Mycobacterium
PGTINTPAYGQAADQ

SEQ ID NO: 540654 - protein, 20 aa, Mycobacterium
PGTIPPSTVSAGVGEANTVG

SEQ ID NO: 540655 - protein, 11 aa, Mycobacterium
PGTKEPVSPDD

SEQ ID NO: 540656 - protein, 11 aa, Mycobacterium
PGTKGLAQGQK

SEQ ID NO: 540657 - protein, 10 aa, Mycobacterium
PGTKGLSQGQ

SEQ ID NO: 540658 - protein, 11 aa, Mycobacterium
PGTKGLTQGQK

SEQ ID NO: 540659 - protein, 5 aa, Mycobacterium
PGTKS

SEQ ID NO: 540660 - protein, 10 aa, Mycobacterium
PGTLEPDAAL

SEQ ID NO: 540661 - protein, 7 aa, Mycobacterium
PGTLERA

SEQ ID NO: 540662 - protein, 5 aa, Mycobacterium
PGTLG

SEQ ID NO: 540663 - protein, 16 aa, Mycobacterium
PGTLKQGEATKRTGTT

SEQ ID NO: 540664 - protein, 6 aa, Mycobacterium
PGTLPE

SEQ ID NO: 540665 - protein, 21 aa, Mycobacterium
PGTLPQAAPGSPIAYTTHQLE

SEQ ID NO: 540666 - protein, 7 aa, Mycobacterium
PGTNAQV

SEQ ID NO: 540667 - protein, 24 aa, Mycobacterium
PGTNFTRTDSLNTGVTQKTVYVDV

SEQ ID NO: 540668 - protein, 9 aa, Mycobacterium
PGTNNSVKG

SEQ ID NO: 540669 - protein, 17 aa, Mycobacterium
PGTNTNLNGSGSNHTSA

SEQ ID NO: 540670 - protein, 12 aa, Mycobacterium
PGTNWDSNPNAM

SEQ ID NO: 540671 - protein, 12 aa, Mycobacterium
PGTNWSSNPNAM

SEQ ID NO: 540672 - protein, 13 aa, Mycobacterium
PGTNWSSNPNAMK

SEQ ID NO: 540673 - protein, 4 aa, Mycobacterium
PGTP

SEQ ID NO: 540674 - protein, 5 aa, Mycobacterium
PGTPA

SEQ ID NO: 540675 - protein, 14 aa, Mycobacterium
PGTPAAETQARLDD

SEQ ID NO: 540676 - protein, 6 aa, Mycobacterium
PGTPAG

SEQ ID NO: 540677 - protein, 8 aa, Mycobacterium
PGTPAGSV

SEQ ID NO: 540678 - protein, 5 aa, Mycobacterium
PGTPE

SEQ ID NO: 540679 - protein, 7 aa, Mycobacterium
PGTPENL

SEQ ID NO: 540680 - protein, 7 aa, Mycobacterium
PGTPGTE

SEQ ID NO: 540681 - protein, 6 aa, Mycobacterium
PGTPIE

SEQ ID NO: 540682 - protein, 10 aa, Mycobacterium
PGTPMAPSVE

SEQ ID NO: 540683 - protein, 11 aa, Mycobacterium
PGTPPGSIGKG

SEQ ID NO: 540684 - protein, 13 aa, Mycobacterium
PGTPPPATGADRT

SEQ ID NO: 540685 - protein, 8 aa, Mycobacterium
PGTPPQRV

SEQ ID NO: 540686 - protein, 6 aa, Mycobacterium
PGTPQN

SEQ ID NO: 540687 - protein, 19 aa, Mycobacterium
PGTPTGTASGGRPGPIRPV

SEQ ID NO: 540688 - protein, 7 aa, Mycobacterium
PGTPVGE

SEQ ID NO: 540689 - protein, 6 aa, Mycobacterium
PGTPVT

SEQ ID NO: 540690 - protein, 6 aa, Mycobacterium
PGTQAR

SEQ ID NO: 540691 - protein, 12 aa, Mycobacterium
PGTQLTPRPEQI

SEQ ID NO: 540692 - protein, 24 aa, Mycobacterium
PGTQPSPSDFGYTADGAPDPAAAK

SEQ ID NO: 540693 - protein, 11 aa, Mycobacterium
PGTREPNKEAV

SEQ ID NO: 540694 - protein, 9 aa, Mycobacterium
PGTRGAEMR

SEQ ID NO: 540695 - protein, 6 aa, Mycobacterium
PGTRRD

SEQ ID NO: 540696 - protein, 17 aa, Mycobacterium
PGTRRQVNSAAAQAYQD

SEQ ID NO: 540697 - protein, 8 aa, Mycobacterium
PGTRTGYR

SEQ ID NO: 540698 - protein, 16 aa, Mycobacterium
PGTSGRAAGPKPRFGH

SEQ ID NO: 540699 - protein, 9 aa, Mycobacterium
PGTSLDPHG

SEQ ID NO: 540700 - protein, 11 aa, Mycobacterium
PGTSLGNHPPV

SEQ ID NO: 540701 - protein, 9 aa, Mycobacterium
PGTSPVTDG

SEQ ID NO: 540702 - protein, 9 aa, Mycobacterium
PGTSQRKHL

SEQ ID NO: 540703 - protein, 11 aa, Mycobacterium
PGTSRGPSSSA

SEQ ID NO: 540704 - protein, 8 aa, Mycobacterium
PGTSRPAR

SEQ ID NO: 540705 - protein, 15 aa, Mycobacterium
PGTSRSRDSGLTERQ

SEQ ID NO: 540706 - protein, 9 aa, Mycobacterium
PGTSSSVKG

SEQ ID NO: 540707 - protein, 6 aa, Mycobacterium
PGTSSV

SEQ ID NO: 540708 - protein, 7 aa, Mycobacterium
PGTSTAV

SEQ ID NO: 540709 - protein, 10 aa, Mycobacterium
PGTSTHGAQF

SEQ ID NO: 540710 - protein, 5 aa, Mycobacterium
PGTSV

SEQ ID NO: 540711 - protein, 10 aa, Mycobacterium
PGTTAHPNSL

SEQ ID NO: 540712 - protein, 8 aa, Mycobacterium
PGTTAKAV

SEQ ID NO: 540713 - protein, 8 aa, Mycobacterium
PGTTGVHS

SEQ ID NO: 540714 - protein, 10 aa, Mycobacterium
PGTTGVHSSG

SEQ ID NO: 540715 - protein, 10 aa, Mycobacterium
PGTTGVHTSG

SEQ ID NO: 540716 - protein, 8 aa, Mycobacterium
PGTTGVYS

SEQ ID NO: 540717 - protein, 6 aa, Mycobacterium
PGTTMT

SEQ ID NO: 540718 - protein, 7 aa, Mycobacterium
PGTTMTT

SEQ ID NO: 540719 - protein, 12 aa, Mycobacterium
PGTTPEQEHNMR

SEQ ID NO: 540720 - protein, 10 aa, Mycobacterium
PGTTSVHSSG

SEQ ID NO: 540721 - protein, 6 aa, Mycobacterium
PGTTTE

SEQ ID NO: 540722 - protein, 10 aa, Mycobacterium
PGTTTPHTEF

SEQ ID NO: 540723 - protein, 7 aa, Mycobacterium
PGTTTSV

SEQ ID NO: 540724 - protein, 17 aa, Mycobacterium
PGTTTSYPGPANGVGAG

SEQ ID NO: 540725 - protein, 4 aa, Mycobacterium
PGTV

SEQ ID NO: 540726 - protein, 6 aa, Mycobacterium
PGTVAD

SEQ ID NO: 540727 - protein, 6 aa, Mycobacterium
PGTVDG

SEQ ID NO: 540728 - protein, 13 aa, Mycobacterium
PGTVDPVRGTSID

SEQ ID NO: 540729 - protein, 19 aa, Mycobacterium
PGTVDQRTGASLDSPNMSG

SEQ ID NO: 540730 - protein, 6 aa, Mycobacterium
PGTVGT

SEQ ID NO: 540731 - protein, 5 aa, Mycobacterium
PGTVS

SEQ ID NO: 540732 - protein, 6 aa, Mycobacterium
PGTVTR

SEQ ID NO: 540733 - protein, 4 aa, Mycobacterium
PGTY

SEQ ID NO: 540734 - protein, 5 aa, Mycobacterium
PGTYT

SEQ ID NO: 540735 - protein, 10 aa, Mycobacterium
PGVAAEGDQV

SEQ ID NO: 540736 - protein, 15 aa, Mycobacterium
PGVADADLNRDPATT

SEQ ID NO: 540737 - protein, 5 aa, Mycobacterium
PGVAK

SEQ ID NO: 540738 - protein, 5 aa, Mycobacterium
PGVAP

SEQ ID NO: 540739 - protein, 9 aa, Mycobacterium
PGVATPTEA

SEQ ID NO: 540740 - protein, 21 aa, Mycobacterium
PGVDAAPRTPGRDGEVARSEK

SEQ ID NO: 540741 - protein, 21 aa, Mycobacterium
PGVDAAPRTPGRDGEVATSEQ

SEQ ID NO: 540742 - protein, 11 aa, Mycobacterium
PGVDGSSPELA

SEQ ID NO: 540743 - protein, 5 aa, Mycobacterium
PGVDP

SEQ ID NO: 540744 - protein, 8 aa, Mycobacterium
PGVDPATD

SEQ ID NO: 540745 - protein, 8 aa, Mycobacterium
PGVDPEKD

SEQ ID NO: 540746 - protein, 9 aa, Mycobacterium
PGVDPGSTH

SEQ ID NO: 540747 - protein, 8 aa, Mycobacterium
PGVDPHPA

SEQ ID NO: 540748 - protein, 13 aa, Mycobacterium
PGVDRPPDSDNET

SEQ ID NO: 540749 - protein, 21 aa, Mycobacterium
PGVEAAPRTPGRDGEVAQSEK

SEQ ID NO: 540750 - protein, 9 aa, Mycobacterium
PGVEANDGD

SEQ ID NO: 540751 - protein, 6 aa, Mycobacterium
PGVEDS

SEQ ID NO: 540752 - protein, 5 aa, Mycobacterium
PGVEK

SEQ ID NO: 540753 - protein, 9 aa, Mycobacterium
PGVEKTNYD

SEQ ID NO: 540754 - protein, 27 aa, Mycobacterium
PGVEPDASAPRMAKGPRFDGDTSELPD

SEQ ID NO: 540755 - protein, 7 aa, Mycobacterium
PGVEPGV

SEQ ID NO: 540756 - protein, 12 aa, Mycobacterium
PGVEPVADGGYG

SEQ ID NO: 540757 - protein, 5 aa, Mycobacterium
PGVES

SEQ ID NO: 540758 - protein, 7 aa, Mycobacterium
PGVETRP

SEQ ID NO: 540759 - protein, 5 aa, Mycobacterium
PGVGA

SEQ ID NO: 540760 - protein, 21 aa, Mycobacterium
PGVGEGAPGRRSRARNASGSV

SEQ ID NO: 540761 - protein, 18 aa, Mycobacterium
PGVGEPAGGGFPALSSTG

SEQ ID NO: 540762 - protein, 7 aa, Mycobacterium
PGVGKST

SEQ ID NO: 540763 - protein, 5 aa, Mycobacterium
PGVGP

SEQ ID NO: 540764 - protein, 8 aa, Mycobacterium
PGVGRPDL

SEQ ID NO: 540765 - protein, 17 aa, Mycobacterium
PGVGSAGDAAATSVQSA

SEQ ID NO: 540766 - protein, 139 aa, Mycobacterium
PGVGSGPGSPMTPHAPGPVHGGGESPSPAAKLPTPDTSTRGPETRPSHTGSPETPRAQQPSAVGPTPGSTPSAPVHSSADQSRQSASTSPASSTSEQTAPKEHGTAPGSSVPPSDSHHNSPPPKPEPPHDSSGLEPPVH

SEQ ID NO: 540767 - protein, 11 aa, Mycobacterium
PGVGSTTRGTL

SEQ ID NO: 540768 - protein, 12 aa, Mycobacterium
PGVGSTTRGTLP

SEQ ID NO: 540769 - protein, 8 aa, Mycobacterium
PGVHGSPI

SEQ ID NO: 540770 - protein, 4 aa, Mycobacterium
PGVK

SEQ ID NO: 540771 - protein, 8 aa, Mycobacterium
PGVKTRRA

SEQ ID NO: 540772 - protein, 13 aa, Mycobacterium
PGVKVDARSERWR

SEQ ID NO: 540773 - protein, 11 aa, Mycobacterium
PGVLPPTRPGH

SEQ ID NO: 540774 - protein, 4 aa, Mycobacterium
PGVP

SEQ ID NO: 540775 - protein, 14 aa, Mycobacterium
PGVPADQLDSEDLG

SEQ ID NO: 540776 - protein, 9 aa, Mycobacterium
PGVPKPDLD

SEQ ID NO: 540777 - protein, 6 aa, Mycobacterium
PGVPPK

SEQ ID NO: 540778 - protein, 8 aa, Mycobacterium
PGVPSDPE

SEQ ID NO: 540779 - protein, 8 aa, Mycobacterium
PGVPTDPA

SEQ ID NO: 540780 - protein, 21 aa, Mycobacterium
PGVQAAPRTPGRDGEVAEAEK

SEQ ID NO: 540781 - protein, 7 aa, Mycobacterium
PGVQAPG

SEQ ID NO: 540782 - protein, 6 aa, Mycobacterium
PGVQQR

SEQ ID NO: 540783 - protein, 8 aa, Mycobacterium
PGVQRTRR

SEQ ID NO: 540784 - protein, 9 aa, Mycobacterium
PGVQSPDTT

SEQ ID NO: 540785 - protein, 6 aa, Mycobacterium
PGVQTP

SEQ ID NO: 540786 - protein, 10 aa, Mycobacterium
PGVQTPDHTL

SEQ ID NO: 540787 - protein, 8 aa, Mycobacterium
PGVQTPDV

SEQ ID NO: 540788 - protein, 15 aa, Mycobacterium
PGVQVSSDAAAARSA

SEQ ID NO: 540789 - protein, 4 aa, Mycobacterium
PGVR

SEQ ID NO: 540790 - protein, 10 aa, Mycobacterium
PGVRDVSPGD

SEQ ID NO: 540791 - protein, 7 aa, Mycobacterium
PGVRGAG

SEQ ID NO: 540792 - protein, 14 aa, Mycobacterium
PGVRGNTGKLDSAE

SEQ ID NO: 540793 - protein, 9 aa, Mycobacterium
PGVRPEPVA

SEQ ID NO: 540794 - protein, 17 aa, Mycobacterium
PGVRRKSQAAVPGDGAA

SEQ ID NO: 540795 - protein, 10 aa, Mycobacterium
PGVRTDSEYS

SEQ ID NO: 540796 - protein, 9 aa, Mycobacterium
PGVSDSIRN

SEQ ID NO: 540797 - protein, 5 aa, Mycobacterium
PGVSG

SEQ ID NO: 540798 - protein, 6 aa, Mycobacterium
PGVSGD

SEQ ID NO: 540799 - protein, 8 aa, Mycobacterium
PGVSPADV

SEQ ID NO: 540800 - protein, 10 aa, Mycobacterium
PGVSPAGETI

SEQ ID NO: 540801 - protein, 11 aa, Mycobacterium
PGVSPDEVREA

SEQ ID NO: 540802 - protein, 9 aa, Mycobacterium
PGVSPPGLD

SEQ ID NO: 540803 - protein, 23 aa, Mycobacterium
PGVSQFGPGDRVTYTGSPLGAYS

SEQ ID NO: 540804 - protein, 5 aa, Mycobacterium
PGVST

SEQ ID NO: 540805 - protein, 5 aa, Mycobacterium
PGVSV

SEQ ID NO: 540806 - protein, 10 aa, Mycobacterium
PGVTAGHSAG

SEQ ID NO: 540807 - protein, 5 aa, Mycobacterium
PGVTD

SEQ ID NO: 540808 - protein, 8 aa, Mycobacterium
PGVTETAA

SEQ ID NO: 540809 - protein, 22 aa, Mycobacterium
PGVTETAASRTYVDDDPDRDRQ

SEQ ID NO: 540810 - protein, 12 aa, Mycobacterium
PGVTETKPGSAM

SEQ ID NO: 540811 - protein, 21 aa, Mycobacterium
PGVTETPASHTYTDVDPERDR

SEQ ID NO: 540812 - protein, 22 aa, Mycobacterium
PGVTETPASRTYTDEDPDRDRR

SEQ ID NO: 540813 - protein, 11 aa, Mycobacterium
PGVTEVAEGDS

SEQ ID NO: 540814 - protein, 6 aa, Mycobacterium
PGVTGG

SEQ ID NO: 540815 - protein, 9 aa, Mycobacterium
PGVTGPAVG

SEQ ID NO: 540816 - protein, 12 aa, Mycobacterium
PGVTGPLAGNPA

SEQ ID NO: 540817 - protein, 8 aa, Mycobacterium
PGVTPDAP

SEQ ID NO: 540818 - protein, 7 aa, Mycobacterium
PGVTPQA

SEQ ID NO: 540819 - protein, 8 aa, Mycobacterium
PGVTRDRV

SEQ ID NO: 540820 - protein, 6 aa, Mycobacterium
PGVTSQ

SEQ ID NO: 540821 - protein, 7 aa, Mycobacterium
PGVTSTE

SEQ ID NO: 540822 - protein, 21 aa, Mycobacterium
PGVTTAAAPTPPEGSTWPSAN

SEQ ID NO: 540823 - protein, 12 aa, Mycobacterium
PGWDAGDKSALR

SEQ ID NO: 540824 - protein, 5 aa, Mycobacterium
PGWDN

SEQ ID NO: 540825 - protein, 7 aa, Mycobacterium
PGWGSER

SEQ ID NO: 540826 - protein, 6 aa, Mycobacterium
PGWNNP

SEQ ID NO: 540827 - protein, 11 aa, Mycobacterium
PGWPSTDPDDH

SEQ ID NO: 540828 - protein, 9 aa, Mycobacterium
PGWQKERQR

SEQ ID NO: 540829 - protein, 7 aa, Mycobacterium
PGWRANR

SEQ ID NO: 540830 - protein, 14 aa, Mycobacterium
PGWRRGATQGHSGT

SEQ ID NO: 540831 - protein, 15 aa, Mycobacterium
PGWSGDPAADPSGAL

SEQ ID NO: 540832 - protein, 11 aa, Mycobacterium
PGWTDTQHPDG

SEQ ID NO: 540833 - protein, 11 aa, Mycobacterium
PGWTREGDSLR

SEQ ID NO: 540834 - protein, 19 aa, Mycobacterium
PGYAGSRPVRVGNAANSQV

SEQ ID NO: 540835 - protein, 21 aa, Mycobacterium
PGYAGYQKNTDRDIPVIICVP

SEQ ID NO: 540836 - protein, 6 aa, Mycobacterium
PGYAPA

SEQ ID NO: 540837 - protein, 8 aa, Mycobacterium
PGYAPGQK

SEQ ID NO: 540838 - protein, 5 aa, Mycobacterium
PGYDA

SEQ ID NO: 540839 - protein, 6 aa, Mycobacterium
PGYDAP

SEQ ID NO: 540840 - protein, 13 aa, Mycobacterium
PGYDGPHGSVSER

SEQ ID NO: 540841 - protein, 12 aa, Mycobacterium
PGYDGYQRNTDR

SEQ ID NO: 540842 - protein, 7 aa, Mycobacterium
PGYDPAR

SEQ ID NO: 540843 - protein, 8 aa, Mycobacterium
PGYDPRRH

SEQ ID NO: 540844 - protein, 10 aa, Mycobacterium
PGYDPSTYDR

SEQ ID NO: 540845 - protein, 10 aa, Mycobacterium
PGYDTNPTAT

SEQ ID NO: 540846 - protein, 4 aa, Mycobacterium
PGYE

SEQ ID NO: 540847 - protein, 9 aa, Mycobacterium
PGYEEQRAA

SEQ ID NO: 540848 - protein, 17 aa, Mycobacterium
PGYEHPGDPRQPDNTHR

SEQ ID NO: 540849 - protein, 4 aa, Mycobacterium
PGYG

SEQ ID NO: 540850 - protein, 12 aa, Mycobacterium
PGYGGRGLDSSL

SEQ ID NO: 540851 - protein, 6 aa, Mycobacterium
PGYGGS

SEQ ID NO: 540852 - protein, 5 aa, Mycobacterium
PGYGP

SEQ ID NO: 540853 - protein, 15 aa, Mycobacterium
PGYGRSAKSVDHTDP

SEQ ID NO: 540854 - protein, 16 aa, Mycobacterium
PGYGRSSKGVDQSDPF

SEQ ID NO: 540855 - protein, 4 aa, Mycobacterium
PGYH

SEQ ID NO: 540856 - protein, 5 aa, Mycobacterium
PGYKG

SEQ ID NO: 540857 - protein, 17 aa, Mycobacterium
PGYKGPDVYSRGAAPER

SEQ ID NO: 540858 - protein, 6 aa, Mycobacterium
PGYKPS

SEQ ID NO: 540859 - protein, 10 aa, Mycobacterium
PGYKPSLPGL

SEQ ID NO: 540860 - protein, 15 aa, Mycobacterium
PGYKPTTKPHNRQIR

SEQ ID NO: 540861 - protein, 4 aa, Mycobacterium
PGYL

SEQ ID NO: 540862 - protein, 5 aa, Mycobacterium
PGYLP

SEQ ID NO: 540863 - protein, 5 aa, Mycobacterium
PGYPA

SEQ ID NO: 540864 - protein, 7 aa, Mycobacterium
PGYPAAR

SEQ ID NO: 540865 - protein, 8 aa, Mycobacterium
PGYPERSA

SEQ ID NO: 540866 - protein, 10 aa, Mycobacterium
PGYPGGADKI

SEQ ID NO: 540867 - protein, 11 aa, Mycobacterium
PGYPGGTDKVG

SEQ ID NO: 540868 - protein, 6 aa, Mycobacterium
PGYPRA

SEQ ID NO: 540869 - protein, 6 aa, Mycobacterium
PGYPSR

SEQ ID NO: 540870 - protein, 5 aa, Mycobacterium
PGYQG

SEQ ID NO: 540871 - protein, 15 aa, Mycobacterium
PGYQGESGEQPRPTT

SEQ ID NO: 540872 - protein, 9 aa, Mycobacterium
PGYQSASSL

SEQ ID NO: 540873 - protein, 10 aa, Mycobacterium
PGYRGADEDL

SEQ ID NO: 540874 - protein, 6 aa, Mycobacterium
PGYRIE

SEQ ID NO: 540875 - protein, 8 aa, Mycobacterium
PGYRQSAE

SEQ ID NO: 540876 - protein, 6 aa, Mycobacterium
PGYRTG

SEQ ID NO: 540877 - protein, 5 aa, Mycobacterium
PGYSA

SEQ ID NO: 540878 - protein, 7 aa, Mycobacterium
PGYSDDE

SEQ ID NO: 540879 - protein, 20 aa, Mycobacterium
PGYTGSFGPIPGGGKPPNFE

SEQ ID NO: 540880 - protein, 4 aa, Mycobacterium
PHAA

SEQ ID NO: 540881 - protein, 9 aa, Mycobacterium
PHAASDALG

SEQ ID NO: 540882 - protein, 7 aa, Mycobacterium
PHADPDT

SEQ ID NO: 540883 - protein, 7 aa, Mycobacterium
PHADTDT

SEQ ID NO: 540884 - protein, 16 aa, Mycobacterium
PHAELGPADPRGSPRL

SEQ ID NO: 540885 - protein, 7 aa, Mycobacterium
PHAFSDD

SEQ ID NO: 540886 - protein, 5 aa, Mycobacterium
PHAGA

SEQ ID NO: 540887 - protein, 6 aa, Mycobacterium
PHAGPV

SEQ ID NO: 540888 - protein, 6 aa, Mycobacterium
PHAGSW

SEQ ID NO: 540889 - protein, 11 aa, Mycobacterium
PHAKAAEVAAR

SEQ ID NO: 540890 - protein, 7 aa, Mycobacterium
PHANDDL

SEQ ID NO: 540891 - protein, 4 aa, Mycobacterium
PHAP

SEQ ID NO: 540892 - protein, 7 aa, Mycobacterium
PHAPDTH

SEQ ID NO: 540893 - protein, 9 aa, Mycobacterium
PHAPDTHPA

SEQ ID NO: 540894 - protein, 10 aa, Mycobacterium
PHAPDTYSPL

SEQ ID NO: 540895 - protein, 6 aa, Mycobacterium
PHAPEL

SEQ ID NO: 540896 - protein, 7 aa, Mycobacterium
PHAPELP

SEQ ID NO: 540897 - protein, 9 aa, Mycobacterium
PHAPKGAQW

SEQ ID NO: 540898 - protein, 24 aa, Mycobacterium
PHAPPAAKAAQLKPPRAPRGGPLQ

SEQ ID NO: 540899 - protein, 11 aa, Mycobacterium
PHAPRAVDADT

SEQ ID NO: 540900 - protein, 8 aa, Mycobacterium
PHAPTGLG

SEQ ID NO: 540901 - protein, 7 aa, Mycobacterium
PHAQHER

SEQ ID NO: 540902 - protein, 4 aa, Mycobacterium
PHAR

SEQ ID NO: 540903 - protein, 10 aa, Mycobacterium
PHARDGVPAL

SEQ ID NO: 540904 - protein, 7 aa, Mycobacterium
PHARNAL

SEQ ID NO: 540905 - protein, 8 aa, Mycobacterium
PHARTAWS

SEQ ID NO: 540906 - protein, 8 aa, Mycobacterium
PHASEAAT

SEQ ID NO: 540907 - protein, 7 aa, Mycobacterium
PHASEGV

SEQ ID NO: 540908 - protein, 6 aa, Mycobacterium
PHASPR

SEQ ID NO: 540909 - protein, 5 aa, Mycobacterium
PHASQ

SEQ ID NO: 540910 - protein, 6 aa, Mycobacterium
PHASTS

SEQ ID NO: 540911 - protein, 4 aa, Mycobacterium
PHAT

SEQ ID NO: 540912 - protein, 11 aa, Mycobacterium
PHATPAPPLVK

SEQ ID NO: 540913 - protein, 6 aa, Mycobacterium
PHDAPG

SEQ ID NO: 540914 - protein, 7 aa, Mycobacterium
PHDATTV

SEQ ID NO: 540915 - protein, 10 aa, Mycobacterium
PHDDDAPGNW

SEQ ID NO: 540916 - protein, 5 aa, Mycobacterium
PHDDG

SEQ ID NO: 540917 - protein, 7 aa, Mycobacterium
PHDDGPG

SEQ ID NO: 540918 - protein, 9 aa, Mycobacterium
PHDDSSLGA

SEQ ID NO: 540919 - protein, 5 aa, Mycobacterium
PHDEA

SEQ ID NO: 540920 - protein, 30 aa, Mycobacterium
PHDESPVVDGPAPEAAAQPDSRSQSQRNHD

SEQ ID NO: 540921 - protein, 30 aa, Mycobacterium
PHDESPVVDGPAPEAAAQRDSRSQSQRNHD

SEQ ID NO: 540922 - protein, 5 aa, Mycobacterium
PHDFP

SEQ ID NO: 540923 - protein, 6 aa, Mycobacterium
PHDKER

SEQ ID NO: 540924 - protein, 18 aa, Mycobacterium
PHDLANTDAAWAGGDARR

SEQ ID NO: 540925 - protein, 12 aa, Mycobacterium
PHDLPDAERGPL

SEQ ID NO: 540926 - protein, 12 aa, Mycobacterium
PHDPAGDQPAAI

SEQ ID NO: 540927 - protein, 5 aa, Mycobacterium
PHDPE

SEQ ID NO: 540928 - protein, 6 aa, Mycobacterium
PHDPGR

SEQ ID NO: 540929 - protein, 6 aa, Mycobacterium
PHDPPW

SEQ ID NO: 540930 - protein, 11 aa, Mycobacterium
PHDPRAGHRCN

SEQ ID NO: 540931 - protein, 4 aa, Mycobacterium
PHDR

SEQ ID NO: 540932 - protein, 10 aa, Mycobacterium
PHDRDEKGRV

SEQ ID NO: 540933 - protein, 10 aa, Mycobacterium
PHDRPPRRYR

SEQ ID NO: 540934 - protein, 6 aa, Mycobacterium
PHDSAA

SEQ ID NO: 540935 - protein, 7 aa, Mycobacterium
PHDTPAV

SEQ ID NO: 540936 - protein, 12 aa, Mycobacterium
PHDVGGEPDAPI

SEQ ID NO: 540937 - protein, 11 aa, Mycobacterium
PHDVRGGTGMD

SEQ ID NO: 540938 - protein, 19 aa, Mycobacterium
PHDVRSGPGMDVPPHPHTG

SEQ ID NO: 540939 - protein, 5 aa, Mycobacterium
PHEAT

SEQ ID NO: 540940 - protein, 6 aa, Mycobacterium
PHEDED

SEQ ID NO: 540941 - protein, 8 aa, Mycobacterium
PHEDSDAA

SEQ ID NO: 540942 - protein, 10 aa, Mycobacterium
PHEDSDAAAA

SEQ ID NO: 540943 - protein, 17 aa, Mycobacterium
PHEELDRDARPGLPGED

SEQ ID NO: 540944 - protein, 5 aa, Mycobacterium
PHEET

SEQ ID NO: 540945 - protein, 10 aa, Mycobacterium
PHELSGGQRQ

SEQ ID NO: 540946 - protein, 4 aa, Mycobacterium
PHEN

SEQ ID NO: 540947 - protein, 4 aa, Mycobacterium
PHEP

SEQ ID NO: 540948 - protein, 7 aa, Mycobacterium
PHEPTTA

SEQ ID NO: 540949 - protein, 6 aa, Mycobacterium
PHERRG

SEQ ID NO: 540950 - protein, 9 aa, Mycobacterium
PHERSAAGF

SEQ ID NO: 540951 - protein, 10 aa, Mycobacterium
PHESGAALRA

SEQ ID NO: 540952 - protein, 6 aa, Mycobacterium
PHESPV

SEQ ID NO: 540953 - protein, 13 aa, Mycobacterium
PHGADPATGQPTT

SEQ ID NO: 540954 - protein, 18 aa, Mycobacterium
PHGAGTRLTESRHAENGV

SEQ ID NO: 540955 - protein, 10 aa, Mycobacterium
PHGDARELGE

SEQ ID NO: 540956 - protein, 7 aa, Mycobacterium
PHGDGPF

SEQ ID NO: 540957 - protein, 6 aa, Mycobacterium
PHGDRA

SEQ ID NO: 540958 - protein, 13 aa, Mycobacterium
PHGDRDPRTLTPD

SEQ ID NO: 540959 - protein, 15 aa, Mycobacterium
PHGDVDTSTPPGLRS

SEQ ID NO: 540960 - protein, 7 aa, Mycobacterium
PHGEEGR

SEQ ID NO: 540961 - protein, 6 aa, Mycobacterium
PHGEGL

SEQ ID NO: 540962 - protein, 7 aa, Mycobacterium
PHGEGLA

SEQ ID NO: 540963 - protein, 7 aa, Mycobacterium
PHGEGLE

SEQ ID NO: 540964 - protein, 9 aa, Mycobacterium
PHGEGLESP

SEQ ID NO: 540965 - protein, 4 aa, Mycobacterium
PHGG

SEQ ID NO: 540966 - protein, 7 aa, Mycobacterium
PHGGDAT

SEQ ID NO: 540967 - protein, 7 aa, Mycobacterium
PHGGDTT

SEQ ID NO: 540968 - protein, 5 aa, Mycobacterium
PHGGE

SEQ ID NO: 540969 - protein, 16 aa, Mycobacterium
PHGGGMGPMPGMPAGG

SEQ ID NO: 540970 - protein, 14 aa, Mycobacterium
PHGGPSIWPMWRDP

SEQ ID NO: 540971 - protein, 4 aa, Mycobacterium
PHGI

SEQ ID NO: 540972 - protein, 5 aa, Mycobacterium
PHGNG

SEQ ID NO: 540973 - protein, 8 aa, Mycobacterium
PHGNPQQL

SEQ ID NO: 540974 - protein, 11 aa, Mycobacterium
PHGNPRDPVTN

SEQ ID NO: 540975 - protein, 4 aa, Mycobacterium
PHGP

SEQ ID NO: 540976 - protein, 6 aa, Mycobacterium
PHGPHV

SEQ ID NO: 540977 - protein, 6 aa, Mycobacterium
PHGPIS

SEQ ID NO: 540978 - protein, 13 aa, Mycobacterium
PHGPLTQDPDAKR

SEQ ID NO: 540979 - protein, 8 aa, Mycobacterium
PHGQTEVS

SEQ ID NO: 540980 - protein, 13 aa, Mycobacterium
PHGRDQVQQNAEI

SEQ ID NO: 540981 - protein, 10 aa, Mycobacterium
PHGRDQVTGK

SEQ ID NO: 540982 - protein, 5 aa, Mycobacterium
PHGSY

SEQ ID NO: 540983 - protein, 4 aa, Mycobacterium
PHGT

SEQ ID NO: 540984 - protein, 9 aa, Mycobacterium
PHGTEDQRA

SEQ ID NO: 540985 - protein, 8 aa, Mycobacterium
PHGTGKTA

SEQ ID NO: 540986 - protein, 10 aa, Mycobacterium
PHGTPEEPKG

SEQ ID NO: 540987 - protein, 5 aa, Mycobacterium
PHGTT

SEQ ID NO: 540988 - protein, 9 aa, Mycobacterium
PHGVEGPVA

SEQ ID NO: 540989 - protein, 11 aa, Mycobacterium
PHGVPASGEYR

SEQ ID NO: 540990 - protein, 5 aa, Mycobacterium
PHGYH

SEQ ID NO: 540991 - protein, 16 aa, Mycobacterium
PHHAEGQAVDQVRNGN

SEQ ID NO: 540992 - protein, 22 aa, Mycobacterium
PHHDSEYQQQKDEQARAKLEDE

SEQ ID NO: 540993 - protein, 4 aa, Mycobacterium
PHHP

SEQ ID NO: 540994 - protein, 17 aa, Mycobacterium
PHHRGGQEIPLGGRDAG

SEQ ID NO: 540995 - protein, 5 aa, Mycobacterium
PHHRP

SEQ ID NO: 540996 - protein, 18 aa, Mycobacterium
PHIDTGSTPTGAAGRPQL

SEQ ID NO: 540997 - protein, 4 aa, Mycobacterium
PHIP

SEQ ID NO: 540998 - protein, 7 aa, Mycobacterium
PHIPNPD

SEQ ID NO: 540999 - protein, 15 aa, Mycobacterium
PHITPPSFPNAGGGL

SEQ ID NO: 541000 - protein, 11 aa, Mycobacterium
PHKGSTPIAEK

SEQ ID NO: 541001 - protein, 15 aa, Mycobacterium
PHKKSRTYSKGNRQK

SEQ ID NO: 541002 - protein, 10 aa, Mycobacterium
PHKPAPSAGW

SEQ ID NO: 541003 - protein, 6 aa, Mycobacterium
PHKRNA

SEQ ID NO: 541004 - protein, 8 aa, Mycobacterium
PHKTSSRR

SEQ ID NO: 541005 - protein, 19 aa, Mycobacterium
PHKTSSRRVEVRSPDSACN

SEQ ID NO: 541006 - protein, 4 aa, Mycobacterium
PHLD

SEQ ID NO: 541007 - protein, 4 aa, Mycobacterium
PHLE

SEQ ID NO: 541008 - protein, 7 aa, Mycobacterium
PHLEDSS

SEQ ID NO: 541009 - protein, 5 aa, Mycobacterium
PHLGE

SEQ ID NO: 541010 - protein, 4 aa, Mycobacterium
PHLK

SEQ ID NO: 541011 - protein, 11 aa, Mycobacterium
PHLRPEADETA

SEQ ID NO: 541012 - protein, 4 aa, Mycobacterium
PHLT

SEQ ID NO: 541013 - protein, 31 aa, Mycobacterium
PHMNPGSSIIGSSSVNSDTPNPTLAPYAATK

SEQ ID NO: 541014 - protein, 4 aa, Mycobacterium
PHND

SEQ ID NO: 541015 - protein, 7 aa, Mycobacterium
PHNPDSV

SEQ ID NO: 541016 - protein, 11 aa, Mycobacterium
PHNPRSNPLGD

SEQ ID NO: 541017 - protein, 6 aa, Mycobacterium
PHNPTG

SEQ ID NO: 541018 - protein, 7 aa, Mycobacterium
PHNPTGA

SEQ ID NO: 541019 - protein, 5 aa, Mycobacterium
PHNSG

SEQ ID NO: 541020 - protein, 4 aa, Mycobacterium
PHNT

SEQ ID NO: 541021 - protein, 7 aa, Mycobacterium
PHNTEPL

SEQ ID NO: 541022 - protein, 12 aa, Mycobacterium
PHNTSTKIPEGS

SEQ ID NO: 541023 - protein, 6 aa, Mycobacterium
PHPAEF

SEQ ID NO: 541024 - protein, 10 aa, Mycobacterium
PHPAGALPDR

SEQ ID NO: 541025 - protein, 17 aa, Mycobacterium
PHPALGDAGHQRHQGGD

SEQ ID NO: 541026 - protein, 6 aa, Mycobacterium
PHPARP

SEQ ID NO: 541027 - protein, 7 aa, Mycobacterium
PHPARPE

SEQ ID NO: 541028 - protein, 4 aa, Mycobacterium
PHPD

SEQ ID NO: 541029 - protein, 9 aa, Mycobacterium
PHPDDPSVT

SEQ ID NO: 541030 - protein, 8 aa, Mycobacterium
PHPDGDPN

SEQ ID NO: 541031 - protein, 8 aa, Mycobacterium
PHPDGTTV

SEQ ID NO: 541032 - protein, 5 aa, Mycobacterium
PHPDS

SEQ ID NO: 541033 - protein, 16 aa, Mycobacterium
PHPEAGPQRAPTPGVH

SEQ ID NO: 541034 - protein, 5 aa, Mycobacterium
PHPEF

SEQ ID NO: 541035 - protein, 7 aa, Mycobacterium
PHPEGGW

SEQ ID NO: 541036 - protein, 7 aa, Mycobacterium
PHPEGIG

SEQ ID NO: 541037 - protein, 10 aa, Mycobacterium
PHPEGLAEPK

SEQ ID NO: 541038 - protein, 7 aa, Mycobacterium
PHPEQRV

SEQ ID NO: 541039 - protein, 6 aa, Mycobacterium
PHPGAD

SEQ ID NO: 541040 - protein, 7 aa, Mycobacterium
PHPGDDD

SEQ ID NO: 541041 - protein, 7 aa, Mycobacterium
PHPGDDR

SEQ ID NO: 541042 - protein, 7 aa, Mycobacterium
PHPGEDV

SEQ ID NO: 541043 - protein, 15 aa, Mycobacterium
PHPGESPESGPGDPV

SEQ ID NO: 541044 - protein, 16 aa, Mycobacterium
PHPGESPGSGPGDPVA

SEQ ID NO: 541045 - protein, 7 aa, Mycobacterium
PHPGGDA

SEQ ID NO: 541046 - protein, 5 aa, Mycobacterium
PHPGR

SEQ ID NO: 541047 - protein, 21 aa, Mycobacterium
PHPGTAPGAHETEGAGPGDPV

SEQ ID NO: 541048 - protein, 8 aa, Mycobacterium
PHPIENPK

SEQ ID NO: 541049 - protein, 13 aa, Mycobacterium
PHPLETSASSTKW

SEQ ID NO: 541050 - protein, 6 aa, Mycobacterium
PHPLTG

SEQ ID NO: 541051 - protein, 8 aa, Mycobacterium
PHPMPSTA

SEQ ID NO: 541052 - protein, 6 aa, Mycobacterium
PHPPAG

SEQ ID NO: 541053 - protein, 15 aa, Mycobacterium
PHPPAGGFSPGGHNG

SEQ ID NO: 541054 - protein, 45 aa, Mycobacterium
PHPPIPPPPSPPPGKPPLGQPPIPPWASPPPPPSLQATRDAYNKL

SEQ ID NO: 541055 - protein, 12 aa, Mycobacterium
PHPPQGNPLGED

SEQ ID NO: 541056 - protein, 20 aa, Mycobacterium
PHPPRDAREFPTSTGKANFS

SEQ ID NO: 541057 - protein, 21 aa, Mycobacterium
PHPPRDDRQFPTHTGKANFSA

SEQ ID NO: 541058 - protein, 19 aa, Mycobacterium
PHPPRDSREFHTATGKANF

SEQ ID NO: 541059 - protein, 17 aa, Mycobacterium
PHPPRDSREFPTHTGKA

SEQ ID NO: 541060 - protein, 18 aa, Mycobacterium
PHPPRDTREFHTSTGRAN

SEQ ID NO: 541061 - protein, 6 aa, Mycobacterium
PHPPRR

SEQ ID NO: 541062 - protein, 7 aa, Mycobacterium
PHPQHRQ

SEQ ID NO: 541063 - protein, 8 aa, Mycobacterium
PHPRDEKG

SEQ ID NO: 541064 - protein, 7 aa, Mycobacterium
PHPRPIP

SEQ ID NO: 541065 - protein, 10 aa, Mycobacterium
PHPSAHHRQQ

SEQ ID NO: 541066 - protein, 8 aa, Mycobacterium
PHPSGDPN

SEQ ID NO: 541067 - protein, 21 aa, Mycobacterium
PHPSIPHAPDAEAQRDTAQRF

SEQ ID NO: 541068 - protein, 24 aa, Mycobacterium
PHPSPPRPSRGTRSRGRSDRRRAP

SEQ ID NO: 541069 - protein, 7 aa, Mycobacterium
PHPTETV

SEQ ID NO: 541070 - protein, 5 aa, Mycobacterium
PHPTI

SEQ ID NO: 541071 - protein, 17 aa, Mycobacterium
PHPTIESASTQAERDEM

SEQ ID NO: 541072 - protein, 7 aa, Mycobacterium
PHPTIPK

SEQ ID NO: 541073 - protein, 7 aa, Mycobacterium
PHPTLGQ

SEQ ID NO: 541074 - protein, 9 aa, Mycobacterium
PHPTREQEN

SEQ ID NO: 541075 - protein, 6 aa, Mycobacterium
PHPTSR

SEQ ID NO: 541076 - protein, 7 aa, Mycobacterium
PHPTSRR

SEQ ID NO: 541077 - protein, 6 aa, Mycobacterium
PHPVGG

SEQ ID NO: 541078 - protein, 4 aa, Mycobacterium
PHQA

SEQ ID NO: 541079 - protein, 10 aa, Mycobacterium
PHQAHDTPTI

SEQ ID NO: 541080 - protein, 6 aa, Mycobacterium
PHQARE

SEQ ID NO: 541081 - protein, 13 aa, Mycobacterium
PHQENDYIMVREL

SEQ ID NO: 541082 - protein, 5 aa, Mycobacterium
PHQGE

SEQ ID NO: 541083 - protein, 8 aa, Mycobacterium
PHQGTEGP

SEQ ID NO: 541084 - protein, 4 aa, Mycobacterium
PHQI

SEQ ID NO: 541085 - protein, 15 aa, Mycobacterium
PHQPSDDATPLPDPF

SEQ ID NO: 541086 - protein, 8 aa, Mycobacterium
PHQPTPTL

SEQ ID NO: 541087 - protein, 9 aa, Mycobacterium
PHQRDEKGR

SEQ ID NO: 541088 - protein, 11 aa, Mycobacterium
PHQRGPYGTTE

SEQ ID NO: 541089 - protein, 7 aa, Mycobacterium
PHQSGTA

SEQ ID NO: 541090 - protein, 22 aa, Mycobacterium
PHQTKRSAGLPPTSHSARDDAV

SEQ ID NO: 541091 - protein, 5 aa, Mycobacterium
PHRAD

SEQ ID NO: 541092 - protein, 10 aa, Mycobacterium
PHRARPESLD

SEQ ID NO: 541093 - protein, 14 aa, Mycobacterium
PHRDGAIPKGTVAA

SEQ ID NO: 541094 - protein, 9 aa, Mycobacterium
PHRDGGQRQ

SEQ ID NO: 541095 - protein, 34 aa, Mycobacterium
PHREPMGDEEPVERKRTEPGEEEKGFESLSASAE

SEQ ID NO: 541096 - protein, 15 aa, Mycobacterium
PHRGGRLRSGTTVNA

SEQ ID NO: 541097 - protein, 21 aa, Mycobacterium
PHRGIPQAPPGPERDATAERF

SEQ ID NO: 541098 - protein, 14 aa, Mycobacterium
PHRGNEPMTEKPSW

SEQ ID NO: 541099 - protein, 7 aa, Mycobacterium
PHRGPRA

SEQ ID NO: 541100 - protein, 9 aa, Mycobacterium
PHRGSGHDR

SEQ ID NO: 541101 - protein, 9 aa, Mycobacterium
PHRGSNHDR

SEQ ID NO: 541102 - protein, 10 aa, Mycobacterium
PHRGSSDARV

SEQ ID NO: 541103 - protein, 8 aa, Mycobacterium
PHRGSSLD

SEQ ID NO: 541104 - protein, 4 aa, Mycobacterium
PHRI

SEQ ID NO: 541105 - protein, 5 aa, Mycobacterium
PHRPG

SEQ ID NO: 541106 - protein, 8 aa, Mycobacterium
PHRPPPAE

SEQ ID NO: 541107 - protein, 10 aa, Mycobacterium
PHRPRPENLD

SEQ ID NO: 541108 - protein, 10 aa, Mycobacterium
PHRPRPENVD

SEQ ID NO: 541109 - protein, 10 aa, Mycobacterium
PHRPRPTDLE

SEQ ID NO: 541110 - protein, 4 aa, Mycobacterium
PHRQ

SEQ ID NO: 541111 - protein, 6 aa, Mycobacterium
PHRQPE

SEQ ID NO: 541112 - protein, 6 aa, Mycobacterium
PHRQTE

SEQ ID NO: 541113 - protein, 8 aa, Mycobacterium
PHRQTEIP

SEQ ID NO: 541114 - protein, 4 aa, Mycobacterium
PHRR

SEQ ID NO: 541115 - protein, 23 aa, Mycobacterium
PHRRGAGARGADGRRPGALPGRL

SEQ ID NO: 541116 - protein, 8 aa, Mycobacterium
PHRRTQRT

SEQ ID NO: 541117 - protein, 7 aa, Mycobacterium
PHRSESG

SEQ ID NO: 541118 - protein, 9 aa, Mycobacterium
PHRSTAAEL

SEQ ID NO: 541119 - protein, 5 aa, Mycobacterium
PHRVP

SEQ ID NO: 541120 - protein, 5 aa, Mycobacterium
PHRYS

SEQ ID NO: 541121 - protein, 9 aa, Mycobacterium
PHRYSQRDI

SEQ ID NO: 541122 - protein, 9 aa, Mycobacterium
PHRYSQSEI

SEQ ID NO: 541123 - protein, 7 aa, Mycobacterium
PHSAPGV

SEQ ID NO: 541124 - protein, 12 aa, Mycobacterium
PHSATPDPAPVP

SEQ ID NO: 541125 - protein, 17 aa, Mycobacterium
PHSDNDPTPRVSVTIKD

SEQ ID NO: 541126 - protein, 11 aa, Mycobacterium
PHSDSSWPAAA

SEQ ID NO: 541127 - protein, 7 aa, Mycobacterium
PHSEARS

SEQ ID NO: 541128 - protein, 38 aa, Mycobacterium
PHSEDEGPSAEAERRAAQMRSDEHSVAGAPPGIAMRPF

SEQ ID NO: 541129 - protein, 16 aa, Mycobacterium
PHSERRQAWEGFFLAT

SEQ ID NO: 541130 - protein, 14 aa, Mycobacterium
PHSGAATAEISSTG

SEQ ID NO: 541131 - protein, 69 aa, Mycobacterium
PHSGGGGIAVPAGRDKKALDDSGSPDGGSSDGGENGVQGAGSNQHGPGHRNGLGRPGDDTDNPLPPPAV

SEQ ID NO: 541132 - protein, 68 aa, Mycobacterium
PHSGGGGIAVPTGKEGSGLGDDNGDPANPNGTGNPQGIGNGHTPRHSGAAKGEDGEPATTGPGSTPAV

SEQ ID NO: 541133 - protein, 9 aa, Mycobacterium
PHSGQHPDV

SEQ ID NO: 541134 - protein, 11 aa, Mycobacterium
PHSHDDGTEHT

SEQ ID NO: 541135 - protein, 17 aa, Mycobacterium
PHSLQSTWGGQAPPPDM

SEQ ID NO: 541136 - protein, 20 aa, Mycobacterium
PHSNRIPGQEEPTDEDPADA

SEQ ID NO: 541137 - protein, 7 aa, Mycobacterium
PHSPATA

SEQ ID NO: 541138 - protein, 15 aa, Mycobacterium
PHSPDTSAASVPKSS

SEQ ID NO: 541139 - protein, 5 aa, Mycobacterium
PHSPE

SEQ ID NO: 541140 - protein, 11 aa, Mycobacterium
PHSPLSNPLGD

SEQ ID NO: 541141 - protein, 7 aa, Mycobacterium
PHSPMAG

SEQ ID NO: 541142 - protein, 6 aa, Mycobacterium
PHSPPE

SEQ ID NO: 541143 - protein, 15 aa, Mycobacterium
PHSPPTDELHSAEDT

SEQ ID NO: 541144 - protein, 6 aa, Mycobacterium
PHSPSV

SEQ ID NO: 541145 - protein, 10 aa, Mycobacterium
PHSRAEHQQA

SEQ ID NO: 541146 - protein, 5 aa, Mycobacterium
PHSRG

SEQ ID NO: 541147 - protein, 16 aa, Mycobacterium
PHSRGLGSSAAAAVGG

SEQ ID NO: 541148 - protein, 11 aa, Mycobacterium
PHSRPPQAELP

SEQ ID NO: 541149 - protein, 17 aa, Mycobacterium
PHSRPPQAELPAEAKAQ

SEQ ID NO: 541150 - protein, 29 aa, Mycobacterium
PHSRPPQAELPPAAKSQIKEAYLRLGLID

SEQ ID NO: 541151 - protein, 14 aa, Mycobacterium
PHSSTDLPYPPAIT

SEQ ID NO: 541152 - protein, 7 aa, Mycobacterium
PHSTERR

SEQ ID NO: 541153 - protein, 5 aa, Mycobacterium
PHSTI

SEQ ID NO: 541154 - protein, 11 aa, Mycobacterium
PHSTPEDLAET

SEQ ID NO: 541155 - protein, 12 aa, Mycobacterium
PHSTPEDLDETA

SEQ ID NO: 541156 - protein, 10 aa, Mycobacterium
PHSTTAAAEL

SEQ ID NO: 541157 - protein, 5 aa, Mycobacterium
PHTAE

SEQ ID NO: 541158 - protein, 18 aa, Mycobacterium
PHTAKGAIDRQAVKLLFA

SEQ ID NO: 541159 - protein, 6 aa, Mycobacterium
PHTAMR

SEQ ID NO: 541160 - protein, 10 aa, Mycobacterium
PHTANGKVDE

SEQ ID NO: 541161 - protein, 10 aa, Mycobacterium
PHTAPRQRHR

SEQ ID NO: 541162 - protein, 12 aa, Mycobacterium
PHTAQSSQAERV

SEQ ID NO: 541163 - protein, 6 aa, Mycobacterium
PHTDDP

SEQ ID NO: 541164 - protein, 9 aa, Mycobacterium
PHTEEPTNW

SEQ ID NO: 541165 - protein, 4 aa, Mycobacterium
PHTF

SEQ ID NO: 541166 - protein, 11 aa, Mycobacterium
PHTGDPAAPAR

SEQ ID NO: 541167 - protein, 14 aa, Mycobacterium
PHTGDTLGKENWNG

SEQ ID NO: 541168 - protein, 7 aa, Mycobacterium
PHTGGQK

SEQ ID NO: 541169 - protein, 16 aa, Mycobacterium
PHTGGQKRVTASGSTL

SEQ ID NO: 541170 - protein, 14 aa, Mycobacterium
PHTGLKHDPEDSSE

SEQ ID NO: 541171 - protein, 9 aa, Mycobacterium
PHTGQHPSV

SEQ ID NO: 541172 - protein, 9 aa, Mycobacterium
PHTGQNADV

SEQ ID NO: 541173 - protein, 5 aa, Mycobacterium
PHTLT

SEQ ID NO: 541174 - protein, 7 aa, Mycobacterium
PHTRPQD

SEQ ID NO: 541175 - protein, 9 aa, Mycobacterium
PHTRTGKKL

SEQ ID NO: 541176 - protein, 10 aa, Mycobacterium
PHTSDAGAAG

SEQ ID NO: 541177 - protein, 13 aa, Mycobacterium
PHTSGLGGTFGGN

SEQ ID NO: 541178 - protein, 6 aa, Mycobacterium
PHTSSG

SEQ ID NO: 541179 - protein, 15 aa, Mycobacterium
PHTTADDPTRYRDQQ

SEQ ID NO: 541180 - protein, 10 aa, Mycobacterium
PHTTPAPPIL

SEQ ID NO: 541181 - protein, 16 aa, Mycobacterium
PHTTSDDPSRYRTQDE

SEQ ID NO: 541182 - protein, 14 aa, Mycobacterium
PHTTSDDPTKYRNA

SEQ ID NO: 541183 - protein, 15 aa, Mycobacterium
PHTTSDDPTRYRPAE

SEQ ID NO: 541184 - protein, 9 aa, Mycobacterium
PHTVDRATT

SEQ ID NO: 541185 - protein, 16 aa, Mycobacterium
PHVADPGRIDSNGRRP

SEQ ID NO: 541186 - protein, 14 aa, Mycobacterium
PHVATPTPAHTPPV

SEQ ID NO: 541187 - protein, 12 aa, Mycobacterium
PHVPNRGKPGRG

SEQ ID NO: 541188 - protein, 13 aa, Mycobacterium
PHVPNRGRPGRGM

SEQ ID NO: 541189 - protein, 12 aa, Mycobacterium
PHVSDAEQSNTS

SEQ ID NO: 541190 - protein, 12 aa, Mycobacterium
PHVSPPSPQRTP

SEQ ID NO: 541191 - protein, 7 aa, Mycobacterium
PHVTDPA

SEQ ID NO: 541192 - protein, 6 aa, Mycobacterium
PHWQPT

SEQ ID NO: 541193 - protein, 4 aa, Mycobacterium
PHYD

SEQ ID NO: 541194 - protein, 11 aa, Mycobacterium
PHYEGTAPYTR

SEQ ID NO: 541195 - protein, 7 aa, Mycobacterium
PHYGEPE

SEQ ID NO: 541196 - protein, 13 aa, Mycobacterium
PHYGGSTARSGGG

SEQ ID NO: 541197 - protein, 6 aa, Mycobacterium
PHYGPP

SEQ ID NO: 541198 - protein, 6 aa, Mycobacterium
PHYPPG

SEQ ID NO: 541199 - protein, 4 aa, Mycobacterium
PIAA

SEQ ID NO: 541200 - protein, 5 aa, Mycobacterium
PIAAG

SEQ ID NO: 541201 - protein, 12 aa, Mycobacterium
PIAATGSDPVSA

SEQ ID NO: 541202 - protein, 9 aa, Mycobacterium
PIADAGREV

SEQ ID NO: 541203 - protein, 12 aa, Mycobacterium
PIADPVSRTQVE

SEQ ID NO: 541204 - protein, 11 aa, Mycobacterium
PIADSTERQAR

SEQ ID NO: 541205 - protein, 7 aa, Mycobacterium
PIAEPAS

SEQ ID NO: 541206 - protein, 7 aa, Mycobacterium
PIAEPGS

SEQ ID NO: 541207 - protein, 6 aa, Mycobacterium
PIAEPT

SEQ ID NO: 541208 - protein, 10 aa, Mycobacterium
PIAETTEAEY

SEQ ID NO: 541209 - protein, 5 aa, Mycobacterium
PIAGP

SEQ ID NO: 541210 - protein, 11 aa, Mycobacterium
PIAGQGAQGGL

SEQ ID NO: 541211 - protein, 21 aa, Mycobacterium
PIAGRSRGPVGPYRPGRQMGA

SEQ ID NO: 541212 - protein, 13 aa, Mycobacterium
PIAGTGGIPGIPG

SEQ ID NO: 541213 - protein, 4 aa, Mycobacterium
PIAP

SEQ ID NO: 541214 - protein, 11 aa, Mycobacterium
PIAPKPVQRPH

SEQ ID NO: 541215 - protein, 14 aa, Mycobacterium
PIAPPGPRPAETTA

SEQ ID NO: 541216 - protein, 10 aa, Mycobacterium
PIAPPSVPPL

SEQ ID NO: 541217 - protein, 7 aa, Mycobacterium
PIARESV

SEQ ID NO: 541218 - protein, 12 aa, Mycobacterium
PIARGSEQARYD

SEQ ID NO: 541219 - protein, 12 aa, Mycobacterium
PIARHGNDEQRQ

SEQ ID NO: 541220 - protein, 5 aa, Mycobacterium
PIARR

SEQ ID NO: 541221 - protein, 11 aa, Mycobacterium
PIATGTPAPRV

SEQ ID NO: 541222 - protein, 18 aa, Mycobacterium
PIATKADNPALPTTPEEI

SEQ ID NO: 541223 - protein, 4 aa, Mycobacterium
PIDA

SEQ ID NO: 541224 - protein, 9 aa, Mycobacterium
PIDAPTSAV

SEQ ID NO: 541225 - protein, 5 aa, Mycobacterium
PIDAT

SEQ ID NO: 541226 - protein, 9 aa, Mycobacterium
PIDATVATR

SEQ ID NO: 541227 - protein, 15 aa, Mycobacterium
PIDDSYANGYANSKW

SEQ ID NO: 541228 - protein, 4 aa, Mycobacterium
PIDE

SEQ ID NO: 541229 - protein, 11 aa, Mycobacterium
PIDESGTVSFN

SEQ ID NO: 541230 - protein, 6 aa, Mycobacterium
PIDESQ

SEQ ID NO: 541231 - protein, 10 aa, Mycobacterium
PIDGADAPIE

SEQ ID NO: 541232 - protein, 6 aa, Mycobacterium
PIDGGT

SEQ ID NO: 541233 - protein, 8 aa, Mycobacterium
PIDGSERR

SEQ ID NO: 541234 - protein, 12 aa, Mycobacterium
PIDKQRKAVTTA

SEQ ID NO: 541235 - protein, 10 aa, Mycobacterium
PIDPAKPNSW

SEQ ID NO: 541236 - protein, 16 aa, Mycobacterium
PIDPDDEGHADYSGPL

SEQ ID NO: 541237 - protein, 15 aa, Mycobacterium
PIDPDDEGMADYSGP

SEQ ID NO: 541238 - protein, 7 aa, Mycobacterium
PIDPNSG

SEQ ID NO: 541239 - protein, 7 aa, Mycobacterium
PIDPPVP

SEQ ID NO: 541240 - protein, 6 aa, Mycobacterium
PIDPQS

SEQ ID NO: 541241 - protein, 5 aa, Mycobacterium
PIDPS

SEQ ID NO: 541242 - protein, 9 aa, Mycobacterium
PIDPSLGES

SEQ ID NO: 541243 - protein, 11 aa, Mycobacterium
PIDPVETGEDD

SEQ ID NO: 541244 - protein, 4 aa, Mycobacterium
PIDR

SEQ ID NO: 541245 - protein, 11 aa, Mycobacterium
PIDRRRASERL

SEQ ID NO: 541246 - protein, 16 aa, Mycobacterium
PIDRTDADSARAALTT

SEQ ID NO: 541247 - protein, 39 aa, Mycobacterium
PIDSASSNGGRKSDSSGGGGSGGGRRGKRGKKGAARTEE

SEQ ID NO: 541248 - protein, 7 aa, Mycobacterium
PIDSGNV

SEQ ID NO: 541249 - protein, 8 aa, Mycobacterium
PIDTGTRL

SEQ ID NO: 541250 - protein, 11 aa, Mycobacterium
PIDTPAAQASA

SEQ ID NO: 541251 - protein, 15 aa, Mycobacterium
PIDTQDYDESAADDP

SEQ ID NO: 541252 - protein, 4 aa, Mycobacterium
PIDY

SEQ ID NO: 541253 - protein, 4 aa, Mycobacterium
PIEA

SEQ ID NO: 541254 - protein, 7 aa, Mycobacterium
PIEAARR

SEQ ID NO: 541255 - protein, 6 aa, Mycobacterium
PIEADG

SEQ ID NO: 541256 - protein, 5 aa, Mycobacterium
PIEAE

SEQ ID NO: 541257 - protein, 141 aa, Mycobacterium
PIEAEERANADEAESDDSDDSDGDDEDDEQTDRPANRRRRRGRRGRGRGRGEQGGPDGQNDSGDDDEPQQRRQKAGRGDADAEDGDDDDSSDYSDSDDSENGDDGSGEGASRRRRRRRRRKSGSGDDGDESSSTDDPPNTV

SEQ ID NO: 541258 - protein, 12 aa, Mycobacterium
PIEASGSPDELG

SEQ ID NO: 541259 - protein, 10 aa, Mycobacterium
PIEDAGREVQ

SEQ ID NO: 541260 - protein, 10 aa, Mycobacterium
PIEDSDKDSL

SEQ ID NO: 541261 - protein, 4 aa, Mycobacterium
PIEE

SEQ ID NO: 541262 - protein, 4 aa, Mycobacterium
PIEG

SEQ ID NO: 541263 - protein, 12 aa, Mycobacterium
PIEGAGARAPEI

SEQ ID NO: 541264 - protein, 12 aa, Mycobacterium
PIEGAGARAPQV

SEQ ID NO: 541265 - protein, 12 aa, Mycobacterium
PIEGAGERAPQV

SEQ ID NO: 541266 - protein, 6 aa, Mycobacterium
PIEGGR

SEQ ID NO: 541267 - protein, 33 aa, Mycobacterium
PIEGQGGDSRPEQPEAGYPSGPGAQSQVEWNGE

SEQ ID NO: 541268 - protein, 12 aa, Mycobacterium
PIEGTGQRAPEI

SEQ ID NO: 541269 - protein, 9 aa, Mycobacterium
PIEKTGDPE

SEQ ID NO: 541270 - protein, 4 aa, Mycobacterium
PIEP

SEQ ID NO: 541271 - protein, 5 aa, Mycobacterium
PIEPG

SEQ ID NO: 541272 - protein, 24 aa, Mycobacterium
PIEPGCPEDQRRTGSCNRRQGPAS

SEQ ID NO: 541273 - protein, 10 aa, Mycobacterium
PIEPPPAASA

SEQ ID NO: 541274 - protein, 7 aa, Mycobacterium
PIEPPTD

SEQ ID NO: 541275 - protein, 8 aa, Mycobacterium
PIEPTLGT

SEQ ID NO: 541276 - protein, 7 aa, Mycobacterium
PIEPTLP

SEQ ID NO: 541277 - protein, 9 aa, Mycobacterium
PIERYGASE

SEQ ID NO: 541278 - protein, 42 aa, Mycobacterium
PIESAPTSAAPAVAPVSTAPAAAASAPAPAPAAGMPAGGMTS

SEQ ID NO: 541279 - protein, 8 aa, Mycobacterium
PIESDAGL

SEQ ID NO: 541280 - protein, 8 aa, Mycobacterium
PIESDEEL

SEQ ID NO: 541281 - protein, 6 aa, Mycobacterium
PIESED

SEQ ID NO: 541282 - protein, 12 aa, Mycobacterium
PIETGDDEDFRT

SEQ ID NO: 541283 - protein, 11 aa, Mycobacterium
PIGAADTRAEY

SEQ ID NO: 541284 - protein, 12 aa, Mycobacterium
PIGAARSAQGQP

SEQ ID NO: 541285 - protein, 8 aa, Mycobacterium
PIGAPERL

SEQ ID NO: 541286 - protein, 5 aa, Mycobacterium
PIGDG

SEQ ID NO: 541287 - protein, 8 aa, Mycobacterium
PIGDGDRP

SEQ ID NO: 541288 - protein, 9 aa, Mycobacterium
PIGDPGQAV

SEQ ID NO: 541289 - protein, 11 aa, Mycobacterium
PIGDPSAEGTL

SEQ ID NO: 541290 - protein, 11 aa, Mycobacterium
PIGDRYDSEDG

SEQ ID NO: 541291 - protein, 16 aa, Mycobacterium
PIGEAQTDAPAGGCPA

SEQ ID NO: 541292 - protein, 19 aa, Mycobacterium
PIGEASLRSEVSQALMPPG

SEQ ID NO: 541293 - protein, 5 aa, Mycobacterium
PIGED

SEQ ID NO: 541294 - protein, 9 aa, Mycobacterium
PIGEDGAAD

SEQ ID NO: 541295 - protein, 11 aa, Mycobacterium
PIGEPAAPSPE

SEQ ID NO: 541296 - protein, 9 aa, Mycobacterium
PIGESGTET

SEQ ID NO: 541297 - protein, 5 aa, Mycobacterium
PIGGA

SEQ ID NO: 541298 - protein, 9 aa, Mycobacterium
PIGGAPGIE

SEQ ID NO: 541299 - protein, 17 aa, Mycobacterium
PIGGESVDGERCMTSSI

SEQ ID NO: 541300 - protein, 8 aa, Mycobacterium
PIGGPGEA

SEQ ID NO: 541301 - protein, 7 aa, Mycobacterium
PIGGTTG

SEQ ID NO: 541302 - protein, 9 aa, Mycobacterium
PIGKGGFND

SEQ ID NO: 541303 - protein, 10 aa, Mycobacterium
PIGNTAADLG

SEQ ID NO: 541304 - protein, 5 aa, Mycobacterium
PIGNV

SEQ ID NO: 541305 - protein, 4 aa, Mycobacterium
PIGP

SEQ ID NO: 541306 - protein, 27 aa, Mycobacterium
PIGPPPGVTPKPLKGMPPFSGPQGPFA

SEQ ID NO: 541307 - protein, 15 aa, Mycobacterium
PIGPRSVYDESKRYA

SEQ ID NO: 541308 - protein, 5 aa, Mycobacterium
PIGPT

SEQ ID NO: 541309 - protein, 10 aa, Mycobacterium
PIGPTDTGTE

SEQ ID NO: 541310 - protein, 15 aa, Mycobacterium
PIGRERKTEELSRAS

SEQ ID NO: 541311 - protein, 43 aa, Mycobacterium
PIGRGPGNFEYKGENHVGGADQKIPGRDGVSPGGGGNGGNGLT

SEQ ID NO: 541312 - protein, 6 aa, Mycobacterium
PIGRGV

SEQ ID NO: 541313 - protein, 12 aa, Mycobacterium
PIGSGGLRPGVD

SEQ ID NO: 541314 - protein, 5 aa, Mycobacterium
PIGSP

SEQ ID NO: 541315 - protein, 9 aa, Mycobacterium
PIGSPGEAV

SEQ ID NO: 541316 - protein, 4 aa, Mycobacterium
PIGT

SEQ ID NO: 541317 - protein, 13 aa, Mycobacterium
PIGTARKGTLRDT

SEQ ID NO: 541318 - protein, 5 aa, Mycobacterium
PIGTP

SEQ ID NO: 541319 - protein, 10 aa, Mycobacterium
PIHGDDDEWE

SEQ ID NO: 541320 - protein, 6 aa, Mycobacterium
PIHGPR

SEQ ID NO: 541321 - protein, 4 aa, Mycobacterium
PIKG

SEQ ID NO: 541322 - protein, 6 aa, Mycobacterium
PIKTAR

SEQ ID NO: 541323 - protein, 9 aa, Mycobacterium
PIKTTPHDA

SEQ ID NO: 541324 - protein, 4 aa, Mycobacterium
PILG

SEQ ID NO: 541325 - protein, 14 aa, Mycobacterium
PINDGYANGYGNAK

SEQ ID NO: 541326 - protein, 8 aa, Mycobacterium
PINPSGGL

SEQ ID NO: 541327 - protein, 19 aa, Mycobacterium
PINPSGGLKAKGHPPGATG

SEQ ID NO: 541328 - protein, 7 aa, Mycobacterium
PIPADQE

SEQ ID NO: 541329 - protein, 10 aa, Mycobacterium
PIPADQEQLA

SEQ ID NO: 541330 - protein, 14 aa, Mycobacterium
PIPAGTTRTAAWTP

SEQ ID NO: 541331 - protein, 12 aa, Mycobacterium
PIPAPEVRARFL

SEQ ID NO: 541332 - protein, 5 aa, Mycobacterium
PIPAR

SEQ ID NO: 541333 - protein, 5 aa, Mycobacterium
PIPAT

SEQ ID NO: 541334 - protein, 13 aa, Mycobacterium
PIPDARRAGPSTL

SEQ ID NO: 541335 - protein, 6 aa, Mycobacterium
PIPDKG

SEQ ID NO: 541336 - protein, 13 aa, Mycobacterium
PIPDPDRAGPSTL

SEQ ID NO: 541337 - protein, 13 aa, Mycobacterium
PIPDPDRAGPSTM

SEQ ID NO: 541338 - protein, 9 aa, Mycobacterium
PIPDTGSLR

SEQ ID NO: 541339 - protein, 5 aa, Mycobacterium
PIPEA

SEQ ID NO: 541340 - protein, 10 aa, Mycobacterium
PIPEATNSAI

SEQ ID NO: 541341 - protein, 7 aa, Mycobacterium
PIPEGKN

SEQ ID NO: 541342 - protein, 7 aa, Mycobacterium
PIPEGQP

SEQ ID NO: 541343 - protein, 17 aa, Mycobacterium
PIPEGVPPPAGDPVPAI

SEQ ID NO: 541344 - protein, 8 aa, Mycobacterium
PIPEIGDG

SEQ ID NO: 541345 - protein, 7 aa, Mycobacterium
PIPERGD

SEQ ID NO: 541346 - protein, 7 aa, Mycobacterium
PIPERPG

SEQ ID NO: 541347 - protein, 18 aa, Mycobacterium
PIPERTSHSDATADGASC

SEQ ID NO: 541348 - protein, 12 aa, Mycobacterium
PIPESDAPRDEY

SEQ ID NO: 541349 - protein, 7 aa, Mycobacterium
PIPGAAE

SEQ ID NO: 541350 - protein, 16 aa, Mycobacterium
PIPGGDDDQSARERAT

SEQ ID NO: 541351 - protein, 9 aa, Mycobacterium
PIPGGEPED

SEQ ID NO: 541352 - protein, 7 aa, Mycobacterium
PIPGNDA

SEQ ID NO: 541353 - protein, 12 aa, Mycobacterium
PIPGPYTQDSRE

SEQ ID NO: 541354 - protein, 6 aa, Mycobacterium
PIPGTK

SEQ ID NO: 541355 - protein, 15 aa, Mycobacterium
PIPGTRRASRVQENV

SEQ ID NO: 541356 - protein, 14 aa, Mycobacterium
PIPGTTKVSRVNEN

SEQ ID NO: 541357 - protein, 4 aa, Mycobacterium
PIPI

SEQ ID NO: 541358 - protein, 30 aa, Mycobacterium
PIPITPATAAKDEGKAPDVTAAHPRAPAAS

SEQ ID NO: 541359 - protein, 4 aa, Mycobacterium
PIPL

SEQ ID NO: 541360 - protein, 6 aa, Mycobacterium
PIPNEK

SEQ ID NO: 541361 - protein, 28 aa, Mycobacterium
PIPPDPPAPPAPNHPAAPPLPPLPPLPP

SEQ ID NO: 541362 - protein, 9 aa, Mycobacterium
PIPPDREAL

SEQ ID NO: 541363 - protein, 7 aa, Mycobacterium
PIPPEQA

SEQ ID NO: 541364 - protein, 6 aa, Mycobacterium
PIPPGS

SEQ ID NO: 541365 - protein, 16 aa, Mycobacterium
PIPPNEPNIREDESDR

SEQ ID NO: 541366 - protein, 14 aa, Mycobacterium
PIPPNTPNIREDEA

SEQ ID NO: 541367 - protein, 15 aa, Mycobacterium
PIPPNTPNIREDESD

SEQ ID NO: 541368 - protein, 7 aa, Mycobacterium
PIPPPLR

SEQ ID NO: 541369 - protein, 7 aa, Mycobacterium
PIPPQSL

SEQ ID NO: 541370 - protein, 9 aa, Mycobacterium
PIPPTDLPD

SEQ ID NO: 541371 - protein, 13 aa, Mycobacterium
PIPPYAPDPEVAP

SEQ ID NO: 541372 - protein, 6 aa, Mycobacterium
PIPQEA

SEQ ID NO: 541373 - protein, 6 aa, Mycobacterium
PIPQGT

SEQ ID NO: 541374 - protein, 10 aa, Mycobacterium
PIPQTAGDVT

SEQ ID NO: 541375 - protein, 10 aa, Mycobacterium
PIPRADPTVW

SEQ ID NO: 541376 - protein, 8 aa, Mycobacterium
PIPRPPSI

SEQ ID NO: 541377 - protein, 13 aa, Mycobacterium
PIPRPSPAVTATS

SEQ ID NO: 541378 - protein, 5 aa, Mycobacterium
PIPRR

SEQ ID NO: 541379 - protein, 18 aa, Mycobacterium
PIPRRRDRPRGRPPQETA

SEQ ID NO: 541380 - protein, 4 aa, Mycobacterium
PIPS

SEQ ID NO: 541381 - protein, 10 aa, Mycobacterium
PIPSAEPRRR

SEQ ID NO: 541382 - protein, 5 aa, Mycobacterium
PIPSG

SEQ ID NO: 541383 - protein, 12 aa, Mycobacterium
PIPSQAQADTWA

SEQ ID NO: 541384 - protein, 4 aa, Mycobacterium
PIPT

SEQ ID NO: 541385 - protein, 9 aa, Mycobacterium
PIPTADSGR

SEQ ID NO: 541386 - protein, 15 aa, Mycobacterium
PIPTDGYDEAAADDP

SEQ ID NO: 541387 - protein, 7 aa, Mycobacterium
PIPTFTG

SEQ ID NO: 541388 - protein, 9 aa, Mycobacterium
PIPTPDSPR

SEQ ID NO: 541389 - protein, 9 aa, Mycobacterium
PIPTPDSPT

SEQ ID NO: 541390 - protein, 8 aa, Mycobacterium
PIPTPPSG

SEQ ID NO: 541391 - protein, 13 aa, Mycobacterium
PIPVGADGSLPAD

SEQ ID NO: 541392 - protein, 6 aa, Mycobacterium
PIPVGS

SEQ ID NO: 541393 - protein, 10 aa, Mycobacterium
PIPVGTQGGT

SEQ ID NO: 541394 - protein, 20 aa, Mycobacterium
PIPYDRATQERRAKRAEREL

SEQ ID NO: 541395 - protein, 8 aa, Mycobacterium
PIQAGEDA

SEQ ID NO: 541396 - protein, 10 aa, Mycobacterium
PIQGDAPSHN

SEQ ID NO: 541397 - protein, 5 aa, Mycobacterium
PIQGV

SEQ ID NO: 541398 - protein, 4 aa, Mycobacterium
PIQP

SEQ ID NO: 541399 - protein, 5 aa, Mycobacterium
PIQPL

SEQ ID NO: 541400 - protein, 4 aa, Mycobacterium
PIRD

SEQ ID NO: 541401 - protein, 8 aa, Mycobacterium
PIRDPRTG

SEQ ID NO: 541402 - protein, 8 aa, Mycobacterium
PIREGEEV

SEQ ID NO: 541403 - protein, 5 aa, Mycobacterium
PIREP

SEQ ID NO: 541404 - protein, 10 aa, Mycobacterium
PIRESEEHAY

SEQ ID NO: 541405 - protein, 11 aa, Mycobacterium
PIRGADEREWA

SEQ ID NO: 541406 - protein, 10 aa, Mycobacterium
PIRGKTATSE

SEQ ID NO: 541407 - protein, 10 aa, Mycobacterium
PIRGPDGSAT

SEQ ID NO: 541408 - protein, 5 aa, Mycobacterium
PIRPQ

SEQ ID NO: 541409 - protein, 6 aa, Mycobacterium
PIRPTA

SEQ ID NO: 541410 - protein, 5 aa, Mycobacterium
PIRQR

SEQ ID NO: 541411 - protein, 10 aa, Mycobacterium
PIRTEPTPCE

SEQ ID NO: 541412 - protein, 7 aa, Mycobacterium
PIRTGDE

SEQ ID NO: 541413 - protein, 13 aa, Mycobacterium
PIRVGDEVEVPVA

SEQ ID NO: 541414 - protein, 5 aa, Mycobacterium
PISAE

SEQ ID NO: 541415 - protein, 7 aa, Mycobacterium
PISAGQA

SEQ ID NO: 541416 - protein, 5 aa, Mycobacterium
PISAN

SEQ ID NO: 541417 - protein, 5 aa, Mycobacterium
PISAP

SEQ ID NO: 541418 - protein, 7 aa, Mycobacterium
PISDAGD

SEQ ID NO: 541419 - protein, 15 aa, Mycobacterium
PISDPDTAVLAMLLA

SEQ ID NO: 541420 - protein, 18 aa, Mycobacterium
PISDPPRQVRRRKRGGFG

SEQ ID NO: 541421 - protein, 10 aa, Mycobacterium
PISDPRHGSG

SEQ ID NO: 541422 - protein, 11 aa, Mycobacterium
PISDPSHGSGI

SEQ ID NO: 541423 - protein, 5 aa, Mycobacterium
PISEE

SEQ ID NO: 541424 - protein, 132 aa, Mycobacterium
PISEPVAGDDADDESGDEGDDDEEQADRPANRRRRRGRRGRGRGRGEQGANDGQDQPGDDGDEAPQKTGGNSTSSDDTEAQDGADSEESDNGDDDNGSADGANRRRRRRRRRKSGAGDDGDEGPAPDDPPNT

SEQ ID NO: 541425 - protein, 5 aa, Mycobacterium
PISEQ

SEQ ID NO: 541426 - protein, 5 aa, Mycobacterium
PISGA

SEQ ID NO: 541427 - protein, 9 aa, Mycobacterium
PISGHGTAV

SEQ ID NO: 541428 - protein, 6 aa, Mycobacterium
PISNQN

SEQ ID NO: 541429 - protein, 4 aa, Mycobacterium
PISP

SEQ ID NO: 541430 - protein, 8 aa, Mycobacterium
PISPADRE

SEQ ID NO: 541431 - protein, 10 aa, Mycobacterium
PISPHRSVAG

SEQ ID NO: 541432 - protein, 8 aa, Mycobacterium
PISPHSAD

SEQ ID NO: 541433 - protein, 8 aa, Mycobacterium
PISPPERL

SEQ ID NO: 541434 - protein, 4 aa, Mycobacterium
PISR

SEQ ID NO: 541435 - protein, 12 aa, Mycobacterium
PISRDSAESRLG

SEQ ID NO: 541436 - protein, 10 aa, Mycobacterium
PISRERAEAR

SEQ ID NO: 541437 - protein, 10 aa, Mycobacterium
PISRERAETR

SEQ ID NO: 541438 - protein, 9 aa, Mycobacterium
PISRQRAEA

SEQ ID NO: 541439 - protein, 10 aa, Mycobacterium
PISRQRAEAR

SEQ ID NO: 541440 - protein, 5 aa, Mycobacterium
PISSA

SEQ ID NO: 541441 - protein, 8 aa, Mycobacterium
PISSPGLS

SEQ ID NO: 541442 - protein, 7 aa, Mycobacterium
PISTPNI

SEQ ID NO: 541443 - protein, 13 aa, Mycobacterium
PITADPDTSTAPT

SEQ ID NO: 541444 - protein, 7 aa, Mycobacterium
PITAERA

SEQ ID NO: 541445 - protein, 7 aa, Mycobacterium
PITAGSG

SEQ ID NO: 541446 - protein, 11 aa, Mycobacterium
PITAPNDGTVQ

SEQ ID NO: 541447 - protein, 7 aa, Mycobacterium
PITAPTQ

SEQ ID NO: 541448 - protein, 13 aa, Mycobacterium
PITDDDATNPITE

SEQ ID NO: 541449 - protein, 14 aa, Mycobacterium
PITDDDDANPITEG

SEQ ID NO: 541450 - protein, 7 aa, Mycobacterium
PITDSEA

SEQ ID NO: 541451 - protein, 5 aa, Mycobacterium
PITED

SEQ ID NO: 541452 - protein, 5 aa, Mycobacterium
PITGQ

SEQ ID NO: 541453 - protein, 11 aa, Mycobacterium
PITGTPGAAGP

SEQ ID NO: 541454 - protein, 4 aa, Mycobacterium
PITI

SEQ ID NO: 541455 - protein, 7 aa, Mycobacterium
PITPASV

SEQ ID NO: 541456 - protein, 12 aa, Mycobacterium
PITPDTEQARYD

SEQ ID NO: 541457 - protein, 6 aa, Mycobacterium
PITPEE

SEQ ID NO: 541458 - protein, 6 aa, Mycobacterium
PITPES

SEQ ID NO: 541459 - protein, 7 aa, Mycobacterium
PITPESI

SEQ ID NO: 541460 - protein, 16 aa, Mycobacterium
PITPGERPGPAVAPDA

SEQ ID NO: 541461 - protein, 6 aa, Mycobacterium
PITPGG

SEQ ID NO: 541462 - protein, 11 aa, Mycobacterium
PITPKPVQRPH

SEQ ID NO: 541463 - protein, 7 aa, Mycobacterium
PITPYDG

SEQ ID NO: 541464 - protein, 12 aa, Mycobacterium
PITRDTEQARYD

SEQ ID NO: 541465 - protein, 10 aa, Mycobacterium
PITRDTPPFA

SEQ ID NO: 541466 - protein, 5 aa, Mycobacterium
PITRE

SEQ ID NO: 541467 - protein, 11 aa, Mycobacterium
PITRPAKQEPW

SEQ ID NO: 541468 - protein, 7 aa, Mycobacterium
PITRPYA

SEQ ID NO: 541469 - protein, 4 aa, Mycobacterium
PITS

SEQ ID NO: 541470 - protein, 7 aa, Mycobacterium
PITSDGS

SEQ ID NO: 541471 - protein, 7 aa, Mycobacterium
PITSRDP

SEQ ID NO: 541472 - protein, 10 aa, Mycobacterium
PITTAKEAAS

SEQ ID NO: 541473 - protein, 7 aa, Mycobacterium
PITTGVN

SEQ ID NO: 541474 - protein, 5 aa, Mycobacterium
PITTP

SEQ ID NO: 541475 - protein, 27 aa, Mycobacterium
PITTSGKVRRASCAEQYRDDTFARLVH

SEQ ID NO: 541476 - protein, 10 aa, Mycobacterium
PITTTKTRAH

SEQ ID NO: 541477 - protein, 8 aa, Mycobacterium
PIVTPEAE

SEQ ID NO: 541478 - protein, 4 aa, Mycobacterium
PIYP

SEQ ID NO: 541479 - protein, 9 aa, Mycobacterium
PKAALARTS

SEQ ID NO: 541480 - protein, 16 aa, Mycobacterium
PKAAPEAAVPARRPEF

SEQ ID NO: 541481 - protein, 10 aa, Mycobacterium
PKAAPGVRGD

SEQ ID NO: 541482 - protein, 4 aa, Mycobacterium
PKAD

SEQ ID NO: 541483 - protein, 9 aa, Mycobacterium
PKADAENPY

SEQ ID NO: 541484 - protein, 23 aa, Mycobacterium
PKADDAGDDADAQAKADGAQVST

SEQ ID NO: 541485 - protein, 5 aa, Mycobacterium
PKADG

SEQ ID NO: 541486 - protein, 6 aa, Mycobacterium
PKADGF

SEQ ID NO: 541487 - protein, 8 aa, Mycobacterium
PKADGGQA

SEQ ID NO: 541488 - protein, 11 aa, Mycobacterium
PKADQPALAKA

SEQ ID NO: 541489 - protein, 6 aa, Mycobacterium
PKADRS

SEQ ID NO: 541490 - protein, 4 aa, Mycobacterium
PKAE

SEQ ID NO: 541491 - protein, 7 aa, Mycobacterium
PKAEGVQ

SEQ ID NO: 541492 - protein, 5 aa, Mycobacterium
PKAEI

SEQ ID NO: 541493 - protein, 10 aa, Mycobacterium
PKAEKRKDGV

SEQ ID NO: 541494 - protein, 40 aa, Mycobacterium
PKAEKSTPSNGSHAVGGGGEVSGEPGGVAYPGADEPDAAT

SEQ ID NO: 541495 - protein, 10 aa, Mycobacterium
PKAERRRRAD

SEQ ID NO: 541496 - protein, 5 aa, Mycobacterium
PKAFG

SEQ ID NO: 541497 - protein, 4 aa, Mycobacterium
PKAG

SEQ ID NO: 541498 - protein, 13 aa, Mycobacterium
PKAGAGADDNTPV

SEQ ID NO: 541499 - protein, 6 aa, Mycobacterium
PKAGGV

SEQ ID NO: 541500 - protein, 9 aa, Mycobacterium
PKAGPEAES

SEQ ID NO: 541501 - protein, 9 aa, Mycobacterium
PKAGSRAPW

SEQ ID NO: 541502 - protein, 8 aa, Mycobacterium
PKAIADGP

SEQ ID NO: 541503 - protein, 5 aa, Mycobacterium
PKAIN

SEQ ID NO: 541504 - protein, 6 aa, Mycobacterium
PKAINS

SEQ ID NO: 541505 - protein, 11 aa, Mycobacterium
PKAKGPAPQRM

SEQ ID NO: 541506 - protein, 13 aa, Mycobacterium
PKAKGPAPQRMGA

SEQ ID NO: 541507 - protein, 10 aa, Mycobacterium
PKAKNSVNAA

SEQ ID NO: 541508 - protein, 4 aa, Mycobacterium
PKAL

SEQ ID NO: 541509 - protein, 8 aa, Mycobacterium
PKALANTD

SEQ ID NO: 541510 - protein, 13 aa, Mycobacterium
PKALPDGVGPATI

SEQ ID NO: 541511 - protein, 7 aa, Mycobacterium
PKALRSN

SEQ ID NO: 541512 - protein, 12 aa, Mycobacterium
PKANKRKDGATY

SEQ ID NO: 541513 - protein, 6 aa, Mycobacterium
PKANLR

SEQ ID NO: 541514 - protein, 8 aa, Mycobacterium
PKANTRSI

SEQ ID NO: 541515 - protein, 9 aa, Mycobacterium
PKAPAGVRG

SEQ ID NO: 541516 - protein, 9 aa, Mycobacterium
PKAPDPLRT

SEQ ID NO: 541517 - protein, 6 aa, Mycobacterium
PKAPFD

SEQ ID NO: 541518 - protein, 9 aa, Mycobacterium
PKAPQGVRG

SEQ ID NO: 541519 - protein, 7 aa, Mycobacterium
PKAPRGA

SEQ ID NO: 541520 - protein, 6 aa, Mycobacterium
PKAPRI

SEQ ID NO: 541521 - protein, 8 aa, Mycobacterium
PKAPRIDH

SEQ ID NO: 541522 - protein, 7 aa, Mycobacterium
PKAPSAG

SEQ ID NO: 541523 - protein, 5 aa, Mycobacterium
PKAPW

SEQ ID NO: 541524 - protein, 4 aa, Mycobacterium
PKAQ

SEQ ID NO: 541525 - protein, 6 aa, Mycobacterium
PKAQRA

SEQ ID NO: 541526 - protein, 13 aa, Mycobacterium
PKARKNRAAPRER

SEQ ID NO: 541527 - protein, 5 aa, Mycobacterium
PKARQ

SEQ ID NO: 541528 - protein, 11 aa, Mycobacterium
PKARRKAREDE

SEQ ID NO: 541529 - protein, 7 aa, Mycobacterium
PKASPAV

SEQ ID NO: 541530 - protein, 8 aa, Mycobacterium
PKASPGVI

SEQ ID NO: 541531 - protein, 9 aa, Mycobacterium
PKASRFNSA

SEQ ID NO: 541532 - protein, 12 aa, Mycobacterium
PKASSPSPQRIA

SEQ ID NO: 541533 - protein, 9 aa, Mycobacterium
PKASTQSVA

SEQ ID NO: 541534 - protein, 6 aa, Mycobacterium
PKATAE

SEQ ID NO: 541535 - protein, 6 aa, Mycobacterium
PKATAL

SEQ ID NO: 541536 - protein, 15 aa, Mycobacterium
PKATAPSPRRIAERG

SEQ ID NO: 541537 - protein, 11 aa, Mycobacterium
PKATASSSSRI

SEQ ID NO: 541538 - protein, 8 aa, Mycobacterium
PKATPENI

SEQ ID NO: 541539 - protein, 10 aa, Mycobacterium
PKATPEQEAA

SEQ ID NO: 541540 - protein, 10 aa, Mycobacterium
PKATPEQTAA

SEQ ID NO: 541541 - protein, 15 aa, Mycobacterium
PKATYSRRKEADDFP

SEQ ID NO: 541542 - protein, 7 aa, Mycobacterium
PKAVENS

SEQ ID NO: 541543 - protein, 7 aa, Mycobacterium
PKAVPSK

SEQ ID NO: 541544 - protein, 8 aa, Mycobacterium
PKAVRQLQ

SEQ ID NO: 541545 - protein, 7 aa, Mycobacterium
PKAVSGT

SEQ ID NO: 541546 - protein, 4 aa, Mycobacterium
PKAY

SEQ ID NO: 541547 - protein, 12 aa, Mycobacterium
PKAYRDRFRTAY

SEQ ID NO: 541548 - protein, 12 aa, Mycobacterium
PKAYRERFRTAY

SEQ ID NO: 541549 - protein, 11 aa, Mycobacterium
PKDAPTGGDPL

SEQ ID NO: 541550 - protein, 4 aa, Mycobacterium
PKDE

SEQ ID NO: 541551 - protein, 8 aa, Mycobacterium
PKDEAAQE

SEQ ID NO: 541552 - protein, 10 aa, Mycobacterium
PKDEVSADEY

SEQ ID NO: 541553 - protein, 13 aa, Mycobacterium
PKDGGRVVVHHIG

SEQ ID NO: 541554 - protein, 14 aa, Mycobacterium
PKDGPEKAGARPPD

SEQ ID NO: 541555 - protein, 6 aa, Mycobacterium
PKDHNR

SEQ ID NO: 541556 - protein, 6 aa, Mycobacterium
PKDHSR

SEQ ID NO: 541557 - protein, 4 aa, Mycobacterium
PKDI

SEQ ID NO: 541558 - protein, 5 aa, Mycobacterium
PKDIQ

SEQ ID NO: 541559 - protein, 8 aa, Mycobacterium
PKDKASDT

SEQ ID NO: 541560 - protein, 8 aa, Mycobacterium
PKDKPSET

SEQ ID NO: 541561 - protein, 6 aa, Mycobacterium
PKDLAG

SEQ ID NO: 541562 - protein, 13 aa, Mycobacterium
PKDLAGASRVGID

SEQ ID NO: 541563 - protein, 14 aa, Mycobacterium
PKDNSDTGNKPFSV

SEQ ID NO: 541564 - protein, 6 aa, Mycobacterium
PKDRDL

SEQ ID NO: 541565 - protein, 6 aa, Mycobacterium
PKDREL

SEQ ID NO: 541566 - protein, 7 aa, Mycobacterium
PKDRKQQ

SEQ ID NO: 541567 - protein, 21 aa, Mycobacterium
PKDSGVAVDGRYRKSAPLEGA

SEQ ID NO: 541568 - protein, 4 aa, Mycobacterium
PKDT

SEQ ID NO: 541569 - protein, 7 aa, Mycobacterium
PKDTGLA

SEQ ID NO: 541570 - protein, 7 aa, Mycobacterium
PKDVPGV

SEQ ID NO: 541571 - protein, 10 aa, Mycobacterium
PKEAAGMDPQ

SEQ ID NO: 541572 - protein, 10 aa, Mycobacterium
PKEAGISLDT

SEQ ID NO: 541573 - protein, 9 aa, Mycobacterium
PKEANDSRC

SEQ ID NO: 541574 - protein, 10 aa, Mycobacterium
PKEEVSAEEY

SEQ ID NO: 541575 - protein, 6 aa, Mycobacterium
PKEEWG

SEQ ID NO: 541576 - protein, 4 aa, Mycobacterium
PKEF

SEQ ID NO: 541577 - protein, 7 aa, Mycobacterium
PKEHRGK

SEQ ID NO: 541578 - protein, 9 aa, Mycobacterium
PKEKHPDTF

SEQ ID NO: 541579 - protein, 5 aa, Mycobacterium
PKELA

SEQ ID NO: 541580 - protein, 4 aa, Mycobacterium
PKEP

SEQ ID NO: 541581 - protein, 7 aa, Mycobacterium
PKEPAEF

SEQ ID NO: 541582 - protein, 17 aa, Mycobacterium
PKEPDPWKGKPWKDIPR

SEQ ID NO: 541583 - protein, 17 aa, Mycobacterium
PKEPEVDRDIPFREARR

SEQ ID NO: 541584 - protein, 17 aa, Mycobacterium
PKEPEVDREIPFRDIRK

SEQ ID NO: 541585 - protein, 8 aa, Mycobacterium
PKEQATVG

SEQ ID NO: 541586 - protein, 7 aa, Mycobacterium
PKERVDE

SEQ ID NO: 541587 - protein, 8 aa, Mycobacterium
PKESGIKG

SEQ ID NO: 541588 - protein, 8 aa, Mycobacterium
PKESPEYS

SEQ ID NO: 541589 - protein, 8 aa, Mycobacterium
PKESTRNE

SEQ ID NO: 541590 - protein, 7 aa, Mycobacterium
PKETGLA

SEQ ID NO: 541591 - protein, 7 aa, Mycobacterium
PKETGLR

SEQ ID NO: 541592 - protein, 6 aa, Mycobacterium
PKEVGA

SEQ ID NO: 541593 - protein, 6 aa, Mycobacterium
PKEVPL

SEQ ID NO: 541594 - protein, 6 aa, Mycobacterium
PKEYDK

SEQ ID NO: 541595 - protein, 10 aa, Mycobacterium
PKFDGTHYEQ

SEQ ID NO: 541596 - protein, 5 aa, Mycobacterium
PKFPA

SEQ ID NO: 541597 - protein, 5 aa, Mycobacterium
PKFPN

SEQ ID NO: 541598 - protein, 6 aa, Mycobacterium
PKFRTG

SEQ ID NO: 541599 - protein, 4 aa, Mycobacterium
PKFS

SEQ ID NO: 541600 - protein, 13 aa, Mycobacterium
PKFSNSNAQTSAE

SEQ ID NO: 541601 - protein, 15 aa, Mycobacterium
PKFSNSNSQTSSEYD

SEQ ID NO: 541602 - protein, 7 aa, Mycobacterium
PKFSRAG

SEQ ID NO: 541603 - protein, 6 aa, Mycobacterium
PKFTGK

SEQ ID NO: 541604 - protein, 7 aa, Mycobacterium
PKFTTEQ

SEQ ID NO: 541605 - protein, 8 aa, Mycobacterium
PKGADEVR

SEQ ID NO: 541606 - protein, 15 aa, Mycobacterium
PKGADGRDSLRAEEV

SEQ ID NO: 541607 - protein, 5 aa, Mycobacterium
PKGAL

SEQ ID NO: 541608 - protein, 6 aa, Mycobacterium
PKGCPV

SEQ ID NO: 541609 - protein, 9 aa, Mycobacterium
PKGDARALP

SEQ ID NO: 541610 - protein, 9 aa, Mycobacterium
PKGDDPGAR

SEQ ID NO: 541611 - protein, 9 aa, Mycobacterium
PKGDVGEDI

SEQ ID NO: 541612 - protein, 9 aa, Mycobacterium
PKGEAKRQE

SEQ ID NO: 541613 - protein, 7 aa, Mycobacterium
PKGEEPH

SEQ ID NO: 541614 - protein, 10 aa, Mycobacterium
PKGESAAARA

SEQ ID NO: 541615 - protein, 12 aa, Mycobacterium
PKGEVRNPERAR

SEQ ID NO: 541616 - protein, 7 aa, Mycobacterium
PKGEYGA

SEQ ID NO: 541617 - protein, 5 aa, Mycobacterium
PKGFA

SEQ ID NO: 541618 - protein, 5 aa, Mycobacterium
PKGFT

SEQ ID NO: 541619 - protein, 4 aa, Mycobacterium
PKGG

SEQ ID NO: 541620 - protein, 9 aa, Mycobacterium
PKGGEKQLH

SEQ ID NO: 541621 - protein, 32 aa, Mycobacterium
PKGGRPGPADHGHEGGMATRENAPELTEPDRE

SEQ ID NO: 541622 - protein, 5 aa, Mycobacterium
PKGGV

SEQ ID NO: 541623 - protein, 4 aa, Mycobacterium
PKGI

SEQ ID NO: 541624 - protein, 11 aa, Mycobacterium
PKGKLDPGETA

SEQ ID NO: 541625 - protein, 14 aa, Mycobacterium
PKGKLDQGETEPVA

SEQ ID NO: 541626 - protein, 10 aa, Mycobacterium
PKGKTRISAE

SEQ ID NO: 541627 - protein, 12 aa, Mycobacterium
PKGKVDPGETAA

SEQ ID NO: 541628 - protein, 13 aa, Mycobacterium
PKGKVDPGETDTV

SEQ ID NO: 541629 - protein, 12 aa, Mycobacterium
PKGKVDPGETTA

SEQ ID NO: 541630 - protein, 4 aa, Mycobacterium
PKGL

SEQ ID NO: 541631 - protein, 6 aa, Mycobacterium
PKGLAG

SEQ ID NO: 541632 - protein, 8 aa, Mycobacterium
PKGMDEKM

SEQ ID NO: 541633 - protein, 7 aa, Mycobacterium
PKGMQSD

SEQ ID NO: 541634 - protein, 7 aa, Mycobacterium
PKGMRAS

SEQ ID NO: 541635 - protein, 11 aa, Mycobacterium
PKGPAEEDGRP

SEQ ID NO: 541636 - protein, 7 aa, Mycobacterium
PKGPDKM

SEQ ID NO: 541637 - protein, 7 aa, Mycobacterium
PKGPDLS

SEQ ID NO: 541638 - protein, 7 aa, Mycobacterium
PKGPDWQ

SEQ ID NO: 541639 - protein, 5 aa, Mycobacterium
PKGPE

SEQ ID NO: 541640 - protein, 9 aa, Mycobacterium
PKGQARQAA

SEQ ID NO: 541641 - protein, 8 aa, Mycobacterium
PKGQHSSF

SEQ ID NO: 541642 - protein, 23 aa, Mycobacterium
PKGQRADGENTESDRAGWTTPEA

SEQ ID NO: 541643 - protein, 4 aa, Mycobacterium
PKGR

SEQ ID NO: 541644 - protein, 12 aa, Mycobacterium
PKGRARQAAEEL

SEQ ID NO: 541645 - protein, 9 aa, Mycobacterium
PKGRDPGAR

SEQ ID NO: 541646 - protein, 6 aa, Mycobacterium
PKGRDQ

SEQ ID NO: 541647 - protein, 7 aa, Mycobacterium
PKGRDQI

SEQ ID NO: 541648 - protein, 11 aa, Mycobacterium
PKGREEPGPIS

SEQ ID NO: 541649 - protein, 10 aa, Mycobacterium
PKGRVTTTEL

SEQ ID NO: 541650 - protein, 4 aa, Mycobacterium
PKGS

SEQ ID NO: 541651 - protein, 10 aa, Mycobacterium
PKGSAGQRRL

SEQ ID NO: 541652 - protein, 8 aa, Mycobacterium
PKGSGKLF

SEQ ID NO: 541653 - protein, 9 aa, Mycobacterium
PKGSGTEVT

SEQ ID NO: 541654 - protein, 8 aa, Mycobacterium
PKGSGTLR

SEQ ID NO: 541655 - protein, 9 aa, Mycobacterium
PKGSGTVRE

SEQ ID NO: 541656 - protein, 16 aa, Mycobacterium
PKGTRLARPVEAVREI

SEQ ID NO: 541657 - protein, 16 aa, Mycobacterium
PKGTRLARPVEQVREI

SEQ ID NO: 541658 - protein, 9 aa, Mycobacterium
PKGTRSTLE

SEQ ID NO: 541659 - protein, 10 aa, Mycobacterium
PKGVRDGERR

SEQ ID NO: 541660 - protein, 7 aa, Mycobacterium
PKGWTGP

SEQ ID NO: 541661 - protein, 4 aa, Mycobacterium
PKGY

SEQ ID NO: 541662 - protein, 8 aa, Mycobacterium
PKGYGGTE

SEQ ID NO: 541663 - protein, 4 aa, Mycobacterium
PKHA

SEQ ID NO: 541664 - protein, 18 aa, Mycobacterium
PKHAEVARGNLKRAGVDD

SEQ ID NO: 541665 - protein, 11 aa, Mycobacterium
PKHLGRTNTPI

SEQ ID NO: 541666 - protein, 8 aa, Mycobacterium
PKHLREAS

SEQ ID NO: 541667 - protein, 13 aa, Mycobacterium
PKHPRLQEFLSKV

SEQ ID NO: 541668 - protein, 6 aa, Mycobacterium
PKHPYT

SEQ ID NO: 541669 - protein, 14 aa, Mycobacterium
PKHRGRLVSKLRFW

SEQ ID NO: 541670 - protein, 8 aa, Mycobacterium
PKHRTDAS

SEQ ID NO: 541671 - protein, 9 aa, Mycobacterium
PKIDEDSDV

SEQ ID NO: 541672 - protein, 12 aa, Mycobacterium
PKIDEDSDVDSD

SEQ ID NO: 541673 - protein, 4 aa, Mycobacterium
PKIG

SEQ ID NO: 541674 - protein, 14 aa, Mycobacterium
PKIGGDAGAGNGGT

SEQ ID NO: 541675 - protein, 4 aa, Mycobacterium
PKIK

SEQ ID NO: 541676 - protein, 7 aa, Mycobacterium
PKIRSRQ

SEQ ID NO: 541677 - protein, 7 aa, Mycobacterium
PKISPDE

SEQ ID NO: 541678 - protein, 57 aa, Mycobacterium
PKKAESAAEPVKKAAEKAPAKKAPAKKATPAAAAKANPTVPAKKAPAKKAPAKKVTQ

SEQ ID NO: 541679 - protein, 23 aa, Mycobacterium
PKKAGPAAPTRTASGSVAVQGAR

SEQ ID NO: 541680 - protein, 5 aa, Mycobacterium
PKKLP

SEQ ID NO: 541681 - protein, 17 aa, Mycobacterium
PKKPNRKSTWFVDWERR

SEQ ID NO: 541682 - protein, 6 aa, Mycobacterium
PKKQID

SEQ ID NO: 541683 - protein, 7 aa, Mycobacterium
PKKQRHK

SEQ ID NO: 541684 - protein, 41 aa, Mycobacterium
PKKSDETAKKAQKAVAKKAPAKKAPAKKAPAKKAAAKKVTQ

SEQ ID NO: 541685 - protein, 4 aa, Mycobacterium
PKLA

SEQ ID NO: 541686 - protein, 5 aa, Mycobacterium
PKLAE

SEQ ID NO: 541687 - protein, 10 aa, Mycobacterium
PKLDAATVGT

SEQ ID NO: 541688 - protein, 9 aa, Mycobacterium
PKLDDAGPI

SEQ ID NO: 541689 - protein, 4 aa, Mycobacterium
PKLE

SEQ ID NO: 541690 - protein, 5 aa, Mycobacterium
PKLEE

SEQ ID NO: 541691 - protein, 6 aa, Mycobacterium
PKLESY

SEQ ID NO: 541692 - protein, 5 aa, Mycobacterium
PKLGG

SEQ ID NO: 541693 - protein, 6 aa, Mycobacterium
PKLKPD

SEQ ID NO: 541694 - protein, 12 aa, Mycobacterium
PKLPAGAPERAA

SEQ ID NO: 541695 - protein, 7 aa, Mycobacterium
PKLPATA

SEQ ID NO: 541696 - protein, 5 aa, Mycobacterium
PKLPD

SEQ ID NO: 541697 - protein, 8 aa, Mycobacterium
PKLPDGRQ

SEQ ID NO: 541698 - protein, 6 aa, Mycobacterium
PKLPGI

SEQ ID NO: 541699 - protein, 6 aa, Mycobacterium
PKLPPI

SEQ ID NO: 541700 - protein, 5 aa, Mycobacterium
PKLRS

SEQ ID NO: 541701 - protein, 26 aa, Mycobacterium
PKLSAATRYEGEQTLAEAAGLADSAQ

SEQ ID NO: 541702 - protein, 17 aa, Mycobacterium
PKLSQRDDIAVLALEVA

SEQ ID NO: 541703 - protein, 12 aa, Mycobacterium
PKLTNKPLTGSY

SEQ ID NO: 541704 - protein, 4 aa, Mycobacterium
PKMA

SEQ ID NO: 541705 - protein, 9 aa, Mycobacterium
PKMASANSP

SEQ ID NO: 541706 - protein, 12 aa, Mycobacterium
PKMRAPRPHAAG

SEQ ID NO: 541707 - protein, 7 aa, Mycobacterium
PKMSEPT

SEQ ID NO: 541708 - protein, 9 aa, Mycobacterium
PKMSGSTPA

SEQ ID NO: 541709 - protein, 7 aa, Mycobacterium
PKMTPDG

SEQ ID NO: 541710 - protein, 9 aa, Mycobacterium
PKNAQADVK

SEQ ID NO: 541711 - protein, 9 aa, Mycobacterium
PKNELPPGG

SEQ ID NO: 541712 - protein, 10 aa, Mycobacterium
PKNGAEPVDP

SEQ ID NO: 541713 - protein, 4 aa, Mycobacterium
PKNH

SEQ ID NO: 541714 - protein, 5 aa, Mycobacterium
PKNHA

SEQ ID NO: 541715 - protein, 7 aa, Mycobacterium
PKNNPAD

SEQ ID NO: 541716 - protein, 4 aa, Mycobacterium
PKNP

SEQ ID NO: 541717 - protein, 7 aa, Mycobacterium
PKNPAQL

SEQ ID NO: 541718 - protein, 8 aa, Mycobacterium
PKNPKKTL

SEQ ID NO: 541719 - protein, 8 aa, Mycobacterium
PKNPKSLS

SEQ ID NO: 541720 - protein, 7 aa, Mycobacterium
PKNPRFS

SEQ ID NO: 541721 - protein, 8 aa, Mycobacterium
PKNPSGKL

SEQ ID NO: 541722 - protein, 6 aa, Mycobacterium
PKNREL

SEQ ID NO: 541723 - protein, 8 aa, Mycobacterium
PKNRPSDT

SEQ ID NO: 541724 - protein, 5 aa, Mycobacterium
PKNRT

SEQ ID NO: 541725 - protein, 12 aa, Mycobacterium
PKNSGAAKLAPS

SEQ ID NO: 541726 - protein, 8 aa, Mycobacterium
PKNTRQRL

SEQ ID NO: 541727 - protein, 4 aa, Mycobacterium
PKNV

SEQ ID NO: 541728 - protein, 4 aa, Mycobacterium
PKPA

SEQ ID NO: 541729 - protein, 14 aa, Mycobacterium
PKPADTDAPKDAKP

SEQ ID NO: 541730 - protein, 5 aa, Mycobacterium
PKPAL

SEQ ID NO: 541731 - protein, 14 aa, Mycobacterium
PKPALSDVADPDRL

SEQ ID NO: 541732 - protein, 17 aa, Mycobacterium
PKPARRGSRMPVRDYRN

SEQ ID NO: 541733 - protein, 7 aa, Mycobacterium
PKPATGM

SEQ ID NO: 541734 - protein, 8 aa, Mycobacterium
PKPATLAT

SEQ ID NO: 541735 - protein, 4 aa, Mycobacterium
PKPD

SEQ ID NO: 541736 - protein, 14 aa, Mycobacterium
PKPDRSADGDIENN

SEQ ID NO: 541737 - protein, 4 aa, Mycobacterium
PKPE

SEQ ID NO: 541738 - protein, 9 aa, Mycobacterium
PKPEAVSDK

SEQ ID NO: 541739 - protein, 19 aa, Mycobacterium
PKPEEDTRPDASTAKPADA

SEQ ID NO: 541740 - protein, 6 aa, Mycobacterium
PKPEIA

SEQ ID NO: 541741 - protein, 22 aa, Mycobacterium
PKPEPASANGVPAAPVSGSVSQ

SEQ ID NO: 541742 - protein, 12 aa, Mycobacterium
PKPEPDSAKGFG

SEQ ID NO: 541743 - protein, 17 aa, Mycobacterium
PKPETLPEPELKKPEDG

SEQ ID NO: 541744 - protein, 19 aa, Mycobacterium
PKPEWARPDGGEAGLHPSN

SEQ ID NO: 541745 - protein, 4 aa, Mycobacterium
PKPF

SEQ ID NO: 541746 - protein, 9 aa, Mycobacterium
PKPFDGDPH

SEQ ID NO: 541747 - protein, 5 aa, Mycobacterium
PKPFE

SEQ ID NO: 541748 - protein, 5 aa, Mycobacterium
PKPFR

SEQ ID NO: 541749 - protein, 10 aa, Mycobacterium
PKPGAAGKSI

SEQ ID NO: 541750 - protein, 10 aa, Mycobacterium
PKPGAESDPA

SEQ ID NO: 541751 - protein, 13 aa, Mycobacterium
PKPGDEAAASGMG

SEQ ID NO: 541752 - protein, 14 aa, Mycobacterium
PKPGFSGGEGELTA

SEQ ID NO: 541753 - protein, 5 aa, Mycobacterium
PKPGQ

SEQ ID NO: 541754 - protein, 10 aa, Mycobacterium
PKPGQTIPGV

SEQ ID NO: 541755 - protein, 7 aa, Mycobacterium
PKPGRLA

SEQ ID NO: 541756 - protein, 15 aa, Mycobacterium
PKPGSGPSAAARERG

SEQ ID NO: 541757 - protein, 16 aa, Mycobacterium
PKPGTGPNEQTRERGH

SEQ ID NO: 541758 - protein, 15 aa, Mycobacterium
PKPGTGPSEAARERG

SEQ ID NO: 541759 - protein, 16 aa, Mycobacterium
PKPGTGPSEQTRERGH

SEQ ID NO: 541760 - protein, 16 aa, Mycobacterium
PKPGTGPSERTRERGH

SEQ ID NO: 541761 - protein, 12 aa, Mycobacterium
PKPGTWRTDSKQ

SEQ ID NO: 541762 - protein, 6 aa, Mycobacterium
PKPGVT

SEQ ID NO: 541763 - protein, 7 aa, Mycobacterium
PKPGVTT

SEQ ID NO: 541764 - protein, 13 aa, Mycobacterium
PKPGWGDAGPNAE

SEQ ID NO: 541765 - protein, 6 aa, Mycobacterium
PKPHAA

SEQ ID NO: 541766 - protein, 10 aa, Mycobacterium
PKPHQRPRPP

SEQ ID NO: 541767 - protein, 4 aa, Mycobacterium
PKPI

SEQ ID NO: 541768 - protein, 22 aa, Mycobacterium
PKPIAAQDESLGDTRPGLSEAE

SEQ ID NO: 541769 - protein, 6 aa, Mycobacterium
PKPIPH

SEQ ID NO: 541770 - protein, 5 aa, Mycobacterium
PKPIR

SEQ ID NO: 541771 - protein, 5 aa, Mycobacterium
PKPIS

SEQ ID NO: 541772 - protein, 6 aa, Mycobacterium
PKPLAR

SEQ ID NO: 541773 - protein, 6 aa, Mycobacterium
PKPLHT

SEQ ID NO: 541774 - protein, 5 aa, Mycobacterium
PKPLP

SEQ ID NO: 541775 - protein, 8 aa, Mycobacterium
PKPLPKDG

SEQ ID NO: 541776 - protein, 5 aa, Mycobacterium
PKPLQ

SEQ ID NO: 541777 - protein, 7 aa, Mycobacterium
PKPLQAG

SEQ ID NO: 541778 - protein, 7 aa, Mycobacterium
PKPLQDN

SEQ ID NO: 541779 - protein, 7 aa, Mycobacterium
PKPLQNN

SEQ ID NO: 541780 - protein, 11 aa, Mycobacterium
PKPLQPAVPGG

SEQ ID NO: 541781 - protein, 5 aa, Mycobacterium
PKPLR

SEQ ID NO: 541782 - protein, 8 aa, Mycobacterium
PKPNEPRG

SEQ ID NO: 541783 - protein, 9 aa, Mycobacterium
PKPNPYMER

SEQ ID NO: 541784 - protein, 6 aa, Mycobacterium
PKPPER

SEQ ID NO: 541785 - protein, 5 aa, Mycobacterium
PKPPF

SEQ ID NO: 541786 - protein, 7 aa, Mycobacterium
PKPPFAQ

SEQ ID NO: 541787 - protein, 5 aa, Mycobacterium
PKPPR

SEQ ID NO: 541788 - protein, 6 aa, Mycobacterium
PKPQDT

SEQ ID NO: 541789 - protein, 10 aa, Mycobacterium
PKPRDRGDPR

SEQ ID NO: 541790 - protein, 7 aa, Mycobacterium
PKPRHSR

SEQ ID NO: 541791 - protein, 8 aa, Mycobacterium
PKPRPKHG

SEQ ID NO: 541792 - protein, 7 aa, Mycobacterium
PKPRTHP

SEQ ID NO: 541793 - protein, 12 aa, Mycobacterium
PKPRTVAVESPL

SEQ ID NO: 541794 - protein, 6 aa, Mycobacterium
PKPRVR

SEQ ID NO: 541795 - protein, 10 aa, Mycobacterium
PKPSEAEEAR

SEQ ID NO: 541796 - protein, 30 aa, Mycobacterium
PKPSFSAPVSGAGRFGTARSAPVRTSTSKR

SEQ ID NO: 541797 - protein, 13 aa, Mycobacterium
PKPSSQPAAASLP

SEQ ID NO: 541798 - protein, 7 aa, Mycobacterium
PKPSTHV

SEQ ID NO: 541799 - protein, 7 aa, Mycobacterium
PKPTDHG

SEQ ID NO: 541800 - protein, 7 aa, Mycobacterium
PKPTLAD

SEQ ID NO: 541801 - protein, 8 aa, Mycobacterium
PKPTPEQE

SEQ ID NO: 541802 - protein, 9 aa, Mycobacterium
PKPTQPGGV

SEQ ID NO: 541803 - protein, 8 aa, Mycobacterium
PKPTREQE

SEQ ID NO: 541804 - protein, 12 aa, Mycobacterium
PKPVDVPGRPHP

SEQ ID NO: 541805 - protein, 7 aa, Mycobacterium
PKPVGWP

SEQ ID NO: 541806 - protein, 6 aa, Mycobacterium
PKPVQR

SEQ ID NO: 541807 - protein, 6 aa, Mycobacterium
PKPVSD

SEQ ID NO: 541808 - protein, 10 aa, Mycobacterium
PKPYAAAQRA

SEQ ID NO: 541809 - protein, 12 aa, Mycobacterium
PKPYGRAASPAE

SEQ ID NO: 541810 - protein, 8 aa, Mycobacterium
PKPYKDAY

SEQ ID NO: 541811 - protein, 7 aa, Mycobacterium
PKQCVQE

SEQ ID NO: 541812 - protein, 7 aa, Mycobacterium
PKQDRDQ

SEQ ID NO: 541813 - protein, 12 aa, Mycobacterium
PKQGDDDGGTGG

SEQ ID NO: 541814 - protein, 5 aa, Mycobacterium
PKQGL

SEQ ID NO: 541815 - protein, 4 aa, Mycobacterium
PKQL

SEQ ID NO: 541816 - protein, 15 aa, Mycobacterium
PKQPFGRDASLDGQE

SEQ ID NO: 541817 - protein, 11 aa, Mycobacterium
PKQPSPAQADA

SEQ ID NO: 541818 - protein, 4 aa, Mycobacterium
PKQR

SEQ ID NO: 541819 - protein, 14 aa, Mycobacterium
PKQSGARVTDDQLN

SEQ ID NO: 541820 - protein, 7 aa, Mycobacterium
PKQTALG

SEQ ID NO: 541821 - protein, 8 aa, Mycobacterium
PKQTTKDG

SEQ ID NO: 541822 - protein, 7 aa, Mycobacterium
PKQVTRD

SEQ ID NO: 541823 - protein, 61 aa, Mycobacterium
PKRAEAAAETASEAAAETAEPVKKAAAPAAKKAAPAKKAAPAKKATPAKSAAKAPAKKVTQ

SEQ ID NO: 541824 - protein, 9 aa, Mycobacterium
PKRAKDLPA

SEQ ID NO: 541825 - protein, 7 aa, Mycobacterium
PKRARDL

SEQ ID NO: 541826 - protein, 8 aa, Mycobacterium
PKRARDLP

SEQ ID NO: 541827 - protein, 9 aa, Mycobacterium
PKRARDLPD

SEQ ID NO: 541828 - protein, 10 aa, Mycobacterium
PKRARDLPKP

SEQ ID NO: 541829 - protein, 5 aa, Mycobacterium
PKRDT

SEQ ID NO: 541830 - protein, 4 aa, Mycobacterium
PKRG

SEQ ID NO: 541831 - protein, 12 aa, Mycobacterium
PKRHTQHRNAAG

SEQ ID NO: 541832 - protein, 6 aa, Mycobacterium
PKRLAE

SEQ ID NO: 541833 - protein, 16 aa, Mycobacterium
PKRLGRQSASAPPLRE

SEQ ID NO: 541834 - protein, 10 aa, Mycobacterium
PKRMGRPEEY

SEQ ID NO: 541835 - protein, 18 aa, Mycobacterium
PKRPAPSGPGRTRSGSVA

SEQ ID NO: 541836 - protein, 14 aa, Mycobacterium
PKRPEGEKLPPTSK

SEQ ID NO: 541837 - protein, 26 aa, Mycobacterium
PKRQAAPARTASGSVAVPGAKARVAR

SEQ ID NO: 541838 - protein, 47 aa, Mycobacterium
PKRQRSRTADRAARIKAEREHNGTQRNLEERPRRGQPPPDYGNDPPP

SEQ ID NO: 541839 - protein, 7 aa, Mycobacterium
PKRRPLD

SEQ ID NO: 541840 - protein, 12 aa, Mycobacterium
PKRRRTRAADHA

SEQ ID NO: 541841 - protein, 15 aa, Mycobacterium
PKRRRTRAQNTARTI

SEQ ID NO: 541842 - protein, 16 aa, Mycobacterium
PKRRRTRAQNTARTIA

SEQ ID NO: 541843 - protein, 7 aa, Mycobacterium
PKRRSGR

SEQ ID NO: 541844 - protein, 4 aa, Mycobacterium
PKRS

SEQ ID NO: 541845 - protein, 14 aa, Mycobacterium
PKRSPADKDGDTAA

SEQ ID NO: 541846 - protein, 16 aa, Mycobacterium
PKRSPAGKDADTAALS

SEQ ID NO: 541847 - protein, 10 aa, Mycobacterium
PKRSPDAPAT

SEQ ID NO: 541848 - protein, 5 aa, Mycobacterium
PKRSR

SEQ ID NO: 541849 - protein, 7 aa, Mycobacterium
PKRVDGG

SEQ ID NO: 541850 - protein, 5 aa, Mycobacterium
PKRVE

SEQ ID NO: 541851 - protein, 4 aa, Mycobacterium
PKRY

SEQ ID NO: 541852 - protein, 8 aa, Mycobacterium
PKRYGSGQ

SEQ ID NO: 541853 - protein, 16 aa, Mycobacterium
PKSAAGKILRKDLRAR

SEQ ID NO: 541854 - protein, 8 aa, Mycobacterium
PKSADGKY

SEQ ID NO: 541855 - protein, 8 aa, Mycobacterium
PKSAGRDE

SEQ ID NO: 541856 - protein, 7 aa, Mycobacterium
PKSANGA

SEQ ID NO: 541857 - protein, 7 aa, Mycobacterium
PKSAPDG

SEQ ID NO: 541858 - protein, 8 aa, Mycobacterium
PKSDRSDL

SEQ ID NO: 541859 - protein, 11 aa, Mycobacterium
PKSDTKPETIS

SEQ ID NO: 541860 - protein, 9 aa, Mycobacterium
PKSEGRRGG

SEQ ID NO: 541861 - protein, 4 aa, Mycobacterium
PKSG

SEQ ID NO: 541862 - protein, 9 aa, Mycobacterium
PKSGAEEHE

SEQ ID NO: 541863 - protein, 42 aa, Mycobacterium
PKSGGGVDPLTDAPAPITAAQRKESGIDAKPEKAEKAGKPAD

SEQ ID NO: 541864 - protein, 43 aa, Mycobacterium
PKSGGGVDPLTDAPAPITPQQRKESGIDAKPREDKPKEDAKSK

SEQ ID NO: 541865 - protein, 35 aa, Mycobacterium
PKSGGGVDPLTEAPAPITAQQRKESGIDAKPGKDG

SEQ ID NO: 541866 - protein, 8 aa, Mycobacterium
PKSGKTRI

SEQ ID NO: 541867 - protein, 8 aa, Mycobacterium
PKSGKTTI

SEQ ID NO: 541868 - protein, 5 aa, Mycobacterium
PKSGM

SEQ ID NO: 541869 - protein, 23 aa, Mycobacterium
PKSGRGPKADSAADNSSQQQQQQ

SEQ ID NO: 541870 - protein, 9 aa, Mycobacterium
PKSGSRAPW

SEQ ID NO: 541871 - protein, 9 aa, Mycobacterium
PKSGTKRPW

SEQ ID NO: 541872 - protein, 7 aa, Mycobacterium
PKSGVSA

SEQ ID NO: 541873 - protein, 10 aa, Mycobacterium
PKSGYPGHGA

SEQ ID NO: 541874 - protein, 10 aa, Mycobacterium
PKSGYPGHSA

SEQ ID NO: 541875 - protein, 7 aa, Mycobacterium
PKSHTHG

SEQ ID NO: 541876 - protein, 8 aa, Mycobacterium
PKSIPRPE

SEQ ID NO: 541877 - protein, 19 aa, Mycobacterium
PKSKDNSTHAAIDDSAVSE

SEQ ID NO: 541878 - protein, 6 aa, Mycobacterium
PKSLPP

SEQ ID NO: 541879 - protein, 15 aa, Mycobacterium
PKSLRDKLATGRGFD

SEQ ID NO: 541880 - protein, 13 aa, Mycobacterium
PKSLREAVNSGRS

SEQ ID NO: 541881 - protein, 12 aa, Mycobacterium
PKSLREKLASGQ

SEQ ID NO: 541882 - protein, 15 aa, Mycobacterium
PKSLRESLRQRQASD

SEQ ID NO: 541883 - protein, 14 aa, Mycobacterium
PKSLSWPTGSPSID

SEQ ID NO: 541884 - protein, 4 aa, Mycobacterium
PKSM

SEQ ID NO: 541885 - protein, 7 aa, Mycobacterium
PKSRGRV

SEQ ID NO: 541886 - protein, 4 aa, Mycobacterium
PKSS

SEQ ID NO: 541887 - protein, 18 aa, Mycobacterium
PKSSGTAIEGGGGLPSGI

SEQ ID NO: 541888 - protein, 11 aa, Mycobacterium
PKSTLESGDGL

SEQ ID NO: 541889 - protein, 11 aa, Mycobacterium
PKSTTETEKNR

SEQ ID NO: 541890 - protein, 9 aa, Mycobacterium
PKSTTVSEK

SEQ ID NO: 541891 - protein, 4 aa, Mycobacterium
PKTA

SEQ ID NO: 541892 - protein, 6 aa, Mycobacterium
PKTAEG

SEQ ID NO: 541893 - protein, 7 aa, Mycobacterium
PKTAEQI

SEQ ID NO: 541894 - protein, 7 aa, Mycobacterium
PKTAEQV

SEQ ID NO: 541895 - protein, 7 aa, Mycobacterium
PKTAQQA

SEQ ID NO: 541896 - protein, 9 aa, Mycobacterium
PKTARPEAL

SEQ ID NO: 541897 - protein, 21 aa, Mycobacterium
PKTATGKISKRALRQNLCAPA

SEQ ID NO: 541898 - protein, 16 aa, Mycobacterium
PKTAYRTPTKNETFEP

SEQ ID NO: 541899 - protein, 7 aa, Mycobacterium
PKTDDPL

SEQ ID NO: 541900 - protein, 8 aa, Mycobacterium
PKTDDVTA

SEQ ID NO: 541901 - protein, 8 aa, Mycobacterium
PKTDPTIT

SEQ ID NO: 541902 - protein, 23 aa, Mycobacterium
PKTDPVDPEAPPVALEEKIVALL

SEQ ID NO: 541903 - protein, 23 aa, Mycobacterium
PKTDPVDPHAPPVTPEEKLVALL

SEQ ID NO: 541904 - protein, 4 aa, Mycobacterium
PKTE

SEQ ID NO: 541905 - protein, 6 aa, Mycobacterium
PKTEPH

SEQ ID NO: 541906 - protein, 14 aa, Mycobacterium
PKTESGKLNRPGLP

SEQ ID NO: 541907 - protein, 32 aa, Mycobacterium
PKTESGKLNRPGLPRPSVSTTGHREPPSTDIE

SEQ ID NO: 541908 - protein, 4 aa, Mycobacterium
PKTG

SEQ ID NO: 541909 - protein, 6 aa, Mycobacterium
PKTGAV

SEQ ID NO: 541910 - protein, 5 aa, Mycobacterium
PKTGE

SEQ ID NO: 541911 - protein, 23 aa, Mycobacterium
PKTGKSGHVQPSEIAESAPTAGL

SEQ ID NO: 541912 - protein, 17 aa, Mycobacterium
PKTGNAMNAPPITDIWS

SEQ ID NO: 541913 - protein, 10 aa, Mycobacterium
PKTGRPVPDS

SEQ ID NO: 541914 - protein, 4 aa, Mycobacterium
PKTH

SEQ ID NO: 541915 - protein, 11 aa, Mycobacterium
PKTHGELGGRG

SEQ ID NO: 541916 - protein, 15 aa, Mycobacterium
PKTKKTKTGYTTDAD

SEQ ID NO: 541917 - protein, 16 aa, Mycobacterium
PKTKRTKTGYTTDADA

SEQ ID NO: 541918 - protein, 10 aa, Mycobacterium
PKTKSDQEKL

SEQ ID NO: 541919 - protein, 14 aa, Mycobacterium
PKTKVAAELRSEAS

SEQ ID NO: 541920 - protein, 8 aa, Mycobacterium
PKTLNNDA

SEQ ID NO: 541921 - protein, 10 aa, Mycobacterium
PKTLSGKKCE

SEQ ID NO: 541922 - protein, 12 aa, Mycobacterium
PKTLTPKRDLGK

SEQ ID NO: 541923 - protein, 8 aa, Mycobacterium
PKTPEPAV

SEQ ID NO: 541924 - protein, 6 aa, Mycobacterium
PKTPQL

SEQ ID NO: 541925 - protein, 15 aa, Mycobacterium
PKTPTDTAALDPDAG

SEQ ID NO: 541926 - protein, 7 aa, Mycobacterium
PKTRADL

SEQ ID NO: 541927 - protein, 7 aa, Mycobacterium
PKTSAGT

SEQ ID NO: 541928 - protein, 9 aa, Mycobacterium
PKTSAPVGP

SEQ ID NO: 541929 - protein, 11 aa, Mycobacterium
PKTSEPTLEQR

SEQ ID NO: 541930 - protein, 20 aa, Mycobacterium
PKTSKPVGPRISLQYRPRDV

SEQ ID NO: 541931 - protein, 23 aa, Mycobacterium
PKTSSGKLRRRATSERLKRCEPA

SEQ ID NO: 541932 - protein, 23 aa, Mycobacterium
PKTSSGKLRRRQTSERLRLFDDA

SEQ ID NO: 541933 - protein, 10 aa, Mycobacterium
PKTSSGKVQR

SEQ ID NO: 541934 - protein, 17 aa, Mycobacterium
PKTSSGKVQRHLLRRGM

SEQ ID NO: 541935 - protein, 8 aa, Mycobacterium
PKTSSTIV

SEQ ID NO: 541936 - protein, 9 aa, Mycobacterium
PKTSTGKIQ

SEQ ID NO: 541937 - protein, 20 aa, Mycobacterium
PKTTAPTGPRVSIQFRPRDV

SEQ ID NO: 541938 - protein, 10 aa, Mycobacterium
PKTTEEDLRR

SEQ ID NO: 541939 - protein, 10 aa, Mycobacterium
PKTTPQQEQA

SEQ ID NO: 541940 - protein, 20 aa, Mycobacterium
PKTTRPTGPRISIQFRPHDV

SEQ ID NO: 541941 - protein, 6 aa, Mycobacterium
PKTTVA

SEQ ID NO: 541942 - protein, 5 aa, Mycobacterium
PKVAT

SEQ ID NO: 541943 - protein, 4 aa, Mycobacterium
PKVD

SEQ ID NO: 541944 - protein, 14 aa, Mycobacterium
PKVDESKTKKVGDS

SEQ ID NO: 541945 - protein, 114 aa, Mycobacterium
PKVDPAKAVEPKTDPAKAVEPKADAAAEPAKPESSKPESSKAEVAKPVTAKPETKAQPAKPESAGPVKVTRDSLKSTPGETGTTGGTKTTEGSKGSVTDSKTPAASTDTKVHDG

SEQ ID NO: 541946 - protein, 23 aa, Mycobacterium
PKVERRTQAPGNPLTGAYRTSDG

SEQ ID NO: 541947 - protein, 17 aa, Mycobacterium
PKVLPDPRSARQPDGVH

SEQ ID NO: 541948 - protein, 18 aa, Mycobacterium
PKVLPDPRSARQPDGVHE

SEQ ID NO: 541949 - protein, 18 aa, Mycobacterium
PKVPDTGATSLDCDAEPV

SEQ ID NO: 541950 - protein, 5 aa, Mycobacterium
PKVPT

SEQ ID NO: 541951 - protein, 8 aa, Mycobacterium
PKVRGRGV

SEQ ID NO: 541952 - protein, 4 aa, Mycobacterium
PKVT

SEQ ID NO: 541953 - protein, 17 aa, Mycobacterium
PKVTGKPAGDDLRSGKR

SEQ ID NO: 541954 - protein, 8 aa, Mycobacterium
PKVTRAEA

SEQ ID NO: 541955 - protein, 7 aa, Mycobacterium
PKVTVGQ

SEQ ID NO: 541956 - protein, 6 aa, Mycobacterium
PKWPDM

SEQ ID NO: 541957 - protein, 12 aa, Mycobacterium
PKWPSRPPEGEQ

SEQ ID NO: 541958 - protein, 16 aa, Mycobacterium
PKWPTAGGNRPGDCRQ

SEQ ID NO: 541959 - protein, 14 aa, Mycobacterium
PKWRRGATQGHSGT

SEQ ID NO: 541960 - protein, 4 aa, Mycobacterium
PKYA

SEQ ID NO: 541961 - protein, 8 aa, Mycobacterium
PKYDQENT

SEQ ID NO: 541962 - protein, 13 aa, Mycobacterium
PKYEVTSGSITLD

SEQ ID NO: 541963 - protein, 14 aa, Mycobacterium
PKYEVTSGSITLDG

SEQ ID NO: 541964 - protein, 4 aa, Mycobacterium
PKYF

SEQ ID NO: 541965 - protein, 5 aa, Mycobacterium
PKYPA

SEQ ID NO: 541966 - protein, 15 aa, Mycobacterium
PKYPPMGKRTLQDDG

SEQ ID NO: 541967 - protein, 7 aa, Mycobacterium
PKYPQTE

SEQ ID NO: 541968 - protein, 12 aa, Mycobacterium
PKYQVTSGSITL

SEQ ID NO: 541969 - protein, 5 aa, Mycobacterium
PKYTP

SEQ ID NO: 541970 - protein, 12 aa, Mycobacterium
PKYTVTSGSITL

SEQ ID NO: 541971 - protein, 13 aa, Mycobacterium
PKYTVTSGSITLD

SEQ ID NO: 541972 - protein, 10 aa, Mycobacterium
PKYVGGLGKP

SEQ ID NO: 541973 - protein, 10 aa, Mycobacterium
PLAAAAADGA

SEQ ID NO: 541974 - protein, 10 aa, Mycobacterium
PLAAADGPLQ

SEQ ID NO: 541975 - protein, 11 aa, Mycobacterium
PLAAAGADDSL

SEQ ID NO: 541976 - protein, 10 aa, Mycobacterium
PLAAAQAEGA

SEQ ID NO: 541977 - protein, 7 aa, Mycobacterium
PLAADSS

SEQ ID NO: 541978 - protein, 15 aa, Mycobacterium
PLAAGAPLDAAAGAP

SEQ ID NO: 541979 - protein, 5 aa, Mycobacterium
PLAAP

SEQ ID NO: 541980 - protein, 10 aa, Mycobacterium
PLAAPDGPLQ

SEQ ID NO: 541981 - protein, 4 aa, Mycobacterium
PLAD

SEQ ID NO: 541982 - protein, 6 aa, Mycobacterium
PLADAS

SEQ ID NO: 541983 - protein, 16 aa, Mycobacterium
PLADDTMSALSLPGVF

SEQ ID NO: 541984 - protein, 10 aa, Mycobacterium
PLADEAAHQY

SEQ ID NO: 541985 - protein, 8 aa, Mycobacterium
PLADGDGW

SEQ ID NO: 541986 - protein, 5 aa, Mycobacterium
PLADK

SEQ ID NO: 541987 - protein, 11 aa, Mycobacterium
PLADSTANQAR

SEQ ID NO: 541988 - protein, 5 aa, Mycobacterium
PLADT

SEQ ID NO: 541989 - protein, 4 aa, Mycobacterium
PLAE

SEQ ID NO: 541990 - protein, 9 aa, Mycobacterium
PLAEARGEI

SEQ ID NO: 541991 - protein, 8 aa, Mycobacterium
PLAEATPT

SEQ ID NO: 541992 - protein, 9 aa, Mycobacterium
PLAEDDPAA

SEQ ID NO: 541993 - protein, 12 aa, Mycobacterium
PLAEKGAGLADS

SEQ ID NO: 541994 - protein, 5 aa, Mycobacterium
PLAEQ

SEQ ID NO: 541995 - protein, 9 aa, Mycobacterium
PLAESAEAL

SEQ ID NO: 541996 - protein, 11 aa, Mycobacterium
PLAESQGEVAY

SEQ ID NO: 541997 - protein, 22 aa, Mycobacterium
PLAETTARGQYGPGWQGSQQVP

SEQ ID NO: 541998 - protein, 12 aa, Mycobacterium
PLAGADPRSGRW

SEQ ID NO: 541999 - protein, 9 aa, Mycobacterium
PLAGDEPGV

SEQ ID NO: 542000 - protein, 14 aa, Mycobacterium
PLAGGSGPSSGAGL

SEQ ID NO: 542001 - protein, 5 aa, Mycobacterium
PLAGN

SEQ ID NO: 542002 - protein, 15 aa, Mycobacterium
PLAGQQRQALADGAR

SEQ ID NO: 542003 - protein, 11 aa, Mycobacterium
PLAGSDPAVGE

SEQ ID NO: 542004 - protein, 17 aa, Mycobacterium
PLAGSSPGRSCGDNQPQ

SEQ ID NO: 542005 - protein, 12 aa, Mycobacterium
PLAGTRALGRGV

SEQ ID NO: 542006 - protein, 8 aa, Mycobacterium
PLAGVSDE

SEQ ID NO: 542007 - protein, 4 aa, Mycobacterium
PLAI

SEQ ID NO: 542008 - protein, 9 aa, Mycobacterium
PLAKGDYSE

SEQ ID NO: 542009 - protein, 4 aa, Mycobacterium
PLAP

SEQ ID NO: 542010 - protein, 6 aa, Mycobacterium
PLAPDE

SEQ ID NO: 542011 - protein, 8 aa, Mycobacterium
PLAPESPL

SEQ ID NO: 542012 - protein, 16 aa, Mycobacterium
PLAPESRTPPIGAPVP

SEQ ID NO: 542013 - protein, 5 aa, Mycobacterium
PLAPG

SEQ ID NO: 542014 - protein, 6 aa, Mycobacterium
PLAPGG

SEQ ID NO: 542015 - protein, 6 aa, Mycobacterium
PLAPGS

SEQ ID NO: 542016 - protein, 19 aa, Mycobacterium
PLAPPGPVPPVPVAPPPVV

SEQ ID NO: 542017 - protein, 12 aa, Mycobacterium
PLAPPTPGESAP

SEQ ID NO: 542018 - protein, 8 aa, Mycobacterium
PLAPRPDR

SEQ ID NO: 542019 - protein, 12 aa, Mycobacterium
PLAPRSGPPPIG

SEQ ID NO: 542020 - protein, 5 aa, Mycobacterium
PLAPS

SEQ ID NO: 542021 - protein, 8 aa, Mycobacterium
PLAPSVDE

SEQ ID NO: 542022 - protein, 7 aa, Mycobacterium
PLAPTGH

SEQ ID NO: 542023 - protein, 16 aa, Mycobacterium
PLAPTGRGLPADGGVR

SEQ ID NO: 542024 - protein, 5 aa, Mycobacterium
PLAPY

SEQ ID NO: 542025 - protein, 8 aa, Mycobacterium
PLARPGAR

SEQ ID NO: 542026 - protein, 8 aa, Mycobacterium
PLARPPGH

SEQ ID NO: 542027 - protein, 15 aa, Mycobacterium
PLARRGAATNQPVRQ

SEQ ID NO: 542028 - protein, 4 aa, Mycobacterium
PLAS

SEQ ID NO: 542029 - protein, 5 aa, Mycobacterium
PLASA

SEQ ID NO: 542030 - protein, 9 aa, Mycobacterium
PLASDTGLS

SEQ ID NO: 542031 - protein, 5 aa, Mycobacterium
PLASG

SEQ ID NO: 542032 - protein, 9 aa, Mycobacterium
PLASGPARL

SEQ ID NO: 542033 - protein, 8 aa, Mycobacterium
PLASTPEE

SEQ ID NO: 542034 - protein, 12 aa, Mycobacterium
PLATPDDLATTA

SEQ ID NO: 542035 - protein, 8 aa, Mycobacterium
PLATPDDM

SEQ ID NO: 542036 - protein, 11 aa, Mycobacterium
PLATPDRNGRP

SEQ ID NO: 542037 - protein, 12 aa, Mycobacterium
PLATRRGDVERG

SEQ ID NO: 542038 - protein, 9 aa, Mycobacterium
PLATSAEAL

SEQ ID NO: 542039 - protein, 8 aa, Mycobacterium
PLCSPSRG

SEQ ID NO: 542040 - protein, 4 aa, Mycobacterium
PLDA

SEQ ID NO: 542041 - protein, 10 aa, Mycobacterium
PLDAQTALQT

SEQ ID NO: 542042 - protein, 4 aa, Mycobacterium
PLDD

SEQ ID NO: 542043 - protein, 14 aa, Mycobacterium
PLDDAARRALADGA

SEQ ID NO: 542044 - protein, 13 aa, Mycobacterium
PLDDDGNITDPGR

SEQ ID NO: 542045 - protein, 12 aa, Mycobacterium
PLDDDGNSAGGV

SEQ ID NO: 542046 - protein, 7 aa, Mycobacterium
PLDDENN

SEQ ID NO: 542047 - protein, 8 aa, Mycobacterium
PLDDEPTY

SEQ ID NO: 542048 - protein, 8 aa, Mycobacterium
PLDDERNA

SEQ ID NO: 542049 - protein, 10 aa, Mycobacterium
PLDDERNATL

SEQ ID NO: 542050 - protein, 5 aa, Mycobacterium
PLDDG

SEQ ID NO: 542051 - protein, 8 aa, Mycobacterium
PLDDGPTY

SEQ ID NO: 542052 - protein, 8 aa, Mycobacterium
PLDDKPTY

SEQ ID NO: 542053 - protein, 6 aa, Mycobacterium
PLDDRG

SEQ ID NO: 542054 - protein, 7 aa, Mycobacterium
PLDDRGL

SEQ ID NO: 542055 - protein, 9 aa, Mycobacterium
PLDDTDREP

SEQ ID NO: 542056 - protein, 11 aa, Mycobacterium
PLDDTGYRAPA

SEQ ID NO: 542057 - protein, 4 aa, Mycobacterium
PLDE

SEQ ID NO: 542058 - protein, 12 aa, Mycobacterium
PLDEATRELADE

SEQ ID NO: 542059 - protein, 14 aa, Mycobacterium
PLDEPARNALAEGA

SEQ ID NO: 542060 - protein, 6 aa, Mycobacterium
PLDEPE

SEQ ID NO: 542061 - protein, 16 aa, Mycobacterium
PLDEQGGVGGHHPGGG

SEQ ID NO: 542062 - protein, 16 aa, Mycobacterium
PLDERWESRDKTSAAL

SEQ ID NO: 542063 - protein, 5 aa, Mycobacterium
PLDET

SEQ ID NO: 542064 - protein, 7 aa, Mycobacterium
PLDETGC

SEQ ID NO: 542065 - protein, 10 aa, Mycobacterium
PLDGDARAPV

SEQ ID NO: 542066 - protein, 9 aa, Mycobacterium
PLDGDDREA

SEQ ID NO: 542067 - protein, 11 aa, Mycobacterium
PLDGPDDERID

SEQ ID NO: 542068 - protein, 8 aa, Mycobacterium
PLDGPPEL

SEQ ID NO: 542069 - protein, 7 aa, Mycobacterium
PLDGRRQ

SEQ ID NO: 542070 - protein, 11 aa, Mycobacterium
PLDITTDDATR

SEQ ID NO: 542071 - protein, 5 aa, Mycobacterium
PLDPA

SEQ ID NO: 542072 - protein, 28 aa, Mycobacterium
PLDPAAAAELENSARNAPLTRPRPGHAD

SEQ ID NO: 542073 - protein, 17 aa, Mycobacterium
PLDPADYPGAPPENLQP

SEQ ID NO: 542074 - protein, 10 aa, Mycobacterium
PLDPAEADQA

SEQ ID NO: 542075 - protein, 8 aa, Mycobacterium
PLDPARGA

SEQ ID NO: 542076 - protein, 5 aa, Mycobacterium
PLDPD

SEQ ID NO: 542077 - protein, 6 aa, Mycobacterium
PLDPGD

SEQ ID NO: 542078 - protein, 5 aa, Mycobacterium
PLDPP

SEQ ID NO: 542079 - protein, 14 aa, Mycobacterium
PLDPPGTPDDPETT

SEQ ID NO: 542080 - protein, 5 aa, Mycobacterium
PLDPR

SEQ ID NO: 542081 - protein, 6 aa, Mycobacterium
PLDPTD

SEQ ID NO: 542082 - protein, 12 aa, Mycobacterium
PLDQPTRPECVG

SEQ ID NO: 542083 - protein, 17 aa, Mycobacterium
PLDQQGGVGGHHPGGGP

SEQ ID NO: 542084 - protein, 23 aa, Mycobacterium
PLDQSRERGTAAEDASRDSASRW

SEQ ID NO: 542085 - protein, 5 aa, Mycobacterium
PLDRG

SEQ ID NO: 542086 - protein, 6 aa, Mycobacterium
PLDRGS

SEQ ID NO: 542087 - protein, 10 aa, Mycobacterium
PLDRSDDPLL

SEQ ID NO: 542088 - protein, 4 aa, Mycobacterium
PLDS

SEQ ID NO: 542089 - protein, 24 aa, Mycobacterium
PLDSAKHPEVPFGSRTPGFFGKPN

SEQ ID NO: 542090 - protein, 11 aa, Mycobacterium
PLDSDPPEHTG

SEQ ID NO: 542091 - protein, 7 aa, Mycobacterium
PLDSDPV

SEQ ID NO: 542092 - protein, 6 aa, Mycobacterium
PLDSET

SEQ ID NO: 542093 - protein, 7 aa, Mycobacterium
PLDSPYR

SEQ ID NO: 542094 - protein, 13 aa, Mycobacterium
PLDSRGDAPRTGE

SEQ ID NO: 542095 - protein, 7 aa, Mycobacterium
PLDSSAD

SEQ ID NO: 542096 - protein, 11 aa, Mycobacterium
PLDTDDSPMTL

SEQ ID NO: 542097 - protein, 15 aa, Mycobacterium
PLDTDRLGAEPPSDY

SEQ ID NO: 542098 - protein, 15 aa, Mycobacterium
PLDTERLGAPAPDTL

SEQ ID NO: 542099 - protein, 5 aa, Mycobacterium
PLDTQ

SEQ ID NO: 542100 - protein, 7 aa, Mycobacterium
PLDTQPA

SEQ ID NO: 542101 - protein, 7 aa, Mycobacterium
PLDTTDA

SEQ ID NO: 542102 - protein, 9 aa, Mycobacterium
PLDTTGHGS

SEQ ID NO: 542103 - protein, 23 aa, Mycobacterium
PLEATSGQTQTRHRLSRGGDRQL

SEQ ID NO: 542104 - protein, 7 aa, Mycobacterium
PLEDGST

SEQ ID NO: 542105 - protein, 7 aa, Mycobacterium
PLEDGTT

SEQ ID NO: 542106 - protein, 5 aa, Mycobacterium
PLEDT

SEQ ID NO: 542107 - protein, 8 aa, Mycobacterium
PLEEATRA

SEQ ID NO: 542108 - protein, 4 aa, Mycobacterium
PLEG

SEQ ID NO: 542109 - protein, 6 aa, Mycobacterium
PLEGDN

SEQ ID NO: 542110 - protein, 10 aa, Mycobacterium
PLEGFDPATV

SEQ ID NO: 542111 - protein, 10 aa, Mycobacterium
PLEGPERDDY

SEQ ID NO: 542112 - protein, 11 aa, Mycobacterium
PLEGQETPERG

SEQ ID NO: 542113 - protein, 14 aa, Mycobacterium
PLEKARAKAGKADV

SEQ ID NO: 542114 - protein, 4 aa, Mycobacterium
PLEP

SEQ ID NO: 542115 - protein, 7 aa, Mycobacterium
PLEPDER

SEQ ID NO: 542116 - protein, 16 aa, Mycobacterium
PLEPDGHAAPAAPPVR

SEQ ID NO: 542117 - protein, 6 aa, Mycobacterium
PLEPEQ

SEQ ID NO: 542118 - protein, 11 aa, Mycobacterium
PLEPKKAAELA

SEQ ID NO: 542119 - protein, 8 aa, Mycobacterium
PLEPPADG

SEQ ID NO: 542120 - protein, 16 aa, Mycobacterium
PLEPPASANPNILPAG

SEQ ID NO: 542121 - protein, 16 aa, Mycobacterium
PLEPPATANPNILPAG

SEQ ID NO: 542122 - protein, 14 aa, Mycobacterium
PLEPPGTPDDPTST

SEQ ID NO: 542123 - protein, 10 aa, Mycobacterium
PLEPRNNGAE

SEQ ID NO: 542124 - protein, 7 aa, Mycobacterium
PLEPTDA

SEQ ID NO: 542125 - protein, 4 aa, Mycobacterium
PLEQ

SEQ ID NO: 542126 - protein, 24 aa, Mycobacterium
PLEQAAQAHTDLEARKTTGSVVLV

SEQ ID NO: 542127 - protein, 9 aa, Mycobacterium
PLEQGEGDS

SEQ ID NO: 542128 - protein, 7 aa, Mycobacterium
PLEQNAP

SEQ ID NO: 542129 - protein, 4 aa, Mycobacterium
PLER

SEQ ID NO: 542130 - protein, 7 aa, Mycobacterium
PLERSNG

SEQ ID NO: 542131 - protein, 10 aa, Mycobacterium
PLESDRPELA

SEQ ID NO: 542132 - protein, 11 aa, Mycobacterium
PLESGDDGPVA

SEQ ID NO: 542133 - protein, 7 aa, Mycobacterium
PLESNAP

SEQ ID NO: 542134 - protein, 31 aa, Mycobacterium
PLESPGDGGDSPAWSRKRGAYEPPDQARMPA

SEQ ID NO: 542135 - protein, 4 aa, Mycobacterium
PLET

SEQ ID NO: 542136 - protein, 6 aa, Mycobacterium
PLETAD

SEQ ID NO: 542137 - protein, 6 aa, Mycobacterium
PLETPA

SEQ ID NO: 542138 - protein, 10 aa, Mycobacterium
PLETPGTRAA

SEQ ID NO: 542139 - protein, 6 aa, Mycobacterium
PLETSA

SEQ ID NO: 542140 - protein, 6 aa, Mycobacterium
PLETTV

SEQ ID NO: 542141 - protein, 8 aa, Mycobacterium
PLFETDDE

SEQ ID NO: 542142 - protein, 10 aa, Mycobacterium
PLGAATRELA

SEQ ID NO: 542143 - protein, 10 aa, Mycobacterium
PLGADESGVT

SEQ ID NO: 542144 - protein, 12 aa, Mycobacterium
PLGAGKTALTKG

SEQ ID NO: 542145 - protein, 7 aa, Mycobacterium
PLGAPPM

SEQ ID NO: 542146 - protein, 6 aa, Mycobacterium
PLGAPQ

SEQ ID NO: 542147 - protein, 9 aa, Mycobacterium
PLGAPTAWP

SEQ ID NO: 542148 - protein, 5 aa, Mycobacterium
PLGAQ

SEQ ID NO: 542149 - protein, 10 aa, Mycobacterium
PLGASGAGGT

SEQ ID NO: 542150 - protein, 8 aa, Mycobacterium
PLGASGGR

SEQ ID NO: 542151 - protein, 12 aa, Mycobacterium
PLGATAGNAVEV

SEQ ID NO: 542152 - protein, 4 aa, Mycobacterium
PLGD

SEQ ID NO: 542153 - protein, 6 aa, Mycobacterium
PLGDEA

SEQ ID NO: 542154 - protein, 5 aa, Mycobacterium
PLGDG

SEQ ID NO: 542155 - protein, 9 aa, Mycobacterium
PLGDGSTAA

SEQ ID NO: 542156 - protein, 5 aa, Mycobacterium
PLGDP

SEQ ID NO: 542157 - protein, 7 aa, Mycobacterium
PLGDSRD

SEQ ID NO: 542158 - protein, 13 aa, Mycobacterium
PLGDTKARTRTGA

SEQ ID NO: 542159 - protein, 4 aa, Mycobacterium
PLGE

SEQ ID NO: 542160 - protein, 7 aa, Mycobacterium
PLGEQRA

SEQ ID NO: 542161 - protein, 11 aa, Mycobacterium
PLGEQRAAADG

SEQ ID NO: 542162 - protein, 11 aa, Mycobacterium
PLGEQRAAETD

SEQ ID NO: 542163 - protein, 11 aa, Mycobacterium
PLGEQRAAETE

SEQ ID NO: 542164 - protein, 11 aa, Mycobacterium
PLGEQRSAATD

SEQ ID NO: 542165 - protein, 5 aa, Mycobacterium
PLGEY

SEQ ID NO: 542166 - protein, 4 aa, Mycobacterium
PLGG

SEQ ID NO: 542167 - protein, 5 aa, Mycobacterium
PLGGD

SEQ ID NO: 542168 - protein, 14 aa, Mycobacterium
PLGGPDGGNGGRGG

SEQ ID NO: 542169 - protein, 7 aa, Mycobacterium
PLGGPRA

SEQ ID NO: 542170 - protein, 8 aa, Mycobacterium
PLGGRSGA

SEQ ID NO: 542171 - protein, 5 aa, Mycobacterium
PLGHA

SEQ ID NO: 542172 - protein, 4 aa, Mycobacterium
PLGL

SEQ ID NO: 542173 - protein, 9 aa, Mycobacterium
PLGLGDERA

SEQ ID NO: 542174 - protein, 5 aa, Mycobacterium
PLGNA

SEQ ID NO: 542175 - protein, 7 aa, Mycobacterium
PLGPGGD

SEQ ID NO: 542176 - protein, 7 aa, Mycobacterium
PLGPGQP

SEQ ID NO: 542177 - protein, 8 aa, Mycobacterium
PLGPGQPP

SEQ ID NO: 542178 - protein, 9 aa, Mycobacterium
PLGPGQPPS

SEQ ID NO: 542179 - protein, 18 aa, Mycobacterium
PLGPGSGVPPIGSPVPGA

SEQ ID NO: 542180 - protein, 9 aa, Mycobacterium
PLGPKGTAA

SEQ ID NO: 542181 - protein, 5 aa, Mycobacterium
PLGPL

SEQ ID NO: 542182 - protein, 7 aa, Mycobacterium
PLGPLAP

SEQ ID NO: 542183 - protein, 8 aa, Mycobacterium
PLGPLAPG

SEQ ID NO: 542184 - protein, 5 aa, Mycobacterium
PLGPN

SEQ ID NO: 542185 - protein, 11 aa, Mycobacterium
PLGPPADWSPE

SEQ ID NO: 542186 - protein, 10 aa, Mycobacterium
PLGPPGEDEL

SEQ ID NO: 542187 - protein, 23 aa, Mycobacterium
PLGPPPGPGPAQAQPQPQGDGFA

SEQ ID NO: 542188 - protein, 8 aa, Mycobacterium
PLGPPQEW

SEQ ID NO: 542189 - protein, 12 aa, Mycobacterium
PLGPPVHDPGSL

SEQ ID NO: 542190 - protein, 10 aa, Mycobacterium
PLGPSGDYQA

SEQ ID NO: 542191 - protein, 14 aa, Mycobacterium
PLGPSLSKRGRRSV

SEQ ID NO: 542192 - protein, 8 aa, Mycobacterium
PLGPTGAG

SEQ ID NO: 542193 - protein, 12 aa, Mycobacterium
PLGPTTARSQHR

SEQ ID NO: 542194 - protein, 4 aa, Mycobacterium
PLGQ

SEQ ID NO: 542195 - protein, 15 aa, Mycobacterium
PLGQAQLLDDGHRVN

SEQ ID NO: 542196 - protein, 8 aa, Mycobacterium
PLGQPRTI

SEQ ID NO: 542197 - protein, 10 aa, Mycobacterium
PLGQPSDASA

SEQ ID NO: 542198 - protein, 4 aa, Mycobacterium
PLGR

SEQ ID NO: 542199 - protein, 12 aa, Mycobacterium
PLGRAAQPSEMA

SEQ ID NO: 542200 - protein, 8 aa, Mycobacterium
PLGRQAEM

SEQ ID NO: 542201 - protein, 8 aa, Mycobacterium
PLGRQAEV

SEQ ID NO: 542202 - protein, 15 aa, Mycobacterium
PLGRQAEVARRAATV

SEQ ID NO: 542203 - protein, 4 aa, Mycobacterium
PLGS

SEQ ID NO: 542204 - protein, 10 aa, Mycobacterium
PLGSDPDAAF

SEQ ID NO: 542205 - protein, 8 aa, Mycobacterium
PLGSTDMG

SEQ ID NO: 542206 - protein, 7 aa, Mycobacterium
PLGSTGA

SEQ ID NO: 542207 - protein, 10 aa, Mycobacterium
PLGSTGESAY

SEQ ID NO: 542208 - protein, 9 aa, Mycobacterium
PLGSTVGNS

SEQ ID NO: 542209 - protein, 7 aa, Mycobacterium
PLGTDGR

SEQ ID NO: 542210 - protein, 7 aa, Mycobacterium
PLGTDPE

SEQ ID NO: 542211 - protein, 9 aa, Mycobacterium
PLGTEDELR

SEQ ID NO: 542212 - protein, 5 aa, Mycobacterium
PLGTG

SEQ ID NO: 542213 - protein, 13 aa, Mycobacterium
PLGTGESSQPARD

SEQ ID NO: 542214 - protein, 11 aa, Mycobacterium
PLGTGSDGQPV

SEQ ID NO: 542215 - protein, 7 aa, Mycobacterium
PLGTHPG

SEQ ID NO: 542216 - protein, 4 aa, Mycobacterium
PLGV

SEQ ID NO: 542217 - protein, 5 aa, Mycobacterium
PLGYS

SEQ ID NO: 542218 - protein, 7 aa, Mycobacterium
PLHERDP

SEQ ID NO: 542219 - protein, 7 aa, Mycobacterium
PLHGGAP

SEQ ID NO: 542220 - protein, 8 aa, Mycobacterium
PLHPASDA

SEQ ID NO: 542221 - protein, 10 aa, Mycobacterium
PLHPPSTATT

SEQ ID NO: 542222 - protein, 13 aa, Mycobacterium
PLHPSQGIERRAS

SEQ ID NO: 542223 - protein, 8 aa, Mycobacterium
PLHPSQSV

SEQ ID NO: 542224 - protein, 6 aa, Mycobacterium
PLHRGR

SEQ ID NO: 542225 - protein, 5 aa, Mycobacterium
PLIPG

SEQ ID NO: 542226 - protein, 5 aa, Mycobacterium
PLKAG

SEQ ID NO: 542227 - protein, 9 aa, Mycobacterium
PLKDTDPAM

SEQ ID NO: 542228 - protein, 9 aa, Mycobacterium
PLKNTATEI

SEQ ID NO: 542229 - protein, 4 aa, Mycobacterium
PLKP

SEQ ID NO: 542230 - protein, 6 aa, Mycobacterium
PLKPTE

SEQ ID NO: 542231 - protein, 17 aa, Mycobacterium
PLKRDPNGSGKSEQPFT

SEQ ID NO: 542232 - protein, 13 aa, Mycobacterium
PLKREDSARSQPF

SEQ ID NO: 542233 - protein, 15 aa, Mycobacterium
PLKSASREERTRAVE

SEQ ID NO: 542234 - protein, 5 aa, Mycobacterium
PLLGQ

SEQ ID NO: 542235 - protein, 14 aa, Mycobacterium
PLLPDEPEGRDDGL

SEQ ID NO: 542236 - protein, 15 aa, Mycobacterium
PLNADAGAPIGSPVP

SEQ ID NO: 542237 - protein, 4 aa, Mycobacterium
PLND

SEQ ID NO: 542238 - protein, 4 aa, Mycobacterium
PLNG

SEQ ID NO: 542239 - protein, 16 aa, Mycobacterium
PLNGKDVRYESGRALG

SEQ ID NO: 542240 - protein, 16 aa, Mycobacterium
PLNPNEQSKKDDNPLN

SEQ ID NO: 542241 - protein, 14 aa, Mycobacterium
PLNPPGTPDDPAST

SEQ ID NO: 542242 - protein, 10 aa, Mycobacterium
PLNPRAADPE

SEQ ID NO: 542243 - protein, 16 aa, Mycobacterium
PLNQGDLGSCTGNATA

SEQ ID NO: 542244 - protein, 8 aa, Mycobacterium
PLNRQKSV

SEQ ID NO: 542245 - protein, 15 aa, Mycobacterium
PLNSNEQVKKDDHPL

SEQ ID NO: 542246 - protein, 11 aa, Mycobacterium
PLNSPRSPQGH

SEQ ID NO: 542247 - protein, 6 aa, Mycobacterium
PLNTQS

SEQ ID NO: 542248 - protein, 7 aa, Mycobacterium
PLNTSGS

SEQ ID NO: 542249 - protein, 9 aa, Mycobacterium
PLPADDGFA

SEQ ID NO: 542250 - protein, 5 aa, Mycobacterium
PLPAE

SEQ ID NO: 542251 - protein, 7 aa, Mycobacterium
PLPAEAA

SEQ ID NO: 542252 - protein, 11 aa, Mycobacterium
PLPAEDGSADR

SEQ ID NO: 542253 - protein, 11 aa, Mycobacterium
PLPAETGPAPY

SEQ ID NO: 542254 - protein, 13 aa, Mycobacterium
PLPAGADAHPNGA

SEQ ID NO: 542255 - protein, 11 aa, Mycobacterium
PLPAGDGSADR

SEQ ID NO: 542256 - protein, 6 aa, Mycobacterium
PLPAGL

SEQ ID NO: 542257 - protein, 11 aa, Mycobacterium
PLPAGRPGVAG

SEQ ID NO: 542258 - protein, 9 aa, Mycobacterium
PLPAGTTRT

SEQ ID NO: 542259 - protein, 11 aa, Mycobacterium
PLPAIESSPGL

SEQ ID NO: 542260 - protein, 10 aa, Mycobacterium
PLPAPAPEAV

SEQ ID NO: 542261 - protein, 18 aa, Mycobacterium
PLPAPETGARSRADALRR

SEQ ID NO: 542262 - protein, 20 aa, Mycobacterium
PLPAPPANAVRPRGRFESTP

SEQ ID NO: 542263 - protein, 9 aa, Mycobacterium
PLPAPPSLT

SEQ ID NO: 542264 - protein, 6 aa, Mycobacterium
PLPAPR

SEQ ID NO: 542265 - protein, 7 aa, Mycobacterium
PLPAPRI

SEQ ID NO: 542266 - protein, 10 aa, Mycobacterium
PLPAPSGQTE

SEQ ID NO: 542267 - protein, 13 aa, Mycobacterium
PLPASSGNTSRHR

SEQ ID NO: 542268 - protein, 16 aa, Mycobacterium
PLPDDVSAGSPEERAA

SEQ ID NO: 542269 - protein, 6 aa, Mycobacterium
PLPDGA

SEQ ID NO: 542270 - protein, 6 aa, Mycobacterium
PLPDGS

SEQ ID NO: 542271 - protein, 5 aa, Mycobacterium
PLPDN

SEQ ID NO: 542272 - protein, 5 aa, Mycobacterium
PLPDP

SEQ ID NO: 542273 - protein, 6 aa, Mycobacterium
PLPDPF

SEQ ID NO: 542274 - protein, 9 aa, Mycobacterium
PLPDPGDSI

SEQ ID NO: 542275 - protein, 7 aa, Mycobacterium
PLPDPGI

SEQ ID NO: 542276 - protein, 9 aa, Mycobacterium
PLPDPSAPV

SEQ ID NO: 542277 - protein, 6 aa, Mycobacterium
PLPDQS

SEQ ID NO: 542278 - protein, 7 aa, Mycobacterium
PLPDRPA

SEQ ID NO: 542279 - protein, 5 aa, Mycobacterium
PLPDS

SEQ ID NO: 542280 - protein, 10 aa, Mycobacterium
PLPDSALGSY

SEQ ID NO: 542281 - protein, 7 aa, Mycobacterium
PLPDTET

SEQ ID NO: 542282 - protein, 11 aa, Mycobacterium
PLPDTVEPQSA

SEQ ID NO: 542283 - protein, 13 aa, Mycobacterium
PLPEANRAALADG

SEQ ID NO: 542284 - protein, 15 aa, Mycobacterium
PLPEAPPGPPPAYAG

SEQ ID NO: 542285 - protein, 6 aa, Mycobacterium
PLPEAQ

SEQ ID NO: 542286 - protein, 13 aa, Mycobacterium
PLPEARSGRSARE

SEQ ID NO: 542287 - protein, 10 aa, Mycobacterium
PLPEDPRYDP

SEQ ID NO: 542288 - protein, 13 aa, Mycobacterium
PLPEHAPDFARRS

SEQ ID NO: 542289 - protein, 20 aa, Mycobacterium
PLPELSSADPADSAAARTLG

SEQ ID NO: 542290 - protein, 27 aa, Mycobacterium
PLPEPPDLPGAAAPDPSRRAERRTRAL

SEQ ID NO: 542291 - protein, 20 aa, Mycobacterium
PLPEPPELPGVSGANPCRRA

SEQ ID NO: 542292 - protein, 16 aa, Mycobacterium
PLPERDAEPTELPGDL

SEQ ID NO: 542293 - protein, 9 aa, Mycobacterium
PLPESPDDD

SEQ ID NO: 542294 - protein, 11 aa, Mycobacterium
PLPETGEDPAA

SEQ ID NO: 542295 - protein, 5 aa, Mycobacterium
PLPFD

SEQ ID NO: 542296 - protein, 7 aa, Mycobacterium
PLPFSGR

SEQ ID NO: 542297 - protein, 5 aa, Mycobacterium
PLPGA

SEQ ID NO: 542298 - protein, 18 aa, Mycobacterium
PLPGAGPVDAAPELQPTL

SEQ ID NO: 542299 - protein, 5 aa, Mycobacterium
PLPGD

SEQ ID NO: 542300 - protein, 6 aa, Mycobacterium
PLPGEP

SEQ ID NO: 542301 - protein, 7 aa, Mycobacterium
PLPGESH

SEQ ID NO: 542302 - protein, 5 aa, Mycobacterium
PLPGG

SEQ ID NO: 542303 - protein, 7 aa, Mycobacterium
PLPGGAP

SEQ ID NO: 542304 - protein, 10 aa, Mycobacterium
PLPGGFPTSL

SEQ ID NO: 542305 - protein, 5 aa, Mycobacterium
PLPGN

SEQ ID NO: 542306 - protein, 16 aa, Mycobacterium
PLPGNGLSSVAPGEGG

SEQ ID NO: 542307 - protein, 9 aa, Mycobacterium
PLPGNPDPV

SEQ ID NO: 542308 - protein, 10 aa, Mycobacterium
PLPGNTGDHA

SEQ ID NO: 542309 - protein, 6 aa, Mycobacterium
PLPGNV

SEQ ID NO: 542310 - protein, 8 aa, Mycobacterium
PLPGPDTE

SEQ ID NO: 542311 - protein, 16 aa, Mycobacterium
PLPGPRSGALAERRRA

SEQ ID NO: 542312 - protein, 10 aa, Mycobacterium
PLPGQAAYGA

SEQ ID NO: 542313 - protein, 7 aa, Mycobacterium
PLPGQEA

SEQ ID NO: 542314 - protein, 5 aa, Mycobacterium
PLPGR

SEQ ID NO: 542315 - protein, 22 aa, Mycobacterium
PLPGRRRPSSRAVRSARVIDTD

SEQ ID NO: 542316 - protein, 10 aa, Mycobacterium
PLPGTEDGAA

SEQ ID NO: 542317 - protein, 7 aa, Mycobacterium
PLPGTGR

SEQ ID NO: 542318 - protein, 13 aa, Mycobacterium
PLPGTVGTGSDAV

SEQ ID NO: 542319 - protein, 6 aa, Mycobacterium
PLPGVS

SEQ ID NO: 542320 - protein, 7 aa, Mycobacterium
PLPGVTD

SEQ ID NO: 542321 - protein, 8 aa, Mycobacterium
PLPHPDPI

SEQ ID NO: 542322 - protein, 9 aa, Mycobacterium
PLPHPDPVD

SEQ ID NO: 542323 - protein, 10 aa, Mycobacterium
PLPHPGDGNP

SEQ ID NO: 542324 - protein, 9 aa, Mycobacterium
PLPISSRER

SEQ ID NO: 542325 - protein, 7 aa, Mycobacterium
PLPKDAA

SEQ ID NO: 542326 - protein, 7 aa, Mycobacterium
PLPKSGW

SEQ ID NO: 542327 - protein, 7 aa, Mycobacterium
PLPLPPS

SEQ ID NO: 542328 - protein, 8 aa, Mycobacterium
PLPLPPSK

SEQ ID NO: 542329 - protein, 5 aa, Mycobacterium
PLPLT

SEQ ID NO: 542330 - protein, 4 aa, Mycobacterium
PLPN

SEQ ID NO: 542331 - protein, 5 aa, Mycobacterium
PLPNS

SEQ ID NO: 542332 - protein, 11 aa, Mycobacterium
PLPNTAGCRSA

SEQ ID NO: 542333 - protein, 12 aa, Mycobacterium
PLPNTAGCRSAA

SEQ ID NO: 542334 - protein, 5 aa, Mycobacterium
PLPPA

SEQ ID NO: 542335 - protein, 7 aa, Mycobacterium
PLPPAAA

SEQ ID NO: 542336 - protein, 7 aa, Mycobacterium
PLPPAGK

SEQ ID NO: 542337 - protein, 16 aa, Mycobacterium
PLPPDSLTQSRTATLT

SEQ ID NO: 542338 - protein, 6 aa, Mycobacterium
PLPPEE

SEQ ID NO: 542339 - protein, 6 aa, Mycobacterium
PLPPGL

SEQ ID NO: 542340 - protein, 7 aa, Mycobacterium
PLPPGLT

SEQ ID NO: 542341 - protein, 7 aa, Mycobacterium
PLPPGSY

SEQ ID NO: 542342 - protein, 6 aa, Mycobacterium
PLPPLP

SEQ ID NO: 542343 - protein, 7 aa, Mycobacterium
PLPPLPT

SEQ ID NO: 542344 - protein, 6 aa, Mycobacterium
PLPPLS

SEQ ID NO: 542345 - protein, 16 aa, Mycobacterium
PLPPPADLPDAHTDDD

SEQ ID NO: 542346 - protein, 35 aa, Mycobacterium
PLPPPAPGRLPPLTPGEMATPRLPAPPPQPPIRGG

SEQ ID NO: 542347 - protein, 9 aa, Mycobacterium
PLPPPGGQW

SEQ ID NO: 542348 - protein, 8 aa, Mycobacterium
PLPPPLPD

SEQ ID NO: 542349 - protein, 8 aa, Mycobacterium
PLPPPPAG

SEQ ID NO: 542350 - protein, 5 aa, Mycobacterium
PLPPR

SEQ ID NO: 542351 - protein, 5 aa, Mycobacterium
PLPPT

SEQ ID NO: 542352 - protein, 18 aa, Mycobacterium
PLPPTGATLPAQTGLTTP

SEQ ID NO: 542353 - protein, 7 aa, Mycobacterium
PLPPTGQ

SEQ ID NO: 542354 - protein, 7 aa, Mycobacterium
PLPQADR

SEQ ID NO: 542355 - protein, 12 aa, Mycobacterium
PLPQDADGTDPL

SEQ ID NO: 542356 - protein, 9 aa, Mycobacterium
PLPQGDPLP

SEQ ID NO: 542357 - protein, 9 aa, Mycobacterium
PLPQRPAVP

SEQ ID NO: 542358 - protein, 4 aa, Mycobacterium
PLPR

SEQ ID NO: 542359 - protein, 6 aa, Mycobacterium
PLPRAD

SEQ ID NO: 542360 - protein, 14 aa, Mycobacterium
PLPREHGHGRRGLG

SEQ ID NO: 542361 - protein, 5 aa, Mycobacterium
PLPRN

SEQ ID NO: 542362 - protein, 9 aa, Mycobacterium
PLPRPGEVE

SEQ ID NO: 542363 - protein, 13 aa, Mycobacterium
PLPSAADAAQRLR

SEQ ID NO: 542364 - protein, 16 aa, Mycobacterium
PLPSPDTENDTRSTGF

SEQ ID NO: 542365 - protein, 12 aa, Mycobacterium
PLPSRAHADDAG

SEQ ID NO: 542366 - protein, 10 aa, Mycobacterium
PLPSTAKSTR

SEQ ID NO: 542367 - protein, 5 aa, Mycobacterium
PLPTD

SEQ ID NO: 542368 - protein, 7 aa, Mycobacterium
PLPTDDE

SEQ ID NO: 542369 - protein, 6 aa, Mycobacterium
PLPTDT

SEQ ID NO: 542370 - protein, 16 aa, Mycobacterium
PLPTEIDEPQRWIDRV

SEQ ID NO: 542371 - protein, 9 aa, Mycobacterium
PLPTETRSA

SEQ ID NO: 542372 - protein, 5 aa, Mycobacterium
PLPTG

SEQ ID NO: 542373 - protein, 19 aa, Mycobacterium
PLPTGPGGAPGCPTGGAGL

SEQ ID NO: 542374 - protein, 6 aa, Mycobacterium
PLPTGS

SEQ ID NO: 542375 - protein, 12 aa, Mycobacterium
PLPTINPAYGSK

SEQ ID NO: 542376 - protein, 7 aa, Mycobacterium
PLPTNAA

SEQ ID NO: 542377 - protein, 22 aa, Mycobacterium
PLPTREPMRRNGPAADESSTAS

SEQ ID NO: 542378 - protein, 12 aa, Mycobacterium
PLPTSDYGVDPE

SEQ ID NO: 542379 - protein, 12 aa, Mycobacterium
PLPTSPGYTGNT

SEQ ID NO: 542380 - protein, 11 aa, Mycobacterium
PLPTSSDGFPE

SEQ ID NO: 542381 - protein, 5 aa, Mycobacterium
PLPTT

SEQ ID NO: 542382 - protein, 5 aa, Mycobacterium
PLPVE

SEQ ID NO: 542383 - protein, 5 aa, Mycobacterium
PLPVP

SEQ ID NO: 542384 - protein, 7 aa, Mycobacterium
PLPVPGL

SEQ ID NO: 542385 - protein, 5 aa, Mycobacterium
PLPVT

SEQ ID NO: 542386 - protein, 8 aa, Mycobacterium
PLPYSSGQ

SEQ ID NO: 542387 - protein, 16 aa, Mycobacterium
PLQAGAASAPIGSPVP

SEQ ID NO: 542388 - protein, 8 aa, Mycobacterium
PLQDPDRA

SEQ ID NO: 542389 - protein, 8 aa, Mycobacterium
PLQGPNGK

SEQ ID NO: 542390 - protein, 7 aa, Mycobacterium
PLQKPHP

SEQ ID NO: 542391 - protein, 7 aa, Mycobacterium
PLQPADE

SEQ ID NO: 542392 - protein, 6 aa, Mycobacterium
PLQPAP

SEQ ID NO: 542393 - protein, 25 aa, Mycobacterium
PLQPAPVTPPLPAPAPETVAAPAPV

SEQ ID NO: 542394 - protein, 6 aa, Mycobacterium
PLQPDG

SEQ ID NO: 542395 - protein, 8 aa, Mycobacterium
PLQPQADR

SEQ ID NO: 542396 - protein, 8 aa, Mycobacterium
PLQPQPDR

SEQ ID NO: 542397 - protein, 8 aa, Mycobacterium
PLQPRPDR

SEQ ID NO: 542398 - protein, 13 aa, Mycobacterium
PLQPSDDNARKLA

SEQ ID NO: 542399 - protein, 7 aa, Mycobacterium
PLQQPHP

SEQ ID NO: 542400 - protein, 6 aa, Mycobacterium
PLQQPK

SEQ ID NO: 542401 - protein, 5 aa, Mycobacterium
PLQRA

SEQ ID NO: 542402 - protein, 11 aa, Mycobacterium
PLQRGRDAQIP

SEQ ID NO: 542403 - protein, 11 aa, Mycobacterium
PLQRTDPGAPF

SEQ ID NO: 542404 - protein, 9 aa, Mycobacterium
PLQSGRPLQ

SEQ ID NO: 542405 - protein, 4 aa, Mycobacterium
PLQT

SEQ ID NO: 542406 - protein, 7 aa, Mycobacterium
PLQTQAS

SEQ ID NO: 542407 - protein, 5 aa, Mycobacterium
PLQTR

SEQ ID NO: 542408 - protein, 5 aa, Mycobacterium
PLQTS

SEQ ID NO: 542409 - protein, 4 aa, Mycobacterium
PLRA

SEQ ID NO: 542410 - protein, 6 aa, Mycobacterium
PLRAGD

SEQ ID NO: 542411 - protein, 17 aa, Mycobacterium
PLRAKPPLEAAKDQYRA

SEQ ID NO: 542412 - protein, 11 aa, Mycobacterium
PLRAVPDDGYP

SEQ ID NO: 542413 - protein, 14 aa, Mycobacterium
PLRDDAGKARRSAV

SEQ ID NO: 542414 - protein, 14 aa, Mycobacterium
PLRDDAGKARRTAV

SEQ ID NO: 542415 - protein, 8 aa, Mycobacterium
PLRDDDGA

SEQ ID NO: 542416 - protein, 9 aa, Mycobacterium
PLRDDGAKY

SEQ ID NO: 542417 - protein, 5 aa, Mycobacterium
PLRDE

SEQ ID NO: 542418 - protein, 10 aa, Mycobacterium
PLRDEGEAYA

SEQ ID NO: 542419 - protein, 10 aa, Mycobacterium
PLRDEGENYA

SEQ ID NO: 542420 - protein, 11 aa, Mycobacterium
PLRDEGENYAT

SEQ ID NO: 542421 - protein, 10 aa, Mycobacterium
PLRDEGEQYA

SEQ ID NO: 542422 - protein, 10 aa, Mycobacterium
PLRDEGNRYA

SEQ ID NO: 542423 - protein, 16 aa, Mycobacterium
PLRDEPGLTGEEAARR

SEQ ID NO: 542424 - protein, 6 aa, Mycobacterium
PLRDGD

SEQ ID NO: 542425 - protein, 7 aa, Mycobacterium
PLRETES

SEQ ID NO: 542426 - protein, 4 aa, Mycobacterium
PLRG

SEQ ID NO: 542427 - protein, 20 aa, Mycobacterium
PLRGGPAARPVAVRNDALQY

SEQ ID NO: 542428 - protein, 5 aa, Mycobacterium
PLRGN

SEQ ID NO: 542429 - protein, 7 aa, Mycobacterium
PLRGPDA

SEQ ID NO: 542430 - protein, 5 aa, Mycobacterium
PLRGR

SEQ ID NO: 542431 - protein, 7 aa, Mycobacterium
PLRGSKA

SEQ ID NO: 542432 - protein, 9 aa, Mycobacterium
PLRGSKSHV

SEQ ID NO: 542433 - protein, 11 aa, Mycobacterium
PLRKDAERNRK

SEQ ID NO: 542434 - protein, 7 aa, Mycobacterium
PLRNNGS

SEQ ID NO: 542435 - protein, 14 aa, Mycobacterium
PLRPAGRVNPGSRY

SEQ ID NO: 542436 - protein, 16 aa, Mycobacterium
PLRPAPPRSRSPLGSS

SEQ ID NO: 542437 - protein, 6 aa, Mycobacterium
PLRPGS

SEQ ID NO: 542438 - protein, 6 aa, Mycobacterium
PLRPGW

SEQ ID NO: 542439 - protein, 9 aa, Mycobacterium
PLRPHPSDP

SEQ ID NO: 542440 - protein, 13 aa, Mycobacterium
PLRPPKRINPGAR

SEQ ID NO: 542441 - protein, 13 aa, Mycobacterium
PLRPPQRINPGAR

SEQ ID NO: 542442 - protein, 18 aa, Mycobacterium
PLRPPQRTPVRETPPPRS

SEQ ID NO: 542443 - protein, 6 aa, Mycobacterium
PLRPTD

SEQ ID NO: 542444 - protein, 14 aa, Mycobacterium
PLRPTKRINPGPRY

SEQ ID NO: 542445 - protein, 7 aa, Mycobacterium
PLRQAPH

SEQ ID NO: 542446 - protein, 4 aa, Mycobacterium
PLRR

SEQ ID NO: 542447 - protein, 8 aa, Mycobacterium
PLRRGSPI

SEQ ID NO: 542448 - protein, 13 aa, Mycobacterium
PLRSGEPARPAGR

SEQ ID NO: 542449 - protein, 9 aa, Mycobacterium
PLRSPGGEH

SEQ ID NO: 542450 - protein, 9 aa, Mycobacterium
PLRSRPRDT

SEQ ID NO: 542451 - protein, 12 aa, Mycobacterium
PLRTDENPFGAS

SEQ ID NO: 542452 - protein, 7 aa, Mycobacterium
PLRTGEQ

SEQ ID NO: 542453 - protein, 6 aa, Mycobacterium
PLRTGQ

SEQ ID NO: 542454 - protein, 16 aa, Mycobacterium
PLRTSHRRPVVSWSAV

SEQ ID NO: 542455 - protein, 13 aa, Mycobacterium
PLSAADIDEAARR

SEQ ID NO: 542456 - protein, 9 aa, Mycobacterium
PLSADDAAT

SEQ ID NO: 542457 - protein, 10 aa, Mycobacterium
PLSADERQTT

SEQ ID NO: 542458 - protein, 8 aa, Mycobacterium
PLSAEQAE

SEQ ID NO: 542459 - protein, 9 aa, Mycobacterium
PLSAGDARA

SEQ ID NO: 542460 - protein, 7 aa, Mycobacterium
PLSAGEL

SEQ ID NO: 542461 - protein, 10 aa, Mycobacterium
PLSANDSHSQ

SEQ ID NO: 542462 - protein, 5 aa, Mycobacterium
PLSAP

SEQ ID NO: 542463 - protein, 9 aa, Mycobacterium
PLSAPEAET

SEQ ID NO: 542464 - protein, 9 aa, Mycobacterium
PLSAQEAEA

SEQ ID NO: 542465 - protein, 6 aa, Mycobacterium
PLSDAG

SEQ ID NO: 542466 - protein, 12 aa, Mycobacterium
PLSDDQRTQIEE

SEQ ID NO: 542467 - protein, 5 aa, Mycobacterium
PLSDE

SEQ ID NO: 542468 - protein, 7 aa, Mycobacterium
PLSDPGD

SEQ ID NO: 542469 - protein, 6 aa, Mycobacterium
PLSEDD

SEQ ID NO: 542470 - protein, 17 aa, Mycobacterium
PLSEEQRTQVEEVTNQA

SEQ ID NO: 542471 - protein, 4 aa, Mycobacterium
PLSG

SEQ ID NO: 542472 - protein, 14 aa, Mycobacterium
PLSGAERTALTDGA

SEQ ID NO: 542473 - protein, 5 aa, Mycobacterium
PLSGH

SEQ ID NO: 542474 - protein, 8 aa, Mycobacterium
PLSGIGPD

SEQ ID NO: 542475 - protein, 12 aa, Mycobacterium
PLSGRAGEFPDA

SEQ ID NO: 542476 - protein, 12 aa, Mycobacterium
PLSGRAGGNADI

SEQ ID NO: 542477 - protein, 12 aa, Mycobacterium
PLSGRAGGNVDA

SEQ ID NO: 542478 - protein, 7 aa, Mycobacterium
PLSGRHG

SEQ ID NO: 542479 - protein, 6 aa, Mycobacterium
PLSGSA

SEQ ID NO: 542480 - protein, 9 aa, Mycobacterium
PLSGSADQD

SEQ ID NO: 542481 - protein, 14 aa, Mycobacterium
PLSGSRREFVSPRE

SEQ ID NO: 542482 - protein, 12 aa, Mycobacterium
PLSKGGTVAKGV

SEQ ID NO: 542483 - protein, 5 aa, Mycobacterium
PLSPA

SEQ ID NO: 542484 - protein, 6 aa, Mycobacterium
PLSPAV

SEQ ID NO: 542485 - protein, 6 aa, Mycobacterium
PLSPDL

SEQ ID NO: 542486 - protein, 7 aa, Mycobacterium
PLSPERA

SEQ ID NO: 542487 - protein, 6 aa, Mycobacterium
PLSPGL

SEQ ID NO: 542488 - protein, 10 aa, Mycobacterium
PLSPGNYNKS

SEQ ID NO: 542489 - protein, 12 aa, Mycobacterium
PLSPHPNDPIRS

SEQ ID NO: 542490 - protein, 16 aa, Mycobacterium
PLSPPEAPRDDEASWQ

SEQ ID NO: 542491 - protein, 8 aa, Mycobacterium
PLSPQRAR

SEQ ID NO: 542492 - protein, 7 aa, Mycobacterium
PLSPRGV

SEQ ID NO: 542493 - protein, 7 aa, Mycobacterium
PLSPTLQ

SEQ ID NO: 542494 - protein, 5 aa, Mycobacterium
PLSPV

SEQ ID NO: 542495 - protein, 7 aa, Mycobacterium
PLSRGAD

SEQ ID NO: 542496 - protein, 4 aa, Mycobacterium
PLSS

SEQ ID NO: 542497 - protein, 7 aa, Mycobacterium
PLSSAER

SEQ ID NO: 542498 - protein, 15 aa, Mycobacterium
PLSSPAAGPDVPSPM

SEQ ID NO: 542499 - protein, 11 aa, Mycobacterium
PLSSPLTPNFP

SEQ ID NO: 542500 - protein, 9 aa, Mycobacterium
PLSSPVPKA

SEQ ID NO: 542501 - protein, 8 aa, Mycobacterium
PLSSVANS

SEQ ID NO: 542502 - protein, 12 aa, Mycobacterium
PLSSVTDSHVTG

SEQ ID NO: 542503 - protein, 15 aa, Mycobacterium
PLSTGAGGHGRPPRI

SEQ ID NO: 542504 - protein, 9 aa, Mycobacterium
PLSTKTKDQ

SEQ ID NO: 542505 - protein, 7 aa, Mycobacterium
PLSTPGA

SEQ ID NO: 542506 - protein, 7 aa, Mycobacterium
PLSTPQV

SEQ ID NO: 542507 - protein, 12 aa, Mycobacterium
PLSYPERHPELS

SEQ ID NO: 542508 - protein, 4 aa, Mycobacterium
PLTA

SEQ ID NO: 542509 - protein, 5 aa, Mycobacterium
PLTAE

SEQ ID NO: 542510 - protein, 6 aa, Mycobacterium
PLTAEQ

SEQ ID NO: 542511 - protein, 16 aa, Mycobacterium
PLTAGSGTPPIGSPVD

SEQ ID NO: 542512 - protein, 47 aa, Mycobacterium
PLTANGGGPAPMAPVGAPAPAPEAPVQGAAAPLPAPAVPAPAPVLPP

SEQ ID NO: 542513 - protein, 16 aa, Mycobacterium
PLTAPDKVTAFTTARP

SEQ ID NO: 542514 - protein, 17 aa, Mycobacterium
PLTAPLSGRAAGTDADL

SEQ ID NO: 542515 - protein, 5 aa, Mycobacterium
PLTAS

SEQ ID NO: 542516 - protein, 10 aa, Mycobacterium
PLTATDNEID

SEQ ID NO: 542517 - protein, 10 aa, Mycobacterium
PLTAYQSGRA

SEQ ID NO: 542518 - protein, 10 aa, Mycobacterium
PLTDETAHQA

SEQ ID NO: 542519 - protein, 8 aa, Mycobacterium
PLTDPSFD

SEQ ID NO: 542520 - protein, 5 aa, Mycobacterium
PLTDQ

SEQ ID NO: 542521 - protein, 18 aa, Mycobacterium
PLTDSDGPRTAKWRELAH

SEQ ID NO: 542522 - protein, 7 aa, Mycobacterium
PLTDSVE

SEQ ID NO: 542523 - protein, 9 aa, Mycobacterium
PLTEAGRAA

SEQ ID NO: 542524 - protein, 5 aa, Mycobacterium
PLTED

SEQ ID NO: 542525 - protein, 6 aa, Mycobacterium
PLTEDQ

SEQ ID NO: 542526 - protein, 8 aa, Mycobacterium
PLTEDQRT

SEQ ID NO: 542527 - protein, 17 aa, Mycobacterium
PLTEEDAAAPESPRLSE

SEQ ID NO: 542528 - protein, 6 aa, Mycobacterium
PLTEGQ

SEQ ID NO: 542529 - protein, 5 aa, Mycobacterium
PLTEI

SEQ ID NO: 542530 - protein, 14 aa, Mycobacterium
PLTELTGPAAWRGA

SEQ ID NO: 542531 - protein, 7 aa, Mycobacterium
PLTEQRE

SEQ ID NO: 542532 - protein, 5 aa, Mycobacterium
PLTET

SEQ ID NO: 542533 - protein, 6 aa, Mycobacterium
PLTGAE

SEQ ID NO: 542534 - protein, 10 aa, Mycobacterium
PLTGAEVSEE

SEQ ID NO: 542535 - protein, 14 aa, Mycobacterium
PLTGAQLAAQFEQL

SEQ ID NO: 542536 - protein, 15 aa, Mycobacterium
PLTGASGSPVSALAI

SEQ ID NO: 542537 - protein, 5 aa, Mycobacterium
PLTGD

SEQ ID NO: 542538 - protein, 5 aa, Mycobacterium
PLTGE

SEQ ID NO: 542539 - protein, 15 aa, Mycobacterium
PLTGERREFVSRRTL

SEQ ID NO: 542540 - protein, 13 aa, Mycobacterium
PLTGGASSLTYAG

SEQ ID NO: 542541 - protein, 10 aa, Mycobacterium
PLTGPQAFTN

SEQ ID NO: 542542 - protein, 10 aa, Mycobacterium
PLTGPQALTN

SEQ ID NO: 542543 - protein, 10 aa, Mycobacterium
PLTGQDPAVS

SEQ ID NO: 542544 - protein, 6 aa, Mycobacterium
PLTGQL

SEQ ID NO: 542545 - protein, 5 aa, Mycobacterium
PLTGR

SEQ ID NO: 542546 - protein, 11 aa, Mycobacterium
PLTGRSGGVAD

SEQ ID NO: 542547 - protein, 11 aa, Mycobacterium
PLTGTTVDGGY

SEQ ID NO: 542548 - protein, 19 aa, Mycobacterium
PLTKKPAETRMGSGKGSPE

SEQ ID NO: 542549 - protein, 4 aa, Mycobacterium
PLTP

SEQ ID NO: 542550 - protein, 10 aa, Mycobacterium
PLTPAQRQAR

SEQ ID NO: 542551 - protein, 7 aa, Mycobacterium
PLTPETA

SEQ ID NO: 542552 - protein, 28 aa, Mycobacterium
PLTPGEERTALPDPVVPTTSSPRTSASA

SEQ ID NO: 542553 - protein, 7 aa, Mycobacterium
PLTPGGV

SEQ ID NO: 542554 - protein, 7 aa, Mycobacterium
PLTPPTT

SEQ ID NO: 542555 - protein, 7 aa, Mycobacterium
PLTPPVK

SEQ ID NO: 542556 - protein, 19 aa, Mycobacterium
PLTPSGKLDRRAATTVQGR

SEQ ID NO: 542557 - protein, 8 aa, Mycobacterium
PLTPTGKV

SEQ ID NO: 542558 - protein, 7 aa, Mycobacterium
PLTPTQR

SEQ ID NO: 542559 - protein, 5 aa, Mycobacterium
PLTQA

SEQ ID NO: 542560 - protein, 12 aa, Mycobacterium
PLTRDDTVTAST

SEQ ID NO: 542561 - protein, 5 aa, Mycobacterium
PLTRG

SEQ ID NO: 542562 - protein, 10 aa, Mycobacterium
PLTSGASAVK

SEQ ID NO: 542563 - protein, 7 aa, Mycobacterium
PLTSGSK

SEQ ID NO: 542564 - protein, 8 aa, Mycobacterium
PLTSHGPA

SEQ ID NO: 542565 - protein, 8 aa, Mycobacterium
PLTSNKDL

SEQ ID NO: 542566 - protein, 4 aa, Mycobacterium
PLTT

SEQ ID NO: 542567 - protein, 8 aa, Mycobacterium
PLTTDDRD

SEQ ID NO: 542568 - protein, 8 aa, Mycobacterium
PLTTRPAG

SEQ ID NO: 542569 - protein, 13 aa, Mycobacterium
PLTTRTATGDRER

SEQ ID NO: 542570 - protein, 10 aa, Mycobacterium
PLTTSREDLE

SEQ ID NO: 542571 - protein, 4 aa, Mycobacterium
PLVG

SEQ ID NO: 542572 - protein, 16 aa, Mycobacterium
PLVPGSGATPIGSPVA

SEQ ID NO: 542573 - protein, 6 aa, Mycobacterium
PLVPRP

SEQ ID NO: 542574 - protein, 4 aa, Mycobacterium
PLYG

SEQ ID NO: 542575 - protein, 17 aa, Mycobacterium
PLYSDGKPCPPLGSPTL

SEQ ID NO: 542576 - protein, 8 aa, Mycobacterium
PMAAAGDP

SEQ ID NO: 542577 - protein, 9 aa, Mycobacterium
PMAAAGQAT

SEQ ID NO: 542578 - protein, 7 aa, Mycobacterium
PMAATAA

SEQ ID NO: 542579 - protein, 6 aa, Mycobacterium
PMADAG

SEQ ID NO: 542580 - protein, 9 aa, Mycobacterium
PMAEGSDGA

SEQ ID NO: 542581 - protein, 15 aa, Mycobacterium
PMAGTTESGWSAGDA

SEQ ID NO: 542582 - protein, 7 aa, Mycobacterium
PMAPNGG

SEQ ID NO: 542583 - protein, 7 aa, Mycobacterium
PMASPDL

SEQ ID NO: 542584 - protein, 6 aa, Mycobacterium
PMDEDP

SEQ ID NO: 542585 - protein, 8 aa, Mycobacterium
PMDPDTDI

SEQ ID NO: 542586 - protein, 13 aa, Mycobacterium
PMDQGRKGQRGIE

SEQ ID NO: 542587 - protein, 8 aa, Mycobacterium
PMDTTPGL

SEQ ID NO: 542588 - protein, 4 aa, Mycobacterium
PMEE

SEQ ID NO: 542589 - protein, 18 aa, Mycobacterium
PMEGTGEVQTPLSGPAAR

SEQ ID NO: 542590 - protein, 17 aa, Mycobacterium
PMEGTGEVQTPLSGRAA

SEQ ID NO: 542591 - protein, 46 aa, Mycobacterium
PMESTDSDDVLNDDGDEVVDPPDDWSAADKHGMTAEEEREGESLDD

SEQ ID NO: 542592 - protein, 9 aa, Mycobacterium
PMGDAGLTG

SEQ ID NO: 542593 - protein, 11 aa, Mycobacterium
PMGEDADSAAF

SEQ ID NO: 542594 - protein, 12 aa, Mycobacterium
PMGGWKTSGIGA

SEQ ID NO: 542595 - protein, 4 aa, Mycobacterium
PMGK

SEQ ID NO: 542596 - protein, 4 aa, Mycobacterium
PMGP

SEQ ID NO: 542597 - protein, 6 aa, Mycobacterium
PMGPAD

SEQ ID NO: 542598 - protein, 67 aa, Mycobacterium
PMGPSVQPAAAAGSSASSGAAPVGAGGMGAGAGAGAGGSSRPGMAAPATLTQERDEADEDDWDDEDD

SEQ ID NO: 542599 - protein, 5 aa, Mycobacterium
PMGRG

SEQ ID NO: 542600 - protein, 8 aa, Mycobacterium
PMGSDGGA

SEQ ID NO: 542601 - protein, 16 aa, Mycobacterium
PMGSDGGAMGLDPATN

SEQ ID NO: 542602 - protein, 17 aa, Mycobacterium
PMGSDGGAWAADPETNY

SEQ ID NO: 542603 - protein, 17 aa, Mycobacterium
PMGSDGGAWAGDPETNY

SEQ ID NO: 542604 - protein, 17 aa, Mycobacterium
PMGSDGGAWASDPATNY

SEQ ID NO: 542605 - protein, 17 aa, Mycobacterium
PMGSDGGAWATDPETNY

SEQ ID NO: 542606 - protein, 8 aa, Mycobacterium
PMGSTDMG

SEQ ID NO: 542607 - protein, 4 aa, Mycobacterium
PMGT

SEQ ID NO: 542608 - protein, 8 aa, Mycobacterium
PMKEAGRG

SEQ ID NO: 542609 - protein, 18 aa, Mycobacterium
PMKKRGEGGSAGSAEPFT

SEQ ID NO: 542610 - protein, 5 aa, Mycobacterium
PMKKT

SEQ ID NO: 542611 - protein, 14 aa, Mycobacterium
PMKRDNGKTEQPFT

SEQ ID NO: 542612 - protein, 13 aa, Mycobacterium
PMKRPESERSQPF

SEQ ID NO: 542613 - protein, 4 aa, Mycobacterium
PMLP

SEQ ID NO: 542614 - protein, 7 aa, Mycobacterium
PMNPNGG

SEQ ID NO: 542615 - protein, 8 aa, Mycobacterium
PMNPNGGL

SEQ ID NO: 542616 - protein, 4 aa, Mycobacterium
PMPA

SEQ ID NO: 542617 - protein, 5 aa, Mycobacterium
PMPAD

SEQ ID NO: 542618 - protein, 10 aa, Mycobacterium
PMPAGPDPER

SEQ ID NO: 542619 - protein, 6 aa, Mycobacterium
PMPASG

SEQ ID NO: 542620 - protein, 4 aa, Mycobacterium
PMPC

SEQ ID NO: 542621 - protein, 5 aa, Mycobacterium
PMPDG

SEQ ID NO: 542622 - protein, 20 aa, Mycobacterium
PMPDPLAPPPFPDPLAPPPL

SEQ ID NO: 542623 - protein, 8 aa, Mycobacterium
PMPEQDVP

SEQ ID NO: 542624 - protein, 12 aa, Mycobacterium
PMPEWAESGDSH

SEQ ID NO: 542625 - protein, 4 aa, Mycobacterium
PMPG

SEQ ID NO: 542626 - protein, 5 aa, Mycobacterium
PMPGG

SEQ ID NO: 542627 - protein, 10 aa, Mycobacterium
PMPGGDAAVR

SEQ ID NO: 542628 - protein, 8 aa, Mycobacterium
PMPGGESA

SEQ ID NO: 542629 - protein, 16 aa, Mycobacterium
PMPGPGKGSAGAGPRY

SEQ ID NO: 542630 - protein, 10 aa, Mycobacterium
PMPHSEPGQW

SEQ ID NO: 542631 - protein, 13 aa, Mycobacterium
PMPNPDVPGGPPA

SEQ ID NO: 542632 - protein, 5 aa, Mycobacterium
PMPRR

SEQ ID NO: 542633 - protein, 4 aa, Mycobacterium
PMPS

SEQ ID NO: 542634 - protein, 21 aa, Mycobacterium
PMPTDGPDWSATDDTSPRLGP

SEQ ID NO: 542635 - protein, 12 aa, Mycobacterium
PMPTPVEPQGPP

SEQ ID NO: 542636 - protein, 5 aa, Mycobacterium
PMPTW

SEQ ID NO: 542637 - protein, 19 aa, Mycobacterium
PMPVGGSTAPAVLGTGRTD

SEQ ID NO: 542638 - protein, 7 aa, Mycobacterium
PMQKPHP

SEQ ID NO: 542639 - protein, 10 aa, Mycobacterium
PMRDPGDGTI

SEQ ID NO: 542640 - protein, 11 aa, Mycobacterium
PMRDPGDGTVI

SEQ ID NO: 542641 - protein, 6 aa, Mycobacterium
PMRGGL

SEQ ID NO: 542642 - protein, 10 aa, Mycobacterium
PMRGNDGESS

SEQ ID NO: 542643 - protein, 4 aa, Mycobacterium
PMRP

SEQ ID NO: 542644 - protein, 6 aa, Mycobacterium
PMRPNG

SEQ ID NO: 542645 - protein, 8 aa, Mycobacterium
PMRRTGDL

SEQ ID NO: 542646 - protein, 25 aa, Mycobacterium
PMSAGPYPGLPGEPAPNPDQSPKRG

SEQ ID NO: 542647 - protein, 9 aa, Mycobacterium
PMSAPAPPV

SEQ ID NO: 542648 - protein, 10 aa, Mycobacterium
PMSGAAGGHV

SEQ ID NO: 542649 - protein, 9 aa, Mycobacterium
PMSGNRPAT

SEQ ID NO: 542650 - protein, 4 aa, Mycobacterium
PMSH

SEQ ID NO: 542651 - protein, 5 aa, Mycobacterium
PMSHD

SEQ ID NO: 542652 - protein, 4 aa, Mycobacterium
PMSP

SEQ ID NO: 542653 - protein, 6 aa, Mycobacterium
PMSPSA

SEQ ID NO: 542654 - protein, 5 aa, Mycobacterium
PMSSA

SEQ ID NO: 542655 - protein, 8 aa, Mycobacterium
PMSSGWES

SEQ ID NO: 542656 - protein, 11 aa, Mycobacterium
PMSTPEDLDET

SEQ ID NO: 542657 - protein, 9 aa, Mycobacterium
PMTAAGSGS

SEQ ID NO: 542658 - protein, 7 aa, Mycobacterium
PMTAYGQ

SEQ ID NO: 542659 - protein, 7 aa, Mycobacterium
PMTDPTQ

SEQ ID NO: 542660 - protein, 4 aa, Mycobacterium
PMTG

SEQ ID NO: 542661 - protein, 14 aa, Mycobacterium
PMTGAELAGTLENL

SEQ ID NO: 542662 - protein, 13 aa, Mycobacterium
PMTGERDVRSEDR

SEQ ID NO: 542663 - protein, 7 aa, Mycobacterium
PMTPEQR

SEQ ID NO: 542664 - protein, 11 aa, Mycobacterium
PMTPEQRQARQ

SEQ ID NO: 542665 - protein, 5 aa, Mycobacterium
PMTPK

SEQ ID NO: 542666 - protein, 5 aa, Mycobacterium
PMTPP

SEQ ID NO: 542667 - protein, 12 aa, Mycobacterium
PMTSEQRQARQA

SEQ ID NO: 542668 - protein, 13 aa, Mycobacterium
PMTSGLPNGEKSR

SEQ ID NO: 542669 - protein, 5 aa, Mycobacterium
PMTTE

SEQ ID NO: 542670 - protein, 12 aa, Mycobacterium
PMTTPPVESGLP

SEQ ID NO: 542671 - protein, 4 aa, Mycobacterium
PMYS

SEQ ID NO: 542672 - protein, 4 aa, Mycobacterium
PNAA

SEQ ID NO: 542673 - protein, 7 aa, Mycobacterium
PNAAAAR

SEQ ID NO: 542674 - protein, 9 aa, Mycobacterium
PNAAAARAT

SEQ ID NO: 542675 - protein, 9 aa, Mycobacterium
PNAAGGTDI

SEQ ID NO: 542676 - protein, 5 aa, Mycobacterium
PNAAP

SEQ ID NO: 542677 - protein, 8 aa, Mycobacterium
PNAAPDER

SEQ ID NO: 542678 - protein, 8 aa, Mycobacterium
PNAASEKL

SEQ ID NO: 542679 - protein, 7 aa, Mycobacterium
PNACGKS

SEQ ID NO: 542680 - protein, 9 aa, Mycobacterium
PNADGRRPD

SEQ ID NO: 542681 - protein, 6 aa, Mycobacterium
PNAEDF

SEQ ID NO: 542682 - protein, 6 aa, Mycobacterium
PNAEPL

SEQ ID NO: 542683 - protein, 10 aa, Mycobacterium
PNAEVAPGNR

SEQ ID NO: 542684 - protein, 6 aa, Mycobacterium
PNAEYD

SEQ ID NO: 542685 - protein, 5 aa, Mycobacterium
PNAGI

SEQ ID NO: 542686 - protein, 8 aa, Mycobacterium
PNAGPTTK

SEQ ID NO: 542687 - protein, 4 aa, Mycobacterium
PNAH

SEQ ID NO: 542688 - protein, 5 aa, Mycobacterium
PNAHR

SEQ ID NO: 542689 - protein, 5 aa, Mycobacterium
PNAHT

SEQ ID NO: 542690 - protein, 12 aa, Mycobacterium
PNAIRNPDGSPT

SEQ ID NO: 542691 - protein, 12 aa, Mycobacterium
PNALSTKGHPEG

SEQ ID NO: 542692 - protein, 27 aa, Mycobacterium
PNALTGDAIPDDYSHDEELTQPPQKPR

SEQ ID NO: 542693 - protein, 9 aa, Mycobacterium
PNALTSSAW

SEQ ID NO: 542694 - protein, 7 aa, Mycobacterium
PNALTST

SEQ ID NO: 542695 - protein, 16 aa, Mycobacterium
PNALTSTEWRDPYAGT

SEQ ID NO: 542696 - protein, 7 aa, Mycobacterium
PNANDYH

SEQ ID NO: 542697 - protein, 6 aa, Mycobacterium
PNANPE

SEQ ID NO: 542698 - protein, 6 aa, Mycobacterium
PNANTD

SEQ ID NO: 542699 - protein, 8 aa, Mycobacterium
PNANTRSI

SEQ ID NO: 542700 - protein, 4 aa, Mycobacterium
PNAP

SEQ ID NO: 542701 - protein, 5 aa, Mycobacterium
PNAPA

SEQ ID NO: 542702 - protein, 11 aa, Mycobacterium
PNAPAAAVGLD

SEQ ID NO: 542703 - protein, 8 aa, Mycobacterium
PNAPDPSQ

SEQ ID NO: 542704 - protein, 14 aa, Mycobacterium
PNAPELERADTYPQ

SEQ ID NO: 542705 - protein, 7 aa, Mycobacterium
PNAPFGS

SEQ ID NO: 542706 - protein, 7 aa, Mycobacterium
PNAPGSI

SEQ ID NO: 542707 - protein, 5 aa, Mycobacterium
PNAPI

SEQ ID NO: 542708 - protein, 9 aa, Mycobacterium
PNAPKREAA

SEQ ID NO: 542709 - protein, 10 aa, Mycobacterium
PNAPTEPADM

SEQ ID NO: 542710 - protein, 6 aa, Mycobacterium
PNAPTL

SEQ ID NO: 542711 - protein, 9 aa, Mycobacterium
PNAQKRKEG

SEQ ID NO: 542712 - protein, 4 aa, Mycobacterium
PNAR

SEQ ID NO: 542713 - protein, 9 aa, Mycobacterium
PNASQRAED

SEQ ID NO: 542714 - protein, 4 aa, Mycobacterium
PNAT

SEQ ID NO: 542715 - protein, 11 aa, Mycobacterium
PNATDDPHEIG

SEQ ID NO: 542716 - protein, 7 aa, Mycobacterium
PNATDGV

SEQ ID NO: 542717 - protein, 14 aa, Mycobacterium
PNATPGITDEERRT

SEQ ID NO: 542718 - protein, 6 aa, Mycobacterium
PNATTI

SEQ ID NO: 542719 - protein, 20 aa, Mycobacterium
PNAVGPGPSIPTQALGGGLG

SEQ ID NO: 542720 - protein, 7 aa, Mycobacterium
PNDAADR

SEQ ID NO: 542721 - protein, 5 aa, Mycobacterium
PNDAE

SEQ ID NO: 542722 - protein, 26 aa, Mycobacterium
PNDASAGKPTPPVPMAPDDPRWPPIP

SEQ ID NO: 542723 - protein, 9 aa, Mycobacterium
PNDDDHGAV

SEQ ID NO: 542724 - protein, 10 aa, Mycobacterium
PNDEPEAGKQ

SEQ ID NO: 542725 - protein, 8 aa, Mycobacterium
PNDEPEVG

SEQ ID NO: 542726 - protein, 7 aa, Mycobacterium
PNDFPAD

SEQ ID NO: 542727 - protein, 20 aa, Mycobacterium
PNDGHKFPGEISGGMRKRAG

SEQ ID NO: 542728 - protein, 6 aa, Mycobacterium
PNDGHR

SEQ ID NO: 542729 - protein, 6 aa, Mycobacterium
PNDGVG

SEQ ID NO: 542730 - protein, 4 aa, Mycobacterium
PNDI

SEQ ID NO: 542731 - protein, 4 aa, Mycobacterium
PNDL

SEQ ID NO: 542732 - protein, 7 aa, Mycobacterium
PNDPDVI

SEQ ID NO: 542733 - protein, 9 aa, Mycobacterium
PNDPGRDAA

SEQ ID NO: 542734 - protein, 14 aa, Mycobacterium
PNDPRTPDQRRADA

SEQ ID NO: 542735 - protein, 9 aa, Mycobacterium
PNDQPEVGK

SEQ ID NO: 542736 - protein, 5 aa, Mycobacterium
PNDRP

SEQ ID NO: 542737 - protein, 5 aa, Mycobacterium
PNDSP

SEQ ID NO: 542738 - protein, 5 aa, Mycobacterium
PNDTF

SEQ ID NO: 542739 - protein, 4 aa, Mycobacterium
PNDV

SEQ ID NO: 542740 - protein, 5 aa, Mycobacterium
PNDVG

SEQ ID NO: 542741 - protein, 5 aa, Mycobacterium
PNDWE

SEQ ID NO: 542742 - protein, 6 aa, Mycobacterium
PNEAHR

SEQ ID NO: 542743 - protein, 6 aa, Mycobacterium
PNEARD

SEQ ID NO: 542744 - protein, 11 aa, Mycobacterium
PNEDAEVSKEI

SEQ ID NO: 542745 - protein, 12 aa, Mycobacterium
PNEDAEVSKEIE

SEQ ID NO: 542746 - protein, 13 aa, Mycobacterium
PNEDAEVSKEVER

SEQ ID NO: 542747 - protein, 13 aa, Mycobacterium
PNEEGYPDSFSTD

SEQ ID NO: 542748 - protein, 9 aa, Mycobacterium
PNEETARQA

SEQ ID NO: 542749 - protein, 5 aa, Mycobacterium
PNEGA

SEQ ID NO: 542750 - protein, 27 aa, Mycobacterium
PNEGGGVGAENGERAYPKAQPDSGADE

SEQ ID NO: 542751 - protein, 7 aa, Mycobacterium
PNEGPLR

SEQ ID NO: 542752 - protein, 4 aa, Mycobacterium
PNEH

SEQ ID NO: 542753 - protein, 4 aa, Mycobacterium
PNEL

SEQ ID NO: 542754 - protein, 13 aa, Mycobacterium
PNENAAGWGPHRD

SEQ ID NO: 542755 - protein, 7 aa, Mycobacterium
PNEPGHV

SEQ ID NO: 542756 - protein, 24 aa, Mycobacterium
PNEPLPPPDEIARTADSYRDPSRL

SEQ ID NO: 542757 - protein, 7 aa, Mycobacterium
PNEPPTG

SEQ ID NO: 542758 - protein, 388 aa, Mycobacterium
PNEPQATAGNPGGSGITGEIGGSGTNGSPATLPTTQVQQGGDGGAGGTGTNAANNEVATGGEGGTGGTGSAGGPGGDGGVGGDASETGTDGVAVGGQGGQGGAGGQFGGGGNGGDGGNVTAGSAGSTAGNGGNGGNANNGTIEGSPAGGNGSAGGDGGDGGDVASGATGTAGTGGTGGAGNDGTINAGTGGNGGAGGRAGSGGANGGNGGTGGTGGDGGKGGGGAVGGSGGDGGDGGINNGAGANGNGGGGGTGGTGSIGAAGGNGGQGGSGGAAGSGGGTAGNGGAGGVGGAGGTGGVGGGGGDGGAGALAGTGGTGGSGGTGGASGAGGSGGGGGLSGSGQSGANGGTGGASQEGQDGQASTDSDGGAGGAGGTGGSGGAAGAGGQ

SEQ ID NO: 542759 - protein, 7 aa, Mycobacterium
PNEPTPT

SEQ ID NO: 542760 - protein, 4 aa, Mycobacterium
PNEQ

SEQ ID NO: 542761 - protein, 9 aa, Mycobacterium
PNEQGNPQY

SEQ ID NO: 542762 - protein, 5 aa, Mycobacterium
PNEQV

SEQ ID NO: 542763 - protein, 10 aa, Mycobacterium
PNERNVGRRR

SEQ ID NO: 542764 - protein, 6 aa, Mycobacterium
PNESFT

SEQ ID NO: 542765 - protein, 12 aa, Mycobacterium
PNEVAPRRKPLN

SEQ ID NO: 542766 - protein, 10 aa, Mycobacterium
PNEVDRGPRR

SEQ ID NO: 542767 - protein, 10 aa, Mycobacterium
PNEYGPPVGE

SEQ ID NO: 542768 - protein, 4 aa, Mycobacterium
PNFA

SEQ ID NO: 542769 - protein, 5 aa, Mycobacterium
PNFEG

SEQ ID NO: 542770 - protein, 4 aa, Mycobacterium
PNFG

SEQ ID NO: 542771 - protein, 4 aa, Mycobacterium
PNGA

SEQ ID NO: 542772 - protein, 5 aa, Mycobacterium
PNGAA

SEQ ID NO: 542773 - protein, 8 aa, Mycobacterium
PNGAGKSS

SEQ ID NO: 542774 - protein, 9 aa, Mycobacterium
PNGAGKSTA

SEQ ID NO: 542775 - protein, 9 aa, Mycobacterium
PNGAGKTTT

SEQ ID NO: 542776 - protein, 7 aa, Mycobacterium
PNGCGKS

SEQ ID NO: 542777 - protein, 4 aa, Mycobacterium
PNGD

SEQ ID NO: 542778 - protein, 7 aa, Mycobacterium
PNGDGTR

SEQ ID NO: 542779 - protein, 10 aa, Mycobacterium
PNGDGVPERL

SEQ ID NO: 542780 - protein, 4 aa, Mycobacterium
PNGE

SEQ ID NO: 542781 - protein, 8 aa, Mycobacterium
PNGEELES

SEQ ID NO: 542782 - protein, 7 aa, Mycobacterium
PNGEGEP

SEQ ID NO: 542783 - protein, 7 aa, Mycobacterium
PNGEPAV

SEQ ID NO: 542784 - protein, 7 aa, Mycobacterium
PNGEPGV

SEQ ID NO: 542785 - protein, 8 aa, Mycobacterium
PNGEPGVV

SEQ ID NO: 542786 - protein, 7 aa, Mycobacterium
PNGESAE

SEQ ID NO: 542787 - protein, 6 aa, Mycobacterium
PNGEVR

SEQ ID NO: 542788 - protein, 6 aa, Mycobacterium
PNGFAP

SEQ ID NO: 542789 - protein, 16 aa, Mycobacterium
PNGGAGAINPPSITSL

SEQ ID NO: 542790 - protein, 6 aa, Mycobacterium
PNGGLD

SEQ ID NO: 542791 - protein, 16 aa, Mycobacterium
PNGGPKTPRSAAQTPE

SEQ ID NO: 542792 - protein, 10 aa, Mycobacterium
PNGGTYTTRP

SEQ ID NO: 542793 - protein, 7 aa, Mycobacterium
PNGHRTD

SEQ ID NO: 542794 - protein, 9 aa, Mycobacterium
PNGHSSSPG

SEQ ID NO: 542795 - protein, 7 aa, Mycobacterium
PNGHTSI

SEQ ID NO: 542796 - protein, 5 aa, Mycobacterium
PNGID

SEQ ID NO: 542797 - protein, 5 aa, Mycobacterium
PNGIG

SEQ ID NO: 542798 - protein, 7 aa, Mycobacterium
PNGIRTA

SEQ ID NO: 542799 - protein, 6 aa, Mycobacterium
PNGKAD

SEQ ID NO: 542800 - protein, 5 aa, Mycobacterium
PNGLA

SEQ ID NO: 542801 - protein, 5 aa, Mycobacterium
PNGLG

SEQ ID NO: 542802 - protein, 20 aa, Mycobacterium
PNGLGGSAADEHAASRTGGR

SEQ ID NO: 542803 - protein, 6 aa, Mycobacterium
PNGLSA

SEQ ID NO: 542804 - protein, 7 aa, Mycobacterium
PNGNLSQ

SEQ ID NO: 542805 - protein, 5 aa, Mycobacterium
PNGNT

SEQ ID NO: 542806 - protein, 6 aa, Mycobacterium
PNGPEL

SEQ ID NO: 542807 - protein, 5 aa, Mycobacterium
PNGPI

SEQ ID NO: 542808 - protein, 5 aa, Mycobacterium
PNGPV

SEQ ID NO: 542809 - protein, 11 aa, Mycobacterium
PNGQARQAAEE

SEQ ID NO: 542810 - protein, 10 aa, Mycobacterium
PNGQGSAVDG

SEQ ID NO: 542811 - protein, 13 aa, Mycobacterium
PNGQGSAVDGGYR

SEQ ID NO: 542812 - protein, 13 aa, Mycobacterium
PNGQGTAVDGGYA

SEQ ID NO: 542813 - protein, 14 aa, Mycobacterium
PNGQGTAVDGGYQL

SEQ ID NO: 542814 - protein, 5 aa, Mycobacterium
PNGRR

SEQ ID NO: 542815 - protein, 4 aa, Mycobacterium
PNGS

SEQ ID NO: 542816 - protein, 9 aa, Mycobacterium
PNGSGTDVT

SEQ ID NO: 542817 - protein, 12 aa, Mycobacterium
PNGSNIRRADGG

SEQ ID NO: 542818 - protein, 8 aa, Mycobacterium
PNGSQDNG

SEQ ID NO: 542819 - protein, 7 aa, Mycobacterium
PNGSTPV

SEQ ID NO: 542820 - protein, 4 aa, Mycobacterium
PNGT

SEQ ID NO: 542821 - protein, 20 aa, Mycobacterium
PNGTASRPAAWRHEKSNGEF

SEQ ID NO: 542822 - protein, 8 aa, Mycobacterium
PNGTGKTS

SEQ ID NO: 542823 - protein, 14 aa, Mycobacterium
PNGTINTGGASLDY

SEQ ID NO: 542824 - protein, 6 aa, Mycobacterium
PNGTMK

SEQ ID NO: 542825 - protein, 9 aa, Mycobacterium
PNGTQDSGE

SEQ ID NO: 542826 - protein, 9 aa, Mycobacterium
PNGTVTAGN

SEQ ID NO: 542827 - protein, 6 aa, Mycobacterium
PNGVGK

SEQ ID NO: 542828 - protein, 9 aa, Mycobacterium
PNGVPGPDR

SEQ ID NO: 542829 - protein, 8 aa, Mycobacterium
PNGYGKTN

SEQ ID NO: 542830 - protein, 9 aa, Mycobacterium
PNGYTGDAT

SEQ ID NO: 542831 - protein, 7 aa, Mycobacterium
PNHDPAA

SEQ ID NO: 542832 - protein, 7 aa, Mycobacterium
PNHDPSA

SEQ ID NO: 542833 - protein, 5 aa, Mycobacterium
PNHEC

SEQ ID NO: 542834 - protein, 14 aa, Mycobacterium
PNHKGGNASGRAVE

SEQ ID NO: 542835 - protein, 12 aa, Mycobacterium
PNHKGGNEAGRA

SEQ ID NO: 542836 - protein, 15 aa, Mycobacterium
PNHLAGPPDDERIPE

SEQ ID NO: 542837 - protein, 13 aa, Mycobacterium
PNHNGGNAAGRAV

SEQ ID NO: 542838 - protein, 28 aa, Mycobacterium
PNHPAAKKARAAAKAQQQRAGRKADETE

SEQ ID NO: 542839 - protein, 19 aa, Mycobacterium
PNHPAAKRAKAAPRRPVRS

SEQ ID NO: 542840 - protein, 27 aa, Mycobacterium
PNHPAAKRAKAQQRRPARGRTDETETV

SEQ ID NO: 542841 - protein, 27 aa, Mycobacterium
PNHPAAKRAQSPPRRPAKRPTDETETV

SEQ ID NO: 542842 - protein, 7 aa, Mycobacterium
PNHPAGQ

SEQ ID NO: 542843 - protein, 15 aa, Mycobacterium
PNIDTKGLKKGQTVR

SEQ ID NO: 542844 - protein, 6 aa, Mycobacterium
PNIETA

SEQ ID NO: 542845 - protein, 13 aa, Mycobacterium
PNIETSELRRGQT

SEQ ID NO: 542846 - protein, 11 aa, Mycobacterium
PNIGADTERVA

SEQ ID NO: 542847 - protein, 7 aa, Mycobacterium
PNIPQDD

SEQ ID NO: 542848 - protein, 8 aa, Mycobacterium
PNIRGEQS

SEQ ID NO: 542849 - protein, 6 aa, Mycobacterium
PNKDQL

SEQ ID NO: 542850 - protein, 11 aa, Mycobacterium
PNKGALSEAAS

SEQ ID NO: 542851 - protein, 17 aa, Mycobacterium
PNKGEEDLRPEQGQPYR

SEQ ID NO: 542852 - protein, 16 aa, Mycobacterium
PNKGEQDQRPAQGEPY

SEQ ID NO: 542853 - protein, 15 aa, Mycobacterium
PNKGETDLRPEQGLP

SEQ ID NO: 542854 - protein, 17 aa, Mycobacterium
PNKGQNDERPLQGDGYS

SEQ ID NO: 542855 - protein, 15 aa, Mycobacterium
PNKGQNDQRPLQGDA

SEQ ID NO: 542856 - protein, 4 aa, Mycobacterium
PNKL

SEQ ID NO: 542857 - protein, 7 aa, Mycobacterium
PNKPGLV

SEQ ID NO: 542858 - protein, 7 aa, Mycobacterium
PNKPGVN

SEQ ID NO: 542859 - protein, 76 aa, Mycobacterium
PNKPRMQELPGSSTAPSTSTSTTTTTTTPTTKTSTTTTTTGTSKTSPTTTTSATGKPDEESGEVGSSDLLGGDAGD

SEQ ID NO: 542860 - protein, 4 aa, Mycobacterium
PNLA

SEQ ID NO: 542861 - protein, 5 aa, Mycobacterium
PNLAD

SEQ ID NO: 542862 - protein, 13 aa, Mycobacterium
PNLAGISGDRETV

SEQ ID NO: 542863 - protein, 10 aa, Mycobacterium
PNLAPEEARD

SEQ ID NO: 542864 - protein, 7 aa, Mycobacterium
PNLATGR

SEQ ID NO: 542865 - protein, 4 aa, Mycobacterium
PNLD

SEQ ID NO: 542866 - protein, 23 aa, Mycobacterium
PNLDDGATQRHQDPLTPAAQDAW

SEQ ID NO: 542867 - protein, 11 aa, Mycobacterium
PNLDPAESGSP

SEQ ID NO: 542868 - protein, 4 aa, Mycobacterium
PNLE

SEQ ID NO: 542869 - protein, 11 aa, Mycobacterium
PNLGPAANSYT

SEQ ID NO: 542870 - protein, 6 aa, Mycobacterium
PNLKPG

SEQ ID NO: 542871 - protein, 11 aa, Mycobacterium
PNLNGGDLSPI

SEQ ID NO: 542872 - protein, 6 aa, Mycobacterium
PNLPAD

SEQ ID NO: 542873 - protein, 12 aa, Mycobacterium
PNLPGGSELGST

SEQ ID NO: 542874 - protein, 7 aa, Mycobacterium
PNLPSGY

SEQ ID NO: 542875 - protein, 4 aa, Mycobacterium
PNLR

SEQ ID NO: 542876 - protein, 32 aa, Mycobacterium
PNLSGARDGLMTEGGETLSRAVSRDSASGSAM

SEQ ID NO: 542877 - protein, 7 aa, Mycobacterium
PNLSPGQ

SEQ ID NO: 542878 - protein, 10 aa, Mycobacterium
PNLSQQLGPG

SEQ ID NO: 542879 - protein, 8 aa, Mycobacterium
PNLSRADL

SEQ ID NO: 542880 - protein, 4 aa, Mycobacterium
PNLT

SEQ ID NO: 542881 - protein, 5 aa, Mycobacterium
PNLTA

SEQ ID NO: 542882 - protein, 13 aa, Mycobacterium
PNMPNLGNRNKRV

SEQ ID NO: 542883 - protein, 7 aa, Mycobacterium
PNMSDED

SEQ ID NO: 542884 - protein, 10 aa, Mycobacterium
PNMTPTSRQR

SEQ ID NO: 542885 - protein, 7 aa, Mycobacterium
PNNAAAP

SEQ ID NO: 542886 - protein, 8 aa, Mycobacterium
PNNAETAA

SEQ ID NO: 542887 - protein, 8 aa, Mycobacterium
PNNARDAG

SEQ ID NO: 542888 - protein, 27 aa, Mycobacterium
PNNFTDPPRYPAAVPEGPVEENLTDED

SEQ ID NO: 542889 - protein, 17 aa, Mycobacterium
PNNGENDRRPAQGEPYR

SEQ ID NO: 542890 - protein, 10 aa, Mycobacterium
PNNITGTGPV

SEQ ID NO: 542891 - protein, 7 aa, Mycobacterium
PNNLPPG

SEQ ID NO: 542892 - protein, 7 aa, Mycobacterium
PNNPDGG

SEQ ID NO: 542893 - protein, 8 aa, Mycobacterium
PNNPIPEG

SEQ ID NO: 542894 - protein, 10 aa, Mycobacterium
PNNPSGQSVS

SEQ ID NO: 542895 - protein, 11 aa, Mycobacterium
PNNPSSTVVDP

SEQ ID NO: 542896 - protein, 7 aa, Mycobacterium
PNNPTGA

SEQ ID NO: 542897 - protein, 9 aa, Mycobacterium
PNNPTGQSV

SEQ ID NO: 542898 - protein, 10 aa, Mycobacterium
PNNPTGQSVS

SEQ ID NO: 542899 - protein, 8 aa, Mycobacterium
PNNPTGTV

SEQ ID NO: 542900 - protein, 9 aa, Mycobacterium
PNNPTSTVV

SEQ ID NO: 542901 - protein, 10 aa, Mycobacterium
PNNPTSTVVD

SEQ ID NO: 542902 - protein, 12 aa, Mycobacterium
PNNPTSTVVDPG

SEQ ID NO: 542903 - protein, 10 aa, Mycobacterium
PNNPTSTVVE

SEQ ID NO: 542904 - protein, 10 aa, Mycobacterium
PNNPTSTVVP

SEQ ID NO: 542905 - protein, 10 aa, Mycobacterium
PNNPVAQYTP

SEQ ID NO: 542906 - protein, 16 aa, Mycobacterium
PNNRDELERNYPRTAA

SEQ ID NO: 542907 - protein, 26 aa, Mycobacterium
PNNYAEPPRYPAPISGPIEENLTDED

SEQ ID NO: 542908 - protein, 7 aa, Mycobacterium
PNPAAAA

SEQ ID NO: 542909 - protein, 14 aa, Mycobacterium
PNPAADGKKASKTP

SEQ ID NO: 542910 - protein, 9 aa, Mycobacterium
PNPADIDAG

SEQ ID NO: 542911 - protein, 7 aa, Mycobacterium
PNPAEEA

SEQ ID NO: 542912 - protein, 10 aa, Mycobacterium
PNPAPGAEDD

SEQ ID NO: 542913 - protein, 9 aa, Mycobacterium
PNPATARVS

SEQ ID NO: 542914 - protein, 8 aa, Mycobacterium
PNPATDPE

SEQ ID NO: 542915 - protein, 8 aa, Mycobacterium
PNPATGAT

SEQ ID NO: 542916 - protein, 6 aa, Mycobacterium
PNPCEG

SEQ ID NO: 542917 - protein, 4 aa, Mycobacterium
PNPD

SEQ ID NO: 542918 - protein, 10 aa, Mycobacterium
PNPDAAASWQ

SEQ ID NO: 542919 - protein, 11 aa, Mycobacterium
PNPDAGRSWDE

SEQ ID NO: 542920 - protein, 7 aa, Mycobacterium
PNPDAHQ

SEQ ID NO: 542921 - protein, 10 aa, Mycobacterium
PNPDDGGQAP

SEQ ID NO: 542922 - protein, 10 aa, Mycobacterium
PNPDDTQRQQ

SEQ ID NO: 542923 - protein, 11 aa, Mycobacterium
PNPDPASSWAE

SEQ ID NO: 542924 - protein, 6 aa, Mycobacterium
PNPDRG

SEQ ID NO: 542925 - protein, 10 aa, Mycobacterium
PNPDWTGNAH

SEQ ID NO: 542926 - protein, 8 aa, Mycobacterium
PNPDYDPY

SEQ ID NO: 542927 - protein, 5 aa, Mycobacterium
PNPEE

SEQ ID NO: 542928 - protein, 10 aa, Mycobacterium
PNPEEPGASD

SEQ ID NO: 542929 - protein, 10 aa, Mycobacterium
PNPEEQGAAD

SEQ ID NO: 542930 - protein, 11 aa, Mycobacterium
PNPEERGASDA

SEQ ID NO: 542931 - protein, 5 aa, Mycobacterium
PNPEY

SEQ ID NO: 542932 - protein, 5 aa, Mycobacterium
PNPGL

SEQ ID NO: 542933 - protein, 6 aa, Mycobacterium
PNPGPV

SEQ ID NO: 542934 - protein, 12 aa, Mycobacterium
PNPHVGFGGNGE

SEQ ID NO: 542935 - protein, 7 aa, Mycobacterium
PNPIPKL

SEQ ID NO: 542936 - protein, 12 aa, Mycobacterium
PNPKTGTVTPDV

SEQ ID NO: 542937 - protein, 6 aa, Mycobacterium
PNPLTG

SEQ ID NO: 542938 - protein, 5 aa, Mycobacterium
PNPND

SEQ ID NO: 542939 - protein, 8 aa, Mycobacterium
PNPNNPDH

SEQ ID NO: 542940 - protein, 7 aa, Mycobacterium
PNPNNRE

SEQ ID NO: 542941 - protein, 11 aa, Mycobacterium
PNPNRAAALTT

SEQ ID NO: 542942 - protein, 5 aa, Mycobacterium
PNPPA

SEQ ID NO: 542943 - protein, 11 aa, Mycobacterium
PNPPAASPLGA

SEQ ID NO: 542944 - protein, 16 aa, Mycobacterium
PNPPAGGFSPGGHDGG

SEQ ID NO: 542945 - protein, 16 aa, Mycobacterium
PNPPAGGFSPGGHNGG

SEQ ID NO: 542946 - protein, 7 aa, Mycobacterium
PNPPDVD

SEQ ID NO: 542947 - protein, 6 aa, Mycobacterium
PNPPEI

SEQ ID NO: 542948 - protein, 17 aa, Mycobacterium
PNPPLPSYDSPEGAAAH

SEQ ID NO: 542949 - protein, 13 aa, Mycobacterium
PNPQAQAPLGPGQ

SEQ ID NO: 542950 - protein, 7 aa, Mycobacterium
PNPQPHL

SEQ ID NO: 542951 - protein, 10 aa, Mycobacterium
PNPRISGEAP

SEQ ID NO: 542952 - protein, 5 aa, Mycobacterium
PNPRL

SEQ ID NO: 542953 - protein, 9 aa, Mycobacterium
PNPSEPTSV

SEQ ID NO: 542954 - protein, 13 aa, Mycobacterium
PNPSNPNHQQHPT

SEQ ID NO: 542955 - protein, 26 aa, Mycobacterium
PNPSPEQAEGARRAAAACPALAIRIE

SEQ ID NO: 542956 - protein, 17 aa, Mycobacterium
PNPSSSTGRDAQAAAAA

SEQ ID NO: 542957 - protein, 12 aa, Mycobacterium
PNPTKRIEKETV

SEQ ID NO: 542958 - protein, 16 aa, Mycobacterium
PNPTRVGGQRRYGDAD

SEQ ID NO: 542959 - protein, 9 aa, Mycobacterium
PNPTSTELP

SEQ ID NO: 542960 - protein, 21 aa, Mycobacterium
PNPVEPPTDIAPDPEATKTWL

SEQ ID NO: 542961 - protein, 21 aa, Mycobacterium
PNPVEPPTGIAPDPSAAKPWL

SEQ ID NO: 542962 - protein, 18 aa, Mycobacterium
PNPVGSLAPPDGSSVPDD

SEQ ID NO: 542963 - protein, 17 aa, Mycobacterium
PNPVGSLAPTDGTPVPA

SEQ ID NO: 542964 - protein, 9 aa, Mycobacterium
PNPVPRAGG

SEQ ID NO: 542965 - protein, 8 aa, Mycobacterium
PNPVSQQR

SEQ ID NO: 542966 - protein, 13 aa, Mycobacterium
PNQAARGEAGPPF

SEQ ID NO: 542967 - protein, 18 aa, Mycobacterium
PNQAGTLSAAKTAHDTAH

SEQ ID NO: 542968 - protein, 11 aa, Mycobacterium
PNQEATLGPNK

SEQ ID NO: 542969 - protein, 12 aa, Mycobacterium
PNQGRRGEPGPP

SEQ ID NO: 542970 - protein, 10 aa, Mycobacterium
PNQLSGGQRQ

SEQ ID NO: 542971 - protein, 4 aa, Mycobacterium
PNQP

SEQ ID NO: 542972 - protein, 8 aa, Mycobacterium
PNQPGIDP

SEQ ID NO: 542973 - protein, 5 aa, Mycobacterium
PNQPN

SEQ ID NO: 542974 - protein, 9 aa, Mycobacterium
PNQPSQRNG

SEQ ID NO: 542975 - protein, 4 aa, Mycobacterium
PNQR

SEQ ID NO: 542976 - protein, 22 aa, Mycobacterium
PNQRSDNTAAELAGTDDKNFFM

SEQ ID NO: 542977 - protein, 5 aa, Mycobacterium
PNQSA

SEQ ID NO: 542978 - protein, 7 aa, Mycobacterium
PNQTEIT

SEQ ID NO: 542979 - protein, 10 aa, Mycobacterium
PNQVQRPHRH

SEQ ID NO: 542980 - protein, 5 aa, Mycobacterium
PNRDG

SEQ ID NO: 542981 - protein, 5 aa, Mycobacterium
PNRDN

SEQ ID NO: 542982 - protein, 22 aa, Mycobacterium
PNREGAWAQQAEAELSTRRHRE

SEQ ID NO: 542983 - protein, 12 aa, Mycobacterium
PNRFDTESAGRA

SEQ ID NO: 542984 - protein, 7 aa, Mycobacterium
PNRGKRS

SEQ ID NO: 542985 - protein, 9 aa, Mycobacterium
PNRGKRSVG

SEQ ID NO: 542986 - protein, 5 aa, Mycobacterium
PNRKG

SEQ ID NO: 542987 - protein, 14 aa, Mycobacterium
PNRLERRKQRTRTA

SEQ ID NO: 542988 - protein, 4 aa, Mycobacterium
PNRP

SEQ ID NO: 542989 - protein, 13 aa, Mycobacterium
PNRPQQDAEKARE

SEQ ID NO: 542990 - protein, 7 aa, Mycobacterium
PNRQPVD

SEQ ID NO: 542991 - protein, 16 aa, Mycobacterium
PNRSTLHKSSNGSRTM

SEQ ID NO: 542992 - protein, 12 aa, Mycobacterium
PNRTFEEGSNSV

SEQ ID NO: 542993 - protein, 28 aa, Mycobacterium
PNRTPVDAQEPPESPQLADGPPRARRKR

SEQ ID NO: 542994 - protein, 10 aa, Mycobacterium
PNRVDGDELR

SEQ ID NO: 542995 - protein, 14 aa, Mycobacterium
PNSAAALPPTPRRA

SEQ ID NO: 542996 - protein, 7 aa, Mycobacterium
PNSAHVE

SEQ ID NO: 542997 - protein, 12 aa, Mycobacterium
PNSCARSQTADI

SEQ ID NO: 542998 - protein, 8 aa, Mycobacterium
PNSEKWET

SEQ ID NO: 542999 - protein, 10 aa, Mycobacterium
PNSEQPAVRE

SEQ ID NO: 543000 - protein, 11 aa, Mycobacterium
PNSESEYGTDL

SEQ ID NO: 543001 - protein, 7 aa, Mycobacterium
PNSGASE

SEQ ID NO: 543002 - protein, 11 aa, Mycobacterium
PNSGFGPAGYS

SEQ ID NO: 543003 - protein, 12 aa, Mycobacterium
PNSGIRPRRGRG

SEQ ID NO: 543004 - protein, 9 aa, Mycobacterium
PNSGPGHNS

SEQ ID NO: 543005 - protein, 5 aa, Mycobacterium
PNSGT

SEQ ID NO: 543006 - protein, 5 aa, Mycobacterium
PNSHA

SEQ ID NO: 543007 - protein, 4 aa, Mycobacterium
PNSL

SEQ ID NO: 543008 - protein, 15 aa, Mycobacterium
PNSLPSGISVPGAPI

SEQ ID NO: 543009 - protein, 19 aa, Mycobacterium
PNSNSQDPAEFYTSEFLVP

SEQ ID NO: 543010 - protein, 4 aa, Mycobacterium
PNSP

SEQ ID NO: 543011 - protein, 9 aa, Mycobacterium
PNSPDERWP

SEQ ID NO: 543012 - protein, 5 aa, Mycobacterium
PNSPF

SEQ ID NO: 543013 - protein, 6 aa, Mycobacterium
PNSPFY

SEQ ID NO: 543014 - protein, 6 aa, Mycobacterium
PNSPSV

SEQ ID NO: 543015 - protein, 7 aa, Mycobacterium
PNSPTGS

SEQ ID NO: 543016 - protein, 9 aa, Mycobacterium
PNSRDTGGI

SEQ ID NO: 543017 - protein, 14 aa, Mycobacterium
PNSTTAATTEEDEV

SEQ ID NO: 543018 - protein, 11 aa, Mycobacterium
PNSVPDKYDAK

SEQ ID NO: 543019 - protein, 4 aa, Mycobacterium
PNSY

SEQ ID NO: 543020 - protein, 7 aa, Mycobacterium
PNTAAHT

SEQ ID NO: 543021 - protein, 10 aa, Mycobacterium
PNTAGCRGAA

SEQ ID NO: 543022 - protein, 5 aa, Mycobacterium
PNTAV

SEQ ID NO: 543023 - protein, 5 aa, Mycobacterium
PNTDQ

SEQ ID NO: 543024 - protein, 5 aa, Mycobacterium
PNTDR

SEQ ID NO: 543025 - protein, 7 aa, Mycobacterium
PNTFPQT

SEQ ID NO: 543026 - protein, 5 aa, Mycobacterium
PNTGA

SEQ ID NO: 543027 - protein, 7 aa, Mycobacterium
PNTGGES

SEQ ID NO: 543028 - protein, 19 aa, Mycobacterium
PNTIDGGTPVVSTEDAATA

SEQ ID NO: 543029 - protein, 10 aa, Mycobacterium
PNTITSPAAL

SEQ ID NO: 543030 - protein, 6 aa, Mycobacterium
PNTLGN

SEQ ID NO: 543031 - protein, 12 aa, Mycobacterium
PNTLGNTRMLLT

SEQ ID NO: 543032 - protein, 16 aa, Mycobacterium
PNTNRRTDRWGGDAQR

SEQ ID NO: 543033 - protein, 7 aa, Mycobacterium
PNTPGVT

SEQ ID NO: 543034 - protein, 14 aa, Mycobacterium
PNTPTGNDRRGATF

SEQ ID NO: 543035 - protein, 6 aa, Mycobacterium
PNTPTL

SEQ ID NO: 543036 - protein, 5 aa, Mycobacterium
PNTPV

SEQ ID NO: 543037 - protein, 15 aa, Mycobacterium
PNTQVTQQVPAPSEH

SEQ ID NO: 543038 - protein, 5 aa, Mycobacterium
PNTRA

SEQ ID NO: 543039 - protein, 42 aa, Mycobacterium
PNTRSGSGAPGQARAKARAKPRKKAPATPVVPPAPPPTANPA

SEQ ID NO: 543040 - protein, 15 aa, Mycobacterium
PNTTPAELASAQKGE

SEQ ID NO: 543041 - protein, 7 aa, Mycobacterium
PNTVPGY

SEQ ID NO: 543042 - protein, 4 aa, Mycobacterium
PNTY

SEQ ID NO: 543043 - protein, 11 aa, Mycobacterium
PNVDGGHERAL

SEQ ID NO: 543044 - protein, 13 aa, Mycobacterium
PNVDGGKERALED

SEQ ID NO: 543045 - protein, 6 aa, Mycobacterium
PNVGKS

SEQ ID NO: 543046 - protein, 8 aa, Mycobacterium
PNVPTEGV

SEQ ID NO: 543047 - protein, 8 aa, Mycobacterium
PNVQEPGS

SEQ ID NO: 543048 - protein, 7 aa, Mycobacterium
PNVQQAT

SEQ ID NO: 543049 - protein, 7 aa, Mycobacterium
PNVTEDQ

SEQ ID NO: 543050 - protein, 14 aa, Mycobacterium
PNVTGKPVGSDLAR

SEQ ID NO: 543051 - protein, 7 aa, Mycobacterium
PNVTGTQ

SEQ ID NO: 543052 - protein, 9 aa, Mycobacterium
PNWPAPGST

SEQ ID NO: 543053 - protein, 10 aa, Mycobacterium
PNWPEAGSSI

SEQ ID NO: 543054 - protein, 10 aa, Mycobacterium
PNWPEPGSSI

SEQ ID NO: 543055 - protein, 4 aa, Mycobacterium
PNWS

SEQ ID NO: 543056 - protein, 8 aa, Mycobacterium
PNWSNSDF

SEQ ID NO: 543057 - protein, 5 aa, Mycobacterium
PNYGG

SEQ ID NO: 543058 - protein, 19 aa, Mycobacterium
PNYPDDHAKPLPDGIEAQT

SEQ ID NO: 543059 - protein, 7 aa, Mycobacterium
PNYPPMG

SEQ ID NO: 543060 - protein, 7 aa, Mycobacterium
PNYPSER

SEQ ID NO: 543061 - protein, 4 aa, Mycobacterium
PNYS

SEQ ID NO: 543062 - protein, 5 aa, Mycobacterium
PNYSG

SEQ ID NO: 543063 - protein, 11 aa, Mycobacterium
PNYSPGHGAGA

SEQ ID NO: 543064 - protein, 16 aa, Mycobacterium
PNYSVPAGNKPLSERE

SEQ ID NO: 543065 - protein, 16 aa, Mycobacterium
PNYSVPAGNRPLSAEE

SEQ ID NO: 543066 - protein, 17 aa, Mycobacterium
PNYSVPAGNRPLTDTDV

SEQ ID NO: 543067 - protein, 42 aa, Mycobacterium
PNYSVPAGNRPLTGEELAEAKANYAERRRKSWRSGGGSPHVA

SEQ ID NO: 543068 - protein, 25 aa, Mycobacterium
PPAAAATAPAKPDPPTPTRPATSST

SEQ ID NO: 543069 - protein, 7 aa, Mycobacterium
PPAAAGA

SEQ ID NO: 543070 - protein, 8 aa, Mycobacterium
PPAAAGAV

SEQ ID NO: 543071 - protein, 6 aa, Mycobacterium
PPAADA

SEQ ID NO: 543072 - protein, 9 aa, Mycobacterium
PPAADGAMG

SEQ ID NO: 543073 - protein, 15 aa, Mycobacterium
PPAADPGVTDEERRT

SEQ ID NO: 543074 - protein, 9 aa, Mycobacterium
PPAADPVSI

SEQ ID NO: 543075 - protein, 20 aa, Mycobacterium
PPAADVAPELDGPEENVTTP

SEQ ID NO: 543076 - protein, 10 aa, Mycobacterium
PPAAEPLETQ

SEQ ID NO: 543077 - protein, 6 aa, Mycobacterium
PPAAEV

SEQ ID NO: 543078 - protein, 8 aa, Mycobacterium
PPAAGATS

SEQ ID NO: 543079 - protein, 18 aa, Mycobacterium
PPAAGGEAPGAGSEPHPV

SEQ ID NO: 543080 - protein, 7 aa, Mycobacterium
PPAAGRA

SEQ ID NO: 543081 - protein, 13 aa, Mycobacterium
PPAALPAESRLGP

SEQ ID NO: 543082 - protein, 11 aa, Mycobacterium
PPAAPPPPPPI

SEQ ID NO: 543083 - protein, 5 aa, Mycobacterium
PPAAQ

SEQ ID NO: 543084 - protein, 6 aa, Mycobacterium
PPAAQN

SEQ ID NO: 543085 - protein, 7 aa, Mycobacterium
PPAAQTG

SEQ ID NO: 543086 - protein, 9 aa, Mycobacterium
PPAARQPAV

SEQ ID NO: 543087 - protein, 64 aa, Mycobacterium
PPAASPQPDTQAPPAQEPAAQVPPGWSPPQPYPGQWPQPAPAAPQPYGGQQFPSQPPPQPTSVQ

SEQ ID NO: 543088 - protein, 27 aa, Mycobacterium
PPAATDGHGSDGSEDADASVHRPDFSR

SEQ ID NO: 543089 - protein, 11 aa, Mycobacterium
PPAATRTKPSV

SEQ ID NO: 543090 - protein, 8 aa, Mycobacterium
PPADDDEA

SEQ ID NO: 543091 - protein, 10 aa, Mycobacterium
PPADGDATAA

SEQ ID NO: 543092 - protein, 9 aa, Mycobacterium
PPADGDRPR

SEQ ID NO: 543093 - protein, 16 aa, Mycobacterium
PPADPDPAVNQALKGG

SEQ ID NO: 543094 - protein, 8 aa, Mycobacterium
PPADPDVS

SEQ ID NO: 543095 - protein, 19 aa, Mycobacterium
PPADQRSAYSDRHGELSPL

SEQ ID NO: 543096 - protein, 5 aa, Mycobacterium
PPADR

SEQ ID NO: 543097 - protein, 12 aa, Mycobacterium
PPADREPAVEPL

SEQ ID NO: 543098 - protein, 7 aa, Mycobacterium
PPADTDK

SEQ ID NO: 543099 - protein, 5 aa, Mycobacterium
PPADV

SEQ ID NO: 543100 - protein, 9 aa, Mycobacterium
PPADWEPGR

SEQ ID NO: 543101 - protein, 24 aa, Mycobacterium
PPAEHAEGARKAAAACPAMAIHIE

SEQ ID NO: 543102 - protein, 8 aa, Mycobacterium
PPAEPDFS

SEQ ID NO: 543103 - protein, 40 aa, Mycobacterium
PPAEPFPGSDGSIPGDDAALDTDEPFENGEAVDGAQPGWP

SEQ ID NO: 543104 - protein, 10 aa, Mycobacterium
PPAEPSSAPR

SEQ ID NO: 543105 - protein, 6 aa, Mycobacterium
PPAERQ

SEQ ID NO: 543106 - protein, 7 aa, Mycobacterium
PPAETSG

SEQ ID NO: 543107 - protein, 6 aa, Mycobacterium
PPAEVA

SEQ ID NO: 543108 - protein, 14 aa, Mycobacterium
PPAEVAEAVRAAVT

SEQ ID NO: 543109 - protein, 6 aa, Mycobacterium
PPAEVP

SEQ ID NO: 543110 - protein, 5 aa, Mycobacterium
PPAEY

SEQ ID NO: 543111 - protein, 4 aa, Mycobacterium
PPAF

SEQ ID NO: 543112 - protein, 4 aa, Mycobacterium
PPAG

SEQ ID NO: 543113 - protein, 9 aa, Mycobacterium
PPAGAGPDY

SEQ ID NO: 543114 - protein, 7 aa, Mycobacterium
PPAGAGR

SEQ ID NO: 543115 - protein, 7 aa, Mycobacterium
PPAGAPN

SEQ ID NO: 543116 - protein, 7 aa, Mycobacterium
PPAGARA

SEQ ID NO: 543117 - protein, 8 aa, Mycobacterium
PPAGDEVS

SEQ ID NO: 543118 - protein, 6 aa, Mycobacterium
PPAGDI

SEQ ID NO: 543119 - protein, 5 aa, Mycobacterium
PPAGE

SEQ ID NO: 543120 - protein, 7 aa, Mycobacterium
PPAGGEE

SEQ ID NO: 543121 - protein, 10 aa, Mycobacterium
PPAGGGPGPH

SEQ ID NO: 543122 - protein, 8 aa, Mycobacterium
PPAGGLTN

SEQ ID NO: 543123 - protein, 25 aa, Mycobacterium
PPAGIGRTAAAGHGPRPARLNGHTG

SEQ ID NO: 543124 - protein, 7 aa, Mycobacterium
PPAGLPG

SEQ ID NO: 543125 - protein, 6 aa, Mycobacterium
PPAGLR

SEQ ID NO: 543126 - protein, 7 aa, Mycobacterium
PPAGNAN

SEQ ID NO: 543127 - protein, 6 aa, Mycobacterium
PPAGPS

SEQ ID NO: 543128 - protein, 6 aa, Mycobacterium
PPAGRV

SEQ ID NO: 543129 - protein, 19 aa, Mycobacterium
PPAGSLGLPGRSEPAAGDG

SEQ ID NO: 543130 - protein, 10 aa, Mycobacterium
PPAGSSAADD

SEQ ID NO: 543131 - protein, 8 aa, Mycobacterium
PPAGSVAG

SEQ ID NO: 543132 - protein, 5 aa, Mycobacterium
PPAGT

SEQ ID NO: 543133 - protein, 7 aa, Mycobacterium
PPAHADD

SEQ ID NO: 543134 - protein, 5 aa, Mycobacterium
PPAHT

SEQ ID NO: 543135 - protein, 6 aa, Mycobacterium
PPAHTR

SEQ ID NO: 543136 - protein, 11 aa, Mycobacterium
PPAKPAPSAAL

SEQ ID NO: 543137 - protein, 10 aa, Mycobacterium
PPALAHSSSR

SEQ ID NO: 543138 - protein, 5 aa, Mycobacterium
PPALD

SEQ ID NO: 543139 - protein, 17 aa, Mycobacterium
PPALKTGAGTRAVSSPR

SEQ ID NO: 543140 - protein, 28 aa, Mycobacterium
PPALPAPTTPVPPVPPSPPLPPVPPLPP

SEQ ID NO: 543141 - protein, 32 aa, Mycobacterium
PPALPQSPAPARPAAPAPEDGSLSIGSLKGTS

SEQ ID NO: 543142 - protein, 7 aa, Mycobacterium
PPALTTD

SEQ ID NO: 543143 - protein, 6 aa, Mycobacterium
PPAMTS

SEQ ID NO: 543144 - protein, 4 aa, Mycobacterium
PPAN

SEQ ID NO: 543145 - protein, 8 aa, Mycobacterium
PPANAPMS

SEQ ID NO: 543146 - protein, 7 aa, Mycobacterium
PPANNAN

SEQ ID NO: 543147 - protein, 5 aa, Mycobacterium
PPAPA

SEQ ID NO: 543148 - protein, 15 aa, Mycobacterium
PPAPAEGHYIAQSLF

SEQ ID NO: 543149 - protein, 15 aa, Mycobacterium
PPAPAEGHYIGQSLF

SEQ ID NO: 543150 - protein, 12 aa, Mycobacterium
PPAPAGEPAGGG

SEQ ID NO: 543151 - protein, 7 aa, Mycobacterium
PPAPAYG

SEQ ID NO: 543152 - protein, 5 aa, Mycobacterium
PPAPF

SEQ ID NO: 543153 - protein, 7 aa, Mycobacterium
PPAPGAT

SEQ ID NO: 543154 - protein, 6 aa, Mycobacterium
PPAPGL

SEQ ID NO: 543155 - protein, 15 aa, Mycobacterium
PPAPGLYTSGPAVQP

SEQ ID NO: 543156 - protein, 26 aa, Mycobacterium
PPAPLDPIDEPERTRDAVGEAAAHGA

SEQ ID NO: 543157 - protein, 6 aa, Mycobacterium
PPAPLR

SEQ ID NO: 543158 - protein, 8 aa, Mycobacterium
PPAPLSNT

SEQ ID NO: 543159 - protein, 6 aa, Mycobacterium
PPAPMT

SEQ ID NO: 543160 - protein, 10 aa, Mycobacterium
PPAPPDAPRP

SEQ ID NO: 543161 - protein, 18 aa, Mycobacterium
PPAPPGISDDPDRRAAGH

SEQ ID NO: 543162 - protein, 20 aa, Mycobacterium
PPAPPGMTDSPDRRAAGRAT

SEQ ID NO: 543163 - protein, 20 aa, Mycobacterium
PPAPPGPAVPNRPAAPPWPP

SEQ ID NO: 543164 - protein, 10 aa, Mycobacterium
PPAPPNSARP

SEQ ID NO: 543165 - protein, 10 aa, Mycobacterium
PPAPPPMPAT

SEQ ID NO: 543166 - protein, 15 aa, Mycobacterium
PPAPPSMTADPDLRA

SEQ ID NO: 543167 - protein, 7 aa, Mycobacterium
PPAPPTT

SEQ ID NO: 543168 - protein, 14 aa, Mycobacterium
PPAPPVDAEQARAD

SEQ ID NO: 543169 - protein, 14 aa, Mycobacterium
PPAPRYRPEKEPGQ

SEQ ID NO: 543170 - protein, 5 aa, Mycobacterium
PPAPT

SEQ ID NO: 543171 - protein, 14 aa, Mycobacterium
PPAPTDLEPPADQT

SEQ ID NO: 543172 - protein, 13 aa, Mycobacterium
PPAPTGPTTLARD

SEQ ID NO: 543173 - protein, 10 aa, Mycobacterium
PPAPTGTRMA

SEQ ID NO: 543174 - protein, 7 aa, Mycobacterium
PPAPVRS

SEQ ID NO: 543175 - protein, 12 aa, Mycobacterium
PPAPVRSDVGDG

SEQ ID NO: 543176 - protein, 5 aa, Mycobacterium
PPAQA

SEQ ID NO: 543177 - protein, 5 aa, Mycobacterium
PPAQG

SEQ ID NO: 543178 - protein, 7 aa, Mycobacterium
PPAQITP

SEQ ID NO: 543179 - protein, 6 aa, Mycobacterium
PPAQLP

SEQ ID NO: 543180 - protein, 4 aa, Mycobacterium
PPAR

SEQ ID NO: 543181 - protein, 23 aa, Mycobacterium
PPARPEPIAEAADRSIDGRDGPI

SEQ ID NO: 543182 - protein, 6 aa, Mycobacterium
PPARPL

SEQ ID NO: 543183 - protein, 8 aa, Mycobacterium
PPARPLPR

SEQ ID NO: 543184 - protein, 16 aa, Mycobacterium
PPARPRGTITRGTTGI

SEQ ID NO: 543185 - protein, 10 aa, Mycobacterium
PPARPRPADM

SEQ ID NO: 543186 - protein, 9 aa, Mycobacterium
PPARPRPAT

SEQ ID NO: 543187 - protein, 15 aa, Mycobacterium
PPARRLGDLATSPGS

SEQ ID NO: 543188 - protein, 23 aa, Mycobacterium
PPARRPETNGRRRGHLRVLPDPA

SEQ ID NO: 543189 - protein, 24 aa, Mycobacterium
PPASAADPAHADGRATRATSETMN

SEQ ID NO: 543190 - protein, 12 aa, Mycobacterium
PPASETVERPRS

SEQ ID NO: 543191 - protein, 6 aa, Mycobacterium
PPASGA

SEQ ID NO: 543192 - protein, 10 aa, Mycobacterium
PPASKDDLPT

SEQ ID NO: 543193 - protein, 10 aa, Mycobacterium
PPASPAGERL

SEQ ID NO: 543194 - protein, 5 aa, Mycobacterium
PPASS

SEQ ID NO: 543195 - protein, 9 aa, Mycobacterium
PPASTTLPG

SEQ ID NO: 543196 - protein, 7 aa, Mycobacterium
PPASVPR

SEQ ID NO: 543197 - protein, 13 aa, Mycobacterium
PPASVTGTPKHRA

SEQ ID NO: 543198 - protein, 14 aa, Mycobacterium
PPASVTGTPKTRAR

SEQ ID NO: 543199 - protein, 29 aa, Mycobacterium
PPATATSTGPARAGVPTPTRPAAPSAASQ

SEQ ID NO: 543200 - protein, 8 aa, Mycobacterium
PPATATYV

SEQ ID NO: 543201 - protein, 6 aa, Mycobacterium
PPATPH

SEQ ID NO: 543202 - protein, 8 aa, Mycobacterium
PPATRASG

SEQ ID NO: 543203 - protein, 7 aa, Mycobacterium
PPATTDY

SEQ ID NO: 543204 - protein, 6 aa, Mycobacterium
PPATTE

SEQ ID NO: 543205 - protein, 5 aa, Mycobacterium
PPATV

SEQ ID NO: 543206 - protein, 7 aa, Mycobacterium
PPAVGDG

SEQ ID NO: 543207 - protein, 12 aa, Mycobacterium
PPAVGGDVATRT

SEQ ID NO: 543208 - protein, 5 aa, Mycobacterium
PPAVN

SEQ ID NO: 543209 - protein, 14 aa, Mycobacterium
PPAVPDGSRPAGQV

SEQ ID NO: 543210 - protein, 31 aa, Mycobacterium
PPAVPSIPAGPVSGAAVAPSVSSSPSAGGPL

SEQ ID NO: 543211 - protein, 5 aa, Mycobacterium
PPAVT

SEQ ID NO: 543212 - protein, 8 aa, Mycobacterium
PPAVTESE

SEQ ID NO: 543213 - protein, 4 aa, Mycobacterium
PPAW

SEQ ID NO: 543214 - protein, 10 aa, Mycobacterium
PPAWASATPA

SEQ ID NO: 543215 - protein, 20 aa, Mycobacterium
PPAWTSAAGPAVASGASSIP

SEQ ID NO: 543216 - protein, 4 aa, Mycobacterium
PPCR

SEQ ID NO: 543217 - protein, 5 aa, Mycobacterium
PPDAA

SEQ ID NO: 543218 - protein, 9 aa, Mycobacterium
PPDAAGPGF

SEQ ID NO: 543219 - protein, 10 aa, Mycobacterium
PPDADASTVA

SEQ ID NO: 543220 - protein, 16 aa, Mycobacterium
PPDADPATAAAGEGIS

SEQ ID NO: 543221 - protein, 7 aa, Mycobacterium
PPDADPG

SEQ ID NO: 543222 - protein, 12 aa, Mycobacterium
PPDADSPNTAQS

SEQ ID NO: 543223 - protein, 6 aa, Mycobacterium
PPDAEA

SEQ ID NO: 543224 - protein, 8 aa, Mycobacterium
PPDAEART

SEQ ID NO: 543225 - protein, 5 aa, Mycobacterium
PPDAG

SEQ ID NO: 543226 - protein, 5 aa, Mycobacterium
PPDAI

SEQ ID NO: 543227 - protein, 8 aa, Mycobacterium
PPDAKDRV

SEQ ID NO: 543228 - protein, 5 aa, Mycobacterium
PPDAP

SEQ ID NO: 543229 - protein, 12 aa, Mycobacterium
PPDAPHNKPTDV

SEQ ID NO: 543230 - protein, 10 aa, Mycobacterium
PPDAPTPAQT

SEQ ID NO: 543231 - protein, 8 aa, Mycobacterium
PPDAQART

SEQ ID NO: 543232 - protein, 10 aa, Mycobacterium
PPDARPGAQI

SEQ ID NO: 543233 - protein, 8 aa, Mycobacterium
PPDATARR

SEQ ID NO: 543234 - protein, 4 aa, Mycobacterium
PPDD

SEQ ID NO: 543235 - protein, 17 aa, Mycobacterium
PPDDDVGAAVATAVGMI

SEQ ID NO: 543236 - protein, 5 aa, Mycobacterium
PPDDF

SEQ ID NO: 543237 - protein, 7 aa, Mycobacterium
PPDDFST

SEQ ID NO: 543238 - protein, 10 aa, Mycobacterium
PPDDLATSDE

SEQ ID NO: 543239 - protein, 7 aa, Mycobacterium
PPDDPGW

SEQ ID NO: 543240 - protein, 7 aa, Mycobacterium
PPDDPRI

SEQ ID NO: 543241 - protein, 7 aa, Mycobacterium
PPDDPRV

SEQ ID NO: 543242 - protein, 5 aa, Mycobacterium
PPDDV

SEQ ID NO: 543243 - protein, 6 aa, Mycobacterium
PPDDYA

SEQ ID NO: 543244 - protein, 13 aa, Mycobacterium
PPDELGMRLAKKP

SEQ ID NO: 543245 - protein, 6 aa, Mycobacterium
PPDEPY

SEQ ID NO: 543246 - protein, 5 aa, Mycobacterium
PPDER

SEQ ID NO: 543247 - protein, 16 aa, Mycobacterium
PPDERAAALRLIAHRD

SEQ ID NO: 543248 - protein, 6 aa, Mycobacterium
PPDERR

SEQ ID NO: 543249 - protein, 8 aa, Mycobacterium
PPDFEGTT

SEQ ID NO: 543250 - protein, 8 aa, Mycobacterium
PPDGDTGL

SEQ ID NO: 543251 - protein, 12 aa, Mycobacterium
PPDGGDLVPVSG

SEQ ID NO: 543252 - protein, 5 aa, Mycobacterium
PPDGL

SEQ ID NO: 543253 - protein, 11 aa, Mycobacterium
PPDGPDGKWGR

SEQ ID NO: 543254 - protein, 7 aa, Mycobacterium
PPDGPTA

SEQ ID NO: 543255 - protein, 8 aa, Mycobacterium
PPDGVTTG

SEQ ID NO: 543256 - protein, 14 aa, Mycobacterium
PPDHTGEAAERNGF

SEQ ID NO: 543257 - protein, 8 aa, Mycobacterium
PPDHTRYR

SEQ ID NO: 543258 - protein, 5 aa, Mycobacterium
PPDKI

SEQ ID NO: 543259 - protein, 4 aa, Mycobacterium
PPDL

SEQ ID NO: 543260 - protein, 7 aa, Mycobacterium
PPDLDGA

SEQ ID NO: 543261 - protein, 10 aa, Mycobacterium
PPDLRGDDDA

SEQ ID NO: 543262 - protein, 8 aa, Mycobacterium
PPDLSDDP

SEQ ID NO: 543263 - protein, 5 aa, Mycobacterium
PPDLT

SEQ ID NO: 543264 - protein, 7 aa, Mycobacterium
PPDMDPQ

SEQ ID NO: 543265 - protein, 7 aa, Mycobacterium
PPDNPHV

SEQ ID NO: 543266 - protein, 13 aa, Mycobacterium
PPDNRPGQPPVGP

SEQ ID NO: 543267 - protein, 7 aa, Mycobacterium
PPDPASV

SEQ ID NO: 543268 - protein, 11 aa, Mycobacterium
PPDPINPQKTV

SEQ ID NO: 543269 - protein, 11 aa, Mycobacterium
PPDPINPQNSI

SEQ ID NO: 543270 - protein, 10 aa, Mycobacterium
PPDPPATRQA

SEQ ID NO: 543271 - protein, 8 aa, Mycobacterium
PPDPPRDP

SEQ ID NO: 543272 - protein, 11 aa, Mycobacterium
PPDPQDPSAHV

SEQ ID NO: 543273 - protein, 6 aa, Mycobacterium
PPDPSP

SEQ ID NO: 543274 - protein, 6 aa, Mycobacterium
PPDQAR

SEQ ID NO: 543275 - protein, 9 aa, Mycobacterium
PPDQDGPGW

SEQ ID NO: 543276 - protein, 5 aa, Mycobacterium
PPDQP

SEQ ID NO: 543277 - protein, 5 aa, Mycobacterium
PPDQQ

SEQ ID NO: 543278 - protein, 5 aa, Mycobacterium
PPDQR

SEQ ID NO: 543279 - protein, 5 aa, Mycobacterium
PPDQV

SEQ ID NO: 543280 - protein, 5 aa, Mycobacterium
PPDRE

SEQ ID NO: 543281 - protein, 7 aa, Mycobacterium
PPDREPA

SEQ ID NO: 543282 - protein, 10 aa, Mycobacterium
PPDRETAYRT

SEQ ID NO: 543283 - protein, 8 aa, Mycobacterium
PPDRGAHR

SEQ ID NO: 543284 - protein, 5 aa, Mycobacterium
PPDRK

SEQ ID NO: 543285 - protein, 8 aa, Mycobacterium
PPDRPDIP

SEQ ID NO: 543286 - protein, 12 aa, Mycobacterium
PPDRRPSEPELT

SEQ ID NO: 543287 - protein, 8 aa, Mycobacterium
PPDRRSIR

SEQ ID NO: 543288 - protein, 8 aa, Mycobacterium
PPDRRSVR

SEQ ID NO: 543289 - protein, 7 aa, Mycobacterium
PPDRSRV

SEQ ID NO: 543290 - protein, 7 aa, Mycobacterium
PPDRTDE

SEQ ID NO: 543291 - protein, 8 aa, Mycobacterium
PPDSATSQ

SEQ ID NO: 543292 - protein, 8 aa, Mycobacterium
PPDSEAEQ

SEQ ID NO: 543293 - protein, 7 aa, Mycobacterium
PPDSGAH

SEQ ID NO: 543294 - protein, 8 aa, Mycobacterium
PPDSPDHD

SEQ ID NO: 543295 - protein, 14 aa, Mycobacterium
PPDSRPGAKTPGAP

SEQ ID NO: 543296 - protein, 13 aa, Mycobacterium
PPDSRPGQSPVGP

SEQ ID NO: 543297 - protein, 15 aa, Mycobacterium
PPDTAPRDTDDVGRP

SEQ ID NO: 543298 - protein, 7 aa, Mycobacterium
PPDTELS

SEQ ID NO: 543299 - protein, 28 aa, Mycobacterium
PPDTELSPVNPYSEVTGPDGQPWPAQDT

SEQ ID NO: 543300 - protein, 10 aa, Mycobacterium
PPDTELTERP

SEQ ID NO: 543301 - protein, 8 aa, Mycobacterium
PPDTGTLR

SEQ ID NO: 543302 - protein, 5 aa, Mycobacterium
PPDTR

SEQ ID NO: 543303 - protein, 12 aa, Mycobacterium
PPDTRPGHAPVG

SEQ ID NO: 543304 - protein, 7 aa, Mycobacterium
PPDTSLR

SEQ ID NO: 543305 - protein, 9 aa, Mycobacterium
PPDTTAPTF

SEQ ID NO: 543306 - protein, 4 aa, Mycobacterium
PPDV

SEQ ID NO: 543307 - protein, 5 aa, Mycobacterium
PPDVA

SEQ ID NO: 543308 - protein, 7 aa, Mycobacterium
PPDVDGV

SEQ ID NO: 543309 - protein, 5 aa, Mycobacterium
PPDVP

SEQ ID NO: 543310 - protein, 12 aa, Mycobacterium
PPDVSNIGESCT

SEQ ID NO: 543311 - protein, 10 aa, Mycobacterium
PPDVSPADDN

SEQ ID NO: 543312 - protein, 7 aa, Mycobacterium
PPDVVGE

SEQ ID NO: 543313 - protein, 5 aa, Mycobacterium
PPDWD

SEQ ID NO: 543314 - protein, 12 aa, Mycobacterium
PPDYTGGRNAGT

SEQ ID NO: 543315 - protein, 8 aa, Mycobacterium
PPEADHDV

SEQ ID NO: 543316 - protein, 7 aa, Mycobacterium
PPEADHN

SEQ ID NO: 543317 - protein, 6 aa, Mycobacterium
PPEAIG

SEQ ID NO: 543318 - protein, 7 aa, Mycobacterium
PPEAKAR

SEQ ID NO: 543319 - protein, 6 aa, Mycobacterium
PPEAQV

SEQ ID NO: 543320 - protein, 10 aa, Mycobacterium
PPEARPPQEE

SEQ ID NO: 543321 - protein, 5 aa, Mycobacterium
PPEAV

SEQ ID NO: 543322 - protein, 6 aa, Mycobacterium
PPEDAD

SEQ ID NO: 543323 - protein, 5 aa, Mycobacterium
PPEDE

SEQ ID NO: 543324 - protein, 5 aa, Mycobacterium
PPEEL

SEQ ID NO: 543325 - protein, 4 aa, Mycobacterium
PPEF

SEQ ID NO: 543326 - protein, 23 aa, Mycobacterium
PPEGFGAPKDRRGHAADADVGLP

SEQ ID NO: 543327 - protein, 25 aa, Mycobacterium
PPEGFGAPKNRRGHAAGTDPGLPEG

SEQ ID NO: 543328 - protein, 16 aa, Mycobacterium
PPEGFGAPKNRRGHAS

SEQ ID NO: 543329 - protein, 7 aa, Mycobacterium
PPEGLTT

SEQ ID NO: 543330 - protein, 7 aa, Mycobacterium
PPEGNDL

SEQ ID NO: 543331 - protein, 33 aa, Mycobacterium
PPEGPVAPPPSAIAPPPGPGFPPPHGGPGPMPP

SEQ ID NO: 543332 - protein, 12 aa, Mycobacterium
PPEGQPAPPYTL

SEQ ID NO: 543333 - protein, 6 aa, Mycobacterium
PPEHGR

SEQ ID NO: 543334 - protein, 5 aa, Mycobacterium
PPEHR

SEQ ID NO: 543335 - protein, 7 aa, Mycobacterium
PPEHSRA

SEQ ID NO: 543336 - protein, 8 aa, Mycobacterium
PPEHTTYY

SEQ ID NO: 543337 - protein, 6 aa, Mycobacterium
PPEITE

SEQ ID NO: 543338 - protein, 10 aa, Mycobacterium
PPEIYERPTS

SEQ ID NO: 543339 - protein, 8 aa, Mycobacterium
PPEKLTGK

SEQ ID NO: 543340 - protein, 5 aa, Mycobacterium
PPEKV

SEQ ID NO: 543341 - protein, 5 aa, Mycobacterium
PPELN

SEQ ID NO: 543342 - protein, 6 aa, Mycobacterium
PPELNR

SEQ ID NO: 543343 - protein, 5 aa, Mycobacterium
PPELP

SEQ ID NO: 543344 - protein, 6 aa, Mycobacterium
PPELPY

SEQ ID NO: 543345 - protein, 17 aa, Mycobacterium
PPELRRRGAARERAAEL

SEQ ID NO: 543346 - protein, 7 aa, Mycobacterium
PPENEEA

SEQ ID NO: 543347 - protein, 13 aa, Mycobacterium
PPENTRTPGTDEW

SEQ ID NO: 543348 - protein, 10 aa, Mycobacterium
PPEPPRDSAA

SEQ ID NO: 543349 - protein, 11 aa, Mycobacterium
PPEQRARPGAR

SEQ ID NO: 543350 - protein, 5 aa, Mycobacterium
PPERE

SEQ ID NO: 543351 - protein, 11 aa, Mycobacterium
PPEREETDAEL

SEQ ID NO: 543352 - protein, 9 aa, Mycobacterium
PPERESEQV

SEQ ID NO: 543353 - protein, 5 aa, Mycobacterium
PPERL

SEQ ID NO: 543354 - protein, 13 aa, Mycobacterium
PPERLNKATPAPF

SEQ ID NO: 543355 - protein, 13 aa, Mycobacterium
PPERLSTASPAPF

SEQ ID NO: 543356 - protein, 13 aa, Mycobacterium
PPERMTKASPAPF

SEQ ID NO: 543357 - protein, 5 aa, Mycobacterium
PPERT

SEQ ID NO: 543358 - protein, 8 aa, Mycobacterium
PPESGTVS

SEQ ID NO: 543359 - protein, 11 aa, Mycobacterium
PPESIPKTDIG

SEQ ID NO: 543360 - protein, 15 aa, Mycobacterium
PPESMTLNGDGKGGV

SEQ ID NO: 543361 - protein, 4 aa, Mycobacterium
PPET

SEQ ID NO: 543362 - protein, 10 aa, Mycobacterium
PPETDEEATR

SEQ ID NO: 543363 - protein, 6 aa, Mycobacterium
PPETFG

SEQ ID NO: 543364 - protein, 5 aa, Mycobacterium
PPETP

SEQ ID NO: 543365 - protein, 7 aa, Mycobacterium
PPETTGF

SEQ ID NO: 543366 - protein, 5 aa, Mycobacterium
PPETV

SEQ ID NO: 543367 - protein, 7 aa, Mycobacterium
PPETVDD

SEQ ID NO: 543368 - protein, 5 aa, Mycobacterium
PPEVH

SEQ ID NO: 543369 - protein, 5 aa, Mycobacterium
PPEVQ

SEQ ID NO: 543370 - protein, 5 aa, Mycobacterium
PPEVS

SEQ ID NO: 543371 - protein, 4 aa, Mycobacterium
PPEW

SEQ ID NO: 543372 - protein, 5 aa, Mycobacterium
PPEYD

SEQ ID NO: 543373 - protein, 4 aa, Mycobacterium
PPFA

SEQ ID NO: 543374 - protein, 5 aa, Mycobacterium
PPFDQ

SEQ ID NO: 543375 - protein, 14 aa, Mycobacterium
PPFEEAPETGATFE

SEQ ID NO: 543376 - protein, 10 aa, Mycobacterium
PPFERRKGES

SEQ ID NO: 543377 - protein, 5 aa, Mycobacterium
PPFGN

SEQ ID NO: 543378 - protein, 7 aa, Mycobacterium
PPFGRKS

SEQ ID NO: 543379 - protein, 5 aa, Mycobacterium
PPFGS

SEQ ID NO: 543380 - protein, 8 aa, Mycobacterium
PPFGSHQG

SEQ ID NO: 543381 - protein, 7 aa, Mycobacterium
PPFGSRG

SEQ ID NO: 543382 - protein, 5 aa, Mycobacterium
PPFGT

SEQ ID NO: 543383 - protein, 14 aa, Mycobacterium
PPFPARGDIAQTDA

SEQ ID NO: 543384 - protein, 8 aa, Mycobacterium
PPFPPAPP

SEQ ID NO: 543385 - protein, 11 aa, Mycobacterium
PPFRPPSFNPV

SEQ ID NO: 543386 - protein, 11 aa, Mycobacterium
PPFSGPQGPFA

SEQ ID NO: 543387 - protein, 5 aa, Mycobacterium
PPFSQ

SEQ ID NO: 543388 - protein, 4 aa, Mycobacterium
PPFV

SEQ ID NO: 543389 - protein, 23 aa, Mycobacterium
PPFYPEAGADPVADAVHSSTDPM

SEQ ID NO: 543390 - protein, 7 aa, Mycobacterium
PPGADVP

SEQ ID NO: 543391 - protein, 8 aa, Mycobacterium
PPGAEPGL

SEQ ID NO: 543392 - protein, 5 aa, Mycobacterium
PPGAG

SEQ ID NO: 543393 - protein, 13 aa, Mycobacterium
PPGAGAPPPLPPG

SEQ ID NO: 543394 - protein, 6 aa, Mycobacterium
PPGAGE

SEQ ID NO: 543395 - protein, 5 aa, Mycobacterium
PPGAI

SEQ ID NO: 543396 - protein, 6 aa, Mycobacterium
PPGAIA

SEQ ID NO: 543397 - protein, 7 aa, Mycobacterium
PPGAKAR

SEQ ID NO: 543398 - protein, 5 aa, Mycobacterium
PPGAM

SEQ ID NO: 543399 - protein, 8 aa, Mycobacterium
PPGAPAPV

SEQ ID NO: 543400 - protein, 11 aa, Mycobacterium
PPGAPYGPLHD

SEQ ID NO: 543401 - protein, 8 aa, Mycobacterium
PPGAQLPS

SEQ ID NO: 543402 - protein, 13 aa, Mycobacterium
PPGASRAKPTDVR

SEQ ID NO: 543403 - protein, 6 aa, Mycobacterium
PPGASY

SEQ ID NO: 543404 - protein, 6 aa, Mycobacterium
PPGATE

SEQ ID NO: 543405 - protein, 7 aa, Mycobacterium
PPGATTD

SEQ ID NO: 543406 - protein, 18 aa, Mycobacterium
PPGAVAGAGTLEAAGATF

SEQ ID NO: 543407 - protein, 4 aa, Mycobacterium
PPGD

SEQ ID NO: 543408 - protein, 6 aa, Mycobacterium
PPGDAP

SEQ ID NO: 543409 - protein, 6 aa, Mycobacterium
PPGDDE

SEQ ID NO: 543410 - protein, 7 aa, Mycobacterium
PPGDDTV

SEQ ID NO: 543411 - protein, 6 aa, Mycobacterium
PPGDFP

SEQ ID NO: 543412 - protein, 8 aa, Mycobacterium
PPGDGPAP

SEQ ID NO: 543413 - protein, 6 aa, Mycobacterium
PPGDIG

SEQ ID NO: 543414 - protein, 5 aa, Mycobacterium
PPGDL

SEQ ID NO: 543415 - protein, 11 aa, Mycobacterium
PPGDLPRRGAH

SEQ ID NO: 543416 - protein, 15 aa, Mycobacterium
PPGDPGSPPHRHSGP

SEQ ID NO: 543417 - protein, 11 aa, Mycobacterium
PPGDPKIVPTS

SEQ ID NO: 543418 - protein, 8 aa, Mycobacterium
PPGDSAEP

SEQ ID NO: 543419 - protein, 5 aa, Mycobacterium
PPGEF

SEQ ID NO: 543420 - protein, 8 aa, Mycobacterium
PPGEGDRA

SEQ ID NO: 543421 - protein, 5 aa, Mycobacterium
PPGEI

SEQ ID NO: 543422 - protein, 6 aa, Mycobacterium
PPGELG

SEQ ID NO: 543423 - protein, 10 aa, Mycobacterium
PPGESGQTLD

SEQ ID NO: 543424 - protein, 11 aa, Mycobacterium
PPGFGAPLPDG

SEQ ID NO: 543425 - protein, 5 aa, Mycobacterium
PPGFP

SEQ ID NO: 543426 - protein, 5 aa, Mycobacterium
PPGGA

SEQ ID NO: 543427 - protein, 10 aa, Mycobacterium
PPGGDDAVDR

SEQ ID NO: 543428 - protein, 6 aa, Mycobacterium
PPGGHF

SEQ ID NO: 543429 - protein, 9 aa, Mycobacterium
PPGGLSASS

SEQ ID NO: 543430 - protein, 6 aa, Mycobacterium
PPGGQE

SEQ ID NO: 543431 - protein, 6 aa, Mycobacterium
PPGGRF

SEQ ID NO: 543432 - protein, 5 aa, Mycobacterium
PPGGT

SEQ ID NO: 543433 - protein, 6 aa, Mycobacterium
PPGGTA

SEQ ID NO: 543434 - protein, 8 aa, Mycobacterium
PPGGVPDS

SEQ ID NO: 543435 - protein, 8 aa, Mycobacterium
PPGGVPVP

SEQ ID NO: 543436 - protein, 4 aa, Mycobacterium
PPGH

SEQ ID NO: 543437 - protein, 9 aa, Mycobacterium
PPGHGDSQS

SEQ ID NO: 543438 - protein, 11 aa, Mycobacterium
PPGHGGSEPLR

SEQ ID NO: 543439 - protein, 13 aa, Mycobacterium
PPGHGSSAPLSGP

SEQ ID NO: 543440 - protein, 10 aa, Mycobacterium
PPGHHAESER

SEQ ID NO: 543441 - protein, 7 aa, Mycobacterium
PPGHRVD

SEQ ID NO: 543442 - protein, 4 aa, Mycobacterium
PPGI

SEQ ID NO: 543443 - protein, 13 aa, Mycobacterium
PPGIGPNAVTEDE

SEQ ID NO: 543444 - protein, 10 aa, Mycobacterium
PPGIQPTRNR

SEQ ID NO: 543445 - protein, 17 aa, Mycobacterium
PPGKNSAPTVGNPSYTI

SEQ ID NO: 543446 - protein, 15 aa, Mycobacterium
PPGLADDQAAAVTTA

SEQ ID NO: 543447 - protein, 7 aa, Mycobacterium
PPGLADE

SEQ ID NO: 543448 - protein, 6 aa, Mycobacterium
PPGLAT

SEQ ID NO: 543449 - protein, 11 aa, Mycobacterium
PPGLGEASKFD

SEQ ID NO: 543450 - protein, 6 aa, Mycobacterium
PPGLNK

SEQ ID NO: 543451 - protein, 4 aa, Mycobacterium
PPGM

SEQ ID NO: 543452 - protein, 8 aa, Mycobacterium
PPGMDSAE

SEQ ID NO: 543453 - protein, 50 aa, Mycobacterium
PPGMGAPAAPVAAGGASAAAPVAPAGNTATPGGSAPTTGPAAGSTVGSGG

SEQ ID NO: 543454 - protein, 49 aa, Mycobacterium
PPGMGAPAAPVAGGASGAAPVAPAGNSATAGGSAPATNSAGSPGGSGGA

SEQ ID NO: 543455 - protein, 6 aa, Mycobacterium
PPGMPG

SEQ ID NO: 543456 - protein, 17 aa, Mycobacterium
PPGNTWEQARKHSRAAV

SEQ ID NO: 543457 - protein, 14 aa, Mycobacterium
PPGPDPVPAPADDW

SEQ ID NO: 543458 - protein, 10 aa, Mycobacterium
PPGPNASKLT

SEQ ID NO: 543459 - protein, 13 aa, Mycobacterium
PPGPPPARTGADR

SEQ ID NO: 543460 - protein, 7 aa, Mycobacterium
PPGPPRA

SEQ ID NO: 543461 - protein, 6 aa, Mycobacterium
PPGPRF

SEQ ID NO: 543462 - protein, 12 aa, Mycobacterium
PPGPRQREGGPS

SEQ ID NO: 543463 - protein, 5 aa, Mycobacterium
PPGPV

SEQ ID NO: 543464 - protein, 13 aa, Mycobacterium
PPGPYGNDPLSWA

SEQ ID NO: 543465 - protein, 12 aa, Mycobacterium
PPGPYQRDRAPS

SEQ ID NO: 543466 - protein, 4 aa, Mycobacterium
PPGQ

SEQ ID NO: 543467 - protein, 5 aa, Mycobacterium
PPGQI

SEQ ID NO: 543468 - protein, 5 aa, Mycobacterium
PPGQL

SEQ ID NO: 543469 - protein, 11 aa, Mycobacterium
PPGQLPGDPRF

SEQ ID NO: 543470 - protein, 7 aa, Mycobacterium
PPGQPAL

SEQ ID NO: 543471 - protein, 10 aa, Mycobacterium
PPGQQPDPSR

SEQ ID NO: 543472 - protein, 10 aa, Mycobacterium
PPGQRPDPSQ

SEQ ID NO: 543473 - protein, 5 aa, Mycobacterium
PPGQT

SEQ ID NO: 543474 - protein, 6 aa, Mycobacterium
PPGQTG

SEQ ID NO: 543475 - protein, 6 aa, Mycobacterium
PPGRGY

SEQ ID NO: 543476 - protein, 6 aa, Mycobacterium
PPGRHA

SEQ ID NO: 543477 - protein, 6 aa, Mycobacterium
PPGRVA

SEQ ID NO: 543478 - protein, 5 aa, Mycobacterium
PPGRY

SEQ ID NO: 543479 - protein, 11 aa, Mycobacterium
PPGSALPPERE

SEQ ID NO: 543480 - protein, 7 aa, Mycobacterium
PPGSATW

SEQ ID NO: 543481 - protein, 7 aa, Mycobacterium
PPGSFES

SEQ ID NO: 543482 - protein, 7 aa, Mycobacterium
PPGSFNN

SEQ ID NO: 543483 - protein, 6 aa, Mycobacterium
PPGSGT

SEQ ID NO: 543484 - protein, 7 aa, Mycobacterium
PPGSMPD

SEQ ID NO: 543485 - protein, 6 aa, Mycobacterium
PPGSPA

SEQ ID NO: 543486 - protein, 11 aa, Mycobacterium
PPGSTLPPERD

SEQ ID NO: 543487 - protein, 17 aa, Mycobacterium
PPGSVSKTTSGKVQRSR

SEQ ID NO: 543488 - protein, 4 aa, Mycobacterium
PPGT

SEQ ID NO: 543489 - protein, 22 aa, Mycobacterium
PPGTAGTGGTGGTLIGENGHDG

SEQ ID NO: 543490 - protein, 8 aa, Mycobacterium
PPGTAKTT

SEQ ID NO: 543491 - protein, 11 aa, Mycobacterium
PPGTDLTATTR

SEQ ID NO: 543492 - protein, 12 aa, Mycobacterium
PPGTEPDARAAI

SEQ ID NO: 543493 - protein, 9 aa, Mycobacterium
PPGTGKSAV

SEQ ID NO: 543494 - protein, 8 aa, Mycobacterium
PPGTGKTT

SEQ ID NO: 543495 - protein, 9 aa, Mycobacterium
PPGTPSARR

SEQ ID NO: 543496 - protein, 11 aa, Mycobacterium
PPGTPSSARLS

SEQ ID NO: 543497 - protein, 13 aa, Mycobacterium
PPGTQLTPRPEQI

SEQ ID NO: 543498 - protein, 7 aa, Mycobacterium
PPGTQPA

SEQ ID NO: 543499 - protein, 15 aa, Mycobacterium
PPGTTARGAGLQSRD

SEQ ID NO: 543500 - protein, 7 aa, Mycobacterium
PPGTTPQ

SEQ ID NO: 543501 - protein, 8 aa, Mycobacterium
PPGTVSTY

SEQ ID NO: 543502 - protein, 11 aa, Mycobacterium
PPGVASGTVQD

SEQ ID NO: 543503 - protein, 11 aa, Mycobacterium
PPGVASNTVQD

SEQ ID NO: 543504 - protein, 5 aa, Mycobacterium
PPGVD

SEQ ID NO: 543505 - protein, 7 aa, Mycobacterium
PPGVDAD

SEQ ID NO: 543506 - protein, 9 aa, Mycobacterium
PPGVDDGQR

SEQ ID NO: 543507 - protein, 18 aa, Mycobacterium
PPGVDSDRFRPDPAARAE

SEQ ID NO: 543508 - protein, 9 aa, Mycobacterium
PPGVEDGQR

SEQ ID NO: 543509 - protein, 5 aa, Mycobacterium
PPGVN

SEQ ID NO: 543510 - protein, 12 aa, Mycobacterium
PPGVQTRGPRAL

SEQ ID NO: 543511 - protein, 6 aa, Mycobacterium
PPGVRP

SEQ ID NO: 543512 - protein, 15 aa, Mycobacterium
PPGVRRPAGIPAGAP

SEQ ID NO: 543513 - protein, 15 aa, Mycobacterium
PPGVRRPAGTPDGVP

SEQ ID NO: 543514 - protein, 5 aa, Mycobacterium
PPGVS

SEQ ID NO: 543515 - protein, 9 aa, Mycobacterium
PPGVSTEAE

SEQ ID NO: 543516 - protein, 9 aa, Mycobacterium
PPGVSTETE

SEQ ID NO: 543517 - protein, 11 aa, Mycobacterium
PPGVTSAPAGL

SEQ ID NO: 543518 - protein, 4 aa, Mycobacterium
PPGW

SEQ ID NO: 543519 - protein, 15 aa, Mycobacterium
PPGWANATSSVTPLP

SEQ ID NO: 543520 - protein, 4 aa, Mycobacterium
PPGY

SEQ ID NO: 543521 - protein, 12 aa, Mycobacterium
PPGYDTSATPYH

SEQ ID NO: 543522 - protein, 5 aa, Mycobacterium
PPGYG

SEQ ID NO: 543523 - protein, 8 aa, Mycobacterium
PPGYGGPA

SEQ ID NO: 543524 - protein, 9 aa, Mycobacterium
PPGYSGPTD

SEQ ID NO: 543525 - protein, 4 aa, Mycobacterium
PPHA

SEQ ID NO: 543526 - protein, 9 aa, Mycobacterium
PPHADPDTA

SEQ ID NO: 543527 - protein, 7 aa, Mycobacterium
PPHEELQ

SEQ ID NO: 543528 - protein, 6 aa, Mycobacterium
PPHEPI

SEQ ID NO: 543529 - protein, 4 aa, Mycobacterium
PPHG

SEQ ID NO: 543530 - protein, 5 aa, Mycobacterium
PPHGG

SEQ ID NO: 543531 - protein, 10 aa, Mycobacterium
PPHGSPRNTV

SEQ ID NO: 543532 - protein, 5 aa, Mycobacterium
PPHHG

SEQ ID NO: 543533 - protein, 4 aa, Mycobacterium
PPHL

SEQ ID NO: 543534 - protein, 5 aa, Mycobacterium
PPHPE

SEQ ID NO: 543535 - protein, 13 aa, Mycobacterium
PPHPRAEGATDKD

SEQ ID NO: 543536 - protein, 13 aa, Mycobacterium
PPHPRAPGATDKD

SEQ ID NO: 543537 - protein, 6 aa, Mycobacterium
PPHPTD

SEQ ID NO: 543538 - protein, 7 aa, Mycobacterium
PPHQPDT

SEQ ID NO: 543539 - protein, 11 aa, Mycobacterium
PPHRYSQNQIT

SEQ ID NO: 543540 - protein, 7 aa, Mycobacterium
PPHSDPH

SEQ ID NO: 543541 - protein, 11 aa, Mycobacterium
PPHSPKGEPNL

SEQ ID NO: 543542 - protein, 5 aa, Mycobacterium
PPHST

SEQ ID NO: 543543 - protein, 5 aa, Mycobacterium
PPHTA

SEQ ID NO: 543544 - protein, 8 aa, Mycobacterium
PPHTDTAE

SEQ ID NO: 543545 - protein, 5 aa, Mycobacterium
PPHTQ

SEQ ID NO: 543546 - protein, 5 aa, Mycobacterium
PPHVG

SEQ ID NO: 543547 - protein, 6 aa, Mycobacterium
PPHVPT

SEQ ID NO: 543548 - protein, 4 aa, Mycobacterium
PPIA

SEQ ID NO: 543549 - protein, 52 aa, Mycobacterium
PPIADRPEPNSAGNEPATDQTSDFSSPKPEESADSGDSLAPQPPAVEQPTAA

SEQ ID NO: 543550 - protein, 4 aa, Mycobacterium
PPID

SEQ ID NO: 543551 - protein, 20 aa, Mycobacterium
PPIDPESPPPAPRDDERSWR

SEQ ID NO: 543552 - protein, 6 aa, Mycobacterium
PPIDTV

SEQ ID NO: 543553 - protein, 24 aa, Mycobacterium
PPIEAPEGAQSAVSDEDKAKAEAV

SEQ ID NO: 543554 - protein, 12 aa, Mycobacterium
PPIGAEVAGQSE

SEQ ID NO: 543555 - protein, 16 aa, Mycobacterium
PPIGATPVDVGDGYER

SEQ ID NO: 543556 - protein, 5 aa, Mycobacterium
PPIGG

SEQ ID NO: 543557 - protein, 15 aa, Mycobacterium
PPIGPTWEEQEETGR

SEQ ID NO: 543558 - protein, 10 aa, Mycobacterium
PPIGRSGRGI

SEQ ID NO: 543559 - protein, 10 aa, Mycobacterium
PPIGTPATSL

SEQ ID NO: 543560 - protein, 4 aa, Mycobacterium
PPIP

SEQ ID NO: 543561 - protein, 6 aa, Mycobacterium
PPIPDR

SEQ ID NO: 543562 - protein, 8 aa, Mycobacterium
PPIPPDSD

SEQ ID NO: 543563 - protein, 13 aa, Mycobacterium
PPIPQVNNRGPVD

SEQ ID NO: 543564 - protein, 10 aa, Mycobacterium
PPIPREPERF

SEQ ID NO: 543565 - protein, 7 aa, Mycobacterium
PPIRTPE

SEQ ID NO: 543566 - protein, 19 aa, Mycobacterium
PPISAGSGWRKRKQPKYED

SEQ ID NO: 543567 - protein, 19 aa, Mycobacterium
PPISAGSGWRKRKQQKYED

SEQ ID NO: 543568 - protein, 5 aa, Mycobacterium
PPKAA

SEQ ID NO: 543569 - protein, 6 aa, Mycobacterium
PPKAAR

SEQ ID NO: 543570 - protein, 8 aa, Mycobacterium
PPKASLDQ

SEQ ID NO: 543571 - protein, 7 aa, Mycobacterium
PPKCGTT

SEQ ID NO: 543572 - protein, 10 aa, Mycobacterium
PPKDEKPEWA

SEQ ID NO: 543573 - protein, 8 aa, Mycobacterium
PPKDEQAA

SEQ ID NO: 543574 - protein, 14 aa, Mycobacterium
PPKDLGYGPASGRG

SEQ ID NO: 543575 - protein, 8 aa, Mycobacterium
PPKEFTAE

SEQ ID NO: 543576 - protein, 8 aa, Mycobacterium
PPKEQRNF

SEQ ID NO: 543577 - protein, 5 aa, Mycobacterium
PPKGQ

SEQ ID NO: 543578 - protein, 10 aa, Mycobacterium
PPKHDRQRQA

SEQ ID NO: 543579 - protein, 7 aa, Mycobacterium
PPKHTAH

SEQ ID NO: 543580 - protein, 9 aa, Mycobacterium
PPKLGEHNE

SEQ ID NO: 543581 - protein, 4 aa, Mycobacterium
PPKN

SEQ ID NO: 543582 - protein, 4 aa, Mycobacterium
PPKP

SEQ ID NO: 543583 - protein, 8 aa, Mycobacterium
PPKPGYNA

SEQ ID NO: 543584 - protein, 17 aa, Mycobacterium
PPKPLDRNGAINERTAT

SEQ ID NO: 543585 - protein, 5 aa, Mycobacterium
PPKRR

SEQ ID NO: 543586 - protein, 12 aa, Mycobacterium
PPKRTSTCDNCD

SEQ ID NO: 543587 - protein, 8 aa, Mycobacterium
PPKSLTAD

SEQ ID NO: 543588 - protein, 8 aa, Mycobacterium
PPKSSHLP

SEQ ID NO: 543589 - protein, 24 aa, Mycobacterium
PPKSTVSFGEPNAEPGVDDASAPA

SEQ ID NO: 543590 - protein, 10 aa, Mycobacterium
PPKTHKERLG

SEQ ID NO: 543591 - protein, 7 aa, Mycobacterium
PPKTRAA

SEQ ID NO: 543592 - protein, 4 aa, Mycobacterium
PPLA

SEQ ID NO: 543593 - protein, 5 aa, Mycobacterium
PPLAD

SEQ ID NO: 543594 - protein, 14 aa, Mycobacterium
PPLAPAGMRTSPVG

SEQ ID NO: 543595 - protein, 11 aa, Mycobacterium
PPLAPPVPPVP

SEQ ID NO: 543596 - protein, 8 aa, Mycobacterium
PPLDPDAA

SEQ ID NO: 543597 - protein, 9 aa, Mycobacterium
PPLDRDRDH

SEQ ID NO: 543598 - protein, 13 aa, Mycobacterium
PPLDTESGVKEAQ

SEQ ID NO: 543599 - protein, 11 aa, Mycobacterium
PPLEDHNPATS

SEQ ID NO: 543600 - protein, 14 aa, Mycobacterium
PPLERATADTPEEA

SEQ ID NO: 543601 - protein, 9 aa, Mycobacterium
PPLFGTEPD

SEQ ID NO: 543602 - protein, 10 aa, Mycobacterium
PPLFGTEPDA

SEQ ID NO: 543603 - protein, 20 aa, Mycobacterium
PPLGAQPVGRDTAPEPEDQI

SEQ ID NO: 543604 - protein, 5 aa, Mycobacterium
PPLGD

SEQ ID NO: 543605 - protein, 7 aa, Mycobacterium
PPLGEHP

SEQ ID NO: 543606 - protein, 13 aa, Mycobacterium
PPLGKRPGSVRSH

SEQ ID NO: 543607 - protein, 6 aa, Mycobacterium
PPLGNT

SEQ ID NO: 543608 - protein, 9 aa, Mycobacterium
PPLGPEAAP

SEQ ID NO: 543609 - protein, 19 aa, Mycobacterium
PPLGQEPQGRLTPGGTIPL

SEQ ID NO: 543610 - protein, 13 aa, Mycobacterium
PPLGSPVSSPMAP

SEQ ID NO: 543611 - protein, 11 aa, Mycobacterium
PPLKSATREEQ

SEQ ID NO: 543612 - protein, 15 aa, Mycobacterium
PPLNGDNLDPRLRGG

SEQ ID NO: 543613 - protein, 5 aa, Mycobacterium
PPLPA

SEQ ID NO: 543614 - protein, 7 aa, Mycobacterium
PPLPAEY

SEQ ID NO: 543615 - protein, 23 aa, Mycobacterium
PPLPAGPAASPPVAAGSAETERR

SEQ ID NO: 543616 - protein, 14 aa, Mycobacterium
PPLPAPNARRSARE

SEQ ID NO: 543617 - protein, 10 aa, Mycobacterium
PPLPDAKRDA

SEQ ID NO: 543618 - protein, 7 aa, Mycobacterium
PPLPDDH

SEQ ID NO: 543619 - protein, 7 aa, Mycobacterium
PPLPDGH

SEQ ID NO: 543620 - protein, 5 aa, Mycobacterium
PPLPE

SEQ ID NO: 543621 - protein, 12 aa, Mycobacterium
PPLPEDEERSEG

SEQ ID NO: 543622 - protein, 12 aa, Mycobacterium
PPLPEDGERNEG

SEQ ID NO: 543623 - protein, 7 aa, Mycobacterium
PPLPEPN

SEQ ID NO: 543624 - protein, 23 aa, Mycobacterium
PPLPESRLPAPAPLADSPWNHPS

SEQ ID NO: 543625 - protein, 11 aa, Mycobacterium
PPLPGAQPAPL

SEQ ID NO: 543626 - protein, 11 aa, Mycobacterium
PPLPGERESAG

SEQ ID NO: 543627 - protein, 8 aa, Mycobacterium
PPLPGGSR

SEQ ID NO: 543628 - protein, 8 aa, Mycobacterium
PPLPGTRI

SEQ ID NO: 543629 - protein, 7 aa, Mycobacterium
PPLPGVG

SEQ ID NO: 543630 - protein, 11 aa, Mycobacterium
PPLPGVPEPLA

SEQ ID NO: 543631 - protein, 9 aa, Mycobacterium
PPLPGYPTE

SEQ ID NO: 543632 - protein, 8 aa, Mycobacterium
PPLPPAPA

SEQ ID NO: 543633 - protein, 7 aa, Mycobacterium
PPLPPEY

SEQ ID NO: 543634 - protein, 8 aa, Mycobacterium
PPLPPGSA

SEQ ID NO: 543635 - protein, 17 aa, Mycobacterium
PPLPPLPAPISNNIPKP

SEQ ID NO: 543636 - protein, 6 aa, Mycobacterium
PPLPPQ

SEQ ID NO: 543637 - protein, 7 aa, Mycobacterium
PPLPQIE

SEQ ID NO: 543638 - protein, 6 aa, Mycobacterium
PPLPRT

SEQ ID NO: 543639 - protein, 8 aa, Mycobacterium
PPLPSPER

SEQ ID NO: 543640 - protein, 24 aa, Mycobacterium
PPLPSTSCSAAAAAGSRRGFWRRG

SEQ ID NO: 543641 - protein, 16 aa, Mycobacterium
PPLPTDPGDRNRTSPF

SEQ ID NO: 543642 - protein, 11 aa, Mycobacterium
PPLPTEDGAQP

SEQ ID NO: 543643 - protein, 16 aa, Mycobacterium
PPLPTTTIGSYPQTSA

SEQ ID NO: 543644 - protein, 12 aa, Mycobacterium
PPLRESSDAAAL

SEQ ID NO: 543645 - protein, 11 aa, Mycobacterium
PPLRPGSPELT

SEQ ID NO: 543646 - protein, 6 aa, Mycobacterium
PPLRRP

SEQ ID NO: 543647 - protein, 7 aa, Mycobacterium
PPLRRPA

SEQ ID NO: 543648 - protein, 8 aa, Mycobacterium
PPLRRPNG

SEQ ID NO: 543649 - protein, 6 aa, Mycobacterium
PPLSQQ

SEQ ID NO: 543650 - protein, 19 aa, Mycobacterium
PPLSTGDAATDREATRAEG

SEQ ID NO: 543651 - protein, 6 aa, Mycobacterium
PPLTDS

SEQ ID NO: 543652 - protein, 6 aa, Mycobacterium
PPLTPQ

SEQ ID NO: 543653 - protein, 5 aa, Mycobacterium
PPLTR

SEQ ID NO: 543654 - protein, 9 aa, Mycobacterium
PPLYDDSGT

SEQ ID NO: 543655 - protein, 5 aa, Mycobacterium
PPLYG

SEQ ID NO: 543656 - protein, 8 aa, Mycobacterium
PPMANGGM

SEQ ID NO: 543657 - protein, 19 aa, Mycobacterium
PPMATGDQAEDREATRAEG

SEQ ID NO: 543658 - protein, 5 aa, Mycobacterium
PPMGR

SEQ ID NO: 543659 - protein, 7 aa, Mycobacterium
PPMPHTP

SEQ ID NO: 543660 - protein, 12 aa, Mycobacterium
PPMPPASSPESL

SEQ ID NO: 543661 - protein, 7 aa, Mycobacterium
PPMPPTG

SEQ ID NO: 543662 - protein, 7 aa, Mycobacterium
PPMRGGL

SEQ ID NO: 543663 - protein, 4 aa, Mycobacterium
PPMS

SEQ ID NO: 543664 - protein, 11 aa, Mycobacterium
PPMSTDPDAPT

SEQ ID NO: 543665 - protein, 14 aa, Mycobacterium
PPMTAPTTAPTHKG

SEQ ID NO: 543666 - protein, 11 aa, Mycobacterium
PPMTAQQAAEL

SEQ ID NO: 543667 - protein, 4 aa, Mycobacterium
PPNA

SEQ ID NO: 543668 - protein, 6 aa, Mycobacterium
PPNADE

SEQ ID NO: 543669 - protein, 13 aa, Mycobacterium
PPNADEGRERALE

SEQ ID NO: 543670 - protein, 14 aa, Mycobacterium
PPNADEGRERALED

SEQ ID NO: 543671 - protein, 5 aa, Mycobacterium
PPNAK

SEQ ID NO: 543672 - protein, 7 aa, Mycobacterium
PPNAQAA

SEQ ID NO: 543673 - protein, 13 aa, Mycobacterium
PPNCGDADTVGGT

SEQ ID NO: 543674 - protein, 5 aa, Mycobacterium
PPNDL

SEQ ID NO: 543675 - protein, 12 aa, Mycobacterium
PPNGEIDTTPGA

SEQ ID NO: 543676 - protein, 10 aa, Mycobacterium
PPNIGSHRPA

SEQ ID NO: 543677 - protein, 4 aa, Mycobacterium
PPNL

SEQ ID NO: 543678 - protein, 5 aa, Mycobacterium
PPNLE

SEQ ID NO: 543679 - protein, 12 aa, Mycobacterium
PPNLEGAAKEAL

SEQ ID NO: 543680 - protein, 11 aa, Mycobacterium
PPNLEGAAQEA

SEQ ID NO: 543681 - protein, 11 aa, Mycobacterium
PPNLEGEAAEA

SEQ ID NO: 543682 - protein, 13 aa, Mycobacterium
PPNLEGEAAEALE

SEQ ID NO: 543683 - protein, 6 aa, Mycobacterium
PPNLHS

SEQ ID NO: 543684 - protein, 5 aa, Mycobacterium
PPNLP

SEQ ID NO: 543685 - protein, 16 aa, Mycobacterium
PPNMPPASQLHARPGP

SEQ ID NO: 543686 - protein, 20 aa, Mycobacterium
PPNNATDAPRYAEPVPEGAI

SEQ ID NO: 543687 - protein, 28 aa, Mycobacterium
PPNNATDAPRYPAPAPEGPIEENLTDED

SEQ ID NO: 543688 - protein, 20 aa, Mycobacterium
PPNNATDPPRYAEPHPPGAI

SEQ ID NO: 543689 - protein, 9 aa, Mycobacterium
PPNNYADPP

SEQ ID NO: 543690 - protein, 6 aa, Mycobacterium
PPNPQF

SEQ ID NO: 543691 - protein, 10 aa, Mycobacterium
PPNPSKPNLD

SEQ ID NO: 543692 - protein, 15 aa, Mycobacterium
PPNPSPPNLDHPAKQ

SEQ ID NO: 543693 - protein, 13 aa, Mycobacterium
PPNPSRPSLSHPG

SEQ ID NO: 543694 - protein, 7 aa, Mycobacterium
PPNPTGK

SEQ ID NO: 543695 - protein, 5 aa, Mycobacterium
PPNQD

SEQ ID NO: 543696 - protein, 7 aa, Mycobacterium
PPNQLPD

SEQ ID NO: 543697 - protein, 7 aa, Mycobacterium
PPNRYTQ

SEQ ID NO: 543698 - protein, 5 aa, Mycobacterium
PPNSK

SEQ ID NO: 543699 - protein, 14 aa, Mycobacterium
PPNTGNAIRTAAAT

SEQ ID NO: 543700 - protein, 7 aa, Mycobacterium
PPNTVDG

SEQ ID NO: 543701 - protein, 21 aa, Mycobacterium
PPNTVDGATPVVSTDDAATAM

SEQ ID NO: 543702 - protein, 11 aa, Mycobacterium
PPNVEGAAAEA

SEQ ID NO: 543703 - protein, 4 aa, Mycobacterium
PPPA

SEQ ID NO: 543704 - protein, 19 aa, Mycobacterium
PPPAAYAPLPEDTTPPPPP

SEQ ID NO: 543705 - protein, 13 aa, Mycobacterium
PPPADPSPKERIR

SEQ ID NO: 543706 - protein, 8 aa, Mycobacterium
PPPADRLT

SEQ ID NO: 543707 - protein, 25 aa, Mycobacterium
PPPAGCTGRAPPGVGGGAGATFEEE

SEQ ID NO: 543708 - protein, 18 aa, Mycobacterium
PPPAGRTEPAQSAPQPRN

SEQ ID NO: 543709 - protein, 5 aa, Mycobacterium
PPPAI

SEQ ID NO: 543710 - protein, 55 aa, Mycobacterium
PPPAPPEGINPPPAGPGPEKPWGPPPGPQPQASGPAYATYDEKTGAFKDPAGGTG

SEQ ID NO: 543711 - protein, 6 aa, Mycobacterium
PPPAQP

SEQ ID NO: 543712 - protein, 15 aa, Mycobacterium
PPPARSASGYRDYGP

SEQ ID NO: 543713 - protein, 128 aa, Mycobacterium
PPPATGSGTSGSTSGSSSSGASSAPSAAAETTAPETPASTPAAEPAAVGSATPASVPSGSSGTPLPEGSSGTPLPEGSSGTPLPEGSSGTPLPANAAPPAEAAPAPVPAAATPAPAAPTTTVAVPAPP

SEQ ID NO: 543714 - protein, 10 aa, Mycobacterium
PPPATTNLPG

SEQ ID NO: 543715 - protein, 6 aa, Mycobacterium
PPPAVA

SEQ ID NO: 543716 - protein, 9 aa, Mycobacterium
PPPAVAANR

SEQ ID NO: 543717 - protein, 6 aa, Mycobacterium
PPPAVG

SEQ ID NO: 543718 - protein, 6 aa, Mycobacterium
PPPAVT

SEQ ID NO: 543719 - protein, 5 aa, Mycobacterium
PPPCT

SEQ ID NO: 543720 - protein, 7 aa, Mycobacterium
PPPDAID

SEQ ID NO: 543721 - protein, 5 aa, Mycobacterium
PPPDF

SEQ ID NO: 543722 - protein, 7 aa, Mycobacterium
PPPDFEA

SEQ ID NO: 543723 - protein, 10 aa, Mycobacterium
PPPDLETGQH

SEQ ID NO: 543724 - protein, 10 aa, Mycobacterium
PPPDTNPEQV

SEQ ID NO: 543725 - protein, 6 aa, Mycobacterium
PPPDYS

SEQ ID NO: 543726 - protein, 7 aa, Mycobacterium
PPPEAPH

SEQ ID NO: 543727 - protein, 9 aa, Mycobacterium
PPPEGASRE

SEQ ID NO: 543728 - protein, 9 aa, Mycobacterium
PPPEPDSTV

SEQ ID NO: 543729 - protein, 7 aa, Mycobacterium
PPPEPGG

SEQ ID NO: 543730 - protein, 11 aa, Mycobacterium
PPPFADSGSVG

SEQ ID NO: 543731 - protein, 4 aa, Mycobacterium
PPPG

SEQ ID NO: 543732 - protein, 12 aa, Mycobacterium
PPPGAPPDRDKG

SEQ ID NO: 543733 - protein, 12 aa, Mycobacterium
PPPGAPSDRDKG

SEQ ID NO: 543734 - protein, 8 aa, Mycobacterium
PPPGDAGL

SEQ ID NO: 543735 - protein, 9 aa, Mycobacterium
PPPGDAGLG

SEQ ID NO: 543736 - protein, 7 aa, Mycobacterium
PPPGDDS

SEQ ID NO: 543737 - protein, 6 aa, Mycobacterium
PPPGGM

SEQ ID NO: 543738 - protein, 9 aa, Mycobacterium
PPPGGRREL

SEQ ID NO: 543739 - protein, 7 aa, Mycobacterium
PPPGMSP

SEQ ID NO: 543740 - protein, 8 aa, Mycobacterium
PPPGSGAD

SEQ ID NO: 543741 - protein, 7 aa, Mycobacterium
PPPGTYP

SEQ ID NO: 543742 - protein, 10 aa, Mycobacterium
PPPGVHGSPI

SEQ ID NO: 543743 - protein, 5 aa, Mycobacterium
PPPGY

SEQ ID NO: 543744 - protein, 7 aa, Mycobacterium
PPPGYPD

SEQ ID NO: 543745 - protein, 4 aa, Mycobacterium
PPPH

SEQ ID NO: 543746 - protein, 9 aa, Mycobacterium
PPPHAPPDA

SEQ ID NO: 543747 - protein, 6 aa, Mycobacterium
PPPHDN

SEQ ID NO: 543748 - protein, 30 aa, Mycobacterium
PPPHSPASWKYPDERGQRTNDYHHPERSGD

SEQ ID NO: 543749 - protein, 27 aa, Mycobacterium
PPPIPAPETPRNEASPAANEPRRYANP

SEQ ID NO: 543750 - protein, 7 aa, Mycobacterium
PPPIRPY

SEQ ID NO: 543751 - protein, 18 aa, Mycobacterium
PPPITARSTVGAGDASLA

SEQ ID NO: 543752 - protein, 6 aa, Mycobacterium
PPPIVP

SEQ ID NO: 543753 - protein, 11 aa, Mycobacterium
PPPKGDPEAPL

SEQ ID NO: 543754 - protein, 15 aa, Mycobacterium
PPPKLGRAAVSRGSL

SEQ ID NO: 543755 - protein, 58 aa, Mycobacterium
PPPKPPPPPKPPPLWPPPNPPKPPPLWPPPNPPKPPGAPPLWPPPKPPGAPPLWPPPK

SEQ ID NO: 543756 - protein, 5 aa, Mycobacterium
PPPLA

SEQ ID NO: 543757 - protein, 6 aa, Mycobacterium
PPPLAP

SEQ ID NO: 543758 - protein, 11 aa, Mycobacterium
PPPLGPGAPPL

SEQ ID NO: 543759 - protein, 5 aa, Mycobacterium
PPPLR

SEQ ID NO: 543760 - protein, 5 aa, Mycobacterium
PPPLS

SEQ ID NO: 543761 - protein, 6 aa, Mycobacterium
PPPLTE

SEQ ID NO: 543762 - protein, 10 aa, Mycobacterium
PPPLTTGGPP

SEQ ID NO: 543763 - protein, 24 aa, Mycobacterium
PPPMNSAAEREWARTNTISPYAAP

SEQ ID NO: 543764 - protein, 12 aa, Mycobacterium
PPPMPPSTGSLR

SEQ ID NO: 543765 - protein, 10 aa, Mycobacterium
PPPNQFPAAT

SEQ ID NO: 543766 - protein, 8 aa, Mycobacterium
PPPPADDV

SEQ ID NO: 543767 - protein, 25 aa, Mycobacterium
PPPPAEITAGRPVTDTSSPTAARAR

SEQ ID NO: 543768 - protein, 12 aa, Mycobacterium
PPPPAPVENTPV

SEQ ID NO: 543769 - protein, 20 aa, Mycobacterium
PPPPASGSMTKASVADPAAP

SEQ ID NO: 543770 - protein, 8 aa, Mycobacterium
PPPPGGWN

SEQ ID NO: 543771 - protein, 28 aa, Mycobacterium
PPPPNEEEGGAPAKKGKKPTGPKPRTGS

SEQ ID NO: 543772 - protein, 9 aa, Mycobacterium
PPPPPAEPF

SEQ ID NO: 543773 - protein, 12 aa, Mycobacterium
PPPPPDAEGNPA

SEQ ID NO: 543774 - protein, 21 aa, Mycobacterium
PPPPPPPFWGPPPPPRPPGHW

SEQ ID NO: 543775 - protein, 9 aa, Mycobacterium
PPPPPSRAP

SEQ ID NO: 543776 - protein, 7 aa, Mycobacterium
PPPPPTP

SEQ ID NO: 543777 - protein, 7 aa, Mycobacterium
PPPPQAQ

SEQ ID NO: 543778 - protein, 7 aa, Mycobacterium
PPPPQEI

SEQ ID NO: 543779 - protein, 4 aa, Mycobacterium
PPPQ

SEQ ID NO: 543780 - protein, 11 aa, Mycobacterium
PPPQGDPDAPL

SEQ ID NO: 543781 - protein, 11 aa, Mycobacterium
PPPQGDSEAPL

SEQ ID NO: 543782 - protein, 6 aa, Mycobacterium
PPPQIA

SEQ ID NO: 543783 - protein, 14 aa, Mycobacterium
PPPQLDRGARTNDY

SEQ ID NO: 543784 - protein, 6 aa, Mycobacterium
PPPQQL

SEQ ID NO: 543785 - protein, 6 aa, Mycobacterium
PPPQQV

SEQ ID NO: 543786 - protein, 4 aa, Mycobacterium
PPPR

SEQ ID NO: 543787 - protein, 6 aa, Mycobacterium
PPPRPH

SEQ ID NO: 543788 - protein, 30 aa, Mycobacterium
PPPRPWPHGASRQHQRTPAAACHSADLSTL

SEQ ID NO: 543789 - protein, 9 aa, Mycobacterium
PPPRRRPAT

SEQ ID NO: 543790 - protein, 5 aa, Mycobacterium
PPPRS

SEQ ID NO: 543791 - protein, 5 aa, Mycobacterium
PPPRT

SEQ ID NO: 543792 - protein, 8 aa, Mycobacterium
PPPRTTVG

SEQ ID NO: 543793 - protein, 4 aa, Mycobacterium
PPPS

SEQ ID NO: 543794 - protein, 10 aa, Mycobacterium
PPPSAEQERE

SEQ ID NO: 543795 - protein, 11 aa, Mycobacterium
PPPSGDPEAPL

SEQ ID NO: 543796 - protein, 11 aa, Mycobacterium
PPPSGGDPGVN

SEQ ID NO: 543797 - protein, 14 aa, Mycobacterium
PPPSTHNGPRTGPA

SEQ ID NO: 543798 - protein, 4 aa, Mycobacterium
PPPT

SEQ ID NO: 543799 - protein, 6 aa, Mycobacterium
PPPTAG

SEQ ID NO: 543800 - protein, 5 aa, Mycobacterium
PPPTE

SEQ ID NO: 543801 - protein, 7 aa, Mycobacterium
PPPTEQV

SEQ ID NO: 543802 - protein, 5 aa, Mycobacterium
PPPTF

SEQ ID NO: 543803 - protein, 9 aa, Mycobacterium
PPPVEGEGM

SEQ ID NO: 543804 - protein, 21 aa, Mycobacterium
PPPVGKPTGEQDAANTPQPPL

SEQ ID NO: 543805 - protein, 19 aa, Mycobacterium
PPPVNGATTPTPSAPLPLG

SEQ ID NO: 543806 - protein, 5 aa, Mycobacterium
PPPVP

SEQ ID NO: 543807 - protein, 12 aa, Mycobacterium
PPPVPDGDDGGF

SEQ ID NO: 543808 - protein, 5 aa, Mycobacterium
PPPVR

SEQ ID NO: 543809 - protein, 5 aa, Mycobacterium
PPPWL

SEQ ID NO: 543810 - protein, 9 aa, Mycobacterium
PPPWQPGRD

SEQ ID NO: 543811 - protein, 12 aa, Mycobacterium
PPPYGRGASAAE

SEQ ID NO: 543812 - protein, 15 aa, Mycobacterium
PPPYVGKNPPDPWTG

SEQ ID NO: 543813 - protein, 6 aa, Mycobacterium
PPQAGL

SEQ ID NO: 543814 - protein, 7 aa, Mycobacterium
PPQAKAR

SEQ ID NO: 543815 - protein, 5 aa, Mycobacterium
PPQAL

SEQ ID NO: 543816 - protein, 5 aa, Mycobacterium
PPQAP

SEQ ID NO: 543817 - protein, 14 aa, Mycobacterium
PPQAPAKAQWTPPS

SEQ ID NO: 543818 - protein, 13 aa, Mycobacterium
PPQAPRAVDAETA

SEQ ID NO: 543819 - protein, 6 aa, Mycobacterium
PPQAQD

SEQ ID NO: 543820 - protein, 4 aa, Mycobacterium
PPQC

SEQ ID NO: 543821 - protein, 6 aa, Mycobacterium
PPQDGG

SEQ ID NO: 543822 - protein, 5 aa, Mycobacterium
PPQDR

SEQ ID NO: 543823 - protein, 6 aa, Mycobacterium
PPQEQS

SEQ ID NO: 543824 - protein, 9 aa, Mycobacterium
PPQGERASF

SEQ ID NO: 543825 - protein, 7 aa, Mycobacterium
PPQGSAI

SEQ ID NO: 543826 - protein, 4 aa, Mycobacterium
PPQH

SEQ ID NO: 543827 - protein, 7 aa, Mycobacterium
PPQIERG

SEQ ID NO: 543828 - protein, 4 aa, Mycobacterium
PPQK

SEQ ID NO: 543829 - protein, 5 aa, Mycobacterium
PPQKQ

SEQ ID NO: 543830 - protein, 4 aa, Mycobacterium
PPQL

SEQ ID NO: 543831 - protein, 14 aa, Mycobacterium
PPQLRTERRFDPAK

SEQ ID NO: 543832 - protein, 7 aa, Mycobacterium
PPQNSPC

SEQ ID NO: 543833 - protein, 7 aa, Mycobacterium
PPQPADI

SEQ ID NO: 543834 - protein, 12 aa, Mycobacterium
PPQPADPDNADR

SEQ ID NO: 543835 - protein, 11 aa, Mycobacterium
PPQPAGSADGA

SEQ ID NO: 543836 - protein, 9 aa, Mycobacterium
PPQPEPPLP

SEQ ID NO: 543837 - protein, 16 aa, Mycobacterium
PPQPPSDQEASAPVPL

SEQ ID NO: 543838 - protein, 8 aa, Mycobacterium
PPQPPVAA

SEQ ID NO: 543839 - protein, 10 aa, Mycobacterium
PPQPRVTPKG

SEQ ID NO: 543840 - protein, 7 aa, Mycobacterium
PPQPVDD

SEQ ID NO: 543841 - protein, 4 aa, Mycobacterium
PPQQ

SEQ ID NO: 543842 - protein, 5 aa, Mycobacterium
PPQQA

SEQ ID NO: 543843 - protein, 5 aa, Mycobacterium
PPQQR

SEQ ID NO: 543844 - protein, 6 aa, Mycobacterium
PPQQSL

SEQ ID NO: 543845 - protein, 6 aa, Mycobacterium
PPQQVP

SEQ ID NO: 543846 - protein, 8 aa, Mycobacterium
PPQREAQD

SEQ ID NO: 543847 - protein, 8 aa, Mycobacterium
PPQRLSPA

SEQ ID NO: 543848 - protein, 13 aa, Mycobacterium
PPQRTLGSAQMPG

SEQ ID NO: 543849 - protein, 5 aa, Mycobacterium
PPQSA

SEQ ID NO: 543850 - protein, 9 aa, Mycobacterium
PPQSDSRQF

SEQ ID NO: 543851 - protein, 5 aa, Mycobacterium
PPQSR

SEQ ID NO: 543852 - protein, 6 aa, Mycobacterium
PPQSRE

SEQ ID NO: 543853 - protein, 10 aa, Mycobacterium
PPQSTPIPQT

SEQ ID NO: 543854 - protein, 12 aa, Mycobacterium
PPQSWSGVDPRS

SEQ ID NO: 543855 - protein, 10 aa, Mycobacterium
PPQTHTTPIE

SEQ ID NO: 543856 - protein, 7 aa, Mycobacterium
PPQTPVR

SEQ ID NO: 543857 - protein, 6 aa, Mycobacterium
PPQTRE

SEQ ID NO: 543858 - protein, 4 aa, Mycobacterium
PPQV

SEQ ID NO: 543859 - protein, 6 aa, Mycobacterium
PPQVEG

SEQ ID NO: 543860 - protein, 6 aa, Mycobacterium
PPQVPG

SEQ ID NO: 543861 - protein, 6 aa, Mycobacterium
PPQVPR

SEQ ID NO: 543862 - protein, 12 aa, Mycobacterium
PPQVPRAVDADT

SEQ ID NO: 543863 - protein, 13 aa, Mycobacterium
PPQWPTRQADTNA

SEQ ID NO: 543864 - protein, 4 aa, Mycobacterium
PPQY

SEQ ID NO: 543865 - protein, 15 aa, Mycobacterium
PPQYPPGAWDSEPAV

SEQ ID NO: 543866 - protein, 4 aa, Mycobacterium
PPRA

SEQ ID NO: 543867 - protein, 11 aa, Mycobacterium
PPRAGQPSAWP

SEQ ID NO: 543868 - protein, 7 aa, Mycobacterium
PPRAPLT

SEQ ID NO: 543869 - protein, 5 aa, Mycobacterium
PPRAV

SEQ ID NO: 543870 - protein, 6 aa, Mycobacterium
PPRCEG

SEQ ID NO: 543871 - protein, 4 aa, Mycobacterium
PPRD

SEQ ID NO: 543872 - protein, 10 aa, Mycobacterium
PPRDGRLSAE

SEQ ID NO: 543873 - protein, 4 aa, Mycobacterium
PPRE

SEQ ID NO: 543874 - protein, 10 aa, Mycobacterium
PPREADPDQA

SEQ ID NO: 543875 - protein, 6 aa, Mycobacterium
PPREDY

SEQ ID NO: 543876 - protein, 4 aa, Mycobacterium
PPRG

SEQ ID NO: 543877 - protein, 23 aa, Mycobacterium
PPRGGTLQGTDAFAPSPKRPEPV

SEQ ID NO: 543878 - protein, 22 aa, Mycobacterium
PPRGRDGGGRTWRTAPRAVVKR

SEQ ID NO: 543879 - protein, 10 aa, Mycobacterium
PPRGRTTEPL

SEQ ID NO: 543880 - protein, 5 aa, Mycobacterium
PPRGS

SEQ ID NO: 543881 - protein, 25 aa, Mycobacterium
PPRGSAATADLENLDENATAEVEDQ

SEQ ID NO: 543882 - protein, 12 aa, Mycobacterium
PPRGSVSAPAAA

SEQ ID NO: 543883 - protein, 6 aa, Mycobacterium
PPRGTV

SEQ ID NO: 543884 - protein, 4 aa, Mycobacterium
PPRH

SEQ ID NO: 543885 - protein, 7 aa, Mycobacterium
PPRHGGA

SEQ ID NO: 543886 - protein, 7 aa, Mycobacterium
PPRHPPA

SEQ ID NO: 543887 - protein, 5 aa, Mycobacterium
PPRHS

SEQ ID NO: 543888 - protein, 5 aa, Mycobacterium
PPRIA

SEQ ID NO: 543889 - protein, 9 aa, Mycobacterium
PPRITAPTS

SEQ ID NO: 543890 - protein, 7 aa, Mycobacterium
PPRKNEP

SEQ ID NO: 543891 - protein, 10 aa, Mycobacterium
PPRNADPDPI

SEQ ID NO: 543892 - protein, 9 aa, Mycobacterium
PPRNAPAAA

SEQ ID NO: 543893 - protein, 9 aa, Mycobacterium
PPRNAPTAA

SEQ ID NO: 543894 - protein, 7 aa, Mycobacterium
PPRNDPR

SEQ ID NO: 543895 - protein, 9 aa, Mycobacterium
PPRNDPRDA

SEQ ID NO: 543896 - protein, 17 aa, Mycobacterium
PPRNEKLTGLTGQQRRA

SEQ ID NO: 543897 - protein, 23 aa, Mycobacterium
PPRPATTANGPAAQAAAVGRATG

SEQ ID NO: 543898 - protein, 10 aa, Mycobacterium
PPRPDGQPTF

SEQ ID NO: 543899 - protein, 11 aa, Mycobacterium
PPRPDGQPTFN

SEQ ID NO: 543900 - protein, 8 aa, Mycobacterium
PPRPEELG

SEQ ID NO: 543901 - protein, 16 aa, Mycobacterium
PPRPEPPRTDEADALP

SEQ ID NO: 543902 - protein, 9 aa, Mycobacterium
PPRPLPGRS

SEQ ID NO: 543903 - protein, 12 aa, Mycobacterium
PPRPRPPAAGWL

SEQ ID NO: 543904 - protein, 6 aa, Mycobacterium
PPRPRR

SEQ ID NO: 543905 - protein, 13 aa, Mycobacterium
PPRPTGPGVPNRR

SEQ ID NO: 543906 - protein, 8 aa, Mycobacterium
PPRQDPRD

SEQ ID NO: 543907 - protein, 5 aa, Mycobacterium
PPRQF

SEQ ID NO: 543908 - protein, 13 aa, Mycobacterium
PPRQLSADSPEGQ

SEQ ID NO: 543909 - protein, 8 aa, Mycobacterium
PPRQSTST

SEQ ID NO: 543910 - protein, 5 aa, Mycobacterium
PPRQV

SEQ ID NO: 543911 - protein, 13 aa, Mycobacterium
PPRRASGPYGRCA

SEQ ID NO: 543912 - protein, 7 aa, Mycobacterium
PPRREAA

SEQ ID NO: 543913 - protein, 9 aa, Mycobacterium
PPRRESVNE

SEQ ID NO: 543914 - protein, 6 aa, Mycobacterium
PPRRGG

SEQ ID NO: 543915 - protein, 7 aa, Mycobacterium
PPRRGGI

SEQ ID NO: 543916 - protein, 7 aa, Mycobacterium
PPRRGNR

SEQ ID NO: 543917 - protein, 8 aa, Mycobacterium
PPRRPGAP

SEQ ID NO: 543918 - protein, 12 aa, Mycobacterium
PPRRQPPRTVPP

SEQ ID NO: 543919 - protein, 14 aa, Mycobacterium
PPRRTFGDGLRSAG

SEQ ID NO: 543920 - protein, 4 aa, Mycobacterium
PPRS

SEQ ID NO: 543921 - protein, 17 aa, Mycobacterium
PPRSAPNSLAPTQHRYP

SEQ ID NO: 543922 - protein, 16 aa, Mycobacterium
PPRSGAPGDADADALP

SEQ ID NO: 543923 - protein, 6 aa, Mycobacterium
PPRSGL

SEQ ID NO: 543924 - protein, 7 aa, Mycobacterium
PPRSGLP

SEQ ID NO: 543925 - protein, 5 aa, Mycobacterium
PPRSL

SEQ ID NO: 543926 - protein, 5 aa, Mycobacterium
PPRSM

SEQ ID NO: 543927 - protein, 14 aa, Mycobacterium
PPRSPLDQEQTRAL

SEQ ID NO: 543928 - protein, 6 aa, Mycobacterium
PPRTGK

SEQ ID NO: 543929 - protein, 8 aa, Mycobacterium
PPRTGKSV

SEQ ID NO: 543930 - protein, 8 aa, Mycobacterium
PPRTGSTA

SEQ ID NO: 543931 - protein, 10 aa, Mycobacterium
PPRTPPTRPG

SEQ ID NO: 543932 - protein, 10 aa, Mycobacterium
PPRTRLPRGT

SEQ ID NO: 543933 - protein, 15 aa, Mycobacterium
PPRTRSGGPLPHGQA

SEQ ID NO: 543934 - protein, 18 aa, Mycobacterium
PPRTRSGNPLPRTGGTVA

SEQ ID NO: 543935 - protein, 5 aa, Mycobacterium
PPRTT

SEQ ID NO: 543936 - protein, 27 aa, Mycobacterium
PPRTTNTAGLASHAASVGQAAGAETQQ

SEQ ID NO: 543937 - protein, 4 aa, Mycobacterium
PPRV

SEQ ID NO: 543938 - protein, 11 aa, Mycobacterium
PPRVEKANKDL

SEQ ID NO: 543939 - protein, 8 aa, Mycobacterium
PPRVPPSP

SEQ ID NO: 543940 - protein, 9 aa, Mycobacterium
PPRVPPTPA

SEQ ID NO: 543941 - protein, 9 aa, Mycobacterium
PPRVPSDRH

SEQ ID NO: 543942 - protein, 4 aa, Mycobacterium
PPSA

SEQ ID NO: 543943 - protein, 8 aa, Mycobacterium
PPSAEAAL

SEQ ID NO: 543944 - protein, 10 aa, Mycobacterium
PPSAEASLAG

SEQ ID NO: 543945 - protein, 10 aa, Mycobacterium
PPSAGLPEPP

SEQ ID NO: 543946 - protein, 13 aa, Mycobacterium
PPSALDADGLRNA

SEQ ID NO: 543947 - protein, 6 aa, Mycobacterium
PPSAPA

SEQ ID NO: 543948 - protein, 7 aa, Mycobacterium
PPSAPAE

SEQ ID NO: 543949 - protein, 10 aa, Mycobacterium
PPSAPATTKL

SEQ ID NO: 543950 - protein, 10 aa, Mycobacterium
PPSAQAALAG

SEQ ID NO: 543951 - protein, 5 aa, Mycobacterium
PPSAR

SEQ ID NO: 543952 - protein, 6 aa, Mycobacterium
PPSARP

SEQ ID NO: 543953 - protein, 12 aa, Mycobacterium
PPSASDPGAPLL

SEQ ID NO: 543954 - protein, 7 aa, Mycobacterium
PPSATGD

SEQ ID NO: 543955 - protein, 8 aa, Mycobacterium
PPSATPDN

SEQ ID NO: 543956 - protein, 11 aa, Mycobacterium
PPSDADEAAKG

SEQ ID NO: 543957 - protein, 6 aa, Mycobacterium
PPSDAR

SEQ ID NO: 543958 - protein, 9 aa, Mycobacterium
PPSDTSADR

SEQ ID NO: 543959 - protein, 7 aa, Mycobacterium
PPSDVPD

SEQ ID NO: 543960 - protein, 6 aa, Mycobacterium
PPSEHK

SEQ ID NO: 543961 - protein, 9 aa, Mycobacterium
PPSELPKAS

SEQ ID NO: 543962 - protein, 12 aa, Mycobacterium
PPSEQGTATSAD

SEQ ID NO: 543963 - protein, 5 aa, Mycobacterium
PPSFG

SEQ ID NO: 543964 - protein, 7 aa, Mycobacterium
PPSGAEA

SEQ ID NO: 543965 - protein, 5 aa, Mycobacterium
PPSGF

SEQ ID NO: 543966 - protein, 13 aa, Mycobacterium
PPSGLGLSTRGYT

SEQ ID NO: 543967 - protein, 8 aa, Mycobacterium
PPSGNEQS

SEQ ID NO: 543968 - protein, 4 aa, Mycobacterium
PPSH

SEQ ID NO: 543969 - protein, 9 aa, Mycobacterium
PPSHAPAFR

SEQ ID NO: 543970 - protein, 9 aa, Mycobacterium
PPSHTDEGL

SEQ ID NO: 543971 - protein, 10 aa, Mycobacterium
PPSIAGAPTS

SEQ ID NO: 543972 - protein, 4 aa, Mycobacterium
PPSL

SEQ ID NO: 543973 - protein, 6 aa, Mycobacterium
PPSLDP

SEQ ID NO: 543974 - protein, 14 aa, Mycobacterium
PPSLQTRAAAKPAV

SEQ ID NO: 543975 - protein, 27 aa, Mycobacterium
PPSLRRRGAARERAQELAGGRIRPPQC

SEQ ID NO: 543976 - protein, 12 aa, Mycobacterium
PPSLTELDAHHP

SEQ ID NO: 543977 - protein, 13 aa, Mycobacterium
PPSNAVAPGTPEW

SEQ ID NO: 543978 - protein, 5 aa, Mycobacterium
PPSPE

SEQ ID NO: 543979 - protein, 6 aa, Mycobacterium
PPSPLT

SEQ ID NO: 543980 - protein, 8 aa, Mycobacterium
PPSQDPVY

SEQ ID NO: 543981 - protein, 38 aa, Mycobacterium
PPSQITDTRAQSGDLPPESAMTAPGRTGSLTLTGQQQG

SEQ ID NO: 543982 - protein, 7 aa, Mycobacterium
PPSQTDV

SEQ ID NO: 543983 - protein, 8 aa, Mycobacterium
PPSQYQGR

SEQ ID NO: 543984 - protein, 4 aa, Mycobacterium
PPSR

SEQ ID NO: 543985 - protein, 8 aa, Mycobacterium
PPSRAIGS

SEQ ID NO: 543986 - protein, 13 aa, Mycobacterium
PPSRRAPAENNPV

SEQ ID NO: 543987 - protein, 6 aa, Mycobacterium
PPSRTL

SEQ ID NO: 543988 - protein, 17 aa, Mycobacterium
PPSSAASAAITAPQNAT

SEQ ID NO: 543989 - protein, 9 aa, Mycobacterium
PPSSSRTEG

SEQ ID NO: 543990 - protein, 6 aa, Mycobacterium
PPSTEQ

SEQ ID NO: 543991 - protein, 8 aa, Mycobacterium
PPSTNGRF

SEQ ID NO: 543992 - protein, 6 aa, Mycobacterium
PPSTPI

SEQ ID NO: 543993 - protein, 8 aa, Mycobacterium
PPSTYRDR

SEQ ID NO: 543994 - protein, 13 aa, Mycobacterium
PPSTYRRQSTDAL

SEQ ID NO: 543995 - protein, 14 aa, Mycobacterium
PPSVDGGPCRPPQH

SEQ ID NO: 543996 - protein, 8 aa, Mycobacterium
PPSVPEGQ

SEQ ID NO: 543997 - protein, 15 aa, Mycobacterium
PPSVQTWSGRRSGCD

SEQ ID NO: 543998 - protein, 8 aa, Mycobacterium
PPSVRPEG

SEQ ID NO: 543999 - protein, 7 aa, Mycobacterium
PPSWAGQ

SEQ ID NO: 544000 - protein, 11 aa, Mycobacterium
PPSWAGTTEVT

SEQ ID NO: 544001 - protein, 22 aa, Mycobacterium
PPSWAPPAPVASPLPSALGGTP

SEQ ID NO: 544002 - protein, 11 aa, Mycobacterium
PPSWASATPAI

SEQ ID NO: 544003 - protein, 10 aa, Mycobacterium
PPSWATPQAA

SEQ ID NO: 544004 - protein, 9 aa, Mycobacterium
PPSWSAPSA

SEQ ID NO: 544005 - protein, 5 aa, Mycobacterium
PPSWT

SEQ ID NO: 544006 - protein, 8 aa, Mycobacterium
PPSYALPE

SEQ ID NO: 544007 - protein, 9 aa, Mycobacterium
PPSYPGCRP

SEQ ID NO: 544008 - protein, 15 aa, Mycobacterium
PPSYSRPKPVRQPHP

SEQ ID NO: 544009 - protein, 7 aa, Mycobacterium
PPTAAAA

SEQ ID NO: 544010 - protein, 8 aa, Mycobacterium
PPTAAPEN

SEQ ID NO: 544011 - protein, 5 aa, Mycobacterium
PPTAD

SEQ ID NO: 544012 - protein, 11 aa, Mycobacterium
PPTAEIPPLAG

SEQ ID NO: 544013 - protein, 5 aa, Mycobacterium
PPTAK

SEQ ID NO: 544014 - protein, 9 aa, Mycobacterium
PPTAQKLST

SEQ ID NO: 544015 - protein, 20 aa, Mycobacterium
PPTASAGTGWRKRKQQKYED

SEQ ID NO: 544016 - protein, 8 aa, Mycobacterium
PPTATLPA

SEQ ID NO: 544017 - protein, 5 aa, Mycobacterium
PPTDA

SEQ ID NO: 544018 - protein, 6 aa, Mycobacterium
PPTDAR

SEQ ID NO: 544019 - protein, 6 aa, Mycobacterium
PPTDDL

SEQ ID NO: 544020 - protein, 7 aa, Mycobacterium
PPTDGEP

SEQ ID NO: 544021 - protein, 18 aa, Mycobacterium
PPTDPRYVEGSAASRVPS

SEQ ID NO: 544022 - protein, 5 aa, Mycobacterium
PPTDR

SEQ ID NO: 544023 - protein, 10 aa, Mycobacterium
PPTDRGVTPR

SEQ ID NO: 544024 - protein, 13 aa, Mycobacterium
PPTDVSGGGPDRH

SEQ ID NO: 544025 - protein, 7 aa, Mycobacterium
PPTDVSP

SEQ ID NO: 544026 - protein, 4 aa, Mycobacterium
PPTE

SEQ ID NO: 544027 - protein, 6 aa, Mycobacterium
PPTEEQ

SEQ ID NO: 544028 - protein, 9 aa, Mycobacterium
PPTEEQPEW

SEQ ID NO: 544029 - protein, 7 aa, Mycobacterium
PPTGARS

SEQ ID NO: 544030 - protein, 13 aa, Mycobacterium
PPTGGEKADPSTV

SEQ ID NO: 544031 - protein, 9 aa, Mycobacterium
PPTGTTDGL

SEQ ID NO: 544032 - protein, 5 aa, Mycobacterium
PPTHT

SEQ ID NO: 544033 - protein, 8 aa, Mycobacterium
PPTHTDEG

SEQ ID NO: 544034 - protein, 5 aa, Mycobacterium
PPTHV

SEQ ID NO: 544035 - protein, 11 aa, Mycobacterium
PPTKRGGTRKK

SEQ ID NO: 544036 - protein, 7 aa, Mycobacterium
PPTLGQH

SEQ ID NO: 544037 - protein, 19 aa, Mycobacterium
PPTLTGDAAADREATRAEG

SEQ ID NO: 544038 - protein, 28 aa, Mycobacterium
PPTLYPPEGFGAPKHRHGHSTGAVTGLP

SEQ ID NO: 544039 - protein, 10 aa, Mycobacterium
PPTNTTEGLD

SEQ ID NO: 544040 - protein, 8 aa, Mycobacterium
PPTPADEV

SEQ ID NO: 544041 - protein, 8 aa, Mycobacterium
PPTPADQV

SEQ ID NO: 544042 - protein, 6 aa, Mycobacterium
PPTPET

SEQ ID NO: 544043 - protein, 5 aa, Mycobacterium
PPTPR

SEQ ID NO: 544044 - protein, 11 aa, Mycobacterium
PPTPSGNTRTY

SEQ ID NO: 544045 - protein, 15 aa, Mycobacterium
PPTPTVRTQASHQRE

SEQ ID NO: 544046 - protein, 22 aa, Mycobacterium
PPTPVDAEPTRSVTGGSAETER

SEQ ID NO: 544047 - protein, 6 aa, Mycobacterium
PPTPWS

SEQ ID NO: 544048 - protein, 5 aa, Mycobacterium
PPTQY

SEQ ID NO: 544049 - protein, 5 aa, Mycobacterium
PPTRF

SEQ ID NO: 544050 - protein, 11 aa, Mycobacterium
PPTRGGRIEPS

SEQ ID NO: 544051 - protein, 6 aa, Mycobacterium
PPTRPE

SEQ ID NO: 544052 - protein, 7 aa, Mycobacterium
PPTRPRS

SEQ ID NO: 544053 - protein, 5 aa, Mycobacterium
PPTRR

SEQ ID NO: 544054 - protein, 11 aa, Mycobacterium
PPTSADEVVSR

SEQ ID NO: 544055 - protein, 14 aa, Mycobacterium
PPTSAPHAAPAMAP

SEQ ID NO: 544056 - protein, 7 aa, Mycobacterium
PPTSATR

SEQ ID NO: 544057 - protein, 13 aa, Mycobacterium
PPTSIDPLSTQRL

SEQ ID NO: 544058 - protein, 12 aa, Mycobacterium
PPTSPGGEPGPR

SEQ ID NO: 544059 - protein, 10 aa, Mycobacterium
PPTSRPPTPR

SEQ ID NO: 544060 - protein, 7 aa, Mycobacterium
PPTSSAH

SEQ ID NO: 544061 - protein, 13 aa, Mycobacterium
PPTSSSAALGDQD

SEQ ID NO: 544062 - protein, 29 aa, Mycobacterium
PPTSTTVTAPAQTGAPTPTRPATTPVAPR

SEQ ID NO: 544063 - protein, 6 aa, Mycobacterium
PPTSVE

SEQ ID NO: 544064 - protein, 5 aa, Mycobacterium
PPTTA

SEQ ID NO: 544065 - protein, 8 aa, Mycobacterium
PPTTGTGM

SEQ ID NO: 544066 - protein, 18 aa, Mycobacterium
PPTTPPTTPVTTPPTTMA

SEQ ID NO: 544067 - protein, 7 aa, Mycobacterium
PPTTRDV

SEQ ID NO: 544068 - protein, 5 aa, Mycobacterium
PPTVQ

SEQ ID NO: 544069 - protein, 5 aa, Mycobacterium
PPTVR

SEQ ID NO: 544070 - protein, 18 aa, Mycobacterium
PPTVTPAAPPARLCNESP

SEQ ID NO: 544071 - protein, 12 aa, Mycobacterium
PPTWTPDSPTTS

SEQ ID NO: 544072 - protein, 10 aa, Mycobacterium
PPVAGGSNRD

SEQ ID NO: 544073 - protein, 8 aa, Mycobacterium
PPVAPGRL

SEQ ID NO: 544074 - protein, 10 aa, Mycobacterium
PPVAPTEATN

SEQ ID NO: 544075 - protein, 7 aa, Mycobacterium
PPVATPS

SEQ ID NO: 544076 - protein, 4 aa, Mycobacterium
PPVD

SEQ ID NO: 544077 - protein, 8 aa, Mycobacterium
PPVDPLPE

SEQ ID NO: 544078 - protein, 6 aa, Mycobacterium
PPVEER

SEQ ID NO: 544079 - protein, 5 aa, Mycobacterium
PPVEF

SEQ ID NO: 544080 - protein, 7 aa, Mycobacterium
PPVEFGP

SEQ ID NO: 544081 - protein, 7 aa, Mycobacterium
PPVEGDS

SEQ ID NO: 544082 - protein, 5 aa, Mycobacterium
PPVEQ

SEQ ID NO: 544083 - protein, 6 aa, Mycobacterium
PPVEQQ

SEQ ID NO: 544084 - protein, 15 aa, Mycobacterium
PPVGAGADDLNDKKA

SEQ ID NO: 544085 - protein, 15 aa, Mycobacterium
PPVGASADDLNDKKA

SEQ ID NO: 544086 - protein, 9 aa, Mycobacterium
PPVGDDPLD

SEQ ID NO: 544087 - protein, 11 aa, Mycobacterium
PPVGERSPEEW

SEQ ID NO: 544088 - protein, 17 aa, Mycobacterium
PPVGETPTGRLAPGANL

SEQ ID NO: 544089 - protein, 15 aa, Mycobacterium
PPVGGGGDQLADPEF

SEQ ID NO: 544090 - protein, 8 aa, Mycobacterium
PPVGGGYS

SEQ ID NO: 544091 - protein, 7 aa, Mycobacterium
PPVGKPL

SEQ ID NO: 544092 - protein, 5 aa, Mycobacterium
PPVGP

SEQ ID NO: 544093 - protein, 14 aa, Mycobacterium
PPVGPGADDLNDKK

SEQ ID NO: 544094 - protein, 15 aa, Mycobacterium
PPVGPGPSSSPEGAA

SEQ ID NO: 544095 - protein, 16 aa, Mycobacterium
PPVGPGPSSSPEGTGV

SEQ ID NO: 544096 - protein, 15 aa, Mycobacterium
PPVGPSADDLNDKKA

SEQ ID NO: 544097 - protein, 5 aa, Mycobacterium
PPVGQ

SEQ ID NO: 544098 - protein, 16 aa, Mycobacterium
PPVGRPPATFRIVAGP

SEQ ID NO: 544099 - protein, 8 aa, Mycobacterium
PPVGTAPG

SEQ ID NO: 544100 - protein, 6 aa, Mycobacterium
PPVGYP

SEQ ID NO: 544101 - protein, 4 aa, Mycobacterium
PPVH

SEQ ID NO: 544102 - protein, 5 aa, Mycobacterium
PPVHP

SEQ ID NO: 544103 - protein, 7 aa, Mycobacterium
PPVNAVP

SEQ ID NO: 544104 - protein, 19 aa, Mycobacterium
PPVPAEPNSPPLPPVPPLP

SEQ ID NO: 544105 - protein, 18 aa, Mycobacterium
PPVPAPTARRASRRPSAQ

SEQ ID NO: 544106 - protein, 5 aa, Mycobacterium
PPVPE

SEQ ID NO: 544107 - protein, 16 aa, Mycobacterium
PPVPPTPPSPELPSEP

SEQ ID NO: 544108 - protein, 21 aa, Mycobacterium
PPVPPVPAAPLATAAGEVAPV

SEQ ID NO: 544109 - protein, 11 aa, Mycobacterium
PPVQAGSSIMP

SEQ ID NO: 544110 - protein, 12 aa, Mycobacterium
PPVQHEPPSPSV

SEQ ID NO: 544111 - protein, 12 aa, Mycobacterium
PPVQPNSAEPEG

SEQ ID NO: 544112 - protein, 5 aa, Mycobacterium
PPVQR

SEQ ID NO: 544113 - protein, 15 aa, Mycobacterium
PPVRGGLPTAVPTDP

SEQ ID NO: 544114 - protein, 7 aa, Mycobacterium
PPVRGTS

SEQ ID NO: 544115 - protein, 30 aa, Mycobacterium
PPVSAGGRGLAGLTPAGEAQRSAAVVRPVV

SEQ ID NO: 544116 - protein, 8 aa, Mycobacterium
PPVSTTNG

SEQ ID NO: 544117 - protein, 5 aa, Mycobacterium
PPVTD

SEQ ID NO: 544118 - protein, 12 aa, Mycobacterium
PPVTGIGQAGLF

SEQ ID NO: 544119 - protein, 15 aa, Mycobacterium
PPVTGPKHESATIGG

SEQ ID NO: 544120 - protein, 7 aa, Mycobacterium
PPVTHTP

SEQ ID NO: 544121 - protein, 7 aa, Mycobacterium
PPVTVPS

SEQ ID NO: 544122 - protein, 11 aa, Mycobacterium
PPWAGGAPQGR

SEQ ID NO: 544123 - protein, 5 aa, Mycobacterium
PPWAS

SEQ ID NO: 544124 - protein, 6 aa, Mycobacterium
PPWDPG

SEQ ID NO: 544125 - protein, 4 aa, Mycobacterium
PPWL

SEQ ID NO: 544126 - protein, 6 aa, Mycobacterium
PPWNRP

SEQ ID NO: 544127 - protein, 20 aa, Mycobacterium
PPWPAGDATVVSSAAEAKDA

SEQ ID NO: 544128 - protein, 13 aa, Mycobacterium
PPWQPGERDSAGS

SEQ ID NO: 544129 - protein, 7 aa, Mycobacterium
PPWTGGS

SEQ ID NO: 544130 - protein, 4 aa, Mycobacterium
PPWV

SEQ ID NO: 544131 - protein, 19 aa, Mycobacterium
PPYAEYQTKTDRLIPVFVV

SEQ ID NO: 544132 - protein, 9 aa, Mycobacterium
PPYATPGEL

SEQ ID NO: 544133 - protein, 5 aa, Mycobacterium
PPYDG

SEQ ID NO: 544134 - protein, 24 aa, Mycobacterium
PPYDPGGANVTATPRRIRPRHFGA

SEQ ID NO: 544135 - protein, 5 aa, Mycobacterium
PPYDS

SEQ ID NO: 544136 - protein, 6 aa, Mycobacterium
PPYDVD

SEQ ID NO: 544137 - protein, 14 aa, Mycobacterium
PPYEPSADGFGDDD

SEQ ID NO: 544138 - protein, 5 aa, Mycobacterium
PPYES

SEQ ID NO: 544139 - protein, 9 aa, Mycobacterium
PPYETPAEL

SEQ ID NO: 544140 - protein, 5 aa, Mycobacterium
PPYEV

SEQ ID NO: 544141 - protein, 11 aa, Mycobacterium
PPYGGTTTWTS

SEQ ID NO: 544142 - protein, 6 aa, Mycobacterium
PPYGNA

SEQ ID NO: 544143 - protein, 5 aa, Mycobacterium
PPYHD

SEQ ID NO: 544144 - protein, 19 aa, Mycobacterium
PPYIPEGAELDPEVADHDP

SEQ ID NO: 544145 - protein, 8 aa, Mycobacterium
PPYITPKD

SEQ ID NO: 544146 - protein, 8 aa, Mycobacterium
PPYPHPDD

SEQ ID NO: 544147 - protein, 5 aa, Mycobacterium
PPYRG

SEQ ID NO: 544148 - protein, 10 aa, Mycobacterium
PPYSDHSQRS

SEQ ID NO: 544149 - protein, 21 aa, Mycobacterium
PPYSDVSARGPFEREQTEKLR

SEQ ID NO: 544150 - protein, 8 aa, Mycobacterium
PPYSVSAE

SEQ ID NO: 544151 - protein, 5 aa, Mycobacterium
PPYTA

SEQ ID NO: 544152 - protein, 10 aa, Mycobacterium
PPYTDSAQRS

SEQ ID NO: 544153 - protein, 6 aa, Mycobacterium
PPYVPD

SEQ ID NO: 544154 - protein, 14 aa, Mycobacterium
PPYVPDNATVEPEV

SEQ ID NO: 544155 - protein, 12 aa, Mycobacterium
PPYVPEAPMDDS

SEQ ID NO: 544156 - protein, 6 aa, Mycobacterium
PPYVPG

SEQ ID NO: 544157 - protein, 23 aa, Mycobacterium
PPYVPTPPDGDTEYISPAAGPSW

SEQ ID NO: 544158 - protein, 11 aa, Mycobacterium
PPYVPTPPGAE

SEQ ID NO: 544159 - protein, 4 aa, Mycobacterium
PQAA

SEQ ID NO: 544160 - protein, 11 aa, Mycobacterium
PQAAANSADDE

SEQ ID NO: 544161 - protein, 6 aa, Mycobacterium
PQAAER

SEQ ID NO: 544162 - protein, 15 aa, Mycobacterium
PQAAEVEQGPEVATA

SEQ ID NO: 544163 - protein, 5 aa, Mycobacterium
PQAAR

SEQ ID NO: 544164 - protein, 9 aa, Mycobacterium
PQAASAPGQ

SEQ ID NO: 544165 - protein, 9 aa, Mycobacterium
PQAAWTSKS

SEQ ID NO: 544166 - protein, 4 aa, Mycobacterium
PQAD

SEQ ID NO: 544167 - protein, 5 aa, Mycobacterium
PQADG

SEQ ID NO: 544168 - protein, 7 aa, Mycobacterium
PQADGSL

SEQ ID NO: 544169 - protein, 8 aa, Mycobacterium
PQADGTPA

SEQ ID NO: 544170 - protein, 6 aa, Mycobacterium
PQADIP

SEQ ID NO: 544171 - protein, 11 aa, Mycobacterium
PQADPPPPTVP

SEQ ID NO: 544172 - protein, 14 aa, Mycobacterium
PQADSRVSRTEIAQ

SEQ ID NO: 544173 - protein, 5 aa, Mycobacterium
PQAEH

SEQ ID NO: 544174 - protein, 5 aa, Mycobacterium
PQAEL

SEQ ID NO: 544175 - protein, 6 aa, Mycobacterium
PQAERR

SEQ ID NO: 544176 - protein, 10 aa, Mycobacterium
PQAGAMSRAA

SEQ ID NO: 544177 - protein, 7 aa, Mycobacterium
PQAGGEE

SEQ ID NO: 544178 - protein, 16 aa, Mycobacterium
PQAGQMAQQASPIAQT

SEQ ID NO: 544179 - protein, 49 aa, Mycobacterium
PQAGQMAQQASPIAQTISQSAQQAASQSSQGASPAQLASDTKPEQQGQL

SEQ ID NO: 544180 - protein, 6 aa, Mycobacterium
PQAGRY

SEQ ID NO: 544181 - protein, 9 aa, Mycobacterium
PQAGTANSP

SEQ ID NO: 544182 - protein, 9 aa, Mycobacterium
PQAGVSPQD

SEQ ID NO: 544183 - protein, 13 aa, Mycobacterium
PQAIGAQASHRDR

SEQ ID NO: 544184 - protein, 10 aa, Mycobacterium
PQAKELAEAK

SEQ ID NO: 544185 - protein, 13 aa, Mycobacterium
PQAKIDDGSVPAR

SEQ ID NO: 544186 - protein, 10 aa, Mycobacterium
PQALDEPRRW

SEQ ID NO: 544187 - protein, 4 aa, Mycobacterium
PQAN

SEQ ID NO: 544188 - protein, 8 aa, Mycobacterium
PQANTGEA

SEQ ID NO: 544189 - protein, 7 aa, Mycobacterium
PQAPARY

SEQ ID NO: 544190 - protein, 5 aa, Mycobacterium
PQAPD

SEQ ID NO: 544191 - protein, 23 aa, Mycobacterium
PQAPEANAPAPRPGRPAIGAGAR

SEQ ID NO: 544192 - protein, 6 aa, Mycobacterium
PQAPFD

SEQ ID NO: 544193 - protein, 13 aa, Mycobacterium
PQAPLRGAPEPTE

SEQ ID NO: 544194 - protein, 12 aa, Mycobacterium
PQAPRVDHGDLP

SEQ ID NO: 544195 - protein, 23 aa, Mycobacterium
PQAPSDRTHPTAAGVPGPGNSAL

SEQ ID NO: 544196 - protein, 7 aa, Mycobacterium
PQAPVRG

SEQ ID NO: 544197 - protein, 7 aa, Mycobacterium
PQAQASI

SEQ ID NO: 544198 - protein, 9 aa, Mycobacterium
PQAQNAQSR

SEQ ID NO: 544199 - protein, 11 aa, Mycobacterium
PQAQRAREGEV

SEQ ID NO: 544200 - protein, 12 aa, Mycobacterium
PQAQRAREGEVP

SEQ ID NO: 544201 - protein, 5 aa, Mycobacterium
PQAQV

SEQ ID NO: 544202 - protein, 20 aa, Mycobacterium
PQARAEPGPNKSRRNRATAT

SEQ ID NO: 544203 - protein, 5 aa, Mycobacterium
PQARE

SEQ ID NO: 544204 - protein, 5 aa, Mycobacterium
PQARH

SEQ ID NO: 544205 - protein, 12 aa, Mycobacterium
PQARNAVDGPTA

SEQ ID NO: 544206 - protein, 13 aa, Mycobacterium
PQARNAVNGPTAA

SEQ ID NO: 544207 - protein, 6 aa, Mycobacterium
PQARSS

SEQ ID NO: 544208 - protein, 9 aa, Mycobacterium
PQASEKELA

SEQ ID NO: 544209 - protein, 9 aa, Mycobacterium
PQASGLGGG

SEQ ID NO: 544210 - protein, 10 aa, Mycobacterium
PQASLAPAKL

SEQ ID NO: 544211 - protein, 12 aa, Mycobacterium
PQASSDRRKSNI

SEQ ID NO: 544212 - protein, 6 aa, Mycobacterium
PQATDA

SEQ ID NO: 544213 - protein, 9 aa, Mycobacterium
PQATDRDES

SEQ ID NO: 544214 - protein, 14 aa, Mycobacterium
PQATETAFGRDPEI

SEQ ID NO: 544215 - protein, 9 aa, Mycobacterium
PQATGGNYS

SEQ ID NO: 544216 - protein, 7 aa, Mycobacterium
PQATGVR

SEQ ID NO: 544217 - protein, 10 aa, Mycobacterium
PQATPAQTQA

SEQ ID NO: 544218 - protein, 15 aa, Mycobacterium
PQATSPSPQRIGQRN

SEQ ID NO: 544219 - protein, 5 aa, Mycobacterium
PQATV

SEQ ID NO: 544220 - protein, 8 aa, Mycobacterium
PQAVAPDF

SEQ ID NO: 544221 - protein, 13 aa, Mycobacterium
PQAVLGPDGTATV

SEQ ID NO: 544222 - protein, 10 aa, Mycobacterium
PQAVPPGEDV

SEQ ID NO: 544223 - protein, 8 aa, Mycobacterium
PQAWAGEP

SEQ ID NO: 544224 - protein, 5 aa, Mycobacterium
PQAYT

SEQ ID NO: 544225 - protein, 6 aa, Mycobacterium
PQCGPD

SEQ ID NO: 544226 - protein, 6 aa, Mycobacterium
PQCPES

SEQ ID NO: 544227 - protein, 7 aa, Mycobacterium
PQCPESA

SEQ ID NO: 544228 - protein, 10 aa, Mycobacterium
PQDAATATAG

SEQ ID NO: 544229 - protein, 11 aa, Mycobacterium
PQDAPTGGDPL

SEQ ID NO: 544230 - protein, 4 aa, Mycobacterium
PQDD

SEQ ID NO: 544231 - protein, 13 aa, Mycobacterium
PQDDKQRAGRGAI

SEQ ID NO: 544232 - protein, 11 aa, Mycobacterium
PQDDQQRAGRG

SEQ ID NO: 544233 - protein, 8 aa, Mycobacterium
PQDDSYEY

SEQ ID NO: 544234 - protein, 5 aa, Mycobacterium
PQDEI

SEQ ID NO: 544235 - protein, 7 aa, Mycobacterium
PQDFQDP

SEQ ID NO: 544236 - protein, 5 aa, Mycobacterium
PQDFT

SEQ ID NO: 544237 - protein, 4 aa, Mycobacterium
PQDG

SEQ ID NO: 544238 - protein, 6 aa, Mycobacterium
PQDGGT

SEQ ID NO: 544239 - protein, 9 aa, Mycobacterium
PQDGSNRSL

SEQ ID NO: 544240 - protein, 9 aa, Mycobacterium
PQDGTDAPE

SEQ ID NO: 544241 - protein, 9 aa, Mycobacterium
PQDISPERL

SEQ ID NO: 544242 - protein, 28 aa, Mycobacterium
PQDKGDGRAPLAIPDRPDDVPRPHPARD

SEQ ID NO: 544243 - protein, 14 aa, Mycobacterium
PQDLTPHSALPPAV

SEQ ID NO: 544244 - protein, 4 aa, Mycobacterium
PQDM

SEQ ID NO: 544245 - protein, 5 aa, Mycobacterium
PQDMD

SEQ ID NO: 544246 - protein, 7 aa, Mycobacterium
PQDPAAL

SEQ ID NO: 544247 - protein, 8 aa, Mycobacterium
PQDPDGTE

SEQ ID NO: 544248 - protein, 8 aa, Mycobacterium
PQDPETLR

SEQ ID NO: 544249 - protein, 10 aa, Mycobacterium
PQDPGASLNP

SEQ ID NO: 544250 - protein, 8 aa, Mycobacterium
PQDPKEGN

SEQ ID NO: 544251 - protein, 6 aa, Mycobacterium
PQDPMT

SEQ ID NO: 544252 - protein, 7 aa, Mycobacterium
PQDPRPR

SEQ ID NO: 544253 - protein, 6 aa, Mycobacterium
PQDPTI

SEQ ID NO: 544254 - protein, 6 aa, Mycobacterium
PQDPTV

SEQ ID NO: 544255 - protein, 12 aa, Mycobacterium
PQDRADNRELGR

SEQ ID NO: 544256 - protein, 4 aa, Mycobacterium
PQDS

SEQ ID NO: 544257 - protein, 9 aa, Mycobacterium
PQDSDEYAD

SEQ ID NO: 544258 - protein, 7 aa, Mycobacterium
PQDSGVR

SEQ ID NO: 544259 - protein, 7 aa, Mycobacterium
PQDSPEY

SEQ ID NO: 544260 - protein, 9 aa, Mycobacterium
PQDSPEYAN

SEQ ID NO: 544261 - protein, 15 aa, Mycobacterium
PQDSYASQVGRDPGR

SEQ ID NO: 544262 - protein, 11 aa, Mycobacterium
PQDTPADTVRQ

SEQ ID NO: 544263 - protein, 7 aa, Mycobacterium
PQDTPYG

SEQ ID NO: 544264 - protein, 4 aa, Mycobacterium
PQEA

SEQ ID NO: 544265 - protein, 7 aa, Mycobacterium
PQEADAL

SEQ ID NO: 544266 - protein, 5 aa, Mycobacterium
PQEAE

SEQ ID NO: 544267 - protein, 7 aa, Mycobacterium
PQEAEAL

SEQ ID NO: 544268 - protein, 10 aa, Mycobacterium
PQEAGEQAMQ

SEQ ID NO: 544269 - protein, 7 aa, Mycobacterium
PQEAPDG

SEQ ID NO: 544270 - protein, 7 aa, Mycobacterium
PQEAQAM

SEQ ID NO: 544271 - protein, 7 aa, Mycobacterium
PQEARGA

SEQ ID NO: 544272 - protein, 12 aa, Mycobacterium
PQEASDELQPAG

SEQ ID NO: 544273 - protein, 13 aa, Mycobacterium
PQEDDAKAKNHPE

SEQ ID NO: 544274 - protein, 5 aa, Mycobacterium
PQEDF

SEQ ID NO: 544275 - protein, 4 aa, Mycobacterium
PQEE

SEQ ID NO: 544276 - protein, 18 aa, Mycobacterium
PQEELREKSVAAAFDALN

SEQ ID NO: 544277 - protein, 5 aa, Mycobacterium
PQEER

SEQ ID NO: 544278 - protein, 51 aa, Mycobacterium
PQEERGAPGSRDAGSDEPSGGPTDRPSGTYRGDESVPDHGAEGGAEGDDQT

SEQ ID NO: 544279 - protein, 6 aa, Mycobacterium
PQEETA

SEQ ID NO: 544280 - protein, 5 aa, Mycobacterium
PQEFG

SEQ ID NO: 544281 - protein, 6 aa, Mycobacterium
PQEGIT

SEQ ID NO: 544282 - protein, 8 aa, Mycobacterium
PQEGLGGQ

SEQ ID NO: 544283 - protein, 6 aa, Mycobacterium
PQEHDR

SEQ ID NO: 544284 - protein, 5 aa, Mycobacterium
PQEPG

SEQ ID NO: 544285 - protein, 12 aa, Mycobacterium
PQEQPEAPGQEN

SEQ ID NO: 544286 - protein, 11 aa, Mycobacterium
PQEQSQRPGHV

SEQ ID NO: 544287 - protein, 13 aa, Mycobacterium
PQERESELRAQRE

SEQ ID NO: 544288 - protein, 4 aa, Mycobacterium
PQET

SEQ ID NO: 544289 - protein, 8 aa, Mycobacterium
PQETERTF

SEQ ID NO: 544290 - protein, 8 aa, Mycobacterium
PQETESAF

SEQ ID NO: 544291 - protein, 5 aa, Mycobacterium
PQEVN

SEQ ID NO: 544292 - protein, 7 aa, Mycobacterium
PQEWESP

SEQ ID NO: 544293 - protein, 4 aa, Mycobacterium
PQEY

SEQ ID NO: 544294 - protein, 6 aa, Mycobacterium
PQEYAD

SEQ ID NO: 544295 - protein, 20 aa, Mycobacterium
PQEYGPDPVPAPAPPGPWDV

SEQ ID NO: 544296 - protein, 5 aa, Mycobacterium
PQEYH

SEQ ID NO: 544297 - protein, 13 aa, Mycobacterium
PQFDDPSIHSGGQ

SEQ ID NO: 544298 - protein, 13 aa, Mycobacterium
PQFDDPSINSGGQ

SEQ ID NO: 544299 - protein, 8 aa, Mycobacterium
PQFDEPSV

SEQ ID NO: 544300 - protein, 15 aa, Mycobacterium
PQFEGQTKTKLGNTE

SEQ ID NO: 544301 - protein, 16 aa, Mycobacterium
PQFGADSSARHRRSGA

SEQ ID NO: 544302 - protein, 16 aa, Mycobacterium
PQFGPDSSARHRRSGA

SEQ ID NO: 544303 - protein, 13 aa, Mycobacterium
PQFGSGRSGAIDP

SEQ ID NO: 544304 - protein, 5 aa, Mycobacterium
PQFPG

SEQ ID NO: 544305 - protein, 4 aa, Mycobacterium
PQFQ

SEQ ID NO: 544306 - protein, 4 aa, Mycobacterium
PQGA

SEQ ID NO: 544307 - protein, 13 aa, Mycobacterium
PQGAAGEDIIGPK

SEQ ID NO: 544308 - protein, 10 aa, Mycobacterium
PQGAAGEDIV

SEQ ID NO: 544309 - protein, 12 aa, Mycobacterium
PQGAAGEDIVGP

SEQ ID NO: 544310 - protein, 13 aa, Mycobacterium
PQGAAGEDIVGPK

SEQ ID NO: 544311 - protein, 6 aa, Mycobacterium
PQGAEY

SEQ ID NO: 544312 - protein, 11 aa, Mycobacterium
PQGAGSEDFSD

SEQ ID NO: 544313 - protein, 10 aa, Mycobacterium
PQGAGTKAEG

SEQ ID NO: 544314 - protein, 7 aa, Mycobacterium
PQGAPHA

SEQ ID NO: 544315 - protein, 16 aa, Mycobacterium
PQGAPRKPLSCDPDGP

SEQ ID NO: 544316 - protein, 9 aa, Mycobacterium
PQGAPRPRN

SEQ ID NO: 544317 - protein, 9 aa, Mycobacterium
PQGASAPGQ

SEQ ID NO: 544318 - protein, 6 aa, Mycobacterium
PQGATH

SEQ ID NO: 544319 - protein, 5 aa, Mycobacterium
PQGDA

SEQ ID NO: 544320 - protein, 9 aa, Mycobacterium
PQGDDPGAR

SEQ ID NO: 544321 - protein, 10 aa, Mycobacterium
PQGDEAPGDL

SEQ ID NO: 544322 - protein, 11 aa, Mycobacterium
PQGDEEPGDLH

SEQ ID NO: 544323 - protein, 10 aa, Mycobacterium
PQGDERPTDL

SEQ ID NO: 544324 - protein, 10 aa, Mycobacterium
PQGDETPGDL

SEQ ID NO: 544325 - protein, 7 aa, Mycobacterium
PQGDGKP

SEQ ID NO: 544326 - protein, 5 aa, Mycobacterium
PQGDK

SEQ ID NO: 544327 - protein, 10 aa, Mycobacterium
PQGDPLPASA

SEQ ID NO: 544328 - protein, 9 aa, Mycobacterium
PQGDPLPSA

SEQ ID NO: 544329 - protein, 12 aa, Mycobacterium
PQGDSRTAEETF

SEQ ID NO: 544330 - protein, 7 aa, Mycobacterium
PQGEGAE

SEQ ID NO: 544331 - protein, 4 aa, Mycobacterium
PQGF

SEQ ID NO: 544332 - protein, 4 aa, Mycobacterium
PQGG

SEQ ID NO: 544333 - protein, 12 aa, Mycobacterium
PQGGAAAPGAER

SEQ ID NO: 544334 - protein, 10 aa, Mycobacterium
PQGGATNERV

SEQ ID NO: 544335 - protein, 7 aa, Mycobacterium
PQGGDEF

SEQ ID NO: 544336 - protein, 11 aa, Mycobacterium
PQGGEGAAAKP

SEQ ID NO: 544337 - protein, 7 aa, Mycobacterium
PQGGNTF

SEQ ID NO: 544338 - protein, 7 aa, Mycobacterium
PQGGPAL

SEQ ID NO: 544339 - protein, 5 aa, Mycobacterium
PQGHP

SEQ ID NO: 544340 - protein, 10 aa, Mycobacterium
PQGNASTALG

SEQ ID NO: 544341 - protein, 10 aa, Mycobacterium
PQGNPAQRRY

SEQ ID NO: 544342 - protein, 17 aa, Mycobacterium
PQGPATLPDPLASARDI

SEQ ID NO: 544343 - protein, 5 aa, Mycobacterium
PQGPF

SEQ ID NO: 544344 - protein, 10 aa, Mycobacterium
PQGPNKPDRV

SEQ ID NO: 544345 - protein, 4 aa, Mycobacterium
PQGQ

SEQ ID NO: 544346 - protein, 14 aa, Mycobacterium
PQGQKRPRLSADER

SEQ ID NO: 544347 - protein, 21 aa, Mycobacterium
PQGQRADGDNTETDKADWVTP

SEQ ID NO: 544348 - protein, 5 aa, Mycobacterium
PQGRA

SEQ ID NO: 544349 - protein, 9 aa, Mycobacterium
PQGRGPEAL

SEQ ID NO: 544350 - protein, 5 aa, Mycobacterium
PQGRQ

SEQ ID NO: 544351 - protein, 6 aa, Mycobacterium
PQGRSV

SEQ ID NO: 544352 - protein, 6 aa, Mycobacterium
PQGRTG

SEQ ID NO: 544353 - protein, 4 aa, Mycobacterium
PQGS

SEQ ID NO: 544354 - protein, 11 aa, Mycobacterium
PQGSAEGAAVG

SEQ ID NO: 544355 - protein, 11 aa, Mycobacterium
PQGSKDAATAC

SEQ ID NO: 544356 - protein, 5 aa, Mycobacterium
PQGSL

SEQ ID NO: 544357 - protein, 8 aa, Mycobacterium
PQGSMTED

SEQ ID NO: 544358 - protein, 9 aa, Mycobacterium
PQGTAPDLA

SEQ ID NO: 544359 - protein, 19 aa, Mycobacterium
PQGTAPDLADADPAELASR

SEQ ID NO: 544360 - protein, 4 aa, Mycobacterium
PQGV

SEQ ID NO: 544361 - protein, 5 aa, Mycobacterium
PQGVT

SEQ ID NO: 544362 - protein, 4 aa, Mycobacterium
PQGY

SEQ ID NO: 544363 - protein, 13 aa, Mycobacterium
PQHAGAGPVVGAG

SEQ ID NO: 544364 - protein, 7 aa, Mycobacterium
PQHAPDY

SEQ ID NO: 544365 - protein, 7 aa, Mycobacterium
PQHAPHY

SEQ ID NO: 544366 - protein, 9 aa, Mycobacterium
PQHAPQYGQ

SEQ ID NO: 544367 - protein, 11 aa, Mycobacterium
PQHDCPPPSPD

SEQ ID NO: 544368 - protein, 10 aa, Mycobacterium
PQHEDARAAD

SEQ ID NO: 544369 - protein, 23 aa, Mycobacterium
PQHEDARAADALRDESYKVSGTA

SEQ ID NO: 544370 - protein, 10 aa, Mycobacterium
PQHEDSRAAD

SEQ ID NO: 544371 - protein, 5 aa, Mycobacterium
PQHGE

SEQ ID NO: 544372 - protein, 7 aa, Mycobacterium
PQHGKPV

SEQ ID NO: 544373 - protein, 6 aa, Mycobacterium
PQHGTA

SEQ ID NO: 544374 - protein, 4 aa, Mycobacterium
PQHH

SEQ ID NO: 544375 - protein, 8 aa, Mycobacterium
PQHPGDDV

SEQ ID NO: 544376 - protein, 6 aa, Mycobacterium
PQHPHN

SEQ ID NO: 544377 - protein, 4 aa, Mycobacterium
PQHQ

SEQ ID NO: 544378 - protein, 10 aa, Mycobacterium
PQHQPSGGVI

SEQ ID NO: 544379 - protein, 6 aa, Mycobacterium
PQHRGT

SEQ ID NO: 544380 - protein, 7 aa, Mycobacterium
PQHSDHG

SEQ ID NO: 544381 - protein, 6 aa, Mycobacterium
PQHSPR

SEQ ID NO: 544382 - protein, 12 aa, Mycobacterium
PQHTRKLPTEPH

SEQ ID NO: 544383 - protein, 30 aa, Mycobacterium
PQIANPSAQATQGTAVANATGNSAASSTQS

SEQ ID NO: 544384 - protein, 13 aa, Mycobacterium
PQIDDQREALERA

SEQ ID NO: 544385 - protein, 4 aa, Mycobacterium
PQIE

SEQ ID NO: 544386 - protein, 9 aa, Mycobacterium
PQIEQPDTV

SEQ ID NO: 544387 - protein, 6 aa, Mycobacterium
PQIETG

SEQ ID NO: 544388 - protein, 8 aa, Mycobacterium
PQIGDNRK

SEQ ID NO: 544389 - protein, 8 aa, Mycobacterium
PQIGEARK

SEQ ID NO: 544390 - protein, 8 aa, Mycobacterium
PQIGEDRK

SEQ ID NO: 544391 - protein, 18 aa, Mycobacterium
PQIGNTGWNDEDGESRGD

SEQ ID NO: 544392 - protein, 7 aa, Mycobacterium
PQIPEPS

SEQ ID NO: 544393 - protein, 7 aa, Mycobacterium
PQIRTSQ

SEQ ID NO: 544394 - protein, 9 aa, Mycobacterium
PQISDTQRQ

SEQ ID NO: 544395 - protein, 5 aa, Mycobacterium
PQITG

SEQ ID NO: 544396 - protein, 7 aa, Mycobacterium
PQKDEIE

SEQ ID NO: 544397 - protein, 17 aa, Mycobacterium
PQKGGSWRDTKCSSPLG

SEQ ID NO: 544398 - protein, 12 aa, Mycobacterium
PQKGPTRPPSPH

SEQ ID NO: 544399 - protein, 5 aa, Mycobacterium
PQKMN

SEQ ID NO: 544400 - protein, 8 aa, Mycobacterium
PQKQGSMT

SEQ ID NO: 544401 - protein, 8 aa, Mycobacterium
PQKRNALS

SEQ ID NO: 544402 - protein, 13 aa, Mycobacterium
PQKSWEANEPAEL

SEQ ID NO: 544403 - protein, 13 aa, Mycobacterium
PQKSWESNEPADL

SEQ ID NO: 544404 - protein, 4 aa, Mycobacterium
PQLA

SEQ ID NO: 544405 - protein, 10 aa, Mycobacterium
PQLAPEDSLG

SEQ ID NO: 544406 - protein, 11 aa, Mycobacterium
PQLAPEGKHAA

SEQ ID NO: 544407 - protein, 7 aa, Mycobacterium
PQLAPEP

SEQ ID NO: 544408 - protein, 4 aa, Mycobacterium
PQLD

SEQ ID NO: 544409 - protein, 5 aa, Mycobacterium
PQLDP

SEQ ID NO: 544410 - protein, 12 aa, Mycobacterium
PQLDPARTGSTA

SEQ ID NO: 544411 - protein, 12 aa, Mycobacterium
PQLDPDRTGSTA

SEQ ID NO: 544412 - protein, 6 aa, Mycobacterium
PQLDPE

SEQ ID NO: 544413 - protein, 12 aa, Mycobacterium
PQLDPGRQGSTA

SEQ ID NO: 544414 - protein, 12 aa, Mycobacterium
PQLDPSRTGSTA

SEQ ID NO: 544415 - protein, 6 aa, Mycobacterium
PQLEAS

SEQ ID NO: 544416 - protein, 6 aa, Mycobacterium
PQLETD

SEQ ID NO: 544417 - protein, 8 aa, Mycobacterium
PQLGAPTN

SEQ ID NO: 544418 - protein, 6 aa, Mycobacterium
PQLGDK

SEQ ID NO: 544419 - protein, 8 aa, Mycobacterium
PQLGELSG

SEQ ID NO: 544420 - protein, 5 aa, Mycobacterium
PQLGP

SEQ ID NO: 544421 - protein, 6 aa, Mycobacterium
PQLGQH

SEQ ID NO: 544422 - protein, 7 aa, Mycobacterium
PQLGRQE

SEQ ID NO: 544423 - protein, 5 aa, Mycobacterium
PQLPD

SEQ ID NO: 544424 - protein, 11 aa, Mycobacterium
PQLPDDADNPL

SEQ ID NO: 544425 - protein, 6 aa, Mycobacterium
PQLPDG

SEQ ID NO: 544426 - protein, 5 aa, Mycobacterium
PQLPE

SEQ ID NO: 544427 - protein, 7 aa, Mycobacterium
PQLPGPL

SEQ ID NO: 544428 - protein, 7 aa, Mycobacterium
PQLPGST

SEQ ID NO: 544429 - protein, 5 aa, Mycobacterium
PQLPH

SEQ ID NO: 544430 - protein, 17 aa, Mycobacterium
PQLPPAPDDYPTFPDTS

SEQ ID NO: 544431 - protein, 5 aa, Mycobacterium
PQLPQ

SEQ ID NO: 544432 - protein, 5 aa, Mycobacterium
PQLPT

SEQ ID NO: 544433 - protein, 4 aa, Mycobacterium
PQLR

SEQ ID NO: 544434 - protein, 7 aa, Mycobacterium
PQLRAPA

SEQ ID NO: 544435 - protein, 10 aa, Mycobacterium
PQLRSANGRE

SEQ ID NO: 544436 - protein, 15 aa, Mycobacterium
PQLSGRGLGHTGGTL

SEQ ID NO: 544437 - protein, 7 aa, Mycobacterium
PQLSRGL

SEQ ID NO: 544438 - protein, 11 aa, Mycobacterium
PQLSTSDGRGP

SEQ ID NO: 544439 - protein, 10 aa, Mycobacterium
PQLTRATAEL

SEQ ID NO: 544440 - protein, 10 aa, Mycobacterium
PQLTSADQQR

SEQ ID NO: 544441 - protein, 15 aa, Mycobacterium
PQMPEQSANPRPDEF

SEQ ID NO: 544442 - protein, 5 aa, Mycobacterium
PQMQQ

SEQ ID NO: 544443 - protein, 4 aa, Mycobacterium
PQMT

SEQ ID NO: 544444 - protein, 24 aa, Mycobacterium
PQMTTPPTAQAQQAVQKGADQGAQ

SEQ ID NO: 544445 - protein, 4 aa, Mycobacterium
PQNF

SEQ ID NO: 544446 - protein, 7 aa, Mycobacterium
PQNGNYG

SEQ ID NO: 544447 - protein, 8 aa, Mycobacterium
PQNKAERT

SEQ ID NO: 544448 - protein, 8 aa, Mycobacterium
PQNPYPAG

SEQ ID NO: 544449 - protein, 6 aa, Mycobacterium
PQNPYS

SEQ ID NO: 544450 - protein, 11 aa, Mycobacterium
PQNRGTGRTAR

SEQ ID NO: 544451 - protein, 10 aa, Mycobacterium
PQNRSERQAI

SEQ ID NO: 544452 - protein, 11 aa, Mycobacterium
PQPAAKTPAQV

SEQ ID NO: 544453 - protein, 7 aa, Mycobacterium
PQPADAE

SEQ ID NO: 544454 - protein, 5 aa, Mycobacterium
PQPAP

SEQ ID NO: 544455 - protein, 6 aa, Mycobacterium
PQPAPL

SEQ ID NO: 544456 - protein, 5 aa, Mycobacterium
PQPAQ

SEQ ID NO: 544457 - protein, 10 aa, Mycobacterium
PQPAQHGGSY

SEQ ID NO: 544458 - protein, 21 aa, Mycobacterium
PQPARRVDDADDRLAPDDAAA

SEQ ID NO: 544459 - protein, 9 aa, Mycobacterium
PQPATPEAV

SEQ ID NO: 544460 - protein, 14 aa, Mycobacterium
PQPDATDPDSGERY

SEQ ID NO: 544461 - protein, 7 aa, Mycobacterium
PQPDDER

SEQ ID NO: 544462 - protein, 16 aa, Mycobacterium
PQPDDHGLGASSGSPL

SEQ ID NO: 544463 - protein, 10 aa, Mycobacterium
PQPDFDGRTP

SEQ ID NO: 544464 - protein, 12 aa, Mycobacterium
PQPEHFADPDKG

SEQ ID NO: 544465 - protein, 10 aa, Mycobacterium
PQPEKGTEFH

SEQ ID NO: 544466 - protein, 13 aa, Mycobacterium
PQPEQWGGGGQPY

SEQ ID NO: 544467 - protein, 19 aa, Mycobacterium
PQPESVPADEAPAQVAPVE

SEQ ID NO: 544468 - protein, 5 aa, Mycobacterium
PQPET

SEQ ID NO: 544469 - protein, 5 aa, Mycobacterium
PQPEY

SEQ ID NO: 544470 - protein, 5 aa, Mycobacterium
PQPFG

SEQ ID NO: 544471 - protein, 7 aa, Mycobacterium
PQPGGDA

SEQ ID NO: 544472 - protein, 16 aa, Mycobacterium
PQPGGGLAPGAPGAAD

SEQ ID NO: 544473 - protein, 13 aa, Mycobacterium
PQPGGSIEEDGAL

SEQ ID NO: 544474 - protein, 5 aa, Mycobacterium
PQPGH

SEQ ID NO: 544475 - protein, 8 aa, Mycobacterium
PQPGMAGN

SEQ ID NO: 544476 - protein, 10 aa, Mycobacterium
PQPGPSTSDI

SEQ ID NO: 544477 - protein, 10 aa, Mycobacterium
PQPGPTTSEI

SEQ ID NO: 544478 - protein, 11 aa, Mycobacterium
PQPGRTDADRN

SEQ ID NO: 544479 - protein, 6 aa, Mycobacterium
PQPGTT

SEQ ID NO: 544480 - protein, 19 aa, Mycobacterium
PQPHVPAEQPAHHEPPSPS

SEQ ID NO: 544481 - protein, 6 aa, Mycobacterium
PQPINR

SEQ ID NO: 544482 - protein, 5 aa, Mycobacterium
PQPIP

SEQ ID NO: 544483 - protein, 6 aa, Mycobacterium
PQPKRA

SEQ ID NO: 544484 - protein, 9 aa, Mycobacterium
PQPKTRSAE

SEQ ID NO: 544485 - protein, 4 aa, Mycobacterium
PQPL

SEQ ID NO: 544486 - protein, 11 aa, Mycobacterium
PQPLDTSRDRR

SEQ ID NO: 544487 - protein, 7 aa, Mycobacterium
PQPLQPW

SEQ ID NO: 544488 - protein, 8 aa, Mycobacterium
PQPLQSKT

SEQ ID NO: 544489 - protein, 10 aa, Mycobacterium
PQPLTDRRYS

SEQ ID NO: 544490 - protein, 4 aa, Mycobacterium
PQPN

SEQ ID NO: 544491 - protein, 7 aa, Mycobacterium
PQPNELP

SEQ ID NO: 544492 - protein, 19 aa, Mycobacterium
PQPPAHRQRQRSVHPQPVR

SEQ ID NO: 544493 - protein, 9 aa, Mycobacterium
PQPPAPDHP

SEQ ID NO: 544494 - protein, 8 aa, Mycobacterium
PQPPEENM

SEQ ID NO: 544495 - protein, 7 aa, Mycobacterium
PQPPFDA

SEQ ID NO: 544496 - protein, 8 aa, Mycobacterium
PQPPFDSG

SEQ ID NO: 544497 - protein, 8 aa, Mycobacterium
PQPPFNTG

SEQ ID NO: 544498 - protein, 5 aa, Mycobacterium
PQPPL

SEQ ID NO: 544499 - protein, 15 aa, Mycobacterium
PQPPLDGDVADRRSK

SEQ ID NO: 544500 - protein, 7 aa, Mycobacterium
PQPPPVA

SEQ ID NO: 544501 - protein, 18 aa, Mycobacterium
PQPPRPGGASSPSPPLDL

SEQ ID NO: 544502 - protein, 13 aa, Mycobacterium
PQPPSHRQRQRTV

SEQ ID NO: 544503 - protein, 19 aa, Mycobacterium
PQPPTEPDLTAPDSVTGQV

SEQ ID NO: 544504 - protein, 6 aa, Mycobacterium
PQPPVA

SEQ ID NO: 544505 - protein, 7 aa, Mycobacterium
PQPPVAA

SEQ ID NO: 544506 - protein, 42 aa, Mycobacterium
PQPPVPPPPSPSPGKPPLGQPPIPPWASPPPPPSLQATRDAY

SEQ ID NO: 544507 - protein, 8 aa, Mycobacterium
PQPPYGQG

SEQ ID NO: 544508 - protein, 7 aa, Mycobacterium
PQPQAED

SEQ ID NO: 544509 - protein, 5 aa, Mycobacterium
PQPQK

SEQ ID NO: 544510 - protein, 20 aa, Mycobacterium
PQPQPAAVQPVQQAAPEVTP

SEQ ID NO: 544511 - protein, 20 aa, Mycobacterium
PQPQPDGSEKVRYDFVLDPE

SEQ ID NO: 544512 - protein, 13 aa, Mycobacterium
PQPQPDSSSVETA

SEQ ID NO: 544513 - protein, 4 aa, Mycobacterium
PQPR

SEQ ID NO: 544514 - protein, 10 aa, Mycobacterium
PQPRPPRDTW

SEQ ID NO: 544515 - protein, 12 aa, Mycobacterium
PQPRPPRDTWES

SEQ ID NO: 544516 - protein, 17 aa, Mycobacterium
PQPRPPRETWDSNPYYS

SEQ ID NO: 544517 - protein, 14 aa, Mycobacterium
PQPRPPRETWPDNP

SEQ ID NO: 544518 - protein, 11 aa, Mycobacterium
PQPRPPRETWS

SEQ ID NO: 544519 - protein, 8 aa, Mycobacterium
PQPRQTDL

SEQ ID NO: 544520 - protein, 4 aa, Mycobacterium
PQPS

SEQ ID NO: 544521 - protein, 11 aa, Mycobacterium
PQPSAGTPEQI

SEQ ID NO: 544522 - protein, 5 aa, Mycobacterium
PQPSG

SEQ ID NO: 544523 - protein, 6 aa, Mycobacterium
PQPSGI

SEQ ID NO: 544524 - protein, 6 aa, Mycobacterium
PQPSHY

SEQ ID NO: 544525 - protein, 9 aa, Mycobacterium
PQPSPELKA

SEQ ID NO: 544526 - protein, 5 aa, Mycobacterium
PQPTG

SEQ ID NO: 544527 - protein, 8 aa, Mycobacterium
PQPTGAVG

SEQ ID NO: 544528 - protein, 4 aa, Mycobacterium
PQPV

SEQ ID NO: 544529 - protein, 8 aa, Mycobacterium
PQPVDGDV

SEQ ID NO: 544530 - protein, 9 aa, Mycobacterium
PQPVDPETV

SEQ ID NO: 544531 - protein, 5 aa, Mycobacterium
PQQAA

SEQ ID NO: 544532 - protein, 13 aa, Mycobacterium
PQQATNPSGLAAQ

SEQ ID NO: 544533 - protein, 14 aa, Mycobacterium
PQQDPPHRQAGSSE

SEQ ID NO: 544534 - protein, 6 aa, Mycobacterium
PQQDPY

SEQ ID NO: 544535 - protein, 7 aa, Mycobacterium
PQQETSG

SEQ ID NO: 544536 - protein, 13 aa, Mycobacterium
PQQFADNMNQATS

SEQ ID NO: 544537 - protein, 18 aa, Mycobacterium
PQQGKTLAEHPDFPGRDL

SEQ ID NO: 544538 - protein, 5 aa, Mycobacterium
PQQIP

SEQ ID NO: 544539 - protein, 6 aa, Mycobacterium
PQQIRD

SEQ ID NO: 544540 - protein, 7 aa, Mycobacterium
PQQLPQV

SEQ ID NO: 544541 - protein, 18 aa, Mycobacterium
PQQLPQVSQGTHPEPVDA

SEQ ID NO: 544542 - protein, 19 aa, Mycobacterium
PQQLPQVSQGTHPEPVDGS

SEQ ID NO: 544543 - protein, 6 aa, Mycobacterium
PQQLTG

SEQ ID NO: 544544 - protein, 4 aa, Mycobacterium
PQQM

SEQ ID NO: 544545 - protein, 15 aa, Mycobacterium
PQQMPPAALDSAKSI

SEQ ID NO: 544546 - protein, 4 aa, Mycobacterium
PQQN

SEQ ID NO: 544547 - protein, 6 aa, Mycobacterium
PQQNTS

SEQ ID NO: 544548 - protein, 5 aa, Mycobacterium
PQQNW

SEQ ID NO: 544549 - protein, 7 aa, Mycobacterium
PQQPADI

SEQ ID NO: 544550 - protein, 5 aa, Mycobacterium
PQQPG

SEQ ID NO: 544551 - protein, 6 aa, Mycobacterium
PQQPGQ

SEQ ID NO: 544552 - protein, 6 aa, Mycobacterium
PQQPKV

SEQ ID NO: 544553 - protein, 5 aa, Mycobacterium
PQQRQ

SEQ ID NO: 544554 - protein, 6 aa, Mycobacterium
PQQSVS

SEQ ID NO: 544555 - protein, 15 aa, Mycobacterium
PQQTEHALSTGTTTL

SEQ ID NO: 544556 - protein, 35 aa, Mycobacterium
PQQTTITAGTSIAANTGEAGATSPAYATNTEQSGI

SEQ ID NO: 544557 - protein, 7 aa, Mycobacterium
PQQVPAG

SEQ ID NO: 544558 - protein, 5 aa, Mycobacterium
PQQWA

SEQ ID NO: 544559 - protein, 6 aa, Mycobacterium
PQQWDE

SEQ ID NO: 544560 - protein, 4 aa, Mycobacterium
PQRA

SEQ ID NO: 544561 - protein, 35 aa, Mycobacterium
PQRAADIATDAAKPAEKSPTTKPKRIGPEKLTGAQ

SEQ ID NO: 544562 - protein, 10 aa, Mycobacterium
PQRADADAAN

SEQ ID NO: 544563 - protein, 8 aa, Mycobacterium
PQRAGGQR

SEQ ID NO: 544564 - protein, 11 aa, Mycobacterium
PQRAGHNRQRQ

SEQ ID NO: 544565 - protein, 14 aa, Mycobacterium
PQRAKSANIRRTPR

SEQ ID NO: 544566 - protein, 10 aa, Mycobacterium
PQRAKTANIR

SEQ ID NO: 544567 - protein, 10 aa, Mycobacterium
PQRAPEADAY

SEQ ID NO: 544568 - protein, 7 aa, Mycobacterium
PQRASSM

SEQ ID NO: 544569 - protein, 7 aa, Mycobacterium
PQRATPG

SEQ ID NO: 544570 - protein, 5 aa, Mycobacterium
PQRDA

SEQ ID NO: 544571 - protein, 10 aa, Mycobacterium
PQRDEQLSAT

SEQ ID NO: 544572 - protein, 10 aa, Mycobacterium
PQRDGGQRQY

SEQ ID NO: 544573 - protein, 4 aa, Mycobacterium
PQRE

SEQ ID NO: 544574 - protein, 11 aa, Mycobacterium
PQREDDADNPL

SEQ ID NO: 544575 - protein, 14 aa, Mycobacterium
PQRGAAALTEFWDS

SEQ ID NO: 544576 - protein, 13 aa, Mycobacterium
PQRGRISTSPLPE

SEQ ID NO: 544577 - protein, 5 aa, Mycobacterium
PQRGV

SEQ ID NO: 544578 - protein, 11 aa, Mycobacterium
PQRHEAGTPNV

SEQ ID NO: 544579 - protein, 12 aa, Mycobacterium
PQRHNAFSTDAR

SEQ ID NO: 544580 - protein, 5 aa, Mycobacterium
PQRIS

SEQ ID NO: 544581 - protein, 7 aa, Mycobacterium
PQRKDYD

SEQ ID NO: 544582 - protein, 5 aa, Mycobacterium
PQRKG

SEQ ID NO: 544583 - protein, 8 aa, Mycobacterium
PQRKPGEA

SEQ ID NO: 544584 - protein, 10 aa, Mycobacterium
PQRKPPPDDV

SEQ ID NO: 544585 - protein, 12 aa, Mycobacterium
PQRLPESLSTND

SEQ ID NO: 544586 - protein, 13 aa, Mycobacterium
PQRLPRQAWVYQP

SEQ ID NO: 544587 - protein, 5 aa, Mycobacterium
PQRMS

SEQ ID NO: 544588 - protein, 19 aa, Mycobacterium
PQRNRRTDDYRGDSARGRA

SEQ ID NO: 544589 - protein, 7 aa, Mycobacterium
PQRPDGS

SEQ ID NO: 544590 - protein, 12 aa, Mycobacterium
PQRPDPQPGTAG

SEQ ID NO: 544591 - protein, 12 aa, Mycobacterium
PQRPRESQSVSG

SEQ ID NO: 544592 - protein, 5 aa, Mycobacterium
PQRPV

SEQ ID NO: 544593 - protein, 10 aa, Mycobacterium
PQRPVGPPRV

SEQ ID NO: 544594 - protein, 15 aa, Mycobacterium
PQRQARQRRGQAEVP

SEQ ID NO: 544595 - protein, 21 aa, Mycobacterium
PQRRAAEPRGREAQVPDPEQP

SEQ ID NO: 544596 - protein, 12 aa, Mycobacterium
PQRRGRPTRPRV

SEQ ID NO: 544597 - protein, 8 aa, Mycobacterium
PQRRLGRR

SEQ ID NO: 544598 - protein, 5 aa, Mycobacterium
PQRRR

SEQ ID NO: 544599 - protein, 25 aa, Mycobacterium
PQRRRRKRHGSSTAPPTVTADAPNR

SEQ ID NO: 544600 - protein, 7 aa, Mycobacterium
PQRRSGA

SEQ ID NO: 544601 - protein, 7 aa, Mycobacterium
PQRRSGG

SEQ ID NO: 544602 - protein, 15 aa, Mycobacterium
PQRSPKVRGAAPDAG

SEQ ID NO: 544603 - protein, 4 aa, Mycobacterium
PQRT

SEQ ID NO: 544604 - protein, 14 aa, Mycobacterium
PQRTSGGGRRYSER

SEQ ID NO: 544605 - protein, 6 aa, Mycobacterium
PQRVET

SEQ ID NO: 544606 - protein, 13 aa, Mycobacterium
PQRVRSERVARGV

SEQ ID NO: 544607 - protein, 6 aa, Mycobacterium
PQRVSS

SEQ ID NO: 544608 - protein, 17 aa, Mycobacterium
PQRYAATQQRRSPDQTL

SEQ ID NO: 544609 - protein, 4 aa, Mycobacterium
PQSA

SEQ ID NO: 544610 - protein, 12 aa, Mycobacterium
PQSAIDDGSVPA

SEQ ID NO: 544611 - protein, 12 aa, Mycobacterium
PQSAIDDGSVTA

SEQ ID NO: 544612 - protein, 8 aa, Mycobacterium
PQSAIDNG

SEQ ID NO: 544613 - protein, 5 aa, Mycobacterium
PQSAL

SEQ ID NO: 544614 - protein, 4 aa, Mycobacterium
PQSD

SEQ ID NO: 544615 - protein, 9 aa, Mycobacterium
PQSDQPPVH

SEQ ID NO: 544616 - protein, 8 aa, Mycobacterium
PQSDVSYT

SEQ ID NO: 544617 - protein, 10 aa, Mycobacterium
PQSEDARAAD

SEQ ID NO: 544618 - protein, 10 aa, Mycobacterium
PQSEDSRAAD

SEQ ID NO: 544619 - protein, 7 aa, Mycobacterium
PQSEGLA

SEQ ID NO: 544620 - protein, 9 aa, Mycobacterium
PQSFSEDPI

SEQ ID NO: 544621 - protein, 8 aa, Mycobacterium
PQSGAPFA

SEQ ID NO: 544622 - protein, 5 aa, Mycobacterium
PQSGS

SEQ ID NO: 544623 - protein, 6 aa, Mycobacterium
PQSGSI

SEQ ID NO: 544624 - protein, 10 aa, Mycobacterium
PQSGSLATDV

SEQ ID NO: 544625 - protein, 10 aa, Mycobacterium
PQSITDKLES

SEQ ID NO: 544626 - protein, 7 aa, Mycobacterium
PQSNPAL

SEQ ID NO: 544627 - protein, 7 aa, Mycobacterium
PQSPAQP

SEQ ID NO: 544628 - protein, 8 aa, Mycobacterium
PQSPEPAR

SEQ ID NO: 544629 - protein, 9 aa, Mycobacterium
PQSPLGNAD

SEQ ID NO: 544630 - protein, 10 aa, Mycobacterium
PQSPQGEGFQ

SEQ ID NO: 544631 - protein, 6 aa, Mycobacterium
PQSPRN

SEQ ID NO: 544632 - protein, 15 aa, Mycobacterium
PQSPRQRGTNESTNG

SEQ ID NO: 544633 - protein, 5 aa, Mycobacterium
PQSPS

SEQ ID NO: 544634 - protein, 6 aa, Mycobacterium
PQSRGR

SEQ ID NO: 544635 - protein, 11 aa, Mycobacterium
PQSRIGATTEA

SEQ ID NO: 544636 - protein, 12 aa, Mycobacterium
PQSRIGATTEAQ

SEQ ID NO: 544637 - protein, 5 aa, Mycobacterium
PQSRR

SEQ ID NO: 544638 - protein, 9 aa, Mycobacterium
PQSRSELAA

SEQ ID NO: 544639 - protein, 12 aa, Mycobacterium
PQSSIKSGEGLA

SEQ ID NO: 544640 - protein, 11 aa, Mycobacterium
PQSSINSGEGL

SEQ ID NO: 544641 - protein, 4 aa, Mycobacterium
PQST

SEQ ID NO: 544642 - protein, 5 aa, Mycobacterium
PQSTA

SEQ ID NO: 544643 - protein, 7 aa, Mycobacterium
PQSTAEI

SEQ ID NO: 544644 - protein, 6 aa, Mycobacterium
PQSTAT

SEQ ID NO: 544645 - protein, 4 aa, Mycobacterium
PQSV

SEQ ID NO: 544646 - protein, 6 aa, Mycobacterium
PQSVGA

SEQ ID NO: 544647 - protein, 6 aa, Mycobacterium
PQSVNG

SEQ ID NO: 544648 - protein, 5 aa, Mycobacterium
PQSVR

SEQ ID NO: 544649 - protein, 10 aa, Mycobacterium
PQSWAGSPAI

SEQ ID NO: 544650 - protein, 14 aa, Mycobacterium
PQSWKKPKPRDDAE

SEQ ID NO: 544651 - protein, 18 aa, Mycobacterium
PQSWKKPKPRDDAEALKA

SEQ ID NO: 544652 - protein, 18 aa, Mycobacterium
PQSWKKPKPRDDAETLKA

SEQ ID NO: 544653 - protein, 14 aa, Mycobacterium
PQSWKKPKPREDAE

SEQ ID NO: 544654 - protein, 6 aa, Mycobacterium
PQSYNV

SEQ ID NO: 544655 - protein, 6 aa, Mycobacterium
PQTAEQ

SEQ ID NO: 544656 - protein, 11 aa, Mycobacterium
PQTAGSVTNRI

SEQ ID NO: 544657 - protein, 45 aa, Mycobacterium
PQTAHPEEHDAPPPVGAEPPTAENPGKLDPEPGYTALPKWVQKSG

SEQ ID NO: 544658 - protein, 18 aa, Mycobacterium
PQTASRSSTATAIPRDPR

SEQ ID NO: 544659 - protein, 8 aa, Mycobacterium
PQTATECP

SEQ ID NO: 544660 - protein, 6 aa, Mycobacterium
PQTCAQ

SEQ ID NO: 544661 - protein, 4 aa, Mycobacterium
PQTD

SEQ ID NO: 544662 - protein, 5 aa, Mycobacterium
PQTDA

SEQ ID NO: 544663 - protein, 8 aa, Mycobacterium
PQTEALAT

SEQ ID NO: 544664 - protein, 13 aa, Mycobacterium
PQTERLQRFLSQV

SEQ ID NO: 544665 - protein, 14 aa, Mycobacterium
PQTFDGGDLRQAHE

SEQ ID NO: 544666 - protein, 7 aa, Mycobacterium
PQTGAGF

SEQ ID NO: 544667 - protein, 6 aa, Mycobacterium
PQTGAV

SEQ ID NO: 544668 - protein, 16 aa, Mycobacterium
PQTGGQKRVTASGDTL

SEQ ID NO: 544669 - protein, 12 aa, Mycobacterium
PQTLEPAPEETS

SEQ ID NO: 544670 - protein, 5 aa, Mycobacterium
PQTLQ

SEQ ID NO: 544671 - protein, 6 aa, Mycobacterium
PQTPAG

SEQ ID NO: 544672 - protein, 7 aa, Mycobacterium
PQTPAGG

SEQ ID NO: 544673 - protein, 8 aa, Mycobacterium
PQTPAGGH

SEQ ID NO: 544674 - protein, 7 aa, Mycobacterium
PQTPAGQ

SEQ ID NO: 544675 - protein, 10 aa, Mycobacterium
PQTPAGQQVT

SEQ ID NO: 544676 - protein, 7 aa, Mycobacterium
PQTPAGV

SEQ ID NO: 544677 - protein, 17 aa, Mycobacterium
PQTPPGGEGEKAANEDS

SEQ ID NO: 544678 - protein, 6 aa, Mycobacterium
PQTPYS

SEQ ID NO: 544679 - protein, 5 aa, Mycobacterium
PQTQA

SEQ ID NO: 544680 - protein, 24 aa, Mycobacterium
PQTQKEPDKEVRAPRARMTGTERR

SEQ ID NO: 544681 - protein, 7 aa, Mycobacterium
PQTRDAI

SEQ ID NO: 544682 - protein, 5 aa, Mycobacterium
PQTRE

SEQ ID NO: 544683 - protein, 5 aa, Mycobacterium
PQTSQ

SEQ ID NO: 544684 - protein, 6 aa, Mycobacterium
PQTSQL

SEQ ID NO: 544685 - protein, 6 aa, Mycobacterium
PQTSSV

SEQ ID NO: 544686 - protein, 5 aa, Mycobacterium
PQTST

SEQ ID NO: 544687 - protein, 4 aa, Mycobacterium
PQTT

SEQ ID NO: 544688 - protein, 6 aa, Mycobacterium
PQTTKD

SEQ ID NO: 544689 - protein, 19 aa, Mycobacterium
PQTTPTQESGPVRGVPSGI

SEQ ID NO: 544690 - protein, 4 aa, Mycobacterium
PQTV

SEQ ID NO: 544691 - protein, 5 aa, Mycobacterium
PQTVG

SEQ ID NO: 544692 - protein, 6 aa, Mycobacterium
PQTVGA

SEQ ID NO: 544693 - protein, 6 aa, Mycobacterium
PQTVPG

SEQ ID NO: 544694 - protein, 7 aa, Mycobacterium
PQTVSGQ

SEQ ID NO: 544695 - protein, 4 aa, Mycobacterium
PQVA

SEQ ID NO: 544696 - protein, 14 aa, Mycobacterium
PQVAQAKAAGDTDT

SEQ ID NO: 544697 - protein, 18 aa, Mycobacterium
PQVDQSARPPVQRRPRFD

SEQ ID NO: 544698 - protein, 18 aa, Mycobacterium
PQVEDPKAYTQAALDLLV

SEQ ID NO: 544699 - protein, 7 aa, Mycobacterium
PQVFPDP

SEQ ID NO: 544700 - protein, 4 aa, Mycobacterium
PQVG

SEQ ID NO: 544701 - protein, 9 aa, Mycobacterium
PQVGEGRKS

SEQ ID NO: 544702 - protein, 11 aa, Mycobacterium
PQVGKKAARRR

SEQ ID NO: 544703 - protein, 5 aa, Mycobacterium
PQVGP

SEQ ID NO: 544704 - protein, 5 aa, Mycobacterium
PQVHP

SEQ ID NO: 544705 - protein, 12 aa, Mycobacterium
PQVNGTQRPRLG

SEQ ID NO: 544706 - protein, 6 aa, Mycobacterium
PQVPGA

SEQ ID NO: 544707 - protein, 6 aa, Mycobacterium
PQVPGV

SEQ ID NO: 544708 - protein, 6 aa, Mycobacterium
PQVPRY

SEQ ID NO: 544709 - protein, 7 aa, Mycobacterium
PQVQEEI

SEQ ID NO: 544710 - protein, 4 aa, Mycobacterium
PQVS

SEQ ID NO: 544711 - protein, 8 aa, Mycobacterium
PQVSDDDV

SEQ ID NO: 544712 - protein, 9 aa, Mycobacterium
PQVSDDDVD

SEQ ID NO: 544713 - protein, 11 aa, Mycobacterium
PQVSDPARYGE

SEQ ID NO: 544714 - protein, 8 aa, Mycobacterium
PQVSGRYT

SEQ ID NO: 544715 - protein, 15 aa, Mycobacterium
PQVSNASANPQLSRD

SEQ ID NO: 544716 - protein, 5 aa, Mycobacterium
PQVSP

SEQ ID NO: 544717 - protein, 4 aa, Mycobacterium
PQVT

SEQ ID NO: 544718 - protein, 5 aa, Mycobacterium
PQVTA

SEQ ID NO: 544719 - protein, 14 aa, Mycobacterium
PQVTGDKAAARDRF

SEQ ID NO: 544720 - protein, 11 aa, Mycobacterium
PQVTGTQRQRL

SEQ ID NO: 544721 - protein, 4 aa, Mycobacterium
PQVV

SEQ ID NO: 544722 - protein, 4 aa, Mycobacterium
PQWE

SEQ ID NO: 544723 - protein, 7 aa, Mycobacterium
PQWQPRA

SEQ ID NO: 544724 - protein, 9 aa, Mycobacterium
PQWSPAQRE

SEQ ID NO: 544725 - protein, 7 aa, Mycobacterium
PQYAPAA

SEQ ID NO: 544726 - protein, 8 aa, Mycobacterium
PQYGGTEM

SEQ ID NO: 544727 - protein, 6 aa, Mycobacterium
PQYQPM

SEQ ID NO: 544728 - protein, 5 aa, Mycobacterium
PQYSP

SEQ ID NO: 544729 - protein, 7 aa, Mycobacterium
PQYTPYS

SEQ ID NO: 544730 - protein, 11 aa, Mycobacterium
PRAAANSADDE

SEQ ID NO: 544731 - protein, 11 aa, Mycobacterium
PRAAAQYNTRR

SEQ ID NO: 544732 - protein, 5 aa, Mycobacterium
PRAAG

SEQ ID NO: 544733 - protein, 7 aa, Mycobacterium
PRAAGIA

SEQ ID NO: 544734 - protein, 15 aa, Mycobacterium
PRAAGSESVGEPART

SEQ ID NO: 544735 - protein, 20 aa, Mycobacterium
PRAAGVSEASRGRSGQGRLA

SEQ ID NO: 544736 - protein, 12 aa, Mycobacterium
PRAAHQREGHER

SEQ ID NO: 544737 - protein, 15 aa, Mycobacterium
PRAALGDSAAHGPDD

SEQ ID NO: 544738 - protein, 8 aa, Mycobacterium
PRAAQRPS

SEQ ID NO: 544739 - protein, 8 aa, Mycobacterium
PRAAQRVS

SEQ ID NO: 544740 - protein, 11 aa, Mycobacterium
PRAAQYDDPDR

SEQ ID NO: 544741 - protein, 8 aa, Mycobacterium
PRAAREEL

SEQ ID NO: 544742 - protein, 14 aa, Mycobacterium
PRAATAHPSPPRAQ

SEQ ID NO: 544743 - protein, 9 aa, Mycobacterium
PRAATEDAE

SEQ ID NO: 544744 - protein, 9 aa, Mycobacterium
PRAATQADG

SEQ ID NO: 544745 - protein, 5 aa, Mycobacterium
PRADA

SEQ ID NO: 544746 - protein, 7 aa, Mycobacterium
PRADEPV

SEQ ID NO: 544747 - protein, 9 aa, Mycobacterium
PRADGERGS

SEQ ID NO: 544748 - protein, 10 aa, Mycobacterium
PRADGTPAPV

SEQ ID NO: 544749 - protein, 37 aa, Mycobacterium
PRADHTPDLRPEKELPPTSTAKHQVEGNQPIPLRGID

SEQ ID NO: 544750 - protein, 9 aa, Mycobacterium
PRADPGLPW

SEQ ID NO: 544751 - protein, 6 aa, Mycobacterium
PRADPQ

SEQ ID NO: 544752 - protein, 6 aa, Mycobacterium
PRADQA

SEQ ID NO: 544753 - protein, 9 aa, Mycobacterium
PRADSVPDD

SEQ ID NO: 544754 - protein, 14 aa, Mycobacterium
PRAEDKPPVPEDLD

SEQ ID NO: 544755 - protein, 9 aa, Mycobacterium
PRAEGERGS

SEQ ID NO: 544756 - protein, 5 aa, Mycobacterium
PRAEL

SEQ ID NO: 544757 - protein, 8 aa, Mycobacterium
PRAEPGAN

SEQ ID NO: 544758 - protein, 5 aa, Mycobacterium
PRAER

SEQ ID NO: 544759 - protein, 10 aa, Mycobacterium
PRAERSDRVD

SEQ ID NO: 544760 - protein, 16 aa, Mycobacterium
PRAESAPTNVPDDLDP

SEQ ID NO: 544761 - protein, 5 aa, Mycobacterium
PRAFP

SEQ ID NO: 544762 - protein, 7 aa, Mycobacterium
PRAGADD

SEQ ID NO: 544763 - protein, 6 aa, Mycobacterium
PRAGAS

SEQ ID NO: 544764 - protein, 13 aa, Mycobacterium
PRAGDGGVGSDRI

SEQ ID NO: 544765 - protein, 8 aa, Mycobacterium
PRAGDHVD

SEQ ID NO: 544766 - protein, 11 aa, Mycobacterium
PRAGEGVGAPR

SEQ ID NO: 544767 - protein, 5 aa, Mycobacterium
PRAGL

SEQ ID NO: 544768 - protein, 6 aa, Mycobacterium
PRAGLS

SEQ ID NO: 544769 - protein, 11 aa, Mycobacterium
PRAGPPPPPAI

SEQ ID NO: 544770 - protein, 5 aa, Mycobacterium
PRAGQ

SEQ ID NO: 544771 - protein, 13 aa, Mycobacterium
PRAGQGVGAPRIR

SEQ ID NO: 544772 - protein, 12 aa, Mycobacterium
PRAGQTAKRLEA

SEQ ID NO: 544773 - protein, 7 aa, Mycobacterium
PRAGRSV

SEQ ID NO: 544774 - protein, 6 aa, Mycobacterium
PRAGRT

SEQ ID NO: 544775 - protein, 8 aa, Mycobacterium
PRAGSGKL

SEQ ID NO: 544776 - protein, 15 aa, Mycobacterium
PRAGTSVATVPPEKV

SEQ ID NO: 544777 - protein, 7 aa, Mycobacterium
PRAGVAD

SEQ ID NO: 544778 - protein, 6 aa, Mycobacterium
PRAGVG

SEQ ID NO: 544779 - protein, 9 aa, Mycobacterium
PRAHKASEA

SEQ ID NO: 544780 - protein, 8 aa, Mycobacterium
PRAHQAAE

SEQ ID NO: 544781 - protein, 9 aa, Mycobacterium
PRAIDNPKD

SEQ ID NO: 544782 - protein, 5 aa, Mycobacterium
PRAIG

SEQ ID NO: 544783 - protein, 8 aa, Mycobacterium
PRAKLSRR

SEQ ID NO: 544784 - protein, 10 aa, Mycobacterium
PRAKTDEDKL

SEQ ID NO: 544785 - protein, 5 aa, Mycobacterium
PRALG

SEQ ID NO: 544786 - protein, 11 aa, Mycobacterium
PRALKRDPASI

SEQ ID NO: 544787 - protein, 8 aa, Mycobacterium
PRALPGSA

SEQ ID NO: 544788 - protein, 6 aa, Mycobacterium
PRALQA

SEQ ID NO: 544789 - protein, 15 aa, Mycobacterium
PRANRTAEANGAEDA

SEQ ID NO: 544790 - protein, 8 aa, Mycobacterium
PRAPEHGA

SEQ ID NO: 544791 - protein, 6 aa, Mycobacterium
PRAPEM

SEQ ID NO: 544792 - protein, 15 aa, Mycobacterium
PRAPRDVRASGKEKS

SEQ ID NO: 544793 - protein, 14 aa, Mycobacterium
PRAPRLADADPASA

SEQ ID NO: 544794 - protein, 4 aa, Mycobacterium
PRAQ

SEQ ID NO: 544795 - protein, 9 aa, Mycobacterium
PRAQGRGLG

SEQ ID NO: 544796 - protein, 18 aa, Mycobacterium
PRAQGSPRLAGRSARNYP

SEQ ID NO: 544797 - protein, 15 aa, Mycobacterium
PRAQRTERPAPRPAP

SEQ ID NO: 544798 - protein, 4 aa, Mycobacterium
PRAR

SEQ ID NO: 544799 - protein, 14 aa, Mycobacterium
PRARAAALASAGGR

SEQ ID NO: 544800 - protein, 7 aa, Mycobacterium
PRARAGW

SEQ ID NO: 544801 - protein, 7 aa, Mycobacterium
PRAREAD

SEQ ID NO: 544802 - protein, 8 aa, Mycobacterium
PRAREEGL

SEQ ID NO: 544803 - protein, 8 aa, Mycobacterium
PRARGLPK

SEQ ID NO: 544804 - protein, 15 aa, Mycobacterium
PRARGRPKGAAFPSE

SEQ ID NO: 544805 - protein, 15 aa, Mycobacterium
PRARGRPYGAAFPSE

SEQ ID NO: 544806 - protein, 8 aa, Mycobacterium
PRARSRQK

SEQ ID NO: 544807 - protein, 10 aa, Mycobacterium
PRARTRRDGV

SEQ ID NO: 544808 - protein, 4 aa, Mycobacterium
PRAS

SEQ ID NO: 544809 - protein, 12 aa, Mycobacterium
PRASDLTAERDT

SEQ ID NO: 544810 - protein, 7 aa, Mycobacterium
PRASMPE

SEQ ID NO: 544811 - protein, 15 aa, Mycobacterium
PRASNASKSTQFNGR

SEQ ID NO: 544812 - protein, 9 aa, Mycobacterium
PRASQAHPI

SEQ ID NO: 544813 - protein, 6 aa, Mycobacterium
PRASRL

SEQ ID NO: 544814 - protein, 8 aa, Mycobacterium
PRATAAKF

SEQ ID NO: 544815 - protein, 11 aa, Mycobacterium
PRATAAKYDAP

SEQ ID NO: 544816 - protein, 11 aa, Mycobacterium
PRATAEKYDAP

SEQ ID NO: 544817 - protein, 6 aa, Mycobacterium
PRATAQ

SEQ ID NO: 544818 - protein, 5 aa, Mycobacterium
PRATG

SEQ ID NO: 544819 - protein, 12 aa, Mycobacterium
PRATIASGASLN

SEQ ID NO: 544820 - protein, 10 aa, Mycobacterium
PRATKPSPWR

SEQ ID NO: 544821 - protein, 9 aa, Mycobacterium
PRATKRNEE

SEQ ID NO: 544822 - protein, 5 aa, Mycobacterium
PRATP

SEQ ID NO: 544823 - protein, 8 aa, Mycobacterium
PRATQGNI

SEQ ID NO: 544824 - protein, 7 aa, Mycobacterium
PRATRAQ

SEQ ID NO: 544825 - protein, 59 aa, Mycobacterium
PRAVGGAGRRRRGRAPHRRRRDPRTGRGAARARKGPGIPGFGRPRGAGGGAVRAGGTPR

SEQ ID NO: 544826 - protein, 11 aa, Mycobacterium
PRCAPSDGDEL

SEQ ID NO: 544827 - protein, 6 aa, Mycobacterium
PRCGHD

SEQ ID NO: 544828 - protein, 9 aa, Mycobacterium
PRCSENRRQ

SEQ ID NO: 544829 - protein, 10 aa, Mycobacterium
PRDAATPSAC

SEQ ID NO: 544830 - protein, 6 aa, Mycobacterium
PRDADP

SEQ ID NO: 544831 - protein, 16 aa, Mycobacterium
PRDAGAGSWSDLIRHM

SEQ ID NO: 544832 - protein, 14 aa, Mycobacterium
PRDAGGRRRFSDDD

SEQ ID NO: 544833 - protein, 6 aa, Mycobacterium
PRDAPD

SEQ ID NO: 544834 - protein, 8 aa, Mycobacterium
PRDARLGS

SEQ ID NO: 544835 - protein, 14 aa, Mycobacterium
PRDASASDDEEPPP

SEQ ID NO: 544836 - protein, 18 aa, Mycobacterium
PRDDDRLTVQTDDGTRVE

SEQ ID NO: 544837 - protein, 5 aa, Mycobacterium
PRDDQ

SEQ ID NO: 544838 - protein, 6 aa, Mycobacterium
PRDDRG

SEQ ID NO: 544839 - protein, 21 aa, Mycobacterium
PRDDTGYGHSAAEVGKVRAPA

SEQ ID NO: 544840 - protein, 7 aa, Mycobacterium
PRDEAAE

SEQ ID NO: 544841 - protein, 14 aa, Mycobacterium
PRDEAEHVEQPGRR

SEQ ID NO: 544842 - protein, 6 aa, Mycobacterium
PRDETA

SEQ ID NO: 544843 - protein, 11 aa, Mycobacterium
PRDEVSDEEYT

SEQ ID NO: 544844 - protein, 5 aa, Mycobacterium
PRDEW

SEQ ID NO: 544845 - protein, 8 aa, Mycobacterium
PRDFATGD

SEQ ID NO: 544846 - protein, 10 aa, Mycobacterium
PRDGARPSLA

SEQ ID NO: 544847 - protein, 5 aa, Mycobacterium
PRDGE

SEQ ID NO: 544848 - protein, 7 aa, Mycobacterium
PRDGEEV

SEQ ID NO: 544849 - protein, 7 aa, Mycobacterium
PRDGESC

SEQ ID NO: 544850 - protein, 8 aa, Mycobacterium
PRDGGNED

SEQ ID NO: 544851 - protein, 8 aa, Mycobacterium
PRDGGSAD

SEQ ID NO: 544852 - protein, 6 aa, Mycobacterium
PRDGGT

SEQ ID NO: 544853 - protein, 7 aa, Mycobacterium
PRDGGTA

SEQ ID NO: 544854 - protein, 7 aa, Mycobacterium
PRDGGTD

SEQ ID NO: 544855 - protein, 10 aa, Mycobacterium
PRDGGVGAPR

SEQ ID NO: 544856 - protein, 7 aa, Mycobacterium
PRDGQAM

SEQ ID NO: 544857 - protein, 17 aa, Mycobacterium
PRDGRFGCGPSKVRPEQ

SEQ ID NO: 544858 - protein, 8 aa, Mycobacterium
PRDGTPTT

SEQ ID NO: 544859 - protein, 14 aa, Mycobacterium
PRDIGERSLNDADT

SEQ ID NO: 544860 - protein, 7 aa, Mycobacterium
PRDKDPE

SEQ ID NO: 544861 - protein, 7 aa, Mycobacterium
PRDKNPD

SEQ ID NO: 544862 - protein, 6 aa, Mycobacterium
PRDLER

SEQ ID NO: 544863 - protein, 5 aa, Mycobacterium
PRDLG

SEQ ID NO: 544864 - protein, 7 aa, Mycobacterium
PRDLGEG

SEQ ID NO: 544865 - protein, 5 aa, Mycobacterium
PRDLS

SEQ ID NO: 544866 - protein, 16 aa, Mycobacterium
PRDLSANGAADAPGDL

SEQ ID NO: 544867 - protein, 14 aa, Mycobacterium
PRDLSGGNYPQVPS

SEQ ID NO: 544868 - protein, 7 aa, Mycobacterium
PRDLSPR

SEQ ID NO: 544869 - protein, 7 aa, Mycobacterium
PRDNPSD

SEQ ID NO: 544870 - protein, 7 aa, Mycobacterium
PRDPADP

SEQ ID NO: 544871 - protein, 5 aa, Mycobacterium
PRDPD

SEQ ID NO: 544872 - protein, 7 aa, Mycobacterium
PRDPHDA

SEQ ID NO: 544873 - protein, 8 aa, Mycobacterium
PRDPHDGD

SEQ ID NO: 544874 - protein, 29 aa, Mycobacterium
PRDPNGAPAITGNNGSAGPLGFPTSDVNT

SEQ ID NO: 544875 - protein, 8 aa, Mycobacterium
PRDPNGKL

SEQ ID NO: 544876 - protein, 6 aa, Mycobacterium
PRDPTV

SEQ ID NO: 544877 - protein, 13 aa, Mycobacterium
PRDQAPNGRFNRR

SEQ ID NO: 544878 - protein, 13 aa, Mycobacterium
PRDQASASRFNRR

SEQ ID NO: 544879 - protein, 13 aa, Mycobacterium
PRDQASATRFNRR

SEQ ID NO: 544880 - protein, 13 aa, Mycobacterium
PRDQASSTRRATR

SEQ ID NO: 544881 - protein, 5 aa, Mycobacterium
PRDRG

SEQ ID NO: 544882 - protein, 10 aa, Mycobacterium
PRDRGGSFEP

SEQ ID NO: 544883 - protein, 10 aa, Mycobacterium
PRDRPGEHER

SEQ ID NO: 544884 - protein, 7 aa, Mycobacterium
PRDRRPR

SEQ ID NO: 544885 - protein, 18 aa, Mycobacterium
PRDSHGRRHPDSRVRRRD

SEQ ID NO: 544886 - protein, 5 aa, Mycobacterium
PRDSL

SEQ ID NO: 544887 - protein, 5 aa, Mycobacterium
PRDST

SEQ ID NO: 544888 - protein, 4 aa, Mycobacterium
PRDT

SEQ ID NO: 544889 - protein, 5 aa, Mycobacterium
PRDTT

SEQ ID NO: 544890 - protein, 7 aa, Mycobacterium
PRDTTLG

SEQ ID NO: 544891 - protein, 10 aa, Mycobacterium
PRDVAGRLPS

SEQ ID NO: 544892 - protein, 6 aa, Mycobacterium
PRDVGE

SEQ ID NO: 544893 - protein, 8 aa, Mycobacterium
PRDVTSAE

SEQ ID NO: 544894 - protein, 6 aa, Mycobacterium
PRDWDQ

SEQ ID NO: 544895 - protein, 4 aa, Mycobacterium
PREA

SEQ ID NO: 544896 - protein, 10 aa, Mycobacterium
PREAAAMDPR

SEQ ID NO: 544897 - protein, 11 aa, Mycobacterium
PREAAAMDPRQ

SEQ ID NO: 544898 - protein, 18 aa, Mycobacterium
PREAEQLPIPPPALAGGG

SEQ ID NO: 544899 - protein, 10 aa, Mycobacterium
PREAPWEATQ

SEQ ID NO: 544900 - protein, 11 aa, Mycobacterium
PREAREPGGKT

SEQ ID NO: 544901 - protein, 10 aa, Mycobacterium
PREATSMDPQ

SEQ ID NO: 544902 - protein, 7 aa, Mycobacterium
PREAVGD

SEQ ID NO: 544903 - protein, 13 aa, Mycobacterium
PREDGAGGDPEFR

SEQ ID NO: 544904 - protein, 16 aa, Mycobacterium
PREDQKPAVPDDLDPD

SEQ ID NO: 544905 - protein, 8 aa, Mycobacterium
PREDRTQF

SEQ ID NO: 544906 - protein, 7 aa, Mycobacterium
PREDSAR

SEQ ID NO: 544907 - protein, 15 aa, Mycobacterium
PREDSGATASVPQDL

SEQ ID NO: 544908 - protein, 4 aa, Mycobacterium
PREE

SEQ ID NO: 544909 - protein, 10 aa, Mycobacterium
PREEGGGGAT

SEQ ID NO: 544910 - protein, 5 aa, Mycobacterium
PREEW

SEQ ID NO: 544911 - protein, 11 aa, Mycobacterium
PREGDDASRHA

SEQ ID NO: 544912 - protein, 12 aa, Mycobacterium
PREGEQPNQRQK

SEQ ID NO: 544913 - protein, 6 aa, Mycobacterium
PREGGI

SEQ ID NO: 544914 - protein, 8 aa, Mycobacterium
PREGGNRD

SEQ ID NO: 544915 - protein, 8 aa, Mycobacterium
PREGGNSD

SEQ ID NO: 544916 - protein, 8 aa, Mycobacterium
PREGRTYP

SEQ ID NO: 544917 - protein, 9 aa, Mycobacterium
PREGTRPTL

SEQ ID NO: 544918 - protein, 13 aa, Mycobacterium
PREHGAQSGQPNV

SEQ ID NO: 544919 - protein, 8 aa, Mycobacterium
PREHGGRS

SEQ ID NO: 544920 - protein, 4 aa, Mycobacterium
PREI

SEQ ID NO: 544921 - protein, 4 aa, Mycobacterium
PREK

SEQ ID NO: 544922 - protein, 7 aa, Mycobacterium
PREPADP

SEQ ID NO: 544923 - protein, 8 aa, Mycobacterium
PREPAVGG

SEQ ID NO: 544924 - protein, 12 aa, Mycobacterium
PREPSAQKSGGK

SEQ ID NO: 544925 - protein, 6 aa, Mycobacterium
PREQAT

SEQ ID NO: 544926 - protein, 5 aa, Mycobacterium
PREQP

SEQ ID NO: 544927 - protein, 4 aa, Mycobacterium
PRER

SEQ ID NO: 544928 - protein, 7 aa, Mycobacterium
PRERGRY

SEQ ID NO: 544929 - protein, 8 aa, Mycobacterium
PRERPSFS

SEQ ID NO: 544930 - protein, 8 aa, Mycobacterium
PRERPSFT

SEQ ID NO: 544931 - protein, 7 aa, Mycobacterium
PRERPTC

SEQ ID NO: 544932 - protein, 6 aa, Mycobacterium
PRERRR

SEQ ID NO: 544933 - protein, 4 aa, Mycobacterium
PRES

SEQ ID NO: 544934 - protein, 6 aa, Mycobacterium
PRESGR

SEQ ID NO: 544935 - protein, 7 aa, Mycobacterium
PRESPID

SEQ ID NO: 544936 - protein, 13 aa, Mycobacterium
PRESSASARTGGA

SEQ ID NO: 544937 - protein, 16 aa, Mycobacterium
PRESSEPTSSVPADLD

SEQ ID NO: 544938 - protein, 7 aa, Mycobacterium
PRETDRT

SEQ ID NO: 544939 - protein, 15 aa, Mycobacterium
PRETGLPRGNPLGVA

SEQ ID NO: 544940 - protein, 5 aa, Mycobacterium
PRETR

SEQ ID NO: 544941 - protein, 4 aa, Mycobacterium
PREY

SEQ ID NO: 544942 - protein, 13 aa, Mycobacterium
PRFATNPDRVAHR

SEQ ID NO: 544943 - protein, 4 aa, Mycobacterium
PRFD

SEQ ID NO: 544944 - protein, 5 aa, Mycobacterium
PRFDQ

SEQ ID NO: 544945 - protein, 4 aa, Mycobacterium
PRFE

SEQ ID NO: 544946 - protein, 8 aa, Mycobacterium
PRFEPARQ

SEQ ID NO: 544947 - protein, 8 aa, Mycobacterium
PRFGDESS

SEQ ID NO: 544948 - protein, 9 aa, Mycobacterium
PRFGGTKRR

SEQ ID NO: 544949 - protein, 5 aa, Mycobacterium
PRFGV

SEQ ID NO: 544950 - protein, 11 aa, Mycobacterium
PRFLPPGDLPA

SEQ ID NO: 544951 - protein, 14 aa, Mycobacterium
PRFSNSDSQTSSEY

SEQ ID NO: 544952 - protein, 11 aa, Mycobacterium
PRFSSAPGTVG

SEQ ID NO: 544953 - protein, 6 aa, Mycobacterium
PRFTPP

SEQ ID NO: 544954 - protein, 5 aa, Mycobacterium
PRGAA

SEQ ID NO: 544955 - protein, 9 aa, Mycobacterium
PRGAGKTHT

SEQ ID NO: 544956 - protein, 7 aa, Mycobacterium
PRGAGPA

SEQ ID NO: 544957 - protein, 15 aa, Mycobacterium
PRGAGSGLSGGASAV

SEQ ID NO: 544958 - protein, 14 aa, Mycobacterium
PRGAGSGLSGGATA

SEQ ID NO: 544959 - protein, 15 aa, Mycobacterium
PRGARIDPGSPVPPS

SEQ ID NO: 544960 - protein, 26 aa, Mycobacterium
PRGARVPAPNQRRPYRPPARPSGETL

SEQ ID NO: 544961 - protein, 9 aa, Mycobacterium
PRGAVRGPA

SEQ ID NO: 544962 - protein, 8 aa, Mycobacterium
PRGDAVPG

SEQ ID NO: 544963 - protein, 16 aa, Mycobacterium
PRGDDGGADGRPAKPL

SEQ ID NO: 544964 - protein, 5 aa, Mycobacterium
PRGDE

SEQ ID NO: 544965 - protein, 9 aa, Mycobacterium
PRGDGPFGQ

SEQ ID NO: 544966 - protein, 10 aa, Mycobacterium
PRGDGPPEES

SEQ ID NO: 544967 - protein, 12 aa, Mycobacterium
PRGDTGYGHGAQ

SEQ ID NO: 544968 - protein, 7 aa, Mycobacterium
PRGDTQW

SEQ ID NO: 544969 - protein, 9 aa, Mycobacterium
PRGEAPDRN

SEQ ID NO: 544970 - protein, 6 aa, Mycobacterium
PRGEAT

SEQ ID NO: 544971 - protein, 15 aa, Mycobacterium
PRGEGDPSARRRQDL

SEQ ID NO: 544972 - protein, 8 aa, Mycobacterium
PRGEGPEK

SEQ ID NO: 544973 - protein, 10 aa, Mycobacterium
PRGERSIARG

SEQ ID NO: 544974 - protein, 6 aa, Mycobacterium
PRGETE

SEQ ID NO: 544975 - protein, 5 aa, Mycobacterium
PRGFE

SEQ ID NO: 544976 - protein, 7 aa, Mycobacterium
PRGFGDN

SEQ ID NO: 544977 - protein, 6 aa, Mycobacterium
PRGFGE

SEQ ID NO: 544978 - protein, 11 aa, Mycobacterium
PRGGEPDQESL

SEQ ID NO: 544979 - protein, 5 aa, Mycobacterium
PRGGF

SEQ ID NO: 544980 - protein, 7 aa, Mycobacterium
PRGGGAS

SEQ ID NO: 544981 - protein, 6 aa, Mycobacterium
PRGGGH

SEQ ID NO: 544982 - protein, 8 aa, Mycobacterium
PRGGGPSL

SEQ ID NO: 544983 - protein, 7 aa, Mycobacterium
PRGGGTS

SEQ ID NO: 544984 - protein, 7 aa, Mycobacterium
PRGGPVD

SEQ ID NO: 544985 - protein, 5 aa, Mycobacterium
PRGGT

SEQ ID NO: 544986 - protein, 13 aa, Mycobacterium
PRGGTAATEVPRT

SEQ ID NO: 544987 - protein, 4 aa, Mycobacterium
PRGH

SEQ ID NO: 544988 - protein, 6 aa, Mycobacterium
PRGHDA

SEQ ID NO: 544989 - protein, 5 aa, Mycobacterium
PRGHR

SEQ ID NO: 544990 - protein, 4 aa, Mycobacterium
PRGI

SEQ ID NO: 544991 - protein, 6 aa, Mycobacterium
PRGIPA

SEQ ID NO: 544992 - protein, 10 aa, Mycobacterium
PRGKAPIADV

SEQ ID NO: 544993 - protein, 16 aa, Mycobacterium
PRGKYFDGDGGSYPNR

SEQ ID NO: 544994 - protein, 8 aa, Mycobacterium
PRGLGSPD

SEQ ID NO: 544995 - protein, 29 aa, Mycobacterium
PRGNHRQGDHRGGEHGRGDQAGAKRVQPG

SEQ ID NO: 544996 - protein, 17 aa, Mycobacterium
PRGNTQWARNARAAGEI

SEQ ID NO: 544997 - protein, 10 aa, Mycobacterium
PRGPDSPTTP

SEQ ID NO: 544998 - protein, 10 aa, Mycobacterium
PRGPGGTKAF

SEQ ID NO: 544999 - protein, 8 aa, Mycobacterium
PRGPQGQV

SEQ ID NO: 545000 - protein, 8 aa, Mycobacterium
PRGPQSQV

SEQ ID NO: 545001 - protein, 8 aa, Mycobacterium
PRGPRGQV

SEQ ID NO: 545002 - protein, 6 aa, Mycobacterium
PRGPRL

SEQ ID NO: 545003 - protein, 6 aa, Mycobacterium
PRGPRR

SEQ ID NO: 545004 - protein, 9 aa, Mycobacterium
PRGPVDPTA

SEQ ID NO: 545005 - protein, 5 aa, Mycobacterium
PRGQT

SEQ ID NO: 545006 - protein, 6 aa, Mycobacterium
PRGRAA

SEQ ID NO: 545007 - protein, 11 aa, Mycobacterium
PRGRDGVGQPC

SEQ ID NO: 545008 - protein, 5 aa, Mycobacterium
PRGRG

SEQ ID NO: 545009 - protein, 22 aa, Mycobacterium
PRGRGRDRQGRQPSLYRTPGRA

SEQ ID NO: 545010 - protein, 20 aa, Mycobacterium
PRGRGRGGRPQFYRPPGRPE

SEQ ID NO: 545011 - protein, 20 aa, Mycobacterium
PRGRGRPPGGGNTAQQAQEQ

SEQ ID NO: 545012 - protein, 8 aa, Mycobacterium
PRGRNEQH

SEQ ID NO: 545013 - protein, 5 aa, Mycobacterium
PRGRQ

SEQ ID NO: 545014 - protein, 6 aa, Mycobacterium
PRGRRE

SEQ ID NO: 545015 - protein, 7 aa, Mycobacterium
PRGRRGA

SEQ ID NO: 545016 - protein, 12 aa, Mycobacterium
PRGRVTNADDAI

SEQ ID NO: 545017 - protein, 9 aa, Mycobacterium
PRGSAARFG

SEQ ID NO: 545018 - protein, 5 aa, Mycobacterium
PRGSG

SEQ ID NO: 545019 - protein, 9 aa, Mycobacterium
PRGSGHPPQ

SEQ ID NO: 545020 - protein, 17 aa, Mycobacterium
PRGSGPVAALPAGPAPV

SEQ ID NO: 545021 - protein, 6 aa, Mycobacterium
PRGSQL

SEQ ID NO: 545022 - protein, 11 aa, Mycobacterium
PRGSRTPASTG

SEQ ID NO: 545023 - protein, 5 aa, Mycobacterium
PRGSV

SEQ ID NO: 545024 - protein, 7 aa, Mycobacterium
PRGSVRE

SEQ ID NO: 545025 - protein, 5 aa, Mycobacterium
PRGTA

SEQ ID NO: 545026 - protein, 15 aa, Mycobacterium
PRGTATTPLQGGSGD

SEQ ID NO: 545027 - protein, 13 aa, Mycobacterium
PRGTAYRIAFRGD

SEQ ID NO: 545028 - protein, 8 aa, Mycobacterium
PRGTENQR

SEQ ID NO: 545029 - protein, 9 aa, Mycobacterium
PRGTPAAEI

SEQ ID NO: 545030 - protein, 7 aa, Mycobacterium
PRGTPGE

SEQ ID NO: 545031 - protein, 5 aa, Mycobacterium
PRGTS

SEQ ID NO: 545032 - protein, 16 aa, Mycobacterium
PRGTTAPTGANPPVLD

SEQ ID NO: 545033 - protein, 5 aa, Mycobacterium
PRGTW

SEQ ID NO: 545034 - protein, 4 aa, Mycobacterium
PRGV

SEQ ID NO: 545035 - protein, 7 aa, Mycobacterium
PRGVAGF

SEQ ID NO: 545036 - protein, 9 aa, Mycobacterium
PRGVGHSTP

SEQ ID NO: 545037 - protein, 15 aa, Mycobacterium
PRGVHSTMSDDRGRP

SEQ ID NO: 545038 - protein, 15 aa, Mycobacterium
PRGWRADNTDIDGVT

SEQ ID NO: 545039 - protein, 12 aa, Mycobacterium
PRGYAEDPDDKI

SEQ ID NO: 545040 - protein, 5 aa, Mycobacterium
PRGYD

SEQ ID NO: 545041 - protein, 13 aa, Mycobacterium
PRGYRGSRAGTVS

SEQ ID NO: 545042 - protein, 12 aa, Mycobacterium
PRHAAPQRQGLG

SEQ ID NO: 545043 - protein, 14 aa, Mycobacterium
PRHATVEKKPPVSV

SEQ ID NO: 545044 - protein, 5 aa, Mycobacterium
PRHEG

SEQ ID NO: 545045 - protein, 13 aa, Mycobacterium
PRHERTKAFLSTI

SEQ ID NO: 545046 - protein, 4 aa, Mycobacterium
PRHG

SEQ ID NO: 545047 - protein, 14 aa, Mycobacterium
PRHGADPPGDHEAL

SEQ ID NO: 545048 - protein, 12 aa, Mycobacterium
PRHKRDPGLSEE

SEQ ID NO: 545049 - protein, 4 aa, Mycobacterium
PRHN

SEQ ID NO: 545050 - protein, 8 aa, Mycobacterium
PRHPGARA

SEQ ID NO: 545051 - protein, 10 aa, Mycobacterium
PRHPGGGVDE

SEQ ID NO: 545052 - protein, 13 aa, Mycobacterium
PRHQETQAGQRER

SEQ ID NO: 545053 - protein, 4 aa, Mycobacterium
PRHR

SEQ ID NO: 545054 - protein, 12 aa, Mycobacterium
PRHRGRGAARVR

SEQ ID NO: 545055 - protein, 7 aa, Mycobacterium
PRHRREE

SEQ ID NO: 545056 - protein, 13 aa, Mycobacterium
PRHRREERSAIER

SEQ ID NO: 545057 - protein, 6 aa, Mycobacterium
PRHSPG

SEQ ID NO: 545058 - protein, 9 aa, Mycobacterium
PRHSTEGID

SEQ ID NO: 545059 - protein, 4 aa, Mycobacterium
PRHT

SEQ ID NO: 545060 - protein, 10 aa, Mycobacterium
PRHTAPATPG

SEQ ID NO: 545061 - protein, 5 aa, Mycobacterium
PRHTQ

SEQ ID NO: 545062 - protein, 6 aa, Mycobacterium
PRIAAE

SEQ ID NO: 545063 - protein, 7 aa, Mycobacterium
PRIADGE

SEQ ID NO: 545064 - protein, 5 aa, Mycobacterium
PRIAE

SEQ ID NO: 545065 - protein, 9 aa, Mycobacterium
PRIDEGAGR

SEQ ID NO: 545066 - protein, 10 aa, Mycobacterium
PRIDGGPGRR

SEQ ID NO: 545067 - protein, 27 aa, Mycobacterium
PRIDGPGSIGSQPSGLPARCPTNGSSR

SEQ ID NO: 545068 - protein, 12 aa, Mycobacterium
PRIDPDNPPFSV

SEQ ID NO: 545069 - protein, 18 aa, Mycobacterium
PRIDRQPPTALPAPEADG

SEQ ID NO: 545070 - protein, 20 aa, Mycobacterium
PRIENRSTKEQAITSPNGGF

SEQ ID NO: 545071 - protein, 15 aa, Mycobacterium
PRIGAGRGPRLIPSG

SEQ ID NO: 545072 - protein, 49 aa, Mycobacterium
PRIGDAGGADARGGRAARRGRRRPGRCGGVGAGAVGAGRASGPGGAGRL

SEQ ID NO: 545073 - protein, 10 aa, Mycobacterium
PRIGGSGGGL

SEQ ID NO: 545074 - protein, 7 aa, Mycobacterium
PRIGTAN

SEQ ID NO: 545075 - protein, 7 aa, Mycobacterium
PRIKTTQ

SEQ ID NO: 545076 - protein, 8 aa, Mycobacterium
PRIPADNG

SEQ ID NO: 545077 - protein, 7 aa, Mycobacterium
PRIPPSD

SEQ ID NO: 545078 - protein, 10 aa, Mycobacterium
PRIPQRPHEP

SEQ ID NO: 545079 - protein, 5 aa, Mycobacterium
PRIRD

SEQ ID NO: 545080 - protein, 25 aa, Mycobacterium
PRISSDISRSPASLGGEKPAPGSEH

SEQ ID NO: 545081 - protein, 27 aa, Mycobacterium
PRISSDITRSPSGFGGEAPQPEPGSEH

SEQ ID NO: 545082 - protein, 6 aa, Mycobacterium
PRISSG

SEQ ID NO: 545083 - protein, 4 aa, Mycobacterium
PRIT

SEQ ID NO: 545084 - protein, 12 aa, Mycobacterium
PRITPGGLSSQF

SEQ ID NO: 545085 - protein, 20 aa, Mycobacterium
PRITPRPAPTARPQLPRPGD

SEQ ID NO: 545086 - protein, 13 aa, Mycobacterium
PRITRAEAATDLG

SEQ ID NO: 545087 - protein, 8 aa, Mycobacterium
PRKAGGRG

SEQ ID NO: 545088 - protein, 8 aa, Mycobacterium
PRKDGGER

SEQ ID NO: 545089 - protein, 6 aa, Mycobacterium
PRKGEV

SEQ ID NO: 545090 - protein, 7 aa, Mycobacterium
PRKGQDT

SEQ ID NO: 545091 - protein, 4 aa, Mycobacterium
PRKM

SEQ ID NO: 545092 - protein, 12 aa, Mycobacterium
PRKPEPAPVRPG

SEQ ID NO: 545093 - protein, 13 aa, Mycobacterium
PRKPSRSERRDKT

SEQ ID NO: 545094 - protein, 5 aa, Mycobacterium
PRKQR

SEQ ID NO: 545095 - protein, 8 aa, Mycobacterium
PRKQSARA

SEQ ID NO: 545096 - protein, 8 aa, Mycobacterium
PRKQWPSG

SEQ ID NO: 545097 - protein, 12 aa, Mycobacterium
PRKRGGGQKRQS

SEQ ID NO: 545098 - protein, 11 aa, Mycobacterium
PRKRGGRRSPS

SEQ ID NO: 545099 - protein, 5 aa, Mycobacterium
PRKRN

SEQ ID NO: 545100 - protein, 9 aa, Mycobacterium
PRKRTSPDM

SEQ ID NO: 545101 - protein, 12 aa, Mycobacterium
PRKSLKAQGYWV

SEQ ID NO: 545102 - protein, 7 aa, Mycobacterium
PRKTAAE

SEQ ID NO: 545103 - protein, 8 aa, Mycobacterium
PRKTETAA

SEQ ID NO: 545104 - protein, 7 aa, Mycobacterium
PRKVTDR

SEQ ID NO: 545105 - protein, 6 aa, Mycobacterium
PRLDSG

SEQ ID NO: 545106 - protein, 6 aa, Mycobacterium
PRLEAD

SEQ ID NO: 545107 - protein, 16 aa, Mycobacterium
PRLEKEAKNKKDRQPL

SEQ ID NO: 545108 - protein, 16 aa, Mycobacterium
PRLEKEARNNKDRKPV

SEQ ID NO: 545109 - protein, 16 aa, Mycobacterium
PRLEKEARNNKERKPV

SEQ ID NO: 545110 - protein, 17 aa, Mycobacterium
PRLEKEARNNKERKPVH

SEQ ID NO: 545111 - protein, 5 aa, Mycobacterium
PRLGD

SEQ ID NO: 545112 - protein, 8 aa, Mycobacterium
PRLGDDSD

SEQ ID NO: 545113 - protein, 5 aa, Mycobacterium
PRLGG

SEQ ID NO: 545114 - protein, 7 aa, Mycobacterium
PRLGGDG

SEQ ID NO: 545115 - protein, 10 aa, Mycobacterium
PRLGKGPAKA

SEQ ID NO: 545116 - protein, 10 aa, Mycobacterium
PRLGPDDALP

SEQ ID NO: 545117 - protein, 11 aa, Mycobacterium
PRLLPDQPDVN

SEQ ID NO: 545118 - protein, 10 aa, Mycobacterium
PRLPDGSTPA

SEQ ID NO: 545119 - protein, 13 aa, Mycobacterium
PRLPDPAEQVDRR

SEQ ID NO: 545120 - protein, 18 aa, Mycobacterium
PRLPEPGQSQLDGEQRGL

SEQ ID NO: 545121 - protein, 5 aa, Mycobacterium
PRLPG

SEQ ID NO: 545122 - protein, 6 aa, Mycobacterium
PRLPGS

SEQ ID NO: 545123 - protein, 7 aa, Mycobacterium
PRLPQIP

SEQ ID NO: 545124 - protein, 12 aa, Mycobacterium
PRLPTYGGNDRT

SEQ ID NO: 545125 - protein, 5 aa, Mycobacterium
PRLQD

SEQ ID NO: 545126 - protein, 9 aa, Mycobacterium
PRLQPGDGR

SEQ ID NO: 545127 - protein, 11 aa, Mycobacterium
PRLSGASPMTN

SEQ ID NO: 545128 - protein, 10 aa, Mycobacterium
PRLSSSAREA

SEQ ID NO: 545129 - protein, 12 aa, Mycobacterium
PRLTAHGPTEEL

SEQ ID NO: 545130 - protein, 11 aa, Mycobacterium
PRLTSDADTGI

SEQ ID NO: 545131 - protein, 9 aa, Mycobacterium
PRMPQARKD

SEQ ID NO: 545132 - protein, 5 aa, Mycobacterium
PRMSR

SEQ ID NO: 545133 - protein, 8 aa, Mycobacterium
PRMTPQER

SEQ ID NO: 545134 - protein, 30 aa, Mycobacterium
PRMTSQTALGAADGVGAPRSSTDEPPKPPE

SEQ ID NO: 545135 - protein, 16 aa, Mycobacterium
PRNAGGKVLKPQLREL

SEQ ID NO: 545136 - protein, 16 aa, Mycobacterium
PRNAGGKVVKPQLREL

SEQ ID NO: 545137 - protein, 16 aa, Mycobacterium
PRNAGGKVVKSQLREL

SEQ ID NO: 545138 - protein, 7 aa, Mycobacterium
PRNATGK

SEQ ID NO: 545139 - protein, 10 aa, Mycobacterium
PRNATGKVAK

SEQ ID NO: 545140 - protein, 7 aa, Mycobacterium
PRNDNTG

SEQ ID NO: 545141 - protein, 14 aa, Mycobacterium
PRNDTGYGHGPEQV

SEQ ID NO: 545142 - protein, 5 aa, Mycobacterium
PRNDV

SEQ ID NO: 545143 - protein, 6 aa, Mycobacterium
PRNEPL

SEQ ID NO: 545144 - protein, 4 aa, Mycobacterium
PRNL

SEQ ID NO: 545145 - protein, 9 aa, Mycobacterium
PRNNDDAAH

SEQ ID NO: 545146 - protein, 4 aa, Mycobacterium
PRNP

SEQ ID NO: 545147 - protein, 5 aa, Mycobacterium
PRNPA

SEQ ID NO: 545148 - protein, 17 aa, Mycobacterium
PRNPAGKVLKRELRELY

SEQ ID NO: 545149 - protein, 10 aa, Mycobacterium
PRNPAPEQHR

SEQ ID NO: 545150 - protein, 7 aa, Mycobacterium
PRNPELG

SEQ ID NO: 545151 - protein, 7 aa, Mycobacterium
PRNPGGK

SEQ ID NO: 545152 - protein, 16 aa, Mycobacterium
PRNPGGKVVKPALREK

SEQ ID NO: 545153 - protein, 16 aa, Mycobacterium
PRNPGGKVVKPQLREW

SEQ ID NO: 545154 - protein, 8 aa, Mycobacterium
PRNPLTGQ

SEQ ID NO: 545155 - protein, 8 aa, Mycobacterium
PRNPRSPV

SEQ ID NO: 545156 - protein, 7 aa, Mycobacterium
PRNPSGK

SEQ ID NO: 545157 - protein, 4 aa, Mycobacterium
PRNR

SEQ ID NO: 545158 - protein, 26 aa, Mycobacterium
PRNRAERRGQRPQPKRTSKNNRKRKR

SEQ ID NO: 545159 - protein, 7 aa, Mycobacterium
PRNRPVR

SEQ ID NO: 545160 - protein, 9 aa, Mycobacterium
PRNRRQEET

SEQ ID NO: 545161 - protein, 10 aa, Mycobacterium
PRNSRPRDAL

SEQ ID NO: 545162 - protein, 18 aa, Mycobacterium
PRNSTGKIARRELQEKVN

SEQ ID NO: 545163 - protein, 17 aa, Mycobacterium
PRNSTGKVLKTELRARF

SEQ ID NO: 545164 - protein, 4 aa, Mycobacterium
PRNT

SEQ ID NO: 545165 - protein, 7 aa, Mycobacterium
PRNTDSE

SEQ ID NO: 545166 - protein, 4 aa, Mycobacterium
PRNV

SEQ ID NO: 545167 - protein, 7 aa, Mycobacterium
PRNVGYG

SEQ ID NO: 545168 - protein, 5 aa, Mycobacterium
PRNVP

SEQ ID NO: 545169 - protein, 19 aa, Mycobacterium
PRNVTGKVSRAQLKLDYGS

SEQ ID NO: 545170 - protein, 13 aa, Mycobacterium
PRPAAEHGQEIPM

SEQ ID NO: 545171 - protein, 10 aa, Mycobacterium
PRPAATAALA

SEQ ID NO: 545172 - protein, 8 aa, Mycobacterium
PRPADELE

SEQ ID NO: 545173 - protein, 6 aa, Mycobacterium
PRPADS

SEQ ID NO: 545174 - protein, 17 aa, Mycobacterium
PRPAGSPVSPDAQAAAA

SEQ ID NO: 545175 - protein, 16 aa, Mycobacterium
PRPAGSRRDAQAAAAA

SEQ ID NO: 545176 - protein, 8 aa, Mycobacterium
PRPALPDI

SEQ ID NO: 545177 - protein, 11 aa, Mycobacterium
PRPAPRPAYTA

SEQ ID NO: 545178 - protein, 5 aa, Mycobacterium
PRPAR

SEQ ID NO: 545179 - protein, 12 aa, Mycobacterium
PRPARARCDDPQ

SEQ ID NO: 545180 - protein, 8 aa, Mycobacterium
PRPATPLS

SEQ ID NO: 545181 - protein, 8 aa, Mycobacterium
PRPAVPDD

SEQ ID NO: 545182 - protein, 11 aa, Mycobacterium
PRPCNGDPPYE

SEQ ID NO: 545183 - protein, 9 aa, Mycobacterium
PRPDAASGR

SEQ ID NO: 545184 - protein, 14 aa, Mycobacterium
PRPDATDPDTGERY

SEQ ID NO: 545185 - protein, 6 aa, Mycobacterium
PRPDAW

SEQ ID NO: 545186 - protein, 8 aa, Mycobacterium
PRPDGGEK

SEQ ID NO: 545187 - protein, 12 aa, Mycobacterium
PRPDGRRAPDGP

SEQ ID NO: 545188 - protein, 7 aa, Mycobacterium
PRPDGTP

SEQ ID NO: 545189 - protein, 9 aa, Mycobacterium
PRPDGTRLA

SEQ ID NO: 545190 - protein, 5 aa, Mycobacterium
PRPDL

SEQ ID NO: 545191 - protein, 8 aa, Mycobacterium
PRPDLGRN

SEQ ID NO: 545192 - protein, 15 aa, Mycobacterium
PRPDREGRRESARRA

SEQ ID NO: 545193 - protein, 7 aa, Mycobacterium
PRPDRGL

SEQ ID NO: 545194 - protein, 22 aa, Mycobacterium
PRPDRRLRRQRGKSDPIDAEAA

SEQ ID NO: 545195 - protein, 17 aa, Mycobacterium
PRPDRTQTAAAARPKCS

SEQ ID NO: 545196 - protein, 16 aa, Mycobacterium
PRPDRTQTVAGQRPKC

SEQ ID NO: 545197 - protein, 6 aa, Mycobacterium
PRPDTY

SEQ ID NO: 545198 - protein, 19 aa, Mycobacterium
PRPDVDADGWRGRPVAPPL

SEQ ID NO: 545199 - protein, 10 aa, Mycobacterium
PRPENYPSLP

SEQ ID NO: 545200 - protein, 10 aa, Mycobacterium
PRPEQEAQAD

SEQ ID NO: 545201 - protein, 5 aa, Mycobacterium
PRPEY

SEQ ID NO: 545202 - protein, 11 aa, Mycobacterium
PRPFDEQEATA

SEQ ID NO: 545203 - protein, 9 aa, Mycobacterium
PRPFGVGTT

SEQ ID NO: 545204 - protein, 4 aa, Mycobacterium
PRPG

SEQ ID NO: 545205 - protein, 7 aa, Mycobacterium
PRPGAAL

SEQ ID NO: 545206 - protein, 6 aa, Mycobacterium
PRPGAD

SEQ ID NO: 545207 - protein, 6 aa, Mycobacterium
PRPGAQ

SEQ ID NO: 545208 - protein, 5 aa, Mycobacterium
PRPGD

SEQ ID NO: 545209 - protein, 10 aa, Mycobacterium
PRPGDDAQLS

SEQ ID NO: 545210 - protein, 7 aa, Mycobacterium
PRPGDDR

SEQ ID NO: 545211 - protein, 19 aa, Mycobacterium
PRPGDLSRRRPRLAEQPRV

SEQ ID NO: 545212 - protein, 10 aa, Mycobacterium
PRPGDTVASG

SEQ ID NO: 545213 - protein, 7 aa, Mycobacterium
PRPGGDR

SEQ ID NO: 545214 - protein, 10 aa, Mycobacterium
PRPGGTAEDD

SEQ ID NO: 545215 - protein, 6 aa, Mycobacterium
PRPGNR

SEQ ID NO: 545216 - protein, 5 aa, Mycobacterium
PRPGQ

SEQ ID NO: 545217 - protein, 6 aa, Mycobacterium
PRPGRM

SEQ ID NO: 545218 - protein, 32 aa, Mycobacterium
PRPGRSITEEVEQPSTPAAEKQAPATGSSETL

SEQ ID NO: 545219 - protein, 7 aa, Mycobacterium
PRPGVAP

SEQ ID NO: 545220 - protein, 5 aa, Mycobacterium
PRPGW

SEQ ID NO: 545221 - protein, 11 aa, Mycobacterium
PRPGWAEQDPR

SEQ ID NO: 545222 - protein, 5 aa, Mycobacterium
PRPHW

SEQ ID NO: 545223 - protein, 5 aa, Mycobacterium
PRPID

SEQ ID NO: 545224 - protein, 7 aa, Mycobacterium
PRPIDDP

SEQ ID NO: 545225 - protein, 5 aa, Mycobacterium
PRPIE

SEQ ID NO: 545226 - protein, 9 aa, Mycobacterium
PRPIPAAPQ

SEQ ID NO: 545227 - protein, 6 aa, Mycobacterium
PRPIPE

SEQ ID NO: 545228 - protein, 14 aa, Mycobacterium
PRPIPRRKESTNDN

SEQ ID NO: 545229 - protein, 10 aa, Mycobacterium
PRPKSKASIG

SEQ ID NO: 545230 - protein, 5 aa, Mycobacterium
PRPLA

SEQ ID NO: 545231 - protein, 11 aa, Mycobacterium
PRPLADESAAT

SEQ ID NO: 545232 - protein, 7 aa, Mycobacterium
PRPLASY

SEQ ID NO: 545233 - protein, 5 aa, Mycobacterium
PRPLK

SEQ ID NO: 545234 - protein, 7 aa, Mycobacterium
PRPLKGF

SEQ ID NO: 545235 - protein, 10 aa, Mycobacterium
PRPLPGDTGL

SEQ ID NO: 545236 - protein, 12 aa, Mycobacterium
PRPLPPSGSARA

SEQ ID NO: 545237 - protein, 7 aa, Mycobacterium
PRPLQDG

SEQ ID NO: 545238 - protein, 9 aa, Mycobacterium
PRPLTPGGP

SEQ ID NO: 545239 - protein, 10 aa, Mycobacterium
PRPLTPGGPG

SEQ ID NO: 545240 - protein, 9 aa, Mycobacterium
PRPLTSPPV

SEQ ID NO: 545241 - protein, 5 aa, Mycobacterium
PRPMA

SEQ ID NO: 545242 - protein, 5 aa, Mycobacterium
PRPNF

SEQ ID NO: 545243 - protein, 15 aa, Mycobacterium
PRPNGHERPSDRREV

SEQ ID NO: 545244 - protein, 10 aa, Mycobacterium
PRPNGPEPAA

SEQ ID NO: 545245 - protein, 22 aa, Mycobacterium
PRPNPDNGKRVTGIDKRPVDGA

SEQ ID NO: 545246 - protein, 10 aa, Mycobacterium
PRPPADGTPP

SEQ ID NO: 545247 - protein, 11 aa, Mycobacterium
PRPPEEDPQGT

SEQ ID NO: 545248 - protein, 7 aa, Mycobacterium
PRPPEGD

SEQ ID NO: 545249 - protein, 28 aa, Mycobacterium
PRPPFASGSLANADEATRIRAAEFLRSR

SEQ ID NO: 545250 - protein, 5 aa, Mycobacterium
PRPPR

SEQ ID NO: 545251 - protein, 7 aa, Mycobacterium
PRPPSGI

SEQ ID NO: 545252 - protein, 5 aa, Mycobacterium
PRPPT

SEQ ID NO: 545253 - protein, 5 aa, Mycobacterium
PRPPV

SEQ ID NO: 545254 - protein, 10 aa, Mycobacterium
PRPQDTVASD

SEQ ID NO: 545255 - protein, 7 aa, Mycobacterium
PRPQLTR

SEQ ID NO: 545256 - protein, 6 aa, Mycobacterium
PRPQTQ

SEQ ID NO: 545257 - protein, 4 aa, Mycobacterium
PRPR

SEQ ID NO: 545258 - protein, 17 aa, Mycobacterium
PRPRARRQPGVGGQPRE

SEQ ID NO: 545259 - protein, 12 aa, Mycobacterium
PRPRDEHTLASP

SEQ ID NO: 545260 - protein, 8 aa, Mycobacterium
PRPRPALG

SEQ ID NO: 545261 - protein, 12 aa, Mycobacterium
PRPRPTGSANRL

SEQ ID NO: 545262 - protein, 10 aa, Mycobacterium
PRPRRASDPA

SEQ ID NO: 545263 - protein, 12 aa, Mycobacterium
PRPRRGADPAEW

SEQ ID NO: 545264 - protein, 12 aa, Mycobacterium
PRPSAAQRDAAE

SEQ ID NO: 545265 - protein, 6 aa, Mycobacterium
PRPSAR

SEQ ID NO: 545266 - protein, 11 aa, Mycobacterium
PRPSDAEEART

SEQ ID NO: 545267 - protein, 6 aa, Mycobacterium
PRPSGI

SEQ ID NO: 545268 - protein, 18 aa, Mycobacterium
PRPSGPSANRDAQAAAAA

SEQ ID NO: 545269 - protein, 6 aa, Mycobacterium
PRPSQR

SEQ ID NO: 545270 - protein, 8 aa, Mycobacterium
PRPSSDSY

SEQ ID NO: 545271 - protein, 8 aa, Mycobacterium
PRPSTQPR

SEQ ID NO: 545272 - protein, 5 aa, Mycobacterium
PRPTA

SEQ ID NO: 545273 - protein, 7 aa, Mycobacterium
PRPTAEA

SEQ ID NO: 545274 - protein, 5 aa, Mycobacterium
PRPTM

SEQ ID NO: 545275 - protein, 7 aa, Mycobacterium
PRPTPVA

SEQ ID NO: 545276 - protein, 8 aa, Mycobacterium
PRPTSLDD

SEQ ID NO: 545277 - protein, 8 aa, Mycobacterium
PRPVEDSI

SEQ ID NO: 545278 - protein, 7 aa, Mycobacterium
PRPVEES

SEQ ID NO: 545279 - protein, 10 aa, Mycobacterium
PRPVEESIRE

SEQ ID NO: 545280 - protein, 13 aa, Mycobacterium
PRPVNPRPGLATA

SEQ ID NO: 545281 - protein, 8 aa, Mycobacterium
PRPVNPRR

SEQ ID NO: 545282 - protein, 5 aa, Mycobacterium
PRPVP

SEQ ID NO: 545283 - protein, 8 aa, Mycobacterium
PRPVPAPD

SEQ ID NO: 545284 - protein, 5 aa, Mycobacterium
PRPVR

SEQ ID NO: 545285 - protein, 6 aa, Mycobacterium
PRPVSP

SEQ ID NO: 545286 - protein, 5 aa, Mycobacterium
PRPVT

SEQ ID NO: 545287 - protein, 4 aa, Mycobacterium
PRPW

SEQ ID NO: 545288 - protein, 14 aa, Mycobacterium
PRPWQPNRPRRAGV

SEQ ID NO: 545289 - protein, 13 aa, Mycobacterium
PRPYPDDRAGRLD

SEQ ID NO: 545290 - protein, 16 aa, Mycobacterium
PRPYREQLTPESATRR

SEQ ID NO: 545291 - protein, 10 aa, Mycobacterium
PRQAQVTASA

SEQ ID NO: 545292 - protein, 11 aa, Mycobacterium
PRQDRAEATRR

SEQ ID NO: 545293 - protein, 9 aa, Mycobacterium
PRQEDADAL

SEQ ID NO: 545294 - protein, 11 aa, Mycobacterium
PRQEDADALPA

SEQ ID NO: 545295 - protein, 47 aa, Mycobacterium
PRQEHGEHQQHHRGRVADDGPAPSRAPGNGCRAAGGVRADDAGRGRL

SEQ ID NO: 545296 - protein, 5 aa, Mycobacterium
PRQGA

SEQ ID NO: 545297 - protein, 7 aa, Mycobacterium
PRQGADA

SEQ ID NO: 545298 - protein, 6 aa, Mycobacterium
PRQGEV

SEQ ID NO: 545299 - protein, 7 aa, Mycobacterium
PRQGEVE

SEQ ID NO: 545300 - protein, 15 aa, Mycobacterium
PRQGGGRLNNATTTE

SEQ ID NO: 545301 - protein, 16 aa, Mycobacterium
PRQGRPDPADPARAAM

SEQ ID NO: 545302 - protein, 7 aa, Mycobacterium
PRQKDYD

SEQ ID NO: 545303 - protein, 5 aa, Mycobacterium
PRQKL

SEQ ID NO: 545304 - protein, 5 aa, Mycobacterium
PRQLP

SEQ ID NO: 545305 - protein, 14 aa, Mycobacterium
PRQPAYAASKAGVA

SEQ ID NO: 545306 - protein, 14 aa, Mycobacterium
PRQPAYAASKAGVT

SEQ ID NO: 545307 - protein, 11 aa, Mycobacterium
PRQPGESPQEF

SEQ ID NO: 545308 - protein, 11 aa, Mycobacterium
PRQPGESPQQF

SEQ ID NO: 545309 - protein, 35 aa, Mycobacterium
PRQPGQPQRPGRHGRRADGRRRHHDHQRRRRQRGT

SEQ ID NO: 545310 - protein, 6 aa, Mycobacterium
PRQPLT

SEQ ID NO: 545311 - protein, 6 aa, Mycobacterium
PRQPRY

SEQ ID NO: 545312 - protein, 9 aa, Mycobacterium
PRQQYSGLD

SEQ ID NO: 545313 - protein, 4 aa, Mycobacterium
PRQR

SEQ ID NO: 545314 - protein, 7 aa, Mycobacterium
PRQRIDE

SEQ ID NO: 545315 - protein, 7 aa, Mycobacterium
PRQSAPD

SEQ ID NO: 545316 - protein, 14 aa, Mycobacterium
PRQSDSPAGRHDQH

SEQ ID NO: 545317 - protein, 22 aa, Mycobacterium
PRQSLTGTPLPPALPATAVAQS

SEQ ID NO: 545318 - protein, 11 aa, Mycobacterium
PRQSTQPARQI

SEQ ID NO: 545319 - protein, 35 aa, Mycobacterium
PRQTDPIRNRTKEENEAAGDEGERRAGINPRGRKR

SEQ ID NO: 545320 - protein, 5 aa, Mycobacterium
PRQTF

SEQ ID NO: 545321 - protein, 7 aa, Mycobacterium
PRQTPTE

SEQ ID NO: 545322 - protein, 8 aa, Mycobacterium
PRQTTADG

SEQ ID NO: 545323 - protein, 5 aa, Mycobacterium
PRQVP

SEQ ID NO: 545324 - protein, 13 aa, Mycobacterium
PRQWAKDNDVDYP

SEQ ID NO: 545325 - protein, 10 aa, Mycobacterium
PRQYDSHTGR

SEQ ID NO: 545326 - protein, 4 aa, Mycobacterium
PRRA

SEQ ID NO: 545327 - protein, 6 aa, Mycobacterium
PRRAAT

SEQ ID NO: 545328 - protein, 16 aa, Mycobacterium
PRRAATAAHYENQDGA

SEQ ID NO: 545329 - protein, 15 aa, Mycobacterium
PRRACTDGEESAKSS

SEQ ID NO: 545330 - protein, 11 aa, Mycobacterium
PRRADGSPLGT

SEQ ID NO: 545331 - protein, 12 aa, Mycobacterium
PRRAESARKGSL

SEQ ID NO: 545332 - protein, 8 aa, Mycobacterium
PRRAKAQT

SEQ ID NO: 545333 - protein, 19 aa, Mycobacterium
PRRAPESPAAVTPELSPPR

SEQ ID NO: 545334 - protein, 8 aa, Mycobacterium
PRRATQPQ

SEQ ID NO: 545335 - protein, 4 aa, Mycobacterium
PRRC

SEQ ID NO: 545336 - protein, 43 aa, Mycobacterium
PRRCSRPSARRACSPSGPAGAGVRSPRPPPWRRRRSSQPEGPR

SEQ ID NO: 545337 - protein, 10 aa, Mycobacterium
PRRDDTSHRR

SEQ ID NO: 545338 - protein, 14 aa, Mycobacterium
PRRDGIDAASEIAT

SEQ ID NO: 545339 - protein, 7 aa, Mycobacterium
PRRDGWG

SEQ ID NO: 545340 - protein, 7 aa, Mycobacterium
PRRDQTD

SEQ ID NO: 545341 - protein, 6 aa, Mycobacterium
PRRDRG

SEQ ID NO: 545342 - protein, 13 aa, Mycobacterium
PRRDRPAATRRGV

SEQ ID NO: 545343 - protein, 10 aa, Mycobacterium
PRRDTDIDSY

SEQ ID NO: 545344 - protein, 7 aa, Mycobacterium
PRRDTTM

SEQ ID NO: 545345 - protein, 4 aa, Mycobacterium
PRRE

SEQ ID NO: 545346 - protein, 17 aa, Mycobacterium
PRREDPGDWTPPAGDGP

SEQ ID NO: 545347 - protein, 5 aa, Mycobacterium
PRREH

SEQ ID NO: 545348 - protein, 6 aa, Mycobacterium
PRREPV

SEQ ID NO: 545349 - protein, 7 aa, Mycobacterium
PRRERAD

SEQ ID NO: 545350 - protein, 10 aa, Mycobacterium
PRRFDPQSCE

SEQ ID NO: 545351 - protein, 22 aa, Mycobacterium
PRRGDKRALAETVQRNAKEALQ

SEQ ID NO: 545352 - protein, 23 aa, Mycobacterium
PRRGDKRALAETVQRNAKEALQQ

SEQ ID NO: 545353 - protein, 7 aa, Mycobacterium
PRRGDYD

SEQ ID NO: 545354 - protein, 9 aa, Mycobacterium
PRRGGEARP

SEQ ID NO: 545355 - protein, 5 aa, Mycobacterium
PRRGI

SEQ ID NO: 545356 - protein, 10 aa, Mycobacterium
PRRGKPINTA

SEQ ID NO: 545357 - protein, 5 aa, Mycobacterium
PRRGL

SEQ ID NO: 545358 - protein, 9 aa, Mycobacterium
PRRGNRKGV

SEQ ID NO: 545359 - protein, 11 aa, Mycobacterium
PRRGRADGELS

SEQ ID NO: 545360 - protein, 5 aa, Mycobacterium
PRRGS

SEQ ID NO: 545361 - protein, 13 aa, Mycobacterium
PRRGTAKEAAQRA

SEQ ID NO: 545362 - protein, 8 aa, Mycobacterium
PRRGTSNS

SEQ ID NO: 545363 - protein, 6 aa, Mycobacterium
PRRHQS

SEQ ID NO: 545364 - protein, 15 aa, Mycobacterium
PRRHSELDGSGTVRD

SEQ ID NO: 545365 - protein, 16 aa, Mycobacterium
PRRIESTAGLTQTSAS

SEQ ID NO: 545366 - protein, 10 aa, Mycobacterium
PRRKPLDPAR

SEQ ID NO: 545367 - protein, 5 aa, Mycobacterium
PRRKT

SEQ ID NO: 545368 - protein, 7 aa, Mycobacterium
PRRLAST

SEQ ID NO: 545369 - protein, 7 aa, Mycobacterium
PRRLPGR

SEQ ID NO: 545370 - protein, 7 aa, Mycobacterium
PRRNAEL

SEQ ID NO: 545371 - protein, 7 aa, Mycobacterium
PRRNAQV

SEQ ID NO: 545372 - protein, 4 aa, Mycobacterium
PRRP

SEQ ID NO: 545373 - protein, 10 aa, Mycobacterium
PRRPAGCTAA

SEQ ID NO: 545374 - protein, 27 aa, Mycobacterium
PRRPAPVTPKRTASGSVAVPGARARVA

SEQ ID NO: 545375 - protein, 8 aa, Mycobacterium
PRRPAYTG

SEQ ID NO: 545376 - protein, 9 aa, Mycobacterium
PRRPDGYGG

SEQ ID NO: 545377 - protein, 14 aa, Mycobacterium
PRRPEPRTAVPAGS

SEQ ID NO: 545378 - protein, 5 aa, Mycobacterium
PRRPG

SEQ ID NO: 545379 - protein, 13 aa, Mycobacterium
PRRPGVSLAPGAR

SEQ ID NO: 545380 - protein, 9 aa, Mycobacterium
PRRPLSDGE

SEQ ID NO: 545381 - protein, 9 aa, Mycobacterium
PRRPQEGHD

SEQ ID NO: 545382 - protein, 6 aa, Mycobacterium
PRRPTV

SEQ ID NO: 545383 - protein, 34 aa, Mycobacterium
PRRQAGRRPVAAPAAVSGARRGANRRRRPHQRQP

SEQ ID NO: 545384 - protein, 8 aa, Mycobacterium
PRRQGGER

SEQ ID NO: 545385 - protein, 20 aa, Mycobacterium
PRRQGGSVTNAGVRPDSAGQ

SEQ ID NO: 545386 - protein, 10 aa, Mycobacterium
PRRQPEQLTT

SEQ ID NO: 545387 - protein, 13 aa, Mycobacterium
PRRQPPKTVPPLR

SEQ ID NO: 545388 - protein, 50 aa, Mycobacterium
PRRQRDADDHAGDAEGGDEPAQRRDQSRRDSGQAAAQPDRQGRGHQVERG

SEQ ID NO: 545389 - protein, 6 aa, Mycobacterium
PRRQRE

SEQ ID NO: 545390 - protein, 16 aa, Mycobacterium
PRRQSAAAASTDQRLG

SEQ ID NO: 545391 - protein, 7 aa, Mycobacterium
PRRREAD

SEQ ID NO: 545392 - protein, 15 aa, Mycobacterium
PRRRGTPEDGKRGET

SEQ ID NO: 545393 - protein, 14 aa, Mycobacterium
PRRRPHEETLDPAH

SEQ ID NO: 545394 - protein, 7 aa, Mycobacterium
PRRRPLD

SEQ ID NO: 545395 - protein, 13 aa, Mycobacterium
PRRRSNPGHRSSP

SEQ ID NO: 545396 - protein, 7 aa, Mycobacterium
PRRRSTR

SEQ ID NO: 545397 - protein, 22 aa, Mycobacterium
PRRRSTRPAVRAKRTTDQAGVD

SEQ ID NO: 545398 - protein, 5 aa, Mycobacterium
PRRRT

SEQ ID NO: 545399 - protein, 10 aa, Mycobacterium
PRRRTDRRAY

SEQ ID NO: 545400 - protein, 17 aa, Mycobacterium
PRRRTDRRTYSARPVAA

SEQ ID NO: 545401 - protein, 9 aa, Mycobacterium
PRRRTDRRY

SEQ ID NO: 545402 - protein, 5 aa, Mycobacterium
PRRRY

SEQ ID NO: 545403 - protein, 5 aa, Mycobacterium
PRRSE

SEQ ID NO: 545404 - protein, 8 aa, Mycobacterium
PRRSETAA

SEQ ID NO: 545405 - protein, 6 aa, Mycobacterium
PRRSGE

SEQ ID NO: 545406 - protein, 9 aa, Mycobacterium
PRRSPHPRR

SEQ ID NO: 545407 - protein, 7 aa, Mycobacterium
PRRSSGL

SEQ ID NO: 545408 - protein, 7 aa, Mycobacterium
PRRTAGG

SEQ ID NO: 545409 - protein, 7 aa, Mycobacterium
PRRTAVG

SEQ ID NO: 545410 - protein, 11 aa, Mycobacterium
PRRTAYDRPQR

SEQ ID NO: 545411 - protein, 7 aa, Mycobacterium
PRRTDEV

SEQ ID NO: 545412 - protein, 8 aa, Mycobacterium
PRRTNGRP

SEQ ID NO: 545413 - protein, 10 aa, Mycobacterium
PRRTPNPRRR

SEQ ID NO: 545414 - protein, 11 aa, Mycobacterium
PRRTPTARRAS

SEQ ID NO: 545415 - protein, 14 aa, Mycobacterium
PRRTSGGGRRYSER

SEQ ID NO: 545416 - protein, 22 aa, Mycobacterium
PRRTSPAGNPAGRAGVDRYSPQ

SEQ ID NO: 545417 - protein, 17 aa, Mycobacterium
PRRTYYPRSQEKTEQAC

SEQ ID NO: 545418 - protein, 9 aa, Mycobacterium
PRRVPGPRT

SEQ ID NO: 545419 - protein, 10 aa, Mycobacterium
PRRVRQPGEP

SEQ ID NO: 545420 - protein, 11 aa, Mycobacterium
PRRVRQPGEPL

SEQ ID NO: 545421 - protein, 7 aa, Mycobacterium
PRRYGAG

SEQ ID NO: 545422 - protein, 11 aa, Mycobacterium
PRRYTRSQVSQ

SEQ ID NO: 545423 - protein, 4 aa, Mycobacterium
PRSA

SEQ ID NO: 545424 - protein, 6 aa, Mycobacterium
PRSAAA

SEQ ID NO: 545425 - protein, 10 aa, Mycobacterium
PRSAAGGHGT

SEQ ID NO: 545426 - protein, 13 aa, Mycobacterium
PRSADEALADGEQ

SEQ ID NO: 545427 - protein, 7 aa, Mycobacterium
PRSAGRN

SEQ ID NO: 545428 - protein, 7 aa, Mycobacterium
PRSAPLP

SEQ ID NO: 545429 - protein, 10 aa, Mycobacterium
PRSARPRDAL

SEQ ID NO: 545430 - protein, 12 aa, Mycobacterium
PRSATSSYAQDA

SEQ ID NO: 545431 - protein, 6 aa, Mycobacterium
PRSAYT

SEQ ID NO: 545432 - protein, 4 aa, Mycobacterium
PRSD

SEQ ID NO: 545433 - protein, 6 aa, Mycobacterium
PRSDAG

SEQ ID NO: 545434 - protein, 10 aa, Mycobacterium
PRSDASAQLT

SEQ ID NO: 545435 - protein, 6 aa, Mycobacterium
PRSDFY

SEQ ID NO: 545436 - protein, 10 aa, Mycobacterium
PRSDNAPAGP

SEQ ID NO: 545437 - protein, 5 aa, Mycobacterium
PRSDQ

SEQ ID NO: 545438 - protein, 12 aa, Mycobacterium
PRSDRGPRKAVR

SEQ ID NO: 545439 - protein, 9 aa, Mycobacterium
PRSDSAESV

SEQ ID NO: 545440 - protein, 6 aa, Mycobacterium
PRSEAS

SEQ ID NO: 545441 - protein, 6 aa, Mycobacterium
PRSEAT

SEQ ID NO: 545442 - protein, 10 aa, Mycobacterium
PRSERAASSG

SEQ ID NO: 545443 - protein, 8 aa, Mycobacterium
PRSERADR

SEQ ID NO: 545444 - protein, 6 aa, Mycobacterium
PRSFTT

SEQ ID NO: 545445 - protein, 13 aa, Mycobacterium
PRSFTTADGDVEG

SEQ ID NO: 545446 - protein, 11 aa, Mycobacterium
PRSGDADEQSL

SEQ ID NO: 545447 - protein, 8 aa, Mycobacterium
PRSGGKID

SEQ ID NO: 545448 - protein, 6 aa, Mycobacterium
PRSGLS

SEQ ID NO: 545449 - protein, 13 aa, Mycobacterium
PRSGRSSAVVSPE

SEQ ID NO: 545450 - protein, 14 aa, Mycobacterium
PRSGRWNPDASARA

SEQ ID NO: 545451 - protein, 12 aa, Mycobacterium
PRSGRWNPDPSA

SEQ ID NO: 545452 - protein, 6 aa, Mycobacterium
PRSGTT

SEQ ID NO: 545453 - protein, 5 aa, Mycobacterium
PRSGV

SEQ ID NO: 545454 - protein, 4 aa, Mycobacterium
PRSH

SEQ ID NO: 545455 - protein, 16 aa, Mycobacterium
PRSIPKTTSGKIRRAR

SEQ ID NO: 545456 - protein, 4 aa, Mycobacterium
PRSL

SEQ ID NO: 545457 - protein, 10 aa, Mycobacterium
PRSLGDPSHD

SEQ ID NO: 545458 - protein, 6 aa, Mycobacterium
PRSLGY

SEQ ID NO: 545459 - protein, 7 aa, Mycobacterium
PRSLGYG

SEQ ID NO: 545460 - protein, 14 aa, Mycobacterium
PRSLPDRACRGRSR

SEQ ID NO: 545461 - protein, 14 aa, Mycobacterium
PRSLREATDNTATL

SEQ ID NO: 545462 - protein, 14 aa, Mycobacterium
PRSNTKGLGETPAE

SEQ ID NO: 545463 - protein, 4 aa, Mycobacterium
PRSP

SEQ ID NO: 545464 - protein, 6 aa, Mycobacterium
PRSPAD

SEQ ID NO: 545465 - protein, 8 aa, Mycobacterium
PRSPRCRR

SEQ ID NO: 545466 - protein, 6 aa, Mycobacterium
PRSPRH

SEQ ID NO: 545467 - protein, 6 aa, Mycobacterium
PRSPSG

SEQ ID NO: 545468 - protein, 15 aa, Mycobacterium
PRSPTGAAADQSPAA

SEQ ID NO: 545469 - protein, 6 aa, Mycobacterium
PRSQPC

SEQ ID NO: 545470 - protein, 6 aa, Mycobacterium
PRSQYG

SEQ ID NO: 545471 - protein, 5 aa, Mycobacterium
PRSRA

SEQ ID NO: 545472 - protein, 6 aa, Mycobacterium
PRSRGA

SEQ ID NO: 545473 - protein, 10 aa, Mycobacterium
PRSRGAGTGR

SEQ ID NO: 545474 - protein, 12 aa, Mycobacterium
PRSRRTSATPRT

SEQ ID NO: 545475 - protein, 5 aa, Mycobacterium
PRSRS

SEQ ID NO: 545476 - protein, 9 aa, Mycobacterium
PRSRVAPTQ

SEQ ID NO: 545477 - protein, 5 aa, Mycobacterium
PRSRY

SEQ ID NO: 545478 - protein, 10 aa, Mycobacterium
PRSRYPYSAD

SEQ ID NO: 545479 - protein, 4 aa, Mycobacterium
PRSS

SEQ ID NO: 545480 - protein, 6 aa, Mycobacterium
PRSSEF

SEQ ID NO: 545481 - protein, 6 aa, Mycobacterium
PRSSES

SEQ ID NO: 545482 - protein, 15 aa, Mycobacterium
PRSSGGKIAKGRLRE

SEQ ID NO: 545483 - protein, 8 aa, Mycobacterium
PRSSPTIA

SEQ ID NO: 545484 - protein, 6 aa, Mycobacterium
PRSSYI

SEQ ID NO: 545485 - protein, 4 aa, Mycobacterium
PRST

SEQ ID NO: 545486 - protein, 21 aa, Mycobacterium
PRSTAAAFPGLARSASLIRLT

SEQ ID NO: 545487 - protein, 21 aa, Mycobacterium
PRSTAAAFPGLARTASLVRLI

SEQ ID NO: 545488 - protein, 21 aa, Mycobacterium
PRSTAEAFPGLARTAALVRLM

SEQ ID NO: 545489 - protein, 8 aa, Mycobacterium
PRSTEEVS

SEQ ID NO: 545490 - protein, 8 aa, Mycobacterium
PRSTEQAK

SEQ ID NO: 545491 - protein, 5 aa, Mycobacterium
PRSTG

SEQ ID NO: 545492 - protein, 21 aa, Mycobacterium
PRSTSEAFPGLARTAGLIRML

SEQ ID NO: 545493 - protein, 9 aa, Mycobacterium
PRSVEQAGA

SEQ ID NO: 545494 - protein, 8 aa, Mycobacterium
PRSVPAGT

SEQ ID NO: 545495 - protein, 10 aa, Mycobacterium
PRSVPGSRGV

SEQ ID NO: 545496 - protein, 10 aa, Mycobacterium
PRSVRGEQRV

SEQ ID NO: 545497 - protein, 34 aa, Mycobacterium
PRSVTAERARHEPRGRQRRPAQVARGDAASGDVQ

SEQ ID NO: 545498 - protein, 4 aa, Mycobacterium
PRSW

SEQ ID NO: 545499 - protein, 18 aa, Mycobacterium
PRTAATKVNRSAMIEARG

SEQ ID NO: 545500 - protein, 6 aa, Mycobacterium
PRTANG

SEQ ID NO: 545501 - protein, 8 aa, Mycobacterium
PRTAPDWS

SEQ ID NO: 545502 - protein, 8 aa, Mycobacterium
PRTAQERV

SEQ ID NO: 545503 - protein, 8 aa, Mycobacterium
PRTASERG

SEQ ID NO: 545504 - protein, 11 aa, Mycobacterium
PRTASGKPDLG

SEQ ID NO: 545505 - protein, 7 aa, Mycobacterium
PRTATGK

SEQ ID NO: 545506 - protein, 21 aa, Mycobacterium
PRTATGKLAKRSLKDRYMEAP

SEQ ID NO: 545507 - protein, 7 aa, Mycobacterium
PRTDTGK

SEQ ID NO: 545508 - protein, 17 aa, Mycobacterium
PRTDTGKLYKQELIAKY

SEQ ID NO: 545509 - protein, 9 aa, Mycobacterium
PRTEAAGAA

SEQ ID NO: 545510 - protein, 10 aa, Mycobacterium
PRTELERDQY

SEQ ID NO: 545511 - protein, 5 aa, Mycobacterium
PRTEM

SEQ ID NO: 545512 - protein, 19 aa, Mycobacterium
PRTEPDAPEVISAIEAVLP

SEQ ID NO: 545513 - protein, 19 aa, Mycobacterium
PRTEPDAPEVISAIEDVLP

SEQ ID NO: 545514 - protein, 5 aa, Mycobacterium
PRTER

SEQ ID NO: 545515 - protein, 9 aa, Mycobacterium
PRTERAPGH

SEQ ID NO: 545516 - protein, 5 aa, Mycobacterium
PRTEV

SEQ ID NO: 545517 - protein, 5 aa, Mycobacterium
PRTFG

SEQ ID NO: 545518 - protein, 4 aa, Mycobacterium
PRTG

SEQ ID NO: 545519 - protein, 7 aa, Mycobacterium
PRTGASL

SEQ ID NO: 545520 - protein, 17 aa, Mycobacterium
PRTGGKGRTRNSRAKGK

SEQ ID NO: 545521 - protein, 7 aa, Mycobacterium
PRTGKAV

SEQ ID NO: 545522 - protein, 7 aa, Mycobacterium
PRTGPDR

SEQ ID NO: 545523 - protein, 6 aa, Mycobacterium
PRTGPP

SEQ ID NO: 545524 - protein, 7 aa, Mycobacterium
PRTGPSS

SEQ ID NO: 545525 - protein, 13 aa, Mycobacterium
PRTGREPSPWKPV

SEQ ID NO: 545526 - protein, 8 aa, Mycobacterium
PRTGRGGR

SEQ ID NO: 545527 - protein, 6 aa, Mycobacterium
PRTGRS

SEQ ID NO: 545528 - protein, 14 aa, Mycobacterium
PRTGVDPQELRRSP

SEQ ID NO: 545529 - protein, 9 aa, Mycobacterium
PRTHEQRRA

SEQ ID NO: 545530 - protein, 5 aa, Mycobacterium
PRTID

SEQ ID NO: 545531 - protein, 8 aa, Mycobacterium
PRTKSGKV

SEQ ID NO: 545532 - protein, 5 aa, Mycobacterium
PRTLT

SEQ ID NO: 545533 - protein, 13 aa, Mycobacterium
PRTLTGRLSADPY

SEQ ID NO: 545534 - protein, 19 aa, Mycobacterium
PRTNKRTDSWGGSAANRRR

SEQ ID NO: 545535 - protein, 18 aa, Mycobacterium
PRTNKRTDSWGGTPAKRR

SEQ ID NO: 545536 - protein, 19 aa, Mycobacterium
PRTNRRTDSWGGSAANRRR

SEQ ID NO: 545537 - protein, 19 aa, Mycobacterium
PRTNVGAGGNYYNNSPRAL

SEQ ID NO: 545538 - protein, 4 aa, Mycobacterium
PRTP

SEQ ID NO: 545539 - protein, 6 aa, Mycobacterium
PRTPAE

SEQ ID NO: 545540 - protein, 8 aa, Mycobacterium
PRTPAKDY

SEQ ID NO: 545541 - protein, 7 aa, Mycobacterium
PRTPAYD

SEQ ID NO: 545542 - protein, 17 aa, Mycobacterium
PRTPDLDDPGAEHDTTR

SEQ ID NO: 545543 - protein, 9 aa, Mycobacterium
PRTPEPHAV

SEQ ID NO: 545544 - protein, 12 aa, Mycobacterium
PRTPGGQPGTYL

SEQ ID NO: 545545 - protein, 11 aa, Mycobacterium
PRTPGQDDPPY

SEQ ID NO: 545546 - protein, 23 aa, Mycobacterium
PRTPGSGDKLTIDPSKAGSFTGT

SEQ ID NO: 545547 - protein, 6 aa, Mycobacterium
PRTPPW

SEQ ID NO: 545548 - protein, 7 aa, Mycobacterium
PRTPSGK

SEQ ID NO: 545549 - protein, 10 aa, Mycobacterium
PRTPSGKADL

SEQ ID NO: 545550 - protein, 19 aa, Mycobacterium
PRTPSGKPDLTAVRARLAQ

SEQ ID NO: 545551 - protein, 9 aa, Mycobacterium
PRTPSWGEP

SEQ ID NO: 545552 - protein, 16 aa, Mycobacterium
PRTPTSETERSSTTAG

SEQ ID NO: 545553 - protein, 5 aa, Mycobacterium
PRTQE

SEQ ID NO: 545554 - protein, 6 aa, Mycobacterium
PRTQKI

SEQ ID NO: 545555 - protein, 7 aa, Mycobacterium
PRTQSGK

SEQ ID NO: 545556 - protein, 5 aa, Mycobacterium
PRTRE

SEQ ID NO: 545557 - protein, 5 aa, Mycobacterium
PRTRG

SEQ ID NO: 545558 - protein, 20 aa, Mycobacterium
PRTRKQARPNVRTPTARAQG

SEQ ID NO: 545559 - protein, 17 aa, Mycobacterium
PRTRSAAPLPRSGNTVA

SEQ ID NO: 545560 - protein, 28 aa, Mycobacterium
PRTSGGPVYKDGQRISPKSIEAPPSISE

SEQ ID NO: 545561 - protein, 6 aa, Mycobacterium
PRTSLG

SEQ ID NO: 545562 - protein, 43 aa, Mycobacterium
PRTSPEAWSETANGLQEKSAELSTSAGGIRRSADDLGSSNSGQ

SEQ ID NO: 545563 - protein, 15 aa, Mycobacterium
PRTSPQASRWSPERA

SEQ ID NO: 545564 - protein, 11 aa, Mycobacterium
PRTSVGKYDKK

SEQ ID NO: 545565 - protein, 27 aa, Mycobacterium
PRTSVGKYDKKAVRSRYAEDGYQVTEA

SEQ ID NO: 545566 - protein, 26 aa, Mycobacterium
PRTSVGKYDKKTIRARHAEGAYEVIH

SEQ ID NO: 545567 - protein, 6 aa, Mycobacterium
PRTTGY

SEQ ID NO: 545568 - protein, 6 aa, Mycobacterium
PRTTHT

SEQ ID NO: 545569 - protein, 5 aa, Mycobacterium
PRTTI

SEQ ID NO: 545570 - protein, 12 aa, Mycobacterium
PRTTIASGASLN

SEQ ID NO: 545571 - protein, 5 aa, Mycobacterium
PRTTR

SEQ ID NO: 545572 - protein, 12 aa, Mycobacterium
PRTTSGKLARSA

SEQ ID NO: 545573 - protein, 7 aa, Mycobacterium
PRTTTGW

SEQ ID NO: 545574 - protein, 7 aa, Mycobacterium
PRTTTQL

SEQ ID NO: 545575 - protein, 5 aa, Mycobacterium
PRTVE

SEQ ID NO: 545576 - protein, 15 aa, Mycobacterium
PRTVEGGKPPPDPAD

SEQ ID NO: 545577 - protein, 4 aa, Mycobacterium
PRVA

SEQ ID NO: 545578 - protein, 7 aa, Mycobacterium
PRVAGAD

SEQ ID NO: 545579 - protein, 10 aa, Mycobacterium
PRVAPAGQQV

SEQ ID NO: 545580 - protein, 7 aa, Mycobacterium
PRVDDDA

SEQ ID NO: 545581 - protein, 10 aa, Mycobacterium
PRVDNPPGSG

SEQ ID NO: 545582 - protein, 7 aa, Mycobacterium
PRVDPDR

SEQ ID NO: 545583 - protein, 12 aa, Mycobacterium
PRVEPARAEEIP

SEQ ID NO: 545584 - protein, 11 aa, Mycobacterium
PRVEYDPDADR

SEQ ID NO: 545585 - protein, 4 aa, Mycobacterium
PRVG

SEQ ID NO: 545586 - protein, 18 aa, Mycobacterium
PRVGGTTDDAREASAETG

SEQ ID NO: 545587 - protein, 6 aa, Mycobacterium
PRVIPE

SEQ ID NO: 545588 - protein, 8 aa, Mycobacterium
PRVKHNSQ

SEQ ID NO: 545589 - protein, 7 aa, Mycobacterium
PRVPDKK

SEQ ID NO: 545590 - protein, 22 aa, Mycobacterium
PRVPDQDRDDERIVTGSDGSAW

SEQ ID NO: 545591 - protein, 7 aa, Mycobacterium
PRVPPNR

SEQ ID NO: 545592 - protein, 8 aa, Mycobacterium
PRVPPSRA

SEQ ID NO: 545593 - protein, 10 aa, Mycobacterium
PRVPPTRPGA

SEQ ID NO: 545594 - protein, 5 aa, Mycobacterium
PRVPS

SEQ ID NO: 545595 - protein, 9 aa, Mycobacterium
PRVPSAEEM

SEQ ID NO: 545596 - protein, 9 aa, Mycobacterium
PRVPSTAEM

SEQ ID NO: 545597 - protein, 9 aa, Mycobacterium
PRVPTTEEM

SEQ ID NO: 545598 - protein, 14 aa, Mycobacterium
PRVQPPPAASGRPR

SEQ ID NO: 545599 - protein, 4 aa, Mycobacterium
PRVR

SEQ ID NO: 545600 - protein, 6 aa, Mycobacterium
PRVRGA

SEQ ID NO: 545601 - protein, 7 aa, Mycobacterium
PRVRPTT

SEQ ID NO: 545602 - protein, 6 aa, Mycobacterium
PRVRRP

SEQ ID NO: 545603 - protein, 7 aa, Mycobacterium
PRVRSPG

SEQ ID NO: 545604 - protein, 6 aa, Mycobacterium
PRVRTG

SEQ ID NO: 545605 - protein, 11 aa, Mycobacterium
PRVSKDHTSAL

SEQ ID NO: 545606 - protein, 9 aa, Mycobacterium
PRVSREQED

SEQ ID NO: 545607 - protein, 12 aa, Mycobacterium
PRVTGVPSTKGT

SEQ ID NO: 545608 - protein, 5 aa, Mycobacterium
PRWAD

SEQ ID NO: 545609 - protein, 12 aa, Mycobacterium
PRWDSGGDGSPH

SEQ ID NO: 545610 - protein, 12 aa, Mycobacterium
PRWEAKDPRTYT

SEQ ID NO: 545611 - protein, 18 aa, Mycobacterium
PRWEPGDKALATRAASGK

SEQ ID NO: 545612 - protein, 10 aa, Mycobacterium
PRWEPGSAQG

SEQ ID NO: 545613 - protein, 19 aa, Mycobacterium
PRWGGDPDAFDPDRFAPDR

SEQ ID NO: 545614 - protein, 8 aa, Mycobacterium
PRWGKPEE

SEQ ID NO: 545615 - protein, 11 aa, Mycobacterium
PRWNDGEHGEP

SEQ ID NO: 545616 - protein, 15 aa, Mycobacterium
PRWPGSAGGPPGPQK

SEQ ID NO: 545617 - protein, 9 aa, Mycobacterium
PRWRPDHRP

SEQ ID NO: 545618 - protein, 15 aa, Mycobacterium
PRWSEQRPTYGEAKP

SEQ ID NO: 545619 - protein, 5 aa, Mycobacterium
PRYAT

SEQ ID NO: 545620 - protein, 5 aa, Mycobacterium
PRYEW

SEQ ID NO: 545621 - protein, 10 aa, Mycobacterium
PRYGDARARA

SEQ ID NO: 545622 - protein, 12 aa, Mycobacterium
PRYGDARGRAAN

SEQ ID NO: 545623 - protein, 7 aa, Mycobacterium
PRYKTRE

SEQ ID NO: 545624 - protein, 5 aa, Mycobacterium
PRYRE

SEQ ID NO: 545625 - protein, 25 aa, Mycobacterium
PRYRVPDEQARAEAAEGYDRNYYPQ

SEQ ID NO: 545626 - protein, 7 aa, Mycobacterium
PRYSPAS

SEQ ID NO: 545627 - protein, 6 aa, Mycobacterium
PRYTEA

SEQ ID NO: 545628 - protein, 13 aa, Mycobacterium
PSAAAARIEGSKA

SEQ ID NO: 545629 - protein, 10 aa, Mycobacterium
PSAAAQLAET

SEQ ID NO: 545630 - protein, 11 aa, Mycobacterium
PSAAAQLAETE

SEQ ID NO: 545631 - protein, 7 aa, Mycobacterium
PSAADRD

SEQ ID NO: 545632 - protein, 9 aa, Mycobacterium
PSAADRERE

SEQ ID NO: 545633 - protein, 5 aa, Mycobacterium
PSAAE

SEQ ID NO: 545634 - protein, 5 aa, Mycobacterium
PSAAF

SEQ ID NO: 545635 - protein, 10 aa, Mycobacterium
PSAAGAPTLE

SEQ ID NO: 545636 - protein, 12 aa, Mycobacterium
PSAAGGGGGGVV

SEQ ID NO: 545637 - protein, 7 aa, Mycobacterium
PSAALTD

SEQ ID NO: 545638 - protein, 16 aa, Mycobacterium
PSAAPAVSSASTIPPF

SEQ ID NO: 545639 - protein, 8 aa, Mycobacterium
PSAAPQTA

SEQ ID NO: 545640 - protein, 8 aa, Mycobacterium
PSAAPRTA

SEQ ID NO: 545641 - protein, 8 aa, Mycobacterium
PSAASRTT

SEQ ID NO: 545642 - protein, 12 aa, Mycobacterium
PSACPASPADDC

SEQ ID NO: 545643 - protein, 10 aa, Mycobacterium
PSACTDDTPV

SEQ ID NO: 545644 - protein, 4 aa, Mycobacterium
PSAD

SEQ ID NO: 545645 - protein, 8 aa, Mycobacterium
PSADAGRQ

SEQ ID NO: 545646 - protein, 10 aa, Mycobacterium
PSADASSRQM

SEQ ID NO: 545647 - protein, 5 aa, Mycobacterium
PSADE

SEQ ID NO: 545648 - protein, 5 aa, Mycobacterium
PSADI

SEQ ID NO: 545649 - protein, 7 aa, Mycobacterium
PSADQAT

SEQ ID NO: 545650 - protein, 13 aa, Mycobacterium
PSADTTPTPAPVE

SEQ ID NO: 545651 - protein, 10 aa, Mycobacterium
PSAEGGHSDV

SEQ ID NO: 545652 - protein, 7 aa, Mycobacterium
PSAEIGS

SEQ ID NO: 545653 - protein, 13 aa, Mycobacterium
PSAELAAATDTEV

SEQ ID NO: 545654 - protein, 8 aa, Mycobacterium
PSAESAAR

SEQ ID NO: 545655 - protein, 10 aa, Mycobacterium
PSAESDPLAS

SEQ ID NO: 545656 - protein, 14 aa, Mycobacterium
PSAFAGDDNGAAPV

SEQ ID NO: 545657 - protein, 8 aa, Mycobacterium
PSAGAPEA

SEQ ID NO: 545658 - protein, 6 aa, Mycobacterium
PSAGDA

SEQ ID NO: 545659 - protein, 5 aa, Mycobacterium
PSAGE

SEQ ID NO: 545660 - protein, 7 aa, Mycobacterium
PSAGGEE

SEQ ID NO: 545661 - protein, 10 aa, Mycobacterium
PSAGGFGEGD

SEQ ID NO: 545662 - protein, 10 aa, Mycobacterium
PSAGGGDARA

SEQ ID NO: 545663 - protein, 12 aa, Mycobacterium
PSAGGGGGATVD

SEQ ID NO: 545664 - protein, 10 aa, Mycobacterium
PSAGGGGKGM

SEQ ID NO: 545665 - protein, 12 aa, Mycobacterium
PSAGGSGGATVD

SEQ ID NO: 545666 - protein, 9 aa, Mycobacterium
PSAGGVDGE

SEQ ID NO: 545667 - protein, 8 aa, Mycobacterium
PSAGKSSL

SEQ ID NO: 545668 - protein, 7 aa, Mycobacterium
PSAGLGG

SEQ ID NO: 545669 - protein, 8 aa, Mycobacterium
PSAGLSPK

SEQ ID NO: 545670 - protein, 6 aa, Mycobacterium
PSAGNA

SEQ ID NO: 545671 - protein, 9 aa, Mycobacterium
PSAGPPPFF

SEQ ID NO: 545672 - protein, 9 aa, Mycobacterium
PSAGSVDGE

SEQ ID NO: 545673 - protein, 7 aa, Mycobacterium
PSAGTRL

SEQ ID NO: 545674 - protein, 6 aa, Mycobacterium
PSAHER

SEQ ID NO: 545675 - protein, 7 aa, Mycobacterium
PSAIAAA

SEQ ID NO: 545676 - protein, 16 aa, Mycobacterium
PSAIAAANRAAQERNL

SEQ ID NO: 545677 - protein, 15 aa, Mycobacterium
PSAIEQAKQRAAAAG

SEQ ID NO: 545678 - protein, 6 aa, Mycobacterium
PSAIGP

SEQ ID NO: 545679 - protein, 9 aa, Mycobacterium
PSAIPADGS

SEQ ID NO: 545680 - protein, 15 aa, Mycobacterium
PSAKPGSRASGDDSL

SEQ ID NO: 545681 - protein, 8 aa, Mycobacterium
PSAKPLEE

SEQ ID NO: 545682 - protein, 6 aa, Mycobacterium
PSALGR

SEQ ID NO: 545683 - protein, 6 aa, Mycobacterium
PSALQA

SEQ ID NO: 545684 - protein, 4 aa, Mycobacterium
PSAM

SEQ ID NO: 545685 - protein, 15 aa, Mycobacterium
PSANDPTLAPPGKHA

SEQ ID NO: 545686 - protein, 10 aa, Mycobacterium
PSANINPERT

SEQ ID NO: 545687 - protein, 5 aa, Mycobacterium
PSANP

SEQ ID NO: 545688 - protein, 18 aa, Mycobacterium
PSANSEQLATEQQGSGES

SEQ ID NO: 545689 - protein, 4 aa, Mycobacterium
PSAP

SEQ ID NO: 545690 - protein, 18 aa, Mycobacterium
PSAPAGRGLTAGQRRRRA

SEQ ID NO: 545691 - protein, 19 aa, Mycobacterium
PSAPAGRGLTATQRRRRAI

SEQ ID NO: 545692 - protein, 6 aa, Mycobacterium
PSAPDI

SEQ ID NO: 545693 - protein, 8 aa, Mycobacterium
PSAPDPLR

SEQ ID NO: 545694 - protein, 8 aa, Mycobacterium
PSAPETTQ

SEQ ID NO: 545695 - protein, 15 aa, Mycobacterium
PSAPGFSEQRPLTGD

SEQ ID NO: 545696 - protein, 5 aa, Mycobacterium
PSAPH

SEQ ID NO: 545697 - protein, 27 aa, Mycobacterium
PSAPHVDQTPDVGGPHGGGGADAGPVG

SEQ ID NO: 545698 - protein, 7 aa, Mycobacterium
PSAPLPN

SEQ ID NO: 545699 - protein, 8 aa, Mycobacterium
PSAPLPPH

SEQ ID NO: 545700 - protein, 18 aa, Mycobacterium
PSAPPDPGYDDAGTPTFE

SEQ ID NO: 545701 - protein, 8 aa, Mycobacterium
PSAPPTHR

SEQ ID NO: 545702 - protein, 12 aa, Mycobacterium
PSAPRSATGSGA

SEQ ID NO: 545703 - protein, 35 aa, Mycobacterium
PSAPSPPLPPQAPRPPVPPCPPSPPAPVAPSVNPA

SEQ ID NO: 545704 - protein, 8 aa, Mycobacterium
PSAPTAHQ

SEQ ID NO: 545705 - protein, 8 aa, Mycobacterium
PSAPVDAS

SEQ ID NO: 545706 - protein, 14 aa, Mycobacterium
PSAPYDGPPPRQED

SEQ ID NO: 545707 - protein, 15 aa, Mycobacterium
PSAPYEGPPPGPGDL

SEQ ID NO: 545708 - protein, 7 aa, Mycobacterium
PSAQPDV

SEQ ID NO: 545709 - protein, 9 aa, Mycobacterium
PSAQPGEVA

SEQ ID NO: 545710 - protein, 5 aa, Mycobacterium
PSAQS

SEQ ID NO: 545711 - protein, 5 aa, Mycobacterium
PSARA

SEQ ID NO: 545712 - protein, 7 aa, Mycobacterium
PSARAAL

SEQ ID NO: 545713 - protein, 15 aa, Mycobacterium
PSARADRLAPPPDCA

SEQ ID NO: 545714 - protein, 5 aa, Mycobacterium
PSARD

SEQ ID NO: 545715 - protein, 16 aa, Mycobacterium
PSARETISVGAQAEAE

SEQ ID NO: 545716 - protein, 7 aa, Mycobacterium
PSARNVT

SEQ ID NO: 545717 - protein, 12 aa, Mycobacterium
PSARPAYDGEDA

SEQ ID NO: 545718 - protein, 9 aa, Mycobacterium
PSARPDGER

SEQ ID NO: 545719 - protein, 7 aa, Mycobacterium
PSARPDV

SEQ ID NO: 545720 - protein, 8 aa, Mycobacterium
PSARQKNK

SEQ ID NO: 545721 - protein, 8 aa, Mycobacterium
PSARRHDA

SEQ ID NO: 545722 - protein, 10 aa, Mycobacterium
PSARSIADGP

SEQ ID NO: 545723 - protein, 5 aa, Mycobacterium
PSART

SEQ ID NO: 545724 - protein, 6 aa, Mycobacterium
PSARVR

SEQ ID NO: 545725 - protein, 15 aa, Mycobacterium
PSASAEPGSFRSRAR

SEQ ID NO: 545726 - protein, 15 aa, Mycobacterium
PSASAIAAAEAEPAL

SEQ ID NO: 545727 - protein, 17 aa, Mycobacterium
PSASFDDAGPGAGPLPE

SEQ ID NO: 545728 - protein, 9 aa, Mycobacterium
PSASGAPGT

SEQ ID NO: 545729 - protein, 15 aa, Mycobacterium
PSASGASSQPQLSRE

SEQ ID NO: 545730 - protein, 14 aa, Mycobacterium
PSASGRTLSTRTTQ

SEQ ID NO: 545731 - protein, 11 aa, Mycobacterium
PSASKAAETAV

SEQ ID NO: 545732 - protein, 9 aa, Mycobacterium
PSASLPPEL

SEQ ID NO: 545733 - protein, 13 aa, Mycobacterium
PSASTDDPDDPDH

SEQ ID NO: 545734 - protein, 4 aa, Mycobacterium
PSAT

SEQ ID NO: 545735 - protein, 10 aa, Mycobacterium
PSATAESKAM

SEQ ID NO: 545736 - protein, 9 aa, Mycobacterium
PSATDLAAA

SEQ ID NO: 545737 - protein, 8 aa, Mycobacterium
PSATEERD

SEQ ID NO: 545738 - protein, 5 aa, Mycobacterium
PSATG

SEQ ID NO: 545739 - protein, 12 aa, Mycobacterium
PSATGSPQQCAD

SEQ ID NO: 545740 - protein, 9 aa, Mycobacterium
PSATHSPLT

SEQ ID NO: 545741 - protein, 5 aa, Mycobacterium
PSATQ

SEQ ID NO: 545742 - protein, 5 aa, Mycobacterium
PSATR

SEQ ID NO: 545743 - protein, 5 aa, Mycobacterium
PSATV

SEQ ID NO: 545744 - protein, 20 aa, Mycobacterium
PSATYEDVPTQPSGYAQTAS

SEQ ID NO: 545745 - protein, 8 aa, Mycobacterium
PSAVAPRG

SEQ ID NO: 545746 - protein, 6 aa, Mycobacterium
PSAVDS

SEQ ID NO: 545747 - protein, 6 aa, Mycobacterium
PSAVPQ

SEQ ID NO: 545748 - protein, 14 aa, Mycobacterium
PSAVPQKAIEETEI

SEQ ID NO: 545749 - protein, 6 aa, Mycobacterium
PSAVTA

SEQ ID NO: 545750 - protein, 10 aa, Mycobacterium
PSAVTGAAGE

SEQ ID NO: 545751 - protein, 8 aa, Mycobacterium
PSAYGAPD

SEQ ID NO: 545752 - protein, 5 aa, Mycobacterium
PSCGD

SEQ ID NO: 545753 - protein, 34 aa, Mycobacterium
PSCRPSSRTPLRRRGGHATPRSYTGQLSRAPAPV

SEQ ID NO: 545754 - protein, 7 aa, Mycobacterium
PSCSTGH

SEQ ID NO: 545755 - protein, 5 aa, Mycobacterium
PSDAA

SEQ ID NO: 545756 - protein, 11 aa, Mycobacterium
PSDAAARGLAD

SEQ ID NO: 545757 - protein, 6 aa, Mycobacterium
PSDAEA

SEQ ID NO: 545758 - protein, 6 aa, Mycobacterium
PSDAEP

SEQ ID NO: 545759 - protein, 7 aa, Mycobacterium
PSDAGVS

SEQ ID NO: 545760 - protein, 5 aa, Mycobacterium
PSDAP

SEQ ID NO: 545761 - protein, 9 aa, Mycobacterium
PSDASTLET

SEQ ID NO: 545762 - protein, 7 aa, Mycobacterium
PSDATST

SEQ ID NO: 545763 - protein, 10 aa, Mycobacterium
PSDCGGGGGG

SEQ ID NO: 545764 - protein, 5 aa, Mycobacterium
PSDDA

SEQ ID NO: 545765 - protein, 10 aa, Mycobacterium
PSDDAPQDYV

SEQ ID NO: 545766 - protein, 14 aa, Mycobacterium
PSDDLDSSRRRAGA

SEQ ID NO: 545767 - protein, 10 aa, Mycobacterium
PSDDPPPIED

SEQ ID NO: 545768 - protein, 8 aa, Mycobacterium
PSDDQRQS

SEQ ID NO: 545769 - protein, 4 aa, Mycobacterium
PSDE

SEQ ID NO: 545770 - protein, 10 aa, Mycobacterium
PSDEALSEAT

SEQ ID NO: 545771 - protein, 8 aa, Mycobacterium
PSDEATHE

SEQ ID NO: 545772 - protein, 7 aa, Mycobacterium
PSDEEFA

SEQ ID NO: 545773 - protein, 18 aa, Mycobacterium
PSDEELAAAGLSGAPDPT

SEQ ID NO: 545774 - protein, 5 aa, Mycobacterium
PSDEI

SEQ ID NO: 545775 - protein, 6 aa, Mycobacterium
PSDGAR

SEQ ID NO: 545776 - protein, 8 aa, Mycobacterium
PSDGEFGD

SEQ ID NO: 545777 - protein, 7 aa, Mycobacterium
PSDGHRQ

SEQ ID NO: 545778 - protein, 12 aa, Mycobacterium
PSDGSGGTPVTG

SEQ ID NO: 545779 - protein, 20 aa, Mycobacterium
PSDGTESGNIAHLNPKGIST

SEQ ID NO: 545780 - protein, 16 aa, Mycobacterium
PSDGTTSQGVGAHRDS

SEQ ID NO: 545781 - protein, 7 aa, Mycobacterium
PSDGYRA

SEQ ID NO: 545782 - protein, 4 aa, Mycobacterium
PSDI

SEQ ID NO: 545783 - protein, 13 aa, Mycobacterium
PSDIEANPRQPRQ

SEQ ID NO: 545784 - protein, 5 aa, Mycobacterium
PSDIP

SEQ ID NO: 545785 - protein, 9 aa, Mycobacterium
PSDKHREQF

SEQ ID NO: 545786 - protein, 19 aa, Mycobacterium
PSDKHRVADADRKYTDLAH

SEQ ID NO: 545787 - protein, 8 aa, Mycobacterium
PSDKPSDT

SEQ ID NO: 545788 - protein, 18 aa, Mycobacterium
PSDKSNDPAAGSSSGPRY

SEQ ID NO: 545789 - protein, 4 aa, Mycobacterium
PSDL

SEQ ID NO: 545790 - protein, 11 aa, Mycobacterium
PSDLAGARAAG

SEQ ID NO: 545791 - protein, 8 aa, Mycobacterium
PSDLEAND

SEQ ID NO: 545792 - protein, 16 aa, Mycobacterium
PSDLQDGPSRLVADYR

SEQ ID NO: 545793 - protein, 10 aa, Mycobacterium
PSDLRAARDA

SEQ ID NO: 545794 - protein, 5 aa, Mycobacterium
PSDLT

SEQ ID NO: 545795 - protein, 6 aa, Mycobacterium
PSDMSP

SEQ ID NO: 545796 - protein, 4 aa, Mycobacterium
PSDN

SEQ ID NO: 545797 - protein, 10 aa, Mycobacterium
PSDNAPEGYV

SEQ ID NO: 545798 - protein, 10 aa, Mycobacterium
PSDNAPPDYV

SEQ ID NO: 545799 - protein, 10 aa, Mycobacterium
PSDNAPPGYV

SEQ ID NO: 545800 - protein, 10 aa, Mycobacterium
PSDNAPQDYV

SEQ ID NO: 545801 - protein, 7 aa, Mycobacterium
PSDNPLV

SEQ ID NO: 545802 - protein, 5 aa, Mycobacterium
PSDPA

SEQ ID NO: 545803 - protein, 12 aa, Mycobacterium
PSDPEAYDAASD

SEQ ID NO: 545804 - protein, 11 aa, Mycobacterium
PSDPGECTDPI

SEQ ID NO: 545805 - protein, 9 aa, Mycobacterium
PSDPHDAER

SEQ ID NO: 545806 - protein, 8 aa, Mycobacterium
PSDPKVPY

SEQ ID NO: 545807 - protein, 17 aa, Mycobacterium
PSDPLDGATPSGASSVT

SEQ ID NO: 545808 - protein, 6 aa, Mycobacterium
PSDPLH

SEQ ID NO: 545809 - protein, 14 aa, Mycobacterium
PSDPMDGATPSGAS

SEQ ID NO: 545810 - protein, 10 aa, Mycobacterium
PSDPPATRQA

SEQ ID NO: 545811 - protein, 12 aa, Mycobacterium
PSDPQGSHDQQS

SEQ ID NO: 545812 - protein, 7 aa, Mycobacterium
PSDPRGI

SEQ ID NO: 545813 - protein, 11 aa, Mycobacterium
PSDPSGNTSAL

SEQ ID NO: 545814 - protein, 8 aa, Mycobacterium
PSDPSGSY

SEQ ID NO: 545815 - protein, 7 aa, Mycobacterium
PSDPYTQ

SEQ ID NO: 545816 - protein, 12 aa, Mycobacterium
PSDQEVEPGSVG

SEQ ID NO: 545817 - protein, 12 aa, Mycobacterium
PSDQGHNGENGT

SEQ ID NO: 545818 - protein, 9 aa, Mycobacterium
PSDRDLDAR

SEQ ID NO: 545819 - protein, 10 aa, Mycobacterium
PSDRTAPDTV

SEQ ID NO: 545820 - protein, 8 aa, Mycobacterium
PSDRTDEA

SEQ ID NO: 545821 - protein, 6 aa, Mycobacterium
PSDSAI

SEQ ID NO: 545822 - protein, 11 aa, Mycobacterium
PSDSAQGSAPP

SEQ ID NO: 545823 - protein, 6 aa, Mycobacterium
PSDSRD

SEQ ID NO: 545824 - protein, 28 aa, Mycobacterium
PSDSSAQKLEDLTGKKVSTSLGSAGDGM

SEQ ID NO: 545825 - protein, 10 aa, Mycobacterium
PSDSSASSDA

SEQ ID NO: 545826 - protein, 12 aa, Mycobacterium
PSDTADAVTDRH

SEQ ID NO: 545827 - protein, 8 aa, Mycobacterium
PSDTTPAS

SEQ ID NO: 545828 - protein, 9 aa, Mycobacterium
PSDTTPEST

SEQ ID NO: 545829 - protein, 7 aa, Mycobacterium
PSDTTPV

SEQ ID NO: 545830 - protein, 11 aa, Mycobacterium
PSDVESATTEI

SEQ ID NO: 545831 - protein, 10 aa, Mycobacterium
PSDVGALDAG

SEQ ID NO: 545832 - protein, 5 aa, Mycobacterium
PSDVP

SEQ ID NO: 545833 - protein, 8 aa, Mycobacterium
PSDVPQGT

SEQ ID NO: 545834 - protein, 5 aa, Mycobacterium
PSDVS

SEQ ID NO: 545835 - protein, 5 aa, Mycobacterium
PSDYA

SEQ ID NO: 545836 - protein, 5 aa, Mycobacterium
PSEAA

SEQ ID NO: 545837 - protein, 9 aa, Mycobacterium
PSEAAATDI

SEQ ID NO: 545838 - protein, 10 aa, Mycobacterium
PSEAAKMDPQ

SEQ ID NO: 545839 - protein, 17 aa, Mycobacterium
PSEAEAAERPRSSSHVP

SEQ ID NO: 545840 - protein, 8 aa, Mycobacterium
PSEAGHAG

SEQ ID NO: 545841 - protein, 17 aa, Mycobacterium
PSEARERAEEEAAEEEF

SEQ ID NO: 545842 - protein, 8 aa, Mycobacterium
PSEATGAD

SEQ ID NO: 545843 - protein, 10 aa, Mycobacterium
PSEDAPDRNP

SEQ ID NO: 545844 - protein, 10 aa, Mycobacterium
PSEDEGRFAG

SEQ ID NO: 545845 - protein, 16 aa, Mycobacterium
PSEDGRGEHPGGLPPW

SEQ ID NO: 545846 - protein, 12 aa, Mycobacterium
PSEDGWYDPATG

SEQ ID NO: 545847 - protein, 9 aa, Mycobacterium
PSEDKAANL

SEQ ID NO: 545848 - protein, 5 aa, Mycobacterium
PSEDL

SEQ ID NO: 545849 - protein, 5 aa, Mycobacterium
PSEDR

SEQ ID NO: 545850 - protein, 7 aa, Mycobacterium
PSEDRGG

SEQ ID NO: 545851 - protein, 6 aa, Mycobacterium
PSEDTF

SEQ ID NO: 545852 - protein, 15 aa, Mycobacterium
PSEEELAEAGLPAAA

SEQ ID NO: 545853 - protein, 13 aa, Mycobacterium
PSEEEQPADDPTK

SEQ ID NO: 545854 - protein, 7 aa, Mycobacterium
PSEESAT

SEQ ID NO: 545855 - protein, 6 aa, Mycobacterium
PSEEVK

SEQ ID NO: 545856 - protein, 4 aa, Mycobacterium
PSEF

SEQ ID NO: 545857 - protein, 13 aa, Mycobacterium
PSEFDSNQPIAAP

SEQ ID NO: 545858 - protein, 5 aa, Mycobacterium
PSEFP

SEQ ID NO: 545859 - protein, 6 aa, Mycobacterium
PSEFTD

SEQ ID NO: 545860 - protein, 4 aa, Mycobacterium
PSEG

SEQ ID NO: 545861 - protein, 14 aa, Mycobacterium
PSEGEPVLHDAWLA

SEQ ID NO: 545862 - protein, 5 aa, Mycobacterium
PSEGR

SEQ ID NO: 545863 - protein, 12 aa, Mycobacterium
PSEGRRSGEREI

SEQ ID NO: 545864 - protein, 7 aa, Mycobacterium
PSEGTGT

SEQ ID NO: 545865 - protein, 10 aa, Mycobacterium
PSEGTPRDVG

SEQ ID NO: 545866 - protein, 20 aa, Mycobacterium
PSEHARRQAAAAAQTDGAAA

SEQ ID NO: 545867 - protein, 20 aa, Mycobacterium
PSEHARRQAAAAAQTDGAAT

SEQ ID NO: 545868 - protein, 7 aa, Mycobacterium
PSEHEYG

SEQ ID NO: 545869 - protein, 8 aa, Mycobacterium
PSEHGYAR

SEQ ID NO: 545870 - protein, 4 aa, Mycobacterium
PSEI

SEQ ID NO: 545871 - protein, 7 aa, Mycobacterium
PSEIDEK

SEQ ID NO: 545872 - protein, 9 aa, Mycobacterium
PSEKDPSAS

SEQ ID NO: 545873 - protein, 8 aa, Mycobacterium
PSEKTGSV

SEQ ID NO: 545874 - protein, 5 aa, Mycobacterium
PSEKV

SEQ ID NO: 545875 - protein, 10 aa, Mycobacterium
PSEKYAKGPE

SEQ ID NO: 545876 - protein, 6 aa, Mycobacterium
PSELDE

SEQ ID NO: 545877 - protein, 7 aa, Mycobacterium
PSELGSP

SEQ ID NO: 545878 - protein, 7 aa, Mycobacterium
PSENGNT

SEQ ID NO: 545879 - protein, 6 aa, Mycobacterium
PSENPG

SEQ ID NO: 545880 - protein, 4 aa, Mycobacterium
PSEP

SEQ ID NO: 545881 - protein, 7 aa, Mycobacterium
PSEPGHV

SEQ ID NO: 545882 - protein, 7 aa, Mycobacterium
PSEPGLS

SEQ ID NO: 545883 - protein, 6 aa, Mycobacterium
PSEPHD

SEQ ID NO: 545884 - protein, 7 aa, Mycobacterium
PSEPRRN

SEQ ID NO: 545885 - protein, 6 aa, Mycobacterium
PSEPSD

SEQ ID NO: 545886 - protein, 8 aa, Mycobacterium
PSEPSGRY

SEQ ID NO: 545887 - protein, 7 aa, Mycobacterium
PSEPTQA

SEQ ID NO: 545888 - protein, 8 aa, Mycobacterium
PSEQTGSV

SEQ ID NO: 545889 - protein, 4 aa, Mycobacterium
PSER

SEQ ID NO: 545890 - protein, 29 aa, Mycobacterium
PSERADGGEAIAAPEDELASRRKSRDRKI

SEQ ID NO: 545891 - protein, 5 aa, Mycobacterium
PSERK

SEQ ID NO: 545892 - protein, 8 aa, Mycobacterium
PSERTGSV

SEQ ID NO: 545893 - protein, 7 aa, Mycobacterium
PSERTPL

SEQ ID NO: 545894 - protein, 8 aa, Mycobacterium
PSERTPLS

SEQ ID NO: 545895 - protein, 8 aa, Mycobacterium
PSERTPLT

SEQ ID NO: 545896 - protein, 7 aa, Mycobacterium
PSESALG

SEQ ID NO: 545897 - protein, 10 aa, Mycobacterium
PSESRDEARI

SEQ ID NO: 545898 - protein, 8 aa, Mycobacterium
PSESRHEA

SEQ ID NO: 545899 - protein, 9 aa, Mycobacterium
PSESRHEAQ

SEQ ID NO: 545900 - protein, 31 aa, Mycobacterium
PSESTEPESDDADTNGKHAVAEADTADGDEF

SEQ ID NO: 545901 - protein, 4 aa, Mycobacterium
PSET

SEQ ID NO: 545902 - protein, 11 aa, Mycobacterium
PSETDDASLGG

SEQ ID NO: 545903 - protein, 6 aa, Mycobacterium
PSETEE

SEQ ID NO: 545904 - protein, 8 aa, Mycobacterium
PSETNPTL

SEQ ID NO: 545905 - protein, 16 aa, Mycobacterium
PSETPGASESAGQTPE

SEQ ID NO: 545906 - protein, 8 aa, Mycobacterium
PSETPLED

SEQ ID NO: 545907 - protein, 15 aa, Mycobacterium
PSETTPSLPECAGAA

SEQ ID NO: 545908 - protein, 15 aa, Mycobacterium
PSETTPSLPECSGAA

SEQ ID NO: 545909 - protein, 17 aa, Mycobacterium
PSEVPGGAEIPEPPTDL

SEQ ID NO: 545910 - protein, 7 aa, Mycobacterium
PSEVTPL

SEQ ID NO: 545911 - protein, 8 aa, Mycobacterium
PSEYGADD

SEQ ID NO: 545912 - protein, 23 aa, Mycobacterium
PSEYGPSNTPMNSPAAIRPRLNQ

SEQ ID NO: 545913 - protein, 8 aa, Mycobacterium
PSEYKRAE

SEQ ID NO: 545914 - protein, 9 aa, Mycobacterium
PSFAENADA

SEQ ID NO: 545915 - protein, 6 aa, Mycobacterium
PSFDGE

SEQ ID NO: 545916 - protein, 10 aa, Mycobacterium
PSFDPPTHTA

SEQ ID NO: 545917 - protein, 19 aa, Mycobacterium
PSFEAPANPSGGRVTFSDS

SEQ ID NO: 545918 - protein, 11 aa, Mycobacterium
PSFEDTQTQVQ

SEQ ID NO: 545919 - protein, 4 aa, Mycobacterium
PSFG

SEQ ID NO: 545920 - protein, 11 aa, Mycobacterium
PSFGKRGYNEK

SEQ ID NO: 545921 - protein, 7 aa, Mycobacterium
PSFGRGP

SEQ ID NO: 545922 - protein, 10 aa, Mycobacterium
PSFKENATAQ

SEQ ID NO: 545923 - protein, 7 aa, Mycobacterium
PSFPRRD

SEQ ID NO: 545924 - protein, 10 aa, Mycobacterium
PSFTENADAP

SEQ ID NO: 545925 - protein, 11 aa, Mycobacterium
PSFTENASAPI

SEQ ID NO: 545926 - protein, 6 aa, Mycobacterium
PSFTGD

SEQ ID NO: 545927 - protein, 4 aa, Mycobacterium
PSFV

SEQ ID NO: 545928 - protein, 6 aa, Mycobacterium
PSGAAE

SEQ ID NO: 545929 - protein, 7 aa, Mycobacterium
PSGAAYS

SEQ ID NO: 545930 - protein, 7 aa, Mycobacterium
PSGAESA

SEQ ID NO: 545931 - protein, 8 aa, Mycobacterium
PSGAGKST

SEQ ID NO: 545932 - protein, 11 aa, Mycobacterium
PSGAGKTTTLK

SEQ ID NO: 545933 - protein, 7 aa, Mycobacterium
PSGALAD

SEQ ID NO: 545934 - protein, 14 aa, Mycobacterium
PSGANEDDIKATYD

SEQ ID NO: 545935 - protein, 5 aa, Mycobacterium
PSGAT

SEQ ID NO: 545936 - protein, 13 aa, Mycobacterium
PSGATNRKDYTAD

SEQ ID NO: 545937 - protein, 10 aa, Mycobacterium
PSGATTKAEG

SEQ ID NO: 545938 - protein, 5 aa, Mycobacterium
PSGAV

SEQ ID NO: 545939 - protein, 14 aa, Mycobacterium
PSGAYTSSGHPEQS

SEQ ID NO: 545940 - protein, 4 aa, Mycobacterium
PSGC

SEQ ID NO: 545941 - protein, 9 aa, Mycobacterium
PSGCGKTTS

SEQ ID NO: 545942 - protein, 9 aa, Mycobacterium
PSGCGKTTT

SEQ ID NO: 545943 - protein, 7 aa, Mycobacterium
PSGDAAR

SEQ ID NO: 545944 - protein, 7 aa, Mycobacterium
PSGDAAT

SEQ ID NO: 545945 - protein, 9 aa, Mycobacterium
PSGDEMSQR

SEQ ID NO: 545946 - protein, 8 aa, Mycobacterium
PSGDGVRV

SEQ ID NO: 545947 - protein, 7 aa, Mycobacterium
PSGDHRA

SEQ ID NO: 545948 - protein, 7 aa, Mycobacterium
PSGDQRD

SEQ ID NO: 545949 - protein, 6 aa, Mycobacterium
PSGDRS

SEQ ID NO: 545950 - protein, 6 aa, Mycobacterium
PSGDTA

SEQ ID NO: 545951 - protein, 5 aa, Mycobacterium
PSGEF

SEQ ID NO: 545952 - protein, 5 aa, Mycobacterium
PSGEL

SEQ ID NO: 545953 - protein, 13 aa, Mycobacterium
PSGELKTKPTQHS

SEQ ID NO: 545954 - protein, 30 aa, Mycobacterium
PSGEQAAEDSAEESTDAAEGEAAEDADDTD

SEQ ID NO: 545955 - protein, 5 aa, Mycobacterium
PSGER

SEQ ID NO: 545956 - protein, 6 aa, Mycobacterium
PSGERV

SEQ ID NO: 545957 - protein, 7 aa, Mycobacterium
PSGETPD

SEQ ID NO: 545958 - protein, 4 aa, Mycobacterium
PSGG

SEQ ID NO: 545959 - protein, 9 aa, Mycobacterium
PSGGEPQRV

SEQ ID NO: 545960 - protein, 5 aa, Mycobacterium
PSGGG

SEQ ID NO: 545961 - protein, 8 aa, Mycobacterium
PSGGGKTT

SEQ ID NO: 545962 - protein, 10 aa, Mycobacterium
PSGGHGCANP

SEQ ID NO: 545963 - protein, 5 aa, Mycobacterium
PSGGL

SEQ ID NO: 545964 - protein, 13 aa, Mycobacterium
PSGGRHSVTHQDE

SEQ ID NO: 545965 - protein, 4 aa, Mycobacterium
PSGH

SEQ ID NO: 545966 - protein, 10 aa, Mycobacterium
PSGHPAAKPF

SEQ ID NO: 545967 - protein, 7 aa, Mycobacterium
PSGHTED

SEQ ID NO: 545968 - protein, 10 aa, Mycobacterium
PSGHVSREPI

SEQ ID NO: 545969 - protein, 5 aa, Mycobacterium
PSGID

SEQ ID NO: 545970 - protein, 14 aa, Mycobacterium
PSGIIGNGGATGAL

SEQ ID NO: 545971 - protein, 14 aa, Mycobacterium
PSGIIGNGGPSGAL

SEQ ID NO: 545972 - protein, 15 aa, Mycobacterium
PSGIKEGASFVIPTM

SEQ ID NO: 545973 - protein, 4 aa, Mycobacterium
PSGK

SEQ ID NO: 545974 - protein, 8 aa, Mycobacterium
PSGKAALP

SEQ ID NO: 545975 - protein, 10 aa, Mycobacterium
PSGKFTSGPH

SEQ ID NO: 545976 - protein, 5 aa, Mycobacterium
PSGKH

SEQ ID NO: 545977 - protein, 23 aa, Mycobacterium
PSGKHSSAVKAAEAADAVRHGAD

SEQ ID NO: 545978 - protein, 16 aa, Mycobacterium
PSGKPGAGSNRDGAAG

SEQ ID NO: 545979 - protein, 18 aa, Mycobacterium
PSGKQGAGSNRDGAAGAD

SEQ ID NO: 545980 - protein, 24 aa, Mycobacterium
PSGKTPSDQLDRSAASAAAQPTQT

SEQ ID NO: 545981 - protein, 4 aa, Mycobacterium
PSGL

SEQ ID NO: 545982 - protein, 56 aa, Mycobacterium
PSGLAPTRAQPPGPVRAQPPHSPAQGQPPPAPAPTRPQSEPAPVDGRRAGKPAKLV

SEQ ID NO: 545983 - protein, 5 aa, Mycobacterium
PSGLE

SEQ ID NO: 545984 - protein, 8 aa, Mycobacterium
PSGLGSPI

SEQ ID NO: 545985 - protein, 10 aa, Mycobacterium
PSGLSADDNL

SEQ ID NO: 545986 - protein, 10 aa, Mycobacterium
PSGLSPDDDL

SEQ ID NO: 545987 - protein, 14 aa, Mycobacterium
PSGMPGPPGPSAKL

SEQ ID NO: 545988 - protein, 11 aa, Mycobacterium
PSGNEAGANEQ

SEQ ID NO: 545989 - protein, 11 aa, Mycobacterium
PSGNPKGLSDY

SEQ ID NO: 545990 - protein, 9 aa, Mycobacterium
PSGNRDEDV

SEQ ID NO: 545991 - protein, 9 aa, Mycobacterium
PSGNRDEEV

SEQ ID NO: 545992 - protein, 6 aa, Mycobacterium
PSGNYK

SEQ ID NO: 545993 - protein, 4 aa, Mycobacterium
PSGP

SEQ ID NO: 545994 - protein, 5 aa, Mycobacterium
PSGPA

SEQ ID NO: 545995 - protein, 8 aa, Mycobacterium
PSGPAGAA

SEQ ID NO: 545996 - protein, 7 aa, Mycobacterium
PSGPAGR

SEQ ID NO: 545997 - protein, 6 aa, Mycobacterium
PSGPDI

SEQ ID NO: 545998 - protein, 8 aa, Mycobacterium
PSGPENCA

SEQ ID NO: 545999 - protein, 10 aa, Mycobacterium
PSGPGNGEAR

SEQ ID NO: 546000 - protein, 13 aa, Mycobacterium
PSGPGRPELVDLC

SEQ ID NO: 546001 - protein, 11 aa, Mycobacterium
PSGPGRPHPRS

SEQ ID NO: 546002 - protein, 15 aa, Mycobacterium
PSGPGVGNSTSVESS

SEQ ID NO: 546003 - protein, 6 aa, Mycobacterium
PSGPLT

SEQ ID NO: 546004 - protein, 9 aa, Mycobacterium
PSGPPGQRM

SEQ ID NO: 546005 - protein, 8 aa, Mycobacterium
PSGPSAET

SEQ ID NO: 546006 - protein, 9 aa, Mycobacterium
PSGPSAETV

SEQ ID NO: 546007 - protein, 10 aa, Mycobacterium
PSGPSTNPEY

SEQ ID NO: 546008 - protein, 6 aa, Mycobacterium
PSGPTA

SEQ ID NO: 546009 - protein, 5 aa, Mycobacterium
PSGPV

SEQ ID NO: 546010 - protein, 6 aa, Mycobacterium
PSGPVT

SEQ ID NO: 546011 - protein, 4 aa, Mycobacterium
PSGQ

SEQ ID NO: 546012 - protein, 8 aa, Mycobacterium
PSGQDADF

SEQ ID NO: 546013 - protein, 7 aa, Mycobacterium
PSGQRGR

SEQ ID NO: 546014 - protein, 5 aa, Mycobacterium
PSGQV

SEQ ID NO: 546015 - protein, 15 aa, Mycobacterium
PSGRCSMRSRILCQR

SEQ ID NO: 546016 - protein, 8 aa, Mycobacterium
PSGRDEAL

SEQ ID NO: 546017 - protein, 8 aa, Mycobacterium
PSGRIERD

SEQ ID NO: 546018 - protein, 14 aa, Mycobacterium
PSGRPESGYAPSAG

SEQ ID NO: 546019 - protein, 8 aa, Mycobacterium
PSGRPFPP

SEQ ID NO: 546020 - protein, 6 aa, Mycobacterium
PSGRRR

SEQ ID NO: 546021 - protein, 9 aa, Mycobacterium
PSGRRSAQE

SEQ ID NO: 546022 - protein, 9 aa, Mycobacterium
PSGRRTAKE

SEQ ID NO: 546023 - protein, 5 aa, Mycobacterium
PSGRS

SEQ ID NO: 546024 - protein, 7 aa, Mycobacterium
PSGRTKE

SEQ ID NO: 546025 - protein, 7 aa, Mycobacterium
PSGRVAT

SEQ ID NO: 546026 - protein, 10 aa, Mycobacterium
PSGRVSREPL

SEQ ID NO: 546027 - protein, 4 aa, Mycobacterium
PSGS

SEQ ID NO: 546028 - protein, 5 aa, Mycobacterium
PSGSD

SEQ ID NO: 546029 - protein, 9 aa, Mycobacterium
PSGSDRSEL

SEQ ID NO: 546030 - protein, 8 aa, Mycobacterium
PSGSEPHG

SEQ ID NO: 546031 - protein, 6 aa, Mycobacterium
PSGSGH

SEQ ID NO: 546032 - protein, 9 aa, Mycobacterium
PSGSGKSTA

SEQ ID NO: 546033 - protein, 8 aa, Mycobacterium
PSGSGNYS

SEQ ID NO: 546034 - protein, 7 aa, Mycobacterium
PSGSPVD

SEQ ID NO: 546035 - protein, 10 aa, Mycobacterium
PSGSSTPPQA

SEQ ID NO: 546036 - protein, 12 aa, Mycobacterium
PSGSTVDATETV

SEQ ID NO: 546037 - protein, 11 aa, Mycobacterium
PSGSTVDPTEA

SEQ ID NO: 546038 - protein, 9 aa, Mycobacterium
PSGTPGDTL

SEQ ID NO: 546039 - protein, 12 aa, Mycobacterium
PSGTPGFTVEPG

SEQ ID NO: 546040 - protein, 12 aa, Mycobacterium
PSGTPRRAEPGT

SEQ ID NO: 546041 - protein, 6 aa, Mycobacterium
PSGTPV

SEQ ID NO: 546042 - protein, 10 aa, Mycobacterium
PSGTQPGDRK

SEQ ID NO: 546043 - protein, 9 aa, Mycobacterium
PSGTRSTLE

SEQ ID NO: 546044 - protein, 10 aa, Mycobacterium
PSGTTRQAYY

SEQ ID NO: 546045 - protein, 7 aa, Mycobacterium
PSGTVEE

SEQ ID NO: 546046 - protein, 6 aa, Mycobacterium
PSGVAA

SEQ ID NO: 546047 - protein, 7 aa, Mycobacterium
PSGVEPR

SEQ ID NO: 546048 - protein, 5 aa, Mycobacterium
PSGVG

SEQ ID NO: 546049 - protein, 10 aa, Mycobacterium
PSGVQTSENL

SEQ ID NO: 546050 - protein, 12 aa, Mycobacterium
PSGVSAGRPSVT

SEQ ID NO: 546051 - protein, 17 aa, Mycobacterium
PSGVSTTSDHPQRSSMT

SEQ ID NO: 546052 - protein, 7 aa, Mycobacterium
PSGVVDP

SEQ ID NO: 546053 - protein, 8 aa, Mycobacterium
PSGYTDTE

SEQ ID NO: 546054 - protein, 6 aa, Mycobacterium
PSHAKE

SEQ ID NO: 546055 - protein, 10 aa, Mycobacterium
PSHAPPTGSM

SEQ ID NO: 546056 - protein, 10 aa, Mycobacterium
PSHATGRTLP

SEQ ID NO: 546057 - protein, 5 aa, Mycobacterium
PSHDD

SEQ ID NO: 546058 - protein, 6 aa, Mycobacterium
PSHDDG

SEQ ID NO: 546059 - protein, 4 aa, Mycobacterium
PSHE

SEQ ID NO: 546060 - protein, 7 aa, Mycobacterium
PSHEELQ

SEQ ID NO: 546061 - protein, 8 aa, Mycobacterium
PSHESPRS

SEQ ID NO: 546062 - protein, 25 aa, Mycobacterium
PSHLDPPHVPAPPTADEDLRTKPAA

SEQ ID NO: 546063 - protein, 31 aa, Mycobacterium
PSHNPPADGGFKYNPPNGGPADTDATNAIAK

SEQ ID NO: 546064 - protein, 31 aa, Mycobacterium
PSHNPPSDGGFKYNPPNGGPADTDATNAIAK

SEQ ID NO: 546065 - protein, 12 aa, Mycobacterium
PSHPENRSDLGR

SEQ ID NO: 546066 - protein, 6 aa, Mycobacterium
PSHPGH

SEQ ID NO: 546067 - protein, 7 aa, Mycobacterium
PSHPGHE

SEQ ID NO: 546068 - protein, 17 aa, Mycobacterium
PSHPLRKDTRGERDGTA

SEQ ID NO: 546069 - protein, 12 aa, Mycobacterium
PSHPTGKPLPAP

SEQ ID NO: 546070 - protein, 10 aa, Mycobacterium
PSHPTQGEGP

SEQ ID NO: 546071 - protein, 6 aa, Mycobacterium
PSHPYT

SEQ ID NO: 546072 - protein, 12 aa, Mycobacterium
PSHRTAGGSRGG

SEQ ID NO: 546073 - protein, 10 aa, Mycobacterium
PSHSDGQTGA

SEQ ID NO: 546074 - protein, 5 aa, Mycobacterium
PSHSG

SEQ ID NO: 546075 - protein, 10 aa, Mycobacterium
PSHSKFGAEG

SEQ ID NO: 546076 - protein, 4 aa, Mycobacterium
PSIA

SEQ ID NO: 546077 - protein, 9 aa, Mycobacterium
PSIDPATQE

SEQ ID NO: 546078 - protein, 11 aa, Mycobacterium
PSIDPDNPPFS

SEQ ID NO: 546079 - protein, 17 aa, Mycobacterium
PSIEAQPGTPLPYPAPE

SEQ ID NO: 546080 - protein, 10 aa, Mycobacterium
PSIGTVGDSF

SEQ ID NO: 546081 - protein, 4 aa, Mycobacterium
PSIL

SEQ ID NO: 546082 - protein, 15 aa, Mycobacterium
PSILSDDQRGSGAQT

SEQ ID NO: 546083 - protein, 9 aa, Mycobacterium
PSINPATGT

SEQ ID NO: 546084 - protein, 6 aa, Mycobacterium
PSIPDA

SEQ ID NO: 546085 - protein, 7 aa, Mycobacterium
PSIPDDL

SEQ ID NO: 546086 - protein, 15 aa, Mycobacterium
PSIRSRRRALQGVRT

SEQ ID NO: 546087 - protein, 11 aa, Mycobacterium
PSISRTATNAE

SEQ ID NO: 546088 - protein, 6 aa, Mycobacterium
PSKATG

SEQ ID NO: 546089 - protein, 12 aa, Mycobacterium
PSKDAARIEGSK

SEQ ID NO: 546090 - protein, 8 aa, Mycobacterium
PSKDEAKK

SEQ ID NO: 546091 - protein, 15 aa, Mycobacterium
PSKDSEHGWTANGEK

SEQ ID NO: 546092 - protein, 5 aa, Mycobacterium
PSKEE

SEQ ID NO: 546093 - protein, 11 aa, Mycobacterium
PSKENHVNPGI

SEQ ID NO: 546094 - protein, 6 aa, Mycobacterium
PSKEQL

SEQ ID NO: 546095 - protein, 10 aa, Mycobacterium
PSKKDNETAL

SEQ ID NO: 546096 - protein, 8 aa, Mycobacterium
PSKLEDSA

SEQ ID NO: 546097 - protein, 8 aa, Mycobacterium
PSKLGSPV

SEQ ID NO: 546098 - protein, 17 aa, Mycobacterium
PSKPARYPNGRALTDDV

SEQ ID NO: 546099 - protein, 7 aa, Mycobacterium
PSKTDTE

SEQ ID NO: 546100 - protein, 13 aa, Mycobacterium
PSKTFNEVLAAAQ

SEQ ID NO: 546101 - protein, 8 aa, Mycobacterium
PSKTGASV

SEQ ID NO: 546102 - protein, 13 aa, Mycobacterium
PSKTLNAALEAAQ

SEQ ID NO: 546103 - protein, 10 aa, Mycobacterium
PSKTPKQKRQ

SEQ ID NO: 546104 - protein, 7 aa, Mycobacterium
PSKVPAM

SEQ ID NO: 546105 - protein, 9 aa, Mycobacterium
PSKYTGPHD

SEQ ID NO: 546106 - protein, 16 aa, Mycobacterium
PSLAATQPVATSSGGL

SEQ ID NO: 546107 - protein, 15 aa, Mycobacterium
PSLADLTPDTLRRVD

SEQ ID NO: 546108 - protein, 6 aa, Mycobacterium
PSLAGT

SEQ ID NO: 546109 - protein, 10 aa, Mycobacterium
PSLAGTRVEP

SEQ ID NO: 546110 - protein, 11 aa, Mycobacterium
PSLAPQLEGTA

SEQ ID NO: 546111 - protein, 8 aa, Mycobacterium
PSLASADA

SEQ ID NO: 546112 - protein, 4 aa, Mycobacterium
PSLE

SEQ ID NO: 546113 - protein, 7 aa, Mycobacterium
PSLEEND

SEQ ID NO: 546114 - protein, 4 aa, Mycobacterium
PSLG

SEQ ID NO: 546115 - protein, 6 aa, Mycobacterium
PSLGGP

SEQ ID NO: 546116 - protein, 10 aa, Mycobacterium
PSLGQRPVAG

SEQ ID NO: 546117 - protein, 7 aa, Mycobacterium
PSLGRSG

SEQ ID NO: 546118 - protein, 5 aa, Mycobacterium
PSLGS

SEQ ID NO: 546119 - protein, 21 aa, Mycobacterium
PSLHAETDAFRNAGRQRGYRS

SEQ ID NO: 546120 - protein, 14 aa, Mycobacterium
PSLKEGGRIPPKAA

SEQ ID NO: 546121 - protein, 5 aa, Mycobacterium
PSLLP

SEQ ID NO: 546122 - protein, 4 aa, Mycobacterium
PSLM

SEQ ID NO: 546123 - protein, 27 aa, Mycobacterium
PSLNASDSKAMAQASHGAAPDIAGRDV

SEQ ID NO: 546124 - protein, 8 aa, Mycobacterium
PSLNGRQA

SEQ ID NO: 546125 - protein, 4 aa, Mycobacterium
PSLP

SEQ ID NO: 546126 - protein, 6 aa, Mycobacterium
PSLPAA

SEQ ID NO: 546127 - protein, 8 aa, Mycobacterium
PSLPAALG

SEQ ID NO: 546128 - protein, 5 aa, Mycobacterium
PSLPD

SEQ ID NO: 546129 - protein, 12 aa, Mycobacterium
PSLPEPPSLPSL

SEQ ID NO: 546130 - protein, 23 aa, Mycobacterium
PSLPSDYGALGGGDGDTTGSGAH

SEQ ID NO: 546131 - protein, 17 aa, Mycobacterium
PSLPSMPGGGSGGGLPM

SEQ ID NO: 546132 - protein, 6 aa, Mycobacterium
PSLPSN

SEQ ID NO: 546133 - protein, 9 aa, Mycobacterium
PSLPSNNPM

SEQ ID NO: 546134 - protein, 6 aa, Mycobacterium
PSLPVP

SEQ ID NO: 546135 - protein, 16 aa, Mycobacterium
PSLQGDTSLGRTVGDS

SEQ ID NO: 546136 - protein, 12 aa, Mycobacterium
PSLQGTITDDEK

SEQ ID NO: 546137 - protein, 7 aa, Mycobacterium
PSLQTEV

SEQ ID NO: 546138 - protein, 13 aa, Mycobacterium
PSLRASADAENLE

SEQ ID NO: 546139 - protein, 14 aa, Mycobacterium
PSLRDAGPKAPAAE

SEQ ID NO: 546140 - protein, 16 aa, Mycobacterium
PSLRGDTSLGRPVGGS

SEQ ID NO: 546141 - protein, 6 aa, Mycobacterium
PSLRGR

SEQ ID NO: 546142 - protein, 6 aa, Mycobacterium
PSLRPR

SEQ ID NO: 546143 - protein, 5 aa, Mycobacterium
PSLRS

SEQ ID NO: 546144 - protein, 4 aa, Mycobacterium
PSLS

SEQ ID NO: 546145 - protein, 6 aa, Mycobacterium
PSLSAT

SEQ ID NO: 546146 - protein, 10 aa, Mycobacterium
PSLSKRGRRS

SEQ ID NO: 546147 - protein, 5 aa, Mycobacterium
PSLSL

SEQ ID NO: 546148 - protein, 14 aa, Mycobacterium
PSLTITRDGSRDVV

SEQ ID NO: 546149 - protein, 5 aa, Mycobacterium
PSLTS

SEQ ID NO: 546150 - protein, 7 aa, Mycobacterium
PSLTTPA

SEQ ID NO: 546151 - protein, 6 aa, Mycobacterium
PSLTTV

SEQ ID NO: 546152 - protein, 20 aa, Mycobacterium
PSLTVTRDGSRDAVSNARPV

SEQ ID NO: 546153 - protein, 9 aa, Mycobacterium
PSLVGPPGG

SEQ ID NO: 546154 - protein, 5 aa, Mycobacterium
PSMEP

SEQ ID NO: 546155 - protein, 25 aa, Mycobacterium
PSMRSELSRRGDESLRYERHDHPRT

SEQ ID NO: 546156 - protein, 13 aa, Mycobacterium
PSNAPVIRAAREN

SEQ ID NO: 546157 - protein, 5 aa, Mycobacterium
PSNAT

SEQ ID NO: 546158 - protein, 6 aa, Mycobacterium
PSNEAP

SEQ ID NO: 546159 - protein, 6 aa, Mycobacterium
PSNESI

SEQ ID NO: 546160 - protein, 5 aa, Mycobacterium
PSNGD

SEQ ID NO: 546161 - protein, 9 aa, Mycobacterium
PSNGGSVNA

SEQ ID NO: 546162 - protein, 7 aa, Mycobacterium
PSNGRAV

SEQ ID NO: 546163 - protein, 6 aa, Mycobacterium
PSNGRL

SEQ ID NO: 546164 - protein, 8 aa, Mycobacterium
PSNGTAPK

SEQ ID NO: 546165 - protein, 18 aa, Mycobacterium
PSNISGATIPEGAQSTGK

SEQ ID NO: 546166 - protein, 9 aa, Mycobacterium
PSNIYQSAN

SEQ ID NO: 546167 - protein, 8 aa, Mycobacterium
PSNLAAAG

SEQ ID NO: 546168 - protein, 16 aa, Mycobacterium
PSNLDPPLDKAPADKA

SEQ ID NO: 546169 - protein, 4 aa, Mycobacterium
PSNN

SEQ ID NO: 546170 - protein, 21 aa, Mycobacterium
PSNNASEPPRYPGPEPTDGAI

SEQ ID NO: 546171 - protein, 6 aa, Mycobacterium
PSNPAD

SEQ ID NO: 546172 - protein, 26 aa, Mycobacterium
PSNPYPLATPDDLAETERSVKETGRR

SEQ ID NO: 546173 - protein, 6 aa, Mycobacterium
PSNRDR

SEQ ID NO: 546174 - protein, 5 aa, Mycobacterium
PSNRL

SEQ ID NO: 546175 - protein, 5 aa, Mycobacterium
PSNRY

SEQ ID NO: 546176 - protein, 21 aa, Mycobacterium
PSNSNAAAARDVADGRAEAAV

SEQ ID NO: 546177 - protein, 30 aa, Mycobacterium
PSNSPEEDSREQRPAEQSDSQTNEADPGVV

SEQ ID NO: 546178 - protein, 30 aa, Mycobacterium
PSNSPEEQRREQRPADQSDGQSSEPDPGVV

SEQ ID NO: 546179 - protein, 6 aa, Mycobacterium
PSNTQV

SEQ ID NO: 546180 - protein, 6 aa, Mycobacterium
PSNTRV

SEQ ID NO: 546181 - protein, 6 aa, Mycobacterium
PSNVDW

SEQ ID NO: 546182 - protein, 8 aa, Mycobacterium
PSNVRRRD

SEQ ID NO: 546183 - protein, 6 aa, Mycobacterium
PSNVST

SEQ ID NO: 546184 - protein, 12 aa, Mycobacterium
PSNVYTDGKPAH

SEQ ID NO: 546185 - protein, 4 aa, Mycobacterium
PSPA

SEQ ID NO: 546186 - protein, 7 aa, Mycobacterium
PSPAAAA

SEQ ID NO: 546187 - protein, 7 aa, Mycobacterium
PSPAAAL

SEQ ID NO: 546188 - protein, 10 aa, Mycobacterium
PSPAARATAL

SEQ ID NO: 546189 - protein, 10 aa, Mycobacterium
PSPADDDPRW

SEQ ID NO: 546190 - protein, 19 aa, Mycobacterium
PSPAEDKDTLAVTEETAQR

SEQ ID NO: 546191 - protein, 9 aa, Mycobacterium
PSPAESSSA

SEQ ID NO: 546192 - protein, 7 aa, Mycobacterium
PSPAGDL

SEQ ID NO: 546193 - protein, 7 aa, Mycobacterium
PSPAHDD

SEQ ID NO: 546194 - protein, 6 aa, Mycobacterium
PSPALG

SEQ ID NO: 546195 - protein, 8 aa, Mycobacterium
PSPANGID

SEQ ID NO: 546196 - protein, 7 aa, Mycobacterium
PSPARID

SEQ ID NO: 546197 - protein, 7 aa, Mycobacterium
PSPARQD

SEQ ID NO: 546198 - protein, 12 aa, Mycobacterium
PSPARTYCTRTV

SEQ ID NO: 546199 - protein, 5 aa, Mycobacterium
PSPAS

SEQ ID NO: 546200 - protein, 12 aa, Mycobacterium
PSPASPELPPDT

SEQ ID NO: 546201 - protein, 8 aa, Mycobacterium
PSPASYAK

SEQ ID NO: 546202 - protein, 11 aa, Mycobacterium
PSPATNAPNVD

SEQ ID NO: 546203 - protein, 12 aa, Mycobacterium
PSPATPALPDDT

SEQ ID NO: 546204 - protein, 7 aa, Mycobacterium
PSPATRE

SEQ ID NO: 546205 - protein, 5 aa, Mycobacterium
PSPAV

SEQ ID NO: 546206 - protein, 8 aa, Mycobacterium
PSPDAVAT

SEQ ID NO: 546207 - protein, 6 aa, Mycobacterium
PSPDLD

SEQ ID NO: 546208 - protein, 10 aa, Mycobacterium
PSPDPDTATT

SEQ ID NO: 546209 - protein, 5 aa, Mycobacterium
PSPDR

SEQ ID NO: 546210 - protein, 6 aa, Mycobacterium
PSPDRI

SEQ ID NO: 546211 - protein, 6 aa, Mycobacterium
PSPDYD

SEQ ID NO: 546212 - protein, 6 aa, Mycobacterium
PSPEAI

SEQ ID NO: 546213 - protein, 7 aa, Mycobacterium
PSPEAIA

SEQ ID NO: 546214 - protein, 7 aa, Mycobacterium
PSPEAIR

SEQ ID NO: 546215 - protein, 6 aa, Mycobacterium
PSPEGP

SEQ ID NO: 546216 - protein, 18 aa, Mycobacterium
PSPELPPPARKPQDHCGN

SEQ ID NO: 546217 - protein, 17 aa, Mycobacterium
PSPFAGVGTGPSAGVGA

SEQ ID NO: 546218 - protein, 6 aa, Mycobacterium
PSPFTP

SEQ ID NO: 546219 - protein, 7 aa, Mycobacterium
PSPGDMQ

SEQ ID NO: 546220 - protein, 8 aa, Mycobacterium
PSPGGREE

SEQ ID NO: 546221 - protein, 5 aa, Mycobacterium
PSPGM

SEQ ID NO: 546222 - protein, 6 aa, Mycobacterium
PSPGRP

SEQ ID NO: 546223 - protein, 4 aa, Mycobacterium
PSPH

SEQ ID NO: 546224 - protein, 5 aa, Mycobacterium
PSPHI

SEQ ID NO: 546225 - protein, 5 aa, Mycobacterium
PSPHT

SEQ ID NO: 546226 - protein, 4 aa, Mycobacterium
PSPI

SEQ ID NO: 546227 - protein, 12 aa, Mycobacterium
PSPIGTTVFDRL

SEQ ID NO: 546228 - protein, 6 aa, Mycobacterium
PSPIRD

SEQ ID NO: 546229 - protein, 16 aa, Mycobacterium
PSPIRNLDDPDAPEAV

SEQ ID NO: 546230 - protein, 4 aa, Mycobacterium
PSPK

SEQ ID NO: 546231 - protein, 17 aa, Mycobacterium
PSPKGLDQMVSSAVALE

SEQ ID NO: 546232 - protein, 7 aa, Mycobacterium
PSPKLPD

SEQ ID NO: 546233 - protein, 6 aa, Mycobacterium
PSPKPF

SEQ ID NO: 546234 - protein, 5 aa, Mycobacterium
PSPLA

SEQ ID NO: 546235 - protein, 5 aa, Mycobacterium
PSPLD

SEQ ID NO: 546236 - protein, 16 aa, Mycobacterium
PSPLDPQNAPQDRPLN

SEQ ID NO: 546237 - protein, 9 aa, Mycobacterium
PSPLDPRVG

SEQ ID NO: 546238 - protein, 10 aa, Mycobacterium
PSPLSSGSAK

SEQ ID NO: 546239 - protein, 6 aa, Mycobacterium
PSPLTP

SEQ ID NO: 546240 - protein, 10 aa, Mycobacterium
PSPNAMEVGP

SEQ ID NO: 546241 - protein, 9 aa, Mycobacterium
PSPNDDTLA

SEQ ID NO: 546242 - protein, 7 aa, Mycobacterium
PSPNGHI

SEQ ID NO: 546243 - protein, 7 aa, Mycobacterium
PSPPADL

SEQ ID NO: 546244 - protein, 28 aa, Mycobacterium
PSPPLLPQSQRDVRDAVNARSAAPSGRA

SEQ ID NO: 546245 - protein, 9 aa, Mycobacterium
PSPPPAPPR

SEQ ID NO: 546246 - protein, 21 aa, Mycobacterium
PSPPPGLAGPDDDRRERADAD

SEQ ID NO: 546247 - protein, 21 aa, Mycobacterium
PSPPPGLAGPGDERRARADAD

SEQ ID NO: 546248 - protein, 30 aa, Mycobacterium
PSPPPGPAVGASEATGEHSADDPRRAQADA

SEQ ID NO: 546249 - protein, 15 aa, Mycobacterium
PSPPRAHTPAPPPDW

SEQ ID NO: 546250 - protein, 14 aa, Mycobacterium
PSPPRGYTSTLPPE

SEQ ID NO: 546251 - protein, 10 aa, Mycobacterium
PSPPSTFQGQ

SEQ ID NO: 546252 - protein, 8 aa, Mycobacterium
PSPPVPTM

SEQ ID NO: 546253 - protein, 4 aa, Mycobacterium
PSPQ

SEQ ID NO: 546254 - protein, 6 aa, Mycobacterium
PSPQLG

SEQ ID NO: 546255 - protein, 7 aa, Mycobacterium
PSPQRRA

SEQ ID NO: 546256 - protein, 6 aa, Mycobacterium
PSPQRT

SEQ ID NO: 546257 - protein, 6 aa, Mycobacterium
PSPRAG

SEQ ID NO: 546258 - protein, 5 aa, Mycobacterium
PSPRN

SEQ ID NO: 546259 - protein, 9 aa, Mycobacterium
PSPRQYTRK

SEQ ID NO: 546260 - protein, 16 aa, Mycobacterium
PSPRRELATREDAQQY

SEQ ID NO: 546261 - protein, 24 aa, Mycobacterium
PSPRSRPADASQIPSATDESKAMA

SEQ ID NO: 546262 - protein, 6 aa, Mycobacterium
PSPRYT

SEQ ID NO: 546263 - protein, 7 aa, Mycobacterium
PSPSAFS

SEQ ID NO: 546264 - protein, 6 aa, Mycobacterium
PSPSDV

SEQ ID NO: 546265 - protein, 13 aa, Mycobacterium
PSPSKRRTATRDV

SEQ ID NO: 546266 - protein, 5 aa, Mycobacterium
PSPSL

SEQ ID NO: 546267 - protein, 7 aa, Mycobacterium
PSPSLQR

SEQ ID NO: 546268 - protein, 32 aa, Mycobacterium
PSPSQTTDPAGLSAQSAAVAQANASAAATDPI

SEQ ID NO: 546269 - protein, 26 aa, Mycobacterium
PSPTADQAEGARRAAAACPALAIHIE

SEQ ID NO: 546270 - protein, 15 aa, Mycobacterium
PSPTAGRGGAGGHPC

SEQ ID NO: 546271 - protein, 7 aa, Mycobacterium
PSPTEHA

SEQ ID NO: 546272 - protein, 7 aa, Mycobacterium
PSPTGSR

SEQ ID NO: 546273 - protein, 6 aa, Mycobacterium
PSPTHE

SEQ ID NO: 546274 - protein, 6 aa, Mycobacterium
PSPTQT

SEQ ID NO: 546275 - protein, 7 aa, Mycobacterium
PSPTRRT

SEQ ID NO: 546276 - protein, 6 aa, Mycobacterium
PSPVGP

SEQ ID NO: 546277 - protein, 13 aa, Mycobacterium
PSPVNRRLQEKLN

SEQ ID NO: 546278 - protein, 5 aa, Mycobacterium
PSPVP

SEQ ID NO: 546279 - protein, 21 aa, Mycobacterium
PSPVPAEDINPADPFTSPQTA

SEQ ID NO: 546280 - protein, 6 aa, Mycobacterium
PSPVPV

SEQ ID NO: 546281 - protein, 15 aa, Mycobacterium
PSPVTTAPRVLRLSC

SEQ ID NO: 546282 - protein, 15 aa, Mycobacterium
PSPVVPPKSAAPLPT

SEQ ID NO: 546283 - protein, 13 aa, Mycobacterium
PSPVWDPNIPEPR

SEQ ID NO: 546284 - protein, 6 aa, Mycobacterium
PSPWAK

SEQ ID NO: 546285 - protein, 4 aa, Mycobacterium
PSPY

SEQ ID NO: 546286 - protein, 4 aa, Mycobacterium
PSQA

SEQ ID NO: 546287 - protein, 7 aa, Mycobacterium
PSQAGPS

SEQ ID NO: 546288 - protein, 7 aa, Mycobacterium
PSQALTG

SEQ ID NO: 546289 - protein, 20 aa, Mycobacterium
PSQATIPDPAPIDDDGRDEY

SEQ ID NO: 546290 - protein, 11 aa, Mycobacterium
PSQDAGGAAAF

SEQ ID NO: 546291 - protein, 8 aa, Mycobacterium
PSQDDTVR

SEQ ID NO: 546292 - protein, 5 aa, Mycobacterium
PSQDI

SEQ ID NO: 546293 - protein, 7 aa, Mycobacterium
PSQDRAS

SEQ ID NO: 546294 - protein, 17 aa, Mycobacterium
PSQETDGRRDAQGAAAA

SEQ ID NO: 546295 - protein, 13 aa, Mycobacterium
PSQIDPNPRQPRQ

SEQ ID NO: 546296 - protein, 4 aa, Mycobacterium
PSQN

SEQ ID NO: 546297 - protein, 16 aa, Mycobacterium
PSQNDPDLAPAGKHAA

SEQ ID NO: 546298 - protein, 19 aa, Mycobacterium
PSQPAAPPDTAPPAPGQHS

SEQ ID NO: 546299 - protein, 8 aa, Mycobacterium
PSQPGQQR

SEQ ID NO: 546300 - protein, 16 aa, Mycobacterium
PSQPYSQQGGYPQQGG

SEQ ID NO: 546301 - protein, 9 aa, Mycobacterium
PSQQNTFTG

SEQ ID NO: 546302 - protein, 6 aa, Mycobacterium
PSQRAA

SEQ ID NO: 546303 - protein, 10 aa, Mycobacterium
PSQREAADDV

SEQ ID NO: 546304 - protein, 20 aa, Mycobacterium
PSQSDSPVGPRQFGSTEHLS

SEQ ID NO: 546305 - protein, 13 aa, Mycobacterium
PSQTVIGGPPAQV

SEQ ID NO: 546306 - protein, 7 aa, Mycobacterium
PSQVAGR

SEQ ID NO: 546307 - protein, 4 aa, Mycobacterium
PSQY

SEQ ID NO: 546308 - protein, 32 aa, Mycobacterium
PSQYGGVDADHPNRFPGVGATDADTKRGRAAT

SEQ ID NO: 546309 - protein, 5 aa, Mycobacterium
PSRAA

SEQ ID NO: 546310 - protein, 6 aa, Mycobacterium
PSRAAE

SEQ ID NO: 546311 - protein, 11 aa, Mycobacterium
PSRADEARRTW

SEQ ID NO: 546312 - protein, 7 aa, Mycobacterium
PSRALTG

SEQ ID NO: 546313 - protein, 7 aa, Mycobacterium
PSRAPRH

SEQ ID NO: 546314 - protein, 6 aa, Mycobacterium
PSRAVE

SEQ ID NO: 546315 - protein, 6 aa, Mycobacterium
PSRAYT

SEQ ID NO: 546316 - protein, 5 aa, Mycobacterium
PSRDA

SEQ ID NO: 546317 - protein, 7 aa, Mycobacterium
PSRDGWE

SEQ ID NO: 546318 - protein, 17 aa, Mycobacterium
PSRDGYSPAARRLEQPT

SEQ ID NO: 546319 - protein, 9 aa, Mycobacterium
PSRDQLERA

SEQ ID NO: 546320 - protein, 6 aa, Mycobacterium
PSRDTP

SEQ ID NO: 546321 - protein, 5 aa, Mycobacterium
PSREA

SEQ ID NO: 546322 - protein, 9 aa, Mycobacterium
PSREAPEGF

SEQ ID NO: 546323 - protein, 8 aa, Mycobacterium
PSREDKPM

SEQ ID NO: 546324 - protein, 23 aa, Mycobacterium
PSREDWAEARTAAGVTSSNHDDM

SEQ ID NO: 546325 - protein, 7 aa, Mycobacterium
PSREPKF

SEQ ID NO: 546326 - protein, 7 aa, Mycobacterium
PSREQAV

SEQ ID NO: 546327 - protein, 7 aa, Mycobacterium
PSRESAI

SEQ ID NO: 546328 - protein, 21 aa, Mycobacterium
PSRESEGIPESALASGSAARA

SEQ ID NO: 546329 - protein, 21 aa, Mycobacterium
PSRESEGIPQSALASGTAARE

SEQ ID NO: 546330 - protein, 11 aa, Mycobacterium
PSRESGRGSGA

SEQ ID NO: 546331 - protein, 11 aa, Mycobacterium
PSRETGRGSGA

SEQ ID NO: 546332 - protein, 6 aa, Mycobacterium
PSREYT

SEQ ID NO: 546333 - protein, 8 aa, Mycobacterium
PSREYTGN

SEQ ID NO: 546334 - protein, 4 aa, Mycobacterium
PSRG

SEQ ID NO: 546335 - protein, 11 aa, Mycobacterium
PSRGDERTRAD

SEQ ID NO: 546336 - protein, 9 aa, Mycobacterium
PSRGGSSIG

SEQ ID NO: 546337 - protein, 7 aa, Mycobacterium
PSRGHPG

SEQ ID NO: 546338 - protein, 7 aa, Mycobacterium
PSRGNPG

SEQ ID NO: 546339 - protein, 8 aa, Mycobacterium
PSRGNPGT

SEQ ID NO: 546340 - protein, 5 aa, Mycobacterium
PSRGR

SEQ ID NO: 546341 - protein, 6 aa, Mycobacterium
PSRHPV

SEQ ID NO: 546342 - protein, 8 aa, Mycobacterium
PSRKLTGN

SEQ ID NO: 546343 - protein, 9 aa, Mycobacterium
PSRKPVPGH

SEQ ID NO: 546344 - protein, 19 aa, Mycobacterium
PSRKSDAGWRATRMDRSTE

SEQ ID NO: 546345 - protein, 4 aa, Mycobacterium
PSRL

SEQ ID NO: 546346 - protein, 16 aa, Mycobacterium
PSRLPAARPREQEPPD

SEQ ID NO: 546347 - protein, 4 aa, Mycobacterium
PSRM

SEQ ID NO: 546348 - protein, 8 aa, Mycobacterium
PSRNGGQT

SEQ ID NO: 546349 - protein, 7 aa, Mycobacterium
PSRNGVA

SEQ ID NO: 546350 - protein, 6 aa, Mycobacterium
PSRNPM

SEQ ID NO: 546351 - protein, 4 aa, Mycobacterium
PSRP

SEQ ID NO: 546352 - protein, 6 aa, Mycobacterium
PSRPAE

SEQ ID NO: 546353 - protein, 6 aa, Mycobacterium
PSRPAL

SEQ ID NO: 546354 - protein, 7 aa, Mycobacterium
PSRPDGK

SEQ ID NO: 546355 - protein, 7 aa, Mycobacterium
PSRPGGG

SEQ ID NO: 546356 - protein, 7 aa, Mycobacterium
PSRPKGK

SEQ ID NO: 546357 - protein, 7 aa, Mycobacterium
PSRPNSA

SEQ ID NO: 546358 - protein, 8 aa, Mycobacterium
PSRPNSPE

SEQ ID NO: 546359 - protein, 7 aa, Mycobacterium
PSRPPRH

SEQ ID NO: 546360 - protein, 10 aa, Mycobacterium
PSRPVNPPRP

SEQ ID NO: 546361 - protein, 11 aa, Mycobacterium
PSRQPDWDGND

SEQ ID NO: 546362 - protein, 8 aa, Mycobacterium
PSRQRRDA

SEQ ID NO: 546363 - protein, 9 aa, Mycobacterium
PSRQSLDRE

SEQ ID NO: 546364 - protein, 5 aa, Mycobacterium
PSRRD

SEQ ID NO: 546365 - protein, 13 aa, Mycobacterium
PSRRDDVSGGDTG

SEQ ID NO: 546366 - protein, 6 aa, Mycobacterium
PSRREF

SEQ ID NO: 546367 - protein, 8 aa, Mycobacterium
PSRREPFT

SEQ ID NO: 546368 - protein, 7 aa, Mycobacterium
PSRRNSL

SEQ ID NO: 546369 - protein, 5 aa, Mycobacterium
PSRRS

SEQ ID NO: 546370 - protein, 31 aa, Mycobacterium
PSRRTKSKPLALPGSDTYKALKKGSGSQAVA

SEQ ID NO: 546371 - protein, 7 aa, Mycobacterium
PSRRVTS

SEQ ID NO: 546372 - protein, 14 aa, Mycobacterium
PSRSLASPTETLGE

SEQ ID NO: 546373 - protein, 11 aa, Mycobacterium
PSRSLKEGTDA

SEQ ID NO: 546374 - protein, 10 aa, Mycobacterium
PSRSTLRPDE

SEQ ID NO: 546375 - protein, 7 aa, Mycobacterium
PSRTPVE

SEQ ID NO: 546376 - protein, 5 aa, Mycobacterium
PSRTY

SEQ ID NO: 546377 - protein, 5 aa, Mycobacterium
PSRYA

SEQ ID NO: 546378 - protein, 5 aa, Mycobacterium
PSRYP

SEQ ID NO: 546379 - protein, 7 aa, Mycobacterium
PSRYPAT

SEQ ID NO: 546380 - protein, 4 aa, Mycobacterium
PSSA

SEQ ID NO: 546381 - protein, 13 aa, Mycobacterium
PSSAAGMLRVMQN

SEQ ID NO: 546382 - protein, 6 aa, Mycobacterium
PSSAAN

SEQ ID NO: 546383 - protein, 9 aa, Mycobacterium
PSSAATAAH

SEQ ID NO: 546384 - protein, 9 aa, Mycobacterium
PSSAGSLPT

SEQ ID NO: 546385 - protein, 6 aa, Mycobacterium
PSSALT

SEQ ID NO: 546386 - protein, 6 aa, Mycobacterium
PSSAQG

SEQ ID NO: 546387 - protein, 6 aa, Mycobacterium
PSSAQV

SEQ ID NO: 546388 - protein, 7 aa, Mycobacterium
PSSCGKT

SEQ ID NO: 546389 - protein, 11 aa, Mycobacterium
PSSCSDRTKST

SEQ ID NO: 546390 - protein, 10 aa, Mycobacterium
PSSDEEAAER

SEQ ID NO: 546391 - protein, 8 aa, Mycobacterium
PSSDPGDV

SEQ ID NO: 546392 - protein, 8 aa, Mycobacterium
PSSDRYER

SEQ ID NO: 546393 - protein, 11 aa, Mycobacterium
PSSELTEEVEA

SEQ ID NO: 546394 - protein, 4 aa, Mycobacterium
PSSF

SEQ ID NO: 546395 - protein, 9 aa, Mycobacterium
PSSFEGSPG

SEQ ID NO: 546396 - protein, 6 aa, Mycobacterium
PSSFTG

SEQ ID NO: 546397 - protein, 14 aa, Mycobacterium
PSSGAVSVTTPAGT

SEQ ID NO: 546398 - protein, 10 aa, Mycobacterium
PSSGGERPAY

SEQ ID NO: 546399 - protein, 9 aa, Mycobacterium
PSSGGFGDA

SEQ ID NO: 546400 - protein, 12 aa, Mycobacterium
PSSGGGGGATVD

SEQ ID NO: 546401 - protein, 10 aa, Mycobacterium
PSSGGVTRAA

SEQ ID NO: 546402 - protein, 8 aa, Mycobacterium
PSSGLDIE

SEQ ID NO: 546403 - protein, 11 aa, Mycobacterium
PSSGLDIEGKQ

SEQ ID NO: 546404 - protein, 8 aa, Mycobacterium
PSSGNTLA

SEQ ID NO: 546405 - protein, 9 aa, Mycobacterium
PSSGPPPYF

SEQ ID NO: 546406 - protein, 5 aa, Mycobacterium
PSSGR

SEQ ID NO: 546407 - protein, 5 aa, Mycobacterium
PSSGT

SEQ ID NO: 546408 - protein, 7 aa, Mycobacterium
PSSGTVY

SEQ ID NO: 546409 - protein, 7 aa, Mycobacterium
PSSGYDR

SEQ ID NO: 546410 - protein, 4 aa, Mycobacterium
PSSH

SEQ ID NO: 546411 - protein, 9 aa, Mycobacterium
PSSIPEDGS

SEQ ID NO: 546412 - protein, 10 aa, Mycobacterium
PSSIPSDGSY

SEQ ID NO: 546413 - protein, 8 aa, Mycobacterium
PSSKISGQ

SEQ ID NO: 546414 - protein, 5 aa, Mycobacterium
PSSLD

SEQ ID NO: 546415 - protein, 17 aa, Mycobacterium
PSSLLGDDSAPNPSETT

SEQ ID NO: 546416 - protein, 11 aa, Mycobacterium
PSSLPSARESA

SEQ ID NO: 546417 - protein, 10 aa, Mycobacterium
PSSMASPAFP

SEQ ID NO: 546418 - protein, 11 aa, Mycobacterium
PSSNATAEVPG

SEQ ID NO: 546419 - protein, 9 aa, Mycobacterium
PSSNTVSNA

SEQ ID NO: 546420 - protein, 11 aa, Mycobacterium
PSSNTVSTADE

SEQ ID NO: 546421 - protein, 12 aa, Mycobacterium
PSSNTVSTANEL

SEQ ID NO: 546422 - protein, 6 aa, Mycobacterium
PSSPAD

SEQ ID NO: 546423 - protein, 11 aa, Mycobacterium
PSSPEREDEYN

SEQ ID NO: 546424 - protein, 11 aa, Mycobacterium
PSSPEREQEYN

SEQ ID NO: 546425 - protein, 5 aa, Mycobacterium
PSSPL

SEQ ID NO: 546426 - protein, 7 aa, Mycobacterium
PSSPLRA

SEQ ID NO: 546427 - protein, 8 aa, Mycobacterium
PSSPMIGN

SEQ ID NO: 546428 - protein, 8 aa, Mycobacterium
PSSPRSLN

SEQ ID NO: 546429 - protein, 7 aa, Mycobacterium
PSSPTGV

SEQ ID NO: 546430 - protein, 13 aa, Mycobacterium
PSSPVGSTDSAGI

SEQ ID NO: 546431 - protein, 8 aa, Mycobacterium
PSSRDPGL

SEQ ID NO: 546432 - protein, 7 aa, Mycobacterium
PSSRGKG

SEQ ID NO: 546433 - protein, 8 aa, Mycobacterium
PSSRGQEA

SEQ ID NO: 546434 - protein, 9 aa, Mycobacterium
PSSRNGDHN

SEQ ID NO: 546435 - protein, 7 aa, Mycobacterium
PSSRQVS

SEQ ID NO: 546436 - protein, 12 aa, Mycobacterium
PSSRTASSARLE

SEQ ID NO: 546437 - protein, 4 aa, Mycobacterium
PSSS

SEQ ID NO: 546438 - protein, 5 aa, Mycobacterium
PSSSA

SEQ ID NO: 546439 - protein, 8 aa, Mycobacterium
PSSSDSRF

SEQ ID NO: 546440 - protein, 6 aa, Mycobacterium
PSSSER

SEQ ID NO: 546441 - protein, 13 aa, Mycobacterium
PSSSGPREPVDPS

SEQ ID NO: 546442 - protein, 13 aa, Mycobacterium
PSSSGVLHHLFWR

SEQ ID NO: 546443 - protein, 10 aa, Mycobacterium
PSSSTALSAS

SEQ ID NO: 546444 - protein, 12 aa, Mycobacterium
PSSSTVSNADEL

SEQ ID NO: 546445 - protein, 7 aa, Mycobacterium
PSSTAEL

SEQ ID NO: 546446 - protein, 22 aa, Mycobacterium
PSSTETGAFPPSPVRAGGFPAR

SEQ ID NO: 546447 - protein, 7 aa, Mycobacterium
PSSTLST

SEQ ID NO: 546448 - protein, 10 aa, Mycobacterium
PSSTPEPFSE

SEQ ID NO: 546449 - protein, 7 aa, Mycobacterium
PSSTPER

SEQ ID NO: 546450 - protein, 6 aa, Mycobacterium
PSSTSF

SEQ ID NO: 546451 - protein, 8 aa, Mycobacterium
PSSTYTRA

SEQ ID NO: 546452 - protein, 7 aa, Mycobacterium
PSSVPQE

SEQ ID NO: 546453 - protein, 7 aa, Mycobacterium
PSSVQDR

SEQ ID NO: 546454 - protein, 10 aa, Mycobacterium
PSSVRDKDGI

SEQ ID NO: 546455 - protein, 5 aa, Mycobacterium
PSSVT

SEQ ID NO: 546456 - protein, 13 aa, Mycobacterium
PSSWEDRTAGTSK

SEQ ID NO: 546457 - protein, 9 aa, Mycobacterium
PSTAEGRRA

SEQ ID NO: 546458 - protein, 6 aa, Mycobacterium
PSTAIP

SEQ ID NO: 546459 - protein, 8 aa, Mycobacterium
PSTALRAG

SEQ ID NO: 546460 - protein, 9 aa, Mycobacterium
PSTASPRTW

SEQ ID NO: 546461 - protein, 9 aa, Mycobacterium
PSTASRSSW

SEQ ID NO: 546462 - protein, 11 aa, Mycobacterium
PSTASTGTEGL

SEQ ID NO: 546463 - protein, 7 aa, Mycobacterium
PSTATRD

SEQ ID NO: 546464 - protein, 11 aa, Mycobacterium
PSTATTGAGGM

SEQ ID NO: 546465 - protein, 10 aa, Mycobacterium
PSTDAGSRGL

SEQ ID NO: 546466 - protein, 15 aa, Mycobacterium
PSTEFAEHKSSHEGQ

SEQ ID NO: 546467 - protein, 7 aa, Mycobacterium
PSTELRA

SEQ ID NO: 546468 - protein, 21 aa, Mycobacterium
PSTGEQYGTAPVSNEQDIDNA

SEQ ID NO: 546469 - protein, 6 aa, Mycobacterium
PSTGEV

SEQ ID NO: 546470 - protein, 9 aa, Mycobacterium
PSTGGSWDA

SEQ ID NO: 546471 - protein, 14 aa, Mycobacterium
PSTGGSWDAGPAWP

SEQ ID NO: 546472 - protein, 5 aa, Mycobacterium
PSTGR

SEQ ID NO: 546473 - protein, 12 aa, Mycobacterium
PSTIARAHSAPA

SEQ ID NO: 546474 - protein, 8 aa, Mycobacterium
PSTIDEGQ

SEQ ID NO: 546475 - protein, 5 aa, Mycobacterium
PSTKR

SEQ ID NO: 546476 - protein, 10 aa, Mycobacterium
PSTKSKGPRQ

SEQ ID NO: 546477 - protein, 19 aa, Mycobacterium
PSTNSAGSGWRKRKQQKFE

SEQ ID NO: 546478 - protein, 4 aa, Mycobacterium
PSTP

SEQ ID NO: 546479 - protein, 8 aa, Mycobacterium
PSTPADAA

SEQ ID NO: 546480 - protein, 6 aa, Mycobacterium
PSTPGD

SEQ ID NO: 546481 - protein, 8 aa, Mycobacterium
PSTPGDEG

SEQ ID NO: 546482 - protein, 6 aa, Mycobacterium
PSTPGW

SEQ ID NO: 546483 - protein, 6 aa, Mycobacterium
PSTPNA

SEQ ID NO: 546484 - protein, 8 aa, Mycobacterium
PSTPSAGD

SEQ ID NO: 546485 - protein, 6 aa, Mycobacterium
PSTPSD

SEQ ID NO: 546486 - protein, 6 aa, Mycobacterium
PSTQNR

SEQ ID NO: 546487 - protein, 46 aa, Mycobacterium
PSTRAGSGSPGQKRKSPKKRTSSTSVGNAAELGNTPPPPKSEYETS

SEQ ID NO: 546488 - protein, 10 aa, Mycobacterium
PSTRHPRRAG

SEQ ID NO: 546489 - protein, 5 aa, Mycobacterium
PSTRK

SEQ ID NO: 546490 - protein, 10 aa, Mycobacterium
PSTRQPTGAR

SEQ ID NO: 546491 - protein, 9 aa, Mycobacterium
PSTRQPVGA

SEQ ID NO: 546492 - protein, 7 aa, Mycobacterium
PSTRRRR

SEQ ID NO: 546493 - protein, 4 aa, Mycobacterium
PSTS

SEQ ID NO: 546494 - protein, 5 aa, Mycobacterium
PSTSA

SEQ ID NO: 546495 - protein, 7 aa, Mycobacterium
PSTSDEL

SEQ ID NO: 546496 - protein, 6 aa, Mycobacterium
PSTSPA

SEQ ID NO: 546497 - protein, 9 aa, Mycobacterium
PSTSPAQTM

SEQ ID NO: 546498 - protein, 35 aa, Mycobacterium
PSTSPSVSKVGPGPSDTNGTVTTASNTPNTTIGTS

SEQ ID NO: 546499 - protein, 8 aa, Mycobacterium
PSTSRGNV

SEQ ID NO: 546500 - protein, 36 aa, Mycobacterium
PSTSSRNTAAGTTRKSTRRRCTPRSSSCPTPASSTG

SEQ ID NO: 546501 - protein, 4 aa, Mycobacterium
PSTT

SEQ ID NO: 546502 - protein, 16 aa, Mycobacterium
PSTTEAQDSALSPRGY

SEQ ID NO: 546503 - protein, 7 aa, Mycobacterium
PSTTPTN

SEQ ID NO: 546504 - protein, 6 aa, Mycobacterium
PSTTQA

SEQ ID NO: 546505 - protein, 8 aa, Mycobacterium
PSTVAGED

SEQ ID NO: 546506 - protein, 5 aa, Mycobacterium
PSTVK

SEQ ID NO: 546507 - protein, 8 aa, Mycobacterium
PSTVSPPM

SEQ ID NO: 546508 - protein, 13 aa, Mycobacterium
PSTWSGHGGGEFA

SEQ ID NO: 546509 - protein, 7 aa, Mycobacterium
PSTYSKK

SEQ ID NO: 546510 - protein, 13 aa, Mycobacterium
PSVAAQRGAEAAR

SEQ ID NO: 546511 - protein, 10 aa, Mycobacterium
PSVAGRTDLE

SEQ ID NO: 546512 - protein, 6 aa, Mycobacterium
PSVAPE

SEQ ID NO: 546513 - protein, 4 aa, Mycobacterium
PSVD

SEQ ID NO: 546514 - protein, 8 aa, Mycobacterium
PSVDGGAK

SEQ ID NO: 546515 - protein, 4 aa, Mycobacterium
PSVE

SEQ ID NO: 546516 - protein, 7 aa, Mycobacterium
PSVEPAL

SEQ ID NO: 546517 - protein, 10 aa, Mycobacterium
PSVEPKHAQT

SEQ ID NO: 546518 - protein, 7 aa, Mycobacterium
PSVESDD

SEQ ID NO: 546519 - protein, 4 aa, Mycobacterium
PSVG

SEQ ID NO: 546520 - protein, 9 aa, Mycobacterium
PSVGAPAIA

SEQ ID NO: 546521 - protein, 7 aa, Mycobacterium
PSVGPGT

SEQ ID NO: 546522 - protein, 9 aa, Mycobacterium
PSVGQEAAR

SEQ ID NO: 546523 - protein, 6 aa, Mycobacterium
PSVGYQ

SEQ ID NO: 546524 - protein, 5 aa, Mycobacterium
PSVHG

SEQ ID NO: 546525 - protein, 6 aa, Mycobacterium
PSVPDT

SEQ ID NO: 546526 - protein, 30 aa, Mycobacterium
PSVPGAPVNSPPAPPTPPSPSTPSFPPPPL

SEQ ID NO: 546527 - protein, 7 aa, Mycobacterium
PSVPNAL

SEQ ID NO: 546528 - protein, 5 aa, Mycobacterium
PSVPP

SEQ ID NO: 546529 - protein, 9 aa, Mycobacterium
PSVPSGAAD

SEQ ID NO: 546530 - protein, 5 aa, Mycobacterium
PSVPT

SEQ ID NO: 546531 - protein, 6 aa, Mycobacterium
PSVQPQ

SEQ ID NO: 546532 - protein, 5 aa, Mycobacterium
PSVSD

SEQ ID NO: 546533 - protein, 7 aa, Mycobacterium
PSVSGAA

SEQ ID NO: 546534 - protein, 7 aa, Mycobacterium
PSVSPDD

SEQ ID NO: 546535 - protein, 10 aa, Mycobacterium
PSVSPRATGH

SEQ ID NO: 546536 - protein, 5 aa, Mycobacterium
PSVTA

SEQ ID NO: 546537 - protein, 18 aa, Mycobacterium
PSVTARPATAPPAPAPED

SEQ ID NO: 546538 - protein, 17 aa, Mycobacterium
PSVTGKPVGSDLARRKK

SEQ ID NO: 546539 - protein, 8 aa, Mycobacterium
PSVTPDDV

SEQ ID NO: 546540 - protein, 6 aa, Mycobacterium
PSVTPE

SEQ ID NO: 546541 - protein, 13 aa, Mycobacterium
PSVVPSASGRLGD

SEQ ID NO: 546542 - protein, 15 aa, Mycobacterium
PSWAAPSSGSASALS

SEQ ID NO: 546543 - protein, 5 aa, Mycobacterium
PSWAT

SEQ ID NO: 546544 - protein, 10 aa, Mycobacterium
PSWATATPAI

SEQ ID NO: 546545 - protein, 23 aa, Mycobacterium
PSWEPGSKAVATRAASGDTLSAL

SEQ ID NO: 546546 - protein, 11 aa, Mycobacterium
PSWEPPIGPEA

SEQ ID NO: 546547 - protein, 4 aa, Mycobacterium
PSWN

SEQ ID NO: 546548 - protein, 5 aa, Mycobacterium
PSWPD

SEQ ID NO: 546549 - protein, 11 aa, Mycobacterium
PSWRKRDQQGA

SEQ ID NO: 546550 - protein, 17 aa, Mycobacterium
PSWTTAAPAPTAGGAAI

SEQ ID NO: 546551 - protein, 5 aa, Mycobacterium
PSYAQ

SEQ ID NO: 546552 - protein, 7 aa, Mycobacterium
PSYDAAR

SEQ ID NO: 546553 - protein, 12 aa, Mycobacterium
PSYDPARPSRVY

SEQ ID NO: 546554 - protein, 9 aa, Mycobacterium
PSYDPLDGD

SEQ ID NO: 546555 - protein, 10 aa, Mycobacterium
PSYDPLDGGH

SEQ ID NO: 546556 - protein, 4 aa, Mycobacterium
PSYE

SEQ ID NO: 546557 - protein, 10 aa, Mycobacterium
PSYGGATTWA

SEQ ID NO: 546558 - protein, 6 aa, Mycobacterium
PSYGGS

SEQ ID NO: 546559 - protein, 17 aa, Mycobacterium
PSYGGTTAWASTEAAYQ

SEQ ID NO: 546560 - protein, 5 aa, Mycobacterium
PSYGI

SEQ ID NO: 546561 - protein, 14 aa, Mycobacterium
PSYGIGPTDPPTAA

SEQ ID NO: 546562 - protein, 13 aa, Mycobacterium
PSYGLGPTDPEVA

SEQ ID NO: 546563 - protein, 10 aa, Mycobacterium
PSYGLGPTEP

SEQ ID NO: 546564 - protein, 5 aa, Mycobacterium
PSYGP

SEQ ID NO: 546565 - protein, 5 aa, Mycobacterium
PSYGW

SEQ ID NO: 546566 - protein, 4 aa, Mycobacterium
PSYH

SEQ ID NO: 546567 - protein, 5 aa, Mycobacterium
PSYLP

SEQ ID NO: 546568 - protein, 6 aa, Mycobacterium
PSYNPW

SEQ ID NO: 546569 - protein, 7 aa, Mycobacterium
PSYPEDG

SEQ ID NO: 546570 - protein, 6 aa, Mycobacterium
PSYPQD

SEQ ID NO: 546571 - protein, 10 aa, Mycobacterium
PSYPTPTQLK

SEQ ID NO: 546572 - protein, 21 aa, Mycobacterium
PSYRQRTRPSQLDPDHDDELP

SEQ ID NO: 546573 - protein, 6 aa, Mycobacterium
PSYSPK

SEQ ID NO: 546574 - protein, 5 aa, Mycobacterium
PTAAA

SEQ ID NO: 546575 - protein, 16 aa, Mycobacterium
PTAAAAEKARQAPVSS

SEQ ID NO: 546576 - protein, 14 aa, Mycobacterium
PTAAADDTLDTTKT

SEQ ID NO: 546577 - protein, 7 aa, Mycobacterium
PTAAAEA

SEQ ID NO: 546578 - protein, 10 aa, Mycobacterium
PTAADDPQKQ

SEQ ID NO: 546579 - protein, 10 aa, Mycobacterium
PTAADNAYAG

SEQ ID NO: 546580 - protein, 5 aa, Mycobacterium
PTAAE

SEQ ID NO: 546581 - protein, 18 aa, Mycobacterium
PTAAERGPLIGTTTTRAH

SEQ ID NO: 546582 - protein, 10 aa, Mycobacterium
PTAAGGTEPA

SEQ ID NO: 546583 - protein, 7 aa, Mycobacterium
PTAAGLP

SEQ ID NO: 546584 - protein, 20 aa, Mycobacterium
PTAAGPVKIDPGMGAPHSSF

SEQ ID NO: 546585 - protein, 13 aa, Mycobacterium
PTAAGQEAPGGLA

SEQ ID NO: 546586 - protein, 9 aa, Mycobacterium
PTAAGRTRR

SEQ ID NO: 546587 - protein, 9 aa, Mycobacterium
PTAAISPRA

SEQ ID NO: 546588 - protein, 5 aa, Mycobacterium
PTAAL

SEQ ID NO: 546589 - protein, 11 aa, Mycobacterium
PTAALNDSDSR

SEQ ID NO: 546590 - protein, 5 aa, Mycobacterium
PTAAM

SEQ ID NO: 546591 - protein, 17 aa, Mycobacterium
PTAAPAPEALTSSDRGT

SEQ ID NO: 546592 - protein, 7 aa, Mycobacterium
PTAAPDD

SEQ ID NO: 546593 - protein, 7 aa, Mycobacterium
PTAAPLT

SEQ ID NO: 546594 - protein, 5 aa, Mycobacterium
PTAAQ

SEQ ID NO: 546595 - protein, 8 aa, Mycobacterium
PTAAQADA

SEQ ID NO: 546596 - protein, 7 aa, Mycobacterium
PTAAQQL

SEQ ID NO: 546597 - protein, 7 aa, Mycobacterium
PTAAQQR

SEQ ID NO: 546598 - protein, 12 aa, Mycobacterium
PTAARAAAQKDQ

SEQ ID NO: 546599 - protein, 8 aa, Mycobacterium
PTAARADA

SEQ ID NO: 546600 - protein, 8 aa, Mycobacterium
PTAARHPA

SEQ ID NO: 546601 - protein, 11 aa, Mycobacterium
PTAASAQAAGY

SEQ ID NO: 546602 - protein, 16 aa, Mycobacterium
PTAASDLRPPVRREGP

SEQ ID NO: 546603 - protein, 9 aa, Mycobacterium
PTADAPGLD

SEQ ID NO: 546604 - protein, 11 aa, Mycobacterium
PTADEDPDATP

SEQ ID NO: 546605 - protein, 5 aa, Mycobacterium
PTADG

SEQ ID NO: 546606 - protein, 12 aa, Mycobacterium
PTADGSSAARIE

SEQ ID NO: 546607 - protein, 5 aa, Mycobacterium
PTADH

SEQ ID NO: 546608 - protein, 20 aa, Mycobacterium
PTADHQSNGAEHALEDAPAR

SEQ ID NO: 546609 - protein, 11 aa, Mycobacterium
PTADLEAAKDA

SEQ ID NO: 546610 - protein, 8 aa, Mycobacterium
PTADPADL

SEQ ID NO: 546611 - protein, 12 aa, Mycobacterium
PTADPAITEEEG

SEQ ID NO: 546612 - protein, 5 aa, Mycobacterium
PTADQ

SEQ ID NO: 546613 - protein, 8 aa, Mycobacterium
PTADTPSY

SEQ ID NO: 546614 - protein, 8 aa, Mycobacterium
PTADYDAG

SEQ ID NO: 546615 - protein, 10 aa, Mycobacterium
PTAEAADAEL

SEQ ID NO: 546616 - protein, 13 aa, Mycobacterium
PTAEAALDGENAA

SEQ ID NO: 546617 - protein, 11 aa, Mycobacterium
PTAEKARERLE

SEQ ID NO: 546618 - protein, 14 aa, Mycobacterium
PTAEPRRARARATD

SEQ ID NO: 546619 - protein, 7 aa, Mycobacterium
PTAEPTP

SEQ ID NO: 546620 - protein, 7 aa, Mycobacterium
PTAEQQR

SEQ ID NO: 546621 - protein, 22 aa, Mycobacterium
PTAERQFSADGDAWDPSALSGT

SEQ ID NO: 546622 - protein, 12 aa, Mycobacterium
PTAESALRPPIR

SEQ ID NO: 546623 - protein, 7 aa, Mycobacterium
PTAESPF

SEQ ID NO: 546624 - protein, 7 aa, Mycobacterium
PTAEVDT

SEQ ID NO: 546625 - protein, 9 aa, Mycobacterium
PTAGAREAA

SEQ ID NO: 546626 - protein, 21 aa, Mycobacterium
PTAGDSFPEAARAAQKSFDAA

SEQ ID NO: 546627 - protein, 13 aa, Mycobacterium
PTAGEPASYPPAT

SEQ ID NO: 546628 - protein, 7 aa, Mycobacterium
PTAGEVG

SEQ ID NO: 546629 - protein, 6 aa, Mycobacterium
PTAGFA

SEQ ID NO: 546630 - protein, 14 aa, Mycobacterium
PTAGGVCAAQPRVT

SEQ ID NO: 546631 - protein, 8 aa, Mycobacterium
PTAGLDPH

SEQ ID NO: 546632 - protein, 10 aa, Mycobacterium
PTAGLDPVNA

SEQ ID NO: 546633 - protein, 5 aa, Mycobacterium
PTAGM

SEQ ID NO: 546634 - protein, 8 aa, Mycobacterium
PTAGQPGE

SEQ ID NO: 546635 - protein, 12 aa, Mycobacterium
PTAGSARHSSGL

SEQ ID NO: 546636 - protein, 4 aa, Mycobacterium
PTAI

SEQ ID NO: 546637 - protein, 5 aa, Mycobacterium
PTAIE

SEQ ID NO: 546638 - protein, 13 aa, Mycobacterium
PTAIEKPVTPTGF

SEQ ID NO: 546639 - protein, 5 aa, Mycobacterium
PTAIT

SEQ ID NO: 546640 - protein, 4 aa, Mycobacterium
PTAK

SEQ ID NO: 546641 - protein, 7 aa, Mycobacterium
PTAKDAE

SEQ ID NO: 546642 - protein, 8 aa, Mycobacterium
PTAKDAGA

SEQ ID NO: 546643 - protein, 6 aa, Mycobacterium
PTAKRY

SEQ ID NO: 546644 - protein, 14 aa, Mycobacterium
PTALEPRAISEEKN

SEQ ID NO: 546645 - protein, 7 aa, Mycobacterium
PTALGRP

SEQ ID NO: 546646 - protein, 15 aa, Mycobacterium
PTANKTATSEPAAAS

SEQ ID NO: 546647 - protein, 15 aa, Mycobacterium
PTANLDQAPAIPPGI

SEQ ID NO: 546648 - protein, 10 aa, Mycobacterium
PTANPSATEA

SEQ ID NO: 546649 - protein, 4 aa, Mycobacterium
PTAP

SEQ ID NO: 546650 - protein, 10 aa, Mycobacterium
PTAPADPWDV

SEQ ID NO: 546651 - protein, 14 aa, Mycobacterium
PTAPAPRGHRPGRG

SEQ ID NO: 546652 - protein, 7 aa, Mycobacterium
PTAPAQA

SEQ ID NO: 546653 - protein, 8 aa, Mycobacterium
PTAPAYGG

SEQ ID NO: 546654 - protein, 7 aa, Mycobacterium
PTAPDAH

SEQ ID NO: 546655 - protein, 11 aa, Mycobacterium
PTAPDTIGDDH

SEQ ID NO: 546656 - protein, 10 aa, Mycobacterium
PTAPEGTPGE

SEQ ID NO: 546657 - protein, 7 aa, Mycobacterium
PTAPEIP

SEQ ID NO: 546658 - protein, 8 aa, Mycobacterium
PTAPFPGK

SEQ ID NO: 546659 - protein, 9 aa, Mycobacterium
PTAPGHDAD

SEQ ID NO: 546660 - protein, 6 aa, Mycobacterium
PTAPGL

SEQ ID NO: 546661 - protein, 9 aa, Mycobacterium
PTAPGRDAA

SEQ ID NO: 546662 - protein, 10 aa, Mycobacterium
PTAPPAAPPV

SEQ ID NO: 546663 - protein, 9 aa, Mycobacterium
PTAPPPPIQ

SEQ ID NO: 546664 - protein, 6 aa, Mycobacterium
PTAPSR

SEQ ID NO: 546665 - protein, 10 aa, Mycobacterium
PTAPWPTDEA

SEQ ID NO: 546666 - protein, 5 aa, Mycobacterium
PTAPY

SEQ ID NO: 546667 - protein, 4 aa, Mycobacterium
PTAQ

SEQ ID NO: 546668 - protein, 19 aa, Mycobacterium
PTAQAAAAAPDYKGAVTDY

SEQ ID NO: 546669 - protein, 6 aa, Mycobacterium
PTAQAD

SEQ ID NO: 546670 - protein, 5 aa, Mycobacterium
PTAQE

SEQ ID NO: 546671 - protein, 8 aa, Mycobacterium
PTAQGLPD

SEQ ID NO: 546672 - protein, 6 aa, Mycobacterium
PTAQGT

SEQ ID NO: 546673 - protein, 13 aa, Mycobacterium
PTAQGYSDSKGIL

SEQ ID NO: 546674 - protein, 19 aa, Mycobacterium
PTAQLPASATPRRRGGGAR

SEQ ID NO: 546675 - protein, 9 aa, Mycobacterium
PTAQLPPKS

SEQ ID NO: 546676 - protein, 18 aa, Mycobacterium
PTARDEEGRADPGKNPDL

SEQ ID NO: 546677 - protein, 6 aa, Mycobacterium
PTARGF

SEQ ID NO: 546678 - protein, 8 aa, Mycobacterium
PTARRRDA

SEQ ID NO: 546679 - protein, 7 aa, Mycobacterium
PTASDDE

SEQ ID NO: 546680 - protein, 10 aa, Mycobacterium
PTASFAEQRE

SEQ ID NO: 546681 - protein, 10 aa, Mycobacterium
PTASFEEQRQ

SEQ ID NO: 546682 - protein, 12 aa, Mycobacterium
PTASFGEQNKQL

SEQ ID NO: 546683 - protein, 5 aa, Mycobacterium
PTASG

SEQ ID NO: 546684 - protein, 5 aa, Mycobacterium
PTASI

SEQ ID NO: 546685 - protein, 13 aa, Mycobacterium
PTASLDADSAQTV

SEQ ID NO: 546686 - protein, 34 aa, Mycobacterium
PTASNGSSVGAKLGSGADSGIRGGAQTGESQTED

SEQ ID NO: 546687 - protein, 8 aa, Mycobacterium
PTASWNGQ

SEQ ID NO: 546688 - protein, 32 aa, Mycobacterium
PTATAAHEGQESVPMPKESASANSSFNQRPTL

SEQ ID NO: 546689 - protein, 14 aa, Mycobacterium
PTATDKSDRITGNE

SEQ ID NO: 546690 - protein, 14 aa, Mycobacterium
PTATDKSGRITGNE

SEQ ID NO: 546691 - protein, 20 aa, Mycobacterium
PTATGEALPWSSSTTAAGRS

SEQ ID NO: 546692 - protein, 9 aa, Mycobacterium
PTATPDSPV

SEQ ID NO: 546693 - protein, 49 aa, Mycobacterium
PTATTLSAANTTAVSPTTKTLASTAVTASAATAPAPTAPAGSTWPSTNP

SEQ ID NO: 546694 - protein, 17 aa, Mycobacterium
PTAVAAATKSAQERGLT

SEQ ID NO: 546695 - protein, 13 aa, Mycobacterium
PTAVEGDGTPISS

SEQ ID NO: 546696 - protein, 5 aa, Mycobacterium
PTAVG

SEQ ID NO: 546697 - protein, 8 aa, Mycobacterium
PTAVGDGV

SEQ ID NO: 546698 - protein, 9 aa, Mycobacterium
PTAYADEPR

SEQ ID NO: 546699 - protein, 12 aa, Mycobacterium
PTAYDGDSPAEV

SEQ ID NO: 546700 - protein, 12 aa, Mycobacterium
PTAYDGDSSDEV

SEQ ID NO: 546701 - protein, 8 aa, Mycobacterium
PTCAAEDD

SEQ ID NO: 546702 - protein, 5 aa, Mycobacterium
PTCPG

SEQ ID NO: 546703 - protein, 4 aa, Mycobacterium
PTDA

SEQ ID NO: 546704 - protein, 5 aa, Mycobacterium
PTDAA

SEQ ID NO: 546705 - protein, 105 aa, Mycobacterium
PTDAAGTVGPPSKSGSKPRTTEKQDDQQGEKSGRARSDAGRRRRTRGGKPVTGHPATTPVASGETATETGSGSGASSPSGNAGATRRRRRRRKPAGVQDNAAASA

SEQ ID NO: 546706 - protein, 8 aa, Mycobacterium
PTDADDEV

SEQ ID NO: 546707 - protein, 6 aa, Mycobacterium
PTDADN

SEQ ID NO: 546708 - protein, 6 aa, Mycobacterium
PTDADP

SEQ ID NO: 546709 - protein, 7 aa, Mycobacterium
PTDAGRA

SEQ ID NO: 546710 - protein, 10 aa, Mycobacterium
PTDAPAAVQS

SEQ ID NO: 546711 - protein, 8 aa, Mycobacterium
PTDAPDYS

SEQ ID NO: 546712 - protein, 11 aa, Mycobacterium
PTDAPEADGTL

SEQ ID NO: 546713 - protein, 14 aa, Mycobacterium
PTDAPEADGTLPWS

SEQ ID NO: 546714 - protein, 15 aa, Mycobacterium
PTDAPTAPHTVRPEY

SEQ ID NO: 546715 - protein, 7 aa, Mycobacterium
PTDASAS

SEQ ID NO: 546716 - protein, 7 aa, Mycobacterium
PTDASSM

SEQ ID NO: 546717 - protein, 7 aa, Mycobacterium
PTDATDA

SEQ ID NO: 546718 - protein, 11 aa, Mycobacterium
PTDATDRRADL

SEQ ID NO: 546719 - protein, 6 aa, Mycobacterium
PTDDAG

SEQ ID NO: 546720 - protein, 10 aa, Mycobacterium
PTDDAGRLRA

SEQ ID NO: 546721 - protein, 14 aa, Mycobacterium
PTDDELAAAGLPQT

SEQ ID NO: 546722 - protein, 5 aa, Mycobacterium
PTDDL

SEQ ID NO: 546723 - protein, 7 aa, Mycobacterium
PTDEADP

SEQ ID NO: 546724 - protein, 7 aa, Mycobacterium
PTDEDSL

SEQ ID NO: 546725 - protein, 5 aa, Mycobacterium
PTDEE

SEQ ID NO: 546726 - protein, 5 aa, Mycobacterium
PTDEI

SEQ ID NO: 546727 - protein, 7 aa, Mycobacterium
PTDELTG

SEQ ID NO: 546728 - protein, 10 aa, Mycobacterium
PTDEPDARRR

SEQ ID NO: 546729 - protein, 6 aa, Mycobacterium
PTDEQA

SEQ ID NO: 546730 - protein, 6 aa, Mycobacterium
PTDERE

SEQ ID NO: 546731 - protein, 8 aa, Mycobacterium
PTDERSTR

SEQ ID NO: 546732 - protein, 5 aa, Mycobacterium
PTDET

SEQ ID NO: 546733 - protein, 10 aa, Mycobacterium
PTDGADPQAV

SEQ ID NO: 546734 - protein, 9 aa, Mycobacterium
PTDGDPVTA

SEQ ID NO: 546735 - protein, 7 aa, Mycobacterium
PTDGDRA

SEQ ID NO: 546736 - protein, 7 aa, Mycobacterium
PTDGHAG

SEQ ID NO: 546737 - protein, 7 aa, Mycobacterium
PTDGHDV

SEQ ID NO: 546738 - protein, 8 aa, Mycobacterium
PTDGLSGS

SEQ ID NO: 546739 - protein, 14 aa, Mycobacterium
PTDGSATAGPGTGV

SEQ ID NO: 546740 - protein, 10 aa, Mycobacterium
PTDGTDERDL

SEQ ID NO: 546741 - protein, 6 aa, Mycobacterium
PTDHDT

SEQ ID NO: 546742 - protein, 5 aa, Mycobacterium
PTDHL

SEQ ID NO: 546743 - protein, 8 aa, Mycobacterium
PTDHRPVT

SEQ ID NO: 546744 - protein, 9 aa, Mycobacterium
PTDHRPVTP

SEQ ID NO: 546745 - protein, 5 aa, Mycobacterium
PTDIP

SEQ ID NO: 546746 - protein, 13 aa, Mycobacterium
PTDITNEDETARA

SEQ ID NO: 546747 - protein, 8 aa, Mycobacterium
PTDKPVAG

SEQ ID NO: 546748 - protein, 5 aa, Mycobacterium
PTDLA

SEQ ID NO: 546749 - protein, 10 aa, Mycobacterium
PTDLPRPDNA

SEQ ID NO: 546750 - protein, 10 aa, Mycobacterium
PTDNLDRGGA

SEQ ID NO: 546751 - protein, 9 aa, Mycobacterium
PTDNTVGID

SEQ ID NO: 546752 - protein, 9 aa, Mycobacterium
PTDNTVGIE

SEQ ID NO: 546753 - protein, 4 aa, Mycobacterium
PTDP

SEQ ID NO: 546754 - protein, 7 aa, Mycobacterium
PTDPAHQ

SEQ ID NO: 546755 - protein, 7 aa, Mycobacterium
PTDPALA

SEQ ID NO: 546756 - protein, 6 aa, Mycobacterium
PTDPAQ

SEQ ID NO: 546757 - protein, 7 aa, Mycobacterium
PTDPARF

SEQ ID NO: 546758 - protein, 13 aa, Mycobacterium
PTDPDESRRAQTA

SEQ ID NO: 546759 - protein, 7 aa, Mycobacterium
PTDPDRF

SEQ ID NO: 546760 - protein, 5 aa, Mycobacterium
PTDPG

SEQ ID NO: 546761 - protein, 9 aa, Mycobacterium
PTDPGAEIE

SEQ ID NO: 546762 - protein, 13 aa, Mycobacterium
PTDPGDRNRTSPF

SEQ ID NO: 546763 - protein, 9 aa, Mycobacterium
PTDPGRDAA

SEQ ID NO: 546764 - protein, 6 aa, Mycobacterium
PTDPGV

SEQ ID NO: 546765 - protein, 5 aa, Mycobacterium
PTDPL

SEQ ID NO: 546766 - protein, 6 aa, Mycobacterium
PTDPQA

SEQ ID NO: 546767 - protein, 10 aa, Mycobacterium
PTDPTPITGG

SEQ ID NO: 546768 - protein, 4 aa, Mycobacterium
PTDQ

SEQ ID NO: 546769 - protein, 8 aa, Mycobacterium
PTDQRPAL

SEQ ID NO: 546770 - protein, 5 aa, Mycobacterium
PTDRE

SEQ ID NO: 546771 - protein, 5 aa, Mycobacterium
PTDRG

SEQ ID NO: 546772 - protein, 6 aa, Mycobacterium
PTDRKI

SEQ ID NO: 546773 - protein, 15 aa, Mycobacterium
PTDRNSDPKLGASRT

SEQ ID NO: 546774 - protein, 14 aa, Mycobacterium
PTDRPQTTSPSFRG

SEQ ID NO: 546775 - protein, 8 aa, Mycobacterium
PTDRPYPA

SEQ ID NO: 546776 - protein, 17 aa, Mycobacterium
PTDRPYPQVADQRGASV

SEQ ID NO: 546777 - protein, 9 aa, Mycobacterium
PTDRTAAVD

SEQ ID NO: 546778 - protein, 6 aa, Mycobacterium
PTDSDG

SEQ ID NO: 546779 - protein, 8 aa, Mycobacterium
PTDSDGKV

SEQ ID NO: 546780 - protein, 10 aa, Mycobacterium
PTDSQTLSSG

SEQ ID NO: 546781 - protein, 4 aa, Mycobacterium
PTDT

SEQ ID NO: 546782 - protein, 13 aa, Mycobacterium
PTDTAGSTGPASP

SEQ ID NO: 546783 - protein, 6 aa, Mycobacterium
PTDTDT

SEQ ID NO: 546784 - protein, 17 aa, Mycobacterium
PTDTEYDPVTGLPRQGD

SEQ ID NO: 546785 - protein, 5 aa, Mycobacterium
PTDTG

SEQ ID NO: 546786 - protein, 5 aa, Mycobacterium
PTDTT

SEQ ID NO: 546787 - protein, 8 aa, Mycobacterium
PTDTTRTA

SEQ ID NO: 546788 - protein, 8 aa, Mycobacterium
PTDTVDRR

SEQ ID NO: 546789 - protein, 4 aa, Mycobacterium
PTDV

SEQ ID NO: 546790 - protein, 5 aa, Mycobacterium
PTDVG

SEQ ID NO: 546791 - protein, 10 aa, Mycobacterium
PTDVSDPEQV

SEQ ID NO: 546792 - protein, 6 aa, Mycobacterium
PTDVTD

SEQ ID NO: 546793 - protein, 8 aa, Mycobacterium
PTDVTDAD

SEQ ID NO: 546794 - protein, 10 aa, Mycobacterium
PTDVTDPEAC

SEQ ID NO: 546795 - protein, 4 aa, Mycobacterium
PTDW

SEQ ID NO: 546796 - protein, 4 aa, Mycobacterium
PTDY

SEQ ID NO: 546797 - protein, 13 aa, Mycobacterium
PTEAEAELRRGRR

SEQ ID NO: 546798 - protein, 5 aa, Mycobacterium
PTEAN

SEQ ID NO: 546799 - protein, 9 aa, Mycobacterium
PTEAREHQT

SEQ ID NO: 546800 - protein, 4 aa, Mycobacterium
PTEC

SEQ ID NO: 546801 - protein, 31 aa, Mycobacterium
PTEDADDLAAPSSATVPAAPTTAAPPPTTTL

SEQ ID NO: 546802 - protein, 14 aa, Mycobacterium
PTEDATLEEAQDNK

SEQ ID NO: 546803 - protein, 11 aa, Mycobacterium
PTEDDEKPPAA

SEQ ID NO: 546804 - protein, 6 aa, Mycobacterium
PTEDEL

SEQ ID NO: 546805 - protein, 7 aa, Mycobacterium
PTEDQQG

SEQ ID NO: 546806 - protein, 11 aa, Mycobacterium
PTEDRFSAEQF

SEQ ID NO: 546807 - protein, 8 aa, Mycobacterium
PTEDRREH

SEQ ID NO: 546808 - protein, 8 aa, Mycobacterium
PTEDRRNH

SEQ ID NO: 546809 - protein, 7 aa, Mycobacterium
PTEEGSI

SEQ ID NO: 546810 - protein, 5 aa, Mycobacterium
PTEEQ

SEQ ID NO: 546811 - protein, 16 aa, Mycobacterium
PTEEYNDAAALSAQEA

SEQ ID NO: 546812 - protein, 15 aa, Mycobacterium
PTEFGDTGLAPAATV

SEQ ID NO: 546813 - protein, 6 aa, Mycobacterium
PTEGAT

SEQ ID NO: 546814 - protein, 6 aa, Mycobacterium
PTEGLA

SEQ ID NO: 546815 - protein, 15 aa, Mycobacterium
PTEGPADDPHPEHGG

SEQ ID NO: 546816 - protein, 9 aa, Mycobacterium
PTEGPTTGT

SEQ ID NO: 546817 - protein, 7 aa, Mycobacterium
PTEGPVN

SEQ ID NO: 546818 - protein, 19 aa, Mycobacterium
PTEHPREGGRYATAPGGTL

SEQ ID NO: 546819 - protein, 4 aa, Mycobacterium
PTEI

SEQ ID NO: 546820 - protein, 7 aa, Mycobacterium
PTEKPDR

SEQ ID NO: 546821 - protein, 9 aa, Mycobacterium
PTEKYAKGA

SEQ ID NO: 546822 - protein, 4 aa, Mycobacterium
PTEL

SEQ ID NO: 546823 - protein, 11 aa, Mycobacterium
PTELAPGGTNA

SEQ ID NO: 546824 - protein, 11 aa, Mycobacterium
PTELARDGDYG

SEQ ID NO: 546825 - protein, 13 aa, Mycobacterium
PTELGGSDGDLAA

SEQ ID NO: 546826 - protein, 8 aa, Mycobacterium
PTENDPVT

SEQ ID NO: 546827 - protein, 10 aa, Mycobacterium
PTENTPDNEG

SEQ ID NO: 546828 - protein, 8 aa, Mycobacterium
PTEPAPQR

SEQ ID NO: 546829 - protein, 8 aa, Mycobacterium
PTEPDEFT

SEQ ID NO: 546830 - protein, 8 aa, Mycobacterium
PTEPEPPY

SEQ ID NO: 546831 - protein, 7 aa, Mycobacterium
PTEPGGY

SEQ ID NO: 546832 - protein, 8 aa, Mycobacterium
PTEPRDET

SEQ ID NO: 546833 - protein, 7 aa, Mycobacterium
PTEPRDQ

SEQ ID NO: 546834 - protein, 9 aa, Mycobacterium
PTEPRDQTL

SEQ ID NO: 546835 - protein, 8 aa, Mycobacterium
PTEPRPEN

SEQ ID NO: 546836 - protein, 8 aa, Mycobacterium
PTEPTPRQ

SEQ ID NO: 546837 - protein, 10 aa, Mycobacterium
PTEPTYNGNT

SEQ ID NO: 546838 - protein, 10 aa, Mycobacterium
PTEQADGSQR

SEQ ID NO: 546839 - protein, 5 aa, Mycobacterium
PTEQG

SEQ ID NO: 546840 - protein, 10 aa, Mycobacterium
PTEQNKSAAQ

SEQ ID NO: 546841 - protein, 5 aa, Mycobacterium
PTEQY

SEQ ID NO: 546842 - protein, 7 aa, Mycobacterium
PTERAAV

SEQ ID NO: 546843 - protein, 23 aa, Mycobacterium
PTEREDQVREAAQSCPEQAIIIT

SEQ ID NO: 546844 - protein, 5 aa, Mycobacterium
PTERG

SEQ ID NO: 546845 - protein, 5 aa, Mycobacterium
PTERH

SEQ ID NO: 546846 - protein, 6 aa, Mycobacterium
PTERID

SEQ ID NO: 546847 - protein, 5 aa, Mycobacterium
PTERL

SEQ ID NO: 546848 - protein, 5 aa, Mycobacterium
PTERS

SEQ ID NO: 546849 - protein, 9 aa, Mycobacterium
PTERTDRRP

SEQ ID NO: 546850 - protein, 6 aa, Mycobacterium
PTESDN

SEQ ID NO: 546851 - protein, 7 aa, Mycobacterium
PTESEDL

SEQ ID NO: 546852 - protein, 7 aa, Mycobacterium
PTESESL

SEQ ID NO: 546853 - protein, 8 aa, Mycobacterium
PTESESLS

SEQ ID NO: 546854 - protein, 7 aa, Mycobacterium
PTESETL

SEQ ID NO: 546855 - protein, 5 aa, Mycobacterium
PTEST

SEQ ID NO: 546856 - protein, 6 aa, Mycobacterium
PTETKG

SEQ ID NO: 546857 - protein, 13 aa, Mycobacterium
PTETPQQPARIER

SEQ ID NO: 546858 - protein, 6 aa, Mycobacterium
PTETSG

SEQ ID NO: 546859 - protein, 10 aa, Mycobacterium
PTETTPPLAE

SEQ ID NO: 546860 - protein, 7 aa, Mycobacterium
PTEVRTR

SEQ ID NO: 546861 - protein, 7 aa, Mycobacterium
PTEVTGR

SEQ ID NO: 546862 - protein, 15 aa, Mycobacterium
PTFASDETRKALHGT

SEQ ID NO: 546863 - protein, 8 aa, Mycobacterium
PTFDAAGK

SEQ ID NO: 546864 - protein, 9 aa, Mycobacterium
PTFDATGTL

SEQ ID NO: 546865 - protein, 9 aa, Mycobacterium
PTFGAPARR

SEQ ID NO: 546866 - protein, 20 aa, Mycobacterium
PTFGERSVNEGFSGGEKKRH

SEQ ID NO: 546867 - protein, 9 aa, Mycobacterium
PTFGQDRTT

SEQ ID NO: 546868 - protein, 8 aa, Mycobacterium
PTFGTTDC

SEQ ID NO: 546869 - protein, 9 aa, Mycobacterium
PTFGTTPDQ

SEQ ID NO: 546870 - protein, 10 aa, Mycobacterium
PTFKDARARG

SEQ ID NO: 546871 - protein, 12 aa, Mycobacterium
PTFNPTNGSTVG

SEQ ID NO: 546872 - protein, 7 aa, Mycobacterium
PTFNQAG

SEQ ID NO: 546873 - protein, 11 aa, Mycobacterium
PTFPADRPTRQ

SEQ ID NO: 546874 - protein, 4 aa, Mycobacterium
PTFS

SEQ ID NO: 546875 - protein, 9 aa, Mycobacterium
PTFSPGDTV

SEQ ID NO: 546876 - protein, 15 aa, Mycobacterium
PTFTADNTDTALRGT

SEQ ID NO: 546877 - protein, 6 aa, Mycobacterium
PTGADD

SEQ ID NO: 546878 - protein, 11 aa, Mycobacterium
PTGADSGAGGM

SEQ ID NO: 546879 - protein, 9 aa, Mycobacterium
PTGAEREST

SEQ ID NO: 546880 - protein, 6 aa, Mycobacterium
PTGAFS

SEQ ID NO: 546881 - protein, 19 aa, Mycobacterium
PTGAGEFGTRTETKNVNSL

SEQ ID NO: 546882 - protein, 8 aa, Mycobacterium
PTGAGHDA

SEQ ID NO: 546883 - protein, 11 aa, Mycobacterium
PTGAGYPPGEL

SEQ ID NO: 546884 - protein, 5 aa, Mycobacterium
PTGAL

SEQ ID NO: 546885 - protein, 8 aa, Mycobacterium
PTGAPTRF

SEQ ID NO: 546886 - protein, 10 aa, Mycobacterium
PTGARPGVEV

SEQ ID NO: 546887 - protein, 7 aa, Mycobacterium
PTGCGGF

SEQ ID NO: 546888 - protein, 16 aa, Mycobacterium
PTGDAASLDADAIPTS

SEQ ID NO: 546889 - protein, 5 aa, Mycobacterium
PTGDI

SEQ ID NO: 546890 - protein, 18 aa, Mycobacterium
PTGDSAPKGAATDAVADE

SEQ ID NO: 546891 - protein, 10 aa, Mycobacterium
PTGDSGSGGA

SEQ ID NO: 546892 - protein, 12 aa, Mycobacterium
PTGDVGPPSRPI

SEQ ID NO: 546893 - protein, 12 aa, Mycobacterium
PTGEAETERQLE

SEQ ID NO: 546894 - protein, 21 aa, Mycobacterium
PTGEAPRQASQASARCGDRTA

SEQ ID NO: 546895 - protein, 7 aa, Mycobacterium
PTGEATH

SEQ ID NO: 546896 - protein, 17 aa, Mycobacterium
PTGEEEELQSSESKVGP

SEQ ID NO: 546897 - protein, 7 aa, Mycobacterium
PTGEGPW

SEQ ID NO: 546898 - protein, 11 aa, Mycobacterium
PTGELPEHTQL

SEQ ID NO: 546899 - protein, 15 aa, Mycobacterium
PTGEPDADYETYKDR

SEQ ID NO: 546900 - protein, 4 aa, Mycobacterium
PTGF

SEQ ID NO: 546901 - protein, 5 aa, Mycobacterium
PTGFG

SEQ ID NO: 546902 - protein, 6 aa, Mycobacterium
PTGFGK

SEQ ID NO: 546903 - protein, 14 aa, Mycobacterium
PTGGAATAAASGSL

SEQ ID NO: 546904 - protein, 7 aa, Mycobacterium
PTGGEIR

SEQ ID NO: 546905 - protein, 6 aa, Mycobacterium
PTGGGG

SEQ ID NO: 546906 - protein, 16 aa, Mycobacterium
PTGGGTLTGESGGELR

SEQ ID NO: 546907 - protein, 11 aa, Mycobacterium
PTGGPSALGQG

SEQ ID NO: 546908 - protein, 4 aa, Mycobacterium
PTGH

SEQ ID NO: 546909 - protein, 9 aa, Mycobacterium
PTGHRYATT

SEQ ID NO: 546910 - protein, 26 aa, Mycobacterium
PTGHTPASKRVASVGKKISKTHAPAE

SEQ ID NO: 546911 - protein, 7 aa, Mycobacterium
PTGHYTR

SEQ ID NO: 546912 - protein, 10 aa, Mycobacterium
PTGIETEGGL

SEQ ID NO: 546913 - protein, 7 aa, Mycobacterium
PTGIQAA

SEQ ID NO: 546914 - protein, 5 aa, Mycobacterium
PTGIY

SEQ ID NO: 546915 - protein, 12 aa, Mycobacterium
PTGLSPRPRSAV

SEQ ID NO: 546916 - protein, 15 aa, Mycobacterium
PTGNPADDPHPEHAG

SEQ ID NO: 546917 - protein, 10 aa, Mycobacterium
PTGNYVPPGG

SEQ ID NO: 546918 - protein, 4 aa, Mycobacterium
PTGP

SEQ ID NO: 546919 - protein, 21 aa, Mycobacterium
PTGPADGESGPSFGPRMGSAT

SEQ ID NO: 546920 - protein, 21 aa, Mycobacterium
PTGPAEGDSGPATLGPRMGDA

SEQ ID NO: 546921 - protein, 21 aa, Mycobacterium
PTGPAEGESDAQGFGPRMGSA

SEQ ID NO: 546922 - protein, 5 aa, Mycobacterium
PTGPC

SEQ ID NO: 546923 - protein, 10 aa, Mycobacterium
PTGPGAGLAS

SEQ ID NO: 546924 - protein, 7 aa, Mycobacterium
PTGPGEV

SEQ ID NO: 546925 - protein, 6 aa, Mycobacterium
PTGPRL

SEQ ID NO: 546926 - protein, 61 aa, Mycobacterium
PTGPRVGGTGYPGAAGAAAPTLSSGVSSVGHGGPVAPGMSGMGGSPMTTSPAGLGGSPNLA

SEQ ID NO: 546927 - protein, 16 aa, Mycobacterium
PTGPSADRVANPGGDL

SEQ ID NO: 546928 - protein, 21 aa, Mycobacterium
PTGPVESGESATLGPKMGGAA

SEQ ID NO: 546929 - protein, 7 aa, Mycobacterium
PTGPVSA

SEQ ID NO: 546930 - protein, 8 aa, Mycobacterium
PTGQGPWP

SEQ ID NO: 546931 - protein, 6 aa, Mycobacterium
PTGQIP

SEQ ID NO: 546932 - protein, 15 aa, Mycobacterium
PTGQTYAGQPPPADE

SEQ ID NO: 546933 - protein, 5 aa, Mycobacterium
PTGRA

SEQ ID NO: 546934 - protein, 8 aa, Mycobacterium
PTGRATYR

SEQ ID NO: 546935 - protein, 11 aa, Mycobacterium
PTGRDVAPGTV

SEQ ID NO: 546936 - protein, 7 aa, Mycobacterium
PTGRIGP

SEQ ID NO: 546937 - protein, 8 aa, Mycobacterium
PTGRIGPD

SEQ ID NO: 546938 - protein, 5 aa, Mycobacterium
PTGRP

SEQ ID NO: 546939 - protein, 7 aa, Mycobacterium
PTGRPDG

SEQ ID NO: 546940 - protein, 6 aa, Mycobacterium
PTGRPT

SEQ ID NO: 546941 - protein, 5 aa, Mycobacterium
PTGRQ

SEQ ID NO: 546942 - protein, 12 aa, Mycobacterium
PTGRRARRGDDG

SEQ ID NO: 546943 - protein, 10 aa, Mycobacterium
PTGRRETAQG

SEQ ID NO: 546944 - protein, 11 aa, Mycobacterium
PTGRVDNDLTN

SEQ ID NO: 546945 - protein, 4 aa, Mycobacterium
PTGS

SEQ ID NO: 546946 - protein, 9 aa, Mycobacterium
PTGSAEERE

SEQ ID NO: 546947 - protein, 11 aa, Mycobacterium
PTGSAGPETYA

SEQ ID NO: 546948 - protein, 6 aa, Mycobacterium
PTGSDA

SEQ ID NO: 546949 - protein, 16 aa, Mycobacterium
PTGSGGSVVYTASRWQ

SEQ ID NO: 546950 - protein, 16 aa, Mycobacterium
PTGSGIELDGTAAQRI

SEQ ID NO: 546951 - protein, 10 aa, Mycobacterium
PTGSGPAPIQ

SEQ ID NO: 546952 - protein, 8 aa, Mycobacterium
PTGSGPSP

SEQ ID NO: 546953 - protein, 9 aa, Mycobacterium
PTGSIKDRP

SEQ ID NO: 546954 - protein, 11 aa, Mycobacterium
PTGSPADDDSA

SEQ ID NO: 546955 - protein, 10 aa, Mycobacterium
PTGSSSLRSA

SEQ ID NO: 546956 - protein, 12 aa, Mycobacterium
PTGSTNAAPPTV

SEQ ID NO: 546957 - protein, 8 aa, Mycobacterium
PTGSTQAP

SEQ ID NO: 546958 - protein, 15 aa, Mycobacterium
PTGSVIGTSSPRRAA

SEQ ID NO: 546959 - protein, 10 aa, Mycobacterium
PTGTASAPFE

SEQ ID NO: 546960 - protein, 7 aa, Mycobacterium
PTGTERT

SEQ ID NO: 546961 - protein, 8 aa, Mycobacterium
PTGTFERG

SEQ ID NO: 546962 - protein, 6 aa, Mycobacterium
PTGTIS

SEQ ID NO: 546963 - protein, 5 aa, Mycobacterium
PTGTP

SEQ ID NO: 546964 - protein, 6 aa, Mycobacterium
PTGTPL

SEQ ID NO: 546965 - protein, 11 aa, Mycobacterium
PTGTQHPDGSL

SEQ ID NO: 546966 - protein, 19 aa, Mycobacterium
PTGTTEFGTRTETKNVNSL

SEQ ID NO: 546967 - protein, 7 aa, Mycobacterium
PTGTTRA

SEQ ID NO: 546968 - protein, 11 aa, Mycobacterium
PTGVPTGMAPP

SEQ ID NO: 546969 - protein, 7 aa, Mycobacterium
PTGVTEP

SEQ ID NO: 546970 - protein, 4 aa, Mycobacterium
PTGW

SEQ ID NO: 546971 - protein, 4 aa, Mycobacterium
PTGY

SEQ ID NO: 546972 - protein, 17 aa, Mycobacterium
PTGYGSAANRAGVRGGD

SEQ ID NO: 546973 - protein, 17 aa, Mycobacterium
PTGYGSAARRARVRGGD

SEQ ID NO: 546974 - protein, 8 aa, Mycobacterium
PTHAVPSR

SEQ ID NO: 546975 - protein, 9 aa, Mycobacterium
PTHDATTNF

SEQ ID NO: 546976 - protein, 10 aa, Mycobacterium
PTHDATTNFR

SEQ ID NO: 546977 - protein, 6 aa, Mycobacterium
PTHDKR

SEQ ID NO: 546978 - protein, 7 aa, Mycobacterium
PTHDTEI

SEQ ID NO: 546979 - protein, 7 aa, Mycobacterium
PTHGSGA

SEQ ID NO: 546980 - protein, 12 aa, Mycobacterium
PTHPDRPDAPNL

SEQ ID NO: 546981 - protein, 12 aa, Mycobacterium
PTHPDSPEAPNM

SEQ ID NO: 546982 - protein, 10 aa, Mycobacterium
PTHPKSRGRL

SEQ ID NO: 546983 - protein, 5 aa, Mycobacterium
PTHPS

SEQ ID NO: 546984 - protein, 7 aa, Mycobacterium
PTHPTDP

SEQ ID NO: 546985 - protein, 23 aa, Mycobacterium
PTHQTEATLRARGDHALADLLHQ

SEQ ID NO: 546986 - protein, 13 aa, Mycobacterium
PTHRSADDGVGEV

SEQ ID NO: 546987 - protein, 13 aa, Mycobacterium
PTHSDTDSPLPKM

SEQ ID NO: 546988 - protein, 5 aa, Mycobacterium
PTHSN

SEQ ID NO: 546989 - protein, 10 aa, Mycobacterium
PTHTTEGLEA

SEQ ID NO: 546990 - protein, 16 aa, Mycobacterium
PTHVPRSAAPIAAVHS

SEQ ID NO: 546991 - protein, 18 aa, Mycobacterium
PTIANDYGQTPLSSAHSI

SEQ ID NO: 546992 - protein, 9 aa, Mycobacterium
PTIGGHEGS

SEQ ID NO: 546993 - protein, 55 aa, Mycobacterium
PTIGSDSRLSTRARTKEPATDSAAAAAAAQASDRREARARRRRRTPAGERGHRDE

SEQ ID NO: 546994 - protein, 10 aa, Mycobacterium
PTIKTPGGHY

SEQ ID NO: 546995 - protein, 4 aa, Mycobacterium
PTIP

SEQ ID NO: 546996 - protein, 5 aa, Mycobacterium
PTIPD

SEQ ID NO: 546997 - protein, 6 aa, Mycobacterium
PTIQPG

SEQ ID NO: 546998 - protein, 7 aa, Mycobacterium
PTIRPDN

SEQ ID NO: 546999 - protein, 10 aa, Mycobacterium
PTIRPNPGEV

SEQ ID NO: 547000 - protein, 7 aa, Mycobacterium
PTISGAS

SEQ ID NO: 547001 - protein, 11 aa, Mycobacterium
PTISGNVPPTV

SEQ ID NO: 547002 - protein, 8 aa, Mycobacterium
PTISGRNS

SEQ ID NO: 547003 - protein, 15 aa, Mycobacterium
PTISGSLADADAQTA

SEQ ID NO: 547004 - protein, 4 aa, Mycobacterium
PTIT

SEQ ID NO: 547005 - protein, 10 aa, Mycobacterium
PTITEGYRQD

SEQ ID NO: 547006 - protein, 14 aa, Mycobacterium
PTITGTTLDPATGL

SEQ ID NO: 547007 - protein, 12 aa, Mycobacterium
PTITTPGTTIPK

SEQ ID NO: 547008 - protein, 5 aa, Mycobacterium
PTKAA

SEQ ID NO: 547009 - protein, 11 aa, Mycobacterium
PTKAPAAQSEA

SEQ ID NO: 547010 - protein, 6 aa, Mycobacterium
PTKGQI

SEQ ID NO: 547011 - protein, 8 aa, Mycobacterium
PTKHEYGN

SEQ ID NO: 547012 - protein, 14 aa, Mycobacterium
PTKLESEAAADAKR

SEQ ID NO: 547013 - protein, 7 aa, Mycobacterium
PTKLTGK

SEQ ID NO: 547014 - protein, 13 aa, Mycobacterium
PTKMSGGEQQRTA

SEQ ID NO: 547015 - protein, 7 aa, Mycobacterium
PTKNIDG

SEQ ID NO: 547016 - protein, 15 aa, Mycobacterium
PTKNIDGTHPIASPT

SEQ ID NO: 547017 - protein, 6 aa, Mycobacterium
PTKPHR

SEQ ID NO: 547018 - protein, 11 aa, Mycobacterium
PTKPSAGGTVP

SEQ ID NO: 547019 - protein, 8 aa, Mycobacterium
PTKPTDRK

SEQ ID NO: 547020 - protein, 12 aa, Mycobacterium
PTKQGEKFDPDG

SEQ ID NO: 547021 - protein, 4 aa, Mycobacterium
PTKR

SEQ ID NO: 547022 - protein, 7 aa, Mycobacterium
PTKRPPN

SEQ ID NO: 547023 - protein, 4 aa, Mycobacterium
PTKT

SEQ ID NO: 547024 - protein, 15 aa, Mycobacterium
PTKTLDGKHPRESDD

SEQ ID NO: 547025 - protein, 9 aa, Mycobacterium
PTKVPSMAD

SEQ ID NO: 547026 - protein, 4 aa, Mycobacterium
PTKW

SEQ ID NO: 547027 - protein, 14 aa, Mycobacterium
PTLADLTPDTVRRV

SEQ ID NO: 547028 - protein, 7 aa, Mycobacterium
PTLAEGA

SEQ ID NO: 547029 - protein, 9 aa, Mycobacterium
PTLAPESAA

SEQ ID NO: 547030 - protein, 9 aa, Mycobacterium
PTLAPSERR

SEQ ID NO: 547031 - protein, 9 aa, Mycobacterium
PTLDPPVHT

SEQ ID NO: 547032 - protein, 12 aa, Mycobacterium
PTLDPSKSGQTA

SEQ ID NO: 547033 - protein, 10 aa, Mycobacterium
PTLDTAARAR

SEQ ID NO: 547034 - protein, 6 aa, Mycobacterium
PTLEEA

SEQ ID NO: 547035 - protein, 4 aa, Mycobacterium
PTLG

SEQ ID NO: 547036 - protein, 12 aa, Mycobacterium
PTLGDSAADVPA

SEQ ID NO: 547037 - protein, 10 aa, Mycobacterium
PTLGPTEDGI

SEQ ID NO: 547038 - protein, 6 aa, Mycobacterium
PTLGQA

SEQ ID NO: 547039 - protein, 6 aa, Mycobacterium
PTLGQH

SEQ ID NO: 547040 - protein, 12 aa, Mycobacterium
PTLGSRASYAGH

SEQ ID NO: 547041 - protein, 4 aa, Mycobacterium
PTLH

SEQ ID NO: 547042 - protein, 14 aa, Mycobacterium
PTLKDLSPDTLRRV

SEQ ID NO: 547043 - protein, 14 aa, Mycobacterium
PTLKDLTPDTLRRV

SEQ ID NO: 547044 - protein, 10 aa, Mycobacterium
PTLNTTGIPS

SEQ ID NO: 547045 - protein, 11 aa, Mycobacterium
PTLPEDTGTLP

SEQ ID NO: 547046 - protein, 13 aa, Mycobacterium
PTLPGDEPFSRDK

SEQ ID NO: 547047 - protein, 10 aa, Mycobacterium
PTLPGESQLP

SEQ ID NO: 547048 - protein, 11 aa, Mycobacterium
PTLPGSRNGGD

SEQ ID NO: 547049 - protein, 7 aa, Mycobacterium
PTLPHPT

SEQ ID NO: 547050 - protein, 8 aa, Mycobacterium
PTLPRGLE

SEQ ID NO: 547051 - protein, 11 aa, Mycobacterium
PTLPRSSTATI

SEQ ID NO: 547052 - protein, 8 aa, Mycobacterium
PTLPTDRQ

SEQ ID NO: 547053 - protein, 15 aa, Mycobacterium
PTLPTLPDDTGTLPS

SEQ ID NO: 547054 - protein, 12 aa, Mycobacterium
PTLPTLPDETGV

SEQ ID NO: 547055 - protein, 7 aa, Mycobacterium
PTLPTTA

SEQ ID NO: 547056 - protein, 6 aa, Mycobacterium
PTLPVS

SEQ ID NO: 547057 - protein, 16 aa, Mycobacterium
PTLQGAGTTVVDEDPN

SEQ ID NO: 547058 - protein, 4 aa, Mycobacterium
PTLS

SEQ ID NO: 547059 - protein, 5 aa, Mycobacterium
PTLSG

SEQ ID NO: 547060 - protein, 11 aa, Mycobacterium
PTLSGDDDHAV

SEQ ID NO: 547061 - protein, 6 aa, Mycobacterium
PTLSGP

SEQ ID NO: 547062 - protein, 10 aa, Mycobacterium
PTLSPPRGLT

SEQ ID NO: 547063 - protein, 4 aa, Mycobacterium
PTLT

SEQ ID NO: 547064 - protein, 8 aa, Mycobacterium
PTLTSKDE

SEQ ID NO: 547065 - protein, 4 aa, Mycobacterium
PTMR

SEQ ID NO: 547066 - protein, 15 aa, Mycobacterium
PTMRSSGRTLRPVRI

SEQ ID NO: 547067 - protein, 4 aa, Mycobacterium
PTMS

SEQ ID NO: 547068 - protein, 4 aa, Mycobacterium
PTNA

SEQ ID NO: 547069 - protein, 9 aa, Mycobacterium
PTNAALDDG

SEQ ID NO: 547070 - protein, 7 aa, Mycobacterium
PTNADNE

SEQ ID NO: 547071 - protein, 8 aa, Mycobacterium
PTNDAPSV

SEQ ID NO: 547072 - protein, 11 aa, Mycobacterium
PTNDARLPQAV

SEQ ID NO: 547073 - protein, 5 aa, Mycobacterium
PTNDQ

SEQ ID NO: 547074 - protein, 8 aa, Mycobacterium
PTNDTEIS

SEQ ID NO: 547075 - protein, 8 aa, Mycobacterium
PTNDTIAD

SEQ ID NO: 547076 - protein, 6 aa, Mycobacterium
PTNDVD

SEQ ID NO: 547077 - protein, 9 aa, Mycobacterium
PTNDVDTDT

SEQ ID NO: 547078 - protein, 6 aa, Mycobacterium
PTNESV

SEQ ID NO: 547079 - protein, 9 aa, Mycobacterium
PTNGGSVNA

SEQ ID NO: 547080 - protein, 10 aa, Mycobacterium
PTNGGSVNAV

SEQ ID NO: 547081 - protein, 10 aa, Mycobacterium
PTNGKVPGAR

SEQ ID NO: 547082 - protein, 6 aa, Mycobacterium
PTNGNH

SEQ ID NO: 547083 - protein, 10 aa, Mycobacterium
PTNGPFPSTV

SEQ ID NO: 547084 - protein, 4 aa, Mycobacterium
PTNH

SEQ ID NO: 547085 - protein, 4 aa, Mycobacterium
PTNI

SEQ ID NO: 547086 - protein, 4 aa, Mycobacterium
PTNL

SEQ ID NO: 547087 - protein, 5 aa, Mycobacterium
PTNNL

SEQ ID NO: 547088 - protein, 12 aa, Mycobacterium
PTNNLDADARGK

SEQ ID NO: 547089 - protein, 11 aa, Mycobacterium
PTNNLDGESRR

SEQ ID NO: 547090 - protein, 11 aa, Mycobacterium
PTNNLDSAARQ

SEQ ID NO: 547091 - protein, 6 aa, Mycobacterium
PTNNQM

SEQ ID NO: 547092 - protein, 13 aa, Mycobacterium
PTNNSDAPASFGR

SEQ ID NO: 547093 - protein, 17 aa, Mycobacterium
PTNPDNPDQPASTDETI

SEQ ID NO: 547094 - protein, 5 aa, Mycobacterium
PTNPY

SEQ ID NO: 547095 - protein, 16 aa, Mycobacterium
PTNRAGRADRIDRAAA

SEQ ID NO: 547096 - protein, 8 aa, Mycobacterium
PTNRDGVR

SEQ ID NO: 547097 - protein, 7 aa, Mycobacterium
PTNREED

SEQ ID NO: 547098 - protein, 9 aa, Mycobacterium
PTNRPAGRL

SEQ ID NO: 547099 - protein, 9 aa, Mycobacterium
PTNSPVLDS

SEQ ID NO: 547100 - protein, 7 aa, Mycobacterium
PTNVDTP

SEQ ID NO: 547101 - protein, 6 aa, Mycobacterium
PTPAAR

SEQ ID NO: 547102 - protein, 16 aa, Mycobacterium
PTPAARQKARQAPVSP

SEQ ID NO: 547103 - protein, 5 aa, Mycobacterium
PTPAD

SEQ ID NO: 547104 - protein, 13 aa, Mycobacterium
PTPADQVVSSKAA

SEQ ID NO: 547105 - protein, 9 aa, Mycobacterium
PTPADVGYR

SEQ ID NO: 547106 - protein, 8 aa, Mycobacterium
PTPAEDQE

SEQ ID NO: 547107 - protein, 6 aa, Mycobacterium
PTPAEL

SEQ ID NO: 547108 - protein, 5 aa, Mycobacterium
PTPAG

SEQ ID NO: 547109 - protein, 8 aa, Mycobacterium
PTPAGGDF

SEQ ID NO: 547110 - protein, 6 aa, Mycobacterium
PTPAGT

SEQ ID NO: 547111 - protein, 7 aa, Mycobacterium
PTPAGTL

SEQ ID NO: 547112 - protein, 9 aa, Mycobacterium
PTPAPCGKT

SEQ ID NO: 547113 - protein, 6 aa, Mycobacterium
PTPAPE

SEQ ID NO: 547114 - protein, 8 aa, Mycobacterium
PTPAPERG

SEQ ID NO: 547115 - protein, 29 aa, Mycobacterium
PTPAQADAAPPPPPGRRRRGSSNPGHVAR

SEQ ID NO: 547116 - protein, 10 aa, Mycobacterium
PTPATSDADD

SEQ ID NO: 547117 - protein, 13 aa, Mycobacterium
PTPAVGGSPTDRA

SEQ ID NO: 547118 - protein, 11 aa, Mycobacterium
PTPAVGGVPTD

SEQ ID NO: 547119 - protein, 11 aa, Mycobacterium
PTPAVGGVPTE

SEQ ID NO: 547120 - protein, 11 aa, Mycobacterium
PTPAVGGVPTK

SEQ ID NO: 547121 - protein, 14 aa, Mycobacterium
PTPAVGGVPTSAAG

SEQ ID NO: 547122 - protein, 41 aa, Mycobacterium
PTPAVSGGPMTGGQPVRENGFARPSPRVAGRSPSGRRCLDA

SEQ ID NO: 547123 - protein, 12 aa, Mycobacterium
PTPDAASSYAER

SEQ ID NO: 547124 - protein, 5 aa, Mycobacterium
PTPDE

SEQ ID NO: 547125 - protein, 9 aa, Mycobacterium
PTPDEPGFA

SEQ ID NO: 547126 - protein, 29 aa, Mycobacterium
PTPDGGLNAPTLRPGKPAGCAASDYKGVT

SEQ ID NO: 547127 - protein, 9 aa, Mycobacterium
PTPDQGADL

SEQ ID NO: 547128 - protein, 8 aa, Mycobacterium
PTPDRREH

SEQ ID NO: 547129 - protein, 6 aa, Mycobacterium
PTPDST

SEQ ID NO: 547130 - protein, 4 aa, Mycobacterium
PTPE

SEQ ID NO: 547131 - protein, 7 aa, Mycobacterium
PTPEDRD

SEQ ID NO: 547132 - protein, 10 aa, Mycobacterium
PTPEEAAAAE

SEQ ID NO: 547133 - protein, 10 aa, Mycobacterium
PTPEEAEAAE

SEQ ID NO: 547134 - protein, 7 aa, Mycobacterium
PTPEIGR

SEQ ID NO: 547135 - protein, 5 aa, Mycobacterium
PTPEN

SEQ ID NO: 547136 - protein, 10 aa, Mycobacterium
PTPEPKAGEV

SEQ ID NO: 547137 - protein, 12 aa, Mycobacterium
PTPEQAAAAEAE

SEQ ID NO: 547138 - protein, 11 aa, Mycobacterium
PTPEQAAAAQK

SEQ ID NO: 547139 - protein, 10 aa, Mycobacterium
PTPEQARAAR

SEQ ID NO: 547140 - protein, 4 aa, Mycobacterium
PTPG

SEQ ID NO: 547141 - protein, 5 aa, Mycobacterium
PTPGA

SEQ ID NO: 547142 - protein, 7 aa, Mycobacterium
PTPGDIG

SEQ ID NO: 547143 - protein, 8 aa, Mycobacterium
PTPGDIGY

SEQ ID NO: 547144 - protein, 6 aa, Mycobacterium
PTPGFS

SEQ ID NO: 547145 - protein, 9 aa, Mycobacterium
PTPGGGAAE

SEQ ID NO: 547146 - protein, 8 aa, Mycobacterium
PTPGHSPG

SEQ ID NO: 547147 - protein, 11 aa, Mycobacterium
PTPGHSPGSTS

SEQ ID NO: 547148 - protein, 55 aa, Mycobacterium
PTPGKPAPAPPAPKPFEPTPVNPHKPVTPGAPVTPVNPRPAPPVTPGKPVTPGVP

SEQ ID NO: 547149 - protein, 5 aa, Mycobacterium
PTPGL

SEQ ID NO: 547150 - protein, 7 aa, Mycobacterium
PTPGPVD

SEQ ID NO: 547151 - protein, 5 aa, Mycobacterium
PTPGT

SEQ ID NO: 547152 - protein, 7 aa, Mycobacterium
PTPGTSF

SEQ ID NO: 547153 - protein, 5 aa, Mycobacterium
PTPGV

SEQ ID NO: 547154 - protein, 6 aa, Mycobacterium
PTPGYG

SEQ ID NO: 547155 - protein, 7 aa, Mycobacterium
PTPHDER

SEQ ID NO: 547156 - protein, 30 aa, Mycobacterium
PTPHQHHAPPRKTAPRRRRRRRNGVARSAQ

SEQ ID NO: 547157 - protein, 11 aa, Mycobacterium
PTPHQHHASPE

SEQ ID NO: 547158 - protein, 5 aa, Mycobacterium
PTPIS

SEQ ID NO: 547159 - protein, 4 aa, Mycobacterium
PTPK

SEQ ID NO: 547160 - protein, 9 aa, Mycobacterium
PTPKRNYGR

SEQ ID NO: 547161 - protein, 5 aa, Mycobacterium
PTPLA

SEQ ID NO: 547162 - protein, 13 aa, Mycobacterium
PTPLAAAGADDSL

SEQ ID NO: 547163 - protein, 6 aa, Mycobacterium
PTPLGG

SEQ ID NO: 547164 - protein, 7 aa, Mycobacterium
PTPLGGE

SEQ ID NO: 547165 - protein, 7 aa, Mycobacterium
PTPLGGT

SEQ ID NO: 547166 - protein, 5 aa, Mycobacterium
PTPLP

SEQ ID NO: 547167 - protein, 12 aa, Mycobacterium
PTPLPDGVGQAT

SEQ ID NO: 547168 - protein, 15 aa, Mycobacterium
PTPLSGSEQREAAAL

SEQ ID NO: 547169 - protein, 14 aa, Mycobacterium
PTPNPGAPEGIQDP

SEQ ID NO: 547170 - protein, 13 aa, Mycobacterium
PTPNRPPSVPSTT

SEQ ID NO: 547171 - protein, 122 aa, Mycobacterium
PTPPAPAAVAPAPAAPPAPAAPPWPPTPPAPPVATPKPPLPPLPPTPPLPPAPPPTPPAPPAPPKPPPPPAPPTSPGLPPTSPPVPAAPPLPPWPPAPPIPERPPPPPIPPAPPSPPRPPAA

SEQ ID NO: 547172 - protein, 6 aa, Mycobacterium
PTPPES

SEQ ID NO: 547173 - protein, 8 aa, Mycobacterium
PTPPEYGP

SEQ ID NO: 547174 - protein, 13 aa, Mycobacterium
PTPPGQPTEPGVP

SEQ ID NO: 547175 - protein, 11 aa, Mycobacterium
PTPPLPPLPPS

SEQ ID NO: 547176 - protein, 12 aa, Mycobacterium
PTPPPAKPAEQA

SEQ ID NO: 547177 - protein, 6 aa, Mycobacterium
PTPPRL

SEQ ID NO: 547178 - protein, 28 aa, Mycobacterium
PTPPVTAPLTAPSHPPSAVGAGSGAPAG

SEQ ID NO: 547179 - protein, 6 aa, Mycobacterium
PTPPWH

SEQ ID NO: 547180 - protein, 8 aa, Mycobacterium
PTPQNDSG

SEQ ID NO: 547181 - protein, 6 aa, Mycobacterium
PTPQQL

SEQ ID NO: 547182 - protein, 7 aa, Mycobacterium
PTPQRER

SEQ ID NO: 547183 - protein, 7 aa, Mycobacterium
PTPQTVG

SEQ ID NO: 547184 - protein, 8 aa, Mycobacterium
PTPQTVGE

SEQ ID NO: 547185 - protein, 12 aa, Mycobacterium
PTPRAETAGGNA

SEQ ID NO: 547186 - protein, 12 aa, Mycobacterium
PTPRAPLPGDQD

SEQ ID NO: 547187 - protein, 12 aa, Mycobacterium
PTPRGVSAQTDP

SEQ ID NO: 547188 - protein, 15 aa, Mycobacterium
PTPRPRAKKATPAMR

SEQ ID NO: 547189 - protein, 9 aa, Mycobacterium
PTPRQYTRK

SEQ ID NO: 547190 - protein, 13 aa, Mycobacterium
PTPRRVLDALRAR

SEQ ID NO: 547191 - protein, 5 aa, Mycobacterium
PTPRV

SEQ ID NO: 547192 - protein, 5 aa, Mycobacterium
PTPSA

SEQ ID NO: 547193 - protein, 12 aa, Mycobacterium
PTPSATAAATAA

SEQ ID NO: 547194 - protein, 7 aa, Mycobacterium
PTPSGEH

SEQ ID NO: 547195 - protein, 7 aa, Mycobacterium
PTPSGQW

SEQ ID NO: 547196 - protein, 5 aa, Mycobacterium
PTPSH

SEQ ID NO: 547197 - protein, 7 aa, Mycobacterium
PTPSNGV

SEQ ID NO: 547198 - protein, 5 aa, Mycobacterium
PTPSR

SEQ ID NO: 547199 - protein, 7 aa, Mycobacterium
PTPSRLE

SEQ ID NO: 547200 - protein, 8 aa, Mycobacterium
PTPSSGGV

SEQ ID NO: 547201 - protein, 28 aa, Mycobacterium
PTPSTPGLTNTGDGEVGGTSSSAALVQD

SEQ ID NO: 547202 - protein, 6 aa, Mycobacterium
PTPSYV

SEQ ID NO: 547203 - protein, 18 aa, Mycobacterium
PTPTARKDYIGGAAETAR

SEQ ID NO: 547204 - protein, 5 aa, Mycobacterium
PTPTE

SEQ ID NO: 547205 - protein, 12 aa, Mycobacterium
PTPTEADETRTR

SEQ ID NO: 547206 - protein, 6 aa, Mycobacterium
PTPTER

SEQ ID NO: 547207 - protein, 11 aa, Mycobacterium
PTPTETGPTAT

SEQ ID NO: 547208 - protein, 7 aa, Mycobacterium
PTPTGEV

SEQ ID NO: 547209 - protein, 12 aa, Mycobacterium
PTPTKPDRAAPG

SEQ ID NO: 547210 - protein, 12 aa, Mycobacterium
PTPTKPGRAAPG

SEQ ID NO: 547211 - protein, 12 aa, Mycobacterium
PTPTKPGREAPG

SEQ ID NO: 547212 - protein, 12 aa, Mycobacterium
PTPTKPGRTAPG

SEQ ID NO: 547213 - protein, 12 aa, Mycobacterium
PTPTKPGRTASG

SEQ ID NO: 547214 - protein, 10 aa, Mycobacterium
PTPTLPETPI

SEQ ID NO: 547215 - protein, 12 aa, Mycobacterium
PTPTPATVSDPA

SEQ ID NO: 547216 - protein, 36 aa, Mycobacterium
PTPTPEPEPTPEPVRKPPEPEPKPWTPQSAHPGRGG

SEQ ID NO: 547217 - protein, 6 aa, Mycobacterium
PTPTQW

SEQ ID NO: 547218 - protein, 13 aa, Mycobacterium
PTPTTTTLEQTDR

SEQ ID NO: 547219 - protein, 4 aa, Mycobacterium
PTPV

SEQ ID NO: 547220 - protein, 12 aa, Mycobacterium
PTPVPHPESAPR

SEQ ID NO: 547221 - protein, 8 aa, Mycobacterium
PTPVPRPA

SEQ ID NO: 547222 - protein, 5 aa, Mycobacterium
PTPVS

SEQ ID NO: 547223 - protein, 5 aa, Mycobacterium
PTPVT

SEQ ID NO: 547224 - protein, 26 aa, Mycobacterium
PTQAAVGEGAADQAGSPLGIWPCGRM

SEQ ID NO: 547225 - protein, 12 aa, Mycobacterium
PTQARSAAGHHR

SEQ ID NO: 547226 - protein, 11 aa, Mycobacterium
PTQATTPGTAG

SEQ ID NO: 547227 - protein, 4 aa, Mycobacterium
PTQD

SEQ ID NO: 547228 - protein, 9 aa, Mycobacterium
PTQDPEAAA

SEQ ID NO: 547229 - protein, 10 aa, Mycobacterium
PTQDRSKDTV

SEQ ID NO: 547230 - protein, 26 aa, Mycobacterium
PTQGAADTVKVGGTVSAGLGQATRVG

SEQ ID NO: 547231 - protein, 8 aa, Mycobacterium
PTQGPTTT

SEQ ID NO: 547232 - protein, 10 aa, Mycobacterium
PTQHSDRPAE

SEQ ID NO: 547233 - protein, 5 aa, Mycobacterium
PTQIP

SEQ ID NO: 547234 - protein, 13 aa, Mycobacterium
PTQISGKADTGIR

SEQ ID NO: 547235 - protein, 9 aa, Mycobacterium
PTQMTPDGS

SEQ ID NO: 547236 - protein, 7 aa, Mycobacterium
PTQNEAL

SEQ ID NO: 547237 - protein, 7 aa, Mycobacterium
PTQNGGG

SEQ ID NO: 547238 - protein, 6 aa, Mycobacterium
PTQPIG

SEQ ID NO: 547239 - protein, 11 aa, Mycobacterium
PTQPRLKRGSR

SEQ ID NO: 547240 - protein, 6 aa, Mycobacterium
PTQRAR

SEQ ID NO: 547241 - protein, 10 aa, Mycobacterium
PTQSDIDSAR

SEQ ID NO: 547242 - protein, 7 aa, Mycobacterium
PTQSVTA

SEQ ID NO: 547243 - protein, 4 aa, Mycobacterium
PTQT

SEQ ID NO: 547244 - protein, 6 aa, Mycobacterium
PTQTTD

SEQ ID NO: 547245 - protein, 5 aa, Mycobacterium
PTQTY

SEQ ID NO: 547246 - protein, 13 aa, Mycobacterium
PTQVTGEGAPISP

SEQ ID NO: 547247 - protein, 4 aa, Mycobacterium
PTQY

SEQ ID NO: 547248 - protein, 14 aa, Mycobacterium
PTRADALDDDARAE

SEQ ID NO: 547249 - protein, 14 aa, Mycobacterium
PTRADALTDAARAE

SEQ ID NO: 547250 - protein, 16 aa, Mycobacterium
PTRADTLTDAAKADLE

SEQ ID NO: 547251 - protein, 6 aa, Mycobacterium
PTRAEA

SEQ ID NO: 547252 - protein, 11 aa, Mycobacterium
PTRAGALTDEA

SEQ ID NO: 547253 - protein, 18 aa, Mycobacterium
PTRAGARADERLRSGAPL

SEQ ID NO: 547254 - protein, 15 aa, Mycobacterium
PTRAGNLTDEARAEL

SEQ ID NO: 547255 - protein, 6 aa, Mycobacterium
PTRARI

SEQ ID NO: 547256 - protein, 7 aa, Mycobacterium
PTRDDFS

SEQ ID NO: 547257 - protein, 7 aa, Mycobacterium
PTRDDVA

SEQ ID NO: 547258 - protein, 4 aa, Mycobacterium
PTRE

SEQ ID NO: 547259 - protein, 10 aa, Mycobacterium
PTREAQDRFN

SEQ ID NO: 547260 - protein, 14 aa, Mycobacterium
PTRFGASGEVPEAV

SEQ ID NO: 547261 - protein, 8 aa, Mycobacterium
PTRFGSPA

SEQ ID NO: 547262 - protein, 9 aa, Mycobacterium
PTRFGSPAA

SEQ ID NO: 547263 - protein, 10 aa, Mycobacterium
PTRFGSPAGQ

SEQ ID NO: 547264 - protein, 15 aa, Mycobacterium
PTRGAAVGDTIDGQS

SEQ ID NO: 547265 - protein, 5 aa, Mycobacterium
PTRGE

SEQ ID NO: 547266 - protein, 11 aa, Mycobacterium
PTRGEQGKGIT

SEQ ID NO: 547267 - protein, 6 aa, Mycobacterium
PTRGLD

SEQ ID NO: 547268 - protein, 14 aa, Mycobacterium
PTRGQRKARAGNAT

SEQ ID NO: 547269 - protein, 10 aa, Mycobacterium
PTRGQTTRRR

SEQ ID NO: 547270 - protein, 7 aa, Mycobacterium
PTRGRSP

SEQ ID NO: 547271 - protein, 14 aa, Mycobacterium
PTRGSIPAGVPTDP

SEQ ID NO: 547272 - protein, 6 aa, Mycobacterium
PTRGVD

SEQ ID NO: 547273 - protein, 7 aa, Mycobacterium
PTRGVDV

SEQ ID NO: 547274 - protein, 11 aa, Mycobacterium
PTRHEQREGRI

SEQ ID NO: 547275 - protein, 9 aa, Mycobacterium
PTRHGPTRA

SEQ ID NO: 547276 - protein, 5 aa, Mycobacterium
PTRIE

SEQ ID NO: 547277 - protein, 4 aa, Mycobacterium
PTRK

SEQ ID NO: 547278 - protein, 8 aa, Mycobacterium
PTRLPGRN

SEQ ID NO: 547279 - protein, 5 aa, Mycobacterium
PTRLS

SEQ ID NO: 547280 - protein, 6 aa, Mycobacterium
PTRMEG

SEQ ID NO: 547281 - protein, 6 aa, Mycobacterium
PTRNGR

SEQ ID NO: 547282 - protein, 17 aa, Mycobacterium
PTRNGRYADGLPDDDPV

SEQ ID NO: 547283 - protein, 5 aa, Mycobacterium
PTRNR

SEQ ID NO: 547284 - protein, 6 aa, Mycobacterium
PTRNTR

SEQ ID NO: 547285 - protein, 7 aa, Mycobacterium
PTRPDPH

SEQ ID NO: 547286 - protein, 9 aa, Mycobacterium
PTRPDPHAQ

SEQ ID NO: 547287 - protein, 9 aa, Mycobacterium
PTRPDRPQE

SEQ ID NO: 547288 - protein, 10 aa, Mycobacterium
PTRPGPGFDP

SEQ ID NO: 547289 - protein, 17 aa, Mycobacterium
PTRPGRRTTGDRREVVL

SEQ ID NO: 547290 - protein, 7 aa, Mycobacterium
PTRPGSY

SEQ ID NO: 547291 - protein, 11 aa, Mycobacterium
PTRPPAEHGGD

SEQ ID NO: 547292 - protein, 7 aa, Mycobacterium
PTRPPFT

SEQ ID NO: 547293 - protein, 11 aa, Mycobacterium
PTRPSDDDWSD

SEQ ID NO: 547294 - protein, 7 aa, Mycobacterium
PTRPYGD

SEQ ID NO: 547295 - protein, 4 aa, Mycobacterium
PTRQ

SEQ ID NO: 547296 - protein, 20 aa, Mycobacterium
PTRQDDARMEDVRPGQLHGR

SEQ ID NO: 547297 - protein, 19 aa, Mycobacterium
PTRQERGATAITSDPRTLR

SEQ ID NO: 547298 - protein, 4 aa, Mycobacterium
PTRR

SEQ ID NO: 547299 - protein, 10 aa, Mycobacterium
PTRRAEAQAR

SEQ ID NO: 547300 - protein, 6 aa, Mycobacterium
PTRRAR

SEQ ID NO: 547301 - protein, 17 aa, Mycobacterium
PTRRAVGNDERCPCSRT

SEQ ID NO: 547302 - protein, 5 aa, Mycobacterium
PTRRD

SEQ ID NO: 547303 - protein, 5 aa, Mycobacterium
PTRRK

SEQ ID NO: 547304 - protein, 6 aa, Mycobacterium
PTRRLG

SEQ ID NO: 547305 - protein, 12 aa, Mycobacterium
PTRRPVTAANSA

SEQ ID NO: 547306 - protein, 19 aa, Mycobacterium
PTRRQVDDSLAAAKSKSAL

SEQ ID NO: 547307 - protein, 19 aa, Mycobacterium
PTRRQVDDSLTAAKSKSAL

SEQ ID NO: 547308 - protein, 10 aa, Mycobacterium
PTRRRTRAHN

SEQ ID NO: 547309 - protein, 5 aa, Mycobacterium
PTRSE

SEQ ID NO: 547310 - protein, 9 aa, Mycobacterium
PTRSEAADV

SEQ ID NO: 547311 - protein, 21 aa, Mycobacterium
PTRSEIEGWDTSELENAASTW

SEQ ID NO: 547312 - protein, 8 aa, Mycobacterium
PTRSGEEV

SEQ ID NO: 547313 - protein, 5 aa, Mycobacterium
PTRSL

SEQ ID NO: 547314 - protein, 12 aa, Mycobacterium
PTRSPGGTAGTP

SEQ ID NO: 547315 - protein, 6 aa, Mycobacterium
PTRSTA

SEQ ID NO: 547316 - protein, 12 aa, Mycobacterium
PTRTDALTEAAR

SEQ ID NO: 547317 - protein, 5 aa, Mycobacterium
PTRTQ

SEQ ID NO: 547318 - protein, 5 aa, Mycobacterium
PTRTV

SEQ ID NO: 547319 - protein, 5 aa, Mycobacterium
PTRVD

SEQ ID NO: 547320 - protein, 10 aa, Mycobacterium
PTRVGGRQPA

SEQ ID NO: 547321 - protein, 15 aa, Mycobacterium
PTRVTGRGAGAGVRL

SEQ ID NO: 547322 - protein, 9 aa, Mycobacterium
PTSADASVP

SEQ ID NO: 547323 - protein, 11 aa, Mycobacterium
PTSAGDPAIAA

SEQ ID NO: 547324 - protein, 9 aa, Mycobacterium
PTSAGYRTF

SEQ ID NO: 547325 - protein, 10 aa, Mycobacterium
PTSAISEREV

SEQ ID NO: 547326 - protein, 5 aa, Mycobacterium
PTSAL

SEQ ID NO: 547327 - protein, 7 aa, Mycobacterium
PTSALAA

SEQ ID NO: 547328 - protein, 6 aa, Mycobacterium
PTSALD

SEQ ID NO: 547329 - protein, 5 aa, Mycobacterium
PTSAP

SEQ ID NO: 547330 - protein, 7 aa, Mycobacterium
PTSAPEQ

SEQ ID NO: 547331 - protein, 15 aa, Mycobacterium
PTSAPGWPAVTGPPV

SEQ ID NO: 547332 - protein, 8 aa, Mycobacterium
PTSASSLA

SEQ ID NO: 547333 - protein, 8 aa, Mycobacterium
PTSAVDAD

SEQ ID NO: 547334 - protein, 7 aa, Mycobacterium
PTSDAGA

SEQ ID NO: 547335 - protein, 7 aa, Mycobacterium
PTSDARI

SEQ ID NO: 547336 - protein, 11 aa, Mycobacterium
PTSDARLPQAV

SEQ ID NO: 547337 - protein, 16 aa, Mycobacterium
PTSDGATVAKELGAGA

SEQ ID NO: 547338 - protein, 6 aa, Mycobacterium
PTSDGR

SEQ ID NO: 547339 - protein, 5 aa, Mycobacterium
PTSDI

SEQ ID NO: 547340 - protein, 10 aa, Mycobacterium
PTSDNRPPRP

SEQ ID NO: 547341 - protein, 6 aa, Mycobacterium
PTSEED

SEQ ID NO: 547342 - protein, 7 aa, Mycobacterium
PTSEGAL

SEQ ID NO: 547343 - protein, 17 aa, Mycobacterium
PTSENLDDRTATGTSEH

SEQ ID NO: 547344 - protein, 5 aa, Mycobacterium
PTSER

SEQ ID NO: 547345 - protein, 10 aa, Mycobacterium
PTSGAPTYEV

SEQ ID NO: 547346 - protein, 12 aa, Mycobacterium
PTSGAYASAKAA

SEQ ID NO: 547347 - protein, 5 aa, Mycobacterium
PTSGD

SEQ ID NO: 547348 - protein, 7 aa, Mycobacterium
PTSGEEF

SEQ ID NO: 547349 - protein, 109 aa, Mycobacterium
PTSGGITSGTATGGEGGVGGAGTTVAAGGVGGHGGNATLAASDAGSSADGTATGGAGGAGGTNHASGGRGGDATISTSGGGTITGGTATGGVGGAGTTGGSGGGGGSGA

SEQ ID NO: 547350 - protein, 11 aa, Mycobacterium
PTSGGTRMQEG

SEQ ID NO: 547351 - protein, 14 aa, Mycobacterium
PTSGLADGGELTAG

SEQ ID NO: 547352 - protein, 11 aa, Mycobacterium
PTSGLDPVNAR

SEQ ID NO: 547353 - protein, 11 aa, Mycobacterium
PTSGMDPVNAR

SEQ ID NO: 547354 - protein, 6 aa, Mycobacterium
PTSGNA

SEQ ID NO: 547355 - protein, 5 aa, Mycobacterium
PTSGP

SEQ ID NO: 547356 - protein, 6 aa, Mycobacterium
PTSGPL

SEQ ID NO: 547357 - protein, 7 aa, Mycobacterium
PTSGPVD

SEQ ID NO: 547358 - protein, 10 aa, Mycobacterium
PTSGRVEVNG

SEQ ID NO: 547359 - protein, 14 aa, Mycobacterium
PTSGSTGKPKLVGQ

SEQ ID NO: 547360 - protein, 7 aa, Mycobacterium
PTSGSVR

SEQ ID NO: 547361 - protein, 17 aa, Mycobacterium
PTSGTLTVDGKDVTKVD

SEQ ID NO: 547362 - protein, 12 aa, Mycobacterium
PTSGTTGPPKRV

SEQ ID NO: 547363 - protein, 5 aa, Mycobacterium
PTSHA

SEQ ID NO: 547364 - protein, 17 aa, Mycobacterium
PTSHGGDDHGDDQLRPA

SEQ ID NO: 547365 - protein, 17 aa, Mycobacterium
PTSHSYRTARGRAERGA

SEQ ID NO: 547366 - protein, 9 aa, Mycobacterium
PTSISGPRD

SEQ ID NO: 547367 - protein, 8 aa, Mycobacterium
PTSKLDAS

SEQ ID NO: 547368 - protein, 9 aa, Mycobacterium
PTSLHDNSE

SEQ ID NO: 547369 - protein, 15 aa, Mycobacterium
PTSMGKDKAPTNNGT

SEQ ID NO: 547370 - protein, 5 aa, Mycobacterium
PTSNG

SEQ ID NO: 547371 - protein, 7 aa, Mycobacterium
PTSNGRF

SEQ ID NO: 547372 - protein, 9 aa, Mycobacterium
PTSNGRLGA

SEQ ID NO: 547373 - protein, 13 aa, Mycobacterium
PTSNMPNTPEETR

SEQ ID NO: 547374 - protein, 12 aa, Mycobacterium
PTSNPGAPNGVV

SEQ ID NO: 547375 - protein, 10 aa, Mycobacterium
PTSNPRGVTG

SEQ ID NO: 547376 - protein, 5 aa, Mycobacterium
PTSNT

SEQ ID NO: 547377 - protein, 15 aa, Mycobacterium
PTSPDDPAAAANKAA

SEQ ID NO: 547378 - protein, 15 aa, Mycobacterium
PTSPDDPAAAANKTA

SEQ ID NO: 547379 - protein, 14 aa, Mycobacterium
PTSPDDPAAEANRA

SEQ ID NO: 547380 - protein, 14 aa, Mycobacterium
PTSPDDPAAPANRA

SEQ ID NO: 547381 - protein, 13 aa, Mycobacterium
PTSPDDPAVPANR

SEQ ID NO: 547382 - protein, 10 aa, Mycobacterium
PTSPGYSGNT

SEQ ID NO: 547383 - protein, 13 aa, Mycobacterium
PTSPSDPAIPANR

SEQ ID NO: 547384 - protein, 6 aa, Mycobacterium
PTSPSQ

SEQ ID NO: 547385 - protein, 8 aa, Mycobacterium
PTSPTSSV

SEQ ID NO: 547386 - protein, 11 aa, Mycobacterium
PTSPVNDGATA

SEQ ID NO: 547387 - protein, 13 aa, Mycobacterium
PTSQAAKFDPSGD

SEQ ID NO: 547388 - protein, 5 aa, Mycobacterium
PTSQG

SEQ ID NO: 547389 - protein, 8 aa, Mycobacterium
PTSQPDAW

SEQ ID NO: 547390 - protein, 5 aa, Mycobacterium
PTSQV

SEQ ID NO: 547391 - protein, 10 aa, Mycobacterium
PTSRKGDHNH

SEQ ID NO: 547392 - protein, 9 aa, Mycobacterium
PTSRNGDHN

SEQ ID NO: 547393 - protein, 6 aa, Mycobacterium
PTSRQA

SEQ ID NO: 547394 - protein, 5 aa, Mycobacterium
PTSRR

SEQ ID NO: 547395 - protein, 19 aa, Mycobacterium
PTSRSSVAAAANSSGATDK

SEQ ID NO: 547396 - protein, 6 aa, Mycobacterium
PTSSAH

SEQ ID NO: 547397 - protein, 18 aa, Mycobacterium
PTSSDVDQLRRAAEVAGR

SEQ ID NO: 547398 - protein, 18 aa, Mycobacterium
PTSSDVDQLSRAADVAAK

SEQ ID NO: 547399 - protein, 7 aa, Mycobacterium
PTSSDVE

SEQ ID NO: 547400 - protein, 6 aa, Mycobacterium
PTSSGF

SEQ ID NO: 547401 - protein, 7 aa, Mycobacterium
PTSSGQW

SEQ ID NO: 547402 - protein, 10 aa, Mycobacterium
PTSSLPQNDS

SEQ ID NO: 547403 - protein, 6 aa, Mycobacterium
PTSSTE

SEQ ID NO: 547404 - protein, 12 aa, Mycobacterium
PTSSTRGIDGAD

SEQ ID NO: 547405 - protein, 9 aa, Mycobacterium
PTSTADAER

SEQ ID NO: 547406 - protein, 10 aa, Mycobacterium
PTSTDRPAAV

SEQ ID NO: 547407 - protein, 7 aa, Mycobacterium
PTSTHGP

SEQ ID NO: 547408 - protein, 9 aa, Mycobacterium
PTSTKTTVT

SEQ ID NO: 547409 - protein, 10 aa, Mycobacterium
PTSTPNRGRR

SEQ ID NO: 547410 - protein, 4 aa, Mycobacterium
PTSV

SEQ ID NO: 547411 - protein, 6 aa, Mycobacterium
PTSVGA

SEQ ID NO: 547412 - protein, 18 aa, Mycobacterium
PTSVLAPSGMTPTPDDDG

SEQ ID NO: 547413 - protein, 7 aa, Mycobacterium
PTSVNTQ

SEQ ID NO: 547414 - protein, 15 aa, Mycobacterium
PTSWTTSASTPHPEA

SEQ ID NO: 547415 - protein, 10 aa, Mycobacterium
PTSYTPTSKR

SEQ ID NO: 547416 - protein, 5 aa, Mycobacterium
PTTAA

SEQ ID NO: 547417 - protein, 8 aa, Mycobacterium
PTTAAPAI

SEQ ID NO: 547418 - protein, 6 aa, Mycobacterium
PTTADG

SEQ ID NO: 547419 - protein, 7 aa, Mycobacterium
PTTADRD

SEQ ID NO: 547420 - protein, 16 aa, Mycobacterium
PTTAEAQDSALSPRGY

SEQ ID NO: 547421 - protein, 16 aa, Mycobacterium
PTTAEAQDSAVSPRGY

SEQ ID NO: 547422 - protein, 6 aa, Mycobacterium
PTTAEE

SEQ ID NO: 547423 - protein, 14 aa, Mycobacterium
PTTAGETNSRPRCE

SEQ ID NO: 547424 - protein, 5 aa, Mycobacterium
PTTAM

SEQ ID NO: 547425 - protein, 9 aa, Mycobacterium
PTTAPAEKW

SEQ ID NO: 547426 - protein, 11 aa, Mycobacterium
PTTAQPPPEAH

SEQ ID NO: 547427 - protein, 10 aa, Mycobacterium
PTTAQPPTGI

SEQ ID NO: 547428 - protein, 11 aa, Mycobacterium
PTTASASQSGW

SEQ ID NO: 547429 - protein, 6 aa, Mycobacterium
PTTATG

SEQ ID NO: 547430 - protein, 7 aa, Mycobacterium
PTTATGK

SEQ ID NO: 547431 - protein, 5 aa, Mycobacterium
PTTAV

SEQ ID NO: 547432 - protein, 7 aa, Mycobacterium
PTTAVGT

SEQ ID NO: 547433 - protein, 6 aa, Mycobacterium
PTTCEA

SEQ ID NO: 547434 - protein, 8 aa, Mycobacterium
PTTDRAAL

SEQ ID NO: 547435 - protein, 8 aa, Mycobacterium
PTTDRTGL

SEQ ID NO: 547436 - protein, 6 aa, Mycobacterium
PTTDRV

SEQ ID NO: 547437 - protein, 4 aa, Mycobacterium
PTTE

SEQ ID NO: 547438 - protein, 6 aa, Mycobacterium
PTTEER

SEQ ID NO: 547439 - protein, 17 aa, Mycobacterium
PTTERDLADGIGPAREL

SEQ ID NO: 547440 - protein, 4 aa, Mycobacterium
PTTF

SEQ ID NO: 547441 - protein, 8 aa, Mycobacterium
PTTFDEES

SEQ ID NO: 547442 - protein, 13 aa, Mycobacterium
PTTFTAGAAPGIA

SEQ ID NO: 547443 - protein, 11 aa, Mycobacterium
PTTGFAGTAEE

SEQ ID NO: 547444 - protein, 10 aa, Mycobacterium
PTTGFDPEAR

SEQ ID NO: 547445 - protein, 9 aa, Mycobacterium
PTTGGTGAE

SEQ ID NO: 547446 - protein, 5 aa, Mycobacterium
PTTGL

SEQ ID NO: 547447 - protein, 10 aa, Mycobacterium
PTTGLDPRSR

SEQ ID NO: 547448 - protein, 11 aa, Mycobacterium
PTTGLDPRSRS

SEQ ID NO: 547449 - protein, 16 aa, Mycobacterium
PTTGLGNTSSSPSSGF

SEQ ID NO: 547450 - protein, 7 aa, Mycobacterium
PTTGPVD

SEQ ID NO: 547451 - protein, 6 aa, Mycobacterium
PTTGQA

SEQ ID NO: 547452 - protein, 5 aa, Mycobacterium
PTTGR

SEQ ID NO: 547453 - protein, 10 aa, Mycobacterium
PTTGRGGKDL

SEQ ID NO: 547454 - protein, 9 aa, Mycobacterium
PTTGSVAGL

SEQ ID NO: 547455 - protein, 8 aa, Mycobacterium
PTTHNAPY

SEQ ID NO: 547456 - protein, 6 aa, Mycobacterium
PTTKAV

SEQ ID NO: 547457 - protein, 15 aa, Mycobacterium
PTTKDRQGNDVGSSY

SEQ ID NO: 547458 - protein, 15 aa, Mycobacterium
PTTKNRQGNDIGTSY

SEQ ID NO: 547459 - protein, 15 aa, Mycobacterium
PTTKNRQGNDVGSSY

SEQ ID NO: 547460 - protein, 15 aa, Mycobacterium
PTTKNRQGNDVGTSY

SEQ ID NO: 547461 - protein, 5 aa, Mycobacterium
PTTKY

SEQ ID NO: 547462 - protein, 15 aa, Mycobacterium
PTTKYESKAHDAGSA

SEQ ID NO: 547463 - protein, 24 aa, Mycobacterium
PTTKYETKAHEAGSAVTEFIWLRH

SEQ ID NO: 547464 - protein, 10 aa, Mycobacterium
PTTLDEASRD

SEQ ID NO: 547465 - protein, 9 aa, Mycobacterium
PTTMSAPKA

SEQ ID NO: 547466 - protein, 11 aa, Mycobacterium
PTTNASALTGP

SEQ ID NO: 547467 - protein, 16 aa, Mycobacterium
PTTNISAGQVDQARSF

SEQ ID NO: 547468 - protein, 6 aa, Mycobacterium
PTTNPD

SEQ ID NO: 547469 - protein, 7 aa, Mycobacterium
PTTNTED

SEQ ID NO: 547470 - protein, 5 aa, Mycobacterium
PTTPA

SEQ ID NO: 547471 - protein, 7 aa, Mycobacterium
PTTPADA

SEQ ID NO: 547472 - protein, 8 aa, Mycobacterium
PTTPADNV

SEQ ID NO: 547473 - protein, 6 aa, Mycobacterium
PTTPAG

SEQ ID NO: 547474 - protein, 7 aa, Mycobacterium
PTTPAGL

SEQ ID NO: 547475 - protein, 6 aa, Mycobacterium
PTTPDC

SEQ ID NO: 547476 - protein, 6 aa, Mycobacterium
PTTPDG

SEQ ID NO: 547477 - protein, 7 aa, Mycobacterium
PTTPDSR

SEQ ID NO: 547478 - protein, 10 aa, Mycobacterium
PTTPERAERA

SEQ ID NO: 547479 - protein, 7 aa, Mycobacterium
PTTPGSR

SEQ ID NO: 547480 - protein, 26 aa, Mycobacterium
PTTPHPNARPARDRRKIPSTSLMRCP

SEQ ID NO: 547481 - protein, 11 aa, Mycobacterium
PTTPLPPPDPH

SEQ ID NO: 547482 - protein, 16 aa, Mycobacterium
PTTPNRQGNDRGTSYR

SEQ ID NO: 547483 - protein, 7 aa, Mycobacterium
PTTPPIE

SEQ ID NO: 547484 - protein, 8 aa, Mycobacterium
PTTPRERI

SEQ ID NO: 547485 - protein, 7 aa, Mycobacterium
PTTPTLT

SEQ ID NO: 547486 - protein, 7 aa, Mycobacterium
PTTQADR

SEQ ID NO: 547487 - protein, 7 aa, Mycobacterium
PTTQDLP

SEQ ID NO: 547488 - protein, 13 aa, Mycobacterium
PTTQGEKFDPTGD

SEQ ID NO: 547489 - protein, 13 aa, Mycobacterium
PTTQGQKFDPSGD

SEQ ID NO: 547490 - protein, 7 aa, Mycobacterium
PTTQKSG

SEQ ID NO: 547491 - protein, 9 aa, Mycobacterium
PTTQPERAR

SEQ ID NO: 547492 - protein, 7 aa, Mycobacterium
PTTQSAD

SEQ ID NO: 547493 - protein, 5 aa, Mycobacterium
PTTRG

SEQ ID NO: 547494 - protein, 13 aa, Mycobacterium
PTTSGTGSEVSPA

SEQ ID NO: 547495 - protein, 11 aa, Mycobacterium
PTTSGTGSEVT

SEQ ID NO: 547496 - protein, 10 aa, Mycobacterium
PTTSPGPVTE

SEQ ID NO: 547497 - protein, 7 aa, Mycobacterium
PTTSPRA

SEQ ID NO: 547498 - protein, 9 aa, Mycobacterium
PTTSRPAGT

SEQ ID NO: 547499 - protein, 8 aa, Mycobacterium
PTTSSGKV

SEQ ID NO: 547500 - protein, 5 aa, Mycobacterium
PTTTA

SEQ ID NO: 547501 - protein, 5 aa, Mycobacterium
PTTTI

SEQ ID NO: 547502 - protein, 6 aa, Mycobacterium
PTTTIS

SEQ ID NO: 547503 - protein, 8 aa, Mycobacterium
PTTTLSDG

SEQ ID NO: 547504 - protein, 7 aa, Mycobacterium
PTTTQGA

SEQ ID NO: 547505 - protein, 5 aa, Mycobacterium
PTTTR

SEQ ID NO: 547506 - protein, 20 aa, Mycobacterium
PTTTRDGGTPVVTTEAASAA

SEQ ID NO: 547507 - protein, 10 aa, Mycobacterium
PTTTRGTEAE

SEQ ID NO: 547508 - protein, 10 aa, Mycobacterium
PTTTTLNGPI

SEQ ID NO: 547509 - protein, 7 aa, Mycobacterium
PTTVDAN

SEQ ID NO: 547510 - protein, 10 aa, Mycobacterium
PTTVGRPPLG

SEQ ID NO: 547511 - protein, 12 aa, Mycobacterium
PTTVKTTAGPVT

SEQ ID NO: 547512 - protein, 7 aa, Mycobacterium
PTVAEEA

SEQ ID NO: 547513 - protein, 21 aa, Mycobacterium
PTVAGSTPVKPTITYPPAGAP

SEQ ID NO: 547514 - protein, 22 aa, Mycobacterium
PTVAPSDPAPVGRGAGSWNTRA

SEQ ID NO: 547515 - protein, 5 aa, Mycobacterium
PTVCD

SEQ ID NO: 547516 - protein, 6 aa, Mycobacterium
PTVDPA

SEQ ID NO: 547517 - protein, 4 aa, Mycobacterium
PTVE

SEQ ID NO: 547518 - protein, 5 aa, Mycobacterium
PTVEE

SEQ ID NO: 547519 - protein, 8 aa, Mycobacterium
PTVEGTGS

SEQ ID NO: 547520 - protein, 19 aa, Mycobacterium
PTVETPSGSLADGDPGYAD

SEQ ID NO: 547521 - protein, 4 aa, Mycobacterium
PTVG

SEQ ID NO: 547522 - protein, 12 aa, Mycobacterium
PTVGGNDQPEEW

SEQ ID NO: 547523 - protein, 8 aa, Mycobacterium
PTVGGYGT

SEQ ID NO: 547524 - protein, 21 aa, Mycobacterium
PTVGNETARLGGHSVAVLRRT

SEQ ID NO: 547525 - protein, 7 aa, Mycobacterium
PTVGTGD

SEQ ID NO: 547526 - protein, 13 aa, Mycobacterium
PTVGYAGGDTIPE

SEQ ID NO: 547527 - protein, 11 aa, Mycobacterium
PTVGYDGTANV

SEQ ID NO: 547528 - protein, 13 aa, Mycobacterium
PTVHSPVDQALAL

SEQ ID NO: 547529 - protein, 4 aa, Mycobacterium
PTVK

SEQ ID NO: 547530 - protein, 17 aa, Mycobacterium
PTVLPDPRSARQPEGVH

SEQ ID NO: 547531 - protein, 17 aa, Mycobacterium
PTVLPDPRSPRQPEGVH

SEQ ID NO: 547532 - protein, 33 aa, Mycobacterium
PTVNSYKRTGATSTASGASWAPRLPSYGGNDRT

SEQ ID NO: 547533 - protein, 13 aa, Mycobacterium
PTVNSYKRTGAVA

SEQ ID NO: 547534 - protein, 4 aa, Mycobacterium
PTVP

SEQ ID NO: 547535 - protein, 8 aa, Mycobacterium
PTVPAGTS

SEQ ID NO: 547536 - protein, 12 aa, Mycobacterium
PTVPAHDEPAGP

SEQ ID NO: 547537 - protein, 5 aa, Mycobacterium
PTVPE

SEQ ID NO: 547538 - protein, 6 aa, Mycobacterium
PTVPPA

SEQ ID NO: 547539 - protein, 7 aa, Mycobacterium
PTVPPLP

SEQ ID NO: 547540 - protein, 6 aa, Mycobacterium
PTVPQG

SEQ ID NO: 547541 - protein, 6 aa, Mycobacterium
PTVPRS

SEQ ID NO: 547542 - protein, 7 aa, Mycobacterium
PTVPRSP

SEQ ID NO: 547543 - protein, 7 aa, Mycobacterium
PTVPTQH

SEQ ID NO: 547544 - protein, 11 aa, Mycobacterium
PTVQEGSEPWV

SEQ ID NO: 547545 - protein, 4 aa, Mycobacterium
PTVR

SEQ ID NO: 547546 - protein, 10 aa, Mycobacterium
PTVRGGTMNP

SEQ ID NO: 547547 - protein, 10 aa, Mycobacterium
PTVRKGDLRE

SEQ ID NO: 547548 - protein, 11 aa, Mycobacterium
PTVSARAQSHP

SEQ ID NO: 547549 - protein, 6 aa, Mycobacterium
PTVSEL

SEQ ID NO: 547550 - protein, 27 aa, Mycobacterium
PTVSGPGPRPGPRPGPRPGPRPSPRPV

SEQ ID NO: 547551 - protein, 15 aa, Mycobacterium
PTVSSPAAEQPAAGL

SEQ ID NO: 547552 - protein, 16 aa, Mycobacterium
PTVTGTATNPTNTTLT

SEQ ID NO: 547553 - protein, 19 aa, Mycobacterium
PTVTSTPSSTVTTPSLPPN

SEQ ID NO: 547554 - protein, 5 aa, Mycobacterium
PTVTT

SEQ ID NO: 547555 - protein, 7 aa, Mycobacterium
PTWANQS

SEQ ID NO: 547556 - protein, 14 aa, Mycobacterium
PTWERSGRTERGRD

SEQ ID NO: 547557 - protein, 12 aa, Mycobacterium
PTWETGPAGPFD

SEQ ID NO: 547558 - protein, 22 aa, Mycobacterium
PTWPGSSAASTAFSAANSEVDT

SEQ ID NO: 547559 - protein, 20 aa, Mycobacterium
PTWPSERRNPLGKDPHVTEP

SEQ ID NO: 547560 - protein, 9 aa, Mycobacterium
PTWRETGRA

SEQ ID NO: 547561 - protein, 4 aa, Mycobacterium
PTYD

SEQ ID NO: 547562 - protein, 13 aa, Mycobacterium
PTYEGSSDKHPDI

SEQ ID NO: 547563 - protein, 7 aa, Mycobacterium
PTYEQTP

SEQ ID NO: 547564 - protein, 8 aa, Mycobacterium
PTYGEETE

SEQ ID NO: 547565 - protein, 8 aa, Mycobacterium
PTYGPSTR

SEQ ID NO: 547566 - protein, 5 aa, Mycobacterium
PTYGT

SEQ ID NO: 547567 - protein, 7 aa, Mycobacterium
PTYKATY

SEQ ID NO: 547568 - protein, 6 aa, Mycobacterium
PTYNRG

SEQ ID NO: 547569 - protein, 5 aa, Mycobacterium
PTYPA

SEQ ID NO: 547570 - protein, 5 aa, Mycobacterium
PTYRS

SEQ ID NO: 547571 - protein, 14 aa, Mycobacterium
PTYSAYAGSKAPVE

SEQ ID NO: 547572 - protein, 12 aa, Mycobacterium
PTYSIGSQQPYV

SEQ ID NO: 547573 - protein, 5 aa, Mycobacterium
PTYSQ

SEQ ID NO: 547574 - protein, 5 aa, Mycobacterium
PVAAA

SEQ ID NO: 547575 - protein, 15 aa, Mycobacterium
PVAAESAAEATRPVA

SEQ ID NO: 547576 - protein, 5 aa, Mycobacterium
PVAAG

SEQ ID NO: 547577 - protein, 13 aa, Mycobacterium
PVAAGGDTRNQNT

SEQ ID NO: 547578 - protein, 10 aa, Mycobacterium
PVAAGGVEPP

SEQ ID NO: 547579 - protein, 9 aa, Mycobacterium
PVAAGPQHR

SEQ ID NO: 547580 - protein, 9 aa, Mycobacterium
PVAAPAAPV

SEQ ID NO: 547581 - protein, 11 aa, Mycobacterium
PVAAPSGEDQR

SEQ ID NO: 547582 - protein, 5 aa, Mycobacterium
PVAAR

SEQ ID NO: 547583 - protein, 19 aa, Mycobacterium
PVAASAPSAVAGGVSSSVA

SEQ ID NO: 547584 - protein, 6 aa, Mycobacterium
PVAASD

SEQ ID NO: 547585 - protein, 10 aa, Mycobacterium
PVAASDAALQ

SEQ ID NO: 547586 - protein, 18 aa, Mycobacterium
PVADRGGQHGTTAARSDF

SEQ ID NO: 547587 - protein, 7 aa, Mycobacterium
PVADRQD

SEQ ID NO: 547588 - protein, 10 aa, Mycobacterium
PVADSTARRA

SEQ ID NO: 547589 - protein, 5 aa, Mycobacterium
PVAEM

SEQ ID NO: 547590 - protein, 9 aa, Mycobacterium
PVAEPGGVP

SEQ ID NO: 547591 - protein, 13 aa, Mycobacterium
PVAETAGTKLATP

SEQ ID NO: 547592 - protein, 13 aa, Mycobacterium
PVAGEGEESAASI

SEQ ID NO: 547593 - protein, 10 aa, Mycobacterium
PVAGGNAGMG

SEQ ID NO: 547594 - protein, 13 aa, Mycobacterium
PVAGPADLAAGRD

SEQ ID NO: 547595 - protein, 13 aa, Mycobacterium
PVAGPAELAAGRE

SEQ ID NO: 547596 - protein, 14 aa, Mycobacterium
PVAGPAELAAGREA

SEQ ID NO: 547597 - protein, 8 aa, Mycobacterium
PVAGPARL

SEQ ID NO: 547598 - protein, 8 aa, Mycobacterium
PVAGQEEQ

SEQ ID NO: 547599 - protein, 13 aa, Mycobacterium
PVAGSAELAAGRE

SEQ ID NO: 547600 - protein, 11 aa, Mycobacterium
PVAGSDPDHPG

SEQ ID NO: 547601 - protein, 8 aa, Mycobacterium
PVAGTPES

SEQ ID NO: 547602 - protein, 8 aa, Mycobacterium
PVAHSRPS

SEQ ID NO: 547603 - protein, 5 aa, Mycobacterium
PVANE

SEQ ID NO: 547604 - protein, 13 aa, Mycobacterium
PVAPMEPSPYLPT

SEQ ID NO: 547605 - protein, 16 aa, Mycobacterium
PVAPNTPAVPSTRRDA

SEQ ID NO: 547606 - protein, 17 aa, Mycobacterium
PVAPPKPIAVPPGSEAA

SEQ ID NO: 547607 - protein, 7 aa, Mycobacterium
PVAPPSW

SEQ ID NO: 547608 - protein, 8 aa, Mycobacterium
PVAPRASV

SEQ ID NO: 547609 - protein, 7 aa, Mycobacterium
PVAPRPG

SEQ ID NO: 547610 - protein, 9 aa, Mycobacterium
PVAPSDGTR

SEQ ID NO: 547611 - protein, 9 aa, Mycobacterium
PVAPTESTN

SEQ ID NO: 547612 - protein, 5 aa, Mycobacterium
PVAQP

SEQ ID NO: 547613 - protein, 6 aa, Mycobacterium
PVARES

SEQ ID NO: 547614 - protein, 7 aa, Mycobacterium
PVARESV

SEQ ID NO: 547615 - protein, 7 aa, Mycobacterium
PVARPCS

SEQ ID NO: 547616 - protein, 12 aa, Mycobacterium
PVARPGPAPQLG

SEQ ID NO: 547617 - protein, 10 aa, Mycobacterium
PVARSAARER

SEQ ID NO: 547618 - protein, 10 aa, Mycobacterium
PVASAGSEAE

SEQ ID NO: 547619 - protein, 6 aa, Mycobacterium
PVASPA

SEQ ID NO: 547620 - protein, 4 aa, Mycobacterium
PVAT

SEQ ID NO: 547621 - protein, 9 aa, Mycobacterium
PVATAEAID

SEQ ID NO: 547622 - protein, 5 aa, Mycobacterium
PVATR

SEQ ID NO: 547623 - protein, 13 aa, Mycobacterium
PVATSVRDAGGQL

SEQ ID NO: 547624 - protein, 4 aa, Mycobacterium
PVAV

SEQ ID NO: 547625 - protein, 12 aa, Mycobacterium
PVCNPADPNTWK

SEQ ID NO: 547626 - protein, 11 aa, Mycobacterium
PVDAATGKPVS

SEQ ID NO: 547627 - protein, 8 aa, Mycobacterium
PVDAGPDY

SEQ ID NO: 547628 - protein, 9 aa, Mycobacterium
PVDAGSPGW

SEQ ID NO: 547629 - protein, 10 aa, Mycobacterium
PVDCSKARRE

SEQ ID NO: 547630 - protein, 9 aa, Mycobacterium
PVDDAGGPE

SEQ ID NO: 547631 - protein, 13 aa, Mycobacterium
PVDDASRGEEIEA

SEQ ID NO: 547632 - protein, 16 aa, Mycobacterium
PVDDDEHRRLVAAAEQ

SEQ ID NO: 547633 - protein, 7 aa, Mycobacterium
PVDDDRG

SEQ ID NO: 547634 - protein, 5 aa, Mycobacterium
PVDDP

SEQ ID NO: 547635 - protein, 7 aa, Mycobacterium
PVDDPAL

SEQ ID NO: 547636 - protein, 8 aa, Mycobacterium
PVDDPNRA

SEQ ID NO: 547637 - protein, 7 aa, Mycobacterium
PVDDPSK

SEQ ID NO: 547638 - protein, 8 aa, Mycobacterium
PVDDSTSD

SEQ ID NO: 547639 - protein, 5 aa, Mycobacterium
PVDEC

SEQ ID NO: 547640 - protein, 7 aa, Mycobacterium
PVDEPSL

SEQ ID NO: 547641 - protein, 6 aa, Mycobacterium
PVDEPV

SEQ ID NO: 547642 - protein, 8 aa, Mycobacterium
PVDERTSD

SEQ ID NO: 547643 - protein, 10 aa, Mycobacterium
PVDGADPQAV

SEQ ID NO: 547644 - protein, 8 aa, Mycobacterium
PVDGEPSH

SEQ ID NO: 547645 - protein, 5 aa, Mycobacterium
PVDGG

SEQ ID NO: 547646 - protein, 7 aa, Mycobacterium
PVDGGES

SEQ ID NO: 547647 - protein, 12 aa, Mycobacterium
PVDGGWSVTKDS

SEQ ID NO: 547648 - protein, 8 aa, Mycobacterium
PVDGNGPS

SEQ ID NO: 547649 - protein, 20 aa, Mycobacterium
PVDGNPGGANRDAQSAAAAV

SEQ ID NO: 547650 - protein, 9 aa, Mycobacterium
PVDGPDGGR

SEQ ID NO: 547651 - protein, 9 aa, Mycobacterium
PVDGPLSTA

SEQ ID NO: 547652 - protein, 7 aa, Mycobacterium
PVDGQGP

SEQ ID NO: 547653 - protein, 7 aa, Mycobacterium
PVDGRAG

SEQ ID NO: 547654 - protein, 11 aa, Mycobacterium
PVDGRPRRAGV

SEQ ID NO: 547655 - protein, 11 aa, Mycobacterium
PVDGSSGKSIR

SEQ ID NO: 547656 - protein, 10 aa, Mycobacterium
PVDGSTTGTV

SEQ ID NO: 547657 - protein, 9 aa, Mycobacterium
PVDGTGPSY

SEQ ID NO: 547658 - protein, 13 aa, Mycobacterium
PVDGYPPAYARDS

SEQ ID NO: 547659 - protein, 13 aa, Mycobacterium
PVDHPQSDTAPNA

SEQ ID NO: 547660 - protein, 7 aa, Mycobacterium
PVDKKRQ

SEQ ID NO: 547661 - protein, 30 aa, Mycobacterium
PVDPAAPITPADPVDPATPITPAAPAAPVD

SEQ ID NO: 547662 - protein, 8 aa, Mycobacterium
PVDPDPAM

SEQ ID NO: 547663 - protein, 5 aa, Mycobacterium
PVDPE

SEQ ID NO: 547664 - protein, 7 aa, Mycobacterium
PVDPGRT

SEQ ID NO: 547665 - protein, 22 aa, Mycobacterium
PVDPGTGWPGDPATPQTPVAAD

SEQ ID NO: 547666 - protein, 8 aa, Mycobacterium
PVDPNHPN

SEQ ID NO: 547667 - protein, 9 aa, Mycobacterium
PVDPNSGAH

SEQ ID NO: 547668 - protein, 5 aa, Mycobacterium
PVDPR

SEQ ID NO: 547669 - protein, 5 aa, Mycobacterium
PVDPS

SEQ ID NO: 547670 - protein, 6 aa, Mycobacterium
PVDPSH

SEQ ID NO: 547671 - protein, 7 aa, Mycobacterium
PVDPSHV

SEQ ID NO: 547672 - protein, 5 aa, Mycobacterium
PVDQP

SEQ ID NO: 547673 - protein, 4 aa, Mycobacterium
PVDR

SEQ ID NO: 547674 - protein, 6 aa, Mycobacterium
PVDRDA

SEQ ID NO: 547675 - protein, 11 aa, Mycobacterium
PVDRDDDEASL

SEQ ID NO: 547676 - protein, 5 aa, Mycobacterium
PVDRP

SEQ ID NO: 547677 - protein, 5 aa, Mycobacterium
PVDRR

SEQ ID NO: 547678 - protein, 5 aa, Mycobacterium
PVDRY

SEQ ID NO: 547679 - protein, 4 aa, Mycobacterium
PVDS

SEQ ID NO: 547680 - protein, 10 aa, Mycobacterium
PVDSAGEIHP

SEQ ID NO: 547681 - protein, 31 aa, Mycobacterium
PVDSAPSNGRKSESGGRRGRRSKKNRAEEPV

SEQ ID NO: 547682 - protein, 14 aa, Mycobacterium
PVDSKGRFDESVPD

SEQ ID NO: 547683 - protein, 10 aa, Mycobacterium
PVDSKRDSAK

SEQ ID NO: 547684 - protein, 45 aa, Mycobacterium
PVDSSSGSNGRKADSGGGGNGGGGGGGGRRSRRGKRGAKPEPEVQ

SEQ ID NO: 547685 - protein, 4 aa, Mycobacterium
PVDT

SEQ ID NO: 547686 - protein, 7 aa, Mycobacterium
PVDTAER

SEQ ID NO: 547687 - protein, 6 aa, Mycobacterium
PVDTDM

SEQ ID NO: 547688 - protein, 7 aa, Mycobacterium
PVDTEDL

SEQ ID NO: 547689 - protein, 15 aa, Mycobacterium
PVDTETAPLAPATVP

SEQ ID NO: 547690 - protein, 7 aa, Mycobacterium
PVDTPDV

SEQ ID NO: 547691 - protein, 18 aa, Mycobacterium
PVDTQSDDEARWRTAGER

SEQ ID NO: 547692 - protein, 10 aa, Mycobacterium
PVDTSLDGDQ

SEQ ID NO: 547693 - protein, 16 aa, Mycobacterium
PVDTTADPALGAERGA

SEQ ID NO: 547694 - protein, 5 aa, Mycobacterium
PVDVQ

SEQ ID NO: 547695 - protein, 5 aa, Mycobacterium
PVEAE

SEQ ID NO: 547696 - protein, 8 aa, Mycobacterium
PVEAGDQM

SEQ ID NO: 547697 - protein, 14 aa, Mycobacterium
PVEDHGYRPAPPGL

SEQ ID NO: 547698 - protein, 10 aa, Mycobacterium
PVEDPHPDVP

SEQ ID NO: 547699 - protein, 9 aa, Mycobacterium
PVEDSDGDT

SEQ ID NO: 547700 - protein, 4 aa, Mycobacterium
PVEE

SEQ ID NO: 547701 - protein, 10 aa, Mycobacterium
PVEEGGYGFD

SEQ ID NO: 547702 - protein, 9 aa, Mycobacterium
PVEEGNDNA

SEQ ID NO: 547703 - protein, 8 aa, Mycobacterium
PVEEPRRS

SEQ ID NO: 547704 - protein, 7 aa, Mycobacterium
PVEERDG

SEQ ID NO: 547705 - protein, 4 aa, Mycobacterium
PVEG

SEQ ID NO: 547706 - protein, 12 aa, Mycobacterium
PVEGAGARAPEI

SEQ ID NO: 547707 - protein, 7 aa, Mycobacterium
PVEGDSG

SEQ ID NO: 547708 - protein, 9 aa, Mycobacterium
PVEGGNANR

SEQ ID NO: 547709 - protein, 10 aa, Mycobacterium
PVELADGQSL

SEQ ID NO: 547710 - protein, 20 aa, Mycobacterium
PVEPDTGETASEPTTTDDDV

SEQ ID NO: 547711 - protein, 5 aa, Mycobacterium
PVEPG

SEQ ID NO: 547712 - protein, 9 aa, Mycobacterium
PVEPLGPDS

SEQ ID NO: 547713 - protein, 10 aa, Mycobacterium
PVEPPARPDD

SEQ ID NO: 547714 - protein, 19 aa, Mycobacterium
PVEPPTDIAPDPDTAKPWL

SEQ ID NO: 547715 - protein, 7 aa, Mycobacterium
PVEQGGE

SEQ ID NO: 547716 - protein, 5 aa, Mycobacterium
PVERA

SEQ ID NO: 547717 - protein, 10 aa, Mycobacterium
PVERSPAARS

SEQ ID NO: 547718 - protein, 7 aa, Mycobacterium
PVESADQ

SEQ ID NO: 547719 - protein, 10 aa, Mycobacterium
PVESKRDSAK

SEQ ID NO: 547720 - protein, 7 aa, Mycobacterium
PVESPSA

SEQ ID NO: 547721 - protein, 8 aa, Mycobacterium
PVESPSDT

SEQ ID NO: 547722 - protein, 8 aa, Mycobacterium
PVESTDAG

SEQ ID NO: 547723 - protein, 18 aa, Mycobacterium
PVESTGGGETSTGSVSAP

SEQ ID NO: 547724 - protein, 9 aa, Mycobacterium
PVESTPAAL

SEQ ID NO: 547725 - protein, 5 aa, Mycobacterium
PVESY

SEQ ID NO: 547726 - protein, 5 aa, Mycobacterium
PVETA

SEQ ID NO: 547727 - protein, 6 aa, Mycobacterium
PVETAT

SEQ ID NO: 547728 - protein, 7 aa, Mycobacterium
PVETGAA

SEQ ID NO: 547729 - protein, 9 aa, Mycobacterium
PVETGETTV

SEQ ID NO: 547730 - protein, 7 aa, Mycobacterium
PVETGTA

SEQ ID NO: 547731 - protein, 4 aa, Mycobacterium
PVEV

SEQ ID NO: 547732 - protein, 4 aa, Mycobacterium
PVGA

SEQ ID NO: 547733 - protein, 19 aa, Mycobacterium
PVGAAGRRRGAGAGGGGCR

SEQ ID NO: 547734 - protein, 13 aa, Mycobacterium
PVGAEDFCAAVRG

SEQ ID NO: 547735 - protein, 12 aa, Mycobacterium
PVGAGAPVPGPL

SEQ ID NO: 547736 - protein, 7 aa, Mycobacterium
PVGAGDA

SEQ ID NO: 547737 - protein, 22 aa, Mycobacterium
PVGAPRGVRRRTRPRLLRATAV

SEQ ID NO: 547738 - protein, 12 aa, Mycobacterium
PVGATESTNPVG

SEQ ID NO: 547739 - protein, 13 aa, Mycobacterium
PVGATSSVAADPA

SEQ ID NO: 547740 - protein, 4 aa, Mycobacterium
PVGD

SEQ ID NO: 547741 - protein, 7 aa, Mycobacterium
PVGDDPA

SEQ ID NO: 547742 - protein, 8 aa, Mycobacterium
PVGDKDSA

SEQ ID NO: 547743 - protein, 9 aa, Mycobacterium
PVGDPGWFG

SEQ ID NO: 547744 - protein, 14 aa, Mycobacterium
PVGDQFGEAGEGVK

SEQ ID NO: 547745 - protein, 5 aa, Mycobacterium
PVGDS

SEQ ID NO: 547746 - protein, 7 aa, Mycobacterium
PVGDTGR

SEQ ID NO: 547747 - protein, 8 aa, Mycobacterium
PVGEDQRQ

SEQ ID NO: 547748 - protein, 7 aa, Mycobacterium
PVGEERT

SEQ ID NO: 547749 - protein, 29 aa, Mycobacterium
PVGEPGTGERGDRGGVGEHEADPLGRQRR

SEQ ID NO: 547750 - protein, 7 aa, Mycobacterium
PVGEQDD

SEQ ID NO: 547751 - protein, 13 aa, Mycobacterium
PVGEQRARSEAVG

SEQ ID NO: 547752 - protein, 5 aa, Mycobacterium
PVGET

SEQ ID NO: 547753 - protein, 25 aa, Mycobacterium
PVGGDGGVRNPNLPPPSRPQDNDFD

SEQ ID NO: 547754 - protein, 35 aa, Mycobacterium; identical to SEQ ID NO: 42033

SEQ ID NO: 547755 - protein, 6 aa, Mycobacterium
PVGGEA

SEQ ID NO: 547756 - protein, 5 aa, Mycobacterium
PVGGP

SEQ ID NO: 547757 - protein, 12 aa, Mycobacterium
PVGGPPGGPAGV

SEQ ID NO: 547758 - protein, 11 aa, Mycobacterium
PVGGQGLNTGV

SEQ ID NO: 547759 - protein, 14 aa, Mycobacterium
PVGGSTAPAVLGND

SEQ ID NO: 547760 - protein, 5 aa, Mycobacterium
PVGGT

SEQ ID NO: 547761 - protein, 12 aa, Mycobacterium
PVGGTAEIAPDP

SEQ ID NO: 547762 - protein, 12 aa, Mycobacterium
PVGGTAEIASDP

SEQ ID NO: 547763 - protein, 10 aa, Mycobacterium
PVGGTDRGDT

SEQ ID NO: 547764 - protein, 13 aa, Mycobacterium
PVGGTKPTTDPQV

SEQ ID NO: 547765 - protein, 7 aa, Mycobacterium
PVGHPNP

SEQ ID NO: 547766 - protein, 10 aa, Mycobacterium
PVGLPAPEAL

SEQ ID NO: 547767 - protein, 10 aa, Mycobacterium
PVGNEGAGTV

SEQ ID NO: 547768 - protein, 6 aa, Mycobacterium
PVGNPP

SEQ ID NO: 547769 - protein, 4 aa, Mycobacterium
PVGP

SEQ ID NO: 547770 - protein, 5 aa, Mycobacterium
PVGPD

SEQ ID NO: 547771 - protein, 19 aa, Mycobacterium
PVGPDGRPSEPLEGQFFGA

SEQ ID NO: 547772 - protein, 7 aa, Mycobacterium
PVGPESY

SEQ ID NO: 547773 - protein, 17 aa, Mycobacterium
PVGPGRPVTATPSPRSD

SEQ ID NO: 547774 - protein, 8 aa, Mycobacterium
PVGPGRQE

SEQ ID NO: 547775 - protein, 19 aa, Mycobacterium
PVGPGTNTRFLPSNNNRYC

SEQ ID NO: 547776 - protein, 8 aa, Mycobacterium
PVGPLRPQ

SEQ ID NO: 547777 - protein, 9 aa, Mycobacterium
PVGPPADGC

SEQ ID NO: 547778 - protein, 7 aa, Mycobacterium
PVGPPDS

SEQ ID NO: 547779 - protein, 27 aa, Mycobacterium
PVGPPPGVEPKPLKGMPPFSGPQGPFA

SEQ ID NO: 547780 - protein, 8 aa, Mycobacterium
PVGPRSVY

SEQ ID NO: 547781 - protein, 48 aa, Mycobacterium
PVGPSPSSPAPATPAPKSPAPRMAPTPAPTRPSPTSPAPRQPPPSPML

SEQ ID NO: 547782 - protein, 6 aa, Mycobacterium
PVGPSR

SEQ ID NO: 547783 - protein, 20 aa, Mycobacterium
PVGPTRRTTAPRKRGDDTRA

SEQ ID NO: 547784 - protein, 8 aa, Mycobacterium
PVGPVTGP

SEQ ID NO: 547785 - protein, 7 aa, Mycobacterium
PVGQDRH

SEQ ID NO: 547786 - protein, 12 aa, Mycobacterium
PVGQRSTGGGEQ

SEQ ID NO: 547787 - protein, 5 aa, Mycobacterium
PVGRA

SEQ ID NO: 547788 - protein, 19 aa, Mycobacterium
PVGRHRRRAAARPAGPPIR

SEQ ID NO: 547789 - protein, 15 aa, Mycobacterium
PVGRPIGGKARFGKP

SEQ ID NO: 547790 - protein, 15 aa, Mycobacterium
PVGRSDAEGTGASEG

SEQ ID NO: 547791 - protein, 15 aa, Mycobacterium
PVGRSSKGVKGESEG

SEQ ID NO: 547792 - protein, 15 aa, Mycobacterium
PVGRSSKKSKGTSEG

SEQ ID NO: 547793 - protein, 13 aa, Mycobacterium
PVGRSTKDGRALS

SEQ ID NO: 547794 - protein, 12 aa, Mycobacterium
PVGRSTPDGRAL

SEQ ID NO: 547795 - protein, 16 aa, Mycobacterium
PVGRSTTDSPAQSEGI

SEQ ID NO: 547796 - protein, 11 aa, Mycobacterium
PVGSASTPLSE

SEQ ID NO: 547797 - protein, 6 aa, Mycobacterium
PVGSAV

SEQ ID NO: 547798 - protein, 5 aa, Mycobacterium
PVGSE

SEQ ID NO: 547799 - protein, 12 aa, Mycobacterium
PVGSGGGEQAKR

SEQ ID NO: 547800 - protein, 8 aa, Mycobacterium
PVGSGKTR

SEQ ID NO: 547801 - protein, 12 aa, Mycobacterium
PVGSPGAMTAEA

SEQ ID NO: 547802 - protein, 8 aa, Mycobacterium
PVGSPGTT

SEQ ID NO: 547803 - protein, 10 aa, Mycobacterium
PVGSSDSAAE

SEQ ID NO: 547804 - protein, 5 aa, Mycobacterium
PVGTA

SEQ ID NO: 547805 - protein, 8 aa, Mycobacterium
PVGTADPV

SEQ ID NO: 547806 - protein, 7 aa, Mycobacterium
PVGTAPG

SEQ ID NO: 547807 - protein, 13 aa, Mycobacterium
PVGTGGGMGAGGP

SEQ ID NO: 547808 - protein, 6 aa, Mycobacterium
PVGTGP

SEQ ID NO: 547809 - protein, 9 aa, Mycobacterium
PVGTPRRAE

SEQ ID NO: 547810 - protein, 7 aa, Mycobacterium
PVGTVDP

SEQ ID NO: 547811 - protein, 12 aa, Mycobacterium
PVHAGDPDDPAP

SEQ ID NO: 547812 - protein, 10 aa, Mycobacterium
PVHGSGGTVT

SEQ ID NO: 547813 - protein, 7 aa, Mycobacterium
PVHPGAD

SEQ ID NO: 547814 - protein, 6 aa, Mycobacterium
PVHPQR

SEQ ID NO: 547815 - protein, 16 aa, Mycobacterium
PVHPTGLTSPIRADPG

SEQ ID NO: 547816 - protein, 26 aa, Mycobacterium
PVHQPTKLTRKPVSEIATRERFDGAP

SEQ ID NO: 547817 - protein, 9 aa, Mycobacterium
PVHSDGPHY

SEQ ID NO: 547818 - protein, 5 aa, Mycobacterium
PVHTG

SEQ ID NO: 547819 - protein, 16 aa, Mycobacterium
PVHTTHPANSQNRDDV

SEQ ID NO: 547820 - protein, 6 aa, Mycobacterium
PVIGAE

SEQ ID NO: 547821 - protein, 28 aa, Mycobacterium
PVIPGRPATERDAAPTEGPIGGRGRNAH

SEQ ID NO: 547822 - protein, 6 aa, Mycobacterium
PVISDG

SEQ ID NO: 547823 - protein, 5 aa, Mycobacterium
PVKAS

SEQ ID NO: 547824 - protein, 4 aa, Mycobacterium
PVKG

SEQ ID NO: 547825 - protein, 13 aa, Mycobacterium
PVKGAQEADSDAY

SEQ ID NO: 547826 - protein, 14 aa, Mycobacterium
PVKGAQEADSDAYR

SEQ ID NO: 547827 - protein, 12 aa, Mycobacterium
PVKGKLKDGTFN

SEQ ID NO: 547828 - protein, 4 aa, Mycobacterium
PVKP

SEQ ID NO: 547829 - protein, 12 aa, Mycobacterium
PVKPGSMGRPLP

SEQ ID NO: 547830 - protein, 13 aa, Mycobacterium
PVKPQDDAPAPPL

SEQ ID NO: 547831 - protein, 13 aa, Mycobacterium
PVKPQENAPAPPL

SEQ ID NO: 547832 - protein, 9 aa, Mycobacterium
PVKPSPPFI

SEQ ID NO: 547833 - protein, 5 aa, Mycobacterium
PVKPT

SEQ ID NO: 547834 - protein, 28 aa, Mycobacterium
PVKPTAAAAPPQEQPAPQEQPVHTRRGK

SEQ ID NO: 547835 - protein, 13 aa, Mycobacterium
PVKQEDNAPAPPL

SEQ ID NO: 547836 - protein, 5 aa, Mycobacterium
PVKQT

SEQ ID NO: 547837 - protein, 4 aa, Mycobacterium
PVKR

SEQ ID NO: 547838 - protein, 8 aa, Mycobacterium
PVKRPTAE

SEQ ID NO: 547839 - protein, 13 aa, Mycobacterium
PVKTASVRNDRGW

SEQ ID NO: 547840 - protein, 9 aa, Mycobacterium
PVKTGGAQH

SEQ ID NO: 547841 - protein, 14 aa, Mycobacterium
PVKTGMAGGARGFG

SEQ ID NO: 547842 - protein, 7 aa, Mycobacterium
PVLDGGG

SEQ ID NO: 547843 - protein, 12 aa, Mycobacterium
PVLGGDARSGRW

SEQ ID NO: 547844 - protein, 8 aa, Mycobacterium
PVLGGEGS

SEQ ID NO: 547845 - protein, 9 aa, Mycobacterium
PVLPGTEGL

SEQ ID NO: 547846 - protein, 5 aa, Mycobacterium
PVMTT

SEQ ID NO: 547847 - protein, 5 aa, Mycobacterium
PVNAD

SEQ ID NO: 547848 - protein, 16 aa, Mycobacterium
PVNASGGVLSSNPIGA

SEQ ID NO: 547849 - protein, 5 aa, Mycobacterium
PVNDL

SEQ ID NO: 547850 - protein, 11 aa, Mycobacterium
PVNDLSRGATV

SEQ ID NO: 547851 - protein, 6 aa, Mycobacterium
PVNEPT

SEQ ID NO: 547852 - protein, 7 aa, Mycobacterium
PVNGAGP

SEQ ID NO: 547853 - protein, 19 aa, Mycobacterium
PVNGAPDGDLRLLELVAEP

SEQ ID NO: 547854 - protein, 8 aa, Mycobacterium
PVNGPARL

SEQ ID NO: 547855 - protein, 8 aa, Mycobacterium
PVNGPERI

SEQ ID NO: 547856 - protein, 24 aa, Mycobacterium
PVNGRGGGKADLAQGSGKGAAGID

SEQ ID NO: 547857 - protein, 7 aa, Mycobacterium
PVNNGQT

SEQ ID NO: 547858 - protein, 12 aa, Mycobacterium
PVNPPATPEDGY

SEQ ID NO: 547859 - protein, 12 aa, Mycobacterium
PVNPPGTPEDGY

SEQ ID NO: 547860 - protein, 10 aa, Mycobacterium
PVNPPTPHST

SEQ ID NO: 547861 - protein, 9 aa, Mycobacterium
PVNPSGGLI

SEQ ID NO: 547862 - protein, 8 aa, Mycobacterium
PVNPSGGV

SEQ ID NO: 547863 - protein, 9 aa, Mycobacterium
PVNRERAEA

SEQ ID NO: 547864 - protein, 6 aa, Mycobacterium
PVNRRA

SEQ ID NO: 547865 - protein, 18 aa, Mycobacterium
PVNSPKVEVNSYSKDGAM

SEQ ID NO: 547866 - protein, 11 aa, Mycobacterium
PVNSQAPKVRP

SEQ ID NO: 547867 - protein, 19 aa, Mycobacterium
PVNSSPSDAERAATANNVG

SEQ ID NO: 547868 - protein, 18 aa, Mycobacterium
PVNSVGSSPASAKRRHSA

SEQ ID NO: 547869 - protein, 5 aa, Mycobacterium
PVPAA

SEQ ID NO: 547870 - protein, 12 aa, Mycobacterium
PVPAAAAPTAYD

SEQ ID NO: 547871 - protein, 22 aa, Mycobacterium
PVPAAHPQHTPLRPGTGQAASL

SEQ ID NO: 547872 - protein, 12 aa, Mycobacterium
PVPAAKASKPVH

SEQ ID NO: 547873 - protein, 5 aa, Mycobacterium
PVPAD

SEQ ID NO: 547874 - protein, 6 aa, Mycobacterium
PVPADP

SEQ ID NO: 547875 - protein, 15 aa, Mycobacterium
PVPADSSTSRDTYGN

SEQ ID NO: 547876 - protein, 5 aa, Mycobacterium
PVPAE

SEQ ID NO: 547877 - protein, 6 aa, Mycobacterium
PVPAGA

SEQ ID NO: 547878 - protein, 5 aa, Mycobacterium
PVPAN

SEQ ID NO: 547879 - protein, 7 aa, Mycobacterium
PVPAPDM

SEQ ID NO: 547880 - protein, 10 aa, Mycobacterium
PVPAPPPVGR

SEQ ID NO: 547881 - protein, 6 aa, Mycobacterium
PVPAPT

SEQ ID NO: 547882 - protein, 21 aa, Mycobacterium
PVPAQKTSQPAATNNRPARRV

SEQ ID NO: 547883 - protein, 5 aa, Mycobacterium
PVPAS

SEQ ID NO: 547884 - protein, 9 aa, Mycobacterium
PVPASRRDH

SEQ ID NO: 547885 - protein, 6 aa, Mycobacterium
PVPATE

SEQ ID NO: 547886 - protein, 8 aa, Mycobacterium
PVPATEAA

SEQ ID NO: 547887 - protein, 14 aa, Mycobacterium
PVPATRRDNWRRTS

SEQ ID NO: 547888 - protein, 9 aa, Mycobacterium
PVPATVETK

SEQ ID NO: 547889 - protein, 4 aa, Mycobacterium
PVPD

SEQ ID NO: 547890 - protein, 5 aa, Mycobacterium
PVPDA

SEQ ID NO: 547891 - protein, 8 aa, Mycobacterium
PVPDAPSE

SEQ ID NO: 547892 - protein, 9 aa, Mycobacterium
PVPDATARV

SEQ ID NO: 547893 - protein, 9 aa, Mycobacterium
PVPDDENPD

SEQ ID NO: 547894 - protein, 8 aa, Mycobacterium
PVPDDSPN

SEQ ID NO: 547895 - protein, 17 aa, Mycobacterium
PVPDNQSVAGQPHTGAT

SEQ ID NO: 547896 - protein, 15 aa, Mycobacterium
PVPDPAEDNAYFPSP

SEQ ID NO: 547897 - protein, 11 aa, Mycobacterium
PVPDPDDDDPL

SEQ ID NO: 547898 - protein, 17 aa, Mycobacterium
PVPDPEDLPDAQEQDSF

SEQ ID NO: 547899 - protein, 6 aa, Mycobacterium
PVPDRV

SEQ ID NO: 547900 - protein, 15 aa, Mycobacterium
PVPDSDAGARSWPDS

SEQ ID NO: 547901 - protein, 9 aa, Mycobacterium
PVPDSSDWQ

SEQ ID NO: 547902 - protein, 9 aa, Mycobacterium
PVPDSSDWT

SEQ ID NO: 547903 - protein, 9 aa, Mycobacterium
PVPDTGTLR

SEQ ID NO: 547904 - protein, 9 aa, Mycobacterium
PVPDTIEEG

SEQ ID NO: 547905 - protein, 6 aa, Mycobacterium
PVPEAL

SEQ ID NO: 547906 - protein, 8 aa, Mycobacterium
PVPEHGTS

SEQ ID NO: 547907 - protein, 27 aa, Mycobacterium
PVPEPEPAPKAAPAAAASAASNEEQAM

SEQ ID NO: 547908 - protein, 8 aa, Mycobacterium
PVPEPGHG

SEQ ID NO: 547909 - protein, 12 aa, Mycobacterium
PVPEPHPPTPLA

SEQ ID NO: 547910 - protein, 11 aa, Mycobacterium
PVPEPTEDGRI

SEQ ID NO: 547911 - protein, 5 aa, Mycobacterium
PVPEQ

SEQ ID NO: 547912 - protein, 5 aa, Mycobacterium
PVPER

SEQ ID NO: 547913 - protein, 7 aa, Mycobacterium
PVPERGD

SEQ ID NO: 547914 - protein, 7 aa, Mycobacterium
PVPERGE

SEQ ID NO: 547915 - protein, 5 aa, Mycobacterium
PVPET

SEQ ID NO: 547916 - protein, 16 aa, Mycobacterium
PVPGAAGASAESADAD

SEQ ID NO: 547917 - protein, 7 aa, Mycobacterium
PVPGADR

SEQ ID NO: 547918 - protein, 12 aa, Mycobacterium
PVPGAESPEQEL

SEQ ID NO: 547919 - protein, 8 aa, Mycobacterium
PVPGAPYG

SEQ ID NO: 547920 - protein, 6 aa, Mycobacterium
PVPGDA

SEQ ID NO: 547921 - protein, 10 aa, Mycobacterium
PVPGDAPEPF

SEQ ID NO: 547922 - protein, 7 aa, Mycobacterium
PVPGDHP

SEQ ID NO: 547923 - protein, 16 aa, Mycobacterium
PVPGDVRGLPAGTQFQ

SEQ ID NO: 547924 - protein, 7 aa, Mycobacterium
PVPGELG

SEQ ID NO: 547925 - protein, 10 aa, Mycobacterium
PVPGFKGSRS

SEQ ID NO: 547926 - protein, 6 aa, Mycobacterium
PVPGFR

SEQ ID NO: 547927 - protein, 8 aa, Mycobacterium
PVPGGDAE

SEQ ID NO: 547928 - protein, 8 aa, Mycobacterium
PVPGGEWA

SEQ ID NO: 547929 - protein, 8 aa, Mycobacterium
PVPGGFTS

SEQ ID NO: 547930 - protein, 7 aa, Mycobacterium
PVPGKGG

SEQ ID NO: 547931 - protein, 7 aa, Mycobacterium
PVPGNRK

SEQ ID NO: 547932 - protein, 14 aa, Mycobacterium
PVPGPADDKYTQGV

SEQ ID NO: 547933 - protein, 6 aa, Mycobacterium
PVPGPE

SEQ ID NO: 547934 - protein, 17 aa, Mycobacterium
PVPGPVPTSPANRDYAP

SEQ ID NO: 547935 - protein, 5 aa, Mycobacterium
PVPGQ

SEQ ID NO: 547936 - protein, 5 aa, Mycobacterium
PVPGR

SEQ ID NO: 547937 - protein, 6 aa, Mycobacterium
PVPGRP

SEQ ID NO: 547938 - protein, 5 aa, Mycobacterium
PVPGS

SEQ ID NO: 547939 - protein, 9 aa, Mycobacterium
PVPGSTERL

SEQ ID NO: 547940 - protein, 9 aa, Mycobacterium
PVPGTEDKG

SEQ ID NO: 547941 - protein, 6 aa, Mycobacterium
PVPGTG

SEQ ID NO: 547942 - protein, 9 aa, Mycobacterium
PVPGYHAPA

SEQ ID NO: 547943 - protein, 12 aa, Mycobacterium
PVPGYHAPPERT

SEQ ID NO: 547944 - protein, 14 aa, Mycobacterium
PVPGYHAPPERTVG

SEQ ID NO: 547945 - protein, 17 aa, Mycobacterium
PVPGYHAPRDRTVTPGT

SEQ ID NO: 547946 - protein, 9 aa, Mycobacterium
PVPGYRGPR

SEQ ID NO: 547947 - protein, 8 aa, Mycobacterium
PVPGYRGS

SEQ ID NO: 547948 - protein, 7 aa, Mycobacterium
PVPHDPG

SEQ ID NO: 547949 - protein, 7 aa, Mycobacterium
PVPHGAA

SEQ ID NO: 547950 - protein, 11 aa, Mycobacterium
PVPHSSGSKTV

SEQ ID NO: 547951 - protein, 4 aa, Mycobacterium
PVPK

SEQ ID NO: 547952 - protein, 13 aa, Mycobacterium
PVPKDGMPIVLRP

SEQ ID NO: 547953 - protein, 9 aa, Mycobacterium
PVPKRGEIS

SEQ ID NO: 547954 - protein, 13 aa, Mycobacterium
PVPNADAPLEPGQ

SEQ ID NO: 547955 - protein, 13 aa, Mycobacterium
PVPNAGAPLGPGQ

SEQ ID NO: 547956 - protein, 8 aa, Mycobacterium
PVPNSENK

SEQ ID NO: 547957 - protein, 4 aa, Mycobacterium
PVPP

SEQ ID NO: 547958 - protein, 9 aa, Mycobacterium
PVPPEQEAL

SEQ ID NO: 547959 - protein, 61 aa, Mycobacterium
PVPPFAPAPPVPNSPAAPPLPPVPPFPPNNPAPPAPPLPPAPASPYISPPTPPLPPFPPVP

SEQ ID NO: 547960 - protein, 12 aa, Mycobacterium
PVPPGEAARYNP

SEQ ID NO: 547961 - protein, 12 aa, Mycobacterium
PVPPGEPARYNP

SEQ ID NO: 547962 - protein, 12 aa, Mycobacterium
PVPPGGPARYNP

SEQ ID NO: 547963 - protein, 11 aa, Mycobacterium
PVPPGRPGVAG

SEQ ID NO: 547964 - protein, 7 aa, Mycobacterium
PVPPGVP

SEQ ID NO: 547965 - protein, 7 aa, Mycobacterium
PVPPIST

SEQ ID NO: 547966 - protein, 6 aa, Mycobacterium
PVPPNW

SEQ ID NO: 547967 - protein, 8 aa, Mycobacterium
PVPPPCAQ

SEQ ID NO: 547968 - protein, 12 aa, Mycobacterium
PVPPPEVRARFL

SEQ ID NO: 547969 - protein, 9 aa, Mycobacterium
PVPPPRPEL

SEQ ID NO: 547970 - protein, 12 aa, Mycobacterium
PVPPTDPKPVAL

SEQ ID NO: 547971 - protein, 23 aa, Mycobacterium
PVPPTTPLDTDATNNPPPGSGPF

SEQ ID NO: 547972 - protein, 7 aa, Mycobacterium
PVPPVGS

SEQ ID NO: 547973 - protein, 37 aa, Mycobacterium
PVPPVPPAPPLPPLPKSTPPLPPAPPAPPLPPSSPVA

SEQ ID NO: 547974 - protein, 12 aa, Mycobacterium
PVPQDPYGLAGS

SEQ ID NO: 547975 - protein, 14 aa, Mycobacterium
PVPQQNPDIPAGPM

SEQ ID NO: 547976 - protein, 5 aa, Mycobacterium
PVPQR

SEQ ID NO: 547977 - protein, 14 aa, Mycobacterium
PVPQTNGPNCGEGW

SEQ ID NO: 547978 - protein, 4 aa, Mycobacterium
PVPR

SEQ ID NO: 547979 - protein, 11 aa, Mycobacterium
PVPRDSGRISG

SEQ ID NO: 547980 - protein, 15 aa, Mycobacterium
PVPREDGTSRSPALP

SEQ ID NO: 547981 - protein, 14 aa, Mycobacterium
PVPRERAGGRRPAV

SEQ ID NO: 547982 - protein, 13 aa, Mycobacterium
PVPRNLPAQAAEA

SEQ ID NO: 547983 - protein, 7 aa, Mycobacterium
PVPSDNP

SEQ ID NO: 547984 - protein, 8 aa, Mycobacterium
PVPSGPSL

SEQ ID NO: 547985 - protein, 12 aa, Mycobacterium
PVPSGPTRRAPL

SEQ ID NO: 547986 - protein, 6 aa, Mycobacterium
PVPTDP

SEQ ID NO: 547987 - protein, 19 aa, Mycobacterium
PVPTDSPLGGGVAQPPLDE

SEQ ID NO: 547988 - protein, 7 aa, Mycobacterium
PVPTEGT

SEQ ID NO: 547989 - protein, 9 aa, Mycobacterium
PVPTGRKIP

SEQ ID NO: 547990 - protein, 8 aa, Mycobacterium
PVPTGRKV

SEQ ID NO: 547991 - protein, 7 aa, Mycobacterium
PVPTRTS

SEQ ID NO: 547992 - protein, 5 aa, Mycobacterium
PVPTT

SEQ ID NO: 547993 - protein, 22 aa, Mycobacterium
PVPVAPENGLESELGNERRLGP

SEQ ID NO: 547994 - protein, 5 aa, Mycobacterium
PVPVG

SEQ ID NO: 547995 - protein, 13 aa, Mycobacterium
PVPVGADGSLPAD

SEQ ID NO: 547996 - protein, 6 aa, Mycobacterium
PVPVPA

SEQ ID NO: 547997 - protein, 7 aa, Mycobacterium
PVPVPAA

SEQ ID NO: 547998 - protein, 7 aa, Mycobacterium
PVPVPSG

SEQ ID NO: 547999 - protein, 10 aa, Mycobacterium
PVPVTSDQHE

SEQ ID NO: 548000 - protein, 8 aa, Mycobacterium
PVQASGAK

SEQ ID NO: 548001 - protein, 8 aa, Mycobacterium
PVQGEDSA

SEQ ID NO: 548002 - protein, 7 aa, Mycobacterium
PVQGPRA

SEQ ID NO: 548003 - protein, 8 aa, Mycobacterium
PVQGRGGK

SEQ ID NO: 548004 - protein, 10 aa, Mycobacterium
PVQGSLPSGW

SEQ ID NO: 548005 - protein, 5 aa, Mycobacterium
PVQKP

SEQ ID NO: 548006 - protein, 7 aa, Mycobacterium
PVQKPYP

SEQ ID NO: 548007 - protein, 4 aa, Mycobacterium
PVQP

SEQ ID NO: 548008 - protein, 8 aa, Mycobacterium
PVQPGGPP

SEQ ID NO: 548009 - protein, 8 aa, Mycobacterium
PVQPPREG

SEQ ID NO: 548010 - protein, 7 aa, Mycobacterium
PVQPRQT

SEQ ID NO: 548011 - protein, 13 aa, Mycobacterium
PVQPTKPPKANEV

SEQ ID NO: 548012 - protein, 4 aa, Mycobacterium
PVQQ

SEQ ID NO: 548013 - protein, 7 aa, Mycobacterium
PVQQPYP

SEQ ID NO: 548014 - protein, 20 aa, Mycobacterium
PVQREDDYTYAQSPDEVASA

SEQ ID NO: 548015 - protein, 7 aa, Mycobacterium
PVQRTGA

SEQ ID NO: 548016 - protein, 5 aa, Mycobacterium
PVQSG

SEQ ID NO: 548017 - protein, 6 aa, Mycobacterium
PVQSTQ

SEQ ID NO: 548018 - protein, 10 aa, Mycobacterium
PVQTERDDDT

SEQ ID NO: 548019 - protein, 8 aa, Mycobacterium
PVQTPSAQ

SEQ ID NO: 548020 - protein, 7 aa, Mycobacterium
PVQTRSE

SEQ ID NO: 548021 - protein, 13 aa, Mycobacterium
PVRAEKASERSVD

SEQ ID NO: 548022 - protein, 10 aa, Mycobacterium
PVRANDDPLR

SEQ ID NO: 548023 - protein, 10 aa, Mycobacterium
PVRANRSARG

SEQ ID NO: 548024 - protein, 5 aa, Mycobacterium
PVRAR

SEQ ID NO: 548025 - protein, 7 aa, Mycobacterium
PVRATSD

SEQ ID NO: 548026 - protein, 5 aa, Mycobacterium
PVRDG

SEQ ID NO: 548027 - protein, 13 aa, Mycobacterium
PVRDHPGARVASS

SEQ ID NO: 548028 - protein, 12 aa, Mycobacterium
PVRDTPQPEPAT

SEQ ID NO: 548029 - protein, 4 aa, Mycobacterium
PVRE

SEQ ID NO: 548030 - protein, 7 aa, Mycobacterium
PVREDAR

SEQ ID NO: 548031 - protein, 4 aa, Mycobacterium
PVRG

SEQ ID NO: 548032 - protein, 8 aa, Mycobacterium
PVRGDKRS

SEQ ID NO: 548033 - protein, 8 aa, Mycobacterium
PVRGDTQR

SEQ ID NO: 548034 - protein, 5 aa, Mycobacterium
PVRGG

SEQ ID NO: 548035 - protein, 6 aa, Mycobacterium
PVRGGV

SEQ ID NO: 548036 - protein, 6 aa, Mycobacterium
PVRGPR

SEQ ID NO: 548037 - protein, 10 aa, Mycobacterium
PVRGRDAQGH

SEQ ID NO: 548038 - protein, 5 aa, Mycobacterium
PVRGS

SEQ ID NO: 548039 - protein, 6 aa, Mycobacterium
PVRGSA

SEQ ID NO: 548040 - protein, 11 aa, Mycobacterium
PVRGSTSGEVF

SEQ ID NO: 548041 - protein, 7 aa, Mycobacterium
PVRHEGK

SEQ ID NO: 548042 - protein, 19 aa, Mycobacterium
PVRHPGDAAPELGYRPSAE

SEQ ID NO: 548043 - protein, 8 aa, Mycobacterium
PVRKQTAA

SEQ ID NO: 548044 - protein, 31 aa, Mycobacterium
PVRNGKAPAKAPAKSTGKTLAKARTRKVVTP

SEQ ID NO: 548045 - protein, 14 aa, Mycobacterium
PVRNREAPAVRLHL

SEQ ID NO: 548046 - protein, 6 aa, Mycobacterium
PVRPAN

SEQ ID NO: 548047 - protein, 6 aa, Mycobacterium
PVRPGD

SEQ ID NO: 548048 - protein, 32 aa, Mycobacterium
PVRPRKEQTPPKEPVPPRSAPPVPKPEAVPEP

SEQ ID NO: 548049 - protein, 12 aa, Mycobacterium
PVRPYGAANAAK

SEQ ID NO: 548050 - protein, 22 aa, Mycobacterium
PVRQPEPNGRRRGHLRVLPDPT

SEQ ID NO: 548051 - protein, 8 aa, Mycobacterium
PVRQPTKL

SEQ ID NO: 548052 - protein, 11 aa, Mycobacterium
PVRRPGEPRLP

SEQ ID NO: 548053 - protein, 9 aa, Mycobacterium
PVRSERGSL

SEQ ID NO: 548054 - protein, 7 aa, Mycobacterium
PVRSGAD

SEQ ID NO: 548055 - protein, 16 aa, Mycobacterium
PVRSSGMTPYVTRLIE

SEQ ID NO: 548056 - protein, 9 aa, Mycobacterium
PVRSTDGRY

SEQ ID NO: 548057 - protein, 5 aa, Mycobacterium
PVRTA

SEQ ID NO: 548058 - protein, 13 aa, Mycobacterium
PVRTDPDQITGPA

SEQ ID NO: 548059 - protein, 5 aa, Mycobacterium
PVRTP

SEQ ID NO: 548060 - protein, 16 aa, Mycobacterium
PVRTSGMTPYVTRLIE

SEQ ID NO: 548061 - protein, 12 aa, Mycobacterium
PVRTTDDELVSA

SEQ ID NO: 548062 - protein, 4 aa, Mycobacterium
PVRV

SEQ ID NO: 548063 - protein, 10 aa, Mycobacterium
PVRVDDDGPL

SEQ ID NO: 548064 - protein, 5 aa, Mycobacterium
PVSAE

SEQ ID NO: 548065 - protein, 12 aa, Mycobacterium
PVSAEPVSQTQQ

SEQ ID NO: 548066 - protein, 13 aa, Mycobacterium
PVSAGTAAEAELS

SEQ ID NO: 548067 - protein, 8 aa, Mycobacterium
PVSAPTAR

SEQ ID NO: 548068 - protein, 5 aa, Mycobacterium
PVSAS

SEQ ID NO: 548069 - protein, 10 aa, Mycobacterium
PVSATECTNP

SEQ ID NO: 548070 - protein, 7 aa, Mycobacterium
PVSDPND

SEQ ID NO: 548071 - protein, 7 aa, Mycobacterium
PVSDSAP

SEQ ID NO: 548072 - protein, 5 aa, Mycobacterium
PVSDT

SEQ ID NO: 548073 - protein, 4 aa, Mycobacterium
PVSE

SEQ ID NO: 548074 - protein, 13 aa, Mycobacterium
PVSEGADATTALR

SEQ ID NO: 548075 - protein, 10 aa, Mycobacterium
PVSELRSGGL

SEQ ID NO: 548076 - protein, 8 aa, Mycobacterium
PVSETRAN

SEQ ID NO: 548077 - protein, 4 aa, Mycobacterium
PVSG

SEQ ID NO: 548078 - protein, 8 aa, Mycobacterium
PVSGEAGV

SEQ ID NO: 548079 - protein, 13 aa, Mycobacterium
PVSGGAGAAAEGK

SEQ ID NO: 548080 - protein, 13 aa, Mycobacterium
PVSGGAGAADKGE

SEQ ID NO: 548081 - protein, 13 aa, Mycobacterium
PVSGGAGAAEKGE

SEQ ID NO: 548082 - protein, 13 aa, Mycobacterium
PVSGGAPGAHKGE

SEQ ID NO: 548083 - protein, 8 aa, Mycobacterium
PVSGGEPL

SEQ ID NO: 548084 - protein, 12 aa, Mycobacterium
PVSGGGGAAAEG

SEQ ID NO: 548085 - protein, 12 aa, Mycobacterium
PVSGGGGAASEG

SEQ ID NO: 548086 - protein, 11 aa, Mycobacterium
PVSGGGPAVEQ

SEQ ID NO: 548087 - protein, 7 aa, Mycobacterium
PVSGHGA

SEQ ID NO: 548088 - protein, 19 aa, Mycobacterium
PVSGKVSAVNTDLEGSPQL

SEQ ID NO: 548089 - protein, 13 aa, Mycobacterium
PVSGPAPGFAEQT

SEQ ID NO: 548090 - protein, 26 aa, Mycobacterium
PVSGPGISGPGQPTAVSPAPGSPAPR

SEQ ID NO: 548091 - protein, 10 aa, Mycobacterium
PVSGPPEEVA

SEQ ID NO: 548092 - protein, 9 aa, Mycobacterium
PVSGSARTA

SEQ ID NO: 548093 - protein, 10 aa, Mycobacterium
PVSGSARTAE

SEQ ID NO: 548094 - protein, 9 aa, Mycobacterium
PVSGSGASI

SEQ ID NO: 548095 - protein, 12 aa, Mycobacterium
PVSGSRGPAEAG

SEQ ID NO: 548096 - protein, 11 aa, Mycobacterium
PVSGTPDDVAR

SEQ ID NO: 548097 - protein, 9 aa, Mycobacterium
PVSGTPGAR

SEQ ID NO: 548098 - protein, 12 aa, Mycobacterium
PVSISTPDPGQR

SEQ ID NO: 548099 - protein, 26 aa, Mycobacterium
PVSKGAGATLTGPMGDPSRSHGPRGL

SEQ ID NO: 548100 - protein, 8 aa, Mycobacterium
PVSKSDYD

SEQ ID NO: 548101 - protein, 4 aa, Mycobacterium
PVSP

SEQ ID NO: 548102 - protein, 8 aa, Mycobacterium
PVSPADTM

SEQ ID NO: 548103 - protein, 6 aa, Mycobacterium
PVSPAP

SEQ ID NO: 548104 - protein, 18 aa, Mycobacterium
PVSPATEEPADVDAARRV

SEQ ID NO: 548105 - protein, 9 aa, Mycobacterium
PVSPGDPNV

SEQ ID NO: 548106 - protein, 9 aa, Mycobacterium
PVSPGDSQV

SEQ ID NO: 548107 - protein, 11 aa, Mycobacterium
PVSPGLAPKTV

SEQ ID NO: 548108 - protein, 7 aa, Mycobacterium
PVSPKPR

SEQ ID NO: 548109 - protein, 12 aa, Mycobacterium
PVSPPATPEDGY

SEQ ID NO: 548110 - protein, 12 aa, Mycobacterium
PVSPPGAPEDGY

SEQ ID NO: 548111 - protein, 11 aa, Mycobacterium
PVSPPNNTGDG

SEQ ID NO: 548112 - protein, 5 aa, Mycobacterium
PVSPT

SEQ ID NO: 548113 - protein, 12 aa, Mycobacterium
PVSPTLQDPLPE

SEQ ID NO: 548114 - protein, 11 aa, Mycobacterium
PVSPTLQEPLP

SEQ ID NO: 548115 - protein, 9 aa, Mycobacterium
PVSPTTQAY

SEQ ID NO: 548116 - protein, 5 aa, Mycobacterium
PVSQP

SEQ ID NO: 548117 - protein, 6 aa, Mycobacterium
PVSQPD

SEQ ID NO: 548118 - protein, 7 aa, Mycobacterium
PVSQRDW

SEQ ID NO: 548119 - protein, 11 aa, Mycobacterium
PVSRGSDQTLT

SEQ ID NO: 548120 - protein, 12 aa, Mycobacterium
PVSSASLGDQRM

SEQ ID NO: 548121 - protein, 6 aa, Mycobacterium
PVSSET

SEQ ID NO: 548122 - protein, 9 aa, Mycobacterium
PVSSGAPLD

SEQ ID NO: 548123 - protein, 7 aa, Mycobacterium
PVSSGEP

SEQ ID NO: 548124 - protein, 9 aa, Mycobacterium
PVSTEEAED

SEQ ID NO: 548125 - protein, 5 aa, Mycobacterium
PVSTK

SEQ ID NO: 548126 - protein, 7 aa, Mycobacterium
PVSTRTA

SEQ ID NO: 548127 - protein, 10 aa, Mycobacterium
PVTAEATDAI

SEQ ID NO: 548128 - protein, 10 aa, Mycobacterium
PVTAGTTGSV

SEQ ID NO: 548129 - protein, 8 aa, Mycobacterium
PVTAPDGY

SEQ ID NO: 548130 - protein, 19 aa, Mycobacterium
PVTARGSGCGLSGAARPCE

SEQ ID NO: 548131 - protein, 30 aa, Mycobacterium
PVTASAARATGAAGAAAAAAERRDGRGSVT

SEQ ID NO: 548132 - protein, 6 aa, Mycobacterium
PVTATA

SEQ ID NO: 548133 - protein, 7 aa, Mycobacterium
PVTDAAE

SEQ ID NO: 548134 - protein, 8 aa, Mycobacterium
PVTDDADV

SEQ ID NO: 548135 - protein, 5 aa, Mycobacterium
PVTDF

SEQ ID NO: 548136 - protein, 12 aa, Mycobacterium
PVTDRSAAERAV

SEQ ID NO: 548137 - protein, 7 aa, Mycobacterium
PVTDSDQ

SEQ ID NO: 548138 - protein, 5 aa, Mycobacterium
PVTDT

SEQ ID NO: 548139 - protein, 12 aa, Mycobacterium
PVTDTRGSADYK

SEQ ID NO: 548140 - protein, 13 aa, Mycobacterium
PVTDTVGSRLANP

SEQ ID NO: 548141 - protein, 8 aa, Mycobacterium
PVTGDAQR

SEQ ID NO: 548142 - protein, 11 aa, Mycobacterium
PVTGDNDGSDL

SEQ ID NO: 548143 - protein, 12 aa, Mycobacterium
PVTGETVPRGVP

SEQ ID NO: 548144 - protein, 8 aa, Mycobacterium
PVTGIGAG

SEQ ID NO: 548145 - protein, 6 aa, Mycobacterium
PVTGNA

SEQ ID NO: 548146 - protein, 7 aa, Mycobacterium
PVTGQEI

SEQ ID NO: 548147 - protein, 20 aa, Mycobacterium
PVTGQEVHDETGAYPAPQSV

SEQ ID NO: 548148 - protein, 6 aa, Mycobacterium
PVTGQS

SEQ ID NO: 548149 - protein, 6 aa, Mycobacterium
PVTGRA

SEQ ID NO: 548150 - protein, 6 aa, Mycobacterium
PVTGRD

SEQ ID NO: 548151 - protein, 6 aa, Mycobacterium
PVTGRE

SEQ ID NO: 548152 - protein, 20 aa, Mycobacterium
PVTGREVHDESGAYPAAPAL

SEQ ID NO: 548153 - protein, 8 aa, Mycobacterium
PVTGRRRG

SEQ ID NO: 548154 - protein, 5 aa, Mycobacterium
PVTGT

SEQ ID NO: 548155 - protein, 10 aa, Mycobacterium
PVTGTKRTYT

SEQ ID NO: 548156 - protein, 8 aa, Mycobacterium
PVTGYPPV

SEQ ID NO: 548157 - protein, 11 aa, Mycobacterium
PVTKPHGKQVR

SEQ ID NO: 548158 - protein, 13 aa, Mycobacterium
PVTLGDGDPLTSS

SEQ ID NO: 548159 - protein, 5 aa, Mycobacterium
PVTLP

SEQ ID NO: 548160 - protein, 5 aa, Mycobacterium
PVTNA

SEQ ID NO: 548161 - protein, 11 aa, Mycobacterium
PVTNPATGAVT

SEQ ID NO: 548162 - protein, 12 aa, Mycobacterium
PVTNPVAGDPDF

SEQ ID NO: 548163 - protein, 20 aa, Mycobacterium
PVTNSRRRYPWGDSAGPVGN

SEQ ID NO: 548164 - protein, 11 aa, Mycobacterium
PVTPAPRYAGT

SEQ ID NO: 548165 - protein, 12 aa, Mycobacterium
PVTPEAKAAVGG

SEQ ID NO: 548166 - protein, 7 aa, Mycobacterium
PVTPGSL

SEQ ID NO: 548167 - protein, 9 aa, Mycobacterium
PVTPKTITQ

SEQ ID NO: 548168 - protein, 8 aa, Mycobacterium
PVTPNPAR

SEQ ID NO: 548169 - protein, 5 aa, Mycobacterium
PVTPP

SEQ ID NO: 548170 - protein, 31 aa, Mycobacterium
PVTPTSSTPLAAAPAASAPGLAGNAGIQPQL

SEQ ID NO: 548171 - protein, 18 aa, Mycobacterium
PVTPVTERAAKALSDTVT

SEQ ID NO: 548172 - protein, 5 aa, Mycobacterium
PVTQA

SEQ ID NO: 548173 - protein, 17 aa, Mycobacterium
PVTRGTPLGSMGDDDPA

SEQ ID NO: 548174 - protein, 6 aa, Mycobacterium
PVTRSR

SEQ ID NO: 548175 - protein, 6 aa, Mycobacterium
PVTRTP

SEQ ID NO: 548176 - protein, 4 aa, Mycobacterium
PVTS

SEQ ID NO: 548177 - protein, 8 aa, Mycobacterium
PVTSAART

SEQ ID NO: 548178 - protein, 8 aa, Mycobacterium
PVTSAASA

SEQ ID NO: 548179 - protein, 5 aa, Mycobacterium
PVTSG

SEQ ID NO: 548180 - protein, 6 aa, Mycobacterium
PVTSGG

SEQ ID NO: 548181 - protein, 21 aa, Mycobacterium
PVTSGTVDVGGTRVDQASGAQ

SEQ ID NO: 548182 - protein, 5 aa, Mycobacterium
PVTSL

SEQ ID NO: 548183 - protein, 10 aa, Mycobacterium
PVTTAARTAY

SEQ ID NO: 548184 - protein, 6 aa, Mycobacterium
PVTTAN

SEQ ID NO: 548185 - protein, 5 aa, Mycobacterium
PVTTP

SEQ ID NO: 548186 - protein, 7 aa, Mycobacterium
PVTTPDG

SEQ ID NO: 548187 - protein, 8 aa, Mycobacterium
PVTTPDVA

SEQ ID NO: 548188 - protein, 16 aa, Mycobacterium
PVTTTAGDAPRSADPM

SEQ ID NO: 548189 - protein, 4 aa, Mycobacterium
PVVD

SEQ ID NO: 548190 - protein, 5 aa, Mycobacterium
PVVDG

SEQ ID NO: 548191 - protein, 18 aa, Mycobacterium
PVVDGQERDDLADDDSAR

SEQ ID NO: 548192 - protein, 13 aa, Mycobacterium
PVVDTSTGPVRGL

SEQ ID NO: 548193 - protein, 7 aa, Mycobacterium
PVVGSGG

SEQ ID NO: 548194 - protein, 7 aa, Mycobacterium
PVVPGSS

SEQ ID NO: 548195 - protein, 19 aa, Mycobacterium
PVVPRGAGTGLSGGATAID

SEQ ID NO: 548196 - protein, 12 aa, Mycobacterium
PVVRGEGYRDES

SEQ ID NO: 548197 - protein, 10 aa, Mycobacterium
PVWAGGDARR

SEQ ID NO: 548198 - protein, 11 aa, Mycobacterium
PVWAGGDPARL

SEQ ID NO: 548199 - protein, 19 aa, Mycobacterium
PVYAPNSYGGPQADPARAA

SEQ ID NO: 548200 - protein, 8 aa, Mycobacterium
PVYSGTKG

SEQ ID NO: 548201 - protein, 6 aa, Mycobacterium
PVYTPG

SEQ ID NO: 548202 - protein, 11 aa, Mycobacterium
PVYTQSSRLQA

SEQ ID NO: 548203 - protein, 12 aa, Mycobacterium
PWAADGKLSPKS

SEQ ID NO: 548204 - protein, 12 aa, Mycobacterium
PWADGASAAAKT

SEQ ID NO: 548205 - protein, 11 aa, Mycobacterium
PWADGASAAAR

SEQ ID NO: 548206 - protein, 8 aa, Mycobacterium
PWADGQDR

SEQ ID NO: 548207 - protein, 4 aa, Mycobacterium
PWAG

SEQ ID NO: 548208 - protein, 6 aa, Mycobacterium
PWAPDD

SEQ ID NO: 548209 - protein, 6 aa, Mycobacterium
PWAPGD

SEQ ID NO: 548210 - protein, 5 aa, Mycobacterium
PWAPV

SEQ ID NO: 548211 - protein, 6 aa, Mycobacterium
PWDEPY

SEQ ID NO: 548212 - protein, 7 aa, Mycobacterium
PWDGTMT

SEQ ID NO: 548213 - protein, 12 aa, Mycobacterium
PWDGYGGRQQRP

SEQ ID NO: 548214 - protein, 12 aa, Mycobacterium
PWDPESGHRCDP

SEQ ID NO: 548215 - protein, 6 aa, Mycobacterium
PWDTAA

SEQ ID NO: 548216 - protein, 10 aa, Mycobacterium
PWDTADEREL

SEQ ID NO: 548217 - protein, 9 aa, Mycobacterium
PWDTSDVRE

SEQ ID NO: 548218 - protein, 6 aa, Mycobacterium
PWDTTD

SEQ ID NO: 548219 - protein, 5 aa, Mycobacterium
PWEGM

SEQ ID NO: 548220 - protein, 12 aa, Mycobacterium
PWEPGGDELTPT

SEQ ID NO: 548221 - protein, 10 aa, Mycobacterium
PWEPKDGIRY

SEQ ID NO: 548222 - protein, 10 aa, Mycobacterium
PWEPQGRPPV

SEQ ID NO: 548223 - protein, 7 aa, Mycobacterium
PWEPSTD

SEQ ID NO: 548224 - protein, 11 aa, Mycobacterium
PWGEGSGRTVA

SEQ ID NO: 548225 - protein, 9 aa, Mycobacterium
PWGGATASA

SEQ ID NO: 548226 - protein, 10 aa, Mycobacterium
PWGGATASAV

SEQ ID NO: 548227 - protein, 10 aa, Mycobacterium
PWGPTGSTGF

SEQ ID NO: 548228 - protein, 9 aa, Mycobacterium
PWGRASGPI

SEQ ID NO: 548229 - protein, 9 aa, Mycobacterium
PWGRASSPV

SEQ ID NO: 548230 - protein, 8 aa, Mycobacterium
PWGRGASR

SEQ ID NO: 548231 - protein, 24 aa, Mycobacterium
PWGRGDPSRPLVPRRPRPRPRGHQ

SEQ ID NO: 548232 - protein, 5 aa, Mycobacterium
PWGVD

SEQ ID NO: 548233 - protein, 6 aa, Mycobacterium
PWKSRT

SEQ ID NO: 548234 - protein, 10 aa, Mycobacterium
PWLGPSSGAM

SEQ ID NO: 548235 - protein, 10 aa, Mycobacterium
PWNETTPESF

SEQ ID NO: 548236 - protein, 23 aa, Mycobacterium
PWNGTGWGQAGGVATAPISRTPF

SEQ ID NO: 548237 - protein, 8 aa, Mycobacterium
PWNNEGKQ

SEQ ID NO: 548238 - protein, 20 aa, Mycobacterium
PWNNSREDQWGPSDDGDRTR

SEQ ID NO: 548239 - protein, 17 aa, Mycobacterium
PWNPEYTAGASSSGSAA

SEQ ID NO: 548240 - protein, 17 aa, Mycobacterium
PWNTDHTAGASSSGSGA

SEQ ID NO: 548241 - protein, 17 aa, Mycobacterium
PWNTDYTAGASSSGSGA

SEQ ID NO: 548242 - protein, 13 aa, Mycobacterium
PWPAISDSVLAEY

SEQ ID NO: 548243 - protein, 13 aa, Mycobacterium
PWPALSDSVLAEY

SEQ ID NO: 548244 - protein, 10 aa, Mycobacterium
PWPATDGQRI

SEQ ID NO: 548245 - protein, 5 aa, Mycobacterium
PWPDE

SEQ ID NO: 548246 - protein, 6 aa, Mycobacterium
PWPDPT

SEQ ID NO: 548247 - protein, 5 aa, Mycobacterium
PWPDS

SEQ ID NO: 548248 - protein, 13 aa, Mycobacterium
PWPDYPPKPKPTD

SEQ ID NO: 548249 - protein, 14 aa, Mycobacterium
PWPEGNDRTPRRAA

SEQ ID NO: 548250 - protein, 8 aa, Mycobacterium
PWPETPGV

SEQ ID NO: 548251 - protein, 13 aa, Mycobacterium
PWPGRPAPLHPNA

SEQ ID NO: 548252 - protein, 16 aa, Mycobacterium
PWPGTPSDAADPTDLA

SEQ ID NO: 548253 - protein, 8 aa, Mycobacterium
PWPREEGR

SEQ ID NO: 548254 - protein, 13 aa, Mycobacterium
PWPRGAGPRRAGV

SEQ ID NO: 548255 - protein, 8 aa, Mycobacterium
PWPRGAKT

SEQ ID NO: 548256 - protein, 12 aa, Mycobacterium
PWPRGEGHGSAA

SEQ ID NO: 548257 - protein, 7 aa, Mycobacterium
PWPRGRA

SEQ ID NO: 548258 - protein, 5 aa, Mycobacterium
PWPRV

SEQ ID NO: 548259 - protein, 5 aa, Mycobacterium
PWPSA

SEQ ID NO: 548260 - protein, 6 aa, Mycobacterium
PWPTAD

SEQ ID NO: 548261 - protein, 71 aa, Mycobacterium
PWPTANSGSPTKRCRRPSRASASRRSQTRTDSSASRWSSSKRSHSPRRDSSAKPSTWPRTTARVSEESPLR

SEQ ID NO: 548262 - protein, 10 aa, Mycobacterium
PWPTNGEQVR

SEQ ID NO: 548263 - protein, 10 aa, Mycobacterium
PWPTTTPPPE

SEQ ID NO: 548264 - protein, 4 aa, Mycobacterium
PWQE

SEQ ID NO: 548265 - protein, 11 aa, Mycobacterium
PWQPGGRRSGS

SEQ ID NO: 548266 - protein, 10 aa, Mycobacterium
PWQPGGRVPA

SEQ ID NO: 548267 - protein, 12 aa, Mycobacterium
PWQRGSNENTNG

SEQ ID NO: 548268 - protein, 12 aa, Mycobacterium
PWRDQPSKPEQD

SEQ ID NO: 548269 - protein, 6 aa, Mycobacterium
PWRPRK

SEQ ID NO: 548270 - protein, 5 aa, Mycobacterium
PWRRP

SEQ ID NO: 548271 - protein, 4 aa, Mycobacterium
PWRS

SEQ ID NO: 548272 - protein, 7 aa, Mycobacterium
PWSDDDE

SEQ ID NO: 548273 - protein, 7 aa, Mycobacterium
PWSEDDE

SEQ ID NO: 548274 - protein, 5 aa, Mycobacterium
PWSGA

SEQ ID NO: 548275 - protein, 7 aa, Mycobacterium
PWSGETT

SEQ ID NO: 548276 - protein, 14 aa, Mycobacterium
PWSGKTREVAPDAA

SEQ ID NO: 548277 - protein, 12 aa, Mycobacterium
PWSGPPRDVARA

SEQ ID NO: 548278 - protein, 4 aa, Mycobacterium
PWSP

SEQ ID NO: 548279 - protein, 8 aa, Mycobacterium
PWSPASRT

SEQ ID NO: 548280 - protein, 7 aa, Mycobacterium
PWSSSHT

SEQ ID NO: 548281 - protein, 9 aa, Mycobacterium
PWSTGGQMP

SEQ ID NO: 548282 - protein, 6 aa, Mycobacterium
PWSTGH

SEQ ID NO: 548283 - protein, 5 aa, Mycobacterium
PWTAD

SEQ ID NO: 548284 - protein, 5 aa, Mycobacterium
PWTDE

SEQ ID NO: 548285 - protein, 6 aa, Mycobacterium
PWTGGS

SEQ ID NO: 548286 - protein, 12 aa, Mycobacterium
PWTNPAARRAGT

SEQ ID NO: 548287 - protein, 12 aa, Mycobacterium
PWTNPDAGRAGT

SEQ ID NO: 548288 - protein, 15 aa, Mycobacterium
PWTTPQATATDGTPL

SEQ ID NO: 548289 - protein, 5 aa, Mycobacterium
PWTTR

SEQ ID NO: 548290 - protein, 10 aa, Mycobacterium
PWWPPGTAQG

SEQ ID NO: 548291 - protein, 10 aa, Mycobacterium
PYAAEGVGTR

SEQ ID NO: 548292 - protein, 10 aa, Mycobacterium
PYAAGPTLRN

SEQ ID NO: 548293 - protein, 7 aa, Mycobacterium
PYAAPGE

SEQ ID NO: 548294 - protein, 8 aa, Mycobacterium
PYADAPRP

SEQ ID NO: 548295 - protein, 21 aa, Mycobacterium
PYADGADKKDRYDEIEQATNR

SEQ ID NO: 548296 - protein, 12 aa, Mycobacterium
PYADGADKLDRY

SEQ ID NO: 548297 - protein, 4 aa, Mycobacterium
PYAE

SEQ ID NO: 548298 - protein, 9 aa, Mycobacterium
PYAERPGLE

SEQ ID NO: 548299 - protein, 4 aa, Mycobacterium
PYAG

SEQ ID NO: 548300 - protein, 10 aa, Mycobacterium
PYAGPDPDGF

SEQ ID NO: 548301 - protein, 5 aa, Mycobacterium
PYAGS

SEQ ID NO: 548302 - protein, 4 aa, Mycobacterium
PYAP

SEQ ID NO: 548303 - protein, 6 aa, Mycobacterium
PYAPDE

SEQ ID NO: 548304 - protein, 6 aa, Mycobacterium
PYAPNG

SEQ ID NO: 548305 - protein, 7 aa, Mycobacterium
PYAPQGV

SEQ ID NO: 548306 - protein, 13 aa, Mycobacterium
PYAPQGVAVPTDG

SEQ ID NO: 548307 - protein, 10 aa, Mycobacterium
PYAQRRADHE

SEQ ID NO: 548308 - protein, 19 aa, Mycobacterium
PYAQTATDAPASADSSAAH

SEQ ID NO: 548309 - protein, 12 aa, Mycobacterium
PYARRSAKSVGS

SEQ ID NO: 548310 - protein, 7 aa, Mycobacterium
PYASEGA

SEQ ID NO: 548311 - protein, 16 aa, Mycobacterium
PYASKRSLPQQLRAMV

SEQ ID NO: 548312 - protein, 24 aa, Mycobacterium
PYASSAAHSRETQNLDYLTSNACI

SEQ ID NO: 548313 - protein, 15 aa, Mycobacterium
PYASSERATDATGHE

SEQ ID NO: 548314 - protein, 6 aa, Mycobacterium
PYATGV

SEQ ID NO: 548315 - protein, 12 aa, Mycobacterium
PYATPSARGAVE

SEQ ID NO: 548316 - protein, 10 aa, Mycobacterium
PYDDEVDPDL

SEQ ID NO: 548317 - protein, 12 aa, Mycobacterium
PYDDRGRRADDA

SEQ ID NO: 548318 - protein, 5 aa, Mycobacterium
PYDEG

SEQ ID NO: 548319 - protein, 20 aa, Mycobacterium
PYDETLTGNVTDRFTPRELA

SEQ ID NO: 548320 - protein, 8 aa, Mycobacterium
PYDGENVP

SEQ ID NO: 548321 - protein, 11 aa, Mycobacterium
PYDGGDDGAVE

SEQ ID NO: 548322 - protein, 6 aa, Mycobacterium
PYDGPF

SEQ ID NO: 548323 - protein, 8 aa, Mycobacterium
PYDKKNPE

SEQ ID NO: 548324 - protein, 10 aa, Mycobacterium
PYDKKNPETM

SEQ ID NO: 548325 - protein, 7 aa, Mycobacterium
PYDKQNA

SEQ ID NO: 548326 - protein, 4 aa, Mycobacterium
PYDP

SEQ ID NO: 548327 - protein, 10 aa, Mycobacterium
PYDPANAPQM

SEQ ID NO: 548328 - protein, 12 aa, Mycobacterium
PYDPANGQRCNP

SEQ ID NO: 548329 - protein, 7 aa, Mycobacterium
PYDPPWG

SEQ ID NO: 548330 - protein, 8 aa, Mycobacterium
PYDRSGRV

SEQ ID NO: 548331 - protein, 9 aa, Mycobacterium
PYDRSGRVG

SEQ ID NO: 548332 - protein, 9 aa, Mycobacterium
PYDSSGRVG

SEQ ID NO: 548333 - protein, 5 aa, Mycobacterium
PYDYP

SEQ ID NO: 548334 - protein, 12 aa, Mycobacterium
PYEAPEDEAAQD

SEQ ID NO: 548335 - protein, 4 aa, Mycobacterium
PYED

SEQ ID NO: 548336 - protein, 7 aa, Mycobacterium
PYEGKPI

SEQ ID NO: 548337 - protein, 6 aa, Mycobacterium
PYEGPL

SEQ ID NO: 548338 - protein, 10 aa, Mycobacterium
PYEGPPGQVH

SEQ ID NO: 548339 - protein, 7 aa, Mycobacterium
PYEISSA

SEQ ID NO: 548340 - protein, 4 aa, Mycobacterium
PYEP

SEQ ID NO: 548341 - protein, 7 aa, Mycobacterium
PYERSTA

SEQ ID NO: 548342 - protein, 27 aa, Mycobacterium
PYESPDDSTPRASERFADPDAREQRKR

SEQ ID NO: 548343 - protein, 7 aa, Mycobacterium
PYETTLA

SEQ ID NO: 548344 - protein, 4 aa, Mycobacterium
PYFE

SEQ ID NO: 548345 - protein, 4 aa, Mycobacterium
PYFG

SEQ ID NO: 548346 - protein, 5 aa, Mycobacterium
PYFGD

SEQ ID NO: 548347 - protein, 4 aa, Mycobacterium
PYGA

SEQ ID NO: 548348 - protein, 5 aa, Mycobacterium
PYGDA

SEQ ID NO: 548349 - protein, 23 aa, Mycobacterium
PYGDQPNPPTEAPAPAQPTTGGG

SEQ ID NO: 548350 - protein, 11 aa, Mycobacterium
PYGDSALKDKP

SEQ ID NO: 548351 - protein, 7 aa, Mycobacterium
PYGEGDP

SEQ ID NO: 548352 - protein, 10 aa, Mycobacterium
PYGETRSYGE

SEQ ID NO: 548353 - protein, 11 aa, Mycobacterium
PYGGEPGSRLY

SEQ ID NO: 548354 - protein, 7 aa, Mycobacterium
PYGGGQG

SEQ ID NO: 548355 - protein, 6 aa, Mycobacterium
PYGGPA

SEQ ID NO: 548356 - protein, 7 aa, Mycobacterium
PYGKDGY

SEQ ID NO: 548357 - protein, 18 aa, Mycobacterium
PYGKKAPPPAAQIGGGAA

SEQ ID NO: 548358 - protein, 15 aa, Mycobacterium
PYGLPPTTIKPSYGM

SEQ ID NO: 548359 - protein, 9 aa, Mycobacterium
PYGLSSSSR

SEQ ID NO: 548360 - protein, 4 aa, Mycobacterium
PYGN

SEQ ID NO: 548361 - protein, 5 aa, Mycobacterium
PYGQA

SEQ ID NO: 548362 - protein, 6 aa, Mycobacterium
PYGQLG

SEQ ID NO: 548363 - protein, 4 aa, Mycobacterium
PYGR

SEQ ID NO: 548364 - protein, 29 aa, Mycobacterium
PYGRQETWEDSPQGWPQRPPYEWMRLHDA

SEQ ID NO: 548365 - protein, 7 aa, Mycobacterium
PYGSLDP

SEQ ID NO: 548366 - protein, 12 aa, Mycobacterium
PYGSNYATGAAS

SEQ ID NO: 548367 - protein, 12 aa, Mycobacterium
PYGTNTPLAGDQ

SEQ ID NO: 548368 - protein, 4 aa, Mycobacterium
PYGV

SEQ ID NO: 548369 - protein, 4 aa, Mycobacterium
PYID

SEQ ID NO: 548370 - protein, 18 aa, Mycobacterium
PYINPGGTGGSGVTGGSQ

SEQ ID NO: 548371 - protein, 12 aa, Mycobacterium
PYIPQDTELEPE

SEQ ID NO: 548372 - protein, 10 aa, Mycobacterium
PYKAQNMSNN

SEQ ID NO: 548373 - protein, 8 aa, Mycobacterium
PYKATGSL

SEQ ID NO: 548374 - protein, 11 aa, Mycobacterium
PYKEATAAELA

SEQ ID NO: 548375 - protein, 10 aa, Mycobacterium
PYKPREDDID

SEQ ID NO: 548376 - protein, 4 aa, Mycobacterium
PYLD

SEQ ID NO: 548377 - protein, 31 aa, Mycobacterium
PYLGPGSSIIGSSSVNSDTPNPTLAPYAATK

SEQ ID NO: 548378 - protein, 4 aa, Mycobacterium
PYMP

SEQ ID NO: 548379 - protein, 5 aa, Mycobacterium
PYNHP

SEQ ID NO: 548380 - protein, 7 aa, Mycobacterium
PYNPKIP

SEQ ID NO: 548381 - protein, 6 aa, Mycobacterium
PYNTGE

SEQ ID NO: 548382 - protein, 5 aa, Mycobacterium
PYPAP

SEQ ID NO: 548383 - protein, 8 aa, Mycobacterium
PYPAPPNP

SEQ ID NO: 548384 - protein, 5 aa, Mycobacterium
PYPDG

SEQ ID NO: 548385 - protein, 6 aa, Mycobacterium
PYPDGQ

SEQ ID NO: 548386 - protein, 5 aa, Mycobacterium
PYPEN

SEQ ID NO: 548387 - protein, 6 aa, Mycobacterium
PYPEPL

SEQ ID NO: 548388 - protein, 15 aa, Mycobacterium
PYPGDSELVDDGHPQ

SEQ ID NO: 548389 - protein, 17 aa, Mycobacterium
PYPGETQDMSDRPRDDM

SEQ ID NO: 548390 - protein, 5 aa, Mycobacterium
PYPGL

SEQ ID NO: 548391 - protein, 7 aa, Mycobacterium
PYPGRPL

SEQ ID NO: 548392 - protein, 11 aa, Mycobacterium
PYPGRTGNAGH

SEQ ID NO: 548393 - protein, 8 aa, Mycobacterium
PYPKPEDL

SEQ ID NO: 548394 - protein, 4 aa, Mycobacterium
PYPP

SEQ ID NO: 548395 - protein, 5 aa, Mycobacterium
PYPPD

SEQ ID NO: 548396 - protein, 16 aa, Mycobacterium
PYPPDLQHALDVLRAE

SEQ ID NO: 548397 - protein, 16 aa, Mycobacterium
PYPPDLQHALDVLRDE

SEQ ID NO: 548398 - protein, 30 aa, Mycobacterium
PYPPNYPKMPGEPKRVQPSRNTDLNRKNKP

SEQ ID NO: 548399 - protein, 25 aa, Mycobacterium
PYPPTPWNANPRDSFGTPGPYEDAV

SEQ ID NO: 548400 - protein, 5 aa, Mycobacterium
PYPQA

SEQ ID NO: 548401 - protein, 8 aa, Mycobacterium
PYPRPGGV

SEQ ID NO: 548402 - protein, 12 aa, Mycobacterium
PYPRQPPGQQRV

SEQ ID NO: 548403 - protein, 4 aa, Mycobacterium
PYPT

SEQ ID NO: 548404 - protein, 5 aa, Mycobacterium
PYPTG

SEQ ID NO: 548405 - protein, 5 aa, Mycobacterium
PYPTY

SEQ ID NO: 548406 - protein, 64 aa, Mycobacterium
PYQAPAPKQVAAPKKAGAPKKGAAPKKGAAPRNGAAPHGSPRPRSAGSGGRRRGPRPGRMRQET

SEQ ID NO: 548407 - protein, 65 aa, Mycobacterium
PYQAPVPANVPARQHRQNTGGNRRRRTNTRSPKTSSPAEAATSHHGATATRRLDRRRSSRPQGST

SEQ ID NO: 548408 - protein, 11 aa, Mycobacterium
PYQATTRIDAT

SEQ ID NO: 548409 - protein, 8 aa, Mycobacterium
PYQDGDLD

SEQ ID NO: 548410 - protein, 10 aa, Mycobacterium
PYQIPTDGSC

SEQ ID NO: 548411 - protein, 5 aa, Mycobacterium
PYQNI

SEQ ID NO: 548412 - protein, 11 aa, Mycobacterium
PYQPDKPNRGL

SEQ ID NO: 548413 - protein, 7 aa, Mycobacterium
PYQPERK

SEQ ID NO: 548414 - protein, 11 aa, Mycobacterium
PYQQPAEPENL

SEQ ID NO: 548415 - protein, 12 aa, Mycobacterium
PYQSGKAESDSC

SEQ ID NO: 548416 - protein, 5 aa, Mycobacterium
PYQST

SEQ ID NO: 548417 - protein, 17 aa, Mycobacterium
PYRASTAAEKASIATPE

SEQ ID NO: 548418 - protein, 6 aa, Mycobacterium
PYRATG

SEQ ID NO: 548419 - protein, 6 aa, Mycobacterium
PYRDSA

SEQ ID NO: 548420 - protein, 12 aa, Mycobacterium
PYREGSRLDPEQ

SEQ ID NO: 548421 - protein, 12 aa, Mycobacterium
PYREPGQRERDG

SEQ ID NO: 548422 - protein, 10 aa, Mycobacterium
PYREPRDQHE

SEQ ID NO: 548423 - protein, 4 aa, Mycobacterium
PYRG

SEQ ID NO: 548424 - protein, 7 aa, Mycobacterium
PYRGGTH

SEQ ID NO: 548425 - protein, 7 aa, Mycobacterium
PYRGPDA

SEQ ID NO: 548426 - protein, 14 aa, Mycobacterium
PYRGSNKSASADPT

SEQ ID NO: 548427 - protein, 8 aa, Mycobacterium
PYRGTANE

SEQ ID NO: 548428 - protein, 5 aa, Mycobacterium
PYRGV

SEQ ID NO: 548429 - protein, 11 aa, Mycobacterium
PYRPDPARRHA

SEQ ID NO: 548430 - protein, 7 aa, Mycobacterium
PYRPLPS

SEQ ID NO: 548431 - protein, 9 aa, Mycobacterium
PYRRAKERG

SEQ ID NO: 548432 - protein, 6 aa, Mycobacterium
PYRRDR

SEQ ID NO: 548433 - protein, 10 aa, Mycobacterium
PYRRSGRSGL

SEQ ID NO: 548434 - protein, 10 aa, Mycobacterium
PYRSGQRITE

SEQ ID NO: 548435 - protein, 12 aa, Mycobacterium
PYRSRADAAETA

SEQ ID NO: 548436 - protein, 31 aa, Mycobacterium
PYRSRTTVTPHDELGTGEPTVSRTGETRGDT

SEQ ID NO: 548437 - protein, 10 aa, Mycobacterium
PYRSSAEDLD

SEQ ID NO: 548438 - protein, 6 aa, Mycobacterium
PYRTPQ

SEQ ID NO: 548439 - protein, 8 aa, Mycobacterium
PYSDAEAD

SEQ ID NO: 548440 - protein, 9 aa, Mycobacterium
PYSDATHTC

SEQ ID NO: 548441 - protein, 8 aa, Mycobacterium
PYSDEAQR

SEQ ID NO: 548442 - protein, 11 aa, Mycobacterium
PYSDGGATHPS

SEQ ID NO: 548443 - protein, 8 aa, Mycobacterium
PYSDGGIP

SEQ ID NO: 548444 - protein, 11 aa, Mycobacterium
PYSDGTPAPTL

SEQ ID NO: 548445 - protein, 21 aa, Mycobacterium
PYSDPGMDGPTIAAATETALA

SEQ ID NO: 548446 - protein, 19 aa, Mycobacterium
PYSDPGMDGPTIAKATEAA

SEQ ID NO: 548447 - protein, 20 aa, Mycobacterium
PYSDPGMDGPTIQRATEAAL

SEQ ID NO: 548448 - protein, 10 aa, Mycobacterium
PYSEDSRAEV

SEQ ID NO: 548449 - protein, 5 aa, Mycobacterium
PYSEK

SEQ ID NO: 548450 - protein, 7 aa, Mycobacterium
PYSESGL

SEQ ID NO: 548451 - protein, 15 aa, Mycobacterium
PYSGDTLGKESWNGR

SEQ ID NO: 548452 - protein, 16 aa, Mycobacterium
PYSGETLGKESWNGRF

SEQ ID NO: 548453 - protein, 11 aa, Mycobacterium
PYSGNTLGKET

SEQ ID NO: 548454 - protein, 9 aa, Mycobacterium
PYSGPTASL

SEQ ID NO: 548455 - protein, 8 aa, Mycobacterium
PYSGPTTA

SEQ ID NO: 548456 - protein, 9 aa, Mycobacterium
PYSPGAGSV

SEQ ID NO: 548457 - protein, 8 aa, Mycobacterium
PYSPLGGG

SEQ ID NO: 548458 - protein, 12 aa, Mycobacterium
PYSRDPRNVARK

SEQ ID NO: 548459 - protein, 12 aa, Mycobacterium
PYSRRTPKLART

SEQ ID NO: 548460 - protein, 6 aa, Mycobacterium
PYSSFD

SEQ ID NO: 548461 - protein, 10 aa, Mycobacterium
PYTADGDRSF

SEQ ID NO: 548462 - protein, 12 aa, Mycobacterium
PYTASSTDLSSR

SEQ ID NO: 548463 - protein, 13 aa, Mycobacterium
PYTDLDPEAPAGE

SEQ ID NO: 548464 - protein, 8 aa, Mycobacterium
PYTDTGEQ

SEQ ID NO: 548465 - protein, 6 aa, Mycobacterium
PYTGGQ

SEQ ID NO: 548466 - protein, 11 aa, Mycobacterium
PYTGRTGNAGH

SEQ ID NO: 548467 - protein, 17 aa, Mycobacterium
PYTGTGTIHNPATGAVA

SEQ ID NO: 548468 - protein, 13 aa, Mycobacterium
PYTKGEDPQPLAD

SEQ ID NO: 548469 - protein, 12 aa, Mycobacterium
PYTPAAPRHPIS

SEQ ID NO: 548470 - protein, 8 aa, Mycobacterium
PYTPEVSP

SEQ ID NO: 548471 - protein, 5 aa, Mycobacterium
PYTRE

SEQ ID NO: 548472 - protein, 9 aa, Mycobacterium
PYTREEAAY

SEQ ID NO: 548473 - protein, 4 aa, Mycobacterium
PYTS

SEQ ID NO: 548474 - protein, 7 aa, Mycobacterium
PYTSGDA

SEQ ID NO: 548475 - protein, 7 aa, Mycobacterium
PYTSHNS

SEQ ID NO: 548476 - protein, 16 aa, Mycobacterium
PYTSKRQLPQQLRAMV

SEQ ID NO: 548477 - protein, 12 aa, Mycobacterium
PYTTATPRDPIV

SEQ ID NO: 548478 - protein, 8 aa, Mycobacterium
PYTTGPMP

SEQ ID NO: 548479 - protein, 12 aa, Mycobacterium
PYTTYKGSSDPV

SEQ ID NO: 548480 - protein, 5 aa, Mycobacterium
PYTVA

SEQ ID NO: 548481 - protein, 30 aa, Mycobacterium
PYVPTSPAVDPGSVAPWAGPATAWDGGADG

SEQ ID NO: 548482 - protein, 10 aa, Mycobacterium
PYWEPGTAQG

SEQ ID NO: 548483 - protein, 5 aa, Mycobacterium
PYYGG

SEQ ID NO: 548484 - protein, 9 aa, Mycobacterium
PYYGTQDDF

SEQ ID NO: 548485 - protein, 4 aa, Mycobacterium
PYYP

SEQ ID NO: 548486 - protein, 7 aa, Mycobacterium
QAAAAAG

SEQ ID NO: 548487 - protein, 6 aa, Mycobacterium
QAAAAD

SEQ ID NO: 548488 - protein, 10 aa, Mycobacterium
QAAAADPDEL

SEQ ID NO: 548489 - protein, 7 aa, Mycobacterium
QAAAAGA

SEQ ID NO: 548490 - protein, 10 aa, Mycobacterium
QAAAAKGGHP

SEQ ID NO: 548491 - protein, 8 aa, Mycobacterium
QAAAAPAA

SEQ ID NO: 548492 - protein, 11 aa, Mycobacterium
QAAAASPAATV

SEQ ID NO: 548493 - protein, 5 aa, Mycobacterium
QAAAE

SEQ ID NO: 548494 - protein, 7 aa, Mycobacterium
QAAAESV

SEQ ID NO: 548495 - protein, 18 aa, Mycobacterium
QAAAETLRRTTTGTRQQL

SEQ ID NO: 548496 - protein, 5 aa, Mycobacterium
QAAAG

SEQ ID NO: 548497 - protein, 8 aa, Mycobacterium
QAAAGAAV

SEQ ID NO: 548498 - protein, 13 aa, Mycobacterium
QAAAGKAHTGGGS

SEQ ID NO: 548499 - protein, 8 aa, Mycobacterium
QAAAGPAR

SEQ ID NO: 548500 - protein, 6 aa, Mycobacterium
QAAAGT

SEQ ID NO: 548501 - protein, 8 aa, Mycobacterium
QAAAGTPV

SEQ ID NO: 548502 - protein, 10 aa, Mycobacterium
QAAAGVGIDT

SEQ ID NO: 548503 - protein, 5 aa, Mycobacterium
QAAAH

SEQ ID NO: 548504 - protein, 7 aa, Mycobacterium
QAAAKEN

SEQ ID NO: 548505 - protein, 7 aa, Mycobacterium
QAAAKGH

SEQ ID NO: 548506 - protein, 19 aa, Mycobacterium
QAAALRDDTTLDNDTTRAK

SEQ ID NO: 548507 - protein, 10 aa, Mycobacterium
QAAALTSGDV

SEQ ID NO: 548508 - protein, 5 aa, Mycobacterium
QAAAP

SEQ ID NO: 548509 - protein, 6 aa, Mycobacterium
QAAAPD

SEQ ID NO: 548510 - protein, 11 aa, Mycobacterium
QAAAPGATPGM

SEQ ID NO: 548511 - protein, 7 aa, Mycobacterium
QAAAPLA

SEQ ID NO: 548512 - protein, 9 aa, Mycobacterium
QAAAPPSYL

SEQ ID NO: 548513 - protein, 13 aa, Mycobacterium
QAAAQARAAAGAY

SEQ ID NO: 548514 - protein, 13 aa, Mycobacterium
QAAAQQDADAGTA

SEQ ID NO: 548515 - protein, 5 aa, Mycobacterium
QAAAR

SEQ ID NO: 548516 - protein, 15 aa, Mycobacterium
QAAARAGATAEEAAE

SEQ ID NO: 548517 - protein, 15 aa, Mycobacterium
QAAARAGATPEEAAE

SEQ ID NO: 548518 - protein, 12 aa, Mycobacterium
QAAARATPEDVD

SEQ ID NO: 548519 - protein, 8 aa, Mycobacterium
QAAARQAE

SEQ ID NO: 548520 - protein, 9 aa, Mycobacterium
QAACGDDAG

SEQ ID NO: 548521 - protein, 6 aa, Mycobacterium
QAADAE

SEQ ID NO: 548522 - protein, 7 aa, Mycobacterium
QAADARG

SEQ ID NO: 548523 - protein, 16 aa, Mycobacterium
QAADASAAGDPAGNEY

SEQ ID NO: 548524 - protein, 6 aa, Mycobacterium
QAADAT

SEQ ID NO: 548525 - protein, 8 aa, Mycobacterium
QAADDRPV

SEQ ID NO: 548526 - protein, 8 aa, Mycobacterium
QAADGYAA

SEQ ID NO: 548527 - protein, 14 aa, Mycobacterium
QAADLAPGNADPAA

SEQ ID NO: 548528 - protein, 6 aa, Mycobacterium
QAADPA

SEQ ID NO: 548529 - protein, 9 aa, Mycobacterium
QAADPRSNL

SEQ ID NO: 548530 - protein, 6 aa, Mycobacterium
QAADSA

SEQ ID NO: 548531 - protein, 16 aa, Mycobacterium
QAADSARARGAPAAAA

SEQ ID NO: 548532 - protein, 9 aa, Mycobacterium
QAADSGSLG

SEQ ID NO: 548533 - protein, 10 aa, Mycobacterium
QAADSGSREA

SEQ ID NO: 548534 - protein, 10 aa, Mycobacterium
QAADSGSRQA

SEQ ID NO: 548535 - protein, 7 aa, Mycobacterium
QAADTGA

SEQ ID NO: 548536 - protein, 7 aa, Mycobacterium
QAAEAAL

SEQ ID NO: 548537 - protein, 13 aa, Mycobacterium
QAAEADGPLAPGE

SEQ ID NO: 548538 - protein, 13 aa, Mycobacterium
QAAEAHSAGEDTF

SEQ ID NO: 548539 - protein, 6 aa, Mycobacterium
QAAEDA

SEQ ID NO: 548540 - protein, 13 aa, Mycobacterium
QAAEDAWNTRDPH

SEQ ID NO: 548541 - protein, 6 aa, Mycobacterium
QAAEGV

SEQ ID NO: 548542 - protein, 5 aa, Mycobacterium
QAAEL

SEQ ID NO: 548543 - protein, 5 aa, Mycobacterium
QAAEM

SEQ ID NO: 548544 - protein, 5 aa, Mycobacterium
QAAEP

SEQ ID NO: 548545 - protein, 12 aa, Mycobacterium
QAAEPSTAAARE

SEQ ID NO: 548546 - protein, 8 aa, Mycobacterium
QAAEPTGL

SEQ ID NO: 548547 - protein, 9 aa, Mycobacterium
QAAEPVDRQ

SEQ ID NO: 548548 - protein, 5 aa, Mycobacterium
QAAEQ

SEQ ID NO: 548549 - protein, 13 aa, Mycobacterium
QAAERPSSTSHVP

SEQ ID NO: 548550 - protein, 5 aa, Mycobacterium
QAAET

SEQ ID NO: 548551 - protein, 10 aa, Mycobacterium
QAAGAAGQAR

SEQ ID NO: 548552 - protein, 6 aa, Mycobacterium
QAAGAD

SEQ ID NO: 548553 - protein, 6 aa, Mycobacterium
QAAGAK

SEQ ID NO: 548554 - protein, 9 aa, Mycobacterium
QAAGASPEI

SEQ ID NO: 548555 - protein, 8 aa, Mycobacterium
QAAGDNAA

SEQ ID NO: 548556 - protein, 8 aa, Mycobacterium
QAAGEGAG

SEQ ID NO: 548557 - protein, 22 aa, Mycobacterium
QAAGEHGRRGDRGKKFESSTRA

SEQ ID NO: 548558 - protein, 17 aa, Mycobacterium
QAAGEPADALPEAVSPN

SEQ ID NO: 548559 - protein, 5 aa, Mycobacterium
QAAGG

SEQ ID NO: 548560 - protein, 7 aa, Mycobacterium
QAAGGEV

SEQ ID NO: 548561 - protein, 9 aa, Mycobacterium
QAAGGGRVV

SEQ ID NO: 548562 - protein, 6 aa, Mycobacterium
QAAGIS

SEQ ID NO: 548563 - protein, 8 aa, Mycobacterium
QAAGITRE

SEQ ID NO: 548564 - protein, 8 aa, Mycobacterium
QAAGKDTV

SEQ ID NO: 548565 - protein, 9 aa, Mycobacterium
QAAGNRVPG

SEQ ID NO: 548566 - protein, 9 aa, Mycobacterium
QAAGPASSI

SEQ ID NO: 548567 - protein, 12 aa, Mycobacterium
QAAGQPGAKARE

SEQ ID NO: 548568 - protein, 14 aa, Mycobacterium
QAAGRAALAPGASL

SEQ ID NO: 548569 - protein, 12 aa, Mycobacterium
QAAGTAGATNAQ

SEQ ID NO: 548570 - protein, 5 aa, Mycobacterium
QAAGV

SEQ ID NO: 548571 - protein, 34 aa, Mycobacterium
QAAGVSERAIEQAEAGEPVTASEADAIETLVGQI

SEQ ID NO: 548572 - protein, 7 aa, Mycobacterium
QAAGVTK

SEQ ID NO: 548573 - protein, 7 aa, Mycobacterium
QAAHPLD

SEQ ID NO: 548574 - protein, 5 aa, Mycobacterium
QAAHR

SEQ ID NO: 548575 - protein, 5 aa, Mycobacterium
QAAIP

SEQ ID NO: 548576 - protein, 9 aa, Mycobacterium
QAAKDGEDV

SEQ ID NO: 548577 - protein, 6 aa, Mycobacterium
QAAKRR

SEQ ID NO: 548578 - protein, 14 aa, Mycobacterium
QAAKSRSEQLRITS

SEQ ID NO: 548579 - protein, 14 aa, Mycobacterium
QAAKTRSEQLRITS

SEQ ID NO: 548580 - protein, 12 aa, Mycobacterium
QAALQTPDARVS

SEQ ID NO: 548581 - protein, 12 aa, Mycobacterium
QAALQTSDARVS

SEQ ID NO: 548582 - protein, 10 aa, Mycobacterium
QAALRNSRGR

SEQ ID NO: 548583 - protein, 16 aa, Mycobacterium
QAANATAAEYSRYGSS

SEQ ID NO: 548584 - protein, 11 aa, Mycobacterium
QAANDASHEHP

SEQ ID NO: 548585 - protein, 6 aa, Mycobacterium
QAANGV

SEQ ID NO: 548586 - protein, 5 aa, Mycobacterium
QAANL

SEQ ID NO: 548587 - protein, 10 aa, Mycobacterium
QAANLAGGGR

SEQ ID NO: 548588 - protein, 5 aa, Mycobacterium
QAANP

SEQ ID NO: 548589 - protein, 8 aa, Mycobacterium
QAANPSAT

SEQ ID NO: 548590 - protein, 6 aa, Mycobacterium
QAAPAY

SEQ ID NO: 548591 - protein, 9 aa, Mycobacterium
QAAPDADTA

SEQ ID NO: 548592 - protein, 11 aa, Mycobacterium
QAAPELAPYAP

SEQ ID NO: 548593 - protein, 12 aa, Mycobacterium
QAAPEQTSDPGV

SEQ ID NO: 548594 - protein, 6 aa, Mycobacterium
QAAPGM

SEQ ID NO: 548595 - protein, 12 aa, Mycobacterium
QAAPKQTSDSGV

SEQ ID NO: 548596 - protein, 7 aa, Mycobacterium
QAAPPDT

SEQ ID NO: 548597 - protein, 18 aa, Mycobacterium
QAAPPDTSSRPTLRRSRH

SEQ ID NO: 548598 - protein, 7 aa, Mycobacterium
QAAPWSG

SEQ ID NO: 548599 - protein, 5 aa, Mycobacterium
QAAQA

SEQ ID NO: 548600 - protein, 8 aa, Mycobacterium
QAAQAVEE

SEQ ID NO: 548601 - protein, 9 aa, Mycobacterium
QAAQDAGLR

SEQ ID NO: 548602 - protein, 9 aa, Mycobacterium
QAAQDRGLR

SEQ ID NO: 548603 - protein, 9 aa, Mycobacterium
QAAQEDPDV

SEQ ID NO: 548604 - protein, 5 aa, Mycobacterium
QAAQL

SEQ ID NO: 548605 - protein, 14 aa, Mycobacterium
QAAQSVQRSAFPDA

SEQ ID NO: 548606 - protein, 10 aa, Mycobacterium
QAAQSVSESW

SEQ ID NO: 548607 - protein, 6 aa, Mycobacterium
QAAQTG

SEQ ID NO: 548608 - protein, 14 aa, Mycobacterium
QAAQTQHTTLPTQT

SEQ ID NO: 548609 - protein, 4 aa, Mycobacterium
QAAR

SEQ ID NO: 548610 - protein, 14 aa, Mycobacterium
QAARAAAALTADGP

SEQ ID NO: 548611 - protein, 13 aa, Mycobacterium
QAARAGASAGAAV

SEQ ID NO: 548612 - protein, 10 aa, Mycobacterium
QAARAKGGHT

SEQ ID NO: 548613 - protein, 9 aa, Mycobacterium
QAARARSGR

SEQ ID NO: 548614 - protein, 7 aa, Mycobacterium
QAARDHQ

SEQ ID NO: 548615 - protein, 10 aa, Mycobacterium
QAAREADHEV

SEQ ID NO: 548616 - protein, 6 aa, Mycobacterium
QAARNA

SEQ ID NO: 548617 - protein, 7 aa, Mycobacterium
QAARPGF

SEQ ID NO: 548618 - protein, 10 aa, Mycobacterium
QAARPPDQSV

SEQ ID NO: 548619 - protein, 13 aa, Mycobacterium
QAARQNQGKNRPQ

SEQ ID NO: 548620 - protein, 29 aa, Mycobacterium
QAARREDPVPPPPAPGYDPQSLSVLFGRS

SEQ ID NO: 548621 - protein, 7 aa, Mycobacterium
QAARRGL

SEQ ID NO: 548622 - protein, 19 aa, Mycobacterium
QAARRRAAHRADPARCARG

SEQ ID NO: 548623 - protein, 8 aa, Mycobacterium
QAARTGDR

SEQ ID NO: 548624 - protein, 8 aa, Mycobacterium
QAARTPAA

SEQ ID NO: 548625 - protein, 7 aa, Mycobacterium
QAARVQQ

SEQ ID NO: 548626 - protein, 9 aa, Mycobacterium
QAARYEPQP

SEQ ID NO: 548627 - protein, 6 aa, Mycobacterium
QAASAQ

SEQ ID NO: 548628 - protein, 9 aa, Mycobacterium
QAASAQAAT

SEQ ID NO: 548629 - protein, 7 aa, Mycobacterium
QAASARR

SEQ ID NO: 548630 - protein, 10 aa, Mycobacterium
QAASASGPLR

SEQ ID NO: 548631 - protein, 8 aa, Mycobacterium
QAASGADL

SEQ ID NO: 548632 - protein, 5 aa, Mycobacterium
QAASP

SEQ ID NO: 548633 - protein, 9 aa, Mycobacterium
QAASPEAEH

SEQ ID NO: 548634 - protein, 12 aa, Mycobacterium
QAASRQSRRAHV

SEQ ID NO: 548635 - protein, 12 aa, Mycobacterium
QAASSAGNPEIR

SEQ ID NO: 548636 - protein, 9 aa, Mycobacterium
QAASSAGVT

SEQ ID NO: 548637 - protein, 10 aa, Mycobacterium
QAASSPLQGN

SEQ ID NO: 548638 - protein, 9 aa, Mycobacterium
QAASVSGSQ

SEQ ID NO: 548639 - protein, 14 aa, Mycobacterium
QAATAAHYENRGGV

SEQ ID NO: 548640 - protein, 15 aa, Mycobacterium
QAATAPAEPAPPATF

SEQ ID NO: 548641 - protein, 10 aa, Mycobacterium
QAATKKRRDE

SEQ ID NO: 548642 - protein, 5 aa, Mycobacterium
QAATP

SEQ ID NO: 548643 - protein, 8 aa, Mycobacterium
QAATPAIE

SEQ ID NO: 548644 - protein, 6 aa, Mycobacterium
QAATPF

SEQ ID NO: 548645 - protein, 11 aa, Mycobacterium
QAATPPAGAGF

SEQ ID NO: 548646 - protein, 8 aa, Mycobacterium
QAATRGGY

SEQ ID NO: 548647 - protein, 14 aa, Mycobacterium
QAATSAAFADNPAS

SEQ ID NO: 548648 - protein, 10 aa, Mycobacterium
QAATSRPDLP

SEQ ID NO: 548649 - protein, 6 aa, Mycobacterium
QAATYR

SEQ ID NO: 548650 - protein, 13 aa, Mycobacterium
QAAVQGAAASVRA

SEQ ID NO: 548651 - protein, 4 aa, Mycobacterium
QAAY

SEQ ID NO: 548652 - protein, 6 aa, Mycobacterium
QAAYDI

SEQ ID NO: 548653 - protein, 13 aa, Mycobacterium
QAAYEGASAEQVR

SEQ ID NO: 548654 - protein, 5 aa, Mycobacterium
QAAYN

SEQ ID NO: 548655 - protein, 6 aa, Mycobacterium
QAAYPL

SEQ ID NO: 548656 - protein, 9 aa, Mycobacterium
QACGAGADC

SEQ ID NO: 548657 - protein, 6 aa, Mycobacterium
QACTAT

SEQ ID NO: 548658 - protein, 21 aa, Mycobacterium
QACTPSSAGRNPTPAASIGGA

SEQ ID NO: 548659 - protein, 8 aa, Mycobacterium
QADAEGVT

SEQ ID NO: 548660 - protein, 12 aa, Mycobacterium
QADAGTQLQTTS

SEQ ID NO: 548661 - protein, 29 aa, Mycobacterium
QADAKESDRIAAENDLAETQRDHDKARAE

SEQ ID NO: 548662 - protein, 7 aa, Mycobacterium
QADAPSV

SEQ ID NO: 548663 - protein, 6 aa, Mycobacterium
QADAPV

SEQ ID NO: 548664 - protein, 6 aa, Mycobacterium
QADARA

SEQ ID NO: 548665 - protein, 13 aa, Mycobacterium
QADDEQAKATAAR

SEQ ID NO: 548666 - protein, 10 aa, Mycobacterium
QADDGSRWGR

SEQ ID NO: 548667 - protein, 7 aa, Mycobacterium
QADDQRD

SEQ ID NO: 548668 - protein, 47 aa, Mycobacterium
QADEAAQNERAQRDEYRAAQTARKEALAAEAEDIAANSTQWKAAGDR

SEQ ID NO: 548669 - protein, 12 aa, Mycobacterium
QADEDQDGNRPA

SEQ ID NO: 548670 - protein, 8 aa, Mycobacterium
QADEEDAQ

SEQ ID NO: 548671 - protein, 5 aa, Mycobacterium
QADEF

SEQ ID NO: 548672 - protein, 8 aa, Mycobacterium
QADERRRA

SEQ ID NO: 548673 - protein, 8 aa, Mycobacterium
QADERSDE

SEQ ID NO: 548674 - protein, 5 aa, Mycobacterium
QADEW

SEQ ID NO: 548675 - protein, 7 aa, Mycobacterium
QADGETP

SEQ ID NO: 548676 - protein, 8 aa, Mycobacterium
QADGGPAS

SEQ ID NO: 548677 - protein, 8 aa, Mycobacterium
QADGHPSG

SEQ ID NO: 548678 - protein, 6 aa, Mycobacterium
QADGMS

SEQ ID NO: 548679 - protein, 9 aa, Mycobacterium
QADGRAKAI

SEQ ID NO: 548680 - protein, 11 aa, Mycobacterium
QADGRRSYAGI

SEQ ID NO: 548681 - protein, 7 aa, Mycobacterium
QADGRVP

SEQ ID NO: 548682 - protein, 5 aa, Mycobacterium
QADGS

SEQ ID NO: 548683 - protein, 12 aa, Mycobacterium
QADGSIRAGIPE

SEQ ID NO: 548684 - protein, 10 aa, Mycobacterium
QADGSVNATG

SEQ ID NO: 548685 - protein, 10 aa, Mycobacterium
QADGTDGTAY

SEQ ID NO: 548686 - protein, 9 aa, Mycobacterium
QADGTETAE

SEQ ID NO: 548687 - protein, 13 aa, Mycobacterium
QADGVASAEVAGP

SEQ ID NO: 548688 - protein, 8 aa, Mycobacterium
QADHRSDE

SEQ ID NO: 548689 - protein, 5 aa, Mycobacterium
QADKD

SEQ ID NO: 548690 - protein, 7 aa, Mycobacterium
QADLGGT

SEQ ID NO: 548691 - protein, 9 aa, Mycobacterium
QADLTGRPR

SEQ ID NO: 548692 - protein, 11 aa, Mycobacterium
QADNNVPNSME

SEQ ID NO: 548693 - protein, 9 aa, Mycobacterium
QADNPKPLG

SEQ ID NO: 548694 - protein, 8 aa, Mycobacterium
QADPAANL

SEQ ID NO: 548695 - protein, 8 aa, Mycobacterium
QADPAPVR

SEQ ID NO: 548696 - protein, 10 aa, Mycobacterium
QADPDKPWKG

SEQ ID NO: 548697 - protein, 8 aa, Mycobacterium
QADPDTVR

SEQ ID NO: 548698 - protein, 8 aa, Mycobacterium
QADPEAVR

SEQ ID NO: 548699 - protein, 12 aa, Mycobacterium
QADPEGASDGFA

SEQ ID NO: 548700 - protein, 18 aa, Mycobacterium
QADPERRRRYQHARGKGG

SEQ ID NO: 548701 - protein, 18 aa, Mycobacterium
QADPERRRRYQRARGKGG

SEQ ID NO: 548702 - protein, 18 aa, Mycobacterium
QADPERRRRYQSARGKGG

SEQ ID NO: 548703 - protein, 11 aa, Mycobacterium
QADPESDRPDA

SEQ ID NO: 548704 - protein, 7 aa, Mycobacterium
QADPGFA

SEQ ID NO: 548705 - protein, 7 aa, Mycobacterium
QADPGLR

SEQ ID NO: 548706 - protein, 6 aa, Mycobacterium
QADPGV

SEQ ID NO: 548707 - protein, 8 aa, Mycobacterium
QADPHHTT

SEQ ID NO: 548708 - protein, 19 aa, Mycobacterium
QADPHRATKDDVVGKGSWT

SEQ ID NO: 548709 - protein, 7 aa, Mycobacterium
QADPLTG

SEQ ID NO: 548710 - protein, 8 aa, Mycobacterium
QADPLTGR

SEQ ID NO: 548711 - protein, 5 aa, Mycobacterium
QADPP

SEQ ID NO: 548712 - protein, 7 aa, Mycobacterium
QADPPHV

SEQ ID NO: 548713 - protein, 8 aa, Mycobacterium
QADPPPLA

SEQ ID NO: 548714 - protein, 18 aa, Mycobacterium
QADPQRRRRYQQARGKGG

SEQ ID NO: 548715 - protein, 13 aa, Mycobacterium
QADPRVAAITAAF

SEQ ID NO: 548716 - protein, 10 aa, Mycobacterium
QADPTAVEPG

SEQ ID NO: 548717 - protein, 8 aa, Mycobacterium
QADPTLTE

SEQ ID NO: 548718 - protein, 13 aa, Mycobacterium
QADQAKLDQSGID

SEQ ID NO: 548719 - protein, 7 aa, Mycobacterium
QADQLGG

SEQ ID NO: 548720 - protein, 8 aa, Mycobacterium
QADQRSDD

SEQ ID NO: 548721 - protein, 10 aa, Mycobacterium
QADREPSTRE

SEQ ID NO: 548722 - protein, 7 aa, Mycobacterium
QADRRTR

SEQ ID NO: 548723 - protein, 9 aa, Mycobacterium
QADRSAREE

SEQ ID NO: 548724 - protein, 7 aa, Mycobacterium
QADRTEL

SEQ ID NO: 548725 - protein, 8 aa, Mycobacterium
QADSGAHV

SEQ ID NO: 548726 - protein, 6 aa, Mycobacterium
QADSNV

SEQ ID NO: 548727 - protein, 8 aa, Mycobacterium
QADSPQAK

SEQ ID NO: 548728 - protein, 17 aa, Mycobacterium
QADSSEHQPSTPSPDST

SEQ ID NO: 548729 - protein, 7 aa, Mycobacterium
QADSSHR

SEQ ID NO: 548730 - protein, 9 aa, Mycobacterium
QADSSTETI

SEQ ID NO: 548731 - protein, 8 aa, Mycobacterium
QADSSTPY

SEQ ID NO: 548732 - protein, 7 aa, Mycobacterium
QADTARE

SEQ ID NO: 548733 - protein, 5 aa, Mycobacterium
QADTE

SEQ ID NO: 548734 - protein, 7 aa, Mycobacterium
QADTEVR

SEQ ID NO: 548735 - protein, 18 aa, Mycobacterium
QADTKDDSQDSEGAAEPD

SEQ ID NO: 548736 - protein, 9 aa, Mycobacterium
QADTLDPDH

SEQ ID NO: 548737 - protein, 10 aa, Mycobacterium
QADTLEPDRT

SEQ ID NO: 548738 - protein, 6 aa, Mycobacterium
QADVDA

SEQ ID NO: 548739 - protein, 6 aa, Mycobacterium
QADYPG

SEQ ID NO: 548740 - protein, 6 aa, Mycobacterium
QAEAAE

SEQ ID NO: 548741 - protein, 13 aa, Mycobacterium
QAEAAERTGSEQL

SEQ ID NO: 548742 - protein, 8 aa, Mycobacterium
QAEADQAL

SEQ ID NO: 548743 - protein, 8 aa, Mycobacterium
QAEAEATH

SEQ ID NO: 548744 - protein, 8 aa, Mycobacterium
QAEAERDA

SEQ ID NO: 548745 - protein, 9 aa, Mycobacterium
QAEAGAVDE

SEQ ID NO: 548746 - protein, 9 aa, Mycobacterium
QAEAGERNG

SEQ ID NO: 548747 - protein, 10 aa, Mycobacterium
QAEAHRDHQR

SEQ ID NO: 548748 - protein, 6 aa, Mycobacterium
QAEAIR

SEQ ID NO: 548749 - protein, 25 aa, Mycobacterium
QAEAQRAAERAAAKAGCDRESEPEV

SEQ ID NO: 548750 - protein, 9 aa, Mycobacterium
QAEARSEAD

SEQ ID NO: 548751 - protein, 9 aa, Mycobacterium
QAEASGATI

SEQ ID NO: 548752 - protein, 13 aa, Mycobacterium
QAEASRPADFPNN

SEQ ID NO: 548753 - protein, 7 aa, Mycobacterium
QAEATGV

SEQ ID NO: 548754 - protein, 7 aa, Mycobacterium
QAEDELD

SEQ ID NO: 548755 - protein, 5 aa, Mycobacterium
QAEDP

SEQ ID NO: 548756 - protein, 9 aa, Mycobacterium
QAEDSGGRH

SEQ ID NO: 548757 - protein, 9 aa, Mycobacterium
QAEDSGGRQ

SEQ ID NO: 548758 - protein, 10 aa, Mycobacterium
QAEDSGGRQA

SEQ ID NO: 548759 - protein, 10 aa, Mycobacterium
QAEDSGSRQA

SEQ ID NO: 548760 - protein, 5 aa, Mycobacterium
QAEEA

SEQ ID NO: 548761 - protein, 6 aa, Mycobacterium
QAEEAA

SEQ ID NO: 548762 - protein, 8 aa, Mycobacterium
QAEEATDK

SEQ ID NO: 548763 - protein, 6 aa, Mycobacterium
QAEEEL

SEQ ID NO: 548764 - protein, 6 aa, Mycobacterium
QAEESG

SEQ ID NO: 548765 - protein, 14 aa, Mycobacterium
QAEETAGQARAAAA

SEQ ID NO: 548766 - protein, 16 aa, Mycobacterium
QAEGARGDSAAAAAAL

SEQ ID NO: 548767 - protein, 47 aa, Mycobacterium
QAEGATQQEKARREELRAANTARKEALAAEAEDLAANATQWKAAGDR

SEQ ID NO: 548768 - protein, 17 aa, Mycobacterium
QAEGDPSTLNVIRRLRV

SEQ ID NO: 548769 - protein, 17 aa, Mycobacterium
QAEGDRSNLEIARQLSV

SEQ ID NO: 548770 - protein, 5 aa, Mycobacterium
QAEGI

SEQ ID NO: 548771 - protein, 7 aa, Mycobacterium
QAEGKSM

SEQ ID NO: 548772 - protein, 5 aa, Mycobacterium
QAEGQ

SEQ ID NO: 548773 - protein, 12 aa, Mycobacterium
QAEGQEATAYQE

SEQ ID NO: 548774 - protein, 6 aa, Mycobacterium
QAEGQF

SEQ ID NO: 548775 - protein, 11 aa, Mycobacterium
QAEGTDNAHEA

SEQ ID NO: 548776 - protein, 11 aa, Mycobacterium
QAEGTDNTHEA

SEQ ID NO: 548777 - protein, 7 aa, Mycobacterium
QAEGTEF

SEQ ID NO: 548778 - protein, 10 aa, Mycobacterium
QAEGVDTSAR

SEQ ID NO: 548779 - protein, 5 aa, Mycobacterium
QAEHE

SEQ ID NO: 548780 - protein, 12 aa, Mycobacterium
QAEHGPNSPAAL

SEQ ID NO: 548781 - protein, 5 aa, Mycobacterium
QAEHI

SEQ ID NO: 548782 - protein, 11 aa, Mycobacterium
QAEHTASQARV

SEQ ID NO: 548783 - protein, 7 aa, Mycobacterium
QAEKEGL

SEQ ID NO: 548784 - protein, 13 aa, Mycobacterium
QAEKVGRDEPNRA

SEQ ID NO: 548785 - protein, 11 aa, Mycobacterium
QAELAGRSRPR

SEQ ID NO: 548786 - protein, 10 aa, Mycobacterium
QAELAQNSVQ

SEQ ID NO: 548787 - protein, 7 aa, Mycobacterium
QAELDSA

SEQ ID NO: 548788 - protein, 15 aa, Mycobacterium
QAELGGAADESVNPV

SEQ ID NO: 548789 - protein, 21 aa, Mycobacterium
QAELGGASDAGGDEASNPVPK

SEQ ID NO: 548790 - protein, 16 aa, Mycobacterium
QAELGSAADESVNPVP

SEQ ID NO: 548791 - protein, 20 aa, Mycobacterium
QAELGSASDTGGDEATNPVP

SEQ ID NO: 548792 - protein, 10 aa, Mycobacterium
QAENEAGEPL

SEQ ID NO: 548793 - protein, 13 aa, Mycobacterium
QAENTVRESTVTE

SEQ ID NO: 548794 - protein, 9 aa, Mycobacterium
QAEPAYRQR

SEQ ID NO: 548795 - protein, 6 aa, Mycobacterium
QAEPDV

SEQ ID NO: 548796 - protein, 5 aa, Mycobacterium
QAEPE

SEQ ID NO: 548797 - protein, 8 aa, Mycobacterium
QAEPELAG

SEQ ID NO: 548798 - protein, 7 aa, Mycobacterium
QAEPLGG

SEQ ID NO: 548799 - protein, 8 aa, Mycobacterium
QAEPQRRA

SEQ ID NO: 548800 - protein, 26 aa, Mycobacterium
QAEPVAESDEVPSTAEPTHSTAGWGV

SEQ ID NO: 548801 - protein, 5 aa, Mycobacterium
QAEPY

SEQ ID NO: 548802 - protein, 7 aa, Mycobacterium
QAEQAAL

SEQ ID NO: 548803 - protein, 7 aa, Mycobacterium
QAEQAAM

SEQ ID NO: 548804 - protein, 9 aa, Mycobacterium
QAEQAAQSA

SEQ ID NO: 548805 - protein, 16 aa, Mycobacterium
QAEQAAVSARAAAGAY

SEQ ID NO: 548806 - protein, 5 aa, Mycobacterium
QAEQG

SEQ ID NO: 548807 - protein, 8 aa, Mycobacterium
QAEQSALS

SEQ ID NO: 548808 - protein, 8 aa, Mycobacterium
QAEQSAMS

SEQ ID NO: 548809 - protein, 15 aa, Mycobacterium
QAEQTAAQAAAAAGA

SEQ ID NO: 548810 - protein, 4 aa, Mycobacterium
QAER

SEQ ID NO: 548811 - protein, 23 aa, Mycobacterium
QAERASLPSPQPDPNHASPAGGG

SEQ ID NO: 548812 - protein, 6 aa, Mycobacterium
QAEREQ

SEQ ID NO: 548813 - protein, 5 aa, Mycobacterium
QAERG

SEQ ID NO: 548814 - protein, 9 aa, Mycobacterium
QAERIGPAT

SEQ ID NO: 548815 - protein, 5 aa, Mycobacterium
QAERL

SEQ ID NO: 548816 - protein, 9 aa, Mycobacterium
QAERLGAGT

SEQ ID NO: 548817 - protein, 8 aa, Mycobacterium
QAERPEKY

SEQ ID NO: 548818 - protein, 6 aa, Mycobacterium
QAERPR

SEQ ID NO: 548819 - protein, 7 aa, Mycobacterium
QAERRAR

SEQ ID NO: 548820 - protein, 12 aa, Mycobacterium
QAESAGLAPENG

SEQ ID NO: 548821 - protein, 10 aa, Mycobacterium
QAESAGLSPV

SEQ ID NO: 548822 - protein, 12 aa, Mycobacterium
QAESAGLTPESG

SEQ ID NO: 548823 - protein, 9 aa, Mycobacterium
QAESDAAAK

SEQ ID NO: 548824 - protein, 5 aa, Mycobacterium
QAESG

SEQ ID NO: 548825 - protein, 5 aa, Mycobacterium
QAEST

SEQ ID NO: 548826 - protein, 8 aa, Mycobacterium
QAETEAPT

SEQ ID NO: 548827 - protein, 7 aa, Mycobacterium
QAETERD

SEQ ID NO: 548828 - protein, 13 aa, Mycobacterium
QAETGKARSAAQE

SEQ ID NO: 548829 - protein, 8 aa, Mycobacterium
QAETGQTP

SEQ ID NO: 548830 - protein, 8 aa, Mycobacterium
QAETRPHE

SEQ ID NO: 548831 - protein, 8 aa, Mycobacterium
QAETTIKK

SEQ ID NO: 548832 - protein, 8 aa, Mycobacterium
QAETTIRK

SEQ ID NO: 548833 - protein, 14 aa, Mycobacterium
QAEVESTRPAVGGA

SEQ ID NO: 548834 - protein, 20 aa, Mycobacterium
QAFGGKASHVGTVAPGAVGG

SEQ ID NO: 548835 - protein, 5 aa, Mycobacterium
QAFGS

SEQ ID NO: 548836 - protein, 6 aa, Mycobacterium
QAFGSP

SEQ ID NO: 548837 - protein, 4 aa, Mycobacterium
QAFS

SEQ ID NO: 548838 - protein, 7 aa, Mycobacterium
QAFTEAG

SEQ ID NO: 548839 - protein, 4 aa, Mycobacterium
QAGA

SEQ ID NO: 548840 - protein, 5 aa, Mycobacterium
QAGAA

SEQ ID NO: 548841 - protein, 12 aa, Mycobacterium
QAGAATGDKKGM

SEQ ID NO: 548842 - protein, 14 aa, Mycobacterium
QAGADDVLGGATGQ

SEQ ID NO: 548843 - protein, 9 aa, Mycobacterium
QAGADESKV

SEQ ID NO: 548844 - protein, 5 aa, Mycobacterium
QAGAE

SEQ ID NO: 548845 - protein, 7 aa, Mycobacterium
QAGAEAA

SEQ ID NO: 548846 - protein, 6 aa, Mycobacterium
QAGAET

SEQ ID NO: 548847 - protein, 12 aa, Mycobacterium
QAGAPAALTTSG

SEQ ID NO: 548848 - protein, 9 aa, Mycobacterium
QAGAPESAR

SEQ ID NO: 548849 - protein, 7 aa, Mycobacterium
QAGAPGG

SEQ ID NO: 548850 - protein, 14 aa, Mycobacterium
QAGAPGWDVSPEEL

SEQ ID NO: 548851 - protein, 13 aa, Mycobacterium
QAGARGREETKSR

SEQ ID NO: 548852 - protein, 8 aa, Mycobacterium
QAGARPAG

SEQ ID NO: 548853 - protein, 7 aa, Mycobacterium
QAGASPA

SEQ ID NO: 548854 - protein, 7 aa, Mycobacterium
QAGATTV

SEQ ID NO: 548855 - protein, 7 aa, Mycobacterium
QAGCTDN

SEQ ID NO: 548856 - protein, 8 aa, Mycobacterium
QAGDADAA

SEQ ID NO: 548857 - protein, 7 aa, Mycobacterium
QAGDAEA

SEQ ID NO: 548858 - protein, 8 aa, Mycobacterium
QAGDAEAA

SEQ ID NO: 548859 - protein, 6 aa, Mycobacterium
QAGDDA

SEQ ID NO: 548860 - protein, 7 aa, Mycobacterium
QAGDDAT

SEQ ID NO: 548861 - protein, 12 aa, Mycobacterium
QAGDDDDRARQL

SEQ ID NO: 548862 - protein, 6 aa, Mycobacterium
QAGDEA

SEQ ID NO: 548863 - protein, 8 aa, Mycobacterium
QAGDEAWG

SEQ ID NO: 548864 - protein, 15 aa, Mycobacterium
QAGDKARDARGETVE

SEQ ID NO: 548865 - protein, 7 aa, Mycobacterium
QAGDPEA

SEQ ID NO: 548866 - protein, 6 aa, Mycobacterium
QAGDPP

SEQ ID NO: 548867 - protein, 5 aa, Mycobacterium
QAGDR

SEQ ID NO: 548868 - protein, 10 aa, Mycobacterium
QAGEAASQAT

SEQ ID NO: 548869 - protein, 15 aa, Mycobacterium
QAGEKARDSRAEPVE

SEQ ID NO: 548870 - protein, 17 aa, Mycobacterium
QAGEKKRKDGDDQPREG

SEQ ID NO: 548871 - protein, 11 aa, Mycobacterium
QAGEKSRDSRC

SEQ ID NO: 548872 - protein, 14 aa, Mycobacterium
QAGEKSRDSRHEPV

SEQ ID NO: 548873 - protein, 16 aa, Mycobacterium
QAGEKSRDSRSEPVEL

SEQ ID NO: 548874 - protein, 7 aa, Mycobacterium
QAGENPR

SEQ ID NO: 548875 - protein, 10 aa, Mycobacterium
QAGEPAPPMP

SEQ ID NO: 548876 - protein, 8 aa, Mycobacterium
QAGEPVAA

SEQ ID NO: 548877 - protein, 9 aa, Mycobacterium
QAGEQELGG

SEQ ID NO: 548878 - protein, 5 aa, Mycobacterium
QAGER

SEQ ID NO: 548879 - protein, 21 aa, Mycobacterium
QAGERTVPLPAAADAGEVDWS

SEQ ID NO: 548880 - protein, 7 aa, Mycobacterium
QAGESPR

SEQ ID NO: 548881 - protein, 9 aa, Mycobacterium
QAGESSKGA

SEQ ID NO: 548882 - protein, 8 aa, Mycobacterium
QAGETAIG

SEQ ID NO: 548883 - protein, 8 aa, Mycobacterium
QAGEVPAD

SEQ ID NO: 548884 - protein, 4 aa, Mycobacterium
QAGG

SEQ ID NO: 548885 - protein, 8 aa, Mycobacterium
QAGGAGDW

SEQ ID NO: 548886 - protein, 8 aa, Mycobacterium
QAGGAGME

SEQ ID NO: 548887 - protein, 9 aa, Mycobacterium
QAGGDPAEA

SEQ ID NO: 548888 - protein, 7 aa, Mycobacterium
QAGGDPW

SEQ ID NO: 548889 - protein, 8 aa, Mycobacterium
QAGGDPWA

SEQ ID NO: 548890 - protein, 6 aa, Mycobacterium
QAGGDV

SEQ ID NO: 548891 - protein, 6 aa, Mycobacterium
QAGGEG

SEQ ID NO: 548892 - protein, 7 aa, Mycobacterium
QAGGEGF

SEQ ID NO: 548893 - protein, 6 aa, Mycobacterium
QAGGEL

SEQ ID NO: 548894 - protein, 8 aa, Mycobacterium
QAGGGGLK

SEQ ID NO: 548895 - protein, 13 aa, Mycobacterium
QAGGGQGQGVPTG

SEQ ID NO: 548896 - protein, 6 aa, Mycobacterium
QAGGPF

SEQ ID NO: 548897 - protein, 11 aa, Mycobacterium
QAGGPNPALDG

SEQ ID NO: 548898 - protein, 7 aa, Mycobacterium
QAGGPVT

SEQ ID NO: 548899 - protein, 6 aa, Mycobacterium
QAGGRA

SEQ ID NO: 548900 - protein, 9 aa, Mycobacterium
QAGGSPAGL

SEQ ID NO: 548901 - protein, 10 aa, Mycobacterium
QAGGSPAGLD

SEQ ID NO: 548902 - protein, 6 aa, Mycobacterium
QAGGVT

SEQ ID NO: 548903 - protein, 6 aa, Mycobacterium
QAGHDD

SEQ ID NO: 548904 - protein, 7 aa, Mycobacterium
QAGHDTF

SEQ ID NO: 548905 - protein, 5 aa, Mycobacterium
QAGHP

SEQ ID NO: 548906 - protein, 21 aa, Mycobacterium
QAGHRHTPAAGHSSQATPIGV

SEQ ID NO: 548907 - protein, 12 aa, Mycobacterium
QAGHSGITDNAD

SEQ ID NO: 548908 - protein, 6 aa, Mycobacterium
QAGKEA

SEQ ID NO: 548909 - protein, 8 aa, Mycobacterium
QAGKGDVT

SEQ ID NO: 548910 - protein, 16 aa, Mycobacterium
QAGKPQTVDVTLGKAE

SEQ ID NO: 548911 - protein, 6 aa, Mycobacterium
QAGKQD

SEQ ID NO: 548912 - protein, 7 aa, Mycobacterium
QAGKRDI

SEQ ID NO: 548913 - protein, 5 aa, Mycobacterium
QAGLP

SEQ ID NO: 548914 - protein, 14 aa, Mycobacterium
QAGLPHGSARPFGY

SEQ ID NO: 548915 - protein, 8 aa, Mycobacterium
QAGLRDDG

SEQ ID NO: 548916 - protein, 8 aa, Mycobacterium
QAGLRDGA

SEQ ID NO: 548917 - protein, 5 aa, Mycobacterium
QAGMA

SEQ ID NO: 548918 - protein, 9 aa, Mycobacterium
QAGMEAERQ

SEQ ID NO: 548919 - protein, 5 aa, Mycobacterium
QAGNA

SEQ ID NO: 548920 - protein, 6 aa, Mycobacterium
QAGNVD

SEQ ID NO: 548921 - protein, 5 aa, Mycobacterium
QAGPA

SEQ ID NO: 548922 - protein, 6 aa, Mycobacterium
QAGPAC

SEQ ID NO: 548923 - protein, 12 aa, Mycobacterium
QAGPCRGERSRL

SEQ ID NO: 548924 - protein, 5 aa, Mycobacterium
QAGPD

SEQ ID NO: 548925 - protein, 16 aa, Mycobacterium
QAGPDAPSRTARGQAA

SEQ ID NO: 548926 - protein, 7 aa, Mycobacterium
QAGPDEL

SEQ ID NO: 548927 - protein, 9 aa, Mycobacterium
QAGPDMTVP

SEQ ID NO: 548928 - protein, 7 aa, Mycobacterium
QAGPDPE

SEQ ID NO: 548929 - protein, 8 aa, Mycobacterium
QAGPEIEN

SEQ ID NO: 548930 - protein, 5 aa, Mycobacterium
QAGPL

SEQ ID NO: 548931 - protein, 8 aa, Mycobacterium
QAGPNGDL

SEQ ID NO: 548932 - protein, 7 aa, Mycobacterium
QAGPNLT

SEQ ID NO: 548933 - protein, 5 aa, Mycobacterium
QAGPR

SEQ ID NO: 548934 - protein, 8 aa, Mycobacterium
QAGPVRPP

SEQ ID NO: 548935 - protein, 4 aa, Mycobacterium
QAGQ

SEQ ID NO: 548936 - protein, 24 aa, Mycobacterium
QAGQGNSAKPRNHPTIVARLDIQH

SEQ ID NO: 548937 - protein, 5 aa, Mycobacterium
QAGQK

SEQ ID NO: 548938 - protein, 5 aa, Mycobacterium
QAGQP

SEQ ID NO: 548939 - protein, 11 aa, Mycobacterium
QAGQPTSTNPI

SEQ ID NO: 548940 - protein, 6 aa, Mycobacterium
QAGQVA

SEQ ID NO: 548941 - protein, 7 aa, Mycobacterium
QAGRERN

SEQ ID NO: 548942 - protein, 9 aa, Mycobacterium
QAGRGRPAK

SEQ ID NO: 548943 - protein, 7 aa, Mycobacterium
QAGRGVT

SEQ ID NO: 548944 - protein, 5 aa, Mycobacterium
QAGRI

SEQ ID NO: 548945 - protein, 6 aa, Mycobacterium
QAGRLP

SEQ ID NO: 548946 - protein, 9 aa, Mycobacterium
QAGRPAQIS

SEQ ID NO: 548947 - protein, 11 aa, Mycobacterium
QAGRRVARSTG

SEQ ID NO: 548948 - protein, 12 aa, Mycobacterium
QAGRTVAPGPLH

SEQ ID NO: 548949 - protein, 6 aa, Mycobacterium
QAGSAE

SEQ ID NO: 548950 - protein, 8 aa, Mycobacterium
QAGSDEYD

SEQ ID NO: 548951 - protein, 6 aa, Mycobacterium
QAGSDP

SEQ ID NO: 548952 - protein, 9 aa, Mycobacterium
QAGSGKDKC

SEQ ID NO: 548953 - protein, 8 aa, Mycobacterium
QAGSGPIV

SEQ ID NO: 548954 - protein, 7 aa, Mycobacterium
QAGSPLE

SEQ ID NO: 548955 - protein, 8 aa, Mycobacterium
QAGSRGGT

SEQ ID NO: 548956 - protein, 7 aa, Mycobacterium
QAGSTEY

SEQ ID NO: 548957 - protein, 4 aa, Mycobacterium
QAGT

SEQ ID NO: 548958 - protein, 8 aa, Mycobacterium
QAGTAAQA

SEQ ID NO: 548959 - protein, 9 aa, Mycobacterium
QAGTADGAT

SEQ ID NO: 548960 - protein, 16 aa, Mycobacterium
QAGTAGANGSEGRALG

SEQ ID NO: 548961 - protein, 7 aa, Mycobacterium
QAGTATC

SEQ ID NO: 548962 - protein, 9 aa, Mycobacterium
QAGTDEQRE

SEQ ID NO: 548963 - protein, 6 aa, Mycobacterium
QAGTGI

SEQ ID NO: 548964 - protein, 9 aa, Mycobacterium
QAGTGTGKS

SEQ ID NO: 548965 - protein, 7 aa, Mycobacterium
QAGTPPK

SEQ ID NO: 548966 - protein, 7 aa, Mycobacterium
QAGTRAT

SEQ ID NO: 548967 - protein, 8 aa, Mycobacterium
QAGTVPKV

SEQ ID NO: 548968 - protein, 6 aa, Mycobacterium
QAGVGR

SEQ ID NO: 548969 - protein, 15 aa, Mycobacterium
QAGVKRSLRARRFDA

SEQ ID NO: 548970 - protein, 16 aa, Mycobacterium
QAGVKRSLRARRFDTA

SEQ ID NO: 548971 - protein, 5 aa, Mycobacterium
QAGVQ

SEQ ID NO: 548972 - protein, 7 aa, Mycobacterium
QAGVRPG

SEQ ID NO: 548973 - protein, 7 aa, Mycobacterium
QAGVSRP

SEQ ID NO: 548974 - protein, 12 aa, Mycobacterium
QAGWENAPYDPA

SEQ ID NO: 548975 - protein, 12 aa, Mycobacterium
QAGWESNEPDEL

SEQ ID NO: 548976 - protein, 6 aa, Mycobacterium
QAGWPS

SEQ ID NO: 548977 - protein, 14 aa, Mycobacterium
QAGYEGLSRTPAPV

SEQ ID NO: 548978 - protein, 6 aa, Mycobacterium
QAHGAD

SEQ ID NO: 548979 - protein, 8 aa, Mycobacterium
QAHGAGDG

SEQ ID NO: 548980 - protein, 13 aa, Mycobacterium
QAHGSVRAGDPHQ

SEQ ID NO: 548981 - protein, 12 aa, Mycobacterium
QAHPDGAPQRAA

SEQ ID NO: 548982 - protein, 14 aa, Mycobacterium
QAHPELKSRPTRPH

SEQ ID NO: 548983 - protein, 9 aa, Mycobacterium
QAHPNRSAR

SEQ ID NO: 548984 - protein, 4 aa, Mycobacterium
QAHQ

SEQ ID NO: 548985 - protein, 4 aa, Mycobacterium
QAHS

SEQ ID NO: 548986 - protein, 8 aa, Mycobacterium
QAHSTKGL

SEQ ID NO: 548987 - protein, 7 aa, Mycobacterium
QAHTVPE

SEQ ID NO: 548988 - protein, 18 aa, Mycobacterium
QAIADTKGELPQSLSGGG

SEQ ID NO: 548989 - protein, 6 aa, Mycobacterium
QAIAPA

SEQ ID NO: 548990 - protein, 7 aa, Mycobacterium
QAIEGPG

SEQ ID NO: 548991 - protein, 6 aa, Mycobacterium
QAINGD

SEQ ID NO: 548992 - protein, 10 aa, Mycobacterium
QAIPAAAAPK

SEQ ID NO: 548993 - protein, 14 aa, Mycobacterium
QAIPGAAAPAGADT

SEQ ID NO: 548994 - protein, 7 aa, Mycobacterium
QAIPSSE

SEQ ID NO: 548995 - protein, 4 aa, Mycobacterium
QAIR

SEQ ID NO: 548996 - protein, 11 aa, Mycobacterium
QAISGASAEYG

SEQ ID NO: 548997 - protein, 17 aa, Mycobacterium
QAISQGSLTPGDTLPPI

SEQ ID NO: 548998 - protein, 9 aa, Mycobacterium
QAKAAAGAY

SEQ ID NO: 548999 - protein, 7 aa, Mycobacterium
QAKAAGL

SEQ ID NO: 549000 - protein, 15 aa, Mycobacterium
QAKALTSDTKAQFTS

SEQ ID NO: 549001 - protein, 10 aa, Mycobacterium
QAKDPAGGYA

SEQ ID NO: 549002 - protein, 10 aa, Mycobacterium
QAKERAAANG

SEQ ID NO: 549003 - protein, 8 aa, Mycobacterium
QAKGAQSL

SEQ ID NO: 549004 - protein, 60 aa, Mycobacterium
QAKGGRGGNGGHGGAGGTGGTGGKGGDGDDCEFGRTGGNGGTGGRGGDGNFAGTGGNGGA

SEQ ID NO: 549005 - protein, 10 aa, Mycobacterium
QAKGKDSGVT

SEQ ID NO: 549006 - protein, 10 aa, Mycobacterium
QAKGKGEDAK

SEQ ID NO: 549007 - protein, 11 aa, Mycobacterium
QAKGPNRSLRE

SEQ ID NO: 549008 - protein, 10 aa, Mycobacterium
QAKKPGFSAD

SEQ ID NO: 549009 - protein, 10 aa, Mycobacterium
QAKNTKSAKR

SEQ ID NO: 549010 - protein, 14 aa, Mycobacterium
QAKPASAGTPKGGT

SEQ ID NO: 549011 - protein, 7 aa, Mycobacterium
QAKPEFT

SEQ ID NO: 549012 - protein, 6 aa, Mycobacterium
QAKPRD

SEQ ID NO: 549013 - protein, 8 aa, Mycobacterium
QAKQLRTA

SEQ ID NO: 549014 - protein, 9 aa, Mycobacterium
QAKRAEAAG

SEQ ID NO: 549015 - protein, 9 aa, Mycobacterium
QAKRAEDAG

SEQ ID NO: 549016 - protein, 11 aa, Mycobacterium
QAKRRDSEVDR

SEQ ID NO: 549017 - protein, 10 aa, Mycobacterium
QAKSAVTESG

SEQ ID NO: 549018 - protein, 10 aa, Mycobacterium
QAKSKGEDAK

SEQ ID NO: 549019 - protein, 11 aa, Mycobacterium
QAKSKGEDARV

SEQ ID NO: 549020 - protein, 5 aa, Mycobacterium
QAKSM

SEQ ID NO: 549021 - protein, 8 aa, Mycobacterium
QAKSYLDG

SEQ ID NO: 549022 - protein, 12 aa, Mycobacterium
QAKTAAARSPEG

SEQ ID NO: 549023 - protein, 9 aa, Mycobacterium
QAKTAGSGG

SEQ ID NO: 549024 - protein, 15 aa, Mycobacterium
QAKTAPLAGNSIATD

SEQ ID NO: 549025 - protein, 15 aa, Mycobacterium
QAKTDRQLPIIRLSP

SEQ ID NO: 549026 - protein, 10 aa, Mycobacterium
QAKTGKGATI

SEQ ID NO: 549027 - protein, 12 aa, Mycobacterium
QAKTGNPPAAGV

SEQ ID NO: 549028 - protein, 21 aa, Mycobacterium
QAKVEATVDDAVNKGKITAAR

SEQ ID NO: 549029 - protein, 16 aa, Mycobacterium
QALADASADRASQIRT

SEQ ID NO: 549030 - protein, 18 aa, Mycobacterium
QALAEESDEPVDEDIPDT

SEQ ID NO: 549031 - protein, 8 aa, Mycobacterium
QALAESQH

SEQ ID NO: 549032 - protein, 12 aa, Mycobacterium
QALAGDRHDPDA

SEQ ID NO: 549033 - protein, 15 aa, Mycobacterium
QALAPTRAAQDEFND

SEQ ID NO: 549034 - protein, 19 aa, Mycobacterium
QALAQQAAQRRANQRVKAG

SEQ ID NO: 549035 - protein, 10 aa, Mycobacterium
QALDDDKAVT

SEQ ID NO: 549036 - protein, 8 aa, Mycobacterium
QALDGDAL

SEQ ID NO: 549037 - protein, 9 aa, Mycobacterium
QALDPDGGL

SEQ ID NO: 549038 - protein, 23 aa, Mycobacterium
QALEKEKAEQAAAESGSHAEATQ

SEQ ID NO: 549039 - protein, 10 aa, Mycobacterium
QALGDKKGIR

SEQ ID NO: 549040 - protein, 6 aa, Mycobacterium
QALGEG

SEQ ID NO: 549041 - protein, 6 aa, Mycobacterium
QALGGD

SEQ ID NO: 549042 - protein, 8 aa, Mycobacterium
QALGPAER

SEQ ID NO: 549043 - protein, 11 aa, Mycobacterium
QALKRKGDASD

SEQ ID NO: 549044 - protein, 6 aa, Mycobacterium
QALPAL

SEQ ID NO: 549045 - protein, 8 aa, Mycobacterium
QALPDTAN

SEQ ID NO: 549046 - protein, 14 aa, Mycobacterium
QALPEVPPNPGKGE

SEQ ID NO: 549047 - protein, 14 aa, Mycobacterium
QALPEVPTRPGKGE

SEQ ID NO: 549048 - protein, 16 aa, Mycobacterium
QALPGPAKLVTNAGHR

SEQ ID NO: 549049 - protein, 6 aa, Mycobacterium
QALPPG

SEQ ID NO: 549050 - protein, 9 aa, Mycobacterium
QALPRDGER

SEQ ID NO: 549051 - protein, 12 aa, Mycobacterium
QALRATGELADG

SEQ ID NO: 549052 - protein, 8 aa, Mycobacterium
QALRPGDT

SEQ ID NO: 549053 - protein, 6 aa, Mycobacterium
QALRSG

SEQ ID NO: 549054 - protein, 15 aa, Mycobacterium
QALRTDGYPGDRGLA

SEQ ID NO: 549055 - protein, 10 aa, Mycobacterium
QALSAAGAVD

SEQ ID NO: 549056 - protein, 6 aa, Mycobacterium
QALSAG

SEQ ID NO: 549057 - protein, 12 aa, Mycobacterium
QALSTTKDNRRR

SEQ ID NO: 549058 - protein, 7 aa, Mycobacterium
QALTADG

SEQ ID NO: 549059 - protein, 7 aa, Mycobacterium
QALTGLG

SEQ ID NO: 549060 - protein, 4 aa, Mycobacterium
QALY

SEQ ID NO: 549061 - protein, 15 aa, Mycobacterium
QAMADASADRASQIR

SEQ ID NO: 549062 - protein, 10 aa, Mycobacterium
QAMADHPDFA

SEQ ID NO: 549063 - protein, 7 aa, Mycobacterium
QAMGAQA

SEQ ID NO: 549064 - protein, 6 aa, Mycobacterium
QAMGGG

SEQ ID NO: 549065 - protein, 5 aa, Mycobacterium
QAMGN

SEQ ID NO: 549066 - protein, 11 aa, Mycobacterium
QAMSRSSPRVG

SEQ ID NO: 549067 - protein, 7 aa, Mycobacterium
QAMTGGS

SEQ ID NO: 549068 - protein, 4 aa, Mycobacterium
QANA

SEQ ID NO: 549069 - protein, 12 aa, Mycobacterium
QANAAALADFNK

SEQ ID NO: 549070 - protein, 13 aa, Mycobacterium
QANAAALADFNKA

SEQ ID NO: 549071 - protein, 14 aa, Mycobacterium
QANAAALADFSKRR

SEQ ID NO: 549072 - protein, 20 aa, Mycobacterium
QANADDLDEAYDAAARAQAQ

SEQ ID NO: 549073 - protein, 24 aa, Mycobacterium
QANADDPDKAADLQANVNSAPSTL

SEQ ID NO: 549074 - protein, 12 aa, Mycobacterium
QANASAERTRQV

SEQ ID NO: 549075 - protein, 13 aa, Mycobacterium
QANCERKANRQPR

SEQ ID NO: 549076 - protein, 4 aa, Mycobacterium
QAND

SEQ ID NO: 549077 - protein, 8 aa, Mycobacterium
QANDPTAH

SEQ ID NO: 549078 - protein, 5 aa, Mycobacterium
QANDR

SEQ ID NO: 549079 - protein, 10 aa, Mycobacterium
QANEDNGYHQ

SEQ ID NO: 549080 - protein, 9 aa, Mycobacterium
QANEDYSEE

SEQ ID NO: 549081 - protein, 12 aa, Mycobacterium
QANEDYTDEFDP

SEQ ID NO: 549082 - protein, 14 aa, Mycobacterium
QANEDYTDEFDPAK

SEQ ID NO: 549083 - protein, 25 aa, Mycobacterium
QANEDYTEEFDPSKYGMADSYDDAG

SEQ ID NO: 549084 - protein, 26 aa, Mycobacterium
QANEDYTEEFDPSKYGMADSYDEQGN

SEQ ID NO: 549085 - protein, 10 aa, Mycobacterium
QANGDEEHTV

SEQ ID NO: 549086 - protein, 11 aa, Mycobacterium
QANGIDPQPLR

SEQ ID NO: 549087 - protein, 6 aa, Mycobacterium
QANGNP

SEQ ID NO: 549088 - protein, 10 aa, Mycobacterium
QANGSVNATG

SEQ ID NO: 549089 - protein, 8 aa, Mycobacterium
QANGTPAG

SEQ ID NO: 549090 - protein, 13 aa, Mycobacterium
QANGTTTSGVEYD

SEQ ID NO: 549091 - protein, 7 aa, Mycobacterium
QANGVST

SEQ ID NO: 549092 - protein, 8 aa, Mycobacterium
QANKREPK

SEQ ID NO: 549093 - protein, 18 aa, Mycobacterium
QANNQGVTGLNPDQAAKR

SEQ ID NO: 549094 - protein, 5 aa, Mycobacterium
QANNR

SEQ ID NO: 549095 - protein, 9 aa, Mycobacterium
QANNSGARE

SEQ ID NO: 549096 - protein, 6 aa, Mycobacterium
QANPDA

SEQ ID NO: 549097 - protein, 10 aa, Mycobacterium
QANPGATDEL

SEQ ID NO: 549098 - protein, 4 aa, Mycobacterium
QANQ

SEQ ID NO: 549099 - protein, 7 aa, Mycobacterium
QANQEKA

SEQ ID NO: 549100 - protein, 7 aa, Mycobacterium
QANQRAQ

SEQ ID NO: 549101 - protein, 18 aa, Mycobacterium
QANREADPAARDGDPVGP

SEQ ID NO: 549102 - protein, 8 aa, Mycobacterium
QANRRAQS

SEQ ID NO: 549103 - protein, 13 aa, Mycobacterium
QANSAAKGHSSAI

SEQ ID NO: 549104 - protein, 14 aa, Mycobacterium
QANSGAQVVSPSGM

SEQ ID NO: 549105 - protein, 11 aa, Mycobacterium
QANSGARVVGP

SEQ ID NO: 549106 - protein, 13 aa, Mycobacterium
QANSIAKEHSSAI

SEQ ID NO: 549107 - protein, 13 aa, Mycobacterium
QANSRAKDHSSAI

SEQ ID NO: 549108 - protein, 13 aa, Mycobacterium
QANTAEAANAPAT

SEQ ID NO: 549109 - protein, 9 aa, Mycobacterium
QANTGESAV

SEQ ID NO: 549110 - protein, 8 aa, Mycobacterium
QANTPARA

SEQ ID NO: 549111 - protein, 6 aa, Mycobacterium
QANTQH

SEQ ID NO: 549112 - protein, 15 aa, Mycobacterium
QANTTRQIPLFELIR

SEQ ID NO: 549113 - protein, 8 aa, Mycobacterium
QANYAASK

SEQ ID NO: 549114 - protein, 10 aa, Mycobacterium
QAPAAPLGDA

SEQ ID NO: 549115 - protein, 5 aa, Mycobacterium
QAPAD

SEQ ID NO: 549116 - protein, 22 aa, Mycobacterium
QAPADAPARAPDGPDTPGPVGP

SEQ ID NO: 549117 - protein, 5 aa, Mycobacterium
QAPAE

SEQ ID NO: 549118 - protein, 10 aa, Mycobacterium
QAPAGGGADT

SEQ ID NO: 549119 - protein, 7 aa, Mycobacterium
QAPAKAL

SEQ ID NO: 549120 - protein, 28 aa, Mycobacterium
QAPAKKPAKGAASADAATASSSEPGGLE

SEQ ID NO: 549121 - protein, 19 aa, Mycobacterium
QAPAPATPVAGLPTPGVSQ

SEQ ID NO: 549122 - protein, 18 aa, Mycobacterium
QAPARPAAEVDGGVDQQR

SEQ ID NO: 549123 - protein, 13 aa, Mycobacterium
QAPARRGRHKNIP

SEQ ID NO: 549124 - protein, 5 aa, Mycobacterium
QAPAS

SEQ ID NO: 549125 - protein, 6 aa, Mycobacterium
QAPATA

SEQ ID NO: 549126 - protein, 10 aa, Mycobacterium
QAPATGRNSL

SEQ ID NO: 549127 - protein, 7 aa, Mycobacterium
QAPAVQG

SEQ ID NO: 549128 - protein, 10 aa, Mycobacterium
QAPDAEQDSL

SEQ ID NO: 549129 - protein, 7 aa, Mycobacterium
QAPDAGF

SEQ ID NO: 549130 - protein, 6 aa, Mycobacterium
QAPDEL

SEQ ID NO: 549131 - protein, 10 aa, Mycobacterium
QAPDGSKPAI

SEQ ID NO: 549132 - protein, 12 aa, Mycobacterium
QAPDKGGFGDGG

SEQ ID NO: 549133 - protein, 6 aa, Mycobacterium
QAPDKL

SEQ ID NO: 549134 - protein, 10 aa, Mycobacterium
QAPDPGQDSL

SEQ ID NO: 549135 - protein, 15 aa, Mycobacterium
QAPDPVPNGRSGRVT

SEQ ID NO: 549136 - protein, 16 aa, Mycobacterium
QAPDQAAPPLAKAEET

SEQ ID NO: 549137 - protein, 7 aa, Mycobacterium
QAPDRTI

SEQ ID NO: 549138 - protein, 8 aa, Mycobacterium
QAPDTGNM

SEQ ID NO: 549139 - protein, 6 aa, Mycobacterium
QAPDVD

SEQ ID NO: 549140 - protein, 11 aa, Mycobacterium
QAPEDPDARTE

SEQ ID NO: 549141 - protein, 14 aa, Mycobacterium
QAPEELVDGVVAQA

SEQ ID NO: 549142 - protein, 15 aa, Mycobacterium
QAPEPATGSFAPTDR

SEQ ID NO: 549143 - protein, 142 aa, Mycobacterium
QAPEPQERPAPVRTEKAEDVDEDAGETDDSDADGEGDGDRPARRRRRGRRGRGRGRGEQGGGEGSDDSGDDAAAEGGEAAEGDDAADGTGDDSPAPDGDESNAEDGDTPEGASRRRRRRRRRKAGSGDDGDGPSDDDPPNTV

SEQ ID NO: 549144 - protein, 6 aa, Mycobacterium
QAPEQA

SEQ ID NO: 549145 - protein, 9 aa, Mycobacterium
QAPEQFTPK

SEQ ID NO: 549146 - protein, 6 aa, Mycobacterium
QAPERR

SEQ ID NO: 549147 - protein, 7 aa, Mycobacterium
QAPERRG

SEQ ID NO: 549148 - protein, 8 aa, Mycobacterium
QAPESERM

SEQ ID NO: 549149 - protein, 20 aa, Mycobacterium
QAPESPAETAAEAISPKAGN

SEQ ID NO: 549150 - protein, 4 aa, Mycobacterium
QAPF

SEQ ID NO: 549151 - protein, 7 aa, Mycobacterium
QAPGDAR

SEQ ID NO: 549152 - protein, 5 aa, Mycobacterium
QAPGG

SEQ ID NO: 549153 - protein, 10 aa, Mycobacterium
QAPGGDYRPD

SEQ ID NO: 549154 - protein, 8 aa, Mycobacterium
QAPGGGDT

SEQ ID NO: 549155 - protein, 9 aa, Mycobacterium
QAPGGVDPL

SEQ ID NO: 549156 - protein, 5 aa, Mycobacterium
QAPGL

SEQ ID NO: 549157 - protein, 8 aa, Mycobacterium
QAPGPIDD

SEQ ID NO: 549158 - protein, 15 aa, Mycobacterium
QAPGPPSSADPGSPA

SEQ ID NO: 549159 - protein, 5 aa, Mycobacterium
QAPGR

SEQ ID NO: 549160 - protein, 9 aa, Mycobacterium
QAPGSLDPQ

SEQ ID NO: 549161 - protein, 6 aa, Mycobacterium
QAPGTQ

SEQ ID NO: 549162 - protein, 7 aa, Mycobacterium
QAPGTSF

SEQ ID NO: 549163 - protein, 12 aa, Mycobacterium
QAPGYTEGAGRE

SEQ ID NO: 549164 - protein, 4 aa, Mycobacterium
QAPI

SEQ ID NO: 549165 - protein, 5 aa, Mycobacterium
QAPIG

SEQ ID NO: 549166 - protein, 6 aa, Mycobacterium
QAPIGT

SEQ ID NO: 549167 - protein, 5 aa, Mycobacterium
QAPIP

SEQ ID NO: 549168 - protein, 6 aa, Mycobacterium
QAPKGL

SEQ ID NO: 549169 - protein, 13 aa, Mycobacterium
QAPLAATKQNLEY

SEQ ID NO: 549170 - protein, 13 aa, Mycobacterium
QAPLEPVSYGVFR

SEQ ID NO: 549171 - protein, 14 aa, Mycobacterium
QAPLPAYPVQVTAG

SEQ ID NO: 549172 - protein, 23 aa, Mycobacterium
QAPLSDALGSPDPYTQALLGTVL

SEQ ID NO: 549173 - protein, 5 aa, Mycobacterium
QAPMP

SEQ ID NO: 549174 - protein, 9 aa, Mycobacterium
QAPPAPEPL

SEQ ID NO: 549175 - protein, 7 aa, Mycobacterium
QAPPARV

SEQ ID NO: 549176 - protein, 8 aa, Mycobacterium
QAPPDTSL

SEQ ID NO: 549177 - protein, 6 aa, Mycobacterium
QAPPGS

SEQ ID NO: 549178 - protein, 8 aa, Mycobacterium
QAPPIPAQ

SEQ ID NO: 549179 - protein, 6 aa, Mycobacterium
QAPPLE

SEQ ID NO: 549180 - protein, 6 aa, Mycobacterium
QAPPNL

SEQ ID NO: 549181 - protein, 10 aa, Mycobacterium
QAPPPAGSKQ

SEQ ID NO: 549182 - protein, 21 aa, Mycobacterium
QAPPPAQAPAAVSAPAAEAGG

SEQ ID NO: 549183 - protein, 14 aa, Mycobacterium
QAPPPGVHGAPNNP

SEQ ID NO: 549184 - protein, 16 aa, Mycobacterium
QAPPQSTDGGFEPQQF

SEQ ID NO: 549185 - protein, 5 aa, Mycobacterium
QAPPR

SEQ ID NO: 549186 - protein, 9 aa, Mycobacterium
QAPPSAGFA

SEQ ID NO: 549187 - protein, 6 aa, Mycobacterium
QAPPTS

SEQ ID NO: 549188 - protein, 5 aa, Mycobacterium
QAPPV

SEQ ID NO: 549189 - protein, 17 aa, Mycobacterium
QAPPVESSTPPAVESPL

SEQ ID NO: 549190 - protein, 8 aa, Mycobacterium
QAPQGITG

SEQ ID NO: 549191 - protein, 13 aa, Mycobacterium
QAPQNGEAEPASI

SEQ ID NO: 549192 - protein, 10 aa, Mycobacterium
QAPRGRDLED

SEQ ID NO: 549193 - protein, 9 aa, Mycobacterium
QAPRPGVAR

SEQ ID NO: 549194 - protein, 12 aa, Mycobacterium
QAPRRQHPQRRR

SEQ ID NO: 549195 - protein, 5 aa, Mycobacterium
QAPRV

SEQ ID NO: 549196 - protein, 7 aa, Mycobacterium
QAPRVDS

SEQ ID NO: 549197 - protein, 16 aa, Mycobacterium
QAPSDPTSLDDHPKAG

SEQ ID NO: 549198 - protein, 8 aa, Mycobacterium
QAPSDYPD

SEQ ID NO: 549199 - protein, 21 aa, Mycobacterium
QAPSFSLPDADGKKVSLADYK

SEQ ID NO: 549200 - protein, 6 aa, Mycobacterium
QAPSGW

SEQ ID NO: 549201 - protein, 4 aa, Mycobacterium
QAPT

SEQ ID NO: 549202 - protein, 9 aa, Mycobacterium
QAPTDQPYG

SEQ ID NO: 549203 - protein, 6 aa, Mycobacterium
QAPTGA

SEQ ID NO: 549204 - protein, 5 aa, Mycobacterium
QAPTH

SEQ ID NO: 549205 - protein, 11 aa, Mycobacterium
QAPTNGPSTAD

SEQ ID NO: 549206 - protein, 7 aa, Mycobacterium
QAPTPAT

SEQ ID NO: 549207 - protein, 22 aa, Mycobacterium
QAPTPPPEAATQHTDPRIAQAE

SEQ ID NO: 549208 - protein, 7 aa, Mycobacterium
QAPTRAL

SEQ ID NO: 549209 - protein, 9 aa, Mycobacterium
QAPTSGNLQ

SEQ ID NO: 549210 - protein, 12 aa, Mycobacterium
QAPTTAHSAEKS

SEQ ID NO: 549211 - protein, 9 aa, Mycobacterium
QAPTVASGA

SEQ ID NO: 549212 - protein, 7 aa, Mycobacterium
QAPVGTQ

SEQ ID NO: 549213 - protein, 4 aa, Mycobacterium
QAQA

SEQ ID NO: 549214 - protein, 8 aa, Mycobacterium
QAQAEAYA

SEQ ID NO: 549215 - protein, 11 aa, Mycobacterium
QAQAEGGEVIG

SEQ ID NO: 549216 - protein, 23 aa, Mycobacterium
QAQARSVGPDALTGEPEPAPVEG

SEQ ID NO: 549217 - protein, 7 aa, Mycobacterium
QAQATGR

SEQ ID NO: 549218 - protein, 11 aa, Mycobacterium
QAQDRGRPGPL

SEQ ID NO: 549219 - protein, 6 aa, Mycobacterium
QAQDVV

SEQ ID NO: 549220 - protein, 4 aa, Mycobacterium
QAQE

SEQ ID NO: 549221 - protein, 9 aa, Mycobacterium
QAQESGVAE

SEQ ID NO: 549222 - protein, 10 aa, Mycobacterium
QAQGETAQET

SEQ ID NO: 549223 - protein, 6 aa, Mycobacterium
QAQGQR

SEQ ID NO: 549224 - protein, 8 aa, Mycobacterium
QAQHPPDV

SEQ ID NO: 549225 - protein, 4 aa, Mycobacterium
QAQI

SEQ ID NO: 549226 - protein, 8 aa, Mycobacterium
QAQIDSSR

SEQ ID NO: 549227 - protein, 4 aa, Mycobacterium
QAQL

SEQ ID NO: 549228 - protein, 5 aa, Mycobacterium
QAQLE

SEQ ID NO: 549229 - protein, 9 aa, Mycobacterium
QAQMSKQSA

SEQ ID NO: 549230 - protein, 18 aa, Mycobacterium
QAQNPTITSSPTGDGPDL

SEQ ID NO: 549231 - protein, 18 aa, Mycobacterium
QAQNPTVTASPSGDGPDL

SEQ ID NO: 549232 - protein, 8 aa, Mycobacterium
QAQNVSGQ

SEQ ID NO: 549233 - protein, 14 aa, Mycobacterium
QAQPANLSVKASGA

SEQ ID NO: 549234 - protein, 10 aa, Mycobacterium
QAQPDADPLD

SEQ ID NO: 549235 - protein, 29 aa, Mycobacterium
QAQPDDVSADELRASAPEARAEILEPVPL

SEQ ID NO: 549236 - protein, 10 aa, Mycobacterium
QAQPDGTSQR

SEQ ID NO: 549237 - protein, 5 aa, Mycobacterium
QAQPG

SEQ ID NO: 549238 - protein, 24 aa, Mycobacterium
QAQPPTWRGPASGPQGKRAYGGQL

SEQ ID NO: 549239 - protein, 7 aa, Mycobacterium
QAQPTLD

SEQ ID NO: 549240 - protein, 17 aa, Mycobacterium
QAQPTLDAAARAGEVRD

SEQ ID NO: 549241 - protein, 23 aa, Mycobacterium
QAQPTLDAAARAGQARESLAQSQ

SEQ ID NO: 549242 - protein, 22 aa, Mycobacterium
QAQPTLDAAARAGQARETFAQS

SEQ ID NO: 549243 - protein, 9 aa, Mycobacterium
QAQQAEADG

SEQ ID NO: 549244 - protein, 6 aa, Mycobacterium
QAQQAK

SEQ ID NO: 549245 - protein, 5 aa, Mycobacterium
QAQQQ

SEQ ID NO: 549246 - protein, 6 aa, Mycobacterium
QAQQQG

SEQ ID NO: 549247 - protein, 17 aa, Mycobacterium
QAQQVAEKAYSQNRSMT

SEQ ID NO: 549248 - protein, 10 aa, Mycobacterium
QAQRFREGEV

SEQ ID NO: 549249 - protein, 10 aa, Mycobacterium
QAQRLREGEI

SEQ ID NO: 549250 - protein, 18 aa, Mycobacterium
QAQRPTLTASPSGDGPDL

SEQ ID NO: 549251 - protein, 5 aa, Mycobacterium
QAQSF

SEQ ID NO: 549252 - protein, 9 aa, Mycobacterium
QAQSSGSQF

SEQ ID NO: 549253 - protein, 13 aa, Mycobacterium
QAQVAQAARRADG

SEQ ID NO: 549254 - protein, 8 aa, Mycobacterium
QARAAAAQ

SEQ ID NO: 549255 - protein, 16 aa, Mycobacterium
QARADAAVTPATPMAQ

SEQ ID NO: 549256 - protein, 21 aa, Mycobacterium
QARADGGEVMGGERHQAEHPS

SEQ ID NO: 549257 - protein, 22 aa, Mycobacterium
QARADGGTVHGGERHELGDEEG

SEQ ID NO: 549258 - protein, 13 aa, Mycobacterium
QARADGVAPPVTP

SEQ ID NO: 549259 - protein, 10 aa, Mycobacterium
QARADRGAAV

SEQ ID NO: 549260 - protein, 10 aa, Mycobacterium
QARAEAGQAL

SEQ ID NO: 549261 - protein, 7 aa, Mycobacterium
QARAEEI

SEQ ID NO: 549262 - protein, 9 aa, Mycobacterium
QARAEGGEV

SEQ ID NO: 549263 - protein, 9 aa, Mycobacterium
QARAETDAE

SEQ ID NO: 549264 - protein, 11 aa, Mycobacterium
QARAETDSEHA

SEQ ID NO: 549265 - protein, 15 aa, Mycobacterium
QARAGATDDAPPQIV

SEQ ID NO: 549266 - protein, 11 aa, Mycobacterium
QARAHDESAPL

SEQ ID NO: 549267 - protein, 12 aa, Mycobacterium
QARAHPAAAKGA

SEQ ID NO: 549268 - protein, 9 aa, Mycobacterium
QARAQRVTS

SEQ ID NO: 549269 - protein, 9 aa, Mycobacterium
QARATDDPL

SEQ ID NO: 549270 - protein, 12 aa, Mycobacterium
QARDEDSQPITD

SEQ ID NO: 549271 - protein, 5 aa, Mycobacterium
QARDG

SEQ ID NO: 549272 - protein, 6 aa, Mycobacterium
QARDGR

SEQ ID NO: 549273 - protein, 12 aa, Mycobacterium
QARDNADGPIPP

SEQ ID NO: 549274 - protein, 9 aa, Mycobacterium
QARDNAGPN

SEQ ID NO: 549275 - protein, 6 aa, Mycobacterium
QARDQL

SEQ ID NO: 549276 - protein, 6 aa, Mycobacterium
QARDSV

SEQ ID NO: 549277 - protein, 5 aa, Mycobacterium
QARDT

SEQ ID NO: 549278 - protein, 7 aa, Mycobacterium
QARDTNF

SEQ ID NO: 549279 - protein, 10 aa, Mycobacterium
QARDTQRSRR

SEQ ID NO: 549280 - protein, 10 aa, Mycobacterium
QARDTTEDVA

SEQ ID NO: 549281 - protein, 11 aa, Mycobacterium
QAREAKSRELA

SEQ ID NO: 549282 - protein, 17 aa, Mycobacterium
QAREEIKHSKNDTDGLG

SEQ ID NO: 549283 - protein, 6 aa, Mycobacterium
QAREID

SEQ ID NO: 549284 - protein, 5 aa, Mycobacterium
QAREK

SEQ ID NO: 549285 - protein, 9 aa, Mycobacterium
QAREKGDNA

SEQ ID NO: 549286 - protein, 7 aa, Mycobacterium
QAREKNK

SEQ ID NO: 549287 - protein, 9 aa, Mycobacterium
QARERGEQV

SEQ ID NO: 549288 - protein, 4 aa, Mycobacterium
QARG

SEQ ID NO: 549289 - protein, 7 aa, Mycobacterium
QARGATV

SEQ ID NO: 549290 - protein, 13 aa, Mycobacterium
QARGEDAPWTGAT

SEQ ID NO: 549291 - protein, 9 aa, Mycobacterium
QARGEDPLS

SEQ ID NO: 549292 - protein, 12 aa, Mycobacterium
QARGPKARLRTT

SEQ ID NO: 549293 - protein, 10 aa, Mycobacterium
QARGPQPSPQ

SEQ ID NO: 549294 - protein, 8 aa, Mycobacterium
QARGQDPL

SEQ ID NO: 549295 - protein, 7 aa, Mycobacterium
QARGQQR

SEQ ID NO: 549296 - protein, 10 aa, Mycobacterium
QARGQQVTSQ

SEQ ID NO: 549297 - protein, 10 aa, Mycobacterium
QARGSQDTSV

SEQ ID NO: 549298 - protein, 10 aa, Mycobacterium
QARGSTGPYL

SEQ ID NO: 549299 - protein, 6 aa, Mycobacterium
QARGYR

SEQ ID NO: 549300 - protein, 8 aa, Mycobacterium
QARHEEAR

SEQ ID NO: 549301 - protein, 9 aa, Mycobacterium
QARHTYPDG

SEQ ID NO: 549302 - protein, 8 aa, Mycobacterium
QARHVDGT

SEQ ID NO: 549303 - protein, 16 aa, Mycobacterium
QARIAEGAGAVAVMAL

SEQ ID NO: 549304 - protein, 7 aa, Mycobacterium
QARISGT

SEQ ID NO: 549305 - protein, 7 aa, Mycobacterium
QARKDEA

SEQ ID NO: 549306 - protein, 13 aa, Mycobacterium
QARKNAKTGKGNG

SEQ ID NO: 549307 - protein, 5 aa, Mycobacterium
QARLG

SEQ ID NO: 549308 - protein, 12 aa, Mycobacterium
QARLGSARPYAE

SEQ ID NO: 549309 - protein, 33 aa, Mycobacterium
QARLTTPPAVPTSASPPGTAPSGPAPPDDEPPP

SEQ ID NO: 549310 - protein, 9 aa, Mycobacterium
QARNAPSGE

SEQ ID NO: 549311 - protein, 7 aa, Mycobacterium
QARNCGS

SEQ ID NO: 549312 - protein, 6 aa, Mycobacterium
QARNLA

SEQ ID NO: 549313 - protein, 18 aa, Mycobacterium
QARNRWQAATGEALPGLT

SEQ ID NO: 549314 - protein, 4 aa, Mycobacterium
QARP

SEQ ID NO: 549315 - protein, 5 aa, Mycobacterium
QARPA

SEQ ID NO: 549316 - protein, 7 aa, Mycobacterium
QARPADT

SEQ ID NO: 549317 - protein, 18 aa, Mycobacterium
QARPAPRGHSVPVPGELG

SEQ ID NO: 549318 - protein, 7 aa, Mycobacterium
QARPDAP

SEQ ID NO: 549319 - protein, 7 aa, Mycobacterium
QARPDAT

SEQ ID NO: 549320 - protein, 5 aa, Mycobacterium
QARPH

SEQ ID NO: 549321 - protein, 5 aa, Mycobacterium
QARPI

SEQ ID NO: 549322 - protein, 7 aa, Mycobacterium
QARPRLD

SEQ ID NO: 549323 - protein, 4 aa, Mycobacterium
QARQ

SEQ ID NO: 549324 - protein, 7 aa, Mycobacterium
QARQAGV

SEQ ID NO: 549325 - protein, 16 aa, Mycobacterium
QARQGAARSTVARRTS

SEQ ID NO: 549326 - protein, 7 aa, Mycobacterium
QARQKNK

SEQ ID NO: 549327 - protein, 8 aa, Mycobacterium
QARQRSEL

SEQ ID NO: 549328 - protein, 10 aa, Mycobacterium
QARRAAAAAP

SEQ ID NO: 549329 - protein, 7 aa, Mycobacterium
QARRAEH

SEQ ID NO: 549330 - protein, 5 aa, Mycobacterium
QARRD

SEQ ID NO: 549331 - protein, 6 aa, Mycobacterium
QARRDD

SEQ ID NO: 549332 - protein, 6 aa, Mycobacterium
QARRDR

SEQ ID NO: 549333 - protein, 8 aa, Mycobacterium
QARRDYDA

SEQ ID NO: 549334 - protein, 13 aa, Mycobacterium
QARREAGSDNPAK

SEQ ID NO: 549335 - protein, 23 aa, Mycobacterium
QARRERAEAISRRRTDRRPFRAP

SEQ ID NO: 549336 - protein, 8 aa, Mycobacterium
QARRGNSP

SEQ ID NO: 549337 - protein, 7 aa, Mycobacterium
QARRQGY

SEQ ID NO: 549338 - protein, 6 aa, Mycobacterium
QARRRP

SEQ ID NO: 549339 - protein, 10 aa, Mycobacterium
QARRSVEEIG

SEQ ID NO: 549340 - protein, 7 aa, Mycobacterium
QARRTPH

SEQ ID NO: 549341 - protein, 10 aa, Mycobacterium
QARRYGPEKV

SEQ ID NO: 549342 - protein, 7 aa, Mycobacterium
QARSDRQ

SEQ ID NO: 549343 - protein, 16 aa, Mycobacterium
QARSEYQSGVAAEDYR

SEQ ID NO: 549344 - protein, 9 aa, Mycobacterium
QARSGAELT

SEQ ID NO: 549345 - protein, 8 aa, Mycobacterium
QARSLDEQ

SEQ ID NO: 549346 - protein, 10 aa, Mycobacterium
QARSNEGSGI

SEQ ID NO: 549347 - protein, 14 aa, Mycobacterium
QARSPQSRAHRAPV

SEQ ID NO: 549348 - protein, 9 aa, Mycobacterium
QARSQQAAR

SEQ ID NO: 549349 - protein, 13 aa, Mycobacterium
QARSRNTSGASNS

SEQ ID NO: 549350 - protein, 15 aa, Mycobacterium
QARTADPAAEFADPD

SEQ ID NO: 549351 - protein, 8 aa, Mycobacterium
QARTEAVQ

SEQ ID NO: 549352 - protein, 34 aa, Mycobacterium
QARTEQLNKESAARLAKQNADKAAADAKSSQDAA

SEQ ID NO: 549353 - protein, 6 aa, Mycobacterium
QARTGM

SEQ ID NO: 549354 - protein, 8 aa, Mycobacterium
QARTGMGK

SEQ ID NO: 549355 - protein, 12 aa, Mycobacterium
QARTQATEGAVD

SEQ ID NO: 549356 - protein, 7 aa, Mycobacterium
QARTQGL

SEQ ID NO: 549357 - protein, 7 aa, Mycobacterium
QARTQYE

SEQ ID NO: 549358 - protein, 11 aa, Mycobacterium
QARTRSAANTP

SEQ ID NO: 549359 - protein, 9 aa, Mycobacterium
QARTTDPDI

SEQ ID NO: 549360 - protein, 6 aa, Mycobacterium
QARVSR

SEQ ID NO: 549361 - protein, 10 aa, Mycobacterium
QARVTKQTAG

SEQ ID NO: 549362 - protein, 28 aa, Mycobacterium
QARWRDSAGEEHEARLGEPLSAEQTARA

SEQ ID NO: 549363 - protein, 10 aa, Mycobacterium
QARYAARGSD

SEQ ID NO: 549364 - protein, 4 aa, Mycobacterium
QASA

SEQ ID NO: 549365 - protein, 8 aa, Mycobacterium
QASAAGEI

SEQ ID NO: 549366 - protein, 14 aa, Mycobacterium
QASAALDAGDPDRA

SEQ ID NO: 549367 - protein, 11 aa, Mycobacterium
QASAAQRAGRC

SEQ ID NO: 549368 - protein, 10 aa, Mycobacterium
QASADLERQV

SEQ ID NO: 549369 - protein, 9 aa, Mycobacterium
QASAEELGG

SEQ ID NO: 549370 - protein, 7 aa, Mycobacterium
QASAEGL

SEQ ID NO: 549371 - protein, 12 aa, Mycobacterium
QASAFRSGTDIS

SEQ ID NO: 549372 - protein, 13 aa, Mycobacterium
QASAPLDAERGPG

SEQ ID NO: 549373 - protein, 9 aa, Mycobacterium
QASARGSTR

SEQ ID NO: 549374 - protein, 6 aa, Mycobacterium
QASARR

SEQ ID NO: 549375 - protein, 8 aa, Mycobacterium
QASATAAV

SEQ ID NO: 549376 - protein, 7 aa, Mycobacterium
QASATPH

SEQ ID NO: 549377 - protein, 4 aa, Mycobacterium
QASD

SEQ ID NO: 549378 - protein, 6 aa, Mycobacterium
QASDAV

SEQ ID NO: 549379 - protein, 8 aa, Mycobacterium
QASDDGAR

SEQ ID NO: 549380 - protein, 7 aa, Mycobacterium
QASDEVE

SEQ ID NO: 549381 - protein, 4 aa, Mycobacterium
QASE

SEQ ID NO: 549382 - protein, 15 aa, Mycobacterium
QASEEELGGRPPSAL

SEQ ID NO: 549383 - protein, 5 aa, Mycobacterium
QASEP

SEQ ID NO: 549384 - protein, 4 aa, Mycobacterium
QASG

SEQ ID NO: 549385 - protein, 17 aa, Mycobacterium
QASGAANPHSRDSITKG

SEQ ID NO: 549386 - protein, 5 aa, Mycobacterium
QASGI

SEQ ID NO: 549387 - protein, 13 aa, Mycobacterium
QASGLDDEAARAR

SEQ ID NO: 549388 - protein, 6 aa, Mycobacterium
QASGLP

SEQ ID NO: 549389 - protein, 9 aa, Mycobacterium
QASGRDHPA

SEQ ID NO: 549390 - protein, 8 aa, Mycobacterium
QASGRSEF

SEQ ID NO: 549391 - protein, 11 aa, Mycobacterium
QASGTGAGGVI

SEQ ID NO: 549392 - protein, 5 aa, Mycobacterium
QASHD

SEQ ID NO: 549393 - protein, 9 aa, Mycobacterium
QASHGRIPD

SEQ ID NO: 549394 - protein, 6 aa, Mycobacterium
QASHHR

SEQ ID NO: 549395 - protein, 6 aa, Mycobacterium
QASKGA

SEQ ID NO: 549396 - protein, 9 aa, Mycobacterium
QASKMTKTV

SEQ ID NO: 549397 - protein, 7 aa, Mycobacterium
QASKNAA

SEQ ID NO: 549398 - protein, 15 aa, Mycobacterium
QASLEQTRNALTDKE

SEQ ID NO: 549399 - protein, 5 aa, Mycobacterium
QASLN

SEQ ID NO: 549400 - protein, 8 aa, Mycobacterium
QASNPKYL

SEQ ID NO: 549401 - protein, 13 aa, Mycobacterium
QASPAAVGAHDKD

SEQ ID NO: 549402 - protein, 10 aa, Mycobacterium
QASPADRPAV

SEQ ID NO: 549403 - protein, 11 aa, Mycobacterium
QASPEERSTDD

SEQ ID NO: 549404 - protein, 8 aa, Mycobacterium
QASPELSA

SEQ ID NO: 549405 - protein, 8 aa, Mycobacterium
QASPSDMN

SEQ ID NO: 549406 - protein, 8 aa, Mycobacterium
QASPSQEC

SEQ ID NO: 549407 - protein, 14 aa, Mycobacterium
QASPSRISPSISST

SEQ ID NO: 549408 - protein, 7 aa, Mycobacterium
QASQGAR

SEQ ID NO: 549409 - protein, 9 aa, Mycobacterium
QASQLGTAT

SEQ ID NO: 549410 - protein, 7 aa, Mycobacterium
QASQNPF

SEQ ID NO: 549411 - protein, 9 aa, Mycobacterium
QASQPAEPD

SEQ ID NO: 549412 - protein, 7 aa, Mycobacterium
QASQSTL

SEQ ID NO: 549413 - protein, 4 aa, Mycobacterium
QASR

SEQ ID NO: 549414 - protein, 6 aa, Mycobacterium
QASRAT

SEQ ID NO: 549415 - protein, 5 aa, Mycobacterium
QASRI

SEQ ID NO: 549416 - protein, 8 aa, Mycobacterium
QASRSGDA

SEQ ID NO: 549417 - protein, 7 aa, Mycobacterium
QASRTQF

SEQ ID NO: 549418 - protein, 6 aa, Mycobacterium
QASSPA

SEQ ID NO: 549419 - protein, 12 aa, Mycobacterium
QASSPAPDRPLE

SEQ ID NO: 549420 - protein, 7 aa, Mycobacterium
QASSRGV

SEQ ID NO: 549421 - protein, 8 aa, Mycobacterium
QASSRSEY

SEQ ID NO: 549422 - protein, 9 aa, Mycobacterium
QASSRYPGG

SEQ ID NO: 549423 - protein, 16 aa, Mycobacterium
QASSTAPVDLSGSDAL

SEQ ID NO: 549424 - protein, 20 aa, Mycobacterium
QASTHRDGRVPTTPGADRTA

SEQ ID NO: 549425 - protein, 10 aa, Mycobacterium
QASTVSSGSI

SEQ ID NO: 549426 - protein, 5 aa, Mycobacterium
QASVD

SEQ ID NO: 549427 - protein, 16 aa, Mycobacterium
QASVTSAKRLGRPEEV

SEQ ID NO: 549428 - protein, 6 aa, Mycobacterium
QASYRS

SEQ ID NO: 549429 - protein, 4 aa, Mycobacterium
QATA

SEQ ID NO: 549430 - protein, 8 aa, Mycobacterium
QATAATGG

SEQ ID NO: 549431 - protein, 16 aa, Mycobacterium
QATAEATRDKQPVPHA

SEQ ID NO: 549432 - protein, 6 aa, Mycobacterium
QATAEK

SEQ ID NO: 549433 - protein, 14 aa, Mycobacterium
QATAERPQQRAAQR

SEQ ID NO: 549434 - protein, 18 aa, Mycobacterium
QATAHSQPSARGHEPIDP

SEQ ID NO: 549435 - protein, 7 aa, Mycobacterium
QATARPA

SEQ ID NO: 549436 - protein, 8 aa, Mycobacterium
QATATAAE

SEQ ID NO: 549437 - protein, 11 aa, Mycobacterium
QATDATLDPAR

SEQ ID NO: 549438 - protein, 9 aa, Mycobacterium
QATDKQLAA

SEQ ID NO: 549439 - protein, 7 aa, Mycobacterium
QATDPGV

SEQ ID NO: 549440 - protein, 5 aa, Mycobacterium
QATDS

SEQ ID NO: 549441 - protein, 11 aa, Mycobacterium
QATEGDRPIDA

SEQ ID NO: 549442 - protein, 8 aa, Mycobacterium
QATGAGEQ

SEQ ID NO: 549443 - protein, 7 aa, Mycobacterium
QATGATG

SEQ ID NO: 549444 - protein, 7 aa, Mycobacterium
QATGISN

SEQ ID NO: 549445 - protein, 9 aa, Mycobacterium
QATGLPTST

SEQ ID NO: 549446 - protein, 5 aa, Mycobacterium
QATGR

SEQ ID NO: 549447 - protein, 14 aa, Mycobacterium
QATGTTSDGTSYDS

SEQ ID NO: 549448 - protein, 5 aa, Mycobacterium
QATIG

SEQ ID NO: 549449 - protein, 5 aa, Mycobacterium
QATKD

SEQ ID NO: 549450 - protein, 12 aa, Mycobacterium
QATKDLPAATGE

SEQ ID NO: 549451 - protein, 9 aa, Mycobacterium
QATKGRAPF

SEQ ID NO: 549452 - protein, 4 aa, Mycobacterium
QATL

SEQ ID NO: 549453 - protein, 13 aa, Mycobacterium
QATLEDNSRTGEQ

SEQ ID NO: 549454 - protein, 23 aa, Mycobacterium
QATNAGTDRAPVTPHNPSRSISA

SEQ ID NO: 549455 - protein, 30 aa, Mycobacterium
QATNGHQTPAERAIATDRKATQERQTTEDN

SEQ ID NO: 549456 - protein, 5 aa, Mycobacterium
QATNQ

SEQ ID NO: 549457 - protein, 4 aa, Mycobacterium
QATP

SEQ ID NO: 549458 - protein, 5 aa, Mycobacterium
QATPA

SEQ ID NO: 549459 - protein, 8 aa, Mycobacterium
QATPAGVA

SEQ ID NO: 549460 - protein, 6 aa, Mycobacterium
QATPDA

SEQ ID NO: 549461 - protein, 10 aa, Mycobacterium
QATPDDAEAL

SEQ ID NO: 549462 - protein, 9 aa, Mycobacterium
QATPEGASA

SEQ ID NO: 549463 - protein, 11 aa, Mycobacterium
QATPGDAFTDE

SEQ ID NO: 549464 - protein, 12 aa, Mycobacterium
QATPGDSFTDEA

SEQ ID NO: 549465 - protein, 8 aa, Mycobacterium
QATPGQTI

SEQ ID NO: 549466 - protein, 10 aa, Mycobacterium
QATQDDPQFP

SEQ ID NO: 549467 - protein, 7 aa, Mycobacterium
QATQQSP

SEQ ID NO: 549468 - protein, 27 aa, Mycobacterium
QATQTQPLAEAPAAALPEPLPAGPVRR

SEQ ID NO: 549469 - protein, 4 aa, Mycobacterium
QATR

SEQ ID NO: 549470 - protein, 6 aa, Mycobacterium
QATRDA

SEQ ID NO: 549471 - protein, 14 aa, Mycobacterium
QATRSAKASGGNNV

SEQ ID NO: 549472 - protein, 8 aa, Mycobacterium
QATRTPDA

SEQ ID NO: 549473 - protein, 11 aa, Mycobacterium
QATRTPDAPAL

SEQ ID NO: 549474 - protein, 4 aa, Mycobacterium
QATS

SEQ ID NO: 549475 - protein, 12 aa, Mycobacterium
QATSAQATGQLS

SEQ ID NO: 549476 - protein, 7 aa, Mycobacterium
QATSDVG

SEQ ID NO: 549477 - protein, 11 aa, Mycobacterium
QATSEIKTGPA

SEQ ID NO: 549478 - protein, 7 aa, Mycobacterium
QATSIPE

SEQ ID NO: 549479 - protein, 5 aa, Mycobacterium
QATSR

SEQ ID NO: 549480 - protein, 8 aa, Mycobacterium
QATSRPPT

SEQ ID NO: 549481 - protein, 8 aa, Mycobacterium
QATSSGAG

SEQ ID NO: 549482 - protein, 7 aa, Mycobacterium
QATSTLG

SEQ ID NO: 549483 - protein, 9 aa, Mycobacterium
QATTAGTGG

SEQ ID NO: 549484 - protein, 6 aa, Mycobacterium
QATTAR

SEQ ID NO: 549485 - protein, 6 aa, Mycobacterium
QATTEN

SEQ ID NO: 549486 - protein, 32 aa, Mycobacterium
QATTGAVKAGAEGYGSNEVTAAGEMAAVRPRM

SEQ ID NO: 549487 - protein, 37 aa, Mycobacterium
QATTNSYNHPTSRTGTSTARSRGNGPSLREESISSMR

SEQ ID NO: 549488 - protein, 13 aa, Mycobacterium
QATTPDANGVERR

SEQ ID NO: 549489 - protein, 24 aa, Mycobacterium
QATTQQAGNTAQTVSNTSSQLATP

SEQ ID NO: 549490 - protein, 5 aa, Mycobacterium
QATTS

SEQ ID NO: 549491 - protein, 9 aa, Mycobacterium
QATTSEDRT

SEQ ID NO: 549492 - protein, 7 aa, Mycobacterium
QATTSLP

SEQ ID NO: 549493 - protein, 11 aa, Mycobacterium
QATTSQATGQL

SEQ ID NO: 549494 - protein, 9 aa, Mycobacterium
QATTTTDEL

SEQ ID NO: 549495 - protein, 4 aa, Mycobacterium
QATV

SEQ ID NO: 549496 - protein, 8 aa, Mycobacterium
QATVEAAS

SEQ ID NO: 549497 - protein, 5 aa, Mycobacterium
QATYD

SEQ ID NO: 549498 - protein, 9 aa, Mycobacterium
QAVAGDSQV

SEQ ID NO: 549499 - protein, 10 aa, Mycobacterium
QAVATDAVPA

SEQ ID NO: 549500 - protein, 6 aa, Mycobacterium
QAVDDG

SEQ ID NO: 549501 - protein, 14 aa, Mycobacterium
QAVDEGNVARMQGM

SEQ ID NO: 549502 - protein, 14 aa, Mycobacterium
QAVDGDKKARSARV

SEQ ID NO: 549503 - protein, 9 aa, Mycobacterium
QAVDPDGEV

SEQ ID NO: 549504 - protein, 20 aa, Mycobacterium
QAVEAAARKDARREVLHQRY

SEQ ID NO: 549505 - protein, 10 aa, Mycobacterium
QAVEEQRGRR

SEQ ID NO: 549506 - protein, 16 aa, Mycobacterium
QAVESARAGGSARHQV

SEQ ID NO: 549507 - protein, 6 aa, Mycobacterium
QAVEST

SEQ ID NO: 549508 - protein, 10 aa, Mycobacterium
QAVGAGSEVE

SEQ ID NO: 549509 - protein, 10 aa, Mycobacterium
QAVGGSHEKQ

SEQ ID NO: 549510 - protein, 5 aa, Mycobacterium
QAVGK

SEQ ID NO: 549511 - protein, 16 aa, Mycobacterium
QAVHRDAGLGAAGEHR

SEQ ID NO: 549512 - protein, 4 aa, Mycobacterium
QAVK

SEQ ID NO: 549513 - protein, 5 aa, Mycobacterium
QAVKE

SEQ ID NO: 549514 - protein, 9 aa, Mycobacterium
QAVLDPDND

SEQ ID NO: 549515 - protein, 6 aa, Mycobacterium
QAVNEG

SEQ ID NO: 549516 - protein, 16 aa, Mycobacterium
QAVPDESSRLPENQGS

SEQ ID NO: 549517 - protein, 17 aa, Mycobacterium
QAVPGDAERLPENQGSC

SEQ ID NO: 549518 - protein, 7 aa, Mycobacterium
QAVPGGP

SEQ ID NO: 549519 - protein, 13 aa, Mycobacterium
QAVPGLAPAPTTH

SEQ ID NO: 549520 - protein, 8 aa, Mycobacterium
QAVPSQDA

SEQ ID NO: 549521 - protein, 6 aa, Mycobacterium
QAVQAG

SEQ ID NO: 549522 - protein, 5 aa, Mycobacterium
QAVQN

SEQ ID NO: 549523 - protein, 4 aa, Mycobacterium
QAVR

SEQ ID NO: 549524 - protein, 6 aa, Mycobacterium
QAVRET

SEQ ID NO: 549525 - protein, 21 aa, Mycobacterium
QAVRGAAGSDAPGTAEDHGPQ

SEQ ID NO: 549526 - protein, 10 aa, Mycobacterium
QAVSAPAGDA

SEQ ID NO: 549527 - protein, 13 aa, Mycobacterium
QAVSAQAEALSPR

SEQ ID NO: 549528 - protein, 11 aa, Mycobacterium
QAVSDVPGTGA

SEQ ID NO: 549529 - protein, 9 aa, Mycobacterium
QAVSGSGIA

SEQ ID NO: 549530 - protein, 14 aa, Mycobacterium
QAVSTSAPAQGMTQ

SEQ ID NO: 549531 - protein, 5 aa, Mycobacterium
QAVTA

SEQ ID NO: 549532 - protein, 7 aa, Mycobacterium
QAVTDRP

SEQ ID NO: 549533 - protein, 6 aa, Mycobacterium
QAVTGS

SEQ ID NO: 549534 - protein, 14 aa, Mycobacterium
QAVTSESLQPIGQP

SEQ ID NO: 549535 - protein, 6 aa, Mycobacterium
QAVTST

SEQ ID NO: 549536 - protein, 6 aa, Mycobacterium
QAWARG

SEQ ID NO: 549537 - protein, 11 aa, Mycobacterium
QAWETGDPAQQ

SEQ ID NO: 549538 - protein, 4 aa, Mycobacterium
QAWQ

SEQ ID NO: 549539 - protein, 10 aa, Mycobacterium
QAWQGPAAAA

SEQ ID NO: 549540 - protein, 12 aa, Mycobacterium
QAWQGPASASMR

SEQ ID NO: 549541 - protein, 9 aa, Mycobacterium
QAWQGPAST

SEQ ID NO: 549542 - protein, 5 aa, Mycobacterium
QAWRR

SEQ ID NO: 549543 - protein, 12 aa, Mycobacterium
QAYADTDGADPE

SEQ ID NO: 549544 - protein, 7 aa, Mycobacterium
QAYAGEE

SEQ ID NO: 549545 - protein, 10 aa, Mycobacterium
QAYARDDHEA

SEQ ID NO: 549546 - protein, 15 aa, Mycobacterium
QAYASAEAAAANPLQ

SEQ ID NO: 549547 - protein, 10 aa, Mycobacterium
QAYDTDPELS

SEQ ID NO: 549548 - protein, 51 aa, Mycobacterium
QAYERGDVTAADDLKKRAEQLEGAGASSAAGGSAAGSAASAASSGGQAASQ

SEQ ID NO: 549549 - protein, 4 aa, Mycobacterium
QAYG

SEQ ID NO: 549550 - protein, 6 aa, Mycobacterium
QAYGRR

SEQ ID NO: 549551 - protein, 16 aa, Mycobacterium
QAYNANRHVSTGNPYK

SEQ ID NO: 549552 - protein, 4 aa, Mycobacterium
QAYP

SEQ ID NO: 549553 - protein, 13 aa, Mycobacterium
QAYPAWKPRTLPA

SEQ ID NO: 549554 - protein, 7 aa, Mycobacterium
QAYPGAT

SEQ ID NO: 549555 - protein, 7 aa, Mycobacterium
QAYPGDE

SEQ ID NO: 549556 - protein, 18 aa, Mycobacterium
QAYPGDEIAKAGPTGVGG

SEQ ID NO: 549557 - protein, 8 aa, Mycobacterium
QAYQDGGA

SEQ ID NO: 549558 - protein, 8 aa, Mycobacterium
QAYQEASA

SEQ ID NO: 549559 - protein, 4 aa, Mycobacterium
QAYS

SEQ ID NO: 549560 - protein, 21 aa, Mycobacterium
QAYSRQEPALEEVTDERDHHT

SEQ ID NO: 549561 - protein, 7 aa, Mycobacterium
QAYSSAQ

SEQ ID NO: 549562 - protein, 7 aa, Mycobacterium
QAYSSFS

SEQ ID NO: 549563 - protein, 13 aa, Mycobacterium
QAYTTRAKNYETE

SEQ ID NO: 549564 - protein, 9 aa, Mycobacterium
QCAGTGETL

SEQ ID NO: 549565 - protein, 5 aa, Mycobacterium
QCATR

SEQ ID NO: 549566 - protein, 9 aa, Mycobacterium
QCESETSGV

SEQ ID NO: 549567 - protein, 19 aa, Mycobacterium
QCESGGNWTANTGNGAYGG

SEQ ID NO: 549568 - protein, 10 aa, Mycobacterium
QCESSTGTPL

SEQ ID NO: 549569 - protein, 9 aa, Mycobacterium
QCGPPPWPP

SEQ ID NO: 549570 - protein, 6 aa, Mycobacterium
QCGRDE

SEQ ID NO: 549571 - protein, 6 aa, Mycobacterium
QCGSAQ

SEQ ID NO: 549572 - protein, 15 aa, Mycobacterium
QCGYDSDDDEYGEEV

SEQ ID NO: 549573 - protein, 7 aa, Mycobacterium
QCNEAEQ

SEQ ID NO: 549574 - protein, 21 aa, Mycobacterium
QCNERRSNQPDGTVGRNSGVL

SEQ ID NO: 549575 - protein, 6 aa, Mycobacterium
QCPDGV

SEQ ID NO: 549576 - protein, 10 aa, Mycobacterium
QCPEAPRDAA

SEQ ID NO: 549577 - protein, 4 aa, Mycobacterium
QCPQ

SEQ ID NO: 549578 - protein, 7 aa, Mycobacterium
QCQQTAA

SEQ ID NO: 549579 - protein, 5 aa, Mycobacterium
QCRGQ

SEQ ID NO: 549580 - protein, 9 aa, Mycobacterium
QCRGQVEGS

SEQ ID NO: 549581 - protein, 11 aa, Mycobacterium
QCRPGRPAAGH

SEQ ID NO: 549582 - protein, 10 aa, Mycobacterium
QCSDAPTDIP

SEQ ID NO: 549583 - protein, 6 aa, Mycobacterium
QCTDPD

SEQ ID NO: 549584 - protein, 17 aa, Mycobacterium
QCTPQPLGAKPPPHDRA

SEQ ID NO: 549585 - protein, 7 aa, Mycobacterium
QCTPTRS

SEQ ID NO: 549586 - protein, 8 aa, Mycobacterium
QCTPYPPG

SEQ ID NO: 549587 - protein, 8 aa, Mycobacterium
QCTVSEKQ

SEQ ID NO: 549588 - protein, 6 aa, Mycobacterium
QDAAAA

SEQ ID NO: 549589 - protein, 13 aa, Mycobacterium
QDAACSAPEAGDV

SEQ ID NO: 549590 - protein, 34 aa, Mycobacterium
QDAADAEAADADRRAHAADAAAKFPANEANGQQE

SEQ ID NO: 549591 - protein, 14 aa, Mycobacterium
QDAAEADQRRLNHE

SEQ ID NO: 549592 - protein, 9 aa, Mycobacterium
QDAAEGPRA

SEQ ID NO: 549593 - protein, 7 aa, Mycobacterium
QDAAGEL

SEQ ID NO: 549594 - protein, 10 aa, Mycobacterium
QDAAGPAATH

SEQ ID NO: 549595 - protein, 21 aa, Mycobacterium
QDAAKNDARSTVPGFDHSDDA

SEQ ID NO: 549596 - protein, 12 aa, Mycobacterium
QDAAREVVSAVI

SEQ ID NO: 549597 - protein, 8 aa, Mycobacterium
QDAATQAR

SEQ ID NO: 549598 - protein, 10 aa, Mycobacterium
QDAATRGIAD

SEQ ID NO: 549599 - protein, 5 aa, Mycobacterium
QDADA

SEQ ID NO: 549600 - protein, 13 aa, Mycobacterium
QDADDNRKLAREP

SEQ ID NO: 549601 - protein, 10 aa, Mycobacterium
QDADENSTVP

SEQ ID NO: 549602 - protein, 11 aa, Mycobacterium
QDADGDPVRGV

SEQ ID NO: 549603 - protein, 7 aa, Mycobacterium
QDADGGA

SEQ ID NO: 549604 - protein, 5 aa, Mycobacterium
QDADL

SEQ ID NO: 549605 - protein, 8 aa, Mycobacterium
QDADRQGL

SEQ ID NO: 549606 - protein, 15 aa, Mycobacterium
QDADSQPSAGYSVAT

SEQ ID NO: 549607 - protein, 8 aa, Mycobacterium
QDAEARAY

SEQ ID NO: 549608 - protein, 8 aa, Mycobacterium
QDAEDTLQ

SEQ ID NO: 549609 - protein, 9 aa, Mycobacterium
QDAEEAGFS

SEQ ID NO: 549610 - protein, 5 aa, Mycobacterium
QDAEL

SEQ ID NO: 549611 - protein, 7 aa, Mycobacterium
QDAELTP

SEQ ID NO: 549612 - protein, 8 aa, Mycobacterium
QDAEQYGR

SEQ ID NO: 549613 - protein, 4 aa, Mycobacterium
QDAG

SEQ ID NO: 549614 - protein, 9 aa, Mycobacterium
QDAGAGGAA

SEQ ID NO: 549615 - protein, 7 aa, Mycobacterium
QDAGAPV

SEQ ID NO: 549616 - protein, 9 aa, Mycobacterium
QDAGDDTVD

SEQ ID NO: 549617 - protein, 10 aa, Mycobacterium
QDAGDDTVDA

SEQ ID NO: 549618 - protein, 7 aa, Mycobacterium
QDAGDDV

SEQ ID NO: 549619 - protein, 7 aa, Mycobacterium
QDAGGEV

SEQ ID NO: 549620 - protein, 7 aa, Mycobacterium
QDAGGPA

SEQ ID NO: 549621 - protein, 8 aa, Mycobacterium
QDAGNSRA

SEQ ID NO: 549622 - protein, 4 aa, Mycobacterium
QDAH

SEQ ID NO: 549623 - protein, 11 aa, Mycobacterium
QDAKSADANLA

SEQ ID NO: 549624 - protein, 7 aa, Mycobacterium
QDALAGN

SEQ ID NO: 549625 - protein, 18 aa, Mycobacterium
QDALNERTLRRSEGAMGP

SEQ ID NO: 549626 - protein, 5 aa, Mycobacterium
QDANT

SEQ ID NO: 549627 - protein, 10 aa, Mycobacterium
QDAPAGGDPL

SEQ ID NO: 549628 - protein, 7 aa, Mycobacterium
QDAPRRP

SEQ ID NO: 549629 - protein, 8 aa, Mycobacterium
QDAPRSMR

SEQ ID NO: 549630 - protein, 9 aa, Mycobacterium
QDAPSCPGW

SEQ ID NO: 549631 - protein, 9 aa, Mycobacterium
QDAPSGPLD

SEQ ID NO: 549632 - protein, 10 aa, Mycobacterium
QDAPTGGDPL

SEQ ID NO: 549633 - protein, 8 aa, Mycobacterium
QDAQGWYD

SEQ ID NO: 549634 - protein, 8 aa, Mycobacterium
QDARAAGK

SEQ ID NO: 549635 - protein, 7 aa, Mycobacterium
QDARDGL

SEQ ID NO: 549636 - protein, 5 aa, Mycobacterium
QDARL

SEQ ID NO: 549637 - protein, 10 aa, Mycobacterium
QDARLTPEQQ

SEQ ID NO: 549638 - protein, 6 aa, Mycobacterium
QDARRH

SEQ ID NO: 549639 - protein, 5 aa, Mycobacterium
QDART

SEQ ID NO: 549640 - protein, 5 aa, Mycobacterium
QDASA

SEQ ID NO: 549641 - protein, 8 aa, Mycobacterium
QDASGRYR

SEQ ID NO: 549642 - protein, 17 aa, Mycobacterium
QDASGVTGTIQRSEALA

SEQ ID NO: 549643 - protein, 8 aa, Mycobacterium
QDASPGAI

SEQ ID NO: 549644 - protein, 23 aa, Mycobacterium
QDASWPSRKSRLAPVEQVASCVS

SEQ ID NO: 549645 - protein, 23 aa, Mycobacterium
QDASWPSRTPSFTPIERATSCLT

SEQ ID NO: 549646 - protein, 13 aa, Mycobacterium
QDATETGPGYASA

SEQ ID NO: 549647 - protein, 8 aa, Mycobacterium
QDATPPAA

SEQ ID NO: 549648 - protein, 14 aa, Mycobacterium
QDATWRRNRAGNEL

SEQ ID NO: 549649 - protein, 8 aa, Mycobacterium
QDAVEHAD

SEQ ID NO: 549650 - protein, 7 aa, Mycobacterium
QDAVNSG

SEQ ID NO: 549651 - protein, 5 aa, Mycobacterium
QDCTA

SEQ ID NO: 549652 - protein, 4 aa, Mycobacterium
QDDA

SEQ ID NO: 549653 - protein, 7 aa, Mycobacterium
QDDAETW

SEQ ID NO: 549654 - protein, 6 aa, Mycobacterium
QDDAHG

SEQ ID NO: 549655 - protein, 13 aa, Mycobacterium
QDDDDTPDDYETG

SEQ ID NO: 549656 - protein, 7 aa, Mycobacterium
QDDDHSV

SEQ ID NO: 549657 - protein, 5 aa, Mycobacterium
QDDDR

SEQ ID NO: 549658 - protein, 5 aa, Mycobacterium
QDDEI

SEQ ID NO: 549659 - protein, 4 aa, Mycobacterium
QDDG

SEQ ID NO: 549660 - protein, 5 aa, Mycobacterium
QDDGV

SEQ ID NO: 549661 - protein, 4 aa, Mycobacterium
QDDI

SEQ ID NO: 549662 - protein, 7 aa, Mycobacterium
QDDKDAE

SEQ ID NO: 549663 - protein, 13 aa, Mycobacterium
QDDLTTAQAADRV

SEQ ID NO: 549664 - protein, 6 aa, Mycobacterium
QDDNFT

SEQ ID NO: 549665 - protein, 13 aa, Mycobacterium
QDDPAAGAAASAA

SEQ ID NO: 549666 - protein, 22 aa, Mycobacterium
QDDPAAGAAASAARIATTTCDQ

SEQ ID NO: 549667 - protein, 6 aa, Mycobacterium
QDDPYP

SEQ ID NO: 549668 - protein, 7 aa, Mycobacterium
QDDQGWL

SEQ ID NO: 549669 - protein, 10 aa, Mycobacterium
QDDRDKIPGA

SEQ ID NO: 549670 - protein, 9 aa, Mycobacterium
QDDRDVADD

SEQ ID NO: 549671 - protein, 13 aa, Mycobacterium
QDDSKDRDRAGGD

SEQ ID NO: 549672 - protein, 4 aa, Mycobacterium
QDDT

SEQ ID NO: 549673 - protein, 5 aa, Mycobacterium
QDDTG

SEQ ID NO: 549674 - protein, 4 aa, Mycobacterium
QDDV

SEQ ID NO: 549675 - protein, 7 aa, Mycobacterium
QDDVDAV

SEQ ID NO: 549676 - protein, 13 aa, Mycobacterium
QDDWKGTLTPRNT

SEQ ID NO: 549677 - protein, 7 aa, Mycobacterium
QDEADER

SEQ ID NO: 549678 - protein, 8 aa, Mycobacterium
QDEAERGD

SEQ ID NO: 549679 - protein, 6 aa, Mycobacterium
QDEAGP

SEQ ID NO: 549680 - protein, 9 aa, Mycobacterium
QDEAGPGAK

SEQ ID NO: 549681 - protein, 14 aa, Mycobacterium
QDEAKRLAGEVDRR

SEQ ID NO: 549682 - protein, 7 aa, Mycobacterium
QDEDGAV

SEQ ID NO: 549683 - protein, 11 aa, Mycobacterium
QDEDGQSFTDQ

SEQ ID NO: 549684 - protein, 8 aa, Mycobacterium
QDEDNSVA

SEQ ID NO: 549685 - protein, 8 aa, Mycobacterium
QDEEHSVS

SEQ ID NO: 549686 - protein, 9 aa, Mycobacterium
QDEEQSVSR

SEQ ID NO: 549687 - protein, 5 aa, Mycobacterium
QDEFD

SEQ ID NO: 549688 - protein, 5 aa, Mycobacterium
QDEHD

SEQ ID NO: 549689 - protein, 6 aa, Mycobacterium
QDEHDQ

SEQ ID NO: 549690 - protein, 11 aa, Mycobacterium
QDEKGEALAKE

SEQ ID NO: 549691 - protein, 6 aa, Mycobacterium
QDEKPD

SEQ ID NO: 549692 - protein, 4 aa, Mycobacterium
QDEL

SEQ ID NO: 549693 - protein, 7 aa, Mycobacterium
QDELDPG

SEQ ID NO: 549694 - protein, 5 aa, Mycobacterium
QDELT

SEQ ID NO: 549695 - protein, 7 aa, Mycobacterium
QDENETA

SEQ ID NO: 549696 - protein, 9 aa, Mycobacterium
QDENGWYDT

SEQ ID NO: 549697 - protein, 8 aa, Mycobacterium
QDENGWYN

SEQ ID NO: 549698 - protein, 7 aa, Mycobacterium
QDEPEVA

SEQ ID NO: 549699 - protein, 22 aa, Mycobacterium
QDEQARTADQIAQDADASALPE

SEQ ID NO: 549700 - protein, 8 aa, Mycobacterium
QDEQLQKR

SEQ ID NO: 549701 - protein, 24 aa, Mycobacterium
QDEQLQRRAAQAVPAAVSAPPSMH

SEQ ID NO: 549702 - protein, 7 aa, Mycobacterium
QDEQTRV

SEQ ID NO: 549703 - protein, 7 aa, Mycobacterium
QDEREIA

SEQ ID NO: 549704 - protein, 4 aa, Mycobacterium
QDES

SEQ ID NO: 549705 - protein, 12 aa, Mycobacterium
QDESPAPDAAVS

SEQ ID NO: 549706 - protein, 7 aa, Mycobacterium
QDESPTM

SEQ ID NO: 549707 - protein, 5 aa, Mycobacterium
QDESV

SEQ ID NO: 549708 - protein, 4 aa, Mycobacterium
QDET

SEQ ID NO: 549709 - protein, 6 aa, Mycobacterium
QDETNL

SEQ ID NO: 549710 - protein, 5 aa, Mycobacterium
QDEWP

SEQ ID NO: 549711 - protein, 7 aa, Mycobacterium
QDEYGED

SEQ ID NO: 549712 - protein, 11 aa, Mycobacterium
QDFAPPPPRYQ

SEQ ID NO: 549713 - protein, 9 aa, Mycobacterium
QDFDGDNAP

SEQ ID NO: 549714 - protein, 9 aa, Mycobacterium
QDFDTAENA

SEQ ID NO: 549715 - protein, 12 aa, Mycobacterium
QDFESRPRYTDP

SEQ ID NO: 549716 - protein, 13 aa, Mycobacterium
QDFNGSASGGKKI

SEQ ID NO: 549717 - protein, 7 aa, Mycobacterium
QDFPEEP

SEQ ID NO: 549718 - protein, 10 aa, Mycobacterium
QDFPPPPPPV

SEQ ID NO: 549719 - protein, 5 aa, Mycobacterium
QDFRS

SEQ ID NO: 549720 - protein, 5 aa, Mycobacterium
QDFTA

SEQ ID NO: 549721 - protein, 12 aa, Mycobacterium
QDFTGSAARARR

SEQ ID NO: 549722 - protein, 9 aa, Mycobacterium
QDFTSRDGG

SEQ ID NO: 549723 - protein, 16 aa, Mycobacterium
QDGAAARSARQTPAEG

SEQ ID NO: 549724 - protein, 14 aa, Mycobacterium
QDGAIGDSEQEQGR

SEQ ID NO: 549725 - protein, 14 aa, Mycobacterium
QDGAPDPACARGTL

SEQ ID NO: 549726 - protein, 9 aa, Mycobacterium
QDGAPDPYC

SEQ ID NO: 549727 - protein, 6 aa, Mycobacterium
QDGAQR

SEQ ID NO: 549728 - protein, 4 aa, Mycobacterium
QDGD

SEQ ID NO: 549729 - protein, 10 aa, Mycobacterium
QDGDAGTVAR

SEQ ID NO: 549730 - protein, 7 aa, Mycobacterium
QDGDEMG

SEQ ID NO: 549731 - protein, 7 aa, Mycobacterium
QDGDGTR

SEQ ID NO: 549732 - protein, 6 aa, Mycobacterium
QDGDQF

SEQ ID NO: 549733 - protein, 10 aa, Mycobacterium
QDGDTAKGTA

SEQ ID NO: 549734 - protein, 5 aa, Mycobacterium
QDGEL

SEQ ID NO: 549735 - protein, 7 aa, Mycobacterium
QDGEPYL

SEQ ID NO: 549736 - protein, 8 aa, Mycobacterium
QDGFGAAD

SEQ ID NO: 549737 - protein, 4 aa, Mycobacterium
QDGG

SEQ ID NO: 549738 - protein, 8 aa, Mycobacterium
QDGGGSTF

SEQ ID NO: 549739 - protein, 7 aa, Mycobacterium
QDGGHSC

SEQ ID NO: 549740 - protein, 7 aa, Mycobacterium
QDGGHSF

SEQ ID NO: 549741 - protein, 10 aa, Mycobacterium
QDGGHSFGSE

SEQ ID NO: 549742 - protein, 6 aa, Mycobacterium
QDGGTA

SEQ ID NO: 549743 - protein, 9 aa, Mycobacterium
QDGHEETLA

SEQ ID NO: 549744 - protein, 5 aa, Mycobacterium
QDGHG

SEQ ID NO: 549745 - protein, 17 aa, Mycobacterium
QDGHGDLAGAQAAARTG

SEQ ID NO: 549746 - protein, 6 aa, Mycobacterium
QDGIGG

SEQ ID NO: 549747 - protein, 6 aa, Mycobacterium
QDGIPD

SEQ ID NO: 549748 - protein, 14 aa, Mycobacterium
QDGKGYASGTQLGE

SEQ ID NO: 549749 - protein, 5 aa, Mycobacterium
QDGLD

SEQ ID NO: 549750 - protein, 8 aa, Mycobacterium
QDGLGRRV

SEQ ID NO: 549751 - protein, 6 aa, Mycobacterium
QDGLPA

SEQ ID NO: 549752 - protein, 9 aa, Mycobacterium
QDGNNRSDI

SEQ ID NO: 549753 - protein, 7 aa, Mycobacterium
QDGPAAV

SEQ ID NO: 549754 - protein, 7 aa, Mycobacterium
QDGPAHG

SEQ ID NO: 549755 - protein, 7 aa, Mycobacterium
QDGPATV

SEQ ID NO: 549756 - protein, 10 aa, Mycobacterium
QDGPIGTGVS

SEQ ID NO: 549757 - protein, 21 aa, Mycobacterium
QDGPQVDRDSYATDPAPSKGE

SEQ ID NO: 549758 - protein, 5 aa, Mycobacterium
QDGPR

SEQ ID NO: 549759 - protein, 20 aa, Mycobacterium
QDGPTDERDNDEAGATASAA

SEQ ID NO: 549760 - protein, 13 aa, Mycobacterium
QDGPWESDGIRRA

SEQ ID NO: 549761 - protein, 4 aa, Mycobacterium
QDGQ

SEQ ID NO: 549762 - protein, 7 aa, Mycobacterium
QDGQPIE

SEQ ID NO: 549763 - protein, 9 aa, Mycobacterium
QDGQPTEKK

SEQ ID NO: 549764 - protein, 15 aa, Mycobacterium
QDGRDPAGISTQDAE

SEQ ID NO: 549765 - protein, 7 aa, Mycobacterium
QDGRFGN

SEQ ID NO: 549766 - protein, 11 aa, Mycobacterium
QDGRGGGGQGM

SEQ ID NO: 549767 - protein, 8 aa, Mycobacterium
QDGRKSPD

SEQ ID NO: 549768 - protein, 13 aa, Mycobacterium
QDGRTATENARAI

SEQ ID NO: 549769 - protein, 6 aa, Mycobacterium
QDGSCS

SEQ ID NO: 549770 - protein, 8 aa, Mycobacterium
QDGSDRPL

SEQ ID NO: 549771 - protein, 16 aa, Mycobacterium
QDGSTSAGRRKETAED

SEQ ID NO: 549772 - protein, 4 aa, Mycobacterium
QDGT

SEQ ID NO: 549773 - protein, 10 aa, Mycobacterium
QDGTEDNYTY

SEQ ID NO: 549774 - protein, 17 aa, Mycobacterium
QDGTGVTGTVQRSEALT

SEQ ID NO: 549775 - protein, 19 aa, Mycobacterium
QDGTPKRVGTRLTNPAYAK

SEQ ID NO: 549776 - protein, 11 aa, Mycobacterium
QDGTPVPTCGR

SEQ ID NO: 549777 - protein, 5 aa, Mycobacterium
QDGTT

SEQ ID NO: 549778 - protein, 6 aa, Mycobacterium
QDGTVD

SEQ ID NO: 549779 - protein, 4 aa, Mycobacterium
QDGV

SEQ ID NO: 549780 - protein, 6 aa, Mycobacterium
QDGVTV

SEQ ID NO: 549781 - protein, 8 aa, Mycobacterium
QDGYDGRP

SEQ ID NO: 549782 - protein, 7 aa, Mycobacterium
QDGYGLP

SEQ ID NO: 549783 - protein, 13 aa, Mycobacterium
QDHARAADAPDEV

SEQ ID NO: 549784 - protein, 7 aa, Mycobacterium
QDHGAEM

SEQ ID NO: 549785 - protein, 28 aa, Mycobacterium
QDHGPGRAAAASTRAAGGGPTGAHGSTS

SEQ ID NO: 549786 - protein, 8 aa, Mycobacterium
QDHHRGDP

SEQ ID NO: 549787 - protein, 7 aa, Mycobacterium
QDHPAGV

SEQ ID NO: 549788 - protein, 5 aa, Mycobacterium
QDHPP

SEQ ID NO: 549789 - protein, 6 aa, Mycobacterium
QDHPPV

SEQ ID NO: 549790 - protein, 15 aa, Mycobacterium
QDHPRGARGKTLSPR

SEQ ID NO: 549791 - protein, 10 aa, Mycobacterium
QDHRSYAGTV

SEQ ID NO: 549792 - protein, 6 aa, Mycobacterium
QDIDKA

SEQ ID NO: 549793 - protein, 6 aa, Mycobacterium
QDIDRH

SEQ ID NO: 549794 - protein, 18 aa, Mycobacterium
QDIGTGRHGGYAQTARYP

SEQ ID NO: 549795 - protein, 7 aa, Mycobacterium
QDIQGND

SEQ ID NO: 549796 - protein, 4 aa, Mycobacterium
QDIR

SEQ ID NO: 549797 - protein, 7 aa, Mycobacterium
QDISDGD

SEQ ID NO: 549798 - protein, 4 aa, Mycobacterium
QDIT

SEQ ID NO: 549799 - protein, 4 aa, Mycobacterium
QDKD

SEQ ID NO: 549800 - protein, 5 aa, Mycobacterium
QDKEE

SEQ ID NO: 549801 - protein, 11 aa, Mycobacterium
QDKGFDPSEPS

SEQ ID NO: 549802 - protein, 9 aa, Mycobacterium
QDKGKRYNS

SEQ ID NO: 549803 - protein, 5 aa, Mycobacterium
QDKGV

SEQ ID NO: 549804 - protein, 52 aa, Mycobacterium
QDKKPGDDPHTKGSSGDGTGSGNPDSTGTTPGGGADSPAGTGDGTGSGNDPL

SEQ ID NO: 549805 - protein, 6 aa, Mycobacterium
QDKLRT

SEQ ID NO: 549806 - protein, 6 aa, Mycobacterium
QDKQQN

SEQ ID NO: 549807 - protein, 8 aa, Mycobacterium
QDKSDSVA

SEQ ID NO: 549808 - protein, 19 aa, Mycobacterium
QDKTPVERLPADNDAAGAL

SEQ ID NO: 549809 - protein, 8 aa, Mycobacterium
QDKTVTDL

SEQ ID NO: 549810 - protein, 9 aa, Mycobacterium
QDLADEPTA

SEQ ID NO: 549811 - protein, 12 aa, Mycobacterium
QDLASPGDHAQV

SEQ ID NO: 549812 - protein, 11 aa, Mycobacterium
QDLDEEDPVAK

SEQ ID NO: 549813 - protein, 4 aa, Mycobacterium
QDLE

SEQ ID NO: 549814 - protein, 10 aa, Mycobacterium
QDLETRESVG

SEQ ID NO: 549815 - protein, 8 aa, Mycobacterium
QDLGPGAT

SEQ ID NO: 549816 - protein, 6 aa, Mycobacterium
QDLPED

SEQ ID NO: 549817 - protein, 8 aa, Mycobacterium
QDLPFPDK

SEQ ID NO: 549818 - protein, 7 aa, Mycobacterium
QDLPGNT

SEQ ID NO: 549819 - protein, 11 aa, Mycobacterium
QDLPLSDESVD

SEQ ID NO: 549820 - protein, 11 aa, Mycobacterium
QDLPPDGPTEI

SEQ ID NO: 549821 - protein, 12 aa, Mycobacterium
QDLPPGAESDVA

SEQ ID NO: 549822 - protein, 11 aa, Mycobacterium
QDLPPNAQTEI

SEQ ID NO: 549823 - protein, 8 aa, Mycobacterium
QDLPPNAV

SEQ ID NO: 549824 - protein, 17 aa, Mycobacterium
QDLRDAGVSDKTLADPA

SEQ ID NO: 549825 - protein, 6 aa, Mycobacterium
QDLSPD

SEQ ID NO: 549826 - protein, 7 aa, Mycobacterium
QDLSPGE

SEQ ID NO: 549827 - protein, 8 aa, Mycobacterium
QDMAEGPA

SEQ ID NO: 549828 - protein, 7 aa, Mycobacterium
QDMDRAA

SEQ ID NO: 549829 - protein, 31 aa, Mycobacterium
QDNAAGTNPPPFAPWDTPDGTPPPGTGLSPK

SEQ ID NO: 549830 - protein, 8 aa, Mycobacterium
QDNDAARA

SEQ ID NO: 549831 - protein, 9 aa, Mycobacterium
QDNDARTAI

SEQ ID NO: 549832 - protein, 4 aa, Mycobacterium
QDNG

SEQ ID NO: 549833 - protein, 8 aa, Mycobacterium
QDNGATPV

SEQ ID NO: 549834 - protein, 4 aa, Mycobacterium
QDNL

SEQ ID NO: 549835 - protein, 8 aa, Mycobacterium
QDNLSAPN

SEQ ID NO: 549836 - protein, 20 aa, Mycobacterium
QDNPAGPAGEPDWPAYQDGD

SEQ ID NO: 549837 - protein, 10 aa, Mycobacterium
QDNPKEDPRS

SEQ ID NO: 549838 - protein, 14 aa, Mycobacterium
QDNPRRSVRLSFLE

SEQ ID NO: 549839 - protein, 6 aa, Mycobacterium
QDNPTH

SEQ ID NO: 549840 - protein, 8 aa, Mycobacterium
QDNQQLGG

SEQ ID NO: 549841 - protein, 26 aa, Mycobacterium
QDNRGGRGRRDDRGGRGRDGGDKSNY

SEQ ID NO: 549842 - protein, 6 aa, Mycobacterium
QDNSPH

SEQ ID NO: 549843 - protein, 9 aa, Mycobacterium
QDNTADRES

SEQ ID NO: 549844 - protein, 7 aa, Mycobacterium
QDNVELA

SEQ ID NO: 549845 - protein, 14 aa, Mycobacterium
QDPAETTNLAGQER

SEQ ID NO: 549846 - protein, 8 aa, Mycobacterium
QDPAHPRR

SEQ ID NO: 549847 - protein, 6 aa, Mycobacterium
QDPAPD

SEQ ID NO: 549848 - protein, 6 aa, Mycobacterium
QDPARR

SEQ ID NO: 549849 - protein, 14 aa, Mycobacterium
QDPASKAYQPGPSL

SEQ ID NO: 549850 - protein, 6 aa, Mycobacterium
QDPATL

SEQ ID NO: 549851 - protein, 15 aa, Mycobacterium
QDPDAALQAGDAPTL

SEQ ID NO: 549852 - protein, 7 aa, Mycobacterium
QDPDDPG

SEQ ID NO: 549853 - protein, 6 aa, Mycobacterium
QDPDEI

SEQ ID NO: 549854 - protein, 5 aa, Mycobacterium
QDPDK

SEQ ID NO: 549855 - protein, 10 aa, Mycobacterium
QDPDKGTQIT

SEQ ID NO: 549856 - protein, 5 aa, Mycobacterium
QDPDR

SEQ ID NO: 549857 - protein, 15 aa, Mycobacterium
QDPDRWTTTPDNEAK

SEQ ID NO: 549858 - protein, 7 aa, Mycobacterium
QDPDSLR

SEQ ID NO: 549859 - protein, 4 aa, Mycobacterium
QDPE

SEQ ID NO: 549860 - protein, 6 aa, Mycobacterium
QDPEAL

SEQ ID NO: 549861 - protein, 19 aa, Mycobacterium
QDPEATVTAGNSSGQNDAA

SEQ ID NO: 549862 - protein, 9 aa, Mycobacterium
QDPEELRRR

SEQ ID NO: 549863 - protein, 12 aa, Mycobacterium
QDPERWKEGRDG

SEQ ID NO: 549864 - protein, 8 aa, Mycobacterium
QDPETAEA

SEQ ID NO: 549865 - protein, 4 aa, Mycobacterium
QDPG

SEQ ID NO: 549866 - protein, 5 aa, Mycobacterium
QDPGL

SEQ ID NO: 549867 - protein, 6 aa, Mycobacterium
QDPGQI

SEQ ID NO: 549868 - protein, 7 aa, Mycobacterium
QDPGRLE

SEQ ID NO: 549869 - protein, 9 aa, Mycobacterium
QDPGVPGNR

SEQ ID NO: 549870 - protein, 10 aa, Mycobacterium
QDPHNSDRRF

SEQ ID NO: 549871 - protein, 6 aa, Mycobacterium
QDPIRQ

SEQ ID NO: 549872 - protein, 12 aa, Mycobacterium
QDPKAVADRHGA

SEQ ID NO: 549873 - protein, 9 aa, Mycobacterium
QDPKSVDAL

SEQ ID NO: 549874 - protein, 11 aa, Mycobacterium
QDPKTRAYRVG

SEQ ID NO: 549875 - protein, 5 aa, Mycobacterium
QDPLE

SEQ ID NO: 549876 - protein, 6 aa, Mycobacterium
QDPNDP

SEQ ID NO: 549877 - protein, 8 aa, Mycobacterium
QDPPRHRV

SEQ ID NO: 549878 - protein, 6 aa, Mycobacterium
QDPQAL

SEQ ID NO: 549879 - protein, 19 aa, Mycobacterium
QDPQATVTAGNASGQNDAA

SEQ ID NO: 549880 - protein, 5 aa, Mycobacterium
QDPQL

SEQ ID NO: 549881 - protein, 11 aa, Mycobacterium
QDPRAGGRTVA

SEQ ID NO: 549882 - protein, 5 aa, Mycobacterium
QDPRI

SEQ ID NO: 549883 - protein, 16 aa, Mycobacterium
QDPRRAAQIRRDDDAM

SEQ ID NO: 549884 - protein, 8 aa, Mycobacterium
QDPRRGVG

SEQ ID NO: 549885 - protein, 6 aa, Mycobacterium
QDPRSE

SEQ ID NO: 549886 - protein, 12 aa, Mycobacterium
QDPRSREQRRAD

SEQ ID NO: 549887 - protein, 8 aa, Mycobacterium
QDPRYSQQ

SEQ ID NO: 549888 - protein, 4 aa, Mycobacterium
QDPS

SEQ ID NO: 549889 - protein, 18 aa, Mycobacterium
QDPSGGSRTVQVTLGKAE

SEQ ID NO: 549890 - protein, 9 aa, Mycobacterium
QDPSGKGEA

SEQ ID NO: 549891 - protein, 6 aa, Mycobacterium
QDPSVA

SEQ ID NO: 549892 - protein, 14 aa, Mycobacterium
QDPSVGASAIDGRQ

SEQ ID NO: 549893 - protein, 4 aa, Mycobacterium
QDPT

SEQ ID NO: 549894 - protein, 10 aa, Mycobacterium
QDPTAAQQRQ

SEQ ID NO: 549895 - protein, 16 aa, Mycobacterium
QDPTAKMSKSAATDAG

SEQ ID NO: 549896 - protein, 9 aa, Mycobacterium
QDPTGDEGF

SEQ ID NO: 549897 - protein, 9 aa, Mycobacterium
QDPTGNGEA

SEQ ID NO: 549898 - protein, 10 aa, Mycobacterium
QDPTPAQQRQ

SEQ ID NO: 549899 - protein, 7 aa, Mycobacterium
QDPTQSA

SEQ ID NO: 549900 - protein, 16 aa, Mycobacterium
QDPTSKMSKSAATDAG

SEQ ID NO: 549901 - protein, 4 aa, Mycobacterium
QDPV

SEQ ID NO: 549902 - protein, 7 aa, Mycobacterium
QDPVAQR

SEQ ID NO: 549903 - protein, 13 aa, Mycobacterium
QDPVATAASNNPM

SEQ ID NO: 549904 - protein, 20 aa, Mycobacterium
QDPVGPSPFDPDGNGHRGKE

SEQ ID NO: 549905 - protein, 10 aa, Mycobacterium
QDQAHGGRFS

SEQ ID NO: 549906 - protein, 21 aa, Mycobacterium
QDQARDALEAAESGAQQGDPL

SEQ ID NO: 549907 - protein, 4 aa, Mycobacterium
QDQE

SEQ ID NO: 549908 - protein, 6 aa, Mycobacterium
QDQGPW

SEQ ID NO: 549909 - protein, 14 aa, Mycobacterium
QDQNLQDGPHGDLR

SEQ ID NO: 549910 - protein, 13 aa, Mycobacterium
QDQNLQDGPHKDL

SEQ ID NO: 549911 - protein, 5 aa, Mycobacterium
QDQPG

SEQ ID NO: 549912 - protein, 6 aa, Mycobacterium
QDQPVS

SEQ ID NO: 549913 - protein, 22 aa, Mycobacterium
QDQRGRNGIPVRDDRTRHQISP

SEQ ID NO: 549914 - protein, 15 aa, Mycobacterium
QDQSISLSRPDQARS

SEQ ID NO: 549915 - protein, 6 aa, Mycobacterium
QDQSPH

SEQ ID NO: 549916 - protein, 9 aa, Mycobacterium
QDRAAAQAA

SEQ ID NO: 549917 - protein, 11 aa, Mycobacterium
QDRAADPNAGM

SEQ ID NO: 549918 - protein, 8 aa, Mycobacterium
QDRADGVT

SEQ ID NO: 549919 - protein, 10 aa, Mycobacterium
QDRAEPSERT

SEQ ID NO: 549920 - protein, 7 aa, Mycobacterium
QDRAETL

SEQ ID NO: 549921 - protein, 10 aa, Mycobacterium
QDRAFDPDAG

SEQ ID NO: 549922 - protein, 10 aa, Mycobacterium
QDRAPDDAAA

SEQ ID NO: 549923 - protein, 6 aa, Mycobacterium
QDRCAE

SEQ ID NO: 549924 - protein, 4 aa, Mycobacterium
QDRD

SEQ ID NO: 549925 - protein, 5 aa, Mycobacterium
QDRDA

SEQ ID NO: 549926 - protein, 9 aa, Mycobacterium
QDRDAAQAA

SEQ ID NO: 549927 - protein, 9 aa, Mycobacterium
QDRDDTFPA

SEQ ID NO: 549928 - protein, 6 aa, Mycobacterium
QDRDEP

SEQ ID NO: 549929 - protein, 7 aa, Mycobacterium
QDRDLGD

SEQ ID NO: 549930 - protein, 20 aa, Mycobacterium
QDRDLTAATANSIPPTIGGG

SEQ ID NO: 549931 - protein, 5 aa, Mycobacterium
QDRDT

SEQ ID NO: 549932 - protein, 8 aa, Mycobacterium
QDREAARA

SEQ ID NO: 549933 - protein, 12 aa, Mycobacterium
QDREAARGTPER

SEQ ID NO: 549934 - protein, 15 aa, Mycobacterium
QDREAARKERDAARI

SEQ ID NO: 549935 - protein, 7 aa, Mycobacterium
QDREGRK

SEQ ID NO: 549936 - protein, 23 aa, Mycobacterium
QDREPRVPVPESVDSKLADGRLD

SEQ ID NO: 549937 - protein, 7 aa, Mycobacterium
QDRESFG

SEQ ID NO: 549938 - protein, 4 aa, Mycobacterium
QDRG

SEQ ID NO: 549939 - protein, 5 aa, Mycobacterium
QDRGA

SEQ ID NO: 549940 - protein, 8 aa, Mycobacterium
QDRGAAQA

SEQ ID NO: 549941 - protein, 9 aa, Mycobacterium
QDRGAAQTA

SEQ ID NO: 549942 - protein, 6 aa, Mycobacterium
QDRIDA

SEQ ID NO: 549943 - protein, 18 aa, Mycobacterium
QDRITQTVDEYRRKEGLD

SEQ ID NO: 549944 - protein, 9 aa, Mycobacterium
QDRPDEDSF

SEQ ID NO: 549945 - protein, 7 aa, Mycobacterium
QDRPDGL

SEQ ID NO: 549946 - protein, 8 aa, Mycobacterium
QDRPPRDE

SEQ ID NO: 549947 - protein, 9 aa, Mycobacterium
QDRQRDQER

SEQ ID NO: 549948 - protein, 10 aa, Mycobacterium
QDRRGAAEPL

SEQ ID NO: 549949 - protein, 9 aa, Mycobacterium
QDRRPEITS

SEQ ID NO: 549950 - protein, 6 aa, Mycobacterium
QDRRQV

SEQ ID NO: 549951 - protein, 6 aa, Mycobacterium
QDRRRW

SEQ ID NO: 549952 - protein, 6 aa, Mycobacterium
QDRSAA

SEQ ID NO: 549953 - protein, 7 aa, Mycobacterium
QDRSAAQ

SEQ ID NO: 549954 - protein, 11 aa, Mycobacterium
QDRSTAALKPA

SEQ ID NO: 549955 - protein, 8 aa, Mycobacterium
QDRSVPDK

SEQ ID NO: 549956 - protein, 4 aa, Mycobacterium
QDRT

SEQ ID NO: 549957 - protein, 8 aa, Mycobacterium
QDRTAARA

SEQ ID NO: 549958 - protein, 6 aa, Mycobacterium
QDRTGG

SEQ ID NO: 549959 - protein, 6 aa, Mycobacterium
QDRTRW

SEQ ID NO: 549960 - protein, 8 aa, Mycobacterium
QDRTSDYT

SEQ ID NO: 549961 - protein, 12 aa, Mycobacterium
QDRTYKPPPDQC

SEQ ID NO: 549962 - protein, 7 aa, Mycobacterium
QDSAKRT

SEQ ID NO: 549963 - protein, 4 aa, Mycobacterium
QDSD

SEQ ID NO: 549964 - protein, 7 aa, Mycobacterium
QDSDAGR

SEQ ID NO: 549965 - protein, 9 aa, Mycobacterium
QDSDANSKI

SEQ ID NO: 549966 - protein, 6 aa, Mycobacterium
QDSDGE

SEQ ID NO: 549967 - protein, 8 aa, Mycobacterium
QDSDTNEL

SEQ ID NO: 549968 - protein, 7 aa, Mycobacterium
QDSDVAR

SEQ ID NO: 549969 - protein, 4 aa, Mycobacterium
QDSE

SEQ ID NO: 549970 - protein, 8 aa, Mycobacterium
QDSEGNAG

SEQ ID NO: 549971 - protein, 7 aa, Mycobacterium
QDSERAR

SEQ ID NO: 549972 - protein, 10 aa, Mycobacterium
QDSFSDGGKF

SEQ ID NO: 549973 - protein, 4 aa, Mycobacterium
QDSG

SEQ ID NO: 549974 - protein, 11 aa, Mycobacterium
QDSGAPPPFAP

SEQ ID NO: 549975 - protein, 10 aa, Mycobacterium
QDSGEAEPAP

SEQ ID NO: 549976 - protein, 9 aa, Mycobacterium
QDSGGARIQ

SEQ ID NO: 549977 - protein, 8 aa, Mycobacterium
QDSGGNLT

SEQ ID NO: 549978 - protein, 24 aa, Mycobacterium
QDSGLDAEDPDTVHPSERGGGSLG

SEQ ID NO: 549979 - protein, 5 aa, Mycobacterium
QDSGR

SEQ ID NO: 549980 - protein, 10 aa, Mycobacterium
QDSHGGGGLI

SEQ ID NO: 549981 - protein, 8 aa, Mycobacterium
QDSIASGN

SEQ ID NO: 549982 - protein, 6 aa, Mycobacterium
QDSIGN

SEQ ID NO: 549983 - protein, 16 aa, Mycobacterium
QDSIKRSAADTSFPAK

SEQ ID NO: 549984 - protein, 7 aa, Mycobacterium
QDSLPEA

SEQ ID NO: 549985 - protein, 6 aa, Mycobacterium
QDSPAV

SEQ ID NO: 549986 - protein, 13 aa, Mycobacterium
QDSPDGWPQSPTY

SEQ ID NO: 549987 - protein, 6 aa, Mycobacterium
QDSPDR

SEQ ID NO: 549988 - protein, 12 aa, Mycobacterium
QDSPEQAPGSQV

SEQ ID NO: 549989 - protein, 8 aa, Mycobacterium
QDSPRHAV

SEQ ID NO: 549990 - protein, 11 aa, Mycobacterium
QDSQSRSSQGV

SEQ ID NO: 549991 - protein, 8 aa, Mycobacterium
QDSRPPVT

SEQ ID NO: 549992 - protein, 13 aa, Mycobacterium
QDSRWSEKKQQKV

SEQ ID NO: 549993 - protein, 4 aa, Mycobacterium
QDSS

SEQ ID NO: 549994 - protein, 9 aa, Mycobacterium
QDSSGRVTG

SEQ ID NO: 549995 - protein, 10 aa, Mycobacterium
QDSSTARRRE

SEQ ID NO: 549996 - protein, 7 aa, Mycobacterium
QDSTDFD

SEQ ID NO: 549997 - protein, 7 aa, Mycobacterium
QDSTGHS

SEQ ID NO: 549998 - protein, 8 aa, Mycobacterium
QDSTGRVT

SEQ ID NO: 549999 - protein, 5 aa, Mycobacterium
QDSVP

SEQ ID NO: 550000 - protein, 8 aa, Mycobacterium
QDTAAGGD

SEQ ID NO: 550001 - protein, 18 aa, Mycobacterium
QDTADRLTATAKAESDKM

SEQ ID NO: 550002 - protein, 18 aa, Mycobacterium
QDTADRLTGNAKSESEKM

SEQ ID NO: 550003 - protein, 17 aa, Mycobacterium
QDTADRLTSSAKAESEK

SEQ ID NO: 550004 - protein, 18 aa, Mycobacterium
QDTADRLTSTAKAEADKL

SEQ ID NO: 550005 - protein, 5 aa, Mycobacterium
QDTAE

SEQ ID NO: 550006 - protein, 16 aa, Mycobacterium
QDTAENERDQSELGGE

SEQ ID NO: 550007 - protein, 7 aa, Mycobacterium
QDTAGSV

SEQ ID NO: 550008 - protein, 7 aa, Mycobacterium
QDTAKKT

SEQ ID NO: 550009 - protein, 10 aa, Mycobacterium
QDTAPDPEDL

SEQ ID NO: 550010 - protein, 8 aa, Mycobacterium
QDTAPQGY

SEQ ID NO: 550011 - protein, 13 aa, Mycobacterium
QDTARNPGTPSFD

SEQ ID NO: 550012 - protein, 7 aa, Mycobacterium
QDTARQV

SEQ ID NO: 550013 - protein, 7 aa, Mycobacterium
QDTATSV

SEQ ID NO: 550014 - protein, 14 aa, Mycobacterium
QDTDGQWSGSQAGL

SEQ ID NO: 550015 - protein, 5 aa, Mycobacterium
QDTDT

SEQ ID NO: 550016 - protein, 6 aa, Mycobacterium
QDTEEL

SEQ ID NO: 550017 - protein, 7 aa, Mycobacterium
QDTEESE

SEQ ID NO: 550018 - protein, 5 aa, Mycobacterium
QDTEG

SEQ ID NO: 550019 - protein, 17 aa, Mycobacterium
QDTENAMDRVACGVIGT

SEQ ID NO: 550020 - protein, 6 aa, Mycobacterium
QDTGAA

SEQ ID NO: 550021 - protein, 13 aa, Mycobacterium
QDTGGWEADATGL

SEQ ID NO: 550022 - protein, 6 aa, Mycobacterium
QDTGHA

SEQ ID NO: 550023 - protein, 11 aa, Mycobacterium
QDTGNRNSETH

SEQ ID NO: 550024 - protein, 7 aa, Mycobacterium
QDTHGIP

SEQ ID NO: 550025 - protein, 4 aa, Mycobacterium
QDTI

SEQ ID NO: 550026 - protein, 4 aa, Mycobacterium
QDTL

SEQ ID NO: 550027 - protein, 7 aa, Mycobacterium
QDTNTIE

SEQ ID NO: 550028 - protein, 18 aa, Mycobacterium
QDTPDKPETVFLRYPGHQ

SEQ ID NO: 550029 - protein, 6 aa, Mycobacterium
QDTPNG

SEQ ID NO: 550030 - protein, 5 aa, Mycobacterium
QDTPT

SEQ ID NO: 550031 - protein, 4 aa, Mycobacterium
QDTS

SEQ ID NO: 550032 - protein, 9 aa, Mycobacterium
QDTSAYGQA

SEQ ID NO: 550033 - protein, 6 aa, Mycobacterium
QDTSEL

SEQ ID NO: 550034 - protein, 9 aa, Mycobacterium
QDTSGEGPC

SEQ ID NO: 550035 - protein, 6 aa, Mycobacterium
QDTSSA

SEQ ID NO: 550036 - protein, 7 aa, Mycobacterium
QDTSTGW

SEQ ID NO: 550037 - protein, 14 aa, Mycobacterium
QDTSYPGRSDPNTA

SEQ ID NO: 550038 - protein, 7 aa, Mycobacterium
QDTTDVD

SEQ ID NO: 550039 - protein, 5 aa, Mycobacterium
QDTTE

SEQ ID NO: 550040 - protein, 8 aa, Mycobacterium
QDTTEATA

SEQ ID NO: 550041 - protein, 8 aa, Mycobacterium
QDTTPEGY

SEQ ID NO: 550042 - protein, 7 aa, Mycobacterium
QDTYGHN

SEQ ID NO: 550043 - protein, 4 aa, Mycobacterium
QDVA

SEQ ID NO: 550044 - protein, 7 aa, Mycobacterium
QDVAPYP

SEQ ID NO: 550045 - protein, 4 aa, Mycobacterium
QDVD

SEQ ID NO: 550046 - protein, 28 aa, Mycobacterium
QDVDEASSSNIDATIPGGASVSAPAPIP

SEQ ID NO: 550047 - protein, 4 aa, Mycobacterium
QDVE

SEQ ID NO: 550048 - protein, 9 aa, Mycobacterium
QDVEAGEDG

SEQ ID NO: 550049 - protein, 13 aa, Mycobacterium
QDVEDSRGERDAR

SEQ ID NO: 550050 - protein, 7 aa, Mycobacterium
QDVENSV

SEQ ID NO: 550051 - protein, 15 aa, Mycobacterium
QDVEPAEGSDGTDGR

SEQ ID NO: 550052 - protein, 8 aa, Mycobacterium
QDVESSYR

SEQ ID NO: 550053 - protein, 9 aa, Mycobacterium
QDVKKGINT

SEQ ID NO: 550054 - protein, 4 aa, Mycobacterium
QDVP

SEQ ID NO: 550055 - protein, 9 aa, Mycobacterium
QDVPAPPER

SEQ ID NO: 550056 - protein, 13 aa, Mycobacterium
QDVPGASDGQTQD

SEQ ID NO: 550057 - protein, 8 aa, Mycobacterium
QDVPGTGA

SEQ ID NO: 550058 - protein, 7 aa, Mycobacterium
QDVPPGD

SEQ ID NO: 550059 - protein, 5 aa, Mycobacterium
QDVPS

SEQ ID NO: 550060 - protein, 18 aa, Mycobacterium
QDVQGNDALDALAQPSPN

SEQ ID NO: 550061 - protein, 6 aa, Mycobacterium
QDVQPG

SEQ ID NO: 550062 - protein, 4 aa, Mycobacterium
QDVR

SEQ ID NO: 550063 - protein, 6 aa, Mycobacterium
QDVRDD

SEQ ID NO: 550064 - protein, 4 aa, Mycobacterium
QDVS

SEQ ID NO: 550065 - protein, 15 aa, Mycobacterium
QDVSQHDSGAYTGEI

SEQ ID NO: 550066 - protein, 13 aa, Mycobacterium
QDVSQKSNTLAKG

SEQ ID NO: 550067 - protein, 4 aa, Mycobacterium
QDVT

SEQ ID NO: 550068 - protein, 10 aa, Mycobacterium
QDVTDDVRRR

SEQ ID NO: 550069 - protein, 17 aa, Mycobacterium
QDVTKVRSKAAKGLSKA

SEQ ID NO: 550070 - protein, 12 aa, Mycobacterium
QDWDPEESKLSD

SEQ ID NO: 550071 - protein, 14 aa, Mycobacterium
QDWDPEQSKLSEVA

SEQ ID NO: 550072 - protein, 11 aa, Mycobacterium
QDWDPEQSQLS

SEQ ID NO: 550073 - protein, 12 aa, Mycobacterium
QDWEPGQSKLSD

SEQ ID NO: 550074 - protein, 11 aa, Mycobacterium
QDWEPGQSQLS

SEQ ID NO: 550075 - protein, 11 aa, Mycobacterium
QDWEPGQSQLT

SEQ ID NO: 550076 - protein, 5 aa, Mycobacterium
QDWQP

SEQ ID NO: 550077 - protein, 15 aa, Mycobacterium
QDYAGVPSSRGSRAL

SEQ ID NO: 550078 - protein, 10 aa, Mycobacterium
QDYAPEGAAA

SEQ ID NO: 550079 - protein, 4 aa, Mycobacterium
QDYG

SEQ ID NO: 550080 - protein, 12 aa, Mycobacterium
QDYKGHPTSGGC

SEQ ID NO: 550081 - protein, 5 aa, Mycobacterium
QDYPL

SEQ ID NO: 550082 - protein, 8 aa, Mycobacterium
QDYPSEPG

SEQ ID NO: 550083 - protein, 9 aa, Mycobacterium
QDYSAKAAL

SEQ ID NO: 550084 - protein, 6 aa, Mycobacterium
QDYSQA

SEQ ID NO: 550085 - protein, 19 aa, Mycobacterium
QDYTDTDDHETGLLSNQMN

SEQ ID NO: 550086 - protein, 6 aa, Mycobacterium
QDYTPV

SEQ ID NO: 550087 - protein, 14 aa, Mycobacterium
QEAAAAKARGKAEA

SEQ ID NO: 550088 - protein, 12 aa, Mycobacterium
QEAAATAARAGV

SEQ ID NO: 550089 - protein, 18 aa, Mycobacterium
QEAAATGDPRRESRLEPG

SEQ ID NO: 550090 - protein, 14 aa, Mycobacterium
QEAAEAAQAAATSA

SEQ ID NO: 550091 - protein, 14 aa, Mycobacterium
QEAAMGDNADFATK

SEQ ID NO: 550092 - protein, 9 aa, Mycobacterium
QEAANGAGL

SEQ ID NO: 550093 - protein, 10 aa, Mycobacterium
QEAANGTPVT

SEQ ID NO: 550094 - protein, 7 aa, Mycobacterium
QEAARDA

SEQ ID NO: 550095 - protein, 7 aa, Mycobacterium
QEAARER

SEQ ID NO: 550096 - protein, 9 aa, Mycobacterium
QEAARTGAR

SEQ ID NO: 550097 - protein, 13 aa, Mycobacterium
QEAATSRGGQQAV

SEQ ID NO: 550098 - protein, 4 aa, Mycobacterium
QEAD

SEQ ID NO: 550099 - protein, 7 aa, Mycobacterium
QEADARR

SEQ ID NO: 550100 - protein, 7 aa, Mycobacterium
QEADEEV

SEQ ID NO: 550101 - protein, 16 aa, Mycobacterium
QEADELAGSDADAHRR

SEQ ID NO: 550102 - protein, 11 aa, Mycobacterium
QEADGNRSKAA

SEQ ID NO: 550103 - protein, 10 aa, Mycobacterium
QEADRPTSID

SEQ ID NO: 550104 - protein, 7 aa, Mycobacterium
QEAEPAR

SEQ ID NO: 550105 - protein, 6 aa, Mycobacterium
QEAGAD

SEQ ID NO: 550106 - protein, 9 aa, Mycobacterium
QEAGADPAL

SEQ ID NO: 550107 - protein, 9 aa, Mycobacterium
QEAGAGTVS

SEQ ID NO: 550108 - protein, 6 aa, Mycobacterium
QEAGGQ

SEQ ID NO: 550109 - protein, 7 aa, Mycobacterium
QEAGPLR

SEQ ID NO: 550110 - protein, 5 aa, Mycobacterium
QEAGQ

SEQ ID NO: 550111 - protein, 18 aa, Mycobacterium
QEAGRDVPDDMTKAQASE

SEQ ID NO: 550112 - protein, 6 aa, Mycobacterium
QEAGSR

SEQ ID NO: 550113 - protein, 6 aa, Mycobacterium
QEAGYD

SEQ ID NO: 550114 - protein, 12 aa, Mycobacterium
QEAIEGDRVPGA

SEQ ID NO: 550115 - protein, 9 aa, Mycobacterium
QEALRPDSE

SEQ ID NO: 550116 - protein, 8 aa, Mycobacterium
QEANQGAA

SEQ ID NO: 550117 - protein, 5 aa, Mycobacterium
QEAPD

SEQ ID NO: 550118 - protein, 8 aa, Mycobacterium
QEAPDSAF

SEQ ID NO: 550119 - protein, 6 aa, Mycobacterium
QEAPES

SEQ ID NO: 550120 - protein, 7 aa, Mycobacterium
QEAPGRR

SEQ ID NO: 550121 - protein, 7 aa, Mycobacterium
QEAPIDA

SEQ ID NO: 550122 - protein, 8 aa, Mycobacterium
QEAQASGI

SEQ ID NO: 550123 - protein, 10 aa, Mycobacterium
QEAREACGGA

SEQ ID NO: 550124 - protein, 8 aa, Mycobacterium
QEARQERA

SEQ ID NO: 550125 - protein, 8 aa, Mycobacterium
QEARRISG

SEQ ID NO: 550126 - protein, 8 aa, Mycobacterium
QEARSQDF

SEQ ID NO: 550127 - protein, 5 aa, Mycobacterium
QEART

SEQ ID NO: 550128 - protein, 18 aa, Mycobacterium
QEASADRASAPGDRARKA

SEQ ID NO: 550129 - protein, 8 aa, Mycobacterium
QEASGGNF

SEQ ID NO: 550130 - protein, 7 aa, Mycobacterium
QEASGRG

SEQ ID NO: 550131 - protein, 6 aa, Mycobacterium
QEASLK

SEQ ID NO: 550132 - protein, 8 aa, Mycobacterium
QEATDGSH

SEQ ID NO: 550133 - protein, 7 aa, Mycobacterium
QEATGGV

SEQ ID NO: 550134 - protein, 5 aa, Mycobacterium
QEATP

SEQ ID NO: 550135 - protein, 6 aa, Mycobacterium
QEATRT

SEQ ID NO: 550136 - protein, 21 aa, Mycobacterium
QEATTAQEVEAPAEEVDPAAA

SEQ ID NO: 550137 - protein, 13 aa, Mycobacterium
QEATTRRAGKKKL

SEQ ID NO: 550138 - protein, 4 aa, Mycobacterium
QEAV

SEQ ID NO: 550139 - protein, 23 aa, Mycobacterium
QEAVNAAATTAPRTPAPEGPVGP

SEQ ID NO: 550140 - protein, 9 aa, Mycobacterium
QEAVPPQTL

SEQ ID NO: 550141 - protein, 6 aa, Mycobacterium
QEAYAA

SEQ ID NO: 550142 - protein, 20 aa, Mycobacterium
QECGDTDRSYYHNSEATGQY

SEQ ID NO: 550143 - protein, 7 aa, Mycobacterium
QEDDAGS

SEQ ID NO: 550144 - protein, 9 aa, Mycobacterium
QEDDTVEIG

SEQ ID NO: 550145 - protein, 9 aa, Mycobacterium
QEDDTVEVG

SEQ ID NO: 550146 - protein, 9 aa, Mycobacterium
QEDGRRSYS

SEQ ID NO: 550147 - protein, 8 aa, Mycobacterium
QEDGTLER

SEQ ID NO: 550148 - protein, 13 aa, Mycobacterium
QEDGVTQAAINGT

SEQ ID NO: 550149 - protein, 7 aa, Mycobacterium
QEDLPSR

SEQ ID NO: 550150 - protein, 4 aa, Mycobacterium
QEDM

SEQ ID NO: 550151 - protein, 9 aa, Mycobacterium
QEDPGELLG

SEQ ID NO: 550152 - protein, 6 aa, Mycobacterium
QEDPPQ

SEQ ID NO: 550153 - protein, 14 aa, Mycobacterium
QEDPPRSFELITKT

SEQ ID NO: 550154 - protein, 7 aa, Mycobacterium
QEDPQTL

SEQ ID NO: 550155 - protein, 15 aa, Mycobacterium
QEDPRAGAAASAARI

SEQ ID NO: 550156 - protein, 8 aa, Mycobacterium
QEDPSPAP

SEQ ID NO: 550157 - protein, 8 aa, Mycobacterium
QEDPVRAR

SEQ ID NO: 550158 - protein, 5 aa, Mycobacterium
QEDQA

SEQ ID NO: 550159 - protein, 4 aa, Mycobacterium
QEDR

SEQ ID NO: 550160 - protein, 10 aa, Mycobacterium
QEDRDKIPGA

SEQ ID NO: 550161 - protein, 9 aa, Mycobacterium
QEDVERSQE

SEQ ID NO: 550162 - protein, 9 aa, Mycobacterium
QEDVNRSQE

SEQ ID NO: 550163 - protein, 6 aa, Mycobacterium
QEDYPQ

SEQ ID NO: 550164 - protein, 6 aa, Mycobacterium
QEEAED

SEQ ID NO: 550165 - protein, 7 aa, Mycobacterium
QEEAEDI

SEQ ID NO: 550166 - protein, 11 aa, Mycobacterium
QEEAEGGTETF

SEQ ID NO: 550167 - protein, 8 aa, Mycobacterium
QEEDGRQV

SEQ ID NO: 550168 - protein, 9 aa, Mycobacterium
QEEDNSVSR

SEQ ID NO: 550169 - protein, 7 aa, Mycobacterium
QEEDPQS

SEQ ID NO: 550170 - protein, 10 aa, Mycobacterium
QEEEYTPPEH

SEQ ID NO: 550171 - protein, 8 aa, Mycobacterium
QEEGEEPA

SEQ ID NO: 550172 - protein, 8 aa, Mycobacterium
QEEGNTYD

SEQ ID NO: 550173 - protein, 5 aa, Mycobacterium
QEEHD

SEQ ID NO: 550174 - protein, 8 aa, Mycobacterium
QEELGSKG

SEQ ID NO: 550175 - protein, 6 aa, Mycobacterium
QEENAR

SEQ ID NO: 550176 - protein, 7 aa, Mycobacterium
QEENPES

SEQ ID NO: 550177 - protein, 6 aa, Mycobacterium
QEEPEA

SEQ ID NO: 550178 - protein, 15 aa, Mycobacterium
QEEPGDEERADSNFQ

SEQ ID NO: 550179 - protein, 5 aa, Mycobacterium
QEERG

SEQ ID NO: 550180 - protein, 6 aa, Mycobacterium
QEERRA

SEQ ID NO: 550181 - protein, 7 aa, Mycobacterium
QEESKGH

SEQ ID NO: 550182 - protein, 4 aa, Mycobacterium
QEET

SEQ ID NO: 550183 - protein, 7 aa, Mycobacterium
QEETDGA

SEQ ID NO: 550184 - protein, 11 aa, Mycobacterium
QEETEPGRREE

SEQ ID NO: 550185 - protein, 4 aa, Mycobacterium
QEEV

SEQ ID NO: 550186 - protein, 12 aa, Mycobacterium
QEFEEQKKRLLP

SEQ ID NO: 550187 - protein, 6 aa, Mycobacterium
QEFPEN

SEQ ID NO: 550188 - protein, 4 aa, Mycobacterium
QEFS

SEQ ID NO: 550189 - protein, 5 aa, Mycobacterium
QEGAA

SEQ ID NO: 550190 - protein, 6 aa, Mycobacterium
QEGADT

SEQ ID NO: 550191 - protein, 7 aa, Mycobacterium
QEGANPN

SEQ ID NO: 550192 - protein, 5 aa, Mycobacterium
QEGAT

SEQ ID NO: 550193 - protein, 10 aa, Mycobacterium
QEGCSRGRGG

SEQ ID NO: 550194 - protein, 7 aa, Mycobacterium
QEGDGTQ

SEQ ID NO: 550195 - protein, 9 aa, Mycobacterium
QEGDPGYKA

SEQ ID NO: 550196 - protein, 10 aa, Mycobacterium
QEGDPVPAER

SEQ ID NO: 550197 - protein, 5 aa, Mycobacterium
QEGEL

SEQ ID NO: 550198 - protein, 6 aa, Mycobacterium
QEGETY

SEQ ID NO: 550199 - protein, 27 aa, Mycobacterium
QEGGDDAKSAAGKQDSPRNSDSSGPAL

SEQ ID NO: 550200 - protein, 8 aa, Mycobacterium
QEGGSIRR

SEQ ID NO: 550201 - protein, 5 aa, Mycobacterium
QEGGV

SEQ ID NO: 550202 - protein, 6 aa, Mycobacterium
QEGHPD

SEQ ID NO: 550203 - protein, 6 aa, Mycobacterium
QEGHSV

SEQ ID NO: 550204 - protein, 5 aa, Mycobacterium
QEGID

SEQ ID NO: 550205 - protein, 9 aa, Mycobacterium
QEGIKEQQR

SEQ ID NO: 550206 - protein, 7 aa, Mycobacterium
QEGISDG

SEQ ID NO: 550207 - protein, 40 aa, Mycobacterium
QEGKAQQDKADAQREVAEKEAEAESARAGAKAAEKRQEAN

SEQ ID NO: 550208 - protein, 4 aa, Mycobacterium
QEGL

SEQ ID NO: 550209 - protein, 6 aa, Mycobacterium
QEGNER

SEQ ID NO: 550210 - protein, 6 aa, Mycobacterium
QEGPDA

SEQ ID NO: 550211 - protein, 10 aa, Mycobacterium
QEGPHPAPAR

SEQ ID NO: 550212 - protein, 7 aa, Mycobacterium
QEGPRVR

SEQ ID NO: 550213 - protein, 7 aa, Mycobacterium
QEGQGRR

SEQ ID NO: 550214 - protein, 7 aa, Mycobacterium
QEGQGSL

SEQ ID NO: 550215 - protein, 9 aa, Mycobacterium
QEGQHSMGH

SEQ ID NO: 550216 - protein, 7 aa, Mycobacterium
QEGQTVR

SEQ ID NO: 550217 - protein, 15 aa, Mycobacterium
QEGRTLGVDPETGHE

SEQ ID NO: 550218 - protein, 6 aa, Mycobacterium
QEGRTM

SEQ ID NO: 550219 - protein, 4 aa, Mycobacterium
QEGS

SEQ ID NO: 550220 - protein, 5 aa, Mycobacterium
QEGSD

SEQ ID NO: 550221 - protein, 5 aa, Mycobacterium
QEGSG

SEQ ID NO: 550222 - protein, 11 aa, Mycobacterium
QEGSLSEVDAD

SEQ ID NO: 550223 - protein, 7 aa, Mycobacterium
QEGTAAE

SEQ ID NO: 550224 - protein, 8 aa, Mycobacterium
QEGTGTRV

SEQ ID NO: 550225 - protein, 4 aa, Mycobacterium
QEGV

SEQ ID NO: 550226 - protein, 13 aa, Mycobacterium
QEGVADEGGKRVG

SEQ ID NO: 550227 - protein, 12 aa, Mycobacterium
QEGVADEGGRRV

SEQ ID NO: 550228 - protein, 7 aa, Mycobacterium
QEGVKDG

SEQ ID NO: 550229 - protein, 16 aa, Mycobacterium
QEGVPKGGADASHLDS

SEQ ID NO: 550230 - protein, 7 aa, Mycobacterium
QEGVSAE

SEQ ID NO: 550231 - protein, 8 aa, Mycobacterium
QEGVSASA

SEQ ID NO: 550232 - protein, 6 aa, Mycobacterium
QEGYRA

SEQ ID NO: 550233 - protein, 9 aa, Mycobacterium
QEHRSDDPN

SEQ ID NO: 550234 - protein, 13 aa, Mycobacterium
QEHRTSAKAAEAL

SEQ ID NO: 550235 - protein, 15 aa, Mycobacterium
QEHSHSGGGLPSYPH

SEQ ID NO: 550236 - protein, 5 aa, Mycobacterium
QEHVT

SEQ ID NO: 550237 - protein, 6 aa, Mycobacterium
QEIPEG

SEQ ID NO: 550238 - protein, 6 aa, Mycobacterium
QEISGS

SEQ ID NO: 550239 - protein, 9 aa, Mycobacterium
QEKAGRDAG

SEQ ID NO: 550240 - protein, 12 aa, Mycobacterium
QEKDKDATGSAG

SEQ ID NO: 550241 - protein, 5 aa, Mycobacterium
QEKFG

SEQ ID NO: 550242 - protein, 8 aa, Mycobacterium
QEKGNEYD

SEQ ID NO: 550243 - protein, 4 aa, Mycobacterium
QEKK

SEQ ID NO: 550244 - protein, 41 aa, Mycobacterium
QEKKAAEGPAGPAASAEPAAEAAPEPASEAPAEPAETPAEA

SEQ ID NO: 550245 - protein, 13 aa, Mycobacterium
QEKKSAGDSAESA

SEQ ID NO: 550246 - protein, 16 aa, Mycobacterium
QEKLGESGESDEVRTR

SEQ ID NO: 550247 - protein, 10 aa, Mycobacterium
QEKPARPRSH

SEQ ID NO: 550248 - protein, 28 aa, Mycobacterium
QEKRAAAEPAADVPATTPDTPAPEPASA

SEQ ID NO: 550249 - protein, 15 aa, Mycobacterium
QEKTARPIPIFELRR

SEQ ID NO: 550250 - protein, 19 aa, Mycobacterium
QELADAAAKPVGEYPTFPD

SEQ ID NO: 550251 - protein, 16 aa, Mycobacterium
QELADASGATAKTGAE

SEQ ID NO: 550252 - protein, 14 aa, Mycobacterium
QELADRAAKPAGEY

SEQ ID NO: 550253 - protein, 11 aa, Mycobacterium
QELAEPRGGLT

SEQ ID NO: 550254 - protein, 9 aa, Mycobacterium
QELAQSLRN

SEQ ID NO: 550255 - protein, 10 aa, Mycobacterium
QELDEASEAA

SEQ ID NO: 550256 - protein, 12 aa, Mycobacterium
QELDPAAFPGVP

SEQ ID NO: 550257 - protein, 20 aa, Mycobacterium
QELDPRQVRDGKPPDDPQGA

SEQ ID NO: 550258 - protein, 5 aa, Mycobacterium
QELDQ

SEQ ID NO: 550259 - protein, 8 aa, Mycobacterium
QELEGRGV

SEQ ID NO: 550260 - protein, 31 aa, Mycobacterium
QELETKLDTAAGRYHRTDSTMGDALDETIQP

SEQ ID NO: 550261 - protein, 4 aa, Mycobacterium
QELG

SEQ ID NO: 550262 - protein, 10 aa, Mycobacterium
QELGDAPGKG

SEQ ID NO: 550263 - protein, 5 aa, Mycobacterium
QELGG

SEQ ID NO: 550264 - protein, 7 aa, Mycobacterium
QELGPGY

SEQ ID NO: 550265 - protein, 6 aa, Mycobacterium
QELPDI

SEQ ID NO: 550266 - protein, 12 aa, Mycobacterium
QELPLGRRNPSI

SEQ ID NO: 550267 - protein, 6 aa, Mycobacterium
QELPPD

SEQ ID NO: 550268 - protein, 13 aa, Mycobacterium
QELPTAVARPNDA

SEQ ID NO: 550269 - protein, 9 aa, Mycobacterium
QELRGSERR

SEQ ID NO: 550270 - protein, 18 aa, Mycobacterium
QELSDGRAVPCDDENGTA

SEQ ID NO: 550271 - protein, 5 aa, Mycobacterium
QELSR

SEQ ID NO: 550272 - protein, 5 aa, Mycobacterium
QELTE

SEQ ID NO: 550273 - protein, 5 aa, Mycobacterium
QELTG

SEQ ID NO: 550274 - protein, 12 aa, Mycobacterium
QENEDVISEEAA

SEQ ID NO: 550275 - protein, 7 aa, Mycobacterium
QENERAQ

SEQ ID NO: 550276 - protein, 9 aa, Mycobacterium
QENGDKDLA

SEQ ID NO: 550277 - protein, 5 aa, Mycobacterium
QENGG

SEQ ID NO: 550278 - protein, 11 aa, Mycobacterium
QENLPGAKPAA

SEQ ID NO: 550279 - protein, 5 aa, Mycobacterium
QENMT

SEQ ID NO: 550280 - protein, 10 aa, Mycobacterium
QENPEQGKGF

SEQ ID NO: 550281 - protein, 7 aa, Mycobacterium
QENPGYT

SEQ ID NO: 550282 - protein, 8 aa, Mycobacterium
QENQQLGG

SEQ ID NO: 550283 - protein, 7 aa, Mycobacterium
QENQRAQ

SEQ ID NO: 550284 - protein, 5 aa, Mycobacterium
QENVT

SEQ ID NO: 550285 - protein, 4 aa, Mycobacterium
QEPA

SEQ ID NO: 550286 - protein, 7 aa, Mycobacterium
QEPAEYH

SEQ ID NO: 550287 - protein, 4 aa, Mycobacterium
QEPD

SEQ ID NO: 550288 - protein, 12 aa, Mycobacterium
QEPDDVASAGRV

SEQ ID NO: 550289 - protein, 10 aa, Mycobacterium
QEPDDVGSVG

SEQ ID NO: 550290 - protein, 7 aa, Mycobacterium
QEPEQSL

SEQ ID NO: 550291 - protein, 6 aa, Mycobacterium
QEPETH

SEQ ID NO: 550292 - protein, 4 aa, Mycobacterium
QEPG

SEQ ID NO: 550293 - protein, 8 aa, Mycobacterium
QEPGDHGV

SEQ ID NO: 550294 - protein, 13 aa, Mycobacterium
QEPGGRVTDMGGP

SEQ ID NO: 550295 - protein, 6 aa, Mycobacterium
QEPGIP

SEQ ID NO: 550296 - protein, 8 aa, Mycobacterium
QEPGTADE

SEQ ID NO: 550297 - protein, 8 aa, Mycobacterium
QEPGTAEE

SEQ ID NO: 550298 - protein, 8 aa, Mycobacterium
QEPGTAEQ

SEQ ID NO: 550299 - protein, 7 aa, Mycobacterium
QEPIGSK

SEQ ID NO: 550300 - protein, 12 aa, Mycobacterium
QEPIPARGQGPD

SEQ ID NO: 550301 - protein, 28 aa, Mycobacterium
QEPLPARGDGPGISGVDPRYARAKSEHD

SEQ ID NO: 550302 - protein, 6 aa, Mycobacterium
QEPPAA

SEQ ID NO: 550303 - protein, 14 aa, Mycobacterium
QEPPEFSSAPSDFL

SEQ ID NO: 550304 - protein, 18 aa, Mycobacterium
QEPPLDETKTVRENVEDG

SEQ ID NO: 550305 - protein, 16 aa, Mycobacterium
QEPPRAELPPKSQEGA

SEQ ID NO: 550306 - protein, 6 aa, Mycobacterium
QEPPRP

SEQ ID NO: 550307 - protein, 6 aa, Mycobacterium
QEPPWG

SEQ ID NO: 550308 - protein, 7 aa, Mycobacterium
QEPSHDD

SEQ ID NO: 550309 - protein, 4 aa, Mycobacterium
QEPT

SEQ ID NO: 550310 - protein, 8 aa, Mycobacterium
QEPTEMGP

SEQ ID NO: 550311 - protein, 9 aa, Mycobacterium
QEPTEQPYG

SEQ ID NO: 550312 - protein, 12 aa, Mycobacterium
QEPVAKSTGENQ

SEQ ID NO: 550313 - protein, 5 aa, Mycobacterium
QEPVR

SEQ ID NO: 550314 - protein, 6 aa, Mycobacterium
QEPVRD

SEQ ID NO: 550315 - protein, 6 aa, Mycobacterium
QEPVST

SEQ ID NO: 550316 - protein, 5 aa, Mycobacterium
QEPVW

SEQ ID NO: 550317 - protein, 4 aa, Mycobacterium
QEPY

SEQ ID NO: 550318 - protein, 8 aa, Mycobacterium
QEQAGVTF

SEQ ID NO: 550319 - protein, 17 aa, Mycobacterium
QEQAKKAAGAADTGDQQ

SEQ ID NO: 550320 - protein, 14 aa, Mycobacterium
QEQAKKVVDTGDQQ

SEQ ID NO: 550321 - protein, 8 aa, Mycobacterium
QEQAPEGI

SEQ ID NO: 550322 - protein, 15 aa, Mycobacterium
QEQATRRGGHPISSQ

SEQ ID NO: 550323 - protein, 4 aa, Mycobacterium
QEQF

SEQ ID NO: 550324 - protein, 17 aa, Mycobacterium
QEQFNAETATPVGPESY

SEQ ID NO: 550325 - protein, 4 aa, Mycobacterium
QEQG

SEQ ID NO: 550326 - protein, 7 aa, Mycobacterium
QEQGIPA

SEQ ID NO: 550327 - protein, 11 aa, Mycobacterium
QEQGSSREEFD

SEQ ID NO: 550328 - protein, 6 aa, Mycobacterium
QEQGVG

SEQ ID NO: 550329 - protein, 16 aa, Mycobacterium
QEQMGGKYPNWQWDPH

SEQ ID NO: 550330 - protein, 10 aa, Mycobacterium
QEQNGQLDCD

SEQ ID NO: 550331 - protein, 5 aa, Mycobacterium
QEQPG

SEQ ID NO: 550332 - protein, 6 aa, Mycobacterium
QEQPPV

SEQ ID NO: 550333 - protein, 10 aa, Mycobacterium
QEQPYEPPGH

SEQ ID NO: 550334 - protein, 5 aa, Mycobacterium
QEQQT

SEQ ID NO: 550335 - protein, 4 aa, Mycobacterium
QEQR

SEQ ID NO: 550336 - protein, 8 aa, Mycobacterium
QEQRDFRN

SEQ ID NO: 550337 - protein, 6 aa, Mycobacterium
QEQRSL

SEQ ID NO: 550338 - protein, 5 aa, Mycobacterium
QEQTE

SEQ ID NO: 550339 - protein, 9 aa, Mycobacterium
QEQTGLPYA

SEQ ID NO: 550340 - protein, 9 aa, Mycobacterium
QEQTPARPI

SEQ ID NO: 550341 - protein, 10 aa, Mycobacterium
QEQYGPHPSG

SEQ ID NO: 550342 - protein, 8 aa, Mycobacterium
QEQYSADP

SEQ ID NO: 550343 - protein, 4 aa, Mycobacterium
QERA

SEQ ID NO: 550344 - protein, 8 aa, Mycobacterium
QERADGLA

SEQ ID NO: 550345 - protein, 13 aa, Mycobacterium
QERAEALRRYGRL

SEQ ID NO: 550346 - protein, 11 aa, Mycobacterium
QERAGAGQAAK

SEQ ID NO: 550347 - protein, 6 aa, Mycobacterium
QERAGR

SEQ ID NO: 550348 - protein, 15 aa, Mycobacterium
QERAKRRLPKSAYSS

SEQ ID NO: 550349 - protein, 6 aa, Mycobacterium
QERANR

SEQ ID NO: 550350 - protein, 8 aa, Mycobacterium
QERDDPAL

SEQ ID NO: 550351 - protein, 8 aa, Mycobacterium
QERDPDCA

SEQ ID NO: 550352 - protein, 8 aa, Mycobacterium
QERDTGSI

SEQ ID NO: 550353 - protein, 6 aa, Mycobacterium
QEREAL

SEQ ID NO: 550354 - protein, 13 aa, Mycobacterium
QEREITERTDLSE

SEQ ID NO: 550355 - protein, 25 aa, Mycobacterium
QERGANGAGGVRAPSDDSKPTDVGA

SEQ ID NO: 550356 - protein, 15 aa, Mycobacterium
QERGDQPAGGPAAKP

SEQ ID NO: 550357 - protein, 12 aa, Mycobacterium
QERGETDPHVNP

SEQ ID NO: 550358 - protein, 7 aa, Mycobacterium
QERGGPG

SEQ ID NO: 550359 - protein, 32 aa, Mycobacterium
QERGLDAGTDTEADAANAQTNGHARAATAAPA

SEQ ID NO: 550360 - protein, 14 aa, Mycobacterium
QERGPEAWRLRLTK

SEQ ID NO: 550361 - protein, 6 aa, Mycobacterium
QERGSG

SEQ ID NO: 550362 - protein, 8 aa, Mycobacterium
QERHAADP

SEQ ID NO: 550363 - protein, 7 aa, Mycobacterium
QERHAED

SEQ ID NO: 550364 - protein, 5 aa, Mycobacterium
QERHD

SEQ ID NO: 550365 - protein, 7 aa, Mycobacterium
QERHDQR

SEQ ID NO: 550366 - protein, 6 aa, Mycobacterium
QERKPG

SEQ ID NO: 550367 - protein, 10 aa, Mycobacterium
QERLEPSERP

SEQ ID NO: 550368 - protein, 12 aa, Mycobacterium
QERNAGTPGKSF

SEQ ID NO: 550369 - protein, 12 aa, Mycobacterium
QERPAAGEPAGL

SEQ ID NO: 550370 - protein, 8 aa, Mycobacterium
QERPDRLA

SEQ ID NO: 550371 - protein, 6 aa, Mycobacterium
QERPGG

SEQ ID NO: 550372 - protein, 16 aa, Mycobacterium
QERPGLTVGLEALLDL

SEQ ID NO: 550373 - protein, 10 aa, Mycobacterium
QERRGKEGND

SEQ ID NO: 550374 - protein, 8 aa, Mycobacterium
QERRPNKR

SEQ ID NO: 550375 - protein, 9 aa, Mycobacterium
QERRPPEVR

SEQ ID NO: 550376 - protein, 8 aa, Mycobacterium
QERSATAT

SEQ ID NO: 550377 - protein, 7 aa, Mycobacterium
QERSDGH

SEQ ID NO: 550378 - protein, 11 aa, Mycobacterium
QERSDPNFSDR

SEQ ID NO: 550379 - protein, 19 aa, Mycobacterium
QERSIAGASSSAKANGALG

SEQ ID NO: 550380 - protein, 6 aa, Mycobacterium
QERSNG

SEQ ID NO: 550381 - protein, 9 aa, Mycobacterium
QERSNGHSY

SEQ ID NO: 550382 - protein, 26 aa, Mycobacterium
QERSPAELAKRETPTAATLEDSRAEL

SEQ ID NO: 550383 - protein, 7 aa, Mycobacterium
QERSRAG

SEQ ID NO: 550384 - protein, 12 aa, Mycobacterium
QERTEQSGNRDV

SEQ ID NO: 550385 - protein, 13 aa, Mycobacterium
QERTGAAYSSTVP

SEQ ID NO: 550386 - protein, 18 aa, Mycobacterium
QERTGRGAKHYRSTTHSA

SEQ ID NO: 550387 - protein, 12 aa, Mycobacterium
QERTPDEAAQEL

SEQ ID NO: 550388 - protein, 8 aa, Mycobacterium
QERYADAR

SEQ ID NO: 550389 - protein, 8 aa, Mycobacterium
QESEVPLR

SEQ ID NO: 550390 - protein, 11 aa, Mycobacterium
QESGAGPTNNW

SEQ ID NO: 550391 - protein, 9 aa, Mycobacterium
QESGEKDLA

SEQ ID NO: 550392 - protein, 5 aa, Mycobacterium
QESGF

SEQ ID NO: 550393 - protein, 6 aa, Mycobacterium
QESGGA

SEQ ID NO: 550394 - protein, 9 aa, Mycobacterium
QESGSDAVS

SEQ ID NO: 550395 - protein, 8 aa, Mycobacterium
QESGTTDV

SEQ ID NO: 550396 - protein, 11 aa, Mycobacterium
QESGTTRPIDP

SEQ ID NO: 550397 - protein, 5 aa, Mycobacterium
QESMR

SEQ ID NO: 550398 - protein, 6 aa, Mycobacterium
QESNLK

SEQ ID NO: 550399 - protein, 6 aa, Mycobacterium
QESPVD

SEQ ID NO: 550400 - protein, 9 aa, Mycobacterium
QESRDETAP

SEQ ID NO: 550401 - protein, 11 aa, Mycobacterium
QESRTGSLEST

SEQ ID NO: 550402 - protein, 7 aa, Mycobacterium
QESRTGV

SEQ ID NO: 550403 - protein, 12 aa, Mycobacterium
QESSGNPRAVSS

SEQ ID NO: 550404 - protein, 9 aa, Mycobacterium
QESSGTTDN

SEQ ID NO: 550405 - protein, 8 aa, Mycobacterium
QESSRGAI

SEQ ID NO: 550406 - protein, 14 aa, Mycobacterium
QESTTPERRAGGAI

SEQ ID NO: 550407 - protein, 7 aa, Mycobacterium
QESVDAG

SEQ ID NO: 550408 - protein, 4 aa, Mycobacterium
QESW

SEQ ID NO: 550409 - protein, 8 aa, Mycobacterium
QETAPLRP

SEQ ID NO: 550410 - protein, 12 aa, Mycobacterium
QETAREVVNKVI

SEQ ID NO: 550411 - protein, 6 aa, Mycobacterium
QETDGG

SEQ ID NO: 550412 - protein, 8 aa, Mycobacterium
QETDGSGA

SEQ ID NO: 550413 - protein, 8 aa, Mycobacterium
QETDPLTR

SEQ ID NO: 550414 - protein, 5 aa, Mycobacterium
QETGA

SEQ ID NO: 550415 - protein, 6 aa, Mycobacterium
QETGIR

SEQ ID NO: 550416 - protein, 6 aa, Mycobacterium
QETGQT

SEQ ID NO: 550417 - protein, 6 aa, Mycobacterium
QETLAA

SEQ ID NO: 550418 - protein, 6 aa, Mycobacterium
QETNDV

SEQ ID NO: 550419 - protein, 5 aa, Mycobacterium
QETPA

SEQ ID NO: 550420 - protein, 6 aa, Mycobacterium
QETPDF

SEQ ID NO: 550421 - protein, 7 aa, Mycobacterium
QETPISS

SEQ ID NO: 550422 - protein, 4 aa, Mycobacterium
QETQ

SEQ ID NO: 550423 - protein, 7 aa, Mycobacterium
QETQTAA

SEQ ID NO: 550424 - protein, 22 aa, Mycobacterium
QETRARRKAALQEATRDSADEI

SEQ ID NO: 550425 - protein, 15 aa, Mycobacterium
QETRPAHRGKRQAAN

SEQ ID NO: 550426 - protein, 11 aa, Mycobacterium
QETSAGNAAAA

SEQ ID NO: 550427 - protein, 7 aa, Mycobacterium
QETSANT

SEQ ID NO: 550428 - protein, 13 aa, Mycobacterium
QETSQLSGGQKQR

SEQ ID NO: 550429 - protein, 5 aa, Mycobacterium
QETSR

SEQ ID NO: 550430 - protein, 14 aa, Mycobacterium
QETSTASSITSTQA

SEQ ID NO: 550431 - protein, 8 aa, Mycobacterium
QETSTIEV

SEQ ID NO: 550432 - protein, 4 aa, Mycobacterium
QETT

SEQ ID NO: 550433 - protein, 9 aa, Mycobacterium
QETTGPGGI

SEQ ID NO: 550434 - protein, 7 aa, Mycobacterium
QETTNFD

SEQ ID NO: 550435 - protein, 6 aa, Mycobacterium
QETTTF

SEQ ID NO: 550436 - protein, 9 aa, Mycobacterium
QETTTSDGR

SEQ ID NO: 550437 - protein, 6 aa, Mycobacterium
QETVGR

SEQ ID NO: 550438 - protein, 8 aa, Mycobacterium
QEVEGGTV

SEQ ID NO: 550439 - protein, 11 aa, Mycobacterium
QEVHSSPAEAA

SEQ ID NO: 550440 - protein, 6 aa, Mycobacterium
QEVPRD

SEQ ID NO: 550441 - protein, 14 aa, Mycobacterium
QEVQRRGPGQVPDG

SEQ ID NO: 550442 - protein, 6 aa, Mycobacterium
QEVRPG

SEQ ID NO: 550443 - protein, 6 aa, Mycobacterium
QEVRTS

SEQ ID NO: 550444 - protein, 14 aa, Mycobacterium
QEVSNTWQDTESWT

SEQ ID NO: 550445 - protein, 8 aa, Mycobacterium
QEVSPGQT

SEQ ID NO: 550446 - protein, 11 aa, Mycobacterium
QEWDPEQSKLS

SEQ ID NO: 550447 - protein, 12 aa, Mycobacterium
QEWEPGQGRLPD

SEQ ID NO: 550448 - protein, 10 aa, Mycobacterium
QEWGTPAVAG

SEQ ID NO: 550449 - protein, 10 aa, Mycobacterium
QEWGTRSPVE

SEQ ID NO: 550450 - protein, 6 aa, Mycobacterium
QEYDGM

SEQ ID NO: 550451 - protein, 8 aa, Mycobacterium
QEYDKQTD

SEQ ID NO: 550452 - protein, 4 aa, Mycobacterium
QEYE

SEQ ID NO: 550453 - protein, 6 aa, Mycobacterium
QEYGDR

SEQ ID NO: 550454 - protein, 10 aa, Mycobacterium
QEYGGEHGGD

SEQ ID NO: 550455 - protein, 6 aa, Mycobacterium
QEYQAA

SEQ ID NO: 550456 - protein, 19 aa, Mycobacterium
QEYQGFPTSSGSRSLANDV

SEQ ID NO: 550457 - protein, 5 aa, Mycobacterium
QEYRG

SEQ ID NO: 550458 - protein, 19 aa, Mycobacterium
QEYRGFPSSCGSRSLANDV

SEQ ID NO: 550459 - protein, 12 aa, Mycobacterium
QEYSRFGDERSR

SEQ ID NO: 550460 - protein, 14 aa, Mycobacterium
QEYTTARRGLSGED

SEQ ID NO: 550461 - protein, 20 aa, Mycobacterium
QFAAARPDEAISAAAADPEL

SEQ ID NO: 550462 - protein, 4 aa, Mycobacterium
QFAE

SEQ ID NO: 550463 - protein, 17 aa, Mycobacterium
QFAPGGPTAAVPPGSWT

SEQ ID NO: 550464 - protein, 9 aa, Mycobacterium
QFASPNELY

SEQ ID NO: 550465 - protein, 7 aa, Mycobacterium
QFDATRR

SEQ ID NO: 550466 - protein, 13 aa, Mycobacterium
QFDEPSINSGGQA

SEQ ID NO: 550467 - protein, 13 aa, Mycobacterium
QFDGYTSGSTKDF

SEQ ID NO: 550468 - protein, 7 aa, Mycobacterium
QFDKPRD

SEQ ID NO: 550469 - protein, 5 aa, Mycobacterium
QFDPD

SEQ ID NO: 550470 - protein, 13 aa, Mycobacterium
QFDPSSGGVGAYD

SEQ ID NO: 550471 - protein, 4 aa, Mycobacterium
QFDR

SEQ ID NO: 550472 - protein, 10 aa, Mycobacterium
QFDSGEPSLD

SEQ ID NO: 550473 - protein, 10 aa, Mycobacterium
QFDSPSQYVP

SEQ ID NO: 550474 - protein, 8 aa, Mycobacterium
QFEDPDGG

SEQ ID NO: 550475 - protein, 4 aa, Mycobacterium
QFEK

SEQ ID NO: 550476 - protein, 26 aa, Mycobacterium
QFERQAEKAEAAGRTKDAEEARASAA

SEQ ID NO: 550477 - protein, 5 aa, Mycobacterium
QFESD

SEQ ID NO: 550478 - protein, 5 aa, Mycobacterium
QFESK

SEQ ID NO: 550479 - protein, 11 aa, Mycobacterium
QFGGADAPRGW

SEQ ID NO: 550480 - protein, 8 aa, Mycobacterium
QFGGPDSA

SEQ ID NO: 550481 - protein, 7 aa, Mycobacterium
QFGGPGV

SEQ ID NO: 550482 - protein, 4 aa, Mycobacterium
QFGK

SEQ ID NO: 550483 - protein, 9 aa, Mycobacterium
QFGPEGRTR

SEQ ID NO: 550484 - protein, 5 aa, Mycobacterium
QFGPK

SEQ ID NO: 550485 - protein, 9 aa, Mycobacterium
QFGSGRSGF

SEQ ID NO: 550486 - protein, 4 aa, Mycobacterium
QFGT

SEQ ID NO: 550487 - protein, 9 aa, Mycobacterium
QFGTSTRED

SEQ ID NO: 550488 - protein, 21 aa, Mycobacterium
QFHPEKSGDAGATLLANWVEG

SEQ ID NO: 550489 - protein, 7 aa, Mycobacterium
QFKGPDY

SEQ ID NO: 550490 - protein, 6 aa, Mycobacterium
QFNRTK

SEQ ID NO: 550491 - protein, 6 aa, Mycobacterium
QFPDDR

SEQ ID NO: 550492 - protein, 8 aa, Mycobacterium
QFPPPDPG

SEQ ID NO: 550493 - protein, 5 aa, Mycobacterium
QFPTS

SEQ ID NO: 550494 - protein, 6 aa, Mycobacterium
QFPTTE

SEQ ID NO: 550495 - protein, 7 aa, Mycobacterium
QFPYTSK

SEQ ID NO: 550496 - protein, 21 aa, Mycobacterium
QFPYTTKTGWTYDSGDYETTM

SEQ ID NO: 550497 - protein, 6 aa, Mycobacterium
QFQERG

SEQ ID NO: 550498 - protein, 13 aa, Mycobacterium
QFRAAKPDTAVDT

SEQ ID NO: 550499 - protein, 6 aa, Mycobacterium
QFRDTE

SEQ ID NO: 550500 - protein, 8 aa, Mycobacterium
QFREKDGR

SEQ ID NO: 550501 - protein, 11 aa, Mycobacterium
QFSAPDDDDSE

SEQ ID NO: 550502 - protein, 9 aa, Mycobacterium
QFSAPDDDS

SEQ ID NO: 550503 - protein, 9 aa, Mycobacterium
QFSAPDDEH

SEQ ID NO: 550504 - protein, 5 aa, Mycobacterium
QFSDD

SEQ ID NO: 550505 - protein, 18 aa, Mycobacterium
QFSPPPQVTNPSGATAQA

SEQ ID NO: 550506 - protein, 6 aa, Mycobacterium
QFTDGA

SEQ ID NO: 550507 - protein, 6 aa, Mycobacterium
QFTGEE

SEQ ID NO: 550508 - protein, 6 aa, Mycobacterium
QFTPES

SEQ ID NO: 550509 - protein, 4 aa, Mycobacterium
QGAA

SEQ ID NO: 550510 - protein, 13 aa, Mycobacterium
QGAAASELAASGV

SEQ ID NO: 550511 - protein, 7 aa, Mycobacterium
QGAAPGE

SEQ ID NO: 550512 - protein, 5 aa, Mycobacterium
QGAAR

SEQ ID NO: 550513 - protein, 11 aa, Mycobacterium
QGAARAGKRTT

SEQ ID NO: 550514 - protein, 5 aa, Mycobacterium
QGAAT

SEQ ID NO: 550515 - protein, 5 aa, Mycobacterium
QGADA

SEQ ID NO: 550516 - protein, 18 aa, Mycobacterium
QGADDAPEATDSAQERPS

SEQ ID NO: 550517 - protein, 8 aa, Mycobacterium
QGADEATG

SEQ ID NO: 550518 - protein, 16 aa, Mycobacterium
QGADELTAEKQAGAEL

SEQ ID NO: 550519 - protein, 6 aa, Mycobacterium
QGADGV

SEQ ID NO: 550520 - protein, 7 aa, Mycobacterium
QGADPLP

SEQ ID NO: 550521 - protein, 9 aa, Mycobacterium
QGADRFRAE

SEQ ID NO: 550522 - protein, 11 aa, Mycobacterium
QGAEATNGDRR

SEQ ID NO: 550523 - protein, 9 aa, Mycobacterium
QGAEGPGEL

SEQ ID NO: 550524 - protein, 5 aa, Mycobacterium
QGAEL

SEQ ID NO: 550525 - protein, 13 aa, Mycobacterium
QGAENLTPTKRKH

SEQ ID NO: 550526 - protein, 6 aa, Mycobacterium
QGAEPK

SEQ ID NO: 550527 - protein, 19 aa, Mycobacterium
QGAESVDPESCSADDVCRY

SEQ ID NO: 550528 - protein, 5 aa, Mycobacterium
QGAFP

SEQ ID NO: 550529 - protein, 4 aa, Mycobacterium
QGAG

SEQ ID NO: 550530 - protein, 9 aa, Mycobacterium
QGAGAPEIA

SEQ ID NO: 550531 - protein, 9 aa, Mycobacterium
QGAGEREIA

SEQ ID NO: 550532 - protein, 5 aa, Mycobacterium
QGAGG

SEQ ID NO: 550533 - protein, 12 aa, Mycobacterium
QGAGGVPDRGIA

SEQ ID NO: 550534 - protein, 15 aa, Mycobacterium
QGAGHAASGYAHANG

SEQ ID NO: 550535 - protein, 5 aa, Mycobacterium
QGAGL

SEQ ID NO: 550536 - protein, 8 aa, Mycobacterium
QGAGPEAL

SEQ ID NO: 550537 - protein, 8 aa, Mycobacterium
QGAGPGQR

SEQ ID NO: 550538 - protein, 8 aa, Mycobacterium
QGAGPGTR

SEQ ID NO: 550539 - protein, 5 aa, Mycobacterium
QGAGR

SEQ ID NO: 550540 - protein, 19 aa, Mycobacterium
QGAGRADATEIERNPRSAA

SEQ ID NO: 550541 - protein, 9 aa, Mycobacterium
QGAGSCIDR

SEQ ID NO: 550542 - protein, 14 aa, Mycobacterium
QGAGSDLASQGISN

SEQ ID NO: 550543 - protein, 9 aa, Mycobacterium
QGAGSPVPL

SEQ ID NO: 550544 - protein, 5 aa, Mycobacterium
QGAGT

SEQ ID NO: 550545 - protein, 8 aa, Mycobacterium
QGAGTREV

SEQ ID NO: 550546 - protein, 4 aa, Mycobacterium
QGAH

SEQ ID NO: 550547 - protein, 13 aa, Mycobacterium
QGAKGPQAVGVSA

SEQ ID NO: 550548 - protein, 13 aa, Mycobacterium
QGAKGPQAVGVTA

SEQ ID NO: 550549 - protein, 12 aa, Mycobacterium
QGAKPGEGGQLP

SEQ ID NO: 550550 - protein, 9 aa, Mycobacterium
QGAKPGLGG

SEQ ID NO: 550551 - protein, 9 aa, Mycobacterium
QGAKRTPAL

SEQ ID NO: 550552 - protein, 6 aa, Mycobacterium
QGAKVT

SEQ ID NO: 550553 - protein, 55 aa, Mycobacterium
QGALGAPKNNNQAAQSQQPQASSAPAEAPQKESGQKESGQKESGLKESAEPTQTA

SEQ ID NO: 550554 - protein, 5 aa, Mycobacterium
QGAMR

SEQ ID NO: 550555 - protein, 9 aa, Mycobacterium
QGANGAAPH

SEQ ID NO: 550556 - protein, 7 aa, Mycobacterium
QGAPAAN

SEQ ID NO: 550557 - protein, 9 aa, Mycobacterium
QGAPAGARE

SEQ ID NO: 550558 - protein, 11 aa, Mycobacterium
QGAPASDDEYA

SEQ ID NO: 550559 - protein, 12 aa, Mycobacterium
QGAPASDDEYER

SEQ ID NO: 550560 - protein, 7 aa, Mycobacterium
QGAPEDI

SEQ ID NO: 550561 - protein, 8 aa, Mycobacterium
QGAPHNEP

SEQ ID NO: 550562 - protein, 7 aa, Mycobacterium
QGAPPEL

SEQ ID NO: 550563 - protein, 5 aa, Mycobacterium
QGAPV

SEQ ID NO: 550564 - protein, 18 aa, Mycobacterium
QGAPVRNADPANDFPTGQ

SEQ ID NO: 550565 - protein, 9 aa, Mycobacterium
QGAQECSEK

SEQ ID NO: 550566 - protein, 12 aa, Mycobacterium
QGAQHGAGEPIA

SEQ ID NO: 550567 - protein, 7 aa, Mycobacterium
QGAQLDE

SEQ ID NO: 550568 - protein, 6 aa, Mycobacterium
QGAQRL

SEQ ID NO: 550569 - protein, 4 aa, Mycobacterium
QGAR

SEQ ID NO: 550570 - protein, 8 aa, Mycobacterium
QGARAEAD

SEQ ID NO: 550571 - protein, 5 aa, Mycobacterium
QGARD

SEQ ID NO: 550572 - protein, 13 aa, Mycobacterium
QGARELAEASQRV

SEQ ID NO: 550573 - protein, 7 aa, Mycobacterium
QGARISG

SEQ ID NO: 550574 - protein, 7 aa, Mycobacterium
QGARKTL

SEQ ID NO: 550575 - protein, 5 aa, Mycobacterium
QGARL

SEQ ID NO: 550576 - protein, 8 aa, Mycobacterium
QGARLARA

SEQ ID NO: 550577 - protein, 6 aa, Mycobacterium
QGARPL

SEQ ID NO: 550578 - protein, 13 aa, Mycobacterium
QGARPPKRTVRGL

SEQ ID NO: 550579 - protein, 7 aa, Mycobacterium
QGARQQQ

SEQ ID NO: 550580 - protein, 7 aa, Mycobacterium
QGASAAI

SEQ ID NO: 550581 - protein, 6 aa, Mycobacterium
QGASAT

SEQ ID NO: 550582 - protein, 9 aa, Mycobacterium
QGASFDTAD

SEQ ID NO: 550583 - protein, 16 aa, Mycobacterium
QGASGGDGGAGGGTGL

SEQ ID NO: 550584 - protein, 8 aa, Mycobacterium
QGASQERI

SEQ ID NO: 550585 - protein, 14 aa, Mycobacterium
QGASSTKVISAGPT

SEQ ID NO: 550586 - protein, 14 aa, Mycobacterium
QGASTTDKDAALEQ

SEQ ID NO: 550587 - protein, 12 aa, Mycobacterium
QGATGATTPIPP

SEQ ID NO: 550588 - protein, 13 aa, Mycobacterium
QGATKQSIERESG

SEQ ID NO: 550589 - protein, 8 aa, Mycobacterium
QGATQHGL

SEQ ID NO: 550590 - protein, 8 aa, Mycobacterium
QGAVEPGR

SEQ ID NO: 550591 - protein, 6 aa, Mycobacterium
QGAVSE

SEQ ID NO: 550592 - protein, 13 aa, Mycobacterium
QGAVSQAAELASN

SEQ ID NO: 550593 - protein, 6 aa, Mycobacterium
QGAWSG

SEQ ID NO: 550594 - protein, 6 aa, Mycobacterium
QGAYST

SEQ ID NO: 550595 - protein, 5 aa, Mycobacterium
QGCGQ

SEQ ID NO: 550596 - protein, 13 aa, Mycobacterium
QGCGSGLAGEPAF

SEQ ID NO: 550597 - protein, 5 aa, Mycobacterium
QGCSP

SEQ ID NO: 550598 - protein, 35 aa, Mycobacterium
QGDADDKVGEPHRDRPHGPDGDEQQAISGRGPPRG

SEQ ID NO: 550599 - protein, 21 aa, Mycobacterium
QGDAGEAARDAMKRSAARFDN

SEQ ID NO: 550600 - protein, 10 aa, Mycobacterium
QGDAGPAAKP

SEQ ID NO: 550601 - protein, 9 aa, Mycobacterium
QGDAGPDEW

SEQ ID NO: 550602 - protein, 11 aa, Mycobacterium
QGDALAQAKPH

SEQ ID NO: 550603 - protein, 12 aa, Mycobacterium
QGDALASAAEDR

SEQ ID NO: 550604 - protein, 12 aa, Mycobacterium
QGDAPMGPEGSI

SEQ ID NO: 550605 - protein, 7 aa, Mycobacterium
QGDATTV

SEQ ID NO: 550606 - protein, 9 aa, Mycobacterium
QGDATTVRD

SEQ ID NO: 550607 - protein, 8 aa, Mycobacterium
QGDDGAAQ

SEQ ID NO: 550608 - protein, 4 aa, Mycobacterium
QGDE

SEQ ID NO: 550609 - protein, 9 aa, Mycobacterium
QGDEEPTQL

SEQ ID NO: 550610 - protein, 10 aa, Mycobacterium
QGDERGARAE

SEQ ID NO: 550611 - protein, 6 aa, Mycobacterium
QGDGAG

SEQ ID NO: 550612 - protein, 15 aa, Mycobacterium
QGDGETVFLRYSRHR

SEQ ID NO: 550613 - protein, 6 aa, Mycobacterium
QGDGGS

SEQ ID NO: 550614 - protein, 9 aa, Mycobacterium
QGDGGSSGL

SEQ ID NO: 550615 - protein, 12 aa, Mycobacterium
QGDGNFRETVSP

SEQ ID NO: 550616 - protein, 9 aa, Mycobacterium
QGDGSGLRA

SEQ ID NO: 550617 - protein, 12 aa, Mycobacterium
QGDGTFKETVTQ

SEQ ID NO: 550618 - protein, 7 aa, Mycobacterium
QGDGTYV

SEQ ID NO: 550619 - protein, 8 aa, Mycobacterium
QGDGTYVR

SEQ ID NO: 550620 - protein, 8 aa, Mycobacterium
QGDIQREA

SEQ ID NO: 550621 - protein, 8 aa, Mycobacterium
QGDISGNA

SEQ ID NO: 550622 - protein, 10 aa, Mycobacterium
QGDKGAAAKP

SEQ ID NO: 550623 - protein, 4 aa, Mycobacterium
QGDL

SEQ ID NO: 550624 - protein, 8 aa, Mycobacterium
QGDLDGGA

SEQ ID NO: 550625 - protein, 14 aa, Mycobacterium
QGDMGYGHSPDDVA

SEQ ID NO: 550626 - protein, 6 aa, Mycobacterium
QGDNSA

SEQ ID NO: 550627 - protein, 10 aa, Mycobacterium
QGDPAEAGER

SEQ ID NO: 550628 - protein, 8 aa, Mycobacterium
QGDPERPT

SEQ ID NO: 550629 - protein, 6 aa, Mycobacterium
QGDPGD

SEQ ID NO: 550630 - protein, 10 aa, Mycobacterium
QGDPTEAGER

SEQ ID NO: 550631 - protein, 8 aa, Mycobacterium
QGDPTGGW

SEQ ID NO: 550632 - protein, 9 aa, Mycobacterium
QGDQGPNGI

SEQ ID NO: 550633 - protein, 8 aa, Mycobacterium
QGDQVESG

SEQ ID NO: 550634 - protein, 17 aa, Mycobacterium
QGDRLGAAQRLDEATRV

SEQ ID NO: 550635 - protein, 12 aa, Mycobacterium
QGDRPYAGPSDY

SEQ ID NO: 550636 - protein, 8 aa, Mycobacterium
QGDRSGVA

SEQ ID NO: 550637 - protein, 5 aa, Mycobacterium
QGDRT

SEQ ID NO: 550638 - protein, 8 aa, Mycobacterium
QGDSANLD

SEQ ID NO: 550639 - protein, 17 aa, Mycobacterium
QGDSLDAELDRGTGGPV

SEQ ID NO: 550640 - protein, 6 aa, Mycobacterium
QGDSNA

SEQ ID NO: 550641 - protein, 11 aa, Mycobacterium
QGDSPFRPSTH

SEQ ID NO: 550642 - protein, 5 aa, Mycobacterium
QGDTP

SEQ ID NO: 550643 - protein, 6 aa, Mycobacterium
QGDTPM

SEQ ID NO: 550644 - protein, 7 aa, Mycobacterium
QGDTSSL

SEQ ID NO: 550645 - protein, 7 aa, Mycobacterium
QGDTVTA

SEQ ID NO: 550646 - protein, 19 aa, Mycobacterium
QGDVVESGANADIKPGNNL

SEQ ID NO: 550647 - protein, 11 aa, Mycobacterium
QGDWNSDSPSR

SEQ ID NO: 550648 - protein, 10 aa, Mycobacterium
QGDWSSDSSS

SEQ ID NO: 550649 - protein, 7 aa, Mycobacterium
QGEAAAP

SEQ ID NO: 550650 - protein, 15 aa, Mycobacterium
QGEAGMATQAKASQL

SEQ ID NO: 550651 - protein, 7 aa, Mycobacterium
QGEASEW

SEQ ID NO: 550652 - protein, 11 aa, Mycobacterium
QGEDPDLGARR

SEQ ID NO: 550653 - protein, 6 aa, Mycobacterium
QGEESI

SEQ ID NO: 550654 - protein, 5 aa, Mycobacterium
QGEGE

SEQ ID NO: 550655 - protein, 10 aa, Mycobacterium
QGEGGRTSGI

SEQ ID NO: 550656 - protein, 7 aa, Mycobacterium
QGEGGVN

SEQ ID NO: 550657 - protein, 9 aa, Mycobacterium
QGEGPDGLN

SEQ ID NO: 550658 - protein, 5 aa, Mycobacterium
QGEGQ

SEQ ID NO: 550659 - protein, 9 aa, Mycobacterium
QGEHSGADG

SEQ ID NO: 550660 - protein, 9 aa, Mycobacterium
QGEKAKKAI

SEQ ID NO: 550661 - protein, 10 aa, Mycobacterium
QGEKAPEGLR

SEQ ID NO: 550662 - protein, 4 aa, Mycobacterium
QGEL

SEQ ID NO: 550663 - protein, 5 aa, Mycobacterium
QGELD

SEQ ID NO: 550664 - protein, 8 aa, Mycobacterium
QGELEGGA

SEQ ID NO: 550665 - protein, 5 aa, Mycobacterium
QGELG

SEQ ID NO: 550666 - protein, 4 aa, Mycobacterium
QGEP

SEQ ID NO: 550667 - protein, 8 aa, Mycobacterium
QGEPADAV

SEQ ID NO: 550668 - protein, 13 aa, Mycobacterium
QGEPGQAERDAHD

SEQ ID NO: 550669 - protein, 11 aa, Mycobacterium
QGEPINGPSPQ

SEQ ID NO: 550670 - protein, 7 aa, Mycobacterium
QGEPPDH

SEQ ID NO: 550671 - protein, 14 aa, Mycobacterium
QGEPPWNIGEPQPE

SEQ ID NO: 550672 - protein, 6 aa, Mycobacterium
QGERDI

SEQ ID NO: 550673 - protein, 9 aa, Mycobacterium
QGERGFDPR

SEQ ID NO: 550674 - protein, 7 aa, Mycobacterium
QGERYGV

SEQ ID NO: 550675 - protein, 8 aa, Mycobacterium
QGERYGVP

SEQ ID NO: 550676 - protein, 7 aa, Mycobacterium
QGESPMT

SEQ ID NO: 550677 - protein, 5 aa, Mycobacterium
QGESS

SEQ ID NO: 550678 - protein, 25 aa, Mycobacterium
QGESVAPEPAPEASVEAPTSDGPAS

SEQ ID NO: 550679 - protein, 17 aa, Mycobacterium
QGESWSGGASTAMAGAA

SEQ ID NO: 550680 - protein, 7 aa, Mycobacterium
QGETDQL

SEQ ID NO: 550681 - protein, 5 aa, Mycobacterium
QGETP

SEQ ID NO: 550682 - protein, 4 aa, Mycobacterium
QGEV

SEQ ID NO: 550683 - protein, 13 aa, Mycobacterium
QGEVGPGGGPSGD

SEQ ID NO: 550684 - protein, 12 aa, Mycobacterium
QGEVGQLYKAVG

SEQ ID NO: 550685 - protein, 4 aa, Mycobacterium
QGEY

SEQ ID NO: 550686 - protein, 25 aa, Mycobacterium
QGEYGGAANGINGGSGGAGGFGISL

SEQ ID NO: 550687 - protein, 7 aa, Mycobacterium
QGEYNGK

SEQ ID NO: 550688 - protein, 19 aa, Mycobacterium
QGFATGDVTTSEIQDATSA

SEQ ID NO: 550689 - protein, 6 aa, Mycobacterium
QGFDSI

SEQ ID NO: 550690 - protein, 6 aa, Mycobacterium
QGFGDT

SEQ ID NO: 550691 - protein, 6 aa, Mycobacterium
QGFGGV

SEQ ID NO: 550692 - protein, 7 aa, Mycobacterium
QGFNSGD

SEQ ID NO: 550693 - protein, 4 aa, Mycobacterium
QGFP

SEQ ID NO: 550694 - protein, 11 aa, Mycobacterium
QGFPDEDGPAA

SEQ ID NO: 550695 - protein, 12 aa, Mycobacterium
QGFPDEDGPASM

SEQ ID NO: 550696 - protein, 10 aa, Mycobacterium
QGFPDEDGPV

SEQ ID NO: 550697 - protein, 15 aa, Mycobacterium
QGFPPGAPYAGPTGK

SEQ ID NO: 550698 - protein, 14 aa, Mycobacterium
QGFPPGAPYIGPAG

SEQ ID NO: 550699 - protein, 14 aa, Mycobacterium
QGFPPGAPYMGPTG

SEQ ID NO: 550700 - protein, 8 aa, Mycobacterium
QGFQGRSS

SEQ ID NO: 550701 - protein, 4 aa, Mycobacterium
QGFR

SEQ ID NO: 550702 - protein, 7 aa, Mycobacterium
QGFSERP

SEQ ID NO: 550703 - protein, 6 aa, Mycobacterium
QGFSET

SEQ ID NO: 550704 - protein, 13 aa, Mycobacterium
QGFSGGAGELRRG

SEQ ID NO: 550705 - protein, 5 aa, Mycobacterium
QGFSP

SEQ ID NO: 550706 - protein, 115 aa, Mycobacterium
QGFSSASPSTVASGASAAGAQPFKPVPGSTIPAGPPPASSAVSAPTSSSAGPVAAPAAPAASAAPMGGVPAAAGPMPMTAPPPAGTPSVAPPPAAPAAPVAPAPAAPAPAQPPPV

SEQ ID NO: 550707 - protein, 12 aa, Mycobacterium
QGGADAAQATVE

SEQ ID NO: 550708 - protein, 6 aa, Mycobacterium
QGGADR

SEQ ID NO: 550709 - protein, 5 aa, Mycobacterium
QGGAE

SEQ ID NO: 550710 - protein, 29 aa, Mycobacterium
QGGAGGTGGAAVGAGNHGGNGGDGGTGAL

SEQ ID NO: 550711 - protein, 23 aa, Mycobacterium
QGGAGLAGEVDARASAGPVHDGE

SEQ ID NO: 550712 - protein, 11 aa, Mycobacterium
QGGAGTSTNMN

SEQ ID NO: 550713 - protein, 12 aa, Mycobacterium
QGGAKPGEGETR

SEQ ID NO: 550714 - protein, 6 aa, Mycobacterium
QGGAPE

SEQ ID NO: 550715 - protein, 15 aa, Mycobacterium
QGGAPIELPPAGSYG

SEQ ID NO: 550716 - protein, 8 aa, Mycobacterium
QGGAPTDA

SEQ ID NO: 550717 - protein, 11 aa, Mycobacterium
QGGATRTPTSL

SEQ ID NO: 550718 - protein, 13 aa, Mycobacterium
QGGAVGEVSGAKI

SEQ ID NO: 550719 - protein, 8 aa, Mycobacterium
QGGAVNPA

SEQ ID NO: 550720 - protein, 19 aa, Mycobacterium
QGGCRAGRARAPGPPSDRC

SEQ ID NO: 550721 - protein, 8 aa, Mycobacterium
QGGDAPGR

SEQ ID NO: 550722 - protein, 13 aa, Mycobacterium
QGGDASSDSYCYP

SEQ ID NO: 550723 - protein, 9 aa, Mycobacterium
QGGDKDAAH

SEQ ID NO: 550724 - protein, 22 aa, Mycobacterium
QGGDMAEQKINEASAAIARLVR

SEQ ID NO: 550725 - protein, 8 aa, Mycobacterium
QGGDPAKI

SEQ ID NO: 550726 - protein, 6 aa, Mycobacterium
QGGDPL

SEQ ID NO: 550727 - protein, 9 aa, Mycobacterium
QGGDTPGHV

SEQ ID NO: 550728 - protein, 5 aa, Mycobacterium
QGGEA

SEQ ID NO: 550729 - protein, 15 aa, Mycobacterium
QGGEAGGHGEGRRST

SEQ ID NO: 550730 - protein, 10 aa, Mycobacterium
QGGEAGGHGM

SEQ ID NO: 550731 - protein, 11 aa, Mycobacterium
QGGEGGGHCGE

SEQ ID NO: 550732 - protein, 12 aa, Mycobacterium
QGGEGGGHTGPV

SEQ ID NO: 550733 - protein, 5 aa, Mycobacterium
QGGEL

SEQ ID NO: 550734 - protein, 10 aa, Mycobacterium
QGGENGATGP

SEQ ID NO: 550735 - protein, 7 aa, Mycobacterium
QGGETTD

SEQ ID NO: 550736 - protein, 7 aa, Mycobacterium
QGGEVSH

SEQ ID NO: 550737 - protein, 4 aa, Mycobacterium
QGGF

SEQ ID NO: 550738 - protein, 5 aa, Mycobacterium
QGGFD

SEQ ID NO: 550739 - protein, 7 aa, Mycobacterium
QGGGASL

SEQ ID NO: 550740 - protein, 16 aa, Mycobacterium
QGGGATASAAELASQY

SEQ ID NO: 550741 - protein, 7 aa, Mycobacterium
QGGGISE

SEQ ID NO: 550742 - protein, 6 aa, Mycobacterium
QGGGRY

SEQ ID NO: 550743 - protein, 14 aa, Mycobacterium
QGGGVVDEPATAQA

SEQ ID NO: 550744 - protein, 12 aa, Mycobacterium
QGGGYRSLEENQ

SEQ ID NO: 550745 - protein, 10 aa, Mycobacterium
QGGIDTPPQR

SEQ ID NO: 550746 - protein, 11 aa, Mycobacterium
QGGIRTEGNSY

SEQ ID NO: 550747 - protein, 12 aa, Mycobacterium
QGGKRAEALRAQ

SEQ ID NO: 550748 - protein, 4 aa, Mycobacterium
QGGL

SEQ ID NO: 550749 - protein, 6 aa, Mycobacterium
QGGLPT

SEQ ID NO: 550750 - protein, 4 aa, Mycobacterium
QGGP

SEQ ID NO: 550751 - protein, 6 aa, Mycobacterium
QGGPAT

SEQ ID NO: 550752 - protein, 13 aa, Mycobacterium
QGGPGATGRSYSD

SEQ ID NO: 550753 - protein, 7 aa, Mycobacterium
QGGPGVY

SEQ ID NO: 550754 - protein, 6 aa, Mycobacterium
QGGPPY

SEQ ID NO: 550755 - protein, 8 aa, Mycobacterium
QGGPQAAP

SEQ ID NO: 550756 - protein, 9 aa, Mycobacterium
QGGPRKQRI

SEQ ID NO: 550757 - protein, 5 aa, Mycobacterium
QGGPT

SEQ ID NO: 550758 - protein, 7 aa, Mycobacterium
QGGPTPS

SEQ ID NO: 550759 - protein, 10 aa, Mycobacterium
QGGPTSPPFA

SEQ ID NO: 550760 - protein, 9 aa, Mycobacterium
QGGQGAGTV

SEQ ID NO: 550761 - protein, 8 aa, Mycobacterium
QGGQGVRS

SEQ ID NO: 550762 - protein, 7 aa, Mycobacterium
QGGQLTE

SEQ ID NO: 550763 - protein, 29 aa, Mycobacterium
QGGQRHRSRGGRGRRLGRNRAPAGRPAPR

SEQ ID NO: 550764 - protein, 5 aa, Mycobacterium
QGGQW

SEQ ID NO: 550765 - protein, 7 aa, Mycobacterium
QGGQYPG

SEQ ID NO: 550766 - protein, 4 aa, Mycobacterium
QGGR

SEQ ID NO: 550767 - protein, 7 aa, Mycobacterium
QGGREVG

SEQ ID NO: 550768 - protein, 9 aa, Mycobacterium
QGGRSGIPL

SEQ ID NO: 550769 - protein, 7 aa, Mycobacterium
QGGSAGG

SEQ ID NO: 550770 - protein, 9 aa, Mycobacterium
QGGSGSITA

SEQ ID NO: 550771 - protein, 5 aa, Mycobacterium
QGGSH

SEQ ID NO: 550772 - protein, 5 aa, Mycobacterium
QGGSI

SEQ ID NO: 550773 - protein, 6 aa, Mycobacterium
QGGSIG

SEQ ID NO: 550774 - protein, 18 aa, Mycobacterium
QGGSLPDRVQQGLAAIVI

SEQ ID NO: 550775 - protein, 7 aa, Mycobacterium
QGGSPQL

SEQ ID NO: 550776 - protein, 8 aa, Mycobacterium
QGGSPVAD

SEQ ID NO: 550777 - protein, 6 aa, Mycobacterium
QGGSTV

SEQ ID NO: 550778 - protein, 12 aa, Mycobacterium
QGGSWQGPTAEE

SEQ ID NO: 550779 - protein, 8 aa, Mycobacterium
QGGTAATQ

SEQ ID NO: 550780 - protein, 9 aa, Mycobacterium
QGGTAATVV

SEQ ID NO: 550781 - protein, 8 aa, Mycobacterium
QGGTAGTV

SEQ ID NO: 550782 - protein, 9 aa, Mycobacterium
QGGTGGIGG

SEQ ID NO: 550783 - protein, 26 aa, Mycobacterium
QGGTGGTGGFGIGGTNGGDGGDGGFG

SEQ ID NO: 550784 - protein, 9 aa, Mycobacterium
QGGTRQPLE

SEQ ID NO: 550785 - protein, 6 aa, Mycobacterium
QGGTSF

SEQ ID NO: 550786 - protein, 5 aa, Mycobacterium
QGGTT

SEQ ID NO: 550787 - protein, 8 aa, Mycobacterium
QGGTTSEG

SEQ ID NO: 550788 - protein, 8 aa, Mycobacterium
QGGTTSMV

SEQ ID NO: 550789 - protein, 6 aa, Mycobacterium
QGGTVG

SEQ ID NO: 550790 - protein, 7 aa, Mycobacterium
QGGVATS

SEQ ID NO: 550791 - protein, 7 aa, Mycobacterium
QGGVDDL

SEQ ID NO: 550792 - protein, 14 aa, Mycobacterium
QGGYIGREDAANLT

SEQ ID NO: 550793 - protein, 12 aa, Mycobacterium
QGHARSDEPVHD

SEQ ID NO: 550794 - protein, 7 aa, Mycobacterium
QGHDATV

SEQ ID NO: 550795 - protein, 9 aa, Mycobacterium
QGHDPDSAA

SEQ ID NO: 550796 - protein, 12 aa, Mycobacterium
QGHDSPAARRVD

SEQ ID NO: 550797 - protein, 6 aa, Mycobacterium
QGHEAS

SEQ ID NO: 550798 - protein, 5 aa, Mycobacterium
QGHGL

SEQ ID NO: 550799 - protein, 17 aa, Mycobacterium
QGHNEQTLSGTCSGTFT

SEQ ID NO: 550800 - protein, 11 aa, Mycobacterium
QGHPEAADDAR

SEQ ID NO: 550801 - protein, 9 aa, Mycobacterium
QGHPETGEE

SEQ ID NO: 550802 - protein, 7 aa, Mycobacterium
QGHPQPR

SEQ ID NO: 550803 - protein, 10 aa, Mycobacterium
QGHPQRKDYP

SEQ ID NO: 550804 - protein, 6 aa, Mycobacterium
QGHPTP

SEQ ID NO: 550805 - protein, 8 aa, Mycobacterium
QGHQGAQE

SEQ ID NO: 550806 - protein, 20 aa, Mycobacterium
QGHSETLTSVGTKAHHAANG

SEQ ID NO: 550807 - protein, 4 aa, Mycobacterium
QGHV

SEQ ID NO: 550808 - protein, 14 aa, Mycobacterium
QGIDDTYKTGRGSI

SEQ ID NO: 550809 - protein, 5 aa, Mycobacterium
QGIDP

SEQ ID NO: 550810 - protein, 21 aa, Mycobacterium
QGIDPSESAGSLAEFERSGRW

SEQ ID NO: 550811 - protein, 9 aa, Mycobacterium
QGIDQRSAC

SEQ ID NO: 550812 - protein, 10 aa, Mycobacterium
QGIDTENAKK

SEQ ID NO: 550813 - protein, 11 aa, Mycobacterium
QGIDTKPYTSR

SEQ ID NO: 550814 - protein, 4 aa, Mycobacterium
QGIG

SEQ ID NO: 550815 - protein, 8 aa, Mycobacterium
QGIGDSAN

SEQ ID NO: 550816 - protein, 6 aa, Mycobacterium
QGIGGS

SEQ ID NO: 550817 - protein, 12 aa, Mycobacterium
QGIGTAEDSPLA

SEQ ID NO: 550818 - protein, 14 aa, Mycobacterium
QGIKPPKWSPTDDY

SEQ ID NO: 550819 - protein, 5 aa, Mycobacterium
QGIPA

SEQ ID NO: 550820 - protein, 5 aa, Mycobacterium
QGIPD

SEQ ID NO: 550821 - protein, 13 aa, Mycobacterium
QGIPDRDERGQRI

SEQ ID NO: 550822 - protein, 7 aa, Mycobacterium
QGIPREA

SEQ ID NO: 550823 - protein, 5 aa, Mycobacterium
QGIPV

SEQ ID NO: 550824 - protein, 4 aa, Mycobacterium
QGIR

SEQ ID NO: 550825 - protein, 15 aa, Mycobacterium
QGIRAEVDSSDDRMN

SEQ ID NO: 550826 - protein, 5 aa, Mycobacterium
QGIRG

SEQ ID NO: 550827 - protein, 4 aa, Mycobacterium
QGIS

SEQ ID NO: 550828 - protein, 9 aa, Mycobacterium
QGISAGTTA

SEQ ID NO: 550829 - protein, 11 aa, Mycobacterium
QGISSEDAKKV

SEQ ID NO: 550830 - protein, 10 aa, Mycobacterium
QGISSENAKK

SEQ ID NO: 550831 - protein, 13 aa, Mycobacterium
QGISVGPSETVDA

SEQ ID NO: 550832 - protein, 6 aa, Mycobacterium
QGITGD

SEQ ID NO: 550833 - protein, 10 aa, Mycobacterium
QGITSEQAKK

SEQ ID NO: 550834 - protein, 7 aa, Mycobacterium
QGITSGP

SEQ ID NO: 550835 - protein, 4 aa, Mycobacterium
QGKA

SEQ ID NO: 550836 - protein, 9 aa, Mycobacterium
QGKAPKDEI

SEQ ID NO: 550837 - protein, 21 aa, Mycobacterium
QGKAQTDIGITSSPAVMTSEG

SEQ ID NO: 550838 - protein, 7 aa, Mycobacterium
QGKDGKR

SEQ ID NO: 550839 - protein, 8 aa, Mycobacterium
QGKDGNRS

SEQ ID NO: 550840 - protein, 5 aa, Mycobacterium
QGKDL

SEQ ID NO: 550841 - protein, 10 aa, Mycobacterium
QGKDNEPAFA

SEQ ID NO: 550842 - protein, 8 aa, Mycobacterium
QGKDPARF

SEQ ID NO: 550843 - protein, 4 aa, Mycobacterium
QGKE

SEQ ID NO: 550844 - protein, 5 aa, Mycobacterium
QGKEE

SEQ ID NO: 550845 - protein, 7 aa, Mycobacterium
QGKEPQW

SEQ ID NO: 550846 - protein, 5 aa, Mycobacterium
QGKGS

SEQ ID NO: 550847 - protein, 6 aa, Mycobacterium
QGKGSQ

SEQ ID NO: 550848 - protein, 13 aa, Mycobacterium
QGKGTNGDSAPIP

SEQ ID NO: 550849 - protein, 12 aa, Mycobacterium
QGKGTNGDSVPV

SEQ ID NO: 550850 - protein, 6 aa, Mycobacterium
QGKGVR

SEQ ID NO: 550851 - protein, 6 aa, Mycobacterium
QGKHGG

SEQ ID NO: 550852 - protein, 8 aa, Mycobacterium
QGKNPKYL

SEQ ID NO: 550853 - protein, 14 aa, Mycobacterium
QGKPDPQYRGTDGN

SEQ ID NO: 550854 - protein, 10 aa, Mycobacterium
QGKPEAAADA

SEQ ID NO: 550855 - protein, 9 aa, Mycobacterium
QGKPVGTVQ

SEQ ID NO: 550856 - protein, 4 aa, Mycobacterium
QGKQ

SEQ ID NO: 550857 - protein, 5 aa, Mycobacterium
QGKQV

SEQ ID NO: 550858 - protein, 5 aa, Mycobacterium
QGKRG

SEQ ID NO: 550859 - protein, 14 aa, Mycobacterium
QGKRRIHQKPSRTE

SEQ ID NO: 550860 - protein, 11 aa, Mycobacterium
QGKSASAADAA

SEQ ID NO: 550861 - protein, 7 aa, Mycobacterium
QGKTAED

SEQ ID NO: 550862 - protein, 8 aa, Mycobacterium
QGKVSDNH

SEQ ID NO: 550863 - protein, 21 aa, Mycobacterium
QGLAPTPHGKNAYTPSASVPM

SEQ ID NO: 550864 - protein, 10 aa, Mycobacterium
QGLASGAAAS

SEQ ID NO: 550865 - protein, 14 aa, Mycobacterium
QGLATRAEGAPDTV

SEQ ID NO: 550866 - protein, 7 aa, Mycobacterium
QGLDNGP

SEQ ID NO: 550867 - protein, 11 aa, Mycobacterium
QGLDPSGPAAA

SEQ ID NO: 550868 - protein, 10 aa, Mycobacterium
QGLDPSGPAE

SEQ ID NO: 550869 - protein, 5 aa, Mycobacterium
QGLEH

SEQ ID NO: 550870 - protein, 5 aa, Mycobacterium
QGLES

SEQ ID NO: 550871 - protein, 4 aa, Mycobacterium
QGLG

SEQ ID NO: 550872 - protein, 6 aa, Mycobacterium
QGLGAA

SEQ ID NO: 550873 - protein, 6 aa, Mycobacterium
QGLGAG

SEQ ID NO: 550874 - protein, 64 aa, Mycobacterium
QGLGDDQFDGRADEAADKKDEAAADGKKDPDAKMAAAKDAAIEEARADSGATFATDGKPAPGIQ

SEQ ID NO: 550875 - protein, 7 aa, Mycobacterium
QGLGEGP

SEQ ID NO: 550876 - protein, 4 aa, Mycobacterium
QGLK

SEQ ID NO: 550877 - protein, 5 aa, Mycobacterium
QGLNA

SEQ ID NO: 550878 - protein, 7 aa, Mycobacterium
QGLNTGM

SEQ ID NO: 550879 - protein, 6 aa, Mycobacterium
QGLPAG

SEQ ID NO: 550880 - protein, 5 aa, Mycobacterium
QGLPD

SEQ ID NO: 550881 - protein, 8 aa, Mycobacterium
QGLPDQPI

SEQ ID NO: 550882 - protein, 10 aa, Mycobacterium
QGLPDRSGEG

SEQ ID NO: 550883 - protein, 8 aa, Mycobacterium
QGLPGGQL

SEQ ID NO: 550884 - protein, 11 aa, Mycobacterium
QGLPPAGDGPV

SEQ ID NO: 550885 - protein, 5 aa, Mycobacterium
QGLPQ

SEQ ID NO: 550886 - protein, 9 aa, Mycobacterium
QGLPRPPSV

SEQ ID NO: 550887 - protein, 9 aa, Mycobacterium
QGLPSGQPK

SEQ ID NO: 550888 - protein, 9 aa, Mycobacterium
QGLPSGQPR

SEQ ID NO: 550889 - protein, 9 aa, Mycobacterium
QGLQRNPGI

SEQ ID NO: 550890 - protein, 6 aa, Mycobacterium
QGLRDT

SEQ ID NO: 550891 - protein, 8 aa, Mycobacterium
QGLRDTTM

SEQ ID NO: 550892 - protein, 11 aa, Mycobacterium
QGLRKTGLPRD

SEQ ID NO: 550893 - protein, 4 aa, Mycobacterium
QGLS

SEQ ID NO: 550894 - protein, 73 aa, Mycobacterium
QGLSAGSALGSLPPATGTGTPAAGQAAATPAAGLTSGAGVPSAGLTGAGATPPAVSPAAPGLATSGGPTSAAP

SEQ ID NO: 550895 - protein, 10 aa, Mycobacterium
QGLSGPNSTS

SEQ ID NO: 550896 - protein, 5 aa, Mycobacterium
QGLSS

SEQ ID NO: 550897 - protein, 7 aa, Mycobacterium
QGLSTHE

SEQ ID NO: 550898 - protein, 9 aa, Mycobacterium
QGLSTQAQQ

SEQ ID NO: 550899 - protein, 4 aa, Mycobacterium
QGLT

SEQ ID NO: 550900 - protein, 12 aa, Mycobacterium
QGLTAKAKSLPP

SEQ ID NO: 550901 - protein, 7 aa, Mycobacterium
QGLTPPA

SEQ ID NO: 550902 - protein, 12 aa, Mycobacterium
QGLTPRSITQPG

SEQ ID NO: 550903 - protein, 8 aa, Mycobacterium
QGLTQRES

SEQ ID NO: 550904 - protein, 12 aa, Mycobacterium
QGLVEGKGQAEQ

SEQ ID NO: 550905 - protein, 84 aa, Mycobacterium
QGMAGKNGLDDAAKIEPADSLGSGAGGGGGDDGATAPAASGGADLKPAASAISGMSSPTSPPLAGASATPSPTAAAAESGMGGS

SEQ ID NO: 550906 - protein, 13 aa, Mycobacterium
QGMDPDGSYSTEI

SEQ ID NO: 550907 - protein, 4 aa, Mycobacterium
QGMG

SEQ ID NO: 550908 - protein, 6 aa, Mycobacterium
QGMKPG

SEQ ID NO: 550909 - protein, 18 aa, Mycobacterium
QGMKSGGFGGPKPNPYME

SEQ ID NO: 550910 - protein, 4 aa, Mycobacterium
QGMP

SEQ ID NO: 550911 - protein, 10 aa, Mycobacterium
QGMPTPLGLP

SEQ ID NO: 550912 - protein, 10 aa, Mycobacterium
QGMRDRPKVT

SEQ ID NO: 550913 - protein, 7 aa, Mycobacterium
QGMRPDD

SEQ ID NO: 550914 - protein, 12 aa, Mycobacterium
QGNAAAASPTIN

SEQ ID NO: 550915 - protein, 12 aa, Mycobacterium
QGNAGDKRAALS

SEQ ID NO: 550916 - protein, 8 aa, Mycobacterium
QGNASSSI

SEQ ID NO: 550917 - protein, 8 aa, Mycobacterium
QGNDDDAN

SEQ ID NO: 550918 - protein, 8 aa, Mycobacterium
QGNEPPEI

SEQ ID NO: 550919 - protein, 5 aa, Mycobacterium
QGNFD

SEQ ID NO: 550920 - protein, 14 aa, Mycobacterium
QGNFGSPGNDPAAA

SEQ ID NO: 550921 - protein, 15 aa, Mycobacterium
QGNFGSPGNDPPAAM

SEQ ID NO: 550922 - protein, 8 aa, Mycobacterium
QGNGAMRQ

SEQ ID NO: 550923 - protein, 5 aa, Mycobacterium
QGNGV

SEQ ID NO: 550924 - protein, 7 aa, Mycobacterium
QGNNSNV

SEQ ID NO: 550925 - protein, 13 aa, Mycobacterium
QGNPAPSTPGFTP

SEQ ID NO: 550926 - protein, 8 aa, Mycobacterium
QGNPDPVS

SEQ ID NO: 550927 - protein, 7 aa, Mycobacterium
QGNPLDT

SEQ ID NO: 550928 - protein, 9 aa, Mycobacterium
QGNPPPEDV

SEQ ID NO: 550929 - protein, 4 aa, Mycobacterium
QGNQ

SEQ ID NO: 550930 - protein, 7 aa, Mycobacterium
QGNQVRV

SEQ ID NO: 550931 - protein, 13 aa, Mycobacterium
QGNSDRRAPNAVK

SEQ ID NO: 550932 - protein, 10 aa, Mycobacterium
QGNSIECPEE

SEQ ID NO: 550933 - protein, 11 aa, Mycobacterium
QGNSIESAEEA

SEQ ID NO: 550934 - protein, 8 aa, Mycobacterium
QGNSSGRR

SEQ ID NO: 550935 - protein, 6 aa, Mycobacterium
QGPAAA

SEQ ID NO: 550936 - protein, 7 aa, Mycobacterium
QGPAKAL

SEQ ID NO: 550937 - protein, 5 aa, Mycobacterium
QGPAP

SEQ ID NO: 550938 - protein, 10 aa, Mycobacterium
QGPAPADLDR

SEQ ID NO: 550939 - protein, 9 aa, Mycobacterium
QGPAPAPVT

SEQ ID NO: 550940 - protein, 9 aa, Mycobacterium
QGPAPEGAT

SEQ ID NO: 550941 - protein, 6 aa, Mycobacterium
QGPARA

SEQ ID NO: 550942 - protein, 7 aa, Mycobacterium
QGPASRA

SEQ ID NO: 550943 - protein, 12 aa, Mycobacterium
QGPATAQSTGEE

SEQ ID NO: 550944 - protein, 7 aa, Mycobacterium
QGPATPW

SEQ ID NO: 550945 - protein, 7 aa, Mycobacterium
QGPATRR

SEQ ID NO: 550946 - protein, 6 aa, Mycobacterium
QGPAWS

SEQ ID NO: 550947 - protein, 13 aa, Mycobacterium
QGPCDTAAADRRA

SEQ ID NO: 550948 - protein, 167 aa, Mycobacterium
QGPCPATTTGTDGTPTGGVTGPGQGAPPGRSAGGVIGPGQVGSAAPLGNAGGVKGPGSGGDPVPGQAGSVTGPGQASTAPAALNSGPAGGVLGPASGTSSSAPKAGGVSGGSVSGSSGASTSASPPVQAHSTATPTSGTPSTTTGHSNSGSGAGTEPSASATPPDAQ

SEQ ID NO: 550949 - protein, 6 aa, Mycobacterium
QGPDAL

SEQ ID NO: 550950 - protein, 10 aa, Mycobacterium
QGPDGPGELR

SEQ ID NO: 550951 - protein, 9 aa, Mycobacterium
QGPDGQRRL

SEQ ID NO: 550952 - protein, 12 aa, Mycobacterium
QGPDGSPRGGVG

SEQ ID NO: 550953 - protein, 8 aa, Mycobacterium
QGPDQRSF

SEQ ID NO: 550954 - protein, 6 aa, Mycobacterium
QGPDQV

SEQ ID NO: 550955 - protein, 13 aa, Mycobacterium
QGPDTDPRVTDDG

SEQ ID NO: 550956 - protein, 20 aa, Mycobacterium
QGPEAGGHRSSFDAGAPDEP

SEQ ID NO: 550957 - protein, 5 aa, Mycobacterium
QGPEI

SEQ ID NO: 550958 - protein, 7 aa, Mycobacterium
QGPELAT

SEQ ID NO: 550959 - protein, 17 aa, Mycobacterium
QGPELSPAGRRGTDDEV

SEQ ID NO: 550960 - protein, 13 aa, Mycobacterium
QGPETEHLLAMAG

SEQ ID NO: 550961 - protein, 25 aa, Mycobacterium
QGPFEDDPNVTDKKLPGNPTRSFRT

SEQ ID NO: 550962 - protein, 6 aa, Mycobacterium
QGPGAA

SEQ ID NO: 550963 - protein, 12 aa, Mycobacterium
QGPGAGGHRGTF

SEQ ID NO: 550964 - protein, 22 aa, Mycobacterium
QGPGAGGHRGTFAPDTEPGEES

SEQ ID NO: 550965 - protein, 7 aa, Mycobacterium
QGPGDRR

SEQ ID NO: 550966 - protein, 12 aa, Mycobacterium
QGPGERPTGAGI

SEQ ID NO: 550967 - protein, 9 aa, Mycobacterium
QGPGGAGVE

SEQ ID NO: 550968 - protein, 6 aa, Mycobacterium
QGPGGE

SEQ ID NO: 550969 - protein, 6 aa, Mycobacterium
QGPGLT

SEQ ID NO: 550970 - protein, 6 aa, Mycobacterium
QGPGSI

SEQ ID NO: 550971 - protein, 6 aa, Mycobacterium
QGPGVV

SEQ ID NO: 550972 - protein, 5 aa, Mycobacterium
QGPID

SEQ ID NO: 550973 - protein, 10 aa, Mycobacterium
QGPITQAGQS

SEQ ID NO: 550974 - protein, 7 aa, Mycobacterium
QGPITSA

SEQ ID NO: 550975 - protein, 8 aa, Mycobacterium
QGPKSAEV

SEQ ID NO: 550976 - protein, 4 aa, Mycobacterium
QGPL

SEQ ID NO: 550977 - protein, 6 aa, Mycobacterium
QGPLGA

SEQ ID NO: 550978 - protein, 6 aa, Mycobacterium
QGPLSA

SEQ ID NO: 550979 - protein, 8 aa, Mycobacterium
QGPLSASE

SEQ ID NO: 550980 - protein, 7 aa, Mycobacterium
QGPMPDD

SEQ ID NO: 550981 - protein, 6 aa, Mycobacterium
QGPNAV

SEQ ID NO: 550982 - protein, 7 aa, Mycobacterium
QGPNAVP

SEQ ID NO: 550983 - protein, 16 aa, Mycobacterium
QGPNLANRDNKDTAHK

SEQ ID NO: 550984 - protein, 14 aa, Mycobacterium
QGPPNKFEAGTGNI

SEQ ID NO: 550985 - protein, 9 aa, Mycobacterium
QGPPRTAGP

SEQ ID NO: 550986 - protein, 8 aa, Mycobacterium
QGPPRTVG

SEQ ID NO: 550987 - protein, 9 aa, Mycobacterium
QGPPRVDGP

SEQ ID NO: 550988 - protein, 9 aa, Mycobacterium
QGPPSPSVA

SEQ ID NO: 550989 - protein, 4 aa, Mycobacterium
QGPQ

SEQ ID NO: 550990 - protein, 7 aa, Mycobacterium
QGPQGPR

SEQ ID NO: 550991 - protein, 7 aa, Mycobacterium
QGPQTYR

SEQ ID NO: 550992 - protein, 7 aa, Mycobacterium
QGPQVGT

SEQ ID NO: 550993 - protein, 4 aa, Mycobacterium
QGPR

SEQ ID NO: 550994 - protein, 7 aa, Mycobacterium
QGPRDSG

SEQ ID NO: 550995 - protein, 6 aa, Mycobacterium
QGPREA

SEQ ID NO: 550996 - protein, 8 aa, Mycobacterium
QGPREAGE

SEQ ID NO: 550997 - protein, 8 aa, Mycobacterium
QGPRESGE

SEQ ID NO: 550998 - protein, 5 aa, Mycobacterium
QGPRL

SEQ ID NO: 550999 - protein, 9 aa, Mycobacterium
QGPRPDGPG

SEQ ID NO: 551000 - protein, 9 aa, Mycobacterium
QGPRPEKDV

SEQ ID NO: 551001 - protein, 7 aa, Mycobacterium
QGPRSTD

SEQ ID NO: 551002 - protein, 7 aa, Mycobacterium
QGPRSTE

SEQ ID NO: 551003 - protein, 4 aa, Mycobacterium
QGPS

SEQ ID NO: 551004 - protein, 5 aa, Mycobacterium
QGPSA

SEQ ID NO: 551005 - protein, 21 aa, Mycobacterium
QGPSAGGHRGTFDATARPSDI

SEQ ID NO: 551006 - protein, 5 aa, Mycobacterium
QGPSG

SEQ ID NO: 551007 - protein, 9 aa, Mycobacterium
QGPSGPISE

SEQ ID NO: 551008 - protein, 7 aa, Mycobacterium
QGPTAAI

SEQ ID NO: 551009 - protein, 7 aa, Mycobacterium
QGPTANP

SEQ ID NO: 551010 - protein, 8 aa, Mycobacterium
QGPTAPWG

SEQ ID NO: 551011 - protein, 10 aa, Mycobacterium
QGPTENGHRP

SEQ ID NO: 551012 - protein, 7 aa, Mycobacterium
QGPTRAL

SEQ ID NO: 551013 - protein, 10 aa, Mycobacterium
QGPTSTPCGT

SEQ ID NO: 551014 - protein, 7 aa, Mycobacterium
QGPTTPW

SEQ ID NO: 551015 - protein, 8 aa, Mycobacterium
QGPTVGKE

SEQ ID NO: 551016 - protein, 6 aa, Mycobacterium
QGPVQL

SEQ ID NO: 551017 - protein, 8 aa, Mycobacterium
QGQAGKLP

SEQ ID NO: 551018 - protein, 9 aa, Mycobacterium
QGQAVNASD

SEQ ID NO: 551019 - protein, 5 aa, Mycobacterium
QGQAY

SEQ ID NO: 551020 - protein, 4 aa, Mycobacterium
QGQD

SEQ ID NO: 551021 - protein, 7 aa, Mycobacterium
QGQDERL

SEQ ID NO: 551022 - protein, 4 aa, Mycobacterium
QGQG

SEQ ID NO: 551023 - protein, 6 aa, Mycobacterium
QGQGAF

SEQ ID NO: 551024 - protein, 7 aa, Mycobacterium
QGQGATV

SEQ ID NO: 551025 - protein, 6 aa, Mycobacterium
QGQGGS

SEQ ID NO: 551026 - protein, 7 aa, Mycobacterium
QGQGGTI

SEQ ID NO: 551027 - protein, 9 aa, Mycobacterium
QGQGTAYTS

SEQ ID NO: 551028 - protein, 6 aa, Mycobacterium
QGQPPM

SEQ ID NO: 551029 - protein, 6 aa, Mycobacterium
QGQPRR

SEQ ID NO: 551030 - protein, 5 aa, Mycobacterium
QGQQR

SEQ ID NO: 551031 - protein, 9 aa, Mycobacterium
QGQQRTAPY

SEQ ID NO: 551032 - protein, 4 aa, Mycobacterium
QGQR

SEQ ID NO: 551033 - protein, 9 aa, Mycobacterium
QGQRARPYT

SEQ ID NO: 551034 - protein, 9 aa, Mycobacterium
QGQRPRAYS

SEQ ID NO: 551035 - protein, 7 aa, Mycobacterium
QGQRPTI

SEQ ID NO: 551036 - protein, 11 aa, Mycobacterium
QGQRSAAGRAA

SEQ ID NO: 551037 - protein, 8 aa, Mycobacterium
QGQSAGDD

SEQ ID NO: 551038 - protein, 5 aa, Mycobacterium
QGQSL

SEQ ID NO: 551039 - protein, 9 aa, Mycobacterium
QGQSPSRDE

SEQ ID NO: 551040 - protein, 7 aa, Mycobacterium
QGQTDSE

SEQ ID NO: 551041 - protein, 5 aa, Mycobacterium
QGQYS

SEQ ID NO: 551042 - protein, 19 aa, Mycobacterium
QGRAAARVPARQQQGARRA

SEQ ID NO: 551043 - protein, 6 aa, Mycobacterium
QGRADL

SEQ ID NO: 551044 - protein, 7 aa, Mycobacterium
QGRAGHG

SEQ ID NO: 551045 - protein, 7 aa, Mycobacterium
QGRAGSR

SEQ ID NO: 551046 - protein, 7 aa, Mycobacterium
QGRASVP

SEQ ID NO: 551047 - protein, 6 aa, Mycobacterium
QGRCPA

SEQ ID NO: 551048 - protein, 7 aa, Mycobacterium
QGRDDDV

SEQ ID NO: 551049 - protein, 6 aa, Mycobacterium
QGRDGL

SEQ ID NO: 551050 - protein, 8 aa, Mycobacterium
QGRDTQAR

SEQ ID NO: 551051 - protein, 6 aa, Mycobacterium
QGRDTR

SEQ ID NO: 551052 - protein, 13 aa, Mycobacterium
QGREATPPSRGTL

SEQ ID NO: 551053 - protein, 13 aa, Mycobacterium
QGREDGSLADPGY

SEQ ID NO: 551054 - protein, 9 aa, Mycobacterium
QGREEFDTE

SEQ ID NO: 551055 - protein, 8 aa, Mycobacterium
QGREEHPS

SEQ ID NO: 551056 - protein, 8 aa, Mycobacterium
QGREGDTD

SEQ ID NO: 551057 - protein, 6 aa, Mycobacterium
QGREHT

SEQ ID NO: 551058 - protein, 8 aa, Mycobacterium
QGREQQAY

SEQ ID NO: 551059 - protein, 9 aa, Mycobacterium
QGRERPSDQ

SEQ ID NO: 551060 - protein, 8 aa, Mycobacterium
QGRERSPS

SEQ ID NO: 551061 - protein, 10 aa, Mycobacterium
QGRETNPSDQ

SEQ ID NO: 551062 - protein, 6 aa, Mycobacterium
QGRGAL

SEQ ID NO: 551063 - protein, 11 aa, Mycobacterium
QGRGDAADQTI

SEQ ID NO: 551064 - protein, 8 aa, Mycobacterium
QGRGDEAD

SEQ ID NO: 551065 - protein, 8 aa, Mycobacterium
QGRGEEAD

SEQ ID NO: 551066 - protein, 8 aa, Mycobacterium
QGRGEEAE

SEQ ID NO: 551067 - protein, 7 aa, Mycobacterium
QGRGETL

SEQ ID NO: 551068 - protein, 5 aa, Mycobacterium
QGRGG

SEQ ID NO: 551069 - protein, 8 aa, Mycobacterium
QGRGGTKA

SEQ ID NO: 551070 - protein, 9 aa, Mycobacterium
QGRGRDADD

SEQ ID NO: 551071 - protein, 7 aa, Mycobacterium
QGRGREA

SEQ ID NO: 551072 - protein, 6 aa, Mycobacterium
QGRGTA

SEQ ID NO: 551073 - protein, 8 aa, Mycobacterium
QGRGTLAQ

SEQ ID NO: 551074 - protein, 5 aa, Mycobacterium
QGRHT

SEQ ID NO: 551075 - protein, 5 aa, Mycobacterium
QGRID

SEQ ID NO: 551076 - protein, 10 aa, Mycobacterium
QGRIDKTTAE

SEQ ID NO: 551077 - protein, 4 aa, Mycobacterium
QGRK

SEQ ID NO: 551078 - protein, 6 aa, Mycobacterium
QGRKPA

SEQ ID NO: 551079 - protein, 4 aa, Mycobacterium
QGRN

SEQ ID NO: 551080 - protein, 5 aa, Mycobacterium
QGRPC

SEQ ID NO: 551081 - protein, 10 aa, Mycobacterium
QGRPEAATDA

SEQ ID NO: 551082 - protein, 9 aa, Mycobacterium
QGRPMGQRG

SEQ ID NO: 551083 - protein, 8 aa, Mycobacterium
QGRPMSPH

SEQ ID NO: 551084 - protein, 8 aa, Mycobacterium
QGRPNPKS

SEQ ID NO: 551085 - protein, 12 aa, Mycobacterium
QGRPRAEAETDA

SEQ ID NO: 551086 - protein, 7 aa, Mycobacterium
QGRPTIK

SEQ ID NO: 551087 - protein, 13 aa, Mycobacterium
QGRPTSEAVEGTA

SEQ ID NO: 551088 - protein, 10 aa, Mycobacterium
QGRPVGGLPR

SEQ ID NO: 551089 - protein, 7 aa, Mycobacterium
QGRQARA

SEQ ID NO: 551090 - protein, 5 aa, Mycobacterium
QGRQV

SEQ ID NO: 551091 - protein, 7 aa, Mycobacterium
QGRQVDD

SEQ ID NO: 551092 - protein, 4 aa, Mycobacterium
QGRR

SEQ ID NO: 551093 - protein, 15 aa, Mycobacterium
QGRRSGARATRADNR

SEQ ID NO: 551094 - protein, 8 aa, Mycobacterium
QGRRTATK

SEQ ID NO: 551095 - protein, 12 aa, Mycobacterium
QGRRTSAADETV

SEQ ID NO: 551096 - protein, 10 aa, Mycobacterium
QGRSPEERRA

SEQ ID NO: 551097 - protein, 8 aa, Mycobacterium
QGRSTPTE

SEQ ID NO: 551098 - protein, 9 aa, Mycobacterium
QGRSTSTGR

SEQ ID NO: 551099 - protein, 5 aa, Mycobacterium
QGRSY

SEQ ID NO: 551100 - protein, 7 aa, Mycobacterium
QGRTAAQ

SEQ ID NO: 551101 - protein, 7 aa, Mycobacterium
QGRTGQV

SEQ ID NO: 551102 - protein, 6 aa, Mycobacterium
QGRTLD

SEQ ID NO: 551103 - protein, 17 aa, Mycobacterium
QGRTLSRGELDRSTNRL

SEQ ID NO: 551104 - protein, 6 aa, Mycobacterium
QGRTPD

SEQ ID NO: 551105 - protein, 10 aa, Mycobacterium
QGRTPGARLD

SEQ ID NO: 551106 - protein, 7 aa, Mycobacterium
QGRTPME

SEQ ID NO: 551107 - protein, 16 aa, Mycobacterium
QGRTSEARRYADEAQR

SEQ ID NO: 551108 - protein, 5 aa, Mycobacterium
QGRTV

SEQ ID NO: 551109 - protein, 4 aa, Mycobacterium
QGRV

SEQ ID NO: 551110 - protein, 6 aa, Mycobacterium
QGRVAG

SEQ ID NO: 551111 - protein, 5 aa, Mycobacterium
QGSAR

SEQ ID NO: 551112 - protein, 11 aa, Mycobacterium
QGSARRQASTK

SEQ ID NO: 551113 - protein, 10 aa, Mycobacterium
QGSASSRAAV

SEQ ID NO: 551114 - protein, 6 aa, Mycobacterium
QGSDAR

SEQ ID NO: 551115 - protein, 9 aa, Mycobacterium
QGSDATAAH

SEQ ID NO: 551116 - protein, 5 aa, Mycobacterium
QGSDI

SEQ ID NO: 551117 - protein, 9 aa, Mycobacterium
QGSDKEAAH

SEQ ID NO: 551118 - protein, 13 aa, Mycobacterium
QGSEAGGHGMSGR

SEQ ID NO: 551119 - protein, 6 aa, Mycobacterium
QGSEAR

SEQ ID NO: 551120 - protein, 7 aa, Mycobacterium
QGSEIAE

SEQ ID NO: 551121 - protein, 10 aa, Mycobacterium
QGSESGGHGM

SEQ ID NO: 551122 - protein, 7 aa, Mycobacterium
QGSEVDE

SEQ ID NO: 551123 - protein, 6 aa, Mycobacterium
QGSGAL

SEQ ID NO: 551124 - protein, 10 aa, Mycobacterium
QGSGDTSGYG

SEQ ID NO: 551125 - protein, 6 aa, Mycobacterium
QGSGGH

SEQ ID NO: 551126 - protein, 8 aa, Mycobacterium
QGSGGPAL

SEQ ID NO: 551127 - protein, 6 aa, Mycobacterium
QGSGHD

SEQ ID NO: 551128 - protein, 9 aa, Mycobacterium
QGSGPEPDA

SEQ ID NO: 551129 - protein, 18 aa, Mycobacterium
QGSGSIVNTSSGGSLGTD

SEQ ID NO: 551130 - protein, 11 aa, Mycobacterium
QGSGYRSLEEN

SEQ ID NO: 551131 - protein, 13 aa, Mycobacterium
QGSKHQVEAGPQS

SEQ ID NO: 551132 - protein, 16 aa, Mycobacterium
QGSLAEAASRSRATPS

SEQ ID NO: 551133 - protein, 10 aa, Mycobacterium
QGSNWNAAQG

SEQ ID NO: 551134 - protein, 26 aa, Mycobacterium
QGSPAEVIGDPKEERTRQFLQRILNP

SEQ ID NO: 551135 - protein, 7 aa, Mycobacterium
QGSPANG

SEQ ID NO: 551136 - protein, 8 aa, Mycobacterium
QGSPAQRR

SEQ ID NO: 551137 - protein, 8 aa, Mycobacterium
QGSPGPAV

SEQ ID NO: 551138 - protein, 8 aa, Mycobacterium
QGSPKHRH

SEQ ID NO: 551139 - protein, 10 aa, Mycobacterium
QGSPPSREDV

SEQ ID NO: 551140 - protein, 9 aa, Mycobacterium
QGSPSARAR

SEQ ID NO: 551141 - protein, 15 aa, Mycobacterium
QGSPVPRGSWQSAAT

SEQ ID NO: 551142 - protein, 4 aa, Mycobacterium
QGSQ

SEQ ID NO: 551143 - protein, 8 aa, Mycobacterium
QGSQFSGM

SEQ ID NO: 551144 - protein, 6 aa, Mycobacterium
QGSQWA

SEQ ID NO: 551145 - protein, 7 aa, Mycobacterium
QGSQWAG

SEQ ID NO: 551146 - protein, 7 aa, Mycobacterium
QGSQWPS

SEQ ID NO: 551147 - protein, 7 aa, Mycobacterium
QGSREAC

SEQ ID NO: 551148 - protein, 7 aa, Mycobacterium
QGSRGAA

SEQ ID NO: 551149 - protein, 6 aa, Mycobacterium
QGSRQF

SEQ ID NO: 551150 - protein, 8 aa, Mycobacterium
QGSSEPFD

SEQ ID NO: 551151 - protein, 5 aa, Mycobacterium
QGSSG

SEQ ID NO: 551152 - protein, 21 aa, Mycobacterium
QGSSRDAFDAEARTASEKDVK

SEQ ID NO: 551153 - protein, 31 aa, Mycobacterium
QGSTATSATSATAARQTELAPAAGPAPAAST

SEQ ID NO: 551154 - protein, 5 aa, Mycobacterium
QGSTD

SEQ ID NO: 551155 - protein, 6 aa, Mycobacterium
QGSTQL

SEQ ID NO: 551156 - protein, 10 aa, Mycobacterium
QGSTRTSERE

SEQ ID NO: 551157 - protein, 5 aa, Mycobacterium
QGSVM

SEQ ID NO: 551158 - protein, 5 aa, Mycobacterium
QGSYG

SEQ ID NO: 551159 - protein, 9 aa, Mycobacterium
QGSYPTLGG

SEQ ID NO: 551160 - protein, 6 aa, Mycobacterium
QGSYQA

SEQ ID NO: 551161 - protein, 4 aa, Mycobacterium
QGTA

SEQ ID NO: 551162 - protein, 6 aa, Mycobacterium
QGTAEE

SEQ ID NO: 551163 - protein, 12 aa, Mycobacterium
QGTAGSTGTPRT

SEQ ID NO: 551164 - protein, 25 aa, Mycobacterium
QGTAKTPVPTKGTPVVRGESGGNTH

SEQ ID NO: 551165 - protein, 14 aa, Mycobacterium
QGTAPDLSDVEPAE

SEQ ID NO: 551166 - protein, 14 aa, Mycobacterium
QGTAPDRAELDGAD

SEQ ID NO: 551167 - protein, 11 aa, Mycobacterium
QGTAPDRQDLE

SEQ ID NO: 551168 - protein, 17 aa, Mycobacterium
QGTAPGLADTDPAELAE

SEQ ID NO: 551169 - protein, 9 aa, Mycobacterium
QGTDAGNAL

SEQ ID NO: 551170 - protein, 10 aa, Mycobacterium
QGTDQPAAQL

SEQ ID NO: 551171 - protein, 8 aa, Mycobacterium
QGTDTQAV

SEQ ID NO: 551172 - protein, 16 aa, Mycobacterium
QGTEGGGHGARRGRST

SEQ ID NO: 551173 - protein, 9 aa, Mycobacterium
QGTEPHSET

SEQ ID NO: 551174 - protein, 6 aa, Mycobacterium
QGTESQ

SEQ ID NO: 551175 - protein, 10 aa, Mycobacterium
QGTGAGRSLG

SEQ ID NO: 551176 - protein, 11 aa, Mycobacterium
QGTGEGATFAR

SEQ ID NO: 551177 - protein, 6 aa, Mycobacterium
QGTGER

SEQ ID NO: 551178 - protein, 7 aa, Mycobacterium
QGTGGGA

SEQ ID NO: 551179 - protein, 6 aa, Mycobacterium
QGTGGS

SEQ ID NO: 551180 - protein, 14 aa, Mycobacterium
QGTGHTVQADHVDP

SEQ ID NO: 551181 - protein, 6 aa, Mycobacterium
QGTGKK

SEQ ID NO: 551182 - protein, 6 aa, Mycobacterium
QGTHPG

SEQ ID NO: 551183 - protein, 20 aa, Mycobacterium
QGTKDYSTENASGGTSGPFY

SEQ ID NO: 551184 - protein, 20 aa, Mycobacterium
QGTKDYSTQNASGGTSGPFY

SEQ ID NO: 551185 - protein, 19 aa, Mycobacterium
QGTKEYSTENASGGSSGPF

SEQ ID NO: 551186 - protein, 7 aa, Mycobacterium
QGTNGEG

SEQ ID NO: 551187 - protein, 11 aa, Mycobacterium
QGTNLDRTTRR

SEQ ID NO: 551188 - protein, 4 aa, Mycobacterium
QGTP

SEQ ID NO: 551189 - protein, 11 aa, Mycobacterium
QGTPAADGAAA

SEQ ID NO: 551190 - protein, 7 aa, Mycobacterium
QGTPAAV

SEQ ID NO: 551191 - protein, 8 aa, Mycobacterium
QGTPASYG

SEQ ID NO: 551192 - protein, 6 aa, Mycobacterium
QGTPAW

SEQ ID NO: 551193 - protein, 7 aa, Mycobacterium
QGTPEWV

SEQ ID NO: 551194 - protein, 8 aa, Mycobacterium
QGTPGPLN

SEQ ID NO: 551195 - protein, 5 aa, Mycobacterium
QGTPL

SEQ ID NO: 551196 - protein, 6 aa, Mycobacterium
QGTPLD

SEQ ID NO: 551197 - protein, 7 aa, Mycobacterium
QGTPPHT

SEQ ID NO: 551198 - protein, 7 aa, Mycobacterium
QGTPPVT

SEQ ID NO: 551199 - protein, 5 aa, Mycobacterium
QGTPR

SEQ ID NO: 551200 - protein, 5 aa, Mycobacterium
QGTPV

SEQ ID NO: 551201 - protein, 6 aa, Mycobacterium
QGTPVN

SEQ ID NO: 551202 - protein, 17 aa, Mycobacterium
QGTQGKLSLSTGAESLA

SEQ ID NO: 551203 - protein, 13 aa, Mycobacterium
QGTQGQLAGSDDA

SEQ ID NO: 551204 - protein, 7 aa, Mycobacterium
QGTQLGP

SEQ ID NO: 551205 - protein, 9 aa, Mycobacterium
QGTQRDQRA

SEQ ID NO: 551206 - protein, 21 aa, Mycobacterium
QGTQTWPAGRPAPGRERKRHA

SEQ ID NO: 551207 - protein, 5 aa, Mycobacterium
QGTRL

SEQ ID NO: 551208 - protein, 13 aa, Mycobacterium
QGTRPPARTVRGL

SEQ ID NO: 551209 - protein, 8 aa, Mycobacterium
QGTRRTRP

SEQ ID NO: 551210 - protein, 9 aa, Mycobacterium
QGTSLTDAA

SEQ ID NO: 551211 - protein, 10 aa, Mycobacterium
QGTTCQQRSI

SEQ ID NO: 551212 - protein, 6 aa, Mycobacterium
QGTTDG

SEQ ID NO: 551213 - protein, 7 aa, Mycobacterium
QGTTGGS

SEQ ID NO: 551214 - protein, 8 aa, Mycobacterium
QGTTPAQH

SEQ ID NO: 551215 - protein, 11 aa, Mycobacterium
QGTTPTSARRA

SEQ ID NO: 551216 - protein, 6 aa, Mycobacterium
QGTTST

SEQ ID NO: 551217 - protein, 4 aa, Mycobacterium
QGTV

SEQ ID NO: 551218 - protein, 9 aa, Mycobacterium
QGTVADGAQ

SEQ ID NO: 551219 - protein, 10 aa, Mycobacterium
QGTVGPEGDL

SEQ ID NO: 551220 - protein, 5 aa, Mycobacterium
QGTVP

SEQ ID NO: 551221 - protein, 9 aa, Mycobacterium
QGTVRPETS

SEQ ID NO: 551222 - protein, 8 aa, Mycobacterium
QGTVRTDS

SEQ ID NO: 551223 - protein, 8 aa, Mycobacterium
QGTVRTES

SEQ ID NO: 551224 - protein, 9 aa, Mycobacterium
QGVDGSKVY

SEQ ID NO: 551225 - protein, 6 aa, Mycobacterium
QGVEAG

SEQ ID NO: 551226 - protein, 6 aa, Mycobacterium
QGVEEL

SEQ ID NO: 551227 - protein, 8 aa, Mycobacterium
QGVENPVR

SEQ ID NO: 551228 - protein, 4 aa, Mycobacterium
QGVG

SEQ ID NO: 551229 - protein, 12 aa, Mycobacterium
QGVGDDTAESLA

SEQ ID NO: 551230 - protein, 6 aa, Mycobacterium
QGVGEE

SEQ ID NO: 551231 - protein, 5 aa, Mycobacterium
QGVGG

SEQ ID NO: 551232 - protein, 13 aa, Mycobacterium
QGVGGNGGAGGKL

SEQ ID NO: 551233 - protein, 10 aa, Mycobacterium
QGVGNRGSDE

SEQ ID NO: 551234 - protein, 8 aa, Mycobacterium
QGVGPGDK

SEQ ID NO: 551235 - protein, 17 aa, Mycobacterium
QGVGSDDEAKFYPEASD

SEQ ID NO: 551236 - protein, 8 aa, Mycobacterium
QGVKTKRQ

SEQ ID NO: 551237 - protein, 9 aa, Mycobacterium
QGVPAQDAT

SEQ ID NO: 551238 - protein, 10 aa, Mycobacterium
QGVPATEITT

SEQ ID NO: 551239 - protein, 5 aa, Mycobacterium
QGVPG

SEQ ID NO: 551240 - protein, 11 aa, Mycobacterium
QGVPGGPGSVD

SEQ ID NO: 551241 - protein, 4 aa, Mycobacterium
QGVQ

SEQ ID NO: 551242 - protein, 14 aa, Mycobacterium
QGVQAAVTATLAEK

SEQ ID NO: 551243 - protein, 10 aa, Mycobacterium
QGVQRGARRP

SEQ ID NO: 551244 - protein, 7 aa, Mycobacterium
QGVRDGQ

SEQ ID NO: 551245 - protein, 9 aa, Mycobacterium
QGVRPEDAA

SEQ ID NO: 551246 - protein, 23 aa, Mycobacterium
QGVRRGKRVRTTKPDPAAARHPD

SEQ ID NO: 551247 - protein, 20 aa, Mycobacterium
QGVRRGKRVRTTKPDPVAAR

SEQ ID NO: 551248 - protein, 4 aa, Mycobacterium
QGVS

SEQ ID NO: 551249 - protein, 4 aa, Mycobacterium
QGVT

SEQ ID NO: 551250 - protein, 5 aa, Mycobacterium
QGVTA

SEQ ID NO: 551251 - protein, 6 aa, Mycobacterium
QGVTAD

SEQ ID NO: 551252 - protein, 7 aa, Mycobacterium
QGVTADT

SEQ ID NO: 551253 - protein, 10 aa, Mycobacterium
QGVTAPAGFR

SEQ ID NO: 551254 - protein, 12 aa, Mycobacterium
QGVTHAEDRDGD

SEQ ID NO: 551255 - protein, 8 aa, Mycobacterium
QGVTNVAP

SEQ ID NO: 551256 - protein, 7 aa, Mycobacterium
QGVTSGP

SEQ ID NO: 551257 - protein, 12 aa, Mycobacterium
QGVYGAAADARR

SEQ ID NO: 551258 - protein, 4 aa, Mycobacterium
QGWL

SEQ ID NO: 551259 - protein, 4 aa, Mycobacterium
QGWN

SEQ ID NO: 551260 - protein, 4 aa, Mycobacterium
QGWR

SEQ ID NO: 551261 - protein, 9 aa, Mycobacterium
QGWSGGRDA

SEQ ID NO: 551262 - protein, 4 aa, Mycobacterium
QGYA

SEQ ID NO: 551263 - protein, 7 aa, Mycobacterium
QGYADPG

SEQ ID NO: 551264 - protein, 6 aa, Mycobacterium
QGYADR

SEQ ID NO: 551265 - protein, 6 aa, Mycobacterium
QGYAYS

SEQ ID NO: 551266 - protein, 4 aa, Mycobacterium
QGYD

SEQ ID NO: 551267 - protein, 12 aa, Mycobacterium
QGYDGPPGTVSD

SEQ ID NO: 551268 - protein, 6 aa, Mycobacterium
QGYDTR

SEQ ID NO: 551269 - protein, 9 aa, Mycobacterium
QGYGGEDTD

SEQ ID NO: 551270 - protein, 4 aa, Mycobacterium
QGYI

SEQ ID NO: 551271 - protein, 5 aa, Mycobacterium
QGYKD

SEQ ID NO: 551272 - protein, 7 aa, Mycobacterium
QGYNSGI

SEQ ID NO: 551273 - protein, 5 aa, Mycobacterium
QGYPL

SEQ ID NO: 551274 - protein, 5 aa, Mycobacterium
QGYQS

SEQ ID NO: 551275 - protein, 18 aa, Mycobacterium
QGYQSRCERTPGARTSEG

SEQ ID NO: 551276 - protein, 10 aa, Mycobacterium
QGYRGRGGLT

SEQ ID NO: 551277 - protein, 12 aa, Mycobacterium
QGYRPEFRGEKD

SEQ ID NO: 551278 - protein, 13 aa, Mycobacterium
QGYRPSNSNATAL

SEQ ID NO: 551279 - protein, 9 aa, Mycobacterium
QGYSDSQGI

SEQ ID NO: 551280 - protein, 7 aa, Mycobacterium
QGYTPDF

SEQ ID NO: 551281 - protein, 7 aa, Mycobacterium
QGYTPNF

SEQ ID NO: 551282 - protein, 6 aa, Mycobacterium
QGYTSD

SEQ ID NO: 551283 - protein, 6 aa, Mycobacterium
QHAAGG

SEQ ID NO: 551284 - protein, 9 aa, Mycobacterium
QHAAPPPKV

SEQ ID NO: 551285 - protein, 9 aa, Mycobacterium
QHAAPTDLY

SEQ ID NO: 551286 - protein, 4 aa, Mycobacterium
QHAD

SEQ ID NO: 551287 - protein, 13 aa, Mycobacterium
QHADAPPEDPWLR

SEQ ID NO: 551288 - protein, 6 aa, Mycobacterium
QHADGG

SEQ ID NO: 551289 - protein, 11 aa, Mycobacterium
QHADKSPPGIV

SEQ ID NO: 551290 - protein, 7 aa, Mycobacterium
QHADPAR

SEQ ID NO: 551291 - protein, 7 aa, Mycobacterium
QHAEATQ

SEQ ID NO: 551292 - protein, 9 aa, Mycobacterium
QHAGAQTGI

SEQ ID NO: 551293 - protein, 6 aa, Mycobacterium
QHAGAR

SEQ ID NO: 551294 - protein, 25 aa, Mycobacterium
QHAGGTEDIEGVPPQIQATPGMPER

SEQ ID NO: 551295 - protein, 5 aa, Mycobacterium
QHAGN

SEQ ID NO: 551296 - protein, 5 aa, Mycobacterium
QHAGS

SEQ ID NO: 551297 - protein, 5 aa, Mycobacterium
QHAHT

SEQ ID NO: 551298 - protein, 11 aa, Mycobacterium
QHANAARSEAA

SEQ ID NO: 551299 - protein, 14 aa, Mycobacterium
QHANENMQNQPHGG

SEQ ID NO: 551300 - protein, 6 aa, Mycobacterium
QHAPRD

SEQ ID NO: 551301 - protein, 13 aa, Mycobacterium
QHAPRDNDDSDVT

SEQ ID NO: 551302 - protein, 11 aa, Mycobacterium
QHAPSTGGRPA

SEQ ID NO: 551303 - protein, 8 aa, Mycobacterium
QHARHEAE

SEQ ID NO: 551304 - protein, 11 aa, Mycobacterium
QHARNESEVGG

SEQ ID NO: 551305 - protein, 6 aa, Mycobacterium
QHARSA

SEQ ID NO: 551306 - protein, 9 aa, Mycobacterium
QHASYDSDA

SEQ ID NO: 551307 - protein, 13 aa, Mycobacterium
QHATVGSPVTRDR

SEQ ID NO: 551308 - protein, 16 aa, Mycobacterium
QHATVTSSPSGDGPDL

SEQ ID NO: 551309 - protein, 6 aa, Mycobacterium
QHDAFG

SEQ ID NO: 551310 - protein, 9 aa, Mycobacterium
QHDAGPENI

SEQ ID NO: 551311 - protein, 4 aa, Mycobacterium
QHDE

SEQ ID NO: 551312 - protein, 7 aa, Mycobacterium
QHDEQYG

SEQ ID NO: 551313 - protein, 4 aa, Mycobacterium
QHDG

SEQ ID NO: 551314 - protein, 9 aa, Mycobacterium
QHDGQDGHP

SEQ ID NO: 551315 - protein, 8 aa, Mycobacterium
QHDGTPAS

SEQ ID NO: 551316 - protein, 10 aa, Mycobacterium
QHDPSLDQRK

SEQ ID NO: 551317 - protein, 8 aa, Mycobacterium
QHDRPAVS

SEQ ID NO: 551318 - protein, 14 aa, Mycobacterium
QHDSATTTRPQSST

SEQ ID NO: 551319 - protein, 6 aa, Mycobacterium
QHDTPC

SEQ ID NO: 551320 - protein, 5 aa, Mycobacterium
QHEAI

SEQ ID NO: 551321 - protein, 7 aa, Mycobacterium
QHEDARA

SEQ ID NO: 551322 - protein, 22 aa, Mycobacterium
QHEDPNAPGLHQSRHDTPDEST

SEQ ID NO: 551323 - protein, 10 aa, Mycobacterium
QHEGDGSRPV

SEQ ID NO: 551324 - protein, 9 aa, Mycobacterium
QHEGDGTHP

SEQ ID NO: 551325 - protein, 9 aa, Mycobacterium
QHEGEGTHP

SEQ ID NO: 551326 - protein, 6 aa, Mycobacterium
QHEPAA

SEQ ID NO: 551327 - protein, 22 aa, Mycobacterium
QHEPESPVRGADQRGPERRLPG

SEQ ID NO: 551328 - protein, 16 aa, Mycobacterium
QHEPSAHAAAADVDAA

SEQ ID NO: 551329 - protein, 13 aa, Mycobacterium
QHEPSAHATAADV

SEQ ID NO: 551330 - protein, 13 aa, Mycobacterium
QHEPTAHAAASDV

SEQ ID NO: 551331 - protein, 14 aa, Mycobacterium
QHEPVGKNISETRR

SEQ ID NO: 551332 - protein, 5 aa, Mycobacterium
QHETE

SEQ ID NO: 551333 - protein, 11 aa, Mycobacterium
QHETSRSGDPH

SEQ ID NO: 551334 - protein, 5 aa, Mycobacterium
QHFGS

SEQ ID NO: 551335 - protein, 18 aa, Mycobacterium
QHFSSAATTLGVSQSTLS

SEQ ID NO: 551336 - protein, 20 aa, Mycobacterium
QHGAGAPKSCCSPSDNPDPS

SEQ ID NO: 551337 - protein, 7 aa, Mycobacterium
QHGAPRG

SEQ ID NO: 551338 - protein, 13 aa, Mycobacterium
QHGDHTGYQTGPA

SEQ ID NO: 551339 - protein, 6 aa, Mycobacterium
QHGDRD

SEQ ID NO: 551340 - protein, 6 aa, Mycobacterium
QHGGDR

SEQ ID NO: 551341 - protein, 11 aa, Mycobacterium
QHGGDTDFSGS

SEQ ID NO: 551342 - protein, 67 aa, Mycobacterium
QHGGLPPDPFPAHDGPRQGRRKTDRRRPAPHGDRRQGGPLPADRPGVGSGAAQWPAAPDRRERPHRP

SEQ ID NO: 551343 - protein, 6 aa, Mycobacterium
QHGGPI

SEQ ID NO: 551344 - protein, 11 aa, Mycobacterium
QHGGSIGPDQL

SEQ ID NO: 551345 - protein, 16 aa, Mycobacterium
QHGGTAPSTADDRGDY

SEQ ID NO: 551346 - protein, 5 aa, Mycobacterium
QHGHD

SEQ ID NO: 551347 - protein, 4 aa, Mycobacterium
QHGM

SEQ ID NO: 551348 - protein, 6 aa, Mycobacterium
QHGNKA

SEQ ID NO: 551349 - protein, 7 aa, Mycobacterium
QHGNKAA

SEQ ID NO: 551350 - protein, 7 aa, Mycobacterium
QHGNKEA

SEQ ID NO: 551351 - protein, 10 aa, Mycobacterium
QHGNKSKDAQ

SEQ ID NO: 551352 - protein, 9 aa, Mycobacterium
QHGNPDGRM

SEQ ID NO: 551353 - protein, 6 aa, Mycobacterium
QHGNRE

SEQ ID NO: 551354 - protein, 5 aa, Mycobacterium
QHGPA

SEQ ID NO: 551355 - protein, 5 aa, Mycobacterium
QHGPD

SEQ ID NO: 551356 - protein, 9 aa, Mycobacterium
QHGPLPAEM

SEQ ID NO: 551357 - protein, 11 aa, Mycobacterium
QHGPMADRAGH

SEQ ID NO: 551358 - protein, 5 aa, Mycobacterium
QHGRA

SEQ ID NO: 551359 - protein, 6 aa, Mycobacterium
QHGRAA

SEQ ID NO: 551360 - protein, 9 aa, Mycobacterium
QHGRPDKKV

SEQ ID NO: 551361 - protein, 6 aa, Mycobacterium
QHGRVP

SEQ ID NO: 551362 - protein, 30 aa, Mycobacterium
QHGSHTTVSQRAAEAVRSVTPPARPRPPRR

SEQ ID NO: 551363 - protein, 31 aa, Mycobacterium
QHGSSVAAARAAAGGGAAGRARRRGGPPREF

SEQ ID NO: 551364 - protein, 4 aa, Mycobacterium
QHGT

SEQ ID NO: 551365 - protein, 5 aa, Mycobacterium
QHGTD

SEQ ID NO: 551366 - protein, 8 aa, Mycobacterium
QHGTGTAK

SEQ ID NO: 551367 - protein, 6 aa, Mycobacterium
QHGTPA

SEQ ID NO: 551368 - protein, 17 aa, Mycobacterium
QHHPEQRGIASGGTSVS

SEQ ID NO: 551369 - protein, 16 aa, Mycobacterium
QHHPKKKGTASGGTTV

SEQ ID NO: 551370 - protein, 7 aa, Mycobacterium
QHHPRQR

SEQ ID NO: 551371 - protein, 17 aa, Mycobacterium
QHHPRQRGIASGGTSVS

SEQ ID NO: 551372 - protein, 17 aa, Mycobacterium
QHHPRQRGIASGGTTVN

SEQ ID NO: 551373 - protein, 9 aa, Mycobacterium
QHHQENPDY

SEQ ID NO: 551374 - protein, 6 aa, Mycobacterium
QHIGPD

SEQ ID NO: 551375 - protein, 7 aa, Mycobacterium
QHIPERG

SEQ ID NO: 551376 - protein, 7 aa, Mycobacterium
QHKPGAN

SEQ ID NO: 551377 - protein, 7 aa, Mycobacterium
QHKPGAS

SEQ ID NO: 551378 - protein, 7 aa, Mycobacterium
QHKPNGA

SEQ ID NO: 551379 - protein, 16 aa, Mycobacterium
QHKRTRGRRGLSLVVN

SEQ ID NO: 551380 - protein, 9 aa, Mycobacterium
QHKTGDPVG

SEQ ID NO: 551381 - protein, 17 aa, Mycobacterium
QHKTSPRTVARILRGPA

SEQ ID NO: 551382 - protein, 6 aa, Mycobacterium
QHLEPG

SEQ ID NO: 551383 - protein, 11 aa, Mycobacterium
QHNGDTDFSGS

SEQ ID NO: 551384 - protein, 14 aa, Mycobacterium
QHNQQRSTESIADD

SEQ ID NO: 551385 - protein, 13 aa, Mycobacterium
QHNQQRTTRSIAD

SEQ ID NO: 551386 - protein, 8 aa, Mycobacterium
QHNSKEEP

SEQ ID NO: 551387 - protein, 7 aa, Mycobacterium
QHNTGQP

SEQ ID NO: 551388 - protein, 8 aa, Mycobacterium
QHNTNPAG

SEQ ID NO: 551389 - protein, 6 aa, Mycobacterium
QHPAKS

SEQ ID NO: 551390 - protein, 13 aa, Mycobacterium
QHPAPARQPALQY

SEQ ID NO: 551391 - protein, 9 aa, Mycobacterium
QHPAPLDPN

SEQ ID NO: 551392 - protein, 5 aa, Mycobacterium
QHPAS

SEQ ID NO: 551393 - protein, 4 aa, Mycobacterium
QHPD

SEQ ID NO: 551394 - protein, 5 aa, Mycobacterium
QHPDA

SEQ ID NO: 551395 - protein, 6 aa, Mycobacterium
QHPDAS

SEQ ID NO: 551396 - protein, 14 aa, Mycobacterium
QHPDDARRAVDSGV

SEQ ID NO: 551397 - protein, 7 aa, Mycobacterium
QHPDGDW

SEQ ID NO: 551398 - protein, 6 aa, Mycobacterium
QHPDGL

SEQ ID NO: 551399 - protein, 8 aa, Mycobacterium
QHPDPAVS

SEQ ID NO: 551400 - protein, 9 aa, Mycobacterium
QHPDTPGLA

SEQ ID NO: 551401 - protein, 6 aa, Mycobacterium
QHPDWA

SEQ ID NO: 551402 - protein, 4 aa, Mycobacterium
QHPE

SEQ ID NO: 551403 - protein, 4 aa, Mycobacterium
QHPG

SEQ ID NO: 551404 - protein, 7 aa, Mycobacterium
QHPGNDV

SEQ ID NO: 551405 - protein, 6 aa, Mycobacterium
QHPGYG

SEQ ID NO: 551406 - protein, 6 aa, Mycobacterium
QHPHAD

SEQ ID NO: 551407 - protein, 7 aa, Mycobacterium
QHPIPPG

SEQ ID NO: 551408 - protein, 4 aa, Mycobacterium
QHPL

SEQ ID NO: 551409 - protein, 12 aa, Mycobacterium
QHPLATKDSDGR

SEQ ID NO: 551410 - protein, 4 aa, Mycobacterium
QHPQ

SEQ ID NO: 551411 - protein, 5 aa, Mycobacterium
QHPTE

SEQ ID NO: 551412 - protein, 7 aa, Mycobacterium
QHPTPGN

SEQ ID NO: 551413 - protein, 5 aa, Mycobacterium
QHQAS

SEQ ID NO: 551414 - protein, 5 aa, Mycobacterium
QHQDA

SEQ ID NO: 551415 - protein, 7 aa, Mycobacterium
QHQDATA

SEQ ID NO: 551416 - protein, 9 aa, Mycobacterium
QHQGPRTRT

SEQ ID NO: 551417 - protein, 8 aa, Mycobacterium
QHQRGRGV

SEQ ID NO: 551418 - protein, 4 aa, Mycobacterium
QHQV

SEQ ID NO: 551419 - protein, 8 aa, Mycobacterium
QHRAEGKA

SEQ ID NO: 551420 - protein, 8 aa, Mycobacterium
QHRAGPAY

SEQ ID NO: 551421 - protein, 5 aa, Mycobacterium
QHRAT

SEQ ID NO: 551422 - protein, 21 aa, Mycobacterium
QHRATQRHQPVSDTPADPDAS

SEQ ID NO: 551423 - protein, 12 aa, Mycobacterium
QHRDARGRQHRA

SEQ ID NO: 551424 - protein, 10 aa, Mycobacterium
QHRDGHRVST

SEQ ID NO: 551425 - protein, 6 aa, Mycobacterium
QHRDKV

SEQ ID NO: 551426 - protein, 18 aa, Mycobacterium
QHRDPDRQLPSEGTTRGA

SEQ ID NO: 551427 - protein, 12 aa, Mycobacterium
QHRDQTGAGEPI

SEQ ID NO: 551428 - protein, 7 aa, Mycobacterium
QHRGQAG

SEQ ID NO: 551429 - protein, 11 aa, Mycobacterium
QHRGQRPRSYT

SEQ ID NO: 551430 - protein, 10 aa, Mycobacterium
QHRHDGPRAA

SEQ ID NO: 551431 - protein, 4 aa, Mycobacterium
QHRK

SEQ ID NO: 551432 - protein, 9 aa, Mycobacterium
QHRPAGQSR

SEQ ID NO: 551433 - protein, 5 aa, Mycobacterium
QHRPD

SEQ ID NO: 551434 - protein, 9 aa, Mycobacterium
QHRPDGESR

SEQ ID NO: 551435 - protein, 7 aa, Mycobacterium
QHRPEGR

SEQ ID NO: 551436 - protein, 24 aa, Mycobacterium
QHRPEPSTPLPARQRASDDSPRQR

SEQ ID NO: 551437 - protein, 7 aa, Mycobacterium
QHRPGAQ

SEQ ID NO: 551438 - protein, 9 aa, Mycobacterium
QHRQRQSDR

SEQ ID NO: 551439 - protein, 11 aa, Mycobacterium
QHRRKGLTTEA

SEQ ID NO: 551440 - protein, 7 aa, Mycobacterium
QHRSTPA

SEQ ID NO: 551441 - protein, 12 aa, Mycobacterium
QHRTAPQATPLA

SEQ ID NO: 551442 - protein, 5 aa, Mycobacterium
QHRTR

SEQ ID NO: 551443 - protein, 5 aa, Mycobacterium
QHSDA

SEQ ID NO: 551444 - protein, 4 aa, Mycobacterium
QHSE

SEQ ID NO: 551445 - protein, 7 aa, Mycobacterium
QHSEDFS

SEQ ID NO: 551446 - protein, 8 aa, Mycobacterium
QHSGNDPV

SEQ ID NO: 551447 - protein, 20 aa, Mycobacterium
QHSGVDQQPLGMSSPAVAPY

SEQ ID NO: 551448 - protein, 5 aa, Mycobacterium
QHSNT

SEQ ID NO: 551449 - protein, 9 aa, Mycobacterium
QHSPSSPVI

SEQ ID NO: 551450 - protein, 8 aa, Mycobacterium
QHSRRRTV

SEQ ID NO: 551451 - protein, 6 aa, Mycobacterium
QHSSSI

SEQ ID NO: 551452 - protein, 10 aa, Mycobacterium
QHSTEQAGGT

SEQ ID NO: 551453 - protein, 14 aa, Mycobacterium
QHTAESYATPRPGT

SEQ ID NO: 551454 - protein, 11 aa, Mycobacterium
QHTDKAPPVRT

SEQ ID NO: 551455 - protein, 9 aa, Mycobacterium
QHTDQAPPV

SEQ ID NO: 551456 - protein, 11 aa, Mycobacterium
QHTDSEALSEA

SEQ ID NO: 551457 - protein, 17 aa, Mycobacterium
QHTGGTGKPLVAPDPVN

SEQ ID NO: 551458 - protein, 5 aa, Mycobacterium
QHTHP

SEQ ID NO: 551459 - protein, 12 aa, Mycobacterium
QHTLGDDDLPVT

SEQ ID NO: 551460 - protein, 8 aa, Mycobacterium
QHTNAQRT

SEQ ID NO: 551461 - protein, 14 aa, Mycobacterium
QHTNPKPQKRDFDE

SEQ ID NO: 551462 - protein, 6 aa, Mycobacterium
QHTQAD

SEQ ID NO: 551463 - protein, 14 aa, Mycobacterium
QHTRRTVTDPSKRH

SEQ ID NO: 551464 - protein, 7 aa, Mycobacterium
QHTTGDI

SEQ ID NO: 551465 - protein, 7 aa, Mycobacterium
QHTTVSD

SEQ ID NO: 551466 - protein, 7 aa, Mycobacterium
QHVQEGT

SEQ ID NO: 551467 - protein, 5 aa, Mycobacterium
QHVRP

SEQ ID NO: 551468 - protein, 4 aa, Mycobacterium
QHVS

SEQ ID NO: 551469 - protein, 5 aa, Mycobacterium
QHVTD

SEQ ID NO: 551470 - protein, 6 aa, Mycobacterium
QHVTPE

SEQ ID NO: 551471 - protein, 5 aa, Mycobacterium
QIAAG

SEQ ID NO: 551472 - protein, 5 aa, Mycobacterium
QIADA

SEQ ID NO: 551473 - protein, 21 aa, Mycobacterium
QIAESQKGKTAEEIAAEQSEL

SEQ ID NO: 551474 - protein, 5 aa, Mycobacterium
QIAGA

SEQ ID NO: 551475 - protein, 7 aa, Mycobacterium
QIAGANR

SEQ ID NO: 551476 - protein, 6 aa, Mycobacterium
QIAGDS

SEQ ID NO: 551477 - protein, 5 aa, Mycobacterium
QIAGP

SEQ ID NO: 551478 - protein, 6 aa, Mycobacterium
QIAGPD

SEQ ID NO: 551479 - protein, 8 aa, Mycobacterium
QIAKDRPD

SEQ ID NO: 551480 - protein, 5 aa, Mycobacterium
QIAPE

SEQ ID NO: 551481 - protein, 6 aa, Mycobacterium
QIAPEE

SEQ ID NO: 551482 - protein, 6 aa, Mycobacterium
QIAPGE

SEQ ID NO: 551483 - protein, 5 aa, Mycobacterium
QIASG

SEQ ID NO: 551484 - protein, 15 aa, Mycobacterium
QIASPDTAPPGAAPV

SEQ ID NO: 551485 - protein, 6 aa, Mycobacterium
QIATDG

SEQ ID NO: 551486 - protein, 10 aa, Mycobacterium
QIDDDPTGSF

SEQ ID NO: 551487 - protein, 5 aa, Mycobacterium
QIDGA

SEQ ID NO: 551488 - protein, 5 aa, Mycobacterium
QIDGR

SEQ ID NO: 551489 - protein, 5 aa, Mycobacterium
QIDPD

SEQ ID NO: 551490 - protein, 7 aa, Mycobacterium
QIDPDSV

SEQ ID NO: 551491 - protein, 11 aa, Mycobacterium
QIDPEGAATRL

SEQ ID NO: 551492 - protein, 25 aa, Mycobacterium
QIDPKTIDKAVQDSVKKSSKPPEIE

SEQ ID NO: 551493 - protein, 7 aa, Mycobacterium
QIDPSAG

SEQ ID NO: 551494 - protein, 7 aa, Mycobacterium
QIDSGDY

SEQ ID NO: 551495 - protein, 8 aa, Mycobacterium
QIDSGTGE

SEQ ID NO: 551496 - protein, 4 aa, Mycobacterium
QIEA

SEQ ID NO: 551497 - protein, 6 aa, Mycobacterium
QIEATA

SEQ ID NO: 551498 - protein, 5 aa, Mycobacterium
QIEGG

SEQ ID NO: 551499 - protein, 8 aa, Mycobacterium
QIEGRDTA

SEQ ID NO: 551500 - protein, 5 aa, Mycobacterium
QIEHQ

SEQ ID NO: 551501 - protein, 7 aa, Mycobacterium
QIENDPS

SEQ ID NO: 551502 - protein, 9 aa, Mycobacterium
QIERDAEEM

SEQ ID NO: 551503 - protein, 5 aa, Mycobacterium
QIESN

SEQ ID NO: 551504 - protein, 9 aa, Mycobacterium
QIESTATEV

SEQ ID NO: 551505 - protein, 6 aa, Mycobacterium
QIESTG

SEQ ID NO: 551506 - protein, 4 aa, Mycobacterium
QIGA

SEQ ID NO: 551507 - protein, 9 aa, Mycobacterium
QIGAEPGVR

SEQ ID NO: 551508 - protein, 7 aa, Mycobacterium
QIGARTP

SEQ ID NO: 551509 - protein, 6 aa, Mycobacterium
QIGDDG

SEQ ID NO: 551510 - protein, 10 aa, Mycobacterium
QIGDDSGPLI

SEQ ID NO: 551511 - protein, 10 aa, Mycobacterium
QIGDEDPDFA

SEQ ID NO: 551512 - protein, 9 aa, Mycobacterium
QIGDERGIA

SEQ ID NO: 551513 - protein, 5 aa, Mycobacterium
QIGDG

SEQ ID NO: 551514 - protein, 6 aa, Mycobacterium
QIGDTA

SEQ ID NO: 551515 - protein, 11 aa, Mycobacterium
QIGEATGNHHP

SEQ ID NO: 551516 - protein, 8 aa, Mycobacterium
QIGEEQGR

SEQ ID NO: 551517 - protein, 8 aa, Mycobacterium
QIGERPSM

SEQ ID NO: 551518 - protein, 6 aa, Mycobacterium
QIGEST

SEQ ID NO: 551519 - protein, 7 aa, Mycobacterium
QIGPESE

SEQ ID NO: 551520 - protein, 10 aa, Mycobacterium
QIGPGRSGLS

SEQ ID NO: 551521 - protein, 9 aa, Mycobacterium
QIGPNPDAH

SEQ ID NO: 551522 - protein, 7 aa, Mycobacterium
QIGPTPA

SEQ ID NO: 551523 - protein, 9 aa, Mycobacterium
QIGPTRAPV

SEQ ID NO: 551524 - protein, 5 aa, Mycobacterium
QIGQT

SEQ ID NO: 551525 - protein, 5 aa, Mycobacterium
QIGRS

SEQ ID NO: 551526 - protein, 7 aa, Mycobacterium
QIGSGRR

SEQ ID NO: 551527 - protein, 12 aa, Mycobacterium
QIGSPTDVYDAP

SEQ ID NO: 551528 - protein, 7 aa, Mycobacterium
QIGSPTY

SEQ ID NO: 551529 - protein, 14 aa, Mycobacterium
QIGTDGTPYAAPRT

SEQ ID NO: 551530 - protein, 7 aa, Mycobacterium
QIGTPDE

SEQ ID NO: 551531 - protein, 16 aa, Mycobacterium
QIHSGGAGVDRDGRDV

SEQ ID NO: 551532 - protein, 4 aa, Mycobacterium
QIKG

SEQ ID NO: 551533 - protein, 10 aa, Mycobacterium
QIKHDDGPLN

SEQ ID NO: 551534 - protein, 9 aa, Mycobacterium
QINGVPRDE

SEQ ID NO: 551535 - protein, 10 aa, Mycobacterium
QINGVPRDGA

SEQ ID NO: 551536 - protein, 10 aa, Mycobacterium
QINGVPRDQA

SEQ ID NO: 551537 - protein, 10 aa, Mycobacterium
QINGVPRDSA

SEQ ID NO: 551538 - protein, 12 aa, Mycobacterium
QINSPTDTVSAA

SEQ ID NO: 551539 - protein, 6 aa, Mycobacterium
QIPAAD

SEQ ID NO: 551540 - protein, 7 aa, Mycobacterium
QIPAADA

SEQ ID NO: 551541 - protein, 12 aa, Mycobacterium
QIPAADATLRER

SEQ ID NO: 551542 - protein, 10 aa, Mycobacterium
QIPAEPATVD

SEQ ID NO: 551543 - protein, 13 aa, Mycobacterium
QIPAPAAPPMGNP

SEQ ID NO: 551544 - protein, 6 aa, Mycobacterium
QIPDKG

SEQ ID NO: 551545 - protein, 7 aa, Mycobacterium
QIPDTEY

SEQ ID NO: 551546 - protein, 5 aa, Mycobacterium
QIPGD

SEQ ID NO: 551547 - protein, 12 aa, Mycobacterium
QIPGPTIRARKG

SEQ ID NO: 551548 - protein, 15 aa, Mycobacterium
QIPGQPPSLLNPPTG

SEQ ID NO: 551549 - protein, 5 aa, Mycobacterium
QIPHD

SEQ ID NO: 551550 - protein, 5 aa, Mycobacterium
QIPPG

SEQ ID NO: 551551 - protein, 9 aa, Mycobacterium
QIPPSAFTE

SEQ ID NO: 551552 - protein, 7 aa, Mycobacterium
QIPQESI

SEQ ID NO: 551553 - protein, 7 aa, Mycobacterium
QIPRRGE

SEQ ID NO: 551554 - protein, 16 aa, Mycobacterium
QIPSFTPPKDLQPGEY

SEQ ID NO: 551555 - protein, 13 aa, Mycobacterium
QIPSSGTHPDTAC

SEQ ID NO: 551556 - protein, 4 aa, Mycobacterium
QIPV

SEQ ID NO: 551557 - protein, 10 aa, Mycobacterium
QIQAQAGRLP

SEQ ID NO: 551558 - protein, 5 aa, Mycobacterium
QIQQN

SEQ ID NO: 551559 - protein, 4 aa, Mycobacterium
QIRA

SEQ ID NO: 551560 - protein, 5 aa, Mycobacterium
QIRAG

SEQ ID NO: 551561 - protein, 8 aa, Mycobacterium
QIRDDPAT

SEQ ID NO: 551562 - protein, 7 aa, Mycobacterium
QIRETEP

SEQ ID NO: 551563 - protein, 6 aa, Mycobacterium
QIRKTK

SEQ ID NO: 551564 - protein, 41 aa, Mycobacterium
QIRPGKDTDKQAPEKQAGNEAKNAAQPATKTQRQLPAAPAV

SEQ ID NO: 551565 - protein, 8 aa, Mycobacterium
QIRQRAGE

SEQ ID NO: 551566 - protein, 7 aa, Mycobacterium
QIRTRTA

SEQ ID NO: 551567 - protein, 8 aa, Mycobacterium
QISAPGSP

SEQ ID NO: 551568 - protein, 6 aa, Mycobacterium
QISDGA

SEQ ID NO: 551569 - protein, 8 aa, Mycobacterium
QISDPAER

SEQ ID NO: 551570 - protein, 8 aa, Mycobacterium
QISDPEVR

SEQ ID NO: 551571 - protein, 11 aa, Mycobacterium
QISENRAGIER

SEQ ID NO: 551572 - protein, 4 aa, Mycobacterium
QISG

SEQ ID NO: 551573 - protein, 11 aa, Mycobacterium
QISGAGTSTLT

SEQ ID NO: 551574 - protein, 6 aa, Mycobacterium
QISGGR

SEQ ID NO: 551575 - protein, 7 aa, Mycobacterium
QISGRDA

SEQ ID NO: 551576 - protein, 17 aa, Mycobacterium
QISQDDNGVTVSTDSGV

SEQ ID NO: 551577 - protein, 6 aa, Mycobacterium
QISSAY

SEQ ID NO: 551578 - protein, 6 aa, Mycobacterium
QITEQT

SEQ ID NO: 551579 - protein, 4 aa, Mycobacterium
QITG

SEQ ID NO: 551580 - protein, 5 aa, Mycobacterium
QITGA

SEQ ID NO: 551581 - protein, 8 aa, Mycobacterium
QITGATAG

SEQ ID NO: 551582 - protein, 13 aa, Mycobacterium
QITGPAELPPDQV

SEQ ID NO: 551583 - protein, 8 aa, Mycobacterium
QITGPDGV

SEQ ID NO: 551584 - protein, 7 aa, Mycobacterium
QITGRDG

SEQ ID NO: 551585 - protein, 11 aa, Mycobacterium
QITPPGSGYYA

SEQ ID NO: 551586 - protein, 6 aa, Mycobacterium
QITPSV

SEQ ID NO: 551587 - protein, 8 aa, Mycobacterium
QITTGSST

SEQ ID NO: 551588 - protein, 5 aa, Mycobacterium
QITWQ

SEQ ID NO: 551589 - protein, 8 aa, Mycobacterium
QIYEGSNQ

SEQ ID NO: 551590 - protein, 6 aa, Mycobacterium
QKAAGA

SEQ ID NO: 551591 - protein, 17 aa, Mycobacterium
QKAAMKSLGQNGRRAVR

SEQ ID NO: 551592 - protein, 7 aa, Mycobacterium
QKAARAY

SEQ ID NO: 551593 - protein, 5 aa, Mycobacterium
QKAAS

SEQ ID NO: 551594 - protein, 13 aa, Mycobacterium
QKADAPSGTATRT

SEQ ID NO: 551595 - protein, 14 aa, Mycobacterium
QKAEEAAAKIGTGE

SEQ ID NO: 551596 - protein, 9 aa, Mycobacterium
QKAENPGED

SEQ ID NO: 551597 - protein, 7 aa, Mycobacterium
QKAEQAK

SEQ ID NO: 551598 - protein, 7 aa, Mycobacterium
QKAGATP

SEQ ID NO: 551599 - protein, 7 aa, Mycobacterium
QKAGDAS

SEQ ID NO: 551600 - protein, 8 aa, Mycobacterium
QKAGDGSV

SEQ ID NO: 551601 - protein, 9 aa, Mycobacterium
QKAGSDLTA

SEQ ID NO: 551602 - protein, 14 aa, Mycobacterium
QKAGTIRPQLPPDI

SEQ ID NO: 551603 - protein, 13 aa, Mycobacterium
QKAHRARSARRAA

SEQ ID NO: 551604 - protein, 4 aa, Mycobacterium
QKAM

SEQ ID NO: 551605 - protein, 17 aa, Mycobacterium
QKANAEATEAINADRER

SEQ ID NO: 551606 - protein, 7 aa, Mycobacterium
QKANPRN

SEQ ID NO: 551607 - protein, 5 aa, Mycobacterium
QKANR

SEQ ID NO: 551608 - protein, 7 aa, Mycobacterium
QKAPKVD

SEQ ID NO: 551609 - protein, 13 aa, Mycobacterium
QKAPTLPRAEATA

SEQ ID NO: 551610 - protein, 4 aa, Mycobacterium
QKAQ

SEQ ID NO: 551611 - protein, 4 aa, Mycobacterium
QKAS

SEQ ID NO: 551612 - protein, 8 aa, Mycobacterium
QKASDGTV

SEQ ID NO: 551613 - protein, 9 aa, Mycobacterium
QKASTGQVR

SEQ ID NO: 551614 - protein, 17 aa, Mycobacterium
QKATAAATASIEADRER

SEQ ID NO: 551615 - protein, 6 aa, Mycobacterium
QKATCE

SEQ ID NO: 551616 - protein, 13 aa, Mycobacterium
QKCSEGKEEVPTP

SEQ ID NO: 551617 - protein, 15 aa, Mycobacterium
QKDAPEISVSDGANP

SEQ ID NO: 551618 - protein, 8 aa, Mycobacterium
QKDDPGIT

SEQ ID NO: 551619 - protein, 10 aa, Mycobacterium
QKDEGDMART

SEQ ID NO: 551620 - protein, 10 aa, Mycobacterium
QKDEGSMAQT

SEQ ID NO: 551621 - protein, 4 aa, Mycobacterium
QKDF

SEQ ID NO: 551622 - protein, 6 aa, Mycobacterium
QKDPQL

SEQ ID NO: 551623 - protein, 20 aa, Mycobacterium
QKDPTLAYGPGRGAIGSPAT

SEQ ID NO: 551624 - protein, 5 aa, Mycobacterium
QKDRD

SEQ ID NO: 551625 - protein, 7 aa, Mycobacterium
QKDREGM

SEQ ID NO: 551626 - protein, 9 aa, Mycobacterium
QKDRSKIPA

SEQ ID NO: 551627 - protein, 17 aa, Mycobacterium
QKDSPDWVHPELRVQGR

SEQ ID NO: 551628 - protein, 16 aa, Mycobacterium
QKEDAAAPADVSEDNR

SEQ ID NO: 551629 - protein, 5 aa, Mycobacterium
QKEIS

SEQ ID NO: 551630 - protein, 8 aa, Mycobacterium
QKEPEPSA

SEQ ID NO: 551631 - protein, 6 aa, Mycobacterium
QKEPNL

SEQ ID NO: 551632 - protein, 41 aa, Mycobacterium
QKEQASDSTSSDTVQPTSGSTPAATSVPTSGATAALSPLSS

SEQ ID NO: 551633 - protein, 16 aa, Mycobacterium
QKERVTNEWAAEGGAA

SEQ ID NO: 551634 - protein, 6 aa, Mycobacterium
QKEYGQ

SEQ ID NO: 551635 - protein, 16 aa, Mycobacterium
QKFGQEPGTYSTEGYD

SEQ ID NO: 551636 - protein, 6 aa, Mycobacterium
QKFPTS

SEQ ID NO: 551637 - protein, 5 aa, Mycobacterium
QKFSG

SEQ ID NO: 551638 - protein, 6 aa, Mycobacterium
QKGADY

SEQ ID NO: 551639 - protein, 10 aa, Mycobacterium
QKGETEETSG

SEQ ID NO: 551640 - protein, 8 aa, Mycobacterium
QKGGKTRI

SEQ ID NO: 551641 - protein, 11 aa, Mycobacterium
QKGGRTVKERR

SEQ ID NO: 551642 - protein, 12 aa, Mycobacterium
QKGGVGKTTITA

SEQ ID NO: 551643 - protein, 11 aa, Mycobacterium
QKGGVGKTTTA

SEQ ID NO: 551644 - protein, 12 aa, Mycobacterium
QKGGVGKTTTAV

SEQ ID NO: 551645 - protein, 6 aa, Mycobacterium
QKGGVP

SEQ ID NO: 551646 - protein, 5 aa, Mycobacterium
QKGNR

SEQ ID NO: 551647 - protein, 7 aa, Mycobacterium
QKGSTVA

SEQ ID NO: 551648 - protein, 22 aa, Mycobacterium
QKGYQDNSSVVPYDPDEAKREL

SEQ ID NO: 551649 - protein, 6 aa, Mycobacterium
QKHSKD

SEQ ID NO: 551650 - protein, 9 aa, Mycobacterium
QKIRGEHPG

SEQ ID NO: 551651 - protein, 9 aa, Mycobacterium
QKKAGAGEI

SEQ ID NO: 551652 - protein, 6 aa, Mycobacterium
QKKDYR

SEQ ID NO: 551653 - protein, 5 aa, Mycobacterium
QKKRL

SEQ ID NO: 551654 - protein, 8 aa, Mycobacterium
QKKSEEVL

SEQ ID NO: 551655 - protein, 25 aa, Mycobacterium
QKKTSAKKTAVKKTTAKAKKAVAHP

SEQ ID NO: 551656 - protein, 7 aa, Mycobacterium
QKLGAAT

SEQ ID NO: 551657 - protein, 12 aa, Mycobacterium
QKLGTDKDGNDV

SEQ ID NO: 551658 - protein, 124 aa, Mycobacterium
QKLPAEGPAVKRGVGTSAAKKAAKKAPARKAATKAPAKKAATKAPAKKAATKAPAKTAAKAPAKKAATKATKAPAKATKTTAKKAAAKAPVRKAATKAPAKKAAAKRPATKAPAKKATSTRRGR

SEQ ID NO: 551659 - protein, 10 aa, Mycobacterium
QKLPPPREPA

SEQ ID NO: 551660 - protein, 9 aa, Mycobacterium
QKLRRRDEQ

SEQ ID NO: 551661 - protein, 10 aa, Mycobacterium
QKLTEETEEA

SEQ ID NO: 551662 - protein, 7 aa, Mycobacterium
QKLTPDE

SEQ ID NO: 551663 - protein, 12 aa, Mycobacterium
QKMSKSKGNGID

SEQ ID NO: 551664 - protein, 20 aa, Mycobacterium
QKNDPPQEGDSGTEGAGDDK

SEQ ID NO: 551665 - protein, 4 aa, Mycobacterium
QKNL

SEQ ID NO: 551666 - protein, 7 aa, Mycobacterium
QKNPDYL

SEQ ID NO: 551667 - protein, 5 aa, Mycobacterium
QKNRL

SEQ ID NO: 551668 - protein, 8 aa, Mycobacterium
QKPAGPAK

SEQ ID NO: 551669 - protein, 8 aa, Mycobacterium
QKPDHING

SEQ ID NO: 551670 - protein, 8 aa, Mycobacterium
QKPDPAAS

SEQ ID NO: 551671 - protein, 5 aa, Mycobacterium
QKPEA

SEQ ID NO: 551672 - protein, 9 aa, Mycobacterium
QKPEENART

SEQ ID NO: 551673 - protein, 10 aa, Mycobacterium
QKPEETERTF

SEQ ID NO: 551674 - protein, 9 aa, Mycobacterium
QKPEIRKAR

SEQ ID NO: 551675 - protein, 14 aa, Mycobacterium
QKPEKPINGSMAPT

SEQ ID NO: 551676 - protein, 6 aa, Mycobacterium
QKPGIY

SEQ ID NO: 551677 - protein, 6 aa, Mycobacterium
QKPHDG

SEQ ID NO: 551678 - protein, 12 aa, Mycobacterium
QKPLTSASARVG

SEQ ID NO: 551679 - protein, 7 aa, Mycobacterium
QKPNLRP

SEQ ID NO: 551680 - protein, 18 aa, Mycobacterium
QKPPYPPLTRATEEQAET

SEQ ID NO: 551681 - protein, 4 aa, Mycobacterium
QKPR

SEQ ID NO: 551682 - protein, 10 aa, Mycobacterium
QKPRDYPAAP

SEQ ID NO: 551683 - protein, 6 aa, Mycobacterium
QKPRGA

SEQ ID NO: 551684 - protein, 5 aa, Mycobacterium
QKPSV

SEQ ID NO: 551685 - protein, 8 aa, Mycobacterium
QKPTEAGV

SEQ ID NO: 551686 - protein, 8 aa, Mycobacterium
QKPTGAGE

SEQ ID NO: 551687 - protein, 7 aa, Mycobacterium
QKPTGDV

SEQ ID NO: 551688 - protein, 8 aa, Mycobacterium
QKPTGETE

SEQ ID NO: 551689 - protein, 8 aa, Mycobacterium
QKPTGKPE

SEQ ID NO: 551690 - protein, 10 aa, Mycobacterium
QKPTNDQSDA

SEQ ID NO: 551691 - protein, 10 aa, Mycobacterium
QKPTPADAAD

SEQ ID NO: 551692 - protein, 7 aa, Mycobacterium
QKPTPGI

SEQ ID NO: 551693 - protein, 48 aa, Mycobacterium
QKQAPATPQYPQYSPQYPSNEYPQYQPYPGNEYPQYPGSSQNPYWGPG

SEQ ID NO: 551694 - protein, 12 aa, Mycobacterium
QKQATLAVTRPQ

SEQ ID NO: 551695 - protein, 9 aa, Mycobacterium
QKQDGGGTI

SEQ ID NO: 551696 - protein, 9 aa, Mycobacterium
QKQDTGGSI

SEQ ID NO: 551697 - protein, 4 aa, Mycobacterium
QKQG

SEQ ID NO: 551698 - protein, 16 aa, Mycobacterium
QKQMQKGINEATQNPI

SEQ ID NO: 551699 - protein, 6 aa, Mycobacterium
QKQPEA

SEQ ID NO: 551700 - protein, 8 aa, Mycobacterium
QKQQHERG

SEQ ID NO: 551701 - protein, 8 aa, Mycobacterium
QKQRGFSY

SEQ ID NO: 551702 - protein, 16 aa, Mycobacterium
QKQRVTAESRADPAPV

SEQ ID NO: 551703 - protein, 4 aa, Mycobacterium
QKQT

SEQ ID NO: 551704 - protein, 7 aa, Mycobacterium
QKQTDAD

SEQ ID NO: 551705 - protein, 4 aa, Mycobacterium
QKRA

SEQ ID NO: 551706 - protein, 8 aa, Mycobacterium
QKRADDLA

SEQ ID NO: 551707 - protein, 8 aa, Mycobacterium
QKRAGDLA

SEQ ID NO: 551708 - protein, 9 aa, Mycobacterium
QKRAGQEVT

SEQ ID NO: 551709 - protein, 9 aa, Mycobacterium
QKRAGQPVS

SEQ ID NO: 551710 - protein, 9 aa, Mycobacterium
QKRAGQPVT

SEQ ID NO: 551711 - protein, 13 aa, Mycobacterium
QKREPDWSPYPWH

SEQ ID NO: 551712 - protein, 19 aa, Mycobacterium
QKRGTVPRQAGLGRPREQP

SEQ ID NO: 551713 - protein, 37 aa, Mycobacterium
QKRKTQIRGASGVDRDGNELSRDTEATPTGGPVDSPD

SEQ ID NO: 551714 - protein, 8 aa, Mycobacterium
QKRLPRPY

SEQ ID NO: 551715 - protein, 18 aa, Mycobacterium
QKRPGSDAAKAAEEASKG

SEQ ID NO: 551716 - protein, 29 aa, Mycobacterium
QKRPGTPSAEAARKASAEQSTPPPDADQT

SEQ ID NO: 551717 - protein, 9 aa, Mycobacterium
QKRPLQPMG

SEQ ID NO: 551718 - protein, 13 aa, Mycobacterium
QKRPPDWSRFPRY

SEQ ID NO: 551719 - protein, 9 aa, Mycobacterium
QKRRAANNL

SEQ ID NO: 551720 - protein, 10 aa, Mycobacterium
QKRRADTGLR

SEQ ID NO: 551721 - protein, 14 aa, Mycobacterium
QKRRGRRQGEPVSR

SEQ ID NO: 551722 - protein, 15 aa, Mycobacterium
QKRSSQKESRGGRKE

SEQ ID NO: 551723 - protein, 14 aa, Mycobacterium
QKSAGARCEPEPVP

SEQ ID NO: 551724 - protein, 9 aa, Mycobacterium
QKSARGEYE

SEQ ID NO: 551725 - protein, 7 aa, Mycobacterium
QKSERDG

SEQ ID NO: 551726 - protein, 5 aa, Mycobacterium
QKSGA

SEQ ID NO: 551727 - protein, 6 aa, Mycobacterium
QKSGAA

SEQ ID NO: 551728 - protein, 13 aa, Mycobacterium
QKSGLAELITELT

SEQ ID NO: 551729 - protein, 5 aa, Mycobacterium
QKSGV

SEQ ID NO: 551730 - protein, 13 aa, Mycobacterium
QKSKGGLEVRGEP

SEQ ID NO: 551731 - protein, 14 aa, Mycobacterium
QKSMGRHLSWFALI

SEQ ID NO: 551732 - protein, 9 aa, Mycobacterium
QKSPKSLPP

SEQ ID NO: 551733 - protein, 6 aa, Mycobacterium
QKSTDG

SEQ ID NO: 551734 - protein, 4 aa, Mycobacterium
QKSV

SEQ ID NO: 551735 - protein, 7 aa, Mycobacterium
QKTAADC

SEQ ID NO: 551736 - protein, 12 aa, Mycobacterium
QKTAREVVNQVI

SEQ ID NO: 551737 - protein, 9 aa, Mycobacterium
QKTATRVVP

SEQ ID NO: 551738 - protein, 6 aa, Mycobacterium
QKTDCP

SEQ ID NO: 551739 - protein, 7 aa, Mycobacterium
QKTDLSA

SEQ ID NO: 551740 - protein, 4 aa, Mycobacterium
QKTG

SEQ ID NO: 551741 - protein, 8 aa, Mycobacterium
QKTLGDNG

SEQ ID NO: 551742 - protein, 8 aa, Mycobacterium
QKTNGRIG

SEQ ID NO: 551743 - protein, 7 aa, Mycobacterium
QKTNTTI

SEQ ID NO: 551744 - protein, 8 aa, Mycobacterium
QKTPAAVT

SEQ ID NO: 551745 - protein, 11 aa, Mycobacterium
QKTPPDGQASL

SEQ ID NO: 551746 - protein, 12 aa, Mycobacterium
QKTSESGASTEI

SEQ ID NO: 551747 - protein, 10 aa, Mycobacterium
QKTSTGSPAI

SEQ ID NO: 551748 - protein, 7 aa, Mycobacterium
QKTTDGD

SEQ ID NO: 551749 - protein, 8 aa, Mycobacterium
QKTVSEGA

SEQ ID NO: 551750 - protein, 15 aa, Mycobacterium
QKVAPGDGALRDPRN

SEQ ID NO: 551751 - protein, 6 aa, Mycobacterium
QKVEET

SEQ ID NO: 551752 - protein, 6 aa, Mycobacterium
QKVGQI

SEQ ID NO: 551753 - protein, 4 aa, Mycobacterium
QKVP

SEQ ID NO: 551754 - protein, 12 aa, Mycobacterium
QKVQDRTAETEW

SEQ ID NO: 551755 - protein, 4 aa, Mycobacterium
QKVT

SEQ ID NO: 551756 - protein, 9 aa, Mycobacterium
QKVTDYGPS

SEQ ID NO: 551757 - protein, 9 aa, Mycobacterium
QKVTPTNNI

SEQ ID NO: 551758 - protein, 5 aa, Mycobacterium
QKWKP

SEQ ID NO: 551759 - protein, 9 aa, Mycobacterium
QKWRPSNLG

SEQ ID NO: 551760 - protein, 10 aa, Mycobacterium
QKYGGYEAHP

SEQ ID NO: 551761 - protein, 18 aa, Mycobacterium
QKYGTDGVTRPGQTQSGL

SEQ ID NO: 551762 - protein, 11 aa, Mycobacterium
QKYRSEKDTFG

SEQ ID NO: 551763 - protein, 16 aa, Mycobacterium
QLAAAGKPWPPDEEEA

SEQ ID NO: 551764 - protein, 11 aa, Mycobacterium
QLAADGGGHDR

SEQ ID NO: 551765 - protein, 10 aa, Mycobacterium
QLAAGDYGTT

SEQ ID NO: 551766 - protein, 5 aa, Mycobacterium
QLAAP

SEQ ID NO: 551767 - protein, 17 aa, Mycobacterium
QLAASQADEAAAHPLTT

SEQ ID NO: 551768 - protein, 4 aa, Mycobacterium
QLAD

SEQ ID NO: 551769 - protein, 10 aa, Mycobacterium
QLADDDAYRR

SEQ ID NO: 551770 - protein, 10 aa, Mycobacterium
QLADGNAHTT

SEQ ID NO: 551771 - protein, 5 aa, Mycobacterium
QLADS

SEQ ID NO: 551772 - protein, 13 aa, Mycobacterium
QLAEKKKSTGRPV

SEQ ID NO: 551773 - protein, 10 aa, Mycobacterium
QLAGEGDRAP

SEQ ID NO: 551774 - protein, 6 aa, Mycobacterium
QLAGGA

SEQ ID NO: 551775 - protein, 5 aa, Mycobacterium
QLAGK

SEQ ID NO: 551776 - protein, 15 aa, Mycobacterium
QLAGQRAQRGAELGR

SEQ ID NO: 551777 - protein, 21 aa, Mycobacterium
QLAGTGAKSYTADGSASPGAG

SEQ ID NO: 551778 - protein, 27 aa, Mycobacterium
QLAKGRKSLEDNVGAPPTTSATAQRNA

SEQ ID NO: 551779 - protein, 13 aa, Mycobacterium
QLAKSDAATRETL

SEQ ID NO: 551780 - protein, 13 aa, Mycobacterium
QLAKSDDATRDAL

SEQ ID NO: 551781 - protein, 11 aa, Mycobacterium
QLAPEAEAAQP

SEQ ID NO: 551782 - protein, 14 aa, Mycobacterium
QLAPEEIRRNADRG

SEQ ID NO: 551783 - protein, 7 aa, Mycobacterium
QLAPGTR

SEQ ID NO: 551784 - protein, 19 aa, Mycobacterium
QLAPKDDEERQKAVDAGHD

SEQ ID NO: 551785 - protein, 10 aa, Mycobacterium
QLAPRDELPA

SEQ ID NO: 551786 - protein, 17 aa, Mycobacterium
QLAPTDDEERQKAIDAG

SEQ ID NO: 551787 - protein, 9 aa, Mycobacterium
QLAPTDYNQ

SEQ ID NO: 551788 - protein, 7 aa, Mycobacterium
QLAPTRN

SEQ ID NO: 551789 - protein, 10 aa, Mycobacterium
QLAQPRGGLT

SEQ ID NO: 551790 - protein, 8 aa, Mycobacterium
QLARPGND

SEQ ID NO: 551791 - protein, 6 aa, Mycobacterium
QLARPQ

SEQ ID NO: 551792 - protein, 9 aa, Mycobacterium
QLASGAQAL

SEQ ID NO: 551793 - protein, 5 aa, Mycobacterium
QLASI

SEQ ID NO: 551794 - protein, 9 aa, Mycobacterium
QLASPGTAF

SEQ ID NO: 551795 - protein, 8 aa, Mycobacterium
QLASTSAA

SEQ ID NO: 551796 - protein, 18 aa, Mycobacterium
QLASTSTVRGWERLRIIL

SEQ ID NO: 551797 - protein, 18 aa, Mycobacterium
QLASTSTVRGWERLRVVL

SEQ ID NO: 551798 - protein, 5 aa, Mycobacterium
QLASV

SEQ ID NO: 551799 - protein, 17 aa, Mycobacterium
QLATAQKATRPRKPEGV

SEQ ID NO: 551800 - protein, 11 aa, Mycobacterium
QLATDDPRGLT

SEQ ID NO: 551801 - protein, 8 aa, Mycobacterium
QLATGELT

SEQ ID NO: 551802 - protein, 8 aa, Mycobacterium
QLATPSDG

SEQ ID NO: 551803 - protein, 6 aa, Mycobacterium
QLATRA

SEQ ID NO: 551804 - protein, 4 aa, Mycobacterium
QLDA

SEQ ID NO: 551805 - protein, 22 aa, Mycobacterium
QLDANGHRGESGWRAIGLPWKQ

SEQ ID NO: 551806 - protein, 11 aa, Mycobacterium
QLDAPGDNPAN

SEQ ID NO: 551807 - protein, 7 aa, Mycobacterium
QLDATDT

SEQ ID NO: 551808 - protein, 9 aa, Mycobacterium
QLDDEDRRR

SEQ ID NO: 551809 - protein, 7 aa, Mycobacterium
QLDDGQL

SEQ ID NO: 551810 - protein, 6 aa, Mycobacterium
QLDDTR

SEQ ID NO: 551811 - protein, 6 aa, Mycobacterium
QLDEDP

SEQ ID NO: 551812 - protein, 7 aa, Mycobacterium
QLDENPY

SEQ ID NO: 551813 - protein, 4 aa, Mycobacterium
QLDG

SEQ ID NO: 551814 - protein, 10 aa, Mycobacterium
QLDGPDSAVP

SEQ ID NO: 551815 - protein, 16 aa, Mycobacterium
QLDGPGVEILRTRLDG

SEQ ID NO: 551816 - protein, 5 aa, Mycobacterium
QLDPA

SEQ ID NO: 551817 - protein, 6 aa, Mycobacterium
QLDPDD

SEQ ID NO: 551818 - protein, 6 aa, Mycobacterium
QLDPEQ

SEQ ID NO: 551819 - protein, 9 aa, Mycobacterium
QLDPGGPDS

SEQ ID NO: 551820 - protein, 5 aa, Mycobacterium
QLDPR

SEQ ID NO: 551821 - protein, 6 aa, Mycobacterium
QLDPRT

SEQ ID NO: 551822 - protein, 15 aa, Mycobacterium
QLDPTSRSRYTGDRS

SEQ ID NO: 551823 - protein, 15 aa, Mycobacterium
QLDPTSTSRYTGDRS

SEQ ID NO: 551824 - protein, 4 aa, Mycobacterium
QLDQ

SEQ ID NO: 551825 - protein, 6 aa, Mycobacterium
QLDRTG

SEQ ID NO: 551826 - protein, 13 aa, Mycobacterium
QLDSAGDGDSEIA

SEQ ID NO: 551827 - protein, 7 aa, Mycobacterium
QLDSSSS

SEQ ID NO: 551828 - protein, 9 aa, Mycobacterium
QLDTARRTL

SEQ ID NO: 551829 - protein, 9 aa, Mycobacterium
QLDTDTTRL

SEQ ID NO: 551830 - protein, 5 aa, Mycobacterium
QLDTV

SEQ ID NO: 551831 - protein, 6 aa, Mycobacterium
QLDVTE

SEQ ID NO: 551832 - protein, 4 aa, Mycobacterium
QLEA

SEQ ID NO: 551833 - protein, 5 aa, Mycobacterium
QLEED

SEQ ID NO: 551834 - protein, 6 aa, Mycobacterium
QLEENP

SEQ ID NO: 551835 - protein, 16 aa, Mycobacterium
QLEGSAARGPGDSGRL

SEQ ID NO: 551836 - protein, 4 aa, Mycobacterium
QLEP

SEQ ID NO: 551837 - protein, 5 aa, Mycobacterium
QLEPE

SEQ ID NO: 551838 - protein, 15 aa, Mycobacterium
QLEQQQQQRAVFDAG

SEQ ID NO: 551839 - protein, 6 aa, Mycobacterium
QLERDG

SEQ ID NO: 551840 - protein, 15 aa, Mycobacterium
QLERGGAPADVSPEL

SEQ ID NO: 551841 - protein, 10 aa, Mycobacterium
QLERGRATTL

SEQ ID NO: 551842 - protein, 8 aa, Mycobacterium
QLESEGAG

SEQ ID NO: 551843 - protein, 9 aa, Mycobacterium
QLESGEDRS

SEQ ID NO: 551844 - protein, 6 aa, Mycobacterium
QLESRA

SEQ ID NO: 551845 - protein, 4 aa, Mycobacterium
QLET

SEQ ID NO: 551846 - protein, 13 aa, Mycobacterium
QLETAQPSADDGL

SEQ ID NO: 551847 - protein, 7 aa, Mycobacterium
QLETGTG

SEQ ID NO: 551848 - protein, 10 aa, Mycobacterium
QLGAEAAANE

SEQ ID NO: 551849 - protein, 6 aa, Mycobacterium
QLGAGP

SEQ ID NO: 551850 - protein, 8 aa, Mycobacterium
QLGAKPAQ

SEQ ID NO: 551851 - protein, 19 aa, Mycobacterium
QLGAQRDDFGAQQRQLKNE

SEQ ID NO: 551852 - protein, 10 aa, Mycobacterium
QLGAQRPAAT

SEQ ID NO: 551853 - protein, 7 aa, Mycobacterium
QLGARTG

SEQ ID NO: 551854 - protein, 8 aa, Mycobacterium
QLGDAPER

SEQ ID NO: 551855 - protein, 10 aa, Mycobacterium
QLGDGDWPGV

SEQ ID NO: 551856 - protein, 18 aa, Mycobacterium
QLGDKGARTLVGQLRKLL

SEQ ID NO: 551857 - protein, 15 aa, Mycobacterium
QLGEGPGGEGSPESI

SEQ ID NO: 551858 - protein, 7 aa, Mycobacterium
QLGEGRE

SEQ ID NO: 551859 - protein, 5 aa, Mycobacterium
QLGET

SEQ ID NO: 551860 - protein, 9 aa, Mycobacterium
QLGGADNAT

SEQ ID NO: 551861 - protein, 9 aa, Mycobacterium
QLGGADRAT

SEQ ID NO: 551862 - protein, 8 aa, Mycobacterium
QLGGATDL

SEQ ID NO: 551863 - protein, 7 aa, Mycobacterium
QLGGATR

SEQ ID NO: 551864 - protein, 5 aa, Mycobacterium
QLGGD

SEQ ID NO: 551865 - protein, 10 aa, Mycobacterium
QLGGEAATSA

SEQ ID NO: 551866 - protein, 8 aa, Mycobacterium
QLGGLPPA

SEQ ID NO: 551867 - protein, 7 aa, Mycobacterium
QLGGPGE

SEQ ID NO: 551868 - protein, 10 aa, Mycobacterium
QLGGRTVADS

SEQ ID NO: 551869 - protein, 9 aa, Mycobacterium
QLGGSDGQP

SEQ ID NO: 551870 - protein, 7 aa, Mycobacterium
QLGGSGF

SEQ ID NO: 551871 - protein, 9 aa, Mycobacterium
QLGGSGPYL

SEQ ID NO: 551872 - protein, 14 aa, Mycobacterium
QLGGTAARALAAEP

SEQ ID NO: 551873 - protein, 12 aa, Mycobacterium
QLGKKSGQGFYT

SEQ ID NO: 551874 - protein, 12 aa, Mycobacterium
QLGKKSGRGFYT

SEQ ID NO: 551875 - protein, 12 aa, Mycobacterium
QLGKKTGKGFYT

SEQ ID NO: 551876 - protein, 4 aa, Mycobacterium
QLGP

SEQ ID NO: 551877 - protein, 12 aa, Mycobacterium
QLGPADGVPTSI

SEQ ID NO: 551878 - protein, 6 aa, Mycobacterium
QLGPDG

SEQ ID NO: 551879 - protein, 6 aa, Mycobacterium
QLGPEG

SEQ ID NO: 551880 - protein, 8 aa, Mycobacterium
QLGPGPGV

SEQ ID NO: 551881 - protein, 5 aa, Mycobacterium
QLGPQ

SEQ ID NO: 551882 - protein, 6 aa, Mycobacterium
QLGPQE

SEQ ID NO: 551883 - protein, 5 aa, Mycobacterium
QLGPT

SEQ ID NO: 551884 - protein, 8 aa, Mycobacterium
QLGQADSL

SEQ ID NO: 551885 - protein, 5 aa, Mycobacterium
QLGQE

SEQ ID NO: 551886 - protein, 9 aa, Mycobacterium
QLGQPGDVS

SEQ ID NO: 551887 - protein, 19 aa, Mycobacterium
QLGQQRAVQRERGGAALGQ

SEQ ID NO: 551888 - protein, 7 aa, Mycobacterium
QLGSAGV

SEQ ID NO: 551889 - protein, 5 aa, Mycobacterium
QLGSG

SEQ ID NO: 551890 - protein, 7 aa, Mycobacterium
QLGSPGG

SEQ ID NO: 551891 - protein, 8 aa, Mycobacterium
QLGSTTNQ

SEQ ID NO: 551892 - protein, 4 aa, Mycobacterium
QLGT

SEQ ID NO: 551893 - protein, 7 aa, Mycobacterium
QLGTAQA

SEQ ID NO: 551894 - protein, 8 aa, Mycobacterium
QLGTDPNR

SEQ ID NO: 551895 - protein, 6 aa, Mycobacterium
QLGTEP

SEQ ID NO: 551896 - protein, 16 aa, Mycobacterium
QLGTGEAGLPPPQTRA

SEQ ID NO: 551897 - protein, 40 aa, Mycobacterium
QLGTGISNSGERNTGIGNSSVGAGVNTGFGNTGQHNTGFA

SEQ ID NO: 551898 - protein, 13 aa, Mycobacterium
QLGTGPVSYEDSI

SEQ ID NO: 551899 - protein, 6 aa, Mycobacterium
QLGTGR

SEQ ID NO: 551900 - protein, 12 aa, Mycobacterium
QLGTPSVDPPLE

SEQ ID NO: 551901 - protein, 6 aa, Mycobacterium
QLGTSP

SEQ ID NO: 551902 - protein, 8 aa, Mycobacterium
QLGTSRAT

SEQ ID NO: 551903 - protein, 6 aa, Mycobacterium
QLHNGS

SEQ ID NO: 551904 - protein, 9 aa, Mycobacterium
QLIGPDGKL

SEQ ID NO: 551905 - protein, 19 aa, Mycobacterium
QLKAQDAGYTLTPEGDKTR

SEQ ID NO: 551906 - protein, 19 aa, Mycobacterium
QLKAQDASYTLTPQGDKTK

SEQ ID NO: 551907 - protein, 5 aa, Mycobacterium
QLKGS

SEQ ID NO: 551908 - protein, 5 aa, Mycobacterium
QLKGV

SEQ ID NO: 551909 - protein, 19 aa, Mycobacterium
QLKKSGSSDADIQQRKNQE

SEQ ID NO: 551910 - protein, 8 aa, Mycobacterium
QLKNGRGA

SEQ ID NO: 551911 - protein, 8 aa, Mycobacterium
QLKPGDRF

SEQ ID NO: 551912 - protein, 7 aa, Mycobacterium
QLKSARA

SEQ ID NO: 551913 - protein, 8 aa, Mycobacterium
QLKSDRAE

SEQ ID NO: 551914 - protein, 5 aa, Mycobacterium
QLKSK

SEQ ID NO: 551915 - protein, 5 aa, Mycobacterium
QLKTG

SEQ ID NO: 551916 - protein, 5 aa, Mycobacterium
QLKTK

SEQ ID NO: 551917 - protein, 19 aa, Mycobacterium
QLKTTTAAYPTLGSDLGSM

SEQ ID NO: 551918 - protein, 7 aa, Mycobacterium
QLNARAD

SEQ ID NO: 551919 - protein, 5 aa, Mycobacterium
QLNEG

SEQ ID NO: 551920 - protein, 9 aa, Mycobacterium
QLNGAAKTD

SEQ ID NO: 551921 - protein, 14 aa, Mycobacterium
QLNGARGDARLPGN

SEQ ID NO: 551922 - protein, 7 aa, Mycobacterium
QLNGRGV

SEQ ID NO: 551923 - protein, 8 aa, Mycobacterium
QLNGRSPL

SEQ ID NO: 551924 - protein, 6 aa, Mycobacterium
QLNNNR

SEQ ID NO: 551925 - protein, 9 aa, Mycobacterium
QLNNPPDPI

SEQ ID NO: 551926 - protein, 7 aa, Mycobacterium
QLNPASG

SEQ ID NO: 551927 - protein, 7 aa, Mycobacterium
QLNPGSF

SEQ ID NO: 551928 - protein, 7 aa, Mycobacterium
QLNPKLR

SEQ ID NO: 551929 - protein, 18 aa, Mycobacterium
QLNSDSGRVTTGVGGRAI

SEQ ID NO: 551930 - protein, 13 aa, Mycobacterium
QLNSPERSGAADQ

SEQ ID NO: 551931 - protein, 15 aa, Mycobacterium
QLNTGNRHSQTPPSV

SEQ ID NO: 551932 - protein, 8 aa, Mycobacterium
QLPAETRA

SEQ ID NO: 551933 - protein, 7 aa, Mycobacterium
QLPAGGT

SEQ ID NO: 551934 - protein, 15 aa, Mycobacterium
QLPAKTESVTVSIKV

SEQ ID NO: 551935 - protein, 5 aa, Mycobacterium
QLPAP

SEQ ID NO: 551936 - protein, 6 aa, Mycobacterium
QLPAPA

SEQ ID NO: 551937 - protein, 8 aa, Mycobacterium
QLPAPATY

SEQ ID NO: 551938 - protein, 5 aa, Mycobacterium
QLPAQ

SEQ ID NO: 551939 - protein, 8 aa, Mycobacterium
QLPATATN

SEQ ID NO: 551940 - protein, 8 aa, Mycobacterium
QLPDAEAA

SEQ ID NO: 551941 - protein, 8 aa, Mycobacterium
QLPDDEEF

SEQ ID NO: 551942 - protein, 13 aa, Mycobacterium
QLPDGSPDDPGDL

SEQ ID NO: 551943 - protein, 19 aa, Mycobacterium
QLPDPPSLPTTGDRGSRRS

SEQ ID NO: 551944 - protein, 6 aa, Mycobacterium
QLPDPR

SEQ ID NO: 551945 - protein, 5 aa, Mycobacterium
QLPEG

SEQ ID NO: 551946 - protein, 6 aa, Mycobacterium
QLPEGT

SEQ ID NO: 551947 - protein, 6 aa, Mycobacterium
QLPEGY

SEQ ID NO: 551948 - protein, 10 aa, Mycobacterium
QLPEPDPIDP

SEQ ID NO: 551949 - protein, 8 aa, Mycobacterium
QLPEQQAW

SEQ ID NO: 551950 - protein, 5 aa, Mycobacterium
QLPEV

SEQ ID NO: 551951 - protein, 11 aa, Mycobacterium
QLPGAGATASR

SEQ ID NO: 551952 - protein, 10 aa, Mycobacterium
QLPGDGPEAM

SEQ ID NO: 551953 - protein, 16 aa, Mycobacterium
QLPGDLAAGEADEHGA

SEQ ID NO: 551954 - protein, 7 aa, Mycobacterium
QLPGDPT

SEQ ID NO: 551955 - protein, 8 aa, Mycobacterium
QLPGEQRV

SEQ ID NO: 551956 - protein, 8 aa, Mycobacterium
QLPGGESV

SEQ ID NO: 551957 - protein, 9 aa, Mycobacterium
QLPGGPDRI

SEQ ID NO: 551958 - protein, 6 aa, Mycobacterium
QLPGGR

SEQ ID NO: 551959 - protein, 7 aa, Mycobacterium
QLPGGSA

SEQ ID NO: 551960 - protein, 14 aa, Mycobacterium
QLPGKPKPDGSQTL

SEQ ID NO: 551961 - protein, 8 aa, Mycobacterium
QLPGRTSA

SEQ ID NO: 551962 - protein, 5 aa, Mycobacterium
QLPGV

SEQ ID NO: 551963 - protein, 7 aa, Mycobacterium
QLPGVDP

SEQ ID NO: 551964 - protein, 4 aa, Mycobacterium
QLPH

SEQ ID NO: 551965 - protein, 4 aa, Mycobacterium
QLPN

SEQ ID NO: 551966 - protein, 6 aa, Mycobacterium
QLPNID

SEQ ID NO: 551967 - protein, 11 aa, Mycobacterium
QLPNRSGDGLS

SEQ ID NO: 551968 - protein, 10 aa, Mycobacterium
QLPNTDPDGR

SEQ ID NO: 551969 - protein, 10 aa, Mycobacterium
QLPNTDPEGR

SEQ ID NO: 551970 - protein, 11 aa, Mycobacterium
QLPNTDPEGRD

SEQ ID NO: 551971 - protein, 8 aa, Mycobacterium
QLPPAYDA

SEQ ID NO: 551972 - protein, 13 aa, Mycobacterium
QLPPDGRPTDLPG

SEQ ID NO: 551973 - protein, 6 aa, Mycobacterium
QLPPDQ

SEQ ID NO: 551974 - protein, 9 aa, Mycobacterium
QLPPGCQPA

SEQ ID NO: 551975 - protein, 6 aa, Mycobacterium
QLPPGS

SEQ ID NO: 551976 - protein, 11 aa, Mycobacterium
QLPPKLAKDPL

SEQ ID NO: 551977 - protein, 20 aa, Mycobacterium
QLPPNAPRAATVNSYSKEGP

SEQ ID NO: 551978 - protein, 11 aa, Mycobacterium
QLPPPPPPGAA

SEQ ID NO: 551979 - protein, 17 aa, Mycobacterium
QLPQTDAGGDPCSPSAS

SEQ ID NO: 551980 - protein, 19 aa, Mycobacterium
QLPQTGAGAIDPSAERAAA

SEQ ID NO: 551981 - protein, 6 aa, Mycobacterium
QLPRAT

SEQ ID NO: 551982 - protein, 10 aa, Mycobacterium
QLPRGDEKPC

SEQ ID NO: 551983 - protein, 7 aa, Mycobacterium
QLPRGGR

SEQ ID NO: 551984 - protein, 15 aa, Mycobacterium
QLPRGSTAELRTATP

SEQ ID NO: 551985 - protein, 9 aa, Mycobacterium
QLPRKGSYL

SEQ ID NO: 551986 - protein, 19 aa, Mycobacterium
QLPRTDTGKLYKQELIKKY

SEQ ID NO: 551987 - protein, 22 aa, Mycobacterium
QLPSDSSGLTLAKPQKPAPSRV

SEQ ID NO: 551988 - protein, 8 aa, Mycobacterium
QLPSEGMT

SEQ ID NO: 551989 - protein, 9 aa, Mycobacterium
QLPSEQATV

SEQ ID NO: 551990 - protein, 5 aa, Mycobacterium
QLPSG

SEQ ID NO: 551991 - protein, 7 aa, Mycobacterium
QLPSGAA

SEQ ID NO: 551992 - protein, 12 aa, Mycobacterium
QLPSKLQKDPLK

SEQ ID NO: 551993 - protein, 6 aa, Mycobacterium
QLPSTY

SEQ ID NO: 551994 - protein, 5 aa, Mycobacterium
QLPTE

SEQ ID NO: 551995 - protein, 5 aa, Mycobacterium
QLPTG

SEQ ID NO: 551996 - protein, 10 aa, Mycobacterium
QLPTNDSATV

SEQ ID NO: 551997 - protein, 9 aa, Mycobacterium
QLPTPEDVE

SEQ ID NO: 551998 - protein, 24 aa, Mycobacterium
QLPTPLATGGASSPSSAPAGSTPA

SEQ ID NO: 551999 - protein, 11 aa, Mycobacterium
QLPTRAAGEAQ

SEQ ID NO: 552000 - protein, 5 aa, Mycobacterium
QLPTY

SEQ ID NO: 552001 - protein, 14 aa, Mycobacterium
QLPTYKSRNRGKGR

SEQ ID NO: 552002 - protein, 26 aa, Mycobacterium
QLPTYKSRNRGNGRSSRRRRYADGKS

SEQ ID NO: 552003 - protein, 4 aa, Mycobacterium
QLPV

SEQ ID NO: 552004 - protein, 7 aa, Mycobacterium
QLQPGGG

SEQ ID NO: 552005 - protein, 7 aa, Mycobacterium
QLQPYQP

SEQ ID NO: 552006 - protein, 15 aa, Mycobacterium
QLQQAASQAMASAAA

SEQ ID NO: 552007 - protein, 5 aa, Mycobacterium
QLQTA

SEQ ID NO: 552008 - protein, 4 aa, Mycobacterium
QLRA

SEQ ID NO: 552009 - protein, 17 aa, Mycobacterium
QLRAPAPTCGSYAPADR

SEQ ID NO: 552010 - protein, 10 aa, Mycobacterium
QLRASTARKI

SEQ ID NO: 552011 - protein, 6 aa, Mycobacterium
QLRDDY

SEQ ID NO: 552012 - protein, 7 aa, Mycobacterium
QLRDEGR

SEQ ID NO: 552013 - protein, 7 aa, Mycobacterium
QLRERTQ

SEQ ID NO: 552014 - protein, 24 aa, Mycobacterium
QLRGGAPAGLPETVGAVRDPDADR

SEQ ID NO: 552015 - protein, 11 aa, Mycobacterium
QLRGRGSPDAV

SEQ ID NO: 552016 - protein, 12 aa, Mycobacterium
QLRGTASEIDRS

SEQ ID NO: 552017 - protein, 16 aa, Mycobacterium
QLRPADSEDDAGLDTD

SEQ ID NO: 552018 - protein, 5 aa, Mycobacterium
QLRPD

SEQ ID NO: 552019 - protein, 17 aa, Mycobacterium
QLRPRDYKGAAARGESL

SEQ ID NO: 552020 - protein, 5 aa, Mycobacterium
QLRQG

SEQ ID NO: 552021 - protein, 11 aa, Mycobacterium
QLRRPRSDDGI

SEQ ID NO: 552022 - protein, 13 aa, Mycobacterium
QLRSERRLRHTRA

SEQ ID NO: 552023 - protein, 19 aa, Mycobacterium
QLRTPGDPYQRAGGALSPE

SEQ ID NO: 552024 - protein, 9 aa, Mycobacterium
QLRTPLEGT

SEQ ID NO: 552025 - protein, 8 aa, Mycobacterium
QLSAAEPY

SEQ ID NO: 552026 - protein, 5 aa, Mycobacterium
QLSAD

SEQ ID NO: 552027 - protein, 7 aa, Mycobacterium
QLSADTL

SEQ ID NO: 552028 - protein, 11 aa, Mycobacterium
QLSAGPAGEPD

SEQ ID NO: 552029 - protein, 12 aa, Mycobacterium
QLSEDHSATEFE

SEQ ID NO: 552030 - protein, 8 aa, Mycobacterium
QLSELGRA

SEQ ID NO: 552031 - protein, 11 aa, Mycobacterium
QLSESARAAEL

SEQ ID NO: 552032 - protein, 12 aa, Mycobacterium
QLSGGDTSALAG

SEQ ID NO: 552033 - protein, 13 aa, Mycobacterium
QLSGGNHEESDDD

SEQ ID NO: 552034 - protein, 10 aa, Mycobacterium
QLSGGQKQRV

SEQ ID NO: 552035 - protein, 9 aa, Mycobacterium
QLSGGQRRR

SEQ ID NO: 552036 - protein, 8 aa, Mycobacterium
QLSGNPIR

SEQ ID NO: 552037 - protein, 8 aa, Mycobacterium
QLSGQPRI

SEQ ID NO: 552038 - protein, 10 aa, Mycobacterium
QLSGTDARKR

SEQ ID NO: 552039 - protein, 7 aa, Mycobacterium
QLSGTRP

SEQ ID NO: 552040 - protein, 12 aa, Mycobacterium
QLSNTSSGVSQQ

SEQ ID NO: 552041 - protein, 4 aa, Mycobacterium
QLSP

SEQ ID NO: 552042 - protein, 7 aa, Mycobacterium
QLSPAKV

SEQ ID NO: 552043 - protein, 5 aa, Mycobacterium
QLSPE

SEQ ID NO: 552044 - protein, 7 aa, Mycobacterium
QLSPETW

SEQ ID NO: 552045 - protein, 9 aa, Mycobacterium
QLSPQTLDT

SEQ ID NO: 552046 - protein, 5 aa, Mycobacterium
QLSQD

SEQ ID NO: 552047 - protein, 9 aa, Mycobacterium
QLSQSGIGT

SEQ ID NO: 552048 - protein, 19 aa, Mycobacterium
QLSREDQTSSTPAASSRRD

SEQ ID NO: 552049 - protein, 9 aa, Mycobacterium
QLSRGEDPA

SEQ ID NO: 552050 - protein, 6 aa, Mycobacterium
QLSSAS

SEQ ID NO: 552051 - protein, 7 aa, Mycobacterium
QLSSGAT

SEQ ID NO: 552052 - protein, 12 aa, Mycobacterium
QLSSGEPGRTRP

SEQ ID NO: 552053 - protein, 11 aa, Mycobacterium
QLSSGPGPAGL

SEQ ID NO: 552054 - protein, 10 aa, Mycobacterium
QLSSGPGPGA

SEQ ID NO: 552055 - protein, 5 aa, Mycobacterium
QLSSP

SEQ ID NO: 552056 - protein, 7 aa, Mycobacterium
QLSSPEA

SEQ ID NO: 552057 - protein, 10 aa, Mycobacterium
QLSTDDSPGF

SEQ ID NO: 552058 - protein, 9 aa, Mycobacterium
QLSTDESPA

SEQ ID NO: 552059 - protein, 13 aa, Mycobacterium
QLSTEASPGDGDD

SEQ ID NO: 552060 - protein, 26 aa, Mycobacterium
QLSTYKGRNRGSGRHSRRQRYADGQS

SEQ ID NO: 552061 - protein, 8 aa, Mycobacterium
QLTAEGRP

SEQ ID NO: 552062 - protein, 4 aa, Mycobacterium
QLTD

SEQ ID NO: 552063 - protein, 26 aa, Mycobacterium
QLTDADPRHAGEIADRTGPPDFGPER

SEQ ID NO: 552064 - protein, 9 aa, Mycobacterium
QLTDAKGRH

SEQ ID NO: 552065 - protein, 7 aa, Mycobacterium
QLTDGGA

SEQ ID NO: 552066 - protein, 10 aa, Mycobacterium
QLTDKTAPRV

SEQ ID NO: 552067 - protein, 7 aa, Mycobacterium
QLTDPEA

SEQ ID NO: 552068 - protein, 8 aa, Mycobacterium
QLTDSQRA

SEQ ID NO: 552069 - protein, 4 aa, Mycobacterium
QLTE

SEQ ID NO: 552070 - protein, 5 aa, Mycobacterium
QLTEG

SEQ ID NO: 552071 - protein, 8 aa, Mycobacterium
QLTESGIP

SEQ ID NO: 552072 - protein, 7 aa, Mycobacterium
QLTESGV

SEQ ID NO: 552073 - protein, 9 aa, Mycobacterium
QLTESGVPS

SEQ ID NO: 552074 - protein, 4 aa, Mycobacterium
QLTG

SEQ ID NO: 552075 - protein, 6 aa, Mycobacterium
QLTGEA

SEQ ID NO: 552076 - protein, 9 aa, Mycobacterium
QLTGGPLRS

SEQ ID NO: 552077 - protein, 17 aa, Mycobacterium
QLTGTTGHDDPNASLPY

SEQ ID NO: 552078 - protein, 6 aa, Mycobacterium
QLTNNR

SEQ ID NO: 552079 - protein, 4 aa, Mycobacterium
QLTP

SEQ ID NO: 552080 - protein, 11 aa, Mycobacterium
QLTPDQPPPVA

SEQ ID NO: 552081 - protein, 8 aa, Mycobacterium
QLTPEENY

SEQ ID NO: 552082 - protein, 5 aa, Mycobacterium
QLTPR

SEQ ID NO: 552083 - protein, 6 aa, Mycobacterium
QLTPRE

SEQ ID NO: 552084 - protein, 7 aa, Mycobacterium
QLTPRLS

SEQ ID NO: 552085 - protein, 6 aa, Mycobacterium
QLTPSD

SEQ ID NO: 552086 - protein, 6 aa, Mycobacterium
QLTQSG

SEQ ID NO: 552087 - protein, 5 aa, Mycobacterium
QLTRG

SEQ ID NO: 552088 - protein, 4 aa, Mycobacterium
QLTS

SEQ ID NO: 552089 - protein, 13 aa, Mycobacterium
QLTSGSEEDETGW

SEQ ID NO: 552090 - protein, 5 aa, Mycobacterium
QLTTA

SEQ ID NO: 552091 - protein, 6 aa, Mycobacterium
QLVGPG

SEQ ID NO: 552092 - protein, 4 aa, Mycobacterium
QLVN

SEQ ID NO: 552093 - protein, 4 aa, Mycobacterium
QMAD

SEQ ID NO: 552094 - protein, 28 aa, Mycobacterium
QMAGRGTDIRLGGSDVGDDDAEKKKVAE

SEQ ID NO: 552095 - protein, 5 aa, Mycobacterium
QMDDQ

SEQ ID NO: 552096 - protein, 7 aa, Mycobacterium
QMDTTRT

SEQ ID NO: 552097 - protein, 14 aa, Mycobacterium
QMEPDAGRVTQRSG

SEQ ID NO: 552098 - protein, 4 aa, Mycobacterium
QMGA

SEQ ID NO: 552099 - protein, 11 aa, Mycobacterium
QMGAPSVGQGG

SEQ ID NO: 552100 - protein, 11 aa, Mycobacterium
QMGDGREEATA

SEQ ID NO: 552101 - protein, 8 aa, Mycobacterium
QMGGEGAQ

SEQ ID NO: 552102 - protein, 9 aa, Mycobacterium
QMGGEGSQW

SEQ ID NO: 552103 - protein, 8 aa, Mycobacterium
QMGGEGTQ

SEQ ID NO: 552104 - protein, 10 aa, Mycobacterium
QMGPEPDAPD

SEQ ID NO: 552105 - protein, 10 aa, Mycobacterium
QMGPGRSGLS

SEQ ID NO: 552106 - protein, 13 aa, Mycobacterium
QMGPNRPGPKGYV

SEQ ID NO: 552107 - protein, 16 aa, Mycobacterium
QMKTDPEKIHRVYQKA

SEQ ID NO: 552108 - protein, 4 aa, Mycobacterium
QMPD

SEQ ID NO: 552109 - protein, 7 aa, Mycobacterium
QMPDDPD

SEQ ID NO: 552110 - protein, 5 aa, Mycobacterium
QMPDG

SEQ ID NO: 552111 - protein, 12 aa, Mycobacterium
QMPGAPELPTVP

SEQ ID NO: 552112 - protein, 9 aa, Mycobacterium
QMPGSYQPV

SEQ ID NO: 552113 - protein, 14 aa, Mycobacterium
QMPPESLGGTTGLG

SEQ ID NO: 552114 - protein, 20 aa, Mycobacterium
QMPSQKTGTIDRTHIVCATG

SEQ ID NO: 552115 - protein, 5 aa, Mycobacterium
QMPTQ

SEQ ID NO: 552116 - protein, 12 aa, Mycobacterium
QMPTTAQGFGKR

SEQ ID NO: 552117 - protein, 10 aa, Mycobacterium
QMQPAYNASK

SEQ ID NO: 552118 - protein, 6 aa, Mycobacterium
QMQPQG

SEQ ID NO: 552119 - protein, 11 aa, Mycobacterium
QMQQGDVAAQT

SEQ ID NO: 552120 - protein, 12 aa, Mycobacterium
QMRAGSSSLDRD

SEQ ID NO: 552121 - protein, 4 aa, Mycobacterium
QMRD

SEQ ID NO: 552122 - protein, 5 aa, Mycobacterium
QMRPG

SEQ ID NO: 552123 - protein, 6 aa, Mycobacterium
QMRPGD

SEQ ID NO: 552124 - protein, 14 aa, Mycobacterium
QMRRTESMSDADWE

SEQ ID NO: 552125 - protein, 4 aa, Mycobacterium
QMRY

SEQ ID NO: 552126 - protein, 6 aa, Mycobacterium
QMSGGG

SEQ ID NO: 552127 - protein, 17 aa, Mycobacterium
QMSGTPPRTPPGRTGTR

SEQ ID NO: 552128 - protein, 5 aa, Mycobacterium
QMSTS

SEQ ID NO: 552129 - protein, 6 aa, Mycobacterium
QMTDGG

SEQ ID NO: 552130 - protein, 7 aa, Mycobacterium
QMTDGGA

SEQ ID NO: 552131 - protein, 4 aa, Mycobacterium
QMTP

SEQ ID NO: 552132 - protein, 8 aa, Mycobacterium
QMTSGGIA

SEQ ID NO: 552133 - protein, 10 aa, Mycobacterium
QNAAATAGGL

SEQ ID NO: 552134 - protein, 10 aa, Mycobacterium
QNAAATTGGL

SEQ ID NO: 552135 - protein, 19 aa, Mycobacterium
QNAAGSASAGPSMDTSAAQ

SEQ ID NO: 552136 - protein, 5 aa, Mycobacterium
QNAAP

SEQ ID NO: 552137 - protein, 6 aa, Mycobacterium
QNAAQD

SEQ ID NO: 552138 - protein, 14 aa, Mycobacterium
QNAAQNAVNTRGQK

SEQ ID NO: 552139 - protein, 14 aa, Mycobacterium
QNAAQRAVDARGGK

SEQ ID NO: 552140 - protein, 8 aa, Mycobacterium
QNADDNSM

SEQ ID NO: 552141 - protein, 8 aa, Mycobacterium
QNADDRDT

SEQ ID NO: 552142 - protein, 10 aa, Mycobacterium
QNADENSTVP

SEQ ID NO: 552143 - protein, 7 aa, Mycobacterium
QNADRAP

SEQ ID NO: 552144 - protein, 10 aa, Mycobacterium
QNADTGPAEL

SEQ ID NO: 552145 - protein, 20 aa, Mycobacterium
QNAEAQSDVAESDLELPATT

SEQ ID NO: 552146 - protein, 11 aa, Mycobacterium
QNAENLNDSLE

SEQ ID NO: 552147 - protein, 6 aa, Mycobacterium
QNAESA

SEQ ID NO: 552148 - protein, 9 aa, Mycobacterium
QNAGDAAAN

SEQ ID NO: 552149 - protein, 7 aa, Mycobacterium
QNAGPQD

SEQ ID NO: 552150 - protein, 7 aa, Mycobacterium
QNALPDK

SEQ ID NO: 552151 - protein, 6 aa, Mycobacterium
QNANSW

SEQ ID NO: 552152 - protein, 13 aa, Mycobacterium
QNANTAMGTAQAG

SEQ ID NO: 552153 - protein, 4 aa, Mycobacterium
QNAP

SEQ ID NO: 552154 - protein, 7 aa, Mycobacterium
QNAPAFR

SEQ ID NO: 552155 - protein, 7 aa, Mycobacterium
QNAPAIA

SEQ ID NO: 552156 - protein, 9 aa, Mycobacterium
QNAPAIAAT

SEQ ID NO: 552157 - protein, 13 aa, Mycobacterium
QNAPAIAATEAEY

SEQ ID NO: 552158 - protein, 13 aa, Mycobacterium
QNAPAIASAEANY

SEQ ID NO: 552159 - protein, 9 aa, Mycobacterium
QNAQSPDEA

SEQ ID NO: 552160 - protein, 8 aa, Mycobacterium
QNAQTVRN

SEQ ID NO: 552161 - protein, 4 aa, Mycobacterium
QNAR

SEQ ID NO: 552162 - protein, 8 aa, Mycobacterium
QNARDRTF

SEQ ID NO: 552163 - protein, 5 aa, Mycobacterium
QNARE

SEQ ID NO: 552164 - protein, 5 aa, Mycobacterium
QNARS

SEQ ID NO: 552165 - protein, 6 aa, Mycobacterium
QNASGA

SEQ ID NO: 552166 - protein, 7 aa, Mycobacterium
QNASGAV

SEQ ID NO: 552167 - protein, 9 aa, Mycobacterium
QNATGDPAI

SEQ ID NO: 552168 - protein, 9 aa, Mycobacterium
QNATGEPAI

SEQ ID NO: 552169 - protein, 17 aa, Mycobacterium
QNATPQDLSDESVAAGA

SEQ ID NO: 552170 - protein, 15 aa, Mycobacterium
QNCDSGSGTAEHPVE

SEQ ID NO: 552171 - protein, 11 aa, Mycobacterium
QNDDASAPLDP

SEQ ID NO: 552172 - protein, 8 aa, Mycobacterium
QNDDRNDR

SEQ ID NO: 552173 - protein, 8 aa, Mycobacterium
QNDEGKKE

SEQ ID NO: 552174 - protein, 4 aa, Mycobacterium
QNDL

SEQ ID NO: 552175 - protein, 5 aa, Mycobacterium
QNDLT

SEQ ID NO: 552176 - protein, 5 aa, Mycobacterium
QNDPI

SEQ ID NO: 552177 - protein, 5 aa, Mycobacterium
QNDPK

SEQ ID NO: 552178 - protein, 5 aa, Mycobacterium
QNDPQ

SEQ ID NO: 552179 - protein, 7 aa, Mycobacterium
QNDPSRL

SEQ ID NO: 552180 - protein, 11 aa, Mycobacterium
QNDPSTVRGAR

SEQ ID NO: 552181 - protein, 8 aa, Mycobacterium
QNDSGAAA

SEQ ID NO: 552182 - protein, 5 aa, Mycobacterium
QNDSV

SEQ ID NO: 552183 - protein, 5 aa, Mycobacterium
QNEAF

SEQ ID NO: 552184 - protein, 6 aa, Mycobacterium
QNEAPG

SEQ ID NO: 552185 - protein, 9 aa, Mycobacterium
QNEARTESA

SEQ ID NO: 552186 - protein, 7 aa, Mycobacterium
QNEASRV

SEQ ID NO: 552187 - protein, 16 aa, Mycobacterium
QNEATREECSSPSDID

SEQ ID NO: 552188 - protein, 7 aa, Mycobacterium
QNEGEGG

SEQ ID NO: 552189 - protein, 13 aa, Mycobacterium
QNEHERNGGPGVG

SEQ ID NO: 552190 - protein, 5 aa, Mycobacterium
QNEHG

SEQ ID NO: 552191 - protein, 9 aa, Mycobacterium
QNEINGDEA

SEQ ID NO: 552192 - protein, 10 aa, Mycobacterium
QNEKGNPFGE

SEQ ID NO: 552193 - protein, 17 aa, Mycobacterium
QNEKGVGQGIRNSGIDR

SEQ ID NO: 552194 - protein, 9 aa, Mycobacterium
QNEKSSIDA

SEQ ID NO: 552195 - protein, 4 aa, Mycobacterium
QNEP

SEQ ID NO: 552196 - protein, 6 aa, Mycobacterium
QNEPNL

SEQ ID NO: 552197 - protein, 6 aa, Mycobacterium
QNEPTL

SEQ ID NO: 552198 - protein, 5 aa, Mycobacterium
QNERA

SEQ ID NO: 552199 - protein, 5 aa, Mycobacterium
QNESS

SEQ ID NO: 552200 - protein, 4 aa, Mycobacterium
QNET

SEQ ID NO: 552201 - protein, 8 aa, Mycobacterium
QNEVGGTD

SEQ ID NO: 552202 - protein, 8 aa, Mycobacterium
QNEVSGTD

SEQ ID NO: 552203 - protein, 15 aa, Mycobacterium
QNEYDNTEHRNAESF

SEQ ID NO: 552204 - protein, 11 aa, Mycobacterium
QNFTPPAPRYK

SEQ ID NO: 552205 - protein, 6 aa, Mycobacterium
QNFTSS

SEQ ID NO: 552206 - protein, 8 aa, Mycobacterium
QNFTSSDG

SEQ ID NO: 552207 - protein, 7 aa, Mycobacterium
QNGADRL

SEQ ID NO: 552208 - protein, 28 aa, Mycobacterium
QNGASPDDAAAATVNNTGISPAQAAAGV

SEQ ID NO: 552209 - protein, 6 aa, Mycobacterium
QNGATR

SEQ ID NO: 552210 - protein, 8 aa, Mycobacterium
QNGDKVDG

SEQ ID NO: 552211 - protein, 11 aa, Mycobacterium
QNGDSPFRPTT

SEQ ID NO: 552212 - protein, 14 aa, Mycobacterium
QNGESSYRMYCFEN

SEQ ID NO: 552213 - protein, 4 aa, Mycobacterium
QNGG

SEQ ID NO: 552214 - protein, 10 aa, Mycobacterium
QNGGATDHGR

SEQ ID NO: 552215 - protein, 11 aa, Mycobacterium
QNGGEPPPFAP

SEQ ID NO: 552216 - protein, 7 aa, Mycobacterium
QNGGEYD

SEQ ID NO: 552217 - protein, 7 aa, Mycobacterium
QNGGGTV

SEQ ID NO: 552218 - protein, 29 aa, Mycobacterium
QNGGPTGSLGYPTSDEAQTNGGPQTASGG

SEQ ID NO: 552219 - protein, 4 aa, Mycobacterium
QNGH

SEQ ID NO: 552220 - protein, 6 aa, Mycobacterium
QNGLDA

SEQ ID NO: 552221 - protein, 4 aa, Mycobacterium
QNGN

SEQ ID NO: 552222 - protein, 6 aa, Mycobacterium
QNGNGY

SEQ ID NO: 552223 - protein, 8 aa, Mycobacterium
QNGNGYND

SEQ ID NO: 552224 - protein, 6 aa, Mycobacterium
QNGNNE

SEQ ID NO: 552225 - protein, 5 aa, Mycobacterium
QNGNP

SEQ ID NO: 552226 - protein, 8 aa, Mycobacterium
QNGNTVAR

SEQ ID NO: 552227 - protein, 6 aa, Mycobacterium
QNGPGQ

SEQ ID NO: 552228 - protein, 9 aa, Mycobacterium
QNGPRDRRP

SEQ ID NO: 552229 - protein, 7 aa, Mycobacterium
QNGSYAS

SEQ ID NO: 552230 - protein, 5 aa, Mycobacterium
QNGTL

SEQ ID NO: 552231 - protein, 4 aa, Mycobacterium
QNGV

SEQ ID NO: 552232 - protein, 5 aa, Mycobacterium
QNGVD

SEQ ID NO: 552233 - protein, 6 aa, Mycobacterium
QNGYPD

SEQ ID NO: 552234 - protein, 7 aa, Mycobacterium
QNHAGPS

SEQ ID NO: 552235 - protein, 6 aa, Mycobacterium
QNHEFP

SEQ ID NO: 552236 - protein, 13 aa, Mycobacterium
QNHPTPETKLDEA

SEQ ID NO: 552237 - protein, 4 aa, Mycobacterium
QNHT

SEQ ID NO: 552238 - protein, 20 aa, Mycobacterium
QNIAGGGWSGQAQATSYDTM

SEQ ID NO: 552239 - protein, 4 aa, Mycobacterium
QNID

SEQ ID NO: 552240 - protein, 13 aa, Mycobacterium
QNIPGGDETLPYT

SEQ ID NO: 552241 - protein, 5 aa, Mycobacterium
QNIRY

SEQ ID NO: 552242 - protein, 20 aa, Mycobacterium
QNISGAGWAGTAEASSYDTM

SEQ ID NO: 552243 - protein, 7 aa, Mycobacterium
QNISGKD

SEQ ID NO: 552244 - protein, 5 aa, Mycobacterium
QNITK

SEQ ID NO: 552245 - protein, 6 aa, Mycobacterium
QNITTD

SEQ ID NO: 552246 - protein, 4 aa, Mycobacterium
QNKD

SEQ ID NO: 552247 - protein, 8 aa, Mycobacterium
QNKPGGSA

SEQ ID NO: 552248 - protein, 6 aa, Mycobacterium
QNKRTV

SEQ ID NO: 552249 - protein, 16 aa, Mycobacterium
QNKSNSAQVTDIEQNK

SEQ ID NO: 552250 - protein, 12 aa, Mycobacterium
QNLDTAADRDAA

SEQ ID NO: 552251 - protein, 6 aa, Mycobacterium
QNLEAP

SEQ ID NO: 552252 - protein, 5 aa, Mycobacterium
QNLET

SEQ ID NO: 552253 - protein, 8 aa, Mycobacterium
QNLGGDRR

SEQ ID NO: 552254 - protein, 4 aa, Mycobacterium
QNLP

SEQ ID NO: 552255 - protein, 13 aa, Mycobacterium
QNLPAQPPDYDAE

SEQ ID NO: 552256 - protein, 11 aa, Mycobacterium
QNLPPAQRPGV

SEQ ID NO: 552257 - protein, 11 aa, Mycobacterium
QNLPSRPTSFD

SEQ ID NO: 552258 - protein, 6 aa, Mycobacterium
QNLQPG

SEQ ID NO: 552259 - protein, 12 aa, Mycobacterium
QNLSADPAPESL

SEQ ID NO: 552260 - protein, 4 aa, Mycobacterium
QNMS

SEQ ID NO: 552261 - protein, 5 aa, Mycobacterium
QNMSN

SEQ ID NO: 552262 - protein, 6 aa, Mycobacterium
QNMSNN

SEQ ID NO: 552263 - protein, 19 aa, Mycobacterium
QNMSNNSAVTVEGGEIGRA

SEQ ID NO: 552264 - protein, 4 aa, Mycobacterium
QNMT

SEQ ID NO: 552265 - protein, 11 aa, Mycobacterium
QNNGNKTTIAP

SEQ ID NO: 552266 - protein, 4 aa, Mycobacterium
QNNN

SEQ ID NO: 552267 - protein, 20 aa, Mycobacterium
QNNPNRLTSPMRRRPDGTYE

SEQ ID NO: 552268 - protein, 16 aa, Mycobacterium
QNNPTDVERATYANNV

SEQ ID NO: 552269 - protein, 21 aa, Mycobacterium
QNNRSRLTSPLRRRSDGTYEE

SEQ ID NO: 552270 - protein, 41 aa, Mycobacterium
QNPAPAATFPQGPGPAPGPAQPVQPAAPAGPVGTGPAPGPR

SEQ ID NO: 552271 - protein, 6 aa, Mycobacterium
QNPASA

SEQ ID NO: 552272 - protein, 36 aa, Mycobacterium
QNPDMSRRNRQKRAAKQKDRRRASSQQGRWNTAPEY

SEQ ID NO: 552273 - protein, 10 aa, Mycobacterium
QNPDPTEEEI

SEQ ID NO: 552274 - protein, 12 aa, Mycobacterium
QNPDWADNPKTY

SEQ ID NO: 552275 - protein, 6 aa, Mycobacterium
QNPEAA

SEQ ID NO: 552276 - protein, 7 aa, Mycobacterium
QNPEEQT

SEQ ID NO: 552277 - protein, 5 aa, Mycobacterium
QNPEL

SEQ ID NO: 552278 - protein, 5 aa, Mycobacterium
QNPEQ

SEQ ID NO: 552279 - protein, 21 aa, Mycobacterium
QNPEVTEKGDHGDDTSPVTEA

SEQ ID NO: 552280 - protein, 16 aa, Mycobacterium
QNPGALETAPVRPGGA

SEQ ID NO: 552281 - protein, 16 aa, Mycobacterium
QNPGGPEAELAGKTAH

SEQ ID NO: 552282 - protein, 7 aa, Mycobacterium
QNPGLSI

SEQ ID NO: 552283 - protein, 4 aa, Mycobacterium
QNPI

SEQ ID NO: 552284 - protein, 4 aa, Mycobacterium
QNPN

SEQ ID NO: 552285 - protein, 6 aa, Mycobacterium
QNPPAA

SEQ ID NO: 552286 - protein, 15 aa, Mycobacterium
QNPPADTTEPHSELR

SEQ ID NO: 552287 - protein, 8 aa, Mycobacterium
QNPPRSGL

SEQ ID NO: 552288 - protein, 5 aa, Mycobacterium
QNPPS

SEQ ID NO: 552289 - protein, 7 aa, Mycobacterium
QNPQAAD

SEQ ID NO: 552290 - protein, 8 aa, Mycobacterium
QNPQAASE

SEQ ID NO: 552291 - protein, 7 aa, Mycobacterium
QNPRPGI

SEQ ID NO: 552292 - protein, 7 aa, Mycobacterium
QNPRPGL

SEQ ID NO: 552293 - protein, 6 aa, Mycobacterium
QNPRTR

SEQ ID NO: 552294 - protein, 7 aa, Mycobacterium
QNPSFGG

SEQ ID NO: 552295 - protein, 6 aa, Mycobacterium
QNPSGV

SEQ ID NO: 552296 - protein, 9 aa, Mycobacterium
QNPTARARA

SEQ ID NO: 552297 - protein, 10 aa, Mycobacterium
QNPTGATPEL

SEQ ID NO: 552298 - protein, 5 aa, Mycobacterium
QNPTI

SEQ ID NO: 552299 - protein, 26 aa, Mycobacterium
QNPTPFTGTAPFGPPKIQPANGSTVG

SEQ ID NO: 552300 - protein, 14 aa, Mycobacterium
QNPVDQEGTYPLPE

SEQ ID NO: 552301 - protein, 6 aa, Mycobacterium
QNPVEY

SEQ ID NO: 552302 - protein, 6 aa, Mycobacterium
QNPVRE

SEQ ID NO: 552303 - protein, 4 aa, Mycobacterium
QNQA

SEQ ID NO: 552304 - protein, 7 aa, Mycobacterium
QNQDTGG

SEQ ID NO: 552305 - protein, 7 aa, Mycobacterium
QNQPARP

SEQ ID NO: 552306 - protein, 5 aa, Mycobacterium
QNQPE

SEQ ID NO: 552307 - protein, 10 aa, Mycobacterium
QNQPTLPDSA

SEQ ID NO: 552308 - protein, 7 aa, Mycobacterium
QNQQPIS

SEQ ID NO: 552309 - protein, 7 aa, Mycobacterium
QNQQPVT

SEQ ID NO: 552310 - protein, 15 aa, Mycobacterium
QNQRDHDHLSRGAAQ

SEQ ID NO: 552311 - protein, 14 aa, Mycobacterium
QNQRSVGARGPATM

SEQ ID NO: 552312 - protein, 8 aa, Mycobacterium
QNRAGGGF

SEQ ID NO: 552313 - protein, 6 aa, Mycobacterium
QNRARQ

SEQ ID NO: 552314 - protein, 7 aa, Mycobacterium
QNRAYPA

SEQ ID NO: 552315 - protein, 9 aa, Mycobacterium
QNREGEGPC

SEQ ID NO: 552316 - protein, 9 aa, Mycobacterium
QNREPNPQI

SEQ ID NO: 552317 - protein, 5 aa, Mycobacterium
QNRGH

SEQ ID NO: 552318 - protein, 6 aa, Mycobacterium
QNRGSG

SEQ ID NO: 552319 - protein, 8 aa, Mycobacterium
QNRPDFPP

SEQ ID NO: 552320 - protein, 7 aa, Mycobacterium
QNRPGAT

SEQ ID NO: 552321 - protein, 9 aa, Mycobacterium
QNRQADNKL

SEQ ID NO: 552322 - protein, 10 aa, Mycobacterium
QNRQHKHGEH

SEQ ID NO: 552323 - protein, 4 aa, Mycobacterium
QNRR

SEQ ID NO: 552324 - protein, 6 aa, Mycobacterium
QNRRPD

SEQ ID NO: 552325 - protein, 10 aa, Mycobacterium
QNRRSHPLQG

SEQ ID NO: 552326 - protein, 16 aa, Mycobacterium
QNRRSHPLQGDQTLAE

SEQ ID NO: 552327 - protein, 17 aa, Mycobacterium
QNRRSHPLQGDQTLAEG

SEQ ID NO: 552328 - protein, 14 aa, Mycobacterium
QNRRSHPLQGNQTL

SEQ ID NO: 552329 - protein, 14 aa, Mycobacterium
QNRRSHPLQGQQTL

SEQ ID NO: 552330 - protein, 4 aa, Mycobacterium
QNRS

SEQ ID NO: 552331 - protein, 6 aa, Mycobacterium
QNRTDA

SEQ ID NO: 552332 - protein, 7 aa, Mycobacterium
QNRTGLR

SEQ ID NO: 552333 - protein, 9 aa, Mycobacterium
QNRVQDPAK

SEQ ID NO: 552334 - protein, 5 aa, Mycobacterium
QNRWA

SEQ ID NO: 552335 - protein, 9 aa, Mycobacterium
QNSAETAAA

SEQ ID NO: 552336 - protein, 20 aa, Mycobacterium
QNSAGRLTTPMRRRPDGEFE

SEQ ID NO: 552337 - protein, 12 aa, Mycobacterium
QNSAKPGRAATG

SEQ ID NO: 552338 - protein, 10 aa, Mycobacterium
QNSAQNGVKL

SEQ ID NO: 552339 - protein, 5 aa, Mycobacterium
QNSAR

SEQ ID NO: 552340 - protein, 7 aa, Mycobacterium
QNSDAHE

SEQ ID NO: 552341 - protein, 9 aa, Mycobacterium
QNSDEVTVE

SEQ ID NO: 552342 - protein, 5 aa, Mycobacterium
QNSDV

SEQ ID NO: 552343 - protein, 9 aa, Mycobacterium
QNSESLGPV

SEQ ID NO: 552344 - protein, 20 aa, Mycobacterium
QNSGARLTSPLRRREDGSFE

SEQ ID NO: 552345 - protein, 10 aa, Mycobacterium
QNSGSKTTIA

SEQ ID NO: 552346 - protein, 12 aa, Mycobacterium
QNSGSKTTVAPY

SEQ ID NO: 552347 - protein, 6 aa, Mycobacterium
QNSPAI

SEQ ID NO: 552348 - protein, 12 aa, Mycobacterium
QNSPAIATTEAN

SEQ ID NO: 552349 - protein, 6 aa, Mycobacterium
QNSPNL

SEQ ID NO: 552350 - protein, 13 aa, Mycobacterium
QNSPQDADARATA

SEQ ID NO: 552351 - protein, 9 aa, Mycobacterium
QNSPTIAAT

SEQ ID NO: 552352 - protein, 8 aa, Mycobacterium
QNSRGRLT

SEQ ID NO: 552353 - protein, 8 aa, Mycobacterium
QNSRTRLT

SEQ ID NO: 552354 - protein, 25 aa, Mycobacterium
QNSSGSLTTQDAINGRQVTRAGEVR

SEQ ID NO: 552355 - protein, 11 aa, Mycobacterium
QNSSSTGEPDR

SEQ ID NO: 552356 - protein, 11 aa, Mycobacterium
QNSSTAAEPDR

SEQ ID NO: 552357 - protein, 17 aa, Mycobacterium
QNSTALDISDDSVATGA

SEQ ID NO: 552358 - protein, 9 aa, Mycobacterium
QNSTNSPGG

SEQ ID NO: 552359 - protein, 8 aa, Mycobacterium
QNSTPLDL

SEQ ID NO: 552360 - protein, 17 aa, Mycobacterium
QNSTPLDVSDESVAAGA

SEQ ID NO: 552361 - protein, 6 aa, Mycobacterium
QNSVRQ

SEQ ID NO: 552362 - protein, 6 aa, Mycobacterium
QNTAGL

SEQ ID NO: 552363 - protein, 7 aa, Mycobacterium
QNTASSV

SEQ ID NO: 552364 - protein, 7 aa, Mycobacterium
QNTDAEG

SEQ ID NO: 552365 - protein, 5 aa, Mycobacterium
QNTDE

SEQ ID NO: 552366 - protein, 14 aa, Mycobacterium
QNTDGGIREAQEKL

SEQ ID NO: 552367 - protein, 16 aa, Mycobacterium
QNTDTVGRIAPVLEKV

SEQ ID NO: 552368 - protein, 8 aa, Mycobacterium
QNTGGGKT

SEQ ID NO: 552369 - protein, 6 aa, Mycobacterium
QNTHGE

SEQ ID NO: 552370 - protein, 4 aa, Mycobacterium
QNTK

SEQ ID NO: 552371 - protein, 10 aa, Mycobacterium
QNTKDAGGAR

SEQ ID NO: 552372 - protein, 8 aa, Mycobacterium
QNTKDVHG

SEQ ID NO: 552373 - protein, 9 aa, Mycobacterium
QNTKDVHGN

SEQ ID NO: 552374 - protein, 9 aa, Mycobacterium
QNTKGPGGR

SEQ ID NO: 552375 - protein, 5 aa, Mycobacterium
QNTKI

SEQ ID NO: 552376 - protein, 11 aa, Mycobacterium
QNTNQAETALR

SEQ ID NO: 552377 - protein, 11 aa, Mycobacterium
QNTNTLYGGGY

SEQ ID NO: 552378 - protein, 5 aa, Mycobacterium
QNTPA

SEQ ID NO: 552379 - protein, 13 aa, Mycobacterium
QNTPAIAAAEANY

SEQ ID NO: 552380 - protein, 12 aa, Mycobacterium
QNTPAIAANEAQ

SEQ ID NO: 552381 - protein, 14 aa, Mycobacterium
QNTPAIAASEADYS

SEQ ID NO: 552382 - protein, 12 aa, Mycobacterium
QNTPAIAATEAA

SEQ ID NO: 552383 - protein, 12 aa, Mycobacterium
QNTPAIAATEAD

SEQ ID NO: 552384 - protein, 13 aa, Mycobacterium
QNTPAIAATEAEY

SEQ ID NO: 552385 - protein, 11 aa, Mycobacterium
QNTPAIAATET

SEQ ID NO: 552386 - protein, 12 aa, Mycobacterium
QNTPAIASTEAQ

SEQ ID NO: 552387 - protein, 13 aa, Mycobacterium
QNTPAIATSEADY

SEQ ID NO: 552388 - protein, 12 aa, Mycobacterium
QNTPAIATTETE

SEQ ID NO: 552389 - protein, 11 aa, Mycobacterium
QNTPSIAATEA

SEQ ID NO: 552390 - protein, 7 aa, Mycobacterium
QNTPTAE

SEQ ID NO: 552391 - protein, 7 aa, Mycobacterium
QNTPVNT

SEQ ID NO: 552392 - protein, 7 aa, Mycobacterium
QNTRRRQ

SEQ ID NO: 552393 - protein, 13 aa, Mycobacterium
QNTSAIAANEAQY

SEQ ID NO: 552394 - protein, 11 aa, Mycobacterium
QNTSAIATTET

SEQ ID NO: 552395 - protein, 9 aa, Mycobacterium
QNTSAQALQ

SEQ ID NO: 552396 - protein, 12 aa, Mycobacterium
QNTSAQALQGVG

SEQ ID NO: 552397 - protein, 9 aa, Mycobacterium
QNTSAQALT

SEQ ID NO: 552398 - protein, 8 aa, Mycobacterium
QNTTASKT

SEQ ID NO: 552399 - protein, 7 aa, Mycobacterium
QNTYERS

SEQ ID NO: 552400 - protein, 5 aa, Mycobacterium
QNVRD

SEQ ID NO: 552401 - protein, 9 aa, Mycobacterium
QNVTEPTRI

SEQ ID NO: 552402 - protein, 9 aa, Mycobacterium
QNVTNPALG

SEQ ID NO: 552403 - protein, 6 aa, Mycobacterium
QNVTRR

SEQ ID NO: 552404 - protein, 11 aa, Mycobacterium
QNWESGDERKQ

SEQ ID NO: 552405 - protein, 14 aa, Mycobacterium
QNYPEAWGDEEKRV

SEQ ID NO: 552406 - protein, 8 aa, Mycobacterium
QNYSEDGD

SEQ ID NO: 552407 - protein, 6 aa, Mycobacterium
QNYYPR

SEQ ID NO: 552408 - protein, 4 aa, Mycobacterium
QPAA

SEQ ID NO: 552409 - protein, 7 aa, Mycobacterium
QPAAAAA

SEQ ID NO: 552410 - protein, 8 aa, Mycobacterium
QPAAAANN

SEQ ID NO: 552411 - protein, 6 aa, Mycobacterium
QPAAAD

SEQ ID NO: 552412 - protein, 10 aa, Mycobacterium
QPAADQPHYN

SEQ ID NO: 552413 - protein, 8 aa, Mycobacterium
QPAAESGA

SEQ ID NO: 552414 - protein, 6 aa, Mycobacterium
QPAAGG

SEQ ID NO: 552415 - protein, 6 aa, Mycobacterium
QPAALD

SEQ ID NO: 552416 - protein, 7 aa, Mycobacterium
QPAARGL

SEQ ID NO: 552417 - protein, 9 aa, Mycobacterium
QPAATAEEI

SEQ ID NO: 552418 - protein, 8 aa, Mycobacterium
QPAATGPR

SEQ ID NO: 552419 - protein, 9 aa, Mycobacterium
QPADEGSTV

SEQ ID NO: 552420 - protein, 14 aa, Mycobacterium
QPADFSHRPSAGDR

SEQ ID NO: 552421 - protein, 5 aa, Mycobacterium
QPADG

SEQ ID NO: 552422 - protein, 19 aa, Mycobacterium
QPADLAKAAEGHVDADSVR

SEQ ID NO: 552423 - protein, 13 aa, Mycobacterium
QPADQSALPRLGP

SEQ ID NO: 552424 - protein, 10 aa, Mycobacterium
QPADSYRNDH

SEQ ID NO: 552425 - protein, 11 aa, Mycobacterium
QPADTAPPIGT

SEQ ID NO: 552426 - protein, 7 aa, Mycobacterium
QPADTAT

SEQ ID NO: 552427 - protein, 30 aa, Mycobacterium
QPADTSTTFTARSGVPQIQDGPFADTKERL

SEQ ID NO: 552428 - protein, 5 aa, Mycobacterium
QPADV

SEQ ID NO: 552429 - protein, 11 aa, Mycobacterium
QPADVSSEATA

SEQ ID NO: 552430 - protein, 4 aa, Mycobacterium
QPAE

SEQ ID NO: 552431 - protein, 46 aa, Mycobacterium
QPAEAAPQAAPTPAPPAEPAAAPAAQPNVSRETSAEYDTPIGAAAE

SEQ ID NO: 552432 - protein, 8 aa, Mycobacterium
QPAEAIDS

SEQ ID NO: 552433 - protein, 17 aa, Mycobacterium
QPAEANDPRVRGAARTH

SEQ ID NO: 552434 - protein, 22 aa, Mycobacterium
QPAEPQRRTSGGGLNISPKGYE

SEQ ID NO: 552435 - protein, 7 aa, Mycobacterium
QPAESDG

SEQ ID NO: 552436 - protein, 10 aa, Mycobacterium
QPAESYQNDH

SEQ ID NO: 552437 - protein, 6 aa, Mycobacterium
QPAETL

SEQ ID NO: 552438 - protein, 14 aa, Mycobacterium
QPAFEDASARAEGY

SEQ ID NO: 552439 - protein, 5 aa, Mycobacterium
QPAGE

SEQ ID NO: 552440 - protein, 6 aa, Mycobacterium
QPAGEA

SEQ ID NO: 552441 - protein, 8 aa, Mycobacterium
QPAGEAGY

SEQ ID NO: 552442 - protein, 13 aa, Mycobacterium
QPAGGDPARQEDA

SEQ ID NO: 552443 - protein, 8 aa, Mycobacterium
QPAGGPRV

SEQ ID NO: 552444 - protein, 7 aa, Mycobacterium
QPAGPER

SEQ ID NO: 552445 - protein, 6 aa, Mycobacterium
QPAGRL

SEQ ID NO: 552446 - protein, 6 aa, Mycobacterium
QPAGSL

SEQ ID NO: 552447 - protein, 11 aa, Mycobacterium
QPAGTLGPQQR

SEQ ID NO: 552448 - protein, 5 aa, Mycobacterium
QPAGV

SEQ ID NO: 552449 - protein, 9 aa, Mycobacterium
QPAHPHRAP

SEQ ID NO: 552450 - protein, 5 aa, Mycobacterium
QPAHR

SEQ ID NO: 552451 - protein, 9 aa, Mycobacterium
QPAKSTDRA

SEQ ID NO: 552452 - protein, 12 aa, Mycobacterium
QPAKTSDPRGLS

SEQ ID NO: 552453 - protein, 4 aa, Mycobacterium
QPAL

SEQ ID NO: 552454 - protein, 5 aa, Mycobacterium
QPALT

SEQ ID NO: 552455 - protein, 4 aa, Mycobacterium
QPAM

SEQ ID NO: 552456 - protein, 6 aa, Mycobacterium
QPAMPG

SEQ ID NO: 552457 - protein, 4 aa, Mycobacterium
QPAN

SEQ ID NO: 552458 - protein, 5 aa, Mycobacterium
QPANL

SEQ ID NO: 552459 - protein, 8 aa, Mycobacterium
QPANPVND

SEQ ID NO: 552460 - protein, 9 aa, Mycobacterium
QPAPAQNKN

SEQ ID NO: 552461 - protein, 11 aa, Mycobacterium
QPAPDPNPIAD

SEQ ID NO: 552462 - protein, 44 aa, Mycobacterium
QPAPEQPHAPSPDPSTPTGQRGGPMDVPRGTNAPATIDGTSFSG

SEQ ID NO: 552463 - protein, 19 aa, Mycobacterium
QPAPGNNNVGMGNTGNNNF

SEQ ID NO: 552464 - protein, 6 aa, Mycobacterium
QPAPLA

SEQ ID NO: 552465 - protein, 25 aa, Mycobacterium
QPAPPHNATQATGSSAGQVTYAGSA

SEQ ID NO: 552466 - protein, 24 aa, Mycobacterium
QPAPQQPRQTTAAGSEPQVPQNVQ

SEQ ID NO: 552467 - protein, 27 aa, Mycobacterium
QPAPQSAEADPLSAPAELGAQRSPAPA

SEQ ID NO: 552468 - protein, 5 aa, Mycobacterium
QPAPT

SEQ ID NO: 552469 - protein, 8 aa, Mycobacterium
QPAPTDLG

SEQ ID NO: 552470 - protein, 6 aa, Mycobacterium
QPAQPG

SEQ ID NO: 552471 - protein, 6 aa, Mycobacterium
QPAQQA

SEQ ID NO: 552472 - protein, 6 aa, Mycobacterium
QPAQQM

SEQ ID NO: 552473 - protein, 6 aa, Mycobacterium
QPAQRR

SEQ ID NO: 552474 - protein, 33 aa, Mycobacterium
QPAQTTDPSGLASQSAAVTQAVGSTVGNLTQTE

SEQ ID NO: 552475 - protein, 4 aa, Mycobacterium
QPAR

SEQ ID NO: 552476 - protein, 14 aa, Mycobacterium
QPARGIDPALQSDP

SEQ ID NO: 552477 - protein, 5 aa, Mycobacterium
QPARQ

SEQ ID NO: 552478 - protein, 16 aa, Mycobacterium
QPARRTNATVSRPGAR

SEQ ID NO: 552479 - protein, 23 aa, Mycobacterium
QPARTMDGRGSFQDTSGANGSLN

SEQ ID NO: 552480 - protein, 6 aa, Mycobacterium
QPARTQ

SEQ ID NO: 552481 - protein, 9 aa, Mycobacterium
QPASADRSR

SEQ ID NO: 552482 - protein, 5 aa, Mycobacterium
QPASG

SEQ ID NO: 552483 - protein, 11 aa, Mycobacterium
QPASGRASAQG

SEQ ID NO: 552484 - protein, 6 aa, Mycobacterium
QPASRL

SEQ ID NO: 552485 - protein, 9 aa, Mycobacterium
QPASSSGAV

SEQ ID NO: 552486 - protein, 7 aa, Mycobacterium
QPASTAA

SEQ ID NO: 552487 - protein, 5 aa, Mycobacterium
QPASY

SEQ ID NO: 552488 - protein, 10 aa, Mycobacterium
QPATDSTPNA

SEQ ID NO: 552489 - protein, 13 aa, Mycobacterium
QPATESTGAAAGP

SEQ ID NO: 552490 - protein, 7 aa, Mycobacterium
QPATNVE

SEQ ID NO: 552491 - protein, 5 aa, Mycobacterium
QPATP

SEQ ID NO: 552492 - protein, 12 aa, Mycobacterium
QPATPAAELGSA

SEQ ID NO: 552493 - protein, 8 aa, Mycobacterium
QPATRPLQ

SEQ ID NO: 552494 - protein, 46 aa, Mycobacterium
QPATRTTGTARAAAHTTASAGTPITPEPGVATGPTDRAGTAHPAGA

SEQ ID NO: 552495 - protein, 8 aa, Mycobacterium
QPATSELT

SEQ ID NO: 552496 - protein, 14 aa, Mycobacterium
QPATTTANPTVAKT

SEQ ID NO: 552497 - protein, 8 aa, Mycobacterium
QPAVDDPE

SEQ ID NO: 552498 - protein, 8 aa, Mycobacterium
QPAVDSAD

SEQ ID NO: 552499 - protein, 8 aa, Mycobacterium
QPAVGAHP

SEQ ID NO: 552500 - protein, 8 aa, Mycobacterium
QPAVRSGN

SEQ ID NO: 552501 - protein, 11 aa, Mycobacterium
QPAVSEPSTAE

SEQ ID NO: 552502 - protein, 4 aa, Mycobacterium
QPAY

SEQ ID NO: 552503 - protein, 5 aa, Mycobacterium
QPCVS

SEQ ID NO: 552504 - protein, 7 aa, Mycobacterium
QPDAGAR

SEQ ID NO: 552505 - protein, 9 aa, Mycobacterium
QPDAGSVAA

SEQ ID NO: 552506 - protein, 5 aa, Mycobacterium
QPDAP

SEQ ID NO: 552507 - protein, 10 aa, Mycobacterium
QPDAQGNRPD

SEQ ID NO: 552508 - protein, 6 aa, Mycobacterium
QPDARR

SEQ ID NO: 552509 - protein, 8 aa, Mycobacterium
QPDAVEGK

SEQ ID NO: 552510 - protein, 7 aa, Mycobacterium
QPDAVVD

SEQ ID NO: 552511 - protein, 5 aa, Mycobacterium
QPDCK

SEQ ID NO: 552512 - protein, 10 aa, Mycobacterium
QPDDGRASLG

SEQ ID NO: 552513 - protein, 15 aa, Mycobacterium
QPDDRALGKAASQAD

SEQ ID NO: 552514 - protein, 18 aa, Mycobacterium
QPDDSEAITVSSAQESGD

SEQ ID NO: 552515 - protein, 12 aa, Mycobacterium
QPDDSRTAAGRL

SEQ ID NO: 552516 - protein, 7 aa, Mycobacterium
QPDDYRD

SEQ ID NO: 552517 - protein, 6 aa, Mycobacterium
QPDELR

SEQ ID NO: 552518 - protein, 16 aa, Mycobacterium
QPDEPFQPYNRDPETL

SEQ ID NO: 552519 - protein, 5 aa, Mycobacterium
QPDEV

SEQ ID NO: 552520 - protein, 14 aa, Mycobacterium
QPDFRDRDKTAAAN

SEQ ID NO: 552521 - protein, 23 aa, Mycobacterium
QPDFREADNRAAANVAAAAKAAG

SEQ ID NO: 552522 - protein, 8 aa, Mycobacterium
QPDGDATA

SEQ ID NO: 552523 - protein, 9 aa, Mycobacterium
QPDGIGGFG

SEQ ID NO: 552524 - protein, 6 aa, Mycobacterium
QPDGQT

SEQ ID NO: 552525 - protein, 13 aa, Mycobacterium
QPDGTTTVLAPAQ

SEQ ID NO: 552526 - protein, 10 aa, Mycobacterium
QPDGVGGFND

SEQ ID NO: 552527 - protein, 5 aa, Mycobacterium
QPDID

SEQ ID NO: 552528 - protein, 4 aa, Mycobacterium
QPDK

SEQ ID NO: 552529 - protein, 9 aa, Mycobacterium
QPDKESVAA

SEQ ID NO: 552530 - protein, 7 aa, Mycobacterium
QPDKGLA

SEQ ID NO: 552531 - protein, 5 aa, Mycobacterium
QPDLE

SEQ ID NO: 552532 - protein, 8 aa, Mycobacterium
QPDLSPKA

SEQ ID NO: 552533 - protein, 9 aa, Mycobacterium
QPDLSPKAW

SEQ ID NO: 552534 - protein, 6 aa, Mycobacterium
QPDLTT

SEQ ID NO: 552535 - protein, 4 aa, Mycobacterium
QPDN

SEQ ID NO: 552536 - protein, 8 aa, Mycobacterium
QPDPPDVD

SEQ ID NO: 552537 - protein, 19 aa, Mycobacterium
QPDPRRPGGRAWSATALLT

SEQ ID NO: 552538 - protein, 10 aa, Mycobacterium
QPDPSHCGGI

SEQ ID NO: 552539 - protein, 6 aa, Mycobacterium
QPDPSY

SEQ ID NO: 552540 - protein, 5 aa, Mycobacterium
QPDQE

SEQ ID NO: 552541 - protein, 6 aa, Mycobacterium
QPDQSG

SEQ ID NO: 552542 - protein, 5 aa, Mycobacterium
QPDQT

SEQ ID NO: 552543 - protein, 5 aa, Mycobacterium
QPDQV

SEQ ID NO: 552544 - protein, 10 aa, Mycobacterium
QPDRDQTERA

SEQ ID NO: 552545 - protein, 7 aa, Mycobacterium
QPDRELS

SEQ ID NO: 552546 - protein, 15 aa, Mycobacterium
QPDRGAKPHRGKPPT

SEQ ID NO: 552547 - protein, 5 aa, Mycobacterium
QPDRI

SEQ ID NO: 552548 - protein, 11 aa, Mycobacterium
QPDRLAGAREE

SEQ ID NO: 552549 - protein, 8 aa, Mycobacterium
QPDRPNRA

SEQ ID NO: 552550 - protein, 8 aa, Mycobacterium
QPDRPNRG

SEQ ID NO: 552551 - protein, 23 aa, Mycobacterium
QPDRSSAKARGGRDGGKPRRKHG

SEQ ID NO: 552552 - protein, 4 aa, Mycobacterium
QPDS

SEQ ID NO: 552553 - protein, 10 aa, Mycobacterium
QPDSAAGQAL

SEQ ID NO: 552554 - protein, 9 aa, Mycobacterium
QPDSGKAHR

SEQ ID NO: 552555 - protein, 29 aa, Mycobacterium
QPDSGTASKSESENPAIPSPKPKAHAPLT

SEQ ID NO: 552556 - protein, 5 aa, Mycobacterium
QPDSN

SEQ ID NO: 552557 - protein, 9 aa, Mycobacterium
QPDSPAGTL

SEQ ID NO: 552558 - protein, 7 aa, Mycobacterium
QPDSPRI

SEQ ID NO: 552559 - protein, 5 aa, Mycobacterium
QPDSV

SEQ ID NO: 552560 - protein, 9 aa, Mycobacterium
QPDSYDPPR

SEQ ID NO: 552561 - protein, 8 aa, Mycobacterium
QPDTASSM

SEQ ID NO: 552562 - protein, 16 aa, Mycobacterium
QPDTDTTEVVDSASNA

SEQ ID NO: 552563 - protein, 8 aa, Mycobacterium
QPDTRDPE

SEQ ID NO: 552564 - protein, 6 aa, Mycobacterium
QPDTRI

SEQ ID NO: 552565 - protein, 6 aa, Mycobacterium
QPDTTA

SEQ ID NO: 552566 - protein, 9 aa, Mycobacterium
QPDTTDPDL

SEQ ID NO: 552567 - protein, 4 aa, Mycobacterium
QPDV

SEQ ID NO: 552568 - protein, 6 aa, Mycobacterium
QPDYHA

SEQ ID NO: 552569 - protein, 11 aa, Mycobacterium
QPDYRPPPAFD

SEQ ID NO: 552570 - protein, 4 aa, Mycobacterium
QPEA

SEQ ID NO: 552571 - protein, 11 aa, Mycobacterium
QPEAGGSRPLD

SEQ ID NO: 552572 - protein, 5 aa, Mycobacterium
QPEAP

SEQ ID NO: 552573 - protein, 24 aa, Mycobacterium
QPEAPLKDAPADKQKLELGEEGMP

SEQ ID NO: 552574 - protein, 6 aa, Mycobacterium
QPEARR

SEQ ID NO: 552575 - protein, 5 aa, Mycobacterium
QPEAS

SEQ ID NO: 552576 - protein, 15 aa, Mycobacterium
QPEASSRRSQLKSDR

SEQ ID NO: 552577 - protein, 5 aa, Mycobacterium
QPEDI

SEQ ID NO: 552578 - protein, 6 aa, Mycobacterium
QPEDRR

SEQ ID NO: 552579 - protein, 7 aa, Mycobacterium
QPEDYRD

SEQ ID NO: 552580 - protein, 8 aa, Mycobacterium
QPEEASDF

SEQ ID NO: 552581 - protein, 14 aa, Mycobacterium
QPEEHRDTEDGAVQ

SEQ ID NO: 552582 - protein, 5 aa, Mycobacterium
QPEER

SEQ ID NO: 552583 - protein, 14 aa, Mycobacterium
QPEETGYTEGGVPT

SEQ ID NO: 552584 - protein, 6 aa, Mycobacterium
QPEEYN

SEQ ID NO: 552585 - protein, 4 aa, Mycobacterium
QPEG

SEQ ID NO: 552586 - protein, 8 aa, Mycobacterium
QPEGGIPN

SEQ ID NO: 552587 - protein, 11 aa, Mycobacterium
QPEGRDDRDGW

SEQ ID NO: 552588 - protein, 4 aa, Mycobacterium
QPEI

SEQ ID NO: 552589 - protein, 4 aa, Mycobacterium
QPEK

SEQ ID NO: 552590 - protein, 6 aa, Mycobacterium
QPEKGL

SEQ ID NO: 552591 - protein, 7 aa, Mycobacterium
QPEKGLA

SEQ ID NO: 552592 - protein, 5 aa, Mycobacterium
QPEKV

SEQ ID NO: 552593 - protein, 19 aa, Mycobacterium
QPELADDPRFASAESRMAN

SEQ ID NO: 552594 - protein, 8 aa, Mycobacterium
QPELATDE

SEQ ID NO: 552595 - protein, 5 aa, Mycobacterium
QPELH

SEQ ID NO: 552596 - protein, 9 aa, Mycobacterium
QPELPSTSV

SEQ ID NO: 552597 - protein, 14 aa, Mycobacterium
QPELRKGKYPDRKV

SEQ ID NO: 552598 - protein, 10 aa, Mycobacterium
QPENRPRERS

SEQ ID NO: 552599 - protein, 7 aa, Mycobacterium
QPENRTP

SEQ ID NO: 552600 - protein, 9 aa, Mycobacterium
QPEPGGAVK

SEQ ID NO: 552601 - protein, 15 aa, Mycobacterium
QPEPGGAVRSAELTP

SEQ ID NO: 552602 - protein, 5 aa, Mycobacterium
QPEPI

SEQ ID NO: 552603 - protein, 6 aa, Mycobacterium
QPEPMT

SEQ ID NO: 552604 - protein, 5 aa, Mycobacterium
QPEQT

SEQ ID NO: 552605 - protein, 5 aa, Mycobacterium
QPEQW

SEQ ID NO: 552606 - protein, 14 aa, Mycobacterium
QPERDAAQATDEVA

SEQ ID NO: 552607 - protein, 8 aa, Mycobacterium
QPERDSIA

SEQ ID NO: 552608 - protein, 6 aa, Mycobacterium
QPERDV

SEQ ID NO: 552609 - protein, 15 aa, Mycobacterium
QPERPRQSDAELPTR

SEQ ID NO: 552610 - protein, 7 aa, Mycobacterium
QPERPVR

SEQ ID NO: 552611 - protein, 8 aa, Mycobacterium
QPERRARS

SEQ ID NO: 552612 - protein, 10 aa, Mycobacterium
QPERRHPRPV

SEQ ID NO: 552613 - protein, 4 aa, Mycobacterium
QPES

SEQ ID NO: 552614 - protein, 6 aa, Mycobacterium
QPETGV

SEQ ID NO: 552615 - protein, 5 aa, Mycobacterium
QPEVE

SEQ ID NO: 552616 - protein, 6 aa, Mycobacterium
QPEVST

SEQ ID NO: 552617 - protein, 6 aa, Mycobacterium
QPEVTG

SEQ ID NO: 552618 - protein, 8 aa, Mycobacterium
QPEVTPEV

SEQ ID NO: 552619 - protein, 5 aa, Mycobacterium
QPEVY

SEQ ID NO: 552620 - protein, 14 aa, Mycobacterium
QPFAASAPTIGPPR

SEQ ID NO: 552621 - protein, 4 aa, Mycobacterium
QPFE

SEQ ID NO: 552622 - protein, 4 aa, Mycobacterium
QPFG

SEQ ID NO: 552623 - protein, 19 aa, Mycobacterium
QPFGGSRGSGTNDKAGSPL

SEQ ID NO: 552624 - protein, 20 aa, Mycobacterium
QPFGGSRGSGTNDKAGSPQN

SEQ ID NO: 552625 - protein, 21 aa, Mycobacterium
QPFGQRGADRGRVGGAGDVTD

SEQ ID NO: 552626 - protein, 10 aa, Mycobacterium
QPFNAEPDHK

SEQ ID NO: 552627 - protein, 12 aa, Mycobacterium
QPFSATTSESLA

SEQ ID NO: 552628 - protein, 8 aa, Mycobacterium
QPFSNAGS

SEQ ID NO: 552629 - protein, 4 aa, Mycobacterium
QPFT

SEQ ID NO: 552630 - protein, 4 aa, Mycobacterium
QPGA

SEQ ID NO: 552631 - protein, 5 aa, Mycobacterium
QPGAA

SEQ ID NO: 552632 - protein, 6 aa, Mycobacterium
QPGADE

SEQ ID NO: 552633 - protein, 6 aa, Mycobacterium
QPGAGE

SEQ ID NO: 552634 - protein, 7 aa, Mycobacterium
QPGAGPE

SEQ ID NO: 552635 - protein, 6 aa, Mycobacterium
QPGAMS

SEQ ID NO: 552636 - protein, 14 aa, Mycobacterium
QPGAQAARHKHPGE

SEQ ID NO: 552637 - protein, 7 aa, Mycobacterium
QPGAQPL

SEQ ID NO: 552638 - protein, 5 aa, Mycobacterium
QPGAR

SEQ ID NO: 552639 - protein, 6 aa, Mycobacterium
QPGATA

SEQ ID NO: 552640 - protein, 6 aa, Mycobacterium
QPGAVK

SEQ ID NO: 552641 - protein, 10 aa, Mycobacterium
QPGAVSPEFA

SEQ ID NO: 552642 - protein, 15 aa, Mycobacterium
QPGDAADSEPRPGPD

SEQ ID NO: 552643 - protein, 15 aa, Mycobacterium
QPGDDDDADADTGPD

SEQ ID NO: 552644 - protein, 9 aa, Mycobacterium
QPGDEDAGV

SEQ ID NO: 552645 - protein, 15 aa, Mycobacterium
QPGDEVGDDPYTGPD

SEQ ID NO: 552646 - protein, 5 aa, Mycobacterium
QPGDI

SEQ ID NO: 552647 - protein, 8 aa, Mycobacterium
QPGDPTDI

SEQ ID NO: 552648 - protein, 9 aa, Mycobacterium
QPGDRTDPA

SEQ ID NO: 552649 - protein, 14 aa, Mycobacterium
QPGDSPHREHNLEP

SEQ ID NO: 552650 - protein, 15 aa, Mycobacterium
QPGDTVDTEPRPGPD

SEQ ID NO: 552651 - protein, 5 aa, Mycobacterium
QPGDV

SEQ ID NO: 552652 - protein, 6 aa, Mycobacterium
QPGDVD

SEQ ID NO: 552653 - protein, 6 aa, Mycobacterium
QPGEAQ

SEQ ID NO: 552654 - protein, 9 aa, Mycobacterium
QPGEGDPVG

SEQ ID NO: 552655 - protein, 14 aa, Mycobacterium
QPGEMPDYSNTARE

SEQ ID NO: 552656 - protein, 8 aa, Mycobacterium
QPGEPEER

SEQ ID NO: 552657 - protein, 8 aa, Mycobacterium
QPGEPLRP

SEQ ID NO: 552658 - protein, 5 aa, Mycobacterium
QPGEQ

SEQ ID NO: 552659 - protein, 6 aa, Mycobacterium
QPGESS

SEQ ID NO: 552660 - protein, 6 aa, Mycobacterium
QPGETA

SEQ ID NO: 552661 - protein, 20 aa, Mycobacterium
QPGFGGSYRPTGADLDERSI

SEQ ID NO: 552662 - protein, 8 aa, Mycobacterium
QPGFGRTG

SEQ ID NO: 552663 - protein, 9 aa, Mycobacterium
QPGFGRTGD

SEQ ID NO: 552664 - protein, 23 aa, Mycobacterium
QPGFRDADKSAAANLATAARDAG

SEQ ID NO: 552665 - protein, 15 aa, Mycobacterium
QPGFRDADRAAAANL

SEQ ID NO: 552666 - protein, 14 aa, Mycobacterium
QPGFRDSDNAAAAN

SEQ ID NO: 552667 - protein, 5 aa, Mycobacterium
QPGGD

SEQ ID NO: 552668 - protein, 7 aa, Mycobacterium
QPGGDTD

SEQ ID NO: 552669 - protein, 7 aa, Mycobacterium
QPGGEVD

SEQ ID NO: 552670 - protein, 6 aa, Mycobacterium
QPGGIS

SEQ ID NO: 552671 - protein, 15 aa, Mycobacterium
QPGGLSGYPSRSESH

SEQ ID NO: 552672 - protein, 11 aa, Mycobacterium
QPGGPGSVTDA

SEQ ID NO: 552673 - protein, 5 aa, Mycobacterium
QPGHA

SEQ ID NO: 552674 - protein, 5 aa, Mycobacterium
QPGHG

SEQ ID NO: 552675 - protein, 6 aa, Mycobacterium
QPGHRS

SEQ ID NO: 552676 - protein, 6 aa, Mycobacterium
QPGISS

SEQ ID NO: 552677 - protein, 11 aa, Mycobacterium
QPGKPQGAGHV

SEQ ID NO: 552678 - protein, 6 aa, Mycobacterium
QPGKRV

SEQ ID NO: 552679 - protein, 4 aa, Mycobacterium
QPGL

SEQ ID NO: 552680 - protein, 7 aa, Mycobacterium
QPGLDGG

SEQ ID NO: 552681 - protein, 5 aa, Mycobacterium
QPGLP

SEQ ID NO: 552682 - protein, 14 aa, Mycobacterium
QPGLPQAWTPDEVQ

SEQ ID NO: 552683 - protein, 17 aa, Mycobacterium
QPGLPQAWTPSETPIRP

SEQ ID NO: 552684 - protein, 5 aa, Mycobacterium
QPGLS

SEQ ID NO: 552685 - protein, 9 aa, Mycobacterium
QPGLTSPTE

SEQ ID NO: 552686 - protein, 8 aa, Mycobacterium
QPGPGEGY

SEQ ID NO: 552687 - protein, 6 aa, Mycobacterium
QPGPQN

SEQ ID NO: 552688 - protein, 11 aa, Mycobacterium
QPGPVSRDQAA

SEQ ID NO: 552689 - protein, 13 aa, Mycobacterium
QPGPVSRDQAADA

SEQ ID NO: 552690 - protein, 5 aa, Mycobacterium
QPGQI

SEQ ID NO: 552691 - protein, 7 aa, Mycobacterium
QPGQKIP

SEQ ID NO: 552692 - protein, 8 aa, Mycobacterium
QPGQPREA

SEQ ID NO: 552693 - protein, 12 aa, Mycobacterium
QPGQSLLSPNDG

SEQ ID NO: 552694 - protein, 9 aa, Mycobacterium
QPGQVQPTT

SEQ ID NO: 552695 - protein, 6 aa, Mycobacterium
QPGQYA

SEQ ID NO: 552696 - protein, 4 aa, Mycobacterium
QPGR

SEQ ID NO: 552697 - protein, 8 aa, Mycobacterium
QPGRAYDP

SEQ ID NO: 552698 - protein, 11 aa, Mycobacterium
QPGRDDKAVTA

SEQ ID NO: 552699 - protein, 7 aa, Mycobacterium
QPGRPLT

SEQ ID NO: 552700 - protein, 10 aa, Mycobacterium
QPGRRPRGPE

SEQ ID NO: 552701 - protein, 7 aa, Mycobacterium
QPGRSFG

SEQ ID NO: 552702 - protein, 11 aa, Mycobacterium
QPGRSNSNDGL

SEQ ID NO: 552703 - protein, 4 aa, Mycobacterium
QPGS

SEQ ID NO: 552704 - protein, 14 aa, Mycobacterium
QPGSADVAAAAREQ

SEQ ID NO: 552705 - protein, 6 aa, Mycobacterium
QPGSGS

SEQ ID NO: 552706 - protein, 8 aa, Mycobacterium
QPGSLGAT

SEQ ID NO: 552707 - protein, 17 aa, Mycobacterium
QPGSLGGGAQDRESPLG

SEQ ID NO: 552708 - protein, 16 aa, Mycobacterium
QPGSLSGGAQDRESPM

SEQ ID NO: 552709 - protein, 9 aa, Mycobacterium
QPGSPASPP

SEQ ID NO: 552710 - protein, 5 aa, Mycobacterium
QPGST

SEQ ID NO: 552711 - protein, 10 aa, Mycobacterium
QPGSTRAEAA

SEQ ID NO: 552712 - protein, 4 aa, Mycobacterium
QPGT

SEQ ID NO: 552713 - protein, 5 aa, Mycobacterium
QPGTA

SEQ ID NO: 552714 - protein, 6 aa, Mycobacterium
QPGTAA

SEQ ID NO: 552715 - protein, 7 aa, Mycobacterium
QPGTDED

SEQ ID NO: 552716 - protein, 6 aa, Mycobacterium
QPGTEG

SEQ ID NO: 552717 - protein, 6 aa, Mycobacterium
QPGTGV

SEQ ID NO: 552718 - protein, 6 aa, Mycobacterium
QPGTKT

SEQ ID NO: 552719 - protein, 8 aa, Mycobacterium
QPGTKTET

SEQ ID NO: 552720 - protein, 9 aa, Mycobacterium
QPGTSEPTL

SEQ ID NO: 552721 - protein, 8 aa, Mycobacterium
QPGTWGPN

SEQ ID NO: 552722 - protein, 7 aa, Mycobacterium
QPGTYNE

SEQ ID NO: 552723 - protein, 8 aa, Mycobacterium
QPGVDPAT

SEQ ID NO: 552724 - protein, 5 aa, Mycobacterium
QPGVG

SEQ ID NO: 552725 - protein, 13 aa, Mycobacterium
QPGVGGSTPRPGR

SEQ ID NO: 552726 - protein, 13 aa, Mycobacterium
QPGVGRKTRQLTP

SEQ ID NO: 552727 - protein, 6 aa, Mycobacterium
QPGVQQ

SEQ ID NO: 552728 - protein, 5 aa, Mycobacterium
QPGVT

SEQ ID NO: 552729 - protein, 4 aa, Mycobacterium
QPGW

SEQ ID NO: 552730 - protein, 9 aa, Mycobacterium
QPGWQEERK

SEQ ID NO: 552731 - protein, 19 aa, Mycobacterium
QPGYGHSDKHTEHEQYNRY

SEQ ID NO: 552732 - protein, 19 aa, Mycobacterium
QPGYGLSDKHTEHEQYNRY

SEQ ID NO: 552733 - protein, 15 aa, Mycobacterium
QPGYGLSDKRAEHGQ

SEQ ID NO: 552734 - protein, 6 aa, Mycobacterium
QPGYSR

SEQ ID NO: 552735 - protein, 12 aa, Mycobacterium
QPHDNAESGEYR

SEQ ID NO: 552736 - protein, 7 aa, Mycobacterium
QPHGASH

SEQ ID NO: 552737 - protein, 8 aa, Mycobacterium
QPHHGDPI

SEQ ID NO: 552738 - protein, 7 aa, Mycobacterium
QPHKRTG

SEQ ID NO: 552739 - protein, 7 aa, Mycobacterium
QPHNAAT

SEQ ID NO: 552740 - protein, 4 aa, Mycobacterium
QPHP

SEQ ID NO: 552741 - protein, 5 aa, Mycobacterium
QPHPA

SEQ ID NO: 552742 - protein, 8 aa, Mycobacterium
QPHPDTGR

SEQ ID NO: 552743 - protein, 13 aa, Mycobacterium
QPHPEQADRPVEG

SEQ ID NO: 552744 - protein, 7 aa, Mycobacterium
QPHPTSR

SEQ ID NO: 552745 - protein, 5 aa, Mycobacterium
QPHRP

SEQ ID NO: 552746 - protein, 5 aa, Mycobacterium
QPHRS

SEQ ID NO: 552747 - protein, 6 aa, Mycobacterium
QPHSGI

SEQ ID NO: 552748 - protein, 6 aa, Mycobacterium
QPHSRG

SEQ ID NO: 552749 - protein, 10 aa, Mycobacterium
QPHTAVRRGG

SEQ ID NO: 552750 - protein, 15 aa, Mycobacterium
QPHTSSGRVPTEKGY

SEQ ID NO: 552751 - protein, 10 aa, Mycobacterium
QPIADPDGGL

SEQ ID NO: 552752 - protein, 4 aa, Mycobacterium
QPID

SEQ ID NO: 552753 - protein, 6 aa, Mycobacterium
QPIESG

SEQ ID NO: 552754 - protein, 9 aa, Mycobacterium
QPIETTRQE

SEQ ID NO: 552755 - protein, 4 aa, Mycobacterium
QPIG

SEQ ID NO: 552756 - protein, 7 aa, Mycobacterium
QPIGGGR

SEQ ID NO: 552757 - protein, 13 aa, Mycobacterium
QPIGSLAPPSQVD

SEQ ID NO: 552758 - protein, 11 aa, Mycobacterium
QPIHGDDDDWA

SEQ ID NO: 552759 - protein, 4 aa, Mycobacterium
QPIP

SEQ ID NO: 552760 - protein, 5 aa, Mycobacterium
QPIPN

SEQ ID NO: 552761 - protein, 5 aa, Mycobacterium
QPIPT

SEQ ID NO: 552762 - protein, 10 aa, Mycobacterium
QPIPTPEHNH

SEQ ID NO: 552763 - protein, 11 aa, Mycobacterium
QPIPVGAQGGT

SEQ ID NO: 552764 - protein, 11 aa, Mycobacterium
QPIPVGKQGGS

SEQ ID NO: 552765 - protein, 11 aa, Mycobacterium
QPIPVGTQGGT

SEQ ID NO: 552766 - protein, 5 aa, Mycobacterium
QPIRE

SEQ ID NO: 552767 - protein, 9 aa, Mycobacterium
QPISGPGEW

SEQ ID NO: 552768 - protein, 16 aa, Mycobacterium
QPISGPGEWNRSDYRP

SEQ ID NO: 552769 - protein, 16 aa, Mycobacterium
QPISGPGEWNRSEYRP

SEQ ID NO: 552770 - protein, 6 aa, Mycobacterium
QPISNG

SEQ ID NO: 552771 - protein, 13 aa, Mycobacterium
QPISSFQGPQPAE

SEQ ID NO: 552772 - protein, 8 aa, Mycobacterium
QPISSPGV

SEQ ID NO: 552773 - protein, 6 aa, Mycobacterium
QPITEI

SEQ ID NO: 552774 - protein, 11 aa, Mycobacterium
QPITSSTLTEE

SEQ ID NO: 552775 - protein, 9 aa, Mycobacterium
QPKEHTQAA

SEQ ID NO: 552776 - protein, 7 aa, Mycobacterium
QPKEYRD

SEQ ID NO: 552777 - protein, 4 aa, Mycobacterium
QPKF

SEQ ID NO: 552778 - protein, 8 aa, Mycobacterium
QPKGDGSL

SEQ ID NO: 552779 - protein, 9 aa, Mycobacterium
QPKLPPNTS

SEQ ID NO: 552780 - protein, 28 aa, Mycobacterium
QPKNEPACPDRGRSDAGLPHKGDPAVPA

SEQ ID NO: 552781 - protein, 5 aa, Mycobacterium
QPKPV

SEQ ID NO: 552782 - protein, 9 aa, Mycobacterium
QPKPVQRPH

SEQ ID NO: 552783 - protein, 8 aa, Mycobacterium
QPKRPPLA

SEQ ID NO: 552784 - protein, 5 aa, Mycobacterium
QPKRR

SEQ ID NO: 552785 - protein, 8 aa, Mycobacterium
QPKSAQHV

SEQ ID NO: 552786 - protein, 7 aa, Mycobacterium
QPKSATI

SEQ ID NO: 552787 - protein, 8 aa, Mycobacterium
QPKSDTPL

SEQ ID NO: 552788 - protein, 8 aa, Mycobacterium
QPKTAAGV

SEQ ID NO: 552789 - protein, 5 aa, Mycobacterium
QPKYV

SEQ ID NO: 552790 - protein, 5 aa, Mycobacterium
QPLAA

SEQ ID NO: 552791 - protein, 6 aa, Mycobacterium
QPLAGT

SEQ ID NO: 552792 - protein, 9 aa, Mycobacterium
QPLAPQAEH

SEQ ID NO: 552793 - protein, 7 aa, Mycobacterium
QPLDGPW

SEQ ID NO: 552794 - protein, 6 aa, Mycobacterium
QPLDLP

SEQ ID NO: 552795 - protein, 6 aa, Mycobacterium
QPLDPG

SEQ ID NO: 552796 - protein, 12 aa, Mycobacterium
QPLDQAGRDGYV

SEQ ID NO: 552797 - protein, 21 aa, Mycobacterium
QPLDSDDDSDTDTDTDESADS

SEQ ID NO: 552798 - protein, 4 aa, Mycobacterium
QPLE

SEQ ID NO: 552799 - protein, 12 aa, Mycobacterium
QPLGAGDPTGWR

SEQ ID NO: 552800 - protein, 8 aa, Mycobacterium
QPLGAQGL

SEQ ID NO: 552801 - protein, 9 aa, Mycobacterium
QPLGGGREG

SEQ ID NO: 552802 - protein, 6 aa, Mycobacterium
QPLGPN

SEQ ID NO: 552803 - protein, 10 aa, Mycobacterium
QPLGSRLADP

SEQ ID NO: 552804 - protein, 8 aa, Mycobacterium
QPLGTHPG

SEQ ID NO: 552805 - protein, 12 aa, Mycobacterium
QPLGVGSGPGSL

SEQ ID NO: 552806 - protein, 13 aa, Mycobacterium
QPLKHGKDKKLPV

SEQ ID NO: 552807 - protein, 6 aa, Mycobacterium
QPLLGG

SEQ ID NO: 552808 - protein, 6 aa, Mycobacterium
QPLNRD

SEQ ID NO: 552809 - protein, 5 aa, Mycobacterium
QPLPA

SEQ ID NO: 552810 - protein, 9 aa, Mycobacterium
QPLPAEGAS

SEQ ID NO: 552811 - protein, 8 aa, Mycobacterium
QPLPAELP

SEQ ID NO: 552812 - protein, 7 aa, Mycobacterium
QPLPGLE

SEQ ID NO: 552813 - protein, 8 aa, Mycobacterium
QPLPGLEG

SEQ ID NO: 552814 - protein, 13 aa, Mycobacterium
QPLPGLEGGAPEF

SEQ ID NO: 552815 - protein, 19 aa, Mycobacterium
QPLPGPGVPVPTETGARTL

SEQ ID NO: 552816 - protein, 9 aa, Mycobacterium
QPLPGPPAL

SEQ ID NO: 552817 - protein, 8 aa, Mycobacterium
QPLPGQPL

SEQ ID NO: 552818 - protein, 9 aa, Mycobacterium
QPLPNQPYN

SEQ ID NO: 552819 - protein, 5 aa, Mycobacterium
QPLPQ

SEQ ID NO: 552820 - protein, 9 aa, Mycobacterium
QPLPRNPGA

SEQ ID NO: 552821 - protein, 6 aa, Mycobacterium
QPLPSS

SEQ ID NO: 552822 - protein, 7 aa, Mycobacterium
QPLQSRP

SEQ ID NO: 552823 - protein, 5 aa, Mycobacterium
QPLRG

SEQ ID NO: 552824 - protein, 6 aa, Mycobacterium
QPLRGK

SEQ ID NO: 552825 - protein, 4 aa, Mycobacterium
QPLS

SEQ ID NO: 552826 - protein, 6 aa, Mycobacterium
QPLSAD

SEQ ID NO: 552827 - protein, 8 aa, Mycobacterium
QPLSADRA

SEQ ID NO: 552828 - protein, 8 aa, Mycobacterium
QPLSAGKL

SEQ ID NO: 552829 - protein, 8 aa, Mycobacterium
QPLSEQGL

SEQ ID NO: 552830 - protein, 6 aa, Mycobacterium
QPLSGT

SEQ ID NO: 552831 - protein, 7 aa, Mycobacterium
QPLSPGE

SEQ ID NO: 552832 - protein, 5 aa, Mycobacterium
QPLSQ

SEQ ID NO: 552833 - protein, 6 aa, Mycobacterium
QPLSSG

SEQ ID NO: 552834 - protein, 12 aa, Mycobacterium
QPLSTGQDDELR

SEQ ID NO: 552835 - protein, 4 aa, Mycobacterium
QPLT

SEQ ID NO: 552836 - protein, 6 aa, Mycobacterium
QPLTEQ

SEQ ID NO: 552837 - protein, 5 aa, Mycobacterium
QPLTS

SEQ ID NO: 552838 - protein, 5 aa, Mycobacterium
QPLWS

SEQ ID NO: 552839 - protein, 7 aa, Mycobacterium
QPMDDDP

SEQ ID NO: 552840 - protein, 5 aa, Mycobacterium
QPMDP

SEQ ID NO: 552841 - protein, 9 aa, Mycobacterium
QPMERRTPY

SEQ ID NO: 552842 - protein, 4 aa, Mycobacterium
QPMG

SEQ ID NO: 552843 - protein, 4 aa, Mycobacterium
QPMP

SEQ ID NO: 552844 - protein, 13 aa, Mycobacterium
QPMSSEQRQARQT

SEQ ID NO: 552845 - protein, 6 aa, Mycobacterium
QPMTRD

SEQ ID NO: 552846 - protein, 4 aa, Mycobacterium
QPMW

SEQ ID NO: 552847 - protein, 6 aa, Mycobacterium
QPNAGH

SEQ ID NO: 552848 - protein, 6 aa, Mycobacterium
QPNALT

SEQ ID NO: 552849 - protein, 11 aa, Mycobacterium
QPNEASPGSAT

SEQ ID NO: 552850 - protein, 6 aa, Mycobacterium
QPNELP

SEQ ID NO: 552851 - protein, 8 aa, Mycobacterium
QPNERRAH

SEQ ID NO: 552852 - protein, 9 aa, Mycobacterium
QPNGGYGHR

SEQ ID NO: 552853 - protein, 8 aa, Mycobacterium
QPNHPDDW

SEQ ID NO: 552854 - protein, 11 aa, Mycobacterium
QPNHPEAKGAV

SEQ ID NO: 552855 - protein, 13 aa, Mycobacterium
QPNHPTDDARGIA

SEQ ID NO: 552856 - protein, 21 aa, Mycobacterium
QPNHPTVPESAPGALRLPLTP

SEQ ID NO: 552857 - protein, 9 aa, Mycobacterium
QPNLPGTVD

SEQ ID NO: 552858 - protein, 5 aa, Mycobacterium
QPNMN

SEQ ID NO: 552859 - protein, 11 aa, Mycobacterium
QPNPDTAESTA

SEQ ID NO: 552860 - protein, 19 aa, Mycobacterium
QPNPRHPGRRPWSAVALLT

SEQ ID NO: 552861 - protein, 19 aa, Mycobacterium
QPNPRHPGRRPWSAVTLLT

SEQ ID NO: 552862 - protein, 9 aa, Mycobacterium
QPNRGKRSI

SEQ ID NO: 552863 - protein, 6 aa, Mycobacterium
QPNSTA

SEQ ID NO: 552864 - protein, 6 aa, Mycobacterium
QPNTGH

SEQ ID NO: 552865 - protein, 17 aa, Mycobacterium
QPNVLPSSTNPTRPHTV

SEQ ID NO: 552866 - protein, 16 aa, Mycobacterium
QPPAAANPAPAGTGVE

SEQ ID NO: 552867 - protein, 21 aa, Mycobacterium
QPPAAGTTVEVSAPPGVTMPT

SEQ ID NO: 552868 - protein, 6 aa, Mycobacterium
QPPAAY

SEQ ID NO: 552869 - protein, 6 aa, Mycobacterium
QPPAEV

SEQ ID NO: 552870 - protein, 5 aa, Mycobacterium
QPPAL

SEQ ID NO: 552871 - protein, 15 aa, Mycobacterium
QPPAPAPADQPRSGL

SEQ ID NO: 552872 - protein, 15 aa, Mycobacterium
QPPAQPDAAQSDPGL

SEQ ID NO: 552873 - protein, 29 aa, Mycobacterium
QPPAQTETAAADDAHGWSQAQGSGPRYNY

SEQ ID NO: 552874 - protein, 9 aa, Mycobacterium
QPPARRRSL

SEQ ID NO: 552875 - protein, 7 aa, Mycobacterium
QPPASVI

SEQ ID NO: 552876 - protein, 5 aa, Mycobacterium
QPPAT

SEQ ID NO: 552877 - protein, 13 aa, Mycobacterium
QPPAVQQRTPDLP

SEQ ID NO: 552878 - protein, 8 aa, Mycobacterium
QPPDARTY

SEQ ID NO: 552879 - protein, 9 aa, Mycobacterium
QPPDLSSLG

SEQ ID NO: 552880 - protein, 5 aa, Mycobacterium
QPPDR

SEQ ID NO: 552881 - protein, 6 aa, Mycobacterium
QPPDRW

SEQ ID NO: 552882 - protein, 6 aa, Mycobacterium
QPPDVD

SEQ ID NO: 552883 - protein, 9 aa, Mycobacterium
QPPEDADEN

SEQ ID NO: 552884 - protein, 6 aa, Mycobacterium
QPPEGM

SEQ ID NO: 552885 - protein, 58 aa, Mycobacterium
QPPEKGRNSDSPDSPDSSLQANGENGGESEASYETAASQASDEASQRNSNNSPENIGP

SEQ ID NO: 552886 - protein, 7 aa, Mycobacterium
QPPFARR

SEQ ID NO: 552887 - protein, 4 aa, Mycobacterium
QPPG

SEQ ID NO: 552888 - protein, 8 aa, Mycobacterium
QPPGAVKG

SEQ ID NO: 552889 - protein, 7 aa, Mycobacterium
QPPGAVQ

SEQ ID NO: 552890 - protein, 12 aa, Mycobacterium
QPPGGRSRDRAA

SEQ ID NO: 552891 - protein, 18 aa, Mycobacterium
QPPGQAPSPAVEASPVTT

SEQ ID NO: 552892 - protein, 7 aa, Mycobacterium
QPPGRAS

SEQ ID NO: 552893 - protein, 12 aa, Mycobacterium
QPPGVPPVPPQL

SEQ ID NO: 552894 - protein, 4 aa, Mycobacterium
QPPI

SEQ ID NO: 552895 - protein, 8 aa, Mycobacterium
QPPIGGTE

SEQ ID NO: 552896 - protein, 5 aa, Mycobacterium
QPPIT

SEQ ID NO: 552897 - protein, 6 aa, Mycobacterium
QPPKGL

SEQ ID NO: 552898 - protein, 7 aa, Mycobacterium
QPPKGLA

SEQ ID NO: 552899 - protein, 9 aa, Mycobacterium
QPPKPTDRA

SEQ ID NO: 552900 - protein, 9 aa, Mycobacterium
QPPKPTDRK

SEQ ID NO: 552901 - protein, 4 aa, Mycobacterium
QPPL

SEQ ID NO: 552902 - protein, 6 aa, Mycobacterium
QPPLDE

SEQ ID NO: 552903 - protein, 5 aa, Mycobacterium
QPPLP

SEQ ID NO: 552904 - protein, 5 aa, Mycobacterium
QPPLQ

SEQ ID NO: 552905 - protein, 6 aa, Mycobacterium
QPPLSR

SEQ ID NO: 552906 - protein, 4 aa, Mycobacterium
QPPM

SEQ ID NO: 552907 - protein, 4 aa, Mycobacterium
QPPP

SEQ ID NO: 552908 - protein, 90 aa, Mycobacterium
QPPPEPPQPSETSEAQLEPSESPAEPPESATGEARPELSAEPRPEEPEPEQEGPEAAPQAEAPQPEESQPEESQAEAPQPEESQPEESRA

SEQ ID NO: 552909 - protein, 5 aa, Mycobacterium
QPPPQ

SEQ ID NO: 552910 - protein, 8 aa, Mycobacterium
QPPPQPVR

SEQ ID NO: 552911 - protein, 12 aa, Mycobacterium
QPPQPVAPDGYQ

SEQ ID NO: 552912 - protein, 8 aa, Mycobacterium
QPPQPVDT

SEQ ID NO: 552913 - protein, 10 aa, Mycobacterium
QPPQTPAAPG

SEQ ID NO: 552914 - protein, 9 aa, Mycobacterium
QPPRPSFEA

SEQ ID NO: 552915 - protein, 7 aa, Mycobacterium
QPPRSGL

SEQ ID NO: 552916 - protein, 22 aa, Mycobacterium
QPPRSLEGNGAFQDGSGRAGSM

SEQ ID NO: 552917 - protein, 6 aa, Mycobacterium
QPPRTS

SEQ ID NO: 552918 - protein, 8 aa, Mycobacterium
QPPSGSGP

SEQ ID NO: 552919 - protein, 6 aa, Mycobacterium
QPPSMQ

SEQ ID NO: 552920 - protein, 6 aa, Mycobacterium
QPPSQL

SEQ ID NO: 552921 - protein, 9 aa, Mycobacterium
QPPSVSQER

SEQ ID NO: 552922 - protein, 5 aa, Mycobacterium
QPPTM

SEQ ID NO: 552923 - protein, 22 aa, Mycobacterium
QPPTTLDGQGSFQDTSGDNGAL

SEQ ID NO: 552924 - protein, 5 aa, Mycobacterium
QPQAS

SEQ ID NO: 552925 - protein, 6 aa, Mycobacterium
QPQDDA

SEQ ID NO: 552926 - protein, 28 aa, Mycobacterium
QPQDGAGRTGARRIGDGPGRVPRDGDHR

SEQ ID NO: 552927 - protein, 7 aa, Mycobacterium
QPQDGTR

SEQ ID NO: 552928 - protein, 6 aa, Mycobacterium
QPQDPV

SEQ ID NO: 552929 - protein, 4 aa, Mycobacterium
QPQE

SEQ ID NO: 552930 - protein, 8 aa, Mycobacterium
QPQEIPDG

SEQ ID NO: 552931 - protein, 15 aa, Mycobacterium
QPQETRTIGADPGLA

SEQ ID NO: 552932 - protein, 6 aa, Mycobacterium
QPQEYR

SEQ ID NO: 552933 - protein, 17 aa, Mycobacterium
QPQFEGQTKTKLGNTEV

SEQ ID NO: 552934 - protein, 4 aa, Mycobacterium
QPQG

SEQ ID NO: 552935 - protein, 5 aa, Mycobacterium
QPQGR

SEQ ID NO: 552936 - protein, 5 aa, Mycobacterium
QPQIA

SEQ ID NO: 552937 - protein, 9 aa, Mycobacterium
QPQLPPAAN

SEQ ID NO: 552938 - protein, 10 aa, Mycobacterium
QPQNSPYPVE

SEQ ID NO: 552939 - protein, 12 aa, Mycobacterium
QPQPCQWCRQLA

SEQ ID NO: 552940 - protein, 8 aa, Mycobacterium
QPQPDTLD

SEQ ID NO: 552941 - protein, 6 aa, Mycobacterium
QPQPGL

SEQ ID NO: 552942 - protein, 5 aa, Mycobacterium
QPQPI

SEQ ID NO: 552943 - protein, 23 aa, Mycobacterium
QPQPPPAPPPAPHRNPNTLAHNP

SEQ ID NO: 552944 - protein, 13 aa, Mycobacterium
QPQPPPPAPQQPI

SEQ ID NO: 552945 - protein, 6 aa, Mycobacterium
QPQQPW

SEQ ID NO: 552946 - protein, 9 aa, Mycobacterium
QPQRAETPV

SEQ ID NO: 552947 - protein, 11 aa, Mycobacterium
QPQRAPAMPAS

SEQ ID NO: 552948 - protein, 6 aa, Mycobacterium
QPQRQW

SEQ ID NO: 552949 - protein, 9 aa, Mycobacterium
QPQTPRLTN

SEQ ID NO: 552950 - protein, 7 aa, Mycobacterium
QPRAEAA

SEQ ID NO: 552951 - protein, 7 aa, Mycobacterium
QPRDATV

SEQ ID NO: 552952 - protein, 7 aa, Mycobacterium
QPRDGVR

SEQ ID NO: 552953 - protein, 15 aa, Mycobacterium
QPRDKNTETDGGEGP

SEQ ID NO: 552954 - protein, 6 aa, Mycobacterium
QPRDVS

SEQ ID NO: 552955 - protein, 11 aa, Mycobacterium
QPRFDRARDRV

SEQ ID NO: 552956 - protein, 5 aa, Mycobacterium
QPRFG

SEQ ID NO: 552957 - protein, 7 aa, Mycobacterium
QPRFSAE

SEQ ID NO: 552958 - protein, 4 aa, Mycobacterium
QPRG

SEQ ID NO: 552959 - protein, 7 aa, Mycobacterium
QPRGTTR

SEQ ID NO: 552960 - protein, 12 aa, Mycobacterium
QPRHHREARRSV

SEQ ID NO: 552961 - protein, 5 aa, Mycobacterium
QPRHI

SEQ ID NO: 552962 - protein, 12 aa, Mycobacterium
QPRIGPRRAEAQ

SEQ ID NO: 552963 - protein, 8 aa, Mycobacterium
QPRKDEPI

SEQ ID NO: 552964 - protein, 4 aa, Mycobacterium
QPRL

SEQ ID NO: 552965 - protein, 7 aa, Mycobacterium
QPRPCPA

SEQ ID NO: 552966 - protein, 7 aa, Mycobacterium
QPRPGED

SEQ ID NO: 552967 - protein, 10 aa, Mycobacterium
QPRPGSRPTL

SEQ ID NO: 552968 - protein, 11 aa, Mycobacterium
QPRPGTRPPLS

SEQ ID NO: 552969 - protein, 8 aa, Mycobacterium
QPRPQDPV

SEQ ID NO: 552970 - protein, 8 aa, Mycobacterium
QPRPQLGE

SEQ ID NO: 552971 - protein, 6 aa, Mycobacterium
QPRQAA

SEQ ID NO: 552972 - protein, 6 aa, Mycobacterium
QPRQQR

SEQ ID NO: 552973 - protein, 4 aa, Mycobacterium
QPRS

SEQ ID NO: 552974 - protein, 5 aa, Mycobacterium
QPRSA

SEQ ID NO: 552975 - protein, 10 aa, Mycobacterium
QPRSPTTTGK

SEQ ID NO: 552976 - protein, 6 aa, Mycobacterium
QPRTGT

SEQ ID NO: 552977 - protein, 8 aa, Mycobacterium
QPRTPRER

SEQ ID NO: 552978 - protein, 9 aa, Mycobacterium
QPRTPRERV

SEQ ID NO: 552979 - protein, 8 aa, Mycobacterium
QPRTQLGE

SEQ ID NO: 552980 - protein, 6 aa, Mycobacterium
QPRTRL

SEQ ID NO: 552981 - protein, 8 aa, Mycobacterium
QPRTSFSG

SEQ ID NO: 552982 - protein, 8 aa, Mycobacterium
QPRTVGGF

SEQ ID NO: 552983 - protein, 8 aa, Mycobacterium
QPRVPDSG

SEQ ID NO: 552984 - protein, 5 aa, Mycobacterium
QPRYE

SEQ ID NO: 552985 - protein, 9 aa, Mycobacterium
QPSAAENHG

SEQ ID NO: 552986 - protein, 8 aa, Mycobacterium
QPSAAMPD

SEQ ID NO: 552987 - protein, 4 aa, Mycobacterium
QPSE

SEQ ID NO: 552988 - protein, 10 aa, Mycobacterium
QPSESYRNDH

SEQ ID NO: 552989 - protein, 8 aa, Mycobacterium
QPSEVTEV

SEQ ID NO: 552990 - protein, 5 aa, Mycobacterium
QPSFG

SEQ ID NO: 552991 - protein, 8 aa, Mycobacterium
QPSGAANA

SEQ ID NO: 552992 - protein, 12 aa, Mycobacterium
QPSGATARYEAR

SEQ ID NO: 552993 - protein, 8 aa, Mycobacterium
QPSGEGTR

SEQ ID NO: 552994 - protein, 7 aa, Mycobacterium
QPSGQEP

SEQ ID NO: 552995 - protein, 8 aa, Mycobacterium
QPSGSVAR

SEQ ID NO: 552996 - protein, 10 aa, Mycobacterium
QPSGTPPSRA

SEQ ID NO: 552997 - protein, 7 aa, Mycobacterium
QPSGYTR

SEQ ID NO: 552998 - protein, 6 aa, Mycobacterium
QPSHAG

SEQ ID NO: 552999 - protein, 9 aa, Mycobacterium
QPSHGTVTV

SEQ ID NO: 553000 - protein, 6 aa, Mycobacterium
QPSHQA

SEQ ID NO: 553001 - protein, 6 aa, Mycobacterium
QPSLER

SEQ ID NO: 553002 - protein, 18 aa, Mycobacterium
QPSLQARRQSTGQQHPVR

SEQ ID NO: 553003 - protein, 6 aa, Mycobacterium
QPSLSR

SEQ ID NO: 553004 - protein, 6 aa, Mycobacterium
QPSMAK

SEQ ID NO: 553005 - protein, 10 aa, Mycobacterium
QPSPAKMGGI

SEQ ID NO: 553006 - protein, 5 aa, Mycobacterium
QPSPH

SEQ ID NO: 553007 - protein, 5 aa, Mycobacterium
QPSPV

SEQ ID NO: 553008 - protein, 6 aa, Mycobacterium
QPSQQL

SEQ ID NO: 553009 - protein, 6 aa, Mycobacterium
QPSRED

SEQ ID NO: 553010 - protein, 14 aa, Mycobacterium
QPSRGIDPAKLSDP

SEQ ID NO: 553011 - protein, 13 aa, Mycobacterium
QPSRHSRTAAEST

SEQ ID NO: 553012 - protein, 10 aa, Mycobacterium
QPSSGAVRAG

SEQ ID NO: 553013 - protein, 7 aa, Mycobacterium
QPSTTQT

SEQ ID NO: 553014 - protein, 5 aa, Mycobacterium
QPSVG

SEQ ID NO: 553015 - protein, 11 aa, Mycobacterium
QPSVSDNKKTV

SEQ ID NO: 553016 - protein, 12 aa, Mycobacterium
QPSVSDSKKSVK

SEQ ID NO: 553017 - protein, 13 aa, Mycobacterium
QPSVSDSKKSVKA

SEQ ID NO: 553018 - protein, 11 aa, Mycobacterium
QPSVSDSKKTV

SEQ ID NO: 553019 - protein, 12 aa, Mycobacterium
QPSVSDSKKTVK

SEQ ID NO: 553020 - protein, 5 aa, Mycobacterium
QPSVT

SEQ ID NO: 553021 - protein, 6 aa, Mycobacterium
QPSYLP

SEQ ID NO: 553022 - protein, 4 aa, Mycobacterium
QPTA

SEQ ID NO: 553023 - protein, 14 aa, Mycobacterium
QPTAEDRGAGDTDE

SEQ ID NO: 553024 - protein, 12 aa, Mycobacterium
QPTAEIKDPDGK

SEQ ID NO: 553025 - protein, 13 aa, Mycobacterium
QPTAESSGTVGRA

SEQ ID NO: 553026 - protein, 8 aa, Mycobacterium
QPTANHPA

SEQ ID NO: 553027 - protein, 10 aa, Mycobacterium
QPTAQAARDR

SEQ ID NO: 553028 - protein, 23 aa, Mycobacterium
QPTDATKAVERVPTDRRPTDEEI

SEQ ID NO: 553029 - protein, 8 aa, Mycobacterium
QPTDERDF

SEQ ID NO: 553030 - protein, 17 aa, Mycobacterium
QPTDPATLPPDAPDERK

SEQ ID NO: 553031 - protein, 17 aa, Mycobacterium
QPTDPSTLPPDAPDDRK

SEQ ID NO: 553032 - protein, 8 aa, Mycobacterium
QPTDQTRG

SEQ ID NO: 553033 - protein, 10 aa, Mycobacterium
QPTEAAPQAH

SEQ ID NO: 553034 - protein, 8 aa, Mycobacterium
QPTEEARA

SEQ ID NO: 553035 - protein, 10 aa, Mycobacterium
QPTEQTRGVQ

SEQ ID NO: 553036 - protein, 14 aa, Mycobacterium
QPTFGGGARSAADV

SEQ ID NO: 553037 - protein, 18 aa, Mycobacterium
QPTFGGGARTATDPDSAG

SEQ ID NO: 553038 - protein, 13 aa, Mycobacterium
QPTGRGYEREIST

SEQ ID NO: 553039 - protein, 13 aa, Mycobacterium
QPTHDRGGHHRPD

SEQ ID NO: 553040 - protein, 4 aa, Mycobacterium
QPTI

SEQ ID NO: 553041 - protein, 6 aa, Mycobacterium
QPTKGL

SEQ ID NO: 553042 - protein, 9 aa, Mycobacterium
QPTKGRGAD

SEQ ID NO: 553043 - protein, 4 aa, Mycobacterium
QPTL

SEQ ID NO: 553044 - protein, 11 aa, Mycobacterium
QPTLPGARNGG

SEQ ID NO: 553045 - protein, 5 aa, Mycobacterium
QPTLQ

SEQ ID NO: 553046 - protein, 6 aa, Mycobacterium
QPTLSQ

SEQ ID NO: 553047 - protein, 5 aa, Mycobacterium
QPTMT

SEQ ID NO: 553048 - protein, 22 aa, Mycobacterium
QPTMTSSELSEQLQASSGAIST

SEQ ID NO: 553049 - protein, 5 aa, Mycobacterium
QPTPE

SEQ ID NO: 553050 - protein, 6 aa, Mycobacterium
QPTPEN

SEQ ID NO: 553051 - protein, 7 aa, Mycobacterium
QPTPRSD

SEQ ID NO: 553052 - protein, 6 aa, Mycobacterium
QPTPRT

SEQ ID NO: 553053 - protein, 51 aa, Mycobacterium
QPTQPPQDWTPPTRPVPAPPPGYPPRPPWPDRPYPQADHPVPPQPSTYTER

SEQ ID NO: 553054 - protein, 6 aa, Mycobacterium
QPTRGS

SEQ ID NO: 553055 - protein, 6 aa, Mycobacterium
QPTSDV

SEQ ID NO: 553056 - protein, 6 aa, Mycobacterium
QPTSIA

SEQ ID NO: 553057 - protein, 24 aa, Mycobacterium
QPTSPTAVAPSASVRAIADSRGVE

SEQ ID NO: 553058 - protein, 7 aa, Mycobacterium
QPTSQAD

SEQ ID NO: 553059 - protein, 25 aa, Mycobacterium
QPTSQLREQHAQARADFTAQLSEDR

SEQ ID NO: 553060 - protein, 6 aa, Mycobacterium
QPTSRE

SEQ ID NO: 553061 - protein, 8 aa, Mycobacterium
QPTSTVQP

SEQ ID NO: 553062 - protein, 4 aa, Mycobacterium
QPTT

SEQ ID NO: 553063 - protein, 5 aa, Mycobacterium
QPTTD

SEQ ID NO: 553064 - protein, 11 aa, Mycobacterium
QPTTDVERDQY

SEQ ID NO: 553065 - protein, 14 aa, Mycobacterium
QPTTIGQAPPTTAL

SEQ ID NO: 553066 - protein, 21 aa, Mycobacterium
QPTTIGQAPPTTALSGVGAGG

SEQ ID NO: 553067 - protein, 7 aa, Mycobacterium
QPTVEID

SEQ ID NO: 553068 - protein, 14 aa, Mycobacterium
QPTVEIDPSQHPVQ

SEQ ID NO: 553069 - protein, 14 aa, Mycobacterium
QPTVEIDPSQHPVT

SEQ ID NO: 553070 - protein, 23 aa, Mycobacterium
QPTWQGNGGSGLPSAASPDGQID

SEQ ID NO: 553071 - protein, 10 aa, Mycobacterium
QPTYNRPDNH

SEQ ID NO: 553072 - protein, 30 aa, Mycobacterium
QPVAAPAAKAVPERGRDGAALRAAQKELGR

SEQ ID NO: 553073 - protein, 8 aa, Mycobacterium
QPVAETVP

SEQ ID NO: 553074 - protein, 16 aa, Mycobacterium
QPVAGPAELAAGRDAV

SEQ ID NO: 553075 - protein, 5 aa, Mycobacterium
QPVAH

SEQ ID NO: 553076 - protein, 7 aa, Mycobacterium
QPVAPAS

SEQ ID NO: 553077 - protein, 20 aa, Mycobacterium
QPVAPSPIPRRVETGPDGYD

SEQ ID NO: 553078 - protein, 13 aa, Mycobacterium
QPVDSRAQARVDG

SEQ ID NO: 553079 - protein, 9 aa, Mycobacterium
QPVEALQGT

SEQ ID NO: 553080 - protein, 5 aa, Mycobacterium
QPVED

SEQ ID NO: 553081 - protein, 4 aa, Mycobacterium
QPVG

SEQ ID NO: 553082 - protein, 5 aa, Mycobacterium
QPVGD

SEQ ID NO: 553083 - protein, 9 aa, Mycobacterium
QPVGEGAEG

SEQ ID NO: 553084 - protein, 111 aa, Mycobacterium
QPVGGDTGGTGTGSTGGTGTGGTTTGGSGTGSTGGTGTGGTTTGGSGTGSTGGTGSSTGGTGTGGTGTGTGGTGTGGTGTGTGGTGTGTGTGGTGTGGSGITATYAPTSQW

SEQ ID NO: 553085 - protein, 20 aa, Mycobacterium
QPVGPPAQRPDIAGQPGDRA

SEQ ID NO: 553086 - protein, 11 aa, Mycobacterium
QPVGRDKLSGG

SEQ ID NO: 553087 - protein, 5 aa, Mycobacterium
QPVGV

SEQ ID NO: 553088 - protein, 4 aa, Mycobacterium
QPVN

SEQ ID NO: 553089 - protein, 5 aa, Mycobacterium
QPVPD

SEQ ID NO: 553090 - protein, 5 aa, Mycobacterium
QPVPG

SEQ ID NO: 553091 - protein, 8 aa, Mycobacterium
QPVPLPPG

SEQ ID NO: 553092 - protein, 11 aa, Mycobacterium
QPVPVGTQGGT

SEQ ID NO: 553093 - protein, 5 aa, Mycobacterium
QPVSA

SEQ ID NO: 553094 - protein, 16 aa, Mycobacterium
QPVSAKGEWNRTDHRP

SEQ ID NO: 553095 - protein, 8 aa, Mycobacterium
QPVSLSPT

SEQ ID NO: 553096 - protein, 9 aa, Mycobacterium
QPVSSGAED

SEQ ID NO: 553097 - protein, 9 aa, Mycobacterium
QPVSSQSEL

SEQ ID NO: 553098 - protein, 12 aa, Mycobacterium
QPVSVPAPRGRT

SEQ ID NO: 553099 - protein, 9 aa, Mycobacterium
QPVTASTSG

SEQ ID NO: 553100 - protein, 8 aa, Mycobacterium
QPVTGATR

SEQ ID NO: 553101 - protein, 54 aa, Mycobacterium
QPVTGTGTGGTGTGGTGTGGTGTGGTGTGGTGTGGTGTGGTGTGGTGTGTGGTL

SEQ ID NO: 553102 - protein, 9 aa, Mycobacterium
QPVTSRGVR

SEQ ID NO: 553103 - protein, 6 aa, Mycobacterium
QPVTVP

SEQ ID NO: 553104 - protein, 17 aa, Mycobacterium
QPWADGQDRLGVEPESG

SEQ ID NO: 553105 - protein, 4 aa, Mycobacterium
QPWE

SEQ ID NO: 553106 - protein, 14 aa, Mycobacterium
QPWEGSVTGADQTR

SEQ ID NO: 553107 - protein, 8 aa, Mycobacterium
QPWEPSSE

SEQ ID NO: 553108 - protein, 13 aa, Mycobacterium
QPWGADRPRRAGV

SEQ ID NO: 553109 - protein, 11 aa, Mycobacterium
QPWNPEPLAGN

SEQ ID NO: 553110 - protein, 9 aa, Mycobacterium
QPWPDPTDP

SEQ ID NO: 553111 - protein, 10 aa, Mycobacterium
QPWPGGRAGR

SEQ ID NO: 553112 - protein, 6 aa, Mycobacterium
QPWSDG

SEQ ID NO: 553113 - protein, 4 aa, Mycobacterium
QPYC

SEQ ID NO: 553114 - protein, 4 aa, Mycobacterium
QPYG

SEQ ID NO: 553115 - protein, 26 aa, Mycobacterium
QPYGDGGSDSADGYAMTGTATSVASG

SEQ ID NO: 553116 - protein, 5 aa, Mycobacterium
QPYGG

SEQ ID NO: 553117 - protein, 4 aa, Mycobacterium
QPYQ

SEQ ID NO: 553118 - protein, 12 aa, Mycobacterium
QPYQEPGQRPRA

SEQ ID NO: 553119 - protein, 13 aa, Mycobacterium
QPYREPGQRSRDE

SEQ ID NO: 553120 - protein, 11 aa, Mycobacterium
QPYRGSSPAAR

SEQ ID NO: 553121 - protein, 11 aa, Mycobacterium
QPYRPQEQPLR

SEQ ID NO: 553122 - protein, 6 aa, Mycobacterium
QQAADS

SEQ ID NO: 553123 - protein, 20 aa, Mycobacterium
QQAAEAQRKAFEEQKNPTWG

SEQ ID NO: 553124 - protein, 20 aa, Mycobacterium
QQAAGLGGKRDSDRAPILGA

SEQ ID NO: 553125 - protein, 9 aa, Mycobacterium
QQAARGNKI

SEQ ID NO: 553126 - protein, 9 aa, Mycobacterium
QQAARRVRA

SEQ ID NO: 553127 - protein, 13 aa, Mycobacterium
QQACKEARSGASQ

SEQ ID NO: 553128 - protein, 6 aa, Mycobacterium
QQADAL

SEQ ID NO: 553129 - protein, 7 aa, Mycobacterium
QQADGMS

SEQ ID NO: 553130 - protein, 8 aa, Mycobacterium
QQADGQAM

SEQ ID NO: 553131 - protein, 23 aa, Mycobacterium
QQADPTGVEPAPTPEPATPSPEL

SEQ ID NO: 553132 - protein, 7 aa, Mycobacterium
QQAEQIR

SEQ ID NO: 553133 - protein, 10 aa, Mycobacterium
QQAERTPDAT

SEQ ID NO: 553134 - protein, 8 aa, Mycobacterium
QQAFGSPS

SEQ ID NO: 553135 - protein, 9 aa, Mycobacterium
QQAGAESVR

SEQ ID NO: 553136 - protein, 8 aa, Mycobacterium
QQAGDAHQ

SEQ ID NO: 553137 - protein, 7 aa, Mycobacterium
QQAGDDL

SEQ ID NO: 553138 - protein, 10 aa, Mycobacterium
QQAGDETDRR

SEQ ID NO: 553139 - protein, 14 aa, Mycobacterium
QQAGETPDPKTAQI

SEQ ID NO: 553140 - protein, 10 aa, Mycobacterium
QQAGKSVTQS

SEQ ID NO: 553141 - protein, 5 aa, Mycobacterium
QQAGL

SEQ ID NO: 553142 - protein, 6 aa, Mycobacterium
QQAGLD

SEQ ID NO: 553143 - protein, 9 aa, Mycobacterium
QQAGPQSMT

SEQ ID NO: 553144 - protein, 6 aa, Mycobacterium
QQAGRA

SEQ ID NO: 553145 - protein, 13 aa, Mycobacterium
QQAHAATKLRARA

SEQ ID NO: 553146 - protein, 8 aa, Mycobacterium
QQAHDRGD

SEQ ID NO: 553147 - protein, 8 aa, Mycobacterium
QQAHNATK

SEQ ID NO: 553148 - protein, 8 aa, Mycobacterium
QQAHSTKG

SEQ ID NO: 553149 - protein, 6 aa, Mycobacterium
QQAKPH

SEQ ID NO: 553150 - protein, 12 aa, Mycobacterium
QQALEDGGVTNA

SEQ ID NO: 553151 - protein, 9 aa, Mycobacterium
QQALGGNTQ

SEQ ID NO: 553152 - protein, 24 aa, Mycobacterium
QQANPARKVYGRQDNPSNPSWPDA

SEQ ID NO: 553153 - protein, 8 aa, Mycobacterium
QQANPRKV

SEQ ID NO: 553154 - protein, 6 aa, Mycobacterium
QQAPEI

SEQ ID NO: 553155 - protein, 9 aa, Mycobacterium
QQAPKSLPP

SEQ ID NO: 553156 - protein, 10 aa, Mycobacterium
QQAPNSTLSS

SEQ ID NO: 553157 - protein, 8 aa, Mycobacterium
QQAPPDME

SEQ ID NO: 553158 - protein, 10 aa, Mycobacterium
QQAPSAGGRV

SEQ ID NO: 553159 - protein, 21 aa, Mycobacterium
QQAQGKTEEATYSKDQTTADV

SEQ ID NO: 553160 - protein, 16 aa, Mycobacterium
QQAQRSYSHRDGITRE

SEQ ID NO: 553161 - protein, 12 aa, Mycobacterium
QQAQTRFGDTEE

SEQ ID NO: 553162 - protein, 7 aa, Mycobacterium
QQARDAL

SEQ ID NO: 553163 - protein, 9 aa, Mycobacterium
QQARDTGAQ

SEQ ID NO: 553164 - protein, 7 aa, Mycobacterium
QQARPRD

SEQ ID NO: 553165 - protein, 7 aa, Mycobacterium
QQARPRE

SEQ ID NO: 553166 - protein, 7 aa, Mycobacterium
QQARPRN

SEQ ID NO: 553167 - protein, 14 aa, Mycobacterium
QQARRRAESELNPE

SEQ ID NO: 553168 - protein, 4 aa, Mycobacterium
QQAT

SEQ ID NO: 553169 - protein, 7 aa, Mycobacterium
QQATAAP

SEQ ID NO: 553170 - protein, 13 aa, Mycobacterium
QQATADAAASGAT

SEQ ID NO: 553171 - protein, 7 aa, Mycobacterium
QQATEQL

SEQ ID NO: 553172 - protein, 6 aa, Mycobacterium
QQATGA

SEQ ID NO: 553173 - protein, 7 aa, Mycobacterium
QQATTRQ

SEQ ID NO: 553174 - protein, 9 aa, Mycobacterium
QQATTVSND

SEQ ID NO: 553175 - protein, 11 aa, Mycobacterium
QQAVSSSGAVP

SEQ ID NO: 553176 - protein, 14 aa, Mycobacterium
QQAVTEYAAEGHSR

SEQ ID NO: 553177 - protein, 6 aa, Mycobacterium
QQCDEP

SEQ ID NO: 553178 - protein, 9 aa, Mycobacterium
QQCPDGSSG

SEQ ID NO: 553179 - protein, 12 aa, Mycobacterium
QQCRGQVEGGVA

SEQ ID NO: 553180 - protein, 5 aa, Mycobacterium
QQDEF

SEQ ID NO: 553181 - protein, 8 aa, Mycobacterium
QQDEPDEE

SEQ ID NO: 553182 - protein, 10 aa, Mycobacterium
QQDGRRPYAT

SEQ ID NO: 553183 - protein, 10 aa, Mycobacterium
QQDGRRSYAG

SEQ ID NO: 553184 - protein, 11 aa, Mycobacterium
QQDLGSKGAPR

SEQ ID NO: 553185 - protein, 6 aa, Mycobacterium
QQDPLA

SEQ ID NO: 553186 - protein, 10 aa, Mycobacterium
QQDRAPDTRE

SEQ ID NO: 553187 - protein, 7 aa, Mycobacterium
QQDRGRR

SEQ ID NO: 553188 - protein, 5 aa, Mycobacterium
QQDRT

SEQ ID NO: 553189 - protein, 14 aa, Mycobacterium
QQDSAQVAARARSQ

SEQ ID NO: 553190 - protein, 13 aa, Mycobacterium
QQDSVQDISAVGS

SEQ ID NO: 553191 - protein, 8 aa, Mycobacterium
QQDTAGDY

SEQ ID NO: 553192 - protein, 5 aa, Mycobacterium
QQEAA

SEQ ID NO: 553193 - protein, 7 aa, Mycobacterium
QQEAGKV

SEQ ID NO: 553194 - protein, 7 aa, Mycobacterium
QQEAGTT

SEQ ID NO: 553195 - protein, 6 aa, Mycobacterium
QQEDKG

SEQ ID NO: 553196 - protein, 10 aa, Mycobacterium
QQEDKRELGD

SEQ ID NO: 553197 - protein, 11 aa, Mycobacterium
QQEDKRELGDY

SEQ ID NO: 553198 - protein, 5 aa, Mycobacterium
QQEHD

SEQ ID NO: 553199 - protein, 5 aa, Mycobacterium
QQENA

SEQ ID NO: 553200 - protein, 16 aa, Mycobacterium
QQEPERDDATAADRVT

SEQ ID NO: 553201 - protein, 7 aa, Mycobacterium
QQEPGWS

SEQ ID NO: 553202 - protein, 8 aa, Mycobacterium
QQEQGTAD

SEQ ID NO: 553203 - protein, 4 aa, Mycobacterium
QQER

SEQ ID NO: 553204 - protein, 8 aa, Mycobacterium
QQERGTAD

SEQ ID NO: 553205 - protein, 9 aa, Mycobacterium
QQERSEEKF

SEQ ID NO: 553206 - protein, 10 aa, Mycobacterium
QQERTRQRFP

SEQ ID NO: 553207 - protein, 12 aa, Mycobacterium
QQESDFKPTFQI

SEQ ID NO: 553208 - protein, 15 aa, Mycobacterium
QQESSDEQLAGPASR

SEQ ID NO: 553209 - protein, 13 aa, Mycobacterium
QQESSPETDAVPG

SEQ ID NO: 553210 - protein, 4 aa, Mycobacterium
QQEW

SEQ ID NO: 553211 - protein, 13 aa, Mycobacterium
QQFADRTGRELTD

SEQ ID NO: 553212 - protein, 10 aa, Mycobacterium
QQFADSDPGV

SEQ ID NO: 553213 - protein, 9 aa, Mycobacterium
QQFDGAPEG

SEQ ID NO: 553214 - protein, 10 aa, Mycobacterium
QQFNEKSAGA

SEQ ID NO: 553215 - protein, 4 aa, Mycobacterium
QQFR

SEQ ID NO: 553216 - protein, 14 aa, Mycobacterium
QQFRPTLSANSEGY

SEQ ID NO: 553217 - protein, 12 aa, Mycobacterium
QQFTGPSAVSAT

SEQ ID NO: 553218 - protein, 4 aa, Mycobacterium
QQGA

SEQ ID NO: 553219 - protein, 8 aa, Mycobacterium
QQGADPAR

SEQ ID NO: 553220 - protein, 12 aa, Mycobacterium
QQGAEPKAHRAE

SEQ ID NO: 553221 - protein, 7 aa, Mycobacterium
QQGASYA

SEQ ID NO: 553222 - protein, 7 aa, Mycobacterium
QQGDALA

SEQ ID NO: 553223 - protein, 13 aa, Mycobacterium
QQGDALGAVDDDR

SEQ ID NO: 553224 - protein, 8 aa, Mycobacterium
QQGDALTP

SEQ ID NO: 553225 - protein, 11 aa, Mycobacterium
QQGDDLGGGTH

SEQ ID NO: 553226 - protein, 12 aa, Mycobacterium
QQGEHRAGIPNR

SEQ ID NO: 553227 - protein, 16 aa, Mycobacterium
QQGEHRDGIPNRSQGD

SEQ ID NO: 553228 - protein, 13 aa, Mycobacterium
QQGEHREGIPNRS

SEQ ID NO: 553229 - protein, 4 aa, Mycobacterium
QQGI

SEQ ID NO: 553230 - protein, 10 aa, Mycobacterium
QQGKGGTLGA

SEQ ID NO: 553231 - protein, 6 aa, Mycobacterium
QQGKHV

SEQ ID NO: 553232 - protein, 8 aa, Mycobacterium
QQGKTGWA

SEQ ID NO: 553233 - protein, 11 aa, Mycobacterium
QQGLDESDARI

SEQ ID NO: 553234 - protein, 5 aa, Mycobacterium
QQGND

SEQ ID NO: 553235 - protein, 9 aa, Mycobacterium
QQGNIAETA

SEQ ID NO: 553236 - protein, 20 aa, Mycobacterium
QQGPMGEEPAQAVEPQPLPG

SEQ ID NO: 553237 - protein, 36 aa, Mycobacterium
QQGPPAHARGARVSGPGAAAATVGTHAGTSLTRSHR

SEQ ID NO: 553238 - protein, 11 aa, Mycobacterium
QQGQAGRQPPY

SEQ ID NO: 553239 - protein, 6 aa, Mycobacterium
QQGQPG

SEQ ID NO: 553240 - protein, 4 aa, Mycobacterium
QQGR

SEQ ID NO: 553241 - protein, 5 aa, Mycobacterium
QQGRA

SEQ ID NO: 553242 - protein, 10 aa, Mycobacterium
QQGRAPIGPL

SEQ ID NO: 553243 - protein, 23 aa, Mycobacterium
QQGRIAESAKALRRAETRHGTKS

SEQ ID NO: 553244 - protein, 14 aa, Mycobacterium
QQGSRITVISPKAI

SEQ ID NO: 553245 - protein, 6 aa, Mycobacterium
QQGTGA

SEQ ID NO: 553246 - protein, 4 aa, Mycobacterium
QQGV

SEQ ID NO: 553247 - protein, 20 aa, Mycobacterium
QQGVDPAEAEPEAQAAGREE

SEQ ID NO: 553248 - protein, 7 aa, Mycobacterium
QQHHQGG

SEQ ID NO: 553249 - protein, 7 aa, Mycobacterium
QQHPDAA

SEQ ID NO: 553250 - protein, 14 aa, Mycobacterium
QQHPPTNVIGPGGV

SEQ ID NO: 553251 - protein, 5 aa, Mycobacterium
QQHQT

SEQ ID NO: 553252 - protein, 12 aa, Mycobacterium
QQHSPTPGHTAS

SEQ ID NO: 553253 - protein, 5 aa, Mycobacterium
QQHSR

SEQ ID NO: 553254 - protein, 7 aa, Mycobacterium
QQHSSVA

SEQ ID NO: 553255 - protein, 5 aa, Mycobacterium
QQHVS

SEQ ID NO: 553256 - protein, 10 aa, Mycobacterium
QQIEAERKAH

SEQ ID NO: 553257 - protein, 4 aa, Mycobacterium
QQIG

SEQ ID NO: 553258 - protein, 8 aa, Mycobacterium
QQIGTPDE

SEQ ID NO: 553259 - protein, 13 aa, Mycobacterium
QQIGTPDELYSSP

SEQ ID NO: 553260 - protein, 8 aa, Mycobacterium
QQIGTPTE

SEQ ID NO: 553261 - protein, 13 aa, Mycobacterium
QQIPDGASYEPKW

SEQ ID NO: 553262 - protein, 6 aa, Mycobacterium
QQIPEA

SEQ ID NO: 553263 - protein, 7 aa, Mycobacterium
QQIPESA

SEQ ID NO: 553264 - protein, 8 aa, Mycobacterium
QQIQGGLE

SEQ ID NO: 553265 - protein, 6 aa, Mycobacterium
QQIRAG

SEQ ID NO: 553266 - protein, 10 aa, Mycobacterium
QQISGTGRRG

SEQ ID NO: 553267 - protein, 13 aa, Mycobacterium
QQKADVSDSAVGA

SEQ ID NO: 553268 - protein, 6 aa, Mycobacterium
QQKAGR

SEQ ID NO: 553269 - protein, 18 aa, Mycobacterium
QQKALEAEYEQTKEKLDA

SEQ ID NO: 553270 - protein, 9 aa, Mycobacterium
QQKAQQARD

SEQ ID NO: 553271 - protein, 8 aa, Mycobacterium
QQKSGERS

SEQ ID NO: 553272 - protein, 5 aa, Mycobacterium
QQKVP

SEQ ID NO: 553273 - protein, 4 aa, Mycobacterium
QQLA

SEQ ID NO: 553274 - protein, 15 aa, Mycobacterium
QQLANSEVHGQAGGG

SEQ ID NO: 553275 - protein, 5 aa, Mycobacterium
QQLDD

SEQ ID NO: 553276 - protein, 6 aa, Mycobacterium
QQLDGL

SEQ ID NO: 553277 - protein, 6 aa, Mycobacterium
QQLDPA

SEQ ID NO: 553278 - protein, 5 aa, Mycobacterium
QQLES

SEQ ID NO: 553279 - protein, 6 aa, Mycobacterium
QQLGTG

SEQ ID NO: 553280 - protein, 16 aa, Mycobacterium
QQLNRDHDAGEGHQGD

SEQ ID NO: 553281 - protein, 4 aa, Mycobacterium
QQLP

SEQ ID NO: 553282 - protein, 6 aa, Mycobacterium
QQLPES

SEQ ID NO: 553283 - protein, 10 aa, Mycobacterium
QQLPPGLSAS

SEQ ID NO: 553284 - protein, 11 aa, Mycobacterium
QQLPPTDDQGR

SEQ ID NO: 553285 - protein, 16 aa, Mycobacterium
QQLPQVSQGKHPEPVD

SEQ ID NO: 553286 - protein, 10 aa, Mycobacterium
QQLPTPSLRS

SEQ ID NO: 553287 - protein, 10 aa, Mycobacterium
QQLSGDGAAA

SEQ ID NO: 553288 - protein, 8 aa, Mycobacterium
QQLSPADE

SEQ ID NO: 553289 - protein, 8 aa, Mycobacterium
QQLSTTAR

SEQ ID NO: 553290 - protein, 9 aa, Mycobacterium
QQLTAPPTV

SEQ ID NO: 553291 - protein, 5 aa, Mycobacterium
QQLTT

SEQ ID NO: 553292 - protein, 7 aa, Mycobacterium
QQMPGNT

SEQ ID NO: 553293 - protein, 6 aa, Mycobacterium
QQMREG

SEQ ID NO: 553294 - protein, 4 aa, Mycobacterium
QQNA

SEQ ID NO: 553295 - protein, 8 aa, Mycobacterium
QQNERAQR

SEQ ID NO: 553296 - protein, 8 aa, Mycobacterium
QQNGADGW

SEQ ID NO: 553297 - protein, 8 aa, Mycobacterium
QQNGIDPT

SEQ ID NO: 553298 - protein, 12 aa, Mycobacterium
QQNGSRDTIGEE

SEQ ID NO: 553299 - protein, 7 aa, Mycobacterium
QQNPEAA

SEQ ID NO: 553300 - protein, 6 aa, Mycobacterium
QQNPVD

SEQ ID NO: 553301 - protein, 7 aa, Mycobacterium
QQNSGGH

SEQ ID NO: 553302 - protein, 34 aa, Mycobacterium
QQNTDPSGSVGQTAAVSRAAGTSIGEAQNAVSSL

SEQ ID NO: 553303 - protein, 7 aa, Mycobacterium
QQPAAGS

SEQ ID NO: 553304 - protein, 14 aa, Mycobacterium
QQPAAGVAGPSADD

SEQ ID NO: 553305 - protein, 18 aa, Mycobacterium
QQPAELRDPVHPGDLLIR

SEQ ID NO: 553306 - protein, 8 aa, Mycobacterium
QQPAGEQE

SEQ ID NO: 553307 - protein, 8 aa, Mycobacterium
QQPAGPAR

SEQ ID NO: 553308 - protein, 18 aa, Mycobacterium
QQPAGPPAPAAAGDQGSA

SEQ ID NO: 553309 - protein, 90 aa, Mycobacterium
QQPANGSESGTGGGGGGGQNGGGSGGGQGSGDLSKLTDGLADKNTKPAFSDGSGNQSGQGQGAGAGSGSGAGGGSPQSGSGGSGSGLGNA

SEQ ID NO: 553310 - protein, 17 aa, Mycobacterium
QQPAQEGPATPTLTERE

SEQ ID NO: 553311 - protein, 15 aa, Mycobacterium
QQPATELPMAQRYFL

SEQ ID NO: 553312 - protein, 11 aa, Mycobacterium
QQPDEGRASLG

SEQ ID NO: 553313 - protein, 9 aa, Mycobacterium
QQPDSAVSG

SEQ ID NO: 553314 - protein, 9 aa, Mycobacterium
QQPDTTLSK

SEQ ID NO: 553315 - protein, 10 aa, Mycobacterium
QQPDVQRTTF

SEQ ID NO: 553316 - protein, 7 aa, Mycobacterium
QQPDYPA

SEQ ID NO: 553317 - protein, 15 aa, Mycobacterium
QQPEDAQADDVPGPV

SEQ ID NO: 553318 - protein, 14 aa, Mycobacterium
QQPEIGQEEAQERA

SEQ ID NO: 553319 - protein, 16 aa, Mycobacterium
QQPEKPINGSMAPTDR

SEQ ID NO: 553320 - protein, 5 aa, Mycobacterium
QQPEV

SEQ ID NO: 553321 - protein, 20 aa, Mycobacterium
QQPFGGGRASGTDDKAGSPL

SEQ ID NO: 553322 - protein, 20 aa, Mycobacterium
QQPFGGSRASGTNDKAGSAQ

SEQ ID NO: 553323 - protein, 11 aa, Mycobacterium
QQPKRSQNGQL

SEQ ID NO: 553324 - protein, 9 aa, Mycobacterium
QQPKSRRTL

SEQ ID NO: 553325 - protein, 4 aa, Mycobacterium
QQPL

SEQ ID NO: 553326 - protein, 7 aa, Mycobacterium
QQPLPKD

SEQ ID NO: 553327 - protein, 8 aa, Mycobacterium
QQPPATAL

SEQ ID NO: 553328 - protein, 9 aa, Mycobacterium
QQPPATALE

SEQ ID NO: 553329 - protein, 6 aa, Mycobacterium
QQPPSL

SEQ ID NO: 553330 - protein, 19 aa, Mycobacterium
QQPPSPTIRAGRGSRRPIT

SEQ ID NO: 553331 - protein, 6 aa, Mycobacterium
QQPPTI

SEQ ID NO: 553332 - protein, 6 aa, Mycobacterium
QQPQEQ

SEQ ID NO: 553333 - protein, 34 aa, Mycobacterium
QQPQGPQSAAQQEPPAGYPPPPQGGTPPANYRAP

SEQ ID NO: 553334 - protein, 6 aa, Mycobacterium
QQPQPR

SEQ ID NO: 553335 - protein, 15 aa, Mycobacterium
QQPQVGASALESGQV

SEQ ID NO: 553336 - protein, 5 aa, Mycobacterium
QQPRR

SEQ ID NO: 553337 - protein, 4 aa, Mycobacterium
QQPS

SEQ ID NO: 553338 - protein, 6 aa, Mycobacterium
QQPSAA

SEQ ID NO: 553339 - protein, 14 aa, Mycobacterium
QQPSAARFPDGEGL

SEQ ID NO: 553340 - protein, 8 aa, Mycobacterium
QQPSPDGL

SEQ ID NO: 553341 - protein, 7 aa, Mycobacterium
QQPSPPV

SEQ ID NO: 553342 - protein, 5 aa, Mycobacterium
QQPSS

SEQ ID NO: 553343 - protein, 17 aa, Mycobacterium
QQPVEQREIGTGRDLEE

SEQ ID NO: 553344 - protein, 12 aa, Mycobacterium
QQPVGAGAASCS

SEQ ID NO: 553345 - protein, 13 aa, Mycobacterium
QQPVGAGSGLGPN

SEQ ID NO: 553346 - protein, 10 aa, Mycobacterium
QQPVGQRVRQ

SEQ ID NO: 553347 - protein, 5 aa, Mycobacterium
QQPVT

SEQ ID NO: 553348 - protein, 4 aa, Mycobacterium
QQPY

SEQ ID NO: 553349 - protein, 5 aa, Mycobacterium
QQPYT

SEQ ID NO: 553350 - protein, 8 aa, Mycobacterium
QQQAESEG

SEQ ID NO: 553351 - protein, 19 aa, Mycobacterium
QQQEQNDIERGLPAQGRTE

SEQ ID NO: 553352 - protein, 8 aa, Mycobacterium
QQQESTRI

SEQ ID NO: 553353 - protein, 8 aa, Mycobacterium
QQQGKRWN

SEQ ID NO: 553354 - protein, 18 aa, Mycobacterium
QQQHESGDRRRNRRQEET

SEQ ID NO: 553355 - protein, 4 aa, Mycobacterium
QQQL

SEQ ID NO: 553356 - protein, 6 aa, Mycobacterium
QQQLPA

SEQ ID NO: 553357 - protein, 6 aa, Mycobacterium
QQQNGG

SEQ ID NO: 553358 - protein, 6 aa, Mycobacterium
QQQPEA

SEQ ID NO: 553359 - protein, 13 aa, Mycobacterium
QQQPQQPPAAGYV

SEQ ID NO: 553360 - protein, 11 aa, Mycobacterium
QQQPVGPGEHG

SEQ ID NO: 553361 - protein, 10 aa, Mycobacterium
QQQQGGPSGT

SEQ ID NO: 553362 - protein, 8 aa, Mycobacterium
QQQQGSAD

SEQ ID NO: 553363 - protein, 5 aa, Mycobacterium
QQQRQ

SEQ ID NO: 553364 - protein, 17 aa, Mycobacterium
QQQSGRPVTLPAGGTSF

SEQ ID NO: 553365 - protein, 7 aa, Mycobacterium
QQQSPEF

SEQ ID NO: 553366 - protein, 6 aa, Mycobacterium
QQQSVE

SEQ ID NO: 553367 - protein, 6 aa, Mycobacterium
QQQSYD

SEQ ID NO: 553368 - protein, 8 aa, Mycobacterium
QQQVETQT

SEQ ID NO: 553369 - protein, 11 aa, Mycobacterium
QQRAAAAGAPV

SEQ ID NO: 553370 - protein, 11 aa, Mycobacterium
QQRAKKRLPKS

SEQ ID NO: 553371 - protein, 13 aa, Mycobacterium
QQRAKKRLPKSAY

SEQ ID NO: 553372 - protein, 5 aa, Mycobacterium
QQRAP

SEQ ID NO: 553373 - protein, 12 aa, Mycobacterium
QQRAQDAANAYA

SEQ ID NO: 553374 - protein, 11 aa, Mycobacterium
QQRARKRLPKS

SEQ ID NO: 553375 - protein, 15 aa, Mycobacterium
QQRDELDAHGDNPAN

SEQ ID NO: 553376 - protein, 6 aa, Mycobacterium
QQRDGK

SEQ ID NO: 553377 - protein, 7 aa, Mycobacterium
QQRDNAL

SEQ ID NO: 553378 - protein, 10 aa, Mycobacterium
QQRDPQPHRH

SEQ ID NO: 553379 - protein, 4 aa, Mycobacterium
QQRE

SEQ ID NO: 553380 - protein, 6 aa, Mycobacterium
QQRERV

SEQ ID NO: 553381 - protein, 4 aa, Mycobacterium
QQRG

SEQ ID NO: 553382 - protein, 20 aa, Mycobacterium
QQRGAGRVRRADAGGQVFGP

SEQ ID NO: 553383 - protein, 15 aa, Mycobacterium
QQRGGAEGGAPEPHR

SEQ ID NO: 553384 - protein, 9 aa, Mycobacterium
QQRGPAENI

SEQ ID NO: 553385 - protein, 5 aa, Mycobacterium
QQRGT

SEQ ID NO: 553386 - protein, 5 aa, Mycobacterium
QQRLT

SEQ ID NO: 553387 - protein, 12 aa, Mycobacterium
QQRNGGYSVDGS

SEQ ID NO: 553388 - protein, 7 aa, Mycobacterium
QQRPEVE

SEQ ID NO: 553389 - protein, 5 aa, Mycobacterium
QQRPI

SEQ ID NO: 553390 - protein, 8 aa, Mycobacterium
QQRPPAEV

SEQ ID NO: 553391 - protein, 5 aa, Mycobacterium
QQRPS

SEQ ID NO: 553392 - protein, 12 aa, Mycobacterium
QQRPTVLEKITT

SEQ ID NO: 553393 - protein, 4 aa, Mycobacterium
QQRQ

SEQ ID NO: 553394 - protein, 6 aa, Mycobacterium
QQRQGS

SEQ ID NO: 553395 - protein, 5 aa, Mycobacterium
QQRQQ

SEQ ID NO: 553396 - protein, 8 aa, Mycobacterium
QQRRAEAR

SEQ ID NO: 553397 - protein, 17 aa, Mycobacterium
QQRRPPSFEDYPERPAG

SEQ ID NO: 553398 - protein, 5 aa, Mycobacterium
QQRRT

SEQ ID NO: 553399 - protein, 4 aa, Mycobacterium
QQRS

SEQ ID NO: 553400 - protein, 9 aa, Mycobacterium
QQRSTFGKP

SEQ ID NO: 553401 - protein, 10 aa, Mycobacterium
QQRSTLDDAW

SEQ ID NO: 553402 - protein, 6 aa, Mycobacterium
QQRSTQ

SEQ ID NO: 553403 - protein, 6 aa, Mycobacterium
QQRTAL

SEQ ID NO: 553404 - protein, 9 aa, Mycobacterium
QQRTANRNA

SEQ ID NO: 553405 - protein, 7 aa, Mycobacterium
QQRTAPP

SEQ ID NO: 553406 - protein, 9 aa, Mycobacterium
QQRTPDPAA

SEQ ID NO: 553407 - protein, 7 aa, Mycobacterium
QQRTQAA

SEQ ID NO: 553408 - protein, 8 aa, Mycobacterium
QQRTTGQG

SEQ ID NO: 553409 - protein, 4 aa, Mycobacterium
QQRV

SEQ ID NO: 553410 - protein, 12 aa, Mycobacterium
QQRVSSIDLCHE

SEQ ID NO: 553411 - protein, 6 aa, Mycobacterium
QQRYEE

SEQ ID NO: 553412 - protein, 8 aa, Mycobacterium
QQRYGASR

SEQ ID NO: 553413 - protein, 12 aa, Mycobacterium
QQSAGGGGPHPG

SEQ ID NO: 553414 - protein, 10 aa, Mycobacterium
QQSAVGGPGV

SEQ ID NO: 553415 - protein, 4 aa, Mycobacterium
QQSD

SEQ ID NO: 553416 - protein, 20 aa, Mycobacterium
QQSDADAWKNGQRQAQEVSD

SEQ ID NO: 553417 - protein, 6 aa, Mycobacterium
QQSDEF

SEQ ID NO: 553418 - protein, 10 aa, Mycobacterium
QQSDRLGGAP

SEQ ID NO: 553419 - protein, 4 aa, Mycobacterium
QQSE

SEQ ID NO: 553420 - protein, 11 aa, Mycobacterium
QQSEAAGGPKM

SEQ ID NO: 553421 - protein, 6 aa, Mycobacterium
QQSEIT

SEQ ID NO: 553422 - protein, 11 aa, Mycobacterium
QQSESAGGPKM

SEQ ID NO: 553423 - protein, 6 aa, Mycobacterium
QQSGAE

SEQ ID NO: 553424 - protein, 8 aa, Mycobacterium
QQSGGGNV

SEQ ID NO: 553425 - protein, 9 aa, Mycobacterium
QQSGLSEAT

SEQ ID NO: 553426 - protein, 103 aa, Mycobacterium
QQSGSGSGGTTDDGAPTGTPHSTQPLSYGQGEDQPPRAAELEPGVDGKPPDVGGDSASDGGSPGEQGQRGANPATPATTEGTTPKPEPPTADSLEGTLAGTPM

SEQ ID NO: 553427 - protein, 6 aa, Mycobacterium
QQSKNP

SEQ ID NO: 553428 - protein, 4 aa, Mycobacterium
QQSL

SEQ ID NO: 553429 - protein, 7 aa, Mycobacterium
QQSLKNS

SEQ ID NO: 553430 - protein, 6 aa, Mycobacterium
QQSMDN

SEQ ID NO: 553431 - protein, 10 aa, Mycobacterium
QQSNPQGPNF

SEQ ID NO: 553432 - protein, 7 aa, Mycobacterium
QQSNTAV

SEQ ID NO: 553433 - protein, 6 aa, Mycobacterium
QQSPHN

SEQ ID NO: 553434 - protein, 10 aa, Mycobacterium
QQSPTGAGTW

SEQ ID NO: 553435 - protein, 10 aa, Mycobacterium
QQSPTRRPDL

SEQ ID NO: 553436 - protein, 6 aa, Mycobacterium
QQSQAD

SEQ ID NO: 553437 - protein, 8 aa, Mycobacterium
QQSRGRVP

SEQ ID NO: 553438 - protein, 8 aa, Mycobacterium
QQSSELQA

SEQ ID NO: 553439 - protein, 11 aa, Mycobacterium
QQSSKADPLHT

SEQ ID NO: 553440 - protein, 9 aa, Mycobacterium
QQSTRPQTV

SEQ ID NO: 553441 - protein, 8 aa, Mycobacterium
QQSTTGHR

SEQ ID NO: 553442 - protein, 11 aa, Mycobacterium
QQSVDDAPGGI

SEQ ID NO: 553443 - protein, 11 aa, Mycobacterium
QQSVDDQPGGI

SEQ ID NO: 553444 - protein, 6 aa, Mycobacterium
QQTAER

SEQ ID NO: 553445 - protein, 7 aa, Mycobacterium
QQTATPI

SEQ ID NO: 553446 - protein, 6 aa, Mycobacterium
QQTDEF

SEQ ID NO: 553447 - protein, 5 aa, Mycobacterium
QQTDG

SEQ ID NO: 553448 - protein, 6 aa, Mycobacterium
QQTDTT

SEQ ID NO: 553449 - protein, 7 aa, Mycobacterium
QQTEPTP

SEQ ID NO: 553450 - protein, 7 aa, Mycobacterium
QQTERGD

SEQ ID NO: 553451 - protein, 5 aa, Mycobacterium
QQTFE

SEQ ID NO: 553452 - protein, 6 aa, Mycobacterium
QQTGAT

SEQ ID NO: 553453 - protein, 9 aa, Mycobacterium
QQTGGKPYG

SEQ ID NO: 553454 - protein, 7 aa, Mycobacterium
QQTGLTK

SEQ ID NO: 553455 - protein, 8 aa, Mycobacterium
QQTGSSLA

SEQ ID NO: 553456 - protein, 5 aa, Mycobacterium
QQTLE

SEQ ID NO: 553457 - protein, 6 aa, Mycobacterium
QQTPAR

SEQ ID NO: 553458 - protein, 7 aa, Mycobacterium
QQTPGAT

SEQ ID NO: 553459 - protein, 4 aa, Mycobacterium
QQTR

SEQ ID NO: 553460 - protein, 6 aa, Mycobacterium
QQTRAA

SEQ ID NO: 553461 - protein, 14 aa, Mycobacterium
QQTRSATSPAPQSL

SEQ ID NO: 553462 - protein, 4 aa, Mycobacterium
QQTS

SEQ ID NO: 553463 - protein, 8 aa, Mycobacterium
QQTSAPDK

SEQ ID NO: 553464 - protein, 6 aa, Mycobacterium
QQTTQL

SEQ ID NO: 553465 - protein, 11 aa, Mycobacterium
QQTTSTEPETR

SEQ ID NO: 553466 - protein, 14 aa, Mycobacterium
QQTVDSAASRGEGY

SEQ ID NO: 553467 - protein, 8 aa, Mycobacterium
QQVANNVA

SEQ ID NO: 553468 - protein, 6 aa, Mycobacterium
QQVATE

SEQ ID NO: 553469 - protein, 8 aa, Mycobacterium
QQVDGSTR

SEQ ID NO: 553470 - protein, 6 aa, Mycobacterium
QQVDSP

SEQ ID NO: 553471 - protein, 7 aa, Mycobacterium
QQVGENG

SEQ ID NO: 553472 - protein, 7 aa, Mycobacterium
QQVGPQT

SEQ ID NO: 553473 - protein, 5 aa, Mycobacterium
QQVHG

SEQ ID NO: 553474 - protein, 4 aa, Mycobacterium
QQVP

SEQ ID NO: 553475 - protein, 13 aa, Mycobacterium
QQVPAEVRDPNAG

SEQ ID NO: 553476 - protein, 13 aa, Mycobacterium
QQVPPDVRDPNAG

SEQ ID NO: 553477 - protein, 13 aa, Mycobacterium
QQVPPEVRDPNAG

SEQ ID NO: 553478 - protein, 9 aa, Mycobacterium
QQVPPTGSR

SEQ ID NO: 553479 - protein, 13 aa, Mycobacterium
QQVPTEVRQPNAT

SEQ ID NO: 553480 - protein, 5 aa, Mycobacterium
QQVRD

SEQ ID NO: 553481 - protein, 4 aa, Mycobacterium
QQVS

SEQ ID NO: 553482 - protein, 9 aa, Mycobacterium
QQVSESGRA

SEQ ID NO: 553483 - protein, 5 aa, Mycobacterium
QQVSF

SEQ ID NO: 553484 - protein, 7 aa, Mycobacterium
QQVSGPT

SEQ ID NO: 553485 - protein, 7 aa, Mycobacterium
QQVSTGD

SEQ ID NO: 553486 - protein, 7 aa, Mycobacterium
QQVTKDR

SEQ ID NO: 553487 - protein, 13 aa, Mycobacterium
QQVYSQSGLGPED

SEQ ID NO: 553488 - protein, 4 aa, Mycobacterium
QQWE

SEQ ID NO: 553489 - protein, 14 aa, Mycobacterium
QQWEDSRRGVVPAD

SEQ ID NO: 553490 - protein, 8 aa, Mycobacterium
QQWEGDPS

SEQ ID NO: 553491 - protein, 9 aa, Mycobacterium
QQWEGSPDA

SEQ ID NO: 553492 - protein, 7 aa, Mycobacterium
QQWSGRE

SEQ ID NO: 553493 - protein, 6 aa, Mycobacterium
QQYDEP

SEQ ID NO: 553494 - protein, 13 aa, Mycobacterium
QQYDGYPGPQIPG

SEQ ID NO: 553495 - protein, 6 aa, Mycobacterium
QQYGED

SEQ ID NO: 553496 - protein, 14 aa, Mycobacterium
QQYGGGSEGAEGYG

SEQ ID NO: 553497 - protein, 17 aa, Mycobacterium
QQYPAQPGYIDNPRPRG

SEQ ID NO: 553498 - protein, 8 aa, Mycobacterium
QQYPPDEL

SEQ ID NO: 553499 - protein, 12 aa, Mycobacterium
QRAAAAQDRGAF

SEQ ID NO: 553500 - protein, 8 aa, Mycobacterium
QRAAAAQR

SEQ ID NO: 553501 - protein, 9 aa, Mycobacterium
QRAAADQTV

SEQ ID NO: 553502 - protein, 11 aa, Mycobacterium
QRAAAGVVPTD

SEQ ID NO: 553503 - protein, 46 aa, Mycobacterium; identical to SEQ ID NO: 184342

SEQ ID NO: 553504 - protein, 8 aa, Mycobacterium
QRAAEAGA

SEQ ID NO: 553505 - protein, 22 aa, Mycobacterium
QRAAEPPSADEPSEAGAPEPVL

SEQ ID NO: 553506 - protein, 8 aa, Mycobacterium
QRAAERGA

SEQ ID NO: 553507 - protein, 20 aa, Mycobacterium
QRAAGGAAGDHFGAAGANDR

SEQ ID NO: 553508 - protein, 26 aa, Mycobacterium
QRAALDAPEARDAAPPLPADDTPADW

SEQ ID NO: 553509 - protein, 37 aa, Mycobacterium
QRAAPSASAPDSPPTPPNTAALAGTQPPGHTTGVPRA

SEQ ID NO: 553510 - protein, 8 aa, Mycobacterium
QRAAQRNP

SEQ ID NO: 553511 - protein, 15 aa, Mycobacterium
QRAATGAALTAEKHH

SEQ ID NO: 553512 - protein, 5 aa, Mycobacterium
QRAAV

SEQ ID NO: 553513 - protein, 8 aa, Mycobacterium
QRADADRP

SEQ ID NO: 553514 - protein, 7 aa, Mycobacterium
QRADAED

SEQ ID NO: 553515 - protein, 9 aa, Mycobacterium
QRADARHPP

SEQ ID NO: 553516 - protein, 8 aa, Mycobacterium
QRADDGAQ

SEQ ID NO: 553517 - protein, 8 aa, Mycobacterium
QRADDTAQ

SEQ ID NO: 553518 - protein, 11 aa, Mycobacterium
QRADEPLDQQA

SEQ ID NO: 553519 - protein, 5 aa, Mycobacterium
QRADG

SEQ ID NO: 553520 - protein, 8 aa, Mycobacterium
QRADGRVT

SEQ ID NO: 553521 - protein, 10 aa, Mycobacterium
QRADGTPRVT

SEQ ID NO: 553522 - protein, 7 aa, Mycobacterium
QRADHAE

SEQ ID NO: 553523 - protein, 5 aa, Mycobacterium
QRADI

SEQ ID NO: 553524 - protein, 12 aa, Mycobacterium
QRADREKQWRSG

SEQ ID NO: 553525 - protein, 13 aa, Mycobacterium
QRADRLSEPAHES

SEQ ID NO: 553526 - protein, 21 aa, Mycobacterium
QRADRPAPRPEAAPAEGLSGA

SEQ ID NO: 553527 - protein, 10 aa, Mycobacterium
QRADSRHPPV

SEQ ID NO: 553528 - protein, 5 aa, Mycobacterium
QRAEA

SEQ ID NO: 553529 - protein, 7 aa, Mycobacterium
QRAEASL

SEQ ID NO: 553530 - protein, 10 aa, Mycobacterium
QRAEDVGPAL

SEQ ID NO: 553531 - protein, 7 aa, Mycobacterium
QRAEEAA

SEQ ID NO: 553532 - protein, 6 aa, Mycobacterium
QRAEED

SEQ ID NO: 553533 - protein, 7 aa, Mycobacterium
QRAEEDA

SEQ ID NO: 553534 - protein, 6 aa, Mycobacterium
QRAEEP

SEQ ID NO: 553535 - protein, 7 aa, Mycobacterium
QRAEESL

SEQ ID NO: 553536 - protein, 9 aa, Mycobacterium
QRAEEYAEF

SEQ ID NO: 553537 - protein, 7 aa, Mycobacterium
QRAEGSA

SEQ ID NO: 553538 - protein, 6 aa, Mycobacterium
QRAEND

SEQ ID NO: 553539 - protein, 14 aa, Mycobacterium
QRAEPDLKSGRGAL

SEQ ID NO: 553540 - protein, 15 aa, Mycobacterium
QRAEPDLKSGRGGLR

SEQ ID NO: 553541 - protein, 5 aa, Mycobacterium
QRAEQ

SEQ ID NO: 553542 - protein, 6 aa, Mycobacterium
QRAEQI

SEQ ID NO: 553543 - protein, 14 aa, Mycobacterium
QRAERLGHPAPDTV

SEQ ID NO: 553544 - protein, 6 aa, Mycobacterium
QRAERS

SEQ ID NO: 553545 - protein, 8 aa, Mycobacterium
QRAESAME

SEQ ID NO: 553546 - protein, 7 aa, Mycobacterium
QRAETGV

SEQ ID NO: 553547 - protein, 8 aa, Mycobacterium
QRAETGVT

SEQ ID NO: 553548 - protein, 9 aa, Mycobacterium
QRAEWSDER

SEQ ID NO: 553549 - protein, 9 aa, Mycobacterium
QRAEWSEQN

SEQ ID NO: 553550 - protein, 7 aa, Mycobacterium
QRAGAGP

SEQ ID NO: 553551 - protein, 6 aa, Mycobacterium
QRAGAR

SEQ ID NO: 553552 - protein, 6 aa, Mycobacterium
QRAGFS

SEQ ID NO: 553553 - protein, 14 aa, Mycobacterium
QRAGGGPGAGPLQG

SEQ ID NO: 553554 - protein, 10 aa, Mycobacterium
QRAGGPADPE

SEQ ID NO: 553555 - protein, 8 aa, Mycobacterium
QRAGGPGR

SEQ ID NO: 553556 - protein, 6 aa, Mycobacterium
QRAGLV

SEQ ID NO: 553557 - protein, 9 aa, Mycobacterium
QRAGQPAEI

SEQ ID NO: 553558 - protein, 6 aa, Mycobacterium
QRAGRY

SEQ ID NO: 553559 - protein, 9 aa, Mycobacterium
QRAGTARRD

SEQ ID NO: 553560 - protein, 6 aa, Mycobacterium
QRAGTD

SEQ ID NO: 553561 - protein, 7 aa, Mycobacterium
QRAGTRL

SEQ ID NO: 553562 - protein, 14 aa, Mycobacterium
QRAGTVRGDVTATD

SEQ ID NO: 553563 - protein, 7 aa, Mycobacterium
QRAGVGR

SEQ ID NO: 553564 - protein, 6 aa, Mycobacterium
QRAGVI

SEQ ID NO: 553565 - protein, 7 aa, Mycobacterium
QRAGVSK

SEQ ID NO: 553566 - protein, 4 aa, Mycobacterium
QRAI

SEQ ID NO: 553567 - protein, 4 aa, Mycobacterium
QRAK

SEQ ID NO: 553568 - protein, 12 aa, Mycobacterium
QRAKAAETAARE

SEQ ID NO: 553569 - protein, 9 aa, Mycobacterium
QRAKQTIPR

SEQ ID NO: 553570 - protein, 5 aa, Mycobacterium
QRAKR

SEQ ID NO: 553571 - protein, 6 aa, Mycobacterium
QRAKRG

SEQ ID NO: 553572 - protein, 10 aa, Mycobacterium
QRAKRRLPKS

SEQ ID NO: 553573 - protein, 14 aa, Mycobacterium
QRAKRRLPKSAYSS

SEQ ID NO: 553574 - protein, 10 aa, Mycobacterium
QRAKSHQQLQ

SEQ ID NO: 553575 - protein, 14 aa, Mycobacterium
QRAKTGWDSLTDSE

SEQ ID NO: 553576 - protein, 5 aa, Mycobacterium
QRALD

SEQ ID NO: 553577 - protein, 11 aa, Mycobacterium
QRALRRGGADG

SEQ ID NO: 553578 - protein, 4 aa, Mycobacterium
QRAM

SEQ ID NO: 553579 - protein, 7 aa, Mycobacterium
QRANQKL

SEQ ID NO: 553580 - protein, 14 aa, Mycobacterium
QRANRVPPDADAGE

SEQ ID NO: 553581 - protein, 7 aa, Mycobacterium
QRANVSK

SEQ ID NO: 553582 - protein, 5 aa, Mycobacterium
QRAPA

SEQ ID NO: 553583 - protein, 9 aa, Mycobacterium
QRAPDDPRI

SEQ ID NO: 553584 - protein, 9 aa, Mycobacterium
QRAPDDPRV

SEQ ID NO: 553585 - protein, 5 aa, Mycobacterium
QRAPG

SEQ ID NO: 553586 - protein, 8 aa, Mycobacterium
QRAPHPAE

SEQ ID NO: 553587 - protein, 14 aa, Mycobacterium
QRAPRTGKKPPYEV

SEQ ID NO: 553588 - protein, 9 aa, Mycobacterium
QRAPTAGEL

SEQ ID NO: 553589 - protein, 9 aa, Mycobacterium
QRAQASAQR

SEQ ID NO: 553590 - protein, 16 aa, Mycobacterium
QRAQEEVWGEDPSVRI

SEQ ID NO: 553591 - protein, 18 aa, Mycobacterium
QRAQNIAKTAASEGSGDF

SEQ ID NO: 553592 - protein, 9 aa, Mycobacterium
QRAQPPRRT

SEQ ID NO: 553593 - protein, 23 aa, Mycobacterium
QRAQQDTAAGGASGKAPADQPGV

SEQ ID NO: 553594 - protein, 24 aa, Mycobacterium
QRAQQNAATAGAAGRTPSAQPGAV

SEQ ID NO: 553595 - protein, 16 aa, Mycobacterium
QRAQSQGFCPDDDPQL

SEQ ID NO: 553596 - protein, 7 aa, Mycobacterium
QRAQTGV

SEQ ID NO: 553597 - protein, 9 aa, Mycobacterium
QRARAEAAG

SEQ ID NO: 553598 - protein, 9 aa, Mycobacterium
QRARAGAAG

SEQ ID NO: 553599 - protein, 17 aa, Mycobacterium
QRARAGDRVPAHHPPAR

SEQ ID NO: 553600 - protein, 5 aa, Mycobacterium
QRARD

SEQ ID NO: 553601 - protein, 10 aa, Mycobacterium
QRARDHGGPA

SEQ ID NO: 553602 - protein, 15 aa, Mycobacterium
QRARGGAGAGPLQGR

SEQ ID NO: 553603 - protein, 7 aa, Mycobacterium
QRARPEV

SEQ ID NO: 553604 - protein, 7 aa, Mycobacterium
QRARPRD

SEQ ID NO: 553605 - protein, 7 aa, Mycobacterium
QRARPRN

SEQ ID NO: 553606 - protein, 8 aa, Mycobacterium
QRARQAEE

SEQ ID NO: 553607 - protein, 6 aa, Mycobacterium
QRARQV

SEQ ID NO: 553608 - protein, 5 aa, Mycobacterium
QRARR

SEQ ID NO: 553609 - protein, 6 aa, Mycobacterium
QRARRA

SEQ ID NO: 553610 - protein, 20 aa, Mycobacterium
QRARRRGHHGVTAPSHKGVP

SEQ ID NO: 553611 - protein, 7 aa, Mycobacterium
QRARSAQ

SEQ ID NO: 553612 - protein, 7 aa, Mycobacterium
QRARSNR

SEQ ID NO: 553613 - protein, 9 aa, Mycobacterium
QRARTPGAK

SEQ ID NO: 553614 - protein, 5 aa, Mycobacterium
QRARV

SEQ ID NO: 553615 - protein, 6 aa, Mycobacterium
QRASAG

SEQ ID NO: 553616 - protein, 15 aa, Mycobacterium
QRASHQDNRLNPARA

SEQ ID NO: 553617 - protein, 10 aa, Mycobacterium
QRASISGESL

SEQ ID NO: 553618 - protein, 8 aa, Mycobacterium
QRASRNPV

SEQ ID NO: 553619 - protein, 13 aa, Mycobacterium
QRASSVPERNQPW

SEQ ID NO: 553620 - protein, 8 aa, Mycobacterium
QRATADSP

SEQ ID NO: 553621 - protein, 8 aa, Mycobacterium
QRATAPLS

SEQ ID NO: 553622 - protein, 7 aa, Mycobacterium
QRATDEG

SEQ ID NO: 553623 - protein, 8 aa, Mycobacterium
QRATDGDY

SEQ ID NO: 553624 - protein, 8 aa, Mycobacterium
QRATGDGH

SEQ ID NO: 553625 - protein, 6 aa, Mycobacterium
QRATGQ

SEQ ID NO: 553626 - protein, 8 aa, Mycobacterium
QRATQRNP

SEQ ID NO: 553627 - protein, 8 aa, Mycobacterium
QRATRRTE

SEQ ID NO: 553628 - protein, 9 aa, Mycobacterium
QRAVDGSDA

SEQ ID NO: 553629 - protein, 6 aa, Mycobacterium
QRAVGT

SEQ ID NO: 553630 - protein, 9 aa, Mycobacterium
QRAVPSLPA

SEQ ID NO: 553631 - protein, 5 aa, Mycobacterium
QRAVQ

SEQ ID NO: 553632 - protein, 9 aa, Mycobacterium
QRAYDTATA

SEQ ID NO: 553633 - protein, 17 aa, Mycobacterium
QRAYEQRAAVKGTSVPA

SEQ ID NO: 553634 - protein, 20 aa, Mycobacterium
QRAYEQRASLNRHGAAAVPD

SEQ ID NO: 553635 - protein, 23 aa, Mycobacterium
QRAYEQRASLTRGGGSAPALPPD

SEQ ID NO: 553636 - protein, 15 aa, Mycobacterium
QRAYESRPGVAGGPV

SEQ ID NO: 553637 - protein, 7 aa, Mycobacterium
QRAYPAA

SEQ ID NO: 553638 - protein, 12 aa, Mycobacterium
QRCASNGQRQAG

SEQ ID NO: 553639 - protein, 7 aa, Mycobacterium
QRCPDRP

SEQ ID NO: 553640 - protein, 8 aa, Mycobacterium
QRDAANTR

SEQ ID NO: 553641 - protein, 10 aa, Mycobacterium
QRDADLTELG

SEQ ID NO: 553642 - protein, 9 aa, Mycobacterium
QRDAGRIGR

SEQ ID NO: 553643 - protein, 10 aa, Mycobacterium
QRDATGRGDR

SEQ ID NO: 553644 - protein, 5 aa, Mycobacterium
QRDAV

SEQ ID NO: 553645 - protein, 14 aa, Mycobacterium
QRDAVAGEADLGGT

SEQ ID NO: 553646 - protein, 6 aa, Mycobacterium
QRDDDG

SEQ ID NO: 553647 - protein, 23 aa, Mycobacterium
QRDDRGGLRGTVERNRRLDSDAA

SEQ ID NO: 553648 - protein, 7 aa, Mycobacterium
QRDEART

SEQ ID NO: 553649 - protein, 5 aa, Mycobacterium
QRDED

SEQ ID NO: 553650 - protein, 9 aa, Mycobacterium
QRDELARQK

SEQ ID NO: 553651 - protein, 20 aa, Mycobacterium
QRDERGGAPERNRRLDSDAA

SEQ ID NO: 553652 - protein, 6 aa, Mycobacterium
QRDGDD

SEQ ID NO: 553653 - protein, 9 aa, Mycobacterium
QRDGDFRPE

SEQ ID NO: 553654 - protein, 15 aa, Mycobacterium
QRDGDRFKLSRADLL

SEQ ID NO: 553655 - protein, 7 aa, Mycobacterium
QRDGEAD

SEQ ID NO: 553656 - protein, 7 aa, Mycobacterium
QRDGGTL

SEQ ID NO: 553657 - protein, 7 aa, Mycobacterium
QRDGSFG

SEQ ID NO: 553658 - protein, 4 aa, Mycobacterium
QRDH

SEQ ID NO: 553659 - protein, 12 aa, Mycobacterium
QRDISESEEHDR

SEQ ID NO: 553660 - protein, 4 aa, Mycobacterium
QRDK

SEQ ID NO: 553661 - protein, 7 aa, Mycobacterium
QRDLADA

SEQ ID NO: 553662 - protein, 5 aa, Mycobacterium
QRDNA

SEQ ID NO: 553663 - protein, 15 aa, Mycobacterium
QRDNGGARLQVFACQ

SEQ ID NO: 553664 - protein, 6 aa, Mycobacterium
QRDNIN

SEQ ID NO: 553665 - protein, 14 aa, Mycobacterium
QRDNPDIKLRSLVA

SEQ ID NO: 553666 - protein, 6 aa, Mycobacterium
QRDPAG

SEQ ID NO: 553667 - protein, 10 aa, Mycobacterium
QRDPAQQRYP

SEQ ID NO: 553668 - protein, 23 aa, Mycobacterium
QRDPAVATRDRPGARPGDLAGGQ

SEQ ID NO: 553669 - protein, 18 aa, Mycobacterium
QRDPDPQSPAGGVSSSVD

SEQ ID NO: 553670 - protein, 8 aa, Mycobacterium
QRDPDVGP

SEQ ID NO: 553671 - protein, 24 aa, Mycobacterium
QRDPGPKPTFNEYPDEVAEAKGVA

SEQ ID NO: 553672 - protein, 8 aa, Mycobacterium
QRDPKGMY

SEQ ID NO: 553673 - protein, 5 aa, Mycobacterium
QRDPP

SEQ ID NO: 553674 - protein, 25 aa, Mycobacterium
QRDPTAAGKRHGAQAATARPQAPVK

SEQ ID NO: 553675 - protein, 22 aa, Mycobacterium
QRDPTAAGKRHGAQAATARPQL

SEQ ID NO: 553676 - protein, 5 aa, Mycobacterium
QRDRA

SEQ ID NO: 553677 - protein, 12 aa, Mycobacterium
QRDRDIQRRQST

SEQ ID NO: 553678 - protein, 33 aa, Mycobacterium
QRDRDSRTQASTAQERWESEGGTTASPRLAQLP

SEQ ID NO: 553679 - protein, 33 aa, Mycobacterium
QRDRDTRNQASTAQERWESEGGTTASLRLAQLP

SEQ ID NO: 553680 - protein, 17 aa, Mycobacterium
QRDRGDPHVAQGQPGTG

SEQ ID NO: 553681 - protein, 13 aa, Mycobacterium
QRDRPDEAGYRGE

SEQ ID NO: 553682 - protein, 14 aa, Mycobacterium
QRDRPPPDAHGPGM

SEQ ID NO: 553683 - protein, 6 aa, Mycobacterium
QRDRYG

SEQ ID NO: 553684 - protein, 6 aa, Mycobacterium
QRDSDD

SEQ ID NO: 553685 - protein, 11 aa, Mycobacterium
QRDSGDVRPAV

SEQ ID NO: 553686 - protein, 9 aa, Mycobacterium
QRDSGTPQF

SEQ ID NO: 553687 - protein, 6 aa, Mycobacterium
QRDSKL

SEQ ID NO: 553688 - protein, 7 aa, Mycobacterium
QRDTDVD

SEQ ID NO: 553689 - protein, 7 aa, Mycobacterium
QRDTEQA

SEQ ID NO: 553690 - protein, 5 aa, Mycobacterium
QRDTL

SEQ ID NO: 553691 - protein, 6 aa, Mycobacterium
QRDTLS

SEQ ID NO: 553692 - protein, 4 aa, Mycobacterium
QRDW

SEQ ID NO: 553693 - protein, 4 aa, Mycobacterium
QREA

SEQ ID NO: 553694 - protein, 6 aa, Mycobacterium
QREAAQ

SEQ ID NO: 553695 - protein, 10 aa, Mycobacterium
QREADRQGVS

SEQ ID NO: 553696 - protein, 10 aa, Mycobacterium
QREAGRTLTA

SEQ ID NO: 553697 - protein, 12 aa, Mycobacterium
QREATGVVPSDT

SEQ ID NO: 553698 - protein, 12 aa, Mycobacterium
QREATSSVPSDT

SEQ ID NO: 553699 - protein, 14 aa, Mycobacterium
QRECASADTASATT

SEQ ID NO: 553700 - protein, 7 aa, Mycobacterium
QREDGER

SEQ ID NO: 553701 - protein, 19 aa, Mycobacterium
QREDRGGATERNRRIDSDA

SEQ ID NO: 553702 - protein, 7 aa, Mycobacterium
QREDSPR

SEQ ID NO: 553703 - protein, 7 aa, Mycobacterium
QREEERI

SEQ ID NO: 553704 - protein, 7 aa, Mycobacterium
QREEGER

SEQ ID NO: 553705 - protein, 7 aa, Mycobacterium
QREEGLT

SEQ ID NO: 553706 - protein, 17 aa, Mycobacterium
QREEGYDGSWTGDENID

SEQ ID NO: 553707 - protein, 20 aa, Mycobacterium
QREERVGAPERNRRLDSDAA

SEQ ID NO: 553708 - protein, 6 aa, Mycobacterium
QREEWP

SEQ ID NO: 553709 - protein, 4 aa, Mycobacterium
QREG

SEQ ID NO: 553710 - protein, 8 aa, Mycobacterium
QREGADYP

SEQ ID NO: 553711 - protein, 7 aa, Mycobacterium
QREGVGG

SEQ ID NO: 553712 - protein, 21 aa, Mycobacterium
QREHAQGPAQGNPLLGQPGAR

SEQ ID NO: 553713 - protein, 5 aa, Mycobacterium
QREHP

SEQ ID NO: 553714 - protein, 6 aa, Mycobacterium
QREHPV

SEQ ID NO: 553715 - protein, 6 aa, Mycobacterium
QREIPR

SEQ ID NO: 553716 - protein, 4 aa, Mycobacterium
QREL

SEQ ID NO: 553717 - protein, 6 aa, Mycobacterium
QRELPY

SEQ ID NO: 553718 - protein, 6 aa, Mycobacterium
QRENQR

SEQ ID NO: 553719 - protein, 7 aa, Mycobacterium
QREPDRK

SEQ ID NO: 553720 - protein, 19 aa, Mycobacterium
QREPLNDAEQFKQEDAPLN

SEQ ID NO: 553721 - protein, 7 aa, Mycobacterium
QREPQRK

SEQ ID NO: 553722 - protein, 17 aa, Mycobacterium
QREPQRRTPLAQVSGDR

SEQ ID NO: 553723 - protein, 21 aa, Mycobacterium
QREPRQESSDEQPARRAANTA

SEQ ID NO: 553724 - protein, 13 aa, Mycobacterium
QREPSAHAASADV

SEQ ID NO: 553725 - protein, 17 aa, Mycobacterium
QREPSARAAAVDAEAAR

SEQ ID NO: 553726 - protein, 11 aa, Mycobacterium
QREPTADTEAA

SEQ ID NO: 553727 - protein, 18 aa, Mycobacterium
QREPTARAAANDAGAARQ

SEQ ID NO: 553728 - protein, 7 aa, Mycobacterium
QREQGER

SEQ ID NO: 553729 - protein, 8 aa, Mycobacterium
QREQGTAD

SEQ ID NO: 553730 - protein, 19 aa, Mycobacterium
QREQGYDGTWTGEENTDTI

SEQ ID NO: 553731 - protein, 4 aa, Mycobacterium
QRER

SEQ ID NO: 553732 - protein, 8 aa, Mycobacterium
QRERASAR

SEQ ID NO: 553733 - protein, 5 aa, Mycobacterium
QRERD

SEQ ID NO: 553734 - protein, 12 aa, Mycobacterium
QRERDPQRASKR

SEQ ID NO: 553735 - protein, 7 aa, Mycobacterium
QRERSAD

SEQ ID NO: 553736 - protein, 5 aa, Mycobacterium
QRERT

SEQ ID NO: 553737 - protein, 5 aa, Mycobacterium
QRESG

SEQ ID NO: 553738 - protein, 7 aa, Mycobacterium
QRESGER

SEQ ID NO: 553739 - protein, 9 aa, Mycobacterium
QRESPDGAT

SEQ ID NO: 553740 - protein, 11 aa, Mycobacterium
QRETAADDGVA

SEQ ID NO: 553741 - protein, 8 aa, Mycobacterium
QRETAAGA

SEQ ID NO: 553742 - protein, 7 aa, Mycobacterium
QRETAQV

SEQ ID NO: 553743 - protein, 7 aa, Mycobacterium
QRETESL

SEQ ID NO: 553744 - protein, 7 aa, Mycobacterium
QRETGGQ

SEQ ID NO: 553745 - protein, 6 aa, Mycobacterium
QRETGM

SEQ ID NO: 553746 - protein, 7 aa, Mycobacterium
QRETGRP

SEQ ID NO: 553747 - protein, 7 aa, Mycobacterium
QRETSAM

SEQ ID NO: 553748 - protein, 14 aa, Mycobacterium
QREVAASEQGLADS

SEQ ID NO: 553749 - protein, 6 aa, Mycobacterium
QREYDG

SEQ ID NO: 553750 - protein, 20 aa, Mycobacterium
QRFEEAAAAGKPVPSNHSPE

SEQ ID NO: 553751 - protein, 4 aa, Mycobacterium
QRFP

SEQ ID NO: 553752 - protein, 7 aa, Mycobacterium
QRFSDGV

SEQ ID NO: 553753 - protein, 17 aa, Mycobacterium
QRFSDPAQAGVSTPLPA

SEQ ID NO: 553754 - protein, 11 aa, Mycobacterium
QRFTSEDTELE

SEQ ID NO: 553755 - protein, 4 aa, Mycobacterium
QRGA

SEQ ID NO: 553756 - protein, 13 aa, Mycobacterium
QRGAAELEGASAD

SEQ ID NO: 553757 - protein, 14 aa, Mycobacterium
QRGADMEAAAKKAV

SEQ ID NO: 553758 - protein, 6 aa, Mycobacterium
QRGAGG

SEQ ID NO: 553759 - protein, 5 aa, Mycobacterium
QRGAH

SEQ ID NO: 553760 - protein, 8 aa, Mycobacterium
QRGAHART

SEQ ID NO: 553761 - protein, 5 aa, Mycobacterium
QRGAL

SEQ ID NO: 553762 - protein, 10 aa, Mycobacterium
QRGARSLGNE

SEQ ID NO: 553763 - protein, 5 aa, Mycobacterium
QRGAT

SEQ ID NO: 553764 - protein, 19 aa, Mycobacterium
QRGDAAEQWRKAKTAASEA

SEQ ID NO: 553765 - protein, 6 aa, Mycobacterium
QRGDAD

SEQ ID NO: 553766 - protein, 7 aa, Mycobacterium
QRGDAEV

SEQ ID NO: 553767 - protein, 6 aa, Mycobacterium
QRGDDF

SEQ ID NO: 553768 - protein, 5 aa, Mycobacterium
QRGDG

SEQ ID NO: 553769 - protein, 25 aa, Mycobacterium
QRGDGVASDRAGASRDEHPHHSPPV

SEQ ID NO: 553770 - protein, 10 aa, Mycobacterium
QRGDKRSLAT

SEQ ID NO: 553771 - protein, 5 aa, Mycobacterium
QRGDQ

SEQ ID NO: 553772 - protein, 14 aa, Mycobacterium
QRGDQQHRSAIGPQ

SEQ ID NO: 553773 - protein, 9 aa, Mycobacterium
QRGDRDGAA

SEQ ID NO: 553774 - protein, 10 aa, Mycobacterium
QRGDRDGAAT

SEQ ID NO: 553775 - protein, 9 aa, Mycobacterium
QRGDREGAA

SEQ ID NO: 553776 - protein, 10 aa, Mycobacterium
QRGDSRDRRL

SEQ ID NO: 553777 - protein, 4 aa, Mycobacterium
QRGE

SEQ ID NO: 553778 - protein, 7 aa, Mycobacterium
QRGEIDA

SEQ ID NO: 553779 - protein, 10 aa, Mycobacterium
QRGEIRDPAL

SEQ ID NO: 553780 - protein, 5 aa, Mycobacterium
QRGEP

SEQ ID NO: 553781 - protein, 7 aa, Mycobacterium
QRGFATQ

SEQ ID NO: 553782 - protein, 4 aa, Mycobacterium
QRGG

SEQ ID NO: 553783 - protein, 18 aa, Mycobacterium
QRGGELAREHGSAHGPPV

SEQ ID NO: 553784 - protein, 7 aa, Mycobacterium
QRGGGAI

SEQ ID NO: 553785 - protein, 9 aa, Mycobacterium
QRGGPPIAT

SEQ ID NO: 553786 - protein, 16 aa, Mycobacterium
QRGGPSTGLPTKTEQA

SEQ ID NO: 553787 - protein, 15 aa, Mycobacterium
QRGGPTARVRDGDGG

SEQ ID NO: 553788 - protein, 6 aa, Mycobacterium
QRGGRY

SEQ ID NO: 553789 - protein, 8 aa, Mycobacterium
QRGGTPTA

SEQ ID NO: 553790 - protein, 9 aa, Mycobacterium
QRGGTPTPF

SEQ ID NO: 553791 - protein, 6 aa, Mycobacterium
QRGGTW

SEQ ID NO: 553792 - protein, 8 aa, Mycobacterium
QRGGVRGY

SEQ ID NO: 553793 - protein, 5 aa, Mycobacterium
QRGGW

SEQ ID NO: 553794 - protein, 4 aa, Mycobacterium
QRGH

SEQ ID NO: 553795 - protein, 6 aa, Mycobacterium
QRGHPK

SEQ ID NO: 553796 - protein, 4 aa, Mycobacterium
QRGI

SEQ ID NO: 553797 - protein, 50 aa, Mycobacterium
QRGIDDSAVETDPARPTGSYSKVTGTDAAGERTTTSRYARAGSAASAMGP

SEQ ID NO: 553798 - protein, 6 aa, Mycobacterium
QRGIGA

SEQ ID NO: 553799 - protein, 7 aa, Mycobacterium
QRGITSR

SEQ ID NO: 553800 - protein, 4 aa, Mycobacterium
QRGK

SEQ ID NO: 553801 - protein, 6 aa, Mycobacterium
QRGKQD

SEQ ID NO: 553802 - protein, 29 aa, Mycobacterium
QRGKSGGNKPGLNAPAPLDHDLGEDEDEE

SEQ ID NO: 553803 - protein, 4 aa, Mycobacterium
QRGL

SEQ ID NO: 553804 - protein, 6 aa, Mycobacterium
QRGLGA

SEQ ID NO: 553805 - protein, 11 aa, Mycobacterium
QRGLSGEKVPG

SEQ ID NO: 553806 - protein, 20 aa, Mycobacterium
QRGLSSPHARPGPLAPDEDG

SEQ ID NO: 553807 - protein, 9 aa, Mycobacterium
QRGMERTRS

SEQ ID NO: 553808 - protein, 7 aa, Mycobacterium
QRGNSPS

SEQ ID NO: 553809 - protein, 5 aa, Mycobacterium
QRGPA

SEQ ID NO: 553810 - protein, 5 aa, Mycobacterium
QRGPD

SEQ ID NO: 553811 - protein, 9 aa, Mycobacterium
QRGPDTARS

SEQ ID NO: 553812 - protein, 8 aa, Mycobacterium
QRGPETAR

SEQ ID NO: 553813 - protein, 6 aa, Mycobacterium
QRGPGA

SEQ ID NO: 553814 - protein, 8 aa, Mycobacterium
QRGPPQVQ

SEQ ID NO: 553815 - protein, 7 aa, Mycobacterium
QRGPTLD

SEQ ID NO: 553816 - protein, 6 aa, Mycobacterium
QRGPVA

SEQ ID NO: 553817 - protein, 6 aa, Mycobacterium
QRGQAR

SEQ ID NO: 553818 - protein, 5 aa, Mycobacterium
QRGQR

SEQ ID NO: 553819 - protein, 4 aa, Mycobacterium
QRGS

SEQ ID NO: 553820 - protein, 6 aa, Mycobacterium
QRGSDE

SEQ ID NO: 553821 - protein, 18 aa, Mycobacterium
QRGSSAFRTQGTPSSPGT

SEQ ID NO: 553822 - protein, 10 aa, Mycobacterium
QRGSSDPRYQ

SEQ ID NO: 553823 - protein, 5 aa, Mycobacterium
QRGST

SEQ ID NO: 553824 - protein, 4 aa, Mycobacterium
QRGT

SEQ ID NO: 553825 - protein, 6 aa, Mycobacterium
QRGTEA

SEQ ID NO: 553826 - protein, 7 aa, Mycobacterium
QRGTEAL

SEQ ID NO: 553827 - protein, 6 aa, Mycobacterium
QRGTGA

SEQ ID NO: 553828 - protein, 7 aa, Mycobacterium
QRGTIAT

SEQ ID NO: 553829 - protein, 6 aa, Mycobacterium
QRGTIP

SEQ ID NO: 553830 - protein, 8 aa, Mycobacterium
QRGTIPND

SEQ ID NO: 553831 - protein, 8 aa, Mycobacterium
QRGTPVAR

SEQ ID NO: 553832 - protein, 7 aa, Mycobacterium
QRGTTAE

SEQ ID NO: 553833 - protein, 11 aa, Mycobacterium
QRGTTELQQGG

SEQ ID NO: 553834 - protein, 9 aa, Mycobacterium
QRGTTSERV

SEQ ID NO: 553835 - protein, 11 aa, Mycobacterium
QRGVPEHGDEI

SEQ ID NO: 553836 - protein, 5 aa, Mycobacterium
QRGVS

SEQ ID NO: 553837 - protein, 10 aa, Mycobacterium
QRGYGRSSKY

SEQ ID NO: 553838 - protein, 8 aa, Mycobacterium
QRHADAGV

SEQ ID NO: 553839 - protein, 5 aa, Mycobacterium
QRHAG

SEQ ID NO: 553840 - protein, 6 aa, Mycobacterium
QRHAGP

SEQ ID NO: 553841 - protein, 6 aa, Mycobacterium
QRHDQS

SEQ ID NO: 553842 - protein, 8 aa, Mycobacterium
QRHEHTRA

SEQ ID NO: 553843 - protein, 6 aa, Mycobacterium
QRHELT

SEQ ID NO: 553844 - protein, 8 aa, Mycobacterium
QRHGPDAG

SEQ ID NO: 553845 - protein, 8 aa, Mycobacterium
QRHGPGRV

SEQ ID NO: 553846 - protein, 6 aa, Mycobacterium
QRHGRG

SEQ ID NO: 553847 - protein, 8 aa, Mycobacterium
QRHGYSSG

SEQ ID NO: 553848 - protein, 4 aa, Mycobacterium
QRHK

SEQ ID NO: 553849 - protein, 6 aa, Mycobacterium
QRHKTP

SEQ ID NO: 553850 - protein, 6 aa, Mycobacterium
QRHPEH

SEQ ID NO: 553851 - protein, 14 aa, Mycobacterium
QRHPELRRSDHDAV

SEQ ID NO: 553852 - protein, 13 aa, Mycobacterium
QRHPEWNTTENES

SEQ ID NO: 553853 - protein, 22 aa, Mycobacterium
QRHPGGGFNPPEPTTKGGPDYG

SEQ ID NO: 553854 - protein, 17 aa, Mycobacterium
QRHPGGTTTHTKAAAGV

SEQ ID NO: 553855 - protein, 10 aa, Mycobacterium
QRHPNSSARL

SEQ ID NO: 553856 - protein, 28 aa, Mycobacterium
QRHQRARHRRAAAAAARNASAGGRRRAR

SEQ ID NO: 553857 - protein, 5 aa, Mycobacterium
QRHRA

SEQ ID NO: 553858 - protein, 8 aa, Mycobacterium
QRHRSRGP

SEQ ID NO: 553859 - protein, 9 aa, Mycobacterium
QRHTPDDAH

SEQ ID NO: 553860 - protein, 6 aa, Mycobacterium
QRIAPG

SEQ ID NO: 553861 - protein, 7 aa, Mycobacterium
QRIASPD

SEQ ID NO: 553862 - protein, 7 aa, Mycobacterium
QRIEPDE

SEQ ID NO: 553863 - protein, 6 aa, Mycobacterium
QRIGRP

SEQ ID NO: 553864 - protein, 9 aa, Mycobacterium
QRIGSGAAS

SEQ ID NO: 553865 - protein, 7 aa, Mycobacterium
QRINDEG

SEQ ID NO: 553866 - protein, 4 aa, Mycobacterium
QRIP

SEQ ID NO: 553867 - protein, 6 aa, Mycobacterium
QRIPGA

SEQ ID NO: 553868 - protein, 5 aa, Mycobacterium
QRIPI

SEQ ID NO: 553869 - protein, 4 aa, Mycobacterium
QRIS

SEQ ID NO: 553870 - protein, 6 aa, Mycobacterium
QRITKQ

SEQ ID NO: 553871 - protein, 5 aa, Mycobacterium
QRITP

SEQ ID NO: 553872 - protein, 11 aa, Mycobacterium
QRITRAKNKVR

SEQ ID NO: 553873 - protein, 6 aa, Mycobacterium
QRKAEH

SEQ ID NO: 553874 - protein, 7 aa, Mycobacterium
QRKAHRT

SEQ ID NO: 553875 - protein, 8 aa, Mycobacterium
QRKDDTPL

SEQ ID NO: 553876 - protein, 10 aa, Mycobacterium
QRKERSGSSF

SEQ ID NO: 553877 - protein, 8 aa, Mycobacterium
QRKGDPIE

SEQ ID NO: 553878 - protein, 9 aa, Mycobacterium
QRKGFDPGY

SEQ ID NO: 553879 - protein, 21 aa, Mycobacterium
QRKGSSGKGRHRYDPDSAEAI

SEQ ID NO: 553880 - protein, 11 aa, Mycobacterium
QRKKADTRRAL

SEQ ID NO: 553881 - protein, 17 aa, Mycobacterium
QRKNRNSERGQVKGSSS

SEQ ID NO: 553882 - protein, 18 aa, Mycobacterium
QRKPGYDGTWTGDENTDM

SEQ ID NO: 553883 - protein, 7 aa, Mycobacterium
QRKQVSD

SEQ ID NO: 553884 - protein, 9 aa, Mycobacterium
QRKSEPTED

SEQ ID NO: 553885 - protein, 6 aa, Mycobacterium
QRKTYT

SEQ ID NO: 553886 - protein, 5 aa, Mycobacterium
QRLAE

SEQ ID NO: 553887 - protein, 4 aa, Mycobacterium
QRLD

SEQ ID NO: 553888 - protein, 6 aa, Mycobacterium
QRLDAG

SEQ ID NO: 553889 - protein, 7 aa, Mycobacterium
QRLDAGE

SEQ ID NO: 553890 - protein, 5 aa, Mycobacterium
QRLDD

SEQ ID NO: 553891 - protein, 4 aa, Mycobacterium
QRLE

SEQ ID NO: 553892 - protein, 6 aa, Mycobacterium
QRLEPE

SEQ ID NO: 553893 - protein, 7 aa, Mycobacterium
QRLESSA

SEQ ID NO: 553894 - protein, 4 aa, Mycobacterium
QRLG

SEQ ID NO: 553895 - protein, 14 aa, Mycobacterium
QRLGEPRRRFQPDR

SEQ ID NO: 553896 - protein, 5 aa, Mycobacterium
QRLGP

SEQ ID NO: 553897 - protein, 5 aa, Mycobacterium
QRLGT

SEQ ID NO: 553898 - protein, 4 aa, Mycobacterium
QRLP

SEQ ID NO: 553899 - protein, 11 aa, Mycobacterium
QRLPAEGPAVK

SEQ ID NO: 553900 - protein, 6 aa, Mycobacterium
QRLPGA

SEQ ID NO: 553901 - protein, 5 aa, Mycobacterium
QRLPL

SEQ ID NO: 553902 - protein, 5 aa, Mycobacterium
QRLSD

SEQ ID NO: 553903 - protein, 9 aa, Mycobacterium
QRLSDEGIG

SEQ ID NO: 553904 - protein, 8 aa, Mycobacterium
QRLSDQEL

SEQ ID NO: 553905 - protein, 5 aa, Mycobacterium
QRLSG

SEQ ID NO: 553906 - protein, 4 aa, Mycobacterium
QRLT

SEQ ID NO: 553907 - protein, 23 aa, Mycobacterium
QRLTAERSRATATVGGPGPEGSI

SEQ ID NO: 553908 - protein, 14 aa, Mycobacterium
QRLTAPRPFEEPVP

SEQ ID NO: 553909 - protein, 6 aa, Mycobacterium
QRLTPE

SEQ ID NO: 553910 - protein, 12 aa, Mycobacterium
QRMNESDNPDTV

SEQ ID NO: 553911 - protein, 9 aa, Mycobacterium
QRMPGDEYE

SEQ ID NO: 553912 - protein, 12 aa, Mycobacterium
QRMSESSDPTTV

SEQ ID NO: 553913 - protein, 11 aa, Mycobacterium
QRMSPVDNADE

SEQ ID NO: 553914 - protein, 8 aa, Mycobacterium
QRNAEYEK

SEQ ID NO: 553915 - protein, 17 aa, Mycobacterium
QRNAGNLSDAGIKFPVL

SEQ ID NO: 553916 - protein, 6 aa, Mycobacterium
QRNAPD

SEQ ID NO: 553917 - protein, 17 aa, Mycobacterium
QRNDPAELGVADPSAVR

SEQ ID NO: 553918 - protein, 8 aa, Mycobacterium
QRNELSGN

SEQ ID NO: 553919 - protein, 7 aa, Mycobacterium
QRNERAQ

SEQ ID NO: 553920 - protein, 5 aa, Mycobacterium
QRNEW

SEQ ID NO: 553921 - protein, 10 aa, Mycobacterium
QRNGDPPPRL

SEQ ID NO: 553922 - protein, 9 aa, Mycobacterium
QRNGKPRIA

SEQ ID NO: 553923 - protein, 10 aa, Mycobacterium
QRNGSPPPRL

SEQ ID NO: 553924 - protein, 8 aa, Mycobacterium
QRNGYGTR

SEQ ID NO: 553925 - protein, 7 aa, Mycobacterium
QRNKAKS

SEQ ID NO: 553926 - protein, 5 aa, Mycobacterium
QRNKY

SEQ ID NO: 553927 - protein, 6 aa, Mycobacterium
QRNKYE

SEQ ID NO: 553928 - protein, 5 aa, Mycobacterium
QRNNV

SEQ ID NO: 553929 - protein, 5 aa, Mycobacterium
QRNPE

SEQ ID NO: 553930 - protein, 6 aa, Mycobacterium
QRNPEA

SEQ ID NO: 553931 - protein, 7 aa, Mycobacterium
QRNPEAV

SEQ ID NO: 553932 - protein, 6 aa, Mycobacterium
QRNPGG

SEQ ID NO: 553933 - protein, 8 aa, Mycobacterium
QRNQPGRP

SEQ ID NO: 553934 - protein, 9 aa, Mycobacterium
QRNRGGVNS

SEQ ID NO: 553935 - protein, 12 aa, Mycobacterium
QRNSKPADASVG

SEQ ID NO: 553936 - protein, 18 aa, Mycobacterium
QRNTGKTREQASDELSGA

SEQ ID NO: 553937 - protein, 12 aa, Mycobacterium
QRNVQYKADGMR

SEQ ID NO: 553938 - protein, 6 aa, Mycobacterium
QRPAAT

SEQ ID NO: 553939 - protein, 12 aa, Mycobacterium
QRPADLAAARSG

SEQ ID NO: 553940 - protein, 14 aa, Mycobacterium
QRPAEAADRGVPGH

SEQ ID NO: 553941 - protein, 8 aa, Mycobacterium
QRPAEDTV

SEQ ID NO: 553942 - protein, 6 aa, Mycobacterium
QRPAEL

SEQ ID NO: 553943 - protein, 9 aa, Mycobacterium
QRPAEYSPL

SEQ ID NO: 553944 - protein, 6 aa, Mycobacterium
QRPAGM

SEQ ID NO: 553945 - protein, 9 aa, Mycobacterium
QRPANQAPL

SEQ ID NO: 553946 - protein, 5 aa, Mycobacterium
QRPAP

SEQ ID NO: 553947 - protein, 9 aa, Mycobacterium
QRPATEPEV

SEQ ID NO: 553948 - protein, 8 aa, Mycobacterium
QRPATTAK

SEQ ID NO: 553949 - protein, 5 aa, Mycobacterium
QRPDA

SEQ ID NO: 553950 - protein, 6 aa, Mycobacterium
QRPDAR

SEQ ID NO: 553951 - protein, 10 aa, Mycobacterium
QRPDDLPPQL

SEQ ID NO: 553952 - protein, 17 aa, Mycobacterium
QRPDEPGPPIHGPATYP

SEQ ID NO: 553953 - protein, 6 aa, Mycobacterium
QRPDEV

SEQ ID NO: 553954 - protein, 8 aa, Mycobacterium
QRPDGAGD

SEQ ID NO: 553955 - protein, 8 aa, Mycobacterium
QRPDGTGW

SEQ ID NO: 553956 - protein, 5 aa, Mycobacterium
QRPDP

SEQ ID NO: 553957 - protein, 6 aa, Mycobacterium
QRPDPF

SEQ ID NO: 553958 - protein, 6 aa, Mycobacterium
QRPDQR

SEQ ID NO: 553959 - protein, 9 aa, Mycobacterium
QRPDTAITA

SEQ ID NO: 553960 - protein, 9 aa, Mycobacterium
QRPEDPEMR

SEQ ID NO: 553961 - protein, 8 aa, Mycobacterium
QRPEGSGD

SEQ ID NO: 553962 - protein, 6 aa, Mycobacterium
QRPEGT

SEQ ID NO: 553963 - protein, 8 aa, Mycobacterium
QRPEIRKA

SEQ ID NO: 553964 - protein, 5 aa, Mycobacterium
QRPER

SEQ ID NO: 553965 - protein, 5 aa, Mycobacterium
QRPEV

SEQ ID NO: 553966 - protein, 5 aa, Mycobacterium
QRPGA

SEQ ID NO: 553967 - protein, 5 aa, Mycobacterium
QRPGF

SEQ ID NO: 553968 - protein, 6 aa, Mycobacterium
QRPGQL

SEQ ID NO: 553969 - protein, 5 aa, Mycobacterium
QRPGS

SEQ ID NO: 553970 - protein, 6 aa, Mycobacterium
QRPGSE

SEQ ID NO: 553971 - protein, 5 aa, Mycobacterium
QRPGV

SEQ ID NO: 553972 - protein, 4 aa, Mycobacterium
QRPH

SEQ ID NO: 553973 - protein, 7 aa, Mycobacterium
QRPHPQT

SEQ ID NO: 553974 - protein, 7 aa, Mycobacterium
QRPIGGE

SEQ ID NO: 553975 - protein, 6 aa, Mycobacterium
QRPKTL

SEQ ID NO: 553976 - protein, 5 aa, Mycobacterium
QRPPD

SEQ ID NO: 553977 - protein, 11 aa, Mycobacterium
QRPPEEDPQGT

SEQ ID NO: 553978 - protein, 7 aa, Mycobacterium
QRPPEET

SEQ ID NO: 553979 - protein, 21 aa, Mycobacterium
QRPPGPAPSFRENPDEPAEAA

SEQ ID NO: 553980 - protein, 9 aa, Mycobacterium
QRPPGPAPT

SEQ ID NO: 553981 - protein, 9 aa, Mycobacterium
QRPPGPEPV

SEQ ID NO: 553982 - protein, 18 aa, Mycobacterium
QRPPMRSQERKPRWHIRI

SEQ ID NO: 553983 - protein, 8 aa, Mycobacterium
QRPPRRLT

SEQ ID NO: 553984 - protein, 4 aa, Mycobacterium
QRPQ

SEQ ID NO: 553985 - protein, 25 aa, Mycobacterium
QRPQGPAPRFSEHDDEAAEAKSVAK

SEQ ID NO: 553986 - protein, 6 aa, Mycobacterium
QRPRGA

SEQ ID NO: 553987 - protein, 10 aa, Mycobacterium
QRPRGNVDET

SEQ ID NO: 553988 - protein, 8 aa, Mycobacterium
QRPRGSQL

SEQ ID NO: 553989 - protein, 5 aa, Mycobacterium
QRPSG

SEQ ID NO: 553990 - protein, 14 aa, Mycobacterium
QRPSGADDVTRPLT

SEQ ID NO: 553991 - protein, 9 aa, Mycobacterium
QRPSGRAEH

SEQ ID NO: 553992 - protein, 7 aa, Mycobacterium
QRPSPRW

SEQ ID NO: 553993 - protein, 7 aa, Mycobacterium
QRPSPTK

SEQ ID NO: 553994 - protein, 6 aa, Mycobacterium
QRPSRP

SEQ ID NO: 553995 - protein, 5 aa, Mycobacterium
QRPST

SEQ ID NO: 553996 - protein, 12 aa, Mycobacterium
QRPSTPAPATGP

SEQ ID NO: 553997 - protein, 6 aa, Mycobacterium
QRPTAG

SEQ ID NO: 553998 - protein, 9 aa, Mycobacterium
QRPTGQESI

SEQ ID NO: 553999 - protein, 5 aa, Mycobacterium
QRPTI

SEQ ID NO: 554000 - protein, 6 aa, Mycobacterium
QRPTLA

SEQ ID NO: 554001 - protein, 6 aa, Mycobacterium
QRPTMA

SEQ ID NO: 554002 - protein, 9 aa, Mycobacterium
QRPTQVAGN

SEQ ID NO: 554003 - protein, 7 aa, Mycobacterium
QRPTYDD

SEQ ID NO: 554004 - protein, 4 aa, Mycobacterium
QRPV

SEQ ID NO: 554005 - protein, 6 aa, Mycobacterium
QRPVDV

SEQ ID NO: 554006 - protein, 4 aa, Mycobacterium
QRPY

SEQ ID NO: 554007 - protein, 14 aa, Mycobacterium
QRPYNKVGAGPLDT

SEQ ID NO: 554008 - protein, 6 aa, Mycobacterium
QRPYQQ

SEQ ID NO: 554009 - protein, 4 aa, Mycobacterium
QRQA

SEQ ID NO: 554010 - protein, 5 aa, Mycobacterium
QRQAE

SEQ ID NO: 554011 - protein, 7 aa, Mycobacterium
QRQAGGG

SEQ ID NO: 554012 - protein, 7 aa, Mycobacterium
QRQAYTD

SEQ ID NO: 554013 - protein, 4 aa, Mycobacterium
QRQD

SEQ ID NO: 554014 - protein, 5 aa, Mycobacterium
QRQEQ

SEQ ID NO: 554015 - protein, 5 aa, Mycobacterium
QRQFT

SEQ ID NO: 554016 - protein, 7 aa, Mycobacterium
QRQGRSL

SEQ ID NO: 554017 - protein, 13 aa, Mycobacterium
QRQGSQDEGGRSE

SEQ ID NO: 554018 - protein, 21 aa, Mycobacterium
QRQHGANIDGGTESVGVPTED

SEQ ID NO: 554019 - protein, 8 aa, Mycobacterium
QRQHTSTD

SEQ ID NO: 554020 - protein, 5 aa, Mycobacterium
QRQIQ

SEQ ID NO: 554021 - protein, 19 aa, Mycobacterium
QRQKASGLIPARESRAEPI

SEQ ID NO: 554022 - protein, 14 aa, Mycobacterium
QRQKKAGRLREDVP

SEQ ID NO: 554023 - protein, 13 aa, Mycobacterium
QRQLAAPPRLSTG

SEQ ID NO: 554024 - protein, 4 aa, Mycobacterium
QRQM

SEQ ID NO: 554025 - protein, 12 aa, Mycobacterium
QRQMPASSDEAT

SEQ ID NO: 554026 - protein, 4 aa, Mycobacterium
QRQN

SEQ ID NO: 554027 - protein, 5 aa, Mycobacterium
QRQPD

SEQ ID NO: 554028 - protein, 7 aa, Mycobacterium
QRQPGYE

SEQ ID NO: 554029 - protein, 8 aa, Mycobacterium
QRQQKGMS

SEQ ID NO: 554030 - protein, 14 aa, Mycobacterium
QRQQRQDRGQSEVP

SEQ ID NO: 554031 - protein, 4 aa, Mycobacterium
QRQR

SEQ ID NO: 554032 - protein, 15 aa, Mycobacterium
QRQRAKADAAARKHA

SEQ ID NO: 554033 - protein, 19 aa, Mycobacterium
QRQRAKADAAARKQAHTDL

SEQ ID NO: 554034 - protein, 10 aa, Mycobacterium
QRQRPATPAE

SEQ ID NO: 554035 - protein, 6 aa, Mycobacterium
QRQRRS

SEQ ID NO: 554036 - protein, 19 aa, Mycobacterium
QRQSLRTRRRTHRGPAHLR

SEQ ID NO: 554037 - protein, 6 aa, Mycobacterium
QRQSPD

SEQ ID NO: 554038 - protein, 9 aa, Mycobacterium
QRQSQRGYA

SEQ ID NO: 554039 - protein, 17 aa, Mycobacterium
QRQTSEGMAANANQPSR

SEQ ID NO: 554040 - protein, 7 aa, Mycobacterium
QRQTSEH

SEQ ID NO: 554041 - protein, 5 aa, Mycobacterium
QRRAA

SEQ ID NO: 554042 - protein, 6 aa, Mycobacterium
QRRAAV

SEQ ID NO: 554043 - protein, 10 aa, Mycobacterium
QRRADEPTLP

SEQ ID NO: 554044 - protein, 6 aa, Mycobacterium
QRRADQ

SEQ ID NO: 554045 - protein, 9 aa, Mycobacterium
QRRAEGLGD

SEQ ID NO: 554046 - protein, 6 aa, Mycobacterium
QRRAGR

SEQ ID NO: 554047 - protein, 9 aa, Mycobacterium
QRRDCPGND

SEQ ID NO: 554048 - protein, 9 aa, Mycobacterium
QRRDDPRDD

SEQ ID NO: 554049 - protein, 6 aa, Mycobacterium
QRRDHR

SEQ ID NO: 554050 - protein, 6 aa, Mycobacterium
QRRDPD

SEQ ID NO: 554051 - protein, 6 aa, Mycobacterium
QRRDRL

SEQ ID NO: 554052 - protein, 8 aa, Mycobacterium
QRRDTESM

SEQ ID NO: 554053 - protein, 7 aa, Mycobacterium
QRRDTQQ

SEQ ID NO: 554054 - protein, 6 aa, Mycobacterium
QRREER

SEQ ID NO: 554055 - protein, 11 aa, Mycobacterium
QRREPPDSLAE

SEQ ID NO: 554056 - protein, 7 aa, Mycobacterium
QRREPSF

SEQ ID NO: 554057 - protein, 5 aa, Mycobacterium
QRRER

SEQ ID NO: 554058 - protein, 11 aa, Mycobacterium
QRRETARTEKN

SEQ ID NO: 554059 - protein, 4 aa, Mycobacterium
QRRG

SEQ ID NO: 554060 - protein, 5 aa, Mycobacterium
QRRGA

SEQ ID NO: 554061 - protein, 6 aa, Mycobacterium
QRRGAD

SEQ ID NO: 554062 - protein, 16 aa, Mycobacterium
QRRGAQTAAHDRIGEP

SEQ ID NO: 554063 - protein, 13 aa, Mycobacterium
QRRGAVAGTGAGT

SEQ ID NO: 554064 - protein, 7 aa, Mycobacterium
QRRGDEA

SEQ ID NO: 554065 - protein, 9 aa, Mycobacterium
QRRGDPGQD

SEQ ID NO: 554066 - protein, 19 aa, Mycobacterium
QRRGDRAGEVASRSRASRL

SEQ ID NO: 554067 - protein, 9 aa, Mycobacterium
QRRGETDFE

SEQ ID NO: 554068 - protein, 5 aa, Mycobacterium
QRRGI

SEQ ID NO: 554069 - protein, 6 aa, Mycobacterium
QRRGIT

SEQ ID NO: 554070 - protein, 5 aa, Mycobacterium
QRRGM

SEQ ID NO: 554071 - protein, 34 aa, Mycobacterium
QRRGPADRPGRGGAETPGRQPARHRAPRRRRTAH

SEQ ID NO: 554072 - protein, 8 aa, Mycobacterium
QRRGRRYR

SEQ ID NO: 554073 - protein, 15 aa, Mycobacterium
QRRGSATSRSTVGTV

SEQ ID NO: 554074 - protein, 7 aa, Mycobacterium
QRRGSDR

SEQ ID NO: 554075 - protein, 5 aa, Mycobacterium
QRRGT

SEQ ID NO: 554076 - protein, 10 aa, Mycobacterium
QRRGTRSNGS

SEQ ID NO: 554077 - protein, 7 aa, Mycobacterium
QRRGVKP

SEQ ID NO: 554078 - protein, 4 aa, Mycobacterium
QRRH

SEQ ID NO: 554079 - protein, 11 aa, Mycobacterium
QRRKGTEEYND

SEQ ID NO: 554080 - protein, 17 aa, Mycobacterium
QRRKHHRGELDDGRAAR

SEQ ID NO: 554081 - protein, 16 aa, Mycobacterium
QRRKIRGRRGLSLVVS

SEQ ID NO: 554082 - protein, 6 aa, Mycobacterium
QRRKLN

SEQ ID NO: 554083 - protein, 25 aa, Mycobacterium
QRRKPDTTAAVPRQGRRTPRAPSSG

SEQ ID NO: 554084 - protein, 7 aa, Mycobacterium
QRRKTPD

SEQ ID NO: 554085 - protein, 7 aa, Mycobacterium
QRRLPDT

SEQ ID NO: 554086 - protein, 5 aa, Mycobacterium
QRRLT

SEQ ID NO: 554087 - protein, 14 aa, Mycobacterium
QRRNSAPAEASSVR

SEQ ID NO: 554088 - protein, 4 aa, Mycobacterium
QRRP

SEQ ID NO: 554089 - protein, 6 aa, Mycobacterium
QRRPAA

SEQ ID NO: 554090 - protein, 6 aa, Mycobacterium
QRRPAG

SEQ ID NO: 554091 - protein, 7 aa, Mycobacterium
QRRPGPV

SEQ ID NO: 554092 - protein, 5 aa, Mycobacterium
QRRPL

SEQ ID NO: 554093 - protein, 12 aa, Mycobacterium
QRRPPRFGDSQE

SEQ ID NO: 554094 - protein, 7 aa, Mycobacterium
QRRPQIT

SEQ ID NO: 554095 - protein, 10 aa, Mycobacterium
QRRPRDEVEA

SEQ ID NO: 554096 - protein, 6 aa, Mycobacterium
QRRPTD

SEQ ID NO: 554097 - protein, 5 aa, Mycobacterium
QRRPV

SEQ ID NO: 554098 - protein, 4 aa, Mycobacterium
QRRQ

SEQ ID NO: 554099 - protein, 11 aa, Mycobacterium
QRRQDTSGHAA

SEQ ID NO: 554100 - protein, 8 aa, Mycobacterium
QRRQPGRA

SEQ ID NO: 554101 - protein, 12 aa, Mycobacterium
QRRQQRRGHHGR

SEQ ID NO: 554102 - protein, 12 aa, Mycobacterium
QRRQSRGQDEVP

SEQ ID NO: 554103 - protein, 8 aa, Mycobacterium
QRRRAEGL

SEQ ID NO: 554104 - protein, 14 aa, Mycobacterium
QRRRAKADAAARKH

SEQ ID NO: 554105 - protein, 18 aa, Mycobacterium
QRRRAKADAAARKHAHTD

SEQ ID NO: 554106 - protein, 19 aa, Mycobacterium
QRRRAKADAAARKQAHTDL

SEQ ID NO: 554107 - protein, 6 aa, Mycobacterium
QRRREL

SEQ ID NO: 554108 - protein, 9 aa, Mycobacterium
QRRRHAGRA

SEQ ID NO: 554109 - protein, 9 aa, Mycobacterium
QRRRKHTDD

SEQ ID NO: 554110 - protein, 10 aa, Mycobacterium
QRRRSDSNSV

SEQ ID NO: 554111 - protein, 6 aa, Mycobacterium
QRRRTR

SEQ ID NO: 554112 - protein, 10 aa, Mycobacterium
QRRSAAGATS

SEQ ID NO: 554113 - protein, 7 aa, Mycobacterium
QRRSASV

SEQ ID NO: 554114 - protein, 7 aa, Mycobacterium
QRRSDDV

SEQ ID NO: 554115 - protein, 9 aa, Mycobacterium
QRRSEPRDD

SEQ ID NO: 554116 - protein, 5 aa, Mycobacterium
QRRSG

SEQ ID NO: 554117 - protein, 13 aa, Mycobacterium
QRRSGRGRPTGAA

SEQ ID NO: 554118 - protein, 10 aa, Mycobacterium
QRRSPADDFS

SEQ ID NO: 554119 - protein, 10 aa, Mycobacterium
QRRSPAGARS

SEQ ID NO: 554120 - protein, 11 aa, Mycobacterium
QRRSPAGTTSW

SEQ ID NO: 554121 - protein, 8 aa, Mycobacterium
QRRSTTRH

SEQ ID NO: 554122 - protein, 7 aa, Mycobacterium
QRRTGEP

SEQ ID NO: 554123 - protein, 6 aa, Mycobacterium
QRRTLA

SEQ ID NO: 554124 - protein, 7 aa, Mycobacterium
QRRTPGL

SEQ ID NO: 554125 - protein, 9 aa, Mycobacterium
QRRTPRAEI

SEQ ID NO: 554126 - protein, 9 aa, Mycobacterium
QRRTTDAQN

SEQ ID NO: 554127 - protein, 5 aa, Mycobacterium
QRRTV

SEQ ID NO: 554128 - protein, 4 aa, Mycobacterium
QRRV

SEQ ID NO: 554129 - protein, 5 aa, Mycobacterium
QRRVD

SEQ ID NO: 554130 - protein, 24 aa, Mycobacterium
QRRVGEAPKTAGLPGTEGQHRTDF

SEQ ID NO: 554131 - protein, 9 aa, Mycobacterium
QRRVQGRRR

SEQ ID NO: 554132 - protein, 24 aa, Mycobacterium
QRRVTEAAKTAGLPGTEGQHRTDF

SEQ ID NO: 554133 - protein, 4 aa, Mycobacterium
QRSA

SEQ ID NO: 554134 - protein, 6 aa, Mycobacterium
QRSADD

SEQ ID NO: 554135 - protein, 8 aa, Mycobacterium
QRSADERV

SEQ ID NO: 554136 - protein, 8 aa, Mycobacterium
QRSADKAV

SEQ ID NO: 554137 - protein, 7 aa, Mycobacterium
QRSADKH

SEQ ID NO: 554138 - protein, 8 aa, Mycobacterium
QRSAGAHP

SEQ ID NO: 554139 - protein, 7 aa, Mycobacterium
QRSAHNT

SEQ ID NO: 554140 - protein, 16 aa, Mycobacterium
QRSAHSTVDKADAERV

SEQ ID NO: 554141 - protein, 5 aa, Mycobacterium
QRSAL

SEQ ID NO: 554142 - protein, 7 aa, Mycobacterium
QRSAPPA

SEQ ID NO: 554143 - protein, 10 aa, Mycobacterium
QRSATGAAPP

SEQ ID NO: 554144 - protein, 8 aa, Mycobacterium
QRSDGRVR

SEQ ID NO: 554145 - protein, 7 aa, Mycobacterium
QRSDGSF

SEQ ID NO: 554146 - protein, 4 aa, Mycobacterium
QRSE

SEQ ID NO: 554147 - protein, 6 aa, Mycobacterium
QRSEDF

SEQ ID NO: 554148 - protein, 20 aa, Mycobacterium
QRSERGGESERNRRLDSDAA

SEQ ID NO: 554149 - protein, 4 aa, Mycobacterium
QRSF

SEQ ID NO: 554150 - protein, 14 aa, Mycobacterium
QRSGAAATRLRPQD

SEQ ID NO: 554151 - protein, 9 aa, Mycobacterium
QRSGEGGPG

SEQ ID NO: 554152 - protein, 10 aa, Mycobacterium
QRSGGPVATE

SEQ ID NO: 554153 - protein, 8 aa, Mycobacterium
QRSGLGPV

SEQ ID NO: 554154 - protein, 8 aa, Mycobacterium
QRSGPTNM

SEQ ID NO: 554155 - protein, 23 aa, Mycobacterium
QRSGQTREIAERDARAMAEPGAL

SEQ ID NO: 554156 - protein, 11 aa, Mycobacterium
QRSGRDRGDFE

SEQ ID NO: 554157 - protein, 14 aa, Mycobacterium
QRSGTRHVIVFEPV

SEQ ID NO: 554158 - protein, 8 aa, Mycobacterium
QRSGVADE

SEQ ID NO: 554159 - protein, 7 aa, Mycobacterium
QRSGYAP

SEQ ID NO: 554160 - protein, 14 aa, Mycobacterium
QRSHDIDRASELAA

SEQ ID NO: 554161 - protein, 4 aa, Mycobacterium
QRSI

SEQ ID NO: 554162 - protein, 5 aa, Mycobacterium
QRSIP

SEQ ID NO: 554163 - protein, 4 aa, Mycobacterium
QRSL

SEQ ID NO: 554164 - protein, 6 aa, Mycobacterium
QRSLDR

SEQ ID NO: 554165 - protein, 17 aa, Mycobacterium
QRSNDDTGVAVPGAPGV

SEQ ID NO: 554166 - protein, 14 aa, Mycobacterium
QRSNGIASAAGALK

SEQ ID NO: 554167 - protein, 8 aa, Mycobacterium
QRSNGRPV

SEQ ID NO: 554168 - protein, 9 aa, Mycobacterium
QRSPATTAL

SEQ ID NO: 554169 - protein, 8 aa, Mycobacterium
QRSPDRDL

SEQ ID NO: 554170 - protein, 20 aa, Mycobacterium
QRSPSGKADYRWAKDQVTQK

SEQ ID NO: 554171 - protein, 19 aa, Mycobacterium
QRSPSGKADYRWAKEQAAD

SEQ ID NO: 554172 - protein, 5 aa, Mycobacterium
QRSQE

SEQ ID NO: 554173 - protein, 13 aa, Mycobacterium
QRSQGKWYPGEPL

SEQ ID NO: 554174 - protein, 8 aa, Mycobacterium
QRSQLSGS

SEQ ID NO: 554175 - protein, 4 aa, Mycobacterium
QRSR

SEQ ID NO: 554176 - protein, 6 aa, Mycobacterium
QRSRGA

SEQ ID NO: 554177 - protein, 16 aa, Mycobacterium
QRSRHQQNTLDPARAA

SEQ ID NO: 554178 - protein, 7 aa, Mycobacterium
QRSRRPY

SEQ ID NO: 554179 - protein, 9 aa, Mycobacterium
QRSRRSEDD

SEQ ID NO: 554180 - protein, 8 aa, Mycobacterium
QRSRRSEE

SEQ ID NO: 554181 - protein, 5 aa, Mycobacterium
QRSRV

SEQ ID NO: 554182 - protein, 7 aa, Mycobacterium
QRSRVED

SEQ ID NO: 554183 - protein, 24 aa, Mycobacterium
QRSSPERSATPCRRSRRWPTTTAV

SEQ ID NO: 554184 - protein, 8 aa, Mycobacterium
QRSSRYPA

SEQ ID NO: 554185 - protein, 12 aa, Mycobacterium
QRSSSQPAAAAV

SEQ ID NO: 554186 - protein, 7 aa, Mycobacterium
QRSTAVG

SEQ ID NO: 554187 - protein, 5 aa, Mycobacterium
QRSTL

SEQ ID NO: 554188 - protein, 8 aa, Mycobacterium
QRSTSVQP

SEQ ID NO: 554189 - protein, 8 aa, Mycobacterium
QRSTTGAR

SEQ ID NO: 554190 - protein, 5 aa, Mycobacterium
QRSVA

SEQ ID NO: 554191 - protein, 22 aa, Mycobacterium
QRSVRKAAGARLRNKPGEPLPV

SEQ ID NO: 554192 - protein, 7 aa, Mycobacterium
QRSVSSA

SEQ ID NO: 554193 - protein, 9 aa, Mycobacterium
QRSYPQPAG

SEQ ID NO: 554194 - protein, 4 aa, Mycobacterium
QRTA

SEQ ID NO: 554195 - protein, 19 aa, Mycobacterium
QRTAAQLSPEEKDAMSHRG

SEQ ID NO: 554196 - protein, 19 aa, Mycobacterium
QRTAGRAAGDHFGQPGAND

SEQ ID NO: 554197 - protein, 11 aa, Mycobacterium
QRTAGRSTRTA

SEQ ID NO: 554198 - protein, 10 aa, Mycobacterium
QRTALSGPRV

SEQ ID NO: 554199 - protein, 11 aa, Mycobacterium
QRTANEDTELS

SEQ ID NO: 554200 - protein, 18 aa, Mycobacterium
QRTAPPGSLDDTTSPPVT

SEQ ID NO: 554201 - protein, 6 aa, Mycobacterium
QRTARQ

SEQ ID NO: 554202 - protein, 10 aa, Mycobacterium
QRTASAIGNY

SEQ ID NO: 554203 - protein, 9 aa, Mycobacterium
QRTAVRPPV

SEQ ID NO: 554204 - protein, 15 aa, Mycobacterium
QRTDAYGGSPQNRAR

SEQ ID NO: 554205 - protein, 7 aa, Mycobacterium
QRTDGER

SEQ ID NO: 554206 - protein, 7 aa, Mycobacterium
QRTDYTD

SEQ ID NO: 554207 - protein, 6 aa, Mycobacterium
QRTEAD

SEQ ID NO: 554208 - protein, 7 aa, Mycobacterium
QRTEADE

SEQ ID NO: 554209 - protein, 7 aa, Mycobacterium
QRTEMSG

SEQ ID NO: 554210 - protein, 5 aa, Mycobacterium
QRTEP

SEQ ID NO: 554211 - protein, 4 aa, Mycobacterium
QRTG

SEQ ID NO: 554212 - protein, 9 aa, Mycobacterium
QRTGAADDP

SEQ ID NO: 554213 - protein, 8 aa, Mycobacterium
QRTGGGAH

SEQ ID NO: 554214 - protein, 7 aa, Mycobacterium
QRTGKPH

SEQ ID NO: 554215 - protein, 7 aa, Mycobacterium
QRTGLTE

SEQ ID NO: 554216 - protein, 7 aa, Mycobacterium
QRTGRPH

SEQ ID NO: 554217 - protein, 11 aa, Mycobacterium
QRTGRTTSPHL

SEQ ID NO: 554218 - protein, 12 aa, Mycobacterium
QRTGSFKARGAY

SEQ ID NO: 554219 - protein, 12 aa, Mycobacterium
QRTGSFKPRGAY

SEQ ID NO: 554220 - protein, 7 aa, Mycobacterium
QRTGSPH

SEQ ID NO: 554221 - protein, 8 aa, Mycobacterium
QRTGTGQL

SEQ ID NO: 554222 - protein, 11 aa, Mycobacterium
QRTLNKGRVPE

SEQ ID NO: 554223 - protein, 7 aa, Mycobacterium
QRTLPDE

SEQ ID NO: 554224 - protein, 6 aa, Mycobacterium
QRTLSG

SEQ ID NO: 554225 - protein, 4 aa, Mycobacterium
QRTN

SEQ ID NO: 554226 - protein, 8 aa, Mycobacterium
QRTPDGVA

SEQ ID NO: 554227 - protein, 7 aa, Mycobacterium
QRTPDLS

SEQ ID NO: 554228 - protein, 9 aa, Mycobacterium
QRTPEAPAV

SEQ ID NO: 554229 - protein, 7 aa, Mycobacterium
QRTPGEL

SEQ ID NO: 554230 - protein, 6 aa, Mycobacterium
QRTPLS

SEQ ID NO: 554231 - protein, 35 aa, Mycobacterium
QRTPPPAAPSQRRDVQTGQPIEQEPAPPAPAQPVP

SEQ ID NO: 554232 - protein, 8 aa, Mycobacterium
QRTPSTMR

SEQ ID NO: 554233 - protein, 5 aa, Mycobacterium
QRTQA

SEQ ID NO: 554234 - protein, 6 aa, Mycobacterium
QRTQAE

SEQ ID NO: 554235 - protein, 6 aa, Mycobacterium
QRTQNE

SEQ ID NO: 554236 - protein, 9 aa, Mycobacterium
QRTRASQGY

SEQ ID NO: 554237 - protein, 7 aa, Mycobacterium
QRTREEA

SEQ ID NO: 554238 - protein, 8 aa, Mycobacterium
QRTRHPEA

SEQ ID NO: 554239 - protein, 8 aa, Mycobacterium
QRTRPGQL

SEQ ID NO: 554240 - protein, 6 aa, Mycobacterium
QRTRRD

SEQ ID NO: 554241 - protein, 7 aa, Mycobacterium
QRTSDDV

SEQ ID NO: 554242 - protein, 8 aa, Mycobacterium
QRTSGQLR

SEQ ID NO: 554243 - protein, 10 aa, Mycobacterium
QRTSPRRSHH

SEQ ID NO: 554244 - protein, 9 aa, Mycobacterium
QRTSPSREV

SEQ ID NO: 554245 - protein, 10 aa, Mycobacterium
QRTSSGQGSA

SEQ ID NO: 554246 - protein, 4 aa, Mycobacterium
QRTT

SEQ ID NO: 554247 - protein, 5 aa, Mycobacterium
QRTTA

SEQ ID NO: 554248 - protein, 11 aa, Mycobacterium
QRTTGQSTRTA

SEQ ID NO: 554249 - protein, 14 aa, Mycobacterium
QRTTRRLSADTVDR

SEQ ID NO: 554250 - protein, 7 aa, Mycobacterium
QRTTTRN

SEQ ID NO: 554251 - protein, 10 aa, Mycobacterium
QRTVANSAGY

SEQ ID NO: 554252 - protein, 5 aa, Mycobacterium
QRTVE

SEQ ID NO: 554253 - protein, 5 aa, Mycobacterium
QRTWA

SEQ ID NO: 554254 - protein, 5 aa, Mycobacterium
QRTYG

SEQ ID NO: 554255 - protein, 10 aa, Mycobacterium
QRVADDAATR

SEQ ID NO: 554256 - protein, 11 aa, Mycobacterium
QRVADTDTVAP

SEQ ID NO: 554257 - protein, 8 aa, Mycobacterium
QRVAEQGS

SEQ ID NO: 554258 - protein, 5 aa, Mycobacterium
QRVAP

SEQ ID NO: 554259 - protein, 6 aa, Mycobacterium
QRVARS

SEQ ID NO: 554260 - protein, 12 aa, Mycobacterium
QRVATEAGIDRP

SEQ ID NO: 554261 - protein, 7 aa, Mycobacterium
QRVEAGT

SEQ ID NO: 554262 - protein, 6 aa, Mycobacterium
QRVETG

SEQ ID NO: 554263 - protein, 7 aa, Mycobacterium
QRVGENG

SEQ ID NO: 554264 - protein, 8 aa, Mycobacterium
QRVGESGW

SEQ ID NO: 554265 - protein, 5 aa, Mycobacterium
QRVGG

SEQ ID NO: 554266 - protein, 14 aa, Mycobacterium
QRVGGADEARRGRD

SEQ ID NO: 554267 - protein, 5 aa, Mycobacterium
QRVGN

SEQ ID NO: 554268 - protein, 10 aa, Mycobacterium
QRVGQGQSLR

SEQ ID NO: 554269 - protein, 7 aa, Mycobacterium
QRVGSGG

SEQ ID NO: 554270 - protein, 7 aa, Mycobacterium
QRVKAGE

SEQ ID NO: 554271 - protein, 12 aa, Mycobacterium
QRVLPPTGNSGT

SEQ ID NO: 554272 - protein, 8 aa, Mycobacterium
QRVNGTPA

SEQ ID NO: 554273 - protein, 4 aa, Mycobacterium
QRVP

SEQ ID NO: 554274 - protein, 7 aa, Mycobacterium
QRVPGPG

SEQ ID NO: 554275 - protein, 6 aa, Mycobacterium
QRVPPG

SEQ ID NO: 554276 - protein, 6 aa, Mycobacterium
QRVPRG

SEQ ID NO: 554277 - protein, 8 aa, Mycobacterium
QRVPTREE

SEQ ID NO: 554278 - protein, 4 aa, Mycobacterium
QRVR

SEQ ID NO: 554279 - protein, 5 aa, Mycobacterium
QRVRP

SEQ ID NO: 554280 - protein, 6 aa, Mycobacterium
QRVRPD

SEQ ID NO: 554281 - protein, 6 aa, Mycobacterium
QRVRPE

SEQ ID NO: 554282 - protein, 7 aa, Mycobacterium
QRVRPED

SEQ ID NO: 554283 - protein, 7 aa, Mycobacterium
QRVSPKD

SEQ ID NO: 554284 - protein, 8 aa, Mycobacterium
QRVSRTRA

SEQ ID NO: 554285 - protein, 7 aa, Mycobacterium
QRVSTSQ

SEQ ID NO: 554286 - protein, 28 aa, Mycobacterium
QRVTAGTTLTAGSAGAAGATGTTGSADT

SEQ ID NO: 554287 - protein, 7 aa, Mycobacterium
QRVTQDE

SEQ ID NO: 554288 - protein, 4 aa, Mycobacterium
QRWG

SEQ ID NO: 554289 - protein, 18 aa, Mycobacterium
QRWPSRAAATLSTHDLPT

SEQ ID NO: 554290 - protein, 6 aa, Mycobacterium
QRWPSV

SEQ ID NO: 554291 - protein, 6 aa, Mycobacterium
QRWRAD

SEQ ID NO: 554292 - protein, 7 aa, Mycobacterium
QRWTEPR

SEQ ID NO: 554293 - protein, 9 aa, Mycobacterium
QRYASESTD

SEQ ID NO: 554294 - protein, 8 aa, Mycobacterium
QRYASSGE

SEQ ID NO: 554295 - protein, 8 aa, Mycobacterium
QRYGDDAL

SEQ ID NO: 554296 - protein, 6 aa, Mycobacterium
QRYGGP

SEQ ID NO: 554297 - protein, 6 aa, Mycobacterium
QRYGRE

SEQ ID NO: 554298 - protein, 8 aa, Mycobacterium
QRYGSDAL

SEQ ID NO: 554299 - protein, 4 aa, Mycobacterium
QRYP

SEQ ID NO: 554300 - protein, 12 aa, Mycobacterium
QRYRAPDTPVEQ

SEQ ID NO: 554301 - protein, 6 aa, Mycobacterium
QRYRRT

SEQ ID NO: 554302 - protein, 4 aa, Mycobacterium
QRYT

SEQ ID NO: 554303 - protein, 5 aa, Mycobacterium
QRYVD

SEQ ID NO: 554304 - protein, 6 aa, Mycobacterium
QSAAAH

SEQ ID NO: 554305 - protein, 7 aa, Mycobacterium
QSAADVD

SEQ ID NO: 554306 - protein, 14 aa, Mycobacterium
QSAADVRASMDTSD

SEQ ID NO: 554307 - protein, 10 aa, Mycobacterium
QSAAETTGGL

SEQ ID NO: 554308 - protein, 10 aa, Mycobacterium
QSAAGGFTPS

SEQ ID NO: 554309 - protein, 13 aa, Mycobacterium
QSAAGRAISGSGN

SEQ ID NO: 554310 - protein, 7 aa, Mycobacterium
QSAAGRG

SEQ ID NO: 554311 - protein, 13 aa, Mycobacterium
QSAAIRSAKSSFS

SEQ ID NO: 554312 - protein, 6 aa, Mycobacterium
QSAAMG

SEQ ID NO: 554313 - protein, 7 aa, Mycobacterium
QSAANQV

SEQ ID NO: 554314 - protein, 10 aa, Mycobacterium
QSAAPRPQVQ

SEQ ID NO: 554315 - protein, 10 aa, Mycobacterium
QSAATPAPAV

SEQ ID NO: 554316 - protein, 8 aa, Mycobacterium
QSADARRL

SEQ ID NO: 554317 - protein, 8 aa, Mycobacterium
QSADEATG

SEQ ID NO: 554318 - protein, 12 aa, Mycobacterium
QSADEDDPVYQR

SEQ ID NO: 554319 - protein, 10 aa, Mycobacterium
QSADESGTAA

SEQ ID NO: 554320 - protein, 6 aa, Mycobacterium
QSADEW

SEQ ID NO: 554321 - protein, 8 aa, Mycobacterium
QSADNPFP

SEQ ID NO: 554322 - protein, 9 aa, Mycobacterium
QSADPGAHP

SEQ ID NO: 554323 - protein, 7 aa, Mycobacterium
QSADPIE

SEQ ID NO: 554324 - protein, 8 aa, Mycobacterium
QSADTDDR

SEQ ID NO: 554325 - protein, 6 aa, Mycobacterium
QSADTV

SEQ ID NO: 554326 - protein, 14 aa, Mycobacterium
QSADVRDAQLSSLA

SEQ ID NO: 554327 - protein, 4 aa, Mycobacterium
QSAE

SEQ ID NO: 554328 - protein, 11 aa, Mycobacterium
QSAEADRSKKR

SEQ ID NO: 554329 - protein, 5 aa, Mycobacterium
QSAED

SEQ ID NO: 554330 - protein, 11 aa, Mycobacterium
QSAEGDPVGGV

SEQ ID NO: 554331 - protein, 6 aa, Mycobacterium
QSAEGM

SEQ ID NO: 554332 - protein, 7 aa, Mycobacterium
QSAEHGL

SEQ ID NO: 554333 - protein, 14 aa, Mycobacterium
QSAEHTRDDAHALL

SEQ ID NO: 554334 - protein, 6 aa, Mycobacterium
QSAELP

SEQ ID NO: 554335 - protein, 11 aa, Mycobacterium
QSAERQAERQI

SEQ ID NO: 554336 - protein, 12 aa, Mycobacterium
QSAESAPEGVDA

SEQ ID NO: 554337 - protein, 10 aa, Mycobacterium
QSAESSRRSL

SEQ ID NO: 554338 - protein, 19 aa, Mycobacterium
QSAETGNENNRYGASTPAV

SEQ ID NO: 554339 - protein, 80 aa, Mycobacterium
QSAETPDNVPDQDEPEHEPASAGSNAASEPWAEGAPEAAATEPGTAEPEAPAATPEPAAAAPTRPRRRRSAARAAGPPVE

SEQ ID NO: 554340 - protein, 7 aa, Mycobacterium
QSAFAAK

SEQ ID NO: 554341 - protein, 6 aa, Mycobacterium
QSAFGA

SEQ ID NO: 554342 - protein, 7 aa, Mycobacterium
QSAFSAK

SEQ ID NO: 554343 - protein, 5 aa, Mycobacterium
QSAGA

SEQ ID NO: 554344 - protein, 10 aa, Mycobacterium
QSAGAARRTL

SEQ ID NO: 554345 - protein, 17 aa, Mycobacterium
QSAGDALTVGSGRRDAP

SEQ ID NO: 554346 - protein, 8 aa, Mycobacterium
QSAGESEL

SEQ ID NO: 554347 - protein, 5 aa, Mycobacterium
QSAGG

SEQ ID NO: 554348 - protein, 7 aa, Mycobacterium
QSAGGDS

SEQ ID NO: 554349 - protein, 7 aa, Mycobacterium
QSAGLSA

SEQ ID NO: 554350 - protein, 5 aa, Mycobacterium
QSAGP

SEQ ID NO: 554351 - protein, 8 aa, Mycobacterium
QSAGPDAL

SEQ ID NO: 554352 - protein, 6 aa, Mycobacterium
QSAGPV

SEQ ID NO: 554353 - protein, 12 aa, Mycobacterium
QSAGRAQAKGGV

SEQ ID NO: 554354 - protein, 5 aa, Mycobacterium
QSAGS

SEQ ID NO: 554355 - protein, 12 aa, Mycobacterium
QSAGSPANPEAN

SEQ ID NO: 554356 - protein, 14 aa, Mycobacterium
QSAGVEGLEAADGA

SEQ ID NO: 554357 - protein, 5 aa, Mycobacterium
QSAGY

SEQ ID NO: 554358 - protein, 12 aa, Mycobacterium
QSAHAASPEQQQ

SEQ ID NO: 554359 - protein, 10 aa, Mycobacterium
QSAHGTNAAS

SEQ ID NO: 554360 - protein, 12 aa, Mycobacterium
QSAHTASAEQQQ

SEQ ID NO: 554361 - protein, 11 aa, Mycobacterium
QSAKADPTHST

SEQ ID NO: 554362 - protein, 9 aa, Mycobacterium
QSAKATETW

SEQ ID NO: 554363 - protein, 11 aa, Mycobacterium
QSAKDAATACE

SEQ ID NO: 554364 - protein, 9 aa, Mycobacterium
QSAKIGETQ

SEQ ID NO: 554365 - protein, 12 aa, Mycobacterium
QSAKNAGSQAKI

SEQ ID NO: 554366 - protein, 7 aa, Mycobacterium
QSAKPVV

SEQ ID NO: 554367 - protein, 4 aa, Mycobacterium
QSAL

SEQ ID NO: 554368 - protein, 6 aa, Mycobacterium
QSALST

SEQ ID NO: 554369 - protein, 4 aa, Mycobacterium
QSAM

SEQ ID NO: 554370 - protein, 7 aa, Mycobacterium
QSANARS

SEQ ID NO: 554371 - protein, 15 aa, Mycobacterium
QSANDITDAGSDESP

SEQ ID NO: 554372 - protein, 11 aa, Mycobacterium
QSANGAAAAPI

SEQ ID NO: 554373 - protein, 8 aa, Mycobacterium
QSAPCRAS

SEQ ID NO: 554374 - protein, 7 aa, Mycobacterium
QSAPERF

SEQ ID NO: 554375 - protein, 25 aa, Mycobacterium
QSAPFPEGGNGPRGRQGSPAKVSLP

SEQ ID NO: 554376 - protein, 8 aa, Mycobacterium
QSAPGLGD

SEQ ID NO: 554377 - protein, 8 aa, Mycobacterium
QSAPGSRI

SEQ ID NO: 554378 - protein, 7 aa, Mycobacterium
QSAPHQP

SEQ ID NO: 554379 - protein, 6 aa, Mycobacterium
QSAPRG

SEQ ID NO: 554380 - protein, 25 aa, Mycobacterium
QSAPRKLDAGGGPVRLDGDERQPIS

SEQ ID NO: 554381 - protein, 9 aa, Mycobacterium
QSAPTTAAD

SEQ ID NO: 554382 - protein, 6 aa, Mycobacterium
QSAQHE

SEQ ID NO: 554383 - protein, 12 aa, Mycobacterium
QSAQTPGYGGGI

SEQ ID NO: 554384 - protein, 10 aa, Mycobacterium
QSAQTRRRSP

SEQ ID NO: 554385 - protein, 8 aa, Mycobacterium
QSARDTGL

SEQ ID NO: 554386 - protein, 7 aa, Mycobacterium
QSAREGV

SEQ ID NO: 554387 - protein, 10 aa, Mycobacterium
QSARGNSLPA

SEQ ID NO: 554388 - protein, 9 aa, Mycobacterium
QSARLARRE

SEQ ID NO: 554389 - protein, 5 aa, Mycobacterium
QSARP

SEQ ID NO: 554390 - protein, 6 aa, Mycobacterium
QSARPG

SEQ ID NO: 554391 - protein, 29 aa, Mycobacterium
QSARPGEDWNGAQRFSGDDPLGMGEGAQA

SEQ ID NO: 554392 - protein, 7 aa, Mycobacterium
QSARPTV

SEQ ID NO: 554393 - protein, 85 aa, Mycobacterium
QSARSSPDATEPDVSAPAGVVTDPDVGTDVAPDEPDDDPDDTAAERDSRDDAEASDDDAAADPGSPREPAPARAEPRPAPIRPAP

SEQ ID NO: 554394 - protein, 12 aa, Mycobacterium
QSASAGNPDTID

SEQ ID NO: 554395 - protein, 13 aa, Mycobacterium
QSASAQLADAIKL

SEQ ID NO: 554396 - protein, 8 aa, Mycobacterium
QSASATWA

SEQ ID NO: 554397 - protein, 10 aa, Mycobacterium
QSASDAVATM

SEQ ID NO: 554398 - protein, 6 aa, Mycobacterium
QSASGL

SEQ ID NO: 554399 - protein, 5 aa, Mycobacterium
QSASL

SEQ ID NO: 554400 - protein, 6 aa, Mycobacterium
QSASVA

SEQ ID NO: 554401 - protein, 69 aa, Mycobacterium
QSATEGAGGGLEAATAAAGGAKAENAIKTGGAEGAAGGEGERAPVDTADKGTADKDKTDERDKTTDAVQ

SEQ ID NO: 554402 - protein, 6 aa, Mycobacterium
QSATGL

SEQ ID NO: 554403 - protein, 28 aa, Mycobacterium
QSATLNGHPTTAPAGTNGHQTAVASLPA

SEQ ID NO: 554404 - protein, 5 aa, Mycobacterium
QSATS

SEQ ID NO: 554405 - protein, 13 aa, Mycobacterium
QSATTGVTCSTRP

SEQ ID NO: 554406 - protein, 12 aa, Mycobacterium
QSATVRQAIGIA

SEQ ID NO: 554407 - protein, 8 aa, Mycobacterium
QSAWGTGS

SEQ ID NO: 554408 - protein, 11 aa, Mycobacterium
QSAYATSKGAL

SEQ ID NO: 554409 - protein, 6 aa, Mycobacterium
QSCDAC

SEQ ID NO: 554410 - protein, 8 aa, Mycobacterium
QSCGSPRN

SEQ ID NO: 554411 - protein, 4 aa, Mycobacterium
QSCV

SEQ ID NO: 554412 - protein, 4 aa, Mycobacterium
QSDA

SEQ ID NO: 554413 - protein, 7 aa, Mycobacterium
QSDAAAR

SEQ ID NO: 554414 - protein, 10 aa, Mycobacterium
QSDADRFQPT

SEQ ID NO: 554415 - protein, 6 aa, Mycobacterium
QSDAYT

SEQ ID NO: 554416 - protein, 9 aa, Mycobacterium
QSDDENTAP

SEQ ID NO: 554417 - protein, 7 aa, Mycobacterium
QSDEKGV

SEQ ID NO: 554418 - protein, 10 aa, Mycobacterium
QSDESRHISN

SEQ ID NO: 554419 - protein, 5 aa, Mycobacterium
QSDET

SEQ ID NO: 554420 - protein, 6 aa, Mycobacterium
QSDGAS

SEQ ID NO: 554421 - protein, 43 aa, Mycobacterium
QSDGPAALPPLPPTSPRRRPQTHSRTRHADKPATSRKNGHRPG

SEQ ID NO: 554422 - protein, 43 aa, Mycobacterium
QSDGPSALPPLPPSAPRRRPQTHSRTRHSDKPATGRKNGHGPG

SEQ ID NO: 554423 - protein, 5 aa, Mycobacterium
QSDGT

SEQ ID NO: 554424 - protein, 12 aa, Mycobacterium
QSDIGGEGPEYG

SEQ ID NO: 554425 - protein, 9 aa, Mycobacterium
QSDLGPKQW

SEQ ID NO: 554426 - protein, 7 aa, Mycobacterium
QSDPLAP

SEQ ID NO: 554427 - protein, 7 aa, Mycobacterium
QSDPSSI

SEQ ID NO: 554428 - protein, 8 aa, Mycobacterium
QSDPYARS

SEQ ID NO: 554429 - protein, 13 aa, Mycobacterium
QSDQQRAAGELKL

SEQ ID NO: 554430 - protein, 13 aa, Mycobacterium
QSDQQRASGELRL

SEQ ID NO: 554431 - protein, 13 aa, Mycobacterium
QSDQQRATGELRL

SEQ ID NO: 554432 - protein, 9 aa, Mycobacterium
QSDQTPENL

SEQ ID NO: 554433 - protein, 4 aa, Mycobacterium
QSDR

SEQ ID NO: 554434 - protein, 7 aa, Mycobacterium
QSDRAGF

SEQ ID NO: 554435 - protein, 9 aa, Mycobacterium
QSDRRDLGN

SEQ ID NO: 554436 - protein, 8 aa, Mycobacterium
QSDSGRDA

SEQ ID NO: 554437 - protein, 12 aa, Mycobacterium
QSDSVTAGDPVR

SEQ ID NO: 554438 - protein, 5 aa, Mycobacterium
QSDTL

SEQ ID NO: 554439 - protein, 7 aa, Mycobacterium
QSDTTAA

SEQ ID NO: 554440 - protein, 9 aa, Mycobacterium
QSDVSSGLQ

SEQ ID NO: 554441 - protein, 19 aa, Mycobacterium
QSDVSSGLQIGGSAGVAPS

SEQ ID NO: 554442 - protein, 20 aa, Mycobacterium
QSDVSSGLQIGGSAGVAPSV

SEQ ID NO: 554443 - protein, 9 aa, Mycobacterium
QSEADPRRR

SEQ ID NO: 554444 - protein, 8 aa, Mycobacterium
QSEAEETL

SEQ ID NO: 554445 - protein, 11 aa, Mycobacterium
QSEAERDGATG

SEQ ID NO: 554446 - protein, 11 aa, Mycobacterium
QSEAERDGGTG

SEQ ID NO: 554447 - protein, 5 aa, Mycobacterium
QSEAM

SEQ ID NO: 554448 - protein, 8 aa, Mycobacterium
QSEAQRRA

SEQ ID NO: 554449 - protein, 7 aa, Mycobacterium
QSEARNA

SEQ ID NO: 554450 - protein, 23 aa, Mycobacterium
QSEATNAATVSASITASPLTGPT

SEQ ID NO: 554451 - protein, 8 aa, Mycobacterium
QSEAYEEA

SEQ ID NO: 554452 - protein, 5 aa, Mycobacterium
QSEDQ

SEQ ID NO: 554453 - protein, 8 aa, Mycobacterium
QSEDVTVE

SEQ ID NO: 554454 - protein, 6 aa, Mycobacterium
QSEEAA

SEQ ID NO: 554455 - protein, 10 aa, Mycobacterium
QSEEAAPARQ

SEQ ID NO: 554456 - protein, 8 aa, Mycobacterium
QSEEALSE

SEQ ID NO: 554457 - protein, 10 aa, Mycobacterium
QSEELKGLDP

SEQ ID NO: 554458 - protein, 9 aa, Mycobacterium
QSEEQARER

SEQ ID NO: 554459 - protein, 5 aa, Mycobacterium
QSEFP

SEQ ID NO: 554460 - protein, 9 aa, Mycobacterium
QSEGDPVAM

SEQ ID NO: 554461 - protein, 14 aa, Mycobacterium
QSEGHDDGREVTKV

SEQ ID NO: 554462 - protein, 8 aa, Mycobacterium
QSEGMTAT

SEQ ID NO: 554463 - protein, 7 aa, Mycobacterium
QSEHPGR

SEQ ID NO: 554464 - protein, 19 aa, Mycobacterium
QSELPDTLRKSSDKAQRTF

SEQ ID NO: 554465 - protein, 7 aa, Mycobacterium
QSELSGA

SEQ ID NO: 554466 - protein, 8 aa, Mycobacterium
QSELSPEA

SEQ ID NO: 554467 - protein, 4 aa, Mycobacterium
QSEN

SEQ ID NO: 554468 - protein, 4 aa, Mycobacterium
QSEP

SEQ ID NO: 554469 - protein, 14 aa, Mycobacterium
QSEPAEPLPSDPRW

SEQ ID NO: 554470 - protein, 7 aa, Mycobacterium
QSEPPAM

SEQ ID NO: 554471 - protein, 9 aa, Mycobacterium
QSEPPTTRS

SEQ ID NO: 554472 - protein, 7 aa, Mycobacterium
QSEPQRH

SEQ ID NO: 554473 - protein, 7 aa, Mycobacterium
QSEPTST

SEQ ID NO: 554474 - protein, 7 aa, Mycobacterium
QSEPVPS

SEQ ID NO: 554475 - protein, 12 aa, Mycobacterium
QSEQGDTGQTAY

SEQ ID NO: 554476 - protein, 8 aa, Mycobacterium
QSEQSIRS

SEQ ID NO: 554477 - protein, 10 aa, Mycobacterium
QSEQTPETEA

SEQ ID NO: 554478 - protein, 7 aa, Mycobacterium
QSERHPV

SEQ ID NO: 554479 - protein, 14 aa, Mycobacterium
QSERMSGAPIDPPQ

SEQ ID NO: 554480 - protein, 8 aa, Mycobacterium
QSERPEDY

SEQ ID NO: 554481 - protein, 9 aa, Mycobacterium
QSERTETTF

SEQ ID NO: 554482 - protein, 6 aa, Mycobacterium
QSERYG

SEQ ID NO: 554483 - protein, 9 aa, Mycobacterium
QSESAAQSS

SEQ ID NO: 554484 - protein, 10 aa, Mycobacterium
QSESGARTWP

SEQ ID NO: 554485 - protein, 7 aa, Mycobacterium
QSESHMR

SEQ ID NO: 554486 - protein, 7 aa, Mycobacterium
QSESMNE

SEQ ID NO: 554487 - protein, 4 aa, Mycobacterium
QSEV

SEQ ID NO: 554488 - protein, 7 aa, Mycobacterium
QSEVPSR

SEQ ID NO: 554489 - protein, 5 aa, Mycobacterium
QSEVY

SEQ ID NO: 554490 - protein, 13 aa, Mycobacterium
QSFEDGGAWGNDQ

SEQ ID NO: 554491 - protein, 4 aa, Mycobacterium
QSFL

SEQ ID NO: 554492 - protein, 11 aa, Mycobacterium
QSFPDAEKFNP

SEQ ID NO: 554493 - protein, 6 aa, Mycobacterium
QSFSTG

SEQ ID NO: 554494 - protein, 5 aa, Mycobacterium
QSFTT

SEQ ID NO: 554495 - protein, 4 aa, Mycobacterium
QSGA

SEQ ID NO: 554496 - protein, 7 aa, Mycobacterium
QSGAARA

SEQ ID NO: 554497 - protein, 21 aa, Mycobacterium
QSGAEPSSGDPSNAPGADRTP

SEQ ID NO: 554498 - protein, 23 aa, Mycobacterium
QSGAGGIGGYGGDIGGTGGAGGV

SEQ ID NO: 554499 - protein, 7 aa, Mycobacterium
QSGAPGG

SEQ ID NO: 554500 - protein, 8 aa, Mycobacterium
QSGAPGGV

SEQ ID NO: 554501 - protein, 8 aa, Mycobacterium
QSGAPRLE

SEQ ID NO: 554502 - protein, 22 aa, Mycobacterium
QSGAQPPAAPPALEGSGADLER

SEQ ID NO: 554503 - protein, 18 aa, Mycobacterium
QSGARLAKEHSSSHGPPV

SEQ ID NO: 554504 - protein, 10 aa, Mycobacterium
QSGATDAKQL

SEQ ID NO: 554505 - protein, 12 aa, Mycobacterium
QSGATPGAGETR

SEQ ID NO: 554506 - protein, 10 aa, Mycobacterium
QSGDESLDYE

SEQ ID NO: 554507 - protein, 6 aa, Mycobacterium
QSGDIA

SEQ ID NO: 554508 - protein, 6 aa, Mycobacterium
QSGEFA

SEQ ID NO: 554509 - protein, 5 aa, Mycobacterium
QSGEL

SEQ ID NO: 554510 - protein, 13 aa, Mycobacterium
QSGEPDESADRRL

SEQ ID NO: 554511 - protein, 11 aa, Mycobacterium
QSGERTPRKNE

SEQ ID NO: 554512 - protein, 8 aa, Mycobacterium
QSGEWKDG

SEQ ID NO: 554513 - protein, 4 aa, Mycobacterium
QSGG

SEQ ID NO: 554514 - protein, 25 aa, Mycobacterium
QSGGAAAAVAAPQTAAAATTAAAVN

SEQ ID NO: 554515 - protein, 14 aa, Mycobacterium
QSGGALRPFPDGQD

SEQ ID NO: 554516 - protein, 6 aa, Mycobacterium
QSGGDI

SEQ ID NO: 554517 - protein, 8 aa, Mycobacterium
QSGGEPGR

SEQ ID NO: 554518 - protein, 8 aa, Mycobacterium
QSGGHAAR

SEQ ID NO: 554519 - protein, 9 aa, Mycobacterium
QSGGSTPKA

SEQ ID NO: 554520 - protein, 7 aa, Mycobacterium
QSGGTAF

SEQ ID NO: 554521 - protein, 5 aa, Mycobacterium
QSGGV

SEQ ID NO: 554522 - protein, 6 aa, Mycobacterium
QSGIGR

SEQ ID NO: 554523 - protein, 23 aa, Mycobacterium
QSGIGREGGPEGIAGFVEHQAII

SEQ ID NO: 554524 - protein, 6 aa, Mycobacterium
QSGIRT

SEQ ID NO: 554525 - protein, 8 aa, Mycobacterium
QSGKATGV

SEQ ID NO: 554526 - protein, 9 aa, Mycobacterium
QSGKPRPLD

SEQ ID NO: 554527 - protein, 5 aa, Mycobacterium
QSGKY

SEQ ID NO: 554528 - protein, 15 aa, Mycobacterium
QSGLGGVAAGTNQAT

SEQ ID NO: 554529 - protein, 8 aa, Mycobacterium
QSGLGPQD

SEQ ID NO: 554530 - protein, 14 aa, Mycobacterium
QSGLGREGAREGLQ

SEQ ID NO: 554531 - protein, 17 aa, Mycobacterium
QSGLGRELGPDAPLGFT

SEQ ID NO: 554532 - protein, 17 aa, Mycobacterium
QSGLGRELGPDAPLSFT

SEQ ID NO: 554533 - protein, 25 aa, Mycobacterium
QSGLGRELGPDAPLSFTETKNVFIA

SEQ ID NO: 554534 - protein, 8 aa, Mycobacterium
QSGLGRTG

SEQ ID NO: 554535 - protein, 10 aa, Mycobacterium
QSGLPKVPTS

SEQ ID NO: 554536 - protein, 5 aa, Mycobacterium
QSGLQ

SEQ ID NO: 554537 - protein, 5 aa, Mycobacterium
QSGMA

SEQ ID NO: 554538 - protein, 13 aa, Mycobacterium
QSGMVDPARLRPR

SEQ ID NO: 554539 - protein, 4 aa, Mycobacterium
QSGN

SEQ ID NO: 554540 - protein, 5 aa, Mycobacterium
QSGNA

SEQ ID NO: 554541 - protein, 6 aa, Mycobacterium
QSGNRA

SEQ ID NO: 554542 - protein, 4 aa, Mycobacterium
QSGP

SEQ ID NO: 554543 - protein, 7 aa, Mycobacterium
QSGPACH

SEQ ID NO: 554544 - protein, 9 aa, Mycobacterium
QSGPAPATL

SEQ ID NO: 554545 - protein, 8 aa, Mycobacterium
QSGPDIQN

SEQ ID NO: 554546 - protein, 8 aa, Mycobacterium
QSGPDRAI

SEQ ID NO: 554547 - protein, 6 aa, Mycobacterium
QSGPHT

SEQ ID NO: 554548 - protein, 5 aa, Mycobacterium
QSGPI

SEQ ID NO: 554549 - protein, 6 aa, Mycobacterium
QSGPKD

SEQ ID NO: 554550 - protein, 6 aa, Mycobacterium
QSGPKE

SEQ ID NO: 554551 - protein, 14 aa, Mycobacterium
QSGPKNGRKSPTRV

SEQ ID NO: 554552 - protein, 8 aa, Mycobacterium
QSGPPAEL

SEQ ID NO: 554553 - protein, 7 aa, Mycobacterium
QSGPSAT

SEQ ID NO: 554554 - protein, 8 aa, Mycobacterium
QSGQPERA

SEQ ID NO: 554555 - protein, 27 aa, Mycobacterium
QSGQPLPPPPAGFSGNTVTASSKVGAG

SEQ ID NO: 554556 - protein, 7 aa, Mycobacterium
QSGREFT

SEQ ID NO: 554557 - protein, 7 aa, Mycobacterium
QSGRPGA

SEQ ID NO: 554558 - protein, 8 aa, Mycobacterium
QSGRREGA

SEQ ID NO: 554559 - protein, 8 aa, Mycobacterium
QSGRSEES

SEQ ID NO: 554560 - protein, 14 aa, Mycobacterium
QSGRSEVSGNPDDH

SEQ ID NO: 554561 - protein, 6 aa, Mycobacterium
QSGRSI

SEQ ID NO: 554562 - protein, 6 aa, Mycobacterium
QSGRVD

SEQ ID NO: 554563 - protein, 6 aa, Mycobacterium
QSGSAR

SEQ ID NO: 554564 - protein, 5 aa, Mycobacterium
QSGSD

SEQ ID NO: 554565 - protein, 28 aa, Mycobacterium
QSGSDGREESPEQHLNPRSGRWRPDASH

SEQ ID NO: 554566 - protein, 10 aa, Mycobacterium
QSGSDGREVS

SEQ ID NO: 554567 - protein, 7 aa, Mycobacterium
QSGSDPV

SEQ ID NO: 554568 - protein, 5 aa, Mycobacterium
QSGSI

SEQ ID NO: 554569 - protein, 8 aa, Mycobacterium
QSGSRTLK

SEQ ID NO: 554570 - protein, 10 aa, Mycobacterium
QSGTATQGPL

SEQ ID NO: 554571 - protein, 6 aa, Mycobacterium
QSGTPM

SEQ ID NO: 554572 - protein, 5 aa, Mycobacterium
QSGVG

SEQ ID NO: 554573 - protein, 6 aa, Mycobacterium
QSGVGG

SEQ ID NO: 554574 - protein, 14 aa, Mycobacterium
QSGVGHGLPGRCDE

SEQ ID NO: 554575 - protein, 8 aa, Mycobacterium
QSGYSPEA

SEQ ID NO: 554576 - protein, 6 aa, Mycobacterium
QSHANV

SEQ ID NO: 554577 - protein, 6 aa, Mycobacterium
QSHGGG

SEQ ID NO: 554578 - protein, 11 aa, Mycobacterium
QSHGNPVEGTV

SEQ ID NO: 554579 - protein, 7 aa, Mycobacterium
QSHGNVE

SEQ ID NO: 554580 - protein, 5 aa, Mycobacterium
QSHRD

SEQ ID NO: 554581 - protein, 17 aa, Mycobacterium
QSHSESGVTAASRSALR

SEQ ID NO: 554582 - protein, 7 aa, Mycobacterium
QSHSGSL

SEQ ID NO: 554583 - protein, 4 aa, Mycobacterium
QSHW

SEQ ID NO: 554584 - protein, 7 aa, Mycobacterium
QSIEGQQ

SEQ ID NO: 554585 - protein, 10 aa, Mycobacterium
QSIGNASVEH

SEQ ID NO: 554586 - protein, 9 aa, Mycobacterium
QSIGQSTQQ

SEQ ID NO: 554587 - protein, 5 aa, Mycobacterium
QSIPA

SEQ ID NO: 554588 - protein, 7 aa, Mycobacterium
QSIPAAA

SEQ ID NO: 554589 - protein, 7 aa, Mycobacterium
QSIPGGI

SEQ ID NO: 554590 - protein, 9 aa, Mycobacterium
QSIPPEQPQ

SEQ ID NO: 554591 - protein, 19 aa, Mycobacterium
QSIPPGARSSSPTADAERS

SEQ ID NO: 554592 - protein, 14 aa, Mycobacterium
QSIQDETGIKPPWS

SEQ ID NO: 554593 - protein, 4 aa, Mycobacterium
QSIR

SEQ ID NO: 554594 - protein, 6 aa, Mycobacterium
QSISGD

SEQ ID NO: 554595 - protein, 5 aa, Mycobacterium
QSISR

SEQ ID NO: 554596 - protein, 8 aa, Mycobacterium
QSITDAKR

SEQ ID NO: 554597 - protein, 8 aa, Mycobacterium
QSITKGSI

SEQ ID NO: 554598 - protein, 6 aa, Mycobacterium
QSKGGF

SEQ ID NO: 554599 - protein, 8 aa, Mycobacterium
QSKHDAFA

SEQ ID NO: 554600 - protein, 6 aa, Mycobacterium
QSKIGG

SEQ ID NO: 554601 - protein, 6 aa, Mycobacterium
QSKPVA

SEQ ID NO: 554602 - protein, 7 aa, Mycobacterium
QSKPVSE

SEQ ID NO: 554603 - protein, 10 aa, Mycobacterium
QSKQAKKREV

SEQ ID NO: 554604 - protein, 6 aa, Mycobacterium
QSKQRL

SEQ ID NO: 554605 - protein, 15 aa, Mycobacterium
QSKQVKGTTYPNPPV

SEQ ID NO: 554606 - protein, 8 aa, Mycobacterium
QSKSPRSA

SEQ ID NO: 554607 - protein, 7 aa, Mycobacterium
QSKSVRS

SEQ ID NO: 554608 - protein, 9 aa, Mycobacterium
QSKTAYQAE

SEQ ID NO: 554609 - protein, 8 aa, Mycobacterium
QSKTINTV

SEQ ID NO: 554610 - protein, 7 aa, Mycobacterium
QSKYASG

SEQ ID NO: 554611 - protein, 13 aa, Mycobacterium
QSLAAAEKITSGE

SEQ ID NO: 554612 - protein, 11 aa, Mycobacterium
QSLADGNKRTG

SEQ ID NO: 554613 - protein, 6 aa, Mycobacterium
QSLAPA

SEQ ID NO: 554614 - protein, 11 aa, Mycobacterium
QSLAPGDRVAS

SEQ ID NO: 554615 - protein, 7 aa, Mycobacterium
QSLAPQW

SEQ ID NO: 554616 - protein, 7 aa, Mycobacterium
QSLASPE

SEQ ID NO: 554617 - protein, 5 aa, Mycobacterium
QSLDD

SEQ ID NO: 554618 - protein, 7 aa, Mycobacterium
QSLDGSA

SEQ ID NO: 554619 - protein, 8 aa, Mycobacterium
QSLGAEPA

SEQ ID NO: 554620 - protein, 8 aa, Mycobacterium
QSLGDPES

SEQ ID NO: 554621 - protein, 13 aa, Mycobacterium
QSLGEESPKTVDP

SEQ ID NO: 554622 - protein, 12 aa, Mycobacterium
QSLKHGKGEKLP

SEQ ID NO: 554623 - protein, 4 aa, Mycobacterium
QSLP

SEQ ID NO: 554624 - protein, 6 aa, Mycobacterium
QSLPAV

SEQ ID NO: 554625 - protein, 5 aa, Mycobacterium
QSLPD

SEQ ID NO: 554626 - protein, 5 aa, Mycobacterium
QSLPG

SEQ ID NO: 554627 - protein, 9 aa, Mycobacterium
QSLPGKAIA

SEQ ID NO: 554628 - protein, 9 aa, Mycobacterium
QSLPGKAIE

SEQ ID NO: 554629 - protein, 9 aa, Mycobacterium
QSLPGKAIQ

SEQ ID NO: 554630 - protein, 7 aa, Mycobacterium
QSLPGRA

SEQ ID NO: 554631 - protein, 13 aa, Mycobacterium
QSLPPTSEQDRER

SEQ ID NO: 554632 - protein, 16 aa, Mycobacterium
QSLPRADTGSLRGDLQ

SEQ ID NO: 554633 - protein, 29 aa, Mycobacterium
QSLPRDTNGSTVTLGGGDEDDVDVPPFMR

SEQ ID NO: 554634 - protein, 6 aa, Mycobacterium
QSLQPH

SEQ ID NO: 554635 - protein, 4 aa, Mycobacterium
QSLR

SEQ ID NO: 554636 - protein, 10 aa, Mycobacterium
QSLSAERAAS

SEQ ID NO: 554637 - protein, 7 aa, Mycobacterium
QSLSAQA

SEQ ID NO: 554638 - protein, 19 aa, Mycobacterium
QSLSATGEQCDTKSVQSGR

SEQ ID NO: 554639 - protein, 13 aa, Mycobacterium
QSLSGELTYGQSV

SEQ ID NO: 554640 - protein, 8 aa, Mycobacterium
QSLTDKPM

SEQ ID NO: 554641 - protein, 8 aa, Mycobacterium
QSLTDKPV

SEQ ID NO: 554642 - protein, 8 aa, Mycobacterium
QSLTTERP

SEQ ID NO: 554643 - protein, 5 aa, Mycobacterium
QSLYG

SEQ ID NO: 554644 - protein, 11 aa, Mycobacterium
QSMGGNGLTKE

SEQ ID NO: 554645 - protein, 11 aa, Mycobacterium
QSMGGNGLTQE

SEQ ID NO: 554646 - protein, 18 aa, Mycobacterium
QSMPDSGYNTAKAAQENL

SEQ ID NO: 554647 - protein, 11 aa, Mycobacterium
QSNAADWKEGV

SEQ ID NO: 554648 - protein, 6 aa, Mycobacterium
QSNAAT

SEQ ID NO: 554649 - protein, 7 aa, Mycobacterium
QSNAERM

SEQ ID NO: 554650 - protein, 8 aa, Mycobacterium
QSNAQRVG

SEQ ID NO: 554651 - protein, 7 aa, Mycobacterium
QSNARGK

SEQ ID NO: 554652 - protein, 7 aa, Mycobacterium
QSNDPLF

SEQ ID NO: 554653 - protein, 10 aa, Mycobacterium
QSNDPRDAQA

SEQ ID NO: 554654 - protein, 5 aa, Mycobacterium
QSNGF

SEQ ID NO: 554655 - protein, 16 aa, Mycobacterium
QSNGSRRWPATKGTVD

SEQ ID NO: 554656 - protein, 8 aa, Mycobacterium
QSNGTFGP

SEQ ID NO: 554657 - protein, 5 aa, Mycobacterium
QSNHE

SEQ ID NO: 554658 - protein, 6 aa, Mycobacterium
QSNHEG

SEQ ID NO: 554659 - protein, 7 aa, Mycobacterium
QSNIAGG

SEQ ID NO: 554660 - protein, 4 aa, Mycobacterium
QSNL

SEQ ID NO: 554661 - protein, 4 aa, Mycobacterium
QSNP

SEQ ID NO: 554662 - protein, 5 aa, Mycobacterium
QSNPD

SEQ ID NO: 554663 - protein, 7 aa, Mycobacterium
QSNPSRW

SEQ ID NO: 554664 - protein, 12 aa, Mycobacterium
QSNSLYRPGGVQ

SEQ ID NO: 554665 - protein, 4 aa, Mycobacterium
QSNT

SEQ ID NO: 554666 - protein, 5 aa, Mycobacterium
QSNTV

SEQ ID NO: 554667 - protein, 5 aa, Mycobacterium
QSNVP

SEQ ID NO: 554668 - protein, 4 aa, Mycobacterium
QSNY

SEQ ID NO: 554669 - protein, 12 aa, Mycobacterium
QSPADDLTEISD

SEQ ID NO: 554670 - protein, 7 aa, Mycobacterium
QSPAGKQ

SEQ ID NO: 554671 - protein, 6 aa, Mycobacterium
QSPAMG

SEQ ID NO: 554672 - protein, 7 aa, Mycobacterium
QSPAVEL

SEQ ID NO: 554673 - protein, 8 aa, Mycobacterium
QSPDAVDA

SEQ ID NO: 554674 - protein, 9 aa, Mycobacterium
QSPDAVGAD

SEQ ID NO: 554675 - protein, 9 aa, Mycobacterium
QSPDDVHQG

SEQ ID NO: 554676 - protein, 14 aa, Mycobacterium
QSPDWSRSYAPGRE

SEQ ID NO: 554677 - protein, 14 aa, Mycobacterium
QSPDWSRTYARGRE

SEQ ID NO: 554678 - protein, 7 aa, Mycobacterium
QSPDYQD

SEQ ID NO: 554679 - protein, 7 aa, Mycobacterium
QSPEAID

SEQ ID NO: 554680 - protein, 6 aa, Mycobacterium
QSPEHV

SEQ ID NO: 554681 - protein, 5 aa, Mycobacterium
QSPEL

SEQ ID NO: 554682 - protein, 8 aa, Mycobacterium
QSPEYQEI

SEQ ID NO: 554683 - protein, 13 aa, Mycobacterium
QSPGAFGADSYDA

SEQ ID NO: 554684 - protein, 17 aa, Mycobacterium
QSPGAGAGHGGANPPVI

SEQ ID NO: 554685 - protein, 10 aa, Mycobacterium
QSPGATPTKH

SEQ ID NO: 554686 - protein, 5 aa, Mycobacterium
QSPGH

SEQ ID NO: 554687 - protein, 6 aa, Mycobacterium
QSPGTH

SEQ ID NO: 554688 - protein, 9 aa, Mycobacterium
QSPHPDAVA

SEQ ID NO: 554689 - protein, 4 aa, Mycobacterium
QSPK

SEQ ID NO: 554690 - protein, 9 aa, Mycobacterium
QSPLAGNPE

SEQ ID NO: 554691 - protein, 5 aa, Mycobacterium
QSPLD

SEQ ID NO: 554692 - protein, 5 aa, Mycobacterium
QSPLG

SEQ ID NO: 554693 - protein, 40 aa, Mycobacterium
QSPPAVPETVPKPPSGTAPTTTPAAPSTSSETARISASRR

SEQ ID NO: 554694 - protein, 11 aa, Mycobacterium
QSPPDSANPAW

SEQ ID NO: 554695 - protein, 10 aa, Mycobacterium
QSPPGSDARE

SEQ ID NO: 554696 - protein, 16 aa, Mycobacterium
QSPPTGADREVTPPRR

SEQ ID NO: 554697 - protein, 15 aa, Mycobacterium
QSPQRPAPQPGQDTR

SEQ ID NO: 554698 - protein, 4 aa, Mycobacterium
QSPR

SEQ ID NO: 554699 - protein, 7 aa, Mycobacterium
QSPRAMA

SEQ ID NO: 554700 - protein, 16 aa, Mycobacterium
QSPREGVKVGRERKST

SEQ ID NO: 554701 - protein, 6 aa, Mycobacterium
QSPRET

SEQ ID NO: 554702 - protein, 6 aa, Mycobacterium
QSPRGL

SEQ ID NO: 554703 - protein, 6 aa, Mycobacterium
QSPRGR

SEQ ID NO: 554704 - protein, 6 aa, Mycobacterium
QSPRND

SEQ ID NO: 554705 - protein, 6 aa, Mycobacterium
QSPRWS

SEQ ID NO: 554706 - protein, 15 aa, Mycobacterium
QSPSEAQLRWELDRC

SEQ ID NO: 554707 - protein, 15 aa, Mycobacterium
QSPSEAQLRWELGGC

SEQ ID NO: 554708 - protein, 15 aa, Mycobacterium
QSPSEGQLRWELARC

SEQ ID NO: 554709 - protein, 15 aa, Mycobacterium
QSPSEGQLRWELKQY

SEQ ID NO: 554710 - protein, 15 aa, Mycobacterium
QSPSEGQLRWELTRY

SEQ ID NO: 554711 - protein, 20 aa, Mycobacterium
QSPSGDGSGKEPLPASTTES

SEQ ID NO: 554712 - protein, 8 aa, Mycobacterium
QSPSKKER

SEQ ID NO: 554713 - protein, 10 aa, Mycobacterium
QSPSPDPATG

SEQ ID NO: 554714 - protein, 7 aa, Mycobacterium
QSPSRRE

SEQ ID NO: 554715 - protein, 18 aa, Mycobacterium
QSPSRRPARGKTDETETV

SEQ ID NO: 554716 - protein, 10 aa, Mycobacterium
QSPSSGRLEK

SEQ ID NO: 554717 - protein, 5 aa, Mycobacterium
QSPTD

SEQ ID NO: 554718 - protein, 8 aa, Mycobacterium
QSPTDDDD

SEQ ID NO: 554719 - protein, 8 aa, Mycobacterium
QSPTFAGN

SEQ ID NO: 554720 - protein, 7 aa, Mycobacterium
QSPTGTA

SEQ ID NO: 554721 - protein, 10 aa, Mycobacterium
QSPTSSYEQR

SEQ ID NO: 554722 - protein, 5 aa, Mycobacterium
QSPWR

SEQ ID NO: 554723 - protein, 6 aa, Mycobacterium
QSPYDA

SEQ ID NO: 554724 - protein, 9 aa, Mycobacterium
QSQAAPADV

SEQ ID NO: 554725 - protein, 8 aa, Mycobacterium
QSQAERFN

SEQ ID NO: 554726 - protein, 11 aa, Mycobacterium
QSQAKGDLTDP

SEQ ID NO: 554727 - protein, 13 aa, Mycobacterium
QSQATAPKVKPLE

SEQ ID NO: 554728 - protein, 10 aa, Mycobacterium
QSQDAGGPAM

SEQ ID NO: 554729 - protein, 6 aa, Mycobacterium
QSQETL

SEQ ID NO: 554730 - protein, 9 aa, Mycobacterium
QSQFGENGF

SEQ ID NO: 554731 - protein, 12 aa, Mycobacterium
QSQGGGAAVNSA

SEQ ID NO: 554732 - protein, 10 aa, Mycobacterium
QSQGQGHETT

SEQ ID NO: 554733 - protein, 9 aa, Mycobacterium
QSQHDGQLA

SEQ ID NO: 554734 - protein, 6 aa, Mycobacterium
QSQKRS

SEQ ID NO: 554735 - protein, 7 aa, Mycobacterium
QSQKRSA

SEQ ID NO: 554736 - protein, 6 aa, Mycobacterium
QSQKTT

SEQ ID NO: 554737 - protein, 13 aa, Mycobacterium
QSQPANPSDPPTI

SEQ ID NO: 554738 - protein, 6 aa, Mycobacterium
QSQPSH

SEQ ID NO: 554739 - protein, 15 aa, Mycobacterium
QSQPWTGRPGAALGE

SEQ ID NO: 554740 - protein, 16 aa, Mycobacterium
QSQQNPGDHTSQQGRT

SEQ ID NO: 554741 - protein, 5 aa, Mycobacterium
QSQQS

SEQ ID NO: 554742 - protein, 8 aa, Mycobacterium
QSQQSGAP

SEQ ID NO: 554743 - protein, 4 aa, Mycobacterium
QSQR

SEQ ID NO: 554744 - protein, 6 aa, Mycobacterium
QSQRQT

SEQ ID NO: 554745 - protein, 9 aa, Mycobacterium
QSQSGSNAY

SEQ ID NO: 554746 - protein, 12 aa, Mycobacterium
QSQTDRARFDDT

SEQ ID NO: 554747 - protein, 7 aa, Mycobacterium
QSQTSVD

SEQ ID NO: 554748 - protein, 13 aa, Mycobacterium
QSQVRNKRKLQQA

SEQ ID NO: 554749 - protein, 4 aa, Mycobacterium
QSRA

SEQ ID NO: 554750 - protein, 7 aa, Mycobacterium
QSRANVD

SEQ ID NO: 554751 - protein, 6 aa, Mycobacterium
QSRDTA

SEQ ID NO: 554752 - protein, 12 aa, Mycobacterium
QSREDQPPTQDV

SEQ ID NO: 554753 - protein, 6 aa, Mycobacterium
QSREEA

SEQ ID NO: 554754 - protein, 8 aa, Mycobacterium
QSREGAWS

SEQ ID NO: 554755 - protein, 5 aa, Mycobacterium
QSRET

SEQ ID NO: 554756 - protein, 4 aa, Mycobacterium
QSRG

SEQ ID NO: 554757 - protein, 28 aa, Mycobacterium
QSRGDAGLGAAPTRPSRSFRPGCSPDRR

SEQ ID NO: 554758 - protein, 7 aa, Mycobacterium
QSRGGIT

SEQ ID NO: 554759 - protein, 9 aa, Mycobacterium
QSRGGTLRR

SEQ ID NO: 554760 - protein, 10 aa, Mycobacterium
QSRGLDPDTI

SEQ ID NO: 554761 - protein, 6 aa, Mycobacterium
QSRGQI

SEQ ID NO: 554762 - protein, 9 aa, Mycobacterium
QSRGTLAQQ

SEQ ID NO: 554763 - protein, 6 aa, Mycobacterium
QSRKAW

SEQ ID NO: 554764 - protein, 8 aa, Mycobacterium
QSRKGPYE

SEQ ID NO: 554765 - protein, 15 aa, Mycobacterium
QSRLEDAAARQPVRG

SEQ ID NO: 554766 - protein, 5 aa, Mycobacterium
QSRLP

SEQ ID NO: 554767 - protein, 7 aa, Mycobacterium
QSRMRGD

SEQ ID NO: 554768 - protein, 6 aa, Mycobacterium
QSRNGE

SEQ ID NO: 554769 - protein, 8 aa, Mycobacterium
QSRNGKDL

SEQ ID NO: 554770 - protein, 9 aa, Mycobacterium
QSRNPEHDK

SEQ ID NO: 554771 - protein, 4 aa, Mycobacterium
QSRP

SEQ ID NO: 554772 - protein, 15 aa, Mycobacterium
QSRPAETAAAIRSHL

SEQ ID NO: 554773 - protein, 8 aa, Mycobacterium
QSRPDTGA

SEQ ID NO: 554774 - protein, 9 aa, Mycobacterium
QSRPGAQDA

SEQ ID NO: 554775 - protein, 13 aa, Mycobacterium
QSRPGDQGGVRDA

SEQ ID NO: 554776 - protein, 17 aa, Mycobacterium
QSRPGSSMGAKPITRPY

SEQ ID NO: 554777 - protein, 8 aa, Mycobacterium
QSRPLPPD

SEQ ID NO: 554778 - protein, 7 aa, Mycobacterium
QSRPRRA

SEQ ID NO: 554779 - protein, 13 aa, Mycobacterium
QSRQFGRGAPPLI

SEQ ID NO: 554780 - protein, 12 aa, Mycobacterium
QSRQHGDGGSVM

SEQ ID NO: 554781 - protein, 10 aa, Mycobacterium
QSRRAARKAG

SEQ ID NO: 554782 - protein, 11 aa, Mycobacterium
QSRRDSADGQR

SEQ ID NO: 554783 - protein, 23 aa, Mycobacterium
QSRRGERQASSISPSGMTADRPN

SEQ ID NO: 554784 - protein, 6 aa, Mycobacterium
QSRRGS

SEQ ID NO: 554785 - protein, 5 aa, Mycobacterium
QSRRP

SEQ ID NO: 554786 - protein, 25 aa, Mycobacterium
QSRRPAGDDVRTAAPEGLEGEFDDQ

SEQ ID NO: 554787 - protein, 9 aa, Mycobacterium
QSRRRGVGT

SEQ ID NO: 554788 - protein, 4 aa, Mycobacterium
QSRS

SEQ ID NO: 554789 - protein, 9 aa, Mycobacterium
QSRSGPPQV

SEQ ID NO: 554790 - protein, 15 aa, Mycobacterium
QSRSRADTFGPDGGE

SEQ ID NO: 554791 - protein, 4 aa, Mycobacterium
QSRT

SEQ ID NO: 554792 - protein, 8 aa, Mycobacterium
QSRTAGTV

SEQ ID NO: 554793 - protein, 11 aa, Mycobacterium
QSRTDTATEAI

SEQ ID NO: 554794 - protein, 6 aa, Mycobacterium
QSRTGL

SEQ ID NO: 554795 - protein, 8 aa, Mycobacterium
QSRTQTAP

SEQ ID NO: 554796 - protein, 10 aa, Mycobacterium
QSRTRPTGIE

SEQ ID NO: 554797 - protein, 16 aa, Mycobacterium
QSRVPGVTATPGHGTQ

SEQ ID NO: 554798 - protein, 7 aa, Mycobacterium
QSRYART

SEQ ID NO: 554799 - protein, 13 aa, Mycobacterium
QSSAAATAPQGLA

SEQ ID NO: 554800 - protein, 16 aa, Mycobacterium
QSSAGSSGTTAGSGGS

SEQ ID NO: 554801 - protein, 10 aa, Mycobacterium
QSSASGKGSI

SEQ ID NO: 554802 - protein, 5 aa, Mycobacterium
QSSAV

SEQ ID NO: 554803 - protein, 6 aa, Mycobacterium
QSSDGL

SEQ ID NO: 554804 - protein, 6 aa, Mycobacterium
QSSDSV

SEQ ID NO: 554805 - protein, 5 aa, Mycobacterium
QSSDW

SEQ ID NO: 554806 - protein, 9 aa, Mycobacterium
QSSEANGGH

SEQ ID NO: 554807 - protein, 8 aa, Mycobacterium
QSSEGQQA

SEQ ID NO: 554808 - protein, 7 aa, Mycobacterium
QSSEGSF

SEQ ID NO: 554809 - protein, 7 aa, Mycobacterium
QSSEHNR

SEQ ID NO: 554810 - protein, 11 aa, Mycobacterium
QSSEQSSPAEP

SEQ ID NO: 554811 - protein, 8 aa, Mycobacterium
QSSEWKDG

SEQ ID NO: 554812 - protein, 5 aa, Mycobacterium
QSSGA

SEQ ID NO: 554813 - protein, 9 aa, Mycobacterium
QSSGDQLPG

SEQ ID NO: 554814 - protein, 8 aa, Mycobacterium
QSSGGASL

SEQ ID NO: 554815 - protein, 6 aa, Mycobacterium
QSSGGV

SEQ ID NO: 554816 - protein, 5 aa, Mycobacterium
QSSGR

SEQ ID NO: 554817 - protein, 8 aa, Mycobacterium
QSSGRPSV

SEQ ID NO: 554818 - protein, 4 aa, Mycobacterium
QSSI

SEQ ID NO: 554819 - protein, 11 aa, Mycobacterium
QSSIDDPQLDT

SEQ ID NO: 554820 - protein, 11 aa, Mycobacterium
QSSIDDPQLET

SEQ ID NO: 554821 - protein, 9 aa, Mycobacterium
QSSKDAAAA

SEQ ID NO: 554822 - protein, 10 aa, Mycobacterium
QSSKDAAAAC

SEQ ID NO: 554823 - protein, 9 aa, Mycobacterium
QSSKDAATA

SEQ ID NO: 554824 - protein, 9 aa, Mycobacterium
QSSKDASAA

SEQ ID NO: 554825 - protein, 8 aa, Mycobacterium
QSSKTRAG

SEQ ID NO: 554826 - protein, 5 aa, Mycobacterium
QSSLP

SEQ ID NO: 554827 - protein, 15 aa, Mycobacterium
QSSLPAEYDGPRSAG

SEQ ID NO: 554828 - protein, 9 aa, Mycobacterium
QSSLPDTYP

SEQ ID NO: 554829 - protein, 15 aa, Mycobacterium
QSSLRAADAALQATG

SEQ ID NO: 554830 - protein, 8 aa, Mycobacterium
QSSLSHPE

SEQ ID NO: 554831 - protein, 8 aa, Mycobacterium
QSSLSHPQ

SEQ ID NO: 554832 - protein, 11 aa, Mycobacterium
QSSLSPDAQRR

SEQ ID NO: 554833 - protein, 13 aa, Mycobacterium
QSSLTQDAEIAQR

SEQ ID NO: 554834 - protein, 11 aa, Mycobacterium
QSSPASHDEEL

SEQ ID NO: 554835 - protein, 8 aa, Mycobacterium
QSSPATSM

SEQ ID NO: 554836 - protein, 33 aa, Mycobacterium
QSSPPNHSSTGAAGSQKKPQSYQPVGPGNHGPT

SEQ ID NO: 554837 - protein, 15 aa, Mycobacterium
QSSPSACGGRSLTQG

SEQ ID NO: 554838 - protein, 12 aa, Mycobacterium
QSSPSAGGGRAL

SEQ ID NO: 554839 - protein, 11 aa, Mycobacterium
QSSPSANGGRA

SEQ ID NO: 554840 - protein, 12 aa, Mycobacterium
QSSPSASGGRSL

SEQ ID NO: 554841 - protein, 11 aa, Mycobacterium
QSSRDAAAACE

SEQ ID NO: 554842 - protein, 17 aa, Mycobacterium
QSSRRAQPEPQWTDASR

SEQ ID NO: 554843 - protein, 17 aa, Mycobacterium
QSSRRARPAPQWTDATR

SEQ ID NO: 554844 - protein, 6 aa, Mycobacterium
QSSSGE

SEQ ID NO: 554845 - protein, 7 aa, Mycobacterium
QSSSRAD

SEQ ID NO: 554846 - protein, 11 aa, Mycobacterium
QSSTAEQTSGW

SEQ ID NO: 554847 - protein, 9 aa, Mycobacterium
QSSTDPAAN

SEQ ID NO: 554848 - protein, 4 aa, Mycobacterium
QSSV

SEQ ID NO: 554849 - protein, 7 aa, Mycobacterium
QSSYTSG

SEQ ID NO: 554850 - protein, 15 aa, Mycobacterium
QSTAGFAEGHPLPLG

SEQ ID NO: 554851 - protein, 6 aa, Mycobacterium
QSTASR

SEQ ID NO: 554852 - protein, 6 aa, Mycobacterium
QSTATE

SEQ ID NO: 554853 - protein, 8 aa, Mycobacterium
QSTDREAL

SEQ ID NO: 554854 - protein, 9 aa, Mycobacterium
QSTDREALA

SEQ ID NO: 554855 - protein, 10 aa, Mycobacterium
QSTDTPMPAM

SEQ ID NO: 554856 - protein, 15 aa, Mycobacterium
QSTDTRPEELKTQGV

SEQ ID NO: 554857 - protein, 8 aa, Mycobacterium
QSTEALDD

SEQ ID NO: 554858 - protein, 7 aa, Mycobacterium
QSTEARR

SEQ ID NO: 554859 - protein, 9 aa, Mycobacterium
QSTEGGQVA

SEQ ID NO: 554860 - protein, 19 aa, Mycobacterium
QSTEQSVTGGRETFGEPKK

SEQ ID NO: 554861 - protein, 8 aa, Mycobacterium
QSTESGRV

SEQ ID NO: 554862 - protein, 15 aa, Mycobacterium
QSTEWSRTYAPGREL

SEQ ID NO: 554863 - protein, 4 aa, Mycobacterium
QSTF

SEQ ID NO: 554864 - protein, 7 aa, Mycobacterium
QSTFGYT

SEQ ID NO: 554865 - protein, 6 aa, Mycobacterium
QSTFPE

SEQ ID NO: 554866 - protein, 6 aa, Mycobacterium
QSTGAE

SEQ ID NO: 554867 - protein, 6 aa, Mycobacterium
QSTGDV

SEQ ID NO: 554868 - protein, 17 aa, Mycobacterium
QSTGEHRKPRTFTQSTK

SEQ ID NO: 554869 - protein, 19 aa, Mycobacterium
QSTGETTLHSDAPGHAEAD

SEQ ID NO: 554870 - protein, 31 aa, Mycobacterium
QSTGLSELKTASDSFEAQAARDGLVEGSGAL

SEQ ID NO: 554871 - protein, 5 aa, Mycobacterium
QSTGN

SEQ ID NO: 554872 - protein, 6 aa, Mycobacterium
QSTGNA

SEQ ID NO: 554873 - protein, 10 aa, Mycobacterium
QSTGNIGPGT

SEQ ID NO: 554874 - protein, 9 aa, Mycobacterium
QSTHDRDQV

SEQ ID NO: 554875 - protein, 9 aa, Mycobacterium
QSTHGAGTY

SEQ ID NO: 554876 - protein, 6 aa, Mycobacterium
QSTHTP

SEQ ID NO: 554877 - protein, 4 aa, Mycobacterium
QSTI

SEQ ID NO: 554878 - protein, 16 aa, Mycobacterium
QSTKRNRDIASRSNEV

SEQ ID NO: 554879 - protein, 4 aa, Mycobacterium
QSTL

SEQ ID NO: 554880 - protein, 5 aa, Mycobacterium
QSTLA

SEQ ID NO: 554881 - protein, 13 aa, Mycobacterium
QSTLDGGNEPGYL

SEQ ID NO: 554882 - protein, 10 aa, Mycobacterium
QSTLSANPVN

SEQ ID NO: 554883 - protein, 5 aa, Mycobacterium
QSTNG

SEQ ID NO: 554884 - protein, 20 aa, Mycobacterium
QSTNTVNYSGELPLAQGVEF

SEQ ID NO: 554885 - protein, 9 aa, Mycobacterium
QSTPAQREG

SEQ ID NO: 554886 - protein, 6 aa, Mycobacterium
QSTPLA

SEQ ID NO: 554887 - protein, 7 aa, Mycobacterium
QSTPNSI

SEQ ID NO: 554888 - protein, 4 aa, Mycobacterium
QSTR

SEQ ID NO: 554889 - protein, 6 aa, Mycobacterium
QSTRDA

SEQ ID NO: 554890 - protein, 7 aa, Mycobacterium
QSTSAST

SEQ ID NO: 554891 - protein, 9 aa, Mycobacterium
QSTSEGSPR

SEQ ID NO: 554892 - protein, 7 aa, Mycobacterium
QSTSGPL

SEQ ID NO: 554893 - protein, 6 aa, Mycobacterium
QSTSRR

SEQ ID NO: 554894 - protein, 5 aa, Mycobacterium
QSTTA

SEQ ID NO: 554895 - protein, 9 aa, Mycobacterium
QSTTQPGVY

SEQ ID NO: 554896 - protein, 10 aa, Mycobacterium
QSTTQPGVYA

SEQ ID NO: 554897 - protein, 15 aa, Mycobacterium
QSTTSKDNPDPAMTS

SEQ ID NO: 554898 - protein, 13 aa, Mycobacterium
QSTTSSTSPTGQR

SEQ ID NO: 554899 - protein, 11 aa, Mycobacterium
QSTVDGTGHTP

SEQ ID NO: 554900 - protein, 8 aa, Mycobacterium
QSVAGERD

SEQ ID NO: 554901 - protein, 9 aa, Mycobacterium
QSVEAGRRR

SEQ ID NO: 554902 - protein, 6 aa, Mycobacterium
QSVEGE

SEQ ID NO: 554903 - protein, 6 aa, Mycobacterium
QSVGDA

SEQ ID NO: 554904 - protein, 8 aa, Mycobacterium
QSVKAAPS

SEQ ID NO: 554905 - protein, 16 aa, Mycobacterium
QSVKKAAGDSPREVPK

SEQ ID NO: 554906 - protein, 6 aa, Mycobacterium
QSVPNS

SEQ ID NO: 554907 - protein, 8 aa, Mycobacterium
QSVRSQSE

SEQ ID NO: 554908 - protein, 16 aa, Mycobacterium
QSVSDRGAKRLLEMLS

SEQ ID NO: 554909 - protein, 7 aa, Mycobacterium
QSVSPGV

SEQ ID NO: 554910 - protein, 4 aa, Mycobacterium
QSVT

SEQ ID NO: 554911 - protein, 14 aa, Mycobacterium
QSVTDGQPLAKPQV

SEQ ID NO: 554912 - protein, 9 aa, Mycobacterium
QSVTRGYTT

SEQ ID NO: 554913 - protein, 7 aa, Mycobacterium
QSVTSTE

SEQ ID NO: 554914 - protein, 5 aa, Mycobacterium
QSWGA

SEQ ID NO: 554915 - protein, 10 aa, Mycobacterium
QSWGRDPNTM

SEQ ID NO: 554916 - protein, 14 aa, Mycobacterium
QSWKAPKPREDAAQ

SEQ ID NO: 554917 - protein, 13 aa, Mycobacterium
QSWKKPPPRDDAD

SEQ ID NO: 554918 - protein, 4 aa, Mycobacterium
QSWQ

SEQ ID NO: 554919 - protein, 6 aa, Mycobacterium
QSWQPD

SEQ ID NO: 554920 - protein, 6 aa, Mycobacterium
QSWSGG

SEQ ID NO: 554921 - protein, 7 aa, Mycobacterium
QSYAGDL

SEQ ID NO: 554922 - protein, 12 aa, Mycobacterium
QSYDEVKKKTDG

SEQ ID NO: 554923 - protein, 6 aa, Mycobacterium
QSYDGP

SEQ ID NO: 554924 - protein, 10 aa, Mycobacterium
QSYEDSPMGR

SEQ ID NO: 554925 - protein, 8 aa, Mycobacterium
QSYQPERK

SEQ ID NO: 554926 - protein, 4 aa, Mycobacterium
QSYR

SEQ ID NO: 554927 - protein, 18 aa, Mycobacterium
QSYRANSLRTAQRAHAPE

SEQ ID NO: 554928 - protein, 7 aa, Mycobacterium
QSYTPNA

SEQ ID NO: 554929 - protein, 11 aa, Mycobacterium
QTAAAAGIPTA

SEQ ID NO: 554930 - protein, 8 aa, Mycobacterium
QTAAEAVK

SEQ ID NO: 554931 - protein, 5 aa, Mycobacterium
QTAAG

SEQ ID NO: 554932 - protein, 9 aa, Mycobacterium
QTAANSAVG

SEQ ID NO: 554933 - protein, 6 aa, Mycobacterium
QTAANV

SEQ ID NO: 554934 - protein, 7 aa, Mycobacterium
QTAAPGH

SEQ ID NO: 554935 - protein, 10 aa, Mycobacterium
QTAASSSGHP

SEQ ID NO: 554936 - protein, 10 aa, Mycobacterium
QTAATALQSS

SEQ ID NO: 554937 - protein, 4 aa, Mycobacterium
QTAD

SEQ ID NO: 554938 - protein, 5 aa, Mycobacterium
QTADA

SEQ ID NO: 554939 - protein, 5 aa, Mycobacterium
QTADD

SEQ ID NO: 554940 - protein, 21 aa, Mycobacterium
QTADDPDAEEQRELEARAAGL

SEQ ID NO: 554941 - protein, 6 aa, Mycobacterium
QTADGT

SEQ ID NO: 554942 - protein, 7 aa, Mycobacterium
QTADIPD

SEQ ID NO: 554943 - protein, 16 aa, Mycobacterium
QTADSSQDRPSLTERE

SEQ ID NO: 554944 - protein, 8 aa, Mycobacterium
QTAEEAAS

SEQ ID NO: 554945 - protein, 5 aa, Mycobacterium
QTAEN

SEQ ID NO: 554946 - protein, 11 aa, Mycobacterium
QTAETAAEPAD

SEQ ID NO: 554947 - protein, 11 aa, Mycobacterium
QTAEVGRTRQR

SEQ ID NO: 554948 - protein, 15 aa, Mycobacterium
QTAGAADRTSGQLET

SEQ ID NO: 554949 - protein, 9 aa, Mycobacterium
QTAGATDPV

SEQ ID NO: 554950 - protein, 10 aa, Mycobacterium
QTAGATTSSE

SEQ ID NO: 554951 - protein, 10 aa, Mycobacterium
QTAGDKRTLA

SEQ ID NO: 554952 - protein, 9 aa, Mycobacterium
QTAGERPIP

SEQ ID NO: 554953 - protein, 12 aa, Mycobacterium
QTAGGITPDEAR

SEQ ID NO: 554954 - protein, 12 aa, Mycobacterium
QTAGNDSTAREF

SEQ ID NO: 554955 - protein, 17 aa, Mycobacterium
QTAGQQLAEKAAEAMAA

SEQ ID NO: 554956 - protein, 19 aa, Mycobacterium
QTAGRGRHGRGWSATPRAQ

SEQ ID NO: 554957 - protein, 19 aa, Mycobacterium
QTAGRGRHGRGWTAAPRAQ

SEQ ID NO: 554958 - protein, 18 aa, Mycobacterium
QTAGRGRHGRSWGAPAHT

SEQ ID NO: 554959 - protein, 19 aa, Mycobacterium
QTAGRGRHGRTWSAPPRSQ

SEQ ID NO: 554960 - protein, 9 aa, Mycobacterium
QTAGRGRLG

SEQ ID NO: 554961 - protein, 19 aa, Mycobacterium
QTAGRGRQGRGWSATPRTQ

SEQ ID NO: 554962 - protein, 18 aa, Mycobacterium
QTAGSNMASTDSAVGSSW

SEQ ID NO: 554963 - protein, 24 aa, Mycobacterium
QTAIDQSPAGRPSMSAPRTEKPFP

SEQ ID NO: 554964 - protein, 13 aa, Mycobacterium
QTALNDAAEGTAV

SEQ ID NO: 554965 - protein, 10 aa, Mycobacterium
QTAMTAPGGV

SEQ ID NO: 554966 - protein, 12 aa, Mycobacterium
QTANDVTARNTL

SEQ ID NO: 554967 - protein, 6 aa, Mycobacterium
QTANGV

SEQ ID NO: 554968 - protein, 5 aa, Mycobacterium
QTANR

SEQ ID NO: 554969 - protein, 5 aa, Mycobacterium
QTAPA

SEQ ID NO: 554970 - protein, 6 aa, Mycobacterium
QTAPGF

SEQ ID NO: 554971 - protein, 5 aa, Mycobacterium
QTAPR

SEQ ID NO: 554972 - protein, 11 aa, Mycobacterium
QTAPSPTDQRE

SEQ ID NO: 554973 - protein, 5 aa, Mycobacterium
QTAPV

SEQ ID NO: 554974 - protein, 5 aa, Mycobacterium
QTAPW

SEQ ID NO: 554975 - protein, 4 aa, Mycobacterium
QTAQ

SEQ ID NO: 554976 - protein, 7 aa, Mycobacterium
QTAQEIA

SEQ ID NO: 554977 - protein, 10 aa, Mycobacterium
QTAQNGISHQ

SEQ ID NO: 554978 - protein, 7 aa, Mycobacterium
QTARDFA

SEQ ID NO: 554979 - protein, 10 aa, Mycobacterium
QTARDLPQTA

SEQ ID NO: 554980 - protein, 5 aa, Mycobacterium
QTARE

SEQ ID NO: 554981 - protein, 5 aa, Mycobacterium
QTARF

SEQ ID NO: 554982 - protein, 8 aa, Mycobacterium
QTARGATA

SEQ ID NO: 554983 - protein, 6 aa, Mycobacterium
QTARRH

SEQ ID NO: 554984 - protein, 13 aa, Mycobacterium
QTARSCADDPAQA

SEQ ID NO: 554985 - protein, 10 aa, Mycobacterium
QTARSGAGVL

SEQ ID NO: 554986 - protein, 5 aa, Mycobacterium
QTASA

SEQ ID NO: 554987 - protein, 6 aa, Mycobacterium
QTASFT

SEQ ID NO: 554988 - protein, 5 aa, Mycobacterium
QTASG

SEQ ID NO: 554989 - protein, 12 aa, Mycobacterium
QTASIGGGTTEM

SEQ ID NO: 554990 - protein, 10 aa, Mycobacterium
QTASLAREHN

SEQ ID NO: 554991 - protein, 8 aa, Mycobacterium
QTATEASG

SEQ ID NO: 554992 - protein, 13 aa, Mycobacterium
QTATGLSANGVEH

SEQ ID NO: 554993 - protein, 8 aa, Mycobacterium
QTATSRHI

SEQ ID NO: 554994 - protein, 7 aa, Mycobacterium
QTATSSI

SEQ ID NO: 554995 - protein, 4 aa, Mycobacterium
QTAV

SEQ ID NO: 554996 - protein, 30 aa, Mycobacterium
QTCDSQGTRTGRHPPDPAANSRARSRRWPG

SEQ ID NO: 554997 - protein, 18 aa, Mycobacterium
QTDAAAGAMPGLSQPAAK

SEQ ID NO: 554998 - protein, 15 aa, Mycobacterium
QTDAASAPPADDVGD

SEQ ID NO: 554999 - protein, 17 aa, Mycobacterium
QTDAEKRAAVETTPARK

SEQ ID NO: 555000 - protein, 8 aa, Mycobacterium
QTDARHTV

SEQ ID NO: 555001 - protein, 9 aa, Mycobacterium
QTDATTGTP

SEQ ID NO: 555002 - protein, 5 aa, Mycobacterium
QTDDG

SEQ ID NO: 555003 - protein, 9 aa, Mycobacterium
QTDDGAAQQ

SEQ ID NO: 555004 - protein, 6 aa, Mycobacterium
QTDDGV

SEQ ID NO: 555005 - protein, 10 aa, Mycobacterium
QTDEPDPAFT

SEQ ID NO: 555006 - protein, 10 aa, Mycobacterium
QTDESGATKR

SEQ ID NO: 555007 - protein, 10 aa, Mycobacterium
QTDETGATKR

SEQ ID NO: 555008 - protein, 8 aa, Mycobacterium
QTDEYAQY

SEQ ID NO: 555009 - protein, 4 aa, Mycobacterium
QTDF

SEQ ID NO: 555010 - protein, 41 aa, Mycobacterium
QTDGPAALPPLPPSSPRRRPQTHSRTRHADGSPPSRKNSHG

SEQ ID NO: 555011 - protein, 44 aa, Mycobacterium
QTDGPTALPPLPPSAPRRRPQTHSRTRHAAEGSPPGRKNGHGPG

SEQ ID NO: 555012 - protein, 15 aa, Mycobacterium
QTDHPAGSGTAESLN

SEQ ID NO: 555013 - protein, 4 aa, Mycobacterium
QTDI

SEQ ID NO: 555014 - protein, 6 aa, Mycobacterium
QTDKAS

SEQ ID NO: 555015 - protein, 5 aa, Mycobacterium
QTDKR

SEQ ID NO: 555016 - protein, 10 aa, Mycobacterium
QTDLDDPDAV

SEQ ID NO: 555017 - protein, 17 aa, Mycobacterium
QTDLESDGVIGYWPSPC

SEQ ID NO: 555018 - protein, 6 aa, Mycobacterium
QTDPDR

SEQ ID NO: 555019 - protein, 6 aa, Mycobacterium
QTDPYT

SEQ ID NO: 555020 - protein, 27 aa, Mycobacterium
QTDRVGAAERKAARRERRQPGESGGED

SEQ ID NO: 555021 - protein, 6 aa, Mycobacterium
QTDRYA

SEQ ID NO: 555022 - protein, 14 aa, Mycobacterium
QTDSAWSENPLSRT

SEQ ID NO: 555023 - protein, 5 aa, Mycobacterium
QTDSE

SEQ ID NO: 555024 - protein, 4 aa, Mycobacterium
QTDT

SEQ ID NO: 555025 - protein, 9 aa, Mycobacterium
QTDTGSSSD

SEQ ID NO: 555026 - protein, 7 aa, Mycobacterium
QTDVERA

SEQ ID NO: 555027 - protein, 5 aa, Mycobacterium
QTDYN

SEQ ID NO: 555028 - protein, 8 aa, Mycobacterium
QTEAGAEL

SEQ ID NO: 555029 - protein, 8 aa, Mycobacterium
QTEANRSA

SEQ ID NO: 555030 - protein, 9 aa, Mycobacterium
QTEDRVENG

SEQ ID NO: 555031 - protein, 6 aa, Mycobacterium
QTEFPE

SEQ ID NO: 555032 - protein, 4 aa, Mycobacterium
QTEG

SEQ ID NO: 555033 - protein, 9 aa, Mycobacterium
QTEGGRERI

SEQ ID NO: 555034 - protein, 9 aa, Mycobacterium
QTEGNPEPL

SEQ ID NO: 555035 - protein, 7 aa, Mycobacterium
QTEGSGF

SEQ ID NO: 555036 - protein, 7 aa, Mycobacterium
QTEIGGR

SEQ ID NO: 555037 - protein, 5 aa, Mycobacterium
QTELA

SEQ ID NO: 555038 - protein, 7 aa, Mycobacterium
QTEPGRD

SEQ ID NO: 555039 - protein, 12 aa, Mycobacterium
QTEQASGGDNRE

SEQ ID NO: 555040 - protein, 9 aa, Mycobacterium
QTEQGMTEP

SEQ ID NO: 555041 - protein, 5 aa, Mycobacterium
QTERM

SEQ ID NO: 555042 - protein, 5 aa, Mycobacterium
QTERP

SEQ ID NO: 555043 - protein, 5 aa, Mycobacterium
QTERT

SEQ ID NO: 555044 - protein, 17 aa, Mycobacterium
QTESASSQAAEQRFDDG

SEQ ID NO: 555045 - protein, 9 aa, Mycobacterium
QTESEGGFS

SEQ ID NO: 555046 - protein, 6 aa, Mycobacterium
QTETGI

SEQ ID NO: 555047 - protein, 8 aa, Mycobacterium
QTETPLPA

SEQ ID NO: 555048 - protein, 10 aa, Mycobacterium
QTEWGSAGDR

SEQ ID NO: 555049 - protein, 11 aa, Mycobacterium
QTFGGGARTAA

SEQ ID NO: 555050 - protein, 6 aa, Mycobacterium
QTFGRD

SEQ ID NO: 555051 - protein, 11 aa, Mycobacterium
QTFNDPDKLSR

SEQ ID NO: 555052 - protein, 6 aa, Mycobacterium
QTFRGP

SEQ ID NO: 555053 - protein, 15 aa, Mycobacterium
QTFTGAANAEATGSF

SEQ ID NO: 555054 - protein, 10 aa, Mycobacterium
QTGAAERATV

SEQ ID NO: 555055 - protein, 5 aa, Mycobacterium
QTGAG

SEQ ID NO: 555056 - protein, 8 aa, Mycobacterium
QTGAPMPT

SEQ ID NO: 555057 - protein, 8 aa, Mycobacterium
QTGAPPTD

SEQ ID NO: 555058 - protein, 7 aa, Mycobacterium
QTGAQVT

SEQ ID NO: 555059 - protein, 6 aa, Mycobacterium
QTGASK

SEQ ID NO: 555060 - protein, 5 aa, Mycobacterium
QTGAT

SEQ ID NO: 555061 - protein, 35 aa, Mycobacterium
QTGATVTQSTAASAPETSIAKPPFTWTTPEGFAVP

SEQ ID NO: 555062 - protein, 15 aa, Mycobacterium
QTGAVPDGAADYPET

SEQ ID NO: 555063 - protein, 9 aa, Mycobacterium
QTGDEVSAQ

SEQ ID NO: 555064 - protein, 10 aa, Mycobacterium
QTGDKTEPFS

SEQ ID NO: 555065 - protein, 4 aa, Mycobacterium
QTGE

SEQ ID NO: 555066 - protein, 11 aa, Mycobacterium
QTGEAPAAASA

SEQ ID NO: 555067 - protein, 8 aa, Mycobacterium
QTGEDTKP

SEQ ID NO: 555068 - protein, 6 aa, Mycobacterium
QTGEHR

SEQ ID NO: 555069 - protein, 11 aa, Mycobacterium
QTGEPQSGSEW

SEQ ID NO: 555070 - protein, 11 aa, Mycobacterium
QTGEPQSGTEW

SEQ ID NO: 555071 - protein, 6 aa, Mycobacterium
QTGGCP

SEQ ID NO: 555072 - protein, 5 aa, Mycobacterium
QTGGD

SEQ ID NO: 555073 - protein, 10 aa, Mycobacterium
QTGGDLDEAE

SEQ ID NO: 555074 - protein, 6 aa, Mycobacterium
QTGGDY

SEQ ID NO: 555075 - protein, 5 aa, Mycobacterium
QTGGE

SEQ ID NO: 555076 - protein, 6 aa, Mycobacterium
QTGGGE

SEQ ID NO: 555077 - protein, 11 aa, Mycobacterium
QTGGIETEELK

SEQ ID NO: 555078 - protein, 6 aa, Mycobacterium
QTGGRL

SEQ ID NO: 555079 - protein, 6 aa, Mycobacterium
QTGGSR

SEQ ID NO: 555080 - protein, 10 aa, Mycobacterium
QTGHQPAGLP

SEQ ID NO: 555081 - protein, 5 aa, Mycobacterium
QTGIA

SEQ ID NO: 555082 - protein, 6 aa, Mycobacterium
QTGIAR

SEQ ID NO: 555083 - protein, 11 aa, Mycobacterium
QTGLAQKGGAV

SEQ ID NO: 555084 - protein, 5 aa, Mycobacterium
QTGLC

SEQ ID NO: 555085 - protein, 5 aa, Mycobacterium
QTGLD

SEQ ID NO: 555086 - protein, 6 aa, Mycobacterium
QTGLRR

SEQ ID NO: 555087 - protein, 9 aa, Mycobacterium
QTGNAEKFA

SEQ ID NO: 555088 - protein, 9 aa, Mycobacterium
QTGNAETAA

SEQ ID NO: 555089 - protein, 19 aa, Mycobacterium
QTGNTNLTNAVTSATSSAY

SEQ ID NO: 555090 - protein, 13 aa, Mycobacterium
QTGPAGSLGPEQR

SEQ ID NO: 555091 - protein, 5 aa, Mycobacterium
QTGPD

SEQ ID NO: 555092 - protein, 10 aa, Mycobacterium
QTGPDPDNDE

SEQ ID NO: 555093 - protein, 5 aa, Mycobacterium
QTGPF

SEQ ID NO: 555094 - protein, 6 aa, Mycobacterium
QTGPFR

SEQ ID NO: 555095 - protein, 7 aa, Mycobacterium
QTGPFRP

SEQ ID NO: 555096 - protein, 8 aa, Mycobacterium
QTGPFRPA

SEQ ID NO: 555097 - protein, 13 aa, Mycobacterium
QTGPFRPGNTVRG

SEQ ID NO: 555098 - protein, 9 aa, Mycobacterium
QTGQGLANG

SEQ ID NO: 555099 - protein, 6 aa, Mycobacterium
QTGQLD

SEQ ID NO: 555100 - protein, 29 aa, Mycobacterium
QTGQQPVPVATDDDGPVLEGGAAGQRPRH

SEQ ID NO: 555101 - protein, 6 aa, Mycobacterium
QTGQQV

SEQ ID NO: 555102 - protein, 9 aa, Mycobacterium
QTGQSLAGS

SEQ ID NO: 555103 - protein, 17 aa, Mycobacterium
QTGQSSATSLAGNLGGG

SEQ ID NO: 555104 - protein, 21 aa, Mycobacterium
QTGRPHRPGPSTAPAPKPPGV

SEQ ID NO: 555105 - protein, 5 aa, Mycobacterium
QTGRS

SEQ ID NO: 555106 - protein, 10 aa, Mycobacterium
QTGRTDTDEH

SEQ ID NO: 555107 - protein, 6 aa, Mycobacterium
QTGRVQ

SEQ ID NO: 555108 - protein, 7 aa, Mycobacterium
QTGSAGV

SEQ ID NO: 555109 - protein, 12 aa, Mycobacterium
QTGSAPDPRVRG

SEQ ID NO: 555110 - protein, 8 aa, Mycobacterium
QTGSDGAR

SEQ ID NO: 555111 - protein, 8 aa, Mycobacterium
QTGSQTLK

SEQ ID NO: 555112 - protein, 6 aa, Mycobacterium
QTGSRD

SEQ ID NO: 555113 - protein, 7 aa, Mycobacterium
QTGSSLT

SEQ ID NO: 555114 - protein, 8 aa, Mycobacterium
QTGTAEEF

SEQ ID NO: 555115 - protein, 11 aa, Mycobacterium
QTGTAEEFAGS

SEQ ID NO: 555116 - protein, 8 aa, Mycobacterium
QTGTAEEL

SEQ ID NO: 555117 - protein, 30 aa, Mycobacterium
QTGTANSGFANSGTSSSGGLNKGDQQSGFG

SEQ ID NO: 555118 - protein, 7 aa, Mycobacterium
QTGTARV

SEQ ID NO: 555119 - protein, 8 aa, Mycobacterium
QTGTEAHD

SEQ ID NO: 555120 - protein, 16 aa, Mycobacterium
QTGTFAQSGRSGGRPA

SEQ ID NO: 555121 - protein, 10 aa, Mycobacterium
QTGTGIGDDD

SEQ ID NO: 555122 - protein, 9 aa, Mycobacterium
QTGTHPRVR

SEQ ID NO: 555123 - protein, 13 aa, Mycobacterium
QTGTIDGDDDLGE

SEQ ID NO: 555124 - protein, 7 aa, Mycobacterium
QTGVGRT

SEQ ID NO: 555125 - protein, 5 aa, Mycobacterium
QTGVP

SEQ ID NO: 555126 - protein, 7 aa, Mycobacterium
QTGYGRT

SEQ ID NO: 555127 - protein, 4 aa, Mycobacterium
QTHA

SEQ ID NO: 555128 - protein, 10 aa, Mycobacterium
QTHDGRSLGH

SEQ ID NO: 555129 - protein, 9 aa, Mycobacterium
QTHDPEGPY

SEQ ID NO: 555130 - protein, 9 aa, Mycobacterium
QTHEPAAEA

SEQ ID NO: 555131 - protein, 7 aa, Mycobacterium
QTHGGNG

SEQ ID NO: 555132 - protein, 5 aa, Mycobacterium
QTHGR

SEQ ID NO: 555133 - protein, 6 aa, Mycobacterium
QTHPGT

SEQ ID NO: 555134 - protein, 24 aa, Mycobacterium
QTHQQGISHQDQMPAAPPPDDLPG

SEQ ID NO: 555135 - protein, 10 aa, Mycobacterium
QTHREKTTVT

SEQ ID NO: 555136 - protein, 9 aa, Mycobacterium
QTHRGPARG

SEQ ID NO: 555137 - protein, 9 aa, Mycobacterium
QTHRPSPVN

SEQ ID NO: 555138 - protein, 9 aa, Mycobacterium
QTHSGEPHS

SEQ ID NO: 555139 - protein, 18 aa, Mycobacterium
QTIAGAATAQARLTGTFA

SEQ ID NO: 555140 - protein, 31 aa, Mycobacterium
QTIASRTDKWDPATAKSRDQLDDDDAAERRA

SEQ ID NO: 555141 - protein, 30 aa, Mycobacterium
QTIASRTDRWDASTAKSRDELDDDATADRR

SEQ ID NO: 555142 - protein, 6 aa, Mycobacterium
QTIDEE

SEQ ID NO: 555143 - protein, 6 aa, Mycobacterium
QTIGED

SEQ ID NO: 555144 - protein, 8 aa, Mycobacterium
QTIGPAPD

SEQ ID NO: 555145 - protein, 17 aa, Mycobacterium
QTIPGSPGGAGDSGSSV

SEQ ID NO: 555146 - protein, 4 aa, Mycobacterium
QTIR

SEQ ID NO: 555147 - protein, 10 aa, Mycobacterium
QTISDSPAGA

SEQ ID NO: 555148 - protein, 7 aa, Mycobacterium
QTIYGGT

SEQ ID NO: 555149 - protein, 4 aa, Mycobacterium
QTKA

SEQ ID NO: 555150 - protein, 8 aa, Mycobacterium
QTKAPSIA

SEQ ID NO: 555151 - protein, 10 aa, Mycobacterium
QTKDRESKEN

SEQ ID NO: 555152 - protein, 4 aa, Mycobacterium
QTKE

SEQ ID NO: 555153 - protein, 11 aa, Mycobacterium
QTKGASHTQQM

SEQ ID NO: 555154 - protein, 7 aa, Mycobacterium
QTKHPQI

SEQ ID NO: 555155 - protein, 9 aa, Mycobacterium
QTKNKAAEY

SEQ ID NO: 555156 - protein, 4 aa, Mycobacterium
QTKP

SEQ ID NO: 555157 - protein, 6 aa, Mycobacterium
QTKPRD

SEQ ID NO: 555158 - protein, 17 aa, Mycobacterium
QTKRSEPVSGPTESPWD

SEQ ID NO: 555159 - protein, 5 aa, Mycobacterium
QTKTG

SEQ ID NO: 555160 - protein, 9 aa, Mycobacterium
QTKTGSTDN

SEQ ID NO: 555161 - protein, 17 aa, Mycobacterium
QTKTTLGSTPTPNPLPT

SEQ ID NO: 555162 - protein, 4 aa, Mycobacterium
QTKY

SEQ ID NO: 555163 - protein, 13 aa, Mycobacterium
QTLAAGGDALTDR

SEQ ID NO: 555164 - protein, 6 aa, Mycobacterium
QTLAGS

SEQ ID NO: 555165 - protein, 11 aa, Mycobacterium
QTLAPQPSRGE

SEQ ID NO: 555166 - protein, 5 aa, Mycobacterium
QTLAQ

SEQ ID NO: 555167 - protein, 4 aa, Mycobacterium
QTLD

SEQ ID NO: 555168 - protein, 11 aa, Mycobacterium
QTLDAEQKTAA

SEQ ID NO: 555169 - protein, 13 aa, Mycobacterium
QTLDEERGTGGNH

SEQ ID NO: 555170 - protein, 8 aa, Mycobacterium
QTLDPTQV

SEQ ID NO: 555171 - protein, 6 aa, Mycobacterium
QTLEPV

SEQ ID NO: 555172 - protein, 5 aa, Mycobacterium
QTLGA

SEQ ID NO: 555173 - protein, 5 aa, Mycobacterium
QTLGG

SEQ ID NO: 555174 - protein, 9 aa, Mycobacterium
QTLGQRNPE

SEQ ID NO: 555175 - protein, 19 aa, Mycobacterium
QTLPQPAEIEDPDQWIDRV

SEQ ID NO: 555176 - protein, 17 aa, Mycobacterium
QTLSDGARIEVVTAVQG

SEQ ID NO: 555177 - protein, 11 aa, Mycobacterium
QTLSGEPVQDK

SEQ ID NO: 555178 - protein, 10 aa, Mycobacterium
QTLSRSQDPV

SEQ ID NO: 555179 - protein, 4 aa, Mycobacterium
QTLT

SEQ ID NO: 555180 - protein, 5 aa, Mycobacterium
QTLTG

SEQ ID NO: 555181 - protein, 6 aa, Mycobacterium
QTLTPD

SEQ ID NO: 555182 - protein, 14 aa, Mycobacterium
QTLTPRPQPADGVS

SEQ ID NO: 555183 - protein, 4 aa, Mycobacterium
QTMA

SEQ ID NO: 555184 - protein, 13 aa, Mycobacterium
QTMAANPSVADDP

SEQ ID NO: 555185 - protein, 4 aa, Mycobacterium
QTMD

SEQ ID NO: 555186 - protein, 5 aa, Mycobacterium
QTMDE

SEQ ID NO: 555187 - protein, 4 aa, Mycobacterium
QTMR

SEQ ID NO: 555188 - protein, 5 aa, Mycobacterium
QTMTS

SEQ ID NO: 555189 - protein, 4 aa, Mycobacterium
QTNA

SEQ ID NO: 555190 - protein, 14 aa, Mycobacterium
QTNASGRIAEPDEI

SEQ ID NO: 555191 - protein, 14 aa, Mycobacterium
QTNASGRVAEPDEI

SEQ ID NO: 555192 - protein, 22 aa, Mycobacterium
QTNCPPNTRPSINEEEAEGATL

SEQ ID NO: 555193 - protein, 10 aa, Mycobacterium
QTNGRVRRAG

SEQ ID NO: 555194 - protein, 8 aa, Mycobacterium
QTNPDGAE

SEQ ID NO: 555195 - protein, 7 aa, Mycobacterium
QTNPDGE

SEQ ID NO: 555196 - protein, 22 aa, Mycobacterium
QTNPGDMSPNVDGPLPPGAAPQ

SEQ ID NO: 555197 - protein, 6 aa, Mycobacterium
QTNPGE

SEQ ID NO: 555198 - protein, 5 aa, Mycobacterium
QTNRQ

SEQ ID NO: 555199 - protein, 13 aa, Mycobacterium
QTNRSAMGGNYQQ

SEQ ID NO: 555200 - protein, 13 aa, Mycobacterium
QTNRSAMGGSYQQ

SEQ ID NO: 555201 - protein, 13 aa, Mycobacterium
QTNRTAMGGNYQQ

SEQ ID NO: 555202 - protein, 10 aa, Mycobacterium
QTNSGSERLE

SEQ ID NO: 555203 - protein, 7 aa, Mycobacterium
QTNYSAA

SEQ ID NO: 555204 - protein, 10 aa, Mycobacterium
QTPAAQDAIA

SEQ ID NO: 555205 - protein, 15 aa, Mycobacterium
QTPAAQQAIAGRTTY

SEQ ID NO: 555206 - protein, 5 aa, Mycobacterium
QTPAD

SEQ ID NO: 555207 - protein, 5 aa, Mycobacterium
QTPAG

SEQ ID NO: 555208 - protein, 7 aa, Mycobacterium
QTPAQPV

SEQ ID NO: 555209 - protein, 23 aa, Mycobacterium
QTPARNLPPIDERGDPKHYCPMV

SEQ ID NO: 555210 - protein, 22 aa, Mycobacterium
QTPARNLPPLDERDNPMHYCPE

SEQ ID NO: 555211 - protein, 10 aa, Mycobacterium
QTPASAPAVA

SEQ ID NO: 555212 - protein, 5 aa, Mycobacterium
QTPCA

SEQ ID NO: 555213 - protein, 5 aa, Mycobacterium
QTPCL

SEQ ID NO: 555214 - protein, 9 aa, Mycobacterium
QTPDAGAAA

SEQ ID NO: 555215 - protein, 6 aa, Mycobacterium
QTPDDC

SEQ ID NO: 555216 - protein, 6 aa, Mycobacterium
QTPDDV

SEQ ID NO: 555217 - protein, 10 aa, Mycobacterium
QTPDEGHRLQ

SEQ ID NO: 555218 - protein, 5 aa, Mycobacterium
QTPDI

SEQ ID NO: 555219 - protein, 5 aa, Mycobacterium
QTPEL

SEQ ID NO: 555220 - protein, 11 aa, Mycobacterium
QTPELAGPATS

SEQ ID NO: 555221 - protein, 4 aa, Mycobacterium
QTPG

SEQ ID NO: 555222 - protein, 7 aa, Mycobacterium
QTPGAGE

SEQ ID NO: 555223 - protein, 8 aa, Mycobacterium
QTPGAGEE

SEQ ID NO: 555224 - protein, 6 aa, Mycobacterium
QTPGFG

SEQ ID NO: 555225 - protein, 16 aa, Mycobacterium
QTPGGPAAALPPPAGL

SEQ ID NO: 555226 - protein, 5 aa, Mycobacterium
QTPGL

SEQ ID NO: 555227 - protein, 12 aa, Mycobacterium
QTPGLQGSAKSV

SEQ ID NO: 555228 - protein, 5 aa, Mycobacterium
QTPGM

SEQ ID NO: 555229 - protein, 5 aa, Mycobacterium
QTPGQ

SEQ ID NO: 555230 - protein, 16 aa, Mycobacterium
QTPGRVAGPAPELGAH

SEQ ID NO: 555231 - protein, 7 aa, Mycobacterium
QTPGSLD

SEQ ID NO: 555232 - protein, 10 aa, Mycobacterium
QTPHTTPPDE

SEQ ID NO: 555233 - protein, 5 aa, Mycobacterium
QTPID

SEQ ID NO: 555234 - protein, 5 aa, Mycobacterium
QTPIG

SEQ ID NO: 555235 - protein, 9 aa, Mycobacterium
QTPIPERGD

SEQ ID NO: 555236 - protein, 18 aa, Mycobacterium
QTPIPRGDEPPDAARPAR

SEQ ID NO: 555237 - protein, 10 aa, Mycobacterium
QTPKAKAGVA

SEQ ID NO: 555238 - protein, 5 aa, Mycobacterium
QTPKV

SEQ ID NO: 555239 - protein, 5 aa, Mycobacterium
QTPLG

SEQ ID NO: 555240 - protein, 5 aa, Mycobacterium
QTPLS

SEQ ID NO: 555241 - protein, 11 aa, Mycobacterium
QTPLSEAGPRI

SEQ ID NO: 555242 - protein, 14 aa, Mycobacterium
QTPMGRAGTPDEIA

SEQ ID NO: 555243 - protein, 8 aa, Mycobacterium
QTPPGDVG

SEQ ID NO: 555244 - protein, 8 aa, Mycobacterium
QTPPKGID

SEQ ID NO: 555245 - protein, 8 aa, Mycobacterium
QTPRASGV

SEQ ID NO: 555246 - protein, 9 aa, Mycobacterium
QTPRPELPG

SEQ ID NO: 555247 - protein, 14 aa, Mycobacterium
QTPSAAAALSPQGL

SEQ ID NO: 555248 - protein, 6 aa, Mycobacterium
QTPSAF

SEQ ID NO: 555249 - protein, 5 aa, Mycobacterium
QTPSD

SEQ ID NO: 555250 - protein, 5 aa, Mycobacterium
QTPSG

SEQ ID NO: 555251 - protein, 9 aa, Mycobacterium
QTPSGPVAT

SEQ ID NO: 555252 - protein, 11 aa, Mycobacterium
QTPSGTDVSEG

SEQ ID NO: 555253 - protein, 5 aa, Mycobacterium
QTPTA

SEQ ID NO: 555254 - protein, 7 aa, Mycobacterium
QTPTAAG

SEQ ID NO: 555255 - protein, 9 aa, Mycobacterium
QTPTQGIGP

SEQ ID NO: 555256 - protein, 12 aa, Mycobacterium
QTPTSNDSDEYT

SEQ ID NO: 555257 - protein, 10 aa, Mycobacterium
QTPTSNGSVE

SEQ ID NO: 555258 - protein, 5 aa, Mycobacterium
QTPVP

SEQ ID NO: 555259 - protein, 5 aa, Mycobacterium
QTPVR

SEQ ID NO: 555260 - protein, 6 aa, Mycobacterium
QTPVTD

SEQ ID NO: 555261 - protein, 9 aa, Mycobacterium
QTQAAIDEA

SEQ ID NO: 555262 - protein, 11 aa, Mycobacterium
QTQAGPVHPPG

SEQ ID NO: 555263 - protein, 16 aa, Mycobacterium
QTQAGRSAATQSRPAL

SEQ ID NO: 555264 - protein, 4 aa, Mycobacterium
QTQG

SEQ ID NO: 555265 - protein, 9 aa, Mycobacterium
QTQGQGHET

SEQ ID NO: 555266 - protein, 8 aa, Mycobacterium
QTQGTNQD

SEQ ID NO: 555267 - protein, 7 aa, Mycobacterium
QTQPGRH

SEQ ID NO: 555268 - protein, 5 aa, Mycobacterium
QTQRD

SEQ ID NO: 555269 - protein, 8 aa, Mycobacterium
QTQSPGIP

SEQ ID NO: 555270 - protein, 9 aa, Mycobacterium
QTQSPPMAP

SEQ ID NO: 555271 - protein, 4 aa, Mycobacterium
QTQW

SEQ ID NO: 555272 - protein, 21 aa, Mycobacterium
QTQWHDTDSGPQVFTPRRYPA

SEQ ID NO: 555273 - protein, 20 aa, Mycobacterium
QTQWYSTDSGDRVFTPRRYP

SEQ ID NO: 555274 - protein, 8 aa, Mycobacterium
QTRADEEG

SEQ ID NO: 555275 - protein, 6 aa, Mycobacterium
QTRADP

SEQ ID NO: 555276 - protein, 5 aa, Mycobacterium
QTRAE

SEQ ID NO: 555277 - protein, 8 aa, Mycobacterium
QTRAECPT

SEQ ID NO: 555278 - protein, 7 aa, Mycobacterium
QTRAGWA

SEQ ID NO: 555279 - protein, 8 aa, Mycobacterium
QTRAKAGD

SEQ ID NO: 555280 - protein, 10 aa, Mycobacterium
QTRAQRVTSE

SEQ ID NO: 555281 - protein, 5 aa, Mycobacterium
QTRDA

SEQ ID NO: 555282 - protein, 7 aa, Mycobacterium
QTRDGAV

SEQ ID NO: 555283 - protein, 10 aa, Mycobacterium
QTRDLSNEAA

SEQ ID NO: 555284 - protein, 10 aa, Mycobacterium
QTRDLSNEAT

SEQ ID NO: 555285 - protein, 9 aa, Mycobacterium
QTRDLTNAA

SEQ ID NO: 555286 - protein, 4 aa, Mycobacterium
QTRE

SEQ ID NO: 555287 - protein, 9 aa, Mycobacterium
QTRENGATI

SEQ ID NO: 555288 - protein, 8 aa, Mycobacterium
QTREPGDV

SEQ ID NO: 555289 - protein, 8 aa, Mycobacterium
QTREPNAQ

SEQ ID NO: 555290 - protein, 9 aa, Mycobacterium
QTREPNAQI

SEQ ID NO: 555291 - protein, 9 aa, Mycobacterium
QTREPNAQV

SEQ ID NO: 555292 - protein, 7 aa, Mycobacterium
QTREPYE

SEQ ID NO: 555293 - protein, 15 aa, Mycobacterium
QTREQFGRPIGKQQA

SEQ ID NO: 555294 - protein, 7 aa, Mycobacterium
QTRERAL

SEQ ID NO: 555295 - protein, 6 aa, Mycobacterium
QTRESF

SEQ ID NO: 555296 - protein, 7 aa, Mycobacterium
QTRESLE

SEQ ID NO: 555297 - protein, 4 aa, Mycobacterium
QTRF

SEQ ID NO: 555298 - protein, 6 aa, Mycobacterium
QTRFQP

SEQ ID NO: 555299 - protein, 17 aa, Mycobacterium
QTRGGAGKCTPHDGNAD

SEQ ID NO: 555300 - protein, 10 aa, Mycobacterium
QTRGGIDPKK

SEQ ID NO: 555301 - protein, 7 aa, Mycobacterium
QTRGKPY

SEQ ID NO: 555302 - protein, 5 aa, Mycobacterium
QTRGP

SEQ ID NO: 555303 - protein, 34 aa, Mycobacterium
QTRGQRAGDRGRGRRHRQPQPGPQRDQSAGDVPV

SEQ ID NO: 555304 - protein, 12 aa, Mycobacterium
QTRGVQRATETG

SEQ ID NO: 555305 - protein, 4 aa, Mycobacterium
QTRL

SEQ ID NO: 555306 - protein, 6 aa, Mycobacterium
QTRNGE

SEQ ID NO: 555307 - protein, 9 aa, Mycobacterium
QTRNVPHTG

SEQ ID NO: 555308 - protein, 4 aa, Mycobacterium
QTRP

SEQ ID NO: 555309 - protein, 13 aa, Mycobacterium
QTRPPGFGRPTDH

SEQ ID NO: 555310 - protein, 11 aa, Mycobacterium
QTRPPTEDGRD

SEQ ID NO: 555311 - protein, 11 aa, Mycobacterium
QTRPQTEDGRD

SEQ ID NO: 555312 - protein, 8 aa, Mycobacterium
QTRQAIEQ

SEQ ID NO: 555313 - protein, 6 aa, Mycobacterium
QTRQDS

SEQ ID NO: 555314 - protein, 6 aa, Mycobacterium
QTRQRA

SEQ ID NO: 555315 - protein, 5 aa, Mycobacterium
QTRRA

SEQ ID NO: 555316 - protein, 7 aa, Mycobacterium
QTRRDTA

SEQ ID NO: 555317 - protein, 11 aa, Mycobacterium
QTRREKTTVTG

SEQ ID NO: 555318 - protein, 6 aa, Mycobacterium
QTRSAT

SEQ ID NO: 555319 - protein, 11 aa, Mycobacterium
QTRSDKGKFTD

SEQ ID NO: 555320 - protein, 10 aa, Mycobacterium
QTRSGGVARN

SEQ ID NO: 555321 - protein, 5 aa, Mycobacterium
QTRSM

SEQ ID NO: 555322 - protein, 5 aa, Mycobacterium
QTRSQ

SEQ ID NO: 555323 - protein, 4 aa, Mycobacterium
QTRT

SEQ ID NO: 555324 - protein, 5 aa, Mycobacterium
QTRTA

SEQ ID NO: 555325 - protein, 8 aa, Mycobacterium
QTRTAVGT

SEQ ID NO: 555326 - protein, 9 aa, Mycobacterium
QTRTGDPGN

SEQ ID NO: 555327 - protein, 7 aa, Mycobacterium
QTRTRTV

SEQ ID NO: 555328 - protein, 8 aa, Mycobacterium
QTRTTREI

SEQ ID NO: 555329 - protein, 14 aa, Mycobacterium
QTRWGERQRGRRGT

SEQ ID NO: 555330 - protein, 21 aa, Mycobacterium
QTRWQRTTDGADRVFTLRRYP

SEQ ID NO: 555331 - protein, 4 aa, Mycobacterium
QTSA

SEQ ID NO: 555332 - protein, 15 aa, Mycobacterium
QTSAAARGLTSSDRV

SEQ ID NO: 555333 - protein, 6 aa, Mycobacterium
QTSAGY

SEQ ID NO: 555334 - protein, 7 aa, Mycobacterium
QTSALAS

SEQ ID NO: 555335 - protein, 7 aa, Mycobacterium
QTSAPDK

SEQ ID NO: 555336 - protein, 6 aa, Mycobacterium
QTSATT

SEQ ID NO: 555337 - protein, 9 aa, Mycobacterium
QTSDEELAE

SEQ ID NO: 555338 - protein, 9 aa, Mycobacterium
QTSDEVTVE

SEQ ID NO: 555339 - protein, 7 aa, Mycobacterium
QTSDGGT

SEQ ID NO: 555340 - protein, 6 aa, Mycobacterium
QTSDPD

SEQ ID NO: 555341 - protein, 7 aa, Mycobacterium
QTSEAAS

SEQ ID NO: 555342 - protein, 9 aa, Mycobacterium
QTSELEDPQ

SEQ ID NO: 555343 - protein, 6 aa, Mycobacterium
QTSFDP

SEQ ID NO: 555344 - protein, 12 aa, Mycobacterium
QTSGGGDRARRL

SEQ ID NO: 555345 - protein, 6 aa, Mycobacterium
QTSGMS

SEQ ID NO: 555346 - protein, 18 aa, Mycobacterium
QTSGRKAAAVGKPAPEGF

SEQ ID NO: 555347 - protein, 6 aa, Mycobacterium
QTSGRV

SEQ ID NO: 555348 - protein, 18 aa, Mycobacterium
QTSGTSGTPKGALRPTPR

SEQ ID NO: 555349 - protein, 15 aa, Mycobacterium
QTSIAEASVSPTGIE

SEQ ID NO: 555350 - protein, 5 aa, Mycobacterium
QTSIE

SEQ ID NO: 555351 - protein, 7 aa, Mycobacterium
QTSINPP

SEQ ID NO: 555352 - protein, 7 aa, Mycobacterium
QTSIPGY

SEQ ID NO: 555353 - protein, 5 aa, Mycobacterium
QTSLP

SEQ ID NO: 555354 - protein, 16 aa, Mycobacterium
QTSLPAGYSGPRSAGT

SEQ ID NO: 555355 - protein, 6 aa, Mycobacterium
QTSPAG

SEQ ID NO: 555356 - protein, 9 aa, Mycobacterium
QTSPAGRGG

SEQ ID NO: 555357 - protein, 11 aa, Mycobacterium
QTSPATSAEYE

SEQ ID NO: 555358 - protein, 17 aa, Mycobacterium
QTSPGPFAGSASDSLSA

SEQ ID NO: 555359 - protein, 13 aa, Mycobacterium
QTSPSACGGRALT

SEQ ID NO: 555360 - protein, 22 aa, Mycobacterium
QTSQDPDHASRIESAANRQAAR

SEQ ID NO: 555361 - protein, 5 aa, Mycobacterium
QTSRS

SEQ ID NO: 555362 - protein, 12 aa, Mycobacterium
QTSRTFGRGPNP

SEQ ID NO: 555363 - protein, 6 aa, Mycobacterium
QTSSQW

SEQ ID NO: 555364 - protein, 5 aa, Mycobacterium
QTSSY

SEQ ID NO: 555365 - protein, 8 aa, Mycobacterium
QTSTFAAN

SEQ ID NO: 555366 - protein, 9 aa, Mycobacterium
QTSTRYPGG

SEQ ID NO: 555367 - protein, 10 aa, Mycobacterium
QTSVTGSRVA

SEQ ID NO: 555368 - protein, 4 aa, Mycobacterium
QTTA

SEQ ID NO: 555369 - protein, 8 aa, Mycobacterium
QTTADDDY

SEQ ID NO: 555370 - protein, 19 aa, Mycobacterium
QTTAEAAATERPDRTPGHA

SEQ ID NO: 555371 - protein, 5 aa, Mycobacterium
QTTAG

SEQ ID NO: 555372 - protein, 10 aa, Mycobacterium
QTTDPQPHEA

SEQ ID NO: 555373 - protein, 8 aa, Mycobacterium
QTTDRDAL

SEQ ID NO: 555374 - protein, 15 aa, Mycobacterium
QTTDSPDAEEQRELE

SEQ ID NO: 555375 - protein, 4 aa, Mycobacterium
QTTE

SEQ ID NO: 555376 - protein, 7 aa, Mycobacterium
QTTEACG

SEQ ID NO: 555377 - protein, 30 aa, Mycobacterium
QTTEPEPAVAAPAAQAESVPSRAAAKPSVR

SEQ ID NO: 555378 - protein, 6 aa, Mycobacterium
QTTEQL

SEQ ID NO: 555379 - protein, 15 aa, Mycobacterium
QTTFNADSRMQGQLD

SEQ ID NO: 555380 - protein, 4 aa, Mycobacterium
QTTG

SEQ ID NO: 555381 - protein, 7 aa, Mycobacterium
QTTGAGD

SEQ ID NO: 555382 - protein, 6 aa, Mycobacterium
QTTGLG

SEQ ID NO: 555383 - protein, 7 aa, Mycobacterium
QTTGREY

SEQ ID NO: 555384 - protein, 5 aa, Mycobacterium
QTTGW

SEQ ID NO: 555385 - protein, 6 aa, Mycobacterium
QTTLTH

SEQ ID NO: 555386 - protein, 14 aa, Mycobacterium
QTTNAGGRATPDWS

SEQ ID NO: 555387 - protein, 13 aa, Mycobacterium
QTTPDEAGKSGET

SEQ ID NO: 555388 - protein, 5 aa, Mycobacterium
QTTPE

SEQ ID NO: 555389 - protein, 17 aa, Mycobacterium
QTTPGGGARTLPDPEFG

SEQ ID NO: 555390 - protein, 18 aa, Mycobacterium
QTTPPHAVEPAEETDGSA

SEQ ID NO: 555391 - protein, 10 aa, Mycobacterium
QTTPSQRAAQ

SEQ ID NO: 555392 - protein, 6 aa, Mycobacterium
QTTPSR

SEQ ID NO: 555393 - protein, 9 aa, Mycobacterium
QTTPTQLRK

SEQ ID NO: 555394 - protein, 8 aa, Mycobacterium
QTTPVEPY

SEQ ID NO: 555395 - protein, 6 aa, Mycobacterium
QTTRKR

SEQ ID NO: 555396 - protein, 8 aa, Mycobacterium
QTTSESAF

SEQ ID NO: 555397 - protein, 5 aa, Mycobacterium
QTTSN

SEQ ID NO: 555398 - protein, 10 aa, Mycobacterium
QTTSPDARDF

SEQ ID NO: 555399 - protein, 8 aa, Mycobacterium
QTTSPLTS

SEQ ID NO: 555400 - protein, 8 aa, Mycobacterium
QTTSPLTT

SEQ ID NO: 555401 - protein, 6 aa, Mycobacterium
QTTTAQ

SEQ ID NO: 555402 - protein, 14 aa, Mycobacterium
QTTTDANGAAPTSV

SEQ ID NO: 555403 - protein, 7 aa, Mycobacterium
QTTTGDH

SEQ ID NO: 555404 - protein, 8 aa, Mycobacterium
QTTVPSAA

SEQ ID NO: 555405 - protein, 4 aa, Mycobacterium
QTVA

SEQ ID NO: 555406 - protein, 6 aa, Mycobacterium
QTVAAA

SEQ ID NO: 555407 - protein, 7 aa, Mycobacterium
QTVAAGA

SEQ ID NO: 555408 - protein, 6 aa, Mycobacterium
QTVAPG

SEQ ID NO: 555409 - protein, 6 aa, Mycobacterium
QTVDPE

SEQ ID NO: 555410 - protein, 21 aa, Mycobacterium
QTVDQAAESNEGINNTATTDA

SEQ ID NO: 555411 - protein, 10 aa, Mycobacterium
QTVGEAESGR

SEQ ID NO: 555412 - protein, 12 aa, Mycobacterium
QTVGGARTPIPP

SEQ ID NO: 555413 - protein, 11 aa, Mycobacterium
QTVGPPSAEPL

SEQ ID NO: 555414 - protein, 8 aa, Mycobacterium
QTVGRRKE

SEQ ID NO: 555415 - protein, 11 aa, Mycobacterium
QTVIGGPPDQV

SEQ ID NO: 555416 - protein, 13 aa, Mycobacterium
QTVKNSPIVPTGA

SEQ ID NO: 555417 - protein, 5 aa, Mycobacterium
QTVPA

SEQ ID NO: 555418 - protein, 6 aa, Mycobacterium
QTVPAG

SEQ ID NO: 555419 - protein, 10 aa, Mycobacterium
QTVPLPDAPQ

SEQ ID NO: 555420 - protein, 9 aa, Mycobacterium
QTVPRRDRG

SEQ ID NO: 555421 - protein, 23 aa, Mycobacterium
QTVPSRDALSKKTAGTSKRTRRS

SEQ ID NO: 555422 - protein, 19 aa, Mycobacterium
QTVQAKDAELQKLAGKLTR

SEQ ID NO: 555423 - protein, 6 aa, Mycobacterium
QTVRDG

SEQ ID NO: 555424 - protein, 10 aa, Mycobacterium
QTVRRSPGSY

SEQ ID NO: 555425 - protein, 4 aa, Mycobacterium
QTVT

SEQ ID NO: 555426 - protein, 8 aa, Mycobacterium
QTVTGAGR

SEQ ID NO: 555427 - protein, 7 aa, Mycobacterium
QTVTGQG

SEQ ID NO: 555428 - protein, 21 aa, Mycobacterium
QTVTNGADLKRPRPRLRGQVS

SEQ ID NO: 555429 - protein, 11 aa, Mycobacterium
QTYAGTDRQVR

SEQ ID NO: 555430 - protein, 10 aa, Mycobacterium
QTYASDAAQL

SEQ ID NO: 555431 - protein, 7 aa, Mycobacterium
QTYDTAA

SEQ ID NO: 555432 - protein, 12 aa, Mycobacterium
QTYGATAPGAGA

SEQ ID NO: 555433 - protein, 12 aa, Mycobacterium
QTYGDTEAGAGA

SEQ ID NO: 555434 - protein, 5 aa, Mycobacterium
QTYQA

SEQ ID NO: 555435 - protein, 18 aa, Mycobacterium
QTYQRATPYAGATPSPAE

SEQ ID NO: 555436 - protein, 4 aa, Mycobacterium
QTYR

SEQ ID NO: 555437 - protein, 10 aa, Mycobacterium
QTYTAGADHA

SEQ ID NO: 555438 - protein, 16 aa, Mycobacterium
QTYTEYPNTTIRNVAV

SEQ ID NO: 555439 - protein, 6 aa, Mycobacterium
QVADNG

SEQ ID NO: 555440 - protein, 5 aa, Mycobacterium
QVAEA

SEQ ID NO: 555441 - protein, 8 aa, Mycobacterium
QVAEASGV

SEQ ID NO: 555442 - protein, 9 aa, Mycobacterium
QVAESGDTA

SEQ ID NO: 555443 - protein, 4 aa, Mycobacterium
QVAG

SEQ ID NO: 555444 - protein, 8 aa, Mycobacterium
QVAGAGRK

SEQ ID NO: 555445 - protein, 9 aa, Mycobacterium
QVAGPTSSI

SEQ ID NO: 555446 - protein, 15 aa, Mycobacterium
QVAGVGGTRPPGQEH

SEQ ID NO: 555447 - protein, 7 aa, Mycobacterium
QVANPGD

SEQ ID NO: 555448 - protein, 7 aa, Mycobacterium
QVAPDGR

SEQ ID NO: 555449 - protein, 8 aa, Mycobacterium
QVAPGTVA

SEQ ID NO: 555450 - protein, 6 aa, Mycobacterium
QVAPQR

SEQ ID NO: 555451 - protein, 5 aa, Mycobacterium
QVAQA

SEQ ID NO: 555452 - protein, 9 aa, Mycobacterium
QVASAGAVE

SEQ ID NO: 555453 - protein, 12 aa, Mycobacterium
QVASAPESTADA

SEQ ID NO: 555454 - protein, 6 aa, Mycobacterium
QVASDA

SEQ ID NO: 555455 - protein, 8 aa, Mycobacterium
QVASDASG

SEQ ID NO: 555456 - protein, 8 aa, Mycobacterium
QVASGSQR

SEQ ID NO: 555457 - protein, 12 aa, Mycobacterium
QVASTQGTGMGG

SEQ ID NO: 555458 - protein, 10 aa, Mycobacterium
QVATASGSDI

SEQ ID NO: 555459 - protein, 6 aa, Mycobacterium
QVATGA

SEQ ID NO: 555460 - protein, 7 aa, Mycobacterium
QVATGAA

SEQ ID NO: 555461 - protein, 18 aa, Mycobacterium
QVATTGPDEEENPAVSTG

SEQ ID NO: 555462 - protein, 12 aa, Mycobacterium
QVCPNQEQPGFT

SEQ ID NO: 555463 - protein, 5 aa, Mycobacterium
QVDAE

SEQ ID NO: 555464 - protein, 15 aa, Mycobacterium
QVDAGSAGNSRDEVA

SEQ ID NO: 555465 - protein, 6 aa, Mycobacterium
QVDDNG

SEQ ID NO: 555466 - protein, 9 aa, Mycobacterium
QVDDPDTGR

SEQ ID NO: 555467 - protein, 10 aa, Mycobacterium
QVDDQREAVE

SEQ ID NO: 555468 - protein, 5 aa, Mycobacterium
QVDDT

SEQ ID NO: 555469 - protein, 10 aa, Mycobacterium
QVDEADGSKA

SEQ ID NO: 555470 - protein, 6 aa, Mycobacterium
QVDEDQ

SEQ ID NO: 555471 - protein, 7 aa, Mycobacterium
QVDEDTE

SEQ ID NO: 555472 - protein, 8 aa, Mycobacterium
QVDEGADE

SEQ ID NO: 555473 - protein, 5 aa, Mycobacterium
QVDET

SEQ ID NO: 555474 - protein, 8 aa, Mycobacterium
QVDGTVPA

SEQ ID NO: 555475 - protein, 12 aa, Mycobacterium
QVDKAEDEPERA

SEQ ID NO: 555476 - protein, 8 aa, Mycobacterium
QVDPDGSF

SEQ ID NO: 555477 - protein, 5 aa, Mycobacterium
QVDPE

SEQ ID NO: 555478 - protein, 8 aa, Mycobacterium
QVDPGLTE

SEQ ID NO: 555479 - protein, 13 aa, Mycobacterium
QVDRENPGDHHRD

SEQ ID NO: 555480 - protein, 5 aa, Mycobacterium
QVDRG

SEQ ID NO: 555481 - protein, 8 aa, Mycobacterium
QVDRGEVV

SEQ ID NO: 555482 - protein, 7 aa, Mycobacterium
QVDRPGT

SEQ ID NO: 555483 - protein, 8 aa, Mycobacterium
QVDRRQRA

SEQ ID NO: 555484 - protein, 14 aa, Mycobacterium
QVDSERGGLPGGQD

SEQ ID NO: 555485 - protein, 7 aa, Mycobacterium
QVDSESL

SEQ ID NO: 555486 - protein, 20 aa, Mycobacterium
QVDSTGGAGPEHPEDPEHRD

SEQ ID NO: 555487 - protein, 11 aa, Mycobacterium
QVDTDSAADTS

SEQ ID NO: 555488 - protein, 9 aa, Mycobacterium
QVDTGPGGI

SEQ ID NO: 555489 - protein, 12 aa, Mycobacterium
QVDTNPDVTPGQ

SEQ ID NO: 555490 - protein, 11 aa, Mycobacterium
QVEASDKPAVV

SEQ ID NO: 555491 - protein, 11 aa, Mycobacterium
QVEEAKERANR

SEQ ID NO: 555492 - protein, 7 aa, Mycobacterium
QVEEDQE

SEQ ID NO: 555493 - protein, 15 aa, Mycobacterium
QVEKARRSRRKGTLA

SEQ ID NO: 555494 - protein, 6 aa, Mycobacterium
QVEPAR

SEQ ID NO: 555495 - protein, 5 aa, Mycobacterium
QVERA

SEQ ID NO: 555496 - protein, 12 aa, Mycobacterium
QVESLNSNAVGT

SEQ ID NO: 555497 - protein, 8 aa, Mycobacterium
QVESPYSS

SEQ ID NO: 555498 - protein, 31 aa, Mycobacterium
QVESTSTEIGETQAATAVSTAADGMPGSTTQ

SEQ ID NO: 555499 - protein, 4 aa, Mycobacterium
QVET

SEQ ID NO: 555500 - protein, 17 aa, Mycobacterium
QVETTSDVAASAAELGE

SEQ ID NO: 555501 - protein, 5 aa, Mycobacterium
QVGAA

SEQ ID NO: 555502 - protein, 13 aa, Mycobacterium
QVGADGNSAPKKA

SEQ ID NO: 555503 - protein, 6 aa, Mycobacterium
QVGADS

SEQ ID NO: 555504 - protein, 7 aa, Mycobacterium
QVGDGET

SEQ ID NO: 555505 - protein, 5 aa, Mycobacterium
QVGDQ

SEQ ID NO: 555506 - protein, 9 aa, Mycobacterium
QVGDQAANI

SEQ ID NO: 555507 - protein, 9 aa, Mycobacterium
QVGDSPGVR

SEQ ID NO: 555508 - protein, 7 aa, Mycobacterium
QVGDSSD

SEQ ID NO: 555509 - protein, 8 aa, Mycobacterium
QVGDTDEF

SEQ ID NO: 555510 - protein, 9 aa, Mycobacterium
QVGDTTDAA

SEQ ID NO: 555511 - protein, 4 aa, Mycobacterium
QVGE

SEQ ID NO: 555512 - protein, 7 aa, Mycobacterium
QVGEDSP

SEQ ID NO: 555513 - protein, 6 aa, Mycobacterium
QVGEPP

SEQ ID NO: 555514 - protein, 10 aa, Mycobacterium
QVGESEEIRP

SEQ ID NO: 555515 - protein, 4 aa, Mycobacterium
QVGG

SEQ ID NO: 555516 - protein, 7 aa, Mycobacterium
QVGGAET

SEQ ID NO: 555517 - protein, 6 aa, Mycobacterium
QVGGPA

SEQ ID NO: 555518 - protein, 14 aa, Mycobacterium
QVGGPGQEAQRVGG

SEQ ID NO: 555519 - protein, 14 aa, Mycobacterium
QVGGRPLKDRTREH

SEQ ID NO: 555520 - protein, 7 aa, Mycobacterium
QVGGTSA

SEQ ID NO: 555521 - protein, 12 aa, Mycobacterium
QVGHRDAAAQVA

SEQ ID NO: 555522 - protein, 4 aa, Mycobacterium
QVGN

SEQ ID NO: 555523 - protein, 18 aa, Mycobacterium
QVGNRAVGDRPSQRLTTG

SEQ ID NO: 555524 - protein, 4 aa, Mycobacterium
QVGP

SEQ ID NO: 555525 - protein, 9 aa, Mycobacterium
QVGPDPEAE

SEQ ID NO: 555526 - protein, 6 aa, Mycobacterium
QVGPED

SEQ ID NO: 555527 - protein, 56 aa, Mycobacterium
QVGPGQQEERHGGAHRDDAHRAHSRADAVGPAAHHDAAEGAQQLREGDQTARGRHR

SEQ ID NO: 555528 - protein, 11 aa, Mycobacterium
QVGPNRPGPRG

SEQ ID NO: 555529 - protein, 6 aa, Mycobacterium
QVGPQR

SEQ ID NO: 555530 - protein, 10 aa, Mycobacterium
QVGRDSAAGF

SEQ ID NO: 555531 - protein, 5 aa, Mycobacterium
QVGRE

SEQ ID NO: 555532 - protein, 28 aa, Mycobacterium
QVGRPGLQHGKDGDDRLGRARKQQRHSL

SEQ ID NO: 555533 - protein, 5 aa, Mycobacterium
QVGSE

SEQ ID NO: 555534 - protein, 8 aa, Mycobacterium
QVGSPTYV

SEQ ID NO: 555535 - protein, 7 aa, Mycobacterium
QVGSRAE

SEQ ID NO: 555536 - protein, 6 aa, Mycobacterium
QVGTTL

SEQ ID NO: 555537 - protein, 6 aa, Mycobacterium
QVHAGA

SEQ ID NO: 555538 - protein, 8 aa, Mycobacterium
QVHGGGAA

SEQ ID NO: 555539 - protein, 9 aa, Mycobacterium
QVKAGGTQR

SEQ ID NO: 555540 - protein, 5 aa, Mycobacterium
QVKHA

SEQ ID NO: 555541 - protein, 4 aa, Mycobacterium
QVKP

SEQ ID NO: 555542 - protein, 5 aa, Mycobacterium
QVKPA

SEQ ID NO: 555543 - protein, 4 aa, Mycobacterium
QVLP

SEQ ID NO: 555544 - protein, 5 aa, Mycobacterium
QVLPT

SEQ ID NO: 555545 - protein, 9 aa, Mycobacterium
QVNGESVAG

SEQ ID NO: 555546 - protein, 18 aa, Mycobacterium
QVNGRNSFQKDKAKGLEA

SEQ ID NO: 555547 - protein, 19 aa, Mycobacterium
QVNGRNSFQRDKAKGFDEV

SEQ ID NO: 555548 - protein, 8 aa, Mycobacterium
QVNGRSAA

SEQ ID NO: 555549 - protein, 9 aa, Mycobacterium
QVNGRSAAD

SEQ ID NO: 555550 - protein, 19 aa, Mycobacterium
QVNGRSSFQRDKAKGLEQY

SEQ ID NO: 555551 - protein, 9 aa, Mycobacterium
QVNGVPRDE

SEQ ID NO: 555552 - protein, 19 aa, Mycobacterium
QVNPDDTFAPAPDTDDHEA

SEQ ID NO: 555553 - protein, 7 aa, Mycobacterium
QVNPSGR

SEQ ID NO: 555554 - protein, 5 aa, Mycobacterium
QVNQG

SEQ ID NO: 555555 - protein, 4 aa, Mycobacterium
QVNR

SEQ ID NO: 555556 - protein, 8 aa, Mycobacterium
QVNSPTYQ

SEQ ID NO: 555557 - protein, 11 aa, Mycobacterium
QVNTGIGNSGH

SEQ ID NO: 555558 - protein, 4 aa, Mycobacterium
QVPA

SEQ ID NO: 555559 - protein, 8 aa, Mycobacterium
QVPAPGAL

SEQ ID NO: 555560 - protein, 7 aa, Mycobacterium
QVPDADD

SEQ ID NO: 555561 - protein, 12 aa, Mycobacterium
QVPEADAAEQHR

SEQ ID NO: 555562 - protein, 11 aa, Mycobacterium
QVPEGAAPAGR

SEQ ID NO: 555563 - protein, 8 aa, Mycobacterium
QVPEGERS

SEQ ID NO: 555564 - protein, 7 aa, Mycobacterium
QVPEGTP

SEQ ID NO: 555565 - protein, 5 aa, Mycobacterium
QVPGA

SEQ ID NO: 555566 - protein, 8 aa, Mycobacterium
QVPGSTSA

SEQ ID NO: 555567 - protein, 10 aa, Mycobacterium
QVPLPKPPQP

SEQ ID NO: 555568 - protein, 4 aa, Mycobacterium
QVPM

SEQ ID NO: 555569 - protein, 5 aa, Mycobacterium
QVPPA

SEQ ID NO: 555570 - protein, 5 aa, Mycobacterium
QVPPG

SEQ ID NO: 555571 - protein, 15 aa, Mycobacterium
QVPPLEDYNPATSPV

SEQ ID NO: 555572 - protein, 17 aa, Mycobacterium
QVPPPFSGLPSADDAEW

SEQ ID NO: 555573 - protein, 12 aa, Mycobacterium
QVPPPQGKADAP

SEQ ID NO: 555574 - protein, 8 aa, Mycobacterium
QVPPQADM

SEQ ID NO: 555575 - protein, 5 aa, Mycobacterium
QVPRG

SEQ ID NO: 555576 - protein, 9 aa, Mycobacterium
QVPRKGSYF

SEQ ID NO: 555577 - protein, 7 aa, Mycobacterium
QVPRPAR

SEQ ID NO: 555578 - protein, 5 aa, Mycobacterium
QVPSA

SEQ ID NO: 555579 - protein, 9 aa, Mycobacterium
QVPSELPTS

SEQ ID NO: 555580 - protein, 6 aa, Mycobacterium
QVPSEQ

SEQ ID NO: 555581 - protein, 16 aa, Mycobacterium
QVPSPQQRQVARPGEW

SEQ ID NO: 555582 - protein, 6 aa, Mycobacterium
QVPSSV

SEQ ID NO: 555583 - protein, 5 aa, Mycobacterium
QVPST

SEQ ID NO: 555584 - protein, 7 aa, Mycobacterium
QVPSTGE

SEQ ID NO: 555585 - protein, 5 aa, Mycobacterium
QVPTD

SEQ ID NO: 555586 - protein, 7 aa, Mycobacterium
QVPTGDE

SEQ ID NO: 555587 - protein, 5 aa, Mycobacterium
QVPTS

SEQ ID NO: 555588 - protein, 5 aa, Mycobacterium
QVPVS

SEQ ID NO: 555589 - protein, 4 aa, Mycobacterium
QVQA

SEQ ID NO: 555590 - protein, 5 aa, Mycobacterium
QVQAG

SEQ ID NO: 555591 - protein, 8 aa, Mycobacterium
QVQDEGSQ

SEQ ID NO: 555592 - protein, 5 aa, Mycobacterium
QVQDG

SEQ ID NO: 555593 - protein, 7 aa, Mycobacterium
QVQGGRT

SEQ ID NO: 555594 - protein, 14 aa, Mycobacterium
QVQPPHRPDGDNRE

SEQ ID NO: 555595 - protein, 5 aa, Mycobacterium
QVQPR

SEQ ID NO: 555596 - protein, 11 aa, Mycobacterium
QVQQGKASDLR

SEQ ID NO: 555597 - protein, 4 aa, Mycobacterium
QVQR

SEQ ID NO: 555598 - protein, 11 aa, Mycobacterium
QVQTDAEQGLA

SEQ ID NO: 555599 - protein, 5 aa, Mycobacterium
QVRAG

SEQ ID NO: 555600 - protein, 9 aa, Mycobacterium
QVRAPDPAE

SEQ ID NO: 555601 - protein, 13 aa, Mycobacterium
QVRARNSDASAAL

SEQ ID NO: 555602 - protein, 9 aa, Mycobacterium
QVRASGRKA

SEQ ID NO: 555603 - protein, 10 aa, Mycobacterium
QVRASGRKAL

SEQ ID NO: 555604 - protein, 4 aa, Mycobacterium
QVRD

SEQ ID NO: 555605 - protein, 12 aa, Mycobacterium
QVRDAAPGATES

SEQ ID NO: 555606 - protein, 5 aa, Mycobacterium
QVRDG

SEQ ID NO: 555607 - protein, 8 aa, Mycobacterium
QVRDGKLT

SEQ ID NO: 555608 - protein, 6 aa, Mycobacterium
QVRDGR

SEQ ID NO: 555609 - protein, 9 aa, Mycobacterium
QVRDNARRT

SEQ ID NO: 555610 - protein, 11 aa, Mycobacterium
QVRDNSRRTIA

SEQ ID NO: 555611 - protein, 10 aa, Mycobacterium
QVRDTQRSRR

SEQ ID NO: 555612 - protein, 17 aa, Mycobacterium
QVRDTQRSRRLASDAPS

SEQ ID NO: 555613 - protein, 9 aa, Mycobacterium
QVRGDRQSI

SEQ ID NO: 555614 - protein, 4 aa, Mycobacterium
QVRP

SEQ ID NO: 555615 - protein, 6 aa, Mycobacterium
QVRPDE

SEQ ID NO: 555616 - protein, 4 aa, Mycobacterium
QVRR

SEQ ID NO: 555617 - protein, 5 aa, Mycobacterium
QVRRP

SEQ ID NO: 555618 - protein, 6 aa, Mycobacterium
QVRSGD

SEQ ID NO: 555619 - protein, 20 aa, Mycobacterium
QVRSGKLGKKAAKADRPAWG

SEQ ID NO: 555620 - protein, 5 aa, Mycobacterium
QVRTG

SEQ ID NO: 555621 - protein, 9 aa, Mycobacterium
QVRTPKASA

SEQ ID NO: 555622 - protein, 7 aa, Mycobacterium
QVRTTTT

SEQ ID NO: 555623 - protein, 9 aa, Mycobacterium
QVSADSGRT

SEQ ID NO: 555624 - protein, 9 aa, Mycobacterium
QVSAESGRT

SEQ ID NO: 555625 - protein, 7 aa, Mycobacterium
QVSAPGQ

SEQ ID NO: 555626 - protein, 33 aa, Mycobacterium
QVSASNGGTATGTVSGGYGGAGTTGGHGGGGGN

SEQ ID NO: 555627 - protein, 8 aa, Mycobacterium
QVSASQDG

SEQ ID NO: 555628 - protein, 13 aa, Mycobacterium
QVSATAPDGPDVR

SEQ ID NO: 555629 - protein, 9 aa, Mycobacterium
QVSDADSAL

SEQ ID NO: 555630 - protein, 6 aa, Mycobacterium
QVSDNG

SEQ ID NO: 555631 - protein, 9 aa, Mycobacterium
QVSDRADRA

SEQ ID NO: 555632 - protein, 4 aa, Mycobacterium
QVSE

SEQ ID NO: 555633 - protein, 10 aa, Mycobacterium
QVSEGAYAPY

SEQ ID NO: 555634 - protein, 5 aa, Mycobacterium
QVSGA

SEQ ID NO: 555635 - protein, 8 aa, Mycobacterium
QVSGGHTV

SEQ ID NO: 555636 - protein, 8 aa, Mycobacterium
QVSGKYTD

SEQ ID NO: 555637 - protein, 11 aa, Mycobacterium
QVSGMTSSAQQ

SEQ ID NO: 555638 - protein, 23 aa, Mycobacterium
QVSGRGKAAKTGARESARTADAR

SEQ ID NO: 555639 - protein, 7 aa, Mycobacterium
QVSGRKA

SEQ ID NO: 555640 - protein, 12 aa, Mycobacterium
QVSIDGKTHKLP

SEQ ID NO: 555641 - protein, 9 aa, Mycobacterium
QVSIDGQTH

SEQ ID NO: 555642 - protein, 12 aa, Mycobacterium
QVSLDGQTRQLP

SEQ ID NO: 555643 - protein, 64 aa, Mycobacterium
QVSNSGHVDSDGDQSAVPNGTPADEQKTVGLDGKEYRKPKPRKKPEPKPVEETAQTEDTPPARA

SEQ ID NO: 555644 - protein, 9 aa, Mycobacterium
QVSPAPPVR

SEQ ID NO: 555645 - protein, 11 aa, Mycobacterium
QVSPDVTAGEY

SEQ ID NO: 555646 - protein, 7 aa, Mycobacterium
QVSPSTL

SEQ ID NO: 555647 - protein, 10 aa, Mycobacterium
QVSPVRTATP

SEQ ID NO: 555648 - protein, 4 aa, Mycobacterium
QVSQ

SEQ ID NO: 555649 - protein, 9 aa, Mycobacterium
QVSQNGSFE

SEQ ID NO: 555650 - protein, 4 aa, Mycobacterium
QVSR

SEQ ID NO: 555651 - protein, 4 aa, Mycobacterium
QVSS

SEQ ID NO: 555652 - protein, 8 aa, Mycobacterium
QVSSGDSD

SEQ ID NO: 555653 - protein, 6 aa, Mycobacterium
QVSSTD

SEQ ID NO: 555654 - protein, 11 aa, Mycobacterium
QVSSTTTSLGG

SEQ ID NO: 555655 - protein, 5 aa, Mycobacterium
QVSSV

SEQ ID NO: 555656 - protein, 12 aa, Mycobacterium
QVSTKAAGTHAG

SEQ ID NO: 555657 - protein, 12 aa, Mycobacterium
QVSTRAASTHAG

SEQ ID NO: 555658 - protein, 4 aa, Mycobacterium
QVTA

SEQ ID NO: 555659 - protein, 6 aa, Mycobacterium
QVTAAS

SEQ ID NO: 555660 - protein, 18 aa, Mycobacterium
QVTATADRQLRQSRAPGV

SEQ ID NO: 555661 - protein, 4 aa, Mycobacterium
QVTD

SEQ ID NO: 555662 - protein, 6 aa, Mycobacterium
QVTDEQ

SEQ ID NO: 555663 - protein, 8 aa, Mycobacterium
QVTDGDSA

SEQ ID NO: 555664 - protein, 7 aa, Mycobacterium
QVTDPAT

SEQ ID NO: 555665 - protein, 8 aa, Mycobacterium
QVTDPATW

SEQ ID NO: 555666 - protein, 6 aa, Mycobacterium
QVTEQH

SEQ ID NO: 555667 - protein, 9 aa, Mycobacterium
QVTGAGSST

SEQ ID NO: 555668 - protein, 13 aa, Mycobacterium
QVTGDAPAGPARL

SEQ ID NO: 555669 - protein, 11 aa, Mycobacterium
QVTGGHPSTSG

SEQ ID NO: 555670 - protein, 13 aa, Mycobacterium
QVTIGSDRQLDDE

SEQ ID NO: 555671 - protein, 4 aa, Mycobacterium
QVTK

SEQ ID NO: 555672 - protein, 5 aa, Mycobacterium
QVTKD

SEQ ID NO: 555673 - protein, 6 aa, Mycobacterium
QVTPGH

SEQ ID NO: 555674 - protein, 6 aa, Mycobacterium
QVTPPE

SEQ ID NO: 555675 - protein, 5 aa, Mycobacterium
QVTQP

SEQ ID NO: 555676 - protein, 7 aa, Mycobacterium
QVTSETP

SEQ ID NO: 555677 - protein, 10 aa, Mycobacterium
QVTSYGPPAS

SEQ ID NO: 555678 - protein, 12 aa, Mycobacterium
QVTTNSNDAAAA

SEQ ID NO: 555679 - protein, 7 aa, Mycobacterium
QVTTTNE

SEQ ID NO: 555680 - protein, 18 aa, Mycobacterium
QVTVTGTKPGSADYDTDL

SEQ ID NO: 555681 - protein, 14 aa, Mycobacterium
QVVGPRDGETPRTR

SEQ ID NO: 555682 - protein, 14 aa, Mycobacterium
QVVGPREGDTPRTR

SEQ ID NO: 555683 - protein, 6 aa, Mycobacterium
QVVGTG

SEQ ID NO: 555684 - protein, 11 aa, Mycobacterium
QVYDQSGLGAE

SEQ ID NO: 555685 - protein, 12 aa, Mycobacterium
QVYDQSGLGPED

SEQ ID NO: 555686 - protein, 12 aa, Mycobacterium
QVYDQSGLGPQD

SEQ ID NO: 555687 - protein, 16 aa, Mycobacterium
QWADESAARGTYPSLT

SEQ ID NO: 555688 - protein, 16 aa, Mycobacterium
QWADESASRGTYPSLA

SEQ ID NO: 555689 - protein, 5 aa, Mycobacterium
QWAEP

SEQ ID NO: 555690 - protein, 9 aa, Mycobacterium
QWDGASADL

SEQ ID NO: 555691 - protein, 6 aa, Mycobacterium
QWDPGK

SEQ ID NO: 555692 - protein, 10 aa, Mycobacterium
QWDPKKQRPE

SEQ ID NO: 555693 - protein, 10 aa, Mycobacterium
QWDPKNQRPE

SEQ ID NO: 555694 - protein, 5 aa, Mycobacterium
QWDRA

SEQ ID NO: 555695 - protein, 12 aa, Mycobacterium
QWEGTSAEPATV

SEQ ID NO: 555696 - protein, 5 aa, Mycobacterium
QWEQA

SEQ ID NO: 555697 - protein, 4 aa, Mycobacterium
QWER

SEQ ID NO: 555698 - protein, 5 aa, Mycobacterium
QWGDA

SEQ ID NO: 555699 - protein, 5 aa, Mycobacterium
QWGGA

SEQ ID NO: 555700 - protein, 5 aa, Mycobacterium
QWGPG

SEQ ID NO: 555701 - protein, 6 aa, Mycobacterium
QWGPGS

SEQ ID NO: 555702 - protein, 9 aa, Mycobacterium
QWGPPATKD

SEQ ID NO: 555703 - protein, 9 aa, Mycobacterium
QWGPPATRD

SEQ ID NO: 555704 - protein, 6 aa, Mycobacterium
QWGPPV

SEQ ID NO: 555705 - protein, 8 aa, Mycobacterium
QWGQRPNA

SEQ ID NO: 555706 - protein, 13 aa, Mycobacterium
QWGSQPALAEGGH

SEQ ID NO: 555707 - protein, 6 aa, Mycobacterium
QWKGRD

SEQ ID NO: 555708 - protein, 13 aa, Mycobacterium
QWPGEPEPVDTTA

SEQ ID NO: 555709 - protein, 12 aa, Mycobacterium
QWPGTSDDFGRE

SEQ ID NO: 555710 - protein, 7 aa, Mycobacterium
QWPPATT

SEQ ID NO: 555711 - protein, 7 aa, Mycobacterium
QWPPGAE

SEQ ID NO: 555712 - protein, 13 aa, Mycobacterium
QWQTDPKDLPASN

SEQ ID NO: 555713 - protein, 7 aa, Mycobacterium
QWQTDPV

SEQ ID NO: 555714 - protein, 7 aa, Mycobacterium
QWRDTSQ

SEQ ID NO: 555715 - protein, 12 aa, Mycobacterium
QWRGRPKNQDAY

SEQ ID NO: 555716 - protein, 5 aa, Mycobacterium
QWRNR

SEQ ID NO: 555717 - protein, 5 aa, Mycobacterium
QWRPD

SEQ ID NO: 555718 - protein, 6 aa, Mycobacterium
QWSDPS

SEQ ID NO: 555719 - protein, 29 aa, Mycobacterium
QWSRETTRRQETFDQASSGKTLSSHLGPS

SEQ ID NO: 555720 - protein, 6 aa, Mycobacterium
QWSTEK

SEQ ID NO: 555721 - protein, 5 aa, Mycobacterium
QWTGR

SEQ ID NO: 555722 - protein, 16 aa, Mycobacterium
QWTPESTEPAAHPNSR

SEQ ID NO: 555723 - protein, 13 aa, Mycobacterium
QWTPPDDRTGTDT

SEQ ID NO: 555724 - protein, 5 aa, Mycobacterium
QWTPR

SEQ ID NO: 555725 - protein, 11 aa, Mycobacterium
QYAESEEEADQ

SEQ ID NO: 555726 - protein, 7 aa, Mycobacterium
QYAETQD

SEQ ID NO: 555727 - protein, 11 aa, Mycobacterium
QYAGREKEIGA

SEQ ID NO: 555728 - protein, 6 aa, Mycobacterium
QYAGSG

SEQ ID NO: 555729 - protein, 16 aa, Mycobacterium
QYAKDSGIDLWRQSSD

SEQ ID NO: 555730 - protein, 13 aa, Mycobacterium
QYAKPRSSDTDAL

SEQ ID NO: 555731 - protein, 14 aa, Mycobacterium
QYALPGGQSEPGED

SEQ ID NO: 555732 - protein, 4 aa, Mycobacterium
QYAP

SEQ ID NO: 555733 - protein, 8 aa, Mycobacterium
QYAPQGWY

SEQ ID NO: 555734 - protein, 10 aa, Mycobacterium
QYAPSGPSSA

SEQ ID NO: 555735 - protein, 5 aa, Mycobacterium
QYAQS

SEQ ID NO: 555736 - protein, 4 aa, Mycobacterium
QYAS

SEQ ID NO: 555737 - protein, 12 aa, Mycobacterium
QYASNRHPGGAV

SEQ ID NO: 555738 - protein, 7 aa, Mycobacterium
QYDEGNV

SEQ ID NO: 555739 - protein, 10 aa, Mycobacterium
QYDGTGNFPQ

SEQ ID NO: 555740 - protein, 12 aa, Mycobacterium
QYDGYPGPDIPG

SEQ ID NO: 555741 - protein, 6 aa, Mycobacterium
QYDPDT

SEQ ID NO: 555742 - protein, 8 aa, Mycobacterium
QYDPTSDF

SEQ ID NO: 555743 - protein, 9 aa, Mycobacterium
QYDPTSDFP

SEQ ID NO: 555744 - protein, 5 aa, Mycobacterium
QYDTP

SEQ ID NO: 555745 - protein, 4 aa, Mycobacterium
QYED

SEQ ID NO: 555746 - protein, 5 aa, Mycobacterium
QYEDL

SEQ ID NO: 555747 - protein, 8 aa, Mycobacterium
QYEGQGAE

SEQ ID NO: 555748 - protein, 11 aa, Mycobacterium
QYEHQGNPYYS

SEQ ID NO: 555749 - protein, 12 aa, Mycobacterium
QYEPYDRPPLSK

SEQ ID NO: 555750 - protein, 8 aa, Mycobacterium
QYERDGHD

SEQ ID NO: 555751 - protein, 4 aa, Mycobacterium
QYEW

SEQ ID NO: 555752 - protein, 7 aa, Mycobacterium
QYGAPTY

SEQ ID NO: 555753 - protein, 9 aa, Mycobacterium
QYGEQSNNI

SEQ ID NO: 555754 - protein, 4 aa, Mycobacterium
QYGG

SEQ ID NO: 555755 - protein, 8 aa, Mycobacterium
QYGGHGRS

SEQ ID NO: 555756 - protein, 7 aa, Mycobacterium
QYGGRDA

SEQ ID NO: 555757 - protein, 4 aa, Mycobacterium
QYGN

SEQ ID NO: 555758 - protein, 9 aa, Mycobacterium
QYGPGHADR

SEQ ID NO: 555759 - protein, 7 aa, Mycobacterium
QYGPGQL

SEQ ID NO: 555760 - protein, 6 aa, Mycobacterium
QYGRKG

SEQ ID NO: 555761 - protein, 10 aa, Mycobacterium
QYGRPDAKTQ

SEQ ID NO: 555762 - protein, 6 aa, Mycobacterium
QYGTTA

SEQ ID NO: 555763 - protein, 7 aa, Mycobacterium
QYGTTTI

SEQ ID NO: 555764 - protein, 6 aa, Mycobacterium
QYGYAK

SEQ ID NO: 555765 - protein, 5 aa, Mycobacterium
QYKDY

SEQ ID NO: 555766 - protein, 8 aa, Mycobacterium
QYKSYRGM

SEQ ID NO: 555767 - protein, 11 aa, Mycobacterium
QYNADQGEVSV

SEQ ID NO: 555768 - protein, 19 aa, Mycobacterium
QYNGYRDEEGVAKDSDTET

SEQ ID NO: 555769 - protein, 20 aa, Mycobacterium
QYPAATARAVTTASAGGPFT

SEQ ID NO: 555770 - protein, 12 aa, Mycobacterium
QYPAGDMSVWNW

SEQ ID NO: 555771 - protein, 11 aa, Mycobacterium
QYPANTGDRPA

SEQ ID NO: 555772 - protein, 12 aa, Mycobacterium
QYPAPTIGTANA

SEQ ID NO: 555773 - protein, 5 aa, Mycobacterium
QYPDD

SEQ ID NO: 555774 - protein, 8 aa, Mycobacterium
QYPDNPTK

SEQ ID NO: 555775 - protein, 4 aa, Mycobacterium
QYPE

SEQ ID NO: 555776 - protein, 26 aa, Mycobacterium
QYPGGAGAGPAHDQPPLDYPPYRSTT

SEQ ID NO: 555777 - protein, 6 aa, Mycobacterium
QYPGRE

SEQ ID NO: 555778 - protein, 6 aa, Mycobacterium
QYPGSS

SEQ ID NO: 555779 - protein, 7 aa, Mycobacterium
QYPGTEG

SEQ ID NO: 555780 - protein, 5 aa, Mycobacterium
QYPGY

SEQ ID NO: 555781 - protein, 6 aa, Mycobacterium
QYPHGE

SEQ ID NO: 555782 - protein, 10 aa, Mycobacterium
QYPLGRADEA

SEQ ID NO: 555783 - protein, 10 aa, Mycobacterium
QYPNASLRRN

SEQ ID NO: 555784 - protein, 29 aa, Mycobacterium
QYPNQQAGARGCRQGVGPEALESLGRLSV

SEQ ID NO: 555785 - protein, 6 aa, Mycobacterium
QYPPDE

SEQ ID NO: 555786 - protein, 6 aa, Mycobacterium
QYPPGD

SEQ ID NO: 555787 - protein, 7 aa, Mycobacterium
QYPPGQV

SEQ ID NO: 555788 - protein, 20 aa, Mycobacterium
QYPPSTASAVATASAGGPFT

SEQ ID NO: 555789 - protein, 5 aa, Mycobacterium
QYPQI

SEQ ID NO: 555790 - protein, 13 aa, Mycobacterium
QYPRQGGKQDFGS

SEQ ID NO: 555791 - protein, 9 aa, Mycobacterium
QYPSLTPEQ

SEQ ID NO: 555792 - protein, 23 aa, Mycobacterium
QYQADKQAEDRARAERAAAAGFN

SEQ ID NO: 555793 - protein, 9 aa, Mycobacterium
QYQAQYREQ

SEQ ID NO: 555794 - protein, 12 aa, Mycobacterium
QYQETMTRARAG

SEQ ID NO: 555795 - protein, 19 aa, Mycobacterium
QYQGYRDEAGVARDSDTET

SEQ ID NO: 555796 - protein, 6 aa, Mycobacterium
QYQNPD

SEQ ID NO: 555797 - protein, 11 aa, Mycobacterium
QYQQAKAQPWR

SEQ ID NO: 555798 - protein, 5 aa, Mycobacterium
QYQRP

SEQ ID NO: 555799 - protein, 5 aa, Mycobacterium
QYQSL

SEQ ID NO: 555800 - protein, 10 aa, Mycobacterium
QYRDSGDGPP

SEQ ID NO: 555801 - protein, 7 aa, Mycobacterium
QYREGAE

SEQ ID NO: 555802 - protein, 11 aa, Mycobacterium
QYRNAGTLPDG

SEQ ID NO: 555803 - protein, 6 aa, Mycobacterium
QYRPDQ

SEQ ID NO: 555804 - protein, 7 aa, Mycobacterium
QYRPRSA

SEQ ID NO: 555805 - protein, 10 aa, Mycobacterium
QYRQAPPSGP

SEQ ID NO: 555806 - protein, 4 aa, Mycobacterium
QYRS

SEQ ID NO: 555807 - protein, 7 aa, Mycobacterium
QYSAPGA

SEQ ID NO: 555808 - protein, 7 aa, Mycobacterium
QYSDESL

SEQ ID NO: 555809 - protein, 5 aa, Mycobacterium
QYSDY

SEQ ID NO: 555810 - protein, 14 aa, Mycobacterium
QYSEALRRDDPSYH

SEQ ID NO: 555811 - protein, 5 aa, Mycobacterium
QYSEP

SEQ ID NO: 555812 - protein, 5 aa, Mycobacterium
QYSGD

SEQ ID NO: 555813 - protein, 13 aa, Mycobacterium
QYSGSGDEPGLQG

SEQ ID NO: 555814 - protein, 9 aa, Mycobacterium
QYSGTDPYA

SEQ ID NO: 555815 - protein, 4 aa, Mycobacterium
QYSK

SEQ ID NO: 555816 - protein, 4 aa, Mycobacterium
QYSQ

SEQ ID NO: 555817 - protein, 5 aa, Mycobacterium
QYTDG

SEQ ID NO: 555818 - protein, 16 aa, Mycobacterium
QYTDGSGYSPNLPQGC

SEQ ID NO: 555819 - protein, 7 aa, Mycobacterium
QYTDRTG

SEQ ID NO: 555820 - protein, 5 aa, Mycobacterium
QYTGG

SEQ ID NO: 555821 - protein, 16 aa, Mycobacterium
QYTGNSISRDDFNEKA

SEQ ID NO: 555822 - protein, 8 aa, Mycobacterium
QYTGRPST

SEQ ID NO: 555823 - protein, 7 aa, Mycobacterium
QYTKEEA

SEQ ID NO: 555824 - protein, 16 aa, Mycobacterium
QYTKERKAFGKPIGSF

SEQ ID NO: 555825 - protein, 13 aa, Mycobacterium
QYTPIDDDTAANW

SEQ ID NO: 555826 - protein, 6 aa, Mycobacterium
RAAAAA

SEQ ID NO: 555827 - protein, 11 aa, Mycobacterium
RAAAAAAQASA

SEQ ID NO: 555828 - protein, 13 aa, Mycobacterium
RAAAAAAQGPGRC

SEQ ID NO: 555829 - protein, 13 aa, Mycobacterium
RAAAADTSGVSID

SEQ ID NO: 555830 - protein, 11 aa, Mycobacterium
RAAAAERGLTN

SEQ ID NO: 555831 - protein, 22 aa, Mycobacterium
RAAAAGADLSAAYQAARDAVGR

SEQ ID NO: 555832 - protein, 23 aa, Mycobacterium
RAAAAGEDLESVGRAADATASRT

SEQ ID NO: 555833 - protein, 9 aa, Mycobacterium
RAAAAGNDL

SEQ ID NO: 555834 - protein, 8 aa, Mycobacterium
RAAAASDA

SEQ ID NO: 555835 - protein, 7 aa, Mycobacterium
RAAAATT

SEQ ID NO: 555836 - protein, 10 aa, Mycobacterium
RAAADDLKGK

SEQ ID NO: 555837 - protein, 9 aa, Mycobacterium
RAAADGKTV

SEQ ID NO: 555838 - protein, 17 aa, Mycobacterium
RAAADGKTVATPEEPKD

SEQ ID NO: 555839 - protein, 17 aa, Mycobacterium
RAAADGKTVATPQEQKD

SEQ ID NO: 555840 - protein, 17 aa, Mycobacterium
RAAADGKTVTTAEEPKD

SEQ ID NO: 555841 - protein, 17 aa, Mycobacterium
RAAADGKTVTTPEEPKD

SEQ ID NO: 555842 - protein, 17 aa, Mycobacterium
RAAADNSDLPLSDSDRL

SEQ ID NO: 555843 - protein, 15 aa, Mycobacterium
RAAADSGRAGEDGLG

SEQ ID NO: 555844 - protein, 6 aa, Mycobacterium
RAAAEA

SEQ ID NO: 555845 - protein, 19 aa, Mycobacterium
RAAAEADLAGKAAGYRPEQ

SEQ ID NO: 555846 - protein, 7 aa, Mycobacterium
RAAAEAM

SEQ ID NO: 555847 - protein, 6 aa, Mycobacterium
RAAAEE

SEQ ID NO: 555848 - protein, 21 aa, Mycobacterium
RAAAEEAAGVPVRRRGKGLAS

SEQ ID NO: 555849 - protein, 8 aa, Mycobacterium
RAAAEGAP

SEQ ID NO: 555850 - protein, 8 aa, Mycobacterium
RAAAEGFK

SEQ ID NO: 555851 - protein, 11 aa, Mycobacterium
RAAAELGSAQD

SEQ ID NO: 555852 - protein, 11 aa, Mycobacterium
RAAAEQAADGY

SEQ ID NO: 555853 - protein, 21 aa, Mycobacterium
RAAAERAAGIGTRKRGKGLAS

SEQ ID NO: 555854 - protein, 7 aa, Mycobacterium
RAAAERG

SEQ ID NO: 555855 - protein, 11 aa, Mycobacterium
RAAAESDGPLP

SEQ ID NO: 555856 - protein, 15 aa, Mycobacterium
RAAAEVAADSYERSL

SEQ ID NO: 555857 - protein, 5 aa, Mycobacterium
RAAAG

SEQ ID NO: 555858 - protein, 12 aa, Mycobacterium
RAAAGERAQQPR

SEQ ID NO: 555859 - protein, 17 aa, Mycobacterium
RAAAGGAAQDPAHADAH

SEQ ID NO: 555860 - protein, 10 aa, Mycobacterium
RAAAGGGDLD

SEQ ID NO: 555861 - protein, 10 aa, Mycobacterium
RAAAGGNSAD

SEQ ID NO: 555862 - protein, 9 aa, Mycobacterium
RAAAGPQDN

SEQ ID NO: 555863 - protein, 13 aa, Mycobacterium
RAAAGRLARPAEI

SEQ ID NO: 555864 - protein, 31 aa, Mycobacterium
RAAAGTPAPSKPEPDRGETAAARDRRTGKEM

SEQ ID NO: 555865 - protein, 12 aa, Mycobacterium
RAAAGVYDDRTG

SEQ ID NO: 555866 - protein, 8 aa, Mycobacterium
RAAAHADD

SEQ ID NO: 555867 - protein, 8 aa, Mycobacterium
RAAAMGAA

SEQ ID NO: 555868 - protein, 5 aa, Mycobacterium
RAAAN

SEQ ID NO: 555869 - protein, 9 aa, Mycobacterium
RAAANGRGL

SEQ ID NO: 555870 - protein, 6 aa, Mycobacterium
RAAANK

SEQ ID NO: 555871 - protein, 7 aa, Mycobacterium
RAAAPDA

SEQ ID NO: 555872 - protein, 8 aa, Mycobacterium
RAAAPGDD

SEQ ID NO: 555873 - protein, 10 aa, Mycobacterium
RAAAPPPLPP

SEQ ID NO: 555874 - protein, 7 aa, Mycobacterium
RAAAPRK

SEQ ID NO: 555875 - protein, 6 aa, Mycobacterium
RAAAQA

SEQ ID NO: 555876 - protein, 10 aa, Mycobacterium
RAAAQDPTPP

SEQ ID NO: 555877 - protein, 6 aa, Mycobacterium
RAAAQR

SEQ ID NO: 555878 - protein, 7 aa, Mycobacterium
RAAARAE

SEQ ID NO: 555879 - protein, 45 aa, Mycobacterium
RAAARQGTHSTKTRGDVSGGGRKPYRQKGTGRARQGSTRAPQFTG

SEQ ID NO: 555880 - protein, 14 aa, Mycobacterium
RAAARQSVKAATDD

SEQ ID NO: 555881 - protein, 6 aa, Mycobacterium
RAAART

SEQ ID NO: 555882 - protein, 6 aa, Mycobacterium
RAAARY

SEQ ID NO: 555883 - protein, 6 aa, Mycobacterium
RAAASA

SEQ ID NO: 555884 - protein, 6 aa, Mycobacterium
RAAASE

SEQ ID NO: 555885 - protein, 7 aa, Mycobacterium
RAAASLK

SEQ ID NO: 555886 - protein, 9 aa, Mycobacterium
RAAASQAWQ

SEQ ID NO: 555887 - protein, 7 aa, Mycobacterium
RAAASRD

SEQ ID NO: 555888 - protein, 11 aa, Mycobacterium
RAAASRRPQPV

SEQ ID NO: 555889 - protein, 16 aa, Mycobacterium
RAAASVTRPDGDGRRL

SEQ ID NO: 555890 - protein, 10 aa, Mycobacterium
RAAATAPAGV

SEQ ID NO: 555891 - protein, 8 aa, Mycobacterium
RAAATAPY

SEQ ID NO: 555892 - protein, 7 aa, Mycobacterium
RAAATAR

SEQ ID NO: 555893 - protein, 12 aa, Mycobacterium
RAAATGGDLNTV

SEQ ID NO: 555894 - protein, 9 aa, Mycobacterium
RAAATTGYL

SEQ ID NO: 555895 - protein, 5 aa, Mycobacterium
RAAAV

SEQ ID NO: 555896 - protein, 14 aa, Mycobacterium
RAAAVNAAAGAERI

SEQ ID NO: 555897 - protein, 9 aa, Mycobacterium
RAAAVSGGV

SEQ ID NO: 555898 - protein, 4 aa, Mycobacterium
RAAD

SEQ ID NO: 555899 - protein, 5 aa, Mycobacterium
RAADA

SEQ ID NO: 555900 - protein, 8 aa, Mycobacterium
RAADAADA

SEQ ID NO: 555901 - protein, 8 aa, Mycobacterium
RAADAAGA

SEQ ID NO: 555902 - protein, 18 aa, Mycobacterium
RAADAEDGSSTFDDPETV

SEQ ID NO: 555903 - protein, 14 aa, Mycobacterium
RAADAKAYETLDRN

SEQ ID NO: 555904 - protein, 13 aa, Mycobacterium
RAADALRSARPTF

SEQ ID NO: 555905 - protein, 8 aa, Mycobacterium
RAADDAQA

SEQ ID NO: 555906 - protein, 8 aa, Mycobacterium
RAADDDRP

SEQ ID NO: 555907 - protein, 7 aa, Mycobacterium
RAADDPD

SEQ ID NO: 555908 - protein, 5 aa, Mycobacterium
RAADG

SEQ ID NO: 555909 - protein, 17 aa, Mycobacterium
RAADGEALQAASSGGQL

SEQ ID NO: 555910 - protein, 9 aa, Mycobacterium
RAADGQLPP

SEQ ID NO: 555911 - protein, 12 aa, Mycobacterium
RAADGSLAPTDL

SEQ ID NO: 555912 - protein, 8 aa, Mycobacterium
RAADGSTV

SEQ ID NO: 555913 - protein, 14 aa, Mycobacterium
RAADLTSEAGNSAS

SEQ ID NO: 555914 - protein, 13 aa, Mycobacterium
RAADNAVKVDPEL

SEQ ID NO: 555915 - protein, 8 aa, Mycobacterium
RAADPAAM

SEQ ID NO: 555916 - protein, 7 aa, Mycobacterium
RAADPDA

SEQ ID NO: 555917 - protein, 8 aa, Mycobacterium
RAADPERM

SEQ ID NO: 555918 - protein, 8 aa, Mycobacterium
RAADPPAM

SEQ ID NO: 555919 - protein, 11 aa, Mycobacterium
RAADQGGSWTP

SEQ ID NO: 555920 - protein, 5 aa, Mycobacterium
RAADR

SEQ ID NO: 555921 - protein, 8 aa, Mycobacterium
RAADRDDL

SEQ ID NO: 555922 - protein, 11 aa, Mycobacterium
RAADREDPGFD

SEQ ID NO: 555923 - protein, 7 aa, Mycobacterium
RAADRGE

SEQ ID NO: 555924 - protein, 7 aa, Mycobacterium
RAADRKY

SEQ ID NO: 555925 - protein, 5 aa, Mycobacterium
RAADS

SEQ ID NO: 555926 - protein, 9 aa, Mycobacterium
RAADSGDDL

SEQ ID NO: 555927 - protein, 9 aa, Mycobacterium
RAADSGGRG

SEQ ID NO: 555928 - protein, 9 aa, Mycobacterium
RAADSGTRG

SEQ ID NO: 555929 - protein, 10 aa, Mycobacterium
RAADTDPDPM

SEQ ID NO: 555930 - protein, 5 aa, Mycobacterium
RAAEA

SEQ ID NO: 555931 - protein, 8 aa, Mycobacterium
RAAEAAGA

SEQ ID NO: 555932 - protein, 16 aa, Mycobacterium
RAAEASAAGDPSGDEY

SEQ ID NO: 555933 - protein, 12 aa, Mycobacterium
RAAEATAQPELA

SEQ ID NO: 555934 - protein, 7 aa, Mycobacterium
RAAEDND

SEQ ID NO: 555935 - protein, 7 aa, Mycobacterium
RAAEDNE

SEQ ID NO: 555936 - protein, 6 aa, Mycobacterium
RAAEDT

SEQ ID NO: 555937 - protein, 5 aa, Mycobacterium
RAAEE

SEQ ID NO: 555938 - protein, 6 aa, Mycobacterium
RAAEEA

SEQ ID NO: 555939 - protein, 12 aa, Mycobacterium
RAAEEADKRGLA

SEQ ID NO: 555940 - protein, 9 aa, Mycobacterium
RAAEEGGRG

SEQ ID NO: 555941 - protein, 7 aa, Mycobacterium
RAAEELG

SEQ ID NO: 555942 - protein, 10 aa, Mycobacterium
RAAEERAAGK

SEQ ID NO: 555943 - protein, 8 aa, Mycobacterium
RAAEGEDN

SEQ ID NO: 555944 - protein, 8 aa, Mycobacterium
RAAEGRRR

SEQ ID NO: 555945 - protein, 11 aa, Mycobacterium
RAAEGTDDYRR

SEQ ID NO: 555946 - protein, 6 aa, Mycobacterium
RAAEGV

SEQ ID NO: 555947 - protein, 7 aa, Mycobacterium
RAAEHTG

SEQ ID NO: 555948 - protein, 10 aa, Mycobacterium
RAAEKSAEEV

SEQ ID NO: 555949 - protein, 20 aa, Mycobacterium
RAAELASAAGVSGSEEGHRL

SEQ ID NO: 555950 - protein, 10 aa, Mycobacterium
RAAEMGGDTS

SEQ ID NO: 555951 - protein, 9 aa, Mycobacterium
RAAENPGRG

SEQ ID NO: 555952 - protein, 7 aa, Mycobacterium
RAAEPAV

SEQ ID NO: 555953 - protein, 8 aa, Mycobacterium
RAAEPRLQ

SEQ ID NO: 555954 - protein, 6 aa, Mycobacterium
RAAEPV

SEQ ID NO: 555955 - protein, 8 aa, Mycobacterium
RAAEQGLP

SEQ ID NO: 555956 - protein, 9 aa, Mycobacterium
RAAEQLSGA

SEQ ID NO: 555957 - protein, 12 aa, Mycobacterium
RAAERDPRGPFI

SEQ ID NO: 555958 - protein, 14 aa, Mycobacterium
RAAEREAGKREGDL

SEQ ID NO: 555959 - protein, 6 aa, Mycobacterium
RAAERG

SEQ ID NO: 555960 - protein, 8 aa, Mycobacterium
RAAERLSE

SEQ ID NO: 555961 - protein, 9 aa, Mycobacterium
RAAERLSER

SEQ ID NO: 555962 - protein, 7 aa, Mycobacterium
RAAERQV

SEQ ID NO: 555963 - protein, 15 aa, Mycobacterium
RAAERRTAAAAADAA

SEQ ID NO: 555964 - protein, 20 aa, Mycobacterium
RAAERYTRRHGHRPKNDYGS

SEQ ID NO: 555965 - protein, 6 aa, Mycobacterium
RAAESG

SEQ ID NO: 555966 - protein, 18 aa, Mycobacterium
RAAESPATVAAYDGASSV

SEQ ID NO: 555967 - protein, 13 aa, Mycobacterium
RAAESPGSEAGAQ

SEQ ID NO: 555968 - protein, 8 aa, Mycobacterium
RAAESPKL

SEQ ID NO: 555969 - protein, 12 aa, Mycobacterium
RAAETASDNPLI

SEQ ID NO: 555970 - protein, 8 aa, Mycobacterium
RAAETERH

SEQ ID NO: 555971 - protein, 11 aa, Mycobacterium
RAAETESDNPL

SEQ ID NO: 555972 - protein, 8 aa, Mycobacterium
RAAETGRR

SEQ ID NO: 555973 - protein, 6 aa, Mycobacterium
RAAETH

SEQ ID NO: 555974 - protein, 8 aa, Mycobacterium
RAAETQPA

SEQ ID NO: 555975 - protein, 9 aa, Mycobacterium
RAAETQSEH

SEQ ID NO: 555976 - protein, 11 aa, Mycobacterium
RAAETRGENPL

SEQ ID NO: 555977 - protein, 8 aa, Mycobacterium
RAAETRRQ

SEQ ID NO: 555978 - protein, 11 aa, Mycobacterium
RAAETRSASPL

SEQ ID NO: 555979 - protein, 13 aa, Mycobacterium
RAAFDTADNLDGL

SEQ ID NO: 555980 - protein, 8 aa, Mycobacterium
RAAFESNG

SEQ ID NO: 555981 - protein, 8 aa, Mycobacterium
RAAFPGAQ

SEQ ID NO: 555982 - protein, 15 aa, Mycobacterium
RAAGAARDQTRPVDE

SEQ ID NO: 555983 - protein, 6 aa, Mycobacterium
RAAGAD

SEQ ID NO: 555984 - protein, 8 aa, Mycobacterium
RAAGADAI

SEQ ID NO: 555985 - protein, 9 aa, Mycobacterium
RAAGADAIH

SEQ ID NO: 555986 - protein, 10 aa, Mycobacterium
RAAGADPALA

SEQ ID NO: 555987 - protein, 6 aa, Mycobacterium
RAAGAG

SEQ ID NO: 555988 - protein, 13 aa, Mycobacterium
RAAGAGRAEPGPI

SEQ ID NO: 555989 - protein, 18 aa, Mycobacterium
RAAGAKAGFSVKPGTPLD

SEQ ID NO: 555990 - protein, 18 aa, Mycobacterium
RAAGAKAGISVKPGTPLD

SEQ ID NO: 555991 - protein, 18 aa, Mycobacterium
RAAGAKAGLSIKPGTPIE

SEQ ID NO: 555992 - protein, 18 aa, Mycobacterium
RAAGAKAGLSIKPGTPLE

SEQ ID NO: 555993 - protein, 18 aa, Mycobacterium
RAAGAKAGLSVKPGTPLE

SEQ ID NO: 555994 - protein, 26 aa, Mycobacterium
RAAGAPAAGEGARALRDAGLKTTTDL

SEQ ID NO: 555995 - protein, 14 aa, Mycobacterium
RAAGAPAATSPRSI

SEQ ID NO: 555996 - protein, 8 aa, Mycobacterium
RAAGAQQA

SEQ ID NO: 555997 - protein, 8 aa, Mycobacterium
RAAGAQRA

SEQ ID NO: 555998 - protein, 9 aa, Mycobacterium
RAAGASKAK

SEQ ID NO: 555999 - protein, 8 aa, Mycobacterium
RAAGASRA

SEQ ID NO: 556000 - protein, 9 aa, Mycobacterium
RAAGASRND

SEQ ID NO: 556001 - protein, 5 aa, Mycobacterium
RAAGD

SEQ ID NO: 556002 - protein, 9 aa, Mycobacterium
RAAGDDESL

SEQ ID NO: 556003 - protein, 10 aa, Mycobacterium
RAAGDPGEHE

SEQ ID NO: 556004 - protein, 5 aa, Mycobacterium
RAAGE

SEQ ID NO: 556005 - protein, 7 aa, Mycobacterium
RAAGEAV

SEQ ID NO: 556006 - protein, 9 aa, Mycobacterium
RAAGEDAPI

SEQ ID NO: 556007 - protein, 12 aa, Mycobacterium
RAAGEDASEDEA

SEQ ID NO: 556008 - protein, 6 aa, Mycobacterium
RAAGEL

SEQ ID NO: 556009 - protein, 6 aa, Mycobacterium
RAAGER

SEQ ID NO: 556010 - protein, 9 aa, Mycobacterium
RAAGERPAE

SEQ ID NO: 556011 - protein, 9 aa, Mycobacterium
RAAGESGRF

SEQ ID NO: 556012 - protein, 18 aa, Mycobacterium
RAAGGACSESAGDAQGMQ

SEQ ID NO: 556013 - protein, 9 aa, Mycobacterium
RAAGGADDR

SEQ ID NO: 556014 - protein, 17 aa, Mycobacterium
RAAGGEPAGLGARDTLR

SEQ ID NO: 556015 - protein, 8 aa, Mycobacterium
RAAGGGDI

SEQ ID NO: 556016 - protein, 9 aa, Mycobacterium
RAAGGGGGM

SEQ ID NO: 556017 - protein, 11 aa, Mycobacterium
RAAGGQASTIR

SEQ ID NO: 556018 - protein, 6 aa, Mycobacterium
RAAGGR

SEQ ID NO: 556019 - protein, 12 aa, Mycobacterium
RAAGGRKSRKHS

SEQ ID NO: 556020 - protein, 6 aa, Mycobacterium
RAAGGS

SEQ ID NO: 556021 - protein, 13 aa, Mycobacterium
RAAGGSAQAAPVD

SEQ ID NO: 556022 - protein, 10 aa, Mycobacterium
RAAGGTAVPT

SEQ ID NO: 556023 - protein, 6 aa, Mycobacterium
RAAGIP

SEQ ID NO: 556024 - protein, 5 aa, Mycobacterium
RAAGK

SEQ ID NO: 556025 - protein, 8 aa, Mycobacterium
RAAGLEPS

SEQ ID NO: 556026 - protein, 6 aa, Mycobacterium
RAAGNP

SEQ ID NO: 556027 - protein, 8 aa, Mycobacterium
RAAGNPWA

SEQ ID NO: 556028 - protein, 7 aa, Mycobacterium
RAAGPAL

SEQ ID NO: 556029 - protein, 7 aa, Mycobacterium
RAAGPDN

SEQ ID NO: 556030 - protein, 8 aa, Mycobacterium
RAAGPESI

SEQ ID NO: 556031 - protein, 9 aa, Mycobacterium
RAAGPNEPV

SEQ ID NO: 556032 - protein, 7 aa, Mycobacterium
RAAGPVR

SEQ ID NO: 556033 - protein, 9 aa, Mycobacterium
RAAGQAELA

SEQ ID NO: 556034 - protein, 14 aa, Mycobacterium
RAAGQRDNSAIEKR

SEQ ID NO: 556035 - protein, 7 aa, Mycobacterium
RAAGQSG

SEQ ID NO: 556036 - protein, 8 aa, Mycobacterium
RAAGQTDQ

SEQ ID NO: 556037 - protein, 5 aa, Mycobacterium
RAAGR

SEQ ID NO: 556038 - protein, 10 aa, Mycobacterium
RAAGRDPAEV

SEQ ID NO: 556039 - protein, 7 aa, Mycobacterium
RAAGRGA

SEQ ID NO: 556040 - protein, 12 aa, Mycobacterium
RAAGRNAGVPQH

SEQ ID NO: 556041 - protein, 7 aa, Mycobacterium
RAAGRNG

SEQ ID NO: 556042 - protein, 10 aa, Mycobacterium
RAAGRQRGYR

SEQ ID NO: 556043 - protein, 12 aa, Mycobacterium
RAAGRVDGVRPG

SEQ ID NO: 556044 - protein, 10 aa, Mycobacterium
RAAGRVEGVR

SEQ ID NO: 556045 - protein, 7 aa, Mycobacterium
RAAGSAV

SEQ ID NO: 556046 - protein, 6 aa, Mycobacterium
RAAGSE

SEQ ID NO: 556047 - protein, 9 aa, Mycobacterium
RAAGTAARL

SEQ ID NO: 556048 - protein, 8 aa, Mycobacterium
RAAGTFTP

SEQ ID NO: 556049 - protein, 10 aa, Mycobacterium
RAAGTLPGAR

SEQ ID NO: 556050 - protein, 13 aa, Mycobacterium
RAAGTSRQDPQPA

SEQ ID NO: 556051 - protein, 6 aa, Mycobacterium
RAAGVE

SEQ ID NO: 556052 - protein, 8 aa, Mycobacterium
RAAGVSRQ

SEQ ID NO: 556053 - protein, 6 aa, Mycobacterium
RAAGVT

SEQ ID NO: 556054 - protein, 8 aa, Mycobacterium
RAAGYTKG

SEQ ID NO: 556055 - protein, 4 aa, Mycobacterium
RAAH

SEQ ID NO: 556056 - protein, 9 aa, Mycobacterium
RAAHAGEDV

SEQ ID NO: 556057 - protein, 7 aa, Mycobacterium
RAAHPGA

SEQ ID NO: 556058 - protein, 18 aa, Mycobacterium
RAAHPSMRAEEAASAAVP

SEQ ID NO: 556059 - protein, 10 aa, Mycobacterium
RAAHQREGSI

SEQ ID NO: 556060 - protein, 9 aa, Mycobacterium
RAAIAGPLT

SEQ ID NO: 556061 - protein, 9 aa, Mycobacterium
RAAIGQPPI

SEQ ID NO: 556062 - protein, 4 aa, Mycobacterium
RAAK

SEQ ID NO: 556063 - protein, 8 aa, Mycobacterium
RAAKAQPL

SEQ ID NO: 556064 - protein, 6 aa, Mycobacterium
RAAKDA

SEQ ID NO: 556065 - protein, 15 aa, Mycobacterium
RAAKDGLSYGAPVEG

SEQ ID NO: 556066 - protein, 16 aa, Mycobacterium
RAAKDVTEAEALIHMV

SEQ ID NO: 556067 - protein, 8 aa, Mycobacterium
RAAKEQPL

SEQ ID NO: 556068 - protein, 9 aa, Mycobacterium
RAAKQNDQA

SEQ ID NO: 556069 - protein, 6 aa, Mycobacterium
RAAKSA

SEQ ID NO: 556070 - protein, 15 aa, Mycobacterium
RAAKSESIQTSDPAT

SEQ ID NO: 556071 - protein, 9 aa, Mycobacterium
RAAKSGTGT

SEQ ID NO: 556072 - protein, 5 aa, Mycobacterium
RAAKT

SEQ ID NO: 556073 - protein, 9 aa, Mycobacterium
RAALAGQAQ

SEQ ID NO: 556074 - protein, 7 aa, Mycobacterium
RAALENK

SEQ ID NO: 556075 - protein, 13 aa, Mycobacterium
RAALGDDGARRRR

SEQ ID NO: 556076 - protein, 11 aa, Mycobacterium
RAALRDSGYEC

SEQ ID NO: 556077 - protein, 6 aa, Mycobacterium
RAALSA

SEQ ID NO: 556078 - protein, 9 aa, Mycobacterium
RAALTNGGA

SEQ ID NO: 556079 - protein, 7 aa, Mycobacterium
RAAMSTR

SEQ ID NO: 556080 - protein, 5 aa, Mycobacterium
RAANE

SEQ ID NO: 556081 - protein, 8 aa, Mycobacterium
RAANPAAP

SEQ ID NO: 556082 - protein, 8 aa, Mycobacterium
RAANPDAP

SEQ ID NO: 556083 - protein, 7 aa, Mycobacterium
RAANQKQ

SEQ ID NO: 556084 - protein, 7 aa, Mycobacterium
RAANSSI

SEQ ID NO: 556085 - protein, 10 aa, Mycobacterium
RAANYPPERV

SEQ ID NO: 556086 - protein, 5 aa, Mycobacterium
RAAPA

SEQ ID NO: 556087 - protein, 20 aa, Mycobacterium
RAAPARPTQRPMSQGANPWS

SEQ ID NO: 556088 - protein, 7 aa, Mycobacterium
RAAPATA

SEQ ID NO: 556089 - protein, 5 aa, Mycobacterium
RAAPD

SEQ ID NO: 556090 - protein, 8 aa, Mycobacterium
RAAPDADV

SEQ ID NO: 556091 - protein, 8 aa, Mycobacterium
RAAPDAEV

SEQ ID NO: 556092 - protein, 16 aa, Mycobacterium
RAAPDGAVPARATEIS

SEQ ID NO: 556093 - protein, 8 aa, Mycobacterium
RAAPEEPN

SEQ ID NO: 556094 - protein, 5 aa, Mycobacterium
RAAPG

SEQ ID NO: 556095 - protein, 6 aa, Mycobacterium
RAAPGA

SEQ ID NO: 556096 - protein, 8 aa, Mycobacterium
RAAPGGQR

SEQ ID NO: 556097 - protein, 14 aa, Mycobacterium
RAAPGLPKVTTEPR

SEQ ID NO: 556098 - protein, 17 aa, Mycobacterium
RAAPGPVPEIAPDPAAP

SEQ ID NO: 556099 - protein, 8 aa, Mycobacterium
RAAPGSGD

SEQ ID NO: 556100 - protein, 11 aa, Mycobacterium
RAAPGTAGRAP

SEQ ID NO: 556101 - protein, 8 aa, Mycobacterium
RAAPGYAA

SEQ ID NO: 556102 - protein, 9 aa, Mycobacterium
RAAPGYAAY

SEQ ID NO: 556103 - protein, 11 aa, Mycobacterium
RAAPGYAAYAA

SEQ ID NO: 556104 - protein, 7 aa, Mycobacterium
RAAPKAD

SEQ ID NO: 556105 - protein, 7 aa, Mycobacterium
RAAPKAK

SEQ ID NO: 556106 - protein, 5 aa, Mycobacterium
RAAPL

SEQ ID NO: 556107 - protein, 7 aa, Mycobacterium
RAAPNTD

SEQ ID NO: 556108 - protein, 7 aa, Mycobacterium
RAAPNTE

SEQ ID NO: 556109 - protein, 16 aa, Mycobacterium
RAAPPAPAVQTATDTG

SEQ ID NO: 556110 - protein, 23 aa, Mycobacterium
RAAPPAQAGRAPDAGDSPPRQRG

SEQ ID NO: 556111 - protein, 11 aa, Mycobacterium
RAAPPDAAGSI

SEQ ID NO: 556112 - protein, 9 aa, Mycobacterium
RAAPPHAAA

SEQ ID NO: 556113 - protein, 6 aa, Mycobacterium
RAAPPL

SEQ ID NO: 556114 - protein, 33 aa, Mycobacterium
RAAPPPKAEPGGEQPAAPDAEVPSGDAVVGGST

SEQ ID NO: 556115 - protein, 28 aa, Mycobacterium
RAAPPSEAHSPASTLGGVPPVRPGRGVT

SEQ ID NO: 556116 - protein, 7 aa, Mycobacterium
RAAPQAD

SEQ ID NO: 556117 - protein, 7 aa, Mycobacterium
RAAPQAK

SEQ ID NO: 556118 - protein, 9 aa, Mycobacterium
RAAPQSTTV

SEQ ID NO: 556119 - protein, 14 aa, Mycobacterium
RAAPRYAAYSAAKA

SEQ ID NO: 556120 - protein, 14 aa, Mycobacterium
RAAPSGLQAQQADS

SEQ ID NO: 556121 - protein, 21 aa, Mycobacterium
RAAPTAPARTASGSVAVPGAR

SEQ ID NO: 556122 - protein, 7 aa, Mycobacterium
RAAPTDD

SEQ ID NO: 556123 - protein, 7 aa, Mycobacterium
RAAPTES

SEQ ID NO: 556124 - protein, 8 aa, Mycobacterium
RAAPTGPV

SEQ ID NO: 556125 - protein, 7 aa, Mycobacterium
RAAPTPV

SEQ ID NO: 556126 - protein, 13 aa, Mycobacterium
RAAPVEDRQSATA

SEQ ID NO: 556127 - protein, 10 aa, Mycobacterium
RAAQAADPVT

SEQ ID NO: 556128 - protein, 9 aa, Mycobacterium
RAAQAGPAA

SEQ ID NO: 556129 - protein, 7 aa, Mycobacterium
RAAQANW

SEQ ID NO: 556130 - protein, 24 aa, Mycobacterium
RAAQAQAGPPPDDETPAPEPESDV

SEQ ID NO: 556131 - protein, 10 aa, Mycobacterium
RAAQATAQAG

SEQ ID NO: 556132 - protein, 8 aa, Mycobacterium
RAAQATRL

SEQ ID NO: 556133 - protein, 18 aa, Mycobacterium
RAAQAVDDRPRNRRQEET

SEQ ID NO: 556134 - protein, 7 aa, Mycobacterium
RAAQDGA

SEQ ID NO: 556135 - protein, 9 aa, Mycobacterium
RAAQEAVRR

SEQ ID NO: 556136 - protein, 34 aa, Mycobacterium
RAAQESAAALKQTQTDRLDKARENLGEAQTRLRA

SEQ ID NO: 556137 - protein, 19 aa, Mycobacterium
RAAQGAAAGQAGASPSSMV

SEQ ID NO: 556138 - protein, 11 aa, Mycobacterium
RAAQGDAAGFA

SEQ ID NO: 556139 - protein, 6 aa, Mycobacterium
RAAQGL

SEQ ID NO: 556140 - protein, 15 aa, Mycobacterium
RAAQGNAHVGDEESL

SEQ ID NO: 556141 - protein, 5 aa, Mycobacterium
RAAQL

SEQ ID NO: 556142 - protein, 7 aa, Mycobacterium
RAAQPVE

SEQ ID NO: 556143 - protein, 6 aa, Mycobacterium
RAAQQG

SEQ ID NO: 556144 - protein, 8 aa, Mycobacterium
RAAQQSWP

SEQ ID NO: 556145 - protein, 28 aa, Mycobacterium
RAAQRARQINNERARNQAYLSERNKPPP

SEQ ID NO: 556146 - protein, 6 aa, Mycobacterium
RAAQRG

SEQ ID NO: 556147 - protein, 8 aa, Mycobacterium
RAAQSLAA

SEQ ID NO: 556148 - protein, 6 aa, Mycobacterium
RAAQTM

SEQ ID NO: 556149 - protein, 7 aa, Mycobacterium
RAAQTRN

SEQ ID NO: 556150 - protein, 5 aa, Mycobacterium
RAAQY

SEQ ID NO: 556151 - protein, 9 aa, Mycobacterium
RAAQYPPER

SEQ ID NO: 556152 - protein, 4 aa, Mycobacterium
RAAR

SEQ ID NO: 556153 - protein, 15 aa, Mycobacterium
RAARAAARAEGEYRD

SEQ ID NO: 556154 - protein, 16 aa, Mycobacterium
RAARAAGVSDADVDAA

SEQ ID NO: 556155 - protein, 6 aa, Mycobacterium
RAARAG

SEQ ID NO: 556156 - protein, 21 aa, Mycobacterium
RAARAGAPESAAGDAEDTDIA

SEQ ID NO: 556157 - protein, 10 aa, Mycobacterium
RAARARDLPP

SEQ ID NO: 556158 - protein, 9 aa, Mycobacterium
RAARARSGR

SEQ ID NO: 556159 - protein, 9 aa, Mycobacterium
RAARARSSR

SEQ ID NO: 556160 - protein, 10 aa, Mycobacterium
RAARARSSRI

SEQ ID NO: 556161 - protein, 6 aa, Mycobacterium
RAARDA

SEQ ID NO: 556162 - protein, 20 aa, Mycobacterium
RAARDAIASASRRSQKKDPL

SEQ ID NO: 556163 - protein, 9 aa, Mycobacterium
RAARDSDVN

SEQ ID NO: 556164 - protein, 5 aa, Mycobacterium
RAARE

SEQ ID NO: 556165 - protein, 8 aa, Mycobacterium
RAAREAAT

SEQ ID NO: 556166 - protein, 13 aa, Mycobacterium
RAAREAATAAQDE

SEQ ID NO: 556167 - protein, 13 aa, Mycobacterium
RAAREAGHRDPQL

SEQ ID NO: 556168 - protein, 10 aa, Mycobacterium
RAAREATAAL

SEQ ID NO: 556169 - protein, 6 aa, Mycobacterium
RAAREG

SEQ ID NO: 556170 - protein, 6 aa, Mycobacterium
RAAREH

SEQ ID NO: 556171 - protein, 13 aa, Mycobacterium
RAARESGLHADGN

SEQ ID NO: 556172 - protein, 11 aa, Mycobacterium
RAARGDAEPAR

SEQ ID NO: 556173 - protein, 19 aa, Mycobacterium
RAARGDSVHDDDPAETGTM

SEQ ID NO: 556174 - protein, 9 aa, Mycobacterium
RAARGEDDV

SEQ ID NO: 556175 - protein, 12 aa, Mycobacterium
RAARGGNQTQRP

SEQ ID NO: 556176 - protein, 8 aa, Mycobacterium
RAARGRAA

SEQ ID NO: 556177 - protein, 17 aa, Mycobacterium
RAARKGPEAAPATATAD

SEQ ID NO: 556178 - protein, 15 aa, Mycobacterium
RAARLGSTLTEPGTR

SEQ ID NO: 556179 - protein, 13 aa, Mycobacterium
RAARPSGDDRESA

SEQ ID NO: 556180 - protein, 19 aa, Mycobacterium
RAARQGRERGTAAHGVEPA

SEQ ID NO: 556181 - protein, 5 aa, Mycobacterium
RAARR

SEQ ID NO: 556182 - protein, 13 aa, Mycobacterium
RAARRAAAQPGLA

SEQ ID NO: 556183 - protein, 6 aa, Mycobacterium
RAARRG

SEQ ID NO: 556184 - protein, 18 aa, Mycobacterium
RAARRPEAWDRPPPGGLP

SEQ ID NO: 556185 - protein, 9 aa, Mycobacterium
RAARRPPSS

SEQ ID NO: 556186 - protein, 10 aa, Mycobacterium
RAARSAGDYY

SEQ ID NO: 556187 - protein, 17 aa, Mycobacterium
RAARSEAALSRSAVTGL

SEQ ID NO: 556188 - protein, 10 aa, Mycobacterium
RAARTAPAGR

SEQ ID NO: 556189 - protein, 13 aa, Mycobacterium
RAARTIDGTYNNL

SEQ ID NO: 556190 - protein, 8 aa, Mycobacterium
RAARTPDA

SEQ ID NO: 556191 - protein, 10 aa, Mycobacterium
RAARTSPERA

SEQ ID NO: 556192 - protein, 9 aa, Mycobacterium
RAASAEGER

SEQ ID NO: 556193 - protein, 12 aa, Mycobacterium
RAASAFKTHGPD

SEQ ID NO: 556194 - protein, 17 aa, Mycobacterium
RAASAGERSIAQSRPVR

SEQ ID NO: 556195 - protein, 6 aa, Mycobacterium
RAASDA

SEQ ID NO: 556196 - protein, 9 aa, Mycobacterium
RAASEAGIE

SEQ ID NO: 556197 - protein, 9 aa, Mycobacterium
RAASEDEEQ

SEQ ID NO: 556198 - protein, 18 aa, Mycobacterium
RAASEPPVTTPSEEPAWK

SEQ ID NO: 556199 - protein, 8 aa, Mycobacterium
RAASERGA

SEQ ID NO: 556200 - protein, 24 aa, Mycobacterium
RAASGDPDPDPDPAAAEDEVDADG

SEQ ID NO: 556201 - protein, 12 aa, Mycobacterium
RAASGEHTEQPK

SEQ ID NO: 556202 - protein, 6 aa, Mycobacterium
RAASGN

SEQ ID NO: 556203 - protein, 12 aa, Mycobacterium
RAASKAAGRAPA

SEQ ID NO: 556204 - protein, 15 aa, Mycobacterium
RAASPITQGGSVATT

SEQ ID NO: 556205 - protein, 11 aa, Mycobacterium
RAASRVEGVRP

SEQ ID NO: 556206 - protein, 11 aa, Mycobacterium
RAASSLAGDLA

SEQ ID NO: 556207 - protein, 8 aa, Mycobacterium
RAASSPDA

SEQ ID NO: 556208 - protein, 9 aa, Mycobacterium
RAASSQPGA

SEQ ID NO: 556209 - protein, 9 aa, Mycobacterium
RAASTSQER

SEQ ID NO: 556210 - protein, 10 aa, Mycobacterium
RAASVEAKAA

SEQ ID NO: 556211 - protein, 8 aa, Mycobacterium
RAASYGDK

SEQ ID NO: 556212 - protein, 26 aa, Mycobacterium
RAATAAHYENRDGAGTIAVPDRDTAG

SEQ ID NO: 556213 - protein, 11 aa, Mycobacterium
RAATAANGGAR

SEQ ID NO: 556214 - protein, 7 aa, Mycobacterium
RAATAKR

SEQ ID NO: 556215 - protein, 13 aa, Mycobacterium
RAATAPAEHGLPV

SEQ ID NO: 556216 - protein, 6 aa, Mycobacterium
RAATAR

SEQ ID NO: 556217 - protein, 8 aa, Mycobacterium
RAATDAAD

SEQ ID NO: 556218 - protein, 9 aa, Mycobacterium
RAATDADGH

SEQ ID NO: 556219 - protein, 10 aa, Mycobacterium
RAATDGAGRY

SEQ ID NO: 556220 - protein, 18 aa, Mycobacterium
RAATDPGVTGGQYYGPSG

SEQ ID NO: 556221 - protein, 9 aa, Mycobacterium
RAATDQPDE

SEQ ID NO: 556222 - protein, 7 aa, Mycobacterium
RAATDRL

SEQ ID NO: 556223 - protein, 7 aa, Mycobacterium
RAATEDA

SEQ ID NO: 556224 - protein, 9 aa, Mycobacterium
RAATEDAEF

SEQ ID NO: 556225 - protein, 8 aa, Mycobacterium
RAATEDEE

SEQ ID NO: 556226 - protein, 14 aa, Mycobacterium
RAATGAAAPSTTAI

SEQ ID NO: 556227 - protein, 12 aa, Mycobacterium
RAATGERGEKPR

SEQ ID NO: 556228 - protein, 9 aa, Mycobacterium
RAATGLGPA

SEQ ID NO: 556229 - protein, 13 aa, Mycobacterium
RAATGLHDSQEQD

SEQ ID NO: 556230 - protein, 9 aa, Mycobacterium
RAATGRADD

SEQ ID NO: 556231 - protein, 13 aa, Mycobacterium
RAATKNAGASAGA

SEQ ID NO: 556232 - protein, 7 aa, Mycobacterium
RAATNGL

SEQ ID NO: 556233 - protein, 8 aa, Mycobacterium
RAATPAGL

SEQ ID NO: 556234 - protein, 9 aa, Mycobacterium
RAATPGDVS

SEQ ID NO: 556235 - protein, 8 aa, Mycobacterium
RAATPPQP

SEQ ID NO: 556236 - protein, 6 aa, Mycobacterium
RAATQL

SEQ ID NO: 556237 - protein, 8 aa, Mycobacterium
RAATQYAQ

SEQ ID NO: 556238 - protein, 5 aa, Mycobacterium
RAATR

SEQ ID NO: 556239 - protein, 19 aa, Mycobacterium
RAATRAPRPAPAGPPARDR

SEQ ID NO: 556240 - protein, 23 aa, Mycobacterium
RAATRRNQIPPGAAVTGTDQRPY

SEQ ID NO: 556241 - protein, 4 aa, Mycobacterium
RAAV

SEQ ID NO: 556242 - protein, 10 aa, Mycobacterium
RAAVEARDKQ

SEQ ID NO: 556243 - protein, 8 aa, Mycobacterium
RAAVGRGD

SEQ ID NO: 556244 - protein, 12 aa, Mycobacterium
RAAVGTPGSMVS

SEQ ID NO: 556245 - protein, 11 aa, Mycobacterium
RAAVPETDQPV

SEQ ID NO: 556246 - protein, 14 aa, Mycobacterium
RAAVSDADLASAAD

SEQ ID NO: 556247 - protein, 16 aa, Mycobacterium
RAAWDNRQTGKDTEDL

SEQ ID NO: 556248 - protein, 8 aa, Mycobacterium
RACPTRTT

SEQ ID NO: 556249 - protein, 8 aa, Mycobacterium
RACSGEGS

SEQ ID NO: 556250 - protein, 6 aa, Mycobacterium
RADAAA

SEQ ID NO: 556251 - protein, 9 aa, Mycobacterium
RADAANGDA

SEQ ID NO: 556252 - protein, 12 aa, Mycobacterium
RADAARELDADT

SEQ ID NO: 556253 - protein, 8 aa, Mycobacterium
RADAARGK

SEQ ID NO: 556254 - protein, 8 aa, Mycobacterium
RADAARRG

SEQ ID NO: 556255 - protein, 5 aa, Mycobacterium
RADAD

SEQ ID NO: 556256 - protein, 7 aa, Mycobacterium
RADADRP

SEQ ID NO: 556257 - protein, 5 aa, Mycobacterium
RADAE

SEQ ID NO: 556258 - protein, 8 aa, Mycobacterium
RADAEDSV

SEQ ID NO: 556259 - protein, 6 aa, Mycobacterium
RADAET

SEQ ID NO: 556260 - protein, 13 aa, Mycobacterium
RADAGMAWKEIPR

SEQ ID NO: 556261 - protein, 5 aa, Mycobacterium
RADAL

SEQ ID NO: 556262 - protein, 5 aa, Mycobacterium
RADAP

SEQ ID NO: 556263 - protein, 8 aa, Mycobacterium
RADAPDKV

SEQ ID NO: 556264 - protein, 6 aa, Mycobacterium
RADAPV

SEQ ID NO: 556265 - protein, 7 aa, Mycobacterium
RADAQRC

SEQ ID NO: 556266 - protein, 14 aa, Mycobacterium
RADARGRALREDGS

SEQ ID NO: 556267 - protein, 8 aa, Mycobacterium
RADARHPP

SEQ ID NO: 556268 - protein, 26 aa, Mycobacterium
RADARRTAQRAHAPQSVFSALEPRDA

SEQ ID NO: 556269 - protein, 13 aa, Mycobacterium
RADATAALAAYQA

SEQ ID NO: 556270 - protein, 7 aa, Mycobacterium
RADATAG

SEQ ID NO: 556271 - protein, 11 aa, Mycobacterium
RADATPTDEEI

SEQ ID NO: 556272 - protein, 6 aa, Mycobacterium
RADAVN

SEQ ID NO: 556273 - protein, 7 aa, Mycobacterium
RADAVNP

SEQ ID NO: 556274 - protein, 12 aa, Mycobacterium
RADAVPERNRPW

SEQ ID NO: 556275 - protein, 8 aa, Mycobacterium
RADDDPLP

SEQ ID NO: 556276 - protein, 10 aa, Mycobacterium
RADDDRRTMN

SEQ ID NO: 556277 - protein, 22 aa, Mycobacterium
RADDEDSGEKPDKTKSAKPGWH

SEQ ID NO: 556278 - protein, 7 aa, Mycobacterium
RADDGPG

SEQ ID NO: 556279 - protein, 5 aa, Mycobacterium
RADDI

SEQ ID NO: 556280 - protein, 7 aa, Mycobacterium
RADDPVT

SEQ ID NO: 556281 - protein, 12 aa, Mycobacterium
RADDSAPVTLPD

SEQ ID NO: 556282 - protein, 6 aa, Mycobacterium
RADDVD

SEQ ID NO: 556283 - protein, 5 aa, Mycobacterium
RADEE

SEQ ID NO: 556284 - protein, 5 aa, Mycobacterium
RADEG

SEQ ID NO: 556285 - protein, 5 aa, Mycobacterium
RADEI

SEQ ID NO: 556286 - protein, 5 aa, Mycobacterium
RADEL

SEQ ID NO: 556287 - protein, 7 aa, Mycobacterium
RADELGR

SEQ ID NO: 556288 - protein, 5 aa, Mycobacterium
RADEN

SEQ ID NO: 556289 - protein, 7 aa, Mycobacterium
RADEPTA

SEQ ID NO: 556290 - protein, 5 aa, Mycobacterium
RADEQ

SEQ ID NO: 556291 - protein, 18 aa, Mycobacterium
RADEQTHRISQSREPDDG

SEQ ID NO: 556292 - protein, 7 aa, Mycobacterium
RADERAR

SEQ ID NO: 556293 - protein, 25 aa, Mycobacterium
RADERGDRRDGRPQPARADARGGGV

SEQ ID NO: 556294 - protein, 7 aa, Mycobacterium
RADERKA

SEQ ID NO: 556295 - protein, 12 aa, Mycobacterium
RADERLRSGAPL

SEQ ID NO: 556296 - protein, 12 aa, Mycobacterium
RADERLRSGESL

SEQ ID NO: 556297 - protein, 6 aa, Mycobacterium
RADESF

SEQ ID NO: 556298 - protein, 11 aa, Mycobacterium
RADESGSGTEI

SEQ ID NO: 556299 - protein, 8 aa, Mycobacterium
RADETERV

SEQ ID NO: 556300 - protein, 6 aa, Mycobacterium
RADETT

SEQ ID NO: 556301 - protein, 8 aa, Mycobacterium
RADFTGTD

SEQ ID NO: 556302 - protein, 8 aa, Mycobacterium
RADGAEIR

SEQ ID NO: 556303 - protein, 6 aa, Mycobacterium
RADGAR

SEQ ID NO: 556304 - protein, 14 aa, Mycobacterium
RADGASAIAGPGDN

SEQ ID NO: 556305 - protein, 14 aa, Mycobacterium
RADGASPGTDERMR

SEQ ID NO: 556306 - protein, 5 aa, Mycobacterium
RADGD

SEQ ID NO: 556307 - protein, 11 aa, Mycobacterium
RADGDDPRPDF

SEQ ID NO: 556308 - protein, 16 aa, Mycobacterium
RADGDEEQLLQLVTQP

SEQ ID NO: 556309 - protein, 12 aa, Mycobacterium
RADGDTRTDAAA

SEQ ID NO: 556310 - protein, 8 aa, Mycobacterium
RADGEDVV

SEQ ID NO: 556311 - protein, 7 aa, Mycobacterium
RADGEPE

SEQ ID NO: 556312 - protein, 8 aa, Mycobacterium
RADGERRA

SEQ ID NO: 556313 - protein, 7 aa, Mycobacterium
RADGGDA

SEQ ID NO: 556314 - protein, 14 aa, Mycobacterium
RADGGDRVQGRIQD

SEQ ID NO: 556315 - protein, 7 aa, Mycobacterium
RADGGEA

SEQ ID NO: 556316 - protein, 7 aa, Mycobacterium
RADGGGD

SEQ ID NO: 556317 - protein, 8 aa, Mycobacterium
RADGGRVA

SEQ ID NO: 556318 - protein, 8 aa, Mycobacterium
RADGIAPV

SEQ ID NO: 556319 - protein, 6 aa, Mycobacterium
RADGLE

SEQ ID NO: 556320 - protein, 8 aa, Mycobacterium
RADGNLNN

SEQ ID NO: 556321 - protein, 8 aa, Mycobacterium
RADGPSNG

SEQ ID NO: 556322 - protein, 6 aa, Mycobacterium
RADGQE

SEQ ID NO: 556323 - protein, 7 aa, Mycobacterium
RADGQLP

SEQ ID NO: 556324 - protein, 7 aa, Mycobacterium
RADGRDC

SEQ ID NO: 556325 - protein, 10 aa, Mycobacterium
RADGRGANHN

SEQ ID NO: 556326 - protein, 12 aa, Mycobacterium
RADGSNPPERGS

SEQ ID NO: 556327 - protein, 16 aa, Mycobacterium
RADGSQHSAIDFQDLG

SEQ ID NO: 556328 - protein, 11 aa, Mycobacterium
RADGSQPPRDF

SEQ ID NO: 556329 - protein, 9 aa, Mycobacterium
RADGSRYRD

SEQ ID NO: 556330 - protein, 6 aa, Mycobacterium
RADGSW

SEQ ID NO: 556331 - protein, 8 aa, Mycobacterium
RADGTDAG

SEQ ID NO: 556332 - protein, 16 aa, Mycobacterium
RADGTEHALTDDAEPY

SEQ ID NO: 556333 - protein, 5 aa, Mycobacterium
RADGV

SEQ ID NO: 556334 - protein, 11 aa, Mycobacterium
RADGYGGSAAQ

SEQ ID NO: 556335 - protein, 11 aa, Mycobacterium
RADGYVQGEGA

SEQ ID NO: 556336 - protein, 9 aa, Mycobacterium
RADHAEHAR

SEQ ID NO: 556337 - protein, 28 aa, Mycobacterium
RADHGDPPAVGATTVAQSPENPDADGVT

SEQ ID NO: 556338 - protein, 39 aa, Mycobacterium
RADHVTEDDDTLGAAVGTTSAPRAPVDAANGEIILHNTP

SEQ ID NO: 556339 - protein, 4 aa, Mycobacterium
RADI

SEQ ID NO: 556340 - protein, 9 aa, Mycobacterium
RADIPDQSG

SEQ ID NO: 556341 - protein, 7 aa, Mycobacterium
RADIPVG

SEQ ID NO: 556342 - protein, 7 aa, Mycobacterium
RADIPYG

SEQ ID NO: 556343 - protein, 6 aa, Mycobacterium
RADKAG

SEQ ID NO: 556344 - protein, 8 aa, Mycobacterium
RADKQGDT

SEQ ID NO: 556345 - protein, 14 aa, Mycobacterium
RADLAPEESAGDHA

SEQ ID NO: 556346 - protein, 6 aa, Mycobacterium
RADLGQ

SEQ ID NO: 556347 - protein, 5 aa, Mycobacterium
RADLP

SEQ ID NO: 556348 - protein, 12 aa, Mycobacterium
RADLQSKQSRLR

SEQ ID NO: 556349 - protein, 7 aa, Mycobacterium
RADLTRP

SEQ ID NO: 556350 - protein, 6 aa, Mycobacterium
RADMGQ

SEQ ID NO: 556351 - protein, 9 aa, Mycobacterium
RADNDLTDA

SEQ ID NO: 556352 - protein, 14 aa, Mycobacterium
RADNNAANALLTTF

SEQ ID NO: 556353 - protein, 17 aa, Mycobacterium
RADNPARVEPGDAPSLT

SEQ ID NO: 556354 - protein, 12 aa, Mycobacterium
RADNPEPGGAPI

SEQ ID NO: 556355 - protein, 9 aa, Mycobacterium
RADNPEQQQ

SEQ ID NO: 556356 - protein, 8 aa, Mycobacterium
RADNSGAG

SEQ ID NO: 556357 - protein, 7 aa, Mycobacterium
RADNTEL

SEQ ID NO: 556358 - protein, 4 aa, Mycobacterium
RADP

SEQ ID NO: 556359 - protein, 7 aa, Mycobacterium
RADPAFG

SEQ ID NO: 556360 - protein, 7 aa, Mycobacterium
RADPALA

SEQ ID NO: 556361 - protein, 10 aa, Mycobacterium
RADPAPPPER

SEQ ID NO: 556362 - protein, 9 aa, Mycobacterium
RADPDAPPW

SEQ ID NO: 556363 - protein, 9 aa, Mycobacterium
RADPDDGRA

SEQ ID NO: 556364 - protein, 8 aa, Mycobacterium
RADPDGSM

SEQ ID NO: 556365 - protein, 15 aa, Mycobacterium
RADPDGVGLAAPDEL

SEQ ID NO: 556366 - protein, 9 aa, Mycobacterium
RADPDPHRR

SEQ ID NO: 556367 - protein, 9 aa, Mycobacterium
RADPDRDAP

SEQ ID NO: 556368 - protein, 8 aa, Mycobacterium
RADPENAV

SEQ ID NO: 556369 - protein, 8 aa, Mycobacterium
RADPERNV

SEQ ID NO: 556370 - protein, 7 aa, Mycobacterium
RADPETI

SEQ ID NO: 556371 - protein, 5 aa, Mycobacterium
RADPG

SEQ ID NO: 556372 - protein, 9 aa, Mycobacterium
RADPGLSEA

SEQ ID NO: 556373 - protein, 9 aa, Mycobacterium
RADPNFETR

SEQ ID NO: 556374 - protein, 6 aa, Mycobacterium
RADPPA

SEQ ID NO: 556375 - protein, 6 aa, Mycobacterium
RADPPL

SEQ ID NO: 556376 - protein, 7 aa, Mycobacterium
RADPPWP

SEQ ID NO: 556377 - protein, 10 aa, Mycobacterium
RADPSRCARR

SEQ ID NO: 556378 - protein, 7 aa, Mycobacterium
RADPTLR

SEQ ID NO: 556379 - protein, 8 aa, Mycobacterium
RADPTQAV

SEQ ID NO: 556380 - protein, 8 aa, Mycobacterium
RADPTRPL

SEQ ID NO: 556381 - protein, 7 aa, Mycobacterium
RADPTRV

SEQ ID NO: 556382 - protein, 4 aa, Mycobacterium
RADQ

SEQ ID NO: 556383 - protein, 10 aa, Mycobacterium
RADQASLGGV

SEQ ID NO: 556384 - protein, 5 aa, Mycobacterium
RADQS

SEQ ID NO: 556385 - protein, 8 aa, Mycobacterium
RADQSSEV

SEQ ID NO: 556386 - protein, 10 aa, Mycobacterium
RADRATGAAA

SEQ ID NO: 556387 - protein, 12 aa, Mycobacterium
RADRHDNEQPGI

SEQ ID NO: 556388 - protein, 5 aa, Mycobacterium
RADRL

SEQ ID NO: 556389 - protein, 8 aa, Mycobacterium
RADRLRSH

SEQ ID NO: 556390 - protein, 7 aa, Mycobacterium
RADRPEA

SEQ ID NO: 556391 - protein, 8 aa, Mycobacterium
RADRPLDE

SEQ ID NO: 556392 - protein, 8 aa, Mycobacterium
RADRPTAW

SEQ ID NO: 556393 - protein, 7 aa, Mycobacterium
RADRPTR

SEQ ID NO: 556394 - protein, 10 aa, Mycobacterium
RADRQRSMNS

SEQ ID NO: 556395 - protein, 5 aa, Mycobacterium
RADRS

SEQ ID NO: 556396 - protein, 13 aa, Mycobacterium
RADRSPSIDEAGS

SEQ ID NO: 556397 - protein, 6 aa, Mycobacterium
RADRTL

SEQ ID NO: 556398 - protein, 13 aa, Mycobacterium
RADRTLAPSTSAM

SEQ ID NO: 556399 - protein, 5 aa, Mycobacterium
RADRW

SEQ ID NO: 556400 - protein, 14 aa, Mycobacterium
RADSAVPKKGNDFA

SEQ ID NO: 556401 - protein, 15 aa, Mycobacterium
RADSAVRKKGNDFAT

SEQ ID NO: 556402 - protein, 14 aa, Mycobacterium
RADSAVRKQGNDFA

SEQ ID NO: 556403 - protein, 10 aa, Mycobacterium
RADSAWPTPL

SEQ ID NO: 556404 - protein, 14 aa, Mycobacterium
RADSDDQEAPDLDK

SEQ ID NO: 556405 - protein, 7 aa, Mycobacterium
RADSDSL

SEQ ID NO: 556406 - protein, 8 aa, Mycobacterium
RADSPEGQ

SEQ ID NO: 556407 - protein, 14 aa, Mycobacterium
RADSPERRAARARS

SEQ ID NO: 556408 - protein, 6 aa, Mycobacterium
RADSQV

SEQ ID NO: 556409 - protein, 11 aa, Mycobacterium
RADSSGDDTGV

SEQ ID NO: 556410 - protein, 12 aa, Mycobacterium
RADSTYQGGRSK

SEQ ID NO: 556411 - protein, 7 aa, Mycobacterium
RADSYSQ

SEQ ID NO: 556412 - protein, 8 aa, Mycobacterium
RADTDALR

SEQ ID NO: 556413 - protein, 7 aa, Mycobacterium
RADTEAR

SEQ ID NO: 556414 - protein, 11 aa, Mycobacterium
RADTLGDAARQ

SEQ ID NO: 556415 - protein, 12 aa, Mycobacterium
RADTPVVLRSVA

SEQ ID NO: 556416 - protein, 5 aa, Mycobacterium
RADTQ

SEQ ID NO: 556417 - protein, 7 aa, Mycobacterium
RADTTGM

SEQ ID NO: 556418 - protein, 17 aa, Mycobacterium
RADTTRGLPRTDEPEPV

SEQ ID NO: 556419 - protein, 11 aa, Mycobacterium
RADTTSPDDMT

SEQ ID NO: 556420 - protein, 7 aa, Mycobacterium
RADTYPQ

SEQ ID NO: 556421 - protein, 4 aa, Mycobacterium
RADV

SEQ ID NO: 556422 - protein, 18 aa, Mycobacterium
RADVGSAFGDRAKSARLR

SEQ ID NO: 556423 - protein, 6 aa, Mycobacterium
RADVTG

SEQ ID NO: 556424 - protein, 5 aa, Mycobacterium
RADWS

SEQ ID NO: 556425 - protein, 9 aa, Mycobacterium
RADYETPIR

SEQ ID NO: 556426 - protein, 10 aa, Mycobacterium
RAEAAASARR

SEQ ID NO: 556427 - protein, 6 aa, Mycobacterium
RAEAAK

SEQ ID NO: 556428 - protein, 9 aa, Mycobacterium
RAEAATAHN

SEQ ID NO: 556429 - protein, 8 aa, Mycobacterium
RAEAAVPH

SEQ ID NO: 556430 - protein, 7 aa, Mycobacterium
RAEADDT

SEQ ID NO: 556431 - protein, 8 aa, Mycobacterium
RAEADEAE

SEQ ID NO: 556432 - protein, 7 aa, Mycobacterium
RAEADPG

SEQ ID NO: 556433 - protein, 8 aa, Mycobacterium
RAEADRND

SEQ ID NO: 556434 - protein, 9 aa, Mycobacterium
RAEADRREG

SEQ ID NO: 556435 - protein, 10 aa, Mycobacterium
RAEADRREGL

SEQ ID NO: 556436 - protein, 6 aa, Mycobacterium
RAEAEA

SEQ ID NO: 556437 - protein, 7 aa, Mycobacterium
RAEAEAE

SEQ ID NO: 556438 - protein, 19 aa, Mycobacterium
RAEAEAEIQRSVDRFKAEG

SEQ ID NO: 556439 - protein, 6 aa, Mycobacterium
RAEAED

SEQ ID NO: 556440 - protein, 6 aa, Mycobacterium
RAEAEE

SEQ ID NO: 556441 - protein, 9 aa, Mycobacterium
RAEAEKRSL

SEQ ID NO: 556442 - protein, 7 aa, Mycobacterium
RAEAENL

SEQ ID NO: 556443 - protein, 10 aa, Mycobacterium
RAEAERRGAA

SEQ ID NO: 556444 - protein, 6 aa, Mycobacterium
RAEAGD

SEQ ID NO: 556445 - protein, 11 aa, Mycobacterium
RAEAGKSNEPF

SEQ ID NO: 556446 - protein, 11 aa, Mycobacterium
RAEAGRRARKE

SEQ ID NO: 556447 - protein, 7 aa, Mycobacterium
RAEAHPD

SEQ ID NO: 556448 - protein, 9 aa, Mycobacterium
RAEALDPSI

SEQ ID NO: 556449 - protein, 10 aa, Mycobacterium
RAEALGGASH

SEQ ID NO: 556450 - protein, 6 aa, Mycobacterium
RAEAPG

SEQ ID NO: 556451 - protein, 7 aa, Mycobacterium
RAEAPHK

SEQ ID NO: 556452 - protein, 7 aa, Mycobacterium
RAEAPPL

SEQ ID NO: 556453 - protein, 11 aa, Mycobacterium
RAEAQAAQQGL

SEQ ID NO: 556454 - protein, 9 aa, Mycobacterium
RAEAQRAYD

SEQ ID NO: 556455 - protein, 8 aa, Mycobacterium
RAEAQREA

SEQ ID NO: 556456 - protein, 7 aa, Mycobacterium
RAEARAR

SEQ ID NO: 556457 - protein, 9 aa, Mycobacterium
RAEARERRD

SEQ ID NO: 556458 - protein, 8 aa, Mycobacterium
RAEARSKN

SEQ ID NO: 556459 - protein, 8 aa, Mycobacterium
RAEASAAG

SEQ ID NO: 556460 - protein, 7 aa, Mycobacterium
RAEASAH

SEQ ID NO: 556461 - protein, 6 aa, Mycobacterium
RAEATG

SEQ ID NO: 556462 - protein, 5 aa, Mycobacterium
RAEAV

SEQ ID NO: 556463 - protein, 7 aa, Mycobacterium
RAEAVNP

SEQ ID NO: 556464 - protein, 5 aa, Mycobacterium
RAEDA

SEQ ID NO: 556465 - protein, 8 aa, Mycobacterium
RAEDAQRR

SEQ ID NO: 556466 - protein, 11 aa, Mycobacterium
RAEDDAAQGRA

SEQ ID NO: 556467 - protein, 9 aa, Mycobacterium
RAEDDGEQQ

SEQ ID NO: 556468 - protein, 5 aa, Mycobacterium
RAEDF

SEQ ID NO: 556469 - protein, 6 aa, Mycobacterium
RAEDGR

SEQ ID NO: 556470 - protein, 7 aa, Mycobacterium
RAEDGSP

SEQ ID NO: 556471 - protein, 8 aa, Mycobacterium
RAEDGTIE

SEQ ID NO: 556472 - protein, 6 aa, Mycobacterium
RAEDPI

SEQ ID NO: 556473 - protein, 15 aa, Mycobacterium
RAEDPQASSVHDSTE

SEQ ID NO: 556474 - protein, 9 aa, Mycobacterium
RAEDPVQRR

SEQ ID NO: 556475 - protein, 6 aa, Mycobacterium
RAEDTI

SEQ ID NO: 556476 - protein, 7 aa, Mycobacterium
RAEEDDM

SEQ ID NO: 556477 - protein, 7 aa, Mycobacterium
RAEEERE

SEQ ID NO: 556478 - protein, 14 aa, Mycobacterium
RAEEFGRRNSSPGE

SEQ ID NO: 556479 - protein, 15 aa, Mycobacterium
RAEENTAKQNVNGAN

SEQ ID NO: 556480 - protein, 5 aa, Mycobacterium
RAEEP

SEQ ID NO: 556481 - protein, 13 aa, Mycobacterium
RAEEPEAVAGGDR

SEQ ID NO: 556482 - protein, 9 aa, Mycobacterium
RAEEQRRQR

SEQ ID NO: 556483 - protein, 5 aa, Mycobacterium
RAEER

SEQ ID NO: 556484 - protein, 19 aa, Mycobacterium
RAEERSVRERLGGSDAAVS

SEQ ID NO: 556485 - protein, 11 aa, Mycobacterium
RAEESGTGTEI

SEQ ID NO: 556486 - protein, 8 aa, Mycobacterium
RAEETVPE

SEQ ID NO: 556487 - protein, 7 aa, Mycobacterium
RAEFAGP

SEQ ID NO: 556488 - protein, 8 aa, Mycobacterium
RAEFDGQS

SEQ ID NO: 556489 - protein, 7 aa, Mycobacterium
RAEFTGA

SEQ ID NO: 556490 - protein, 13 aa, Mycobacterium
RAEGAGHSYGTTA

SEQ ID NO: 556491 - protein, 17 aa, Mycobacterium
RAEGAGVPTASVESPAG

SEQ ID NO: 556492 - protein, 6 aa, Mycobacterium
RAEGAL

SEQ ID NO: 556493 - protein, 13 aa, Mycobacterium
RAEGASASGAKVS

SEQ ID NO: 556494 - protein, 9 aa, Mycobacterium
RAEGAVPHP

SEQ ID NO: 556495 - protein, 5 aa, Mycobacterium
RAEGD

SEQ ID NO: 556496 - protein, 6 aa, Mycobacterium
RAEGDD

SEQ ID NO: 556497 - protein, 10 aa, Mycobacterium
RAEGDGRVRD

SEQ ID NO: 556498 - protein, 7 aa, Mycobacterium
RAEGDLD

SEQ ID NO: 556499 - protein, 9 aa, Mycobacterium
RAEGELTAD

SEQ ID NO: 556500 - protein, 23 aa, Mycobacterium
RAEGFDTDNPSLKATDTFIIKVA

SEQ ID NO: 556501 - protein, 7 aa, Mycobacterium
RAEGGGD

SEQ ID NO: 556502 - protein, 9 aa, Mycobacterium
RAEGIKRGD

SEQ ID NO: 556503 - protein, 10 aa, Mycobacterium
RAEGKRGGEF

SEQ ID NO: 556504 - protein, 9 aa, Mycobacterium
RAEGLKKAG

SEQ ID NO: 556505 - protein, 7 aa, Mycobacterium
RAEGLTA

SEQ ID NO: 556506 - protein, 9 aa, Mycobacterium
RAEGNGRHE

SEQ ID NO: 556507 - protein, 22 aa, Mycobacterium
RAEGNRALDAGDHDAALQSASS

SEQ ID NO: 556508 - protein, 22 aa, Mycobacterium
RAEGNRALDAGDHEGALRSAGS

SEQ ID NO: 556509 - protein, 17 aa, Mycobacterium
RAEGNRALDSGDHDGAL

SEQ ID NO: 556510 - protein, 5 aa, Mycobacterium
RAEGR

SEQ ID NO: 556511 - protein, 9 aa, Mycobacterium
RAEGRDAGW

SEQ ID NO: 556512 - protein, 7 aa, Mycobacterium
RAEGRDP

SEQ ID NO: 556513 - protein, 11 aa, Mycobacterium
RAEGRLPSDAP

SEQ ID NO: 556514 - protein, 7 aa, Mycobacterium
RAEGRQP

SEQ ID NO: 556515 - protein, 9 aa, Mycobacterium
RAEGRRGGE

SEQ ID NO: 556516 - protein, 7 aa, Mycobacterium
RAEGRSG

SEQ ID NO: 556517 - protein, 11 aa, Mycobacterium
RAEGRVKRDAP

SEQ ID NO: 556518 - protein, 6 aa, Mycobacterium
RAEGTD

SEQ ID NO: 556519 - protein, 7 aa, Mycobacterium
RAEGTEF

SEQ ID NO: 556520 - protein, 8 aa, Mycobacterium
RAEGTEFR

SEQ ID NO: 556521 - protein, 18 aa, Mycobacterium
RAEGTWGAYDSGPAPGLG

SEQ ID NO: 556522 - protein, 6 aa, Mycobacterium
RAEHGG

SEQ ID NO: 556523 - protein, 8 aa, Mycobacterium
RAEHGTKE

SEQ ID NO: 556524 - protein, 5 aa, Mycobacterium
RAEHT

SEQ ID NO: 556525 - protein, 7 aa, Mycobacterium
RAEHTGE

SEQ ID NO: 556526 - protein, 10 aa, Mycobacterium
RAEIAEATKE

SEQ ID NO: 556527 - protein, 6 aa, Mycobacterium
RAEKDG

SEQ ID NO: 556528 - protein, 6 aa, Mycobacterium
RAEKER

SEQ ID NO: 556529 - protein, 8 aa, Mycobacterium
RAEKNYGP

SEQ ID NO: 556530 - protein, 11 aa, Mycobacterium
RAEKYSPFSGA

SEQ ID NO: 556531 - protein, 4 aa, Mycobacterium
RAEL

SEQ ID NO: 556532 - protein, 16 aa, Mycobacterium
RAELADREHRAAEADR

SEQ ID NO: 556533 - protein, 13 aa, Mycobacterium
RAELAGPDDPQPW

SEQ ID NO: 556534 - protein, 14 aa, Mycobacterium
RAELAGPDDTQPWL

SEQ ID NO: 556535 - protein, 7 aa, Mycobacterium
RAELARE

SEQ ID NO: 556536 - protein, 5 aa, Mycobacterium
RAELD

SEQ ID NO: 556537 - protein, 7 aa, Mycobacterium
RAELGGP

SEQ ID NO: 556538 - protein, 10 aa, Mycobacterium
RAELGGSGVP

SEQ ID NO: 556539 - protein, 17 aa, Mycobacterium
RAELSQRERQAAEADRA

SEQ ID NO: 556540 - protein, 5 aa, Mycobacterium
RAELT

SEQ ID NO: 556541 - protein, 6 aa, Mycobacterium
RAENAG

SEQ ID NO: 556542 - protein, 9 aa, Mycobacterium
RAENDDVTL

SEQ ID NO: 556543 - protein, 9 aa, Mycobacterium
RAENHGEAV

SEQ ID NO: 556544 - protein, 9 aa, Mycobacterium
RAENPEQQQ

SEQ ID NO: 556545 - protein, 12 aa, Mycobacterium
RAENTSAGPSQL

SEQ ID NO: 556546 - protein, 5 aa, Mycobacterium
RAENV

SEQ ID NO: 556547 - protein, 5 aa, Mycobacterium
RAEPA

SEQ ID NO: 556548 - protein, 30 aa, Mycobacterium
RAEPAAARRASTRAYRDSHTDVSDGSAKTD

SEQ ID NO: 556549 - protein, 6 aa, Mycobacterium
RAEPAL

SEQ ID NO: 556550 - protein, 8 aa, Mycobacterium
RAEPALRD

SEQ ID NO: 556551 - protein, 13 aa, Mycobacterium
RAEPATLDPEQGF

SEQ ID NO: 556552 - protein, 14 aa, Mycobacterium
RAEPDLKSGRGGLR

SEQ ID NO: 556553 - protein, 34 aa, Mycobacterium
RAEPDPDGGATGRSRWRRKNPKNAHVAQDGKPKL

SEQ ID NO: 556554 - protein, 11 aa, Mycobacterium
RAEPERGHPRA

SEQ ID NO: 556555 - protein, 7 aa, Mycobacterium
RAEPFAG

SEQ ID NO: 556556 - protein, 8 aa, Mycobacterium
RAEPGASA

SEQ ID NO: 556557 - protein, 10 aa, Mycobacterium
RAEPKPPVDA

SEQ ID NO: 556558 - protein, 5 aa, Mycobacterium
RAEPL

SEQ ID NO: 556559 - protein, 7 aa, Mycobacterium
RAEPLGD

SEQ ID NO: 556560 - protein, 6 aa, Mycobacterium
RAEPPD

SEQ ID NO: 556561 - protein, 8 aa, Mycobacterium
RAEPPTDI

SEQ ID NO: 556562 - protein, 8 aa, Mycobacterium
RAEPQGSI

SEQ ID NO: 556563 - protein, 8 aa, Mycobacterium
RAEPRTKV

SEQ ID NO: 556564 - protein, 5 aa, Mycobacterium
RAEPT

SEQ ID NO: 556565 - protein, 7 aa, Mycobacterium
RAEPTAE

SEQ ID NO: 556566 - protein, 7 aa, Mycobacterium
RAEPVGA

SEQ ID NO: 556567 - protein, 12 aa, Mycobacterium
RAEQAEKRKRGE

SEQ ID NO: 556568 - protein, 6 aa, Mycobacterium
RAEQAG

SEQ ID NO: 556569 - protein, 13 aa, Mycobacterium
RAEQAGSQRESRY

SEQ ID NO: 556570 - protein, 15 aa, Mycobacterium
RAEQAGSQRESRYGA

SEQ ID NO: 556571 - protein, 18 aa, Mycobacterium
RAEQAKYTSNAKYKTDPQ

SEQ ID NO: 556572 - protein, 7 aa, Mycobacterium
RAEQDPA

SEQ ID NO: 556573 - protein, 7 aa, Mycobacterium
RAEQDPE

SEQ ID NO: 556574 - protein, 7 aa, Mycobacterium
RAEQDTV

SEQ ID NO: 556575 - protein, 7 aa, Mycobacterium
RAEQHGW

SEQ ID NO: 556576 - protein, 7 aa, Mycobacterium
RAEQHPD

SEQ ID NO: 556577 - protein, 5 aa, Mycobacterium
RAEQI

SEQ ID NO: 556578 - protein, 12 aa, Mycobacterium
RAEQKEKRDRGE

SEQ ID NO: 556579 - protein, 11 aa, Mycobacterium
RAEQKERRARG

SEQ ID NO: 556580 - protein, 5 aa, Mycobacterium
RAEQL

SEQ ID NO: 556581 - protein, 6 aa, Mycobacterium
RAEQLR

SEQ ID NO: 556582 - protein, 8 aa, Mycobacterium
RAEQPGED

SEQ ID NO: 556583 - protein, 5 aa, Mycobacterium
RAEQQ

SEQ ID NO: 556584 - protein, 12 aa, Mycobacterium
RAEQQDPKRSRR

SEQ ID NO: 556585 - protein, 10 aa, Mycobacterium
RAEQQPQPKL

SEQ ID NO: 556586 - protein, 8 aa, Mycobacterium
RAEQTAMQ

SEQ ID NO: 556587 - protein, 6 aa, Mycobacterium
RAEQTG

SEQ ID NO: 556588 - protein, 8 aa, Mycobacterium
RAEQTGRV

SEQ ID NO: 556589 - protein, 30 aa, Mycobacterium
RAEQYEQQAQKAAAAGRAKEAEEAKANAEQ

SEQ ID NO: 556590 - protein, 4 aa, Mycobacterium
RAER

SEQ ID NO: 556591 - protein, 10 aa, Mycobacterium
RAERAGGELS

SEQ ID NO: 556592 - protein, 12 aa, Mycobacterium
RAERARAGGGFE

SEQ ID NO: 556593 - protein, 19 aa, Mycobacterium
RAERARNEKYLSERNKPPP

SEQ ID NO: 556594 - protein, 12 aa, Mycobacterium
RAERDAVAALGL

SEQ ID NO: 556595 - protein, 6 aa, Mycobacterium
RAERDC

SEQ ID NO: 556596 - protein, 10 aa, Mycobacterium
RAERDDDAVQ

SEQ ID NO: 556597 - protein, 12 aa, Mycobacterium
RAERDEAATQAA

SEQ ID NO: 556598 - protein, 7 aa, Mycobacterium
RAERDGD

SEQ ID NO: 556599 - protein, 7 aa, Mycobacterium
RAERDGN

SEQ ID NO: 556600 - protein, 9 aa, Mycobacterium
RAERDNERC

SEQ ID NO: 556601 - protein, 5 aa, Mycobacterium
RAERE

SEQ ID NO: 556602 - protein, 6 aa, Mycobacterium
RAEREI

SEQ ID NO: 556603 - protein, 13 aa, Mycobacterium
RAEREVGPGEYRP

SEQ ID NO: 556604 - protein, 8 aa, Mycobacterium
RAERGEKN

SEQ ID NO: 556605 - protein, 7 aa, Mycobacterium
RAERGES

SEQ ID NO: 556606 - protein, 8 aa, Mycobacterium
RAERGETN

SEQ ID NO: 556607 - protein, 9 aa, Mycobacterium
RAERGGPRF

SEQ ID NO: 556608 - protein, 7 aa, Mycobacterium
RAERHDR

SEQ ID NO: 556609 - protein, 7 aa, Mycobacterium
RAERHEQ

SEQ ID NO: 556610 - protein, 8 aa, Mycobacterium
RAERHSPF

SEQ ID NO: 556611 - protein, 5 aa, Mycobacterium
RAERL

SEQ ID NO: 556612 - protein, 12 aa, Mycobacterium
RAERPYQATAVI

SEQ ID NO: 556613 - protein, 14 aa, Mycobacterium
RAERRAQAHIPGRA

SEQ ID NO: 556614 - protein, 6 aa, Mycobacterium
RAERRE

SEQ ID NO: 556615 - protein, 19 aa, Mycobacterium
RAERRPQPRRTIVERPLPD

SEQ ID NO: 556616 - protein, 15 aa, Mycobacterium
RAERTASQARSAAAA

SEQ ID NO: 556617 - protein, 11 aa, Mycobacterium
RAERVAADRDE

SEQ ID NO: 556618 - protein, 11 aa, Mycobacterium
RAERVARDREE

SEQ ID NO: 556619 - protein, 4 aa, Mycobacterium
RAES

SEQ ID NO: 556620 - protein, 5 aa, Mycobacterium
RAESA

SEQ ID NO: 556621 - protein, 11 aa, Mycobacterium
RAESADGREGV

SEQ ID NO: 556622 - protein, 9 aa, Mycobacterium
RAESADLSS

SEQ ID NO: 556623 - protein, 25 aa, Mycobacterium
RAESAQCGRPVGDDAAAHTAPADMQ

SEQ ID NO: 556624 - protein, 15 aa, Mycobacterium
RAESAVPGSAPTAPT

SEQ ID NO: 556625 - protein, 15 aa, Mycobacterium
RAESDALGDRSPEID

SEQ ID NO: 556626 - protein, 7 aa, Mycobacterium
RAESDEL

SEQ ID NO: 556627 - protein, 5 aa, Mycobacterium
RAESE

SEQ ID NO: 556628 - protein, 9 aa, Mycobacterium
RAESEGTDG

SEQ ID NO: 556629 - protein, 18 aa, Mycobacterium
RAESEPIEIGEGSNIQDG

SEQ ID NO: 556630 - protein, 17 aa, Mycobacterium
RAESERAACPNGEDNRL

SEQ ID NO: 556631 - protein, 5 aa, Mycobacterium
RAESG

SEQ ID NO: 556632 - protein, 9 aa, Mycobacterium
RAESGGIED

SEQ ID NO: 556633 - protein, 8 aa, Mycobacterium
RAESGGLL

SEQ ID NO: 556634 - protein, 8 aa, Mycobacterium
RAESGGVL

SEQ ID NO: 556635 - protein, 9 aa, Mycobacterium
RAESGGVLG

SEQ ID NO: 556636 - protein, 11 aa, Mycobacterium
RAESKESGGKV

SEQ ID NO: 556637 - protein, 10 aa, Mycobacterium
RAESLHPVGE

SEQ ID NO: 556638 - protein, 8 aa, Mycobacterium
RAESLNAS

SEQ ID NO: 556639 - protein, 8 aa, Mycobacterium
RAESPAKP

SEQ ID NO: 556640 - protein, 8 aa, Mycobacterium
RAESPYNG

SEQ ID NO: 556641 - protein, 10 aa, Mycobacterium
RAESRRNGAT

SEQ ID NO: 556642 - protein, 9 aa, Mycobacterium
RAESSEAVG

SEQ ID NO: 556643 - protein, 5 aa, Mycobacterium
RAEST

SEQ ID NO: 556644 - protein, 12 aa, Mycobacterium
RAESTRVNLEGT

SEQ ID NO: 556645 - protein, 11 aa, Mycobacterium
RAESVTRTDTG

SEQ ID NO: 556646 - protein, 12 aa, Mycobacterium
RAESYATSDPRS

SEQ ID NO: 556647 - protein, 4 aa, Mycobacterium
RAET

SEQ ID NO: 556648 - protein, 5 aa, Mycobacterium
RAETA

SEQ ID NO: 556649 - protein, 7 aa, Mycobacterium
RAETDAP

SEQ ID NO: 556650 - protein, 8 aa, Mycobacterium
RAETDDVT

SEQ ID NO: 556651 - protein, 11 aa, Mycobacterium
RAETDGLDSTA

SEQ ID NO: 556652 - protein, 18 aa, Mycobacterium
RAETGKGASRRARRDGKI

SEQ ID NO: 556653 - protein, 9 aa, Mycobacterium
RAETGPDTQ

SEQ ID NO: 556654 - protein, 6 aa, Mycobacterium
RAETGV

SEQ ID NO: 556655 - protein, 5 aa, Mycobacterium
RAETL

SEQ ID NO: 556656 - protein, 8 aa, Mycobacterium
RAETPDDV

SEQ ID NO: 556657 - protein, 8 aa, Mycobacterium
RAETPEDV

SEQ ID NO: 556658 - protein, 8 aa, Mycobacterium
RAETRREH

SEQ ID NO: 556659 - protein, 8 aa, Mycobacterium
RAETRVPT

SEQ ID NO: 556660 - protein, 7 aa, Mycobacterium
RAETSAP

SEQ ID NO: 556661 - protein, 9 aa, Mycobacterium
RAETSASNV

SEQ ID NO: 556662 - protein, 9 aa, Mycobacterium
RAETSQRAR

SEQ ID NO: 556663 - protein, 7 aa, Mycobacterium
RAETTAN

SEQ ID NO: 556664 - protein, 7 aa, Mycobacterium
RAETTGV

SEQ ID NO: 556665 - protein, 5 aa, Mycobacterium
RAETV

SEQ ID NO: 556666 - protein, 16 aa, Mycobacterium
RAEVGGELACEVTHEQ

SEQ ID NO: 556667 - protein, 7 aa, Mycobacterium
RAEVGRS

SEQ ID NO: 556668 - protein, 9 aa, Mycobacterium
RAEVPDGTT

SEQ ID NO: 556669 - protein, 5 aa, Mycobacterium
RAEVS

SEQ ID NO: 556670 - protein, 13 aa, Mycobacterium
RAEVTHTGEDGHD

SEQ ID NO: 556671 - protein, 4 aa, Mycobacterium
RAEW

SEQ ID NO: 556672 - protein, 5 aa, Mycobacterium
RAEWD

SEQ ID NO: 556673 - protein, 12 aa, Mycobacterium
RAEWEDSVNETR

SEQ ID NO: 556674 - protein, 16 aa, Mycobacterium
RAEYDPDNLFNSWMGR

SEQ ID NO: 556675 - protein, 5 aa, Mycobacterium
RAEYP

SEQ ID NO: 556676 - protein, 12 aa, Mycobacterium
RAEYRPITDTEA

SEQ ID NO: 556677 - protein, 4 aa, Mycobacterium
RAFA

SEQ ID NO: 556678 - protein, 11 aa, Mycobacterium
RAFARGSGRPA

SEQ ID NO: 556679 - protein, 8 aa, Mycobacterium
RAFDDDSL

SEQ ID NO: 556680 - protein, 11 aa, Mycobacterium
RAFDESSWPHD

SEQ ID NO: 556681 - protein, 8 aa, Mycobacterium
RAFDGGPW

SEQ ID NO: 556682 - protein, 10 aa, Mycobacterium
RAFDPSAGKP

SEQ ID NO: 556683 - protein, 11 aa, Mycobacterium
RAFDPSAGKPL

SEQ ID NO: 556684 - protein, 21 aa, Mycobacterium
RAFESRRAESISRAVLAGISA

SEQ ID NO: 556685 - protein, 4 aa, Mycobacterium
RAFG

SEQ ID NO: 556686 - protein, 18 aa, Mycobacterium
RAFGAGVPAAQAPANELA

SEQ ID NO: 556687 - protein, 8 aa, Mycobacterium
RAFGNGKV

SEQ ID NO: 556688 - protein, 23 aa, Mycobacterium
RAFGRGEDADRVARDDLESNAKE

SEQ ID NO: 556689 - protein, 8 aa, Mycobacterium
RAFKPSPA

SEQ ID NO: 556690 - protein, 7 aa, Mycobacterium
RAFPGTP

SEQ ID NO: 556691 - protein, 8 aa, Mycobacterium
RAFSAGGD

SEQ ID NO: 556692 - protein, 10 aa, Mycobacterium
RAFSAGNDLK

SEQ ID NO: 556693 - protein, 13 aa, Mycobacterium
RAFSDAKTRAEQY

SEQ ID NO: 556694 - protein, 6 aa, Mycobacterium
RAFSGG

SEQ ID NO: 556695 - protein, 8 aa, Mycobacterium
RAFSGGYD

SEQ ID NO: 556696 - protein, 10 aa, Mycobacterium
RAFSPSEVAP

SEQ ID NO: 556697 - protein, 5 aa, Mycobacterium
RAGAA

SEQ ID NO: 556698 - protein, 8 aa, Mycobacterium
RAGAAAAG

SEQ ID NO: 556699 - protein, 7 aa, Mycobacterium
RAGAAER

SEQ ID NO: 556700 - protein, 11 aa, Mycobacterium
RAGAAETIDAT

SEQ ID NO: 556701 - protein, 8 aa, Mycobacterium
RAGAAPVA

SEQ ID NO: 556702 - protein, 8 aa, Mycobacterium
RAGAARAA

SEQ ID NO: 556703 - protein, 7 aa, Mycobacterium
RAGAASE

SEQ ID NO: 556704 - protein, 6 aa, Mycobacterium
RAGAAT

SEQ ID NO: 556705 - protein, 8 aa, Mycobacterium
RAGAATER

SEQ ID NO: 556706 - protein, 7 aa, Mycobacterium
RAGAATV

SEQ ID NO: 556707 - protein, 6 aa, Mycobacterium
RAGAAV

SEQ ID NO: 556708 - protein, 5 aa, Mycobacterium
RAGAD

SEQ ID NO: 556709 - protein, 24 aa, Mycobacterium
RAGADEAADDISGDAEESTKADAE

SEQ ID NO: 556710 - protein, 7 aa, Mycobacterium
RAGADPE

SEQ ID NO: 556711 - protein, 7 aa, Mycobacterium
RAGADPQ

SEQ ID NO: 556712 - protein, 10 aa, Mycobacterium
RAGADQRGRI

SEQ ID NO: 556713 - protein, 9 aa, Mycobacterium
RAGADSTEA

SEQ ID NO: 556714 - protein, 15 aa, Mycobacterium
RAGADWEPRPLDDQT

SEQ ID NO: 556715 - protein, 10 aa, Mycobacterium
RAGAEALRQG

SEQ ID NO: 556716 - protein, 15 aa, Mycobacterium
RAGAEATHERLGGPG

SEQ ID NO: 556717 - protein, 8 aa, Mycobacterium
RAGAEGDK

SEQ ID NO: 556718 - protein, 6 aa, Mycobacterium
RAGAES

SEQ ID NO: 556719 - protein, 51 aa, Mycobacterium
RAGAESQGSPEPEPDPPGGGQSAGQDCPPQQQNSNSRPQQAPKPSAGPSKV

SEQ ID NO: 556720 - protein, 12 aa, Mycobacterium
RAGAGAAGFTDD

SEQ ID NO: 556721 - protein, 17 aa, Mycobacterium
RAGAGDVGDDGPVRDDR

SEQ ID NO: 556722 - protein, 6 aa, Mycobacterium
RAGAGE

SEQ ID NO: 556723 - protein, 8 aa, Mycobacterium
RAGAGGGK

SEQ ID NO: 556724 - protein, 11 aa, Mycobacterium
RAGAGGRPSRT

SEQ ID NO: 556725 - protein, 9 aa, Mycobacterium
RAGAGSDEH

SEQ ID NO: 556726 - protein, 6 aa, Mycobacterium
RAGAGV

SEQ ID NO: 556727 - protein, 6 aa, Mycobacterium
RAGAHP

SEQ ID NO: 556728 - protein, 22 aa, Mycobacterium
RAGAPDAPADRSPAEESAAGPV

SEQ ID NO: 556729 - protein, 14 aa, Mycobacterium
RAGAPDWDVTPEEL

SEQ ID NO: 556730 - protein, 10 aa, Mycobacterium
RAGAPEREEN

SEQ ID NO: 556731 - protein, 8 aa, Mycobacterium
RAGAPGQA

SEQ ID NO: 556732 - protein, 9 aa, Mycobacterium
RAGAPPRPS

SEQ ID NO: 556733 - protein, 8 aa, Mycobacterium
RAGAPRKV

SEQ ID NO: 556734 - protein, 10 aa, Mycobacterium
RAGAPRRKGR

SEQ ID NO: 556735 - protein, 5 aa, Mycobacterium
RAGAQ

SEQ ID NO: 556736 - protein, 8 aa, Mycobacterium
RAGAQGIR

SEQ ID NO: 556737 - protein, 8 aa, Mycobacterium
RAGAQPDA

SEQ ID NO: 556738 - protein, 13 aa, Mycobacterium
RAGAQPQRTGRKG

SEQ ID NO: 556739 - protein, 10 aa, Mycobacterium
RAGARDERGW

SEQ ID NO: 556740 - protein, 6 aa, Mycobacterium
RAGARF

SEQ ID NO: 556741 - protein, 12 aa, Mycobacterium
RAGARGGPDDRR

SEQ ID NO: 556742 - protein, 24 aa, Mycobacterium
RAGARYMGPERAEEFGRRNSSPGE

SEQ ID NO: 556743 - protein, 12 aa, Mycobacterium
RAGASGGEIADP

SEQ ID NO: 556744 - protein, 6 aa, Mycobacterium
RAGASV

SEQ ID NO: 556745 - protein, 5 aa, Mycobacterium
RAGAT

SEQ ID NO: 556746 - protein, 8 aa, Mycobacterium
RAGATAAE

SEQ ID NO: 556747 - protein, 20 aa, Mycobacterium
RAGATAAELSRAATQANGGV

SEQ ID NO: 556748 - protein, 7 aa, Mycobacterium
RAGATLK

SEQ ID NO: 556749 - protein, 8 aa, Mycobacterium
RAGATPPA

SEQ ID NO: 556750 - protein, 6 aa, Mycobacterium
RAGATT

SEQ ID NO: 556751 - protein, 5 aa, Mycobacterium
RAGAV

SEQ ID NO: 556752 - protein, 12 aa, Mycobacterium
RAGAVTDAGREL

SEQ ID NO: 556753 - protein, 8 aa, Mycobacterium
RAGDAQVP

SEQ ID NO: 556754 - protein, 6 aa, Mycobacterium
RAGDAT

SEQ ID NO: 556755 - protein, 6 aa, Mycobacterium
RAGDAV

SEQ ID NO: 556756 - protein, 17 aa, Mycobacterium
RAGDDSEVVAARGLLTA

SEQ ID NO: 556757 - protein, 7 aa, Mycobacterium
RAGDEIT

SEQ ID NO: 556758 - protein, 13 aa, Mycobacterium
RAGDFNARSEALQ

SEQ ID NO: 556759 - protein, 9 aa, Mycobacterium
RAGDFTARS

SEQ ID NO: 556760 - protein, 10 aa, Mycobacterium
RAGDGGDELR

SEQ ID NO: 556761 - protein, 7 aa, Mycobacterium
RAGDGGL

SEQ ID NO: 556762 - protein, 7 aa, Mycobacterium
RAGDGLA

SEQ ID NO: 556763 - protein, 10 aa, Mycobacterium
RAGDGRPDLD

SEQ ID NO: 556764 - protein, 7 aa, Mycobacterium
RAGDGTG

SEQ ID NO: 556765 - protein, 7 aa, Mycobacterium
RAGDGVS

SEQ ID NO: 556766 - protein, 5 aa, Mycobacterium
RAGDH

SEQ ID NO: 556767 - protein, 6 aa, Mycobacterium
RAGDHD

SEQ ID NO: 556768 - protein, 10 aa, Mycobacterium
RAGDLAPARA

SEQ ID NO: 556769 - protein, 10 aa, Mycobacterium
RAGDLTTRSA

SEQ ID NO: 556770 - protein, 9 aa, Mycobacterium
RAGDPAEIA

SEQ ID NO: 556771 - protein, 8 aa, Mycobacterium
RAGDPAEV

SEQ ID NO: 556772 - protein, 8 aa, Mycobacterium
RAGDPSRL

SEQ ID NO: 556773 - protein, 10 aa, Mycobacterium
RAGDRAPDAL

SEQ ID NO: 556774 - protein, 10 aa, Mycobacterium
RAGDRGAVEA

SEQ ID NO: 556775 - protein, 7 aa, Mycobacterium
RAGDRSR

SEQ ID NO: 556776 - protein, 5 aa, Mycobacterium
RAGDT

SEQ ID NO: 556777 - protein, 6 aa, Mycobacterium
RAGDVD

SEQ ID NO: 556778 - protein, 10 aa, Mycobacterium
RAGDVPPVGA

SEQ ID NO: 556779 - protein, 8 aa, Mycobacterium
RAGDVSAQ

SEQ ID NO: 556780 - protein, 5 aa, Mycobacterium
RAGEA

SEQ ID NO: 556781 - protein, 6 aa, Mycobacterium
RAGEAA

SEQ ID NO: 556782 - protein, 7 aa, Mycobacterium
RAGEAAL

SEQ ID NO: 556783 - protein, 21 aa, Mycobacterium
RAGEAHQQLTSSKVTGKVVLT

SEQ ID NO: 556784 - protein, 6 aa, Mycobacterium
RAGEAP

SEQ ID NO: 556785 - protein, 6 aa, Mycobacterium
RAGEAT

SEQ ID NO: 556786 - protein, 22 aa, Mycobacterium
RAGEDKPGKSSGGGMFGGGSPG

SEQ ID NO: 556787 - protein, 5 aa, Mycobacterium
RAGEG

SEQ ID NO: 556788 - protein, 8 aa, Mycobacterium
RAGEGATT

SEQ ID NO: 556789 - protein, 8 aa, Mycobacterium
RAGEGKLT

SEQ ID NO: 556790 - protein, 19 aa, Mycobacterium
RAGEGYRLTGTRTQVGYGP

SEQ ID NO: 556791 - protein, 13 aa, Mycobacterium
RAGEIDQAEYEKR

SEQ ID NO: 556792 - protein, 8 aa, Mycobacterium
RAGEPAEV

SEQ ID NO: 556793 - protein, 8 aa, Mycobacterium
RAGEPAVG

SEQ ID NO: 556794 - protein, 8 aa, Mycobacterium
RAGEPDEV

SEQ ID NO: 556795 - protein, 11 aa, Mycobacterium
RAGEPESRARY

SEQ ID NO: 556796 - protein, 7 aa, Mycobacterium
RAGEPEY

SEQ ID NO: 556797 - protein, 8 aa, Mycobacterium
RAGEPLPV

SEQ ID NO: 556798 - protein, 8 aa, Mycobacterium
RAGEPQEV

SEQ ID NO: 556799 - protein, 16 aa, Mycobacterium
RAGEPSWPSPFGPGRP

SEQ ID NO: 556800 - protein, 7 aa, Mycobacterium
RAGEPVG

SEQ ID NO: 556801 - protein, 18 aa, Mycobacterium
RAGEQAFKQANPASGTHR

SEQ ID NO: 556802 - protein, 7 aa, Mycobacterium
RAGEQGR

SEQ ID NO: 556803 - protein, 5 aa, Mycobacterium
RAGER

SEQ ID NO: 556804 - protein, 9 aa, Mycobacterium
RAGERGAIE

SEQ ID NO: 556805 - protein, 8 aa, Mycobacterium
RAGERGAL

SEQ ID NO: 556806 - protein, 12 aa, Mycobacterium
RAGERTRDAVGA

SEQ ID NO: 556807 - protein, 5 aa, Mycobacterium
RAGES

SEQ ID NO: 556808 - protein, 8 aa, Mycobacterium
RAGESAGA

SEQ ID NO: 556809 - protein, 8 aa, Mycobacterium
RAGESIDD

SEQ ID NO: 556810 - protein, 24 aa, Mycobacterium
RAGESPHRIAPNPAEVSDGAASVI

SEQ ID NO: 556811 - protein, 11 aa, Mycobacterium
RAGESPQTAAQ

SEQ ID NO: 556812 - protein, 8 aa, Mycobacterium
RAGESRAY

SEQ ID NO: 556813 - protein, 7 aa, Mycobacterium
RAGESVS

SEQ ID NO: 556814 - protein, 9 aa, Mycobacterium
RAGETERDD

SEQ ID NO: 556815 - protein, 8 aa, Mycobacterium
RAGETLDD

SEQ ID NO: 556816 - protein, 9 aa, Mycobacterium
RAGETLDDG

SEQ ID NO: 556817 - protein, 8 aa, Mycobacterium
RAGETLDQ

SEQ ID NO: 556818 - protein, 6 aa, Mycobacterium
RAGETR

SEQ ID NO: 556819 - protein, 6 aa, Mycobacterium
RAGETV

SEQ ID NO: 556820 - protein, 5 aa, Mycobacterium
RAGEY

SEQ ID NO: 556821 - protein, 16 aa, Mycobacterium
RAGFRAPAPTAGQHEP

SEQ ID NO: 556822 - protein, 6 aa, Mycobacterium
RAGFTD

SEQ ID NO: 556823 - protein, 4 aa, Mycobacterium
RAGG

SEQ ID NO: 556824 - protein, 7 aa, Mycobacterium
RAGGAAP

SEQ ID NO: 556825 - protein, 7 aa, Mycobacterium
RAGGANV

SEQ ID NO: 556826 - protein, 6 aa, Mycobacterium
RAGGAP

SEQ ID NO: 556827 - protein, 27 aa, Mycobacterium
RAGGAQLSERELAEQAEELDTALRNLG

SEQ ID NO: 556828 - protein, 7 aa, Mycobacterium
RAGGARG

SEQ ID NO: 556829 - protein, 19 aa, Mycobacterium
RAGGAVSENATDTPRRRRR

SEQ ID NO: 556830 - protein, 9 aa, Mycobacterium
RAGGDAAQN

SEQ ID NO: 556831 - protein, 10 aa, Mycobacterium
RAGGDAGSGE

SEQ ID NO: 556832 - protein, 7 aa, Mycobacterium
RAGGDAQ

SEQ ID NO: 556833 - protein, 7 aa, Mycobacterium
RAGGDAR

SEQ ID NO: 556834 - protein, 7 aa, Mycobacterium
RAGGDPW

SEQ ID NO: 556835 - protein, 9 aa, Mycobacterium
RAGGDTGAS

SEQ ID NO: 556836 - protein, 9 aa, Mycobacterium
RAGGDTGAT

SEQ ID NO: 556837 - protein, 5 aa, Mycobacterium
RAGGE

SEQ ID NO: 556838 - protein, 20 aa, Mycobacterium
RAGGEQKDTVSRSTLPAGNN

SEQ ID NO: 556839 - protein, 5 aa, Mycobacterium
RAGGF

SEQ ID NO: 556840 - protein, 6 aa, Mycobacterium
RAGGFS

SEQ ID NO: 556841 - protein, 8 aa, Mycobacterium
RAGGGDAH

SEQ ID NO: 556842 - protein, 9 aa, Mycobacterium
RAGGGGPDI

SEQ ID NO: 556843 - protein, 7 aa, Mycobacterium
RAGGGQA

SEQ ID NO: 556844 - protein, 6 aa, Mycobacterium
RAGGGV

SEQ ID NO: 556845 - protein, 5 aa, Mycobacterium
RAGGH

SEQ ID NO: 556846 - protein, 7 aa, Mycobacterium
RAGGHDR

SEQ ID NO: 556847 - protein, 6 aa, Mycobacterium
RAGGHT

SEQ ID NO: 556848 - protein, 9 aa, Mycobacterium
RAGGIGAPR

SEQ ID NO: 556849 - protein, 5 aa, Mycobacterium
RAGGL

SEQ ID NO: 556850 - protein, 7 aa, Mycobacterium
RAGGLPG

SEQ ID NO: 556851 - protein, 6 aa, Mycobacterium
RAGGLV

SEQ ID NO: 556852 - protein, 15 aa, Mycobacterium
RAGGMLSGGSGGELP

SEQ ID NO: 556853 - protein, 6 aa, Mycobacterium
RAGGMT

SEQ ID NO: 556854 - protein, 10 aa, Mycobacterium
RAGGPDPGYA

SEQ ID NO: 556855 - protein, 5 aa, Mycobacterium
RAGGR

SEQ ID NO: 556856 - protein, 12 aa, Mycobacterium
RAGGRDNRPTQR

SEQ ID NO: 556857 - protein, 7 aa, Mycobacterium
RAGGRPV

SEQ ID NO: 556858 - protein, 8 aa, Mycobacterium
RAGGRQAG

SEQ ID NO: 556859 - protein, 11 aa, Mycobacterium
RAGGRTTPIGT

SEQ ID NO: 556860 - protein, 6 aa, Mycobacterium
RAGGSG

SEQ ID NO: 556861 - protein, 8 aa, Mycobacterium
RAGGSGGN

SEQ ID NO: 556862 - protein, 12 aa, Mycobacterium
RAGGSPADPEPE

SEQ ID NO: 556863 - protein, 11 aa, Mycobacterium
RAGGSSPKLGG

SEQ ID NO: 556864 - protein, 8 aa, Mycobacterium
RAGGTATL

SEQ ID NO: 556865 - protein, 8 aa, Mycobacterium
RAGGTAVD

SEQ ID NO: 556866 - protein, 6 aa, Mycobacterium
RAGGTV

SEQ ID NO: 556867 - protein, 6 aa, Mycobacterium
RAGGVD

SEQ ID NO: 556868 - protein, 9 aa, Mycobacterium
RAGGVGAPR

SEQ ID NO: 556869 - protein, 23 aa, Mycobacterium
RAGGVGGHRRQDSFQPPDQRPDA

SEQ ID NO: 556870 - protein, 7 aa, Mycobacterium
RAGGVRA

SEQ ID NO: 556871 - protein, 9 aa, Mycobacterium
RAGGVSARP

SEQ ID NO: 556872 - protein, 8 aa, Mycobacterium
RAGGVSGR

SEQ ID NO: 556873 - protein, 12 aa, Mycobacterium
RAGGVSKPPYAT

SEQ ID NO: 556874 - protein, 11 aa, Mycobacterium
RAGGVSQPPFD

SEQ ID NO: 556875 - protein, 6 aa, Mycobacterium
RAGHAS

SEQ ID NO: 556876 - protein, 13 aa, Mycobacterium
RAGHDDDFNRGDS

SEQ ID NO: 556877 - protein, 37 aa, Mycobacterium
RAGHDDDFNRGDSAYDNYYGDPTLPNPNLRPLGKPPY

SEQ ID NO: 556878 - protein, 7 aa, Mycobacterium
RAGHDTA

SEQ ID NO: 556879 - protein, 14 aa, Mycobacterium
RAGHGDALRDAGAD

SEQ ID NO: 556880 - protein, 8 aa, Mycobacterium
RAGHGFPA

SEQ ID NO: 556881 - protein, 8 aa, Mycobacterium
RAGHPDGN

SEQ ID NO: 556882 - protein, 6 aa, Mycobacterium
RAGHPE

SEQ ID NO: 556883 - protein, 7 aa, Mycobacterium
RAGHPGA

SEQ ID NO: 556884 - protein, 18 aa, Mycobacterium
RAGHPGRRRGRLRRPRGA

SEQ ID NO: 556885 - protein, 8 aa, Mycobacterium
RAGHTDGN

SEQ ID NO: 556886 - protein, 8 aa, Mycobacterium
RAGIDPKK

SEQ ID NO: 556887 - protein, 16 aa, Mycobacterium
RAGINSGSAVPNSDGS

SEQ ID NO: 556888 - protein, 5 aa, Mycobacterium
RAGIT

SEQ ID NO: 556889 - protein, 9 aa, Mycobacterium
RAGKAGLPA

SEQ ID NO: 556890 - protein, 9 aa, Mycobacterium
RAGKAGLVP

SEQ ID NO: 556891 - protein, 9 aa, Mycobacterium
RAGKAGVPA

SEQ ID NO: 556892 - protein, 11 aa, Mycobacterium
RAGKGPSPVTA

SEQ ID NO: 556893 - protein, 10 aa, Mycobacterium
RAGKLDPNRV

SEQ ID NO: 556894 - protein, 12 aa, Mycobacterium
RAGKNIRGVIAF

SEQ ID NO: 556895 - protein, 5 aa, Mycobacterium
RAGKQ

SEQ ID NO: 556896 - protein, 14 aa, Mycobacterium
RAGKRHIEAFVLSR

SEQ ID NO: 556897 - protein, 12 aa, Mycobacterium
RAGKSNSGKGAA

SEQ ID NO: 556898 - protein, 9 aa, Mycobacterium
RAGLDTPVR

SEQ ID NO: 556899 - protein, 5 aa, Mycobacterium
RAGLE

SEQ ID NO: 556900 - protein, 8 aa, Mycobacterium
RAGLPGHH

SEQ ID NO: 556901 - protein, 20 aa, Mycobacterium
RAGLPNSAEDKGAQAAAAAL

SEQ ID NO: 556902 - protein, 7 aa, Mycobacterium
RAGLPSA

SEQ ID NO: 556903 - protein, 12 aa, Mycobacterium
RAGLPVAERALE

SEQ ID NO: 556904 - protein, 6 aa, Mycobacterium
RAGLSA

SEQ ID NO: 556905 - protein, 8 aa, Mycobacterium
RAGLSESN

SEQ ID NO: 556906 - protein, 7 aa, Mycobacterium
RAGLSGA

SEQ ID NO: 556907 - protein, 5 aa, Mycobacterium
RAGLT

SEQ ID NO: 556908 - protein, 6 aa, Mycobacterium
RAGLTK

SEQ ID NO: 556909 - protein, 4 aa, Mycobacterium
RAGN

SEQ ID NO: 556910 - protein, 10 aa, Mycobacterium
RAGNEGAKDL

SEQ ID NO: 556911 - protein, 6 aa, Mycobacterium
RAGNHR

SEQ ID NO: 556912 - protein, 8 aa, Mycobacterium
RAGNKPKF

SEQ ID NO: 556913 - protein, 7 aa, Mycobacterium
RAGNPGA

SEQ ID NO: 556914 - protein, 8 aa, Mycobacterium
RAGNPPEI

SEQ ID NO: 556915 - protein, 8 aa, Mycobacterium
RAGNQQAK

SEQ ID NO: 556916 - protein, 14 aa, Mycobacterium
RAGNRGPTAAPQNL

SEQ ID NO: 556917 - protein, 8 aa, Mycobacterium
RAGNSLPT

SEQ ID NO: 556918 - protein, 9 aa, Mycobacterium
RAGNSLPTQ

SEQ ID NO: 556919 - protein, 8 aa, Mycobacterium
RAGNTGAD

SEQ ID NO: 556920 - protein, 16 aa, Mycobacterium
RAGPAERGDTEADRRA

SEQ ID NO: 556921 - protein, 7 aa, Mycobacterium
RAGPAEV

SEQ ID NO: 556922 - protein, 7 aa, Mycobacterium
RAGPAKV

SEQ ID NO: 556923 - protein, 6 aa, Mycobacterium
RAGPAY

SEQ ID NO: 556924 - protein, 9 aa, Mycobacterium
RAGPDATAL

SEQ ID NO: 556925 - protein, 7 aa, Mycobacterium
RAGPDGC

SEQ ID NO: 556926 - protein, 13 aa, Mycobacterium
RAGPDHPGRPRAG

SEQ ID NO: 556927 - protein, 8 aa, Mycobacterium
RAGPGEVR

SEQ ID NO: 556928 - protein, 16 aa, Mycobacterium
RAGPGLRQEAQQAQNA

SEQ ID NO: 556929 - protein, 10 aa, Mycobacterium
RAGPGPVTDA

SEQ ID NO: 556930 - protein, 10 aa, Mycobacterium
RAGPGSLGDR

SEQ ID NO: 556931 - protein, 7 aa, Mycobacterium
RAGPGSS

SEQ ID NO: 556932 - protein, 5 aa, Mycobacterium
RAGPP

SEQ ID NO: 556933 - protein, 18 aa, Mycobacterium
RAGPPDSDSSATLPGGTE

SEQ ID NO: 556934 - protein, 62 aa, Mycobacterium
RAGPPPPPDQAQDKGEDKAQDKAQDGAHDKGESKTDGESPAAATEQAAAAVPSGDAVVGGST

SEQ ID NO: 556935 - protein, 6 aa, Mycobacterium
RAGPPQ

SEQ ID NO: 556936 - protein, 41 aa, Mycobacterium
RAGPQPKEEAKAETDGQPNGEAQAPPAAGVPSSDAVVGGST

SEQ ID NO: 556937 - protein, 7 aa, Mycobacterium
RAGPTRT

SEQ ID NO: 556938 - protein, 6 aa, Mycobacterium
RAGQAL

SEQ ID NO: 556939 - protein, 8 aa, Mycobacterium
RAGQDAAG

SEQ ID NO: 556940 - protein, 11 aa, Mycobacterium
RAGQDVGTERA

SEQ ID NO: 556941 - protein, 16 aa, Mycobacterium
RAGQEASISGLQAGAD

SEQ ID NO: 556942 - protein, 17 aa, Mycobacterium
RAGQEASVEGLDAGADD

SEQ ID NO: 556943 - protein, 9 aa, Mycobacterium
RAGQEPTTR

SEQ ID NO: 556944 - protein, 10 aa, Mycobacterium
RAGQGSDEHY

SEQ ID NO: 556945 - protein, 6 aa, Mycobacterium
RAGQPA

SEQ ID NO: 556946 - protein, 6 aa, Mycobacterium
RAGQPV

SEQ ID NO: 556947 - protein, 7 aa, Mycobacterium
RAGQRNY

SEQ ID NO: 556948 - protein, 6 aa, Mycobacterium
RAGQRR

SEQ ID NO: 556949 - protein, 6 aa, Mycobacterium
RAGQSH

SEQ ID NO: 556950 - protein, 9 aa, Mycobacterium
RAGQTDDGG

SEQ ID NO: 556951 - protein, 15 aa, Mycobacterium
RAGRAAEPLHATGPK

SEQ ID NO: 556952 - protein, 10 aa, Mycobacterium
RAGRAGFDTA

SEQ ID NO: 556953 - protein, 11 aa, Mycobacterium
RAGRAGRRSGA

SEQ ID NO: 556954 - protein, 9 aa, Mycobacterium
RAGRAHKTV

SEQ ID NO: 556955 - protein, 11 aa, Mycobacterium
RAGRDAVTRSG

SEQ ID NO: 556956 - protein, 11 aa, Mycobacterium
RAGRDDDAASL

SEQ ID NO: 556957 - protein, 7 aa, Mycobacterium
RAGRDGL

SEQ ID NO: 556958 - protein, 8 aa, Mycobacterium
RAGRDIKA

SEQ ID NO: 556959 - protein, 15 aa, Mycobacterium
RAGREGAQVADTPGM

SEQ ID NO: 556960 - protein, 8 aa, Mycobacterium
RAGREGVD

SEQ ID NO: 556961 - protein, 6 aa, Mycobacterium
RAGREL

SEQ ID NO: 556962 - protein, 8 aa, Mycobacterium
RAGREPGE

SEQ ID NO: 556963 - protein, 8 aa, Mycobacterium
RAGRERYD

SEQ ID NO: 556964 - protein, 6 aa, Mycobacterium
RAGRET

SEQ ID NO: 556965 - protein, 5 aa, Mycobacterium
RAGRF

SEQ ID NO: 556966 - protein, 9 aa, Mycobacterium
RAGRGATTM

SEQ ID NO: 556967 - protein, 7 aa, Mycobacterium
RAGRGLD

SEQ ID NO: 556968 - protein, 8 aa, Mycobacterium
RAGRGSDR

SEQ ID NO: 556969 - protein, 8 aa, Mycobacterium
RAGRHDRR

SEQ ID NO: 556970 - protein, 12 aa, Mycobacterium
RAGRIGHDGHPR

SEQ ID NO: 556971 - protein, 5 aa, Mycobacterium
RAGRK

SEQ ID NO: 556972 - protein, 7 aa, Mycobacterium
RAGRNPV

SEQ ID NO: 556973 - protein, 5 aa, Mycobacterium
RAGRP

SEQ ID NO: 556974 - protein, 6 aa, Mycobacterium
RAGRPA

SEQ ID NO: 556975 - protein, 11 aa, Mycobacterium
RAGRPGAAPTS

SEQ ID NO: 556976 - protein, 8 aa, Mycobacterium
RAGRPLRA

SEQ ID NO: 556977 - protein, 5 aa, Mycobacterium
RAGRQ

SEQ ID NO: 556978 - protein, 12 aa, Mycobacterium
RAGRQDTPQRRA

SEQ ID NO: 556979 - protein, 8 aa, Mycobacterium
RAGRQERQ

SEQ ID NO: 556980 - protein, 8 aa, Mycobacterium
RAGRQRGL

SEQ ID NO: 556981 - protein, 5 aa, Mycobacterium
RAGRR

SEQ ID NO: 556982 - protein, 10 aa, Mycobacterium
RAGRRDGRPV

SEQ ID NO: 556983 - protein, 9 aa, Mycobacterium
RAGRSATDI

SEQ ID NO: 556984 - protein, 15 aa, Mycobacterium
RAGRSKRGSKPRVAG

SEQ ID NO: 556985 - protein, 10 aa, Mycobacterium
RAGRSRSGFE

SEQ ID NO: 556986 - protein, 7 aa, Mycobacterium
RAGRTGE

SEQ ID NO: 556987 - protein, 7 aa, Mycobacterium
RAGRTRA

SEQ ID NO: 556988 - protein, 5 aa, Mycobacterium
RAGSA

SEQ ID NO: 556989 - protein, 18 aa, Mycobacterium
RAGSADGSGGDQPSPDVG

SEQ ID NO: 556990 - protein, 12 aa, Mycobacterium
RAGSAGLWSLIT

SEQ ID NO: 556991 - protein, 27 aa, Mycobacterium
RAGSAGSAGAARPAGAAVSAGSIGAAE

SEQ ID NO: 556992 - protein, 7 aa, Mycobacterium
RAGSAGT

SEQ ID NO: 556993 - protein, 8 aa, Mycobacterium
RAGSDKEI

SEQ ID NO: 556994 - protein, 16 aa, Mycobacterium
RAGSEQPPMDDEDAEA

SEQ ID NO: 556995 - protein, 14 aa, Mycobacterium
RAGSESSNGDQSTL

SEQ ID NO: 556996 - protein, 9 aa, Mycobacterium
RAGSGGNGC

SEQ ID NO: 556997 - protein, 22 aa, Mycobacterium
RAGSGPGVTACPAGPAVTAGAT

SEQ ID NO: 556998 - protein, 8 aa, Mycobacterium
RAGSGQPL

SEQ ID NO: 556999 - protein, 8 aa, Mycobacterium
RAGSGRAL

SEQ ID NO: 557000 - protein, 22 aa, Mycobacterium
RAGSGRLRSRHPAATSREAITG

SEQ ID NO: 557001 - protein, 5 aa, Mycobacterium
RAGSH

SEQ ID NO: 557002 - protein, 12 aa, Mycobacterium
RAGSHASVRVSV

SEQ ID NO: 557003 - protein, 6 aa, Mycobacterium
RAGSIG

SEQ ID NO: 557004 - protein, 14 aa, Mycobacterium
RAGSLRSSEMSDPT

SEQ ID NO: 557005 - protein, 16 aa, Mycobacterium
RAGSLSVAGGPSATAD

SEQ ID NO: 557006 - protein, 16 aa, Mycobacterium
RAGSMGVAGGPQATGE

SEQ ID NO: 557007 - protein, 5 aa, Mycobacterium
RAGSN

SEQ ID NO: 557008 - protein, 6 aa, Mycobacterium
RAGSNA

SEQ ID NO: 557009 - protein, 9 aa, Mycobacterium
RAGSPADEA

SEQ ID NO: 557010 - protein, 10 aa, Mycobacterium
RAGSPQGRAE

SEQ ID NO: 557011 - protein, 16 aa, Mycobacterium
RAGSQCRPSSTPHNTT

SEQ ID NO: 557012 - protein, 6 aa, Mycobacterium
RAGSQW

SEQ ID NO: 557013 - protein, 6 aa, Mycobacterium
RAGSRA

SEQ ID NO: 557014 - protein, 9 aa, Mycobacterium
RAGSRGADF

SEQ ID NO: 557015 - protein, 9 aa, Mycobacterium
RAGSRLGRG

SEQ ID NO: 557016 - protein, 6 aa, Mycobacterium
RAGSSS

SEQ ID NO: 557017 - protein, 8 aa, Mycobacterium
RAGSTGAQ

SEQ ID NO: 557018 - protein, 6 aa, Mycobacterium
RAGSTH

SEQ ID NO: 557019 - protein, 7 aa, Mycobacterium
RAGSTTG

SEQ ID NO: 557020 - protein, 10 aa, Mycobacterium
RAGTADFTDD

SEQ ID NO: 557021 - protein, 11 aa, Mycobacterium
RAGTANPISDD

SEQ ID NO: 557022 - protein, 11 aa, Mycobacterium
RAGTANPISED

SEQ ID NO: 557023 - protein, 6 aa, Mycobacterium
RAGTAY

SEQ ID NO: 557024 - protein, 9 aa, Mycobacterium
RAGTDDTLD

SEQ ID NO: 557025 - protein, 6 aa, Mycobacterium
RAGTDF

SEQ ID NO: 557026 - protein, 34 aa, Mycobacterium
RAGTDLESTPDASATEPRPTRGREIGEQRAYTLV

SEQ ID NO: 557027 - protein, 6 aa, Mycobacterium
RAGTEL

SEQ ID NO: 557028 - protein, 14 aa, Mycobacterium
RAGTIKPSRDPKGR

SEQ ID NO: 557029 - protein, 15 aa, Mycobacterium
RAGTIKPSRDPQARA

SEQ ID NO: 557030 - protein, 6 aa, Mycobacterium
RAGTKI

SEQ ID NO: 557031 - protein, 14 aa, Mycobacterium
RAGTLTPGELRGST

SEQ ID NO: 557032 - protein, 5 aa, Mycobacterium
RAGTP

SEQ ID NO: 557033 - protein, 8 aa, Mycobacterium
RAGTPGAD

SEQ ID NO: 557034 - protein, 9 aa, Mycobacterium
RAGTPGPLA

SEQ ID NO: 557035 - protein, 9 aa, Mycobacterium
RAGTPNADR

SEQ ID NO: 557036 - protein, 7 aa, Mycobacterium
RAGTPPA

SEQ ID NO: 557037 - protein, 8 aa, Mycobacterium
RAGTPPPV

SEQ ID NO: 557038 - protein, 13 aa, Mycobacterium
RAGTRWTSTDDFA

SEQ ID NO: 557039 - protein, 10 aa, Mycobacterium
RAGTSEQAIA

SEQ ID NO: 557040 - protein, 29 aa, Mycobacterium
RAGTSKMGTWNAPTKLTKAAKKVRSPWAA

SEQ ID NO: 557041 - protein, 6 aa, Mycobacterium
RAGTSR

SEQ ID NO: 557042 - protein, 6 aa, Mycobacterium
RAGTTG

SEQ ID NO: 557043 - protein, 5 aa, Mycobacterium
RAGTV

SEQ ID NO: 557044 - protein, 6 aa, Mycobacterium
RAGTVG

SEQ ID NO: 557045 - protein, 15 aa, Mycobacterium
RAGTVKPSRDPQARA

SEQ ID NO: 557046 - protein, 6 aa, Mycobacterium
RAGTVP

SEQ ID NO: 557047 - protein, 21 aa, Mycobacterium
RAGVASTTQPPDGQIPDGDNL

SEQ ID NO: 557048 - protein, 13 aa, Mycobacterium
RAGVDAKSGYSAR

SEQ ID NO: 557049 - protein, 8 aa, Mycobacterium
RAGVGKST

SEQ ID NO: 557050 - protein, 11 aa, Mycobacterium
RAGVGRPRTGY

SEQ ID NO: 557051 - protein, 12 aa, Mycobacterium
RAGVGRPRTGYR

SEQ ID NO: 557052 - protein, 12 aa, Mycobacterium
RAGVKGTSGMRK

SEQ ID NO: 557053 - protein, 5 aa, Mycobacterium
RAGVS

SEQ ID NO: 557054 - protein, 11 aa, Mycobacterium
RAGVSEPTVRR

SEQ ID NO: 557055 - protein, 6 aa, Mycobacterium
RAGVSR

SEQ ID NO: 557056 - protein, 8 aa, Mycobacterium
RAGVSRPS

SEQ ID NO: 557057 - protein, 8 aa, Mycobacterium
RAGVSRPT

SEQ ID NO: 557058 - protein, 7 aa, Mycobacterium
RAGVSRS

SEQ ID NO: 557059 - protein, 6 aa, Mycobacterium
RAGVSS

SEQ ID NO: 557060 - protein, 5 aa, Mycobacterium
RAGVT

SEQ ID NO: 557061 - protein, 7 aa, Mycobacterium
RAGVTDG

SEQ ID NO: 557062 - protein, 6 aa, Mycobacterium
RAGVTR

SEQ ID NO: 557063 - protein, 11 aa, Mycobacterium
RAGYDTPCYDT

SEQ ID NO: 557064 - protein, 5 aa, Mycobacterium
RAGYE

SEQ ID NO: 557065 - protein, 12 aa, Mycobacterium
RAGYPDPGGQIG

SEQ ID NO: 557066 - protein, 14 aa, Mycobacterium
RAGYSPAALRGSRS

SEQ ID NO: 557067 - protein, 14 aa, Mycobacterium
RAGYSPAALRGSRT

SEQ ID NO: 557068 - protein, 12 aa, Mycobacterium
RAHAATKLRARA

SEQ ID NO: 557069 - protein, 17 aa, Mycobacterium
RAHADFGDSAGQLIEEL

SEQ ID NO: 557070 - protein, 12 aa, Mycobacterium
RAHAGKSKRALA

SEQ ID NO: 557071 - protein, 8 aa, Mycobacterium
RAHAGPRV

SEQ ID NO: 557072 - protein, 4 aa, Mycobacterium
RAHD

SEQ ID NO: 557073 - protein, 10 aa, Mycobacterium
RAHDGDADAG

SEQ ID NO: 557074 - protein, 11 aa, Mycobacterium
RAHDKADPLNP

SEQ ID NO: 557075 - protein, 6 aa, Mycobacterium
RAHDPE

SEQ ID NO: 557076 - protein, 10 aa, Mycobacterium
RAHDPEKAGI

SEQ ID NO: 557077 - protein, 7 aa, Mycobacterium
RAHDRQD

SEQ ID NO: 557078 - protein, 9 aa, Mycobacterium
RAHDTATPQ

SEQ ID NO: 557079 - protein, 5 aa, Mycobacterium
RAHEA

SEQ ID NO: 557080 - protein, 6 aa, Mycobacterium
RAHEAA

SEQ ID NO: 557081 - protein, 5 aa, Mycobacterium
RAHEE

SEQ ID NO: 557082 - protein, 8 aa, Mycobacterium
RAHEGDAG

SEQ ID NO: 557083 - protein, 21 aa, Mycobacterium
RAHEPEDPGRQTAGQPYGPRH

SEQ ID NO: 557084 - protein, 7 aa, Mycobacterium
RAHGADA

SEQ ID NO: 557085 - protein, 6 aa, Mycobacterium
RAHGAR

SEQ ID NO: 557086 - protein, 6 aa, Mycobacterium
RAHGDD

SEQ ID NO: 557087 - protein, 9 aa, Mycobacterium
RAHGDPAAH

SEQ ID NO: 557088 - protein, 12 aa, Mycobacterium
RAHGDPKPLREA

SEQ ID NO: 557089 - protein, 6 aa, Mycobacterium
RAHGEH

SEQ ID NO: 557090 - protein, 6 aa, Mycobacterium
RAHGEN

SEQ ID NO: 557091 - protein, 6 aa, Mycobacterium
RAHGER

SEQ ID NO: 557092 - protein, 10 aa, Mycobacterium
RAHGPANDRR

SEQ ID NO: 557093 - protein, 6 aa, Mycobacterium
RAHGQL

SEQ ID NO: 557094 - protein, 6 aa, Mycobacterium
RAHGRG

SEQ ID NO: 557095 - protein, 12 aa, Mycobacterium
RAHHGRAATAAA

SEQ ID NO: 557096 - protein, 9 aa, Mycobacterium
RAHHGRAGT

SEQ ID NO: 557097 - protein, 9 aa, Mycobacterium
RAHNTDGSR

SEQ ID NO: 557098 - protein, 8 aa, Mycobacterium
RAHPDDPV

SEQ ID NO: 557099 - protein, 10 aa, Mycobacterium
RAHPDRAPGD

SEQ ID NO: 557100 - protein, 5 aa, Mycobacterium
RAHPG

SEQ ID NO: 557101 - protein, 5 aa, Mycobacterium
RAHPI

SEQ ID NO: 557102 - protein, 6 aa, Mycobacterium
RAHPPR

SEQ ID NO: 557103 - protein, 17 aa, Mycobacterium
RAHPRERAADADRLPRH

SEQ ID NO: 557104 - protein, 12 aa, Mycobacterium
RAHPSSGSATGR

SEQ ID NO: 557105 - protein, 8 aa, Mycobacterium
RAHQGDAG

SEQ ID NO: 557106 - protein, 6 aa, Mycobacterium
RAHQHT

SEQ ID NO: 557107 - protein, 12 aa, Mycobacterium
RAHQPSESVRAG

SEQ ID NO: 557108 - protein, 9 aa, Mycobacterium
RAHQPVPQF

SEQ ID NO: 557109 - protein, 9 aa, Mycobacterium
RAHQTPGVA

SEQ ID NO: 557110 - protein, 4 aa, Mycobacterium
RAHR

SEQ ID NO: 557111 - protein, 5 aa, Mycobacterium
RAHRP

SEQ ID NO: 557112 - protein, 9 aa, Mycobacterium
RAHSAGYQP

SEQ ID NO: 557113 - protein, 7 aa, Mycobacterium
RAHSGPA

SEQ ID NO: 557114 - protein, 15 aa, Mycobacterium
RAHSPAGEVTFPDPT

SEQ ID NO: 557115 - protein, 11 aa, Mycobacterium
RAHSSSVPVGR

SEQ ID NO: 557116 - protein, 8 aa, Mycobacterium
RAHTAPGT

SEQ ID NO: 557117 - protein, 22 aa, Mycobacterium
RAHTATGHGIGQGAASTKGGPV

SEQ ID NO: 557118 - protein, 10 aa, Mycobacterium
RAHTGDRERT

SEQ ID NO: 557119 - protein, 12 aa, Mycobacterium
RAIAGETVLAEL

SEQ ID NO: 557120 - protein, 17 aa, Mycobacterium
RAIAGGTPDPLGKPDDI

SEQ ID NO: 557121 - protein, 36 aa, Mycobacterium
RAIAGTGGLGRPDRPGGATTRDQTAPQTGAPTGPIT

SEQ ID NO: 557122 - protein, 20 aa, Mycobacterium
RAIDGTETLAAEPDSEAASL

SEQ ID NO: 557123 - protein, 6 aa, Mycobacterium
RAIDST

SEQ ID NO: 557124 - protein, 6 aa, Mycobacterium
RAIEAA

SEQ ID NO: 557125 - protein, 10 aa, Mycobacterium
RAIESGRPEP

SEQ ID NO: 557126 - protein, 21 aa, Mycobacterium
RAIGDDGTTVSAREISESSGV

SEQ ID NO: 557127 - protein, 14 aa, Mycobacterium
RAIGGGSNDAHYAA

SEQ ID NO: 557128 - protein, 6 aa, Mycobacterium
RAIGKG

SEQ ID NO: 557129 - protein, 6 aa, Mycobacterium
RAIGPG

SEQ ID NO: 557130 - protein, 12 aa, Mycobacterium
RAIKQGTELAAR

SEQ ID NO: 557131 - protein, 19 aa, Mycobacterium
RAIKRAKAEESTPIIRKRK

SEQ ID NO: 557132 - protein, 9 aa, Mycobacterium
RAIPGPAGS

SEQ ID NO: 557133 - protein, 8 aa, Mycobacterium
RAIPPYES

SEQ ID NO: 557134 - protein, 6 aa, Mycobacterium
RAIPSA

SEQ ID NO: 557135 - protein, 15 aa, Mycobacterium
RAIPSAYDGLKPGQR

SEQ ID NO: 557136 - protein, 14 aa, Mycobacterium
RAIQTAPTGATIDA

SEQ ID NO: 557137 - protein, 11 aa, Mycobacterium
RAIRNSGGTVS

SEQ ID NO: 557138 - protein, 12 aa, Mycobacterium
RAIRQGTELAAK

SEQ ID NO: 557139 - protein, 7 aa, Mycobacterium
RAISGPV

SEQ ID NO: 557140 - protein, 10 aa, Mycobacterium
RAISSRGGNG

SEQ ID NO: 557141 - protein, 17 aa, Mycobacterium
RAITAGGGTPGEVRESE

SEQ ID NO: 557142 - protein, 9 aa, Mycobacterium
RAITDPGAL

SEQ ID NO: 557143 - protein, 9 aa, Mycobacterium
RAITDSGAV

SEQ ID NO: 557144 - protein, 6 aa, Mycobacterium
RAKAAG

SEQ ID NO: 557145 - protein, 29 aa, Mycobacterium
RAKAAKSAPSRPRKAAKPPAPRTRAKATT

SEQ ID NO: 557146 - protein, 8 aa, Mycobacterium
RAKAAVSG

SEQ ID NO: 557147 - protein, 14 aa, Mycobacterium
RAKADDIPDAEDAR

SEQ ID NO: 557148 - protein, 6 aa, Mycobacterium
RAKAEA

SEQ ID NO: 557149 - protein, 10 aa, Mycobacterium
RAKAEAENLT

SEQ ID NO: 557150 - protein, 9 aa, Mycobacterium
RAKAETASA

SEQ ID NO: 557151 - protein, 9 aa, Mycobacterium
RAKAPAGLT

SEQ ID NO: 557152 - protein, 8 aa, Mycobacterium
RAKAPEGS

SEQ ID NO: 557153 - protein, 9 aa, Mycobacterium
RAKAPERGY

SEQ ID NO: 557154 - protein, 7 aa, Mycobacterium
RAKAPGM

SEQ ID NO: 557155 - protein, 6 aa, Mycobacterium
RAKAPR

SEQ ID NO: 557156 - protein, 9 aa, Mycobacterium
RAKAPTEIP

SEQ ID NO: 557157 - protein, 13 aa, Mycobacterium
RAKASGQSEGGSA

SEQ ID NO: 557158 - protein, 8 aa, Mycobacterium
RAKDAEPL

SEQ ID NO: 557159 - protein, 10 aa, Mycobacterium
RAKDPGRGYA

SEQ ID NO: 557160 - protein, 9 aa, Mycobacterium
RAKDQSTGI

SEQ ID NO: 557161 - protein, 16 aa, Mycobacterium
RAKEGARQASGSVRTV

SEQ ID NO: 557162 - protein, 6 aa, Mycobacterium
RAKEHG

SEQ ID NO: 557163 - protein, 5 aa, Mycobacterium
RAKEL

SEQ ID NO: 557164 - protein, 8 aa, Mycobacterium
RAKESFGV

SEQ ID NO: 557165 - protein, 7 aa, Mycobacterium
RAKETAD

SEQ ID NO: 557166 - protein, 5 aa, Mycobacterium
RAKFG

SEQ ID NO: 557167 - protein, 8 aa, Mycobacterium
RAKGALSG

SEQ ID NO: 557168 - protein, 6 aa, Mycobacterium
RAKGDD

SEQ ID NO: 557169 - protein, 8 aa, Mycobacterium
RAKGEQAI

SEQ ID NO: 557170 - protein, 5 aa, Mycobacterium
RAKGG

SEQ ID NO: 557171 - protein, 8 aa, Mycobacterium
RAKGLGSL

SEQ ID NO: 557172 - protein, 13 aa, Mycobacterium
RAKGNGGDDFDPN

SEQ ID NO: 557173 - protein, 8 aa, Mycobacterium
RAKGSDVD

SEQ ID NO: 557174 - protein, 8 aa, Mycobacterium
RAKHDPAQ

SEQ ID NO: 557175 - protein, 6 aa, Mycobacterium
RAKKNA

SEQ ID NO: 557176 - protein, 9 aa, Mycobacterium
RAKLTQEQA

SEQ ID NO: 557177 - protein, 8 aa, Mycobacterium
RAKNKIRK

SEQ ID NO: 557178 - protein, 14 aa, Mycobacterium
RAKPASAGAPTGGT

SEQ ID NO: 557179 - protein, 14 aa, Mycobacterium
RAKPASAGTPGGGT

SEQ ID NO: 557180 - protein, 13 aa, Mycobacterium
RAKPGDTAIEAGG

SEQ ID NO: 557181 - protein, 17 aa, Mycobacterium
RAKPGKAKKAGGTDGLA

SEQ ID NO: 557182 - protein, 11 aa, Mycobacterium
RAKPHEGPPVG

SEQ ID NO: 557183 - protein, 7 aa, Mycobacterium
RAKPRKI

SEQ ID NO: 557184 - protein, 11 aa, Mycobacterium
RAKPRSPEGLK

SEQ ID NO: 557185 - protein, 14 aa, Mycobacterium
RAKPTTPGLDTSGL

SEQ ID NO: 557186 - protein, 7 aa, Mycobacterium
RAKQAGL

SEQ ID NO: 557187 - protein, 12 aa, Mycobacterium
RAKRDARTDLTG

SEQ ID NO: 557188 - protein, 7 aa, Mycobacterium
RAKRTVS

SEQ ID NO: 557189 - protein, 9 aa, Mycobacterium
RAKSDRRDQ

SEQ ID NO: 557190 - protein, 12 aa, Mycobacterium
RAKSGASVGGQA

SEQ ID NO: 557191 - protein, 5 aa, Mycobacterium
RAKSS

SEQ ID NO: 557192 - protein, 14 aa, Mycobacterium
RAKSSGQRQAGTAA

SEQ ID NO: 557193 - protein, 4 aa, Mycobacterium
RAKT

SEQ ID NO: 557194 - protein, 10 aa, Mycobacterium
RAKTGQTGAA

SEQ ID NO: 557195 - protein, 9 aa, Mycobacterium
RAKTGRNGA

SEQ ID NO: 557196 - protein, 9 aa, Mycobacterium
RAKTLGEAA

SEQ ID NO: 557197 - protein, 10 aa, Mycobacterium
RAKTLGEQAG

SEQ ID NO: 557198 - protein, 9 aa, Mycobacterium
RAKTQELGA

SEQ ID NO: 557199 - protein, 9 aa, Mycobacterium
RAKTYADAG

SEQ ID NO: 557200 - protein, 6 aa, Mycobacterium
RAKVGR

SEQ ID NO: 557201 - protein, 14 aa, Mycobacterium
RAKVTDVRRTTPRS

SEQ ID NO: 557202 - protein, 16 aa, Mycobacterium
RAKYYEEKAASRAAAQ

SEQ ID NO: 557203 - protein, 7 aa, Mycobacterium
RALAPTT

SEQ ID NO: 557204 - protein, 17 aa, Mycobacterium
RALAQSAPGVRSPAAQR

SEQ ID NO: 557205 - protein, 6 aa, Mycobacterium
RALDDT

SEQ ID NO: 557206 - protein, 13 aa, Mycobacterium
RALDNRPPIEGGD

SEQ ID NO: 557207 - protein, 10 aa, Mycobacterium
RALDPSAGEP

SEQ ID NO: 557208 - protein, 10 aa, Mycobacterium
RALDPSAGKP

SEQ ID NO: 557209 - protein, 8 aa, Mycobacterium
RALDTDRP

SEQ ID NO: 557210 - protein, 12 aa, Mycobacterium
RALGGDPDRDGA

SEQ ID NO: 557211 - protein, 10 aa, Mycobacterium
RALGGGRPAC

SEQ ID NO: 557212 - protein, 13 aa, Mycobacterium
RALGPDADRSITG

SEQ ID NO: 557213 - protein, 35 aa, Mycobacterium
RALGSTAGLRRRDRGALSADEPAEPRERATEGPIT

SEQ ID NO: 557214 - protein, 11 aa, Mycobacterium
RALGTDSTAPL

SEQ ID NO: 557215 - protein, 6 aa, Mycobacterium
RALNAG

SEQ ID NO: 557216 - protein, 13 aa, Mycobacterium
RALNPAPHLTNSP

SEQ ID NO: 557217 - protein, 7 aa, Mycobacterium
RALNTTR

SEQ ID NO: 557218 - protein, 4 aa, Mycobacterium
RALP

SEQ ID NO: 557219 - protein, 13 aa, Mycobacterium
RALPAPDYTTTAQ

SEQ ID NO: 557220 - protein, 15 aa, Mycobacterium
RALPAPDYTTTSAQT

SEQ ID NO: 557221 - protein, 13 aa, Mycobacterium
RALPDAGRPDDPV

SEQ ID NO: 557222 - protein, 15 aa, Mycobacterium
RALPDGPNGPNGTGW

SEQ ID NO: 557223 - protein, 12 aa, Mycobacterium
RALPGAERFPED

SEQ ID NO: 557224 - protein, 12 aa, Mycobacterium
RALPGAQSFPEE

SEQ ID NO: 557225 - protein, 6 aa, Mycobacterium
RALPGD

SEQ ID NO: 557226 - protein, 13 aa, Mycobacterium
RALPGDPDFGDPL

SEQ ID NO: 557227 - protein, 12 aa, Mycobacterium
RALPKDDEPPLD

SEQ ID NO: 557228 - protein, 8 aa, Mycobacterium
RALPPGHA

SEQ ID NO: 557229 - protein, 7 aa, Mycobacterium
RALPRGL

SEQ ID NO: 557230 - protein, 4 aa, Mycobacterium
RALQ

SEQ ID NO: 557231 - protein, 8 aa, Mycobacterium
RALQGPLA

SEQ ID NO: 557232 - protein, 11 aa, Mycobacterium
RALQPDEASAV

SEQ ID NO: 557233 - protein, 7 aa, Mycobacterium
RALQSPQ

SEQ ID NO: 557234 - protein, 7 aa, Mycobacterium
RALRGNP

SEQ ID NO: 557235 - protein, 9 aa, Mycobacterium
RALRGPDTD

SEQ ID NO: 557236 - protein, 7 aa, Mycobacterium
RALRGTA

SEQ ID NO: 557237 - protein, 8 aa, Mycobacterium
RALRRGKT

SEQ ID NO: 557238 - protein, 6 aa, Mycobacterium
RALSAG

SEQ ID NO: 557239 - protein, 7 aa, Mycobacterium
RALSDPD

SEQ ID NO: 557240 - protein, 18 aa, Mycobacterium
RALSEQARAEHAWTARVQ

SEQ ID NO: 557241 - protein, 5 aa, Mycobacterium
RALSG

SEQ ID NO: 557242 - protein, 10 aa, Mycobacterium
RALSNAPASA

SEQ ID NO: 557243 - protein, 6 aa, Mycobacterium
RALSRA

SEQ ID NO: 557244 - protein, 7 aa, Mycobacterium
RALSSDA

SEQ ID NO: 557245 - protein, 24 aa, Mycobacterium
RALSSDTVSRPATSYTAAAPDNSI

SEQ ID NO: 557246 - protein, 7 aa, Mycobacterium
RALSSEA

SEQ ID NO: 557247 - protein, 7 aa, Mycobacterium
RALSSTA

SEQ ID NO: 557248 - protein, 5 aa, Mycobacterium
RALTE

SEQ ID NO: 557249 - protein, 6 aa, Mycobacterium
RALTKA

SEQ ID NO: 557250 - protein, 7 aa, Mycobacterium
RALTQTN

SEQ ID NO: 557251 - protein, 8 aa, Mycobacterium
RAMAGSRK

SEQ ID NO: 557252 - protein, 4 aa, Mycobacterium
RAME

SEQ ID NO: 557253 - protein, 4 aa, Mycobacterium
RAMS

SEQ ID NO: 557254 - protein, 13 aa, Mycobacterium
RAMSAPSSGSSKV

SEQ ID NO: 557255 - protein, 6 aa, Mycobacterium
RAMTQT

SEQ ID NO: 557256 - protein, 17 aa, Mycobacterium
RAMTTRDGWSDDGERVT

SEQ ID NO: 557257 - protein, 4 aa, Mycobacterium
RANA

SEQ ID NO: 557258 - protein, 8 aa, Mycobacterium
RANAAEAL

SEQ ID NO: 557259 - protein, 10 aa, Mycobacterium
RANAKQAVAT

SEQ ID NO: 557260 - protein, 9 aa, Mycobacterium
RANALGGTS

SEQ ID NO: 557261 - protein, 8 aa, Mycobacterium
RANAPDKV

SEQ ID NO: 557262 - protein, 18 aa, Mycobacterium
RANAPQKSHSLRAFNVTE

SEQ ID NO: 557263 - protein, 10 aa, Mycobacterium
RANASRNPAA

SEQ ID NO: 557264 - protein, 7 aa, Mycobacterium
RANATAK

SEQ ID NO: 557265 - protein, 6 aa, Mycobacterium
RANDGI

SEQ ID NO: 557266 - protein, 22 aa, Mycobacterium
RANDGSAPSYGDDAVTAQAADA

SEQ ID NO: 557267 - protein, 7 aa, Mycobacterium
RANDSEF

SEQ ID NO: 557268 - protein, 8 aa, Mycobacterium
RANDTNPG

SEQ ID NO: 557269 - protein, 4 aa, Mycobacterium
RANE

SEQ ID NO: 557270 - protein, 10 aa, Mycobacterium
RANELNPYRG

SEQ ID NO: 557271 - protein, 11 aa, Mycobacterium
RANELNPYRGE

SEQ ID NO: 557272 - protein, 9 aa, Mycobacterium
RANEPTDTE

SEQ ID NO: 557273 - protein, 5 aa, Mycobacterium
RANFG

SEQ ID NO: 557274 - protein, 5 aa, Mycobacterium
RANGA

SEQ ID NO: 557275 - protein, 8 aa, Mycobacterium
RANGDGDF

SEQ ID NO: 557276 - protein, 10 aa, Mycobacterium
RANGGEVGGQ

SEQ ID NO: 557277 - protein, 8 aa, Mycobacterium
RANGGGDI

SEQ ID NO: 557278 - protein, 13 aa, Mycobacterium
RANGGKVGGPFEN

SEQ ID NO: 557279 - protein, 11 aa, Mycobacterium
RANGGKVGGQF

SEQ ID NO: 557280 - protein, 12 aa, Mycobacterium
RANGGKVGGQFE

SEQ ID NO: 557281 - protein, 6 aa, Mycobacterium
RANGGY

SEQ ID NO: 557282 - protein, 7 aa, Mycobacterium
RANGPLA

SEQ ID NO: 557283 - protein, 6 aa, Mycobacterium
RANGQD

SEQ ID NO: 557284 - protein, 8 aa, Mycobacterium
RANGQPAF

SEQ ID NO: 557285 - protein, 11 aa, Mycobacterium
RANGRTYVGEQ

SEQ ID NO: 557286 - protein, 6 aa, Mycobacterium
RANGSA

SEQ ID NO: 557287 - protein, 6 aa, Mycobacterium
RANGSW

SEQ ID NO: 557288 - protein, 11 aa, Mycobacterium
RANGTPPPEVP

SEQ ID NO: 557289 - protein, 10 aa, Mycobacterium
RANGVRPGDR

SEQ ID NO: 557290 - protein, 7 aa, Mycobacterium
RANGVSS

SEQ ID NO: 557291 - protein, 8 aa, Mycobacterium
RANGYTEI

SEQ ID NO: 557292 - protein, 11 aa, Mycobacterium
RANKDNLDPKR

SEQ ID NO: 557293 - protein, 11 aa, Mycobacterium
RANKDNTDPKR

SEQ ID NO: 557294 - protein, 11 aa, Mycobacterium
RANKDNTDPTR

SEQ ID NO: 557295 - protein, 11 aa, Mycobacterium
RANKDNTDSRR

SEQ ID NO: 557296 - protein, 9 aa, Mycobacterium
RANKDNVDP

SEQ ID NO: 557297 - protein, 7 aa, Mycobacterium
RANKSRL

SEQ ID NO: 557298 - protein, 15 aa, Mycobacterium
RANLSASETAQAAGV

SEQ ID NO: 557299 - protein, 8 aa, Mycobacterium
RANNPNGH

SEQ ID NO: 557300 - protein, 4 aa, Mycobacterium
RANP

SEQ ID NO: 557301 - protein, 6 aa, Mycobacterium
RANPDR

SEQ ID NO: 557302 - protein, 11 aa, Mycobacterium
RANPDRPPGDF

SEQ ID NO: 557303 - protein, 7 aa, Mycobacterium
RANPGDD

SEQ ID NO: 557304 - protein, 7 aa, Mycobacterium
RANPIEG

SEQ ID NO: 557305 - protein, 10 aa, Mycobacterium
RANPKPQGRS

SEQ ID NO: 557306 - protein, 16 aa, Mycobacterium
RANPPERQEHGELQAQ

SEQ ID NO: 557307 - protein, 6 aa, Mycobacterium
RANPQY

SEQ ID NO: 557308 - protein, 5 aa, Mycobacterium
RANPR

SEQ ID NO: 557309 - protein, 8 aa, Mycobacterium
RANPTPAL

SEQ ID NO: 557310 - protein, 18 aa, Mycobacterium
RANPVPARGRIEATNPCG

SEQ ID NO: 557311 - protein, 4 aa, Mycobacterium
RANQ

SEQ ID NO: 557312 - protein, 4 aa, Mycobacterium
RANR

SEQ ID NO: 557313 - protein, 11 aa, Mycobacterium
RANRATDPQWA

SEQ ID NO: 557314 - protein, 11 aa, Mycobacterium
RANRGEPDAGR

SEQ ID NO: 557315 - protein, 9 aa, Mycobacterium
RANRPSTFP

SEQ ID NO: 557316 - protein, 7 aa, Mycobacterium
RANRSAR

SEQ ID NO: 557317 - protein, 9 aa, Mycobacterium
RANRYNEIS

SEQ ID NO: 557318 - protein, 6 aa, Mycobacterium
RANSEN

SEQ ID NO: 557319 - protein, 10 aa, Mycobacterium
RANSGRPAGR

SEQ ID NO: 557320 - protein, 8 aa, Mycobacterium
RANSHTTK

SEQ ID NO: 557321 - protein, 7 aa, Mycobacterium
RANSRRR

SEQ ID NO: 557322 - protein, 9 aa, Mycobacterium
RANSTDIDR

SEQ ID NO: 557323 - protein, 8 aa, Mycobacterium
RANSTVQN

SEQ ID NO: 557324 - protein, 9 aa, Mycobacterium
RANTAAARA

SEQ ID NO: 557325 - protein, 6 aa, Mycobacterium
RANTAF

SEQ ID NO: 557326 - protein, 11 aa, Mycobacterium
RANTGKSKRAL

SEQ ID NO: 557327 - protein, 10 aa, Mycobacterium
RANTGRPAGR

SEQ ID NO: 557328 - protein, 10 aa, Mycobacterium
RANTHGPKGL

SEQ ID NO: 557329 - protein, 10 aa, Mycobacterium
RANTPEAGVP

SEQ ID NO: 557330 - protein, 11 aa, Mycobacterium
RANTPEPKGFS

SEQ ID NO: 557331 - protein, 11 aa, Mycobacterium
RANTSDRHTRR

SEQ ID NO: 557332 - protein, 12 aa, Mycobacterium
RANTSDSRTRQR

SEQ ID NO: 557333 - protein, 10 aa, Mycobacterium
RANTSGRDVR

SEQ ID NO: 557334 - protein, 6 aa, Mycobacterium
RANVSK

SEQ ID NO: 557335 - protein, 4 aa, Mycobacterium
RANW

SEQ ID NO: 557336 - protein, 7 aa, Mycobacterium
RANYPEA

SEQ ID NO: 557337 - protein, 4 aa, Mycobacterium
RAPA

SEQ ID NO: 557338 - protein, 17 aa, Mycobacterium
RAPAAVSGDAQDKLTAR

SEQ ID NO: 557339 - protein, 6 aa, Mycobacterium
RAPADR

SEQ ID NO: 557340 - protein, 12 aa, Mycobacterium
RAPADSGPGSAR

SEQ ID NO: 557341 - protein, 20 aa, Mycobacterium
RAPAGPVPAYPRASNDRDGA

SEQ ID NO: 557342 - protein, 8 aa, Mycobacterium
RAPAGSRR

SEQ ID NO: 557343 - protein, 8 aa, Mycobacterium
RAPANRPD

SEQ ID NO: 557344 - protein, 6 aa, Mycobacterium
RAPAPA

SEQ ID NO: 557345 - protein, 9 aa, Mycobacterium
RAPAQGGRI

SEQ ID NO: 557346 - protein, 6 aa, Mycobacterium
RAPAQR

SEQ ID NO: 557347 - protein, 5 aa, Mycobacterium
RAPAR

SEQ ID NO: 557348 - protein, 6 aa, Mycobacterium
RAPARS

SEQ ID NO: 557349 - protein, 6 aa, Mycobacterium
RAPARW

SEQ ID NO: 557350 - protein, 11 aa, Mycobacterium
RAPASAAGPDL

SEQ ID NO: 557351 - protein, 8 aa, Mycobacterium
RAPASQHR

SEQ ID NO: 557352 - protein, 11 aa, Mycobacterium
RAPATDADTVT

SEQ ID NO: 557353 - protein, 6 aa, Mycobacterium
RAPATF

SEQ ID NO: 557354 - protein, 6 aa, Mycobacterium
RAPATV

SEQ ID NO: 557355 - protein, 12 aa, Mycobacterium
RAPAYEARTSLT

SEQ ID NO: 557356 - protein, 4 aa, Mycobacterium
RAPD

SEQ ID NO: 557357 - protein, 8 aa, Mycobacterium
RAPDADAA

SEQ ID NO: 557358 - protein, 8 aa, Mycobacterium
RAPDADKA

SEQ ID NO: 557359 - protein, 10 aa, Mycobacterium
RAPDATTSSL

SEQ ID NO: 557360 - protein, 13 aa, Mycobacterium
RAPDFAPATVGDE

SEQ ID NO: 557361 - protein, 6 aa, Mycobacterium
RAPDGA

SEQ ID NO: 557362 - protein, 6 aa, Mycobacterium
RAPDGS

SEQ ID NO: 557363 - protein, 6 aa, Mycobacterium
RAPDHE

SEQ ID NO: 557364 - protein, 14 aa, Mycobacterium
RAPDKRTGSSSVTG

SEQ ID NO: 557365 - protein, 11 aa, Mycobacterium
RAPDNARSDVA

SEQ ID NO: 557366 - protein, 10 aa, Mycobacterium
RAPDNGRNRT

SEQ ID NO: 557367 - protein, 6 aa, Mycobacterium
RAPDPA

SEQ ID NO: 557368 - protein, 10 aa, Mycobacterium
RAPDPAQDSL

SEQ ID NO: 557369 - protein, 8 aa, Mycobacterium
RAPDPDAA

SEQ ID NO: 557370 - protein, 9 aa, Mycobacterium
RAPDPDDRR

SEQ ID NO: 557371 - protein, 8 aa, Mycobacterium
RAPDQVTG

SEQ ID NO: 557372 - protein, 7 aa, Mycobacterium
RAPDSAC

SEQ ID NO: 557373 - protein, 12 aa, Mycobacterium
RAPDSGAGPDAF

SEQ ID NO: 557374 - protein, 12 aa, Mycobacterium
RAPDTEPATPDV

SEQ ID NO: 557375 - protein, 11 aa, Mycobacterium
RAPDTSPGNLR

SEQ ID NO: 557376 - protein, 12 aa, Mycobacterium
RAPDWEPPPVSA

SEQ ID NO: 557377 - protein, 4 aa, Mycobacterium
RAPE

SEQ ID NO: 557378 - protein, 13 aa, Mycobacterium
RAPEAQPTEGLPE

SEQ ID NO: 557379 - protein, 6 aa, Mycobacterium
RAPEDV

SEQ ID NO: 557380 - protein, 8 aa, Mycobacterium
RAPEEERL

SEQ ID NO: 557381 - protein, 8 aa, Mycobacterium
RAPEESDD

SEQ ID NO: 557382 - protein, 5 aa, Mycobacterium
RAPEF

SEQ ID NO: 557383 - protein, 16 aa, Mycobacterium
RAPEGAGLPGISPSNT

SEQ ID NO: 557384 - protein, 9 aa, Mycobacterium
RAPEGAPDT

SEQ ID NO: 557385 - protein, 7 aa, Mycobacterium
RAPEGQE

SEQ ID NO: 557386 - protein, 7 aa, Mycobacterium
RAPEGVN

SEQ ID NO: 557387 - protein, 6 aa, Mycobacterium
RAPEIS

SEQ ID NO: 557388 - protein, 8 aa, Mycobacterium
RAPEKRPD

SEQ ID NO: 557389 - protein, 5 aa, Mycobacterium
RAPEL

SEQ ID NO: 557390 - protein, 7 aa, Mycobacterium
RAPEPHP

SEQ ID NO: 557391 - protein, 6 aa, Mycobacterium
RAPEQG

SEQ ID NO: 557392 - protein, 7 aa, Mycobacterium
RAPEQLG

SEQ ID NO: 557393 - protein, 5 aa, Mycobacterium
RAPER

SEQ ID NO: 557394 - protein, 7 aa, Mycobacterium
RAPERID

SEQ ID NO: 557395 - protein, 21 aa, Mycobacterium
RAPERTAPYGPYRTRSPKDSS

SEQ ID NO: 557396 - protein, 14 aa, Mycobacterium
RAPERYRGDVEPLD

SEQ ID NO: 557397 - protein, 11 aa, Mycobacterium
RAPESAAGPDL

SEQ ID NO: 557398 - protein, 5 aa, Mycobacterium
RAPET

SEQ ID NO: 557399 - protein, 6 aa, Mycobacterium
RAPEVE

SEQ ID NO: 557400 - protein, 4 aa, Mycobacterium
RAPF

SEQ ID NO: 557401 - protein, 7 aa, Mycobacterium
RAPFAST

SEQ ID NO: 557402 - protein, 5 aa, Mycobacterium
RAPFN

SEQ ID NO: 557403 - protein, 10 aa, Mycobacterium
RAPGARASAR

SEQ ID NO: 557404 - protein, 6 aa, Mycobacterium
RAPGAY

SEQ ID NO: 557405 - protein, 6 aa, Mycobacterium
RAPGDD

SEQ ID NO: 557406 - protein, 7 aa, Mycobacterium
RAPGDER

SEQ ID NO: 557407 - protein, 6 aa, Mycobacterium
RAPGDP

SEQ ID NO: 557408 - protein, 9 aa, Mycobacterium
RAPGEGGRV

SEQ ID NO: 557409 - protein, 20 aa, Mycobacterium
RAPGETKAAVYPGDAGSGAA

SEQ ID NO: 557410 - protein, 6 aa, Mycobacterium
RAPGFA

SEQ ID NO: 557411 - protein, 7 aa, Mycobacterium
RAPGGAG

SEQ ID NO: 557412 - protein, 7 aa, Mycobacterium
RAPGGDV

SEQ ID NO: 557413 - protein, 13 aa, Mycobacterium
RAPGGRQSRKPSR

SEQ ID NO: 557414 - protein, 6 aa, Mycobacterium
RAPGGV

SEQ ID NO: 557415 - protein, 7 aa, Mycobacterium
RAPGNLS

SEQ ID NO: 557416 - protein, 13 aa, Mycobacterium
RAPGPAGELSDSV

SEQ ID NO: 557417 - protein, 19 aa, Mycobacterium
RAPGPAGGDDMPDYQRVNV

SEQ ID NO: 557418 - protein, 6 aa, Mycobacterium
RAPGPL

SEQ ID NO: 557419 - protein, 8 aa, Mycobacterium
RAPGPRQA

SEQ ID NO: 557420 - protein, 6 aa, Mycobacterium
RAPGQA

SEQ ID NO: 557421 - protein, 7 aa, Mycobacterium
RAPGRDY

SEQ ID NO: 557422 - protein, 12 aa, Mycobacterium
RAPGSAAGIETR

SEQ ID NO: 557423 - protein, 7 aa, Mycobacterium
RAPGSRL

SEQ ID NO: 557424 - protein, 7 aa, Mycobacterium
RAPGTHK

SEQ ID NO: 557425 - protein, 6 aa, Mycobacterium
RAPGTL

SEQ ID NO: 557426 - protein, 9 aa, Mycobacterium
RAPGTQNDE

SEQ ID NO: 557427 - protein, 4 aa, Mycobacterium
RAPH

SEQ ID NO: 557428 - protein, 8 aa, Mycobacterium
RAPHGGES

SEQ ID NO: 557429 - protein, 7 aa, Mycobacterium
RAPHSGT

SEQ ID NO: 557430 - protein, 5 aa, Mycobacterium
RAPIR

SEQ ID NO: 557431 - protein, 9 aa, Mycobacterium
RAPKPGSPV

SEQ ID NO: 557432 - protein, 7 aa, Mycobacterium
RAPLPPE

SEQ ID NO: 557433 - protein, 9 aa, Mycobacterium
RAPNGANTQ

SEQ ID NO: 557434 - protein, 7 aa, Mycobacterium
RAPNPTW

SEQ ID NO: 557435 - protein, 6 aa, Mycobacterium
RAPPEK

SEQ ID NO: 557436 - protein, 14 aa, Mycobacterium
RAPPGAAGVRANPN

SEQ ID NO: 557437 - protein, 27 aa, Mycobacterium
RAPPTTAVRSSPSGTAGFPDIGGLLLP

SEQ ID NO: 557438 - protein, 7 aa, Mycobacterium
RAPQADI

SEQ ID NO: 557439 - protein, 6 aa, Mycobacterium
RAPQEL

SEQ ID NO: 557440 - protein, 8 aa, Mycobacterium
RAPQGELP

SEQ ID NO: 557441 - protein, 6 aa, Mycobacterium
RAPQGV

SEQ ID NO: 557442 - protein, 7 aa, Mycobacterium
RAPQPDI

SEQ ID NO: 557443 - protein, 20 aa, Mycobacterium
RAPQQGGRVVTGGEAPDLPG

SEQ ID NO: 557444 - protein, 14 aa, Mycobacterium
RAPQRPAPLPGQDT

SEQ ID NO: 557445 - protein, 11 aa, Mycobacterium
RAPQRPSTQWA

SEQ ID NO: 557446 - protein, 5 aa, Mycobacterium
RAPRA

SEQ ID NO: 557447 - protein, 9 aa, Mycobacterium
RAPRADDGL

SEQ ID NO: 557448 - protein, 10 aa, Mycobacterium
RAPRDANRVR

SEQ ID NO: 557449 - protein, 7 aa, Mycobacterium
RAPRDEL

SEQ ID NO: 557450 - protein, 50 aa, Mycobacterium
RAPRGGKNGGDGGNGSSNAEIKGIDGSTRLEAKRQRRRDGRDAGRRRPPV

SEQ ID NO: 557451 - protein, 14 aa, Mycobacterium
RAPRGYDAGRHDDD

SEQ ID NO: 557452 - protein, 14 aa, Mycobacterium
RAPRGYDQGNHADD

SEQ ID NO: 557453 - protein, 6 aa, Mycobacterium
RAPRKV

SEQ ID NO: 557454 - protein, 47 aa, Mycobacterium
RAPRNGGAGDEESGSNEIKGIDGSTRLEAKRQRRRDGRDAGRRRPPV

SEQ ID NO: 557455 - protein, 7 aa, Mycobacterium
RAPRPVD

SEQ ID NO: 557456 - protein, 12 aa, Mycobacterium
RAPRQGLQNKPD

SEQ ID NO: 557457 - protein, 5 aa, Mycobacterium
RAPRR

SEQ ID NO: 557458 - protein, 13 aa, Mycobacterium
RAPRRGRADGELS

SEQ ID NO: 557459 - protein, 9 aa, Mycobacterium
RAPRRPNAE

SEQ ID NO: 557460 - protein, 6 aa, Mycobacterium
RAPRSA

SEQ ID NO: 557461 - protein, 52 aa, Mycobacterium
RAPRSGGKSGNSDSGDDSGGNEIKGIDGSTRLEAKRQRRRDGRDAGRRRPPV

SEQ ID NO: 557462 - protein, 15 aa, Mycobacterium
RAPRSPHAARADDPD

SEQ ID NO: 557463 - protein, 5 aa, Mycobacterium
RAPRT

SEQ ID NO: 557464 - protein, 45 aa, Mycobacterium
RAPRTERSDKSDDSEIQGISGSTRLEAKRQRRRDGRDAGRRRPPI

SEQ ID NO: 557465 - protein, 6 aa, Mycobacterium
RAPSAI

SEQ ID NO: 557466 - protein, 7 aa, Mycobacterium
RAPSDGV

SEQ ID NO: 557467 - protein, 5 aa, Mycobacterium
RAPSG

SEQ ID NO: 557468 - protein, 19 aa, Mycobacterium
RAPSGGKGGRGADGRDYDD

SEQ ID NO: 557469 - protein, 11 aa, Mycobacterium
RAPSGGNSQPW

SEQ ID NO: 557470 - protein, 9 aa, Mycobacterium
RAPSGMAPF

SEQ ID NO: 557471 - protein, 9 aa, Mycobacterium
RAPSIDNTQ

SEQ ID NO: 557472 - protein, 7 aa, Mycobacterium
RAPSIHN

SEQ ID NO: 557473 - protein, 9 aa, Mycobacterium
RAPSLHNSQ

SEQ ID NO: 557474 - protein, 8 aa, Mycobacterium
RAPSLHNT

SEQ ID NO: 557475 - protein, 8 aa, Mycobacterium
RAPSPLAE

SEQ ID NO: 557476 - protein, 9 aa, Mycobacterium
RAPSPLPEH

SEQ ID NO: 557477 - protein, 13 aa, Mycobacterium
RAPSPSGGCSTRY

SEQ ID NO: 557478 - protein, 11 aa, Mycobacterium
RAPSRGFPRPR

SEQ ID NO: 557479 - protein, 7 aa, Mycobacterium
RAPSSCE

SEQ ID NO: 557480 - protein, 8 aa, Mycobacterium
RAPSTISR

SEQ ID NO: 557481 - protein, 6 aa, Mycobacterium
RAPTAL

SEQ ID NO: 557482 - protein, 18 aa, Mycobacterium
RAPTERPGGTWQARTRPP

SEQ ID NO: 557483 - protein, 7 aa, Mycobacterium
RAPTGSL

SEQ ID NO: 557484 - protein, 8 aa, Mycobacterium
RAPTNRPD

SEQ ID NO: 557485 - protein, 11 aa, Mycobacterium
RAPTPADAGRL

SEQ ID NO: 557486 - protein, 10 aa, Mycobacterium
RAPTPDTGAK

SEQ ID NO: 557487 - protein, 8 aa, Mycobacterium
RAPTPPLN

SEQ ID NO: 557488 - protein, 21 aa, Mycobacterium
RAPTPQPSPRTAGTPRSSDAL

SEQ ID NO: 557489 - protein, 7 aa, Mycobacterium
RAPTPSG

SEQ ID NO: 557490 - protein, 9 aa, Mycobacterium
RAPTPTDAA

SEQ ID NO: 557491 - protein, 6 aa, Mycobacterium
RAPTRR

SEQ ID NO: 557492 - protein, 5 aa, Mycobacterium
RAPVD

SEQ ID NO: 557493 - protein, 7 aa, Mycobacterium
RAPVGTQ

SEQ ID NO: 557494 - protein, 4 aa, Mycobacterium
RAPW

SEQ ID NO: 557495 - protein, 5 aa, Mycobacterium
RAPWG

SEQ ID NO: 557496 - protein, 4 aa, Mycobacterium
RAPY

SEQ ID NO: 557497 - protein, 9 aa, Mycobacterium
RAPYETTNR

SEQ ID NO: 557498 - protein, 7 aa, Mycobacterium
RAPYRGQ

SEQ ID NO: 557499 - protein, 8 aa, Mycobacterium
RAPYRTSD

SEQ ID NO: 557500 - protein, 7 aa, Mycobacterium
RAPYTTL

SEQ ID NO: 557501 - protein, 6 aa, Mycobacterium
RAQAAG

SEQ ID NO: 557502 - protein, 11 aa, Mycobacterium
RAQAAGGPDRI

SEQ ID NO: 557503 - protein, 7 aa, Mycobacterium
RAQADGD

SEQ ID NO: 557504 - protein, 8 aa, Mycobacterium
RAQAGDRA

SEQ ID NO: 557505 - protein, 15 aa, Mycobacterium
RAQAGSSGRFDGADV

SEQ ID NO: 557506 - protein, 8 aa, Mycobacterium
RAQAQGAG

SEQ ID NO: 557507 - protein, 13 aa, Mycobacterium
RAQARGGSHEAAA

SEQ ID NO: 557508 - protein, 14 aa, Mycobacterium
RAQARQSVKAATEQ

SEQ ID NO: 557509 - protein, 16 aa, Mycobacterium
RAQARTPEFQQTYPTR

SEQ ID NO: 557510 - protein, 11 aa, Mycobacterium
RAQASAGVPGQ

SEQ ID NO: 557511 - protein, 7 aa, Mycobacterium
RAQATED

SEQ ID NO: 557512 - protein, 22 aa, Mycobacterium
RAQCKSRNRCDSAPRGPSPSRC

SEQ ID NO: 557513 - protein, 15 aa, Mycobacterium
RAQDAGQVTPDADAR

SEQ ID NO: 557514 - protein, 10 aa, Mycobacterium
RAQDDGIGRR

SEQ ID NO: 557515 - protein, 9 aa, Mycobacterium
RAQDGDSQL

SEQ ID NO: 557516 - protein, 8 aa, Mycobacterium
RAQDGGGI

SEQ ID NO: 557517 - protein, 10 aa, Mycobacterium
RAQDPTGDAG

SEQ ID NO: 557518 - protein, 6 aa, Mycobacterium
RAQDRR

SEQ ID NO: 557519 - protein, 14 aa, Mycobacterium
RAQEAAERERIEHD

SEQ ID NO: 557520 - protein, 9 aa, Mycobacterium
RAQEAGGQF

SEQ ID NO: 557521 - protein, 13 aa, Mycobacterium
RAQEGGLSQIDDD

SEQ ID NO: 557522 - protein, 13 aa, Mycobacterium
RAQEGSLSQIDDD

SEQ ID NO: 557523 - protein, 13 aa, Mycobacterium
RAQEGSLSQIDED

SEQ ID NO: 557524 - protein, 13 aa, Mycobacterium
RAQEGSLSQVDED

SEQ ID NO: 557525 - protein, 7 aa, Mycobacterium
RAQEPDW

SEQ ID NO: 557526 - protein, 7 aa, Mycobacterium
RAQEQGH

SEQ ID NO: 557527 - protein, 13 aa, Mycobacterium
RAQERAAARRGAA

SEQ ID NO: 557528 - protein, 9 aa, Mycobacterium
RAQERGQLR

SEQ ID NO: 557529 - protein, 7 aa, Mycobacterium
RAQERQA

SEQ ID NO: 557530 - protein, 5 aa, Mycobacterium
RAQGA

SEQ ID NO: 557531 - protein, 6 aa, Mycobacterium
RAQGAD

SEQ ID NO: 557532 - protein, 6 aa, Mycobacterium
RAQGAG

SEQ ID NO: 557533 - protein, 6 aa, Mycobacterium
RAQGAS

SEQ ID NO: 557534 - protein, 9 aa, Mycobacterium
RAQGEDEEA

SEQ ID NO: 557535 - protein, 5 aa, Mycobacterium
RAQGG

SEQ ID NO: 557536 - protein, 12 aa, Mycobacterium
RAQGGVSRMSDP

SEQ ID NO: 557537 - protein, 11 aa, Mycobacterium
RAQGGYRPLGD

SEQ ID NO: 557538 - protein, 7 aa, Mycobacterium
RAQGHGL

SEQ ID NO: 557539 - protein, 8 aa, Mycobacterium
RAQGLPAT

SEQ ID NO: 557540 - protein, 6 aa, Mycobacterium
RAQGSG

SEQ ID NO: 557541 - protein, 7 aa, Mycobacterium
RAQGSGQ

SEQ ID NO: 557542 - protein, 32 aa, Mycobacterium
RAQHLDGDPDFSAGPDPDELEAQADAVAEQEQ

SEQ ID NO: 557543 - protein, 16 aa, Mycobacterium
RAQHPGEINHNDGGRG

SEQ ID NO: 557544 - protein, 7 aa, Mycobacterium
RAQIATR

SEQ ID NO: 557545 - protein, 13 aa, Mycobacterium
RAQIDTPRRSTGH

SEQ ID NO: 557546 - protein, 5 aa, Mycobacterium
RAQIG

SEQ ID NO: 557547 - protein, 16 aa, Mycobacterium
RAQKGFSARKYGPEKV

SEQ ID NO: 557548 - protein, 9 aa, Mycobacterium
RAQKLSGAA

SEQ ID NO: 557549 - protein, 5 aa, Mycobacterium
RAQKQ

SEQ ID NO: 557550 - protein, 9 aa, Mycobacterium
RAQKSPEFP

SEQ ID NO: 557551 - protein, 14 aa, Mycobacterium
RAQLDSSPAAQRRY

SEQ ID NO: 557552 - protein, 5 aa, Mycobacterium
RAQLE

SEQ ID NO: 557553 - protein, 5 aa, Mycobacterium
RAQMA

SEQ ID NO: 557554 - protein, 7 aa, Mycobacterium
RAQNPDA

SEQ ID NO: 557555 - protein, 11 aa, Mycobacterium
RAQNPTGAALS

SEQ ID NO: 557556 - protein, 17 aa, Mycobacterium
RAQNPTGAALSAPRADE

SEQ ID NO: 557557 - protein, 17 aa, Mycobacterium
RAQNPTGAAVSADRATA

SEQ ID NO: 557558 - protein, 4 aa, Mycobacterium
RAQP

SEQ ID NO: 557559 - protein, 11 aa, Mycobacterium
RAQPDQKARET

SEQ ID NO: 557560 - protein, 9 aa, Mycobacterium
RAQPGRDDK

SEQ ID NO: 557561 - protein, 8 aa, Mycobacterium
RAQPGRRA

SEQ ID NO: 557562 - protein, 19 aa, Mycobacterium
RAQPGTLKQGEATKKTGTT

SEQ ID NO: 557563 - protein, 19 aa, Mycobacterium
RAQPRASRPRRGNDLETET

SEQ ID NO: 557564 - protein, 11 aa, Mycobacterium
RAQPSDASATE

SEQ ID NO: 557565 - protein, 5 aa, Mycobacterium
RAQPV

SEQ ID NO: 557566 - protein, 9 aa, Mycobacterium
RAQQAEATR

SEQ ID NO: 557567 - protein, 6 aa, Mycobacterium
RAQQDG

SEQ ID NO: 557568 - protein, 9 aa, Mycobacterium
RAQQGDSEA

SEQ ID NO: 557569 - protein, 9 aa, Mycobacterium
RAQQPQQVG

SEQ ID NO: 557570 - protein, 18 aa, Mycobacterium
RAQQRAAARHGAAMRRKR

SEQ ID NO: 557571 - protein, 10 aa, Mycobacterium
RAQQRGEIPA

SEQ ID NO: 557572 - protein, 6 aa, Mycobacterium
RAQQRR

SEQ ID NO: 557573 - protein, 5 aa, Mycobacterium
RAQQW

SEQ ID NO: 557574 - protein, 5 aa, Mycobacterium
RAQRA

SEQ ID NO: 557575 - protein, 9 aa, Mycobacterium
RAQRADGSW

SEQ ID NO: 557576 - protein, 8 aa, Mycobacterium
RAQRAREA

SEQ ID NO: 557577 - protein, 11 aa, Mycobacterium
RAQRAREAREY

SEQ ID NO: 557578 - protein, 6 aa, Mycobacterium
RAQRAS

SEQ ID NO: 557579 - protein, 7 aa, Mycobacterium
RAQRDGD

SEQ ID NO: 557580 - protein, 15 aa, Mycobacterium
RAQRDGHLRPGVSAT

SEQ ID NO: 557581 - protein, 17 aa, Mycobacterium
RAQRDGVARSEADPENS

SEQ ID NO: 557582 - protein, 14 aa, Mycobacterium
RAQRDGYSPGNDPH

SEQ ID NO: 557583 - protein, 9 aa, Mycobacterium
RAQRDRRYI

SEQ ID NO: 557584 - protein, 10 aa, Mycobacterium
RAQRDSDRNA

SEQ ID NO: 557585 - protein, 5 aa, Mycobacterium
RAQRE

SEQ ID NO: 557586 - protein, 13 aa, Mycobacterium
RAQRELAAAGDRI

SEQ ID NO: 557587 - protein, 10 aa, Mycobacterium
RAQRETDRNA

SEQ ID NO: 557588 - protein, 18 aa, Mycobacterium
RAQRGPAGDDLPPGDAAH

SEQ ID NO: 557589 - protein, 18 aa, Mycobacterium
RAQRGSVATQEDAGLASG

SEQ ID NO: 557590 - protein, 14 aa, Mycobacterium
RAQRKSELRSVEDP

SEQ ID NO: 557591 - protein, 10 aa, Mycobacterium
RAQRKTGNVE

SEQ ID NO: 557592 - protein, 9 aa, Mycobacterium
RAQRKTTDG

SEQ ID NO: 557593 - protein, 6 aa, Mycobacterium
RAQRNP

SEQ ID NO: 557594 - protein, 12 aa, Mycobacterium
RAQRRSSNGRPR

SEQ ID NO: 557595 - protein, 8 aa, Mycobacterium
RAQRRVTS

SEQ ID NO: 557596 - protein, 11 aa, Mycobacterium
RAQRSARPLPA

SEQ ID NO: 557597 - protein, 7 aa, Mycobacterium
RAQRSSG

SEQ ID NO: 557598 - protein, 18 aa, Mycobacterium
RAQRTLGSAQAMMLGDYR

SEQ ID NO: 557599 - protein, 6 aa, Mycobacterium
RAQRVG

SEQ ID NO: 557600 - protein, 4 aa, Mycobacterium
RAQS

SEQ ID NO: 557601 - protein, 9 aa, Mycobacterium
RAQSASRGS

SEQ ID NO: 557602 - protein, 8 aa, Mycobacterium
RAQSEGFA

SEQ ID NO: 557603 - protein, 9 aa, Mycobacterium
RAQSEGFTT

SEQ ID NO: 557604 - protein, 9 aa, Mycobacterium
RAQSGETKH

SEQ ID NO: 557605 - protein, 12 aa, Mycobacterium
RAQSIPERNQPW

SEQ ID NO: 557606 - protein, 8 aa, Mycobacterium
RAQSLDGK

SEQ ID NO: 557607 - protein, 14 aa, Mycobacterium
RAQSRGTATQLPQG

SEQ ID NO: 557608 - protein, 15 aa, Mycobacterium
RAQSRGTATQLPQGH

SEQ ID NO: 557609 - protein, 9 aa, Mycobacterium
RAQSRRRED

SEQ ID NO: 557610 - protein, 5 aa, Mycobacterium
RAQSS

SEQ ID NO: 557611 - protein, 6 aa, Mycobacterium
RAQSSV

SEQ ID NO: 557612 - protein, 8 aa, Mycobacterium
RAQSTGEP

SEQ ID NO: 557613 - protein, 10 aa, Mycobacterium
RAQSVTRTES

SEQ ID NO: 557614 - protein, 7 aa, Mycobacterium
RAQTDGA

SEQ ID NO: 557615 - protein, 9 aa, Mycobacterium
RAQTDGHTR

SEQ ID NO: 557616 - protein, 5 aa, Mycobacterium
RAQTI

SEQ ID NO: 557617 - protein, 5 aa, Mycobacterium
RAQTS

SEQ ID NO: 557618 - protein, 6 aa, Mycobacterium
RAQTSG

SEQ ID NO: 557619 - protein, 5 aa, Mycobacterium
RAQTT

SEQ ID NO: 557620 - protein, 8 aa, Mycobacterium
RAQVGPGD

SEQ ID NO: 557621 - protein, 14 aa, Mycobacterium
RAQWSENDDGLSPL

SEQ ID NO: 557622 - protein, 7 aa, Mycobacterium
RAQYDPA

SEQ ID NO: 557623 - protein, 5 aa, Mycobacterium
RAQYE

SEQ ID NO: 557624 - protein, 14 aa, Mycobacterium
RAQYPRDSQSEGGA

SEQ ID NO: 557625 - protein, 11 aa, Mycobacterium
RARAAADAAPA

SEQ ID NO: 557626 - protein, 7 aa, Mycobacterium
RARAAAT

SEQ ID NO: 557627 - protein, 10 aa, Mycobacterium
RARAADVNNK

SEQ ID NO: 557628 - protein, 22 aa, Mycobacterium
RARAAEPTAARSACAPTPYRRR

SEQ ID NO: 557629 - protein, 6 aa, Mycobacterium
RARAAG

SEQ ID NO: 557630 - protein, 7 aa, Mycobacterium
RARAAGA

SEQ ID NO: 557631 - protein, 9 aa, Mycobacterium
RARAAGLPV

SEQ ID NO: 557632 - protein, 12 aa, Mycobacterium
RARAASANAGVP

SEQ ID NO: 557633 - protein, 12 aa, Mycobacterium
RARADDVTVAGK

SEQ ID NO: 557634 - protein, 6 aa, Mycobacterium
RARADT

SEQ ID NO: 557635 - protein, 9 aa, Mycobacterium
RARAEAGAT

SEQ ID NO: 557636 - protein, 8 aa, Mycobacterium
RARAEAIE

SEQ ID NO: 557637 - protein, 14 aa, Mycobacterium
RARAEEVSRRRTAY

SEQ ID NO: 557638 - protein, 11 aa, Mycobacterium
RARAEHPNARR

SEQ ID NO: 557639 - protein, 9 aa, Mycobacterium
RARAGAGPT

SEQ ID NO: 557640 - protein, 12 aa, Mycobacterium
RARAGGNGGGPT

SEQ ID NO: 557641 - protein, 10 aa, Mycobacterium
RARAGRNGAT

SEQ ID NO: 557642 - protein, 8 aa, Mycobacterium
RARAGRPD

SEQ ID NO: 557643 - protein, 6 aa, Mycobacterium
RARAGY

SEQ ID NO: 557644 - protein, 7 aa, Mycobacterium
RARALPK

SEQ ID NO: 557645 - protein, 8 aa, Mycobacterium
RARAPEAT

SEQ ID NO: 557646 - protein, 12 aa, Mycobacterium
RARAPGGEQVRE

SEQ ID NO: 557647 - protein, 9 aa, Mycobacterium
RARARGHDH

SEQ ID NO: 557648 - protein, 11 aa, Mycobacterium
RARARRGGQQV

SEQ ID NO: 557649 - protein, 17 aa, Mycobacterium
RARASATGRLHSQDAAG

SEQ ID NO: 557650 - protein, 6 aa, Mycobacterium
RARASG

SEQ ID NO: 557651 - protein, 9 aa, Mycobacterium
RARATADTG

SEQ ID NO: 557652 - protein, 14 aa, Mycobacterium
RARATARATVPAST

SEQ ID NO: 557653 - protein, 8 aa, Mycobacterium
RARATGAL

SEQ ID NO: 557654 - protein, 9 aa, Mycobacterium
RARATTPDM

SEQ ID NO: 557655 - protein, 8 aa, Mycobacterium
RARATTTG

SEQ ID NO: 557656 - protein, 6 aa, Mycobacterium
RARCGR

SEQ ID NO: 557657 - protein, 16 aa, Mycobacterium
RARDAAQQHGRGSGRG

SEQ ID NO: 557658 - protein, 7 aa, Mycobacterium
RARDAGV

SEQ ID NO: 557659 - protein, 14 aa, Mycobacterium
RARDAIKASGEKFD

SEQ ID NO: 557660 - protein, 9 aa, Mycobacterium
RARDDGQLP

SEQ ID NO: 557661 - protein, 11 aa, Mycobacterium
RARDEGAAAIS

SEQ ID NO: 557662 - protein, 10 aa, Mycobacterium
RARDEGAPLP

SEQ ID NO: 557663 - protein, 5 aa, Mycobacterium
RARDF

SEQ ID NO: 557664 - protein, 9 aa, Mycobacterium
RARDGGGPT

SEQ ID NO: 557665 - protein, 7 aa, Mycobacterium
RARDGQA

SEQ ID NO: 557666 - protein, 10 aa, Mycobacterium
RARDKAGNAD

SEQ ID NO: 557667 - protein, 14 aa, Mycobacterium
RARDLPKGAVYPGE

SEQ ID NO: 557668 - protein, 14 aa, Mycobacterium
RARDLTSQAVQSAL

SEQ ID NO: 557669 - protein, 10 aa, Mycobacterium
RARDNGAPPI

SEQ ID NO: 557670 - protein, 9 aa, Mycobacterium
RARDRAPEL

SEQ ID NO: 557671 - protein, 6 aa, Mycobacterium
RARDRG

SEQ ID NO: 557672 - protein, 6 aa, Mycobacterium
RARDSG

SEQ ID NO: 557673 - protein, 8 aa, Mycobacterium
RARDSHDR

SEQ ID NO: 557674 - protein, 13 aa, Mycobacterium
RARDVAPGRTLPD

SEQ ID NO: 557675 - protein, 10 aa, Mycobacterium
RAREAAEARM

SEQ ID NO: 557676 - protein, 8 aa, Mycobacterium
RAREAAHA

SEQ ID NO: 557677 - protein, 14 aa, Mycobacterium
RAREAREKARIARE

SEQ ID NO: 557678 - protein, 6 aa, Mycobacterium
RAREAS

SEQ ID NO: 557679 - protein, 7 aa, Mycobacterium
RAREATS

SEQ ID NO: 557680 - protein, 7 aa, Mycobacterium
RAREGGI

SEQ ID NO: 557681 - protein, 8 aa, Mycobacterium
RAREGRSL

SEQ ID NO: 557682 - protein, 16 aa, Mycobacterium
RAREHGDLESGPLRSV

SEQ ID NO: 557683 - protein, 11 aa, Mycobacterium
RAREKAATREL

SEQ ID NO: 557684 - protein, 9 aa, Mycobacterium
RARELADDA

SEQ ID NO: 557685 - protein, 7 aa, Mycobacterium
RARENAR

SEQ ID NO: 557686 - protein, 6 aa, Mycobacterium
RAREQH

SEQ ID NO: 557687 - protein, 5 aa, Mycobacterium
RARER

SEQ ID NO: 557688 - protein, 24 aa, Mycobacterium
RARERAEQADAASSTSGTFRGVPT

SEQ ID NO: 557689 - protein, 6 aa, Mycobacterium
RARERG

SEQ ID NO: 557690 - protein, 8 aa, Mycobacterium
RARESGAV

SEQ ID NO: 557691 - protein, 13 aa, Mycobacterium
RARETAGGTSHPI

SEQ ID NO: 557692 - protein, 6 aa, Mycobacterium
RARETF

SEQ ID NO: 557693 - protein, 9 aa, Mycobacterium
RAREVTATR

SEQ ID NO: 557694 - protein, 5 aa, Mycobacterium
RARFT

SEQ ID NO: 557695 - protein, 5 aa, Mycobacterium
RARGA

SEQ ID NO: 557696 - protein, 13 aa, Mycobacterium
RARGAALAAAGAS

SEQ ID NO: 557697 - protein, 9 aa, Mycobacterium
RARGACEDY

SEQ ID NO: 557698 - protein, 7 aa, Mycobacterium
RARGADG

SEQ ID NO: 557699 - protein, 15 aa, Mycobacterium
RARGAEVSGALNPAQ

SEQ ID NO: 557700 - protein, 9 aa, Mycobacterium
RARGAGAKR

SEQ ID NO: 557701 - protein, 6 aa, Mycobacterium
RARGAR

SEQ ID NO: 557702 - protein, 10 aa, Mycobacterium
RARGDGEVHP

SEQ ID NO: 557703 - protein, 8 aa, Mycobacterium
RARGDLKP

SEQ ID NO: 557704 - protein, 9 aa, Mycobacterium
RARGELAPG

SEQ ID NO: 557705 - protein, 9 aa, Mycobacterium
RARGEQTRR

SEQ ID NO: 557706 - protein, 19 aa, Mycobacterium
RARGGAVGAGARLDAPPDR

SEQ ID NO: 557707 - protein, 8 aa, Mycobacterium
RARGGDGV

SEQ ID NO: 557708 - protein, 10 aa, Mycobacterium
RARGHGRPAG

SEQ ID NO: 557709 - protein, 13 aa, Mycobacterium
RARGHLAGLDFEL

SEQ ID NO: 557710 - protein, 17 aa, Mycobacterium
RARGIKTGDGTGDADMG

SEQ ID NO: 557711 - protein, 21 aa, Mycobacterium
RARGITGETVRPDGGFGLGAP

SEQ ID NO: 557712 - protein, 6 aa, Mycobacterium
RARGPQ

SEQ ID NO: 557713 - protein, 8 aa, Mycobacterium
RARGQAAA

SEQ ID NO: 557714 - protein, 28 aa, Mycobacterium
RARGRKAELSLADGSSLTARLGGTDGDQ

SEQ ID NO: 557715 - protein, 9 aa, Mycobacterium
RARGRNQDE

SEQ ID NO: 557716 - protein, 6 aa, Mycobacterium
RARGSG

SEQ ID NO: 557717 - protein, 12 aa, Mycobacterium
RARGTAASVRPL

SEQ ID NO: 557718 - protein, 12 aa, Mycobacterium
RARGTDPGGLPP

SEQ ID NO: 557719 - protein, 10 aa, Mycobacterium
RARGTKAVSP

SEQ ID NO: 557720 - protein, 7 aa, Mycobacterium
RARGTTW

SEQ ID NO: 557721 - protein, 19 aa, Mycobacterium
RARGYDVDKPRNLAKSVTV

SEQ ID NO: 557722 - protein, 7 aa, Mycobacterium
RARGYGG

SEQ ID NO: 557723 - protein, 7 aa, Mycobacterium
RARHDPG

SEQ ID NO: 557724 - protein, 5 aa, Mycobacterium
RARHE

SEQ ID NO: 557725 - protein, 15 aa, Mycobacterium
RARHEPRRGQPGPLP

SEQ ID NO: 557726 - protein, 5 aa, Mycobacterium
RARHG

SEQ ID NO: 557727 - protein, 17 aa, Mycobacterium
RARHPGHDATAHRIRSR

SEQ ID NO: 557728 - protein, 6 aa, Mycobacterium
RARIEQ

SEQ ID NO: 557729 - protein, 5 aa, Mycobacterium
RARIG

SEQ ID NO: 557730 - protein, 5 aa, Mycobacterium
RARIT

SEQ ID NO: 557731 - protein, 5 aa, Mycobacterium
RARKA

SEQ ID NO: 557732 - protein, 14 aa, Mycobacterium
RARKHGDLESGPLK

SEQ ID NO: 557733 - protein, 16 aa, Mycobacterium
RARKHGDLESGPLKSV

SEQ ID NO: 557734 - protein, 9 aa, Mycobacterium
RARKRGKPV

SEQ ID NO: 557735 - protein, 6 aa, Mycobacterium
RARKSV

SEQ ID NO: 557736 - protein, 5 aa, Mycobacterium
RARLD

SEQ ID NO: 557737 - protein, 7 aa, Mycobacterium
RARLDEA

SEQ ID NO: 557738 - protein, 5 aa, Mycobacterium
RARLE

SEQ ID NO: 557739 - protein, 7 aa, Mycobacterium
RARLGTN

SEQ ID NO: 557740 - protein, 17 aa, Mycobacterium
RARLSGPRRRPGRRRLD

SEQ ID NO: 557741 - protein, 8 aa, Mycobacterium
RARLTPRE

SEQ ID NO: 557742 - protein, 4 aa, Mycobacterium
RARN

SEQ ID NO: 557743 - protein, 10 aa, Mycobacterium
RARNGAPVAT

SEQ ID NO: 557744 - protein, 11 aa, Mycobacterium
RARNGDQAATH

SEQ ID NO: 557745 - protein, 11 aa, Mycobacterium
RARNNTRTAGV

SEQ ID NO: 557746 - protein, 8 aa, Mycobacterium
RARNRAWS

SEQ ID NO: 557747 - protein, 29 aa, Mycobacterium
RARNRNHVQRRANTAEQELRQARKAEIEA

SEQ ID NO: 557748 - protein, 6 aa, Mycobacterium
RARPAG

SEQ ID NO: 557749 - protein, 23 aa, Mycobacterium
RARPARSAVSRARRAFDEPACDS

SEQ ID NO: 557750 - protein, 6 aa, Mycobacterium
RARPDT

SEQ ID NO: 557751 - protein, 8 aa, Mycobacterium
RARPEAAA

SEQ ID NO: 557752 - protein, 13 aa, Mycobacterium
RARPGNKNDGCHV

SEQ ID NO: 557753 - protein, 6 aa, Mycobacterium
RARPGT

SEQ ID NO: 557754 - protein, 19 aa, Mycobacterium
RARPGTNTTYPGPANGAAA

SEQ ID NO: 557755 - protein, 6 aa, Mycobacterium
RARPMP

SEQ ID NO: 557756 - protein, 5 aa, Mycobacterium
RARPP

SEQ ID NO: 557757 - protein, 7 aa, Mycobacterium
RARPPVG

SEQ ID NO: 557758 - protein, 7 aa, Mycobacterium
RARPQAQ

SEQ ID NO: 557759 - protein, 6 aa, Mycobacterium
RARPQI

SEQ ID NO: 557760 - protein, 9 aa, Mycobacterium
RARPSGEQP

SEQ ID NO: 557761 - protein, 17 aa, Mycobacterium
RARPSRGWARQLRRSRP

SEQ ID NO: 557762 - protein, 10 aa, Mycobacterium
RARPSSRGLT

SEQ ID NO: 557763 - protein, 14 aa, Mycobacterium
RARQAALASAGTVS

SEQ ID NO: 557764 - protein, 12 aa, Mycobacterium
RARQAALASSGR

SEQ ID NO: 557765 - protein, 8 aa, Mycobacterium
RARQAEAT

SEQ ID NO: 557766 - protein, 6 aa, Mycobacterium
RARQAG

SEQ ID NO: 557767 - protein, 8 aa, Mycobacterium
RARQAGAT

SEQ ID NO: 557768 - protein, 8 aa, Mycobacterium
RARQCSAD

SEQ ID NO: 557769 - protein, 5 aa, Mycobacterium
RARQE

SEQ ID NO: 557770 - protein, 7 aa, Mycobacterium
RARQESA

SEQ ID NO: 557771 - protein, 5 aa, Mycobacterium
RARQG

SEQ ID NO: 557772 - protein, 6 aa, Mycobacterium
RARQKG

SEQ ID NO: 557773 - protein, 23 aa, Mycobacterium
RARQNPDPPSASEASNGPPPAAR

SEQ ID NO: 557774 - protein, 5 aa, Mycobacterium
RARQQ

SEQ ID NO: 557775 - protein, 15 aa, Mycobacterium
RARQQGGRQRPARVG

SEQ ID NO: 557776 - protein, 7 aa, Mycobacterium
RARQRKE

SEQ ID NO: 557777 - protein, 9 aa, Mycobacterium
RARQRLTGE

SEQ ID NO: 557778 - protein, 8 aa, Mycobacterium
RARQRPTG

SEQ ID NO: 557779 - protein, 9 aa, Mycobacterium
RARQSGAPI

SEQ ID NO: 557780 - protein, 7 aa, Mycobacterium
RARQSGM

SEQ ID NO: 557781 - protein, 12 aa, Mycobacterium
RARRAAGPDAPE

SEQ ID NO: 557782 - protein, 8 aa, Mycobacterium
RARRAGAT

SEQ ID NO: 557783 - protein, 12 aa, Mycobacterium
RARRARRPAAAQ

SEQ ID NO: 557784 - protein, 12 aa, Mycobacterium
RARRDEAGYREY

SEQ ID NO: 557785 - protein, 21 aa, Mycobacterium
RARRDGAETVVGGGEAEGLPE

SEQ ID NO: 557786 - protein, 12 aa, Mycobacterium
RARRDLPDTARA

SEQ ID NO: 557787 - protein, 14 aa, Mycobacterium
RARRDQVRATGRSI

SEQ ID NO: 557788 - protein, 8 aa, Mycobacterium
RARRGSGE

SEQ ID NO: 557789 - protein, 7 aa, Mycobacterium
RARRPEV

SEQ ID NO: 557790 - protein, 11 aa, Mycobacterium
RARRPKTAKLV

SEQ ID NO: 557791 - protein, 7 aa, Mycobacterium
RARRPSL

SEQ ID NO: 557792 - protein, 9 aa, Mycobacterium
RARRPTSLG

SEQ ID NO: 557793 - protein, 5 aa, Mycobacterium
RARRR

SEQ ID NO: 557794 - protein, 8 aa, Mycobacterium
RARRRAGA

SEQ ID NO: 557795 - protein, 6 aa, Mycobacterium
RARRRG

SEQ ID NO: 557796 - protein, 8 aa, Mycobacterium
RARRRGTK

SEQ ID NO: 557797 - protein, 6 aa, Mycobacterium
RARRSV

SEQ ID NO: 557798 - protein, 12 aa, Mycobacterium
RARRVGTALRRL

SEQ ID NO: 557799 - protein, 13 aa, Mycobacterium
RARRYGTRPGIDH

SEQ ID NO: 557800 - protein, 4 aa, Mycobacterium
RARS

SEQ ID NO: 557801 - protein, 13 aa, Mycobacterium
RARSAAVAAAGAA

SEQ ID NO: 557802 - protein, 15 aa, Mycobacterium
RARSAEPPSRALPGQ

SEQ ID NO: 557803 - protein, 15 aa, Mycobacterium
RARSDEVAREITTGV

SEQ ID NO: 557804 - protein, 15 aa, Mycobacterium
RARSDRQASSPCSCG

SEQ ID NO: 557805 - protein, 37 aa, Mycobacterium
RARSDSSDSPNVTAQSPSGPNVTEVSRSADDEADLEA

SEQ ID NO: 557806 - protein, 9 aa, Mycobacterium
RARSEGHQD

SEQ ID NO: 557807 - protein, 9 aa, Mycobacterium
RARSGAGPL

SEQ ID NO: 557808 - protein, 9 aa, Mycobacterium
RARSGDEPE

SEQ ID NO: 557809 - protein, 7 aa, Mycobacterium
RARSGHS

SEQ ID NO: 557810 - protein, 10 aa, Mycobacterium
RARSGPPGPV

SEQ ID NO: 557811 - protein, 11 aa, Mycobacterium
RARSGRPSGDL

SEQ ID NO: 557812 - protein, 5 aa, Mycobacterium
RARSH

SEQ ID NO: 557813 - protein, 15 aa, Mycobacterium
RARSHGDLDSGPLKA

SEQ ID NO: 557814 - protein, 8 aa, Mycobacterium
RARSLGES

SEQ ID NO: 557815 - protein, 6 aa, Mycobacterium
RARSPE

SEQ ID NO: 557816 - protein, 9 aa, Mycobacterium
RARSPEVAE

SEQ ID NO: 557817 - protein, 9 aa, Mycobacterium
RARSRAGGA

SEQ ID NO: 557818 - protein, 29 aa, Mycobacterium
RARSRRAVPTDSVPERCDARADPAARDPD

SEQ ID NO: 557819 - protein, 7 aa, Mycobacterium
RARSRTS

SEQ ID NO: 557820 - protein, 5 aa, Mycobacterium
RARSS

SEQ ID NO: 557821 - protein, 6 aa, Mycobacterium
RARSSL

SEQ ID NO: 557822 - protein, 8 aa, Mycobacterium
RARSTGVS

SEQ ID NO: 557823 - protein, 7 aa, Mycobacterium
RARTADV

SEQ ID NO: 557824 - protein, 13 aa, Mycobacterium
RARTAGRHWPPEG

SEQ ID NO: 557825 - protein, 12 aa, Mycobacterium
RARTANASLMRT

SEQ ID NO: 557826 - protein, 5 aa, Mycobacterium
RARTE

SEQ ID NO: 557827 - protein, 7 aa, Mycobacterium
RARTERA

SEQ ID NO: 557828 - protein, 9 aa, Mycobacterium
RARTESAEQ

SEQ ID NO: 557829 - protein, 7 aa, Mycobacterium
RARTGKV

SEQ ID NO: 557830 - protein, 11 aa, Mycobacterium
RARTGRNGASW

SEQ ID NO: 557831 - protein, 17 aa, Mycobacterium
RARTGSVADIVGSLVGD

SEQ ID NO: 557832 - protein, 9 aa, Mycobacterium
RARTGTSKS

SEQ ID NO: 557833 - protein, 6 aa, Mycobacterium
RARTNK

SEQ ID NO: 557834 - protein, 13 aa, Mycobacterium
RARTPSTPATPSG

SEQ ID NO: 557835 - protein, 16 aa, Mycobacterium
RARTQRVAERATPEAL

SEQ ID NO: 557836 - protein, 8 aa, Mycobacterium
RARTQTDK

SEQ ID NO: 557837 - protein, 13 aa, Mycobacterium
RARTRAQSSAARI

SEQ ID NO: 557838 - protein, 5 aa, Mycobacterium
RARTS

SEQ ID NO: 557839 - protein, 8 aa, Mycobacterium
RARTSDVP

SEQ ID NO: 557840 - protein, 7 aa, Mycobacterium
RARTSEN

SEQ ID NO: 557841 - protein, 7 aa, Mycobacterium
RARTSRR

SEQ ID NO: 557842 - protein, 8 aa, Mycobacterium
RARTTGRP

SEQ ID NO: 557843 - protein, 4 aa, Mycobacterium
RARV

SEQ ID NO: 557844 - protein, 13 aa, Mycobacterium
RARVAAGTETRRR

SEQ ID NO: 557845 - protein, 11 aa, Mycobacterium
RARVERRTKES

SEQ ID NO: 557846 - protein, 17 aa, Mycobacterium
RARVGKRAGFGIKTGAD

SEQ ID NO: 557847 - protein, 8 aa, Mycobacterium
RARVPGPH

SEQ ID NO: 557848 - protein, 7 aa, Mycobacterium
RARVTPG

SEQ ID NO: 557849 - protein, 8 aa, Mycobacterium
RARVTSHT

SEQ ID NO: 557850 - protein, 5 aa, Mycobacterium
RARWG

SEQ ID NO: 557851 - protein, 4 aa, Mycobacterium
RARY

SEQ ID NO: 557852 - protein, 19 aa, Mycobacterium
RASAAASDLDDPEAMDGAW

SEQ ID NO: 557853 - protein, 8 aa, Mycobacterium
RASAAAYE

SEQ ID NO: 557854 - protein, 11 aa, Mycobacterium
RASAADRELGR

SEQ ID NO: 557855 - protein, 6 aa, Mycobacterium
RASAAE

SEQ ID NO: 557856 - protein, 9 aa, Mycobacterium
RASAAEHDV

SEQ ID NO: 557857 - protein, 10 aa, Mycobacterium
RASAAERDVR

SEQ ID NO: 557858 - protein, 14 aa, Mycobacterium
RASAAGTSTTPGAL

SEQ ID NO: 557859 - protein, 15 aa, Mycobacterium
RASAANASKSKSPVG

SEQ ID NO: 557860 - protein, 10 aa, Mycobacterium
RASADAPVPL

SEQ ID NO: 557861 - protein, 15 aa, Mycobacterium
RASADDVLGGAPGQG

SEQ ID NO: 557862 - protein, 8 aa, Mycobacterium
RASADGQV

SEQ ID NO: 557863 - protein, 10 aa, Mycobacterium
RASADLERQV

SEQ ID NO: 557864 - protein, 8 aa, Mycobacterium
RASADRDW

SEQ ID NO: 557865 - protein, 16 aa, Mycobacterium
RASADRPVATATGQAG

SEQ ID NO: 557866 - protein, 10 aa, Mycobacterium
RASAEAGERL

SEQ ID NO: 557867 - protein, 16 aa, Mycobacterium
RASAEEAGRWSPDRAN

SEQ ID NO: 557868 - protein, 6 aa, Mycobacterium
RASAGA

SEQ ID NO: 557869 - protein, 9 aa, Mycobacterium
RASAGDHEL

SEQ ID NO: 557870 - protein, 12 aa, Mycobacterium
RASAGPGQHTPR

SEQ ID NO: 557871 - protein, 13 aa, Mycobacterium
RASAGQGGPHHGY

SEQ ID NO: 557872 - protein, 9 aa, Mycobacterium
RASAGRALE

SEQ ID NO: 557873 - protein, 12 aa, Mycobacterium
RASARRGEASAL

SEQ ID NO: 557874 - protein, 11 aa, Mycobacterium
RASARRRDTTL

SEQ ID NO: 557875 - protein, 14 aa, Mycobacterium
RASARTPGKSDPID

SEQ ID NO: 557876 - protein, 14 aa, Mycobacterium
RASARTRGKSDTID

SEQ ID NO: 557877 - protein, 9 aa, Mycobacterium
RASASAYSR

SEQ ID NO: 557878 - protein, 8 aa, Mycobacterium
RASASDID

SEQ ID NO: 557879 - protein, 9 aa, Mycobacterium
RASASGPAI

SEQ ID NO: 557880 - protein, 7 aa, Mycobacterium
RASATQQ

SEQ ID NO: 557881 - protein, 4 aa, Mycobacterium
RASC

SEQ ID NO: 557882 - protein, 9 aa, Mycobacterium
RASDAAGLP

SEQ ID NO: 557883 - protein, 9 aa, Mycobacterium
RASDAPATL

SEQ ID NO: 557884 - protein, 11 aa, Mycobacterium
RASDARRGRGE

SEQ ID NO: 557885 - protein, 8 aa, Mycobacterium
RASDGRPL

SEQ ID NO: 557886 - protein, 7 aa, Mycobacterium
RASDGTR

SEQ ID NO: 557887 - protein, 5 aa, Mycobacterium
RASDH

SEQ ID NO: 557888 - protein, 16 aa, Mycobacterium
RASDRALAARSGPAVV

SEQ ID NO: 557889 - protein, 7 aa, Mycobacterium
RASDSSV

SEQ ID NO: 557890 - protein, 4 aa, Mycobacterium
RASE

SEQ ID NO: 557891 - protein, 9 aa, Mycobacterium
RASEAAGAD

SEQ ID NO: 557892 - protein, 7 aa, Mycobacterium
RASEAGW

SEQ ID NO: 557893 - protein, 12 aa, Mycobacterium
RASEARGEGPCP

SEQ ID NO: 557894 - protein, 5 aa, Mycobacterium
RASEE

SEQ ID NO: 557895 - protein, 9 aa, Mycobacterium
RASEGVGTS

SEQ ID NO: 557896 - protein, 7 aa, Mycobacterium
RASEKWQ

SEQ ID NO: 557897 - protein, 7 aa, Mycobacterium
RASEPAR

SEQ ID NO: 557898 - protein, 6 aa, Mycobacterium
RASEPG

SEQ ID NO: 557899 - protein, 7 aa, Mycobacterium
RASETAE

SEQ ID NO: 557900 - protein, 7 aa, Mycobacterium
RASEYPQ

SEQ ID NO: 557901 - protein, 12 aa, Mycobacterium
RASFTGAAADQV

SEQ ID NO: 557902 - protein, 10 aa, Mycobacterium
RASGADPDAV

SEQ ID NO: 557903 - protein, 8 aa, Mycobacterium
RASGAGYR

SEQ ID NO: 557904 - protein, 6 aa, Mycobacterium
RASGAH

SEQ ID NO: 557905 - protein, 9 aa, Mycobacterium
RASGALTTP

SEQ ID NO: 557906 - protein, 6 aa, Mycobacterium
RASGAR

SEQ ID NO: 557907 - protein, 7 aa, Mycobacterium
RASGDAR

SEQ ID NO: 557908 - protein, 7 aa, Mycobacterium
RASGDDG

SEQ ID NO: 557909 - protein, 9 aa, Mycobacterium
RASGDPDAV

SEQ ID NO: 557910 - protein, 11 aa, Mycobacterium
RASGGASARHR

SEQ ID NO: 557911 - protein, 17 aa, Mycobacterium
RASGGDTARTKACPKMS

SEQ ID NO: 557912 - protein, 7 aa, Mycobacterium
RASGGQA

SEQ ID NO: 557913 - protein, 10 aa, Mycobacterium
RASGHRERGV

SEQ ID NO: 557914 - protein, 5 aa, Mycobacterium
RASGL

SEQ ID NO: 557915 - protein, 13 aa, Mycobacterium
RASGLGRRLRHSP

SEQ ID NO: 557916 - protein, 8 aa, Mycobacterium
RASGLSRR

SEQ ID NO: 557917 - protein, 12 aa, Mycobacterium
RASGNGSSRDDV

SEQ ID NO: 557918 - protein, 25 aa, Mycobacterium
RASGPGPARTFPEDSPEISRADPVD

SEQ ID NO: 557919 - protein, 12 aa, Mycobacterium
RASGRAKLVEGR

SEQ ID NO: 557920 - protein, 6 aa, Mycobacterium
RASGRF

SEQ ID NO: 557921 - protein, 7 aa, Mycobacterium
RASGRKA

SEQ ID NO: 557922 - protein, 7 aa, Mycobacterium
RASGRRF

SEQ ID NO: 557923 - protein, 6 aa, Mycobacterium
RASGRT

SEQ ID NO: 557924 - protein, 12 aa, Mycobacterium
RASGSDPDAIQN

SEQ ID NO: 557925 - protein, 17 aa, Mycobacterium
RASGSLAGRVASRSHEA

SEQ ID NO: 557926 - protein, 10 aa, Mycobacterium
RASGSRGPYL

SEQ ID NO: 557927 - protein, 8 aa, Mycobacterium
RASGTLDD

SEQ ID NO: 557928 - protein, 6 aa, Mycobacterium
RASGVT

SEQ ID NO: 557929 - protein, 4 aa, Mycobacterium
RASH

SEQ ID NO: 557930 - protein, 10 aa, Mycobacterium
RASHADQELS

SEQ ID NO: 557931 - protein, 14 aa, Mycobacterium
RASHASTAGRTAPA

SEQ ID NO: 557932 - protein, 4 aa, Mycobacterium
RASI

SEQ ID NO: 557933 - protein, 7 aa, Mycobacterium
RASIGKP

SEQ ID NO: 557934 - protein, 7 aa, Mycobacterium
RASISGA

SEQ ID NO: 557935 - protein, 8 aa, Mycobacterium
RASISGAE

SEQ ID NO: 557936 - protein, 7 aa, Mycobacterium
RASITDP

SEQ ID NO: 557937 - protein, 12 aa, Mycobacterium
RASKAPRSNPEA

SEQ ID NO: 557938 - protein, 18 aa, Mycobacterium
RASKKRAESWLAAQSAQE

SEQ ID NO: 557939 - protein, 10 aa, Mycobacterium
RASKQPDAHP

SEQ ID NO: 557940 - protein, 15 aa, Mycobacterium
RASKRRAAQWLAAQN

SEQ ID NO: 557941 - protein, 6 aa, Mycobacterium
RASLPE

SEQ ID NO: 557942 - protein, 12 aa, Mycobacterium
RASLQSKQSRLR

SEQ ID NO: 557943 - protein, 11 aa, Mycobacterium
RASNARPGFTV

SEQ ID NO: 557944 - protein, 8 aa, Mycobacterium
RASNTSEL

SEQ ID NO: 557945 - protein, 6 aa, Mycobacterium
RASPAR

SEQ ID NO: 557946 - protein, 14 aa, Mycobacterium
RASPDHQRPLDDQS

SEQ ID NO: 557947 - protein, 16 aa, Mycobacterium
RASPGGTGAAKCGGNY

SEQ ID NO: 557948 - protein, 5 aa, Mycobacterium
RASPS

SEQ ID NO: 557949 - protein, 16 aa, Mycobacterium
RASPSAGSLAPITDPA

SEQ ID NO: 557950 - protein, 10 aa, Mycobacterium
RASQGVESEK

SEQ ID NO: 557951 - protein, 10 aa, Mycobacterium
RASQKSREIA

SEQ ID NO: 557952 - protein, 11 aa, Mycobacterium
RASQPAAEPSI

SEQ ID NO: 557953 - protein, 9 aa, Mycobacterium
RASQSGVQS

SEQ ID NO: 557954 - protein, 6 aa, Mycobacterium
RASRAG

SEQ ID NO: 557955 - protein, 10 aa, Mycobacterium
RASRDQPAVE

SEQ ID NO: 557956 - protein, 11 aa, Mycobacterium
RASRGEDDTSA

SEQ ID NO: 557957 - protein, 10 aa, Mycobacterium
RASRKTLSVG

SEQ ID NO: 557958 - protein, 14 aa, Mycobacterium
RASRLENAASRAEG

SEQ ID NO: 557959 - protein, 11 aa, Mycobacterium
RASRNPDSHPT

SEQ ID NO: 557960 - protein, 11 aa, Mycobacterium
RASRPGLQEDQ

SEQ ID NO: 557961 - protein, 8 aa, Mycobacterium
RASRPGQP

SEQ ID NO: 557962 - protein, 8 aa, Mycobacterium
RASRPLAT

SEQ ID NO: 557963 - protein, 15 aa, Mycobacterium
RASRPPSGASSSPLS

SEQ ID NO: 557964 - protein, 38 aa, Mycobacterium
RASRPTPEPPPDGPPGGAADSGDAAPRTRYQPIPVTLD

SEQ ID NO: 557965 - protein, 7 aa, Mycobacterium
RASRPVN

SEQ ID NO: 557966 - protein, 5 aa, Mycobacterium
RASRR

SEQ ID NO: 557967 - protein, 8 aa, Mycobacterium
RASRRPED

SEQ ID NO: 557968 - protein, 6 aa, Mycobacterium
RASRSE

SEQ ID NO: 557969 - protein, 8 aa, Mycobacterium
RASRTAGS

SEQ ID NO: 557970 - protein, 14 aa, Mycobacterium
RASRTAKADPQEAI

SEQ ID NO: 557971 - protein, 7 aa, Mycobacterium
RASRTMQ

SEQ ID NO: 557972 - protein, 4 aa, Mycobacterium
RASS

SEQ ID NO: 557973 - protein, 15 aa, Mycobacterium
RASSADTSGNGQPAL

SEQ ID NO: 557974 - protein, 6 aa, Mycobacterium
RASSAS

SEQ ID NO: 557975 - protein, 8 aa, Mycobacterium
RASSEDQA

SEQ ID NO: 557976 - protein, 5 aa, Mycobacterium
RASSK

SEQ ID NO: 557977 - protein, 7 aa, Mycobacterium
RASSPLT

SEQ ID NO: 557978 - protein, 18 aa, Mycobacterium
RASSSPPARDNSASITQS

SEQ ID NO: 557979 - protein, 6 aa, Mycobacterium
RASSTK

SEQ ID NO: 557980 - protein, 6 aa, Mycobacterium
RASSVN

SEQ ID NO: 557981 - protein, 19 aa, Mycobacterium
RASSVPERNVPWPYARRGG

SEQ ID NO: 557982 - protein, 13 aa, Mycobacterium
RASSYGEAHRGTG

SEQ ID NO: 557983 - protein, 4 aa, Mycobacterium
RAST

SEQ ID NO: 557984 - protein, 8 aa, Mycobacterium
RASTAKRE

SEQ ID NO: 557985 - protein, 11 aa, Mycobacterium
RASTATHANPI

SEQ ID NO: 557986 - protein, 9 aa, Mycobacterium
RASTDDAGH

SEQ ID NO: 557987 - protein, 18 aa, Mycobacterium
RASTDGPAINGTYRATSV

SEQ ID NO: 557988 - protein, 8 aa, Mycobacterium
RASTEPRI

SEQ ID NO: 557989 - protein, 8 aa, Mycobacterium
RASTETGH

SEQ ID NO: 557990 - protein, 5 aa, Mycobacterium
RASTG

SEQ ID NO: 557991 - protein, 7 aa, Mycobacterium
RASTINK

SEQ ID NO: 557992 - protein, 9 aa, Mycobacterium
RASTPGQRV

SEQ ID NO: 557993 - protein, 10 aa, Mycobacterium
RASTPNAQPR

SEQ ID NO: 557994 - protein, 9 aa, Mycobacterium
RASTSGQRI

SEQ ID NO: 557995 - protein, 7 aa, Mycobacterium
RASVGKP

SEQ ID NO: 557996 - protein, 6 aa, Mycobacterium
RASVRN

SEQ ID NO: 557997 - protein, 6 aa, Mycobacterium
RASYAD

SEQ ID NO: 557998 - protein, 7 aa, Mycobacterium
RASYAKA

SEQ ID NO: 557999 - protein, 9 aa, Mycobacterium
RASYDSPEL

SEQ ID NO: 558000 - protein, 7 aa, Mycobacterium
RASYEAG

SEQ ID NO: 558001 - protein, 20 aa, Mycobacterium
RASYGAAATAISGGATNSDV

SEQ ID NO: 558002 - protein, 13 aa, Mycobacterium
RASYYSVPDGPAD

SEQ ID NO: 558003 - protein, 7 aa, Mycobacterium
RATAAKF

SEQ ID NO: 558004 - protein, 7 aa, Mycobacterium
RATAAQS

SEQ ID NO: 558005 - protein, 10 aa, Mycobacterium
RATADGERFE

SEQ ID NO: 558006 - protein, 12 aa, Mycobacterium
RATADQIGTQST

SEQ ID NO: 558007 - protein, 12 aa, Mycobacterium
RATADQIGTQTT

SEQ ID NO: 558008 - protein, 13 aa, Mycobacterium
RATADQIGTQTTQ

SEQ ID NO: 558009 - protein, 14 aa, Mycobacterium
RATADQIGTQTTQI

SEQ ID NO: 558010 - protein, 12 aa, Mycobacterium
RATADVPAVPAQ

SEQ ID NO: 558011 - protein, 14 aa, Mycobacterium
RATADVSAVSGQPM

SEQ ID NO: 558012 - protein, 6 aa, Mycobacterium
RATAEA

SEQ ID NO: 558013 - protein, 6 aa, Mycobacterium
RATAEG

SEQ ID NO: 558014 - protein, 7 aa, Mycobacterium
RATAEGR

SEQ ID NO: 558015 - protein, 13 aa, Mycobacterium
RATAEGRKAEFAG

SEQ ID NO: 558016 - protein, 10 aa, Mycobacterium
RATAEGRKRE

SEQ ID NO: 558017 - protein, 13 aa, Mycobacterium
RATAEGRKSEFAE

SEQ ID NO: 558018 - protein, 9 aa, Mycobacterium
RATAEQRES

SEQ ID NO: 558019 - protein, 11 aa, Mycobacterium
RATAGADEFSA

SEQ ID NO: 558020 - protein, 11 aa, Mycobacterium
RATAGGVTDDA

SEQ ID NO: 558021 - protein, 8 aa, Mycobacterium
RATAGTDI

SEQ ID NO: 558022 - protein, 8 aa, Mycobacterium
RATAGTDL

SEQ ID NO: 558023 - protein, 5 aa, Mycobacterium
RATAL

SEQ ID NO: 558024 - protein, 7 aa, Mycobacterium
RATALRR

SEQ ID NO: 558025 - protein, 23 aa, Mycobacterium
RATALRRAGQPVGPRRLAGRDGD

SEQ ID NO: 558026 - protein, 7 aa, Mycobacterium
RATANGF

SEQ ID NO: 558027 - protein, 5 aa, Mycobacterium
RATAQ

SEQ ID NO: 558028 - protein, 7 aa, Mycobacterium
RATAQGR

SEQ ID NO: 558029 - protein, 8 aa, Mycobacterium
RATAQNGR

SEQ ID NO: 558030 - protein, 24 aa, Mycobacterium
RATARAADADPEISATTDRRRALD

SEQ ID NO: 558031 - protein, 8 aa, Mycobacterium
RATARAEQ

SEQ ID NO: 558032 - protein, 10 aa, Mycobacterium
RATARAYRTE

SEQ ID NO: 558033 - protein, 12 aa, Mycobacterium
RATARQADATAL

SEQ ID NO: 558034 - protein, 13 aa, Mycobacterium
RATASEPFDAESR

SEQ ID NO: 558035 - protein, 12 aa, Mycobacterium
RATASLRRNERE

SEQ ID NO: 558036 - protein, 8 aa, Mycobacterium
RATATAKE

SEQ ID NO: 558037 - protein, 16 aa, Mycobacterium
RATATEEYDASTQPPR

SEQ ID NO: 558038 - protein, 14 aa, Mycobacterium
RATATGAGWAGPGD

SEQ ID NO: 558039 - protein, 7 aa, Mycobacterium
RATATTT

SEQ ID NO: 558040 - protein, 4 aa, Mycobacterium
RATD

SEQ ID NO: 558041 - protein, 9 aa, Mycobacterium
RATDAAGAR

SEQ ID NO: 558042 - protein, 14 aa, Mycobacterium
RATDATVRPTDAEL

SEQ ID NO: 558043 - protein, 5 aa, Mycobacterium
RATDD

SEQ ID NO: 558044 - protein, 8 aa, Mycobacterium
RATDEQKS

SEQ ID NO: 558045 - protein, 38 aa, Mycobacterium
RATDEQRRRRERANAERKATALRTQAAKMGAKATKAVA

SEQ ID NO: 558046 - protein, 8 aa, Mycobacterium
RATDGETV

SEQ ID NO: 558047 - protein, 10 aa, Mycobacterium
RATDKLADLG

SEQ ID NO: 558048 - protein, 14 aa, Mycobacterium
RATDPTIRPTDDEL

SEQ ID NO: 558049 - protein, 8 aa, Mycobacterium
RATDRSEY

SEQ ID NO: 558050 - protein, 7 aa, Mycobacterium
RATDTAV

SEQ ID NO: 558051 - protein, 7 aa, Mycobacterium
RATDTPL

SEQ ID NO: 558052 - protein, 4 aa, Mycobacterium
RATE

SEQ ID NO: 558053 - protein, 7 aa, Mycobacterium
RATEAGF

SEQ ID NO: 558054 - protein, 12 aa, Mycobacterium
RATEANRPDGVL

SEQ ID NO: 558055 - protein, 7 aa, Mycobacterium
RATEDVE

SEQ ID NO: 558056 - protein, 5 aa, Mycobacterium
RATEE

SEQ ID NO: 558057 - protein, 10 aa, Mycobacterium
RATEERPSWG

SEQ ID NO: 558058 - protein, 8 aa, Mycobacterium
RATEGARI

SEQ ID NO: 558059 - protein, 9 aa, Mycobacterium
RATEGQGHP

SEQ ID NO: 558060 - protein, 8 aa, Mycobacterium
RATEGTDI

SEQ ID NO: 558061 - protein, 9 aa, Mycobacterium
RATEGTDIP

SEQ ID NO: 558062 - protein, 7 aa, Mycobacterium
RATEPAA

SEQ ID NO: 558063 - protein, 6 aa, Mycobacterium
RATEQL

SEQ ID NO: 558064 - protein, 6 aa, Mycobacterium
RATERA

SEQ ID NO: 558065 - protein, 9 aa, Mycobacterium
RATGAAEAI

SEQ ID NO: 558066 - protein, 9 aa, Mycobacterium
RATGAAVDA

SEQ ID NO: 558067 - protein, 6 aa, Mycobacterium
RATGAE

SEQ ID NO: 558068 - protein, 9 aa, Mycobacterium
RATGASADL

SEQ ID NO: 558069 - protein, 11 aa, Mycobacterium
RATGATGADVE

SEQ ID NO: 558070 - protein, 5 aa, Mycobacterium
RATGD

SEQ ID NO: 558071 - protein, 6 aa, Mycobacterium
RATGEV

SEQ ID NO: 558072 - protein, 9 aa, Mycobacterium
RATGFTERT

SEQ ID NO: 558073 - protein, 9 aa, Mycobacterium
RATGGGFDA

SEQ ID NO: 558074 - protein, 10 aa, Mycobacterium
RATGGPAEQT

SEQ ID NO: 558075 - protein, 7 aa, Mycobacterium
RATGGRA

SEQ ID NO: 558076 - protein, 7 aa, Mycobacterium
RATGGVP

SEQ ID NO: 558077 - protein, 5 aa, Mycobacterium
RATGI

SEQ ID NO: 558078 - protein, 7 aa, Mycobacterium
RATGIDK

SEQ ID NO: 558079 - protein, 10 aa, Mycobacterium
RATGLQRGET

SEQ ID NO: 558080 - protein, 8 aa, Mycobacterium
RATGPDKV

SEQ ID NO: 558081 - protein, 8 aa, Mycobacterium
RATGQDAE

SEQ ID NO: 558082 - protein, 6 aa, Mycobacterium
RATGQE

SEQ ID NO: 558083 - protein, 6 aa, Mycobacterium
RATGRG

SEQ ID NO: 558084 - protein, 10 aa, Mycobacterium
RATGRRDPRL

SEQ ID NO: 558085 - protein, 11 aa, Mycobacterium
RATGSAAPLGR

SEQ ID NO: 558086 - protein, 8 aa, Mycobacterium
RATGSEEL

SEQ ID NO: 558087 - protein, 7 aa, Mycobacterium
RATGSRD

SEQ ID NO: 558088 - protein, 5 aa, Mycobacterium
RATGT

SEQ ID NO: 558089 - protein, 7 aa, Mycobacterium
RATGTAV

SEQ ID NO: 558090 - protein, 6 aa, Mycobacterium
RATGTE

SEQ ID NO: 558091 - protein, 17 aa, Mycobacterium
RATGTTFTARPAPDAAA

SEQ ID NO: 558092 - protein, 5 aa, Mycobacterium
RATGV

SEQ ID NO: 558093 - protein, 6 aa, Mycobacterium
RATGVR

SEQ ID NO: 558094 - protein, 38 aa, Mycobacterium
RATGVTSPAGKASTTIAAGTTGATEAVQPRGSPGTTIT

SEQ ID NO: 558095 - protein, 7 aa, Mycobacterium
RATHTRL

SEQ ID NO: 558096 - protein, 8 aa, Mycobacterium
RATIENDG

SEQ ID NO: 558097 - protein, 7 aa, Mycobacterium
RATIGGR

SEQ ID NO: 558098 - protein, 10 aa, Mycobacterium
RATITGSGQI

SEQ ID NO: 558099 - protein, 9 aa, Mycobacterium
RATKDPVSV

SEQ ID NO: 558100 - protein, 9 aa, Mycobacterium
RATKGTPLS

SEQ ID NO: 558101 - protein, 11 aa, Mycobacterium
RATKNPDSHPT

SEQ ID NO: 558102 - protein, 7 aa, Mycobacterium
RATKPGA

SEQ ID NO: 558103 - protein, 21 aa, Mycobacterium
RATKPQVPSLSSLPGRPSRPA

SEQ ID NO: 558104 - protein, 11 aa, Mycobacterium
RATKQPDAHPT

SEQ ID NO: 558105 - protein, 4 aa, Mycobacterium
RATL

SEQ ID NO: 558106 - protein, 5 aa, Mycobacterium
RATLE

SEQ ID NO: 558107 - protein, 10 aa, Mycobacterium
RATLREGPVD

SEQ ID NO: 558108 - protein, 8 aa, Mycobacterium
RATLTAAP

SEQ ID NO: 558109 - protein, 4 aa, Mycobacterium
RATM

SEQ ID NO: 558110 - protein, 19 aa, Mycobacterium
RATNGKSRGSAEPGRVTAT

SEQ ID NO: 558111 - protein, 11 aa, Mycobacterium
RATNQGDGLSI

SEQ ID NO: 558112 - protein, 6 aa, Mycobacterium
RATNRH

SEQ ID NO: 558113 - protein, 6 aa, Mycobacterium
RATPDA

SEQ ID NO: 558114 - protein, 13 aa, Mycobacterium
RATPFASGELSPA

SEQ ID NO: 558115 - protein, 8 aa, Mycobacterium
RATPFGDT

SEQ ID NO: 558116 - protein, 5 aa, Mycobacterium
RATPG

SEQ ID NO: 558117 - protein, 8 aa, Mycobacterium
RATPHPRA

SEQ ID NO: 558118 - protein, 7 aa, Mycobacterium
RATPIED

SEQ ID NO: 558119 - protein, 6 aa, Mycobacterium
RATPPI

SEQ ID NO: 558120 - protein, 13 aa, Mycobacterium
RATPPMTGDERTT

SEQ ID NO: 558121 - protein, 5 aa, Mycobacterium
RATPR

SEQ ID NO: 558122 - protein, 7 aa, Mycobacterium
RATQAEL

SEQ ID NO: 558123 - protein, 6 aa, Mycobacterium
RATQHR

SEQ ID NO: 558124 - protein, 7 aa, Mycobacterium
RATQHRL

SEQ ID NO: 558125 - protein, 7 aa, Mycobacterium
RATQHRM

SEQ ID NO: 558126 - protein, 8 aa, Mycobacterium
RATQRAEA

SEQ ID NO: 558127 - protein, 4 aa, Mycobacterium
RATR

SEQ ID NO: 558128 - protein, 6 aa, Mycobacterium
RATRAG

SEQ ID NO: 558129 - protein, 19 aa, Mycobacterium
RATRAGRGWPTDPTLGDTV

SEQ ID NO: 558130 - protein, 7 aa, Mycobacterium
RATRDDI

SEQ ID NO: 558131 - protein, 10 aa, Mycobacterium
RATRDQEDAA

SEQ ID NO: 558132 - protein, 8 aa, Mycobacterium
RATRDTLT

SEQ ID NO: 558133 - protein, 9 aa, Mycobacterium
RATREAITR

SEQ ID NO: 558134 - protein, 9 aa, Mycobacterium
RATRGGERK

SEQ ID NO: 558135 - protein, 9 aa, Mycobacterium
RATRGGGRK

SEQ ID NO: 558136 - protein, 7 aa, Mycobacterium
RATRGLG

SEQ ID NO: 558137 - protein, 7 aa, Mycobacterium
RATRGRA

SEQ ID NO: 558138 - protein, 25 aa, Mycobacterium
RATRGSSAAPSLITPAPSGQTGRAE

SEQ ID NO: 558139 - protein, 13 aa, Mycobacterium
RATRGTRAGGNEV

SEQ ID NO: 558140 - protein, 13 aa, Mycobacterium
RATRKDVRPSAAE

SEQ ID NO: 558141 - protein, 16 aa, Mycobacterium
RATRKDVRPTKAEQAR

SEQ ID NO: 558142 - protein, 13 aa, Mycobacterium
RATRKEVRPSASE

SEQ ID NO: 558143 - protein, 11 aa, Mycobacterium
RATRKLNPQKI

SEQ ID NO: 558144 - protein, 11 aa, Mycobacterium
RATRKLNPQQI

SEQ ID NO: 558145 - protein, 6 aa, Mycobacterium
RATRPG

SEQ ID NO: 558146 - protein, 13 aa, Mycobacterium
RATRPSAFRTARR

SEQ ID NO: 558147 - protein, 16 aa, Mycobacterium
RATRPSEEYRTPTEDE

SEQ ID NO: 558148 - protein, 5 aa, Mycobacterium
RATRQ

SEQ ID NO: 558149 - protein, 11 aa, Mycobacterium
RATRQPDAHPT

SEQ ID NO: 558150 - protein, 9 aa, Mycobacterium
RATRQRTVN

SEQ ID NO: 558151 - protein, 10 aa, Mycobacterium
RATRQSRYDE

SEQ ID NO: 558152 - protein, 9 aa, Mycobacterium
RATRREARQ

SEQ ID NO: 558153 - protein, 5 aa, Mycobacterium
RATRS

SEQ ID NO: 558154 - protein, 6 aa, Mycobacterium
RATRSH

SEQ ID NO: 558155 - protein, 18 aa, Mycobacterium
RATRTGNGWPSDPTLGES

SEQ ID NO: 558156 - protein, 5 aa, Mycobacterium
RATSA

SEQ ID NO: 558157 - protein, 8 aa, Mycobacterium
RATSAGAR

SEQ ID NO: 558158 - protein, 10 aa, Mycobacterium
RATSAQIAEA

SEQ ID NO: 558159 - protein, 6 aa, Mycobacterium
RATSAR

SEQ ID NO: 558160 - protein, 10 aa, Mycobacterium
RATSDPEEAL

SEQ ID NO: 558161 - protein, 7 aa, Mycobacterium
RATSELR

SEQ ID NO: 558162 - protein, 9 aa, Mycobacterium
RATSGGAVL

SEQ ID NO: 558163 - protein, 9 aa, Mycobacterium
RATSGVATT

SEQ ID NO: 558164 - protein, 7 aa, Mycobacterium
RATSLGA

SEQ ID NO: 558165 - protein, 5 aa, Mycobacterium
RATSP

SEQ ID NO: 558166 - protein, 7 aa, Mycobacterium
RATSQGR

SEQ ID NO: 558167 - protein, 10 aa, Mycobacterium
RATSRAQNRA

SEQ ID NO: 558168 - protein, 5 aa, Mycobacterium
RATSS

SEQ ID NO: 558169 - protein, 10 aa, Mycobacterium
RATSSALRKA

SEQ ID NO: 558170 - protein, 6 aa, Mycobacterium
RATSSV

SEQ ID NO: 558171 - protein, 7 aa, Mycobacterium
RATSTIE

SEQ ID NO: 558172 - protein, 5 aa, Mycobacterium
RATTA

SEQ ID NO: 558173 - protein, 10 aa, Mycobacterium
RATTADTDAW

SEQ ID NO: 558174 - protein, 8 aa, Mycobacterium
RATTAEQL

SEQ ID NO: 558175 - protein, 6 aa, Mycobacterium
RATTAG

SEQ ID NO: 558176 - protein, 6 aa, Mycobacterium
RATTAR

SEQ ID NO: 558177 - protein, 10 aa, Mycobacterium
RATTDEAGRY

SEQ ID NO: 558178 - protein, 13 aa, Mycobacterium
RATTDFAEAANSA

SEQ ID NO: 558179 - protein, 7 aa, Mycobacterium
RATTDGH

SEQ ID NO: 558180 - protein, 17 aa, Mycobacterium
RATTESLAENTSDAHTG

SEQ ID NO: 558181 - protein, 8 aa, Mycobacterium
RATTGAVR

SEQ ID NO: 558182 - protein, 8 aa, Mycobacterium
RATTPEKV

SEQ ID NO: 558183 - protein, 7 aa, Mycobacterium
RATTQQM

SEQ ID NO: 558184 - protein, 6 aa, Mycobacterium
RATTRA

SEQ ID NO: 558185 - protein, 8 aa, Mycobacterium
RATTRGEL

SEQ ID NO: 558186 - protein, 15 aa, Mycobacterium
RATTRGVVPTDDELE

SEQ ID NO: 558187 - protein, 6 aa, Mycobacterium
RATTST

SEQ ID NO: 558188 - protein, 7 aa, Mycobacterium
RATTSTV

SEQ ID NO: 558189 - protein, 7 aa, Mycobacterium
RATTTGA

SEQ ID NO: 558190 - protein, 8 aa, Mycobacterium
RATTTQEI

SEQ ID NO: 558191 - protein, 5 aa, Mycobacterium
RATTV

SEQ ID NO: 558192 - protein, 13 aa, Mycobacterium
RATVSTAEAHPRA

SEQ ID NO: 558193 - protein, 5 aa, Mycobacterium
RATWT

SEQ ID NO: 558194 - protein, 7 aa, Mycobacterium
RATWTRE

SEQ ID NO: 558195 - protein, 10 aa, Mycobacterium
RATYAQQAGA

SEQ ID NO: 558196 - protein, 16 aa, Mycobacterium
RATYDPDGLFNSWMGR

SEQ ID NO: 558197 - protein, 15 aa, Mycobacterium
RATYPSPRRVAERGS

SEQ ID NO: 558198 - protein, 15 aa, Mycobacterium
RATYRQQPLEPPGQG

SEQ ID NO: 558199 - protein, 4 aa, Mycobacterium
RAVA

SEQ ID NO: 558200 - protein, 12 aa, Mycobacterium
RAVAGETVLAEL

SEQ ID NO: 558201 - protein, 5 aa, Mycobacterium
RAVAR

SEQ ID NO: 558202 - protein, 8 aa, Mycobacterium
RAVATDKG

SEQ ID NO: 558203 - protein, 13 aa, Mycobacterium
RAVATEAGVQPPT

SEQ ID NO: 558204 - protein, 6 aa, Mycobacterium
RAVATR

SEQ ID NO: 558205 - protein, 5 aa, Mycobacterium
RAVDA

SEQ ID NO: 558206 - protein, 9 aa, Mycobacterium
RAVDAGVPA

SEQ ID NO: 558207 - protein, 9 aa, Mycobacterium
RAVDDGAGG

SEQ ID NO: 558208 - protein, 8 aa, Mycobacterium
RAVDDQGN

SEQ ID NO: 558209 - protein, 16 aa, Mycobacterium
RAVDDSYANGYSNSKW

SEQ ID NO: 558210 - protein, 14 aa, Mycobacterium
RAVDEAKSVRGVDG

SEQ ID NO: 558211 - protein, 18 aa, Mycobacterium
RAVDPARDFPAEAPTGAI

SEQ ID NO: 558212 - protein, 10 aa, Mycobacterium
RAVDRESAYE

SEQ ID NO: 558213 - protein, 5 aa, Mycobacterium
RAVDS

SEQ ID NO: 558214 - protein, 7 aa, Mycobacterium
RAVEDNG

SEQ ID NO: 558215 - protein, 12 aa, Mycobacterium
RAVEPETPYGRP

SEQ ID NO: 558216 - protein, 6 aa, Mycobacterium
RAVEQG

SEQ ID NO: 558217 - protein, 10 aa, Mycobacterium
RAVESERPDA

SEQ ID NO: 558218 - protein, 4 aa, Mycobacterium
RAVG

SEQ ID NO: 558219 - protein, 8 aa, Mycobacterium
RAVGDGGD

SEQ ID NO: 558220 - protein, 24 aa, Mycobacterium
RAVGGGSEFASGTAAENASEMPPD

SEQ ID NO: 558221 - protein, 10 aa, Mycobacterium
RAVGGPSASR

SEQ ID NO: 558222 - protein, 8 aa, Mycobacterium
RAVGPGDE

SEQ ID NO: 558223 - protein, 11 aa, Mycobacterium
RAVGPPTRALP

SEQ ID NO: 558224 - protein, 11 aa, Mycobacterium
RAVGSDTPLDA

SEQ ID NO: 558225 - protein, 6 aa, Mycobacterium
RAVKDG

SEQ ID NO: 558226 - protein, 7 aa, Mycobacterium
RAVKDGD

SEQ ID NO: 558227 - protein, 12 aa, Mycobacterium
RAVPDGPDGQGW

SEQ ID NO: 558228 - protein, 8 aa, Mycobacterium
RAVPDSGD

SEQ ID NO: 558229 - protein, 6 aa, Mycobacterium
RAVPEE

SEQ ID NO: 558230 - protein, 5 aa, Mycobacterium
RAVPK

SEQ ID NO: 558231 - protein, 17 aa, Mycobacterium
RAVPPAPAASYGCRTRP

SEQ ID NO: 558232 - protein, 11 aa, Mycobacterium
RAVPPATENGV

SEQ ID NO: 558233 - protein, 7 aa, Mycobacterium
RAVPPTA

SEQ ID NO: 558234 - protein, 8 aa, Mycobacterium
RAVPPYES

SEQ ID NO: 558235 - protein, 7 aa, Mycobacterium
RAVPTSD

SEQ ID NO: 558236 - protein, 4 aa, Mycobacterium
RAVQ

SEQ ID NO: 558237 - protein, 6 aa, Mycobacterium
RAVQDG

SEQ ID NO: 558238 - protein, 12 aa, Mycobacterium
RAVQPPARELPG

SEQ ID NO: 558239 - protein, 14 aa, Mycobacterium
RAVQSLGGNGLTTE

SEQ ID NO: 558240 - protein, 4 aa, Mycobacterium
RAVR

SEQ ID NO: 558241 - protein, 5 aa, Mycobacterium
RAVRD

SEQ ID NO: 558242 - protein, 7 aa, Mycobacterium
RAVRDDD

SEQ ID NO: 558243 - protein, 6 aa, Mycobacterium
RAVRGD

SEQ ID NO: 558244 - protein, 7 aa, Mycobacterium
RAVRGDA

SEQ ID NO: 558245 - protein, 16 aa, Mycobacterium
RAVRGGSASFSAGPDR

SEQ ID NO: 558246 - protein, 11 aa, Mycobacterium
RAVRGTGVGEY

SEQ ID NO: 558247 - protein, 25 aa, Mycobacterium
RAVRPENRAKASIKGSGADVTPAPA

SEQ ID NO: 558248 - protein, 9 aa, Mycobacterium
RAVRPGADG

SEQ ID NO: 558249 - protein, 4 aa, Mycobacterium
RAVS

SEQ ID NO: 558250 - protein, 17 aa, Mycobacterium
RAVSAGKVTEREKDEAL

SEQ ID NO: 558251 - protein, 12 aa, Mycobacterium
RAVSAQKDGTLA

SEQ ID NO: 558252 - protein, 8 aa, Mycobacterium
RAVSDQAE

SEQ ID NO: 558253 - protein, 16 aa, Mycobacterium
RAVSEGDLTPDSDPDV

SEQ ID NO: 558254 - protein, 22 aa, Mycobacterium
RAVSGVGAPGVASAQPGRGRRV

SEQ ID NO: 558255 - protein, 13 aa, Mycobacterium
RAVSSDDDSMSTS

SEQ ID NO: 558256 - protein, 16 aa, Mycobacterium
RAVSSQASDDAGETTL

SEQ ID NO: 558257 - protein, 6 aa, Mycobacterium
RAVTAE

SEQ ID NO: 558258 - protein, 7 aa, Mycobacterium
RAVTDDR

SEQ ID NO: 558259 - protein, 8 aa, Mycobacterium
RAVTDGGW

SEQ ID NO: 558260 - protein, 25 aa, Mycobacterium
RAVTDQGLRKDGDRRAVKDDRRELR

SEQ ID NO: 558261 - protein, 7 aa, Mycobacterium
RAVTDRP

SEQ ID NO: 558262 - protein, 6 aa, Mycobacterium
RAVTSA

SEQ ID NO: 558263 - protein, 9 aa, Mycobacterium
RAVTTAAER

SEQ ID NO: 558264 - protein, 9 aa, Mycobacterium
RAVTTDPAQ

SEQ ID NO: 558265 - protein, 9 aa, Mycobacterium
RAVTTPERT

SEQ ID NO: 558266 - protein, 6 aa, Mycobacterium
RAVTTT

SEQ ID NO: 558267 - protein, 6 aa, Mycobacterium
RAWDEG

SEQ ID NO: 558268 - protein, 10 aa, Mycobacterium
RAWSGDAATA

SEQ ID NO: 558269 - protein, 7 aa, Mycobacterium
RAYDGAA

SEQ ID NO: 558270 - protein, 11 aa, Mycobacterium
RAYDRADPAAQ

SEQ ID NO: 558271 - protein, 17 aa, Mycobacterium
RAYDTATRLGERTGQQV

SEQ ID NO: 558272 - protein, 6 aa, Mycobacterium
RAYEDG

SEQ ID NO: 558273 - protein, 17 aa, Mycobacterium
RAYEPATAVPPLTTWRT

SEQ ID NO: 558274 - protein, 6 aa, Mycobacterium
RAYEPQ

SEQ ID NO: 558275 - protein, 4 aa, Mycobacterium
RAYG

SEQ ID NO: 558276 - protein, 20 aa, Mycobacterium
RAYGAADARRALGEARRRGT

SEQ ID NO: 558277 - protein, 20 aa, Mycobacterium
RAYGAADARRALTEARRRGT

SEQ ID NO: 558278 - protein, 6 aa, Mycobacterium
RAYGAS

SEQ ID NO: 558279 - protein, 6 aa, Mycobacterium
RAYGDP

SEQ ID NO: 558280 - protein, 8 aa, Mycobacterium
RAYGPATK

SEQ ID NO: 558281 - protein, 6 aa, Mycobacterium
RAYGTE

SEQ ID NO: 558282 - protein, 9 aa, Mycobacterium
RAYKAKKPV

SEQ ID NO: 558283 - protein, 8 aa, Mycobacterium
RAYPGGLT

SEQ ID NO: 558284 - protein, 23 aa, Mycobacterium
RAYPNGREVSPAAPSDLKSSAAD

SEQ ID NO: 558285 - protein, 7 aa, Mycobacterium
RAYPTDK

SEQ ID NO: 558286 - protein, 9 aa, Mycobacterium
RAYQPGPSL

SEQ ID NO: 558287 - protein, 7 aa, Mycobacterium
RAYRADG

SEQ ID NO: 558288 - protein, 9 aa, Mycobacterium
RAYRPPTRR

SEQ ID NO: 558289 - protein, 8 aa, Mycobacterium
RAYRSDGQ

SEQ ID NO: 558290 - protein, 5 aa, Mycobacterium
RAYRT

SEQ ID NO: 558291 - protein, 13 aa, Mycobacterium
RAYSDDASGTVWG

SEQ ID NO: 558292 - protein, 6 aa, Mycobacterium
RAYTGR

SEQ ID NO: 558293 - protein, 6 aa, Mycobacterium
RAYTLN

SEQ ID NO: 558294 - protein, 8 aa, Mycobacterium
RAYTPGGQ

SEQ ID NO: 558295 - protein, 4 aa, Mycobacterium
RAYY

SEQ ID NO: 558296 - protein, 10 aa, Mycobacterium
RCAAEPGWAS

SEQ ID NO: 558297 - protein, 5 aa, Mycobacterium
RCAET

SEQ ID NO: 558298 - protein, 10 aa, Mycobacterium
RCAPGPDGPI

SEQ ID NO: 558299 - protein, 8 aa, Mycobacterium
RCATGTGT

SEQ ID NO: 558300 - protein, 5 aa, Mycobacterium
RCDAQ

SEQ ID NO: 558301 - protein, 7 aa, Mycobacterium
RCDDDQI

SEQ ID NO: 558302 - protein, 5 aa, Mycobacterium
RCDDE

SEQ ID NO: 558303 - protein, 8 aa, Mycobacterium
RCDDPAGD

SEQ ID NO: 558304 - protein, 6 aa, Mycobacterium
RCDDPR

SEQ ID NO: 558305 - protein, 4 aa, Mycobacterium
RCDR

SEQ ID NO: 558306 - protein, 7 aa, Mycobacterium
RCDSDDS

SEQ ID NO: 558307 - protein, 5 aa, Mycobacterium
RCDSY

SEQ ID NO: 558308 - protein, 4 aa, Mycobacterium
RCEA

SEQ ID NO: 558309 - protein, 6 aa, Mycobacterium
RCEDDQ

SEQ ID NO: 558310 - protein, 7 aa, Mycobacterium
RCEGAAG

SEQ ID NO: 558311 - protein, 6 aa, Mycobacterium
RCEGPR

SEQ ID NO: 558312 - protein, 7 aa, Mycobacterium
RCEPDDV

SEQ ID NO: 558313 - protein, 5 aa, Mycobacterium
RCEQR

SEQ ID NO: 558314 - protein, 4 aa, Mycobacterium
RCES

SEQ ID NO: 558315 - protein, 7 aa, Mycobacterium
RCGAATP

SEQ ID NO: 558316 - protein, 6 aa, Mycobacterium
RCGAQG

SEQ ID NO: 558317 - protein, 7 aa, Mycobacterium
RCGEADP

SEQ ID NO: 558318 - protein, 4 aa, Mycobacterium
RCGG

SEQ ID NO: 558319 - protein, 11 aa, Mycobacterium
RCGGDGRVRAR

SEQ ID NO: 558320 - protein, 5 aa, Mycobacterium
RCGGE

SEQ ID NO: 558321 - protein, 9 aa, Mycobacterium
RCGGGIAGG

SEQ ID NO: 558322 - protein, 9 aa, Mycobacterium
RCGGPGLAG

SEQ ID NO: 558323 - protein, 10 aa, Mycobacterium
RCGGPGLAGE

SEQ ID NO: 558324 - protein, 12 aa, Mycobacterium
RCGHPGAGGCAA

SEQ ID NO: 558325 - protein, 6 aa, Mycobacterium
RCGSPA

SEQ ID NO: 558326 - protein, 11 aa, Mycobacterium
RCGSPQYDNGV

SEQ ID NO: 558327 - protein, 13 aa, Mycobacterium
RCGTGTATVGGRR

SEQ ID NO: 558328 - protein, 7 aa, Mycobacterium
RCNPSGR

SEQ ID NO: 558329 - protein, 16 aa, Mycobacterium
RCPAGATNNAKISAVA

SEQ ID NO: 558330 - protein, 7 aa, Mycobacterium
RCPGNRT

SEQ ID NO: 558331 - protein, 12 aa, Mycobacterium
RCPSSTVDHIDT

SEQ ID NO: 558332 - protein, 4 aa, Mycobacterium
RCPT

SEQ ID NO: 558333 - protein, 7 aa, Mycobacterium
RCRAGRP

SEQ ID NO: 558334 - protein, 22 aa, Mycobacterium
RCRDDSRPTSSGTPAIAPGTPV

SEQ ID NO: 558335 - protein, 8 aa, Mycobacterium
RCRDGGTA

SEQ ID NO: 558336 - protein, 6 aa, Mycobacterium
RCREGR

SEQ ID NO: 558337 - protein, 4 aa, Mycobacterium
RCRP

SEQ ID NO: 558338 - protein, 7 aa, Mycobacterium
RCRPGDD

SEQ ID NO: 558339 - protein, 8 aa, Mycobacterium
RCRPSQPA

SEQ ID NO: 558340 - protein, 5 aa, Mycobacterium
RCRQT

SEQ ID NO: 558341 - protein, 4 aa, Mycobacterium
RCSE

SEQ ID NO: 558342 - protein, 9 aa, Mycobacterium
RCSSADTSE

SEQ ID NO: 558343 - protein, 8 aa, Mycobacterium
RCSSRGHQ

SEQ ID NO: 558344 - protein, 13 aa, Mycobacterium
RCSTAAQEEFEQA

SEQ ID NO: 558345 - protein, 6 aa, Mycobacterium
RCSTAP

SEQ ID NO: 558346 - protein, 7 aa, Mycobacterium
RCTAEAD

SEQ ID NO: 558347 - protein, 11 aa, Mycobacterium
RCTAEAENAFQ

SEQ ID NO: 558348 - protein, 9 aa, Mycobacterium
RCTDTGARR

SEQ ID NO: 558349 - protein, 6 aa, Mycobacterium
RCTPRD

SEQ ID NO: 558350 - protein, 6 aa, Mycobacterium
RCTQTA

SEQ ID NO: 558351 - protein, 8 aa, Mycobacterium
RCTTQTGD

SEQ ID NO: 558352 - protein, 17 aa, Mycobacterium
RCVGGGSAAKRRAPPRC

SEQ ID NO: 558353 - protein, 4 aa, Mycobacterium
RDAA

SEQ ID NO: 558354 - protein, 8 aa, Mycobacterium
RDAAADAA

SEQ ID NO: 558355 - protein, 9 aa, Mycobacterium
RDAAADATD

SEQ ID NO: 558356 - protein, 8 aa, Mycobacterium
RDAAAHAG

SEQ ID NO: 558357 - protein, 6 aa, Mycobacterium
RDAAAL

SEQ ID NO: 558358 - protein, 7 aa, Mycobacterium
RDAAAQG

SEQ ID NO: 558359 - protein, 7 aa, Mycobacterium
RDAADTM

SEQ ID NO: 558360 - protein, 6 aa, Mycobacterium
RDAAEA

SEQ ID NO: 558361 - protein, 14 aa, Mycobacterium
RDAAEALGMAVIAP

SEQ ID NO: 558362 - protein, 12 aa, Mycobacterium
RDAAEANGAVAT

SEQ ID NO: 558363 - protein, 10 aa, Mycobacterium
RDAAGEPSHV

SEQ ID NO: 558364 - protein, 8 aa, Mycobacterium
RDAAGGSV

SEQ ID NO: 558365 - protein, 7 aa, Mycobacterium
RDAAGQL

SEQ ID NO: 558366 - protein, 9 aa, Mycobacterium
RDAAGQQRV

SEQ ID NO: 558367 - protein, 9 aa, Mycobacterium
RDAAHQHAQ

SEQ ID NO: 558368 - protein, 6 aa, Mycobacterium
RDAAID

SEQ ID NO: 558369 - protein, 7 aa, Mycobacterium
RDAANDL

SEQ ID NO: 558370 - protein, 23 aa, Mycobacterium
RDAANGEVGQPARSYRDRDATSR

SEQ ID NO: 558371 - protein, 9 aa, Mycobacterium
RDAANGLPR

SEQ ID NO: 558372 - protein, 11 aa, Mycobacterium
RDAANQAARQA

SEQ ID NO: 558373 - protein, 10 aa, Mycobacterium
RDAANRPKGI

SEQ ID NO: 558374 - protein, 8 aa, Mycobacterium
RDAAPDGI

SEQ ID NO: 558375 - protein, 7 aa, Mycobacterium
RDAAPDV

SEQ ID NO: 558376 - protein, 8 aa, Mycobacterium
RDAARDAG

SEQ ID NO: 558377 - protein, 8 aa, Mycobacterium
RDAARGDA

SEQ ID NO: 558378 - protein, 11 aa, Mycobacterium
RDAARPADATH

SEQ ID NO: 558379 - protein, 6 aa, Mycobacterium
RDAATG

SEQ ID NO: 558380 - protein, 11 aa, Mycobacterium
RDAATPSRAYA

SEQ ID NO: 558381 - protein, 5 aa, Mycobacterium
RDACE

SEQ ID NO: 558382 - protein, 6 aa, Mycobacterium
RDADAA

SEQ ID NO: 558383 - protein, 14 aa, Mycobacterium
RDADAIVEDYLRAG

SEQ ID NO: 558384 - protein, 5 aa, Mycobacterium
RDADG

SEQ ID NO: 558385 - protein, 12 aa, Mycobacterium
RDADGAAARQAA

SEQ ID NO: 558386 - protein, 8 aa, Mycobacterium
RDADGAEA

SEQ ID NO: 558387 - protein, 21 aa, Mycobacterium
RDADGKPDGTTAAAVQQEAAR

SEQ ID NO: 558388 - protein, 10 aa, Mycobacterium
RDADGLGRTV

SEQ ID NO: 558389 - protein, 9 aa, Mycobacterium
RDADGSNPW

SEQ ID NO: 558390 - protein, 32 aa, Mycobacterium
RDADGTPSITGNNGSAGPLGLPTSDENTEGDQ

SEQ ID NO: 558391 - protein, 7 aa, Mycobacterium
RDADGYQ

SEQ ID NO: 558392 - protein, 10 aa, Mycobacterium
RDADLTPLGS

SEQ ID NO: 558393 - protein, 5 aa, Mycobacterium
RDADP

SEQ ID NO: 558394 - protein, 7 aa, Mycobacterium
RDADPAI

SEQ ID NO: 558395 - protein, 7 aa, Mycobacterium
RDADPED

SEQ ID NO: 558396 - protein, 7 aa, Mycobacterium
RDADPGI

SEQ ID NO: 558397 - protein, 6 aa, Mycobacterium
RDADRE

SEQ ID NO: 558398 - protein, 15 aa, Mycobacterium
RDADRGRVVKPSTRT

SEQ ID NO: 558399 - protein, 5 aa, Mycobacterium
RDADY

SEQ ID NO: 558400 - protein, 5 aa, Mycobacterium
RDAED

SEQ ID NO: 558401 - protein, 57 aa, Mycobacterium
RDAEDTPDADDPDAGDVAAAKAAAEADADDGDAADDDAADGDAAAPDPDDQVDTEYG

SEQ ID NO: 558402 - protein, 10 aa, Mycobacterium
RDAEDTPYGR

SEQ ID NO: 558403 - protein, 11 aa, Mycobacterium
RDAEESAASSL

SEQ ID NO: 558404 - protein, 12 aa, Mycobacterium
RDAEESERHGGP

SEQ ID NO: 558405 - protein, 14 aa, Mycobacterium
RDAEGAAAATEQNW

SEQ ID NO: 558406 - protein, 9 aa, Mycobacterium
RDAEKSGRP

SEQ ID NO: 558407 - protein, 6 aa, Mycobacterium
RDAEKT

SEQ ID NO: 558408 - protein, 5 aa, Mycobacterium
RDAEL

SEQ ID NO: 558409 - protein, 6 aa, Mycobacterium
RDAEQM

SEQ ID NO: 558410 - protein, 7 aa, Mycobacterium
RDAEQTH

SEQ ID NO: 558411 - protein, 5 aa, Mycobacterium
RDAER

SEQ ID NO: 558412 - protein, 6 aa, Mycobacterium
RDAERC

SEQ ID NO: 558413 - protein, 9 aa, Mycobacterium
RDAERFGTR

SEQ ID NO: 558414 - protein, 9 aa, Mycobacterium
RDAERLAEE

SEQ ID NO: 558415 - protein, 7 aa, Mycobacterium
RDAERRY

SEQ ID NO: 558416 - protein, 6 aa, Mycobacterium
RDAETG

SEQ ID NO: 558417 - protein, 8 aa, Mycobacterium
RDAEVSVQ

SEQ ID NO: 558418 - protein, 6 aa, Mycobacterium
RDAGAA

SEQ ID NO: 558419 - protein, 12 aa, Mycobacterium
RDAGAAEQDAQQ

SEQ ID NO: 558420 - protein, 6 aa, Mycobacterium
RDAGAD

SEQ ID NO: 558421 - protein, 17 aa, Mycobacterium
RDAGAGPVPNYPAPDGV

SEQ ID NO: 558422 - protein, 7 aa, Mycobacterium
RDAGAPA

SEQ ID NO: 558423 - protein, 5 aa, Mycobacterium
RDAGD

SEQ ID NO: 558424 - protein, 8 aa, Mycobacterium
RDAGDDLG

SEQ ID NO: 558425 - protein, 5 aa, Mycobacterium
RDAGG

SEQ ID NO: 558426 - protein, 6 aa, Mycobacterium
RDAGGE

SEQ ID NO: 558427 - protein, 14 aa, Mycobacterium
RDAGGGDKPVQGGT

SEQ ID NO: 558428 - protein, 10 aa, Mycobacterium
RDAGGRGPAR

SEQ ID NO: 558429 - protein, 9 aa, Mycobacterium
RDAGGRPTT

SEQ ID NO: 558430 - protein, 8 aa, Mycobacterium
RDAGHPMA

SEQ ID NO: 558431 - protein, 7 aa, Mycobacterium
RDAGIPT

SEQ ID NO: 558432 - protein, 5 aa, Mycobacterium
RDAGL

SEQ ID NO: 558433 - protein, 18 aa, Mycobacterium
RDAGLESAGRRGTGGGLP

SEQ ID NO: 558434 - protein, 6 aa, Mycobacterium
RDAGLP

SEQ ID NO: 558435 - protein, 6 aa, Mycobacterium
RDAGLS

SEQ ID NO: 558436 - protein, 8 aa, Mycobacterium
RDAGNRRR

SEQ ID NO: 558437 - protein, 6 aa, Mycobacterium
RDAGPA

SEQ ID NO: 558438 - protein, 6 aa, Mycobacterium
RDAGQV

SEQ ID NO: 558439 - protein, 6 aa, Mycobacterium
RDAGRS

SEQ ID NO: 558440 - protein, 7 aa, Mycobacterium
RDAGTVQ

SEQ ID NO: 558441 - protein, 5 aa, Mycobacterium
RDAGV

SEQ ID NO: 558442 - protein, 6 aa, Mycobacterium
RDAGVD

SEQ ID NO: 558443 - protein, 6 aa, Mycobacterium
RDAGVT

SEQ ID NO: 558444 - protein, 7 aa, Mycobacterium
RDAGYDD

SEQ ID NO: 558445 - protein, 8 aa, Mycobacterium
RDAGYTDV

SEQ ID NO: 558446 - protein, 5 aa, Mycobacterium
RDAHA

SEQ ID NO: 558447 - protein, 9 aa, Mycobacterium
RDAHGDPDW

SEQ ID NO: 558448 - protein, 6 aa, Mycobacterium
RDAHGT

SEQ ID NO: 558449 - protein, 13 aa, Mycobacterium
RDAHGYGQTPEEV

SEQ ID NO: 558450 - protein, 10 aa, Mycobacterium
RDAISEVPED

SEQ ID NO: 558451 - protein, 9 aa, Mycobacterium
RDAKGNPVQ

SEQ ID NO: 558452 - protein, 10 aa, Mycobacterium
RDAKGNRQRA

SEQ ID NO: 558453 - protein, 6 aa, Mycobacterium
RDAKSV

SEQ ID NO: 558454 - protein, 4 aa, Mycobacterium
RDAL

SEQ ID NO: 558455 - protein, 8 aa, Mycobacterium
RDALESPE

SEQ ID NO: 558456 - protein, 6 aa, Mycobacterium
RDALKR

SEQ ID NO: 558457 - protein, 5 aa, Mycobacterium
RDALP

SEQ ID NO: 558458 - protein, 14 aa, Mycobacterium
RDALPAKAGRVPDL

SEQ ID NO: 558459 - protein, 9 aa, Mycobacterium
RDANRPRAV

SEQ ID NO: 558460 - protein, 6 aa, Mycobacterium
RDAPAQ

SEQ ID NO: 558461 - protein, 11 aa, Mycobacterium
RDAPGAGSTPP

SEQ ID NO: 558462 - protein, 6 aa, Mycobacterium
RDAPNR

SEQ ID NO: 558463 - protein, 13 aa, Mycobacterium
RDAPPPAPRDDER

SEQ ID NO: 558464 - protein, 7 aa, Mycobacterium
RDAPPRL

SEQ ID NO: 558465 - protein, 7 aa, Mycobacterium
RDAPQAL

SEQ ID NO: 558466 - protein, 7 aa, Mycobacterium
RDAPQQL

SEQ ID NO: 558467 - protein, 6 aa, Mycobacterium
RDAPQR

SEQ ID NO: 558468 - protein, 7 aa, Mycobacterium
RDAPRPL

SEQ ID NO: 558469 - protein, 14 aa, Mycobacterium
RDAPRRSAPRPPAR

SEQ ID NO: 558470 - protein, 14 aa, Mycobacterium
RDAPTGRLASLVWM

SEQ ID NO: 558471 - protein, 10 aa, Mycobacterium
RDAPVKGGQH

SEQ ID NO: 558472 - protein, 8 aa, Mycobacterium
RDAPVSDE

SEQ ID NO: 558473 - protein, 7 aa, Mycobacterium
RDAPWPD

SEQ ID NO: 558474 - protein, 8 aa, Mycobacterium
RDAPWPGS

SEQ ID NO: 558475 - protein, 6 aa, Mycobacterium
RDAPYP

SEQ ID NO: 558476 - protein, 13 aa, Mycobacterium
RDAQAPSLAEAQA

SEQ ID NO: 558477 - protein, 20 aa, Mycobacterium
RDAQEKFNAGMGADGDATPY

SEQ ID NO: 558478 - protein, 6 aa, Mycobacterium
RDAQGR

SEQ ID NO: 558479 - protein, 9 aa, Mycobacterium
RDAQGRSNY

SEQ ID NO: 558480 - protein, 11 aa, Mycobacterium
RDAQPVAAPRR

SEQ ID NO: 558481 - protein, 10 aa, Mycobacterium
RDAQRAGAPF

SEQ ID NO: 558482 - protein, 22 aa, Mycobacterium
RDAQREADHYREQARRAADEAI

SEQ ID NO: 558483 - protein, 13 aa, Mycobacterium
RDARAGKLDPNRV

SEQ ID NO: 558484 - protein, 10 aa, Mycobacterium
RDARAGRLDP

SEQ ID NO: 558485 - protein, 7 aa, Mycobacterium
RDARDAV

SEQ ID NO: 558486 - protein, 11 aa, Mycobacterium
RDARDELAGLT

SEQ ID NO: 558487 - protein, 8 aa, Mycobacterium
RDARGDDR

SEQ ID NO: 558488 - protein, 10 aa, Mycobacterium
RDARGQGHTT

SEQ ID NO: 558489 - protein, 8 aa, Mycobacterium
RDARPGEV

SEQ ID NO: 558490 - protein, 8 aa, Mycobacterium
RDARRADA

SEQ ID NO: 558491 - protein, 10 aa, Mycobacterium
RDARSDNAAF

SEQ ID NO: 558492 - protein, 6 aa, Mycobacterium
RDARSG

SEQ ID NO: 558493 - protein, 5 aa, Mycobacterium
RDART

SEQ ID NO: 558494 - protein, 24 aa, Mycobacterium
RDARTGEPIRTYSNAGANSGGEQE

SEQ ID NO: 558495 - protein, 6 aa, Mycobacterium
RDASAD

SEQ ID NO: 558496 - protein, 21 aa, Mycobacterium
RDASAEIRHGTQGTPISSGDE

SEQ ID NO: 558497 - protein, 8 aa, Mycobacterium
RDASDAPT

SEQ ID NO: 558498 - protein, 7 aa, Mycobacterium
RDASDDA

SEQ ID NO: 558499 - protein, 12 aa, Mycobacterium
RDASGAASTPPV

SEQ ID NO: 558500 - protein, 12 aa, Mycobacterium
RDASGVRPAGPR

SEQ ID NO: 558501 - protein, 21 aa, Mycobacterium
RDASKTPEPVPKEIPKTGNND

SEQ ID NO: 558502 - protein, 6 aa, Mycobacterium
RDASPY

SEQ ID NO: 558503 - protein, 5 aa, Mycobacterium
RDAST

SEQ ID NO: 558504 - protein, 4 aa, Mycobacterium
RDAT

SEQ ID NO: 558505 - protein, 8 aa, Mycobacterium
RDATARHP

SEQ ID NO: 558506 - protein, 29 aa, Mycobacterium
RDATDAYREYEQAAQSAGQNAGQNFAGGL

SEQ ID NO: 558507 - protein, 6 aa, Mycobacterium
RDATDQ

SEQ ID NO: 558508 - protein, 9 aa, Mycobacterium
RDATDSEEI

SEQ ID NO: 558509 - protein, 10 aa, Mycobacterium
RDATEAERAE

SEQ ID NO: 558510 - protein, 11 aa, Mycobacterium
RDATEAEREEY

SEQ ID NO: 558511 - protein, 7 aa, Mycobacterium
RDATEVR

SEQ ID NO: 558512 - protein, 9 aa, Mycobacterium
RDATGEGAR

SEQ ID NO: 558513 - protein, 9 aa, Mycobacterium
RDATGHGQQ

SEQ ID NO: 558514 - protein, 8 aa, Mycobacterium
RDATGHQA

SEQ ID NO: 558515 - protein, 9 aa, Mycobacterium
RDATGHQGR

SEQ ID NO: 558516 - protein, 7 aa, Mycobacterium
RDATGTT

SEQ ID NO: 558517 - protein, 14 aa, Mycobacterium
RDATNGRLGGPVTV

SEQ ID NO: 558518 - protein, 24 aa, Mycobacterium
RDATNTARSQRNSKPGDPKASASA

SEQ ID NO: 558519 - protein, 5 aa, Mycobacterium
RDATQ

SEQ ID NO: 558520 - protein, 6 aa, Mycobacterium
RDATQR

SEQ ID NO: 558521 - protein, 7 aa, Mycobacterium
RDATRQR

SEQ ID NO: 558522 - protein, 9 aa, Mycobacterium
RDATRRGRA

SEQ ID NO: 558523 - protein, 18 aa, Mycobacterium
RDATTPGPTAPQAQRDGF

SEQ ID NO: 558524 - protein, 5 aa, Mycobacterium
RDATY

SEQ ID NO: 558525 - protein, 4 aa, Mycobacterium
RDAV

SEQ ID NO: 558526 - protein, 12 aa, Mycobacterium
RDAVAGKTVAGR

SEQ ID NO: 558527 - protein, 5 aa, Mycobacterium
RDAVP

SEQ ID NO: 558528 - protein, 18 aa, Mycobacterium
RDAVPPRKGSGRVPGRPS

SEQ ID NO: 558529 - protein, 27 aa, Mycobacterium
RDAYEKGMTDKSQEFAKHGNRIYLPLH

SEQ ID NO: 558530 - protein, 4 aa, Mycobacterium
RDCD

SEQ ID NO: 558531 - protein, 5 aa, Mycobacterium
RDCDL

SEQ ID NO: 558532 - protein, 5 aa, Mycobacterium
RDCEL

SEQ ID NO: 558533 - protein, 10 aa, Mycobacterium
RDDAAARARL

SEQ ID NO: 558534 - protein, 6 aa, Mycobacterium
RDDAAD

SEQ ID NO: 558535 - protein, 6 aa, Mycobacterium
RDDAAE

SEQ ID NO: 558536 - protein, 6 aa, Mycobacterium
RDDADL

SEQ ID NO: 558537 - protein, 13 aa, Mycobacterium
RDDADNAPETRSE

SEQ ID NO: 558538 - protein, 9 aa, Mycobacterium
RDDADRDAP

SEQ ID NO: 558539 - protein, 5 aa, Mycobacterium
RDDAE

SEQ ID NO: 558540 - protein, 10 aa, Mycobacterium
RDDAGRTTSI

SEQ ID NO: 558541 - protein, 5 aa, Mycobacterium
RDDAH

SEQ ID NO: 558542 - protein, 10 aa, Mycobacterium
RDDAKGPSAS

SEQ ID NO: 558543 - protein, 6 aa, Mycobacterium
RDDANL

SEQ ID NO: 558544 - protein, 14 aa, Mycobacterium
RDDAPPARYGPPPW

SEQ ID NO: 558545 - protein, 8 aa, Mycobacterium
RDDAQPIA

SEQ ID NO: 558546 - protein, 6 aa, Mycobacterium
RDDARL

SEQ ID NO: 558547 - protein, 5 aa, Mycobacterium
RDDAT

SEQ ID NO: 558548 - protein, 15 aa, Mycobacterium
RDDDAAFGHSAGPQS

SEQ ID NO: 558549 - protein, 9 aa, Mycobacterium
RDDDADKFD

SEQ ID NO: 558550 - protein, 10 aa, Mycobacterium
RDDDDALAPA

SEQ ID NO: 558551 - protein, 8 aa, Mycobacterium
RDDDDAVA

SEQ ID NO: 558552 - protein, 10 aa, Mycobacterium
RDDDDDLPAG

SEQ ID NO: 558553 - protein, 6 aa, Mycobacterium
RDDDGR

SEQ ID NO: 558554 - protein, 6 aa, Mycobacterium
RDDDGV

SEQ ID NO: 558555 - protein, 5 aa, Mycobacterium
RDDDH

SEQ ID NO: 558556 - protein, 8 aa, Mycobacterium
RDDDNYQR

SEQ ID NO: 558557 - protein, 8 aa, Mycobacterium
RDDDPEDA

SEQ ID NO: 558558 - protein, 9 aa, Mycobacterium
RDDDPEDAL

SEQ ID NO: 558559 - protein, 8 aa, Mycobacterium
RDDDPEDL

SEQ ID NO: 558560 - protein, 9 aa, Mycobacterium
RDDDPEDTL

SEQ ID NO: 558561 - protein, 10 aa, Mycobacterium
RDDDPSDADV

SEQ ID NO: 558562 - protein, 7 aa, Mycobacterium
RDDDRAM

SEQ ID NO: 558563 - protein, 10 aa, Mycobacterium
RDDDRASVRG

SEQ ID NO: 558564 - protein, 8 aa, Mycobacterium
RDDDRGTE

SEQ ID NO: 558565 - protein, 10 aa, Mycobacterium
RDDDRGTETV

SEQ ID NO: 558566 - protein, 5 aa, Mycobacterium
RDDDT

SEQ ID NO: 558567 - protein, 7 aa, Mycobacterium
RDDEAKQ

SEQ ID NO: 558568 - protein, 6 aa, Mycobacterium
RDDEDA

SEQ ID NO: 558569 - protein, 9 aa, Mycobacterium
RDDEEARTR

SEQ ID NO: 558570 - protein, 15 aa, Mycobacterium
RDDEFGGSLENRAKV

SEQ ID NO: 558571 - protein, 13 aa, Mycobacterium
RDDEGPRPREATA

SEQ ID NO: 558572 - protein, 5 aa, Mycobacterium
RDDEL

SEQ ID NO: 558573 - protein, 9 aa, Mycobacterium
RDDENSRIT

SEQ ID NO: 558574 - protein, 5 aa, Mycobacterium
RDDES

SEQ ID NO: 558575 - protein, 6 aa, Mycobacterium
RDDESL

SEQ ID NO: 558576 - protein, 6 aa, Mycobacterium
RDDEVE

SEQ ID NO: 558577 - protein, 4 aa, Mycobacterium
RDDF

SEQ ID NO: 558578 - protein, 6 aa, Mycobacterium
RDDFPR

SEQ ID NO: 558579 - protein, 5 aa, Mycobacterium
RDDGA

SEQ ID NO: 558580 - protein, 10 aa, Mycobacterium
RDDGAGELGR

SEQ ID NO: 558581 - protein, 7 aa, Mycobacterium
RDDGAGT

SEQ ID NO: 558582 - protein, 25 aa, Mycobacterium
RDDGEHQQQIGGVERQPKPRRGRRV

SEQ ID NO: 558583 - protein, 9 aa, Mycobacterium
RDDGKTLVG

SEQ ID NO: 558584 - protein, 8 aa, Mycobacterium
RDDGPTDI

SEQ ID NO: 558585 - protein, 7 aa, Mycobacterium
RDDGRPP

SEQ ID NO: 558586 - protein, 6 aa, Mycobacterium
RDDGRT

SEQ ID NO: 558587 - protein, 18 aa, Mycobacterium
RDDGSFAPHDGKSSGELQ

SEQ ID NO: 558588 - protein, 9 aa, Mycobacterium
RDDGSSARN

SEQ ID NO: 558589 - protein, 9 aa, Mycobacterium
RDDGSTARN

SEQ ID NO: 558590 - protein, 8 aa, Mycobacterium
RDDGSWID

SEQ ID NO: 558591 - protein, 12 aa, Mycobacterium
RDDGTGNGGPVA

SEQ ID NO: 558592 - protein, 5 aa, Mycobacterium
RDDGY

SEQ ID NO: 558593 - protein, 12 aa, Mycobacterium
RDDKVPEDVRWE

SEQ ID NO: 558594 - protein, 4 aa, Mycobacterium
RDDL

SEQ ID NO: 558595 - protein, 5 aa, Mycobacterium
RDDLD

SEQ ID NO: 558596 - protein, 9 aa, Mycobacterium
RDDLDDAAL

SEQ ID NO: 558597 - protein, 9 aa, Mycobacterium
RDDLGRQPV

SEQ ID NO: 558598 - protein, 8 aa, Mycobacterium
RDDLKTPF

SEQ ID NO: 558599 - protein, 45 aa, Mycobacterium
RDDLQREGEAQQDKADAQREAAQKEAEAESARAAAKANEERQKAE

SEQ ID NO: 558600 - protein, 9 aa, Mycobacterium
RDDLSEKDL

SEQ ID NO: 558601 - protein, 6 aa, Mycobacterium
RDDMGG

SEQ ID NO: 558602 - protein, 6 aa, Mycobacterium
RDDMNS

SEQ ID NO: 558603 - protein, 7 aa, Mycobacterium
RDDMTQE

SEQ ID NO: 558604 - protein, 7 aa, Mycobacterium
RDDNNSR

SEQ ID NO: 558605 - protein, 5 aa, Mycobacterium
RDDNV

SEQ ID NO: 558606 - protein, 9 aa, Mycobacterium
RDDPAAVAP

SEQ ID NO: 558607 - protein, 10 aa, Mycobacterium
RDDPADAEVP

SEQ ID NO: 558608 - protein, 17 aa, Mycobacterium
RDDPAETATATFEIRTD

SEQ ID NO: 558609 - protein, 7 aa, Mycobacterium
RDDPAHA

SEQ ID NO: 558610 - protein, 8 aa, Mycobacterium
RDDPDAGH

SEQ ID NO: 558611 - protein, 16 aa, Mycobacterium
RDDPDRDDAHAADVAT

SEQ ID NO: 558612 - protein, 10 aa, Mycobacterium
RDDPDSVANA

SEQ ID NO: 558613 - protein, 6 aa, Mycobacterium
RDDPEF

SEQ ID NO: 558614 - protein, 7 aa, Mycobacterium
RDDPGAA

SEQ ID NO: 558615 - protein, 10 aa, Mycobacterium
RDDPGADTER

SEQ ID NO: 558616 - protein, 8 aa, Mycobacterium
RDDPGDVD

SEQ ID NO: 558617 - protein, 11 aa, Mycobacterium
RDDPGVPVQSG

SEQ ID NO: 558618 - protein, 7 aa, Mycobacterium
RDDPNAL

SEQ ID NO: 558619 - protein, 13 aa, Mycobacterium
RDDPNQAVASDPY

SEQ ID NO: 558620 - protein, 13 aa, Mycobacterium
RDDPNQPVAADPY

SEQ ID NO: 558621 - protein, 7 aa, Mycobacterium
RDDPPPI

SEQ ID NO: 558622 - protein, 9 aa, Mycobacterium
RDDPSSVDP

SEQ ID NO: 558623 - protein, 19 aa, Mycobacterium
RDDPSSVDPSWHEFLVDYN

SEQ ID NO: 558624 - protein, 13 aa, Mycobacterium
RDDPTAGAAASAA

SEQ ID NO: 558625 - protein, 15 aa, Mycobacterium
RDDPVDELEQPVFAW

SEQ ID NO: 558626 - protein, 15 aa, Mycobacterium
RDDPVNELEQPVFAW

SEQ ID NO: 558627 - protein, 11 aa, Mycobacterium
RDDQGHPARSK

SEQ ID NO: 558628 - protein, 13 aa, Mycobacterium
RDDQGRPTKSRQE

SEQ ID NO: 558629 - protein, 5 aa, Mycobacterium
RDDQL

SEQ ID NO: 558630 - protein, 11 aa, Mycobacterium
RDDQNHPTRSR

SEQ ID NO: 558631 - protein, 9 aa, Mycobacterium
RDDQNRSSI

SEQ ID NO: 558632 - protein, 8 aa, Mycobacterium
RDDQTPLG

SEQ ID NO: 558633 - protein, 9 aa, Mycobacterium
RDDRAATIT

SEQ ID NO: 558634 - protein, 7 aa, Mycobacterium
RDDRELA

SEQ ID NO: 558635 - protein, 7 aa, Mycobacterium
RDDRGTV

SEQ ID NO: 558636 - protein, 11 aa, Mycobacterium
RDDRKASFKRS

SEQ ID NO: 558637 - protein, 16 aa, Mycobacterium
RDDRPLKREGTADDVA

SEQ ID NO: 558638 - protein, 15 aa, Mycobacterium
RDDRPLKREGTPEDI

SEQ ID NO: 558639 - protein, 9 aa, Mycobacterium
RDDRRSDRR

SEQ ID NO: 558640 - protein, 4 aa, Mycobacterium
RDDS

SEQ ID NO: 558641 - protein, 7 aa, Mycobacterium
RDDSGAR

SEQ ID NO: 558642 - protein, 6 aa, Mycobacterium
RDDSGV

SEQ ID NO: 558643 - protein, 9 aa, Mycobacterium
RDDSPYPVR

SEQ ID NO: 558644 - protein, 8 aa, Mycobacterium
RDDSREAV

SEQ ID NO: 558645 - protein, 6 aa, Mycobacterium
RDDSTV

SEQ ID NO: 558646 - protein, 6 aa, Mycobacterium
RDDTDL

SEQ ID NO: 558647 - protein, 20 aa, Mycobacterium
RDDTGRHHEPTHRDSVTIGP

SEQ ID NO: 558648 - protein, 6 aa, Mycobacterium
RDDTPL

SEQ ID NO: 558649 - protein, 9 aa, Mycobacterium
RDDTQARQT

SEQ ID NO: 558650 - protein, 21 aa, Mycobacterium
RDDTRLKETATALSDAGSPEV

SEQ ID NO: 558651 - protein, 6 aa, Mycobacterium
RDDTSV

SEQ ID NO: 558652 - protein, 8 aa, Mycobacterium
RDDTVRDA

SEQ ID NO: 558653 - protein, 6 aa, Mycobacterium
RDDVDG

SEQ ID NO: 558654 - protein, 13 aa, Mycobacterium
RDDVGDGTSKANT

SEQ ID NO: 558655 - protein, 6 aa, Mycobacterium
RDDVPG

SEQ ID NO: 558656 - protein, 11 aa, Mycobacterium
RDDVTSKHRTL

SEQ ID NO: 558657 - protein, 8 aa, Mycobacterium
RDDYGGDL

SEQ ID NO: 558658 - protein, 8 aa, Mycobacterium
RDDYSGDM

SEQ ID NO: 558659 - protein, 6 aa, Mycobacterium
RDEAAT

SEQ ID NO: 558660 - protein, 5 aa, Mycobacterium
RDEAD

SEQ ID NO: 558661 - protein, 8 aa, Mycobacterium
RDEADDRP

SEQ ID NO: 558662 - protein, 11 aa, Mycobacterium
RDEAEAARGEA

SEQ ID NO: 558663 - protein, 13 aa, Mycobacterium
RDEAGKAGNMASA

SEQ ID NO: 558664 - protein, 13 aa, Mycobacterium
RDEAGKAPNIATA

SEQ ID NO: 558665 - protein, 6 aa, Mycobacterium
RDEAGP

SEQ ID NO: 558666 - protein, 7 aa, Mycobacterium
RDEAGTA

SEQ ID NO: 558667 - protein, 6 aa, Mycobacterium
RDEAKA

SEQ ID NO: 558668 - protein, 6 aa, Mycobacterium
RDEANR

SEQ ID NO: 558669 - protein, 7 aa, Mycobacterium
RDEANSV

SEQ ID NO: 558670 - protein, 8 aa, Mycobacterium
RDEAPRVS

SEQ ID NO: 558671 - protein, 8 aa, Mycobacterium
RDEAPSVK

SEQ ID NO: 558672 - protein, 8 aa, Mycobacterium
RDEAPSVR

SEQ ID NO: 558673 - protein, 8 aa, Mycobacterium
RDEAQRTG

SEQ ID NO: 558674 - protein, 8 aa, Mycobacterium
RDEARRAR

SEQ ID NO: 558675 - protein, 18 aa, Mycobacterium
RDEARRSARVDGVAGRPL

SEQ ID NO: 558676 - protein, 8 aa, Mycobacterium
RDEASSPM

SEQ ID NO: 558677 - protein, 8 aa, Mycobacterium
RDEATAQQ

SEQ ID NO: 558678 - protein, 8 aa, Mycobacterium
RDEAVEAG

SEQ ID NO: 558679 - protein, 5 aa, Mycobacterium
RDEDA

SEQ ID NO: 558680 - protein, 13 aa, Mycobacterium
RDEDDDPAARQWP

SEQ ID NO: 558681 - protein, 7 aa, Mycobacterium
RDEDELR

SEQ ID NO: 558682 - protein, 12 aa, Mycobacterium
RDEDGPAAGVDE

SEQ ID NO: 558683 - protein, 7 aa, Mycobacterium
RDEDGRW

SEQ ID NO: 558684 - protein, 9 aa, Mycobacterium
RDEDGSTFD

SEQ ID NO: 558685 - protein, 17 aa, Mycobacterium
RDEDKDATGSIGVDPDG

SEQ ID NO: 558686 - protein, 17 aa, Mycobacterium
RDEDKDAVGSAGTDPDG

SEQ ID NO: 558687 - protein, 8 aa, Mycobacterium
RDEDPEQG

SEQ ID NO: 558688 - protein, 5 aa, Mycobacterium
RDEDS

SEQ ID NO: 558689 - protein, 4 aa, Mycobacterium
RDEE

SEQ ID NO: 558690 - protein, 19 aa, Mycobacterium
RDEEETGRARRLADSTATP

SEQ ID NO: 558691 - protein, 6 aa, Mycobacterium
RDEEGR

SEQ ID NO: 558692 - protein, 12 aa, Mycobacterium
RDEEGRPKRSRQ

SEQ ID NO: 558693 - protein, 6 aa, Mycobacterium
RDEEIR

SEQ ID NO: 558694 - protein, 7 aa, Mycobacterium
RDEEKCS

SEQ ID NO: 558695 - protein, 8 aa, Mycobacterium
RDEELSAA

SEQ ID NO: 558696 - protein, 6 aa, Mycobacterium
RDEERH

SEQ ID NO: 558697 - protein, 5 aa, Mycobacterium
RDEES

SEQ ID NO: 558698 - protein, 6 aa, Mycobacterium
RDEESV

SEQ ID NO: 558699 - protein, 15 aa, Mycobacterium
RDEETGRPMSDDQVR

SEQ ID NO: 558700 - protein, 7 aa, Mycobacterium
RDEFPDK

SEQ ID NO: 558701 - protein, 7 aa, Mycobacterium
RDEFRGE

SEQ ID NO: 558702 - protein, 4 aa, Mycobacterium
RDEG

SEQ ID NO: 558703 - protein, 5 aa, Mycobacterium
RDEGA

SEQ ID NO: 558704 - protein, 6 aa, Mycobacterium
RDEGAG

SEQ ID NO: 558705 - protein, 7 aa, Mycobacterium
RDEGARL

SEQ ID NO: 558706 - protein, 11 aa, Mycobacterium
RDEGDRQPPSY

SEQ ID NO: 558707 - protein, 6 aa, Mycobacterium
RDEGHV

SEQ ID NO: 558708 - protein, 6 aa, Mycobacterium
RDEGIA

SEQ ID NO: 558709 - protein, 9 aa, Mycobacterium
RDEGPDSDF

SEQ ID NO: 558710 - protein, 16 aa, Mycobacterium
RDEGPKGVKAQIQGEE

SEQ ID NO: 558711 - protein, 5 aa, Mycobacterium
RDEGQ

SEQ ID NO: 558712 - protein, 7 aa, Mycobacterium
RDEGQTL

SEQ ID NO: 558713 - protein, 6 aa, Mycobacterium
RDEGRA

SEQ ID NO: 558714 - protein, 6 aa, Mycobacterium
RDEGRE

SEQ ID NO: 558715 - protein, 10 aa, Mycobacterium
RDEGSAPQHG

SEQ ID NO: 558716 - protein, 14 aa, Mycobacterium
RDEGTLTGRPGAQR

SEQ ID NO: 558717 - protein, 8 aa, Mycobacterium
RDEGTSAH

SEQ ID NO: 558718 - protein, 19 aa, Mycobacterium
RDEGYAAATSRRVAAEAGV

SEQ ID NO: 558719 - protein, 4 aa, Mycobacterium
RDEH

SEQ ID NO: 558720 - protein, 13 aa, Mycobacterium
RDEHAEEKDGRTL

SEQ ID NO: 558721 - protein, 8 aa, Mycobacterium
RDEHGTPQ

SEQ ID NO: 558722 - protein, 8 aa, Mycobacterium
RDEHPRAD

SEQ ID NO: 558723 - protein, 10 aa, Mycobacterium
RDEHPRTDLT

SEQ ID NO: 558724 - protein, 4 aa, Mycobacterium
RDEI

SEQ ID NO: 558725 - protein, 13 aa, Mycobacterium
RDEIDPDKRSVEP

SEQ ID NO: 558726 - protein, 12 aa, Mycobacterium
RDEIGQLYKAVG

SEQ ID NO: 558727 - protein, 12 aa, Mycobacterium
RDEIGSLYKAVG

SEQ ID NO: 558728 - protein, 7 aa, Mycobacterium
RDEITSG

SEQ ID NO: 558729 - protein, 4 aa, Mycobacterium
RDEK

SEQ ID NO: 558730 - protein, 4 aa, Mycobacterium
RDEL

SEQ ID NO: 558731 - protein, 5 aa, Mycobacterium
RDELA

SEQ ID NO: 558732 - protein, 8 aa, Mycobacterium
RDELARRK

SEQ ID NO: 558733 - protein, 7 aa, Mycobacterium
RDELDGA

SEQ ID NO: 558734 - protein, 8 aa, Mycobacterium
RDELDSAA

SEQ ID NO: 558735 - protein, 7 aa, Mycobacterium
RDELNGG

SEQ ID NO: 558736 - protein, 7 aa, Mycobacterium
RDELPAK

SEQ ID NO: 558737 - protein, 5 aa, Mycobacterium
RDELS

SEQ ID NO: 558738 - protein, 12 aa, Mycobacterium
RDELTRQQQGRR

SEQ ID NO: 558739 - protein, 4 aa, Mycobacterium
RDEM

SEQ ID NO: 558740 - protein, 7 aa, Mycobacterium
RDENPYP

SEQ ID NO: 558741 - protein, 7 aa, Mycobacterium
RDEPAQV

SEQ ID NO: 558742 - protein, 13 aa, Mycobacterium
RDEPARQLTEKSE

SEQ ID NO: 558743 - protein, 7 aa, Mycobacterium
RDEPEDA

SEQ ID NO: 558744 - protein, 14 aa, Mycobacterium
RDEPFGDHGRRASG

SEQ ID NO: 558745 - protein, 14 aa, Mycobacterium
RDEPFGDYGRKPTE

SEQ ID NO: 558746 - protein, 5 aa, Mycobacterium
RDEPG

SEQ ID NO: 558747 - protein, 10 aa, Mycobacterium
RDEPHADAEK

SEQ ID NO: 558748 - protein, 19 aa, Mycobacterium
RDEPNGRKSVPGWLLSAHL

SEQ ID NO: 558749 - protein, 7 aa, Mycobacterium
RDEPPLP

SEQ ID NO: 558750 - protein, 8 aa, Mycobacterium
RDEPPQAA

SEQ ID NO: 558751 - protein, 8 aa, Mycobacterium
RDEPPQEF

SEQ ID NO: 558752 - protein, 15 aa, Mycobacterium
RDEPRDDGDEDTECD

SEQ ID NO: 558753 - protein, 9 aa, Mycobacterium
RDEPRPQAT

SEQ ID NO: 558754 - protein, 6 aa, Mycobacterium
RDEPSL

SEQ ID NO: 558755 - protein, 15 aa, Mycobacterium
RDEQDGESAKPGEHT

SEQ ID NO: 558756 - protein, 7 aa, Mycobacterium
RDEQDPR

SEQ ID NO: 558757 - protein, 7 aa, Mycobacterium
RDEQEQL

SEQ ID NO: 558758 - protein, 9 aa, Mycobacterium
RDEQGKTGP

SEQ ID NO: 558759 - protein, 15 aa, Mycobacterium
RDEQQHHLSPTREID

SEQ ID NO: 558760 - protein, 9 aa, Mycobacterium
RDEQTKAMT

SEQ ID NO: 558761 - protein, 7 aa, Mycobacterium
RDERAHR

SEQ ID NO: 558762 - protein, 6 aa, Mycobacterium
RDERDI

SEQ ID NO: 558763 - protein, 7 aa, Mycobacterium
RDERDPR

SEQ ID NO: 558764 - protein, 10 aa, Mycobacterium
RDERDSAGDV

SEQ ID NO: 558765 - protein, 7 aa, Mycobacterium
RDERENG

SEQ ID NO: 558766 - protein, 12 aa, Mycobacterium
RDERGTRSTAAN

SEQ ID NO: 558767 - protein, 7 aa, Mycobacterium
RDERGVP

SEQ ID NO: 558768 - protein, 8 aa, Mycobacterium
RDERGVPP

SEQ ID NO: 558769 - protein, 11 aa, Mycobacterium
RDERQFGPDAG

SEQ ID NO: 558770 - protein, 11 aa, Mycobacterium
RDERRRANIES

SEQ ID NO: 558771 - protein, 7 aa, Mycobacterium
RDERRRH

SEQ ID NO: 558772 - protein, 13 aa, Mycobacterium
RDERRRRNIERNA

SEQ ID NO: 558773 - protein, 9 aa, Mycobacterium
RDERTDNAA

SEQ ID NO: 558774 - protein, 10 aa, Mycobacterium
RDERTDNAGF

SEQ ID NO: 558775 - protein, 10 aa, Mycobacterium
RDERTDNEGF

SEQ ID NO: 558776 - protein, 9 aa, Mycobacterium
RDERTGNAA

SEQ ID NO: 558777 - protein, 9 aa, Mycobacterium
RDESADDGI

SEQ ID NO: 558778 - protein, 12 aa, Mycobacterium
RDESARVNLQGT

SEQ ID NO: 558779 - protein, 5 aa, Mycobacterium
RDESD

SEQ ID NO: 558780 - protein, 8 aa, Mycobacterium
RDESDAAI

SEQ ID NO: 558781 - protein, 7 aa, Mycobacterium
RDESDLG

SEQ ID NO: 558782 - protein, 12 aa, Mycobacterium
RDESDRLGDGPL

SEQ ID NO: 558783 - protein, 13 aa, Mycobacterium
RDESDRLGDGPLD

SEQ ID NO: 558784 - protein, 7 aa, Mycobacterium
RDESGGL

SEQ ID NO: 558785 - protein, 10 aa, Mycobacterium
RDESGKPQIA

SEQ ID NO: 558786 - protein, 9 aa, Mycobacterium
RDESGQSTL

SEQ ID NO: 558787 - protein, 8 aa, Mycobacterium
RDESGVPT

SEQ ID NO: 558788 - protein, 9 aa, Mycobacterium
RDESIRPQD

SEQ ID NO: 558789 - protein, 6 aa, Mycobacterium
RDESTL

SEQ ID NO: 558790 - protein, 21 aa, Mycobacterium
RDETASLRTGNTIDVLPPFAG

SEQ ID NO: 558791 - protein, 8 aa, Mycobacterium
RDETERRV

SEQ ID NO: 558792 - protein, 5 aa, Mycobacterium
RDEVD

SEQ ID NO: 558793 - protein, 7 aa, Mycobacterium
RDEVGDS

SEQ ID NO: 558794 - protein, 14 aa, Mycobacterium
RDEYGGLARDGELR

SEQ ID NO: 558795 - protein, 6 aa, Mycobacterium
RDFADA

SEQ ID NO: 558796 - protein, 11 aa, Mycobacterium
RDFAGADPIAQ

SEQ ID NO: 558797 - protein, 16 aa, Mycobacterium
RDFDPATGAYSSAPLP

SEQ ID NO: 558798 - protein, 5 aa, Mycobacterium
RDFGG

SEQ ID NO: 558799 - protein, 8 aa, Mycobacterium
RDFGGRTG

SEQ ID NO: 558800 - protein, 8 aa, Mycobacterium
RDFGTADE

SEQ ID NO: 558801 - protein, 6 aa, Mycobacterium
RDFPGA

SEQ ID NO: 558802 - protein, 16 aa, Mycobacterium
RDFPSRDTTCNASPRE

SEQ ID NO: 558803 - protein, 5 aa, Mycobacterium
RDFSE

SEQ ID NO: 558804 - protein, 5 aa, Mycobacterium
RDFSP

SEQ ID NO: 558805 - protein, 6 aa, Mycobacterium
RDFTDR

SEQ ID NO: 558806 - protein, 10 aa, Mycobacterium
RDFTPKQEEA

SEQ ID NO: 558807 - protein, 6 aa, Mycobacterium
RDGAAD

SEQ ID NO: 558808 - protein, 17 aa, Mycobacterium
RDGAADGLQSRGADTVA

SEQ ID NO: 558809 - protein, 13 aa, Mycobacterium
RDGAAQVQDEGSQ

SEQ ID NO: 558810 - protein, 10 aa, Mycobacterium
RDGAARGEGR

SEQ ID NO: 558811 - protein, 17 aa, Mycobacterium
RDGADGDENAAARDQLT

SEQ ID NO: 558812 - protein, 12 aa, Mycobacterium
RDGADGRLSVVS

SEQ ID NO: 558813 - protein, 8 aa, Mycobacterium
RDGAELTE

SEQ ID NO: 558814 - protein, 23 aa, Mycobacterium
RDGAESAAEKGPQKGPQKGPRKG

SEQ ID NO: 558815 - protein, 6 aa, Mycobacterium
RDGAGE

SEQ ID NO: 558816 - protein, 7 aa, Mycobacterium
RDGAGHA

SEQ ID NO: 558817 - protein, 10 aa, Mycobacterium
RDGANGEPKQ

SEQ ID NO: 558818 - protein, 8 aa, Mycobacterium
RDGAPELY

SEQ ID NO: 558819 - protein, 7 aa, Mycobacterium
RDGAPGV

SEQ ID NO: 558820 - protein, 8 aa, Mycobacterium
RDGAPQLY

SEQ ID NO: 558821 - protein, 10 aa, Mycobacterium
RDGAQDDPID

SEQ ID NO: 558822 - protein, 6 aa, Mycobacterium
RDGAQE

SEQ ID NO: 558823 - protein, 6 aa, Mycobacterium
RDGAQQ

SEQ ID NO: 558824 - protein, 7 aa, Mycobacterium
RDGATDT

SEQ ID NO: 558825 - protein, 12 aa, Mycobacterium
RDGAVAATNIES

SEQ ID NO: 558826 - protein, 6 aa, Mycobacterium
RDGAVS

SEQ ID NO: 558827 - protein, 9 aa, Mycobacterium
RDGAVSADS

SEQ ID NO: 558828 - protein, 5 aa, Mycobacterium
RDGAY

SEQ ID NO: 558829 - protein, 6 aa, Mycobacterium
RDGCPS

SEQ ID NO: 558830 - protein, 6 aa, Mycobacterium
RDGDAA

SEQ ID NO: 558831 - protein, 7 aa, Mycobacterium
RDGDAAR

SEQ ID NO: 558832 - protein, 11 aa, Mycobacterium
RDGDAGAAHVN

SEQ ID NO: 558833 - protein, 7 aa, Mycobacterium
RDGDDDV

SEQ ID NO: 558834 - protein, 6 aa, Mycobacterium
RDGDDI

SEQ ID NO: 558835 - protein, 6 aa, Mycobacterium
RDGDDQ

SEQ ID NO: 558836 - protein, 7 aa, Mycobacterium
RDGDEES

SEQ ID NO: 558837 - protein, 18 aa, Mycobacterium
RDGDGPDARYRNTAETAR

SEQ ID NO: 558838 - protein, 7 aa, Mycobacterium
RDGDKIE

SEQ ID NO: 558839 - protein, 10 aa, Mycobacterium
RDGDKPPVEG

SEQ ID NO: 558840 - protein, 5 aa, Mycobacterium
RDGDL

SEQ ID NO: 558841 - protein, 9 aa, Mycobacterium
RDGDPPNCG

SEQ ID NO: 558842 - protein, 9 aa, Mycobacterium
RDGDREPVE

SEQ ID NO: 558843 - protein, 9 aa, Mycobacterium
RDGDRERSV

SEQ ID NO: 558844 - protein, 7 aa, Mycobacterium
RDGDRIT

SEQ ID NO: 558845 - protein, 5 aa, Mycobacterium
RDGDS

SEQ ID NO: 558846 - protein, 9 aa, Mycobacterium
RDGDSVAAA

SEQ ID NO: 558847 - protein, 9 aa, Mycobacterium
RDGDTDPVE

SEQ ID NO: 558848 - protein, 14 aa, Mycobacterium
RDGDTDTGSQWSPN

SEQ ID NO: 558849 - protein, 12 aa, Mycobacterium
RDGDVTTATASI

SEQ ID NO: 558850 - protein, 13 aa, Mycobacterium
RDGDVTTATDSIT

SEQ ID NO: 558851 - protein, 5 aa, Mycobacterium
RDGEA

SEQ ID NO: 558852 - protein, 7 aa, Mycobacterium
RDGEAAG

SEQ ID NO: 558853 - protein, 8 aa, Mycobacterium
RDGEAGAS

SEQ ID NO: 558854 - protein, 10 aa, Mycobacterium
RDGEAGDRYT

SEQ ID NO: 558855 - protein, 10 aa, Mycobacterium
RDGEAIRTGR

SEQ ID NO: 558856 - protein, 6 aa, Mycobacterium
RDGEAL

SEQ ID NO: 558857 - protein, 6 aa, Mycobacterium
RDGEAT

SEQ ID NO: 558858 - protein, 12 aa, Mycobacterium
RDGEATVDTSSR

SEQ ID NO: 558859 - protein, 6 aa, Mycobacterium
RDGEDV

SEQ ID NO: 558860 - protein, 5 aa, Mycobacterium
RDGEE

SEQ ID NO: 558861 - protein, 6 aa, Mycobacterium
RDGEEI

SEQ ID NO: 558862 - protein, 5 aa, Mycobacterium
RDGEG

SEQ ID NO: 558863 - protein, 7 aa, Mycobacterium
RDGEHGR

SEQ ID NO: 558864 - protein, 7 aa, Mycobacterium
RDGEIDA

SEQ ID NO: 558865 - protein, 7 aa, Mycobacterium
RDGEIDE

SEQ ID NO: 558866 - protein, 8 aa, Mycobacterium
RDGEIDPS

SEQ ID NO: 558867 - protein, 5 aa, Mycobacterium
RDGEK

SEQ ID NO: 558868 - protein, 8 aa, Mycobacterium
RDGEPARV

SEQ ID NO: 558869 - protein, 5 aa, Mycobacterium
RDGEQ

SEQ ID NO: 558870 - protein, 7 aa, Mycobacterium
RDGEQTH

SEQ ID NO: 558871 - protein, 12 aa, Mycobacterium
RDGEQVRYPPAQ

SEQ ID NO: 558872 - protein, 7 aa, Mycobacterium
RDGERVT

SEQ ID NO: 558873 - protein, 5 aa, Mycobacterium
RDGEV

SEQ ID NO: 558874 - protein, 8 aa, Mycobacterium
RDGEWSTN

SEQ ID NO: 558875 - protein, 10 aa, Mycobacterium
RDGFDQSDDP

SEQ ID NO: 558876 - protein, 16 aa, Mycobacterium
RDGGDAGEIAWLSRGV

SEQ ID NO: 558877 - protein, 9 aa, Mycobacterium
RDGGEAGSG

SEQ ID NO: 558878 - protein, 9 aa, Mycobacterium
RDGGELGDQ

SEQ ID NO: 558879 - protein, 15 aa, Mycobacterium
RDGGERYAGKGVQKA

SEQ ID NO: 558880 - protein, 12 aa, Mycobacterium
RDGGERYGGKGV

SEQ ID NO: 558881 - protein, 11 aa, Mycobacterium
RDGGETVSRKT

SEQ ID NO: 558882 - protein, 30 aa, Mycobacterium
RDGGGAADGSARCRAAQRPKTAAAHPRSGL

SEQ ID NO: 558883 - protein, 5 aa, Mycobacterium
RDGGH

SEQ ID NO: 558884 - protein, 6 aa, Mycobacterium
RDGGIN

SEQ ID NO: 558885 - protein, 7 aa, Mycobacterium
RDGGIND

SEQ ID NO: 558886 - protein, 5 aa, Mycobacterium
RDGGL

SEQ ID NO: 558887 - protein, 8 aa, Mycobacterium
RDGGLASG

SEQ ID NO: 558888 - protein, 10 aa, Mycobacterium
RDGGLKQGRP

SEQ ID NO: 558889 - protein, 9 aa, Mycobacterium
RDGGPTEQK

SEQ ID NO: 558890 - protein, 7 aa, Mycobacterium
RDGGPVE

SEQ ID NO: 558891 - protein, 7 aa, Mycobacterium
RDGGQVD

SEQ ID NO: 558892 - protein, 8 aa, Mycobacterium
RDGGRGQH

SEQ ID NO: 558893 - protein, 6 aa, Mycobacterium
RDGGRS

SEQ ID NO: 558894 - protein, 6 aa, Mycobacterium
RDGGRV

SEQ ID NO: 558895 - protein, 6 aa, Mycobacterium
RDGGSA

SEQ ID NO: 558896 - protein, 9 aa, Mycobacterium
RDGGSAADA

SEQ ID NO: 558897 - protein, 15 aa, Mycobacterium
RDGGSRYGGKGVEKA

SEQ ID NO: 558898 - protein, 9 aa, Mycobacterium
RDGGSRYLG

SEQ ID NO: 558899 - protein, 8 aa, Mycobacterium
RDGGTAAD

SEQ ID NO: 558900 - protein, 7 aa, Mycobacterium
RDGGTNL

SEQ ID NO: 558901 - protein, 5 aa, Mycobacterium
RDGGV

SEQ ID NO: 558902 - protein, 7 aa, Mycobacterium
RDGGVAS

SEQ ID NO: 558903 - protein, 9 aa, Mycobacterium
RDGGVGAGS

SEQ ID NO: 558904 - protein, 14 aa, Mycobacterium
RDGGYRDDSELAAR

SEQ ID NO: 558905 - protein, 6 aa, Mycobacterium
RDGGYT

SEQ ID NO: 558906 - protein, 4 aa, Mycobacterium
RDGH

SEQ ID NO: 558907 - protein, 7 aa, Mycobacterium
RDGHGGA

SEQ ID NO: 558908 - protein, 8 aa, Mycobacterium
RDGHGVPG

SEQ ID NO: 558909 - protein, 19 aa, Mycobacterium
RDGHPEFRRPGEPQPPFGD

SEQ ID NO: 558910 - protein, 5 aa, Mycobacterium
RDGHQ

SEQ ID NO: 558911 - protein, 11 aa, Mycobacterium
RDGHQSRRGHR

SEQ ID NO: 558912 - protein, 6 aa, Mycobacterium
RDGHRN

SEQ ID NO: 558913 - protein, 9 aa, Mycobacterium
RDGHRSPRL

SEQ ID NO: 558914 - protein, 7 aa, Mycobacterium
RDGHSDY

SEQ ID NO: 558915 - protein, 4 aa, Mycobacterium
RDGI

SEQ ID NO: 558916 - protein, 13 aa, Mycobacterium
RDGIPTAAPLGPE

SEQ ID NO: 558917 - protein, 5 aa, Mycobacterium
RDGIR

SEQ ID NO: 558918 - protein, 8 aa, Mycobacterium
RDGISENE

SEQ ID NO: 558919 - protein, 6 aa, Mycobacterium
RDGITE

SEQ ID NO: 558920 - protein, 5 aa, Mycobacterium
RDGKF

SEQ ID NO: 558921 - protein, 13 aa, Mycobacterium
RDGKPEDPAGGSQ

SEQ ID NO: 558922 - protein, 7 aa, Mycobacterium
RDGKPVA

SEQ ID NO: 558923 - protein, 5 aa, Mycobacterium
RDGKR

SEQ ID NO: 558924 - protein, 5 aa, Mycobacterium
RDGLA

SEQ ID NO: 558925 - protein, 12 aa, Mycobacterium
RDGLDPRQPTRV

SEQ ID NO: 558926 - protein, 6 aa, Mycobacterium
RDGLKS

SEQ ID NO: 558927 - protein, 6 aa, Mycobacterium
RDGLPD

SEQ ID NO: 558928 - protein, 9 aa, Mycobacterium
RDGLPPPAI

SEQ ID NO: 558929 - protein, 5 aa, Mycobacterium
RDGLQ

SEQ ID NO: 558930 - protein, 5 aa, Mycobacterium
RDGLR

SEQ ID NO: 558931 - protein, 9 aa, Mycobacterium
RDGLTPATL

SEQ ID NO: 558932 - protein, 6 aa, Mycobacterium
RDGMPS

SEQ ID NO: 558933 - protein, 5 aa, Mycobacterium
RDGNA

SEQ ID NO: 558934 - protein, 9 aa, Mycobacterium
RDGNDPSLE

SEQ ID NO: 558935 - protein, 8 aa, Mycobacterium
RDGNFGNP

SEQ ID NO: 558936 - protein, 11 aa, Mycobacterium
RDGNGNYSVSV

SEQ ID NO: 558937 - protein, 5 aa, Mycobacterium
RDGNI

SEQ ID NO: 558938 - protein, 6 aa, Mycobacterium
RDGNPV

SEQ ID NO: 558939 - protein, 14 aa, Mycobacterium
RDGNRGPTAAPQGL

SEQ ID NO: 558940 - protein, 13 aa, Mycobacterium
RDGNRGPTAAPQN

SEQ ID NO: 558941 - protein, 6 aa, Mycobacterium
RDGNST

SEQ ID NO: 558942 - protein, 7 aa, Mycobacterium
RDGNTEP

SEQ ID NO: 558943 - protein, 20 aa, Mycobacterium
RDGNTSPWRSAGTAQRRGRA

SEQ ID NO: 558944 - protein, 7 aa, Mycobacterium
RDGPAAA

SEQ ID NO: 558945 - protein, 7 aa, Mycobacterium
RDGPAEA

SEQ ID NO: 558946 - protein, 8 aa, Mycobacterium
RDGPDAGL

SEQ ID NO: 558947 - protein, 7 aa, Mycobacterium
RDGPDVE

SEQ ID NO: 558948 - protein, 8 aa, Mycobacterium
RDGPGAGL

SEQ ID NO: 558949 - protein, 7 aa, Mycobacterium
RDGPGGG

SEQ ID NO: 558950 - protein, 7 aa, Mycobacterium
RDGPGGP

SEQ ID NO: 558951 - protein, 7 aa, Mycobacterium
RDGPGHA

SEQ ID NO: 558952 - protein, 6 aa, Mycobacterium
RDGPHG

SEQ ID NO: 558953 - protein, 7 aa, Mycobacterium
RDGPLAA

SEQ ID NO: 558954 - protein, 7 aa, Mycobacterium
RDGPPEV

SEQ ID NO: 558955 - protein, 5 aa, Mycobacterium
RDGPR

SEQ ID NO: 558956 - protein, 9 aa, Mycobacterium
RDGPTATAF

SEQ ID NO: 558957 - protein, 20 aa, Mycobacterium
RDGPVKASRYDRGKPRRKRI

SEQ ID NO: 558958 - protein, 4 aa, Mycobacterium
RDGQ

SEQ ID NO: 558959 - protein, 7 aa, Mycobacterium
RDGQAVG

SEQ ID NO: 558960 - protein, 6 aa, Mycobacterium
RDGQEG

SEQ ID NO: 558961 - protein, 8 aa, Mycobacterium
RDGQEVPD

SEQ ID NO: 558962 - protein, 14 aa, Mycobacterium
RDGQGIALNEDLHA

SEQ ID NO: 558963 - protein, 7 aa, Mycobacterium
RDGQLAG

SEQ ID NO: 558964 - protein, 6 aa, Mycobacterium
RDGQNK

SEQ ID NO: 558965 - protein, 15 aa, Mycobacterium
RDGQPLANLVNQPTG

SEQ ID NO: 558966 - protein, 12 aa, Mycobacterium
RDGQPVGEGEPG

SEQ ID NO: 558967 - protein, 18 aa, Mycobacterium
RDGQRRHPSDNTDEPERA

SEQ ID NO: 558968 - protein, 7 aa, Mycobacterium
RDGQTVG

SEQ ID NO: 558969 - protein, 7 aa, Mycobacterium
RDGRAAV

SEQ ID NO: 558970 - protein, 8 aa, Mycobacterium
RDGRADET

SEQ ID NO: 558971 - protein, 16 aa, Mycobacterium
RDGRADPGGDLPVNTD

SEQ ID NO: 558972 - protein, 17 aa, Mycobacterium
RDGRADPGGDLPVNTDG

SEQ ID NO: 558973 - protein, 6 aa, Mycobacterium
RDGRAE

SEQ ID NO: 558974 - protein, 6 aa, Mycobacterium
RDGRAS

SEQ ID NO: 558975 - protein, 8 aa, Mycobacterium
RDGRATGV

SEQ ID NO: 558976 - protein, 9 aa, Mycobacterium
RDGRDDSGF

SEQ ID NO: 558977 - protein, 9 aa, Mycobacterium
RDGRDGSGL

SEQ ID NO: 558978 - protein, 9 aa, Mycobacterium
RDGRDGTGC

SEQ ID NO: 558979 - protein, 9 aa, Mycobacterium
RDGRGLDDG

SEQ ID NO: 558980 - protein, 9 aa, Mycobacterium
RDGRHATTE

SEQ ID NO: 558981 - protein, 10 aa, Mycobacterium
RDGRHSTTEV

SEQ ID NO: 558982 - protein, 5 aa, Mycobacterium
RDGRI

SEQ ID NO: 558983 - protein, 6 aa, Mycobacterium
RDGRIR

SEQ ID NO: 558984 - protein, 6 aa, Mycobacterium
RDGRKR

SEQ ID NO: 558985 - protein, 5 aa, Mycobacterium
RDGRN

SEQ ID NO: 558986 - protein, 12 aa, Mycobacterium
RDGRNQGYAPAT

SEQ ID NO: 558987 - protein, 5 aa, Mycobacterium
RDGRP

SEQ ID NO: 558988 - protein, 14 aa, Mycobacterium
RDGRPIAPGPRPRL

SEQ ID NO: 558989 - protein, 11 aa, Mycobacterium
RDGRPSTTPAF

SEQ ID NO: 558990 - protein, 9 aa, Mycobacterium
RDGRPTVAG

SEQ ID NO: 558991 - protein, 5 aa, Mycobacterium
RDGRR

SEQ ID NO: 558992 - protein, 5 aa, Mycobacterium
RDGRT

SEQ ID NO: 558993 - protein, 9 aa, Mycobacterium
RDGRTLPDA

SEQ ID NO: 558994 - protein, 4 aa, Mycobacterium
RDGS

SEQ ID NO: 558995 - protein, 5 aa, Mycobacterium
RDGSA

SEQ ID NO: 558996 - protein, 9 aa, Mycobacterium
RDGSANRRT

SEQ ID NO: 558997 - protein, 7 aa, Mycobacterium
RDGSDVT

SEQ ID NO: 558998 - protein, 5 aa, Mycobacterium
RDGSE

SEQ ID NO: 558999 - protein, 9 aa, Mycobacterium
RDGSEEYLD

SEQ ID NO: 559000 - protein, 8 aa, Mycobacterium
RDGSGVDS

SEQ ID NO: 559001 - protein, 14 aa, Mycobacterium
RDGSGVRRGPRERH

SEQ ID NO: 559002 - protein, 7 aa, Mycobacterium
RDGSLRS

SEQ ID NO: 559003 - protein, 8 aa, Mycobacterium
RDGSPADM

SEQ ID NO: 559004 - protein, 7 aa, Mycobacterium
RDGSPQV

SEQ ID NO: 559005 - protein, 13 aa, Mycobacterium
RDGSPWPNTQPTM

SEQ ID NO: 559006 - protein, 16 aa, Mycobacterium
RDGSRAEHDAAEQSPF

SEQ ID NO: 559007 - protein, 6 aa, Mycobacterium
RDGSRY

SEQ ID NO: 559008 - protein, 17 aa, Mycobacterium
RDGSSCRDAGRGGLRGG

SEQ ID NO: 559009 - protein, 12 aa, Mycobacterium
RDGSSTTATSTA

SEQ ID NO: 559010 - protein, 8 aa, Mycobacterium
RDGSTPAA

SEQ ID NO: 559011 - protein, 7 aa, Mycobacterium
RDGSVRV

SEQ ID NO: 559012 - protein, 5 aa, Mycobacterium
RDGTA

SEQ ID NO: 559013 - protein, 6 aa, Mycobacterium
RDGTAD

SEQ ID NO: 559014 - protein, 10 aa, Mycobacterium
RDGTADRPTT

SEQ ID NO: 559015 - protein, 9 aa, Mycobacterium
RDGTAERRT

SEQ ID NO: 559016 - protein, 7 aa, Mycobacterium
RDGTAGR

SEQ ID NO: 559017 - protein, 9 aa, Mycobacterium
RDGTAGRRA

SEQ ID NO: 559018 - protein, 6 aa, Mycobacterium
RDGTAH

SEQ ID NO: 559019 - protein, 9 aa, Mycobacterium
RDGTAHRRT

SEQ ID NO: 559020 - protein, 7 aa, Mycobacterium
RDGTANR

SEQ ID NO: 559021 - protein, 8 aa, Mycobacterium
RDGTANRL

SEQ ID NO: 559022 - protein, 9 aa, Mycobacterium
RDGTANRRT

SEQ ID NO: 559023 - protein, 9 aa, Mycobacterium
RDGTAPPLL

SEQ ID NO: 559024 - protein, 7 aa, Mycobacterium
RDGTAVD

SEQ ID NO: 559025 - protein, 13 aa, Mycobacterium
RDGTDDEDDDLAA

SEQ ID NO: 559026 - protein, 9 aa, Mycobacterium
RDGTDQLSE

SEQ ID NO: 559027 - protein, 7 aa, Mycobacterium
RDGTDSV

SEQ ID NO: 559028 - protein, 16 aa, Mycobacterium
RDGTDVETWPQLTGWT

SEQ ID NO: 559029 - protein, 8 aa, Mycobacterium
RDGTEKFG

SEQ ID NO: 559030 - protein, 7 aa, Mycobacterium
RDGTERE

SEQ ID NO: 559031 - protein, 6 aa, Mycobacterium
RDGTGM

SEQ ID NO: 559032 - protein, 13 aa, Mycobacterium
RDGTHSGNAPADA

SEQ ID NO: 559033 - protein, 8 aa, Mycobacterium
RDGTLEPD

SEQ ID NO: 559034 - protein, 8 aa, Mycobacterium
RDGTLSHE

SEQ ID NO: 559035 - protein, 5 aa, Mycobacterium
RDGTN

SEQ ID NO: 559036 - protein, 7 aa, Mycobacterium
RDGTPAV

SEQ ID NO: 559037 - protein, 7 aa, Mycobacterium
RDGTPMR

SEQ ID NO: 559038 - protein, 7 aa, Mycobacterium
RDGTPVD

SEQ ID NO: 559039 - protein, 5 aa, Mycobacterium
RDGTT

SEQ ID NO: 559040 - protein, 5 aa, Mycobacterium
RDGTV

SEQ ID NO: 559041 - protein, 7 aa, Mycobacterium
RDGTVSD

SEQ ID NO: 559042 - protein, 5 aa, Mycobacterium
RDGVA

SEQ ID NO: 559043 - protein, 12 aa, Mycobacterium
RDGVAESTNASV

SEQ ID NO: 559044 - protein, 5 aa, Mycobacterium
RDGVD

SEQ ID NO: 559045 - protein, 8 aa, Mycobacterium
RDGVDPGA

SEQ ID NO: 559046 - protein, 10 aa, Mycobacterium
RDGVDTGVGG

SEQ ID NO: 559047 - protein, 5 aa, Mycobacterium
RDGVH

SEQ ID NO: 559048 - protein, 12 aa, Mycobacterium
RDGVKDTAEAAR

SEQ ID NO: 559049 - protein, 12 aa, Mycobacterium
RDGVKDTTEAAR

SEQ ID NO: 559050 - protein, 10 aa, Mycobacterium
RDGVPDSPGG

SEQ ID NO: 559051 - protein, 8 aa, Mycobacterium
RDGVSRTP

SEQ ID NO: 559052 - protein, 9 aa, Mycobacterium
RDGVSRTPV

SEQ ID NO: 559053 - protein, 8 aa, Mycobacterium
RDGVTTEV

SEQ ID NO: 559054 - protein, 5 aa, Mycobacterium
RDGWP

SEQ ID NO: 559055 - protein, 6 aa, Mycobacterium
RDGWPD

SEQ ID NO: 559056 - protein, 14 aa, Mycobacterium
RDGYAESDKNWTRR

SEQ ID NO: 559057 - protein, 5 aa, Mycobacterium
RDGYE

SEQ ID NO: 559058 - protein, 6 aa, Mycobacterium
RDGYEG

SEQ ID NO: 559059 - protein, 11 aa, Mycobacterium
RDGYGQTVQSG

SEQ ID NO: 559060 - protein, 10 aa, Mycobacterium
RDGYGQTVRS

SEQ ID NO: 559061 - protein, 11 aa, Mycobacterium
RDGYGQTVTSG

SEQ ID NO: 559062 - protein, 13 aa, Mycobacterium
RDGYGRTVKSGRY

SEQ ID NO: 559063 - protein, 7 aa, Mycobacterium
RDGYTNA

SEQ ID NO: 559064 - protein, 6 aa, Mycobacterium
RDGYVN

SEQ ID NO: 559065 - protein, 5 aa, Mycobacterium
RDHAR

SEQ ID NO: 559066 - protein, 8 aa, Mycobacterium
RDHDASRA

SEQ ID NO: 559067 - protein, 8 aa, Mycobacterium
RDHDGGKT

SEQ ID NO: 559068 - protein, 5 aa, Mycobacterium
RDHGA

SEQ ID NO: 559069 - protein, 7 aa, Mycobacterium
RDHGGPA

SEQ ID NO: 559070 - protein, 15 aa, Mycobacterium
RDHHSETAATTPGPA

SEQ ID NO: 559071 - protein, 8 aa, Mycobacterium
RDHNDTVD

SEQ ID NO: 559072 - protein, 4 aa, Mycobacterium
RDHP

SEQ ID NO: 559073 - protein, 5 aa, Mycobacterium
RDHPD

SEQ ID NO: 559074 - protein, 6 aa, Mycobacterium
RDHPDF

SEQ ID NO: 559075 - protein, 6 aa, Mycobacterium
RDHPEK

SEQ ID NO: 559076 - protein, 6 aa, Mycobacterium
RDHPGE

SEQ ID NO: 559077 - protein, 6 aa, Mycobacterium
RDHPGV

SEQ ID NO: 559078 - protein, 8 aa, Mycobacterium
RDHPHPAR

SEQ ID NO: 559079 - protein, 13 aa, Mycobacterium
RDHPVSQSGAKTQ

SEQ ID NO: 559080 - protein, 4 aa, Mycobacterium
RDHR

SEQ ID NO: 559081 - protein, 6 aa, Mycobacterium
RDHRKY

SEQ ID NO: 559082 - protein, 12 aa, Mycobacterium
RDHRQELTPEQV

SEQ ID NO: 559083 - protein, 10 aa, Mycobacterium
RDHRQFPPDG

SEQ ID NO: 559084 - protein, 8 aa, Mycobacterium
RDHRTVPP

SEQ ID NO: 559085 - protein, 17 aa, Mycobacterium
RDHSGGGVGGTKGSLAH

SEQ ID NO: 559086 - protein, 9 aa, Mycobacterium
RDHSTQSTV

SEQ ID NO: 559087 - protein, 7 aa, Mycobacterium
RDHTRRK

SEQ ID NO: 559088 - protein, 4 aa, Mycobacterium
RDIA

SEQ ID NO: 559089 - protein, 11 aa, Mycobacterium
RDIAAGGQGAP

SEQ ID NO: 559090 - protein, 13 aa, Mycobacterium
RDIAEDTKQPVER

SEQ ID NO: 559091 - protein, 10 aa, Mycobacterium
RDIDAARAEK

SEQ ID NO: 559092 - protein, 7 aa, Mycobacterium
RDIEAGT

SEQ ID NO: 559093 - protein, 14 aa, Mycobacterium
RDIEEQVADPDGRL

SEQ ID NO: 559094 - protein, 11 aa, Mycobacterium
RDIEGSAADEI

SEQ ID NO: 559095 - protein, 4 aa, Mycobacterium
RDIN

SEQ ID NO: 559096 - protein, 5 aa, Mycobacterium
RDING

SEQ ID NO: 559097 - protein, 8 aa, Mycobacterium
RDINPSKQ

SEQ ID NO: 559098 - protein, 7 aa, Mycobacterium
RDINPSR

SEQ ID NO: 559099 - protein, 8 aa, Mycobacterium
RDINPSRQ

SEQ ID NO: 559100 - protein, 7 aa, Mycobacterium
RDINPTE

SEQ ID NO: 559101 - protein, 5 aa, Mycobacterium
RDIPL

SEQ ID NO: 559102 - protein, 10 aa, Mycobacterium
RDIPSDDDAA

SEQ ID NO: 559103 - protein, 8 aa, Mycobacterium
RDIQRDEM

SEQ ID NO: 559104 - protein, 12 aa, Mycobacterium
RDITASGRSSIA

SEQ ID NO: 559105 - protein, 5 aa, Mycobacterium
RDITG

SEQ ID NO: 559106 - protein, 6 aa, Mycobacterium
RDITSR

SEQ ID NO: 559107 - protein, 9 aa, Mycobacterium
RDKAAAENL

SEQ ID NO: 559108 - protein, 13 aa, Mycobacterium
RDKATLPGPGGAA

SEQ ID NO: 559109 - protein, 7 aa, Mycobacterium
RDKDGGD

SEQ ID NO: 559110 - protein, 6 aa, Mycobacterium
RDKDGL

SEQ ID NO: 559111 - protein, 9 aa, Mycobacterium
RDKDGRYHG

SEQ ID NO: 559112 - protein, 5 aa, Mycobacterium
RDKDL

SEQ ID NO: 559113 - protein, 8 aa, Mycobacterium
RDKDPDYG

SEQ ID NO: 559114 - protein, 4 aa, Mycobacterium
RDKE

SEQ ID NO: 559115 - protein, 6 aa, Mycobacterium
RDKEDL

SEQ ID NO: 559116 - protein, 6 aa, Mycobacterium
RDKERL

SEQ ID NO: 559117 - protein, 20 aa, Mycobacterium
RDKGAESAIDGAGLQESDPA

SEQ ID NO: 559118 - protein, 8 aa, Mycobacterium
RDKGGDAF

SEQ ID NO: 559119 - protein, 9 aa, Mycobacterium
RDKGRANDR

SEQ ID NO: 559120 - protein, 4 aa, Mycobacterium
RDKH

SEQ ID NO: 559121 - protein, 7 aa, Mycobacterium
RDKHESA

SEQ ID NO: 559122 - protein, 8 aa, Mycobacterium
RDKIAESG

SEQ ID NO: 559123 - protein, 6 aa, Mycobacterium
RDKKVR

SEQ ID NO: 559124 - protein, 8 aa, Mycobacterium
RDKLEDET

SEQ ID NO: 559125 - protein, 7 aa, Mycobacterium
RDKLGGT

SEQ ID NO: 559126 - protein, 7 aa, Mycobacterium
RDKNPDL

SEQ ID NO: 559127 - protein, 19 aa, Mycobacterium
RDKPDHSDTVEGSLEDRGF

SEQ ID NO: 559128 - protein, 11 aa, Mycobacterium
RDKPRSPEGLK

SEQ ID NO: 559129 - protein, 10 aa, Mycobacterium
RDKRDKRLPR

SEQ ID NO: 559130 - protein, 9 aa, Mycobacterium
RDKSAARTA

SEQ ID NO: 559131 - protein, 19 aa, Mycobacterium
RDKSGEEAAEWERQEEAAY

SEQ ID NO: 559132 - protein, 10 aa, Mycobacterium
RDKSKGLEQE

SEQ ID NO: 559133 - protein, 14 aa, Mycobacterium
RDKTGKGQKVSASM

SEQ ID NO: 559134 - protein, 9 aa, Mycobacterium
RDKTTDLAP

SEQ ID NO: 559135 - protein, 9 aa, Mycobacterium
RDLAAGADD

SEQ ID NO: 559136 - protein, 13 aa, Mycobacterium
RDLADARAAGGAD

SEQ ID NO: 559137 - protein, 8 aa, Mycobacterium
RDLADPSV

SEQ ID NO: 559138 - protein, 7 aa, Mycobacterium
RDLAGQG

SEQ ID NO: 559139 - protein, 9 aa, Mycobacterium
RDLASPGDT

SEQ ID NO: 559140 - protein, 18 aa, Mycobacterium
RDLDDDAHADRSGDLADE

SEQ ID NO: 559141 - protein, 6 aa, Mycobacterium
RDLDEL

SEQ ID NO: 559142 - protein, 8 aa, Mycobacterium
RDLEAGTV

SEQ ID NO: 559143 - protein, 5 aa, Mycobacterium
RDLGD

SEQ ID NO: 559144 - protein, 6 aa, Mycobacterium
RDLGDP

SEQ ID NO: 559145 - protein, 7 aa, Mycobacterium
RDLGPGA

SEQ ID NO: 559146 - protein, 5 aa, Mycobacterium
RDLNP

SEQ ID NO: 559147 - protein, 5 aa, Mycobacterium
RDLPA

SEQ ID NO: 559148 - protein, 11 aa, Mycobacterium
RDLPDDSWRNE

SEQ ID NO: 559149 - protein, 6 aa, Mycobacterium
RDLPET

SEQ ID NO: 559150 - protein, 9 aa, Mycobacterium
RDLPGEKTM

SEQ ID NO: 559151 - protein, 17 aa, Mycobacterium
RDLPGEKTMQRYGDDDE

SEQ ID NO: 559152 - protein, 17 aa, Mycobacterium
RDLPGESTMRRYSDDEE

SEQ ID NO: 559153 - protein, 4 aa, Mycobacterium
RDLQ

SEQ ID NO: 559154 - protein, 4 aa, Mycobacterium
RDLR

SEQ ID NO: 559155 - protein, 10 aa, Mycobacterium
RDLRARAESG

SEQ ID NO: 559156 - protein, 13 aa, Mycobacterium
RDLRGGNYPQVPS

SEQ ID NO: 559157 - protein, 6 aa, Mycobacterium
RDLRPT

SEQ ID NO: 559158 - protein, 8 aa, Mycobacterium
RDLRQPPV

SEQ ID NO: 559159 - protein, 5 aa, Mycobacterium
RDLRT

SEQ ID NO: 559160 - protein, 14 aa, Mycobacterium
RDLRTGAEYEPGTR

SEQ ID NO: 559161 - protein, 13 aa, Mycobacterium
RDLSAGNYPQVPS

SEQ ID NO: 559162 - protein, 6 aa, Mycobacterium
RDLSDD

SEQ ID NO: 559163 - protein, 17 aa, Mycobacterium
RDLSDRRNRARELAQEA

SEQ ID NO: 559164 - protein, 10 aa, Mycobacterium
RDLSPEAIGG

SEQ ID NO: 559165 - protein, 7 aa, Mycobacterium
RDLSPKA

SEQ ID NO: 559166 - protein, 9 aa, Mycobacterium
RDLSTSNFP

SEQ ID NO: 559167 - protein, 10 aa, Mycobacterium
RDLSTSNFPQ

SEQ ID NO: 559168 - protein, 5 aa, Mycobacterium
RDLTD

SEQ ID NO: 559169 - protein, 8 aa, Mycobacterium
RDLTEEQR

SEQ ID NO: 559170 - protein, 23 aa, Mycobacterium
RDLTPAQWGDGGSATFTSRDTDY

SEQ ID NO: 559171 - protein, 5 aa, Mycobacterium
RDMAP

SEQ ID NO: 559172 - protein, 13 aa, Mycobacterium
RDMPDTPRPPLAE

SEQ ID NO: 559173 - protein, 5 aa, Mycobacterium
RDMPH

SEQ ID NO: 559174 - protein, 14 aa, Mycobacterium
RDNAAKMQQRIKDR

SEQ ID NO: 559175 - protein, 13 aa, Mycobacterium
RDNADDAPETRSE

SEQ ID NO: 559176 - protein, 26 aa, Mycobacterium
RDNATRPTPGSYTKSIDELEEMAGGQ

SEQ ID NO: 559177 - protein, 5 aa, Mycobacterium
RDNDA

SEQ ID NO: 559178 - protein, 12 aa, Mycobacterium
RDNDNRARAKSL

SEQ ID NO: 559179 - protein, 7 aa, Mycobacterium
RDNDPTI

SEQ ID NO: 559180 - protein, 8 aa, Mycobacterium
RDNDPTIT

SEQ ID NO: 559181 - protein, 5 aa, Mycobacterium
RDNEG

SEQ ID NO: 559182 - protein, 11 aa, Mycobacterium
RDNEPAPKGNK

SEQ ID NO: 559183 - protein, 7 aa, Mycobacterium
RDNGAEI

SEQ ID NO: 559184 - protein, 10 aa, Mycobacterium
RDNGATPAAN

SEQ ID NO: 559185 - protein, 8 aa, Mycobacterium
RDNGGTLP

SEQ ID NO: 559186 - protein, 5 aa, Mycobacterium
RDNGI

SEQ ID NO: 559187 - protein, 8 aa, Mycobacterium
RDNGPRAV

SEQ ID NO: 559188 - protein, 9 aa, Mycobacterium
RDNGRGAGG

SEQ ID NO: 559189 - protein, 6 aa, Mycobacterium
RDNGRN

SEQ ID NO: 559190 - protein, 8 aa, Mycobacterium
RDNGSGRV

SEQ ID NO: 559191 - protein, 9 aa, Mycobacterium
RDNGSGRVV

SEQ ID NO: 559192 - protein, 6 aa, Mycobacterium
RDNGSL

SEQ ID NO: 559193 - protein, 8 aa, Mycobacterium
RDNGTGRV

SEQ ID NO: 559194 - protein, 8 aa, Mycobacterium
RDNHDREF

SEQ ID NO: 559195 - protein, 10 aa, Mycobacterium
RDNKDATKQY

SEQ ID NO: 559196 - protein, 5 aa, Mycobacterium
RDNLE

SEQ ID NO: 559197 - protein, 5 aa, Mycobacterium
RDNLT

SEQ ID NO: 559198 - protein, 4 aa, Mycobacterium
RDNP

SEQ ID NO: 559199 - protein, 6 aa, Mycobacterium
RDNPDR

SEQ ID NO: 559200 - protein, 6 aa, Mycobacterium
RDNPEL

SEQ ID NO: 559201 - protein, 8 aa, Mycobacterium
RDNPNDLR

SEQ ID NO: 559202 - protein, 8 aa, Mycobacterium
RDNPNELR

SEQ ID NO: 559203 - protein, 14 aa, Mycobacterium
RDNPRRSVRLSFLG

SEQ ID NO: 559204 - protein, 14 aa, Mycobacterium
RDNPRRSVRLSFVE

SEQ ID NO: 559205 - protein, 6 aa, Mycobacterium
RDNPSL

SEQ ID NO: 559206 - protein, 10 aa, Mycobacterium
RDNPTAPLPE

SEQ ID NO: 559207 - protein, 5 aa, Mycobacterium
RDNQL

SEQ ID NO: 559208 - protein, 5 aa, Mycobacterium
RDNQQ

SEQ ID NO: 559209 - protein, 14 aa, Mycobacterium
RDNRRRSVRLSFVS

SEQ ID NO: 559210 - protein, 4 aa, Mycobacterium
RDNS

SEQ ID NO: 559211 - protein, 7 aa, Mycobacterium
RDNSAER

SEQ ID NO: 559212 - protein, 9 aa, Mycobacterium
RDNSRATTF

SEQ ID NO: 559213 - protein, 17 aa, Mycobacterium
RDNTPSGTTVATDQTIE

SEQ ID NO: 559214 - protein, 4 aa, Mycobacterium
RDPA

SEQ ID NO: 559215 - protein, 5 aa, Mycobacterium
RDPAA

SEQ ID NO: 559216 - protein, 8 aa, Mycobacterium
RDPAAAPS

SEQ ID NO: 559217 - protein, 13 aa, Mycobacterium
RDPAAEATTEARK

SEQ ID NO: 559218 - protein, 6 aa, Mycobacterium
RDPAAR

SEQ ID NO: 559219 - protein, 12 aa, Mycobacterium
RDPAARPPGAAA

SEQ ID NO: 559220 - protein, 7 aa, Mycobacterium
RDPADPL

SEQ ID NO: 559221 - protein, 10 aa, Mycobacterium
RDPADRDRLT

SEQ ID NO: 559222 - protein, 6 aa, Mycobacterium
RDPAEL

SEQ ID NO: 559223 - protein, 6 aa, Mycobacterium
RDPAEV

SEQ ID NO: 559224 - protein, 8 aa, Mycobacterium
RDPAGAAQ

SEQ ID NO: 559225 - protein, 19 aa, Mycobacterium
RDPAGAEIGRKNLTNPPPM

SEQ ID NO: 559226 - protein, 13 aa, Mycobacterium
RDPAGNLIRIQQL

SEQ ID NO: 559227 - protein, 9 aa, Mycobacterium
RDPAGTAQR

SEQ ID NO: 559228 - protein, 5 aa, Mycobacterium
RDPAP

SEQ ID NO: 559229 - protein, 7 aa, Mycobacterium
RDPAPGL

SEQ ID NO: 559230 - protein, 13 aa, Mycobacterium
RDPAPRPTPPLPI

SEQ ID NO: 559231 - protein, 21 aa, Mycobacterium
RDPAPRPTPPQPIPQDLSPND

SEQ ID NO: 559232 - protein, 5 aa, Mycobacterium
RDPAQ

SEQ ID NO: 559233 - protein, 5 aa, Mycobacterium
RDPAR

SEQ ID NO: 559234 - protein, 7 aa, Mycobacterium
RDPARHR

SEQ ID NO: 559235 - protein, 11 aa, Mycobacterium
RDPARQLPSEG

SEQ ID NO: 559236 - protein, 15 aa, Mycobacterium
RDPARRPSPTRRSAD

SEQ ID NO: 559237 - protein, 8 aa, Mycobacterium
RDPASIDS

SEQ ID NO: 559238 - protein, 5 aa, Mycobacterium
RDPAT

SEQ ID NO: 559239 - protein, 10 aa, Mycobacterium
RDPATAATKA

SEQ ID NO: 559240 - protein, 6 aa, Mycobacterium
RDPATT

SEQ ID NO: 559241 - protein, 6 aa, Mycobacterium
RDPAVQ

SEQ ID NO: 559242 - protein, 13 aa, Mycobacterium
RDPAVRQSNYDDE

SEQ ID NO: 559243 - protein, 5 aa, Mycobacterium
RDPAY

SEQ ID NO: 559244 - protein, 8 aa, Mycobacterium
RDPDAALK

SEQ ID NO: 559245 - protein, 9 aa, Mycobacterium
RDPDADSTV

SEQ ID NO: 559246 - protein, 9 aa, Mycobacterium
RDPDADTTV

SEQ ID NO: 559247 - protein, 6 aa, Mycobacterium
RDPDDD

SEQ ID NO: 559248 - protein, 7 aa, Mycobacterium
RDPDEHE

SEQ ID NO: 559249 - protein, 7 aa, Mycobacterium
RDPDERQ

SEQ ID NO: 559250 - protein, 7 aa, Mycobacterium
RDPDGHR

SEQ ID NO: 559251 - protein, 6 aa, Mycobacterium
RDPDGL

SEQ ID NO: 559252 - protein, 6 aa, Mycobacterium
RDPDGN

SEQ ID NO: 559253 - protein, 13 aa, Mycobacterium
RDPDGNLIEIAVY

SEQ ID NO: 559254 - protein, 16 aa, Mycobacterium
RDPDGNLVEVATYQRP

SEQ ID NO: 559255 - protein, 13 aa, Mycobacterium
RDPDGNNVEAVFH

SEQ ID NO: 559256 - protein, 6 aa, Mycobacterium
RDPDGR

SEQ ID NO: 559257 - protein, 10 aa, Mycobacterium
RDPDGSVYPS

SEQ ID NO: 559258 - protein, 9 aa, Mycobacterium
RDPDGTVTT

SEQ ID NO: 559259 - protein, 7 aa, Mycobacterium
RDPDLAE

SEQ ID NO: 559260 - protein, 8 aa, Mycobacterium
RDPDLAEA

SEQ ID NO: 559261 - protein, 8 aa, Mycobacterium
RDPDLSTA

SEQ ID NO: 559262 - protein, 7 aa, Mycobacterium
RDPDNAQ

SEQ ID NO: 559263 - protein, 8 aa, Mycobacterium
RDPDRDEL

SEQ ID NO: 559264 - protein, 10 aa, Mycobacterium
RDPDREATGR

SEQ ID NO: 559265 - protein, 10 aa, Mycobacterium
RDPDREESGR

SEQ ID NO: 559266 - protein, 10 aa, Mycobacterium
RDPDREETGR

SEQ ID NO: 559267 - protein, 6 aa, Mycobacterium
RDPDRV

SEQ ID NO: 559268 - protein, 10 aa, Mycobacterium
RDPDSAPRIA

SEQ ID NO: 559269 - protein, 8 aa, Mycobacterium
RDPDSRRN

SEQ ID NO: 559270 - protein, 8 aa, Mycobacterium
RDPDSVDA

SEQ ID NO: 559271 - protein, 10 aa, Mycobacterium
RDPDSVESAV

SEQ ID NO: 559272 - protein, 8 aa, Mycobacterium
RDPDSVSA

SEQ ID NO: 559273 - protein, 7 aa, Mycobacterium
RDPDTAA

SEQ ID NO: 559274 - protein, 19 aa, Mycobacterium
RDPDTAARLRAEDDAVDAE

SEQ ID NO: 559275 - protein, 8 aa, Mycobacterium
RDPDTDTP

SEQ ID NO: 559276 - protein, 18 aa, Mycobacterium
RDPDTEKPLTEDSVREAL

SEQ ID NO: 559277 - protein, 6 aa, Mycobacterium
RDPDTG

SEQ ID NO: 559278 - protein, 7 aa, Mycobacterium
RDPDYPA

SEQ ID NO: 559279 - protein, 5 aa, Mycobacterium
RDPEA

SEQ ID NO: 559280 - protein, 7 aa, Mycobacterium
RDPEAGR

SEQ ID NO: 559281 - protein, 8 aa, Mycobacterium
RDPEASQQ

SEQ ID NO: 559282 - protein, 6 aa, Mycobacterium
RDPEAV

SEQ ID NO: 559283 - protein, 9 aa, Mycobacterium
RDPEDGAQV

SEQ ID NO: 559284 - protein, 16 aa, Mycobacterium
RDPEEWGGNRGPINDQ

SEQ ID NO: 559285 - protein, 5 aa, Mycobacterium
RDPEG

SEQ ID NO: 559286 - protein, 6 aa, Mycobacterium
RDPEGN

SEQ ID NO: 559287 - protein, 6 aa, Mycobacterium
RDPEGQ

SEQ ID NO: 559288 - protein, 6 aa, Mycobacterium
RDPEGT

SEQ ID NO: 559289 - protein, 6 aa, Mycobacterium
RDPEGY

SEQ ID NO: 559290 - protein, 14 aa, Mycobacterium
RDPEHQHRIAKWKT

SEQ ID NO: 559291 - protein, 14 aa, Mycobacterium
RDPEHQQRIAKWRT

SEQ ID NO: 559292 - protein, 5 aa, Mycobacterium
RDPEI

SEQ ID NO: 559293 - protein, 16 aa, Mycobacterium
RDPEKAARINEEDDAM

SEQ ID NO: 559294 - protein, 6 aa, Mycobacterium
RDPENG

SEQ ID NO: 559295 - protein, 11 aa, Mycobacterium
RDPERSDRVDE

SEQ ID NO: 559296 - protein, 7 aa, Mycobacterium
RDPESVE

SEQ ID NO: 559297 - protein, 14 aa, Mycobacterium
RDPETGEPGQWTEP

SEQ ID NO: 559298 - protein, 5 aa, Mycobacterium
RDPEV

SEQ ID NO: 559299 - protein, 6 aa, Mycobacterium
RDPEYG

SEQ ID NO: 559300 - protein, 5 aa, Mycobacterium
RDPGA

SEQ ID NO: 559301 - protein, 10 aa, Mycobacterium
RDPGDADPTV

SEQ ID NO: 559302 - protein, 9 aa, Mycobacterium
RDPGDVDID

SEQ ID NO: 559303 - protein, 5 aa, Mycobacterium
RDPGE

SEQ ID NO: 559304 - protein, 7 aa, Mycobacterium
RDPGGDI

SEQ ID NO: 559305 - protein, 6 aa, Mycobacterium
RDPGGL

SEQ ID NO: 559306 - protein, 6 aa, Mycobacterium
RDPGKL

SEQ ID NO: 559307 - protein, 6 aa, Mycobacterium
RDPGPA

SEQ ID NO: 559308 - protein, 7 aa, Mycobacterium
RDPGRED

SEQ ID NO: 559309 - protein, 9 aa, Mycobacterium
RDPGSRRAK

SEQ ID NO: 559310 - protein, 5 aa, Mycobacterium
RDPGT

SEQ ID NO: 559311 - protein, 6 aa, Mycobacterium
RDPGTP

SEQ ID NO: 559312 - protein, 12 aa, Mycobacterium
RDPGVEVEEATK

SEQ ID NO: 559313 - protein, 9 aa, Mycobacterium
RDPGVPDGR

SEQ ID NO: 559314 - protein, 4 aa, Mycobacterium
RDPH

SEQ ID NO: 559315 - protein, 7 aa, Mycobacterium
RDPHAGG

SEQ ID NO: 559316 - protein, 7 aa, Mycobacterium
RDPHEAT

SEQ ID NO: 559317 - protein, 6 aa, Mycobacterium
RDPHGV

SEQ ID NO: 559318 - protein, 7 aa, Mycobacterium
RDPHGVR

SEQ ID NO: 559319 - protein, 7 aa, Mycobacterium
RDPHPTL

SEQ ID NO: 559320 - protein, 7 aa, Mycobacterium
RDPIAAT

SEQ ID NO: 559321 - protein, 29 aa, Mycobacterium
RDPIPAAESPTVPSDIGRTPKGTATTQAA

SEQ ID NO: 559322 - protein, 8 aa, Mycobacterium
RDPISGSQ

SEQ ID NO: 559323 - protein, 9 aa, Mycobacterium
RDPKAQKVI

SEQ ID NO: 559324 - protein, 23 aa, Mycobacterium
RDPKAYAGPDSAAVNAKLAEFAH

SEQ ID NO: 559325 - protein, 8 aa, Mycobacterium
RDPKDAEY

SEQ ID NO: 559326 - protein, 16 aa, Mycobacterium
RDPKFSPAREALDNPS

SEQ ID NO: 559327 - protein, 15 aa, Mycobacterium
RDPKFTPAREALDNP

SEQ ID NO: 559328 - protein, 5 aa, Mycobacterium
RDPKK

SEQ ID NO: 559329 - protein, 11 aa, Mycobacterium
RDPKLADAVTP

SEQ ID NO: 559330 - protein, 9 aa, Mycobacterium
RDPLEQSRR

SEQ ID NO: 559331 - protein, 6 aa, Mycobacterium
RDPNAL

SEQ ID NO: 559332 - protein, 9 aa, Mycobacterium
RDPNDPTNY

SEQ ID NO: 559333 - protein, 6 aa, Mycobacterium
RDPNKL

SEQ ID NO: 559334 - protein, 6 aa, Mycobacterium
RDPNKN

SEQ ID NO: 559335 - protein, 5 aa, Mycobacterium
RDPNN

SEQ ID NO: 559336 - protein, 14 aa, Mycobacterium
RDPNPGVADHAKDD

SEQ ID NO: 559337 - protein, 6 aa, Mycobacterium
RDPNPH

SEQ ID NO: 559338 - protein, 9 aa, Mycobacterium
RDPNPHVGF

SEQ ID NO: 559339 - protein, 8 aa, Mycobacterium
RDPNRPRA

SEQ ID NO: 559340 - protein, 5 aa, Mycobacterium
RDPNS

SEQ ID NO: 559341 - protein, 5 aa, Mycobacterium
RDPNT

SEQ ID NO: 559342 - protein, 10 aa, Mycobacterium
RDPPAKPTLP

SEQ ID NO: 559343 - protein, 4 aa, Mycobacterium
RDPQ

SEQ ID NO: 559344 - protein, 5 aa, Mycobacterium
RDPQA

SEQ ID NO: 559345 - protein, 11 aa, Mycobacterium
RDPQAERRSRI

SEQ ID NO: 559346 - protein, 5 aa, Mycobacterium
RDPQC

SEQ ID NO: 559347 - protein, 7 aa, Mycobacterium
RDPQGGA

SEQ ID NO: 559348 - protein, 5 aa, Mycobacterium
RDPQH

SEQ ID NO: 559349 - protein, 7 aa, Mycobacterium
RDPQNRA

SEQ ID NO: 559350 - protein, 11 aa, Mycobacterium
RDPQPQRHTSI

SEQ ID NO: 559351 - protein, 16 aa, Mycobacterium
RDPQQAARLREQDDAM

SEQ ID NO: 559352 - protein, 9 aa, Mycobacterium
RDPQQSPFG

SEQ ID NO: 559353 - protein, 5 aa, Mycobacterium
RDPQR

SEQ ID NO: 559354 - protein, 21 aa, Mycobacterium
RDPQRGKNAAEEVAAAGAASA

SEQ ID NO: 559355 - protein, 7 aa, Mycobacterium
RDPQRKA

SEQ ID NO: 559356 - protein, 8 aa, Mycobacterium
RDPQSRAR

SEQ ID NO: 559357 - protein, 12 aa, Mycobacterium
RDPQTGEYRLGP

SEQ ID NO: 559358 - protein, 5 aa, Mycobacterium
RDPQV

SEQ ID NO: 559359 - protein, 4 aa, Mycobacterium
RDPR

SEQ ID NO: 559360 - protein, 5 aa, Mycobacterium
RDPRA

SEQ ID NO: 559361 - protein, 12 aa, Mycobacterium
RDPRDLDQRRAA

SEQ ID NO: 559362 - protein, 5 aa, Mycobacterium
RDPRG

SEQ ID NO: 559363 - protein, 6 aa, Mycobacterium
RDPRHR

SEQ ID NO: 559364 - protein, 11 aa, Mycobacterium
RDPRKPSWGEP

SEQ ID NO: 559365 - protein, 6 aa, Mycobacterium
RDPRLT

SEQ ID NO: 559366 - protein, 5 aa, Mycobacterium
RDPRP

SEQ ID NO: 559367 - protein, 10 aa, Mycobacterium
RDPRPAARRD

SEQ ID NO: 559368 - protein, 7 aa, Mycobacterium
RDPRPDR

SEQ ID NO: 559369 - protein, 12 aa, Mycobacterium
RDPRPHRGCTRG

SEQ ID NO: 559370 - protein, 6 aa, Mycobacterium
RDPRPT

SEQ ID NO: 559371 - protein, 6 aa, Mycobacterium
RDPRQA

SEQ ID NO: 559372 - protein, 9 aa, Mycobacterium
RDPRQPPFG

SEQ ID NO: 559373 - protein, 5 aa, Mycobacterium
RDPRR

SEQ ID NO: 559374 - protein, 13 aa, Mycobacterium
RDPRSGANAEAVT

SEQ ID NO: 559375 - protein, 12 aa, Mycobacterium
RDPRSGANARAV

SEQ ID NO: 559376 - protein, 7 aa, Mycobacterium
RDPRTKE

SEQ ID NO: 559377 - protein, 15 aa, Mycobacterium
RDPRTTLADTVAALR

SEQ ID NO: 559378 - protein, 9 aa, Mycobacterium
RDPRVPNQV

SEQ ID NO: 559379 - protein, 7 aa, Mycobacterium
RDPRVSN

SEQ ID NO: 559380 - protein, 4 aa, Mycobacterium
RDPS

SEQ ID NO: 559381 - protein, 5 aa, Mycobacterium
RDPSA

SEQ ID NO: 559382 - protein, 6 aa, Mycobacterium
RDPSAL

SEQ ID NO: 559383 - protein, 11 aa, Mycobacterium
RDPSDASRPKI

SEQ ID NO: 559384 - protein, 5 aa, Mycobacterium
RDPSF

SEQ ID NO: 559385 - protein, 17 aa, Mycobacterium
RDPSGDSDFTDDFTDDD

SEQ ID NO: 559386 - protein, 8 aa, Mycobacterium
RDPSGNSV

SEQ ID NO: 559387 - protein, 8 aa, Mycobacterium
RDPSHARE

SEQ ID NO: 559388 - protein, 7 aa, Mycobacterium
RDPSHPG

SEQ ID NO: 559389 - protein, 8 aa, Mycobacterium
RDPSHPGQ

SEQ ID NO: 559390 - protein, 10 aa, Mycobacterium
RDPSKGIEEL

SEQ ID NO: 559391 - protein, 5 aa, Mycobacterium
RDPSL

SEQ ID NO: 559392 - protein, 6 aa, Mycobacterium
RDPSLR

SEQ ID NO: 559393 - protein, 9 aa, Mycobacterium
RDPSPDHYR

SEQ ID NO: 559394 - protein, 10 aa, Mycobacterium
RDPSPRASNW

SEQ ID NO: 559395 - protein, 20 aa, Mycobacterium
RDPSPRASNWRATGTLDDEL

SEQ ID NO: 559396 - protein, 17 aa, Mycobacterium
RDPSPRASNWRSSTTLE

SEQ ID NO: 559397 - protein, 17 aa, Mycobacterium
RDPSPRPSNWRATGTLE

SEQ ID NO: 559398 - protein, 7 aa, Mycobacterium
RDPSRAR

SEQ ID NO: 559399 - protein, 11 aa, Mycobacterium
RDPSRDEARRN

SEQ ID NO: 559400 - protein, 7 aa, Mycobacterium
RDPSRED

SEQ ID NO: 559401 - protein, 9 aa, Mycobacterium
RDPSSDSAT

SEQ ID NO: 559402 - protein, 6 aa, Mycobacterium
RDPSTP

SEQ ID NO: 559403 - protein, 8 aa, Mycobacterium
RDPSVFDK

SEQ ID NO: 559404 - protein, 12 aa, Mycobacterium
RDPSVKATATMP

SEQ ID NO: 559405 - protein, 9 aa, Mycobacterium
RDPTADPTD

SEQ ID NO: 559406 - protein, 6 aa, Mycobacterium
RDPTAL

SEQ ID NO: 559407 - protein, 5 aa, Mycobacterium
RDPTL

SEQ ID NO: 559408 - protein, 7 aa, Mycobacterium
RDPTQSA

SEQ ID NO: 559409 - protein, 7 aa, Mycobacterium
RDPTRGG

SEQ ID NO: 559410 - protein, 8 aa, Mycobacterium
RDPTRGGL

SEQ ID NO: 559411 - protein, 8 aa, Mycobacterium
RDPTTPYS

SEQ ID NO: 559412 - protein, 14 aa, Mycobacterium
RDPTTVREPSDRPN

SEQ ID NO: 559413 - protein, 4 aa, Mycobacterium
RDPV

SEQ ID NO: 559414 - protein, 5 aa, Mycobacterium
RDPVA

SEQ ID NO: 559415 - protein, 16 aa, Mycobacterium
RDPVADPGTTTGTPGD

SEQ ID NO: 559416 - protein, 7 aa, Mycobacterium
RDPVPAA

SEQ ID NO: 559417 - protein, 5 aa, Mycobacterium
RDPVT

SEQ ID NO: 559418 - protein, 12 aa, Mycobacterium
RDPVTAKESAEL

SEQ ID NO: 559419 - protein, 4 aa, Mycobacterium
RDPY

SEQ ID NO: 559420 - protein, 9 aa, Mycobacterium
RDPYGRTAR

SEQ ID NO: 559421 - protein, 6 aa, Mycobacterium
RDPYGV

SEQ ID NO: 559422 - protein, 4 aa, Mycobacterium
RDQA

SEQ ID NO: 559423 - protein, 16 aa, Mycobacterium
RDQAAQAKAQALQDQP

SEQ ID NO: 559424 - protein, 5 aa, Mycobacterium
RDQAD

SEQ ID NO: 559425 - protein, 6 aa, Mycobacterium
RDQADA

SEQ ID NO: 559426 - protein, 5 aa, Mycobacterium
RDQAE

SEQ ID NO: 559427 - protein, 8 aa, Mycobacterium
RDQAGRTR

SEQ ID NO: 559428 - protein, 17 aa, Mycobacterium
RDQAPAAARARAHADNQ

SEQ ID NO: 559429 - protein, 10 aa, Mycobacterium
RDQAPEAERI

SEQ ID NO: 559430 - protein, 8 aa, Mycobacterium
RDQAPREP

SEQ ID NO: 559431 - protein, 5 aa, Mycobacterium
RDQAR

SEQ ID NO: 559432 - protein, 8 aa, Mycobacterium
RDQARLTR

SEQ ID NO: 559433 - protein, 15 aa, Mycobacterium
RDQASATRRANHPGP

SEQ ID NO: 559434 - protein, 13 aa, Mycobacterium
RDQASATRRANHQ

SEQ ID NO: 559435 - protein, 5 aa, Mycobacterium
RDQAV

SEQ ID NO: 559436 - protein, 9 aa, Mycobacterium
RDQDDEQSV

SEQ ID NO: 559437 - protein, 10 aa, Mycobacterium
RDQDDGVADS

SEQ ID NO: 559438 - protein, 17 aa, Mycobacterium
RDQDKDAVGSAGTDPDG

SEQ ID NO: 559439 - protein, 6 aa, Mycobacterium
RDQDLK

SEQ ID NO: 559440 - protein, 8 aa, Mycobacterium
RDQDPDHG

SEQ ID NO: 559441 - protein, 12 aa, Mycobacterium
RDQDSDRDDLTR

SEQ ID NO: 559442 - protein, 9 aa, Mycobacterium
RDQDSPLDA

SEQ ID NO: 559443 - protein, 4 aa, Mycobacterium
RDQE

SEQ ID NO: 559444 - protein, 6 aa, Mycobacterium
RDQEAL

SEQ ID NO: 559445 - protein, 7 aa, Mycobacterium
RDQEPLA

SEQ ID NO: 559446 - protein, 6 aa, Mycobacterium
RDQERA

SEQ ID NO: 559447 - protein, 6 aa, Mycobacterium
RDQEVE

SEQ ID NO: 559448 - protein, 4 aa, Mycobacterium
RDQG

SEQ ID NO: 559449 - protein, 12 aa, Mycobacterium
RDQGDLDGLVLE

SEQ ID NO: 559450 - protein, 5 aa, Mycobacterium
RDQGG

SEQ ID NO: 559451 - protein, 8 aa, Mycobacterium
RDQGGRRR

SEQ ID NO: 559452 - protein, 7 aa, Mycobacterium
RDQGPLR

SEQ ID NO: 559453 - protein, 6 aa, Mycobacterium
RDQGPS

SEQ ID NO: 559454 - protein, 8 aa, Mycobacterium
RDQGPTYP

SEQ ID NO: 559455 - protein, 6 aa, Mycobacterium
RDQGWG

SEQ ID NO: 559456 - protein, 4 aa, Mycobacterium
RDQH

SEQ ID NO: 559457 - protein, 15 aa, Mycobacterium
RDQIKGKSTTKASPL

SEQ ID NO: 559458 - protein, 5 aa, Mycobacterium
RDQKA

SEQ ID NO: 559459 - protein, 6 aa, Mycobacterium
RDQLGD

SEQ ID NO: 559460 - protein, 5 aa, Mycobacterium
RDQLR

SEQ ID NO: 559461 - protein, 12 aa, Mycobacterium
RDQLRGKARAGI

SEQ ID NO: 559462 - protein, 7 aa, Mycobacterium
RDQNGEV

SEQ ID NO: 559463 - protein, 4 aa, Mycobacterium
RDQP

SEQ ID NO: 559464 - protein, 6 aa, Mycobacterium
RDQPAE

SEQ ID NO: 559465 - protein, 6 aa, Mycobacterium
RDQPGD

SEQ ID NO: 559466 - protein, 15 aa, Mycobacterium
RDQPHPSPIVPPRVD

SEQ ID NO: 559467 - protein, 8 aa, Mycobacterium
RDQPQGSI

SEQ ID NO: 559468 - protein, 7 aa, Mycobacterium
RDQPSEP

SEQ ID NO: 559469 - protein, 13 aa, Mycobacterium
RDQPSGPRRDPEE

SEQ ID NO: 559470 - protein, 8 aa, Mycobacterium
RDQPWKRR

SEQ ID NO: 559471 - protein, 15 aa, Mycobacterium
RDQQARRDAAAHPGD

SEQ ID NO: 559472 - protein, 4 aa, Mycobacterium
RDQR

SEQ ID NO: 559473 - protein, 5 aa, Mycobacterium
RDQRD

SEQ ID NO: 559474 - protein, 6 aa, Mycobacterium
RDQRDK

SEQ ID NO: 559475 - protein, 6 aa, Mycobacterium
RDQRIA

SEQ ID NO: 559476 - protein, 5 aa, Mycobacterium
RDQRR

SEQ ID NO: 559477 - protein, 14 aa, Mycobacterium
RDQRRKYRQGRVNA

SEQ ID NO: 559478 - protein, 12 aa, Mycobacterium
RDQSEHAGSVAA

SEQ ID NO: 559479 - protein, 23 aa, Mycobacterium
RDQSKAADLAKTLGRNATTGEFG

SEQ ID NO: 559480 - protein, 23 aa, Mycobacterium
RDQSKAAELAKDLGGGATAGEFG

SEQ ID NO: 559481 - protein, 4 aa, Mycobacterium
RDQT

SEQ ID NO: 559482 - protein, 7 aa, Mycobacterium
RDQTEAI

SEQ ID NO: 559483 - protein, 20 aa, Mycobacterium
RDQTGDIGVSNNNGSGVEQT

SEQ ID NO: 559484 - protein, 13 aa, Mycobacterium
RDQTGDWDAAGQT

SEQ ID NO: 559485 - protein, 7 aa, Mycobacterium
RDQTGET

SEQ ID NO: 559486 - protein, 8 aa, Mycobacterium
RDQTGEVK

SEQ ID NO: 559487 - protein, 8 aa, Mycobacterium
RDQTGRFQ

SEQ ID NO: 559488 - protein, 4 aa, Mycobacterium
RDQV

SEQ ID NO: 559489 - protein, 11 aa, Mycobacterium
RDQVSDPDLQE

SEQ ID NO: 559490 - protein, 14 aa, Mycobacterium
RDQYAQDDGEGVGR

SEQ ID NO: 559491 - protein, 12 aa, Mycobacterium
RDQYDQSPAESV

SEQ ID NO: 559492 - protein, 14 aa, Mycobacterium
RDQYRQRAGRELGD

SEQ ID NO: 559493 - protein, 11 aa, Mycobacterium
RDRAAAMGAAG

SEQ ID NO: 559494 - protein, 8 aa, Mycobacterium
RDRAAAQG

SEQ ID NO: 559495 - protein, 7 aa, Mycobacterium
RDRAALS

SEQ ID NO: 559496 - protein, 5 aa, Mycobacterium
RDRAD

SEQ ID NO: 559497 - protein, 7 aa, Mycobacterium
RDRAEEL

SEQ ID NO: 559498 - protein, 8 aa, Mycobacterium
RDRAGKLA

SEQ ID NO: 559499 - protein, 28 aa, Mycobacterium
RDRAPVRRRTRGRLRRPRRAARVPGGVG

SEQ ID NO: 559500 - protein, 5 aa, Mycobacterium
RDRAR

SEQ ID NO: 559501 - protein, 9 aa, Mycobacterium
RDRARARDL

SEQ ID NO: 559502 - protein, 16 aa, Mycobacterium
RDRARGRDQDRGNGLE

SEQ ID NO: 559503 - protein, 9 aa, Mycobacterium
RDRARKQGA

SEQ ID NO: 559504 - protein, 9 aa, Mycobacterium
RDRARKQGG

SEQ ID NO: 559505 - protein, 8 aa, Mycobacterium
RDRARREA

SEQ ID NO: 559506 - protein, 15 aa, Mycobacterium
RDRARRTGTHPRGHA

SEQ ID NO: 559507 - protein, 12 aa, Mycobacterium
RDRASAITRRRT

SEQ ID NO: 559508 - protein, 6 aa, Mycobacterium
RDRASG

SEQ ID NO: 559509 - protein, 9 aa, Mycobacterium
RDRDAARAA

SEQ ID NO: 559510 - protein, 9 aa, Mycobacterium
RDRDAAREA

SEQ ID NO: 559511 - protein, 8 aa, Mycobacterium
RDRDATRT

SEQ ID NO: 559512 - protein, 11 aa, Mycobacterium
RDRDDLGRQPV

SEQ ID NO: 559513 - protein, 6 aa, Mycobacterium
RDRDDP

SEQ ID NO: 559514 - protein, 5 aa, Mycobacterium
RDRDG

SEQ ID NO: 559515 - protein, 7 aa, Mycobacterium
RDRDGEA

SEQ ID NO: 559516 - protein, 6 aa, Mycobacterium
RDRDGV

SEQ ID NO: 559517 - protein, 9 aa, Mycobacterium
RDRDGVRAT

SEQ ID NO: 559518 - protein, 11 aa, Mycobacterium
RDRDPDAARAA

SEQ ID NO: 559519 - protein, 8 aa, Mycobacterium
RDRDPSDL

SEQ ID NO: 559520 - protein, 13 aa, Mycobacterium
RDRDRIDEAAAEH

SEQ ID NO: 559521 - protein, 8 aa, Mycobacterium
RDRDSGSE

SEQ ID NO: 559522 - protein, 7 aa, Mycobacterium
RDREAHH

SEQ ID NO: 559523 - protein, 6 aa, Mycobacterium
RDREDW

SEQ ID NO: 559524 - protein, 5 aa, Mycobacterium
RDREN

SEQ ID NO: 559525 - protein, 6 aa, Mycobacterium
RDRERA

SEQ ID NO: 559526 - protein, 7 aa, Mycobacterium
RDRETEL

SEQ ID NO: 559527 - protein, 10 aa, Mycobacterium
RDRETGENFD

SEQ ID NO: 559528 - protein, 8 aa, Mycobacterium
RDRETQPF

SEQ ID NO: 559529 - protein, 6 aa, Mycobacterium
RDRFGG

SEQ ID NO: 559530 - protein, 11 aa, Mycobacterium
RDRGADDAPGF

SEQ ID NO: 559531 - protein, 7 aa, Mycobacterium
RDRGAEA

SEQ ID NO: 559532 - protein, 9 aa, Mycobacterium
RDRGCPPPF

SEQ ID NO: 559533 - protein, 8 aa, Mycobacterium
RDRGEAQP

SEQ ID NO: 559534 - protein, 7 aa, Mycobacterium
RDRGEAV

SEQ ID NO: 559535 - protein, 9 aa, Mycobacterium
RDRGELAPQ

SEQ ID NO: 559536 - protein, 5 aa, Mycobacterium
RDRGG

SEQ ID NO: 559537 - protein, 7 aa, Mycobacterium
RDRGGAV

SEQ ID NO: 559538 - protein, 6 aa, Mycobacterium
RDRGGT

SEQ ID NO: 559539 - protein, 9 aa, Mycobacterium
RDRGIGSPT

SEQ ID NO: 559540 - protein, 15 aa, Mycobacterium
RDRGLTPDADYSNLS

SEQ ID NO: 559541 - protein, 11 aa, Mycobacterium
RDRGNTAYAQA

SEQ ID NO: 559542 - protein, 8 aa, Mycobacterium
RDRGPDAL

SEQ ID NO: 559543 - protein, 11 aa, Mycobacterium
RDRGPQGPKDY

SEQ ID NO: 559544 - protein, 5 aa, Mycobacterium
RDRGW

SEQ ID NO: 559545 - protein, 7 aa, Mycobacterium
RDRHAVE

SEQ ID NO: 559546 - protein, 14 aa, Mycobacterium
RDRHPAPLDPNFTG

SEQ ID NO: 559547 - protein, 10 aa, Mycobacterium
RDRHTAPPAF

SEQ ID NO: 559548 - protein, 4 aa, Mycobacterium
RDRI

SEQ ID NO: 559549 - protein, 8 aa, Mycobacterium
RDRKETVR

SEQ ID NO: 559550 - protein, 5 aa, Mycobacterium
RDRLD

SEQ ID NO: 559551 - protein, 8 aa, Mycobacterium
RDRLNSGN

SEQ ID NO: 559552 - protein, 14 aa, Mycobacterium
RDRLRADRNRSHDE

SEQ ID NO: 559553 - protein, 9 aa, Mycobacterium
RDRLRENGI

SEQ ID NO: 559554 - protein, 51 aa, Mycobacterium
RDRMAAERDRVANDRELSADERERRADQREGTAADRERERLQRSADRDERL

SEQ ID NO: 559555 - protein, 5 aa, Mycobacterium
RDRMG

SEQ ID NO: 559556 - protein, 4 aa, Mycobacterium
RDRN

SEQ ID NO: 559557 - protein, 7 aa, Mycobacterium
RDRNDDE

SEQ ID NO: 559558 - protein, 6 aa, Mycobacterium
RDRPAE

SEQ ID NO: 559559 - protein, 12 aa, Mycobacterium
RDRPDATAEALD

SEQ ID NO: 559560 - protein, 17 aa, Mycobacterium
RDRPDPSTYIGSGKAAE

SEQ ID NO: 559561 - protein, 18 aa, Mycobacterium
RDRPDPSTYIGSGKAAEL

SEQ ID NO: 559562 - protein, 6 aa, Mycobacterium
RDRPGQ

SEQ ID NO: 559563 - protein, 8 aa, Mycobacterium
RDRPGRHR

SEQ ID NO: 559564 - protein, 22 aa, Mycobacterium
RDRPHPVADPEARRRGQAEPAV

SEQ ID NO: 559565 - protein, 8 aa, Mycobacterium
RDRPPNID

SEQ ID NO: 559566 - protein, 6 aa, Mycobacterium
RDRPQT

SEQ ID NO: 559567 - protein, 6 aa, Mycobacterium
RDRPRE

SEQ ID NO: 559568 - protein, 13 aa, Mycobacterium
RDRPVPSARGWSA

SEQ ID NO: 559569 - protein, 6 aa, Mycobacterium
RDRRDF

SEQ ID NO: 559570 - protein, 6 aa, Mycobacterium
RDRREN

SEQ ID NO: 559571 - protein, 7 aa, Mycobacterium
RDRRESA

SEQ ID NO: 559572 - protein, 7 aa, Mycobacterium
RDRRQGL

SEQ ID NO: 559573 - protein, 13 aa, Mycobacterium
RDRRQRWRAIKPA

SEQ ID NO: 559574 - protein, 8 aa, Mycobacterium
RDRRRAEA

SEQ ID NO: 559575 - protein, 6 aa, Mycobacterium
RDRRSR

SEQ ID NO: 559576 - protein, 6 aa, Mycobacterium
RDRRTD

SEQ ID NO: 559577 - protein, 8 aa, Mycobacterium
RDRRVAGS

SEQ ID NO: 559578 - protein, 8 aa, Mycobacterium
RDRSASEQ

SEQ ID NO: 559579 - protein, 5 aa, Mycobacterium
RDRSD

SEQ ID NO: 559580 - protein, 10 aa, Mycobacterium
RDRSDRRDEV

SEQ ID NO: 559581 - protein, 8 aa, Mycobacterium
RDRSEAQN

SEQ ID NO: 559582 - protein, 9 aa, Mycobacterium
RDRSGMVTA

SEQ ID NO: 559583 - protein, 21 aa, Mycobacterium
RDRSQRPKSGAVVDVLPPFAG

SEQ ID NO: 559584 - protein, 6 aa, Mycobacterium
RDRSQT

SEQ ID NO: 559585 - protein, 7 aa, Mycobacterium
RDRSRTT

SEQ ID NO: 559586 - protein, 25 aa, Mycobacterium
RDRSTDQTHKARTRQRSSDTGYDLG

SEQ ID NO: 559587 - protein, 4 aa, Mycobacterium
RDRT

SEQ ID NO: 559588 - protein, 12 aa, Mycobacterium
RDRTAADETADA

SEQ ID NO: 559589 - protein, 7 aa, Mycobacterium
RDRTAAG

SEQ ID NO: 559590 - protein, 11 aa, Mycobacterium
RDRTGEGQRVD

SEQ ID NO: 559591 - protein, 11 aa, Mycobacterium
RDRTGQGQRVD

SEQ ID NO: 559592 - protein, 21 aa, Mycobacterium
RDRTKTPEPVPAEPPETGAND

SEQ ID NO: 559593 - protein, 7 aa, Mycobacterium
RDRTNEL

SEQ ID NO: 559594 - protein, 10 aa, Mycobacterium
RDRTPDDAAA

SEQ ID NO: 559595 - protein, 12 aa, Mycobacterium
RDRTPDERASEM

SEQ ID NO: 559596 - protein, 7 aa, Mycobacterium
RDRTPPR

SEQ ID NO: 559597 - protein, 11 aa, Mycobacterium
RDRTPSEGAAE

SEQ ID NO: 559598 - protein, 8 aa, Mycobacterium
RDRTQAQN

SEQ ID NO: 559599 - protein, 28 aa, Mycobacterium
RDRTRAEKAAASIGAHGVQSDVSNPDEL

SEQ ID NO: 559600 - protein, 10 aa, Mycobacterium
RDRTRPGVEP

SEQ ID NO: 559601 - protein, 8 aa, Mycobacterium
RDRTSPPL

SEQ ID NO: 559602 - protein, 7 aa, Mycobacterium
RDRTTGE

SEQ ID NO: 559603 - protein, 8 aa, Mycobacterium
RDRVDGAD

SEQ ID NO: 559604 - protein, 13 aa, Mycobacterium
RDRVGGRSSTATI

SEQ ID NO: 559605 - protein, 15 aa, Mycobacterium
RDRVNGRTAEPSGEA

SEQ ID NO: 559606 - protein, 10 aa, Mycobacterium
RDRVRAAGSD

SEQ ID NO: 559607 - protein, 11 aa, Mycobacterium
RDRVSAATDGF

SEQ ID NO: 559608 - protein, 16 aa, Mycobacterium
RDRYDTVAGPANAAAN

SEQ ID NO: 559609 - protein, 18 aa, Mycobacterium
RDRYEETKGAISAQTEVR

SEQ ID NO: 559610 - protein, 10 aa, Mycobacterium
RDRYGKSALT

SEQ ID NO: 559611 - protein, 7 aa, Mycobacterium
RDRYSQG

SEQ ID NO: 559612 - protein, 5 aa, Mycobacterium
RDSAA

SEQ ID NO: 559613 - protein, 7 aa, Mycobacterium
RDSAAAT

SEQ ID NO: 559614 - protein, 13 aa, Mycobacterium
RDSADDDDEGHGA

SEQ ID NO: 559615 - protein, 12 aa, Mycobacterium
RDSADGRVSVVQ

SEQ ID NO: 559616 - protein, 29 aa, Mycobacterium
RDSADPAAKLPSRRRDEKVPPGAPTQRIG

SEQ ID NO: 559617 - protein, 6 aa, Mycobacterium
RDSAET

SEQ ID NO: 559618 - protein, 5 aa, Mycobacterium
RDSAG

SEQ ID NO: 559619 - protein, 8 aa, Mycobacterium
RDSAGNPW

SEQ ID NO: 559620 - protein, 7 aa, Mycobacterium
RDSAGPY

SEQ ID NO: 559621 - protein, 5 aa, Mycobacterium
RDSAP

SEQ ID NO: 559622 - protein, 60 aa, Mycobacterium
RDSAPPQDQDGEDPDPEPDGPGGGASDSAPDPAKASDSQQDSAYAAGSSRPSPAPSATFR

SEQ ID NO: 559623 - protein, 16 aa, Mycobacterium
RDSAQVDDALQRTNAE

SEQ ID NO: 559624 - protein, 8 aa, Mycobacterium
RDSAWPDT

SEQ ID NO: 559625 - protein, 6 aa, Mycobacterium
RDSDAD

SEQ ID NO: 559626 - protein, 9 aa, Mycobacterium
RDSDAPVRE

SEQ ID NO: 559627 - protein, 18 aa, Mycobacterium
RDSDDPAGLARKKATDIQ

SEQ ID NO: 559628 - protein, 12 aa, Mycobacterium
RDSDEQASAPSL

SEQ ID NO: 559629 - protein, 7 aa, Mycobacterium
RDSDGAP

SEQ ID NO: 559630 - protein, 8 aa, Mycobacterium
RDSDGGWS

SEQ ID NO: 559631 - protein, 9 aa, Mycobacterium
RDSDGRATA

SEQ ID NO: 559632 - protein, 9 aa, Mycobacterium
RDSDGRNAQ

SEQ ID NO: 559633 - protein, 11 aa, Mycobacterium
RDSDHTKAPVP

SEQ ID NO: 559634 - protein, 10 aa, Mycobacterium
RDSDHTRAPI

SEQ ID NO: 559635 - protein, 8 aa, Mycobacterium
RDSDPDRR

SEQ ID NO: 559636 - protein, 10 aa, Mycobacterium
RDSDPTDDLA

SEQ ID NO: 559637 - protein, 8 aa, Mycobacterium
RDSDPVRD

SEQ ID NO: 559638 - protein, 8 aa, Mycobacterium
RDSDRAEK

SEQ ID NO: 559639 - protein, 8 aa, Mycobacterium
RDSDRSHF

SEQ ID NO: 559640 - protein, 6 aa, Mycobacterium
RDSDTA

SEQ ID NO: 559641 - protein, 5 aa, Mycobacterium
RDSDV

SEQ ID NO: 559642 - protein, 6 aa, Mycobacterium
RDSDVA

SEQ ID NO: 559643 - protein, 9 aa, Mycobacterium
RDSEAADAY

SEQ ID NO: 559644 - protein, 10 aa, Mycobacterium
RDSEDGAVTE

SEQ ID NO: 559645 - protein, 10 aa, Mycobacterium
RDSEDGRVTD

SEQ ID NO: 559646 - protein, 11 aa, Mycobacterium
RDSEDGSVTEV

SEQ ID NO: 559647 - protein, 8 aa, Mycobacterium
RDSEGAEV

SEQ ID NO: 559648 - protein, 9 aa, Mycobacterium
RDSEGMHEN

SEQ ID NO: 559649 - protein, 20 aa, Mycobacterium
RDSEPDWGPYAAPTAPENAP

SEQ ID NO: 559650 - protein, 20 aa, Mycobacterium
RDSEPDWGPYAAPTAPENSP

SEQ ID NO: 559651 - protein, 20 aa, Mycobacterium
RDSEPDWGPYAAPTAPQDAP

SEQ ID NO: 559652 - protein, 7 aa, Mycobacterium
RDSERDL

SEQ ID NO: 559653 - protein, 6 aa, Mycobacterium
RDSETC

SEQ ID NO: 559654 - protein, 13 aa, Mycobacterium
RDSETFASSTGNT

SEQ ID NO: 559655 - protein, 10 aa, Mycobacterium
RDSETWSSQA

SEQ ID NO: 559656 - protein, 6 aa, Mycobacterium
RDSGAD

SEQ ID NO: 559657 - protein, 7 aa, Mycobacterium
RDSGAQT

SEQ ID NO: 559658 - protein, 8 aa, Mycobacterium
RDSGARAL

SEQ ID NO: 559659 - protein, 15 aa, Mycobacterium
RDSGATADNDPDAVA

SEQ ID NO: 559660 - protein, 8 aa, Mycobacterium
RDSGDDVS

SEQ ID NO: 559661 - protein, 9 aa, Mycobacterium
RDSGFGKGD

SEQ ID NO: 559662 - protein, 6 aa, Mycobacterium
RDSGNF

SEQ ID NO: 559663 - protein, 7 aa, Mycobacterium
RDSGRFD

SEQ ID NO: 559664 - protein, 10 aa, Mycobacterium
RDSGSAVADY

SEQ ID NO: 559665 - protein, 6 aa, Mycobacterium
RDSGTV

SEQ ID NO: 559666 - protein, 10 aa, Mycobacterium
RDSGWGRSGP

SEQ ID NO: 559667 - protein, 12 aa, Mycobacterium
RDSIPPQLSGGM

SEQ ID NO: 559668 - protein, 5 aa, Mycobacterium
RDSIR

SEQ ID NO: 559669 - protein, 11 aa, Mycobacterium
RDSKFDEGAEA

SEQ ID NO: 559670 - protein, 16 aa, Mycobacterium
RDSKRADRVPHGNLGV

SEQ ID NO: 559671 - protein, 5 aa, Mycobacterium
RDSLA

SEQ ID NO: 559672 - protein, 15 aa, Mycobacterium
RDSLRGAAASAVAAG

SEQ ID NO: 559673 - protein, 7 aa, Mycobacterium
RDSLRQR

SEQ ID NO: 559674 - protein, 9 aa, Mycobacterium
RDSLRRAAA

SEQ ID NO: 559675 - protein, 15 aa, Mycobacterium
RDSLRSAAADAVAAG

SEQ ID NO: 559676 - protein, 15 aa, Mycobacterium
RDSLRSAAADAVTAG

SEQ ID NO: 559677 - protein, 11 aa, Mycobacterium
RDSLSGDQAAG

SEQ ID NO: 559678 - protein, 9 aa, Mycobacterium
RDSNGNPIS

SEQ ID NO: 559679 - protein, 16 aa, Mycobacterium
RDSPDGPVRYPHGADA

SEQ ID NO: 559680 - protein, 8 aa, Mycobacterium
RDSPQRAH

SEQ ID NO: 559681 - protein, 7 aa, Mycobacterium
RDSPYTR

SEQ ID NO: 559682 - protein, 5 aa, Mycobacterium
RDSQK

SEQ ID NO: 559683 - protein, 6 aa, Mycobacterium
RDSQKG

SEQ ID NO: 559684 - protein, 8 aa, Mycobacterium
RDSQPAGY

SEQ ID NO: 559685 - protein, 5 aa, Mycobacterium
RDSQT

SEQ ID NO: 559686 - protein, 5 aa, Mycobacterium
RDSRA

SEQ ID NO: 559687 - protein, 10 aa, Mycobacterium
RDSRAGDPNL

SEQ ID NO: 559688 - protein, 9 aa, Mycobacterium
RDSRITPTE

SEQ ID NO: 559689 - protein, 4 aa, Mycobacterium
RDSS

SEQ ID NO: 559690 - protein, 8 aa, Mycobacterium
RDSSAAAP

SEQ ID NO: 559691 - protein, 7 aa, Mycobacterium
RDSSGRV

SEQ ID NO: 559692 - protein, 8 aa, Mycobacterium
RDSSPSLA

SEQ ID NO: 559693 - protein, 8 aa, Mycobacterium
RDSSTFNP

SEQ ID NO: 559694 - protein, 17 aa, Mycobacterium
RDSSTGKTVDNINPANE

SEQ ID NO: 559695 - protein, 4 aa, Mycobacterium
RDST

SEQ ID NO: 559696 - protein, 16 aa, Mycobacterium
RDSTDSADSANPTLGG

SEQ ID NO: 559697 - protein, 5 aa, Mycobacterium
RDSTF

SEQ ID NO: 559698 - protein, 7 aa, Mycobacterium
RDSVEQE

SEQ ID NO: 559699 - protein, 6 aa, Mycobacterium
RDSVGT

SEQ ID NO: 559700 - protein, 4 aa, Mycobacterium
RDSY

SEQ ID NO: 559701 - protein, 7 aa, Mycobacterium
RDSYDAD

SEQ ID NO: 559702 - protein, 4 aa, Mycobacterium
RDTA

SEQ ID NO: 559703 - protein, 5 aa, Mycobacterium
RDTAA

SEQ ID NO: 559704 - protein, 7 aa, Mycobacterium
RDTAAGA

SEQ ID NO: 559705 - protein, 8 aa, Mycobacterium
RDTAAGGD

SEQ ID NO: 559706 - protein, 12 aa, Mycobacterium
RDTAAVGSPIHS

SEQ ID NO: 559707 - protein, 12 aa, Mycobacterium
RDTADELRRRLR

SEQ ID NO: 559708 - protein, 10 aa, Mycobacterium
RDTADISDRE

SEQ ID NO: 559709 - protein, 10 aa, Mycobacterium
RDTADISDRQ

SEQ ID NO: 559710 - protein, 9 aa, Mycobacterium
RDTAEREAR

SEQ ID NO: 559711 - protein, 9 aa, Mycobacterium
RDTAGVETR

SEQ ID NO: 559712 - protein, 20 aa, Mycobacterium
RDTAIRRQGPGGQIGDSVSE

SEQ ID NO: 559713 - protein, 8 aa, Mycobacterium
RDTAKGQA

SEQ ID NO: 559714 - protein, 15 aa, Mycobacterium
RDTAPAGLGLPPPRH

SEQ ID NO: 559715 - protein, 9 aa, Mycobacterium
RDTAPAGPG

SEQ ID NO: 559716 - protein, 9 aa, Mycobacterium
RDTARAVSR

SEQ ID NO: 559717 - protein, 6 aa, Mycobacterium
RDTASI

SEQ ID NO: 559718 - protein, 6 aa, Mycobacterium
RDTATT

SEQ ID NO: 559719 - protein, 5 aa, Mycobacterium
RDTCR

SEQ ID NO: 559720 - protein, 5 aa, Mycobacterium
RDTDA

SEQ ID NO: 559721 - protein, 10 aa, Mycobacterium
RDTDAAQADI

SEQ ID NO: 559722 - protein, 6 aa, Mycobacterium
RDTDAD

SEQ ID NO: 559723 - protein, 5 aa, Mycobacterium
RDTDD

SEQ ID NO: 559724 - protein, 8 aa, Mycobacterium
RDTDDPKV

SEQ ID NO: 559725 - protein, 5 aa, Mycobacterium
RDTDG

SEQ ID NO: 559726 - protein, 6 aa, Mycobacterium
RDTDGA

SEQ ID NO: 559727 - protein, 6 aa, Mycobacterium
RDTDGK

SEQ ID NO: 559728 - protein, 7 aa, Mycobacterium
RDTDGLS

SEQ ID NO: 559729 - protein, 8 aa, Mycobacterium
RDTDGQAY

SEQ ID NO: 559730 - protein, 13 aa, Mycobacterium
RDTDGRAYDGARN

SEQ ID NO: 559731 - protein, 11 aa, Mycobacterium
RDTDGRNASQV

SEQ ID NO: 559732 - protein, 6 aa, Mycobacterium
RDTDGV

SEQ ID NO: 559733 - protein, 6 aa, Mycobacterium
RDTDGY

SEQ ID NO: 559734 - protein, 7 aa, Mycobacterium
RDTDKAV

SEQ ID NO: 559735 - protein, 5 aa, Mycobacterium
RDTDR

SEQ ID NO: 559736 - protein, 6 aa, Mycobacterium
RDTDTA

SEQ ID NO: 559737 - protein, 8 aa, Mycobacterium
RDTDTKHR

SEQ ID NO: 559738 - protein, 5 aa, Mycobacterium
RDTDV

SEQ ID NO: 559739 - protein, 4 aa, Mycobacterium
RDTE

SEQ ID NO: 559740 - protein, 8 aa, Mycobacterium
RDTEAQRE

SEQ ID NO: 559741 - protein, 6 aa, Mycobacterium
RDTEDL

SEQ ID NO: 559742 - protein, 5 aa, Mycobacterium
RDTEG

SEQ ID NO: 559743 - protein, 12 aa, Mycobacterium
RDTEGLSPDQKR

SEQ ID NO: 559744 - protein, 11 aa, Mycobacterium
RDTEPTPDDHA

SEQ ID NO: 559745 - protein, 7 aa, Mycobacterium
RDTESWT

SEQ ID NO: 559746 - protein, 5 aa, Mycobacterium
RDTGA

SEQ ID NO: 559747 - protein, 6 aa, Mycobacterium
RDTGAD

SEQ ID NO: 559748 - protein, 8 aa, Mycobacterium
RDTGILDG

SEQ ID NO: 559749 - protein, 10 aa, Mycobacterium
RDTGITDGPP

SEQ ID NO: 559750 - protein, 8 aa, Mycobacterium
RDTGQLDD

SEQ ID NO: 559751 - protein, 8 aa, Mycobacterium
RDTGSEKR

SEQ ID NO: 559752 - protein, 6 aa, Mycobacterium
RDTGWG

SEQ ID NO: 559753 - protein, 5 aa, Mycobacterium
RDTHD

SEQ ID NO: 559754 - protein, 8 aa, Mycobacterium
RDTHPDDR

SEQ ID NO: 559755 - protein, 9 aa, Mycobacterium
RDTIGPDRS

SEQ ID NO: 559756 - protein, 8 aa, Mycobacterium
RDTIGPRR

SEQ ID NO: 559757 - protein, 13 aa, Mycobacterium
RDTLRAKAPEGLT

SEQ ID NO: 559758 - protein, 5 aa, Mycobacterium
RDTLT

SEQ ID NO: 559759 - protein, 8 aa, Mycobacterium
RDTMGDND

SEQ ID NO: 559760 - protein, 5 aa, Mycobacterium
RDTNA

SEQ ID NO: 559761 - protein, 8 aa, Mycobacterium
RDTPAAEL

SEQ ID NO: 559762 - protein, 7 aa, Mycobacterium
RDTPDER

SEQ ID NO: 559763 - protein, 11 aa, Mycobacterium
RDTPGEQTGGD

SEQ ID NO: 559764 - protein, 7 aa, Mycobacterium
RDTPKER

SEQ ID NO: 559765 - protein, 9 aa, Mycobacterium
RDTPLPQRS

SEQ ID NO: 559766 - protein, 8 aa, Mycobacterium
RDTPPDRL

SEQ ID NO: 559767 - protein, 8 aa, Mycobacterium
RDTPPSDV

SEQ ID NO: 559768 - protein, 11 aa, Mycobacterium
RDTPRAPSANL

SEQ ID NO: 559769 - protein, 6 aa, Mycobacterium
RDTPRS

SEQ ID NO: 559770 - protein, 11 aa, Mycobacterium
RDTPRTPSPGL

SEQ ID NO: 559771 - protein, 15 aa, Mycobacterium
RDTPYEVDDETGPVN

SEQ ID NO: 559772 - protein, 4 aa, Mycobacterium
RDTQ

SEQ ID NO: 559773 - protein, 16 aa, Mycobacterium
RDTQERRAKRAEKDLR

SEQ ID NO: 559774 - protein, 14 aa, Mycobacterium
RDTQKLSDEAAEEL

SEQ ID NO: 559775 - protein, 8 aa, Mycobacterium
RDTQPEGY

SEQ ID NO: 559776 - protein, 14 aa, Mycobacterium
RDTQRGSRRRSEIP

SEQ ID NO: 559777 - protein, 7 aa, Mycobacterium
RDTQVAE

SEQ ID NO: 559778 - protein, 4 aa, Mycobacterium
RDTR

SEQ ID NO: 559779 - protein, 9 aa, Mycobacterium
RDTRAPGID

SEQ ID NO: 559780 - protein, 14 aa, Mycobacterium
RDTRDAKAPAVNER

SEQ ID NO: 559781 - protein, 6 aa, Mycobacterium
RDTREA

SEQ ID NO: 559782 - protein, 19 aa, Mycobacterium
RDTRGREISAACGQLAFEN

SEQ ID NO: 559783 - protein, 7 aa, Mycobacterium
RDTRKKM

SEQ ID NO: 559784 - protein, 5 aa, Mycobacterium
RDTRR

SEQ ID NO: 559785 - protein, 12 aa, Mycobacterium
RDTRRQLAGDES

SEQ ID NO: 559786 - protein, 10 aa, Mycobacterium
RDTSADAWTQ

SEQ ID NO: 559787 - protein, 9 aa, Mycobacterium
RDTSAQAWA

SEQ ID NO: 559788 - protein, 9 aa, Mycobacterium
RDTSDAEDL

SEQ ID NO: 559789 - protein, 7 aa, Mycobacterium
RDTSDEQ

SEQ ID NO: 559790 - protein, 11 aa, Mycobacterium
RDTSGRPGHNQ

SEQ ID NO: 559791 - protein, 18 aa, Mycobacterium
RDTSKDPVGSAGTDPDGI

SEQ ID NO: 559792 - protein, 16 aa, Mycobacterium
RDTSLTVPAKTSAGYP

SEQ ID NO: 559793 - protein, 8 aa, Mycobacterium
RDTSPEGY

SEQ ID NO: 559794 - protein, 12 aa, Mycobacterium
RDTSPSPPAVTD

SEQ ID NO: 559795 - protein, 7 aa, Mycobacterium
RDTSRRA

SEQ ID NO: 559796 - protein, 12 aa, Mycobacterium
RDTSRSAPPSVE

SEQ ID NO: 559797 - protein, 10 aa, Mycobacterium
RDTSTYPSAV

SEQ ID NO: 559798 - protein, 21 aa, Mycobacterium
RDTTAARGLTGAGRAGENADL

SEQ ID NO: 559799 - protein, 17 aa, Mycobacterium
RDTTDRALAARRGDPVI

SEQ ID NO: 559800 - protein, 8 aa, Mycobacterium
RDTTGTLG

SEQ ID NO: 559801 - protein, 6 aa, Mycobacterium
RDTTHR

SEQ ID NO: 559802 - protein, 17 aa, Mycobacterium
RDTTLDVPTRQSSGYPV

SEQ ID NO: 559803 - protein, 16 aa, Mycobacterium
RDTTLEVPDKTSTGYP

SEQ ID NO: 559804 - protein, 9 aa, Mycobacterium
RDTTSDNVQ

SEQ ID NO: 559805 - protein, 8 aa, Mycobacterium
RDTTSDTV

SEQ ID NO: 559806 - protein, 12 aa, Mycobacterium
RDTVVSPENSRR

SEQ ID NO: 559807 - protein, 8 aa, Mycobacterium
RDTYRPPE

SEQ ID NO: 559808 - protein, 9 aa, Mycobacterium
RDTYRPPKA

SEQ ID NO: 559809 - protein, 22 aa, Mycobacterium
RDTYTKSLREAQANGHLTPQDA

SEQ ID NO: 559810 - protein, 5 aa, Mycobacterium
RDVAA

SEQ ID NO: 559811 - protein, 4 aa, Mycobacterium
RDVD

SEQ ID NO: 559812 - protein, 6 aa, Mycobacterium
RDVDGA

SEQ ID NO: 559813 - protein, 7 aa, Mycobacterium
RDVDGAA

SEQ ID NO: 559814 - protein, 8 aa, Mycobacterium
RDVDPAVA

SEQ ID NO: 559815 - protein, 9 aa, Mycobacterium
RDVDPTVAG

SEQ ID NO: 559816 - protein, 6 aa, Mycobacterium
RDVEAG

SEQ ID NO: 559817 - protein, 8 aa, Mycobacterium
RDVGDDEH

SEQ ID NO: 559818 - protein, 5 aa, Mycobacterium
RDVGN

SEQ ID NO: 559819 - protein, 10 aa, Mycobacterium
RDVGQRAAQL

SEQ ID NO: 559820 - protein, 6 aa, Mycobacterium
RDVGRT

SEQ ID NO: 559821 - protein, 8 aa, Mycobacterium
RDVGTGGR

SEQ ID NO: 559822 - protein, 9 aa, Mycobacterium
RDVNPPAPL

SEQ ID NO: 559823 - protein, 4 aa, Mycobacterium
RDVP

SEQ ID NO: 559824 - protein, 24 aa, Mycobacterium
RDVPAPGDTVSPSFSGRPPTQAAL

SEQ ID NO: 559825 - protein, 6 aa, Mycobacterium
RDVPPG

SEQ ID NO: 559826 - protein, 6 aa, Mycobacterium
RDVQAG

SEQ ID NO: 559827 - protein, 7 aa, Mycobacterium
RDVQRAE

SEQ ID NO: 559828 - protein, 7 aa, Mycobacterium
RDVREGP

SEQ ID NO: 559829 - protein, 11 aa, Mycobacterium
RDVRGLDTSGL

SEQ ID NO: 559830 - protein, 16 aa, Mycobacterium
RDVSAEPGAAAAGGIG

SEQ ID NO: 559831 - protein, 14 aa, Mycobacterium
RDVTARGSDPAAAL

SEQ ID NO: 559832 - protein, 8 aa, Mycobacterium
RDVTDDEH

SEQ ID NO: 559833 - protein, 11 aa, Mycobacterium
RDVTGVPPQQR

SEQ ID NO: 559834 - protein, 19 aa, Mycobacterium
RDVTMDSSSVGIPTDAPDG

SEQ ID NO: 559835 - protein, 5 aa, Mycobacterium
RDVTS

SEQ ID NO: 559836 - protein, 11 aa, Mycobacterium
RDVTSATPRER

SEQ ID NO: 559837 - protein, 6 aa, Mycobacterium
RDVTTG

SEQ ID NO: 559838 - protein, 10 aa, Mycobacterium
RDWGSPAIPE

SEQ ID NO: 559839 - protein, 10 aa, Mycobacterium
RDWGSPKIPE

SEQ ID NO: 559840 - protein, 11 aa, Mycobacterium
RDWGSPKIPEK

SEQ ID NO: 559841 - protein, 11 aa, Mycobacterium
RDWGSPKIPEQ

SEQ ID NO: 559842 - protein, 6 aa, Mycobacterium
RDWSDG

SEQ ID NO: 559843 - protein, 10 aa, Mycobacterium
RDWSRTEVQG

SEQ ID NO: 559844 - protein, 8 aa, Mycobacterium
RDYDPAYS

SEQ ID NO: 559845 - protein, 6 aa, Mycobacterium
RDYDPE

SEQ ID NO: 559846 - protein, 10 aa, Mycobacterium
RDYDPSKGSA

SEQ ID NO: 559847 - protein, 10 aa, Mycobacterium
RDYENQASFA

SEQ ID NO: 559848 - protein, 9 aa, Mycobacterium
RDYNKTSGD

SEQ ID NO: 559849 - protein, 14 aa, Mycobacterium
RDYNTTVGNEEHAS

SEQ ID NO: 559850 - protein, 6 aa, Mycobacterium
RDYPAA

SEQ ID NO: 559851 - protein, 7 aa, Mycobacterium
RDYPHEP

SEQ ID NO: 559852 - protein, 6 aa, Mycobacterium
RDYPNA

SEQ ID NO: 559853 - protein, 8 aa, Mycobacterium
RDYSDVSP

SEQ ID NO: 559854 - protein, 12 aa, Mycobacterium
RDYSKPGKPDID

SEQ ID NO: 559855 - protein, 18 aa, Mycobacterium
RDYSSNRNRPDLDATSRM

SEQ ID NO: 559856 - protein, 7 aa, Mycobacterium
RDYTPED

SEQ ID NO: 559857 - protein, 6 aa, Mycobacterium
REAAAE

SEQ ID NO: 559858 - protein, 6 aa, Mycobacterium
REAAAT

SEQ ID NO: 559859 - protein, 14 aa, Mycobacterium
REAADAAGPGRSKQ

SEQ ID NO: 559860 - protein, 11 aa, Mycobacterium
REAADRGLTNA

SEQ ID NO: 559861 - protein, 8 aa, Mycobacterium
REAAEATR

SEQ ID NO: 559862 - protein, 8 aa, Mycobacterium
REAAEDDV

SEQ ID NO: 559863 - protein, 7 aa, Mycobacterium
REAAENP

SEQ ID NO: 559864 - protein, 21 aa, Mycobacterium
REAAERDIAERADPLGCSRRD

SEQ ID NO: 559865 - protein, 16 aa, Mycobacterium
REAAERDIQKKRQAGL

SEQ ID NO: 559866 - protein, 11 aa, Mycobacterium
REAAERVAGSR

SEQ ID NO: 559867 - protein, 11 aa, Mycobacterium
REAAEWSRTHR

SEQ ID NO: 559868 - protein, 11 aa, Mycobacterium
REAAGGTLTGA

SEQ ID NO: 559869 - protein, 6 aa, Mycobacterium
REAAIK

SEQ ID NO: 559870 - protein, 5 aa, Mycobacterium
REAAP

SEQ ID NO: 559871 - protein, 8 aa, Mycobacterium
REAAPNGI

SEQ ID NO: 559872 - protein, 5 aa, Mycobacterium
REAAR

SEQ ID NO: 559873 - protein, 9 aa, Mycobacterium
REAAREGGH

SEQ ID NO: 559874 - protein, 8 aa, Mycobacterium
REAARNSQ

SEQ ID NO: 559875 - protein, 6 aa, Mycobacterium
REAARR

SEQ ID NO: 559876 - protein, 6 aa, Mycobacterium
REAART

SEQ ID NO: 559877 - protein, 9 aa, Mycobacterium
REAASMDPQ

SEQ ID NO: 559878 - protein, 11 aa, Mycobacterium
REAATPSRAYA

SEQ ID NO: 559879 - protein, 11 aa, Mycobacterium
REAATSAGLGA

SEQ ID NO: 559880 - protein, 4 aa, Mycobacterium
READ

SEQ ID NO: 559881 - protein, 8 aa, Mycobacterium
READAGDA

SEQ ID NO: 559882 - protein, 19 aa, Mycobacterium
READAGRPPYPLPSYWLLS

SEQ ID NO: 559883 - protein, 6 aa, Mycobacterium
READAY

SEQ ID NO: 559884 - protein, 6 aa, Mycobacterium
READED

SEQ ID NO: 559885 - protein, 15 aa, Mycobacterium
READGALTADYEGTL

SEQ ID NO: 559886 - protein, 9 aa, Mycobacterium
READGASDD

SEQ ID NO: 559887 - protein, 22 aa, Mycobacterium
READGHSVTPTAESVHGAGHRE

SEQ ID NO: 559888 - protein, 6 aa, Mycobacterium
READGP

SEQ ID NO: 559889 - protein, 7 aa, Mycobacterium
READGPV

SEQ ID NO: 559890 - protein, 9 aa, Mycobacterium
READGSRLE

SEQ ID NO: 559891 - protein, 6 aa, Mycobacterium
READNG

SEQ ID NO: 559892 - protein, 8 aa, Mycobacterium
READNKTR

SEQ ID NO: 559893 - protein, 11 aa, Mycobacterium
READPDDRRKS

SEQ ID NO: 559894 - protein, 17 aa, Mycobacterium
READPNRSLVGRLFRSD

SEQ ID NO: 559895 - protein, 5 aa, Mycobacterium
READR

SEQ ID NO: 559896 - protein, 12 aa, Mycobacterium
READSPAARQAA

SEQ ID NO: 559897 - protein, 14 aa, Mycobacterium
READTRGDGRSRGQ

SEQ ID NO: 559898 - protein, 5 aa, Mycobacterium
REAEA

SEQ ID NO: 559899 - protein, 9 aa, Mycobacterium
REAEAATTL

SEQ ID NO: 559900 - protein, 11 aa, Mycobacterium
REAEAKGRGAV

SEQ ID NO: 559901 - protein, 7 aa, Mycobacterium
REAEASG

SEQ ID NO: 559902 - protein, 19 aa, Mycobacterium
REAEHDDRIATQGSESYAE

SEQ ID NO: 559903 - protein, 18 aa, Mycobacterium
REAELAADEAAKRAYQQA

SEQ ID NO: 559904 - protein, 5 aa, Mycobacterium
REAEN

SEQ ID NO: 559905 - protein, 6 aa, Mycobacterium
REAEPE

SEQ ID NO: 559906 - protein, 6 aa, Mycobacterium
REAEQN

SEQ ID NO: 559907 - protein, 13 aa, Mycobacterium
REAERGLDPRDVG

SEQ ID NO: 559908 - protein, 22 aa, Mycobacterium
REAFESGRGAARRAGKTVITVG

SEQ ID NO: 559909 - protein, 22 aa, Mycobacterium
REAFESRNRPGHRPGKTVIVVR

SEQ ID NO: 559910 - protein, 5 aa, Mycobacterium
REAFG

SEQ ID NO: 559911 - protein, 9 aa, Mycobacterium
REAFNRRRG

SEQ ID NO: 559912 - protein, 5 aa, Mycobacterium
REAGA

SEQ ID NO: 559913 - protein, 6 aa, Mycobacterium
REAGAI

SEQ ID NO: 559914 - protein, 8 aa, Mycobacterium
REAGAPAA

SEQ ID NO: 559915 - protein, 7 aa, Mycobacterium
REAGATP

SEQ ID NO: 559916 - protein, 15 aa, Mycobacterium
REAGDPPRLGGPGPV

SEQ ID NO: 559917 - protein, 14 aa, Mycobacterium
REAGDPPRLPAPGP

SEQ ID NO: 559918 - protein, 10 aa, Mycobacterium
REAGDTRTQA

SEQ ID NO: 559919 - protein, 8 aa, Mycobacterium
REAGEADI

SEQ ID NO: 559920 - protein, 9 aa, Mycobacterium
REAGEGLRD

SEQ ID NO: 559921 - protein, 13 aa, Mycobacterium
REAGEPHGRPRAK

SEQ ID NO: 559922 - protein, 13 aa, Mycobacterium
REAGGGDKPVQAG

SEQ ID NO: 559923 - protein, 18 aa, Mycobacterium
REAGGTVIEEPSQQPYGK

SEQ ID NO: 559924 - protein, 13 aa, Mycobacterium
REAGHDAAAERVQ

SEQ ID NO: 559925 - protein, 8 aa, Mycobacterium
REAGKTGG

SEQ ID NO: 559926 - protein, 7 aa, Mycobacterium
REAGLSD

SEQ ID NO: 559927 - protein, 14 aa, Mycobacterium
REAGLSENSVRRRV

SEQ ID NO: 559928 - protein, 10 aa, Mycobacterium
REAGNEEPHL

SEQ ID NO: 559929 - protein, 8 aa, Mycobacterium
REAGNGQV

SEQ ID NO: 559930 - protein, 17 aa, Mycobacterium
REAGNPVVQAAAPAPPK

SEQ ID NO: 559931 - protein, 9 aa, Mycobacterium
REAGPDVTT

SEQ ID NO: 559932 - protein, 8 aa, Mycobacterium
REAGPHES

SEQ ID NO: 559933 - protein, 9 aa, Mycobacterium
REAGRGAPD

SEQ ID NO: 559934 - protein, 9 aa, Mycobacterium
REAGSQDVP

SEQ ID NO: 559935 - protein, 8 aa, Mycobacterium
REAGVAKP

SEQ ID NO: 559936 - protein, 6 aa, Mycobacterium
REAGVD

SEQ ID NO: 559937 - protein, 10 aa, Mycobacterium
REAGVPPTET

SEQ ID NO: 559938 - protein, 6 aa, Mycobacterium
REAGYS

SEQ ID NO: 559939 - protein, 9 aa, Mycobacterium
REAHSLDPQ

SEQ ID NO: 559940 - protein, 4 aa, Mycobacterium
REAI

SEQ ID NO: 559941 - protein, 9 aa, Mycobacterium
REAIGDAPG

SEQ ID NO: 559942 - protein, 7 aa, Mycobacterium
REAIGED

SEQ ID NO: 559943 - protein, 11 aa, Mycobacterium
REAISDVPKDR

SEQ ID NO: 559944 - protein, 14 aa, Mycobacterium
REAKDAKNEAASEE

SEQ ID NO: 559945 - protein, 11 aa, Mycobacterium
REAKDANANEE

SEQ ID NO: 559946 - protein, 14 aa, Mycobacterium
REAKNAKNEAASEE

SEQ ID NO: 559947 - protein, 29 aa, Mycobacterium
REALGGRPFGDGTPPGPPVAGERVPAGHG

SEQ ID NO: 559948 - protein, 6 aa, Mycobacterium
REALGR

SEQ ID NO: 559949 - protein, 11 aa, Mycobacterium
REAMPSSDVDS

SEQ ID NO: 559950 - protein, 9 aa, Mycobacterium
REANANDRR

SEQ ID NO: 559951 - protein, 6 aa, Mycobacterium
REANGV

SEQ ID NO: 559952 - protein, 6 aa, Mycobacterium
REAPAR

SEQ ID NO: 559953 - protein, 7 aa, Mycobacterium
REAPDAA

SEQ ID NO: 559954 - protein, 7 aa, Mycobacterium
REAPEAA

SEQ ID NO: 559955 - protein, 8 aa, Mycobacterium
REAPERGT

SEQ ID NO: 559956 - protein, 8 aa, Mycobacterium
REAPGRGT

SEQ ID NO: 559957 - protein, 10 aa, Mycobacterium
REAPGRKGPW

SEQ ID NO: 559958 - protein, 8 aa, Mycobacterium
REAPLPGV

SEQ ID NO: 559959 - protein, 8 aa, Mycobacterium
REAPPLPA

SEQ ID NO: 559960 - protein, 7 aa, Mycobacterium
REAPREA

SEQ ID NO: 559961 - protein, 10 aa, Mycobacterium
REAPSDLPPR

SEQ ID NO: 559962 - protein, 14 aa, Mycobacterium
REAPTGRLASLVWM

SEQ ID NO: 559963 - protein, 14 aa, Mycobacterium
REAQAGAQHESIDA

SEQ ID NO: 559964 - protein, 11 aa, Mycobacterium
REAQAKEQAMQ

SEQ ID NO: 559965 - protein, 13 aa, Mycobacterium
REAQAPTADEYGP

SEQ ID NO: 559966 - protein, 17 aa, Mycobacterium
REAQKEWEARGPKGRAK

SEQ ID NO: 559967 - protein, 7 aa, Mycobacterium
REAQPGK

SEQ ID NO: 559968 - protein, 15 aa, Mycobacterium
REAQRNGSVRAGDPV

SEQ ID NO: 559969 - protein, 8 aa, Mycobacterium
REAQSRAP

SEQ ID NO: 559970 - protein, 13 aa, Mycobacterium
REARDQAETRRRA

SEQ ID NO: 559971 - protein, 7 aa, Mycobacterium
REAREFE

SEQ ID NO: 559972 - protein, 8 aa, Mycobacterium
REARGGTI

SEQ ID NO: 559973 - protein, 7 aa, Mycobacterium
REARQEP

SEQ ID NO: 559974 - protein, 10 aa, Mycobacterium
REARRAEKIT

SEQ ID NO: 559975 - protein, 12 aa, Mycobacterium
REARSGDQSYWT

SEQ ID NO: 559976 - protein, 7 aa, Mycobacterium
REARSRG

SEQ ID NO: 559977 - protein, 10 aa, Mycobacterium
REARTAGRLQ

SEQ ID NO: 559978 - protein, 12 aa, Mycobacterium
REARTSDDKPNR

SEQ ID NO: 559979 - protein, 10 aa, Mycobacterium
REASAPRDEL

SEQ ID NO: 559980 - protein, 17 aa, Mycobacterium
REASAQQRLGASRDHSA

SEQ ID NO: 559981 - protein, 10 aa, Mycobacterium
REASDADQRA

SEQ ID NO: 559982 - protein, 10 aa, Mycobacterium
REASGPELAA

SEQ ID NO: 559983 - protein, 6 aa, Mycobacterium
REASPV

SEQ ID NO: 559984 - protein, 13 aa, Mycobacterium
REASQGEAGEDID

SEQ ID NO: 559985 - protein, 5 aa, Mycobacterium
REASR

SEQ ID NO: 559986 - protein, 7 aa, Mycobacterium
REATAAF

SEQ ID NO: 559987 - protein, 18 aa, Mycobacterium
REATADTGRHIPVFRLTP

SEQ ID NO: 559988 - protein, 8 aa, Mycobacterium
REATAMDP

SEQ ID NO: 559989 - protein, 9 aa, Mycobacterium
REATAMDPQ

SEQ ID NO: 559990 - protein, 9 aa, Mycobacterium
REATEESGI

SEQ ID NO: 559991 - protein, 10 aa, Mycobacterium
REATEESGIE

SEQ ID NO: 559992 - protein, 10 aa, Mycobacterium
REATEESGIS

SEQ ID NO: 559993 - protein, 9 aa, Mycobacterium
REATEESGV

SEQ ID NO: 559994 - protein, 8 aa, Mycobacterium
REATEPMR

SEQ ID NO: 559995 - protein, 12 aa, Mycobacterium
REATEQETARNM

SEQ ID NO: 559996 - protein, 6 aa, Mycobacterium
REATEV

SEQ ID NO: 559997 - protein, 8 aa, Mycobacterium
REATGGAG

SEQ ID NO: 559998 - protein, 17 aa, Mycobacterium
REATGHADSTDTLIGAQ

SEQ ID NO: 559999 - protein, 5 aa, Mycobacterium
REATH

SEQ ID NO: 560000 - protein, 12 aa, Mycobacterium
REATNGRLGGPV

SEQ ID NO: 560001 - protein, 11 aa, Mycobacterium
REATNGTPDTD

SEQ ID NO: 560002 - protein, 9 aa, Mycobacterium
REATRRGVP

SEQ ID NO: 560003 - protein, 9 aa, Mycobacterium
REATSIDPQ

SEQ ID NO: 560004 - protein, 7 aa, Mycobacterium
REAVEND

SEQ ID NO: 560005 - protein, 7 aa, Mycobacterium
REAVSEA

SEQ ID NO: 560006 - protein, 12 aa, Mycobacterium
REAWSTAGEFAR

SEQ ID NO: 560007 - protein, 11 aa, Mycobacterium
REAYGDTSQLS

SEQ ID NO: 560008 - protein, 11 aa, Mycobacterium
REAYGDTSQMS

SEQ ID NO: 560009 - protein, 14 aa, Mycobacterium
RECEGDGPSELSAA

SEQ ID NO: 560010 - protein, 14 aa, Mycobacterium
RECEGDGPSPISAA

SEQ ID NO: 560011 - protein, 5 aa, Mycobacterium
RECSP

SEQ ID NO: 560012 - protein, 5 aa, Mycobacterium
REDAD

SEQ ID NO: 560013 - protein, 6 aa, Mycobacterium
REDADG

SEQ ID NO: 560014 - protein, 8 aa, Mycobacterium
REDADGVT

SEQ ID NO: 560015 - protein, 8 aa, Mycobacterium
REDAGGPA

SEQ ID NO: 560016 - protein, 6 aa, Mycobacterium
REDAPH

SEQ ID NO: 560017 - protein, 19 aa, Mycobacterium
REDASRYPAEFSGGQKQRI

SEQ ID NO: 560018 - protein, 4 aa, Mycobacterium
REDD

SEQ ID NO: 560019 - protein, 21 aa, Mycobacterium
REDDEGKLSRRPPSKLSEAAA

SEQ ID NO: 560020 - protein, 12 aa, Mycobacterium
REDDEVTLDGPG

SEQ ID NO: 560021 - protein, 7 aa, Mycobacterium
REDDGAL

SEQ ID NO: 560022 - protein, 7 aa, Mycobacterium
REDDKDL

SEQ ID NO: 560023 - protein, 7 aa, Mycobacterium
REDDPNS

SEQ ID NO: 560024 - protein, 10 aa, Mycobacterium
REDDREYLGA

SEQ ID NO: 560025 - protein, 9 aa, Mycobacterium
REDDTVEIG

SEQ ID NO: 560026 - protein, 6 aa, Mycobacterium
REDEAA

SEQ ID NO: 560027 - protein, 9 aa, Mycobacterium
REDEATGAA

SEQ ID NO: 560028 - protein, 8 aa, Mycobacterium
REDEDALS

SEQ ID NO: 560029 - protein, 15 aa, Mycobacterium
REDEDRMPVAPGGIR

SEQ ID NO: 560030 - protein, 7 aa, Mycobacterium
REDEDSF

SEQ ID NO: 560031 - protein, 5 aa, Mycobacterium
REDEP

SEQ ID NO: 560032 - protein, 6 aa, Mycobacterium
REDFGT

SEQ ID NO: 560033 - protein, 7 aa, Mycobacterium
REDFPPN

SEQ ID NO: 560034 - protein, 4 aa, Mycobacterium
REDG

SEQ ID NO: 560035 - protein, 14 aa, Mycobacterium
REDGCPPGSIGKGF

SEQ ID NO: 560036 - protein, 11 aa, Mycobacterium
REDGDYSPRLN

SEQ ID NO: 560037 - protein, 6 aa, Mycobacterium
REDGGA

SEQ ID NO: 560038 - protein, 8 aa, Mycobacterium
REDGGKAH

SEQ ID NO: 560039 - protein, 5 aa, Mycobacterium
REDGN

SEQ ID NO: 560040 - protein, 6 aa, Mycobacterium
REDGPD

SEQ ID NO: 560041 - protein, 7 aa, Mycobacterium
REDGPDV

SEQ ID NO: 560042 - protein, 8 aa, Mycobacterium
REDGQQSI

SEQ ID NO: 560043 - protein, 8 aa, Mycobacterium
REDGREYL

SEQ ID NO: 560044 - protein, 9 aa, Mycobacterium
REDGREYLG

SEQ ID NO: 560045 - protein, 9 aa, Mycobacterium
REDGSAIPG

SEQ ID NO: 560046 - protein, 5 aa, Mycobacterium
REDGV

SEQ ID NO: 560047 - protein, 5 aa, Mycobacterium
REDHG

SEQ ID NO: 560048 - protein, 9 aa, Mycobacterium
REDKSPLGG

SEQ ID NO: 560049 - protein, 4 aa, Mycobacterium
REDL

SEQ ID NO: 560050 - protein, 7 aa, Mycobacterium
REDLGGA

SEQ ID NO: 560051 - protein, 8 aa, Mycobacterium
REDPDEAR

SEQ ID NO: 560052 - protein, 7 aa, Mycobacterium
REDPPPI

SEQ ID NO: 560053 - protein, 10 aa, Mycobacterium
REDPSANLAA

SEQ ID NO: 560054 - protein, 13 aa, Mycobacterium
REDPSHPASADPF

SEQ ID NO: 560055 - protein, 10 aa, Mycobacterium
REDPSSVDPS

SEQ ID NO: 560056 - protein, 7 aa, Mycobacterium
REDPTFP

SEQ ID NO: 560057 - protein, 8 aa, Mycobacterium
REDQPGDR

SEQ ID NO: 560058 - protein, 12 aa, Mycobacterium
REDQPYKESYGM

SEQ ID NO: 560059 - protein, 8 aa, Mycobacterium
REDQRQAV

SEQ ID NO: 560060 - protein, 8 aa, Mycobacterium
REDQTPLG

SEQ ID NO: 560061 - protein, 15 aa, Mycobacterium
REDRDVGEDAAADTP

SEQ ID NO: 560062 - protein, 15 aa, Mycobacterium
REDRGWPADPQLGET

SEQ ID NO: 560063 - protein, 7 aa, Mycobacterium
REDRLAG

SEQ ID NO: 560064 - protein, 9 aa, Mycobacterium
REDRPATSG

SEQ ID NO: 560065 - protein, 8 aa, Mycobacterium
REDRPGDR

SEQ ID NO: 560066 - protein, 9 aa, Mycobacterium
REDRPGNRQ

SEQ ID NO: 560067 - protein, 15 aa, Mycobacterium
REDRPLKREGTPEDI

SEQ ID NO: 560068 - protein, 9 aa, Mycobacterium
REDRQDRYH

SEQ ID NO: 560069 - protein, 9 aa, Mycobacterium
REDRQGRYH

SEQ ID NO: 560070 - protein, 10 aa, Mycobacterium
REDRRGDGLG

SEQ ID NO: 560071 - protein, 6 aa, Mycobacterium
REDRSG

SEQ ID NO: 560072 - protein, 7 aa, Mycobacterium
REDRSRI

SEQ ID NO: 560073 - protein, 4 aa, Mycobacterium
REDS

SEQ ID NO: 560074 - protein, 6 aa, Mycobacterium
REDSPR

SEQ ID NO: 560075 - protein, 16 aa, Mycobacterium
REDSRTDWERGGLPNR

SEQ ID NO: 560076 - protein, 11 aa, Mycobacterium
REDTDKLAGRA

SEQ ID NO: 560077 - protein, 7 aa, Mycobacterium
REDTDSV

SEQ ID NO: 560078 - protein, 13 aa, Mycobacterium
REDTGQAARDIPG

SEQ ID NO: 560079 - protein, 9 aa, Mycobacterium
REDTPGDKR

SEQ ID NO: 560080 - protein, 8 aa, Mycobacterium
REDTREYL

SEQ ID NO: 560081 - protein, 6 aa, Mycobacterium
REDVER

SEQ ID NO: 560082 - protein, 7 aa, Mycobacterium
REDVPED

SEQ ID NO: 560083 - protein, 44 aa, Mycobacterium
REEAAKRGMPERGRRRGAEQPAAPRGVAAPAPGASRPDPADPTL

SEQ ID NO: 560084 - protein, 9 aa, Mycobacterium
REEAAPYAA

SEQ ID NO: 560085 - protein, 8 aa, Mycobacterium
REEADRLG

SEQ ID NO: 560086 - protein, 9 aa, Mycobacterium
REEAEKRGL

SEQ ID NO: 560087 - protein, 41 aa, Mycobacterium
REEAGKAAKGGSVSADRRPRGTETAAAPKVSMPDPKDPTLW

SEQ ID NO: 560088 - protein, 9 aa, Mycobacterium
REEAGKTGP

SEQ ID NO: 560089 - protein, 7 aa, Mycobacterium
REEAGPE

SEQ ID NO: 560090 - protein, 38 aa, Mycobacterium
REEAKGGGRKDNNRRGQETAARPKPPPVQRPDPTDPTL

SEQ ID NO: 560091 - protein, 5 aa, Mycobacterium
REEAP

SEQ ID NO: 560092 - protein, 7 aa, Mycobacterium
REEAPGL

SEQ ID NO: 560093 - protein, 5 aa, Mycobacterium
REEAR

SEQ ID NO: 560094 - protein, 6 aa, Mycobacterium
REEASA

SEQ ID NO: 560095 - protein, 9 aa, Mycobacterium
REEASRCGA

SEQ ID NO: 560096 - protein, 7 aa, Mycobacterium
REEATGQ

SEQ ID NO: 560097 - protein, 10 aa, Mycobacterium
REEDAGPTNN

SEQ ID NO: 560098 - protein, 5 aa, Mycobacterium
REEDK

SEQ ID NO: 560099 - protein, 5 aa, Mycobacterium
REEDV

SEQ ID NO: 560100 - protein, 4 aa, Mycobacterium
REEE

SEQ ID NO: 560101 - protein, 5 aa, Mycobacterium
REEEA

SEQ ID NO: 560102 - protein, 6 aa, Mycobacterium
REEEAA

SEQ ID NO: 560103 - protein, 9 aa, Mycobacterium
REEEGTVEK

SEQ ID NO: 560104 - protein, 4 aa, Mycobacterium
REEF

SEQ ID NO: 560105 - protein, 10 aa, Mycobacterium
REEGKEADPR

SEQ ID NO: 560106 - protein, 5 aa, Mycobacterium
REEGR

SEQ ID NO: 560107 - protein, 8 aa, Mycobacterium
REEGRADL

SEQ ID NO: 560108 - protein, 8 aa, Mycobacterium
REEGSKTY

SEQ ID NO: 560109 - protein, 4 aa, Mycobacterium
REEH

SEQ ID NO: 560110 - protein, 6 aa, Mycobacterium
REEHDA

SEQ ID NO: 560111 - protein, 5 aa, Mycobacterium
REEHG

SEQ ID NO: 560112 - protein, 5 aa, Mycobacterium
REEHS

SEQ ID NO: 560113 - protein, 25 aa, Mycobacterium
REEHSARPADAERGAGDHRRFSCKS

SEQ ID NO: 560114 - protein, 4 aa, Mycobacterium
REEI

SEQ ID NO: 560115 - protein, 12 aa, Mycobacterium
REEKGPKDHTVP

SEQ ID NO: 560116 - protein, 15 aa, Mycobacterium
REELEAKEAEEPTKQ

SEQ ID NO: 560117 - protein, 7 aa, Mycobacterium
REELEDK

SEQ ID NO: 560118 - protein, 21 aa, Mycobacterium
REELRDSGSPATSSLVTEPAA

SEQ ID NO: 560119 - protein, 11 aa, Mycobacterium
REENPDPDTAA

SEQ ID NO: 560120 - protein, 11 aa, Mycobacterium
REENPDPDTPA

SEQ ID NO: 560121 - protein, 10 aa, Mycobacterium
REENPDPTMP

SEQ ID NO: 560122 - protein, 7 aa, Mycobacterium
REENPQE

SEQ ID NO: 560123 - protein, 6 aa, Mycobacterium
REEPGG

SEQ ID NO: 560124 - protein, 20 aa, Mycobacterium
REEPHPSPIVPPRDDDDAAA

SEQ ID NO: 560125 - protein, 20 aa, Mycobacterium
REEPHPSPIVPPRGDGARSA

SEQ ID NO: 560126 - protein, 5 aa, Mycobacterium
REEPI

SEQ ID NO: 560127 - protein, 11 aa, Mycobacterium
REEPIGSVGAG

SEQ ID NO: 560128 - protein, 7 aa, Mycobacterium
REEPKRA

SEQ ID NO: 560129 - protein, 16 aa, Mycobacterium
REEPVRPDDAHSGDAE

SEQ ID NO: 560130 - protein, 4 aa, Mycobacterium
REEQ

SEQ ID NO: 560131 - protein, 5 aa, Mycobacterium
REEQQ

SEQ ID NO: 560132 - protein, 11 aa, Mycobacterium
REEQRRRRQQG

SEQ ID NO: 560133 - protein, 7 aa, Mycobacterium
REERASA

SEQ ID NO: 560134 - protein, 17 aa, Mycobacterium
REERASAEAEAQAAQVY

SEQ ID NO: 560135 - protein, 21 aa, Mycobacterium
REERKGKAASDHAPVQIDIRR

SEQ ID NO: 560136 - protein, 6 aa, Mycobacterium
REESAR

SEQ ID NO: 560137 - protein, 7 aa, Mycobacterium
REESARV

SEQ ID NO: 560138 - protein, 17 aa, Mycobacterium
REESERRETGNVELEIT

SEQ ID NO: 560139 - protein, 5 aa, Mycobacterium
REESG

SEQ ID NO: 560140 - protein, 9 aa, Mycobacterium
REESRDTAH

SEQ ID NO: 560141 - protein, 6 aa, Mycobacterium
REESVE

SEQ ID NO: 560142 - protein, 5 aa, Mycobacterium
REETE

SEQ ID NO: 560143 - protein, 8 aa, Mycobacterium
REETNTLS

SEQ ID NO: 560144 - protein, 8 aa, Mycobacterium
REETSSLS

SEQ ID NO: 560145 - protein, 5 aa, Mycobacterium
REETV

SEQ ID NO: 560146 - protein, 5 aa, Mycobacterium
REEWP

SEQ ID NO: 560147 - protein, 8 aa, Mycobacterium
REEYTDHD

SEQ ID NO: 560148 - protein, 4 aa, Mycobacterium
REFA

SEQ ID NO: 560149 - protein, 6 aa, Mycobacterium
REFATS

SEQ ID NO: 560150 - protein, 10 aa, Mycobacterium
REFGDARTDF

SEQ ID NO: 560151 - protein, 6 aa, Mycobacterium
REFGDT

SEQ ID NO: 560152 - protein, 7 aa, Mycobacterium
REFGGSN

SEQ ID NO: 560153 - protein, 6 aa, Mycobacterium
REFPAK

SEQ ID NO: 560154 - protein, 13 aa, Mycobacterium
REFRTSGDDIAAN

SEQ ID NO: 560155 - protein, 4 aa, Mycobacterium
REFS

SEQ ID NO: 560156 - protein, 4 aa, Mycobacterium
REGA

SEQ ID NO: 560157 - protein, 5 aa, Mycobacterium
REGAA

SEQ ID NO: 560158 - protein, 10 aa, Mycobacterium
REGAADGPEC

SEQ ID NO: 560159 - protein, 9 aa, Mycobacterium
REGADDVER

SEQ ID NO: 560160 - protein, 6 aa, Mycobacterium
REGADK

SEQ ID NO: 560161 - protein, 7 aa, Mycobacterium
REGADYP

SEQ ID NO: 560162 - protein, 10 aa, Mycobacterium
REGAGDTGVT

SEQ ID NO: 560163 - protein, 10 aa, Mycobacterium
REGAGDTGYT

SEQ ID NO: 560164 - protein, 8 aa, Mycobacterium
REGAGGDV

SEQ ID NO: 560165 - protein, 10 aa, Mycobacterium
REGAGTIGAA

SEQ ID NO: 560166 - protein, 5 aa, Mycobacterium
REGAP

SEQ ID NO: 560167 - protein, 5 aa, Mycobacterium
REGAQ

SEQ ID NO: 560168 - protein, 12 aa, Mycobacterium
REGAREADTIAS

SEQ ID NO: 560169 - protein, 7 aa, Mycobacterium
REGATSG

SEQ ID NO: 560170 - protein, 6 aa, Mycobacterium
REGCEN

SEQ ID NO: 560171 - protein, 5 aa, Mycobacterium
REGDA

SEQ ID NO: 560172 - protein, 11 aa, Mycobacterium
REGDAAAEEQL

SEQ ID NO: 560173 - protein, 6 aa, Mycobacterium
REGDID

SEQ ID NO: 560174 - protein, 7 aa, Mycobacterium
REGDPAR

SEQ ID NO: 560175 - protein, 24 aa, Mycobacterium
REGDSSVAPLGAGTGGSKSLLTST

SEQ ID NO: 560176 - protein, 5 aa, Mycobacterium
REGDT

SEQ ID NO: 560177 - protein, 13 aa, Mycobacterium
REGDTRDYTGARN

SEQ ID NO: 560178 - protein, 6 aa, Mycobacterium
REGEDE

SEQ ID NO: 560179 - protein, 11 aa, Mycobacterium
REGEDEDLERA

SEQ ID NO: 560180 - protein, 6 aa, Mycobacterium
REGEGR

SEQ ID NO: 560181 - protein, 6 aa, Mycobacterium
REGEHG

SEQ ID NO: 560182 - protein, 16 aa, Mycobacterium
REGERAASGATAERIR

SEQ ID NO: 560183 - protein, 10 aa, Mycobacterium
REGERGRGRG

SEQ ID NO: 560184 - protein, 9 aa, Mycobacterium
REGEVPPVK

SEQ ID NO: 560185 - protein, 4 aa, Mycobacterium
REGG

SEQ ID NO: 560186 - protein, 14 aa, Mycobacterium
REGGALDAGGSETL

SEQ ID NO: 560187 - protein, 13 aa, Mycobacterium
REGGASRIHPDDT

SEQ ID NO: 560188 - protein, 21 aa, Mycobacterium
REGGEKPSKSGGGGMFGGGSA

SEQ ID NO: 560189 - protein, 8 aa, Mycobacterium
REGGGARL

SEQ ID NO: 560190 - protein, 9 aa, Mycobacterium
REGGGRAVA

SEQ ID NO: 560191 - protein, 9 aa, Mycobacterium
REGGGWGAD

SEQ ID NO: 560192 - protein, 7 aa, Mycobacterium
REGGHSA

SEQ ID NO: 560193 - protein, 8 aa, Mycobacterium
REGGHSQR

SEQ ID NO: 560194 - protein, 7 aa, Mycobacterium
REGGHSR

SEQ ID NO: 560195 - protein, 7 aa, Mycobacterium
REGGHTR

SEQ ID NO: 560196 - protein, 5 aa, Mycobacterium
REGGK

SEQ ID NO: 560197 - protein, 5 aa, Mycobacterium
REGGL

SEQ ID NO: 560198 - protein, 7 aa, Mycobacterium
REGGNRD

SEQ ID NO: 560199 - protein, 11 aa, Mycobacterium
REGGPAAEDVA

SEQ ID NO: 560200 - protein, 11 aa, Mycobacterium
REGGPAATSGV

SEQ ID NO: 560201 - protein, 7 aa, Mycobacterium
REGGPNG

SEQ ID NO: 560202 - protein, 6 aa, Mycobacterium
REGGQA

SEQ ID NO: 560203 - protein, 7 aa, Mycobacterium
REGGRTV

SEQ ID NO: 560204 - protein, 5 aa, Mycobacterium
REGGV

SEQ ID NO: 560205 - protein, 4 aa, Mycobacterium
REGH

SEQ ID NO: 560206 - protein, 8 aa, Mycobacterium
REGIDPRN

SEQ ID NO: 560207 - protein, 42 aa, Mycobacterium
REGKAQQDKADAQQAAAKKEAEAESARAGAKAAEKRQESEQR

SEQ ID NO: 560208 - protein, 14 aa, Mycobacterium
REGLTDRAAGDDDV

SEQ ID NO: 560209 - protein, 14 aa, Mycobacterium
REGLTERASGDDEP

SEQ ID NO: 560210 - protein, 4 aa, Mycobacterium
REGN

SEQ ID NO: 560211 - protein, 5 aa, Mycobacterium
REGNE

SEQ ID NO: 560212 - protein, 8 aa, Mycobacterium
REGNGRTG

SEQ ID NO: 560213 - protein, 10 aa, Mycobacterium
REGNSTRDEI

SEQ ID NO: 560214 - protein, 5 aa, Mycobacterium
REGPI

SEQ ID NO: 560215 - protein, 5 aa, Mycobacterium
REGPK

SEQ ID NO: 560216 - protein, 22 aa, Mycobacterium
REGPQRDRDSYVTDPEPSKGEL

SEQ ID NO: 560217 - protein, 40 aa, Mycobacterium
REGQAQQDKADAQREAAQKEAEAESARKAADINEARQKAE

SEQ ID NO: 560218 - protein, 17 aa, Mycobacterium
REGQDRPDRGRSANGVA

SEQ ID NO: 560219 - protein, 10 aa, Mycobacterium
REGQLPEKKQ

SEQ ID NO: 560220 - protein, 12 aa, Mycobacterium
REGQPDEGREPG

SEQ ID NO: 560221 - protein, 9 aa, Mycobacterium
REGQPRRAA

SEQ ID NO: 560222 - protein, 7 aa, Mycobacterium
REGQQAG

SEQ ID NO: 560223 - protein, 18 aa, Mycobacterium
REGQRRHPSDNTDEPARA

SEQ ID NO: 560224 - protein, 5 aa, Mycobacterium
REGQT

SEQ ID NO: 560225 - protein, 18 aa, Mycobacterium
REGRATAQVQTTLEAFPV

SEQ ID NO: 560226 - protein, 5 aa, Mycobacterium
REGRD

SEQ ID NO: 560227 - protein, 6 aa, Mycobacterium
REGRDA

SEQ ID NO: 560228 - protein, 6 aa, Mycobacterium
REGREA

SEQ ID NO: 560229 - protein, 7 aa, Mycobacterium
REGREAV

SEQ ID NO: 560230 - protein, 5 aa, Mycobacterium
REGRK

SEQ ID NO: 560231 - protein, 6 aa, Mycobacterium
REGRLR

SEQ ID NO: 560232 - protein, 5 aa, Mycobacterium
REGRR

SEQ ID NO: 560233 - protein, 5 aa, Mycobacterium
REGRT

SEQ ID NO: 560234 - protein, 8 aa, Mycobacterium
REGSARAR

SEQ ID NO: 560235 - protein, 9 aa, Mycobacterium
REGSARSRD

SEQ ID NO: 560236 - protein, 5 aa, Mycobacterium
REGSD

SEQ ID NO: 560237 - protein, 13 aa, Mycobacterium
REGSDGKQVAEGI

SEQ ID NO: 560238 - protein, 11 aa, Mycobacterium
REGSDGKSVAE

SEQ ID NO: 560239 - protein, 17 aa, Mycobacterium
REGSDNRSASHPSTGAR

SEQ ID NO: 560240 - protein, 8 aa, Mycobacterium
REGSDTIA

SEQ ID NO: 560241 - protein, 9 aa, Mycobacterium
REGSDTVAE

SEQ ID NO: 560242 - protein, 7 aa, Mycobacterium
REGSEEY

SEQ ID NO: 560243 - protein, 13 aa, Mycobacterium
REGSEYDSAKDVQ

SEQ ID NO: 560244 - protein, 8 aa, Mycobacterium
REGSGKGV

SEQ ID NO: 560245 - protein, 8 aa, Mycobacterium
REGSGRGE

SEQ ID NO: 560246 - protein, 6 aa, Mycobacterium
REGSGT

SEQ ID NO: 560247 - protein, 15 aa, Mycobacterium
REGSKSREKVTEQGL

SEQ ID NO: 560248 - protein, 7 aa, Mycobacterium
REGSPVK

SEQ ID NO: 560249 - protein, 15 aa, Mycobacterium
REGSSAEHDAAERSP

SEQ ID NO: 560250 - protein, 7 aa, Mycobacterium
REGTAER

SEQ ID NO: 560251 - protein, 14 aa, Mycobacterium
REGTALDAGGSETL

SEQ ID NO: 560252 - protein, 5 aa, Mycobacterium
REGTD

SEQ ID NO: 560253 - protein, 14 aa, Mycobacterium
REGTIAAPKDQLRN

SEQ ID NO: 560254 - protein, 5 aa, Mycobacterium
REGTN

SEQ ID NO: 560255 - protein, 6 aa, Mycobacterium
REGTPV

SEQ ID NO: 560256 - protein, 6 aa, Mycobacterium
REGTVE

SEQ ID NO: 560257 - protein, 8 aa, Mycobacterium
REGTVREA

SEQ ID NO: 560258 - protein, 8 aa, Mycobacterium
REGVGTLD

SEQ ID NO: 560259 - protein, 6 aa, Mycobacterium
REGVRS

SEQ ID NO: 560260 - protein, 4 aa, Mycobacterium
REGW

SEQ ID NO: 560261 - protein, 5 aa, Mycobacterium
REGWP

SEQ ID NO: 560262 - protein, 7 aa, Mycobacterium
REGWSES

SEQ ID NO: 560263 - protein, 4 aa, Mycobacterium
REGY

SEQ ID NO: 560264 - protein, 12 aa, Mycobacterium
REGYAESDRNWT

SEQ ID NO: 560265 - protein, 4 aa, Mycobacterium
REHA

SEQ ID NO: 560266 - protein, 7 aa, Mycobacterium
REHAPEL

SEQ ID NO: 560267 - protein, 9 aa, Mycobacterium
REHARERGQ

SEQ ID NO: 560268 - protein, 17 aa, Mycobacterium
REHARTDWDNDGIPTRE

SEQ ID NO: 560269 - protein, 17 aa, Mycobacterium
REHARTDWDNDGVPTRE

SEQ ID NO: 560270 - protein, 5 aa, Mycobacterium
REHDS

SEQ ID NO: 560271 - protein, 10 aa, Mycobacterium
REHGADDPRI

SEQ ID NO: 560272 - protein, 7 aa, Mycobacterium
REHGGAS

SEQ ID NO: 560273 - protein, 6 aa, Mycobacterium
REHGGE

SEQ ID NO: 560274 - protein, 7 aa, Mycobacterium
REHGGGR

SEQ ID NO: 560275 - protein, 8 aa, Mycobacterium
REHGRDDP

SEQ ID NO: 560276 - protein, 7 aa, Mycobacterium
REHGRGP

SEQ ID NO: 560277 - protein, 5 aa, Mycobacterium
REHGV

SEQ ID NO: 560278 - protein, 4 aa, Mycobacterium
REHH

SEQ ID NO: 560279 - protein, 5 aa, Mycobacterium
REHHD

SEQ ID NO: 560280 - protein, 17 aa, Mycobacterium
REHHGADRDVDADAQSV

SEQ ID NO: 560281 - protein, 6 aa, Mycobacterium
REHKRD

SEQ ID NO: 560282 - protein, 4 aa, Mycobacterium
REHN

SEQ ID NO: 560283 - protein, 5 aa, Mycobacterium
REHNL

SEQ ID NO: 560284 - protein, 5 aa, Mycobacterium
REHPD

SEQ ID NO: 560285 - protein, 7 aa, Mycobacterium
REHPDAE

SEQ ID NO: 560286 - protein, 7 aa, Mycobacterium
REHPGWN

SEQ ID NO: 560287 - protein, 5 aa, Mycobacterium
REHPN

SEQ ID NO: 560288 - protein, 10 aa, Mycobacterium
REHPSAPDEH

SEQ ID NO: 560289 - protein, 18 aa, Mycobacterium
REHQGDSSDASGDASDVE

SEQ ID NO: 560290 - protein, 11 aa, Mycobacterium
REHRGPDASAY

SEQ ID NO: 560291 - protein, 7 aa, Mycobacterium
REHRRGR

SEQ ID NO: 560292 - protein, 4 aa, Mycobacterium
REHS

SEQ ID NO: 560293 - protein, 6 aa, Mycobacterium
REHSAS

SEQ ID NO: 560294 - protein, 8 aa, Mycobacterium
REHSGTAA

SEQ ID NO: 560295 - protein, 7 aa, Mycobacterium
REHTETP

SEQ ID NO: 560296 - protein, 10 aa, Mycobacterium
REHTGDGPAE

SEQ ID NO: 560297 - protein, 8 aa, Mycobacterium
REHTGPPE

SEQ ID NO: 560298 - protein, 13 aa, Mycobacterium
REHYGRDDQGGTA

SEQ ID NO: 560299 - protein, 12 aa, Mycobacterium
REIAERGAPPRQ

SEQ ID NO: 560300 - protein, 11 aa, Mycobacterium
REIDESEEHAR

SEQ ID NO: 560301 - protein, 6 aa, Mycobacterium
REIDGS

SEQ ID NO: 560302 - protein, 6 aa, Mycobacterium
REIDSR

SEQ ID NO: 560303 - protein, 12 aa, Mycobacterium
REIEDAAATEIE

SEQ ID NO: 560304 - protein, 10 aa, Mycobacterium
REIEGKPSTT

SEQ ID NO: 560305 - protein, 8 aa, Mycobacterium
REIEGSGY

SEQ ID NO: 560306 - protein, 5 aa, Mycobacterium
REIET

SEQ ID NO: 560307 - protein, 7 aa, Mycobacterium
REIETVE

SEQ ID NO: 560308 - protein, 12 aa, Mycobacterium
REIGQTSDRVAA

SEQ ID NO: 560309 - protein, 5 aa, Mycobacterium
REIPD

SEQ ID NO: 560310 - protein, 12 aa, Mycobacterium
REIRADRPFGTT

SEQ ID NO: 560311 - protein, 10 aa, Mycobacterium
REIRDTAEAL

SEQ ID NO: 560312 - protein, 9 aa, Mycobacterium
REIRDTSEA

SEQ ID NO: 560313 - protein, 6 aa, Mycobacterium
REIRPA

SEQ ID NO: 560314 - protein, 6 aa, Mycobacterium
REISDR

SEQ ID NO: 560315 - protein, 4 aa, Mycobacterium
REIT

SEQ ID NO: 560316 - protein, 19 aa, Mycobacterium
REITAATANSIPPTVGGGN

SEQ ID NO: 560317 - protein, 4 aa, Mycobacterium
REKA

SEQ ID NO: 560318 - protein, 10 aa, Mycobacterium
REKAGDTGAV

SEQ ID NO: 560319 - protein, 8 aa, Mycobacterium
REKAHQPA

SEQ ID NO: 560320 - protein, 9 aa, Mycobacterium
REKASDGTP

SEQ ID NO: 560321 - protein, 9 aa, Mycobacterium
REKDDVTEV

SEQ ID NO: 560322 - protein, 8 aa, Mycobacterium
REKEAQEV

SEQ ID NO: 560323 - protein, 9 aa, Mycobacterium
REKESAASR

SEQ ID NO: 560324 - protein, 5 aa, Mycobacterium
REKGA

SEQ ID NO: 560325 - protein, 6 aa, Mycobacterium
REKGAE

SEQ ID NO: 560326 - protein, 15 aa, Mycobacterium
REKGSWDRDRPYEGQ

SEQ ID NO: 560327 - protein, 7 aa, Mycobacterium
REKGWQQ

SEQ ID NO: 560328 - protein, 14 aa, Mycobacterium
REKHAARAEELAAA

SEQ ID NO: 560329 - protein, 4 aa, Mycobacterium
REKL

SEQ ID NO: 560330 - protein, 15 aa, Mycobacterium
REKLGDPGDRDAENK

SEQ ID NO: 560331 - protein, 31 aa, Mycobacterium
REKLGGRPFGDGTPPGPPRESERVPDPGPCP

SEQ ID NO: 560332 - protein, 8 aa, Mycobacterium
REKNADDW

SEQ ID NO: 560333 - protein, 7 aa, Mycobacterium
REKNPEA

SEQ ID NO: 560334 - protein, 19 aa, Mycobacterium
REKPDHSDTVEGSLEDRGF

SEQ ID NO: 560335 - protein, 14 aa, Mycobacterium
REKPEPDRGRTNLG

SEQ ID NO: 560336 - protein, 6 aa, Mycobacterium
REKPID

SEQ ID NO: 560337 - protein, 8 aa, Mycobacterium
REKPKTED

SEQ ID NO: 560338 - protein, 13 aa, Mycobacterium
REKPKTPKPPREW

SEQ ID NO: 560339 - protein, 6 aa, Mycobacterium
REKPQD

SEQ ID NO: 560340 - protein, 7 aa, Mycobacterium
REKQAAY

SEQ ID NO: 560341 - protein, 12 aa, Mycobacterium
REKQARMSTDAV

SEQ ID NO: 560342 - protein, 9 aa, Mycobacterium
REKRHREQF

SEQ ID NO: 560343 - protein, 5 aa, Mycobacterium
REKRR

SEQ ID NO: 560344 - protein, 9 aa, Mycobacterium
REKSGKGQV

SEQ ID NO: 560345 - protein, 17 aa, Mycobacterium
REKSQAISHPPTTRPIP

SEQ ID NO: 560346 - protein, 7 aa, Mycobacterium
REKSSFG

SEQ ID NO: 560347 - protein, 6 aa, Mycobacterium
REKSYA

SEQ ID NO: 560348 - protein, 9 aa, Mycobacterium
REKTGDTGA

SEQ ID NO: 560349 - protein, 13 aa, Mycobacterium
RELAADDASFADE

SEQ ID NO: 560350 - protein, 8 aa, Mycobacterium
RELADDST

SEQ ID NO: 560351 - protein, 12 aa, Mycobacterium
RELADEKGDRLG

SEQ ID NO: 560352 - protein, 6 aa, Mycobacterium
RELADG

SEQ ID NO: 560353 - protein, 8 aa, Mycobacterium
RELAESSG

SEQ ID NO: 560354 - protein, 6 aa, Mycobacterium
RELAQA

SEQ ID NO: 560355 - protein, 6 aa, Mycobacterium
RELATG

SEQ ID NO: 560356 - protein, 4 aa, Mycobacterium
RELD

SEQ ID NO: 560357 - protein, 7 aa, Mycobacterium
RELDGDG

SEQ ID NO: 560358 - protein, 7 aa, Mycobacterium
RELGAAQ

SEQ ID NO: 560359 - protein, 6 aa, Mycobacterium
RELGAD

SEQ ID NO: 560360 - protein, 13 aa, Mycobacterium
RELGAKGTDVPAD

SEQ ID NO: 560361 - protein, 7 aa, Mycobacterium
RELGDDD

SEQ ID NO: 560362 - protein, 9 aa, Mycobacterium
RELGNTPEE

SEQ ID NO: 560363 - protein, 7 aa, Mycobacterium
RELGPKS

SEQ ID NO: 560364 - protein, 13 aa, Mycobacterium
RELGRNAARHAKG

SEQ ID NO: 560365 - protein, 8 aa, Mycobacterium
RELGSRSI

SEQ ID NO: 560366 - protein, 26 aa, Mycobacterium
RELKDSGSNSPDRRTQISRASSGGAT

SEQ ID NO: 560367 - protein, 4 aa, Mycobacterium
RELL

SEQ ID NO: 560368 - protein, 5 aa, Mycobacterium
RELNP

SEQ ID NO: 560369 - protein, 4 aa, Mycobacterium
RELP

SEQ ID NO: 560370 - protein, 17 aa, Mycobacterium
RELPAGLKRAQRAVAVA

SEQ ID NO: 560371 - protein, 6 aa, Mycobacterium
RELPDA

SEQ ID NO: 560372 - protein, 9 aa, Mycobacterium
RELPEPDDE

SEQ ID NO: 560373 - protein, 5 aa, Mycobacterium
RELPG

SEQ ID NO: 560374 - protein, 8 aa, Mycobacterium
RELPKRRP

SEQ ID NO: 560375 - protein, 16 aa, Mycobacterium
RELPSGVAAGSPQERE

SEQ ID NO: 560376 - protein, 10 aa, Mycobacterium
RELPSGVTRP

SEQ ID NO: 560377 - protein, 8 aa, Mycobacterium
RELPTRAT

SEQ ID NO: 560378 - protein, 27 aa, Mycobacterium
RELPVTGSSAKYTRTRPRDRKLLVGGY

SEQ ID NO: 560379 - protein, 6 aa, Mycobacterium
RELQSS

SEQ ID NO: 560380 - protein, 4 aa, Mycobacterium
RELR

SEQ ID NO: 560381 - protein, 9 aa, Mycobacterium
RELSDGGRV

SEQ ID NO: 560382 - protein, 10 aa, Mycobacterium
RELSGGQRQR

SEQ ID NO: 560383 - protein, 10 aa, Mycobacterium
RELSNGQRQR

SEQ ID NO: 560384 - protein, 5 aa, Mycobacterium
RELSQ

SEQ ID NO: 560385 - protein, 6 aa, Mycobacterium
RELSRQ

SEQ ID NO: 560386 - protein, 15 aa, Mycobacterium
RELTASDHSSETNQP

SEQ ID NO: 560387 - protein, 7 aa, Mycobacterium
RELTRDN

SEQ ID NO: 560388 - protein, 7 aa, Mycobacterium
RELTREA

SEQ ID NO: 560389 - protein, 9 aa, Mycobacterium
RELTREAGK

SEQ ID NO: 560390 - protein, 22 aa, Mycobacterium
RELTRKAGSGMRARGTAPRMAQ

SEQ ID NO: 560391 - protein, 25 aa, Mycobacterium
REMPAGAKRAERRAAGTRTAIVGSV

SEQ ID NO: 560392 - protein, 5 aa, Mycobacterium
REMSG

SEQ ID NO: 560393 - protein, 5 aa, Mycobacterium
REMTA

SEQ ID NO: 560394 - protein, 12 aa, Mycobacterium
REMTAGPNDARS

SEQ ID NO: 560395 - protein, 7 aa, Mycobacterium
REMTGTT

SEQ ID NO: 560396 - protein, 4 aa, Mycobacterium
RENA

SEQ ID NO: 560397 - protein, 8 aa, Mycobacterium
RENAAAAG

SEQ ID NO: 560398 - protein, 16 aa, Mycobacterium
RENAAPTAELVKVAAG

SEQ ID NO: 560399 - protein, 7 aa, Mycobacterium
RENADQC

SEQ ID NO: 560400 - protein, 7 aa, Mycobacterium
RENAREA

SEQ ID NO: 560401 - protein, 8 aa, Mycobacterium
RENATPTA

SEQ ID NO: 560402 - protein, 16 aa, Mycobacterium
RENATPTAELVKVDSG

SEQ ID NO: 560403 - protein, 16 aa, Mycobacterium
RENATPTAELVKVTGG

SEQ ID NO: 560404 - protein, 4 aa, Mycobacterium
REND

SEQ ID NO: 560405 - protein, 6 aa, Mycobacterium
RENEIE

SEQ ID NO: 560406 - protein, 18 aa, Mycobacterium
RENFPTKSYDTKEGFEQH

SEQ ID NO: 560407 - protein, 4 aa, Mycobacterium
RENG

SEQ ID NO: 560408 - protein, 10 aa, Mycobacterium
RENGATARSA

SEQ ID NO: 560409 - protein, 11 aa, Mycobacterium
RENGDPPRLAE

SEQ ID NO: 560410 - protein, 5 aa, Mycobacterium
RENHR

SEQ ID NO: 560411 - protein, 7 aa, Mycobacterium
RENKARL

SEQ ID NO: 560412 - protein, 5 aa, Mycobacterium
RENLE

SEQ ID NO: 560413 - protein, 14 aa, Mycobacterium
RENNCPNPACESDA

SEQ ID NO: 560414 - protein, 14 aa, Mycobacterium
RENNCPNPGCASDA

SEQ ID NO: 560415 - protein, 5 aa, Mycobacterium
RENNL

SEQ ID NO: 560416 - protein, 14 aa, Mycobacterium
RENPAAHPLHTPSG

SEQ ID NO: 560417 - protein, 7 aa, Mycobacterium
RENPAGI

SEQ ID NO: 560418 - protein, 9 aa, Mycobacterium
RENPARTAA

SEQ ID NO: 560419 - protein, 5 aa, Mycobacterium
RENPG

SEQ ID NO: 560420 - protein, 5 aa, Mycobacterium
RENPP

SEQ ID NO: 560421 - protein, 6 aa, Mycobacterium
RENPPD

SEQ ID NO: 560422 - protein, 5 aa, Mycobacterium
RENPR

SEQ ID NO: 560423 - protein, 11 aa, Mycobacterium
RENPVEADGPV

SEQ ID NO: 560424 - protein, 12 aa, Mycobacterium
RENPYTTAPGST

SEQ ID NO: 560425 - protein, 12 aa, Mycobacterium
RENQNPDVSPAE

SEQ ID NO: 560426 - protein, 4 aa, Mycobacterium
RENR

SEQ ID NO: 560427 - protein, 14 aa, Mycobacterium
RENSDGKAVAEGLG

SEQ ID NO: 560428 - protein, 9 aa, Mycobacterium
RENSDTNGA

SEQ ID NO: 560429 - protein, 6 aa, Mycobacterium
RENSYT

SEQ ID NO: 560430 - protein, 16 aa, Mycobacterium
RENTAPTAGLVKVGSG

SEQ ID NO: 560431 - protein, 7 aa, Mycobacterium
RENTSVE

SEQ ID NO: 560432 - protein, 4 aa, Mycobacterium
REPA

SEQ ID NO: 560433 - protein, 16 aa, Mycobacterium
REPAAEATTESRKGMW

SEQ ID NO: 560434 - protein, 14 aa, Mycobacterium
REPAALSRASAEHA

SEQ ID NO: 560435 - protein, 5 aa, Mycobacterium
REPAD

SEQ ID NO: 560436 - protein, 7 aa, Mycobacterium
REPADDL

SEQ ID NO: 560437 - protein, 8 aa, Mycobacterium
REPAEPIR

SEQ ID NO: 560438 - protein, 5 aa, Mycobacterium
REPAG

SEQ ID NO: 560439 - protein, 7 aa, Mycobacterium
REPAGCD

SEQ ID NO: 560440 - protein, 15 aa, Mycobacterium
REPAGPWGAGRRVEA

SEQ ID NO: 560441 - protein, 18 aa, Mycobacterium
REPAGPWGPGRPTEAADA

SEQ ID NO: 560442 - protein, 16 aa, Mycobacterium
REPANDKERTEMTSAD

SEQ ID NO: 560443 - protein, 8 aa, Mycobacterium
REPAPMSA

SEQ ID NO: 560444 - protein, 9 aa, Mycobacterium
REPAPTAQE

SEQ ID NO: 560445 - protein, 11 aa, Mycobacterium
REPASEPGGPL

SEQ ID NO: 560446 - protein, 9 aa, Mycobacterium
REPATAAER

SEQ ID NO: 560447 - protein, 15 aa, Mycobacterium
REPATPLRGAPAPTD

SEQ ID NO: 560448 - protein, 5 aa, Mycobacterium
REPDA

SEQ ID NO: 560449 - protein, 6 aa, Mycobacterium
REPDAA

SEQ ID NO: 560450 - protein, 9 aa, Mycobacterium
REPDARPAE

SEQ ID NO: 560451 - protein, 9 aa, Mycobacterium
REPDDEERH

SEQ ID NO: 560452 - protein, 8 aa, Mycobacterium
REPDGGGF

SEQ ID NO: 560453 - protein, 13 aa, Mycobacterium
REPDGGGFSPPGV

SEQ ID NO: 560454 - protein, 5 aa, Mycobacterium
REPDL

SEQ ID NO: 560455 - protein, 7 aa, Mycobacterium
REPDQRR

SEQ ID NO: 560456 - protein, 6 aa, Mycobacterium
REPDRK

SEQ ID NO: 560457 - protein, 4 aa, Mycobacterium
REPE

SEQ ID NO: 560458 - protein, 7 aa, Mycobacterium
REPEAEF

SEQ ID NO: 560459 - protein, 8 aa, Mycobacterium
REPEDDAN

SEQ ID NO: 560460 - protein, 6 aa, Mycobacterium
REPELT

SEQ ID NO: 560461 - protein, 5 aa, Mycobacterium
REPER

SEQ ID NO: 560462 - protein, 10 aa, Mycobacterium
REPESTGEVT

SEQ ID NO: 560463 - protein, 7 aa, Mycobacterium
REPEYSP

SEQ ID NO: 560464 - protein, 4 aa, Mycobacterium
REPF

SEQ ID NO: 560465 - protein, 13 aa, Mycobacterium
REPFSRRPLDGPR

SEQ ID NO: 560466 - protein, 10 aa, Mycobacterium
REPGAPHRTE

SEQ ID NO: 560467 - protein, 6 aa, Mycobacterium
REPGAQ

SEQ ID NO: 560468 - protein, 6 aa, Mycobacterium
REPGAW

SEQ ID NO: 560469 - protein, 15 aa, Mycobacterium
REPGDVELLSGEFAI

SEQ ID NO: 560470 - protein, 7 aa, Mycobacterium
REPGELP

SEQ ID NO: 560471 - protein, 7 aa, Mycobacterium
REPGGSI

SEQ ID NO: 560472 - protein, 6 aa, Mycobacterium
REPGIG

SEQ ID NO: 560473 - protein, 5 aa, Mycobacterium
REPGM

SEQ ID NO: 560474 - protein, 28 aa, Mycobacterium
REPGNITASEAVRTGADIATGAELFTAA

SEQ ID NO: 560475 - protein, 6 aa, Mycobacterium
REPGPA

SEQ ID NO: 560476 - protein, 6 aa, Mycobacterium
REPGPI

SEQ ID NO: 560477 - protein, 6 aa, Mycobacterium
REPGPR

SEQ ID NO: 560478 - protein, 8 aa, Mycobacterium
REPGRADA

SEQ ID NO: 560479 - protein, 22 aa, Mycobacterium
REPGREDTETIDSGSAAAALGG

SEQ ID NO: 560480 - protein, 9 aa, Mycobacterium
REPGSARDL

SEQ ID NO: 560481 - protein, 8 aa, Mycobacterium
REPGSDAV

SEQ ID NO: 560482 - protein, 8 aa, Mycobacterium
REPGTAGG

SEQ ID NO: 560483 - protein, 8 aa, Mycobacterium
REPGTASA

SEQ ID NO: 560484 - protein, 6 aa, Mycobacterium
REPGVV

SEQ ID NO: 560485 - protein, 5 aa, Mycobacterium
REPID

SEQ ID NO: 560486 - protein, 9 aa, Mycobacterium
REPIGPDAL

SEQ ID NO: 560487 - protein, 6 aa, Mycobacterium
REPIPN

SEQ ID NO: 560488 - protein, 8 aa, Mycobacterium
REPKEGGT

SEQ ID NO: 560489 - protein, 4 aa, Mycobacterium
REPL

SEQ ID NO: 560490 - protein, 10 aa, Mycobacterium
REPLSGPADV

SEQ ID NO: 560491 - protein, 6 aa, Mycobacterium
REPLTD

SEQ ID NO: 560492 - protein, 5 aa, Mycobacterium
REPNK

SEQ ID NO: 560493 - protein, 5 aa, Mycobacterium
REPPA

SEQ ID NO: 560494 - protein, 8 aa, Mycobacterium
REPPAVPA

SEQ ID NO: 560495 - protein, 6 aa, Mycobacterium
REPPGS

SEQ ID NO: 560496 - protein, 6 aa, Mycobacterium
REPPKR

SEQ ID NO: 560497 - protein, 11 aa, Mycobacterium
REPPLFGTEPD

SEQ ID NO: 560498 - protein, 7 aa, Mycobacterium
REPPPPW

SEQ ID NO: 560499 - protein, 13 aa, Mycobacterium
REPPPQPVPPMPV

SEQ ID NO: 560500 - protein, 4 aa, Mycobacterium
REPQ

SEQ ID NO: 560501 - protein, 14 aa, Mycobacterium
REPQAYNSNYAGEF

SEQ ID NO: 560502 - protein, 7 aa, Mycobacterium
REPQPGK

SEQ ID NO: 560503 - protein, 8 aa, Mycobacterium
REPQSAGA

SEQ ID NO: 560504 - protein, 11 aa, Mycobacterium
REPQSAGACGS

SEQ ID NO: 560505 - protein, 9 aa, Mycobacterium
REPREAGKH

SEQ ID NO: 560506 - protein, 5 aa, Mycobacterium
REPRH

SEQ ID NO: 560507 - protein, 5 aa, Mycobacterium
REPRR

SEQ ID NO: 560508 - protein, 12 aa, Mycobacterium
REPRRADAVPAD

SEQ ID NO: 560509 - protein, 8 aa, Mycobacterium
REPRSGIR

SEQ ID NO: 560510 - protein, 5 aa, Mycobacterium
REPRT

SEQ ID NO: 560511 - protein, 14 aa, Mycobacterium
REPRTGRLASVIWL

SEQ ID NO: 560512 - protein, 10 aa, Mycobacterium
REPSDAAAGV

SEQ ID NO: 560513 - protein, 8 aa, Mycobacterium
REPSNNAD

SEQ ID NO: 560514 - protein, 15 aa, Mycobacterium
REPSRRERRDDELKE

SEQ ID NO: 560515 - protein, 18 aa, Mycobacterium
REPSSGPVSADPTLETVT

SEQ ID NO: 560516 - protein, 5 aa, Mycobacterium
REPTD

SEQ ID NO: 560517 - protein, 6 aa, Mycobacterium
REPTGD

SEQ ID NO: 560518 - protein, 10 aa, Mycobacterium
REPTGHPNSL

SEQ ID NO: 560519 - protein, 9 aa, Mycobacterium
REPTGRGVR

SEQ ID NO: 560520 - protein, 6 aa, Mycobacterium
REPTGV

SEQ ID NO: 560521 - protein, 6 aa, Mycobacterium
REPTMG

SEQ ID NO: 560522 - protein, 6 aa, Mycobacterium
REPVAR

SEQ ID NO: 560523 - protein, 20 aa, Mycobacterium
REQADKYAASGGAEAADMKG

SEQ ID NO: 560524 - protein, 8 aa, Mycobacterium
REQADRER

SEQ ID NO: 560525 - protein, 11 aa, Mycobacterium
REQAESSPSIV

SEQ ID NO: 560526 - protein, 10 aa, Mycobacterium
REQAGDHGAT

SEQ ID NO: 560527 - protein, 9 aa, Mycobacterium
REQAGGFGA

SEQ ID NO: 560528 - protein, 6 aa, Mycobacterium
REQALD

SEQ ID NO: 560529 - protein, 8 aa, Mycobacterium
REQARGVV

SEQ ID NO: 560530 - protein, 6 aa, Mycobacterium
REQARL

SEQ ID NO: 560531 - protein, 12 aa, Mycobacterium
REQARTNGRRDG

SEQ ID NO: 560532 - protein, 6 aa, Mycobacterium
REQATW

SEQ ID NO: 560533 - protein, 13 aa, Mycobacterium
REQAYRGDREPLQ

SEQ ID NO: 560534 - protein, 4 aa, Mycobacterium
REQD

SEQ ID NO: 560535 - protein, 5 aa, Mycobacterium
REQDA

SEQ ID NO: 560536 - protein, 11 aa, Mycobacterium
REQDPGDPAVP

SEQ ID NO: 560537 - protein, 7 aa, Mycobacterium
REQDRFS

SEQ ID NO: 560538 - protein, 7 aa, Mycobacterium
REQDRPA

SEQ ID NO: 560539 - protein, 5 aa, Mycobacterium
REQDW

SEQ ID NO: 560540 - protein, 4 aa, Mycobacterium
REQE

SEQ ID NO: 560541 - protein, 6 aa, Mycobacterium
REQELP

SEQ ID NO: 560542 - protein, 5 aa, Mycobacterium
REQER

SEQ ID NO: 560543 - protein, 16 aa, Mycobacterium
REQFGRPDKPAPRVEG

SEQ ID NO: 560544 - protein, 86 aa, Mycobacterium
REQFGRPSGDRERGGAGRSGSPPSIPSGDRERGGAGRSGSPPSIPSGDRERGGAGRSGSPPSIPSGDRERGGAGRSGSPPSRPGGA

SEQ ID NO: 560545 - protein, 46 aa, Mycobacterium
REQFGRSGDRERGRGDRKRGVAGRSGSSRTVQAGRSGSPPSDPGGS

SEQ ID NO: 560546 - protein, 6 aa, Mycobacterium
REQGAQ

SEQ ID NO: 560547 - protein, 18 aa, Mycobacterium
REQGAVGPAMQTRSEQSH

SEQ ID NO: 560548 - protein, 6 aa, Mycobacterium
REQGGA

SEQ ID NO: 560549 - protein, 29 aa, Mycobacterium
REQGGEAAKPSGVAGDLATPGPGPGPNAV

SEQ ID NO: 560550 - protein, 7 aa, Mycobacterium
REQGGGR

SEQ ID NO: 560551 - protein, 10 aa, Mycobacterium
REQGGYRPLA

SEQ ID NO: 560552 - protein, 9 aa, Mycobacterium
REQGHRRPE

SEQ ID NO: 560553 - protein, 6 aa, Mycobacterium
REQGRG

SEQ ID NO: 560554 - protein, 10 aa, Mycobacterium
REQGRGGEAA

SEQ ID NO: 560555 - protein, 12 aa, Mycobacterium
REQGRRQRREQI

SEQ ID NO: 560556 - protein, 16 aa, Mycobacterium
REQGYDGTFTGDENAD

SEQ ID NO: 560557 - protein, 17 aa, Mycobacterium
REQGYDGTWTGDENIEK

SEQ ID NO: 560558 - protein, 5 aa, Mycobacterium
REQHI

SEQ ID NO: 560559 - protein, 4 aa, Mycobacterium
REQI

SEQ ID NO: 560560 - protein, 6 aa, Mycobacterium
REQIAE

SEQ ID NO: 560561 - protein, 5 aa, Mycobacterium
REQIP

SEQ ID NO: 560562 - protein, 8 aa, Mycobacterium
REQISDRG

SEQ ID NO: 560563 - protein, 5 aa, Mycobacterium
REQKA

SEQ ID NO: 560564 - protein, 7 aa, Mycobacterium
REQKRPG

SEQ ID NO: 560565 - protein, 4 aa, Mycobacterium
REQL

SEQ ID NO: 560566 - protein, 9 aa, Mycobacterium
REQLSEQGL

SEQ ID NO: 560567 - protein, 11 aa, Mycobacterium
REQLTGDEAHE

SEQ ID NO: 560568 - protein, 7 aa, Mycobacterium
REQMKDP

SEQ ID NO: 560569 - protein, 9 aa, Mycobacterium
REQNSYADR

SEQ ID NO: 560570 - protein, 5 aa, Mycobacterium
REQPE

SEQ ID NO: 560571 - protein, 7 aa, Mycobacterium
REQPEST

SEQ ID NO: 560572 - protein, 8 aa, Mycobacterium
REQPGGET

SEQ ID NO: 560573 - protein, 16 aa, Mycobacterium
REQPHPSPIVPPRQPL

SEQ ID NO: 560574 - protein, 6 aa, Mycobacterium
REQPLP

SEQ ID NO: 560575 - protein, 19 aa, Mycobacterium
REQPLPGVSGATIADGVSA

SEQ ID NO: 560576 - protein, 8 aa, Mycobacterium
REQPLTGI

SEQ ID NO: 560577 - protein, 8 aa, Mycobacterium
REQPMAGV

SEQ ID NO: 560578 - protein, 16 aa, Mycobacterium
REQPPVGDGAAGGHRQ

SEQ ID NO: 560579 - protein, 5 aa, Mycobacterium
REQPS

SEQ ID NO: 560580 - protein, 6 aa, Mycobacterium
REQPTL

SEQ ID NO: 560581 - protein, 6 aa, Mycobacterium
REQPWR

SEQ ID NO: 560582 - protein, 13 aa, Mycobacterium
REQRAQWVNDIVP

SEQ ID NO: 560583 - protein, 10 aa, Mycobacterium
REQREGQSLD

SEQ ID NO: 560584 - protein, 8 aa, Mycobacterium
REQRGARG

SEQ ID NO: 560585 - protein, 6 aa, Mycobacterium
REQRGS

SEQ ID NO: 560586 - protein, 17 aa, Mycobacterium
REQSAAATRSPGPTGAA

SEQ ID NO: 560587 - protein, 9 aa, Mycobacterium
REQSGPITG

SEQ ID NO: 560588 - protein, 5 aa, Mycobacterium
REQSP

SEQ ID NO: 560589 - protein, 9 aa, Mycobacterium
REQSPPPQA

SEQ ID NO: 560590 - protein, 7 aa, Mycobacterium
REQSPYP

SEQ ID NO: 560591 - protein, 7 aa, Mycobacterium
REQSRPE

SEQ ID NO: 560592 - protein, 10 aa, Mycobacterium
REQSSRDARA

SEQ ID NO: 560593 - protein, 6 aa, Mycobacterium
REQSTK

SEQ ID NO: 560594 - protein, 4 aa, Mycobacterium
REQT

SEQ ID NO: 560595 - protein, 10 aa, Mycobacterium
REQTPETEAA

SEQ ID NO: 560596 - protein, 10 aa, Mycobacterium
REQTRKSVGA

SEQ ID NO: 560597 - protein, 6 aa, Mycobacterium
REQTTG

SEQ ID NO: 560598 - protein, 7 aa, Mycobacterium
REQVRQY

SEQ ID NO: 560599 - protein, 10 aa, Mycobacterium
REQWDDGNNT

SEQ ID NO: 560600 - protein, 5 aa, Mycobacterium
REQWQ

SEQ ID NO: 560601 - protein, 13 aa, Mycobacterium
REQYEQQGNPYYS

SEQ ID NO: 560602 - protein, 12 aa, Mycobacterium
REQYGDTSSLSA

SEQ ID NO: 560603 - protein, 11 aa, Mycobacterium
REQYGKTIGSY

SEQ ID NO: 560604 - protein, 10 aa, Mycobacterium
REQYGSAIGS

SEQ ID NO: 560605 - protein, 10 aa, Mycobacterium
REQYGSTIGS

SEQ ID NO: 560606 - protein, 11 aa, Mycobacterium
REQYIDENAGS

SEQ ID NO: 560607 - protein, 18 aa, Mycobacterium
RERAAAAGATPMDSPAAQ

SEQ ID NO: 560608 - protein, 12 aa, Mycobacterium
RERAAARDATAD

SEQ ID NO: 560609 - protein, 18 aa, Mycobacterium
RERAADRGVPFNQVRHGK

SEQ ID NO: 560610 - protein, 11 aa, Mycobacterium
RERAAKQARDV

SEQ ID NO: 560611 - protein, 14 aa, Mycobacterium
RERAALTSDEVTVT

SEQ ID NO: 560612 - protein, 9 aa, Mycobacterium
RERADDRGV

SEQ ID NO: 560613 - protein, 12 aa, Mycobacterium
RERAGAKQAKEA

SEQ ID NO: 560614 - protein, 13 aa, Mycobacterium
RERAGAREKKEEL

SEQ ID NO: 560615 - protein, 5 aa, Mycobacterium
RERAL

SEQ ID NO: 560616 - protein, 13 aa, Mycobacterium
RERANGDGNSTTM

SEQ ID NO: 560617 - protein, 7 aa, Mycobacterium
RERANRA

SEQ ID NO: 560618 - protein, 7 aa, Mycobacterium
RERANRK

SEQ ID NO: 560619 - protein, 24 aa, Mycobacterium
RERAPEEGRLRNRRSDHPGYPSRE

SEQ ID NO: 560620 - protein, 5 aa, Mycobacterium
RERAQ

SEQ ID NO: 560621 - protein, 19 aa, Mycobacterium
RERAQRALADASAHRVSGM

SEQ ID NO: 560622 - protein, 23 aa, Mycobacterium
RERAQRAVAKANPAGAYEKVSGK

SEQ ID NO: 560623 - protein, 13 aa, Mycobacterium
RERARQAAGTDDV

SEQ ID NO: 560624 - protein, 9 aa, Mycobacterium
RERASRRID

SEQ ID NO: 560625 - protein, 10 aa, Mycobacterium
RERATARRAE

SEQ ID NO: 560626 - protein, 8 aa, Mycobacterium
RERDARRD

SEQ ID NO: 560627 - protein, 8 aa, Mycobacterium
RERDDAGW

SEQ ID NO: 560628 - protein, 9 aa, Mycobacterium
RERDDPALA

SEQ ID NO: 560629 - protein, 16 aa, Mycobacterium
RERDELARGTHAERRE

SEQ ID NO: 560630 - protein, 6 aa, Mycobacterium
RERDLD

SEQ ID NO: 560631 - protein, 7 aa, Mycobacterium
RERDPAQ

SEQ ID NO: 560632 - protein, 6 aa, Mycobacterium
RERDPI

SEQ ID NO: 560633 - protein, 17 aa, Mycobacterium
RERDPNRSVVRRLLRSD

SEQ ID NO: 560634 - protein, 11 aa, Mycobacterium
RERDPQRASKR

SEQ ID NO: 560635 - protein, 5 aa, Mycobacterium
REREA

SEQ ID NO: 560636 - protein, 6 aa, Mycobacterium
REREEV

SEQ ID NO: 560637 - protein, 7 aa, Mycobacterium
REREGKA

SEQ ID NO: 560638 - protein, 7 aa, Mycobacterium
RERERAE

SEQ ID NO: 560639 - protein, 12 aa, Mycobacterium
RERERRTKRDEA

SEQ ID NO: 560640 - protein, 16 aa, Mycobacterium
RERESEPLIVSVEGRH

SEQ ID NO: 560641 - protein, 15 aa, Mycobacterium
RERETAKWTTASREI

SEQ ID NO: 560642 - protein, 7 aa, Mycobacterium
RERFSEQ

SEQ ID NO: 560643 - protein, 6 aa, Mycobacterium
RERGAD

SEQ ID NO: 560644 - protein, 6 aa, Mycobacterium
RERGAE

SEQ ID NO: 560645 - protein, 8 aa, Mycobacterium
RERGDLKP

SEQ ID NO: 560646 - protein, 5 aa, Mycobacterium
RERGH

SEQ ID NO: 560647 - protein, 7 aa, Mycobacterium
RERGIDA

SEQ ID NO: 560648 - protein, 12 aa, Mycobacterium
RERGIDATTGDL

SEQ ID NO: 560649 - protein, 21 aa, Mycobacterium
RERGPELTPRGGPGGRPPVPH

SEQ ID NO: 560650 - protein, 9 aa, Mycobacterium
RERGPGATS

SEQ ID NO: 560651 - protein, 8 aa, Mycobacterium
RERGPGVS

SEQ ID NO: 560652 - protein, 5 aa, Mycobacterium
RERGQ

SEQ ID NO: 560653 - protein, 10 aa, Mycobacterium
RERGQPTPAP

SEQ ID NO: 560654 - protein, 9 aa, Mycobacterium
RERGRDPHR

SEQ ID NO: 560655 - protein, 6 aa, Mycobacterium
RERGRR

SEQ ID NO: 560656 - protein, 5 aa, Mycobacterium
RERGS

SEQ ID NO: 560657 - protein, 6 aa, Mycobacterium
RERGSA

SEQ ID NO: 560658 - protein, 8 aa, Mycobacterium
RERGSGSV

SEQ ID NO: 560659 - protein, 5 aa, Mycobacterium
RERGT

SEQ ID NO: 560660 - protein, 5 aa, Mycobacterium
RERGV

SEQ ID NO: 560661 - protein, 7 aa, Mycobacterium
RERGVPR

SEQ ID NO: 560662 - protein, 5 aa, Mycobacterium
RERGY

SEQ ID NO: 560663 - protein, 6 aa, Mycobacterium
RERHGA

SEQ ID NO: 560664 - protein, 7 aa, Mycobacterium
RERHGEV

SEQ ID NO: 560665 - protein, 8 aa, Mycobacterium
RERHPDAD

SEQ ID NO: 560666 - protein, 11 aa, Mycobacterium
RERHSQKNERP

SEQ ID NO: 560667 - protein, 4 aa, Mycobacterium
RERI

SEQ ID NO: 560668 - protein, 20 aa, Mycobacterium
RERIGEEAPPPAIGNHDQHE

SEQ ID NO: 560669 - protein, 20 aa, Mycobacterium
RERIGEEAPTPSIAEPHDHE

SEQ ID NO: 560670 - protein, 7 aa, Mycobacterium
RERIPDE

SEQ ID NO: 560671 - protein, 10 aa, Mycobacterium
RERIPDEKAR

SEQ ID NO: 560672 - protein, 7 aa, Mycobacterium
RERISPA

SEQ ID NO: 560673 - protein, 5 aa, Mycobacterium
RERKP

SEQ ID NO: 560674 - protein, 10 aa, Mycobacterium
RERKREMEHR

SEQ ID NO: 560675 - protein, 5 aa, Mycobacterium
RERKW

SEQ ID NO: 560676 - protein, 9 aa, Mycobacterium
RERLDSDPD

SEQ ID NO: 560677 - protein, 5 aa, Mycobacterium
RERLN

SEQ ID NO: 560678 - protein, 7 aa, Mycobacterium
RERLNPQ

SEQ ID NO: 560679 - protein, 4 aa, Mycobacterium
RERN

SEQ ID NO: 560680 - protein, 5 aa, Mycobacterium
RERNA

SEQ ID NO: 560681 - protein, 7 aa, Mycobacterium
RERNANK

SEQ ID NO: 560682 - protein, 8 aa, Mycobacterium
RERPAGEP

SEQ ID NO: 560683 - protein, 9 aa, Mycobacterium
RERPATTAD

SEQ ID NO: 560684 - protein, 5 aa, Mycobacterium
RERPE

SEQ ID NO: 560685 - protein, 16 aa, Mycobacterium
RERPEQPRDTGGPRTE

SEQ ID NO: 560686 - protein, 9 aa, Mycobacterium
RERPETAAD

SEQ ID NO: 560687 - protein, 8 aa, Mycobacterium
RERPGAKG

SEQ ID NO: 560688 - protein, 8 aa, Mycobacterium
RERPGGET

SEQ ID NO: 560689 - protein, 6 aa, Mycobacterium
RERPGT

SEQ ID NO: 560690 - protein, 15 aa, Mycobacterium
RERPPQQEDTELPGQ

SEQ ID NO: 560691 - protein, 6 aa, Mycobacterium
RERPRS

SEQ ID NO: 560692 - protein, 5 aa, Mycobacterium
RERPV

SEQ ID NO: 560693 - protein, 13 aa, Mycobacterium
RERQAQRDRRHAT

SEQ ID NO: 560694 - protein, 4 aa, Mycobacterium
RERR

SEQ ID NO: 560695 - protein, 30 aa, Mycobacterium
RERRAAARESRRARGQHIGRPKALDNAKAA

SEQ ID NO: 560696 - protein, 23 aa, Mycobacterium
RERRAAARESRRRRQLPATKPHK

SEQ ID NO: 560697 - protein, 31 aa, Mycobacterium
RERRAASRESRRARQLPATKPAKLTAERQKQ

SEQ ID NO: 560698 - protein, 31 aa, Mycobacterium
RERRAASRESRRSRSLPATKPSKLSADRQEQ

SEQ ID NO: 560699 - protein, 12 aa, Mycobacterium
RERREPSATSVE

SEQ ID NO: 560700 - protein, 20 aa, Mycobacterium
RERRGEEDGRAVQSRGNCST

SEQ ID NO: 560701 - protein, 8 aa, Mycobacterium
RERRHRRR

SEQ ID NO: 560702 - protein, 8 aa, Mycobacterium
RERRPDRV

SEQ ID NO: 560703 - protein, 8 aa, Mycobacterium
RERRRDAA

SEQ ID NO: 560704 - protein, 30 aa, Mycobacterium
RERRSAAREARRSRGQSIGRPKALDESKAA

SEQ ID NO: 560705 - protein, 11 aa, Mycobacterium
RERSDPDFADR

SEQ ID NO: 560706 - protein, 7 aa, Mycobacterium
RERSEGD

SEQ ID NO: 560707 - protein, 14 aa, Mycobacterium
RERSELAPYESGQS

SEQ ID NO: 560708 - protein, 9 aa, Mycobacterium
RERSGDPAE

SEQ ID NO: 560709 - protein, 7 aa, Mycobacterium
RERSGEI

SEQ ID NO: 560710 - protein, 9 aa, Mycobacterium
RERSGEPSV

SEQ ID NO: 560711 - protein, 9 aa, Mycobacterium
RERSGIRQA

SEQ ID NO: 560712 - protein, 9 aa, Mycobacterium
RERSGKGQV

SEQ ID NO: 560713 - protein, 8 aa, Mycobacterium
RERSGRYS

SEQ ID NO: 560714 - protein, 12 aa, Mycobacterium
RERSGVKQSKER

SEQ ID NO: 560715 - protein, 11 aa, Mycobacterium
RERSGVRQTKE

SEQ ID NO: 560716 - protein, 6 aa, Mycobacterium
RERSPN

SEQ ID NO: 560717 - protein, 11 aa, Mycobacterium
RERSTGDDGAA

SEQ ID NO: 560718 - protein, 10 aa, Mycobacterium
RERSTGEADR

SEQ ID NO: 560719 - protein, 9 aa, Mycobacterium
RERSTLDTA

SEQ ID NO: 560720 - protein, 7 aa, Mycobacterium
RERSTTA

SEQ ID NO: 560721 - protein, 7 aa, Mycobacterium
RERTADL

SEQ ID NO: 560722 - protein, 8 aa, Mycobacterium
RERTAEEY

SEQ ID NO: 560723 - protein, 21 aa, Mycobacterium
RERTAHGTPSGVDAAATGADG

SEQ ID NO: 560724 - protein, 16 aa, Mycobacterium
RERTEAAAKEAGPGTV

SEQ ID NO: 560725 - protein, 8 aa, Mycobacterium
RERTGEAS

SEQ ID NO: 560726 - protein, 8 aa, Mycobacterium
RERTGEPS

SEQ ID NO: 560727 - protein, 17 aa, Mycobacterium
RERTQDIPHTTSTALAS

SEQ ID NO: 560728 - protein, 7 aa, Mycobacterium
RERTRQG

SEQ ID NO: 560729 - protein, 10 aa, Mycobacterium
RERTSRGGSE

SEQ ID NO: 560730 - protein, 5 aa, Mycobacterium
RERTT

SEQ ID NO: 560731 - protein, 13 aa, Mycobacterium
RERVNRNRPIWAV

SEQ ID NO: 560732 - protein, 9 aa, Mycobacterium
RERVQPPSM

SEQ ID NO: 560733 - protein, 7 aa, Mycobacterium
RERVSGE

SEQ ID NO: 560734 - protein, 12 aa, Mycobacterium
RERVVTESPKTA

SEQ ID NO: 560735 - protein, 4 aa, Mycobacterium
RERY

SEQ ID NO: 560736 - protein, 13 aa, Mycobacterium
RERYGPPERASRA

SEQ ID NO: 560737 - protein, 19 aa, Mycobacterium
RERYRDAAAAQRALRSGAS

SEQ ID NO: 560738 - protein, 7 aa, Mycobacterium
RERYSGG

SEQ ID NO: 560739 - protein, 6 aa, Mycobacterium
RERYSP

SEQ ID NO: 560740 - protein, 4 aa, Mycobacterium
RESA

SEQ ID NO: 560741 - protein, 15 aa, Mycobacterium
RESAAQRGDATPVGG

SEQ ID NO: 560742 - protein, 18 aa, Mycobacterium
RESADEARFDSNELSAGR

SEQ ID NO: 560743 - protein, 11 aa, Mycobacterium
RESAERSAQAL

SEQ ID NO: 560744 - protein, 10 aa, Mycobacterium
RESAESGLPA

SEQ ID NO: 560745 - protein, 12 aa, Mycobacterium
RESAPPAARPPW

SEQ ID NO: 560746 - protein, 9 aa, Mycobacterium
RESAPTARS

SEQ ID NO: 560747 - protein, 16 aa, Mycobacterium
RESAQSPADLGHSVAS

SEQ ID NO: 560748 - protein, 5 aa, Mycobacterium
RESAV

SEQ ID NO: 560749 - protein, 4 aa, Mycobacterium
RESD

SEQ ID NO: 560750 - protein, 24 aa, Mycobacterium
RESDAERCGRGDSSAGVRCTQGGP

SEQ ID NO: 560751 - protein, 6 aa, Mycobacterium
RESDAS

SEQ ID NO: 560752 - protein, 5 aa, Mycobacterium
RESDD

SEQ ID NO: 560753 - protein, 10 aa, Mycobacterium
RESDDGTPLP

SEQ ID NO: 560754 - protein, 8 aa, Mycobacterium
RESDDNVS

SEQ ID NO: 560755 - protein, 11 aa, Mycobacterium
RESDEPADPAR

SEQ ID NO: 560756 - protein, 8 aa, Mycobacterium
RESDEQMA

SEQ ID NO: 560757 - protein, 7 aa, Mycobacterium
RESDERM

SEQ ID NO: 560758 - protein, 9 aa, Mycobacterium
RESDGGGFC

SEQ ID NO: 560759 - protein, 5 aa, Mycobacterium
RESDL

SEQ ID NO: 560760 - protein, 14 aa, Mycobacterium
RESDTTKWRDPSGS

SEQ ID NO: 560761 - protein, 4 aa, Mycobacterium
RESE

SEQ ID NO: 560762 - protein, 15 aa, Mycobacterium
RESEADELCSESERL

SEQ ID NO: 560763 - protein, 5 aa, Mycobacterium
RESEG

SEQ ID NO: 560764 - protein, 8 aa, Mycobacterium
RESEGAVQ

SEQ ID NO: 560765 - protein, 9 aa, Mycobacterium
RESEGESAR

SEQ ID NO: 560766 - protein, 7 aa, Mycobacterium
RESESMR

SEQ ID NO: 560767 - protein, 10 aa, Mycobacterium
RESETDPGAW

SEQ ID NO: 560768 - protein, 4 aa, Mycobacterium
RESG

SEQ ID NO: 560769 - protein, 5 aa, Mycobacterium
RESGA

SEQ ID NO: 560770 - protein, 6 aa, Mycobacterium
RESGAH

SEQ ID NO: 560771 - protein, 7 aa, Mycobacterium
RESGASV

SEQ ID NO: 560772 - protein, 7 aa, Mycobacterium
RESGAYC

SEQ ID NO: 560773 - protein, 8 aa, Mycobacterium
RESGDDVG

SEQ ID NO: 560774 - protein, 8 aa, Mycobacterium
RESGDDVS

SEQ ID NO: 560775 - protein, 7 aa, Mycobacterium
RESGDRF

SEQ ID NO: 560776 - protein, 5 aa, Mycobacterium
RESGE

SEQ ID NO: 560777 - protein, 8 aa, Mycobacterium
RESGGDAH

SEQ ID NO: 560778 - protein, 16 aa, Mycobacterium
RESGGDTARTRSCPKL

SEQ ID NO: 560779 - protein, 8 aa, Mycobacterium
RESGGTIG

SEQ ID NO: 560780 - protein, 9 aa, Mycobacterium
RESGKTPGL

SEQ ID NO: 560781 - protein, 7 aa, Mycobacterium
RESGLPE

SEQ ID NO: 560782 - protein, 9 aa, Mycobacterium
RESGPGAVE

SEQ ID NO: 560783 - protein, 5 aa, Mycobacterium
RESGR

SEQ ID NO: 560784 - protein, 7 aa, Mycobacterium
RESGSGL

SEQ ID NO: 560785 - protein, 5 aa, Mycobacterium
RESGT

SEQ ID NO: 560786 - protein, 7 aa, Mycobacterium
RESGTAV

SEQ ID NO: 560787 - protein, 7 aa, Mycobacterium
RESGTLA

SEQ ID NO: 560788 - protein, 12 aa, Mycobacterium
RESGVATAGESV

SEQ ID NO: 560789 - protein, 6 aa, Mycobacterium
RESGVG

SEQ ID NO: 560790 - protein, 7 aa, Mycobacterium
RESGVQA

SEQ ID NO: 560791 - protein, 14 aa, Mycobacterium
RESGVQPPRAEAPD

SEQ ID NO: 560792 - protein, 16 aa, Mycobacterium
RESGVYSRDGHSDYGN

SEQ ID NO: 560793 - protein, 6 aa, Mycobacterium
RESIGG

SEQ ID NO: 560794 - protein, 6 aa, Mycobacterium
RESKEE

SEQ ID NO: 560795 - protein, 15 aa, Mycobacterium
RESLDGSAGIGFGEP

SEQ ID NO: 560796 - protein, 7 aa, Mycobacterium
RESLDSA

SEQ ID NO: 560797 - protein, 8 aa, Mycobacterium
RESLESAQ

SEQ ID NO: 560798 - protein, 5 aa, Mycobacterium
RESLG

SEQ ID NO: 560799 - protein, 9 aa, Mycobacterium
RESLRGGGS

SEQ ID NO: 560800 - protein, 14 aa, Mycobacterium
RESLRRGDAVRTPG

SEQ ID NO: 560801 - protein, 6 aa, Mycobacterium
RESLRS

SEQ ID NO: 560802 - protein, 8 aa, Mycobacterium
RESNETMA

SEQ ID NO: 560803 - protein, 13 aa, Mycobacterium
RESNSIDQRSGVS

SEQ ID NO: 560804 - protein, 26 aa, Mycobacterium
RESNYDPKAENHWDSNAARGTPSKGA

SEQ ID NO: 560805 - protein, 8 aa, Mycobacterium
RESNYNAN

SEQ ID NO: 560806 - protein, 6 aa, Mycobacterium
RESPAI

SEQ ID NO: 560807 - protein, 12 aa, Mycobacterium
RESPDPVLTTPD

SEQ ID NO: 560808 - protein, 11 aa, Mycobacterium
RESPENHASPD

SEQ ID NO: 560809 - protein, 6 aa, Mycobacterium
RESPHW

SEQ ID NO: 560810 - protein, 6 aa, Mycobacterium
RESPPM

SEQ ID NO: 560811 - protein, 7 aa, Mycobacterium
RESPVNQ

SEQ ID NO: 560812 - protein, 5 aa, Mycobacterium
RESQW

SEQ ID NO: 560813 - protein, 4 aa, Mycobacterium
RESR

SEQ ID NO: 560814 - protein, 5 aa, Mycobacterium
RESRD

SEQ ID NO: 560815 - protein, 6 aa, Mycobacterium
RESRGA

SEQ ID NO: 560816 - protein, 13 aa, Mycobacterium
RESRGLRQPSRAA

SEQ ID NO: 560817 - protein, 11 aa, Mycobacterium
RESRGRGNISA

SEQ ID NO: 560818 - protein, 17 aa, Mycobacterium
RESRQYVRTTNKVGRRL

SEQ ID NO: 560819 - protein, 10 aa, Mycobacterium
RESSDTTTDP

SEQ ID NO: 560820 - protein, 11 aa, Mycobacterium
RESSGRGQTVE

SEQ ID NO: 560821 - protein, 9 aa, Mycobacterium
RESSSLASE

SEQ ID NO: 560822 - protein, 11 aa, Mycobacterium
RESSSNPELKL

SEQ ID NO: 560823 - protein, 13 aa, Mycobacterium
RESSSVDQRSGVS

SEQ ID NO: 560824 - protein, 15 aa, Mycobacterium
RESTALDAGGSEPLY

SEQ ID NO: 560825 - protein, 11 aa, Mycobacterium
RESTAPSDELE

SEQ ID NO: 560826 - protein, 7 aa, Mycobacterium
RESTGGF

SEQ ID NO: 560827 - protein, 8 aa, Mycobacterium
RESTGGFT

SEQ ID NO: 560828 - protein, 9 aa, Mycobacterium
RESTGPFRN

SEQ ID NO: 560829 - protein, 13 aa, Mycobacterium
RESTLRRKERQRL

SEQ ID NO: 560830 - protein, 10 aa, Mycobacterium
RESTSERVRA

SEQ ID NO: 560831 - protein, 10 aa, Mycobacterium
RESTTPTDEL

SEQ ID NO: 560832 - protein, 8 aa, Mycobacterium
RESTVRQA

SEQ ID NO: 560833 - protein, 10 aa, Mycobacterium
RESVEDAASR

SEQ ID NO: 560834 - protein, 9 aa, Mycobacterium
RESVRDEKR

SEQ ID NO: 560835 - protein, 9 aa, Mycobacterium
RESVRPGKE

SEQ ID NO: 560836 - protein, 10 aa, Mycobacterium
RESVTRSGVT

SEQ ID NO: 560837 - protein, 7 aa, Mycobacterium
RESYDDW

SEQ ID NO: 560838 - protein, 15 aa, Mycobacterium
RESYSEGDDEELGEV

SEQ ID NO: 560839 - protein, 13 aa, Mycobacterium
RETADARVAGGPD

SEQ ID NO: 560840 - protein, 14 aa, Mycobacterium
RETAERRKAERAKV

SEQ ID NO: 560841 - protein, 9 aa, Mycobacterium
RETAFGPGD

SEQ ID NO: 560842 - protein, 7 aa, Mycobacterium
RETAGAV

SEQ ID NO: 560843 - protein, 10 aa, Mycobacterium
RETAGERPIP

SEQ ID NO: 560844 - protein, 11 aa, Mycobacterium
RETAGWPEGEP

SEQ ID NO: 560845 - protein, 9 aa, Mycobacterium
RETAKRRPV

SEQ ID NO: 560846 - protein, 8 aa, Mycobacterium
RETANWPE

SEQ ID NO: 560847 - protein, 13 aa, Mycobacterium
RETASADLPGGPF

SEQ ID NO: 560848 - protein, 8 aa, Mycobacterium
RETASQAL

SEQ ID NO: 560849 - protein, 4 aa, Mycobacterium
RETC

SEQ ID NO: 560850 - protein, 9 aa, Mycobacterium
RETDDDGNV

SEQ ID NO: 560851 - protein, 6 aa, Mycobacterium
RETDDR

SEQ ID NO: 560852 - protein, 9 aa, Mycobacterium
RETDEDDNV

SEQ ID NO: 560853 - protein, 11 aa, Mycobacterium
RETDEESTVPS

SEQ ID NO: 560854 - protein, 12 aa, Mycobacterium
RETDEPELRVSG

SEQ ID NO: 560855 - protein, 6 aa, Mycobacterium
RETDGA

SEQ ID NO: 560856 - protein, 9 aa, Mycobacterium
RETDGGTEV

SEQ ID NO: 560857 - protein, 7 aa, Mycobacterium
RETDPDF

SEQ ID NO: 560858 - protein, 7 aa, Mycobacterium
RETDPEL

SEQ ID NO: 560859 - protein, 7 aa, Mycobacterium
RETDPRL

SEQ ID NO: 560860 - protein, 9 aa, Mycobacterium
RETDQDGNL

SEQ ID NO: 560861 - protein, 7 aa, Mycobacterium
RETDTRV

SEQ ID NO: 560862 - protein, 8 aa, Mycobacterium
RETDTSTT

SEQ ID NO: 560863 - protein, 15 aa, Mycobacterium
RETETTKWRDPSGNV

SEQ ID NO: 560864 - protein, 16 aa, Mycobacterium
RETETTKWRDPTGSVG

SEQ ID NO: 560865 - protein, 8 aa, Mycobacterium
RETFGDDA

SEQ ID NO: 560866 - protein, 4 aa, Mycobacterium
RETG

SEQ ID NO: 560867 - protein, 10 aa, Mycobacterium
RETGAAPGGA

SEQ ID NO: 560868 - protein, 6 aa, Mycobacterium
RETGAD

SEQ ID NO: 560869 - protein, 6 aa, Mycobacterium
RETGAR

SEQ ID NO: 560870 - protein, 7 aa, Mycobacterium
RETGARL

SEQ ID NO: 560871 - protein, 17 aa, Mycobacterium
RETGARTTIAEDPQADL

SEQ ID NO: 560872 - protein, 7 aa, Mycobacterium
RETGATP

SEQ ID NO: 560873 - protein, 5 aa, Mycobacterium
RETGD

SEQ ID NO: 560874 - protein, 6 aa, Mycobacterium
RETGEA

SEQ ID NO: 560875 - protein, 7 aa, Mycobacterium
RETGGAV

SEQ ID NO: 560876 - protein, 11 aa, Mycobacterium
RETGGKAGGLF

SEQ ID NO: 560877 - protein, 9 aa, Mycobacterium
RETGHPPKV

SEQ ID NO: 560878 - protein, 8 aa, Mycobacterium
RETGLGPE

SEQ ID NO: 560879 - protein, 12 aa, Mycobacterium
RETGNIYEKDGA

SEQ ID NO: 560880 - protein, 9 aa, Mycobacterium
RETGQLEQD

SEQ ID NO: 560881 - protein, 5 aa, Mycobacterium
RETGR

SEQ ID NO: 560882 - protein, 7 aa, Mycobacterium
RETGRAS

SEQ ID NO: 560883 - protein, 6 aa, Mycobacterium
RETGRE

SEQ ID NO: 560884 - protein, 10 aa, Mycobacterium
RETGRGPGDY

SEQ ID NO: 560885 - protein, 6 aa, Mycobacterium
RETGRL

SEQ ID NO: 560886 - protein, 6 aa, Mycobacterium
RETGSA

SEQ ID NO: 560887 - protein, 7 aa, Mycobacterium
RETGSTI

SEQ ID NO: 560888 - protein, 6 aa, Mycobacterium
RETGTA

SEQ ID NO: 560889 - protein, 9 aa, Mycobacterium
RETGTTKVN

SEQ ID NO: 560890 - protein, 17 aa, Mycobacterium
RETGVDPGGRAPVRERA

SEQ ID NO: 560891 - protein, 15 aa, Mycobacterium
RETGYENLPAQDETA

SEQ ID NO: 560892 - protein, 4 aa, Mycobacterium
RETI

SEQ ID NO: 560893 - protein, 5 aa, Mycobacterium
RETIR

SEQ ID NO: 560894 - protein, 9 aa, Mycobacterium
RETISEEGW

SEQ ID NO: 560895 - protein, 21 aa, Mycobacterium
RETKTVGTGRRKPRSADATEL

SEQ ID NO: 560896 - protein, 11 aa, Mycobacterium
RETLARQRETI

SEQ ID NO: 560897 - protein, 12 aa, Mycobacterium
RETLDGDDAKVT

SEQ ID NO: 560898 - protein, 12 aa, Mycobacterium
RETLNDDDARVT

SEQ ID NO: 560899 - protein, 6 aa, Mycobacterium
RETPDR

SEQ ID NO: 560900 - protein, 7 aa, Mycobacterium
RETPEVA

SEQ ID NO: 560901 - protein, 10 aa, Mycobacterium
RETPGKRGAC

SEQ ID NO: 560902 - protein, 5 aa, Mycobacterium
RETPL

SEQ ID NO: 560903 - protein, 6 aa, Mycobacterium
RETPLR

SEQ ID NO: 560904 - protein, 7 aa, Mycobacterium
RETPRPG

SEQ ID NO: 560905 - protein, 9 aa, Mycobacterium
RETQGPARI

SEQ ID NO: 560906 - protein, 9 aa, Mycobacterium
RETQGPSRI

SEQ ID NO: 560907 - protein, 6 aa, Mycobacterium
RETQTT

SEQ ID NO: 560908 - protein, 4 aa, Mycobacterium
RETR

SEQ ID NO: 560909 - protein, 6 aa, Mycobacterium
RETRAR

SEQ ID NO: 560910 - protein, 5 aa, Mycobacterium
RETRE

SEQ ID NO: 560911 - protein, 6 aa, Mycobacterium
RETREA

SEQ ID NO: 560912 - protein, 7 aa, Mycobacterium
RETREGF

SEQ ID NO: 560913 - protein, 9 aa, Mycobacterium
RETRGAPEG

SEQ ID NO: 560914 - protein, 16 aa, Mycobacterium
RETRGLTGAAEGADPV

SEQ ID NO: 560915 - protein, 5 aa, Mycobacterium
RETRL

SEQ ID NO: 560916 - protein, 6 aa, Mycobacterium
RETRRT

SEQ ID NO: 560917 - protein, 8 aa, Mycobacterium
RETSAAYR

SEQ ID NO: 560918 - protein, 6 aa, Mycobacterium
RETSAR

SEQ ID NO: 560919 - protein, 8 aa, Mycobacterium
RETSASRQ

SEQ ID NO: 560920 - protein, 6 aa, Mycobacterium
RETSDA

SEQ ID NO: 560921 - protein, 12 aa, Mycobacterium
RETSEAVLPRLF

SEQ ID NO: 560922 - protein, 12 aa, Mycobacterium
RETSESVLPRLF

SEQ ID NO: 560923 - protein, 10 aa, Mycobacterium
RETSGATRVR

SEQ ID NO: 560924 - protein, 7 aa, Mycobacterium
RETSHEA

SEQ ID NO: 560925 - protein, 5 aa, Mycobacterium
RETSP

SEQ ID NO: 560926 - protein, 15 aa, Mycobacterium
RETSRTFPSVNPATA

SEQ ID NO: 560927 - protein, 5 aa, Mycobacterium
RETSS

SEQ ID NO: 560928 - protein, 5 aa, Mycobacterium
RETST

SEQ ID NO: 560929 - protein, 8 aa, Mycobacterium
RETSTGER

SEQ ID NO: 560930 - protein, 5 aa, Mycobacterium
RETSV

SEQ ID NO: 560931 - protein, 5 aa, Mycobacterium
RETTD

SEQ ID NO: 560932 - protein, 7 aa, Mycobacterium
RETTDFD

SEQ ID NO: 560933 - protein, 5 aa, Mycobacterium
RETTF

SEQ ID NO: 560934 - protein, 7 aa, Mycobacterium
RETTGES

SEQ ID NO: 560935 - protein, 6 aa, Mycobacterium
RETTNF

SEQ ID NO: 560936 - protein, 15 aa, Mycobacterium
RETVDGAGEAPGVLP

SEQ ID NO: 560937 - protein, 7 aa, Mycobacterium
RETWPGD

SEQ ID NO: 560938 - protein, 12 aa, Mycobacterium
RETYGDTSSLSA

SEQ ID NO: 560939 - protein, 5 aa, Mycobacterium
REVAG

SEQ ID NO: 560940 - protein, 7 aa, Mycobacterium
REVAGPA

SEQ ID NO: 560941 - protein, 12 aa, Mycobacterium
REVAPSATPEHP

SEQ ID NO: 560942 - protein, 6 aa, Mycobacterium
REVARA

SEQ ID NO: 560943 - protein, 4 aa, Mycobacterium
REVD

SEQ ID NO: 560944 - protein, 7 aa, Mycobacterium
REVDDPH

SEQ ID NO: 560945 - protein, 12 aa, Mycobacterium
REVDGQAAYEAR

SEQ ID NO: 560946 - protein, 11 aa, Mycobacterium
REVDGQPAYEA

SEQ ID NO: 560947 - protein, 7 aa, Mycobacterium
REVDPDR

SEQ ID NO: 560948 - protein, 7 aa, Mycobacterium
REVGERA

SEQ ID NO: 560949 - protein, 10 aa, Mycobacterium
REVGETGKEI

SEQ ID NO: 560950 - protein, 13 aa, Mycobacterium
REVGGGDARSDVG

SEQ ID NO: 560951 - protein, 11 aa, Mycobacterium
REVGGGDKRCD

SEQ ID NO: 560952 - protein, 9 aa, Mycobacterium
REVGGGDVR

SEQ ID NO: 560953 - protein, 11 aa, Mycobacterium
REVGGGESRYD

SEQ ID NO: 560954 - protein, 7 aa, Mycobacterium
REVGGPA

SEQ ID NO: 560955 - protein, 8 aa, Mycobacterium
REVNTAGD

SEQ ID NO: 560956 - protein, 4 aa, Mycobacterium
REVP

SEQ ID NO: 560957 - protein, 6 aa, Mycobacterium
REVPES

SEQ ID NO: 560958 - protein, 10 aa, Mycobacterium
REVPGGEPYV

SEQ ID NO: 560959 - protein, 6 aa, Mycobacterium
REVQAS

SEQ ID NO: 560960 - protein, 14 aa, Mycobacterium
REVQGLQQSGPVEA

SEQ ID NO: 560961 - protein, 8 aa, Mycobacterium
REVQPGER

SEQ ID NO: 560962 - protein, 10 aa, Mycobacterium
REVRGPAGLQ

SEQ ID NO: 560963 - protein, 8 aa, Mycobacterium
REVRGPDA

SEQ ID NO: 560964 - protein, 4 aa, Mycobacterium
REVS

SEQ ID NO: 560965 - protein, 8 aa, Mycobacterium
REVSDSAR

SEQ ID NO: 560966 - protein, 9 aa, Mycobacterium
REVSDSARV

SEQ ID NO: 560967 - protein, 7 aa, Mycobacterium
REVSGAG

SEQ ID NO: 560968 - protein, 9 aa, Mycobacterium
REVSGTDRA

SEQ ID NO: 560969 - protein, 16 aa, Mycobacterium
REVSPEEIAEAMKSMP

SEQ ID NO: 560970 - protein, 6 aa, Mycobacterium
REVSPG

SEQ ID NO: 560971 - protein, 15 aa, Mycobacterium
REVSSDANVLNDDSR

SEQ ID NO: 560972 - protein, 4 aa, Mycobacterium
REVT

SEQ ID NO: 560973 - protein, 7 aa, Mycobacterium
REVTGSA

SEQ ID NO: 560974 - protein, 9 aa, Mycobacterium
REVTRGERR

SEQ ID NO: 560975 - protein, 9 aa, Mycobacterium
REVTRGGRQ

SEQ ID NO: 560976 - protein, 8 aa, Mycobacterium
REVTRGQR

SEQ ID NO: 560977 - protein, 11 aa, Mycobacterium
REVTRYGDGQI

SEQ ID NO: 560978 - protein, 4 aa, Mycobacterium
REWA

SEQ ID NO: 560979 - protein, 4 aa, Mycobacterium
REWE

SEQ ID NO: 560980 - protein, 5 aa, Mycobacterium
REWNP

SEQ ID NO: 560981 - protein, 5 aa, Mycobacterium
REWQP

SEQ ID NO: 560982 - protein, 11 aa, Mycobacterium
REYAAGSSSRI

SEQ ID NO: 560983 - protein, 4 aa, Mycobacterium
REYD

SEQ ID NO: 560984 - protein, 18 aa, Mycobacterium
REYDPELRPATAKPGITA

SEQ ID NO: 560985 - protein, 6 aa, Mycobacterium
REYGDG

SEQ ID NO: 560986 - protein, 9 aa, Mycobacterium
REYGGRGAS

SEQ ID NO: 560987 - protein, 9 aa, Mycobacterium
REYGGRGAT

SEQ ID NO: 560988 - protein, 10 aa, Mycobacterium
REYNKSSGDV

SEQ ID NO: 560989 - protein, 5 aa, Mycobacterium
REYPD

SEQ ID NO: 560990 - protein, 5 aa, Mycobacterium
REYPN

SEQ ID NO: 560991 - protein, 11 aa, Mycobacterium
REYQEDSVQRT

SEQ ID NO: 560992 - protein, 11 aa, Mycobacterium
REYQESSVQRT

SEQ ID NO: 560993 - protein, 12 aa, Mycobacterium
REYQPRAISDED

SEQ ID NO: 560994 - protein, 9 aa, Mycobacterium
REYSEGPAA

SEQ ID NO: 560995 - protein, 5 aa, Mycobacterium
REYTD

SEQ ID NO: 560996 - protein, 15 aa, Mycobacterium
REYTDRRYGKVTTER

SEQ ID NO: 560997 - protein, 4 aa, Mycobacterium
RFAA

SEQ ID NO: 560998 - protein, 15 aa, Mycobacterium
RFADEAKKMHDSTNN

SEQ ID NO: 560999 - protein, 7 aa, Mycobacterium
RFADEDS

SEQ ID NO: 561000 - protein, 7 aa, Mycobacterium
RFADETS

SEQ ID NO: 561001 - protein, 4 aa, Mycobacterium
RFAE

SEQ ID NO: 561002 - protein, 9 aa, Mycobacterium
RFAEGTPAG

SEQ ID NO: 561003 - protein, 10 aa, Mycobacterium
RFAEGTPDGV

SEQ ID NO: 561004 - protein, 7 aa, Mycobacterium
RFAGPDA

SEQ ID NO: 561005 - protein, 9 aa, Mycobacterium
RFAGTPDAP

SEQ ID NO: 561006 - protein, 6 aa, Mycobacterium
RFANEA

SEQ ID NO: 561007 - protein, 9 aa, Mycobacterium
RFANPTPKG

SEQ ID NO: 561008 - protein, 6 aa, Mycobacterium
RFAPDG

SEQ ID NO: 561009 - protein, 17 aa, Mycobacterium
RFAPDGTLLEGPATRGL

SEQ ID NO: 561010 - protein, 6 aa, Mycobacterium
RFAPGD

SEQ ID NO: 561011 - protein, 5 aa, Mycobacterium
RFAPH

SEQ ID NO: 561012 - protein, 12 aa, Mycobacterium
RFAPKKSKGRDR

SEQ ID NO: 561013 - protein, 11 aa, Mycobacterium
RFAQQGYEKTT

SEQ ID NO: 561014 - protein, 7 aa, Mycobacterium
RFASPAA

SEQ ID NO: 561015 - protein, 5 aa, Mycobacterium
RFATT

SEQ ID NO: 561016 - protein, 6 aa, Mycobacterium
RFATTG

SEQ ID NO: 561017 - protein, 6 aa, Mycobacterium
RFDASG

SEQ ID NO: 561018 - protein, 6 aa, Mycobacterium
RFDDPD

SEQ ID NO: 561019 - protein, 5 aa, Mycobacterium
RFDED

SEQ ID NO: 561020 - protein, 12 aa, Mycobacterium
RFDGDEDTDAEH

SEQ ID NO: 561021 - protein, 10 aa, Mycobacterium
RFDPGESPQL

SEQ ID NO: 561022 - protein, 6 aa, Mycobacterium
RFDPRT

SEQ ID NO: 561023 - protein, 4 aa, Mycobacterium
RFEG

SEQ ID NO: 561024 - protein, 8 aa, Mycobacterium
RFEGPDGA

SEQ ID NO: 561025 - protein, 9 aa, Mycobacterium
RFEGPEGTV

SEQ ID NO: 561026 - protein, 6 aa, Mycobacterium
RFENDP

SEQ ID NO: 561027 - protein, 5 aa, Mycobacterium
RFENG

SEQ ID NO: 561028 - protein, 6 aa, Mycobacterium
RFEPVD

SEQ ID NO: 561029 - protein, 5 aa, Mycobacterium
RFEQP

SEQ ID NO: 561030 - protein, 9 aa, Mycobacterium
RFERAGNDG

SEQ ID NO: 561031 - protein, 12 aa, Mycobacterium
RFGADSATHHRH

SEQ ID NO: 561032 - protein, 16 aa, Mycobacterium
RFGAGSAQRHRESGAV

SEQ ID NO: 561033 - protein, 6 aa, Mycobacterium
RFGDAK

SEQ ID NO: 561034 - protein, 25 aa, Mycobacterium
RFGDEEQMRAASDEGRLRDERPPHH

SEQ ID NO: 561035 - protein, 6 aa, Mycobacterium
RFGDPE

SEQ ID NO: 561036 - protein, 10 aa, Mycobacterium
RFGEAPQRLP

SEQ ID NO: 561037 - protein, 6 aa, Mycobacterium
RFGEPD

SEQ ID NO: 561038 - protein, 16 aa, Mycobacterium
RFGEPDRGPAKLADGT

SEQ ID NO: 561039 - protein, 10 aa, Mycobacterium
RFGGAGGDFG

SEQ ID NO: 561040 - protein, 6 aa, Mycobacterium
RFGGET

SEQ ID NO: 561041 - protein, 7 aa, Mycobacterium
RFGGQQA

SEQ ID NO: 561042 - protein, 9 aa, Mycobacterium
RFGGRDGTN

SEQ ID NO: 561043 - protein, 4 aa, Mycobacterium
RFGN

SEQ ID NO: 561044 - protein, 15 aa, Mycobacterium
RFGPDDLHSTAGDVG

SEQ ID NO: 561045 - protein, 10 aa, Mycobacterium
RFGPNKPVAG

SEQ ID NO: 561046 - protein, 16 aa, Mycobacterium
RFGPPRAAPTRSGMSK

SEQ ID NO: 561047 - protein, 10 aa, Mycobacterium
RFGPRQPDGR

SEQ ID NO: 561048 - protein, 6 aa, Mycobacterium
RFGPST

SEQ ID NO: 561049 - protein, 9 aa, Mycobacterium
RFGPTQADG

SEQ ID NO: 561050 - protein, 6 aa, Mycobacterium
RFGQNT

SEQ ID NO: 561051 - protein, 4 aa, Mycobacterium
RFGR

SEQ ID NO: 561052 - protein, 15 aa, Mycobacterium
RFGRRGGTSDTASNP

SEQ ID NO: 561053 - protein, 7 aa, Mycobacterium
RFGRRRR

SEQ ID NO: 561054 - protein, 9 aa, Mycobacterium
RFGSPPAAG

SEQ ID NO: 561055 - protein, 7 aa, Mycobacterium
RFGSQGG

SEQ ID NO: 561056 - protein, 9 aa, Mycobacterium
RFGSREPDK

SEQ ID NO: 561057 - protein, 4 aa, Mycobacterium
RFGT

SEQ ID NO: 561058 - protein, 7 aa, Mycobacterium
RFGTNTA

SEQ ID NO: 561059 - protein, 6 aa, Mycobacterium
RFKSTS

SEQ ID NO: 561060 - protein, 5 aa, Mycobacterium
RFNGS

SEQ ID NO: 561061 - protein, 5 aa, Mycobacterium
RFNPD

SEQ ID NO: 561062 - protein, 5 aa, Mycobacterium
RFNPT

SEQ ID NO: 561063 - protein, 5 aa, Mycobacterium
RFNTG

SEQ ID NO: 561064 - protein, 5 aa, Mycobacterium
RFPAH

SEQ ID NO: 561065 - protein, 9 aa, Mycobacterium
RFPDDEPLN

SEQ ID NO: 561066 - protein, 6 aa, Mycobacterium
RFPDKS

SEQ ID NO: 561067 - protein, 8 aa, Mycobacterium
RFPDKSVR

SEQ ID NO: 561068 - protein, 11 aa, Mycobacterium
RFPDPSTIQEA

SEQ ID NO: 561069 - protein, 5 aa, Mycobacterium
RFPDS

SEQ ID NO: 561070 - protein, 10 aa, Mycobacterium
RFPEPGNPAH

SEQ ID NO: 561071 - protein, 7 aa, Mycobacterium
RFPEQAS

SEQ ID NO: 561072 - protein, 9 aa, Mycobacterium
RFPGDDERV

SEQ ID NO: 561073 - protein, 9 aa, Mycobacterium
RFPGDEDRV

SEQ ID NO: 561074 - protein, 9 aa, Mycobacterium
RFPGDEERV

SEQ ID NO: 561075 - protein, 8 aa, Mycobacterium
RFPGDENR

SEQ ID NO: 561076 - protein, 10 aa, Mycobacterium
RFPGDRDAVQ

SEQ ID NO: 561077 - protein, 12 aa, Mycobacterium
RFPGFTEPDPSY

SEQ ID NO: 561078 - protein, 5 aa, Mycobacterium
RFPGG

SEQ ID NO: 561079 - protein, 7 aa, Mycobacterium
RFPGGSV

SEQ ID NO: 561080 - protein, 7 aa, Mycobacterium
RFPGSEL

SEQ ID NO: 561081 - protein, 17 aa, Mycobacterium
RFPKGTSDGWPDSHNPL

SEQ ID NO: 561082 - protein, 10 aa, Mycobacterium
RFPNPNDRDH

SEQ ID NO: 561083 - protein, 4 aa, Mycobacterium
RFPP

SEQ ID NO: 561084 - protein, 9 aa, Mycobacterium
RFPPAPHKD

SEQ ID NO: 561085 - protein, 5 aa, Mycobacterium
RFPPE

SEQ ID NO: 561086 - protein, 15 aa, Mycobacterium
RFPPGTATFEPDGPD

SEQ ID NO: 561087 - protein, 4 aa, Mycobacterium
RFPS

SEQ ID NO: 561088 - protein, 5 aa, Mycobacterium
RFPSG

SEQ ID NO: 561089 - protein, 7 aa, Mycobacterium
RFPSSGL

SEQ ID NO: 561090 - protein, 5 aa, Mycobacterium
RFPTA

SEQ ID NO: 561091 - protein, 10 aa, Mycobacterium
RFPTAADDVR

SEQ ID NO: 561092 - protein, 12 aa, Mycobacterium
RFPTDEPVNPLG

SEQ ID NO: 561093 - protein, 10 aa, Mycobacterium
RFPTEGRPDH

SEQ ID NO: 561094 - protein, 8 aa, Mycobacterium
RFPTGPVS

SEQ ID NO: 561095 - protein, 7 aa, Mycobacterium
RFPTPEP

SEQ ID NO: 561096 - protein, 11 aa, Mycobacterium
RFRDGDDREPA

SEQ ID NO: 561097 - protein, 12 aa, Mycobacterium
RFREAADSQGFD

SEQ ID NO: 561098 - protein, 10 aa, Mycobacterium
RFREDTRDYA

SEQ ID NO: 561099 - protein, 11 aa, Mycobacterium
RFRPGPGPRTI

SEQ ID NO: 561100 - protein, 12 aa, Mycobacterium
RFRRGGADRPAV

SEQ ID NO: 561101 - protein, 10 aa, Mycobacterium
RFSATDRNTL

SEQ ID NO: 561102 - protein, 15 aa, Mycobacterium
RFSEKEAKAIANQNT

SEQ ID NO: 561103 - protein, 14 aa, Mycobacterium
RFSEKEATAIANQN

SEQ ID NO: 561104 - protein, 9 aa, Mycobacterium
RFSGGSSGL

SEQ ID NO: 561105 - protein, 10 aa, Mycobacterium
RFSGGSSGLS

SEQ ID NO: 561106 - protein, 9 aa, Mycobacterium
RFSGGTSGL

SEQ ID NO: 561107 - protein, 9 aa, Mycobacterium
RFSNGRPPG

SEQ ID NO: 561108 - protein, 13 aa, Mycobacterium
RFSNSNAHTSGEY

SEQ ID NO: 561109 - protein, 9 aa, Mycobacterium
RFSNSRPPG

SEQ ID NO: 561110 - protein, 5 aa, Mycobacterium
RFSPE

SEQ ID NO: 561111 - protein, 17 aa, Mycobacterium
RFSPVDGSPTKPARAGW

SEQ ID NO: 561112 - protein, 7 aa, Mycobacterium
RFSRGDT

SEQ ID NO: 561113 - protein, 7 aa, Mycobacterium
RFSRSDL

SEQ ID NO: 561114 - protein, 27 aa, Mycobacterium
RFSRTQPGRPTPPPQRGADTEAVLRDW

SEQ ID NO: 561115 - protein, 9 aa, Mycobacterium
RFSRTSRTT

SEQ ID NO: 561116 - protein, 10 aa, Mycobacterium
RFSRTTEKSL

SEQ ID NO: 561117 - protein, 4 aa, Mycobacterium
RFSS

SEQ ID NO: 561118 - protein, 12 aa, Mycobacterium
RFSSGDRSATSP

SEQ ID NO: 561119 - protein, 16 aa, Mycobacterium
RFSSVDGSPTRPARAG

SEQ ID NO: 561120 - protein, 18 aa, Mycobacterium
RFSTAAGSFPRRCPSRRP

SEQ ID NO: 561121 - protein, 17 aa, Mycobacterium
RFSTPGGGTNLDGEGTP

SEQ ID NO: 561122 - protein, 6 aa, Mycobacterium
RFSTRA

SEQ ID NO: 561123 - protein, 10 aa, Mycobacterium
RFTDPAESKA

SEQ ID NO: 561124 - protein, 9 aa, Mycobacterium
RFTDPAESR

SEQ ID NO: 561125 - protein, 7 aa, Mycobacterium
RFTDRQR

SEQ ID NO: 561126 - protein, 4 aa, Mycobacterium
RFTE

SEQ ID NO: 561127 - protein, 7 aa, Mycobacterium
RFTGPDD

SEQ ID NO: 561128 - protein, 7 aa, Mycobacterium
RFTGPNS

SEQ ID NO: 561129 - protein, 13 aa, Mycobacterium
RFTNSNPQTSPEY

SEQ ID NO: 561130 - protein, 5 aa, Mycobacterium
RFTPE

SEQ ID NO: 561131 - protein, 15 aa, Mycobacterium
RFTPEAAERTAVPGV

SEQ ID NO: 561132 - protein, 15 aa, Mycobacterium
RFTPESAERTAVPGV

SEQ ID NO: 561133 - protein, 14 aa, Mycobacterium
RFTPGADPATVAPA

SEQ ID NO: 561134 - protein, 8 aa, Mycobacterium
RFTPSGDE

SEQ ID NO: 561135 - protein, 10 aa, Mycobacterium
RFTQEGRGRK

SEQ ID NO: 561136 - protein, 4 aa, Mycobacterium
RFTR

SEQ ID NO: 561137 - protein, 12 aa, Mycobacterium
RFTTPSRADDDD

SEQ ID NO: 561138 - protein, 9 aa, Mycobacterium
RGAAAAQGY

SEQ ID NO: 561139 - protein, 6 aa, Mycobacterium
RGAAAS

SEQ ID NO: 561140 - protein, 8 aa, Mycobacterium
RGAAATAE

SEQ ID NO: 561141 - protein, 14 aa, Mycobacterium
RGAADALGRGVRSE

SEQ ID NO: 561142 - protein, 6 aa, Mycobacterium
RGAADI

SEQ ID NO: 561143 - protein, 7 aa, Mycobacterium
RGAAEAE

SEQ ID NO: 561144 - protein, 12 aa, Mycobacterium
RGAAELEGASAS

SEQ ID NO: 561145 - protein, 12 aa, Mycobacterium
RGAAELEGASAT

SEQ ID NO: 561146 - protein, 8 aa, Mycobacterium
RGAAEPNL

SEQ ID NO: 561147 - protein, 6 aa, Mycobacterium
RGAAEV

SEQ ID NO: 561148 - protein, 5 aa, Mycobacterium
RGAAG

SEQ ID NO: 561149 - protein, 8 aa, Mycobacterium
RGAAGAAS

SEQ ID NO: 561150 - protein, 8 aa, Mycobacterium
RGAAKLAG

SEQ ID NO: 561151 - protein, 14 aa, Mycobacterium
RGAAPADARTTTIG

SEQ ID NO: 561152 - protein, 6 aa, Mycobacterium
RGAAPE

SEQ ID NO: 561153 - protein, 14 aa, Mycobacterium
RGAAPESKAGQVHY

SEQ ID NO: 561154 - protein, 16 aa, Mycobacterium
RGAAPLRDTRNESVSF

SEQ ID NO: 561155 - protein, 9 aa, Mycobacterium
RGAAPSAAE

SEQ ID NO: 561156 - protein, 15 aa, Mycobacterium
RGAAPTTVISSPDRA

SEQ ID NO: 561157 - protein, 26 aa, Mycobacterium
RGAAPVQPEPTPPATTLAPSAEVPPE

SEQ ID NO: 561158 - protein, 6 aa, Mycobacterium
RGAARD

SEQ ID NO: 561159 - protein, 7 aa, Mycobacterium
RGAARPA

SEQ ID NO: 561160 - protein, 12 aa, Mycobacterium
RGAARTGRDPND

SEQ ID NO: 561161 - protein, 14 aa, Mycobacterium
RGAARVDDDQFRPG

SEQ ID NO: 561162 - protein, 9 aa, Mycobacterium
RGAATSKEI

SEQ ID NO: 561163 - protein, 8 aa, Mycobacterium
RGACPAGQ

SEQ ID NO: 561164 - protein, 5 aa, Mycobacterium
RGADA

SEQ ID NO: 561165 - protein, 13 aa, Mycobacterium
RGADAPAVNERTP

SEQ ID NO: 561166 - protein, 14 aa, Mycobacterium
RGADAPDADGPANL

SEQ ID NO: 561167 - protein, 6 aa, Mycobacterium
RGADAR

SEQ ID NO: 561168 - protein, 11 aa, Mycobacterium
RGADATARGLP

SEQ ID NO: 561169 - protein, 12 aa, Mycobacterium
RGADATFEERYR

SEQ ID NO: 561170 - protein, 6 aa, Mycobacterium
RGADAV

SEQ ID NO: 561171 - protein, 19 aa, Mycobacterium
RGADDAALGGEAAETIDAT

SEQ ID NO: 561172 - protein, 23 aa, Mycobacterium
RGADDEVAAPATEVAGSDALPEP

SEQ ID NO: 561173 - protein, 10 aa, Mycobacterium
RGADDQRDVG

SEQ ID NO: 561174 - protein, 12 aa, Mycobacterium
RGADESGAKSEV

SEQ ID NO: 561175 - protein, 5 aa, Mycobacterium
RGADG

SEQ ID NO: 561176 - protein, 8 aa, Mycobacterium
RGADGAYQ

SEQ ID NO: 561177 - protein, 17 aa, Mycobacterium
RGADGDQEADLAEAESA

SEQ ID NO: 561178 - protein, 6 aa, Mycobacterium
RGADGE

SEQ ID NO: 561179 - protein, 7 aa, Mycobacterium
RGADGEI

SEQ ID NO: 561180 - protein, 7 aa, Mycobacterium
RGADGPR

SEQ ID NO: 561181 - protein, 14 aa, Mycobacterium
RGADNDDAGADDGV

SEQ ID NO: 561182 - protein, 13 aa, Mycobacterium
RGADPLTGEPTSD

SEQ ID NO: 561183 - protein, 14 aa, Mycobacterium
RGADPRDSTRPMSV

SEQ ID NO: 561184 - protein, 15 aa, Mycobacterium
RGADPTIETTNGSTA

SEQ ID NO: 561185 - protein, 10 aa, Mycobacterium
RGADQAGARA

SEQ ID NO: 561186 - protein, 9 aa, Mycobacterium
RGADQLSGD

SEQ ID NO: 561187 - protein, 5 aa, Mycobacterium
RGADR

SEQ ID NO: 561188 - protein, 12 aa, Mycobacterium
RGADREPATADD

SEQ ID NO: 561189 - protein, 12 aa, Mycobacterium
RGADREPATAED

SEQ ID NO: 561190 - protein, 13 aa, Mycobacterium
RGADREPATEDDL

SEQ ID NO: 561191 - protein, 13 aa, Mycobacterium
RGADREPATPEDL

SEQ ID NO: 561192 - protein, 12 aa, Mycobacterium
RGADREPATPQD

SEQ ID NO: 561193 - protein, 11 aa, Mycobacterium
RGADYGVGTGE

SEQ ID NO: 561194 - protein, 12 aa, Mycobacterium
RGADYGVTTGPV

SEQ ID NO: 561195 - protein, 4 aa, Mycobacterium
RGAE

SEQ ID NO: 561196 - protein, 14 aa, Mycobacterium
RGAEATVDYDREDL

SEQ ID NO: 561197 - protein, 15 aa, Mycobacterium
RGAEATVDYDREDLK

SEQ ID NO: 561198 - protein, 7 aa, Mycobacterium
RGAEDAD

SEQ ID NO: 561199 - protein, 10 aa, Mycobacterium
RGAEDTPYGR

SEQ ID NO: 561200 - protein, 29 aa, Mycobacterium
RGAEEEAQAAGGAAGRAGGEGAAGARGAL

SEQ ID NO: 561201 - protein, 8 aa, Mycobacterium
RGAEGTDN

SEQ ID NO: 561202 - protein, 5 aa, Mycobacterium
RGAEH

SEQ ID NO: 561203 - protein, 10 aa, Mycobacterium
RGAEIGPGAR

SEQ ID NO: 561204 - protein, 11 aa, Mycobacterium
RGAEIGPGARL

SEQ ID NO: 561205 - protein, 9 aa, Mycobacterium
RGAEIGPGV

SEQ ID NO: 561206 - protein, 17 aa, Mycobacterium
RGAEIYPDDEPLGPGRR

SEQ ID NO: 561207 - protein, 11 aa, Mycobacterium
RGAEKANRKVE

SEQ ID NO: 561208 - protein, 6 aa, Mycobacterium
RGAEPV

SEQ ID NO: 561209 - protein, 20 aa, Mycobacterium
RGAERADEQEIERNPRSAPV

SEQ ID NO: 561210 - protein, 19 aa, Mycobacterium
RGAERANDEEIEVNPRSAP

SEQ ID NO: 561211 - protein, 6 aa, Mycobacterium
RGAERI

SEQ ID NO: 561212 - protein, 21 aa, Mycobacterium
RGAERQANDIRRAREAKEIRG

SEQ ID NO: 561213 - protein, 9 aa, Mycobacterium
RGAESDGGG

SEQ ID NO: 561214 - protein, 7 aa, Mycobacterium
RGAETTQ

SEQ ID NO: 561215 - protein, 11 aa, Mycobacterium
RGAEVAGGARL

SEQ ID NO: 561216 - protein, 7 aa, Mycobacterium
RGAEVPD

SEQ ID NO: 561217 - protein, 26 aa, Mycobacterium
RGAFGGAGGCSARQTFRGGASMWNRT

SEQ ID NO: 561218 - protein, 5 aa, Mycobacterium
RGAGA

SEQ ID NO: 561219 - protein, 19 aa, Mycobacterium
RGAGAPRRALSPTRTAPPW

SEQ ID NO: 561220 - protein, 11 aa, Mycobacterium
RGAGASASAVA

SEQ ID NO: 561221 - protein, 5 aa, Mycobacterium
RGAGD

SEQ ID NO: 561222 - protein, 16 aa, Mycobacterium
RGAGESSRPADQSGYR

SEQ ID NO: 561223 - protein, 5 aa, Mycobacterium
RGAGG

SEQ ID NO: 561224 - protein, 10 aa, Mycobacterium
RGAGGAQPGC

SEQ ID NO: 561225 - protein, 10 aa, Mycobacterium
RGAGGARPGC

SEQ ID NO: 561226 - protein, 14 aa, Mycobacterium
RGAGGARSAPHPAD

SEQ ID NO: 561227 - protein, 11 aa, Mycobacterium
RGAGGGAAETL

SEQ ID NO: 561228 - protein, 9 aa, Mycobacterium
RGAGGGDGG

SEQ ID NO: 561229 - protein, 11 aa, Mycobacterium
RGAGGPRREDH

SEQ ID NO: 561230 - protein, 20 aa, Mycobacterium
RGAGGRPSRPRRGNDLETET

SEQ ID NO: 561231 - protein, 12 aa, Mycobacterium
RGAGGVGQDRGQ

SEQ ID NO: 561232 - protein, 8 aa, Mycobacterium
RGAGISPT

SEQ ID NO: 561233 - protein, 7 aa, Mycobacterium
RGAGISR

SEQ ID NO: 561234 - protein, 12 aa, Mycobacterium
RGAGKAEDAKKL

SEQ ID NO: 561235 - protein, 5 aa, Mycobacterium
RGAGM

SEQ ID NO: 561236 - protein, 9 aa, Mycobacterium
RGAGNDYAV

SEQ ID NO: 561237 - protein, 8 aa, Mycobacterium
RGAGPATA

SEQ ID NO: 561238 - protein, 7 aa, Mycobacterium
RGAGPGH

SEQ ID NO: 561239 - protein, 7 aa, Mycobacterium
RGAGPGT

SEQ ID NO: 561240 - protein, 7 aa, Mycobacterium
RGAGPHK

SEQ ID NO: 561241 - protein, 6 aa, Mycobacterium
RGAGRG

SEQ ID NO: 561242 - protein, 9 aa, Mycobacterium
RGAGRPEAT

SEQ ID NO: 561243 - protein, 6 aa, Mycobacterium
RGAGRR

SEQ ID NO: 561244 - protein, 12 aa, Mycobacterium
RGAGSGGLADSA

SEQ ID NO: 561245 - protein, 14 aa, Mycobacterium
RGAGSGLSGGATAL

SEQ ID NO: 561246 - protein, 15 aa, Mycobacterium
RGAGSGLSGGATALD

SEQ ID NO: 561247 - protein, 17 aa, Mycobacterium
RGAGSVGGAVATAAVAT

SEQ ID NO: 561248 - protein, 5 aa, Mycobacterium
RGAGT

SEQ ID NO: 561249 - protein, 8 aa, Mycobacterium
RGAGTAKR

SEQ ID NO: 561250 - protein, 15 aa, Mycobacterium
RGAGTGLSGGATALD

SEQ ID NO: 561251 - protein, 17 aa, Mycobacterium
RGAGTGLSGGSTAQDGA

SEQ ID NO: 561252 - protein, 11 aa, Mycobacterium
RGAGTSDGAGA

SEQ ID NO: 561253 - protein, 21 aa, Mycobacterium
RGAGTSGGVGSPLSDQEGEDV

SEQ ID NO: 561254 - protein, 7 aa, Mycobacterium
RGAGVPA

SEQ ID NO: 561255 - protein, 6 aa, Mycobacterium
RGAGYA

SEQ ID NO: 561256 - protein, 8 aa, Mycobacterium
RGAGYADS

SEQ ID NO: 561257 - protein, 8 aa, Mycobacterium
RGAHARSA

SEQ ID NO: 561258 - protein, 8 aa, Mycobacterium
RGAHDFGA

SEQ ID NO: 561259 - protein, 19 aa, Mycobacterium
RGAHEGRNAFAGPGGTRIG

SEQ ID NO: 561260 - protein, 18 aa, Mycobacterium
RGAHQSALDKASRPRTGE

SEQ ID NO: 561261 - protein, 11 aa, Mycobacterium
RGAIDERRADQ

SEQ ID NO: 561262 - protein, 8 aa, Mycobacterium
RGAKEEAL

SEQ ID NO: 561263 - protein, 11 aa, Mycobacterium
RGAKGKKAKSV

SEQ ID NO: 561264 - protein, 19 aa, Mycobacterium
RGAKGSERQGVSRSRTGIN

SEQ ID NO: 561265 - protein, 10 aa, Mycobacterium
RGAKPDKLRQ

SEQ ID NO: 561266 - protein, 8 aa, Mycobacterium
RGAKPERL

SEQ ID NO: 561267 - protein, 8 aa, Mycobacterium
RGAKPGCA

SEQ ID NO: 561268 - protein, 8 aa, Mycobacterium
RGAKPGER

SEQ ID NO: 561269 - protein, 9 aa, Mycobacterium
RGAKRTPAL

SEQ ID NO: 561270 - protein, 34 aa, Mycobacterium
RGAKTRAKAAHDADAPAAQRGTAQAADAPTDTPQ

SEQ ID NO: 561271 - protein, 26 aa, Mycobacterium
RGAKTRARARHPDDPAAHSADGDNQP

SEQ ID NO: 561272 - protein, 32 aa, Mycobacterium
RGAKTRARARHPEGHGDGTAPDTDASADTPSP

SEQ ID NO: 561273 - protein, 9 aa, Mycobacterium
RGALATAAR

SEQ ID NO: 561274 - protein, 13 aa, Mycobacterium
RGALDAGSTVTEA

SEQ ID NO: 561275 - protein, 18 aa, Mycobacterium
RGALEGDGSGKNGADNLR

SEQ ID NO: 561276 - protein, 21 aa, Mycobacterium
RGALEGDPSGRYSADNNRARR

SEQ ID NO: 561277 - protein, 7 aa, Mycobacterium
RGALGTA

SEQ ID NO: 561278 - protein, 7 aa, Mycobacterium
RGALPDK

SEQ ID NO: 561279 - protein, 19 aa, Mycobacterium
RGALPGDPSGPNGNDNNRV

SEQ ID NO: 561280 - protein, 5 aa, Mycobacterium
RGALT

SEQ ID NO: 561281 - protein, 6 aa, Mycobacterium
RGANDR

SEQ ID NO: 561282 - protein, 7 aa, Mycobacterium
RGANSSV

SEQ ID NO: 561283 - protein, 5 aa, Mycobacterium
RGANV

SEQ ID NO: 561284 - protein, 5 aa, Mycobacterium
RGAPA

SEQ ID NO: 561285 - protein, 8 aa, Mycobacterium
RGAPAGVA

SEQ ID NO: 561286 - protein, 12 aa, Mycobacterium
RGAPAPHDRPRT

SEQ ID NO: 561287 - protein, 6 aa, Mycobacterium
RGAPAR

SEQ ID NO: 561288 - protein, 5 aa, Mycobacterium
RGAPD

SEQ ID NO: 561289 - protein, 8 aa, Mycobacterium
RGAPDRAP

SEQ ID NO: 561290 - protein, 5 aa, Mycobacterium
RGAPG

SEQ ID NO: 561291 - protein, 10 aa, Mycobacterium
RGAPGGDLPV

SEQ ID NO: 561292 - protein, 10 aa, Mycobacterium
RGAPGHGGDA

SEQ ID NO: 561293 - protein, 6 aa, Mycobacterium
RGAPGL

SEQ ID NO: 561294 - protein, 9 aa, Mycobacterium
RGAPKGSAQ

SEQ ID NO: 561295 - protein, 6 aa, Mycobacterium
RGAPNE

SEQ ID NO: 561296 - protein, 14 aa, Mycobacterium
RGAPNFAAEARLAF

SEQ ID NO: 561297 - protein, 6 aa, Mycobacterium
RGAPRP

SEQ ID NO: 561298 - protein, 6 aa, Mycobacterium
RGAPVP

SEQ ID NO: 561299 - protein, 8 aa, Mycobacterium
RGAQATVD

SEQ ID NO: 561300 - protein, 5 aa, Mycobacterium
RGAQG

SEQ ID NO: 561301 - protein, 6 aa, Mycobacterium
RGAQGV

SEQ ID NO: 561302 - protein, 27 aa, Mycobacterium
RGAQKQADEIRRSRETKAVRDREHANE

SEQ ID NO: 561303 - protein, 7 aa, Mycobacterium
RGAQNAD

SEQ ID NO: 561304 - protein, 9 aa, Mycobacterium
RGAQPEKPV

SEQ ID NO: 561305 - protein, 15 aa, Mycobacterium
RGAQRQADDIRRAQE

SEQ ID NO: 561306 - protein, 27 aa, Mycobacterium
RGAQRQADDIRRARESKAVRDREHANE

SEQ ID NO: 561307 - protein, 15 aa, Mycobacterium
RGAQVGTTLTWRAPL

SEQ ID NO: 561308 - protein, 13 aa, Mycobacterium
RGARAGKLDPNRV

SEQ ID NO: 561309 - protein, 10 aa, Mycobacterium
RGARAGRLDP

SEQ ID NO: 561310 - protein, 8 aa, Mycobacterium
RGARARLD

SEQ ID NO: 561311 - protein, 6 aa, Mycobacterium
RGARDF

SEQ ID NO: 561312 - protein, 5 aa, Mycobacterium
RGARE

SEQ ID NO: 561313 - protein, 6 aa, Mycobacterium
RGARGM

SEQ ID NO: 561314 - protein, 12 aa, Mycobacterium
RGARGSFPPRRS

SEQ ID NO: 561315 - protein, 17 aa, Mycobacterium
RGARLAKDHSSSHGPPV

SEQ ID NO: 561316 - protein, 13 aa, Mycobacterium
RGARNEDATADDI

SEQ ID NO: 561317 - protein, 5 aa, Mycobacterium
RGARQ

SEQ ID NO: 561318 - protein, 11 aa, Mycobacterium
RGARRSGNRQL

SEQ ID NO: 561319 - protein, 7 aa, Mycobacterium
RGARRTL

SEQ ID NO: 561320 - protein, 9 aa, Mycobacterium
RGARSLGKE

SEQ ID NO: 561321 - protein, 7 aa, Mycobacterium
RGARSVP

SEQ ID NO: 561322 - protein, 5 aa, Mycobacterium
RGART

SEQ ID NO: 561323 - protein, 24 aa, Mycobacterium
RGARTAGARLDGADLRGTTADPGL

SEQ ID NO: 561324 - protein, 38 aa, Mycobacterium
RGARTGEIAGKALSGARDGALESAERVTREQGAEDAAD

SEQ ID NO: 561325 - protein, 19 aa, Mycobacterium
RGARTNGTKLDDADLRGAN

SEQ ID NO: 561326 - protein, 5 aa, Mycobacterium
RGARV

SEQ ID NO: 561327 - protein, 6 aa, Mycobacterium
RGARYQ

SEQ ID NO: 561328 - protein, 8 aa, Mycobacterium
RGASALAQ

SEQ ID NO: 561329 - protein, 8 aa, Mycobacterium
RGASGEVQ

SEQ ID NO: 561330 - protein, 15 aa, Mycobacterium
RGASGRGKSAPRAVS

SEQ ID NO: 561331 - protein, 8 aa, Mycobacterium
RGASGSAF

SEQ ID NO: 561332 - protein, 10 aa, Mycobacterium
RGASGSSYGS

SEQ ID NO: 561333 - protein, 12 aa, Mycobacterium
RGASPGAARGCG

SEQ ID NO: 561334 - protein, 10 aa, Mycobacterium
RGASPGGDLS

SEQ ID NO: 561335 - protein, 13 aa, Mycobacterium
RGASQARKNGYRR

SEQ ID NO: 561336 - protein, 7 aa, Mycobacterium
RGASRGM

SEQ ID NO: 561337 - protein, 14 aa, Mycobacterium
RGASSAASAANGAI

SEQ ID NO: 561338 - protein, 16 aa, Mycobacterium
RGASSAASAASATVDA

SEQ ID NO: 561339 - protein, 9 aa, Mycobacterium
RGASTSREV

SEQ ID NO: 561340 - protein, 15 aa, Mycobacterium
RGATDEALKRAGAFA

SEQ ID NO: 561341 - protein, 8 aa, Mycobacterium
RGATDEED

SEQ ID NO: 561342 - protein, 10 aa, Mycobacterium
RGATDEEDQL

SEQ ID NO: 561343 - protein, 8 aa, Mycobacterium
RGATDPTL

SEQ ID NO: 561344 - protein, 5 aa, Mycobacterium
RGATE

SEQ ID NO: 561345 - protein, 8 aa, Mycobacterium
RGATEEED

SEQ ID NO: 561346 - protein, 12 aa, Mycobacterium
RGATGTTERTCR

SEQ ID NO: 561347 - protein, 26 aa, Mycobacterium
RGATKKAAKGAATTAAAAEAGGLERP

SEQ ID NO: 561348 - protein, 26 aa, Mycobacterium
RGATKKAAKGAATTATAAEAGGLERP

SEQ ID NO: 561349 - protein, 18 aa, Mycobacterium
RGATPPPATVGAPETVPD

SEQ ID NO: 561350 - protein, 7 aa, Mycobacterium
RGATPSV

SEQ ID NO: 561351 - protein, 5 aa, Mycobacterium
RGATR

SEQ ID NO: 561352 - protein, 6 aa, Mycobacterium
RGATRR

SEQ ID NO: 561353 - protein, 11 aa, Mycobacterium
RGATSADATAE

SEQ ID NO: 561354 - protein, 11 aa, Mycobacterium
RGATSEDDALT

SEQ ID NO: 561355 - protein, 5 aa, Mycobacterium
RGATT

SEQ ID NO: 561356 - protein, 8 aa, Mycobacterium
RGATTTTY

SEQ ID NO: 561357 - protein, 14 aa, Mycobacterium
RGATTVEPTQEAQD

SEQ ID NO: 561358 - protein, 5 aa, Mycobacterium
RGATV

SEQ ID NO: 561359 - protein, 6 aa, Mycobacterium
RGATVD

SEQ ID NO: 561360 - protein, 5 aa, Mycobacterium
RGATY

SEQ ID NO: 561361 - protein, 25 aa, Mycobacterium
RGAVAAAAGSAAALAAEATPGIAGP

SEQ ID NO: 561362 - protein, 9 aa, Mycobacterium
RGAVEGTQA

SEQ ID NO: 561363 - protein, 7 aa, Mycobacterium
RGAVPGP

SEQ ID NO: 561364 - protein, 5 aa, Mycobacterium
RGAVS

SEQ ID NO: 561365 - protein, 4 aa, Mycobacterium
RGAW

SEQ ID NO: 561366 - protein, 4 aa, Mycobacterium
RGAY

SEQ ID NO: 561367 - protein, 12 aa, Mycobacterium
RGAYKTEYTEGT

SEQ ID NO: 561368 - protein, 12 aa, Mycobacterium
RGAYQSSYTPGT

SEQ ID NO: 561369 - protein, 7 aa, Mycobacterium
RGCPGRT

SEQ ID NO: 561370 - protein, 7 aa, Mycobacterium
RGCQDPL

SEQ ID NO: 561371 - protein, 8 aa, Mycobacterium
RGCSASGC

SEQ ID NO: 561372 - protein, 12 aa, Mycobacterium
RGCSKPGCDAPA

SEQ ID NO: 561373 - protein, 5 aa, Mycobacterium
RGCTH

SEQ ID NO: 561374 - protein, 9 aa, Mycobacterium
RGCTHPGCD

SEQ ID NO: 561375 - protein, 12 aa, Mycobacterium
RGCTKPGCDAPA

SEQ ID NO: 561376 - protein, 6 aa, Mycobacterium
RGCTRP

SEQ ID NO: 561377 - protein, 8 aa, Mycobacterium
RGCTRPGC

SEQ ID NO: 561378 - protein, 10 aa, Mycobacterium
RGDAAAGASK

SEQ ID NO: 561379 - protein, 17 aa, Mycobacterium
RGDAAKHRAAQASSQAD

SEQ ID NO: 561380 - protein, 8 aa, Mycobacterium
RGDAAKNQ

SEQ ID NO: 561381 - protein, 16 aa, Mycobacterium
RGDAERSDPLSGLTQQ

SEQ ID NO: 561382 - protein, 5 aa, Mycobacterium
RGDAG

SEQ ID NO: 561383 - protein, 10 aa, Mycobacterium
RGDAGASLAL

SEQ ID NO: 561384 - protein, 8 aa, Mycobacterium
RGDAGDWR

SEQ ID NO: 561385 - protein, 6 aa, Mycobacterium
RGDAGR

SEQ ID NO: 561386 - protein, 5 aa, Mycobacterium
RGDAH

SEQ ID NO: 561387 - protein, 16 aa, Mycobacterium
RGDAPEAFDGAAPPSA

SEQ ID NO: 561388 - protein, 12 aa, Mycobacterium
RGDAPSSPLNAT

SEQ ID NO: 561389 - protein, 6 aa, Mycobacterium
RGDARE

SEQ ID NO: 561390 - protein, 8 aa, Mycobacterium
RGDARSRD

SEQ ID NO: 561391 - protein, 7 aa, Mycobacterium
RGDASFA

SEQ ID NO: 561392 - protein, 8 aa, Mycobacterium
RGDATEQL

SEQ ID NO: 561393 - protein, 7 aa, Mycobacterium
RGDATYE

SEQ ID NO: 561394 - protein, 6 aa, Mycobacterium
RGDAVA

SEQ ID NO: 561395 - protein, 4 aa, Mycobacterium
RGDD

SEQ ID NO: 561396 - protein, 8 aa, Mycobacterium
RGDDGADS

SEQ ID NO: 561397 - protein, 11 aa, Mycobacterium
RGDDGALPQQA

SEQ ID NO: 561398 - protein, 6 aa, Mycobacterium
RGDDGE

SEQ ID NO: 561399 - protein, 13 aa, Mycobacterium
RGDDGEQLSDQEI

SEQ ID NO: 561400 - protein, 18 aa, Mycobacterium
RGDDGRISAKDTGERDEV

SEQ ID NO: 561401 - protein, 6 aa, Mycobacterium
RGDDQA

SEQ ID NO: 561402 - protein, 12 aa, Mycobacterium
RGDDQRASAEQI

SEQ ID NO: 561403 - protein, 8 aa, Mycobacterium
RGDDRAAT

SEQ ID NO: 561404 - protein, 10 aa, Mycobacterium
RGDDRSTSDA

SEQ ID NO: 561405 - protein, 6 aa, Mycobacterium
RGDDRV

SEQ ID NO: 561406 - protein, 7 aa, Mycobacterium
RGDDTAT

SEQ ID NO: 561407 - protein, 7 aa, Mycobacterium
RGDEAFN

SEQ ID NO: 561408 - protein, 14 aa, Mycobacterium
RGDEDELRSQAGPL

SEQ ID NO: 561409 - protein, 11 aa, Mycobacterium
RGDEDQLRGQA

SEQ ID NO: 561410 - protein, 9 aa, Mycobacterium
RGDEPGPLP

SEQ ID NO: 561411 - protein, 15 aa, Mycobacterium
RGDERLGQGGVPADR

SEQ ID NO: 561412 - protein, 9 aa, Mycobacterium
RGDETATTV

SEQ ID NO: 561413 - protein, 14 aa, Mycobacterium
RGDEYGGSLANRAK

SEQ ID NO: 561414 - protein, 9 aa, Mycobacterium
RGDFSTGTG

SEQ ID NO: 561415 - protein, 10 aa, Mycobacterium
RGDGAGNAGF

SEQ ID NO: 561416 - protein, 8 aa, Mycobacterium
RGDGAPRD

SEQ ID NO: 561417 - protein, 10 aa, Mycobacterium
RGDGDEADDL

SEQ ID NO: 561418 - protein, 36 aa, Mycobacterium
RGDGGDGGAGGAGRPASFNSNGGPGGNGGNGGSAGL

SEQ ID NO: 561419 - protein, 7 aa, Mycobacterium
RGDGGEA

SEQ ID NO: 561420 - protein, 15 aa, Mycobacterium
RGDGGYAVGEGSQHV

SEQ ID NO: 561421 - protein, 24 aa, Mycobacterium
RGDGHPDHEAAGRAASAACARTGT

SEQ ID NO: 561422 - protein, 12 aa, Mycobacterium
RGDGHPDHEAVG

SEQ ID NO: 561423 - protein, 14 aa, Mycobacterium
RGDGHPDHEAVGRA

SEQ ID NO: 561424 - protein, 6 aa, Mycobacterium
RGDGLP

SEQ ID NO: 561425 - protein, 6 aa, Mycobacterium
RGDGND

SEQ ID NO: 561426 - protein, 6 aa, Mycobacterium
RGDGPG

SEQ ID NO: 561427 - protein, 7 aa, Mycobacterium
RGDGPLA

SEQ ID NO: 561428 - protein, 10 aa, Mycobacterium
RGDGPVTDRG

SEQ ID NO: 561429 - protein, 5 aa, Mycobacterium
RGDGR

SEQ ID NO: 561430 - protein, 6 aa, Mycobacterium
RGDGRL

SEQ ID NO: 561431 - protein, 9 aa, Mycobacterium
RGDGRVASA

SEQ ID NO: 561432 - protein, 5 aa, Mycobacterium
RGDGS

SEQ ID NO: 561433 - protein, 9 aa, Mycobacterium
RGDGSTGVD

SEQ ID NO: 561434 - protein, 11 aa, Mycobacterium
RGDGTDGAMDE

SEQ ID NO: 561435 - protein, 7 aa, Mycobacterium
RGDGTRP

SEQ ID NO: 561436 - protein, 11 aa, Mycobacterium
RGDHADEPPVA

SEQ ID NO: 561437 - protein, 7 aa, Mycobacterium
RGDHAGA

SEQ ID NO: 561438 - protein, 8 aa, Mycobacterium
RGDHAPNR

SEQ ID NO: 561439 - protein, 5 aa, Mycobacterium
RGDHC

SEQ ID NO: 561440 - protein, 29 aa, Mycobacterium
RGDHRAVDSVSSPLRSGRQADGAQGRERL

SEQ ID NO: 561441 - protein, 6 aa, Mycobacterium
RGDHYP

SEQ ID NO: 561442 - protein, 12 aa, Mycobacterium
RGDIDTSEEHDR

SEQ ID NO: 561443 - protein, 15 aa, Mycobacterium
RGDIGGVSTAVGPVD

SEQ ID NO: 561444 - protein, 14 aa, Mycobacterium
RGDKAARDDRVPPA

SEQ ID NO: 561445 - protein, 13 aa, Mycobacterium
RGDKDHPGTKGYT

SEQ ID NO: 561446 - protein, 11 aa, Mycobacterium
RGDKEGGDAAA

SEQ ID NO: 561447 - protein, 19 aa, Mycobacterium
RGDKRALAETVQRNAQEAL

SEQ ID NO: 561448 - protein, 15 aa, Mycobacterium
RGDKVAATARDTATL

SEQ ID NO: 561449 - protein, 13 aa, Mycobacterium
RGDLRAEGHGNSV

SEQ ID NO: 561450 - protein, 4 aa, Mycobacterium
RGDM

SEQ ID NO: 561451 - protein, 11 aa, Mycobacterium
RGDNAATKGGE

SEQ ID NO: 561452 - protein, 6 aa, Mycobacterium
RGDNGQ

SEQ ID NO: 561453 - protein, 35 aa, Mycobacterium
RGDNRDSRGDNRDSRGRRDGGGRGGRDRDGDKSNY

SEQ ID NO: 561454 - protein, 8 aa, Mycobacterium
RGDPADRR

SEQ ID NO: 561455 - protein, 18 aa, Mycobacterium
RGDPANGVPELSASSAAR

SEQ ID NO: 561456 - protein, 5 aa, Mycobacterium
RGDPC

SEQ ID NO: 561457 - protein, 11 aa, Mycobacterium
RGDPDAGTAAL

SEQ ID NO: 561458 - protein, 9 aa, Mycobacterium
RGDPDAGVT

SEQ ID NO: 561459 - protein, 13 aa, Mycobacterium
RGDPDPPDDPRPG

SEQ ID NO: 561460 - protein, 10 aa, Mycobacterium
RGDPDSGATA

SEQ ID NO: 561461 - protein, 9 aa, Mycobacterium
RGDPDTRAR

SEQ ID NO: 561462 - protein, 10 aa, Mycobacterium
RGDPEPRSSL

SEQ ID NO: 561463 - protein, 8 aa, Mycobacterium
RGDPESGV

SEQ ID NO: 561464 - protein, 11 aa, Mycobacterium
RGDPESTGRAE

SEQ ID NO: 561465 - protein, 9 aa, Mycobacterium
RGDPLPAGA

SEQ ID NO: 561466 - protein, 24 aa, Mycobacterium
RGDPLRPASPPLRSPREQAKVGTV

SEQ ID NO: 561467 - protein, 14 aa, Mycobacterium
RGDPPRDDWSPAPV

SEQ ID NO: 561468 - protein, 14 aa, Mycobacterium
RGDPPRDDWSPPPI

SEQ ID NO: 561469 - protein, 13 aa, Mycobacterium
RGDPPRGYPGERV

SEQ ID NO: 561470 - protein, 20 aa, Mycobacterium
RGDPSDNLPGIPGVGEKTAS

SEQ ID NO: 561471 - protein, 21 aa, Mycobacterium
RGDPSDNLPGIPGVGEKTASK

SEQ ID NO: 561472 - protein, 9 aa, Mycobacterium
RGDPSERRR

SEQ ID NO: 561473 - protein, 7 aa, Mycobacterium
RGDPSGL

SEQ ID NO: 561474 - protein, 6 aa, Mycobacterium
RGDPSL

SEQ ID NO: 561475 - protein, 7 aa, Mycobacterium
RGDPVRT

SEQ ID NO: 561476 - protein, 8 aa, Mycobacterium
RGDPVSSF

SEQ ID NO: 561477 - protein, 19 aa, Mycobacterium
RGDPWTPASDSALAAGPRA

SEQ ID NO: 561478 - protein, 7 aa, Mycobacterium
RGDQIPG

SEQ ID NO: 561479 - protein, 9 aa, Mycobacterium
RGDQKNASL

SEQ ID NO: 561480 - protein, 6 aa, Mycobacterium
RGDQLQ

SEQ ID NO: 561481 - protein, 5 aa, Mycobacterium
RGDQV

SEQ ID NO: 561482 - protein, 4 aa, Mycobacterium
RGDR

SEQ ID NO: 561483 - protein, 7 aa, Mycobacterium
RGDRAAL

SEQ ID NO: 561484 - protein, 9 aa, Mycobacterium
RGDRDDLDH

SEQ ID NO: 561485 - protein, 8 aa, Mycobacterium
RGDRDIQV

SEQ ID NO: 561486 - protein, 13 aa, Mycobacterium
RGDRDRPGAASGR

SEQ ID NO: 561487 - protein, 8 aa, Mycobacterium
RGDRDSDT

SEQ ID NO: 561488 - protein, 5 aa, Mycobacterium
RGDRE

SEQ ID NO: 561489 - protein, 6 aa, Mycobacterium
RGDREG

SEQ ID NO: 561490 - protein, 6 aa, Mycobacterium
RGDRER

SEQ ID NO: 561491 - protein, 7 aa, Mycobacterium
RGDRERF

SEQ ID NO: 561492 - protein, 10 aa, Mycobacterium
RGDRGRPTRE

SEQ ID NO: 561493 - protein, 7 aa, Mycobacterium
RGDRGVA

SEQ ID NO: 561494 - protein, 6 aa, Mycobacterium
RGDRIA

SEQ ID NO: 561495 - protein, 13 aa, Mycobacterium
RGDRKLQTPASAE

SEQ ID NO: 561496 - protein, 6 aa, Mycobacterium
RGDRPV

SEQ ID NO: 561497 - protein, 7 aa, Mycobacterium
RGDRQRD

SEQ ID NO: 561498 - protein, 5 aa, Mycobacterium
RGDRR

SEQ ID NO: 561499 - protein, 7 aa, Mycobacterium
RGDRRRT

SEQ ID NO: 561500 - protein, 9 aa, Mycobacterium
RGDRSAIPG

SEQ ID NO: 561501 - protein, 6 aa, Mycobacterium
RGDRSV

SEQ ID NO: 561502 - protein, 14 aa, Mycobacterium
RGDSAEAEPAHARP

SEQ ID NO: 561503 - protein, 10 aa, Mycobacterium
RGDSAYDNYY

SEQ ID NO: 561504 - protein, 6 aa, Mycobacterium
RGDSDA

SEQ ID NO: 561505 - protein, 8 aa, Mycobacterium
RGDSPQHD

SEQ ID NO: 561506 - protein, 9 aa, Mycobacterium
RGDSPRRDV

SEQ ID NO: 561507 - protein, 10 aa, Mycobacterium
RGDSPRRGSA

SEQ ID NO: 561508 - protein, 13 aa, Mycobacterium
RGDSQAATRTLTD

SEQ ID NO: 561509 - protein, 9 aa, Mycobacterium
RGDSSRPLT

SEQ ID NO: 561510 - protein, 12 aa, Mycobacterium
RGDSTAPKNTGL

SEQ ID NO: 561511 - protein, 19 aa, Mycobacterium
RGDSVTAGVHPQGDLAPRD

SEQ ID NO: 561512 - protein, 6 aa, Mycobacterium
RGDTAD

SEQ ID NO: 561513 - protein, 9 aa, Mycobacterium
RGDTATARS

SEQ ID NO: 561514 - protein, 8 aa, Mycobacterium
RGDTGPDM

SEQ ID NO: 561515 - protein, 12 aa, Mycobacterium
RGDTGPELQSQA

SEQ ID NO: 561516 - protein, 5 aa, Mycobacterium
RGDTL

SEQ ID NO: 561517 - protein, 6 aa, Mycobacterium
RGDTLR

SEQ ID NO: 561518 - protein, 13 aa, Mycobacterium
RGDTLVEPTDAQL

SEQ ID NO: 561519 - protein, 14 aa, Mycobacterium
RGDTLVEPTDTQLA

SEQ ID NO: 561520 - protein, 9 aa, Mycobacterium
RGDTPLPVR

SEQ ID NO: 561521 - protein, 8 aa, Mycobacterium
RGDTPMPV

SEQ ID NO: 561522 - protein, 20 aa, Mycobacterium
RGDTRGPNRRVSPRRTGGAP

SEQ ID NO: 561523 - protein, 15 aa, Mycobacterium
RGDTRIRATAEGRSS

SEQ ID NO: 561524 - protein, 6 aa, Mycobacterium
RGDTRT

SEQ ID NO: 561525 - protein, 7 aa, Mycobacterium
RGDTSRA

SEQ ID NO: 561526 - protein, 5 aa, Mycobacterium
RGDTT

SEQ ID NO: 561527 - protein, 14 aa, Mycobacterium
RGDTTVTVAFPGGS

SEQ ID NO: 561528 - protein, 5 aa, Mycobacterium
RGDTV

SEQ ID NO: 561529 - protein, 4 aa, Mycobacterium
RGDV

SEQ ID NO: 561530 - protein, 10 aa, Mycobacterium
RGDVDPKGGL

SEQ ID NO: 561531 - protein, 21 aa, Mycobacterium
RGDVPRGASAGSAPGTDVSDD

SEQ ID NO: 561532 - protein, 10 aa, Mycobacterium
RGDVRDRESL

SEQ ID NO: 561533 - protein, 23 aa, Mycobacterium
RGDVRRSKSSGRDTHWLAASEHI

SEQ ID NO: 561534 - protein, 10 aa, Mycobacterium
RGDVVTPDTD

SEQ ID NO: 561535 - protein, 5 aa, Mycobacterium
RGDYD

SEQ ID NO: 561536 - protein, 7 aa, Mycobacterium
RGDYNTG

SEQ ID NO: 561537 - protein, 5 aa, Mycobacterium
RGDYP

SEQ ID NO: 561538 - protein, 7 aa, Mycobacterium
RGDYQDL

SEQ ID NO: 561539 - protein, 10 aa, Mycobacterium
RGEAAGRQVA

SEQ ID NO: 561540 - protein, 17 aa, Mycobacterium
RGEAERGPSGREPPEEL

SEQ ID NO: 561541 - protein, 14 aa, Mycobacterium
RGEAGDRQIPGEPR

SEQ ID NO: 561542 - protein, 14 aa, Mycobacterium
RGEAGDRQVAGEPR

SEQ ID NO: 561543 - protein, 14 aa, Mycobacterium
RGEAGDRQVPGAPR

SEQ ID NO: 561544 - protein, 14 aa, Mycobacterium
RGEAGDRQVPGEPK

SEQ ID NO: 561545 - protein, 15 aa, Mycobacterium
RGEAGDRQVPGNPRV

SEQ ID NO: 561546 - protein, 17 aa, Mycobacterium
RGEAGELAVESACMTFD

SEQ ID NO: 561547 - protein, 15 aa, Mycobacterium
RGEAGERQVPGDPRV

SEQ ID NO: 561548 - protein, 15 aa, Mycobacterium
RGEAGERQVPGNPRV

SEQ ID NO: 561549 - protein, 30 aa, Mycobacterium
RGEAGRRVGEAADLGPRRALTGEPLPAQLT

SEQ ID NO: 561550 - protein, 5 aa, Mycobacterium
RGEAK

SEQ ID NO: 561551 - protein, 23 aa, Mycobacterium
RGEAKNATRPNRGGAATKTPRRV

SEQ ID NO: 561552 - protein, 6 aa, Mycobacterium
RGEAPC

SEQ ID NO: 561553 - protein, 8 aa, Mycobacterium
RGEAPLDP

SEQ ID NO: 561554 - protein, 6 aa, Mycobacterium
RGEASE

SEQ ID NO: 561555 - protein, 8 aa, Mycobacterium
RGEASEQL

SEQ ID NO: 561556 - protein, 5 aa, Mycobacterium
RGEAT

SEQ ID NO: 561557 - protein, 9 aa, Mycobacterium
RGEATDAEA

SEQ ID NO: 561558 - protein, 8 aa, Mycobacterium
RGEATEQL

SEQ ID NO: 561559 - protein, 8 aa, Mycobacterium
RGEATQQL

SEQ ID NO: 561560 - protein, 6 aa, Mycobacterium
RGECPC

SEQ ID NO: 561561 - protein, 8 aa, Mycobacterium
RGEDAAAM

SEQ ID NO: 561562 - protein, 11 aa, Mycobacterium
RGEDGKRSEFT

SEQ ID NO: 561563 - protein, 14 aa, Mycobacterium
RGEDGTVLGPGETG

SEQ ID NO: 561564 - protein, 5 aa, Mycobacterium
RGEDR

SEQ ID NO: 561565 - protein, 25 aa, Mycobacterium
RGEDRDHPPARGQIAEQAAPFGEQE

SEQ ID NO: 561566 - protein, 6 aa, Mycobacterium
RGEDRQ

SEQ ID NO: 561567 - protein, 8 aa, Mycobacterium
RGEDSWER

SEQ ID NO: 561568 - protein, 6 aa, Mycobacterium
RGEDYD

SEQ ID NO: 561569 - protein, 14 aa, Mycobacterium
RGEEAAALTGEDAD

SEQ ID NO: 561570 - protein, 7 aa, Mycobacterium
RGEEELD

SEQ ID NO: 561571 - protein, 27 aa, Mycobacterium
RGEEELDTRFGNDAQGGEDPGPPFGGG

SEQ ID NO: 561572 - protein, 9 aa, Mycobacterium
RGEEETPEQ

SEQ ID NO: 561573 - protein, 6 aa, Mycobacterium
RGEEIT

SEQ ID NO: 561574 - protein, 14 aa, Mycobacterium
RGEEKAKNLSYGDQ

SEQ ID NO: 561575 - protein, 15 aa, Mycobacterium
RGEEKAKNLSYGDQR

SEQ ID NO: 561576 - protein, 5 aa, Mycobacterium
RGEET

SEQ ID NO: 561577 - protein, 13 aa, Mycobacterium
RGEFASGSATEQL

SEQ ID NO: 561578 - protein, 5 aa, Mycobacterium
RGEGA

SEQ ID NO: 561579 - protein, 5 aa, Mycobacterium
RGEGD

SEQ ID NO: 561580 - protein, 12 aa, Mycobacterium
RGEGEFEGEPPW

SEQ ID NO: 561581 - protein, 12 aa, Mycobacterium
RGEGEGTAKEPD

SEQ ID NO: 561582 - protein, 6 aa, Mycobacterium
RGEGER

SEQ ID NO: 561583 - protein, 8 aa, Mycobacterium
RGEGEREV

SEQ ID NO: 561584 - protein, 16 aa, Mycobacterium
RGEGERTDPLSGLTDQ

SEQ ID NO: 561585 - protein, 9 aa, Mycobacterium
RGEGFTPHR

SEQ ID NO: 561586 - protein, 8 aa, Mycobacterium
RGEGGGGI

SEQ ID NO: 561587 - protein, 12 aa, Mycobacterium
RGEGGHGSTPHL

SEQ ID NO: 561588 - protein, 13 aa, Mycobacterium
RGEGGTVLGPGHT

SEQ ID NO: 561589 - protein, 9 aa, Mycobacterium
RGEGIDPEA

SEQ ID NO: 561590 - protein, 7 aa, Mycobacterium
RGEGLNQ

SEQ ID NO: 561591 - protein, 8 aa, Mycobacterium
RGEGLNQD

SEQ ID NO: 561592 - protein, 8 aa, Mycobacterium
RGEGLSRD

SEQ ID NO: 561593 - protein, 8 aa, Mycobacterium
RGEGPGTV

SEQ ID NO: 561594 - protein, 6 aa, Mycobacterium
RGEGVD

SEQ ID NO: 561595 - protein, 16 aa, Mycobacterium
RGEHPPTVTRAPVIFQ

SEQ ID NO: 561596 - protein, 7 aa, Mycobacterium
RGEHRPQ

SEQ ID NO: 561597 - protein, 15 aa, Mycobacterium
RGEHRQHSGVRAEPK

SEQ ID NO: 561598 - protein, 9 aa, Mycobacterium
RGEIEPDQV

SEQ ID NO: 561599 - protein, 8 aa, Mycobacterium
RGEITQGR

SEQ ID NO: 561600 - protein, 4 aa, Mycobacterium
RGEK

SEQ ID NO: 561601 - protein, 6 aa, Mycobacterium
RGEKDF

SEQ ID NO: 561602 - protein, 9 aa, Mycobacterium
RGELAGTGV

SEQ ID NO: 561603 - protein, 7 aa, Mycobacterium
RGELASE

SEQ ID NO: 561604 - protein, 17 aa, Mycobacterium
RGELEATATERARLEGA

SEQ ID NO: 561605 - protein, 7 aa, Mycobacterium
RGELPER

SEQ ID NO: 561606 - protein, 12 aa, Mycobacterium
RGELPNPDEDAL

SEQ ID NO: 561607 - protein, 12 aa, Mycobacterium
RGELPSPEDKES

SEQ ID NO: 561608 - protein, 7 aa, Mycobacterium
RGELRGS

SEQ ID NO: 561609 - protein, 13 aa, Mycobacterium
RGELRTDKTPAAI

SEQ ID NO: 561610 - protein, 13 aa, Mycobacterium
RGELRTQKTPAAV

SEQ ID NO: 561611 - protein, 5 aa, Mycobacterium
RGELS

SEQ ID NO: 561612 - protein, 7 aa, Mycobacterium
RGELSAA

SEQ ID NO: 561613 - protein, 10 aa, Mycobacterium
RGELSAPDGD

SEQ ID NO: 561614 - protein, 9 aa, Mycobacterium
RGELSGDEA

SEQ ID NO: 561615 - protein, 5 aa, Mycobacterium
RGENI

SEQ ID NO: 561616 - protein, 17 aa, Mycobacterium
RGENPDVPRGLSKVTET

SEQ ID NO: 561617 - protein, 4 aa, Mycobacterium
RGEP

SEQ ID NO: 561618 - protein, 16 aa, Mycobacterium
RGEPARAPSGRDPAAE

SEQ ID NO: 561619 - protein, 14 aa, Mycobacterium
RGEPDRPPGPPGAA

SEQ ID NO: 561620 - protein, 17 aa, Mycobacterium
RGEPERLPSGCEPPPEL

SEQ ID NO: 561621 - protein, 17 aa, Mycobacterium
RGEPERLPSGREPPPEL

SEQ ID NO: 561622 - protein, 17 aa, Mycobacterium
RGEPERPPSGREPPAEL

SEQ ID NO: 561623 - protein, 8 aa, Mycobacterium
RGEPGRDV

SEQ ID NO: 561624 - protein, 12 aa, Mycobacterium
RGEPGRPDNPAK

SEQ ID NO: 561625 - protein, 8 aa, Mycobacterium
RGEPGTPV

SEQ ID NO: 561626 - protein, 6 aa, Mycobacterium
RGEPGY

SEQ ID NO: 561627 - protein, 9 aa, Mycobacterium
RGEPGYGSG

SEQ ID NO: 561628 - protein, 10 aa, Mycobacterium
RGEPLNEGAD

SEQ ID NO: 561629 - protein, 6 aa, Mycobacterium
RGEPLQ

SEQ ID NO: 561630 - protein, 7 aa, Mycobacterium
RGEPPVD

SEQ ID NO: 561631 - protein, 6 aa, Mycobacterium
RGEPSA

SEQ ID NO: 561632 - protein, 21 aa, Mycobacterium
RGEPVHPAPTPEARPPASGDE

SEQ ID NO: 561633 - protein, 10 aa, Mycobacterium
RGEPVSPSTV

SEQ ID NO: 561634 - protein, 10 aa, Mycobacterium
RGEPWTPTEI

SEQ ID NO: 561635 - protein, 9 aa, Mycobacterium
RGEPYRSDF

SEQ ID NO: 561636 - protein, 8 aa, Mycobacterium
RGEPYRSG

SEQ ID NO: 561637 - protein, 6 aa, Mycobacterium
RGEQAD

SEQ ID NO: 561638 - protein, 14 aa, Mycobacterium
RGEQADHDPPSALN

SEQ ID NO: 561639 - protein, 16 aa, Mycobacterium
RGEQITDADPDDCPVR

SEQ ID NO: 561640 - protein, 33 aa, Mycobacterium
RGEQPGPRQLTAPDPVVSTTTTDDVDAAAAGAT

SEQ ID NO: 561641 - protein, 4 aa, Mycobacterium
RGER

SEQ ID NO: 561642 - protein, 5 aa, Mycobacterium
RGERG

SEQ ID NO: 561643 - protein, 9 aa, Mycobacterium
RGERPGARS

SEQ ID NO: 561644 - protein, 9 aa, Mycobacterium
RGERPGPMQ

SEQ ID NO: 561645 - protein, 12 aa, Mycobacterium
RGERPPRDRPRT

SEQ ID NO: 561646 - protein, 9 aa, Mycobacterium
RGERPPVRG

SEQ ID NO: 561647 - protein, 6 aa, Mycobacterium
RGERPS

SEQ ID NO: 561648 - protein, 5 aa, Mycobacterium
RGERR

SEQ ID NO: 561649 - protein, 4 aa, Mycobacterium
RGES

SEQ ID NO: 561650 - protein, 7 aa, Mycobacterium
RGESAGW

SEQ ID NO: 561651 - protein, 13 aa, Mycobacterium
RGESARIAAAADD

SEQ ID NO: 561652 - protein, 8 aa, Mycobacterium
RGESGTPV

SEQ ID NO: 561653 - protein, 6 aa, Mycobacterium
RGESID

SEQ ID NO: 561654 - protein, 9 aa, Mycobacterium
RGESLADRE

SEQ ID NO: 561655 - protein, 32 aa, Mycobacterium
RGESLPAGGAATPGATGATETGGAVAEKPFGQ

SEQ ID NO: 561656 - protein, 7 aa, Mycobacterium
RGESLSD

SEQ ID NO: 561657 - protein, 12 aa, Mycobacterium
RGESPAEGVPPI

SEQ ID NO: 561658 - protein, 25 aa, Mycobacterium
RGESPGEGIPPMATPPWDTKAPKDS

SEQ ID NO: 561659 - protein, 11 aa, Mycobacterium
RGESSAEAFGE

SEQ ID NO: 561660 - protein, 6 aa, Mycobacterium
RGESSG

SEQ ID NO: 561661 - protein, 9 aa, Mycobacterium
RGESSGSAF

SEQ ID NO: 561662 - protein, 5 aa, Mycobacterium
RGESV

SEQ ID NO: 561663 - protein, 11 aa, Mycobacterium
RGETAARANAP

SEQ ID NO: 561664 - protein, 7 aa, Mycobacterium
RGETDDV

SEQ ID NO: 561665 - protein, 9 aa, Mycobacterium
RGETDEEDQ

SEQ ID NO: 561666 - protein, 6 aa, Mycobacterium
RGETEL

SEQ ID NO: 561667 - protein, 6 aa, Mycobacterium
RGEVAE

SEQ ID NO: 561668 - protein, 7 aa, Mycobacterium
RGEVAPA

SEQ ID NO: 561669 - protein, 11 aa, Mycobacterium
RGEVKSPSPKV

SEQ ID NO: 561670 - protein, 8 aa, Mycobacterium
RGEVPAGR

SEQ ID NO: 561671 - protein, 14 aa, Mycobacterium
RGEVPGPRELTKPE

SEQ ID NO: 561672 - protein, 23 aa, Mycobacterium
RGEVPSLGSGPKPPWSIGEPQPE

SEQ ID NO: 561673 - protein, 8 aa, Mycobacterium
RGEVRTDN

SEQ ID NO: 561674 - protein, 5 aa, Mycobacterium
RGEVT

SEQ ID NO: 561675 - protein, 5 aa, Mycobacterium
RGEVY

SEQ ID NO: 561676 - protein, 5 aa, Mycobacterium
RGEWT

SEQ ID NO: 561677 - protein, 14 aa, Mycobacterium
RGEYDELPTPPVGL

SEQ ID NO: 561678 - protein, 8 aa, Mycobacterium
RGEYGSGK

SEQ ID NO: 561679 - protein, 11 aa, Mycobacterium
RGEYKSAANRF

SEQ ID NO: 561680 - protein, 8 aa, Mycobacterium
RGEYRPGA

SEQ ID NO: 561681 - protein, 5 aa, Mycobacterium
RGFDP

SEQ ID NO: 561682 - protein, 12 aa, Mycobacterium
RGFESKVSPGAG

SEQ ID NO: 561683 - protein, 6 aa, Mycobacterium
RGFGDP

SEQ ID NO: 561684 - protein, 8 aa, Mycobacterium
RGFGRSDK

SEQ ID NO: 561685 - protein, 9 aa, Mycobacterium
RGFGRSDTS

SEQ ID NO: 561686 - protein, 4 aa, Mycobacterium
RGFP

SEQ ID NO: 561687 - protein, 6 aa, Mycobacterium
RGFPEK

SEQ ID NO: 561688 - protein, 4 aa, Mycobacterium
RGFQ

SEQ ID NO: 561689 - protein, 18 aa, Mycobacterium
RGFSAADDISGGLETGFG

SEQ ID NO: 561690 - protein, 13 aa, Mycobacterium
RGFSEDPKALEPA

SEQ ID NO: 561691 - protein, 12 aa, Mycobacterium
RGFSPGQNQQGD

SEQ ID NO: 561692 - protein, 9 aa, Mycobacterium
RGFSSRSFS

SEQ ID NO: 561693 - protein, 4 aa, Mycobacterium
RGFT

SEQ ID NO: 561694 - protein, 6 aa, Mycobacterium
RGFTAA

SEQ ID NO: 561695 - protein, 9 aa, Mycobacterium
RGGAAPSID

SEQ ID NO: 561696 - protein, 23 aa, Mycobacterium
RGGADPECANGQPDAVPAGKGQQ

SEQ ID NO: 561697 - protein, 18 aa, Mycobacterium
RGGAEQKDPLSGLTEQER

SEQ ID NO: 561698 - protein, 8 aa, Mycobacterium
RGGAESLN

SEQ ID NO: 561699 - protein, 6 aa, Mycobacterium
RGGAEV

SEQ ID NO: 561700 - protein, 6 aa, Mycobacterium
RGGAGE

SEQ ID NO: 561701 - protein, 11 aa, Mycobacterium
RGGAGQGSQRF

SEQ ID NO: 561702 - protein, 9 aa, Mycobacterium
RGGAGRTWQ

SEQ ID NO: 561703 - protein, 5 aa, Mycobacterium
RGGAM

SEQ ID NO: 561704 - protein, 9 aa, Mycobacterium
RGGAPETID

SEQ ID NO: 561705 - protein, 10 aa, Mycobacterium
RGGAPGTRET

SEQ ID NO: 561706 - protein, 8 aa, Mycobacterium
RGGAPLST

SEQ ID NO: 561707 - protein, 5 aa, Mycobacterium
RGGAR

SEQ ID NO: 561708 - protein, 13 aa, Mycobacterium
RGGASANRDPAAD

SEQ ID NO: 561709 - protein, 11 aa, Mycobacterium
RGGASNCSGGM

SEQ ID NO: 561710 - protein, 8 aa, Mycobacterium
RGGASPTL

SEQ ID NO: 561711 - protein, 6 aa, Mycobacterium
RGGATA

SEQ ID NO: 561712 - protein, 6 aa, Mycobacterium
RGGATI

SEQ ID NO: 561713 - protein, 8 aa, Mycobacterium
RGGATPRA

SEQ ID NO: 561714 - protein, 21 aa, Mycobacterium
RGGATSPVATGPSVPAADEVP

SEQ ID NO: 561715 - protein, 5 aa, Mycobacterium
RGGAY

SEQ ID NO: 561716 - protein, 14 aa, Mycobacterium
RGGAYSAAKGGLTA

SEQ ID NO: 561717 - protein, 6 aa, Mycobacterium
RGGDAR

SEQ ID NO: 561718 - protein, 16 aa, Mycobacterium
RGGDDDAESSDGILES

SEQ ID NO: 561719 - protein, 12 aa, Mycobacterium
RGGDDDSEISDG

SEQ ID NO: 561720 - protein, 12 aa, Mycobacterium
RGGDDDSEVSDG

SEQ ID NO: 561721 - protein, 24 aa, Mycobacterium
RGGDGGNGGNAGATGGNGGNGGNI

SEQ ID NO: 561722 - protein, 6 aa, Mycobacterium
RGGDIG

SEQ ID NO: 561723 - protein, 8 aa, Mycobacterium
RGGDPDAI

SEQ ID NO: 561724 - protein, 14 aa, Mycobacterium
RGGDPDRPGKSDPL

SEQ ID NO: 561725 - protein, 14 aa, Mycobacterium
RGGDPDRPGKSDQL

SEQ ID NO: 561726 - protein, 14 aa, Mycobacterium
RGGDPERAGKTDEL

SEQ ID NO: 561727 - protein, 13 aa, Mycobacterium
RGGDPGRPGKNDA

SEQ ID NO: 561728 - protein, 14 aa, Mycobacterium
RGGDPQRPGKTDQL

SEQ ID NO: 561729 - protein, 13 aa, Mycobacterium
RGGDPSRPGKTDQ

SEQ ID NO: 561730 - protein, 10 aa, Mycobacterium
RGGDRASNSA

SEQ ID NO: 561731 - protein, 6 aa, Mycobacterium
RGGDRP

SEQ ID NO: 561732 - protein, 7 aa, Mycobacterium
RGGDRRL

SEQ ID NO: 561733 - protein, 6 aa, Mycobacterium
RGGDVA

SEQ ID NO: 561734 - protein, 14 aa, Mycobacterium
RGGDVRDAQPVSTE

SEQ ID NO: 561735 - protein, 14 aa, Mycobacterium
RGGEAPNAIAEHTE

SEQ ID NO: 561736 - protein, 12 aa, Mycobacterium
RGGEDAEGETLD

SEQ ID NO: 561737 - protein, 12 aa, Mycobacterium
RGGEDDSEISDG

SEQ ID NO: 561738 - protein, 7 aa, Mycobacterium
RGGEDRE

SEQ ID NO: 561739 - protein, 5 aa, Mycobacterium
RGGEH

SEQ ID NO: 561740 - protein, 7 aa, Mycobacterium
RGGEHGA

SEQ ID NO: 561741 - protein, 10 aa, Mycobacterium
RGGEKISPEH

SEQ ID NO: 561742 - protein, 8 aa, Mycobacterium
RGGELDPS

SEQ ID NO: 561743 - protein, 6 aa, Mycobacterium
RGGELG

SEQ ID NO: 561744 - protein, 8 aa, Mycobacterium
RGGEPPLS

SEQ ID NO: 561745 - protein, 9 aa, Mycobacterium
RGGEPTPTD

SEQ ID NO: 561746 - protein, 8 aa, Mycobacterium
RGGEQAAG

SEQ ID NO: 561747 - protein, 10 aa, Mycobacterium
RGGERAAGVP

SEQ ID NO: 561748 - protein, 19 aa, Mycobacterium
RGGERGDIAPIGGAGQDGT

SEQ ID NO: 561749 - protein, 6 aa, Mycobacterium
RGGERV

SEQ ID NO: 561750 - protein, 6 aa, Mycobacterium
RGGETG

SEQ ID NO: 561751 - protein, 10 aa, Mycobacterium
RGGETVSATD

SEQ ID NO: 561752 - protein, 5 aa, Mycobacterium
RGGFT

SEQ ID NO: 561753 - protein, 5 aa, Mycobacterium
RGGGA

SEQ ID NO: 561754 - protein, 7 aa, Mycobacterium
RGGGADL

SEQ ID NO: 561755 - protein, 10 aa, Mycobacterium
RGGGASSPAL

SEQ ID NO: 561756 - protein, 6 aa, Mycobacterium
RGGGAV

SEQ ID NO: 561757 - protein, 5 aa, Mycobacterium
RGGGD

SEQ ID NO: 561758 - protein, 9 aa, Mycobacterium
RGGGDGPPL

SEQ ID NO: 561759 - protein, 12 aa, Mycobacterium
RGGGDPEPDTAG

SEQ ID NO: 561760 - protein, 23 aa, Mycobacterium
RGGGDVADSPERNLGDGLPVRHH

SEQ ID NO: 561761 - protein, 16 aa, Mycobacterium
RGGGEGSGPDNKQLYQ

SEQ ID NO: 561762 - protein, 7 aa, Mycobacterium
RGGGEYG

SEQ ID NO: 561763 - protein, 9 aa, Mycobacterium
RGGGEYGPE

SEQ ID NO: 561764 - protein, 9 aa, Mycobacterium
RGGGEYGPG

SEQ ID NO: 561765 - protein, 9 aa, Mycobacterium
RGGGEYGPQ

SEQ ID NO: 561766 - protein, 9 aa, Mycobacterium
RGGGEYGPT

SEQ ID NO: 561767 - protein, 11 aa, Mycobacterium
RGGGGRARRQR

SEQ ID NO: 561768 - protein, 8 aa, Mycobacterium
RGGGGRYG

SEQ ID NO: 561769 - protein, 6 aa, Mycobacterium
RGGGGS

SEQ ID NO: 561770 - protein, 6 aa, Mycobacterium
RGGGLP

SEQ ID NO: 561771 - protein, 9 aa, Mycobacterium
RGGGLPTRT

SEQ ID NO: 561772 - protein, 7 aa, Mycobacterium
RGGGNDL

SEQ ID NO: 561773 - protein, 7 aa, Mycobacterium
RGGGNTM

SEQ ID NO: 561774 - protein, 20 aa, Mycobacterium
RGGGNTRGPAKLEVVFTPVP

SEQ ID NO: 561775 - protein, 6 aa, Mycobacterium
RGGGNV

SEQ ID NO: 561776 - protein, 15 aa, Mycobacterium
RGGGPVRLKSSGKDY

SEQ ID NO: 561777 - protein, 6 aa, Mycobacterium
RGGGQW

SEQ ID NO: 561778 - protein, 5 aa, Mycobacterium
RGGGR

SEQ ID NO: 561779 - protein, 6 aa, Mycobacterium
RGGGRH

SEQ ID NO: 561780 - protein, 9 aa, Mycobacterium
RGGGRKGKK

SEQ ID NO: 561781 - protein, 9 aa, Mycobacterium
RGGGRPAKA

SEQ ID NO: 561782 - protein, 17 aa, Mycobacterium
RGGGSEGGAALRSVPGT

SEQ ID NO: 561783 - protein, 8 aa, Mycobacterium
RGGGTTYK

SEQ ID NO: 561784 - protein, 15 aa, Mycobacterium
RGGGTTYKLPPGSFD

SEQ ID NO: 561785 - protein, 4 aa, Mycobacterium
RGGH

SEQ ID NO: 561786 - protein, 8 aa, Mycobacterium
RGGHDEAT

SEQ ID NO: 561787 - protein, 6 aa, Mycobacterium
RGGHDY

SEQ ID NO: 561788 - protein, 13 aa, Mycobacterium
RGGHPTPMSSTKA

SEQ ID NO: 561789 - protein, 6 aa, Mycobacterium
RGGHVT

SEQ ID NO: 561790 - protein, 13 aa, Mycobacterium
RGGIGGDSNGVLA

SEQ ID NO: 561791 - protein, 5 aa, Mycobacterium
RGGIQ

SEQ ID NO: 561792 - protein, 10 aa, Mycobacterium
RGGISTEESL

SEQ ID NO: 561793 - protein, 10 aa, Mycobacterium
RGGITTEEAL

SEQ ID NO: 561794 - protein, 13 aa, Mycobacterium
RGGKAAGSVSKKT

SEQ ID NO: 561795 - protein, 15 aa, Mycobacterium
RGGKAAGSVSKKTDY

SEQ ID NO: 561796 - protein, 11 aa, Mycobacterium
RGGKPNPAPST

SEQ ID NO: 561797 - protein, 10 aa, Mycobacterium
RGGKPTDNPH

SEQ ID NO: 561798 - protein, 6 aa, Mycobacterium
RGGLEQ

SEQ ID NO: 561799 - protein, 7 aa, Mycobacterium
RGGLQGR

SEQ ID NO: 561800 - protein, 5 aa, Mycobacterium
RGGLS

SEQ ID NO: 561801 - protein, 12 aa, Mycobacterium
RGGLSDQEGVGK

SEQ ID NO: 561802 - protein, 10 aa, Mycobacterium
RGGLSEGPTV

SEQ ID NO: 561803 - protein, 6 aa, Mycobacterium
RGGLTG

SEQ ID NO: 561804 - protein, 8 aa, Mycobacterium
RGGLTGRR

SEQ ID NO: 561805 - protein, 9 aa, Mycobacterium
RGGNAFDAA

SEQ ID NO: 561806 - protein, 11 aa, Mycobacterium
RGGNANQENVG

SEQ ID NO: 561807 - protein, 29 aa, Mycobacterium
RGGNDGQGGAGQGDVQAGAERRDGPGGGE

SEQ ID NO: 561808 - protein, 7 aa, Mycobacterium
RGGNEAG

SEQ ID NO: 561809 - protein, 7 aa, Mycobacterium
RGGNPAP

SEQ ID NO: 561810 - protein, 9 aa, Mycobacterium
RGGNPSPWR

SEQ ID NO: 561811 - protein, 9 aa, Mycobacterium
RGGNTTNGG

SEQ ID NO: 561812 - protein, 7 aa, Mycobacterium
RGGPADK

SEQ ID NO: 561813 - protein, 7 aa, Mycobacterium
RGGPADV

SEQ ID NO: 561814 - protein, 11 aa, Mycobacterium
RGGPAGVQATR

SEQ ID NO: 561815 - protein, 7 aa, Mycobacterium
RGGPARQ

SEQ ID NO: 561816 - protein, 9 aa, Mycobacterium
RGGPATSYE

SEQ ID NO: 561817 - protein, 10 aa, Mycobacterium
RGGPCPSTYP

SEQ ID NO: 561818 - protein, 16 aa, Mycobacterium
RGGPDARRRAYETDGM

SEQ ID NO: 561819 - protein, 5 aa, Mycobacterium
RGGPE

SEQ ID NO: 561820 - protein, 17 aa, Mycobacterium
RGGPGGVPNTHDDAEYD

SEQ ID NO: 561821 - protein, 8 aa, Mycobacterium
RGGPGHRD

SEQ ID NO: 561822 - protein, 20 aa, Mycobacterium
RGGPGRVPGSCGTDRDNLSP

SEQ ID NO: 561823 - protein, 8 aa, Mycobacterium
RGGPGYQE

SEQ ID NO: 561824 - protein, 6 aa, Mycobacterium
RGGPLR

SEQ ID NO: 561825 - protein, 8 aa, Mycobacterium
RGGPNGAE

SEQ ID NO: 561826 - protein, 9 aa, Mycobacterium
RGGPPITPL

SEQ ID NO: 561827 - protein, 13 aa, Mycobacterium
RGGPPIWPMWREP

SEQ ID NO: 561828 - protein, 9 aa, Mycobacterium
RGGPPLGTS

SEQ ID NO: 561829 - protein, 8 aa, Mycobacterium
RGGPQAAR

SEQ ID NO: 561830 - protein, 6 aa, Mycobacterium
RGGPSA

SEQ ID NO: 561831 - protein, 23 aa, Mycobacterium
RGGPSALTGARDPRLSRQARRES

SEQ ID NO: 561832 - protein, 9 aa, Mycobacterium
RGGPTSPEF

SEQ ID NO: 561833 - protein, 14 aa, Mycobacterium
RGGPVPEEYTTRAE

SEQ ID NO: 561834 - protein, 7 aa, Mycobacterium
RGGPVTT

SEQ ID NO: 561835 - protein, 4 aa, Mycobacterium
RGGQ

SEQ ID NO: 561836 - protein, 12 aa, Mycobacterium
RGGQADQESVGK

SEQ ID NO: 561837 - protein, 7 aa, Mycobacterium
RGGQDAE

SEQ ID NO: 561838 - protein, 7 aa, Mycobacterium
RGGQDPA

SEQ ID NO: 561839 - protein, 8 aa, Mycobacterium
RGGQGLKE

SEQ ID NO: 561840 - protein, 12 aa, Mycobacterium
RGGQPRRSPRVA

SEQ ID NO: 561841 - protein, 8 aa, Mycobacterium
RGGQPTAY

SEQ ID NO: 561842 - protein, 19 aa, Mycobacterium
RGGQSGAADGGDGKPGPAT

SEQ ID NO: 561843 - protein, 14 aa, Mycobacterium
RGGQTGADAADETF

SEQ ID NO: 561844 - protein, 5 aa, Mycobacterium
RGGRA

SEQ ID NO: 561845 - protein, 5 aa, Mycobacterium
RGGRE

SEQ ID NO: 561846 - protein, 10 aa, Mycobacterium
RGGREDATDL

SEQ ID NO: 561847 - protein, 6 aa, Mycobacterium
RGGRIR

SEQ ID NO: 561848 - protein, 8 aa, Mycobacterium
RGGRLSRQ

SEQ ID NO: 561849 - protein, 6 aa, Mycobacterium
RGGRPT

SEQ ID NO: 561850 - protein, 5 aa, Mycobacterium
RGGRR

SEQ ID NO: 561851 - protein, 14 aa, Mycobacterium
RGGRRTAGPSFDRD

SEQ ID NO: 561852 - protein, 13 aa, Mycobacterium
RGGRSPAQQERDI

SEQ ID NO: 561853 - protein, 9 aa, Mycobacterium
RGGRTEKTV

SEQ ID NO: 561854 - protein, 10 aa, Mycobacterium
RGGRVGPDQL

SEQ ID NO: 561855 - protein, 5 aa, Mycobacterium
RGGSA

SEQ ID NO: 561856 - protein, 8 aa, Mycobacterium
RGGSAAKV

SEQ ID NO: 561857 - protein, 8 aa, Mycobacterium
RGGSADEV

SEQ ID NO: 561858 - protein, 15 aa, Mycobacterium
RGGSADGLTSPDAAH

SEQ ID NO: 561859 - protein, 6 aa, Mycobacterium
RGGSAG

SEQ ID NO: 561860 - protein, 6 aa, Mycobacterium
RGGSAS

SEQ ID NO: 561861 - protein, 15 aa, Mycobacterium
RGGSGAGSDLAAKRR

SEQ ID NO: 561862 - protein, 10 aa, Mycobacterium
RGGSGVGAGD

SEQ ID NO: 561863 - protein, 8 aa, Mycobacterium
RGGSPPHE

SEQ ID NO: 561864 - protein, 5 aa, Mycobacterium
RGGSV

SEQ ID NO: 561865 - protein, 12 aa, Mycobacterium
RGGTAQDEGGRD

SEQ ID NO: 561866 - protein, 8 aa, Mycobacterium
RGGTATDV

SEQ ID NO: 561867 - protein, 13 aa, Mycobacterium
RGGTATFRAPDPH

SEQ ID NO: 561868 - protein, 6 aa, Mycobacterium
RGGTDL

SEQ ID NO: 561869 - protein, 14 aa, Mycobacterium
RGGTGEQRAGRPSL

SEQ ID NO: 561870 - protein, 14 aa, Mycobacterium
RGGTGGTGGNGGVG

SEQ ID NO: 561871 - protein, 5 aa, Mycobacterium
RGGTN

SEQ ID NO: 561872 - protein, 8 aa, Mycobacterium
RGGTPLRS

SEQ ID NO: 561873 - protein, 6 aa, Mycobacterium
RGGTPV

SEQ ID NO: 561874 - protein, 5 aa, Mycobacterium
RGGTR

SEQ ID NO: 561875 - protein, 7 aa, Mycobacterium
RGGTRGE

SEQ ID NO: 561876 - protein, 5 aa, Mycobacterium
RGGTS

SEQ ID NO: 561877 - protein, 5 aa, Mycobacterium
RGGTT

SEQ ID NO: 561878 - protein, 6 aa, Mycobacterium
RGGTTG

SEQ ID NO: 561879 - protein, 14 aa, Mycobacterium
RGGTVGRGGGPSYD

SEQ ID NO: 561880 - protein, 10 aa, Mycobacterium
RGGTYDGTDI

SEQ ID NO: 561881 - protein, 5 aa, Mycobacterium
RGGVA

SEQ ID NO: 561882 - protein, 5 aa, Mycobacterium
RGGVD

SEQ ID NO: 561883 - protein, 8 aa, Mycobacterium
RGGVDRRR

SEQ ID NO: 561884 - protein, 6 aa, Mycobacterium
RGGVEQ

SEQ ID NO: 561885 - protein, 7 aa, Mycobacterium
RGGVGGI

SEQ ID NO: 561886 - protein, 5 aa, Mycobacterium
RGGVL

SEQ ID NO: 561887 - protein, 12 aa, Mycobacterium
RGGVLGDTTGAT

SEQ ID NO: 561888 - protein, 6 aa, Mycobacterium
RGGVTV

SEQ ID NO: 561889 - protein, 14 aa, Mycobacterium
RGGWRAGGVRDGQA

SEQ ID NO: 561890 - protein, 4 aa, Mycobacterium
RGGY

SEQ ID NO: 561891 - protein, 6 aa, Mycobacterium
RGGYDG

SEQ ID NO: 561892 - protein, 8 aa, Mycobacterium
RGGYDSSA

SEQ ID NO: 561893 - protein, 14 aa, Mycobacterium
RGGYIGREDAANLT

SEQ ID NO: 561894 - protein, 5 aa, Mycobacterium
RGGYK

SEQ ID NO: 561895 - protein, 5 aa, Mycobacterium
RGGYV

SEQ ID NO: 561896 - protein, 14 aa, Mycobacterium
RGHAAAAPENEEHQ

SEQ ID NO: 561897 - protein, 7 aa, Mycobacterium
RGHAAAR

SEQ ID NO: 561898 - protein, 5 aa, Mycobacterium
RGHAQ

SEQ ID NO: 561899 - protein, 18 aa, Mycobacterium
RGHDDADPRLSKGVTTSD

SEQ ID NO: 561900 - protein, 8 aa, Mycobacterium
RGHDDHPL

SEQ ID NO: 561901 - protein, 29 aa, Mycobacterium
RGHDGAAGVAPAPPPPGAEASDDRATRRW

SEQ ID NO: 561902 - protein, 7 aa, Mycobacterium
RGHDPGA

SEQ ID NO: 561903 - protein, 5 aa, Mycobacterium
RGHDR

SEQ ID NO: 561904 - protein, 6 aa, Mycobacterium
RGHEPV

SEQ ID NO: 561905 - protein, 9 aa, Mycobacterium
RGHERPSGT

SEQ ID NO: 561906 - protein, 5 aa, Mycobacterium
RGHGA

SEQ ID NO: 561907 - protein, 18 aa, Mycobacterium
RGHGASSDAEEHSLQREA

SEQ ID NO: 561908 - protein, 5 aa, Mycobacterium
RGHGD

SEQ ID NO: 561909 - protein, 13 aa, Mycobacterium
RGHGDSDRAPDAD

SEQ ID NO: 561910 - protein, 15 aa, Mycobacterium
RGHGDSDRSPSANYS

SEQ ID NO: 561911 - protein, 14 aa, Mycobacterium
RGHGKSDAAPEGTV

SEQ ID NO: 561912 - protein, 14 aa, Mycobacterium
RGHGKSTGRKVPQD

SEQ ID NO: 561913 - protein, 14 aa, Mycobacterium
RGHGQSGEAAPQTY

SEQ ID NO: 561914 - protein, 14 aa, Mycobacterium
RGHGRSETPRGRNR

SEQ ID NO: 561915 - protein, 14 aa, Mycobacterium
RGHGRSGEAEPETY

SEQ ID NO: 561916 - protein, 11 aa, Mycobacterium
RGHGRSGGKRA

SEQ ID NO: 561917 - protein, 15 aa, Mycobacterium
RGHGRSGVPPRRGGY

SEQ ID NO: 561918 - protein, 15 aa, Mycobacterium
RGHGSSDAPDDIDAY

SEQ ID NO: 561919 - protein, 10 aa, Mycobacterium
RGHGTPEGRD

SEQ ID NO: 561920 - protein, 26 aa, Mycobacterium
RGHHGPDGGDPLRPAPPRSRSPLRST

SEQ ID NO: 561921 - protein, 23 aa, Mycobacterium
RGHHGPDGGDPLRPAPPRSRSPR

SEQ ID NO: 561922 - protein, 5 aa, Mycobacterium
RGHKS

SEQ ID NO: 561923 - protein, 4 aa, Mycobacterium
RGHP

SEQ ID NO: 561924 - protein, 7 aa, Mycobacterium
RGHPSRE

SEQ ID NO: 561925 - protein, 5 aa, Mycobacterium
RGHRG

SEQ ID NO: 561926 - protein, 6 aa, Mycobacterium
RGHRPV

SEQ ID NO: 561927 - protein, 7 aa, Mycobacterium
RGHRPVR

SEQ ID NO: 561928 - protein, 9 aa, Mycobacterium
RGHRTPDKR

SEQ ID NO: 561929 - protein, 5 aa, Mycobacterium
RGHRY

SEQ ID NO: 561930 - protein, 8 aa, Mycobacterium
RGHSGARE

SEQ ID NO: 561931 - protein, 4 aa, Mycobacterium
RGHT

SEQ ID NO: 561932 - protein, 6 aa, Mycobacterium
RGHTAA

SEQ ID NO: 561933 - protein, 7 aa, Mycobacterium
RGHTEVE

SEQ ID NO: 561934 - protein, 5 aa, Mycobacterium
RGHTS

SEQ ID NO: 561935 - protein, 6 aa, Mycobacterium
RGIAPP

SEQ ID NO: 561936 - protein, 15 aa, Mycobacterium
RGIAPTDAGATLAAE

SEQ ID NO: 561937 - protein, 7 aa, Mycobacterium
RGIAQPA

SEQ ID NO: 561938 - protein, 4 aa, Mycobacterium
RGID

SEQ ID NO: 561939 - protein, 12 aa, Mycobacterium
RGIEPDARSGAV

SEQ ID NO: 561940 - protein, 4 aa, Mycobacterium
RGIG

SEQ ID NO: 561941 - protein, 5 aa, Mycobacterium
RGIGA

SEQ ID NO: 561942 - protein, 16 aa, Mycobacterium
RGIGAAAARREAANGS

SEQ ID NO: 561943 - protein, 6 aa, Mycobacterium
RGIGPD

SEQ ID NO: 561944 - protein, 11 aa, Mycobacterium
RGIGPSATRKL

SEQ ID NO: 561945 - protein, 5 aa, Mycobacterium
RGIGQ

SEQ ID NO: 561946 - protein, 5 aa, Mycobacterium
RGIGR

SEQ ID NO: 561947 - protein, 19 aa, Mycobacterium
RGIGSRRTRGFDSSPRTAH

SEQ ID NO: 561948 - protein, 5 aa, Mycobacterium
RGIGY

SEQ ID NO: 561949 - protein, 9 aa, Mycobacterium
RGIHADPDK

SEQ ID NO: 561950 - protein, 18 aa, Mycobacterium
RGIKTTTAREWAEANLTR

SEQ ID NO: 561951 - protein, 4 aa, Mycobacterium
RGIP

SEQ ID NO: 561952 - protein, 12 aa, Mycobacterium
RGIPDEAVDPAG

SEQ ID NO: 561953 - protein, 7 aa, Mycobacterium
RGIPEPT

SEQ ID NO: 561954 - protein, 12 aa, Mycobacterium
RGIPKRAGGNGD

SEQ ID NO: 561955 - protein, 6 aa, Mycobacterium
RGIPRS

SEQ ID NO: 561956 - protein, 6 aa, Mycobacterium
RGIPTE

SEQ ID NO: 561957 - protein, 4 aa, Mycobacterium
RGIQ

SEQ ID NO: 561958 - protein, 5 aa, Mycobacterium
RGIRG

SEQ ID NO: 561959 - protein, 7 aa, Mycobacterium
RGIRTAE

SEQ ID NO: 561960 - protein, 6 aa, Mycobacterium
RGISPA

SEQ ID NO: 561961 - protein, 14 aa, Mycobacterium
RGISPAAAAKLADD

SEQ ID NO: 561962 - protein, 6 aa, Mycobacterium
RGISSR

SEQ ID NO: 561963 - protein, 15 aa, Mycobacterium
RGISSVDTTSDAETQ

SEQ ID NO: 561964 - protein, 12 aa, Mycobacterium
RGISTTDDIPDH

SEQ ID NO: 561965 - protein, 13 aa, Mycobacterium
RGITNSSTAPRYE

SEQ ID NO: 561966 - protein, 12 aa, Mycobacterium
RGITPAAAATLA

SEQ ID NO: 561967 - protein, 15 aa, Mycobacterium
RGITPASAAKLADDH

SEQ ID NO: 561968 - protein, 9 aa, Mycobacterium
RGITPDDGP

SEQ ID NO: 561969 - protein, 5 aa, Mycobacterium
RGITQ

SEQ ID NO: 561970 - protein, 6 aa, Mycobacterium
RGITRA

SEQ ID NO: 561971 - protein, 10 aa, Mycobacterium
RGITSQTAQA

SEQ ID NO: 561972 - protein, 12 aa, Mycobacterium
RGITSRRQLRSG

SEQ ID NO: 561973 - protein, 8 aa, Mycobacterium
RGKALGEA

SEQ ID NO: 561974 - protein, 10 aa, Mycobacterium
RGKARLKHDD

SEQ ID NO: 561975 - protein, 6 aa, Mycobacterium
RGKDSV

SEQ ID NO: 561976 - protein, 4 aa, Mycobacterium
RGKE

SEQ ID NO: 561977 - protein, 7 aa, Mycobacterium
RGKEAHD

SEQ ID NO: 561978 - protein, 8 aa, Mycobacterium
RGKEAHEA

SEQ ID NO: 561979 - protein, 12 aa, Mycobacterium
RGKELKATATAR

SEQ ID NO: 561980 - protein, 6 aa, Mycobacterium
RGKELS

SEQ ID NO: 561981 - protein, 5 aa, Mycobacterium
RGKES

SEQ ID NO: 561982 - protein, 7 aa, Mycobacterium
RGKESHA

SEQ ID NO: 561983 - protein, 8 aa, Mycobacterium
RGKESHAA

SEQ ID NO: 561984 - protein, 6 aa, Mycobacterium
RGKGEQ

SEQ ID NO: 561985 - protein, 11 aa, Mycobacterium
RGKGGKGRVAP

SEQ ID NO: 561986 - protein, 16 aa, Mycobacterium
RGKGGRAVRPGPPPTV

SEQ ID NO: 561987 - protein, 7 aa, Mycobacterium
RGKHGAG

SEQ ID NO: 561988 - protein, 15 aa, Mycobacterium
RGKIAAGAPIAEVLG

SEQ ID NO: 561989 - protein, 11 aa, Mycobacterium
RGKIDGDEDVL

SEQ ID NO: 561990 - protein, 5 aa, Mycobacterium
RGKIT

SEQ ID NO: 561991 - protein, 4 aa, Mycobacterium
RGKK

SEQ ID NO: 561992 - protein, 8 aa, Mycobacterium
RGKKAHDE

SEQ ID NO: 561993 - protein, 9 aa, Mycobacterium
RGKLGSDPA

SEQ ID NO: 561994 - protein, 14 aa, Mycobacterium
RGKLRAASSGLDKL

SEQ ID NO: 561995 - protein, 8 aa, Mycobacterium
RGKLTARE

SEQ ID NO: 561996 - protein, 10 aa, Mycobacterium
RGKMTSPAAR

SEQ ID NO: 561997 - protein, 6 aa, Mycobacterium
RGKNGE

SEQ ID NO: 561998 - protein, 4 aa, Mycobacterium
RGKP

SEQ ID NO: 561999 - protein, 16 aa, Mycobacterium
RGKPAPALRPDGAIPE

SEQ ID NO: 562000 - protein, 9 aa, Mycobacterium
RGKPAPEQL

SEQ ID NO: 562001 - protein, 8 aa, Mycobacterium
RGKPCSEQ

SEQ ID NO: 562002 - protein, 5 aa, Mycobacterium
RGKPD

SEQ ID NO: 562003 - protein, 9 aa, Mycobacterium
RGKPNLTPD

SEQ ID NO: 562004 - protein, 7 aa, Mycobacterium
RGKPPRH

SEQ ID NO: 562005 - protein, 13 aa, Mycobacterium
RGKPTDQLPGPGR

SEQ ID NO: 562006 - protein, 6 aa, Mycobacterium
RGKPTW

SEQ ID NO: 562007 - protein, 16 aa, Mycobacterium
RGKRAAVARSVDDGLA

SEQ ID NO: 562008 - protein, 7 aa, Mycobacterium
RGKRNPI

SEQ ID NO: 562009 - protein, 6 aa, Mycobacterium
RGKRSA

SEQ ID NO: 562010 - protein, 15 aa, Mycobacterium
RGKRVSTGAPNSGTE

SEQ ID NO: 562011 - protein, 16 aa, Mycobacterium
RGKSAHAAAYPERGVN

SEQ ID NO: 562012 - protein, 8 aa, Mycobacterium
RGKSASLE

SEQ ID NO: 562013 - protein, 14 aa, Mycobacterium
RGKSEGDEKGEVRP

SEQ ID NO: 562014 - protein, 7 aa, Mycobacterium
RGKSGAL

SEQ ID NO: 562015 - protein, 6 aa, Mycobacterium
RGKSGR

SEQ ID NO: 562016 - protein, 6 aa, Mycobacterium
RGKSIA

SEQ ID NO: 562017 - protein, 10 aa, Mycobacterium
RGKSPYGAPQ

SEQ ID NO: 562018 - protein, 5 aa, Mycobacterium
RGKSR

SEQ ID NO: 562019 - protein, 4 aa, Mycobacterium
RGKT

SEQ ID NO: 562020 - protein, 8 aa, Mycobacterium
RGKTARKE

SEQ ID NO: 562021 - protein, 10 aa, Mycobacterium
RGKTIRPKTL

SEQ ID NO: 562022 - protein, 12 aa, Mycobacterium
RGKTIRPKTLNQ

SEQ ID NO: 562023 - protein, 7 aa, Mycobacterium
RGKTPPV

SEQ ID NO: 562024 - protein, 4 aa, Mycobacterium
RGKV

SEQ ID NO: 562025 - protein, 19 aa, Mycobacterium
RGKVDDEGLKFAKKPAPVA

SEQ ID NO: 562026 - protein, 5 aa, Mycobacterium
RGKWD

SEQ ID NO: 562027 - protein, 4 aa, Mycobacterium
RGLA

SEQ ID NO: 562028 - protein, 7 aa, Mycobacterium
RGLAADG

SEQ ID NO: 562029 - protein, 6 aa, Mycobacterium
RGLAGR

SEQ ID NO: 562030 - protein, 20 aa, Mycobacterium
RGLAPRSKRDIAAAAAAGRF

SEQ ID NO: 562031 - protein, 9 aa, Mycobacterium
RGLAQDGDL

SEQ ID NO: 562032 - protein, 9 aa, Mycobacterium
RGLAQTAPD

SEQ ID NO: 562033 - protein, 13 aa, Mycobacterium
RGLAQTEYAPGTL

SEQ ID NO: 562034 - protein, 5 aa, Mycobacterium
RGLAR

SEQ ID NO: 562035 - protein, 7 aa, Mycobacterium
RGLATDG

SEQ ID NO: 562036 - protein, 6 aa, Mycobacterium
RGLDPR

SEQ ID NO: 562037 - protein, 9 aa, Mycobacterium
RGLDSDPRI

SEQ ID NO: 562038 - protein, 17 aa, Mycobacterium
RGLDTDEVLGKNPVRGT

SEQ ID NO: 562039 - protein, 7 aa, Mycobacterium
RGLDTSA

SEQ ID NO: 562040 - protein, 6 aa, Mycobacterium
RGLEKN

SEQ ID NO: 562041 - protein, 7 aa, Mycobacterium
RGLEPGD

SEQ ID NO: 562042 - protein, 5 aa, Mycobacterium
RGLGE

SEQ ID NO: 562043 - protein, 17 aa, Mycobacterium
RGLGGAVKDNDDKFPPE

SEQ ID NO: 562044 - protein, 7 aa, Mycobacterium
RGLGGTQ

SEQ ID NO: 562045 - protein, 12 aa, Mycobacterium
RGLGKSSIQELT

SEQ ID NO: 562046 - protein, 6 aa, Mycobacterium
RGLGPA

SEQ ID NO: 562047 - protein, 13 aa, Mycobacterium
RGLGPTDVAGPAG

SEQ ID NO: 562048 - protein, 5 aa, Mycobacterium
RGLGR

SEQ ID NO: 562049 - protein, 12 aa, Mycobacterium
RGLGRGTAGTAT

SEQ ID NO: 562050 - protein, 6 aa, Mycobacterium
RGLGTR

SEQ ID NO: 562051 - protein, 11 aa, Mycobacterium
RGLHPSDSDYI

SEQ ID NO: 562052 - protein, 11 aa, Mycobacterium
RGLKGESAPVF

SEQ ID NO: 562053 - protein, 9 aa, Mycobacterium
RGLLPGNGS

SEQ ID NO: 562054 - protein, 4 aa, Mycobacterium
RGLN

SEQ ID NO: 562055 - protein, 12 aa, Mycobacterium
RGLNNSCGKLTD

SEQ ID NO: 562056 - protein, 12 aa, Mycobacterium
RGLNRRSGPPVH

SEQ ID NO: 562057 - protein, 4 aa, Mycobacterium
RGLP

SEQ ID NO: 562058 - protein, 10 aa, Mycobacterium
RGLPAEGDDI

SEQ ID NO: 562059 - protein, 6 aa, Mycobacterium
RGLPAK

SEQ ID NO: 562060 - protein, 5 aa, Mycobacterium
RGLPG

SEQ ID NO: 562061 - protein, 12 aa, Mycobacterium
RGLPGASRRFGE

SEQ ID NO: 562062 - protein, 8 aa, Mycobacterium
RGLPGDPM

SEQ ID NO: 562063 - protein, 13 aa, Mycobacterium
RGLPGQPPDPDIT

SEQ ID NO: 562064 - protein, 6 aa, Mycobacterium
RGLPGR

SEQ ID NO: 562065 - protein, 11 aa, Mycobacterium
RGLPKEGESLD

SEQ ID NO: 562066 - protein, 8 aa, Mycobacterium
RGLPPAEP

SEQ ID NO: 562067 - protein, 8 aa, Mycobacterium
RGLPPKRR

SEQ ID NO: 562068 - protein, 8 aa, Mycobacterium
RGLPPPQI

SEQ ID NO: 562069 - protein, 10 aa, Mycobacterium
RGLPPSGDAL

SEQ ID NO: 562070 - protein, 23 aa, Mycobacterium
RGLPPSPDATSTGLEGARGADVD

SEQ ID NO: 562071 - protein, 6 aa, Mycobacterium
RGLPQR

SEQ ID NO: 562072 - protein, 9 aa, Mycobacterium
RGLPRSATT

SEQ ID NO: 562073 - protein, 7 aa, Mycobacterium
RGLPTAA

SEQ ID NO: 562074 - protein, 23 aa, Mycobacterium
RGLPTGASEPAPAREEALGDNAF

SEQ ID NO: 562075 - protein, 15 aa, Mycobacterium
RGLPTGETAEQPAMS

SEQ ID NO: 562076 - protein, 10 aa, Mycobacterium
RGLPTGGEDI

SEQ ID NO: 562077 - protein, 7 aa, Mycobacterium
RGLPTRD

SEQ ID NO: 562078 - protein, 8 aa, Mycobacterium
RGLPTTED

SEQ ID NO: 562079 - protein, 6 aa, Mycobacterium
RGLQSR

SEQ ID NO: 562080 - protein, 6 aa, Mycobacterium
RGLRAA

SEQ ID NO: 562081 - protein, 9 aa, Mycobacterium
RGLRAAAEA

SEQ ID NO: 562082 - protein, 10 aa, Mycobacterium
RGLRDGDAGV

SEQ ID NO: 562083 - protein, 7 aa, Mycobacterium
RGLRPGD

SEQ ID NO: 562084 - protein, 13 aa, Mycobacterium
RGLRQGGGRKLRT

SEQ ID NO: 562085 - protein, 8 aa, Mycobacterium
RGLRQGVP

SEQ ID NO: 562086 - protein, 5 aa, Mycobacterium
RGLRR

SEQ ID NO: 562087 - protein, 4 aa, Mycobacterium
RGLS

SEQ ID NO: 562088 - protein, 8 aa, Mycobacterium
RGLSADGR

SEQ ID NO: 562089 - protein, 12 aa, Mycobacterium
RGLSGAAARFGE

SEQ ID NO: 562090 - protein, 10 aa, Mycobacterium
RGLSGVEQVG

SEQ ID NO: 562091 - protein, 6 aa, Mycobacterium
RGLSPA

SEQ ID NO: 562092 - protein, 8 aa, Mycobacterium
RGLSPDGR

SEQ ID NO: 562093 - protein, 6 aa, Mycobacterium
RGLSPE

SEQ ID NO: 562094 - protein, 5 aa, Mycobacterium
RGLTA

SEQ ID NO: 562095 - protein, 9 aa, Mycobacterium
RGLTDTEGL

SEQ ID NO: 562096 - protein, 10 aa, Mycobacterium
RGLTEESPEI

SEQ ID NO: 562097 - protein, 8 aa, Mycobacterium
RGLTGGGT

SEQ ID NO: 562098 - protein, 9 aa, Mycobacterium
RGLTPASDY

SEQ ID NO: 562099 - protein, 11 aa, Mycobacterium
RGLTTGAIPHE

SEQ ID NO: 562100 - protein, 5 aa, Mycobacterium
RGMAE

SEQ ID NO: 562101 - protein, 23 aa, Mycobacterium
RGMAEDDARARIAAQASDEQRRA

SEQ ID NO: 562102 - protein, 7 aa, Mycobacterium
RGMATPD

SEQ ID NO: 562103 - protein, 5 aa, Mycobacterium
RGMDR

SEQ ID NO: 562104 - protein, 16 aa, Mycobacterium
RGMKGQSWRGAAGIGE

SEQ ID NO: 562105 - protein, 11 aa, Mycobacterium
RGMPEEDARAR

SEQ ID NO: 562106 - protein, 6 aa, Mycobacterium
RGMPPG

SEQ ID NO: 562107 - protein, 4 aa, Mycobacterium
RGMR

SEQ ID NO: 562108 - protein, 4 aa, Mycobacterium
RGMS

SEQ ID NO: 562109 - protein, 14 aa, Mycobacterium
RGMSDDELDRAETD

SEQ ID NO: 562110 - protein, 11 aa, Mycobacterium
RGMSEADARAR

SEQ ID NO: 562111 - protein, 5 aa, Mycobacterium
RGMSQ

SEQ ID NO: 562112 - protein, 15 aa, Mycobacterium
RGMTAPTPPQTNGSA

SEQ ID NO: 562113 - protein, 5 aa, Mycobacterium
RGMTG

SEQ ID NO: 562114 - protein, 7 aa, Mycobacterium
RGMTGSC

SEQ ID NO: 562115 - protein, 8 aa, Mycobacterium
RGMTTTTK

SEQ ID NO: 562116 - protein, 6 aa, Mycobacterium
RGNAAY

SEQ ID NO: 562117 - protein, 8 aa, Mycobacterium
RGNAAYTG

SEQ ID NO: 562118 - protein, 8 aa, Mycobacterium
RGNADTGR

SEQ ID NO: 562119 - protein, 7 aa, Mycobacterium
RGNADVA

SEQ ID NO: 562120 - protein, 8 aa, Mycobacterium
RGNADVTP

SEQ ID NO: 562121 - protein, 6 aa, Mycobacterium
RGNAEV

SEQ ID NO: 562122 - protein, 7 aa, Mycobacterium
RGNAPLP

SEQ ID NO: 562123 - protein, 11 aa, Mycobacterium
RGNARGGERVR

SEQ ID NO: 562124 - protein, 19 aa, Mycobacterium
RGNASTIQAGNEQAEAALG

SEQ ID NO: 562125 - protein, 6 aa, Mycobacterium
RGNDGK

SEQ ID NO: 562126 - protein, 6 aa, Mycobacterium
RGNDRP

SEQ ID NO: 562127 - protein, 4 aa, Mycobacterium
RGNE

SEQ ID NO: 562128 - protein, 7 aa, Mycobacterium
RGNEKAD

SEQ ID NO: 562129 - protein, 9 aa, Mycobacterium
RGNERLGEE

SEQ ID NO: 562130 - protein, 12 aa, Mycobacterium
RGNGAADGGSSG

SEQ ID NO: 562131 - protein, 7 aa, Mycobacterium
RGNGDPL

SEQ ID NO: 562132 - protein, 9 aa, Mycobacterium
RGNGGGLSA

SEQ ID NO: 562133 - protein, 7 aa, Mycobacterium
RGNGHGT

SEQ ID NO: 562134 - protein, 19 aa, Mycobacterium
RGNGKSPVTITNPDLTANE

SEQ ID NO: 562135 - protein, 8 aa, Mycobacterium
RGNGLDPA

SEQ ID NO: 562136 - protein, 7 aa, Mycobacterium
RGNGTGP

SEQ ID NO: 562137 - protein, 13 aa, Mycobacterium
RGNGVGADDPAGL

SEQ ID NO: 562138 - protein, 11 aa, Mycobacterium
RGNHSSEPTLG

SEQ ID NO: 562139 - protein, 5 aa, Mycobacterium
RGNHT

SEQ ID NO: 562140 - protein, 4 aa, Mycobacterium
RGNL

SEQ ID NO: 562141 - protein, 17 aa, Mycobacterium
RGNLAGDTRADNTRAQR

SEQ ID NO: 562142 - protein, 9 aa, Mycobacterium
RGNNNRATD

SEQ ID NO: 562143 - protein, 6 aa, Mycobacterium
RGNPDT

SEQ ID NO: 562144 - protein, 7 aa, Mycobacterium
RGNPDYS

SEQ ID NO: 562145 - protein, 10 aa, Mycobacterium
RGNPVAASAE

SEQ ID NO: 562146 - protein, 10 aa, Mycobacterium
RGNPVSPSTV

SEQ ID NO: 562147 - protein, 13 aa, Mycobacterium
RGNQAAGEQPKAL

SEQ ID NO: 562148 - protein, 5 aa, Mycobacterium
RGNQL

SEQ ID NO: 562149 - protein, 4 aa, Mycobacterium
RGNR

SEQ ID NO: 562150 - protein, 11 aa, Mycobacterium
RGNRARRRTGL

SEQ ID NO: 562151 - protein, 7 aa, Mycobacterium
RGNREGQ

SEQ ID NO: 562152 - protein, 6 aa, Mycobacterium
RGNRGG

SEQ ID NO: 562153 - protein, 4 aa, Mycobacterium
RGNS

SEQ ID NO: 562154 - protein, 8 aa, Mycobacterium
RGNSQGLS

SEQ ID NO: 562155 - protein, 8 aa, Mycobacterium
RGNSYAHA

SEQ ID NO: 562156 - protein, 7 aa, Mycobacterium
RGNTGAL

SEQ ID NO: 562157 - protein, 5 aa, Mycobacterium
RGNTQ

SEQ ID NO: 562158 - protein, 6 aa, Mycobacterium
RGNTYA

SEQ ID NO: 562159 - protein, 4 aa, Mycobacterium
RGNV

SEQ ID NO: 562160 - protein, 12 aa, Mycobacterium
RGNVGLELELTP

SEQ ID NO: 562161 - protein, 4 aa, Mycobacterium
RGNY

SEQ ID NO: 562162 - protein, 4 aa, Mycobacterium
RGPA

SEQ ID NO: 562163 - protein, 16 aa, Mycobacterium
RGPAAGEIAAEAAERE

SEQ ID NO: 562164 - protein, 9 aa, Mycobacterium
RGPAAPGAT

SEQ ID NO: 562165 - protein, 9 aa, Mycobacterium
RGPAAQTGI

SEQ ID NO: 562166 - protein, 6 aa, Mycobacterium
RGPAAS

SEQ ID NO: 562167 - protein, 10 aa, Mycobacterium
RGPAATADAA

SEQ ID NO: 562168 - protein, 8 aa, Mycobacterium
RGPAATSI

SEQ ID NO: 562169 - protein, 10 aa, Mycobacterium
RGPAAVPGTA

SEQ ID NO: 562170 - protein, 9 aa, Mycobacterium
RGPADGDGA

SEQ ID NO: 562171 - protein, 8 aa, Mycobacterium
RGPADLPD

SEQ ID NO: 562172 - protein, 8 aa, Mycobacterium
RGPAETAG

SEQ ID NO: 562173 - protein, 7 aa, Mycobacterium
RGPAGGG

SEQ ID NO: 562174 - protein, 7 aa, Mycobacterium
RGPAGQD

SEQ ID NO: 562175 - protein, 6 aa, Mycobacterium
RGPAGV

SEQ ID NO: 562176 - protein, 5 aa, Mycobacterium
RGPAP

SEQ ID NO: 562177 - protein, 10 aa, Mycobacterium
RGPAPGPVTE

SEQ ID NO: 562178 - protein, 11 aa, Mycobacterium
RGPAQAGPAGR

SEQ ID NO: 562179 - protein, 7 aa, Mycobacterium
RGPARMP

SEQ ID NO: 562180 - protein, 8 aa, Mycobacterium
RGPARVPE

SEQ ID NO: 562181 - protein, 14 aa, Mycobacterium
RGPASESMAASAAP

SEQ ID NO: 562182 - protein, 8 aa, Mycobacterium
RGPASGEA

SEQ ID NO: 562183 - protein, 7 aa, Mycobacterium
RGPASSA

SEQ ID NO: 562184 - protein, 9 aa, Mycobacterium
RGPASTDVL

SEQ ID NO: 562185 - protein, 5 aa, Mycobacterium
RGPAT

SEQ ID NO: 562186 - protein, 40 aa, Mycobacterium
RGPATPDAPATPATPDASGASGASGASGASGASGAVAAPE

SEQ ID NO: 562187 - protein, 6 aa, Mycobacterium
RGPATR

SEQ ID NO: 562188 - protein, 20 aa, Mycobacterium
RGPATVPQLPDPVRAHRDGN

SEQ ID NO: 562189 - protein, 4 aa, Mycobacterium
RGPD

SEQ ID NO: 562190 - protein, 5 aa, Mycobacterium
RGPDA

SEQ ID NO: 562191 - protein, 9 aa, Mycobacterium
RGPDAPDLN

SEQ ID NO: 562192 - protein, 11 aa, Mycobacterium
RGPDAPGAAEL

SEQ ID NO: 562193 - protein, 9 aa, Mycobacterium
RGPDATTVA

SEQ ID NO: 562194 - protein, 6 aa, Mycobacterium
RGPDAV

SEQ ID NO: 562195 - protein, 6 aa, Mycobacterium
RGPDDR

SEQ ID NO: 562196 - protein, 11 aa, Mycobacterium
RGPDEAGARSE

SEQ ID NO: 562197 - protein, 6 aa, Mycobacterium
RGPDEV

SEQ ID NO: 562198 - protein, 7 aa, Mycobacterium
RGPDGDP

SEQ ID NO: 562199 - protein, 9 aa, Mycobacterium
RGPDGDTWS

SEQ ID NO: 562200 - protein, 6 aa, Mycobacterium
RGPDGR

SEQ ID NO: 562201 - protein, 10 aa, Mycobacterium
RGPDGVERTA

SEQ ID NO: 562202 - protein, 6 aa, Mycobacterium
RGPDSV

SEQ ID NO: 562203 - protein, 5 aa, Mycobacterium
RGPDT

SEQ ID NO: 562204 - protein, 17 aa, Mycobacterium
RGPDYGIDGGPEANEDR

SEQ ID NO: 562205 - protein, 13 aa, Mycobacterium
RGPDYGPEGGPIV

SEQ ID NO: 562206 - protein, 13 aa, Mycobacterium
RGPDYGPEGGPVV

SEQ ID NO: 562207 - protein, 4 aa, Mycobacterium
RGPE

SEQ ID NO: 562208 - protein, 15 aa, Mycobacterium
RGPEAAELSGDDADE

SEQ ID NO: 562209 - protein, 15 aa, Mycobacterium
RGPEAAQLSGDDADE

SEQ ID NO: 562210 - protein, 15 aa, Mycobacterium
RGPEAAQLTGDDADE

SEQ ID NO: 562211 - protein, 9 aa, Mycobacterium
RGPEAEARR

SEQ ID NO: 562212 - protein, 15 aa, Mycobacterium
RGPEATQLSGDDADE

SEQ ID NO: 562213 - protein, 7 aa, Mycobacterium
RGPEEAH

SEQ ID NO: 562214 - protein, 11 aa, Mycobacterium
RGPEGSEPPRG

SEQ ID NO: 562215 - protein, 7 aa, Mycobacterium
RGPELTS

SEQ ID NO: 562216 - protein, 9 aa, Mycobacterium
RGPEPPAER

SEQ ID NO: 562217 - protein, 7 aa, Mycobacterium
RGPEQRV

SEQ ID NO: 562218 - protein, 13 aa, Mycobacterium
RGPETEHLLALAG

SEQ ID NO: 562219 - protein, 17 aa, Mycobacterium
RGPEYGIEGGPEANEDR

SEQ ID NO: 562220 - protein, 17 aa, Mycobacterium
RGPEYGVEGGPEANEDR

SEQ ID NO: 562221 - protein, 9 aa, Mycobacterium
RGPFARPPV

SEQ ID NO: 562222 - protein, 4 aa, Mycobacterium
RGPG

SEQ ID NO: 562223 - protein, 5 aa, Mycobacterium
RGPGA

SEQ ID NO: 562224 - protein, 6 aa, Mycobacterium
RGPGAA

SEQ ID NO: 562225 - protein, 6 aa, Mycobacterium
RGPGFG

SEQ ID NO: 562226 - protein, 5 aa, Mycobacterium
RGPGG

SEQ ID NO: 562227 - protein, 7 aa, Mycobacterium
RGPGGDA

SEQ ID NO: 562228 - protein, 9 aa, Mycobacterium
RGPGGEREI

SEQ ID NO: 562229 - protein, 6 aa, Mycobacterium
RGPGGG

SEQ ID NO: 562230 - protein, 6 aa, Mycobacterium
RGPGGK

SEQ ID NO: 562231 - protein, 5 aa, Mycobacterium
RGPGI

SEQ ID NO: 562232 - protein, 15 aa, Mycobacterium
RGPGLEDRQDRHDRF

SEQ ID NO: 562233 - protein, 5 aa, Mycobacterium
RGPGP

SEQ ID NO: 562234 - protein, 9 aa, Mycobacterium
RGPGPAPLR

SEQ ID NO: 562235 - protein, 8 aa, Mycobacterium
RGPGPQPD

SEQ ID NO: 562236 - protein, 10 aa, Mycobacterium
RGPGQDAGAR

SEQ ID NO: 562237 - protein, 4 aa, Mycobacterium
RGPH

SEQ ID NO: 562238 - protein, 20 aa, Mycobacterium
RGPHAAASAAPIADSDISEV

SEQ ID NO: 562239 - protein, 10 aa, Mycobacterium
RGPHAATAAA

SEQ ID NO: 562240 - protein, 16 aa, Mycobacterium
RGPHAKQQSPEIGITD

SEQ ID NO: 562241 - protein, 12 aa, Mycobacterium
RGPHDGIGGNRA

SEQ ID NO: 562242 - protein, 18 aa, Mycobacterium
RGPHGGAPGADAAVTGPL

SEQ ID NO: 562243 - protein, 11 aa, Mycobacterium
RGPIGDMATTD

SEQ ID NO: 562244 - protein, 10 aa, Mycobacterium
RGPINPTPAG

SEQ ID NO: 562245 - protein, 8 aa, Mycobacterium
RGPIPGRD

SEQ ID NO: 562246 - protein, 10 aa, Mycobacterium
RGPKATGALR

SEQ ID NO: 562247 - protein, 6 aa, Mycobacterium
RGPKAV

SEQ ID NO: 562248 - protein, 10 aa, Mycobacterium
RGPKEERESA

SEQ ID NO: 562249 - protein, 7 aa, Mycobacterium
RGPLDED

SEQ ID NO: 562250 - protein, 6 aa, Mycobacterium
RGPLDR

SEQ ID NO: 562251 - protein, 10 aa, Mycobacterium
RGPLDTDEAT

SEQ ID NO: 562252 - protein, 5 aa, Mycobacterium
RGPLG

SEQ ID NO: 562253 - protein, 7 aa, Mycobacterium
RGPLGQV

SEQ ID NO: 562254 - protein, 5 aa, Mycobacterium
RGPLH

SEQ ID NO: 562255 - protein, 5 aa, Mycobacterium
RGPLQ

SEQ ID NO: 562256 - protein, 6 aa, Mycobacterium
RGPLQL

SEQ ID NO: 562257 - protein, 10 aa, Mycobacterium
RGPLRAGPNG

SEQ ID NO: 562258 - protein, 6 aa, Mycobacterium
RGPLRG

SEQ ID NO: 562259 - protein, 9 aa, Mycobacterium
RGPLSGRSL

SEQ ID NO: 562260 - protein, 9 aa, Mycobacterium
RGPLSHDEA

SEQ ID NO: 562261 - protein, 10 aa, Mycobacterium
RGPLSTEEAT

SEQ ID NO: 562262 - protein, 10 aa, Mycobacterium
RGPLTAEEAT

SEQ ID NO: 562263 - protein, 4 aa, Mycobacterium
RGPM

SEQ ID NO: 562264 - protein, 6 aa, Mycobacterium
RGPNAR

SEQ ID NO: 562265 - protein, 14 aa, Mycobacterium
RGPNDGSADRRAGA

SEQ ID NO: 562266 - protein, 8 aa, Mycobacterium
RGPNDRAG

SEQ ID NO: 562267 - protein, 9 aa, Mycobacterium
RGPNEGSWT

SEQ ID NO: 562268 - protein, 5 aa, Mycobacterium
RGPNG

SEQ ID NO: 562269 - protein, 22 aa, Mycobacterium
RGPNGAGWPQLGQNSQGQNLTP

SEQ ID NO: 562270 - protein, 9 aa, Mycobacterium
RGPNGQDLV

SEQ ID NO: 562271 - protein, 12 aa, Mycobacterium
RGPNGQDLVSND

SEQ ID NO: 562272 - protein, 8 aa, Mycobacterium
RGPNGTLQ

SEQ ID NO: 562273 - protein, 8 aa, Mycobacterium
RGPNTGSR

SEQ ID NO: 562274 - protein, 9 aa, Mycobacterium
RGPPPRARV

SEQ ID NO: 562275 - protein, 4 aa, Mycobacterium
RGPQ

SEQ ID NO: 562276 - protein, 6 aa, Mycobacterium
RGPQAQ

SEQ ID NO: 562277 - protein, 12 aa, Mycobacterium
RGPQFSDEVYPL

SEQ ID NO: 562278 - protein, 7 aa, Mycobacterium
RGPQGNS

SEQ ID NO: 562279 - protein, 7 aa, Mycobacterium
RGPQGQV

SEQ ID NO: 562280 - protein, 8 aa, Mycobacterium
RGPQPDGH

SEQ ID NO: 562281 - protein, 20 aa, Mycobacterium
RGPQQRPSRPRRGNDLETET

SEQ ID NO: 562282 - protein, 5 aa, Mycobacterium
RGPQR

SEQ ID NO: 562283 - protein, 10 aa, Mycobacterium
RGPRAAAATR

SEQ ID NO: 562284 - protein, 5 aa, Mycobacterium
RGPRE

SEQ ID NO: 562285 - protein, 43 aa, Mycobacterium
RGPRERRQQAVRQPQPPGAAQARRSRDADRGRGLPGAKGPGCV

SEQ ID NO: 562286 - protein, 8 aa, Mycobacterium
RGPRGVIG

SEQ ID NO: 562287 - protein, 8 aa, Mycobacterium
RGPRHAGN

SEQ ID NO: 562288 - protein, 14 aa, Mycobacterium
RGPRKSWRPGLFRA

SEQ ID NO: 562289 - protein, 10 aa, Mycobacterium
RGPRLPETHR

SEQ ID NO: 562290 - protein, 13 aa, Mycobacterium
RGPRRADATPPDT

SEQ ID NO: 562291 - protein, 6 aa, Mycobacterium
RGPRRK

SEQ ID NO: 562292 - protein, 9 aa, Mycobacterium
RGPRRRPRR

SEQ ID NO: 562293 - protein, 17 aa, Mycobacterium
RGPRSYVGAEGDPDAAN

SEQ ID NO: 562294 - protein, 10 aa, Mycobacterium
RGPRVARGGR

SEQ ID NO: 562295 - protein, 6 aa, Mycobacterium
RGPRVG

SEQ ID NO: 562296 - protein, 10 aa, Mycobacterium
RGPRVGEPGD

SEQ ID NO: 562297 - protein, 10 aa, Mycobacterium
RGPSATKMTA

SEQ ID NO: 562298 - protein, 19 aa, Mycobacterium
RGPSGVIGSNKKDSQDTVN

SEQ ID NO: 562299 - protein, 18 aa, Mycobacterium
RGPSGVIGTNKKCSQETV

SEQ ID NO: 562300 - protein, 6 aa, Mycobacterium
RGPSIS

SEQ ID NO: 562301 - protein, 6 aa, Mycobacterium
RGPSSA

SEQ ID NO: 562302 - protein, 7 aa, Mycobacterium
RGPSSGF

SEQ ID NO: 562303 - protein, 6 aa, Mycobacterium
RGPSSP

SEQ ID NO: 562304 - protein, 10 aa, Mycobacterium
RGPSSPPRFD

SEQ ID NO: 562305 - protein, 6 aa, Mycobacterium
RGPSSV

SEQ ID NO: 562306 - protein, 4 aa, Mycobacterium
RGPT

SEQ ID NO: 562307 - protein, 10 aa, Mycobacterium
RGPTEGAGAP

SEQ ID NO: 562308 - protein, 6 aa, Mycobacterium
RGPTGE

SEQ ID NO: 562309 - protein, 8 aa, Mycobacterium
RGPTGELQ

SEQ ID NO: 562310 - protein, 10 aa, Mycobacterium
RGPTGSRLTD

SEQ ID NO: 562311 - protein, 14 aa, Mycobacterium
RGPTLRRRGDKQRQ

SEQ ID NO: 562312 - protein, 10 aa, Mycobacterium
RGPTPAQIGD

SEQ ID NO: 562313 - protein, 6 aa, Mycobacterium
RGPTPP

SEQ ID NO: 562314 - protein, 9 aa, Mycobacterium
RGPTRGDDL

SEQ ID NO: 562315 - protein, 9 aa, Mycobacterium
RGPTRGDGL

SEQ ID NO: 562316 - protein, 6 aa, Mycobacterium
RGPTSP

SEQ ID NO: 562317 - protein, 5 aa, Mycobacterium
RGPTV

SEQ ID NO: 562318 - protein, 7 aa, Mycobacterium
RGPVDPL

SEQ ID NO: 562319 - protein, 19 aa, Mycobacterium
RGPVDQQNGGAMAERDDEV

SEQ ID NO: 562320 - protein, 5 aa, Mycobacterium
RGPVE

SEQ ID NO: 562321 - protein, 6 aa, Mycobacterium
RGPVHD

SEQ ID NO: 562322 - protein, 7 aa, Mycobacterium
RGPVHEG

SEQ ID NO: 562323 - protein, 7 aa, Mycobacterium
RGPVHTG

SEQ ID NO: 562324 - protein, 7 aa, Mycobacterium
RGPVPAE

SEQ ID NO: 562325 - protein, 10 aa, Mycobacterium
RGPVRGGPDA

SEQ ID NO: 562326 - protein, 10 aa, Mycobacterium
RGPVRGGPNG

SEQ ID NO: 562327 - protein, 9 aa, Mycobacterium
RGPVTTEPH

SEQ ID NO: 562328 - protein, 4 aa, Mycobacterium
RGPW

SEQ ID NO: 562329 - protein, 7 aa, Mycobacterium
RGPWGQT

SEQ ID NO: 562330 - protein, 5 aa, Mycobacterium
RGPYA

SEQ ID NO: 562331 - protein, 16 aa, Mycobacterium
RGPYDNDLDSSSPPRR

SEQ ID NO: 562332 - protein, 9 aa, Mycobacterium
RGPYETTNR

SEQ ID NO: 562333 - protein, 10 aa, Mycobacterium
RGQAATSEDS

SEQ ID NO: 562334 - protein, 9 aa, Mycobacterium
RGQADEERF

SEQ ID NO: 562335 - protein, 16 aa, Mycobacterium
RGQADGRYRDDIDPAV

SEQ ID NO: 562336 - protein, 14 aa, Mycobacterium
RGQADGRYRSDIDP

SEQ ID NO: 562337 - protein, 7 aa, Mycobacterium
RGQAGAW

SEQ ID NO: 562338 - protein, 6 aa, Mycobacterium
RGQAGD

SEQ ID NO: 562339 - protein, 13 aa, Mycobacterium
RGQAGDGSAEEAL

SEQ ID NO: 562340 - protein, 14 aa, Mycobacterium
RGQAGDRQIPGDPK

SEQ ID NO: 562341 - protein, 9 aa, Mycobacterium
RGQAPEGGW

SEQ ID NO: 562342 - protein, 11 aa, Mycobacterium
RGQAREAAETL

SEQ ID NO: 562343 - protein, 10 aa, Mycobacterium
RGQAVSPSAV

SEQ ID NO: 562344 - protein, 9 aa, Mycobacterium
RGQDASYDV

SEQ ID NO: 562345 - protein, 14 aa, Mycobacterium
RGQDAVEGDRVPGA

SEQ ID NO: 562346 - protein, 7 aa, Mycobacterium
RGQDEGV

SEQ ID NO: 562347 - protein, 5 aa, Mycobacterium
RGQDG

SEQ ID NO: 562348 - protein, 8 aa, Mycobacterium
RGQDNLDR

SEQ ID NO: 562349 - protein, 9 aa, Mycobacterium
RGQDSTAGT

SEQ ID NO: 562350 - protein, 4 aa, Mycobacterium
RGQE

SEQ ID NO: 562351 - protein, 7 aa, Mycobacterium
RGQEAAQ

SEQ ID NO: 562352 - protein, 4 aa, Mycobacterium
RGQG

SEQ ID NO: 562353 - protein, 15 aa, Mycobacterium
RGQGAASEPEPPQTL

SEQ ID NO: 562354 - protein, 5 aa, Mycobacterium
RGQGG

SEQ ID NO: 562355 - protein, 7 aa, Mycobacterium
RGQGGVA

SEQ ID NO: 562356 - protein, 6 aa, Mycobacterium
RGQGHT

SEQ ID NO: 562357 - protein, 6 aa, Mycobacterium
RGQGKT

SEQ ID NO: 562358 - protein, 6 aa, Mycobacterium
RGQGLG

SEQ ID NO: 562359 - protein, 8 aa, Mycobacterium
RGQGNEEA

SEQ ID NO: 562360 - protein, 6 aa, Mycobacterium
RGQGRS

SEQ ID NO: 562361 - protein, 19 aa, Mycobacterium
RGQHDLATKQRHRAWPKIC

SEQ ID NO: 562362 - protein, 10 aa, Mycobacterium
RGQHRTNTYH

SEQ ID NO: 562363 - protein, 12 aa, Mycobacterium
RGQIDGRVVIDY

SEQ ID NO: 562364 - protein, 8 aa, Mycobacterium
RGQIGDAD

SEQ ID NO: 562365 - protein, 16 aa, Mycobacterium
RGQIGSPDEAPADAAA

SEQ ID NO: 562366 - protein, 9 aa, Mycobacterium
RGQISSAPN

SEQ ID NO: 562367 - protein, 8 aa, Mycobacterium
RGQKPHGL

SEQ ID NO: 562368 - protein, 4 aa, Mycobacterium
RGQL

SEQ ID NO: 562369 - protein, 5 aa, Mycobacterium
RGQLP

SEQ ID NO: 562370 - protein, 10 aa, Mycobacterium
RGQNSGIEPE

SEQ ID NO: 562371 - protein, 6 aa, Mycobacterium
RGQPAL

SEQ ID NO: 562372 - protein, 25 aa, Mycobacterium
RGQPAPPVVPRPSATAGSGGTDLER

SEQ ID NO: 562373 - protein, 8 aa, Mycobacterium
RGQPARAA

SEQ ID NO: 562374 - protein, 7 aa, Mycobacterium
RGQPGEL

SEQ ID NO: 562375 - protein, 7 aa, Mycobacterium
RGQPLRE

SEQ ID NO: 562376 - protein, 9 aa, Mycobacterium
RGQPPGPLA

SEQ ID NO: 562377 - protein, 7 aa, Mycobacterium
RGQPRAE

SEQ ID NO: 562378 - protein, 13 aa, Mycobacterium
RGQPRVGQRGANH

SEQ ID NO: 562379 - protein, 4 aa, Mycobacterium
RGQQ

SEQ ID NO: 562380 - protein, 17 aa, Mycobacterium
RGQQDGGIQGHPLPQTE

SEQ ID NO: 562381 - protein, 12 aa, Mycobacterium
RGQRGADGPSYE

SEQ ID NO: 562382 - protein, 10 aa, Mycobacterium
RGQRGGRPRI

SEQ ID NO: 562383 - protein, 7 aa, Mycobacterium
RGQRKGL

SEQ ID NO: 562384 - protein, 9 aa, Mycobacterium
RGQRNEAEF

SEQ ID NO: 562385 - protein, 6 aa, Mycobacterium
RGQRPV

SEQ ID NO: 562386 - protein, 24 aa, Mycobacterium
RGQRRAAHPQGRRRQRHRRHGTDR

SEQ ID NO: 562387 - protein, 8 aa, Mycobacterium
RGQRRATF

SEQ ID NO: 562388 - protein, 6 aa, Mycobacterium
RGQRRT

SEQ ID NO: 562389 - protein, 7 aa, Mycobacterium
RGQRSDT

SEQ ID NO: 562390 - protein, 11 aa, Mycobacterium
RGQRSGRYRPD

SEQ ID NO: 562391 - protein, 27 aa, Mycobacterium
RGQRTGSEHHRGDPVAQGLRQGRTPED

SEQ ID NO: 562392 - protein, 5 aa, Mycobacterium
RGQRV

SEQ ID NO: 562393 - protein, 6 aa, Mycobacterium
RGQSAG

SEQ ID NO: 562394 - protein, 43 aa, Mycobacterium
RGQSKNAKTPARGGAGPKASRRAEQPAAAAHAAASRPDPRDPT

SEQ ID NO: 562395 - protein, 6 aa, Mycobacterium
RGQSLD

SEQ ID NO: 562396 - protein, 6 aa, Mycobacterium
RGQSVE

SEQ ID NO: 562397 - protein, 11 aa, Mycobacterium
RGQTRAESRRA

SEQ ID NO: 562398 - protein, 16 aa, Mycobacterium
RGQTRNQQWDPPEGRD

SEQ ID NO: 562399 - protein, 27 aa, Mycobacterium
RGQTSVTTVGPDGQARQALRAGEGATT

SEQ ID NO: 562400 - protein, 8 aa, Mycobacterium
RGQTVRNG

SEQ ID NO: 562401 - protein, 10 aa, Mycobacterium
RGQVSGPAPA

SEQ ID NO: 562402 - protein, 12 aa, Mycobacterium
RGRAAESVKQRV

SEQ ID NO: 562403 - protein, 6 aa, Mycobacterium
RGRAAK

SEQ ID NO: 562404 - protein, 8 aa, Mycobacterium
RGRAATSP

SEQ ID NO: 562405 - protein, 7 aa, Mycobacterium
RGRADDE

SEQ ID NO: 562406 - protein, 10 aa, Mycobacterium
RGRADDTEDI

SEQ ID NO: 562407 - protein, 9 aa, Mycobacterium
RGRAEADHT

SEQ ID NO: 562408 - protein, 10 aa, Mycobacterium
RGRAEANDKT

SEQ ID NO: 562409 - protein, 10 aa, Mycobacterium
RGRAFGPGEL

SEQ ID NO: 562410 - protein, 6 aa, Mycobacterium
RGRAGA

SEQ ID NO: 562411 - protein, 7 aa, Mycobacterium
RGRAGHG

SEQ ID NO: 562412 - protein, 8 aa, Mycobacterium
RGRAGHGS

SEQ ID NO: 562413 - protein, 7 aa, Mycobacterium
RGRAGVA

SEQ ID NO: 562414 - protein, 8 aa, Mycobacterium
RGRAIGSD

SEQ ID NO: 562415 - protein, 12 aa, Mycobacterium
RGRALGPVRAVG

SEQ ID NO: 562416 - protein, 7 aa, Mycobacterium
RGRANEL

SEQ ID NO: 562417 - protein, 5 aa, Mycobacterium
RGRAR

SEQ ID NO: 562418 - protein, 13 aa, Mycobacterium
RGRARAVGDPTTL

SEQ ID NO: 562419 - protein, 6 aa, Mycobacterium
RGRARD

SEQ ID NO: 562420 - protein, 6 aa, Mycobacterium
RGRART

SEQ ID NO: 562421 - protein, 7 aa, Mycobacterium
RGRARTL

SEQ ID NO: 562422 - protein, 5 aa, Mycobacterium
RGRAS

SEQ ID NO: 562423 - protein, 5 aa, Mycobacterium
RGRDA

SEQ ID NO: 562424 - protein, 9 aa, Mycobacterium
RGRDAQQAR

SEQ ID NO: 562425 - protein, 6 aa, Mycobacterium
RGRDAR

SEQ ID NO: 562426 - protein, 11 aa, Mycobacterium
RGRDDTGRDAE

SEQ ID NO: 562427 - protein, 6 aa, Mycobacterium
RGRDEG

SEQ ID NO: 562428 - protein, 8 aa, Mycobacterium
RGRDEGGT

SEQ ID NO: 562429 - protein, 26 aa, Mycobacterium
RGRDGDDTQREPREAVADRDAPEDVE

SEQ ID NO: 562430 - protein, 26 aa, Mycobacterium
RGRDGRKLSEEWGDSPRAYRGGTVPG

SEQ ID NO: 562431 - protein, 11 aa, Mycobacterium
RGRDNDVPGRE

SEQ ID NO: 562432 - protein, 16 aa, Mycobacterium
RGRDPRGAGRGAGRHR

SEQ ID NO: 562433 - protein, 4 aa, Mycobacterium
RGRE

SEQ ID NO: 562434 - protein, 5 aa, Mycobacterium
RGREA

SEQ ID NO: 562435 - protein, 6 aa, Mycobacterium
RGREDG

SEQ ID NO: 562436 - protein, 7 aa, Mycobacterium
RGREGDL

SEQ ID NO: 562437 - protein, 12 aa, Mycobacterium
RGREGGGPPTAF

SEQ ID NO: 562438 - protein, 7 aa, Mycobacterium
RGREGNL

SEQ ID NO: 562439 - protein, 13 aa, Mycobacterium
RGREGPAEAPASF

SEQ ID NO: 562440 - protein, 7 aa, Mycobacterium
RGREGRA

SEQ ID NO: 562441 - protein, 11 aa, Mycobacterium
RGREKEHEEFR

SEQ ID NO: 562442 - protein, 13 aa, Mycobacterium
RGRELSQPPARFG

SEQ ID NO: 562443 - protein, 7 aa, Mycobacterium
RGRENRS

SEQ ID NO: 562444 - protein, 11 aa, Mycobacterium
RGREQPTVAAP

SEQ ID NO: 562445 - protein, 9 aa, Mycobacterium
RGREQSPRG

SEQ ID NO: 562446 - protein, 9 aa, Mycobacterium
RGREREIDT

SEQ ID NO: 562447 - protein, 12 aa, Mycobacterium
RGRERPTVAAPR

SEQ ID NO: 562448 - protein, 11 aa, Mycobacterium
RGRESGGGATA

SEQ ID NO: 562449 - protein, 6 aa, Mycobacterium
RGRETN

SEQ ID NO: 562450 - protein, 6 aa, Mycobacterium
RGRFPG

SEQ ID NO: 562451 - protein, 11 aa, Mycobacterium
RGRGAESAAPL

SEQ ID NO: 562452 - protein, 8 aa, Mycobacterium
RGRGAGSA

SEQ ID NO: 562453 - protein, 11 aa, Mycobacterium
RGRGGAAVEDG

SEQ ID NO: 562454 - protein, 7 aa, Mycobacterium
RGRGGAG

SEQ ID NO: 562455 - protein, 6 aa, Mycobacterium
RGRGGF

SEQ ID NO: 562456 - protein, 7 aa, Mycobacterium
RGRGGGF

SEQ ID NO: 562457 - protein, 6 aa, Mycobacterium
RGRGGM

SEQ ID NO: 562458 - protein, 12 aa, Mycobacterium
RGRGGPNRRGRK

SEQ ID NO: 562459 - protein, 17 aa, Mycobacterium
RGRGGREVCGSRGAIRS

SEQ ID NO: 562460 - protein, 6 aa, Mycobacterium
RGRGHD

SEQ ID NO: 562461 - protein, 7 aa, Mycobacterium
RGRGHGD

SEQ ID NO: 562462 - protein, 10 aa, Mycobacterium
RGRGIPPERL

SEQ ID NO: 562463 - protein, 8 aa, Mycobacterium
RGRGIPRE

SEQ ID NO: 562464 - protein, 5 aa, Mycobacterium
RGRGP

SEQ ID NO: 562465 - protein, 5 aa, Mycobacterium
RGRGQ

SEQ ID NO: 562466 - protein, 11 aa, Mycobacterium
RGRGQAHDDPA

SEQ ID NO: 562467 - protein, 8 aa, Mycobacterium
RGRGQATV

SEQ ID NO: 562468 - protein, 8 aa, Mycobacterium
RGRGQSHD

SEQ ID NO: 562469 - protein, 16 aa, Mycobacterium
RGRGRIRKTRTTVNQR

SEQ ID NO: 562470 - protein, 6 aa, Mycobacterium
RGRGRR

SEQ ID NO: 562471 - protein, 10 aa, Mycobacterium
RGRGSQEVQS

SEQ ID NO: 562472 - protein, 10 aa, Mycobacterium
RGRGSTRPDG

SEQ ID NO: 562473 - protein, 5 aa, Mycobacterium
RGRGT

SEQ ID NO: 562474 - protein, 13 aa, Mycobacterium
RGRGVGSEFREGT

SEQ ID NO: 562475 - protein, 5 aa, Mycobacterium
RGRHD

SEQ ID NO: 562476 - protein, 7 aa, Mycobacterium
RGRHDRT

SEQ ID NO: 562477 - protein, 7 aa, Mycobacterium
RGRHPAG

SEQ ID NO: 562478 - protein, 6 aa, Mycobacterium
RGRHRE

SEQ ID NO: 562479 - protein, 6 aa, Mycobacterium
RGRHTN

SEQ ID NO: 562480 - protein, 23 aa, Mycobacterium
RGRIDKSTAELADERSAVTELKL

SEQ ID NO: 562481 - protein, 8 aa, Mycobacterium
RGRKDEAI

SEQ ID NO: 562482 - protein, 7 aa, Mycobacterium
RGRKSFS

SEQ ID NO: 562483 - protein, 10 aa, Mycobacterium
RGRKSGKQRA

SEQ ID NO: 562484 - protein, 10 aa, Mycobacterium
RGRKSGRAYE

SEQ ID NO: 562485 - protein, 15 aa, Mycobacterium
RGRKTVNIVAAGQAT

SEQ ID NO: 562486 - protein, 15 aa, Mycobacterium
RGRKTVSIVAAGQTT

SEQ ID NO: 562487 - protein, 7 aa, Mycobacterium
RGRLADG

SEQ ID NO: 562488 - protein, 7 aa, Mycobacterium
RGRLDSW

SEQ ID NO: 562489 - protein, 5 aa, Mycobacterium
RGRLG

SEQ ID NO: 562490 - protein, 5 aa, Mycobacterium
RGRLP

SEQ ID NO: 562491 - protein, 18 aa, Mycobacterium
RGRLPGDDGTSAAEKDGF

SEQ ID NO: 562492 - protein, 5 aa, Mycobacterium
RGRMA

SEQ ID NO: 562493 - protein, 6 aa, Mycobacterium
RGRMAG

SEQ ID NO: 562494 - protein, 5 aa, Mycobacterium
RGRMD

SEQ ID NO: 562495 - protein, 6 aa, Mycobacterium
RGRMDK

SEQ ID NO: 562496 - protein, 5 aa, Mycobacterium
RGRNA

SEQ ID NO: 562497 - protein, 5 aa, Mycobacterium
RGRNG

SEQ ID NO: 562498 - protein, 8 aa, Mycobacterium
RGRNQDDL

SEQ ID NO: 562499 - protein, 8 aa, Mycobacterium
RGRNQDEI

SEQ ID NO: 562500 - protein, 9 aa, Mycobacterium
RGRNVPPER

SEQ ID NO: 562501 - protein, 10 aa, Mycobacterium
RGRNVPPERL

SEQ ID NO: 562502 - protein, 11 aa, Mycobacterium
RGRPAEGLETP

SEQ ID NO: 562503 - protein, 27 aa, Mycobacterium
RGRPAGPRIPGAGRPAEMTPPPFTGPG

SEQ ID NO: 562504 - protein, 14 aa, Mycobacterium
RGRPATGPNSKSDI

SEQ ID NO: 562505 - protein, 12 aa, Mycobacterium
RGRPDQPPIQAG

SEQ ID NO: 562506 - protein, 8 aa, Mycobacterium
RGRPDTQI

SEQ ID NO: 562507 - protein, 7 aa, Mycobacterium
RGRPEER

SEQ ID NO: 562508 - protein, 7 aa, Mycobacterium
RGRPEQR

SEQ ID NO: 562509 - protein, 9 aa, Mycobacterium
RGRPEQRIP

SEQ ID NO: 562510 - protein, 6 aa, Mycobacterium
RGRPGK

SEQ ID NO: 562511 - protein, 15 aa, Mycobacterium
RGRPGPRAASGWWRR

SEQ ID NO: 562512 - protein, 9 aa, Mycobacterium
RGRPGTPAA

SEQ ID NO: 562513 - protein, 12 aa, Mycobacterium
RGRPKSEAVEGT

SEQ ID NO: 562514 - protein, 5 aa, Mycobacterium
RGRPL

SEQ ID NO: 562515 - protein, 8 aa, Mycobacterium
RGRPPDAD

SEQ ID NO: 562516 - protein, 12 aa, Mycobacterium
RGRPRDEPVAKR

SEQ ID NO: 562517 - protein, 10 aa, Mycobacterium
RGRPSGPVVA

SEQ ID NO: 562518 - protein, 9 aa, Mycobacterium
RGRPSKAIS

SEQ ID NO: 562519 - protein, 7 aa, Mycobacterium
RGRPTVP

SEQ ID NO: 562520 - protein, 6 aa, Mycobacterium
RGRPVA

SEQ ID NO: 562521 - protein, 10 aa, Mycobacterium
RGRPVSPSTV

SEQ ID NO: 562522 - protein, 11 aa, Mycobacterium
RGRPYGQPRNT

SEQ ID NO: 562523 - protein, 6 aa, Mycobacterium
RGRQAA

SEQ ID NO: 562524 - protein, 6 aa, Mycobacterium
RGRQLT

SEQ ID NO: 562525 - protein, 5 aa, Mycobacterium
RGRQR

SEQ ID NO: 562526 - protein, 7 aa, Mycobacterium
RGRQTDL

SEQ ID NO: 562527 - protein, 15 aa, Mycobacterium
RGRRAGRKRSGSAEL

SEQ ID NO: 562528 - protein, 5 aa, Mycobacterium
RGRRD

SEQ ID NO: 562529 - protein, 11 aa, Mycobacterium
RGRRGDDVASE

SEQ ID NO: 562530 - protein, 13 aa, Mycobacterium
RGRRGDFAGPKGK

SEQ ID NO: 562531 - protein, 7 aa, Mycobacterium
RGRRGIK

SEQ ID NO: 562532 - protein, 7 aa, Mycobacterium
RGRRGLE

SEQ ID NO: 562533 - protein, 7 aa, Mycobacterium
RGRRGQE

SEQ ID NO: 562534 - protein, 12 aa, Mycobacterium
RGRRGRTDREQQ

SEQ ID NO: 562535 - protein, 7 aa, Mycobacterium
RGRRHRD

SEQ ID NO: 562536 - protein, 16 aa, Mycobacterium
RGRRLGGRGSPMGRPA

SEQ ID NO: 562537 - protein, 30 aa, Mycobacterium
RGRRPASPPGRTIATTRSPQLGRQRPVGSV

SEQ ID NO: 562538 - protein, 11 aa, Mycobacterium
RGRRPDNYPQP

SEQ ID NO: 562539 - protein, 21 aa, Mycobacterium
RGRRRGKRVPEVRDSGTNDLA

SEQ ID NO: 562540 - protein, 6 aa, Mycobacterium
RGRRSE

SEQ ID NO: 562541 - protein, 8 aa, Mycobacterium
RGRRSGKL

SEQ ID NO: 562542 - protein, 14 aa, Mycobacterium
RGRRTARPSGDDRE

SEQ ID NO: 562543 - protein, 14 aa, Mycobacterium
RGRRTDAKVVEGDP

SEQ ID NO: 562544 - protein, 9 aa, Mycobacterium
RGRRVGTQD

SEQ ID NO: 562545 - protein, 19 aa, Mycobacterium
RGRSEGSAIASDAPGDGPL

SEQ ID NO: 562546 - protein, 9 aa, Mycobacterium
RGRSEHTRR

SEQ ID NO: 562547 - protein, 7 aa, Mycobacterium
RGRSHAE

SEQ ID NO: 562548 - protein, 6 aa, Mycobacterium
RGRSLT

SEQ ID NO: 562549 - protein, 23 aa, Mycobacterium
RGRSSTCAGRTGMSRNSDWPVTL

SEQ ID NO: 562550 - protein, 8 aa, Mycobacterium
RGRSTGRL

SEQ ID NO: 562551 - protein, 7 aa, Mycobacterium
RGRSTMN

SEQ ID NO: 562552 - protein, 5 aa, Mycobacterium
RGRSV

SEQ ID NO: 562553 - protein, 13 aa, Mycobacterium
RGRSVGPSARVVG

SEQ ID NO: 562554 - protein, 6 aa, Mycobacterium
RGRSYR

SEQ ID NO: 562555 - protein, 4 aa, Mycobacterium
RGRT

SEQ ID NO: 562556 - protein, 12 aa, Mycobacterium
RGRTASRPADLA

SEQ ID NO: 562557 - protein, 10 aa, Mycobacterium
RGRTDAPADG

SEQ ID NO: 562558 - protein, 7 aa, Mycobacterium
RGRTEET

SEQ ID NO: 562559 - protein, 7 aa, Mycobacterium
RGRTENH

SEQ ID NO: 562560 - protein, 9 aa, Mycobacterium
RGRTGRGQH

SEQ ID NO: 562561 - protein, 9 aa, Mycobacterium
RGRTNELNR

SEQ ID NO: 562562 - protein, 6 aa, Mycobacterium
RGRTPR

SEQ ID NO: 562563 - protein, 6 aa, Mycobacterium
RGRTRE

SEQ ID NO: 562564 - protein, 9 aa, Mycobacterium
RGRTRGDDL

SEQ ID NO: 562565 - protein, 8 aa, Mycobacterium
RGRTRPEH

SEQ ID NO: 562566 - protein, 12 aa, Mycobacterium
RGRTSGALRDRN

SEQ ID NO: 562567 - protein, 8 aa, Mycobacterium
RGRTSGKM

SEQ ID NO: 562568 - protein, 9 aa, Mycobacterium
RGRTSGRDY

SEQ ID NO: 562569 - protein, 14 aa, Mycobacterium
RGRTTAGGKHYPVP

SEQ ID NO: 562570 - protein, 4 aa, Mycobacterium
RGRV

SEQ ID NO: 562571 - protein, 5 aa, Mycobacterium
RGRVA

SEQ ID NO: 562572 - protein, 21 aa, Mycobacterium
RGRVAARRRADQRAESARQHP

SEQ ID NO: 562573 - protein, 22 aa, Mycobacterium
RGRVAARRRAGQRADASREHPS

SEQ ID NO: 562574 - protein, 9 aa, Mycobacterium
RGRVDNDAT

SEQ ID NO: 562575 - protein, 10 aa, Mycobacterium
RGRVDNDATL

SEQ ID NO: 562576 - protein, 10 aa, Mycobacterium
RGRVEPAPRR

SEQ ID NO: 562577 - protein, 9 aa, Mycobacterium
RGRVPEHGE

SEQ ID NO: 562578 - protein, 5 aa, Mycobacterium
RGRVR

SEQ ID NO: 562579 - protein, 5 aa, Mycobacterium
RGRVT

SEQ ID NO: 562580 - protein, 7 aa, Mycobacterium
RGRVTDE

SEQ ID NO: 562581 - protein, 9 aa, Mycobacterium
RGRVTESMT

SEQ ID NO: 562582 - protein, 13 aa, Mycobacterium
RGRYDAGPDALRQ

SEQ ID NO: 562583 - protein, 14 aa, Mycobacterium
RGRYGPAEIPRGTE

SEQ ID NO: 562584 - protein, 15 aa, Mycobacterium
RGRYGPGERLPRGTE

SEQ ID NO: 562585 - protein, 4 aa, Mycobacterium
RGSA

SEQ ID NO: 562586 - protein, 6 aa, Mycobacterium
RGSAAA

SEQ ID NO: 562587 - protein, 10 aa, Mycobacterium
RGSAERVAPI

SEQ ID NO: 562588 - protein, 10 aa, Mycobacterium
RGSAGPTADE

SEQ ID NO: 562589 - protein, 9 aa, Mycobacterium
RGSAGTTNL

SEQ ID NO: 562590 - protein, 9 aa, Mycobacterium
RGSAITESQ

SEQ ID NO: 562591 - protein, 11 aa, Mycobacterium
RGSAKAEDARQ

SEQ ID NO: 562592 - protein, 5 aa, Mycobacterium
RGSAL

SEQ ID NO: 562593 - protein, 9 aa, Mycobacterium
RGSAPDGPG

SEQ ID NO: 562594 - protein, 9 aa, Mycobacterium
RGSAPTRGA

SEQ ID NO: 562595 - protein, 6 aa, Mycobacterium
RGSATG

SEQ ID NO: 562596 - protein, 13 aa, Mycobacterium
RGSAVTTGERVSA

SEQ ID NO: 562597 - protein, 6 aa, Mycobacterium
RGSDAV

SEQ ID NO: 562598 - protein, 6 aa, Mycobacterium
RGSDEG

SEQ ID NO: 562599 - protein, 10 aa, Mycobacterium
RGSDENAPAV

SEQ ID NO: 562600 - protein, 6 aa, Mycobacterium
RGSDGK

SEQ ID NO: 562601 - protein, 7 aa, Mycobacterium
RGSDGQW

SEQ ID NO: 562602 - protein, 8 aa, Mycobacterium
RGSDGQWR

SEQ ID NO: 562603 - protein, 8 aa, Mycobacterium
RGSDGRYA

SEQ ID NO: 562604 - protein, 10 aa, Mycobacterium
RGSDLQPRET

SEQ ID NO: 562605 - protein, 9 aa, Mycobacterium
RGSDPDSGA

SEQ ID NO: 562606 - protein, 24 aa, Mycobacterium
RGSDRGAVDAARRAADAAHSAGQY

SEQ ID NO: 562607 - protein, 15 aa, Mycobacterium
RGSDSEETASGDGVL

SEQ ID NO: 562608 - protein, 7 aa, Mycobacterium
RGSDSTA

SEQ ID NO: 562609 - protein, 7 aa, Mycobacterium
RGSDTAS

SEQ ID NO: 562610 - protein, 4 aa, Mycobacterium
RGSE

SEQ ID NO: 562611 - protein, 12 aa, Mycobacterium
RGSEDEPGDVPP

SEQ ID NO: 562612 - protein, 22 aa, Mycobacterium
RGSEGDPIASHSQAAAVARTAN

SEQ ID NO: 562613 - protein, 12 aa, Mycobacterium
RGSEGGGHGETK

SEQ ID NO: 562614 - protein, 21 aa, Mycobacterium
RGSEGLRQAGQDAQRSPAAVA

SEQ ID NO: 562615 - protein, 13 aa, Mycobacterium
RGSELQSDGTNLA

SEQ ID NO: 562616 - protein, 6 aa, Mycobacterium
RGSERR

SEQ ID NO: 562617 - protein, 5 aa, Mycobacterium
RGSFS

SEQ ID NO: 562618 - protein, 10 aa, Mycobacterium
RGSGAGATAD

SEQ ID NO: 562619 - protein, 8 aa, Mycobacterium
RGSGAQPY

SEQ ID NO: 562620 - protein, 10 aa, Mycobacterium
RGSGARSVSD

SEQ ID NO: 562621 - protein, 6 aa, Mycobacterium
RGSGAW

SEQ ID NO: 562622 - protein, 8 aa, Mycobacterium
RGSGDMKA

SEQ ID NO: 562623 - protein, 7 aa, Mycobacterium
RGSGDRL

SEQ ID NO: 562624 - protein, 11 aa, Mycobacterium
RGSGDTSGYGG

SEQ ID NO: 562625 - protein, 5 aa, Mycobacterium
RGSGE

SEQ ID NO: 562626 - protein, 6 aa, Mycobacterium
RGSGED

SEQ ID NO: 562627 - protein, 8 aa, Mycobacterium
RGSGERPY

SEQ ID NO: 562628 - protein, 15 aa, Mycobacterium
RGSGESSCPASRSGY

SEQ ID NO: 562629 - protein, 12 aa, Mycobacterium
RGSGFDADSPTA

SEQ ID NO: 562630 - protein, 7 aa, Mycobacterium
RGSGGFG

SEQ ID NO: 562631 - protein, 8 aa, Mycobacterium
RGSGGPFR

SEQ ID NO: 562632 - protein, 5 aa, Mycobacterium
RGSGL

SEQ ID NO: 562633 - protein, 6 aa, Mycobacterium
RGSGMD

SEQ ID NO: 562634 - protein, 7 aa, Mycobacterium
RGSGMPD

SEQ ID NO: 562635 - protein, 7 aa, Mycobacterium
RGSGPFA

SEQ ID NO: 562636 - protein, 8 aa, Mycobacterium
RGSGPRSI

SEQ ID NO: 562637 - protein, 9 aa, Mycobacterium
RGSGPSGRD

SEQ ID NO: 562638 - protein, 5 aa, Mycobacterium
RGSGQ

SEQ ID NO: 562639 - protein, 6 aa, Mycobacterium
RGSGQW

SEQ ID NO: 562640 - protein, 9 aa, Mycobacterium
RGSGRDAAN

SEQ ID NO: 562641 - protein, 17 aa, Mycobacterium
RGSGRPPFPPAGLPHDR

SEQ ID NO: 562642 - protein, 8 aa, Mycobacterium
RGSGSAGK

SEQ ID NO: 562643 - protein, 9 aa, Mycobacterium
RGSGTGPWG

SEQ ID NO: 562644 - protein, 13 aa, Mycobacterium
RGSGVDRADPRVS

SEQ ID NO: 562645 - protein, 6 aa, Mycobacterium
RGSGVR

SEQ ID NO: 562646 - protein, 14 aa, Mycobacterium
RGSHEEVGSRAAGL

SEQ ID NO: 562647 - protein, 11 aa, Mycobacterium
RGSHGSMPQAS

SEQ ID NO: 562648 - protein, 5 aa, Mycobacterium
RGSHV

SEQ ID NO: 562649 - protein, 12 aa, Mycobacterium
RGSIDWSDPNDE

SEQ ID NO: 562650 - protein, 10 aa, Mycobacterium
RGSIGPDGIG

SEQ ID NO: 562651 - protein, 5 aa, Mycobacterium
RGSKG

SEQ ID NO: 562652 - protein, 5 aa, Mycobacterium
RGSKN

SEQ ID NO: 562653 - protein, 34 aa, Mycobacterium
RGSKTARTRVGRGEGSKGKSAGRGTKGTKARKQV

SEQ ID NO: 562654 - protein, 39 aa, Mycobacterium
RGSKTARTRVGRGEGSKGKTAGRGTKGTKARKNVPATFE

SEQ ID NO: 562655 - protein, 13 aa, Mycobacterium
RGSLGAGPLTAPV

SEQ ID NO: 562656 - protein, 6 aa, Mycobacterium
RGSLPA

SEQ ID NO: 562657 - protein, 7 aa, Mycobacterium
RGSLPAD

SEQ ID NO: 562658 - protein, 8 aa, Mycobacterium
RGSLPGKG

SEQ ID NO: 562659 - protein, 7 aa, Mycobacterium
RGSLPPR

SEQ ID NO: 562660 - protein, 19 aa, Mycobacterium
RGSLRSNASLTATPGNSGV

SEQ ID NO: 562661 - protein, 5 aa, Mycobacterium
RGSLS

SEQ ID NO: 562662 - protein, 7 aa, Mycobacterium
RGSLSGT

SEQ ID NO: 562663 - protein, 19 aa, Mycobacterium
RGSLSVRDAQDGVAGAPAG

SEQ ID NO: 562664 - protein, 8 aa, Mycobacterium
RGSLTATT

SEQ ID NO: 562665 - protein, 5 aa, Mycobacterium
RGSMP

SEQ ID NO: 562666 - protein, 6 aa, Mycobacterium
RGSMPG

SEQ ID NO: 562667 - protein, 6 aa, Mycobacterium
RGSNAR

SEQ ID NO: 562668 - protein, 9 aa, Mycobacterium
RGSNDPAMA

SEQ ID NO: 562669 - protein, 14 aa, Mycobacterium
RGSNENTNGPLRDS

SEQ ID NO: 562670 - protein, 7 aa, Mycobacterium
RGSNGGD

SEQ ID NO: 562671 - protein, 4 aa, Mycobacterium
RGSP

SEQ ID NO: 562672 - protein, 7 aa, Mycobacterium
RGSPADF

SEQ ID NO: 562673 - protein, 14 aa, Mycobacterium
RGSPRLPPRSRDAH

SEQ ID NO: 562674 - protein, 14 aa, Mycobacterium
RGSPRMPPRPRDAH

SEQ ID NO: 562675 - protein, 5 aa, Mycobacterium
RGSPV

SEQ ID NO: 562676 - protein, 10 aa, Mycobacterium
RGSPVALGGT

SEQ ID NO: 562677 - protein, 6 aa, Mycobacterium
RGSPVG

SEQ ID NO: 562678 - protein, 15 aa, Mycobacterium
RGSRDSVELTPQEDA

SEQ ID NO: 562679 - protein, 6 aa, Mycobacterium
RGSRDV

SEQ ID NO: 562680 - protein, 10 aa, Mycobacterium
RGSRGDEDIE

SEQ ID NO: 562681 - protein, 6 aa, Mycobacterium
RGSRGP

SEQ ID NO: 562682 - protein, 6 aa, Mycobacterium
RGSRLG

SEQ ID NO: 562683 - protein, 5 aa, Mycobacterium
RGSRP

SEQ ID NO: 562684 - protein, 18 aa, Mycobacterium
RGSRPARMNSRTNSGDYR

SEQ ID NO: 562685 - protein, 7 aa, Mycobacterium
RGSRTPD

SEQ ID NO: 562686 - protein, 8 aa, Mycobacterium
RGSRTPDR

SEQ ID NO: 562687 - protein, 4 aa, Mycobacterium
RGSS

SEQ ID NO: 562688 - protein, 8 aa, Mycobacterium
RGSSEGAL

SEQ ID NO: 562689 - protein, 8 aa, Mycobacterium
RGSSGERE

SEQ ID NO: 562690 - protein, 12 aa, Mycobacterium
RGSSSAARSNEA

SEQ ID NO: 562691 - protein, 12 aa, Mycobacterium
RGSSSAARSNQA

SEQ ID NO: 562692 - protein, 5 aa, Mycobacterium
RGSSV

SEQ ID NO: 562693 - protein, 24 aa, Mycobacterium
RGSSVSSSPIKGTLPRHADPAGLR

SEQ ID NO: 562694 - protein, 7 aa, Mycobacterium
RGSTKLS

SEQ ID NO: 562695 - protein, 9 aa, Mycobacterium
RGSTPGLTP

SEQ ID NO: 562696 - protein, 6 aa, Mycobacterium
RGSTPP

SEQ ID NO: 562697 - protein, 5 aa, Mycobacterium
RGSTR

SEQ ID NO: 562698 - protein, 9 aa, Mycobacterium
RGSTRGDDL

SEQ ID NO: 562699 - protein, 6 aa, Mycobacterium
RGSTSA

SEQ ID NO: 562700 - protein, 6 aa, Mycobacterium
RGSTSY

SEQ ID NO: 562701 - protein, 5 aa, Mycobacterium
RGSTV

SEQ ID NO: 562702 - protein, 5 aa, Mycobacterium
RGSTW

SEQ ID NO: 562703 - protein, 7 aa, Mycobacterium
RGSVATT

SEQ ID NO: 562704 - protein, 13 aa, Mycobacterium
RGSVDPRAGQDSQ

SEQ ID NO: 562705 - protein, 11 aa, Mycobacterium
RGSVGAAGHPI

SEQ ID NO: 562706 - protein, 8 aa, Mycobacterium
RGSVGPVG

SEQ ID NO: 562707 - protein, 12 aa, Mycobacterium
RGSVGRANPGTQ

SEQ ID NO: 562708 - protein, 7 aa, Mycobacterium
RGSVPAS

SEQ ID NO: 562709 - protein, 11 aa, Mycobacterium
RGSVPASTQLA

SEQ ID NO: 562710 - protein, 7 aa, Mycobacterium
RGSVSGT

SEQ ID NO: 562711 - protein, 5 aa, Mycobacterium
RGSVT

SEQ ID NO: 562712 - protein, 5 aa, Mycobacterium
RGSVV

SEQ ID NO: 562713 - protein, 10 aa, Mycobacterium
RGSWGPDAAQ

SEQ ID NO: 562714 - protein, 20 aa, Mycobacterium
RGSWRKPSSRLTTDPRASRG

SEQ ID NO: 562715 - protein, 7 aa, Mycobacterium
RGSWTPG

SEQ ID NO: 562716 - protein, 5 aa, Mycobacterium
RGSYD

SEQ ID NO: 562717 - protein, 5 aa, Mycobacterium
RGSYL

SEQ ID NO: 562718 - protein, 4 aa, Mycobacterium
RGTA

SEQ ID NO: 562719 - protein, 5 aa, Mycobacterium
RGTAA

SEQ ID NO: 562720 - protein, 9 aa, Mycobacterium
RGTAAHADA

SEQ ID NO: 562721 - protein, 8 aa, Mycobacterium
RGTAATAG

SEQ ID NO: 562722 - protein, 5 aa, Mycobacterium
RGTAD

SEQ ID NO: 562723 - protein, 8 aa, Mycobacterium
RGTADNAG

SEQ ID NO: 562724 - protein, 9 aa, Mycobacterium
RGTAEDLTS

SEQ ID NO: 562725 - protein, 7 aa, Mycobacterium
RGTAEHA

SEQ ID NO: 562726 - protein, 6 aa, Mycobacterium
RGTAEY

SEQ ID NO: 562727 - protein, 8 aa, Mycobacterium
RGTAGAAH

SEQ ID NO: 562728 - protein, 7 aa, Mycobacterium
RGTAGER

SEQ ID NO: 562729 - protein, 15 aa, Mycobacterium
RGTAGERQVPGNPRV

SEQ ID NO: 562730 - protein, 10 aa, Mycobacterium
RGTAGTGGYG

SEQ ID NO: 562731 - protein, 7 aa, Mycobacterium
RGTAIGP

SEQ ID NO: 562732 - protein, 9 aa, Mycobacterium
RGTAITESQ

SEQ ID NO: 562733 - protein, 11 aa, Mycobacterium
RGTAKAEDARR

SEQ ID NO: 562734 - protein, 5 aa, Mycobacterium
RGTAL

SEQ ID NO: 562735 - protein, 7 aa, Mycobacterium
RGTANKH

SEQ ID NO: 562736 - protein, 8 aa, Mycobacterium
RGTAPDIE

SEQ ID NO: 562737 - protein, 8 aa, Mycobacterium
RGTAPSGR

SEQ ID NO: 562738 - protein, 7 aa, Mycobacterium
RGTAPTM

SEQ ID NO: 562739 - protein, 8 aa, Mycobacterium
RGTAQTAG

SEQ ID NO: 562740 - protein, 8 aa, Mycobacterium
RGTARAQY

SEQ ID NO: 562741 - protein, 10 aa, Mycobacterium
RGTASLAGDP

SEQ ID NO: 562742 - protein, 26 aa, Mycobacterium
RGTASPPVASPPAAPLPPPPPRDQPL

SEQ ID NO: 562743 - protein, 7 aa, Mycobacterium
RGTDAGA

SEQ ID NO: 562744 - protein, 9 aa, Mycobacterium
RGTDAPHPE

SEQ ID NO: 562745 - protein, 10 aa, Mycobacterium
RGTDDDAQGV

SEQ ID NO: 562746 - protein, 10 aa, Mycobacterium
RGTDDGALEQ

SEQ ID NO: 562747 - protein, 10 aa, Mycobacterium
RGTDDGQLAE

SEQ ID NO: 562748 - protein, 19 aa, Mycobacterium
RGTDDPGLGGESAETIDAT

SEQ ID NO: 562749 - protein, 6 aa, Mycobacterium
RGTDEN

SEQ ID NO: 562750 - protein, 9 aa, Mycobacterium
RGTDESSAR

SEQ ID NO: 562751 - protein, 9 aa, Mycobacterium
RGTDPDSEK

SEQ ID NO: 562752 - protein, 9 aa, Mycobacterium
RGTDPDSGE

SEQ ID NO: 562753 - protein, 9 aa, Mycobacterium
RGTDPEAAA

SEQ ID NO: 562754 - protein, 9 aa, Mycobacterium
RGTDPETGT

SEQ ID NO: 562755 - protein, 9 aa, Mycobacterium
RGTDPQSGQ

SEQ ID NO: 562756 - protein, 24 aa, Mycobacterium
RGTDPRPLPSLPGTAEKPLSSTDY

SEQ ID NO: 562757 - protein, 12 aa, Mycobacterium
RGTDQPDGGTGL

SEQ ID NO: 562758 - protein, 7 aa, Mycobacterium
RGTDQRE

SEQ ID NO: 562759 - protein, 24 aa, Mycobacterium
RGTDRDADRTIAAGAGRHDRRPRA

SEQ ID NO: 562760 - protein, 6 aa, Mycobacterium
RGTDRT

SEQ ID NO: 562761 - protein, 12 aa, Mycobacterium
RGTDSDTVTPQE

SEQ ID NO: 562762 - protein, 6 aa, Mycobacterium
RGTDSL

SEQ ID NO: 562763 - protein, 8 aa, Mycobacterium
RGTDSLNV

SEQ ID NO: 562764 - protein, 11 aa, Mycobacterium
RGTDSRSLATE

SEQ ID NO: 562765 - protein, 12 aa, Mycobacterium
RGTDSTDGAEDY

SEQ ID NO: 562766 - protein, 12 aa, Mycobacterium
RGTDVARSRRGG

SEQ ID NO: 562767 - protein, 4 aa, Mycobacterium
RGTE

SEQ ID NO: 562768 - protein, 10 aa, Mycobacterium
RGTEADWSEA

SEQ ID NO: 562769 - protein, 11 aa, Mycobacterium
RGTEAKRPDSV

SEQ ID NO: 562770 - protein, 12 aa, Mycobacterium
RGTEDAEGETLD

SEQ ID NO: 562771 - protein, 7 aa, Mycobacterium
RGTEGDL

SEQ ID NO: 562772 - protein, 6 aa, Mycobacterium
RGTEIG

SEQ ID NO: 562773 - protein, 11 aa, Mycobacterium
RGTELRDPTMS

SEQ ID NO: 562774 - protein, 10 aa, Mycobacterium
RGTEPGRGRG

SEQ ID NO: 562775 - protein, 5 aa, Mycobacterium
RGTER

SEQ ID NO: 562776 - protein, 6 aa, Mycobacterium
RGTERN

SEQ ID NO: 562777 - protein, 6 aa, Mycobacterium
RGTETD

SEQ ID NO: 562778 - protein, 4 aa, Mycobacterium
RGTF

SEQ ID NO: 562779 - protein, 16 aa, Mycobacterium
RGTFDQPMSAQERADA

SEQ ID NO: 562780 - protein, 13 aa, Mycobacterium
RGTFNAAPERPAM

SEQ ID NO: 562781 - protein, 5 aa, Mycobacterium
RGTGA

SEQ ID NO: 562782 - protein, 13 aa, Mycobacterium
RGTGADALQTRTY

SEQ ID NO: 562783 - protein, 10 aa, Mycobacterium
RGTGASSGDW

SEQ ID NO: 562784 - protein, 9 aa, Mycobacterium
RGTGEDVHT

SEQ ID NO: 562785 - protein, 5 aa, Mycobacterium
RGTGG

SEQ ID NO: 562786 - protein, 8 aa, Mycobacterium
RGTGGACP

SEQ ID NO: 562787 - protein, 9 aa, Mycobacterium
RGTGGSGGT

SEQ ID NO: 562788 - protein, 7 aa, Mycobacterium
RGTGHQA

SEQ ID NO: 562789 - protein, 8 aa, Mycobacterium
RGTGIDDQ

SEQ ID NO: 562790 - protein, 6 aa, Mycobacterium
RGTGIR

SEQ ID NO: 562791 - protein, 11 aa, Mycobacterium
RGTGKAEEARE

SEQ ID NO: 562792 - protein, 8 aa, Mycobacterium
RGTGKAVA

SEQ ID NO: 562793 - protein, 10 aa, Mycobacterium
RGTGKSYPGV

SEQ ID NO: 562794 - protein, 6 aa, Mycobacterium
RGTGQW

SEQ ID NO: 562795 - protein, 5 aa, Mycobacterium
RGTGR

SEQ ID NO: 562796 - protein, 11 aa, Mycobacterium
RGTGRARRYGT

SEQ ID NO: 562797 - protein, 19 aa, Mycobacterium
RGTGRDHPVRRRRSGAESW

SEQ ID NO: 562798 - protein, 6 aa, Mycobacterium
RGTGRP

SEQ ID NO: 562799 - protein, 8 aa, Mycobacterium
RGTGRPVA

SEQ ID NO: 562800 - protein, 7 aa, Mycobacterium
RGTGRSC

SEQ ID NO: 562801 - protein, 5 aa, Mycobacterium
RGTGS

SEQ ID NO: 562802 - protein, 6 aa, Mycobacterium
RGTGSH

SEQ ID NO: 562803 - protein, 9 aa, Mycobacterium
RGTGSHDSV

SEQ ID NO: 562804 - protein, 7 aa, Mycobacterium
RGTGSNT

SEQ ID NO: 562805 - protein, 10 aa, Mycobacterium
RGTGSSGGSF

SEQ ID NO: 562806 - protein, 7 aa, Mycobacterium
RGTGSYD

SEQ ID NO: 562807 - protein, 7 aa, Mycobacterium
RGTGVDD

SEQ ID NO: 562808 - protein, 10 aa, Mycobacterium
RGTGVTTRTR

SEQ ID NO: 562809 - protein, 19 aa, Mycobacterium
RGTHGSGLGNADKALTKTP

SEQ ID NO: 562810 - protein, 11 aa, Mycobacterium
RGTIDGDEDVI

SEQ ID NO: 562811 - protein, 11 aa, Mycobacterium
RGTIEGDEDVL

SEQ ID NO: 562812 - protein, 8 aa, Mycobacterium
RGTISPVS

SEQ ID NO: 562813 - protein, 8 aa, Mycobacterium
RGTKHAAA

SEQ ID NO: 562814 - protein, 7 aa, Mycobacterium
RGTKHTA

SEQ ID NO: 562815 - protein, 8 aa, Mycobacterium
RGTKLTEP

SEQ ID NO: 562816 - protein, 20 aa, Mycobacterium
RGTKPGLENASAPPKRPPMP

SEQ ID NO: 562817 - protein, 17 aa, Mycobacterium
RGTLPGDGRADNNRARR

SEQ ID NO: 562818 - protein, 14 aa, Mycobacterium
RGTLRSGRRQQRES

SEQ ID NO: 562819 - protein, 8 aa, Mycobacterium
RGTNDDAH

SEQ ID NO: 562820 - protein, 6 aa, Mycobacterium
RGTNLL

SEQ ID NO: 562821 - protein, 5 aa, Mycobacterium
RGTNM

SEQ ID NO: 562822 - protein, 7 aa, Mycobacterium
RGTNPAV

SEQ ID NO: 562823 - protein, 9 aa, Mycobacterium
RGTNSGAPN

SEQ ID NO: 562824 - protein, 4 aa, Mycobacterium
RGTP

SEQ ID NO: 562825 - protein, 5 aa, Mycobacterium
RGTPD

SEQ ID NO: 562826 - protein, 9 aa, Mycobacterium
RGTPGPGQI

SEQ ID NO: 562827 - protein, 6 aa, Mycobacterium
RGTPLS

SEQ ID NO: 562828 - protein, 7 aa, Mycobacterium
RGTPLSE

SEQ ID NO: 562829 - protein, 14 aa, Mycobacterium
RGTPPDLDPALTQA

SEQ ID NO: 562830 - protein, 9 aa, Mycobacterium
RGTPSEAAQ

SEQ ID NO: 562831 - protein, 10 aa, Mycobacterium
RGTPTSEEDL

SEQ ID NO: 562832 - protein, 6 aa, Mycobacterium
RGTPVS

SEQ ID NO: 562833 - protein, 4 aa, Mycobacterium
RGTQ

SEQ ID NO: 562834 - protein, 7 aa, Mycobacterium
RGTQAGG

SEQ ID NO: 562835 - protein, 8 aa, Mycobacterium
RGTQEAYQ

SEQ ID NO: 562836 - protein, 13 aa, Mycobacterium
RGTQLQRARAGEI

SEQ ID NO: 562837 - protein, 12 aa, Mycobacterium
RGTQSQDCSGPR

SEQ ID NO: 562838 - protein, 9 aa, Mycobacterium
RGTRAHSAR

SEQ ID NO: 562839 - protein, 13 aa, Mycobacterium
RGTRGAEKVAESA

SEQ ID NO: 562840 - protein, 9 aa, Mycobacterium
RGTRKPLTD

SEQ ID NO: 562841 - protein, 7 aa, Mycobacterium
RGTRKTL

SEQ ID NO: 562842 - protein, 17 aa, Mycobacterium
RGTRPRTRPETTGEAGD

SEQ ID NO: 562843 - protein, 10 aa, Mycobacterium
RGTRRPVTTK

SEQ ID NO: 562844 - protein, 4 aa, Mycobacterium
RGTS

SEQ ID NO: 562845 - protein, 7 aa, Mycobacterium
RGTSAAE

SEQ ID NO: 562846 - protein, 8 aa, Mycobacterium
RGTSAREA

SEQ ID NO: 562847 - protein, 5 aa, Mycobacterium
RGTSL

SEQ ID NO: 562848 - protein, 9 aa, Mycobacterium
RGTSQQHGQ

SEQ ID NO: 562849 - protein, 9 aa, Mycobacterium
RGTSRDGFD

SEQ ID NO: 562850 - protein, 10 aa, Mycobacterium
RGTSRIADPP

SEQ ID NO: 562851 - protein, 7 aa, Mycobacterium
RGTSRPL

SEQ ID NO: 562852 - protein, 12 aa, Mycobacterium
RGTSTIAGSTAT

SEQ ID NO: 562853 - protein, 13 aa, Mycobacterium
RGTSTLADGSQLV

SEQ ID NO: 562854 - protein, 6 aa, Mycobacterium
RGTSYN

SEQ ID NO: 562855 - protein, 4 aa, Mycobacterium
RGTT

SEQ ID NO: 562856 - protein, 7 aa, Mycobacterium
RGTTAGA

SEQ ID NO: 562857 - protein, 12 aa, Mycobacterium
RGTTEAVSGDPA

SEQ ID NO: 562858 - protein, 17 aa, Mycobacterium
RGTTKPRTGLDGPDTEL

SEQ ID NO: 562859 - protein, 8 aa, Mycobacterium
RGTTPAER

SEQ ID NO: 562860 - protein, 10 aa, Mycobacterium
RGTTQKASRI

SEQ ID NO: 562861 - protein, 11 aa, Mycobacterium
RGTTQKASRIR

SEQ ID NO: 562862 - protein, 9 aa, Mycobacterium
RGTTTISTG

SEQ ID NO: 562863 - protein, 17 aa, Mycobacterium
RGTTTSPDMGPGGAGYG

SEQ ID NO: 562864 - protein, 9 aa, Mycobacterium
RGTTTTVET

SEQ ID NO: 562865 - protein, 11 aa, Mycobacterium
RGTTVDRRDAH

SEQ ID NO: 562866 - protein, 5 aa, Mycobacterium
RGTVG

SEQ ID NO: 562867 - protein, 7 aa, Mycobacterium
RGTVGEV

SEQ ID NO: 562868 - protein, 6 aa, Mycobacterium
RGTVGP

SEQ ID NO: 562869 - protein, 10 aa, Mycobacterium
RGTVHGDEDV

SEQ ID NO: 562870 - protein, 13 aa, Mycobacterium
RGTVNPDVEPRRT

SEQ ID NO: 562871 - protein, 7 aa, Mycobacterium
RGTVQGV

SEQ ID NO: 562872 - protein, 11 aa, Mycobacterium
RGTVTDDRDQT

SEQ ID NO: 562873 - protein, 7 aa, Mycobacterium
RGTVTGR

SEQ ID NO: 562874 - protein, 13 aa, Mycobacterium
RGTVTTTDDVPDQ

SEQ ID NO: 562875 - protein, 4 aa, Mycobacterium
RGTW

SEQ ID NO: 562876 - protein, 6 aa, Mycobacterium
RGTWTP

SEQ ID NO: 562877 - protein, 5 aa, Mycobacterium
RGTYG

SEQ ID NO: 562878 - protein, 7 aa, Mycobacterium
RGTYGGA

SEQ ID NO: 562879 - protein, 13 aa, Mycobacterium
RGVAAADDITPDL

SEQ ID NO: 562880 - protein, 10 aa, Mycobacterium
RGVAARPGQV

SEQ ID NO: 562881 - protein, 8 aa, Mycobacterium
RGVADRAA

SEQ ID NO: 562882 - protein, 6 aa, Mycobacterium
RGVAPD

SEQ ID NO: 562883 - protein, 8 aa, Mycobacterium
RGVAPDQL

SEQ ID NO: 562884 - protein, 6 aa, Mycobacterium
RGVAPK

SEQ ID NO: 562885 - protein, 7 aa, Mycobacterium
RGVATSG

SEQ ID NO: 562886 - protein, 6 aa, Mycobacterium
RGVDAT

SEQ ID NO: 562887 - protein, 19 aa, Mycobacterium
RGVDDSDSEAVTAAESQRA

SEQ ID NO: 562888 - protein, 11 aa, Mycobacterium
RGVDDTGDTAV

SEQ ID NO: 562889 - protein, 12 aa, Mycobacterium
RGVDGDASNSWS

SEQ ID NO: 562890 - protein, 8 aa, Mycobacterium
RGVDGEAG

SEQ ID NO: 562891 - protein, 34 aa, Mycobacterium
RGVDPEFNPGVESVSPSGLAGDASPRGRALQTGE

SEQ ID NO: 562892 - protein, 8 aa, Mycobacterium
RGVEHRRQ

SEQ ID NO: 562893 - protein, 10 aa, Mycobacterium
RGVEKKLRSG

SEQ ID NO: 562894 - protein, 5 aa, Mycobacterium
RGVEP

SEQ ID NO: 562895 - protein, 21 aa, Mycobacterium
RGVEPGYDGVGATPPPASTEI

SEQ ID NO: 562896 - protein, 6 aa, Mycobacterium
RGVFTD

SEQ ID NO: 562897 - protein, 7 aa, Mycobacterium
RGVGAGS

SEQ ID NO: 562898 - protein, 9 aa, Mycobacterium
RGVGASRPA

SEQ ID NO: 562899 - protein, 12 aa, Mycobacterium
RGVGEGPGEVPL

SEQ ID NO: 562900 - protein, 14 aa, Mycobacterium
RGVGETRSCGTGTV

SEQ ID NO: 562901 - protein, 8 aa, Mycobacterium
RGVGHSTP

SEQ ID NO: 562902 - protein, 9 aa, Mycobacterium
RGVGHSTPS

SEQ ID NO: 562903 - protein, 6 aa, Mycobacterium
RGVGPG

SEQ ID NO: 562904 - protein, 7 aa, Mycobacterium
RGVGPGD

SEQ ID NO: 562905 - protein, 8 aa, Mycobacterium
RGVGRPER

SEQ ID NO: 562906 - protein, 11 aa, Mycobacterium
RGVGSGRYRPQ

SEQ ID NO: 562907 - protein, 6 aa, Mycobacterium
RGVGTE

SEQ ID NO: 562908 - protein, 9 aa, Mycobacterium
RGVGTETPV

SEQ ID NO: 562909 - protein, 6 aa, Mycobacterium
RGVKGG

SEQ ID NO: 562910 - protein, 11 aa, Mycobacterium
RGVPAPGDDVD

SEQ ID NO: 562911 - protein, 6 aa, Mycobacterium
RGVPDR

SEQ ID NO: 562912 - protein, 11 aa, Mycobacterium
RGVPKRAGGHG

SEQ ID NO: 562913 - protein, 11 aa, Mycobacterium
RGVPKRSGGHG

SEQ ID NO: 562914 - protein, 13 aa, Mycobacterium
RGVPPGMFPRGRR

SEQ ID NO: 562915 - protein, 11 aa, Mycobacterium
RGVQDRAPVTI

SEQ ID NO: 562916 - protein, 6 aa, Mycobacterium
RGVRAT

SEQ ID NO: 562917 - protein, 19 aa, Mycobacterium
RGVRATGATLSAEQAKWAQ

SEQ ID NO: 562918 - protein, 8 aa, Mycobacterium
RGVRGPYR

SEQ ID NO: 562919 - protein, 14 aa, Mycobacterium
RGVRGTIGHTQPRR

SEQ ID NO: 562920 - protein, 6 aa, Mycobacterium
RGVRPQ

SEQ ID NO: 562921 - protein, 16 aa, Mycobacterium
RGVRSARPRAVPSARK

SEQ ID NO: 562922 - protein, 4 aa, Mycobacterium
RGVS

SEQ ID NO: 562923 - protein, 13 aa, Mycobacterium
RGVSDSISAGRTP

SEQ ID NO: 562924 - protein, 8 aa, Mycobacterium
RGVSEDAA

SEQ ID NO: 562925 - protein, 5 aa, Mycobacterium
RGVSP

SEQ ID NO: 562926 - protein, 18 aa, Mycobacterium
RGVSPGAWDREKEGYIVA

SEQ ID NO: 562927 - protein, 6 aa, Mycobacterium
RGVSSE

SEQ ID NO: 562928 - protein, 15 aa, Mycobacterium
RGVSSGKVTERERDR

SEQ ID NO: 562929 - protein, 8 aa, Mycobacterium
RGVSSGPV

SEQ ID NO: 562930 - protein, 4 aa, Mycobacterium
RGVT

SEQ ID NO: 562931 - protein, 7 aa, Mycobacterium
RGVTDEQ

SEQ ID NO: 562932 - protein, 10 aa, Mycobacterium
RGVTEDGTLR

SEQ ID NO: 562933 - protein, 10 aa, Mycobacterium
RGVTPAQAKE

SEQ ID NO: 562934 - protein, 8 aa, Mycobacterium
RGVTPEQA

SEQ ID NO: 562935 - protein, 10 aa, Mycobacterium
RGVTPEQAQQ

SEQ ID NO: 562936 - protein, 10 aa, Mycobacterium
RGVTPQQAKD

SEQ ID NO: 562937 - protein, 6 aa, Mycobacterium
RGVTRP

SEQ ID NO: 562938 - protein, 7 aa, Mycobacterium
RGVTSSQ

SEQ ID NO: 562939 - protein, 14 aa, Mycobacterium
RGVTTRADDGTRTV

SEQ ID NO: 562940 - protein, 12 aa, Mycobacterium
RGVTWTGRKATL

SEQ ID NO: 562941 - protein, 15 aa, Mycobacterium
RGWAQSAAEREAGVA

SEQ ID NO: 562942 - protein, 15 aa, Mycobacterium
RGWAQSAAEREPGVA

SEQ ID NO: 562943 - protein, 5 aa, Mycobacterium
RGWDG

SEQ ID NO: 562944 - protein, 4 aa, Mycobacterium
RGWE

SEQ ID NO: 562945 - protein, 7 aa, Mycobacterium
RGWGEGG

SEQ ID NO: 562946 - protein, 6 aa, Mycobacterium
RGWGPT

SEQ ID NO: 562947 - protein, 7 aa, Mycobacterium
RGWPGTM

SEQ ID NO: 562948 - protein, 11 aa, Mycobacterium
RGWQGSPERFG

SEQ ID NO: 562949 - protein, 10 aa, Mycobacterium
RGWQTSSTTV

SEQ ID NO: 562950 - protein, 12 aa, Mycobacterium
RGWRADNTDIDG

SEQ ID NO: 562951 - protein, 17 aa, Mycobacterium
RGWRGQRAAAGAGRTVS

SEQ ID NO: 562952 - protein, 10 aa, Mycobacterium
RGWRTSSQTV

SEQ ID NO: 562953 - protein, 9 aa, Mycobacterium
RGWSADAAT

SEQ ID NO: 562954 - protein, 5 aa, Mycobacterium
RGWSR

SEQ ID NO: 562955 - protein, 5 aa, Mycobacterium
RGWST

SEQ ID NO: 562956 - protein, 7 aa, Mycobacterium
RGWSTTR

SEQ ID NO: 562957 - protein, 9 aa, Mycobacterium
RGWTASESL

SEQ ID NO: 562958 - protein, 6 aa, Mycobacterium
RGWTEG

SEQ ID NO: 562959 - protein, 11 aa, Mycobacterium
RGYAGPDREVR

SEQ ID NO: 562960 - protein, 6 aa, Mycobacterium
RGYAPL

SEQ ID NO: 562961 - protein, 8 aa, Mycobacterium
RGYDETTV

SEQ ID NO: 562962 - protein, 6 aa, Mycobacterium
RGYDGD

SEQ ID NO: 562963 - protein, 8 aa, Mycobacterium
RGYDGTSI

SEQ ID NO: 562964 - protein, 9 aa, Mycobacterium
RGYDGTSIE

SEQ ID NO: 562965 - protein, 12 aa, Mycobacterium
RGYDGTSTNRIA

SEQ ID NO: 562966 - protein, 11 aa, Mycobacterium
RGYDSDHPRVA

SEQ ID NO: 562967 - protein, 11 aa, Mycobacterium
RGYDSDHPRVQ

SEQ ID NO: 562968 - protein, 26 aa, Mycobacterium
RGYDSYEDALDGASDEPLPAQPAGSD

SEQ ID NO: 562969 - protein, 4 aa, Mycobacterium
RGYE

SEQ ID NO: 562970 - protein, 6 aa, Mycobacterium
RGYESK

SEQ ID NO: 562971 - protein, 4 aa, Mycobacterium
RGYG

SEQ ID NO: 562972 - protein, 6 aa, Mycobacterium
RGYGAP

SEQ ID NO: 562973 - protein, 6 aa, Mycobacterium
RGYGED

SEQ ID NO: 562974 - protein, 23 aa, Mycobacterium
RGYGNSERPQASPDHSTYSKREM

SEQ ID NO: 562975 - protein, 7 aa, Mycobacterium
RGYGRGQ

SEQ ID NO: 562976 - protein, 10 aa, Mycobacterium
RGYGSPAPVP

SEQ ID NO: 562977 - protein, 5 aa, Mycobacterium
RGYGY

SEQ ID NO: 562978 - protein, 6 aa, Mycobacterium
RGYGYG

SEQ ID NO: 562979 - protein, 7 aa, Mycobacterium
RGYGYGP

SEQ ID NO: 562980 - protein, 8 aa, Mycobacterium
RGYNKTSV

SEQ ID NO: 562981 - protein, 7 aa, Mycobacterium
RGYPEDP

SEQ ID NO: 562982 - protein, 5 aa, Mycobacterium
RGYPL

SEQ ID NO: 562983 - protein, 6 aa, Mycobacterium
RGYPTA

SEQ ID NO: 562984 - protein, 6 aa, Mycobacterium
RGYRNH

SEQ ID NO: 562985 - protein, 7 aa, Mycobacterium
RGYRPDE

SEQ ID NO: 562986 - protein, 12 aa, Mycobacterium
RGYRRPRSGGLS

SEQ ID NO: 562987 - protein, 12 aa, Mycobacterium
RGYRSTYADYSE

SEQ ID NO: 562988 - protein, 6 aa, Mycobacterium
RGYSDG

SEQ ID NO: 562989 - protein, 8 aa, Mycobacterium
RGYSPEFA

SEQ ID NO: 562990 - protein, 8 aa, Mycobacterium
RGYSPHDA

SEQ ID NO: 562991 - protein, 5 aa, Mycobacterium
RGYSQ

SEQ ID NO: 562992 - protein, 11 aa, Mycobacterium
RGYSQGDPYGN

SEQ ID NO: 562993 - protein, 11 aa, Mycobacterium
RGYSTGDPYGN

SEQ ID NO: 562994 - protein, 6 aa, Mycobacterium
RGYTAE

SEQ ID NO: 562995 - protein, 6 aa, Mycobacterium
RGYTGR

SEQ ID NO: 562996 - protein, 21 aa, Mycobacterium
RGYTKGDVRDPLSGESTGTAI

SEQ ID NO: 562997 - protein, 9 aa, Mycobacterium
RGYTPARAA

SEQ ID NO: 562998 - protein, 5 aa, Mycobacterium
RGYTR

SEQ ID NO: 562999 - protein, 10 aa, Mycobacterium
RGYTSQAKNG

SEQ ID NO: 563000 - protein, 5 aa, Mycobacterium
RGYTY

SEQ ID NO: 563001 - protein, 11 aa, Mycobacterium
RGYVQKKGSAL

SEQ ID NO: 563002 - protein, 4 aa, Mycobacterium
RHAA

SEQ ID NO: 563003 - protein, 8 aa, Mycobacterium
RHAAAAEA

SEQ ID NO: 563004 - protein, 18 aa, Mycobacterium
RHAAEEARRARDAAEIRA

SEQ ID NO: 563005 - protein, 5 aa, Mycobacterium
RHAAG

SEQ ID NO: 563006 - protein, 13 aa, Mycobacterium
RHAAGGRTARENI

SEQ ID NO: 563007 - protein, 4 aa, Mycobacterium
RHAD

SEQ ID NO: 563008 - protein, 7 aa, Mycobacterium
RHADDRP

SEQ ID NO: 563009 - protein, 6 aa, Mycobacterium
RHADNS

SEQ ID NO: 563010 - protein, 13 aa, Mycobacterium
RHAEEAAQPGRAT

SEQ ID NO: 563011 - protein, 10 aa, Mycobacterium
RHAENGTSAV

SEQ ID NO: 563012 - protein, 6 aa, Mycobacterium
RHAEPG

SEQ ID NO: 563013 - protein, 8 aa, Mycobacterium
RHAGDRPL

SEQ ID NO: 563014 - protein, 9 aa, Mycobacterium
RHAGGDSHH

SEQ ID NO: 563015 - protein, 9 aa, Mycobacterium
RHAGGNPRD

SEQ ID NO: 563016 - protein, 11 aa, Mycobacterium
RHAGGSAGGRT

SEQ ID NO: 563017 - protein, 18 aa, Mycobacterium
RHAGPEQEALNSESSRRM

SEQ ID NO: 563018 - protein, 14 aa, Mycobacterium
RHAGPEVGDHGDRV

SEQ ID NO: 563019 - protein, 5 aa, Mycobacterium
RHAGQ

SEQ ID NO: 563020 - protein, 7 aa, Mycobacterium
RHAGTGA

SEQ ID NO: 563021 - protein, 6 aa, Mycobacterium
RHAGYS

SEQ ID NO: 563022 - protein, 11 aa, Mycobacterium
RHAHSGDSAAL

SEQ ID NO: 563023 - protein, 8 aa, Mycobacterium
RHAKGGEL

SEQ ID NO: 563024 - protein, 9 aa, Mycobacterium
RHAKPGDFD

SEQ ID NO: 563025 - protein, 7 aa, Mycobacterium
RHAPDGL

SEQ ID NO: 563026 - protein, 6 aa, Mycobacterium
RHAPGE

SEQ ID NO: 563027 - protein, 6 aa, Mycobacterium
RHAPPG

SEQ ID NO: 563028 - protein, 27 aa, Mycobacterium
RHAPTAAVQPAKPKPTRAKVNASAPAD

SEQ ID NO: 563029 - protein, 12 aa, Mycobacterium
RHAPTPRSARPR

SEQ ID NO: 563030 - protein, 9 aa, Mycobacterium
RHAQPAESV

SEQ ID NO: 563031 - protein, 6 aa, Mycobacterium
RHAQRK

SEQ ID NO: 563032 - protein, 4 aa, Mycobacterium
RHAR

SEQ ID NO: 563033 - protein, 12 aa, Mycobacterium
RHARATEAARAA

SEQ ID NO: 563034 - protein, 15 aa, Mycobacterium
RHARSTAVPPREPLT

SEQ ID NO: 563035 - protein, 14 aa, Mycobacterium
RHATPDSPAIRGAD

SEQ ID NO: 563036 - protein, 9 aa, Mycobacterium
RHDADGSGA

SEQ ID NO: 563037 - protein, 8 aa, Mycobacterium
RHDAEDAV

SEQ ID NO: 563038 - protein, 5 aa, Mycobacterium
RHDDE

SEQ ID NO: 563039 - protein, 11 aa, Mycobacterium
RHDDRRGKLTP

SEQ ID NO: 563040 - protein, 4 aa, Mycobacterium
RHDE

SEQ ID NO: 563041 - protein, 4 aa, Mycobacterium
RHDG

SEQ ID NO: 563042 - protein, 6 aa, Mycobacterium
RHDGEL

SEQ ID NO: 563043 - protein, 6 aa, Mycobacterium
RHDGER

SEQ ID NO: 563044 - protein, 6 aa, Mycobacterium
RHDGPA

SEQ ID NO: 563045 - protein, 9 aa, Mycobacterium
RHDGPAKDR

SEQ ID NO: 563046 - protein, 5 aa, Mycobacterium
RHDHE

SEQ ID NO: 563047 - protein, 5 aa, Mycobacterium
RHDHT

SEQ ID NO: 563048 - protein, 7 aa, Mycobacterium
RHDLGSK

SEQ ID NO: 563049 - protein, 10 aa, Mycobacterium
RHDNPSTRER

SEQ ID NO: 563050 - protein, 4 aa, Mycobacterium
RHDP

SEQ ID NO: 563051 - protein, 7 aa, Mycobacterium
RHDPADD

SEQ ID NO: 563052 - protein, 8 aa, Mycobacterium
RHDPDDVR

SEQ ID NO: 563053 - protein, 7 aa, Mycobacterium
RHDPDVQ

SEQ ID NO: 563054 - protein, 5 aa, Mycobacterium
RHDPE

SEQ ID NO: 563055 - protein, 9 aa, Mycobacterium
RHDPGAPLR

SEQ ID NO: 563056 - protein, 13 aa, Mycobacterium
RHDPLKTDDKARA

SEQ ID NO: 563057 - protein, 6 aa, Mycobacterium
RHDPPQ

SEQ ID NO: 563058 - protein, 5 aa, Mycobacterium
RHDPR

SEQ ID NO: 563059 - protein, 7 aa, Mycobacterium
RHDPSDT

SEQ ID NO: 563060 - protein, 9 aa, Mycobacterium
RHDPSDTTW

SEQ ID NO: 563061 - protein, 15 aa, Mycobacterium
RHDPVDGLEQPVFAW

SEQ ID NO: 563062 - protein, 16 aa, Mycobacterium
RHDQEPSRVQIDPLHI

SEQ ID NO: 563063 - protein, 10 aa, Mycobacterium
RHDREAYTAG

SEQ ID NO: 563064 - protein, 10 aa, Mycobacterium
RHDRETGDNF

SEQ ID NO: 563065 - protein, 4 aa, Mycobacterium
RHDV

SEQ ID NO: 563066 - protein, 6 aa, Mycobacterium
RHDVNP

SEQ ID NO: 563067 - protein, 10 aa, Mycobacterium
RHEAAAQRRV

SEQ ID NO: 563068 - protein, 13 aa, Mycobacterium
RHEAAGTTHSAEY

SEQ ID NO: 563069 - protein, 13 aa, Mycobacterium
RHEAAGTTYAPEY

SEQ ID NO: 563070 - protein, 35 aa, Mycobacterium
RHEAEHHGPGVPAATAARPTRTVPRSRLTSMALGR

SEQ ID NO: 563071 - protein, 9 aa, Mycobacterium
RHEAGAADL

SEQ ID NO: 563072 - protein, 13 aa, Mycobacterium
RHEAGGRPTTSPI

SEQ ID NO: 563073 - protein, 10 aa, Mycobacterium
RHEDTPAIAH

SEQ ID NO: 563074 - protein, 5 aa, Mycobacterium
RHEEP

SEQ ID NO: 563075 - protein, 23 aa, Mycobacterium
RHEESEADRLRRQARNATDEADL

SEQ ID NO: 563076 - protein, 14 aa, Mycobacterium
RHEGEAATSLTSDT

SEQ ID NO: 563077 - protein, 13 aa, Mycobacterium
RHEGLDDDQRTAQ

SEQ ID NO: 563078 - protein, 13 aa, Mycobacterium
RHEGLDDERRTAQ

SEQ ID NO: 563079 - protein, 5 aa, Mycobacterium
RHEHT

SEQ ID NO: 563080 - protein, 4 aa, Mycobacterium
RHEI

SEQ ID NO: 563081 - protein, 6 aa, Mycobacterium
RHEPER

SEQ ID NO: 563082 - protein, 5 aa, Mycobacterium
RHEPS

SEQ ID NO: 563083 - protein, 34 aa, Mycobacterium
RHEQRSGAYRPQELTSQSTDYGGRTRGGGHGILS

SEQ ID NO: 563084 - protein, 6 aa, Mycobacterium
RHEQSA

SEQ ID NO: 563085 - protein, 10 aa, Mycobacterium
RHEQSSAGTE

SEQ ID NO: 563086 - protein, 5 aa, Mycobacterium
RHERD

SEQ ID NO: 563087 - protein, 14 aa, Mycobacterium
RHEREKRLRPEGSR

SEQ ID NO: 563088 - protein, 20 aa, Mycobacterium
RHESEPARRPGYFPRPPEER

SEQ ID NO: 563089 - protein, 6 aa, Mycobacterium
RHESRR

SEQ ID NO: 563090 - protein, 11 aa, Mycobacterium
RHESSTAPGAW

SEQ ID NO: 563091 - protein, 4 aa, Mycobacterium
RHEY

SEQ ID NO: 563092 - protein, 4 aa, Mycobacterium
RHGA

SEQ ID NO: 563093 - protein, 6 aa, Mycobacterium
RHGADG

SEQ ID NO: 563094 - protein, 13 aa, Mycobacterium
RHGADGARSAENE

SEQ ID NO: 563095 - protein, 6 aa, Mycobacterium
RHGAER

SEQ ID NO: 563096 - protein, 5 aa, Mycobacterium
RHGAG

SEQ ID NO: 563097 - protein, 6 aa, Mycobacterium
RHGAGA

SEQ ID NO: 563098 - protein, 12 aa, Mycobacterium
RHGAGEYQVVYC

SEQ ID NO: 563099 - protein, 7 aa, Mycobacterium
RHGALPD

SEQ ID NO: 563100 - protein, 14 aa, Mycobacterium
RHGARHRARPAQPH

SEQ ID NO: 563101 - protein, 8 aa, Mycobacterium
RHGARPTA

SEQ ID NO: 563102 - protein, 10 aa, Mycobacterium
RHGATAGDFA

SEQ ID NO: 563103 - protein, 7 aa, Mycobacterium
RHGATSV

SEQ ID NO: 563104 - protein, 7 aa, Mycobacterium
RHGDDPE

SEQ ID NO: 563105 - protein, 9 aa, Mycobacterium
RHGDDSRAR

SEQ ID NO: 563106 - protein, 7 aa, Mycobacterium
RHGDHNH

SEQ ID NO: 563107 - protein, 8 aa, Mycobacterium
RHGDPAVE

SEQ ID NO: 563108 - protein, 9 aa, Mycobacterium
RHGDPTTVA

SEQ ID NO: 563109 - protein, 8 aa, Mycobacterium
RHGDTGPL

SEQ ID NO: 563110 - protein, 7 aa, Mycobacterium
RHGEGRP

SEQ ID NO: 563111 - protein, 8 aa, Mycobacterium
RHGERRGD

SEQ ID NO: 563112 - protein, 10 aa, Mycobacterium
RHGETAGDFP

SEQ ID NO: 563113 - protein, 13 aa, Mycobacterium
RHGEVDSADLEAQ

SEQ ID NO: 563114 - protein, 12 aa, Mycobacterium
RHGEVDSKQLEQ

SEQ ID NO: 563115 - protein, 13 aa, Mycobacterium
RHGEVDSVDLEVQ

SEQ ID NO: 563116 - protein, 5 aa, Mycobacterium
RHGFD

SEQ ID NO: 563117 - protein, 5 aa, Mycobacterium
RHGGA

SEQ ID NO: 563118 - protein, 12 aa, Mycobacterium
RHGGAKPRELRS

SEQ ID NO: 563119 - protein, 15 aa, Mycobacterium
RHGGDDPAAEARRRW

SEQ ID NO: 563120 - protein, 5 aa, Mycobacterium
RHGGE

SEQ ID NO: 563121 - protein, 11 aa, Mycobacterium
RHGGGSRWNAG

SEQ ID NO: 563122 - protein, 8 aa, Mycobacterium
RHGGPEQL

SEQ ID NO: 563123 - protein, 8 aa, Mycobacterium
RHGGSGYG

SEQ ID NO: 563124 - protein, 9 aa, Mycobacterium
RHGGSPQIR

SEQ ID NO: 563125 - protein, 14 aa, Mycobacterium
RHGLSTPDSEEAAV

SEQ ID NO: 563126 - protein, 5 aa, Mycobacterium
RHGNP

SEQ ID NO: 563127 - protein, 7 aa, Mycobacterium
RHGNRED

SEQ ID NO: 563128 - protein, 9 aa, Mycobacterium
RHGPDEVSA

SEQ ID NO: 563129 - protein, 5 aa, Mycobacterium
RHGPE

SEQ ID NO: 563130 - protein, 11 aa, Mycobacterium
RHGPGDTRPSL

SEQ ID NO: 563131 - protein, 6 aa, Mycobacterium
RHGPGG

SEQ ID NO: 563132 - protein, 7 aa, Mycobacterium
RHGPGHT

SEQ ID NO: 563133 - protein, 5 aa, Mycobacterium
RHGPQ

SEQ ID NO: 563134 - protein, 6 aa, Mycobacterium
RHGQSI

SEQ ID NO: 563135 - protein, 6 aa, Mycobacterium
RHGQTA

SEQ ID NO: 563136 - protein, 13 aa, Mycobacterium
RHGQVDSSDLEAQ

SEQ ID NO: 563137 - protein, 7 aa, Mycobacterium
RHGRDAG

SEQ ID NO: 563138 - protein, 7 aa, Mycobacterium
RHGRPLD

SEQ ID NO: 563139 - protein, 8 aa, Mycobacterium
RHGRPLDT

SEQ ID NO: 563140 - protein, 13 aa, Mycobacterium
RHGRPLDTATVPA

SEQ ID NO: 563141 - protein, 13 aa, Mycobacterium
RHGRPLDTGAIPA

SEQ ID NO: 563142 - protein, 11 aa, Mycobacterium
RHGRRSSCGRR

SEQ ID NO: 563143 - protein, 5 aa, Mycobacterium
RHGRS

SEQ ID NO: 563144 - protein, 13 aa, Mycobacterium
RHGRSNKQRARDI

SEQ ID NO: 563145 - protein, 9 aa, Mycobacterium
RHGSGNVVA

SEQ ID NO: 563146 - protein, 12 aa, Mycobacterium
RHGSNTIERDRA

SEQ ID NO: 563147 - protein, 9 aa, Mycobacterium
RHGTDRPWR

SEQ ID NO: 563148 - protein, 8 aa, Mycobacterium
RHGTGAST

SEQ ID NO: 563149 - protein, 13 aa, Mycobacterium
RHGTGGAVTEAAA

SEQ ID NO: 563150 - protein, 6 aa, Mycobacterium
RHGTGT

SEQ ID NO: 563151 - protein, 11 aa, Mycobacterium
RHGTKSKLPPE

SEQ ID NO: 563152 - protein, 5 aa, Mycobacterium
RHGTT

SEQ ID NO: 563153 - protein, 6 aa, Mycobacterium
RHGTVS

SEQ ID NO: 563154 - protein, 5 aa, Mycobacterium
RHGVA

SEQ ID NO: 563155 - protein, 10 aa, Mycobacterium
RHGVGEGDEV

SEQ ID NO: 563156 - protein, 9 aa, Mycobacterium
RHGVNNPKA

SEQ ID NO: 563157 - protein, 5 aa, Mycobacterium
RHGYN

SEQ ID NO: 563158 - protein, 12 aa, Mycobacterium
RHGYPVREAAQL

SEQ ID NO: 563159 - protein, 5 aa, Mycobacterium
RHHGV

SEQ ID NO: 563160 - protein, 11 aa, Mycobacterium
RHHKQAADTGA

SEQ ID NO: 563161 - protein, 5 aa, Mycobacterium
RHHNR

SEQ ID NO: 563162 - protein, 14 aa, Mycobacterium
RHHRGHAGRPRPHG

SEQ ID NO: 563163 - protein, 8 aa, Mycobacterium
RHHSGDGR

SEQ ID NO: 563164 - protein, 5 aa, Mycobacterium
RHHTQ

SEQ ID NO: 563165 - protein, 6 aa, Mycobacterium
RHHTQR

SEQ ID NO: 563166 - protein, 6 aa, Mycobacterium
RHHTSV

SEQ ID NO: 563167 - protein, 12 aa, Mycobacterium
RHIAGRGPRDTY

SEQ ID NO: 563168 - protein, 4 aa, Mycobacterium
RHIT

SEQ ID NO: 563169 - protein, 8 aa, Mycobacterium
RHKATGER

SEQ ID NO: 563170 - protein, 9 aa, Mycobacterium
RHKATGERF

SEQ ID NO: 563171 - protein, 8 aa, Mycobacterium
RHKATGEV

SEQ ID NO: 563172 - protein, 4 aa, Mycobacterium
RHKD

SEQ ID NO: 563173 - protein, 12 aa, Mycobacterium
RHKDSGERNDVA

SEQ ID NO: 563174 - protein, 4 aa, Mycobacterium
RHKG

SEQ ID NO: 563175 - protein, 4 aa, Mycobacterium
RHKN

SEQ ID NO: 563176 - protein, 5 aa, Mycobacterium
RHKSK

SEQ ID NO: 563177 - protein, 7 aa, Mycobacterium
RHKVGPG

SEQ ID NO: 563178 - protein, 4 aa, Mycobacterium
RHLD

SEQ ID NO: 563179 - protein, 8 aa, Mycobacterium
RHLRTDES

SEQ ID NO: 563180 - protein, 9 aa, Mycobacterium
RHLSGEARS

SEQ ID NO: 563181 - protein, 5 aa, Mycobacterium
RHNAA

SEQ ID NO: 563182 - protein, 12 aa, Mycobacterium
RHNEAHGIDPEL

SEQ ID NO: 563183 - protein, 6 aa, Mycobacterium
RHNGAE

SEQ ID NO: 563184 - protein, 9 aa, Mycobacterium
RHNGCPQDT

SEQ ID NO: 563185 - protein, 7 aa, Mycobacterium
RHNGHPV

SEQ ID NO: 563186 - protein, 5 aa, Mycobacterium
RHNGS

SEQ ID NO: 563187 - protein, 11 aa, Mycobacterium
RHNGVSGQARM

SEQ ID NO: 563188 - protein, 7 aa, Mycobacterium
RHNKAAQ

SEQ ID NO: 563189 - protein, 7 aa, Mycobacterium
RHNNEAQ

SEQ ID NO: 563190 - protein, 9 aa, Mycobacterium
RHNPADPDD

SEQ ID NO: 563191 - protein, 9 aa, Mycobacterium
RHNPDGPYG

SEQ ID NO: 563192 - protein, 12 aa, Mycobacterium
RHNQARGIDPAL

SEQ ID NO: 563193 - protein, 6 aa, Mycobacterium
RHNQDA

SEQ ID NO: 563194 - protein, 4 aa, Mycobacterium
RHNR

SEQ ID NO: 563195 - protein, 6 aa, Mycobacterium
RHNREA

SEQ ID NO: 563196 - protein, 5 aa, Mycobacterium
RHNRR

SEQ ID NO: 563197 - protein, 10 aa, Mycobacterium
RHNSARQTRI

SEQ ID NO: 563198 - protein, 11 aa, Mycobacterium
RHPAASGRLRP

SEQ ID NO: 563199 - protein, 6 aa, Mycobacterium
RHPAAT

SEQ ID NO: 563200 - protein, 14 aa, Mycobacterium
RHPAKTVTTGAAEA

SEQ ID NO: 563201 - protein, 9 aa, Mycobacterium
RHPAPLDPN

SEQ ID NO: 563202 - protein, 7 aa, Mycobacterium
RHPARRD

SEQ ID NO: 563203 - protein, 7 aa, Mycobacterium
RHPDASV

SEQ ID NO: 563204 - protein, 7 aa, Mycobacterium
RHPDATG

SEQ ID NO: 563205 - protein, 6 aa, Mycobacterium
RHPDDH

SEQ ID NO: 563206 - protein, 12 aa, Mycobacterium
RHPDEPAGTPHV

SEQ ID NO: 563207 - protein, 7 aa, Mycobacterium
RHPDGDW

SEQ ID NO: 563208 - protein, 10 aa, Mycobacterium
RHPDGDYTIN

SEQ ID NO: 563209 - protein, 6 aa, Mycobacterium
RHPDGR

SEQ ID NO: 563210 - protein, 8 aa, Mycobacterium
RHPDGRDA

SEQ ID NO: 563211 - protein, 9 aa, Mycobacterium
RHPDGRPHH

SEQ ID NO: 563212 - protein, 6 aa, Mycobacterium
RHPDHR

SEQ ID NO: 563213 - protein, 5 aa, Mycobacterium
RHPDK

SEQ ID NO: 563214 - protein, 5 aa, Mycobacterium
RHPDL

SEQ ID NO: 563215 - protein, 11 aa, Mycobacterium
RHPDRPAGTAY

SEQ ID NO: 563216 - protein, 10 aa, Mycobacterium
RHPDRPKGVP

SEQ ID NO: 563217 - protein, 9 aa, Mycobacterium
RHPDRQAGV

SEQ ID NO: 563218 - protein, 5 aa, Mycobacterium
RHPDS

SEQ ID NO: 563219 - protein, 5 aa, Mycobacterium
RHPDY

SEQ ID NO: 563220 - protein, 6 aa, Mycobacterium
RHPEDA

SEQ ID NO: 563221 - protein, 7 aa, Mycobacterium
RHPEDGE

SEQ ID NO: 563222 - protein, 9 aa, Mycobacterium
RHPEGKDAE

SEQ ID NO: 563223 - protein, 6 aa, Mycobacterium
RHPEGL

SEQ ID NO: 563224 - protein, 12 aa, Mycobacterium
RHPEIDGSGTVR

SEQ ID NO: 563225 - protein, 5 aa, Mycobacterium
RHPEP

SEQ ID NO: 563226 - protein, 11 aa, Mycobacterium
RHPEPAPRLGE

SEQ ID NO: 563227 - protein, 5 aa, Mycobacterium
RHPER

SEQ ID NO: 563228 - protein, 10 aa, Mycobacterium
RHPESQARRY

SEQ ID NO: 563229 - protein, 12 aa, Mycobacterium
RHPFGTALKRLL

SEQ ID NO: 563230 - protein, 4 aa, Mycobacterium
RHPG

SEQ ID NO: 563231 - protein, 15 aa, Mycobacterium
RHPGAPVPANLGGEP

SEQ ID NO: 563232 - protein, 12 aa, Mycobacterium
RHPGFTTPDPSY

SEQ ID NO: 563233 - protein, 5 aa, Mycobacterium
RHPGK

SEQ ID NO: 563234 - protein, 8 aa, Mycobacterium
RHPGKRSP

SEQ ID NO: 563235 - protein, 6 aa, Mycobacterium
RHPGLR

SEQ ID NO: 563236 - protein, 7 aa, Mycobacterium
RHPGRRS

SEQ ID NO: 563237 - protein, 9 aa, Mycobacterium
RHPGSPGLR

SEQ ID NO: 563238 - protein, 6 aa, Mycobacterium
RHPGTA

SEQ ID NO: 563239 - protein, 6 aa, Mycobacterium
RHPGTN

SEQ ID NO: 563240 - protein, 6 aa, Mycobacterium
RHPGTS

SEQ ID NO: 563241 - protein, 12 aa, Mycobacterium
RHPGVKKTKAYK

SEQ ID NO: 563242 - protein, 5 aa, Mycobacterium
RHPKT

SEQ ID NO: 563243 - protein, 12 aa, Mycobacterium
RHPLPSGRSLQA

SEQ ID NO: 563244 - protein, 6 aa, Mycobacterium
RHPNAQ

SEQ ID NO: 563245 - protein, 6 aa, Mycobacterium
RHPNEP

SEQ ID NO: 563246 - protein, 13 aa, Mycobacterium
RHPNGGAASGEYR

SEQ ID NO: 563247 - protein, 5 aa, Mycobacterium
RHPNP

SEQ ID NO: 563248 - protein, 9 aa, Mycobacterium
RHPNPHKDS

SEQ ID NO: 563249 - protein, 9 aa, Mycobacterium
RHPNPHKES

SEQ ID NO: 563250 - protein, 8 aa, Mycobacterium
RHPPPDTG

SEQ ID NO: 563251 - protein, 22 aa, Mycobacterium
RHPPPGDLNAPGPCRAAGTSDL

SEQ ID NO: 563252 - protein, 14 aa, Mycobacterium
RHPQYGRAARARRD

SEQ ID NO: 563253 - protein, 4 aa, Mycobacterium
RHPR

SEQ ID NO: 563254 - protein, 7 aa, Mycobacterium
RHPRARG

SEQ ID NO: 563255 - protein, 6 aa, Mycobacterium
RHPRDD

SEQ ID NO: 563256 - protein, 6 aa, Mycobacterium
RHPRTG

SEQ ID NO: 563257 - protein, 9 aa, Mycobacterium
RHPSAPPQL

SEQ ID NO: 563258 - protein, 10 aa, Mycobacterium
RHPSHNSAGL

SEQ ID NO: 563259 - protein, 7 aa, Mycobacterium
RHPSPAG

SEQ ID NO: 563260 - protein, 6 aa, Mycobacterium
RHPSSA

SEQ ID NO: 563261 - protein, 20 aa, Mycobacterium
RHPSSAAPPRFARPRTGRSR

SEQ ID NO: 563262 - protein, 8 aa, Mycobacterium
RHPTARTH

SEQ ID NO: 563263 - protein, 6 aa, Mycobacterium
RHPTEQ

SEQ ID NO: 563264 - protein, 5 aa, Mycobacterium
RHPTR

SEQ ID NO: 563265 - protein, 7 aa, Mycobacterium
RHPTVSN

SEQ ID NO: 563266 - protein, 11 aa, Mycobacterium
RHQDHERRGRK

SEQ ID NO: 563267 - protein, 4 aa, Mycobacterium
RHQG

SEQ ID NO: 563268 - protein, 6 aa, Mycobacterium
RHQHGE

SEQ ID NO: 563269 - protein, 4 aa, Mycobacterium
RHQN

SEQ ID NO: 563270 - protein, 7 aa, Mycobacterium
RHQPADQ

SEQ ID NO: 563271 - protein, 6 aa, Mycobacterium
RHQPDS

SEQ ID NO: 563272 - protein, 24 aa, Mycobacterium
RHQPPARGVAARGGHAAEEQVDGH

SEQ ID NO: 563273 - protein, 6 aa, Mycobacterium
RHQRPS

SEQ ID NO: 563274 - protein, 5 aa, Mycobacterium
RHQTP

SEQ ID NO: 563275 - protein, 7 aa, Mycobacterium
RHRARRP

SEQ ID NO: 563276 - protein, 17 aa, Mycobacterium
RHRASESANHHDEQERR

SEQ ID NO: 563277 - protein, 7 aa, Mycobacterium
RHRDDNG

SEQ ID NO: 563278 - protein, 7 aa, Mycobacterium
RHRDGDW

SEQ ID NO: 563279 - protein, 14 aa, Mycobacterium
RHRDRGGEEDGPGG

SEQ ID NO: 563280 - protein, 49 aa, Mycobacterium
RHREPAGLGRRHRPQRAGFRPAQAAGAGRAGGARRRRPAGGARRRRPRP

SEQ ID NO: 563281 - protein, 6 aa, Mycobacterium
RHREPD

SEQ ID NO: 563282 - protein, 6 aa, Mycobacterium
RHRETS

SEQ ID NO: 563283 - protein, 5 aa, Mycobacterium
RHRGE

SEQ ID NO: 563284 - protein, 7 aa, Mycobacterium
RHRGGQK

SEQ ID NO: 563285 - protein, 17 aa, Mycobacterium
RHRGKSSIDKGSGTASP

SEQ ID NO: 563286 - protein, 6 aa, Mycobacterium
RHRGPA

SEQ ID NO: 563287 - protein, 11 aa, Mycobacterium
RHRGPDEPGTW

SEQ ID NO: 563288 - protein, 12 aa, Mycobacterium
RHRGPDEPGTWN

SEQ ID NO: 563289 - protein, 6 aa, Mycobacterium
RHRGPK

SEQ ID NO: 563290 - protein, 8 aa, Mycobacterium
RHRGSGDI

SEQ ID NO: 563291 - protein, 12 aa, Mycobacterium
RHRHAGGEYAAR

SEQ ID NO: 563292 - protein, 8 aa, Mycobacterium
RHRKSSKK

SEQ ID NO: 563293 - protein, 12 aa, Mycobacterium
RHRNGRGNPSFA

SEQ ID NO: 563294 - protein, 5 aa, Mycobacterium
RHRNP

SEQ ID NO: 563295 - protein, 6 aa, Mycobacterium
RHRPDH

SEQ ID NO: 563296 - protein, 8 aa, Mycobacterium
RHRPDNGL

SEQ ID NO: 563297 - protein, 5 aa, Mycobacterium
RHRPP

SEQ ID NO: 563298 - protein, 5 aa, Mycobacterium
RHRPR

SEQ ID NO: 563299 - protein, 8 aa, Mycobacterium
RHRQAEGL

SEQ ID NO: 563300 - protein, 5 aa, Mycobacterium
RHRQR

SEQ ID NO: 563301 - protein, 15 aa, Mycobacterium
RHRQSTVPATPGALT

SEQ ID NO: 563302 - protein, 11 aa, Mycobacterium
RHRREQYEEFA

SEQ ID NO: 563303 - protein, 13 aa, Mycobacterium
RHRRPGRAARGAA

SEQ ID NO: 563304 - protein, 23 aa, Mycobacterium
RHRRPSAPDNAAGRLTPNEGSWQ

SEQ ID NO: 563305 - protein, 9 aa, Mycobacterium
RHRRSLGDR

SEQ ID NO: 563306 - protein, 12 aa, Mycobacterium
RHRRSPRRTSNN

SEQ ID NO: 563307 - protein, 14 aa, Mycobacterium
RHRSAGGRAASGWA

SEQ ID NO: 563308 - protein, 7 aa, Mycobacterium
RHRSGDS

SEQ ID NO: 563309 - protein, 14 aa, Mycobacterium
RHRSNAGLGPGEPI

SEQ ID NO: 563310 - protein, 8 aa, Mycobacterium
RHRSRARR

SEQ ID NO: 563311 - protein, 4 aa, Mycobacterium
RHRT

SEQ ID NO: 563312 - protein, 24 aa, Mycobacterium
RHRTPAHPTLPTPNQRESGAIPPH

SEQ ID NO: 563313 - protein, 6 aa, Mycobacterium
RHSADE

SEQ ID NO: 563314 - protein, 18 aa, Mycobacterium
RHSAIDGAPTRPAKGGWS

SEQ ID NO: 563315 - protein, 10 aa, Mycobacterium
RHSDDDAGEW

SEQ ID NO: 563316 - protein, 11 aa, Mycobacterium
RHSEPEDEPTR

SEQ ID NO: 563317 - protein, 7 aa, Mycobacterium
RHSGAGR

SEQ ID NO: 563318 - protein, 7 aa, Mycobacterium
RHSGATQ

SEQ ID NO: 563319 - protein, 7 aa, Mycobacterium
RHSGATS

SEQ ID NO: 563320 - protein, 7 aa, Mycobacterium
RHSGGDI

SEQ ID NO: 563321 - protein, 13 aa, Mycobacterium
RHSGHDDEEVQRG

SEQ ID NO: 563322 - protein, 7 aa, Mycobacterium
RHSGHDF

SEQ ID NO: 563323 - protein, 9 aa, Mycobacterium
RHSGKTGEE

SEQ ID NO: 563324 - protein, 10 aa, Mycobacterium
RHSGSDETVQ

SEQ ID NO: 563325 - protein, 6 aa, Mycobacterium
RHSGSS

SEQ ID NO: 563326 - protein, 6 aa, Mycobacterium
RHSGVR

SEQ ID NO: 563327 - protein, 7 aa, Mycobacterium
RHSHDAP

SEQ ID NO: 563328 - protein, 10 aa, Mycobacterium
RHSKTRDAEA

SEQ ID NO: 563329 - protein, 4 aa, Mycobacterium
RHSP

SEQ ID NO: 563330 - protein, 6 aa, Mycobacterium
RHSPGV

SEQ ID NO: 563331 - protein, 5 aa, Mycobacterium
RHSPQ

SEQ ID NO: 563332 - protein, 6 aa, Mycobacterium
RHSQQW

SEQ ID NO: 563333 - protein, 6 aa, Mycobacterium
RHSQRT

SEQ ID NO: 563334 - protein, 6 aa, Mycobacterium
RHSRGV

SEQ ID NO: 563335 - protein, 9 aa, Mycobacterium
RHSRQQPSW

SEQ ID NO: 563336 - protein, 11 aa, Mycobacterium
RHSTGPDATRT

SEQ ID NO: 563337 - protein, 16 aa, Mycobacterium
RHTAETTVADARQRAD

SEQ ID NO: 563338 - protein, 17 aa, Mycobacterium
RHTAETTVTEARQRADG

SEQ ID NO: 563339 - protein, 9 aa, Mycobacterium
RHTDEAPPV

SEQ ID NO: 563340 - protein, 7 aa, Mycobacterium
RHTDGDR

SEQ ID NO: 563341 - protein, 16 aa, Mycobacterium
RHTDGPPDWPTGPLPP

SEQ ID NO: 563342 - protein, 13 aa, Mycobacterium
RHTEPEDESTRRL

SEQ ID NO: 563343 - protein, 5 aa, Mycobacterium
RHTGE

SEQ ID NO: 563344 - protein, 8 aa, Mycobacterium
RHTGGSDG

SEQ ID NO: 563345 - protein, 7 aa, Mycobacterium
RHTGKDA

SEQ ID NO: 563346 - protein, 18 aa, Mycobacterium
RHTGKDPAQIRKDTDRDK

SEQ ID NO: 563347 - protein, 18 aa, Mycobacterium
RHTGKDPSVIRKDTDRDK

SEQ ID NO: 563348 - protein, 8 aa, Mycobacterium
RHTGPGVE

SEQ ID NO: 563349 - protein, 18 aa, Mycobacterium
RHTGRPAEEIRKDTDRDK

SEQ ID NO: 563350 - protein, 11 aa, Mycobacterium
RHTGRTPPALN

SEQ ID NO: 563351 - protein, 7 aa, Mycobacterium
RHTGTPV

SEQ ID NO: 563352 - protein, 16 aa, Mycobacterium
RHTHRQGALDADRAAR

SEQ ID NO: 563353 - protein, 8 aa, Mycobacterium
RHTNTDDL

SEQ ID NO: 563354 - protein, 5 aa, Mycobacterium
RHTPE

SEQ ID NO: 563355 - protein, 8 aa, Mycobacterium
RHTPTDAG

SEQ ID NO: 563356 - protein, 15 aa, Mycobacterium
RHTPTKATRSASGSV

SEQ ID NO: 563357 - protein, 4 aa, Mycobacterium
RHTR

SEQ ID NO: 563358 - protein, 9 aa, Mycobacterium
RHTRPTDAE

SEQ ID NO: 563359 - protein, 15 aa, Mycobacterium
RHTRSQHWDPPGASD

SEQ ID NO: 563360 - protein, 8 aa, Mycobacterium
RHTRSTRL

SEQ ID NO: 563361 - protein, 6 aa, Mycobacterium
RHTSRE

SEQ ID NO: 563362 - protein, 8 aa, Mycobacterium
RHTTNVQT

SEQ ID NO: 563363 - protein, 10 aa, Mycobacterium
RHTTVGAGDS

SEQ ID NO: 563364 - protein, 4 aa, Mycobacterium
RHTY

SEQ ID NO: 563365 - protein, 4 aa, Mycobacterium
RHVG

SEQ ID NO: 563366 - protein, 18 aa, Mycobacterium
RHVGDDSPAVAAPPTPER

SEQ ID NO: 563367 - protein, 13 aa, Mycobacterium
RHWTGNPQREGTV

SEQ ID NO: 563368 - protein, 5 aa, Mycobacterium
RHYNP

SEQ ID NO: 563369 - protein, 6 aa, Mycobacterium
RHYRPD

SEQ ID NO: 563370 - protein, 4 aa, Mycobacterium
RIAA

SEQ ID NO: 563371 - protein, 13 aa, Mycobacterium
RIAADDATGDLSA

SEQ ID NO: 563372 - protein, 13 aa, Mycobacterium
RIADESRAARRAA

SEQ ID NO: 563373 - protein, 7 aa, Mycobacterium
RIADSRT

SEQ ID NO: 563374 - protein, 10 aa, Mycobacterium
RIAEAEDQTV

SEQ ID NO: 563375 - protein, 6 aa, Mycobacterium
RIAEDG

SEQ ID NO: 563376 - protein, 17 aa, Mycobacterium
RIAEETAKAEGKPEQAL

SEQ ID NO: 563377 - protein, 17 aa, Mycobacterium
RIAEETAKEEGKPEQAL

SEQ ID NO: 563378 - protein, 17 aa, Mycobacterium
RIAEETARAEGKPEQAL

SEQ ID NO: 563379 - protein, 17 aa, Mycobacterium
RIAEETARNEGKPEQAL

SEQ ID NO: 563380 - protein, 11 aa, Mycobacterium
RIAERGAPQSL

SEQ ID NO: 563381 - protein, 9 aa, Mycobacterium
RIAESEGAA

SEQ ID NO: 563382 - protein, 14 aa, Mycobacterium
RIAETAAAAGSGDF

SEQ ID NO: 563383 - protein, 7 aa, Mycobacterium
RIAETPS

SEQ ID NO: 563384 - protein, 6 aa, Mycobacterium
RIAGDK

SEQ ID NO: 563385 - protein, 10 aa, Mycobacterium
RIAGEERAPA

SEQ ID NO: 563386 - protein, 10 aa, Mycobacterium
RIAGEERAPV

SEQ ID NO: 563387 - protein, 12 aa, Mycobacterium
RIAGGDETLPYT

SEQ ID NO: 563388 - protein, 17 aa, Mycobacterium
RIAGYPSTGLPEPASDD

SEQ ID NO: 563389 - protein, 4 aa, Mycobacterium
RIAP

SEQ ID NO: 563390 - protein, 8 aa, Mycobacterium
RIAPEPCD

SEQ ID NO: 563391 - protein, 6 aa, Mycobacterium
RIAQTQ

SEQ ID NO: 563392 - protein, 4 aa, Mycobacterium
RIAR

SEQ ID NO: 563393 - protein, 6 aa, Mycobacterium
RIARDG

SEQ ID NO: 563394 - protein, 7 aa, Mycobacterium
RIARDGE

SEQ ID NO: 563395 - protein, 6 aa, Mycobacterium
RIARGG

SEQ ID NO: 563396 - protein, 6 aa, Mycobacterium
RIATPD

SEQ ID NO: 563397 - protein, 6 aa, Mycobacterium
RIAYGA

SEQ ID NO: 563398 - protein, 8 aa, Mycobacterium
RIDAGGRT

SEQ ID NO: 563399 - protein, 6 aa, Mycobacterium
RIDAGK

SEQ ID NO: 563400 - protein, 6 aa, Mycobacterium
RIDAQS

SEQ ID NO: 563401 - protein, 11 aa, Mycobacterium
RIDASDVDAAR

SEQ ID NO: 563402 - protein, 4 aa, Mycobacterium
RIDD

SEQ ID NO: 563403 - protein, 11 aa, Mycobacterium
RIDDADAAAGM

SEQ ID NO: 563404 - protein, 8 aa, Mycobacterium
RIDDETAP

SEQ ID NO: 563405 - protein, 9 aa, Mycobacterium
RIDDPDEAV

SEQ ID NO: 563406 - protein, 9 aa, Mycobacterium
RIDDPDYQG

SEQ ID NO: 563407 - protein, 6 aa, Mycobacterium
RIDEDM

SEQ ID NO: 563408 - protein, 10 aa, Mycobacterium
RIDEPGDDTL

SEQ ID NO: 563409 - protein, 5 aa, Mycobacterium
RIDER

SEQ ID NO: 563410 - protein, 8 aa, Mycobacterium
RIDGDETC

SEQ ID NO: 563411 - protein, 6 aa, Mycobacterium
RIDGPG

SEQ ID NO: 563412 - protein, 6 aa, Mycobacterium
RIDGSP

SEQ ID NO: 563413 - protein, 9 aa, Mycobacterium
RIDGSPYRY

SEQ ID NO: 563414 - protein, 8 aa, Mycobacterium
RIDGTDAD

SEQ ID NO: 563415 - protein, 21 aa, Mycobacterium
RIDKSTGELADERNAVTELGL

SEQ ID NO: 563416 - protein, 21 aa, Mycobacterium
RIDKTTAELADERKAVTELGL

SEQ ID NO: 563417 - protein, 6 aa, Mycobacterium
RIDPAA

SEQ ID NO: 563418 - protein, 14 aa, Mycobacterium
RIDPAKDADGLHPT

SEQ ID NO: 563419 - protein, 14 aa, Mycobacterium
RIDPDKDADGLHPT

SEQ ID NO: 563420 - protein, 8 aa, Mycobacterium
RIDPDVSG

SEQ ID NO: 563421 - protein, 14 aa, Mycobacterium
RIDPGKDADGLHPT

SEQ ID NO: 563422 - protein, 8 aa, Mycobacterium
RIDPGSTR

SEQ ID NO: 563423 - protein, 16 aa, Mycobacterium
RIDPQAPTVAAARGQR

SEQ ID NO: 563424 - protein, 8 aa, Mycobacterium
RIDPQEPA

SEQ ID NO: 563425 - protein, 8 aa, Mycobacterium
RIDPRSTG

SEQ ID NO: 563426 - protein, 14 aa, Mycobacterium
RIDPSKDADGLHPT

SEQ ID NO: 563427 - protein, 8 aa, Mycobacterium
RIDPTARG

SEQ ID NO: 563428 - protein, 6 aa, Mycobacterium
RIDQDR

SEQ ID NO: 563429 - protein, 4 aa, Mycobacterium
RIDR

SEQ ID NO: 563430 - protein, 20 aa, Mycobacterium
RIDRDGAGWSITTDDEDVRA

SEQ ID NO: 563431 - protein, 23 aa, Mycobacterium
RIDRSGSSSDGSCSRACPRSRRA

SEQ ID NO: 563432 - protein, 6 aa, Mycobacterium
RIDSAD

SEQ ID NO: 563433 - protein, 4 aa, Mycobacterium
RIDT

SEQ ID NO: 563434 - protein, 6 aa, Mycobacterium
RIDTAN

SEQ ID NO: 563435 - protein, 8 aa, Mycobacterium
RIDTDRER

SEQ ID NO: 563436 - protein, 15 aa, Mycobacterium
RIDTGHDHGAGDTLA

SEQ ID NO: 563437 - protein, 21 aa, Mycobacterium
RIDTTHDHGAGDTLAAATASA

SEQ ID NO: 563438 - protein, 5 aa, Mycobacterium
RIEDA

SEQ ID NO: 563439 - protein, 5 aa, Mycobacterium
RIEDQ

SEQ ID NO: 563440 - protein, 7 aa, Mycobacterium
RIEDRES

SEQ ID NO: 563441 - protein, 8 aa, Mycobacterium
RIEEGTTA

SEQ ID NO: 563442 - protein, 11 aa, Mycobacterium
RIEGHNSPDGK

SEQ ID NO: 563443 - protein, 11 aa, Mycobacterium
RIEGIGRPRVE

SEQ ID NO: 563444 - protein, 11 aa, Mycobacterium
RIENAEAKDAI

SEQ ID NO: 563445 - protein, 18 aa, Mycobacterium
RIENRSTKEQAITSPNGG

SEQ ID NO: 563446 - protein, 6 aa, Mycobacterium
RIEPDT

SEQ ID NO: 563447 - protein, 6 aa, Mycobacterium
RIEPGE

SEQ ID NO: 563448 - protein, 12 aa, Mycobacterium
RIEQGENAAAAW

SEQ ID NO: 563449 - protein, 6 aa, Mycobacterium
RIEQNK

SEQ ID NO: 563450 - protein, 8 aa, Mycobacterium
RIERTTDG

SEQ ID NO: 563451 - protein, 5 aa, Mycobacterium
RIGAD

SEQ ID NO: 563452 - protein, 11 aa, Mycobacterium
RIGARDSDFEA

SEQ ID NO: 563453 - protein, 5 aa, Mycobacterium
RIGDD

SEQ ID NO: 563454 - protein, 20 aa, Mycobacterium
RIGDHDEAPAVQQRTPDLPH

SEQ ID NO: 563455 - protein, 10 aa, Mycobacterium
RIGDPATDIG

SEQ ID NO: 563456 - protein, 9 aa, Mycobacterium
RIGDPDYRG

SEQ ID NO: 563457 - protein, 9 aa, Mycobacterium
RIGDPLDPA

SEQ ID NO: 563458 - protein, 9 aa, Mycobacterium
RIGDQPPEH

SEQ ID NO: 563459 - protein, 8 aa, Mycobacterium
RIGEEGKG

SEQ ID NO: 563460 - protein, 13 aa, Mycobacterium
RIGEESSSVPDHD

SEQ ID NO: 563461 - protein, 9 aa, Mycobacterium
RIGEGTGRL

SEQ ID NO: 563462 - protein, 9 aa, Mycobacterium
RIGEPAPAF

SEQ ID NO: 563463 - protein, 11 aa, Mycobacterium
RIGEQTQQIAG

SEQ ID NO: 563464 - protein, 5 aa, Mycobacterium
RIGGA

SEQ ID NO: 563465 - protein, 5 aa, Mycobacterium
RIGGP

SEQ ID NO: 563466 - protein, 22 aa, Mycobacterium
RIGGPDDGGISDDDVDVPPFMR

SEQ ID NO: 563467 - protein, 14 aa, Mycobacterium
RIGGRQPAHCTASG

SEQ ID NO: 563468 - protein, 5 aa, Mycobacterium
RIGGV

SEQ ID NO: 563469 - protein, 24 aa, Mycobacterium
RIGIPNTAAERESARLHASSSSGA

SEQ ID NO: 563470 - protein, 6 aa, Mycobacterium
RIGPTP

SEQ ID NO: 563471 - protein, 15 aa, Mycobacterium
RIGPTPADLGQDDAV

SEQ ID NO: 563472 - protein, 14 aa, Mycobacterium
RIGPTPEDLGQDDA

SEQ ID NO: 563473 - protein, 15 aa, Mycobacterium
RIGPTPEDLGQDDAV

SEQ ID NO: 563474 - protein, 19 aa, Mycobacterium
RIGQAAQAKLDKPDPRPVP

SEQ ID NO: 563475 - protein, 8 aa, Mycobacterium
RIGQEGKG

SEQ ID NO: 563476 - protein, 9 aa, Mycobacterium
RIGQQDGAL

SEQ ID NO: 563477 - protein, 5 aa, Mycobacterium
RIGRA

SEQ ID NO: 563478 - protein, 14 aa, Mycobacterium
RIGRDHNEIERSTS

SEQ ID NO: 563479 - protein, 9 aa, Mycobacterium
RIGRQTNPH

SEQ ID NO: 563480 - protein, 19 aa, Mycobacterium
RIGRSAQAKLDEPDSRPVA

SEQ ID NO: 563481 - protein, 75 aa, Mycobacterium
RIGSGSAAAAPPESKPAPAPEAAPETKAAPEPKAAPEPKPAPEPKAAPEPKPAPAATPQPAAAPAPSAGDGTPYV

SEQ ID NO: 563482 - protein, 14 aa, Mycobacterium
RIGSRTEFSEAAAK

SEQ ID NO: 563483 - protein, 6 aa, Mycobacterium
RIGTAG

SEQ ID NO: 563484 - protein, 19 aa, Mycobacterium
RIGTDTANRINSALLAPVN

SEQ ID NO: 563485 - protein, 10 aa, Mycobacterium
RIGTEAARYR

SEQ ID NO: 563486 - protein, 8 aa, Mycobacterium
RIGTEGRD

SEQ ID NO: 563487 - protein, 10 aa, Mycobacterium
RIGTERTSGF

SEQ ID NO: 563488 - protein, 13 aa, Mycobacterium
RIGTGEGRGAATD

SEQ ID NO: 563489 - protein, 77 aa, Mycobacterium
RIGTGSQAAAPAAPKPAPAPEAEPEPKPEPKPEPKPEPAARPAPEPKPEPATAPAPKAETPPSQPATQGGAEGTPYV

SEQ ID NO: 563490 - protein, 6 aa, Mycobacterium
RIKANG

SEQ ID NO: 563491 - protein, 14 aa, Mycobacterium
RIKDEAEASARARA

SEQ ID NO: 563492 - protein, 20 aa, Mycobacterium
RIKPGTSLPAPSGIFPRYQN

SEQ ID NO: 563493 - protein, 11 aa, Mycobacterium
RIKPSSRYEDL

SEQ ID NO: 563494 - protein, 6 aa, Mycobacterium
RIKRDD

SEQ ID NO: 563495 - protein, 8 aa, Mycobacterium
RIKTDDEV

SEQ ID NO: 563496 - protein, 8 aa, Mycobacterium
RIKTPEEI

SEQ ID NO: 563497 - protein, 16 aa, Mycobacterium
RINGGTNGLADRRDRY

SEQ ID NO: 563498 - protein, 10 aa, Mycobacterium
RINNGDDNQI

SEQ ID NO: 563499 - protein, 4 aa, Mycobacterium
RINP

SEQ ID NO: 563500 - protein, 5 aa, Mycobacterium
RINPG

SEQ ID NO: 563501 - protein, 7 aa, Mycobacterium
RINSSTG

SEQ ID NO: 563502 - protein, 10 aa, Mycobacterium
RIPADDPPFT

SEQ ID NO: 563503 - protein, 10 aa, Mycobacterium
RIPADTPMSA

SEQ ID NO: 563504 - protein, 9 aa, Mycobacterium
RIPAEEDRR

SEQ ID NO: 563505 - protein, 5 aa, Mycobacterium
RIPAQ

SEQ ID NO: 563506 - protein, 6 aa, Mycobacterium
RIPASR

SEQ ID NO: 563507 - protein, 10 aa, Mycobacterium
RIPASYATTE

SEQ ID NO: 563508 - protein, 5 aa, Mycobacterium
RIPDA

SEQ ID NO: 563509 - protein, 6 aa, Mycobacterium
RIPDDL

SEQ ID NO: 563510 - protein, 8 aa, Mycobacterium
RIPDGSYQ

SEQ ID NO: 563511 - protein, 5 aa, Mycobacterium
RIPDP

SEQ ID NO: 563512 - protein, 10 aa, Mycobacterium
RIPDPDNSRH

SEQ ID NO: 563513 - protein, 5 aa, Mycobacterium
RIPDR

SEQ ID NO: 563514 - protein, 10 aa, Mycobacterium
RIPDSPARPI

SEQ ID NO: 563515 - protein, 5 aa, Mycobacterium
RIPDT

SEQ ID NO: 563516 - protein, 14 aa, Mycobacterium
RIPEDYRTENGRFP

SEQ ID NO: 563517 - protein, 14 aa, Mycobacterium
RIPEPAPRTSHGPA

SEQ ID NO: 563518 - protein, 5 aa, Mycobacterium
RIPEQ

SEQ ID NO: 563519 - protein, 14 aa, Mycobacterium
RIPERQPHAKGSGA

SEQ ID NO: 563520 - protein, 4 aa, Mycobacterium
RIPG

SEQ ID NO: 563521 - protein, 6 aa, Mycobacterium
RIPGAD

SEQ ID NO: 563522 - protein, 5 aa, Mycobacterium
RIPGD

SEQ ID NO: 563523 - protein, 9 aa, Mycobacterium
RIPGDDDHT

SEQ ID NO: 563524 - protein, 7 aa, Mycobacterium
RIPGGPA

SEQ ID NO: 563525 - protein, 5 aa, Mycobacterium
RIPGH

SEQ ID NO: 563526 - protein, 8 aa, Mycobacterium
RIPGPDGK

SEQ ID NO: 563527 - protein, 6 aa, Mycobacterium
RIPGPS

SEQ ID NO: 563528 - protein, 5 aa, Mycobacterium
RIPKD

SEQ ID NO: 563529 - protein, 7 aa, Mycobacterium
RIPNQGL

SEQ ID NO: 563530 - protein, 18 aa, Mycobacterium
RIPPGYADAKNKEDPTGD

SEQ ID NO: 563531 - protein, 13 aa, Mycobacterium
RIPPNQRFESPNP

SEQ ID NO: 563532 - protein, 7 aa, Mycobacterium
RIPPPGA

SEQ ID NO: 563533 - protein, 22 aa, Mycobacterium
RIPQGAEDSMPPTLYVSAQRRP

SEQ ID NO: 563534 - protein, 5 aa, Mycobacterium
RIPQT

SEQ ID NO: 563535 - protein, 6 aa, Mycobacterium
RIPREG

SEQ ID NO: 563536 - protein, 24 aa, Mycobacterium
RIPRRRSTRPPARSKRNMDQDPVD

SEQ ID NO: 563537 - protein, 14 aa, Mycobacterium
RIPRTNDYEQAGQR

SEQ ID NO: 563538 - protein, 4 aa, Mycobacterium
RIPT

SEQ ID NO: 563539 - protein, 6 aa, Mycobacterium
RIPTEP

SEQ ID NO: 563540 - protein, 11 aa, Mycobacterium
RIPTGDPEAAA

SEQ ID NO: 563541 - protein, 12 aa, Mycobacterium
RIPTGFGTEPGE

SEQ ID NO: 563542 - protein, 12 aa, Mycobacterium
RIPTGLGTEPGE

SEQ ID NO: 563543 - protein, 7 aa, Mycobacterium
RIPTGPL

SEQ ID NO: 563544 - protein, 6 aa, Mycobacterium
RIPTRH

SEQ ID NO: 563545 - protein, 7 aa, Mycobacterium
RIPTRTQ

SEQ ID NO: 563546 - protein, 11 aa, Mycobacterium
RIPYDKPGRHR

SEQ ID NO: 563547 - protein, 5 aa, Mycobacterium
RIPYR

SEQ ID NO: 563548 - protein, 5 aa, Mycobacterium
RIQPG

SEQ ID NO: 563549 - protein, 12 aa, Mycobacterium
RIQPKDPDSVQW

SEQ ID NO: 563550 - protein, 7 aa, Mycobacterium
RIQPPAT

SEQ ID NO: 563551 - protein, 10 aa, Mycobacterium
RIQSKSKEMG

SEQ ID NO: 563552 - protein, 5 aa, Mycobacterium
RIRAG

SEQ ID NO: 563553 - protein, 6 aa, Mycobacterium
RIRDDA

SEQ ID NO: 563554 - protein, 5 aa, Mycobacterium
RIRER

SEQ ID NO: 563555 - protein, 7 aa, Mycobacterium
RIRGTRA

SEQ ID NO: 563556 - protein, 4 aa, Mycobacterium
RIRK

SEQ ID NO: 563557 - protein, 5 aa, Mycobacterium
RIRKT

SEQ ID NO: 563558 - protein, 4 aa, Mycobacterium
RIRN

SEQ ID NO: 563559 - protein, 5 aa, Mycobacterium
RIRNN

SEQ ID NO: 563560 - protein, 7 aa, Mycobacterium
RIRNTPR

SEQ ID NO: 563561 - protein, 12 aa, Mycobacterium
RIRPDPATSAAN

SEQ ID NO: 563562 - protein, 5 aa, Mycobacterium
RIRPG

SEQ ID NO: 563563 - protein, 8 aa, Mycobacterium
RIRPGPEA

SEQ ID NO: 563564 - protein, 10 aa, Mycobacterium
RIRPGREPEV

SEQ ID NO: 563565 - protein, 22 aa, Mycobacterium
RIRPGRGSRPRTKNRPEHADAQ

SEQ ID NO: 563566 - protein, 7 aa, Mycobacterium
RIRPSTI

SEQ ID NO: 563567 - protein, 7 aa, Mycobacterium
RIRPSTM

SEQ ID NO: 563568 - protein, 8 aa, Mycobacterium
RIRPTSGH

SEQ ID NO: 563569 - protein, 7 aa, Mycobacterium
RIRRGGA

SEQ ID NO: 563570 - protein, 8 aa, Mycobacterium
RIRRGQVD

SEQ ID NO: 563571 - protein, 7 aa, Mycobacterium
RIRSAEP

SEQ ID NO: 563572 - protein, 13 aa, Mycobacterium
RIRTGSAHLENSP

SEQ ID NO: 563573 - protein, 6 aa, Mycobacterium
RIRTSD

SEQ ID NO: 563574 - protein, 7 aa, Mycobacterium
RIRTSDG

SEQ ID NO: 563575 - protein, 6 aa, Mycobacterium
RISAES

SEQ ID NO: 563576 - protein, 5 aa, Mycobacterium
RISDA

SEQ ID NO: 563577 - protein, 12 aa, Mycobacterium
RISDDAPTVAAA

SEQ ID NO: 563578 - protein, 14 aa, Mycobacterium
RISDPGSRRSRPLH

SEQ ID NO: 563579 - protein, 9 aa, Mycobacterium
RISGAPSDI

SEQ ID NO: 563580 - protein, 10 aa, Mycobacterium
RISGDSAAAH

SEQ ID NO: 563581 - protein, 7 aa, Mycobacterium
RISKGSD

SEQ ID NO: 563582 - protein, 7 aa, Mycobacterium
RISPDTI

SEQ ID NO: 563583 - protein, 7 aa, Mycobacterium
RISPEQE

SEQ ID NO: 563584 - protein, 8 aa, Mycobacterium
RISPGSGA

SEQ ID NO: 563585 - protein, 10 aa, Mycobacterium
RISPNDTAGA

SEQ ID NO: 563586 - protein, 13 aa, Mycobacterium
RISQTDTPKPTPT

SEQ ID NO: 563587 - protein, 8 aa, Mycobacterium
RISSGTHS

SEQ ID NO: 563588 - protein, 15 aa, Mycobacterium
RISSGTHSTWAPGEQ

SEQ ID NO: 563589 - protein, 13 aa, Mycobacterium
RISSSTVAAGGPI

SEQ ID NO: 563590 - protein, 6 aa, Mycobacterium
RISTES

SEQ ID NO: 563591 - protein, 5 aa, Mycobacterium
RISTG

SEQ ID NO: 563592 - protein, 6 aa, Mycobacterium
RISTGQ

SEQ ID NO: 563593 - protein, 6 aa, Mycobacterium
RITAPK

SEQ ID NO: 563594 - protein, 5 aa, Mycobacterium
RITAT

SEQ ID NO: 563595 - protein, 9 aa, Mycobacterium
RITDEGGRA

SEQ ID NO: 563596 - protein, 5 aa, Mycobacterium
RITEG

SEQ ID NO: 563597 - protein, 6 aa, Mycobacterium
RITEQG

SEQ ID NO: 563598 - protein, 27 aa, Mycobacterium
RITERGATRADDRISEAGMEDRKKEGY

SEQ ID NO: 563599 - protein, 7 aa, Mycobacterium
RITGAAT

SEQ ID NO: 563600 - protein, 10 aa, Mycobacterium
RITGGVRRQA

SEQ ID NO: 563601 - protein, 8 aa, Mycobacterium
RITGNTTR

SEQ ID NO: 563602 - protein, 12 aa, Mycobacterium
RITGPDAGRANR

SEQ ID NO: 563603 - protein, 6 aa, Mycobacterium
RITGRD

SEQ ID NO: 563604 - protein, 6 aa, Mycobacterium
RITGSA

SEQ ID NO: 563605 - protein, 12 aa, Mycobacterium
RITGSRRRSNAE

SEQ ID NO: 563606 - protein, 5 aa, Mycobacterium
RITHT

SEQ ID NO: 563607 - protein, 7 aa, Mycobacterium
RITKTEG

SEQ ID NO: 563608 - protein, 4 aa, Mycobacterium
RITN

SEQ ID NO: 563609 - protein, 4 aa, Mycobacterium
RITP

SEQ ID NO: 563610 - protein, 7 aa, Mycobacterium
RITPDKR

SEQ ID NO: 563611 - protein, 10 aa, Mycobacterium
RITPGDHEKR

SEQ ID NO: 563612 - protein, 12 aa, Mycobacterium
RITPGSGEKRSA

SEQ ID NO: 563613 - protein, 5 aa, Mycobacterium
RITPR

SEQ ID NO: 563614 - protein, 19 aa, Mycobacterium
RITPSKREFRASPAFDSEA

SEQ ID NO: 563615 - protein, 7 aa, Mycobacterium
RITPTDA

SEQ ID NO: 563616 - protein, 5 aa, Mycobacterium
RITSE

SEQ ID NO: 563617 - protein, 21 aa, Mycobacterium
RITSSGTGGSASEADVRAAMA

SEQ ID NO: 563618 - protein, 12 aa, Mycobacterium
RITSTRGKSITS

SEQ ID NO: 563619 - protein, 4 aa, Mycobacterium
RITT

SEQ ID NO: 563620 - protein, 6 aa, Mycobacterium
RITTGQ

SEQ ID NO: 563621 - protein, 7 aa, Mycobacterium
RITTSGG

SEQ ID NO: 563622 - protein, 10 aa, Mycobacterium
RITTSGGTAM

SEQ ID NO: 563623 - protein, 4 aa, Mycobacterium
RITY

SEQ ID NO: 563624 - protein, 5 aa, Mycobacterium
RIVPD

SEQ ID NO: 563625 - protein, 4 aa, Mycobacterium
RKAA

SEQ ID NO: 563626 - protein, 9 aa, Mycobacterium
RKAAAAGSS

SEQ ID NO: 563627 - protein, 13 aa, Mycobacterium
RKAAEGLARDPDA

SEQ ID NO: 563628 - protein, 7 aa, Mycobacterium
RKAAEGY

SEQ ID NO: 563629 - protein, 20 aa, Mycobacterium
RKAAERRGAAAQPMGAGEGA

SEQ ID NO: 563630 - protein, 14 aa, Mycobacterium
RKAAGGSAAGMLSP

SEQ ID NO: 563631 - protein, 24 aa, Mycobacterium
RKAAKAARAAAGDAETGTDESNEA

SEQ ID NO: 563632 - protein, 9 aa, Mycobacterium
RKAAKRLAK

SEQ ID NO: 563633 - protein, 8 aa, Mycobacterium
RKAANRDD

SEQ ID NO: 563634 - protein, 18 aa, Mycobacterium
RKAAQGKDVRLGGGASTV

SEQ ID NO: 563635 - protein, 22 aa, Mycobacterium
RKAARAAAGVDPQHPDHPHERD

SEQ ID NO: 563636 - protein, 8 aa, Mycobacterium
RKAARGLA

SEQ ID NO: 563637 - protein, 15 aa, Mycobacterium
RKAATKLADHPQAAP

SEQ ID NO: 563638 - protein, 7 aa, Mycobacterium
RKADPHG

SEQ ID NO: 563639 - protein, 8 aa, Mycobacterium
RKADPPVP

SEQ ID NO: 563640 - protein, 9 aa, Mycobacterium
RKADSGYAS

SEQ ID NO: 563641 - protein, 6 aa, Mycobacterium
RKAEAA

SEQ ID NO: 563642 - protein, 9 aa, Mycobacterium
RKAEEPGDD

SEQ ID NO: 563643 - protein, 8 aa, Mycobacterium
RKAEPTDD

SEQ ID NO: 563644 - protein, 7 aa, Mycobacterium
RKAFGTP

SEQ ID NO: 563645 - protein, 12 aa, Mycobacterium
RKAFTGAAADQV

SEQ ID NO: 563646 - protein, 10 aa, Mycobacterium
RKAGAAERGR

SEQ ID NO: 563647 - protein, 7 aa, Mycobacterium
RKAGASA

SEQ ID NO: 563648 - protein, 6 aa, Mycobacterium
RKAGHQ

SEQ ID NO: 563649 - protein, 8 aa, Mycobacterium
RKAGIKGD

SEQ ID NO: 563650 - protein, 7 aa, Mycobacterium
RKAGPDA

SEQ ID NO: 563651 - protein, 16 aa, Mycobacterium
RKAGQNATAKTAVERG

SEQ ID NO: 563652 - protein, 6 aa, Mycobacterium
RKAGRQ

SEQ ID NO: 563653 - protein, 17 aa, Mycobacterium
RKAGSDTDHAAAAADGW

SEQ ID NO: 563654 - protein, 9 aa, Mycobacterium
RKAGSELDH

SEQ ID NO: 563655 - protein, 8 aa, Mycobacterium
RKAGTEIR

SEQ ID NO: 563656 - protein, 10 aa, Mycobacterium
RKAGTEIRVP

SEQ ID NO: 563657 - protein, 16 aa, Mycobacterium
RKAGTETDHAADAAAG

SEQ ID NO: 563658 - protein, 31 aa, Mycobacterium
RKAGTKKGPTVGSGGQRRRALEGRGPTPPAH

SEQ ID NO: 563659 - protein, 9 aa, Mycobacterium
RKAGVKPTI

SEQ ID NO: 563660 - protein, 5 aa, Mycobacterium
RKAHG

SEQ ID NO: 563661 - protein, 12 aa, Mycobacterium
RKAHGDAAGTRS

SEQ ID NO: 563662 - protein, 12 aa, Mycobacterium
RKAIRDSRIGPT

SEQ ID NO: 563663 - protein, 6 aa, Mycobacterium
RKAKAG

SEQ ID NO: 563664 - protein, 9 aa, Mycobacterium
RKAKDNRDD

SEQ ID NO: 563665 - protein, 9 aa, Mycobacterium
RKAKENRED

SEQ ID NO: 563666 - protein, 22 aa, Mycobacterium
RKAKVDGIPDTESAVTPDLLED

SEQ ID NO: 563667 - protein, 17 aa, Mycobacterium
RKAMETDYEEAKKQLEA

SEQ ID NO: 563668 - protein, 9 aa, Mycobacterium
RKANDELNR

SEQ ID NO: 563669 - protein, 7 aa, Mycobacterium
RKANGPF

SEQ ID NO: 563670 - protein, 21 aa, Mycobacterium
RKANKVTSTPKPVANRLPSAV

SEQ ID NO: 563671 - protein, 9 aa, Mycobacterium
RKAPDGAYD

SEQ ID NO: 563672 - protein, 27 aa, Mycobacterium
RKAPDNDKIRRRAATESSEKQAQKVRQ

SEQ ID NO: 563673 - protein, 16 aa, Mycobacterium
RKAPDPDKDQGGGAAG

SEQ ID NO: 563674 - protein, 7 aa, Mycobacterium
RKAPGSS

SEQ ID NO: 563675 - protein, 19 aa, Mycobacterium
RKAPVTEPAVEPLSSPIAP

SEQ ID NO: 563676 - protein, 4 aa, Mycobacterium
RKAQ

SEQ ID NO: 563677 - protein, 8 aa, Mycobacterium
RKAQRDIG

SEQ ID NO: 563678 - protein, 9 aa, Mycobacterium
RKAQREGDV

SEQ ID NO: 563679 - protein, 20 aa, Mycobacterium
RKAQTQVQARAARSGQIERD

SEQ ID NO: 563680 - protein, 12 aa, Mycobacterium
RKARERGANPDL

SEQ ID NO: 563681 - protein, 8 aa, Mycobacterium
RKARERLD

SEQ ID NO: 563682 - protein, 12 aa, Mycobacterium
RKARGAAGPAER

SEQ ID NO: 563683 - protein, 7 aa, Mycobacterium
RKARGGV

SEQ ID NO: 563684 - protein, 12 aa, Mycobacterium
RKASANAGDPGA

SEQ ID NO: 563685 - protein, 8 aa, Mycobacterium
RKASAREM

SEQ ID NO: 563686 - protein, 50 aa, Mycobacterium
RKASKARGTWRATSATAGYSSDARRAGDRAGRRARLGGDTELTGARSALE

SEQ ID NO: 563687 - protein, 13 aa, Mycobacterium
RKASVAAGDPHAT

SEQ ID NO: 563688 - protein, 6 aa, Mycobacterium
RKATEA

SEQ ID NO: 563689 - protein, 6 aa, Mycobacterium
RKATRK

SEQ ID NO: 563690 - protein, 8 aa, Mycobacterium
RKAVDAGV

SEQ ID NO: 563691 - protein, 5 aa, Mycobacterium
RKAVG

SEQ ID NO: 563692 - protein, 12 aa, Mycobacterium
RKDADTLATPQV

SEQ ID NO: 563693 - protein, 5 aa, Mycobacterium
RKDAG

SEQ ID NO: 563694 - protein, 7 aa, Mycobacterium
RKDDGNA

SEQ ID NO: 563695 - protein, 17 aa, Mycobacterium
RKDDNGRVTVTVRLGES

SEQ ID NO: 563696 - protein, 7 aa, Mycobacterium
RKDDPRI

SEQ ID NO: 563697 - protein, 12 aa, Mycobacterium
RKDDSPVGAHAR

SEQ ID NO: 563698 - protein, 12 aa, Mycobacterium
RKDDYGGSIDNR

SEQ ID NO: 563699 - protein, 12 aa, Mycobacterium
RKDEYGGDIDNR

SEQ ID NO: 563700 - protein, 12 aa, Mycobacterium
RKDGRLQGGNTH

SEQ ID NO: 563701 - protein, 6 aa, Mycobacterium
RKDGSG

SEQ ID NO: 563702 - protein, 8 aa, Mycobacterium
RKDGTAVS

SEQ ID NO: 563703 - protein, 5 aa, Mycobacterium
RKDID

SEQ ID NO: 563704 - protein, 5 aa, Mycobacterium
RKDIG

SEQ ID NO: 563705 - protein, 6 aa, Mycobacterium
RKDIPD

SEQ ID NO: 563706 - protein, 22 aa, Mycobacterium
RKDLGAPKDNQQTNPDGGTYQQ

SEQ ID NO: 563707 - protein, 8 aa, Mycobacterium
RKDLSDKT

SEQ ID NO: 563708 - protein, 7 aa, Mycobacterium
RKDLTEA

SEQ ID NO: 563709 - protein, 10 aa, Mycobacterium
RKDNPEGPLG

SEQ ID NO: 563710 - protein, 14 aa, Mycobacterium
RKDNPSNPSPPEAH

SEQ ID NO: 563711 - protein, 9 aa, Mycobacterium
RKDPATPKI

SEQ ID NO: 563712 - protein, 10 aa, Mycobacterium
RKDPEGLGRS

SEQ ID NO: 563713 - protein, 9 aa, Mycobacterium
RKDPSTPKI

SEQ ID NO: 563714 - protein, 8 aa, Mycobacterium
RKDQHPAI

SEQ ID NO: 563715 - protein, 8 aa, Mycobacterium
RKDRPEPV

SEQ ID NO: 563716 - protein, 7 aa, Mycobacterium
RKDSASI

SEQ ID NO: 563717 - protein, 8 aa, Mycobacterium
RKDTADRY

SEQ ID NO: 563718 - protein, 8 aa, Mycobacterium
RKDTDRDK

SEQ ID NO: 563719 - protein, 17 aa, Mycobacterium
RKDTNADVNDRYPVPSG

SEQ ID NO: 563720 - protein, 8 aa, Mycobacterium
RKDTRERL

SEQ ID NO: 563721 - protein, 13 aa, Mycobacterium
RKDYNSFGSRRGN

SEQ ID NO: 563722 - protein, 12 aa, Mycobacterium
RKEAAKTAEAID

SEQ ID NO: 563723 - protein, 19 aa, Mycobacterium
RKEAEAEVQRSVERFQASG

SEQ ID NO: 563724 - protein, 7 aa, Mycobacterium
RKEAELS

SEQ ID NO: 563725 - protein, 8 aa, Mycobacterium
RKEAIGAQ

SEQ ID NO: 563726 - protein, 9 aa, Mycobacterium
RKEAVGPQT

SEQ ID NO: 563727 - protein, 10 aa, Mycobacterium
RKEDAGPTNN

SEQ ID NO: 563728 - protein, 10 aa, Mycobacterium
RKEDASDDSR

SEQ ID NO: 563729 - protein, 7 aa, Mycobacterium
RKEDEVE

SEQ ID NO: 563730 - protein, 4 aa, Mycobacterium
RKEE

SEQ ID NO: 563731 - protein, 30 aa, Mycobacterium
RKEFGPLTDTPPEMGDGVEDGWRESYPSRL

SEQ ID NO: 563732 - protein, 6 aa, Mycobacterium
RKEGDR

SEQ ID NO: 563733 - protein, 11 aa, Mycobacterium
RKEGDTGGTIS

SEQ ID NO: 563734 - protein, 12 aa, Mycobacterium
RKEGGKTGTWTR

SEQ ID NO: 563735 - protein, 9 aa, Mycobacterium
RKEGKIGRA

SEQ ID NO: 563736 - protein, 8 aa, Mycobacterium
RKEGSEER

SEQ ID NO: 563737 - protein, 14 aa, Mycobacterium
RKEGSSKERAARIS

SEQ ID NO: 563738 - protein, 11 aa, Mycobacterium
RKEISEDEEHQ

SEQ ID NO: 563739 - protein, 5 aa, Mycobacterium
RKEKR

SEQ ID NO: 563740 - protein, 12 aa, Mycobacterium
RKELGKPRATVD

SEQ ID NO: 563741 - protein, 5 aa, Mycobacterium
RKELP

SEQ ID NO: 563742 - protein, 7 aa, Mycobacterium
RKEMAQD

SEQ ID NO: 563743 - protein, 12 aa, Mycobacterium
RKEPAKTADAID

SEQ ID NO: 563744 - protein, 13 aa, Mycobacterium
RKEPEKTAAAIDP

SEQ ID NO: 563745 - protein, 12 aa, Mycobacterium
RKEPEKTAEAID

SEQ ID NO: 563746 - protein, 10 aa, Mycobacterium
RKEQPNQGVQ

SEQ ID NO: 563747 - protein, 9 aa, Mycobacterium
RKEREPGDD

SEQ ID NO: 563748 - protein, 9 aa, Mycobacterium
RKESETPGA

SEQ ID NO: 563749 - protein, 18 aa, Mycobacterium
RKESRGGHAREDYPNRDD

SEQ ID NO: 563750 - protein, 7 aa, Mycobacterium
RKETADR

SEQ ID NO: 563751 - protein, 6 aa, Mycobacterium
RKETGV

SEQ ID NO: 563752 - protein, 10 aa, Mycobacterium
RKETSDSATL

SEQ ID NO: 563753 - protein, 6 aa, Mycobacterium
RKEYGQ

SEQ ID NO: 563754 - protein, 7 aa, Mycobacterium
RKFAERG

SEQ ID NO: 563755 - protein, 5 aa, Mycobacterium
RKFNG

SEQ ID NO: 563756 - protein, 6 aa, Mycobacterium
RKFPRA

SEQ ID NO: 563757 - protein, 4 aa, Mycobacterium
RKFR

SEQ ID NO: 563758 - protein, 10 aa, Mycobacterium
RKGADGRVHG

SEQ ID NO: 563759 - protein, 5 aa, Mycobacterium
RKGAG

SEQ ID NO: 563760 - protein, 16 aa, Mycobacterium
RKGAKVSKKHDTATTP

SEQ ID NO: 563761 - protein, 8 aa, Mycobacterium
RKGAPETF

SEQ ID NO: 563762 - protein, 10 aa, Mycobacterium
RKGASPSPEV

SEQ ID NO: 563763 - protein, 17 aa, Mycobacterium
RKGDADAYSLSTDEVAD

SEQ ID NO: 563764 - protein, 16 aa, Mycobacterium
RKGDADAYSLSTEEVA

SEQ ID NO: 563765 - protein, 13 aa, Mycobacterium
RKGDAIDRIRYFP

SEQ ID NO: 563766 - protein, 6 aa, Mycobacterium
RKGDGF

SEQ ID NO: 563767 - protein, 6 aa, Mycobacterium
RKGDRV

SEQ ID NO: 563768 - protein, 9 aa, Mycobacterium
RKGEAGPLA

SEQ ID NO: 563769 - protein, 6 aa, Mycobacterium
RKGEAT

SEQ ID NO: 563770 - protein, 6 aa, Mycobacterium
RKGEGF

SEQ ID NO: 563771 - protein, 7 aa, Mycobacterium
RKGEGPG

SEQ ID NO: 563772 - protein, 10 aa, Mycobacterium
RKGETAARTM

SEQ ID NO: 563773 - protein, 8 aa, Mycobacterium
RKGETNRV

SEQ ID NO: 563774 - protein, 6 aa, Mycobacterium
RKGETS

SEQ ID NO: 563775 - protein, 4 aa, Mycobacterium
RKGG

SEQ ID NO: 563776 - protein, 20 aa, Mycobacterium
RKGGASAATVKATAEQLVAM

SEQ ID NO: 563777 - protein, 7 aa, Mycobacterium
RKGGGPG

SEQ ID NO: 563778 - protein, 18 aa, Mycobacterium
RKGGKDGPRATLVGRHPR

SEQ ID NO: 563779 - protein, 8 aa, Mycobacterium
RKGGMTDA

SEQ ID NO: 563780 - protein, 6 aa, Mycobacterium
RKGGQI

SEQ ID NO: 563781 - protein, 5 aa, Mycobacterium
RKGID

SEQ ID NO: 563782 - protein, 8 aa, Mycobacterium
RKGIPTYG

SEQ ID NO: 563783 - protein, 7 aa, Mycobacterium
RKGITSR

SEQ ID NO: 563784 - protein, 24 aa, Mycobacterium
RKGLPPNPDATSTGLDGARGADVD

SEQ ID NO: 563785 - protein, 6 aa, Mycobacterium
RKGLPT

SEQ ID NO: 563786 - protein, 4 aa, Mycobacterium
RKGN

SEQ ID NO: 563787 - protein, 8 aa, Mycobacterium
RKGPGQTL

SEQ ID NO: 563788 - protein, 8 aa, Mycobacterium
RKGPLAAP

SEQ ID NO: 563789 - protein, 17 aa, Mycobacterium
RKGPNNNPTAVPGDVGS

SEQ ID NO: 563790 - protein, 7 aa, Mycobacterium
RKGPWTV

SEQ ID NO: 563791 - protein, 7 aa, Mycobacterium
RKGQAAV

SEQ ID NO: 563792 - protein, 6 aa, Mycobacterium
RKGQDT

SEQ ID NO: 563793 - protein, 14 aa, Mycobacterium
RKGQRALRRGGADG

SEQ ID NO: 563794 - protein, 9 aa, Mycobacterium
RKGQTTGRL

SEQ ID NO: 563795 - protein, 6 aa, Mycobacterium
RKGQTV

SEQ ID NO: 563796 - protein, 8 aa, Mycobacterium
RKGRAGER

SEQ ID NO: 563797 - protein, 5 aa, Mycobacterium
RKGRN

SEQ ID NO: 563798 - protein, 18 aa, Mycobacterium
RKGRNNNPTAAPGDVGSP

SEQ ID NO: 563799 - protein, 18 aa, Mycobacterium
RKGRNNSPTAAPGDVGSP

SEQ ID NO: 563800 - protein, 18 aa, Mycobacterium
RKGRNNSPTAAPTDVGSP

SEQ ID NO: 563801 - protein, 18 aa, Mycobacterium
RKGRNNSVTAAPGDVGSP

SEQ ID NO: 563802 - protein, 9 aa, Mycobacterium
RKGRYPDRK

SEQ ID NO: 563803 - protein, 4 aa, Mycobacterium
RKGS

SEQ ID NO: 563804 - protein, 7 aa, Mycobacterium
RKGSDYD

SEQ ID NO: 563805 - protein, 7 aa, Mycobacterium
RKGSGPG

SEQ ID NO: 563806 - protein, 6 aa, Mycobacterium
RKGSGY

SEQ ID NO: 563807 - protein, 4 aa, Mycobacterium
RKGT

SEQ ID NO: 563808 - protein, 12 aa, Mycobacterium
RKGTAVARGVGT

SEQ ID NO: 563809 - protein, 7 aa, Mycobacterium
RKGTERL

SEQ ID NO: 563810 - protein, 9 aa, Mycobacterium
RKGVISGRT

SEQ ID NO: 563811 - protein, 5 aa, Mycobacterium
RKGWP

SEQ ID NO: 563812 - protein, 6 aa, Mycobacterium
RKGYVS

SEQ ID NO: 563813 - protein, 11 aa, Mycobacterium
RKHAAKNPKAY

SEQ ID NO: 563814 - protein, 10 aa, Mycobacterium
RKHAANNPKA

SEQ ID NO: 563815 - protein, 11 aa, Mycobacterium
RKHAANNPKAH

SEQ ID NO: 563816 - protein, 9 aa, Mycobacterium
RKHAATNPK

SEQ ID NO: 563817 - protein, 6 aa, Mycobacterium
RKHGKQ

SEQ ID NO: 563818 - protein, 8 aa, Mycobacterium
RKHGPVGN

SEQ ID NO: 563819 - protein, 17 aa, Mycobacterium
RKHGSDDDHAAAAADGW

SEQ ID NO: 563820 - protein, 4 aa, Mycobacterium
RKHN

SEQ ID NO: 563821 - protein, 5 aa, Mycobacterium
RKHNA

SEQ ID NO: 563822 - protein, 7 aa, Mycobacterium
RKHPGAA

SEQ ID NO: 563823 - protein, 5 aa, Mycobacterium
RKHPR

SEQ ID NO: 563824 - protein, 10 aa, Mycobacterium
RKHPRARAGW

SEQ ID NO: 563825 - protein, 6 aa, Mycobacterium
RKHRSA

SEQ ID NO: 563826 - protein, 10 aa, Mycobacterium
RKHSHAESRG

SEQ ID NO: 563827 - protein, 9 aa, Mycobacterium
RKIASTAPN

SEQ ID NO: 563828 - protein, 7 aa, Mycobacterium
RKIDAEL

SEQ ID NO: 563829 - protein, 18 aa, Mycobacterium
RKIEPEKRPNLRLAQQFT

SEQ ID NO: 563830 - protein, 7 aa, Mycobacterium
RKIGARS

SEQ ID NO: 563831 - protein, 16 aa, Mycobacterium
RKINDSYANGYGNSKW

SEQ ID NO: 563832 - protein, 6 aa, Mycobacterium
RKISTK

SEQ ID NO: 563833 - protein, 9 aa, Mycobacterium
RKITPSEYR

SEQ ID NO: 563834 - protein, 18 aa, Mycobacterium
RKKAAAKGADEDKKANVD

SEQ ID NO: 563835 - protein, 28 aa, Mycobacterium
RKKAAAKGAGEDKKANVDAAVNMHRGKA

SEQ ID NO: 563836 - protein, 26 aa, Mycobacterium
RKKAAAKGGGEDKKANVDAALKMHSG

SEQ ID NO: 563837 - protein, 9 aa, Mycobacterium
RKKAGSIEE

SEQ ID NO: 563838 - protein, 11 aa, Mycobacterium
RKKANSPKYAD

SEQ ID NO: 563839 - protein, 9 aa, Mycobacterium
RKKDARTRA

SEQ ID NO: 563840 - protein, 5 aa, Mycobacterium
RKKDE

SEQ ID NO: 563841 - protein, 4 aa, Mycobacterium
RKKG

SEQ ID NO: 563842 - protein, 37 aa, Mycobacterium
RKKGDSKEKAARISNAAAGRGKSSVGRKGGKSGSYQD

SEQ ID NO: 563843 - protein, 9 aa, Mycobacterium
RKKGGLSGY

SEQ ID NO: 563844 - protein, 16 aa, Mycobacterium
RKKGGLSGYPCRAESE

SEQ ID NO: 563845 - protein, 17 aa, Mycobacterium
RKKGGLSGYPSRAESEH

SEQ ID NO: 563846 - protein, 15 aa, Mycobacterium
RKKGTGVRPSLISSA

SEQ ID NO: 563847 - protein, 7 aa, Mycobacterium
RKKKRYQ

SEQ ID NO: 563848 - protein, 8 aa, Mycobacterium
RKKLTDDL

SEQ ID NO: 563849 - protein, 9 aa, Mycobacterium
RKKNPETGY

SEQ ID NO: 563850 - protein, 6 aa, Mycobacterium
RKKNRY

SEQ ID NO: 563851 - protein, 7 aa, Mycobacterium
RKKPGTH

SEQ ID NO: 563852 - protein, 27 aa, Mycobacterium
RKKPKARKRGGHGGGAATGDSVTAPMQ

SEQ ID NO: 563853 - protein, 27 aa, Mycobacterium
RKKPKPRKRGGGGGAAASGDAVTAPMQ

SEQ ID NO: 563854 - protein, 14 aa, Mycobacterium
RKKQRQPAEYPTDE

SEQ ID NO: 563855 - protein, 14 aa, Mycobacterium
RKKQRQPAEYPTEA

SEQ ID NO: 563856 - protein, 14 aa, Mycobacterium
RKKQRQPSEYPTDE

SEQ ID NO: 563857 - protein, 63 aa, Mycobacterium
RKKRNPDEGEPNDESLTHETEWPSAPKTAAQKPSAESVKLSGQGRPTLTSGDESADGDQPVSD

SEQ ID NO: 563858 - protein, 10 aa, Mycobacterium
RKKRQAARDS

SEQ ID NO: 563859 - protein, 8 aa, Mycobacterium
RKKRRTRA

SEQ ID NO: 563860 - protein, 6 aa, Mycobacterium
RKKVAT

SEQ ID NO: 563861 - protein, 14 aa, Mycobacterium
RKKYGDVDPQRNAQ

SEQ ID NO: 563862 - protein, 10 aa, Mycobacterium
RKLADDPELV

SEQ ID NO: 563863 - protein, 21 aa, Mycobacterium
RKLDGEPGLDGSPSPAEPMTE

SEQ ID NO: 563864 - protein, 7 aa, Mycobacterium
RKLDNGS

SEQ ID NO: 563865 - protein, 8 aa, Mycobacterium
RKLDPGAL

SEQ ID NO: 563866 - protein, 7 aa, Mycobacterium
RKLDPVS

SEQ ID NO: 563867 - protein, 18 aa, Mycobacterium
RKLEAQPKSVGDGADVRR

SEQ ID NO: 563868 - protein, 14 aa, Mycobacterium
RKLEPGPSADEAYT

SEQ ID NO: 563869 - protein, 5 aa, Mycobacterium
RKLET

SEQ ID NO: 563870 - protein, 9 aa, Mycobacterium
RKLGADKGM

SEQ ID NO: 563871 - protein, 8 aa, Mycobacterium
RKLGGDNA

SEQ ID NO: 563872 - protein, 7 aa, Mycobacterium
RKLGRSG

SEQ ID NO: 563873 - protein, 6 aa, Mycobacterium
RKLGVP

SEQ ID NO: 563874 - protein, 6 aa, Mycobacterium
RKLPGR

SEQ ID NO: 563875 - protein, 23 aa, Mycobacterium
RKLSPPRRRPATSVTYREAFGNP

SEQ ID NO: 563876 - protein, 7 aa, Mycobacterium
RKLTEGD

SEQ ID NO: 563877 - protein, 6 aa, Mycobacterium
RKLTPD

SEQ ID NO: 563878 - protein, 11 aa, Mycobacterium
RKMSKSKGNVI

SEQ ID NO: 563879 - protein, 12 aa, Mycobacterium
RKMSKSRGNGID

SEQ ID NO: 563880 - protein, 4 aa, Mycobacterium
RKNG

SEQ ID NO: 563881 - protein, 7 aa, Mycobacterium
RKNGGDV

SEQ ID NO: 563882 - protein, 9 aa, Mycobacterium
RKNGPHPKN

SEQ ID NO: 563883 - protein, 10 aa, Mycobacterium
RKNHEANAET

SEQ ID NO: 563884 - protein, 6 aa, Mycobacterium
RKNKGV

SEQ ID NO: 563885 - protein, 13 aa, Mycobacterium
RKNLAAPGDRAAE

SEQ ID NO: 563886 - protein, 12 aa, Mycobacterium
RKNRRGSALGQA

SEQ ID NO: 563887 - protein, 36 aa, Mycobacterium
RKNTRKAAKGKNKQAGKKKGGRGPTPPKNRNPLGAG

SEQ ID NO: 563888 - protein, 7 aa, Mycobacterium
RKNVGDK

SEQ ID NO: 563889 - protein, 8 aa, Mycobacterium
RKPANPQQ

SEQ ID NO: 563890 - protein, 7 aa, Mycobacterium
RKPAPDM

SEQ ID NO: 563891 - protein, 9 aa, Mycobacterium
RKPAPSVSQ

SEQ ID NO: 563892 - protein, 8 aa, Mycobacterium
RKPASPQQ

SEQ ID NO: 563893 - protein, 4 aa, Mycobacterium
RKPD

SEQ ID NO: 563894 - protein, 10 aa, Mycobacterium
RKPDDEPGSE

SEQ ID NO: 563895 - protein, 9 aa, Mycobacterium
RKPDDTGGV

SEQ ID NO: 563896 - protein, 5 aa, Mycobacterium
RKPDI

SEQ ID NO: 563897 - protein, 6 aa, Mycobacterium
RKPDIA

SEQ ID NO: 563898 - protein, 7 aa, Mycobacterium
RKPDIPG

SEQ ID NO: 563899 - protein, 5 aa, Mycobacterium
RKPDK

SEQ ID NO: 563900 - protein, 7 aa, Mycobacterium
RKPDKHP

SEQ ID NO: 563901 - protein, 46 aa, Mycobacterium
RKPDSSRGKAGSAPKRTAREKTLAKQAARAAAGKVARDPGRPKRGR

SEQ ID NO: 563902 - protein, 7 aa, Mycobacterium
RKPDVAE

SEQ ID NO: 563903 - protein, 10 aa, Mycobacterium
RKPEDAPDSE

SEQ ID NO: 563904 - protein, 8 aa, Mycobacterium
RKPEGRSF

SEQ ID NO: 563905 - protein, 7 aa, Mycobacterium
RKPEHAA

SEQ ID NO: 563906 - protein, 7 aa, Mycobacterium
RKPEHAE

SEQ ID NO: 563907 - protein, 7 aa, Mycobacterium
RKPEHQA

SEQ ID NO: 563908 - protein, 9 aa, Mycobacterium
RKPEPDSGR

SEQ ID NO: 563909 - protein, 15 aa, Mycobacterium
RKPERPLRGAPAPTD

SEQ ID NO: 563910 - protein, 6 aa, Mycobacterium
RKPETD

SEQ ID NO: 563911 - protein, 7 aa, Mycobacterium
RKPEVAE

SEQ ID NO: 563912 - protein, 11 aa, Mycobacterium
RKPGATTTTSA

SEQ ID NO: 563913 - protein, 15 aa, Mycobacterium
RKPGATTTTSAVRGQ

SEQ ID NO: 563914 - protein, 11 aa, Mycobacterium
RKPGAVTTTSA

SEQ ID NO: 563915 - protein, 32 aa, Mycobacterium
RKPGAVTTTSAVRGQFKTDKASRAEALELILR

SEQ ID NO: 563916 - protein, 10 aa, Mycobacterium
RKPGEAVAAG

SEQ ID NO: 563917 - protein, 9 aa, Mycobacterium
RKPGEIPGW

SEQ ID NO: 563918 - protein, 12 aa, Mycobacterium
RKPGETGGTFSA

SEQ ID NO: 563919 - protein, 6 aa, Mycobacterium
RKPGGH

SEQ ID NO: 563920 - protein, 12 aa, Mycobacterium
RKPGGRQGRRPS

SEQ ID NO: 563921 - protein, 13 aa, Mycobacterium
RKPGLGELISELT

SEQ ID NO: 563922 - protein, 7 aa, Mycobacterium
RKPGNTR

SEQ ID NO: 563923 - protein, 9 aa, Mycobacterium
RKPGPAQHP

SEQ ID NO: 563924 - protein, 10 aa, Mycobacterium
RKPGPAQHPT

SEQ ID NO: 563925 - protein, 8 aa, Mycobacterium
RKPGPRQA

SEQ ID NO: 563926 - protein, 6 aa, Mycobacterium
RKPGQL

SEQ ID NO: 563927 - protein, 45 aa, Mycobacterium
RKPGTKKGPTVGSGGVRRRGLEGKGATPPAEQRTKHPAAKRAAVQ

SEQ ID NO: 563928 - protein, 32 aa, Mycobacterium
RKPGTKKGPTVGSGGVRRRGLEGRGATPPAHM

SEQ ID NO: 563929 - protein, 17 aa, Mycobacterium
RKPGYDGTWTGDENTDM

SEQ ID NO: 563930 - protein, 15 aa, Mycobacterium
RKPHRSRGKGTDVEL

SEQ ID NO: 563931 - protein, 12 aa, Mycobacterium
RKPHWDGRDRAT

SEQ ID NO: 563932 - protein, 7 aa, Mycobacterium
RKPIPED

SEQ ID NO: 563933 - protein, 7 aa, Mycobacterium
RKPISED

SEQ ID NO: 563934 - protein, 6 aa, Mycobacterium
RKPKGR

SEQ ID NO: 563935 - protein, 26 aa, Mycobacterium
RKPKPRKRGAHSGAAASGDAVTAPMQ

SEQ ID NO: 563936 - protein, 26 aa, Mycobacterium
RKPKPRKRGAHTGAAASGDAVTAPMQ

SEQ ID NO: 563937 - protein, 28 aa, Mycobacterium
RKPLRPRDRHSARPIDPDALSADGQREC

SEQ ID NO: 563938 - protein, 7 aa, Mycobacterium
RKPLSAA

SEQ ID NO: 563939 - protein, 5 aa, Mycobacterium
RKPLT

SEQ ID NO: 563940 - protein, 8 aa, Mycobacterium
RKPLTASQ

SEQ ID NO: 563941 - protein, 12 aa, Mycobacterium
RKPLTASQIGEA

SEQ ID NO: 563942 - protein, 7 aa, Mycobacterium
RKPLTND

SEQ ID NO: 563943 - protein, 5 aa, Mycobacterium
RKPMD

SEQ ID NO: 563944 - protein, 5 aa, Mycobacterium
RKPNN

SEQ ID NO: 563945 - protein, 12 aa, Mycobacterium
RKPPAATRGRRK

SEQ ID NO: 563946 - protein, 8 aa, Mycobacterium
RKPPPPAL

SEQ ID NO: 563947 - protein, 7 aa, Mycobacterium
RKPPRGT

SEQ ID NO: 563948 - protein, 40 aa, Mycobacterium
RKPRAERGDEIQGISGSTRLEAKRQRRRDGRDAGRRRPPI

SEQ ID NO: 563949 - protein, 8 aa, Mycobacterium
RKPRDPWP

SEQ ID NO: 563950 - protein, 6 aa, Mycobacterium
RKPRQL

SEQ ID NO: 563951 - protein, 13 aa, Mycobacterium
RKPRRWTARRGVG

SEQ ID NO: 563952 - protein, 7 aa, Mycobacterium
RKPSDYV

SEQ ID NO: 563953 - protein, 9 aa, Mycobacterium
RKPTKSASQ

SEQ ID NO: 563954 - protein, 10 aa, Mycobacterium
RKPTKSPNQL

SEQ ID NO: 563955 - protein, 5 aa, Mycobacterium
RKPTR

SEQ ID NO: 563956 - protein, 9 aa, Mycobacterium
RKPTTFDSY

SEQ ID NO: 563957 - protein, 23 aa, Mycobacterium
RKPVEVAEPDLAQAGAGGAGPAA

SEQ ID NO: 563958 - protein, 7 aa, Mycobacterium
RKPVPIP

SEQ ID NO: 563959 - protein, 5 aa, Mycobacterium
RKPVQ

SEQ ID NO: 563960 - protein, 16 aa, Mycobacterium
RKPVQPRQSRRAARIT

SEQ ID NO: 563961 - protein, 9 aa, Mycobacterium
RKQAKPGQF

SEQ ID NO: 563962 - protein, 10 aa, Mycobacterium
RKQAKPGQFD

SEQ ID NO: 563963 - protein, 12 aa, Mycobacterium
RKQARDKNLPGL

SEQ ID NO: 563964 - protein, 12 aa, Mycobacterium
RKQDAAIKKGLT

SEQ ID NO: 563965 - protein, 12 aa, Mycobacterium
RKQDDAIKRGLP

SEQ ID NO: 563966 - protein, 7 aa, Mycobacterium
RKQDEVE

SEQ ID NO: 563967 - protein, 8 aa, Mycobacterium
RKQDPQHA

SEQ ID NO: 563968 - protein, 11 aa, Mycobacterium
RKQDSQAAAQA

SEQ ID NO: 563969 - protein, 17 aa, Mycobacterium
RKQEAADEAAAQVDGNA

SEQ ID NO: 563970 - protein, 16 aa, Mycobacterium
RKQEAADEAAAQVGER

SEQ ID NO: 563971 - protein, 8 aa, Mycobacterium
RKQEAIDA

SEQ ID NO: 563972 - protein, 16 aa, Mycobacterium
RKQESADAAAAEVGER

SEQ ID NO: 563973 - protein, 12 aa, Mycobacterium
RKQESEHDSRRT

SEQ ID NO: 563974 - protein, 16 aa, Mycobacterium
RKQETAEAAAAEVGER

SEQ ID NO: 563975 - protein, 37 aa, Mycobacterium
RKQGDSKEKAARISNAAAARGKSSVGRKGGKSGSYQD

SEQ ID NO: 563976 - protein, 37 aa, Mycobacterium
RKQGDSKEKAARISNAAASRGRSKVGRSGGKSGSYED

SEQ ID NO: 563977 - protein, 6 aa, Mycobacterium
RKQGPV

SEQ ID NO: 563978 - protein, 18 aa, Mycobacterium
RKQGYDGTWTGDDNTDML

SEQ ID NO: 563979 - protein, 10 aa, Mycobacterium
RKQGYGPDVT

SEQ ID NO: 563980 - protein, 7 aa, Mycobacterium
RKQMQSK

SEQ ID NO: 563981 - protein, 8 aa, Mycobacterium
RKQNPSHG

SEQ ID NO: 563982 - protein, 4 aa, Mycobacterium
RKQP

SEQ ID NO: 563983 - protein, 12 aa, Mycobacterium
RKQPEKTAEAID

SEQ ID NO: 563984 - protein, 8 aa, Mycobacterium
RKQPYSAL

SEQ ID NO: 563985 - protein, 9 aa, Mycobacterium
RKQQAEALA

SEQ ID NO: 563986 - protein, 7 aa, Mycobacterium
RKQQAIR

SEQ ID NO: 563987 - protein, 10 aa, Mycobacterium
RKQRAALPPM

SEQ ID NO: 563988 - protein, 8 aa, Mycobacterium
RKQRRNAA

SEQ ID NO: 563989 - protein, 17 aa, Mycobacterium
RKQSGVYHAPETRAAVG

SEQ ID NO: 563990 - protein, 7 aa, Mycobacterium
RKQSPYP

SEQ ID NO: 563991 - protein, 9 aa, Mycobacterium
RKQSTRESL

SEQ ID NO: 563992 - protein, 15 aa, Mycobacterium
RKQTGVYRLPNSATA

SEQ ID NO: 563993 - protein, 14 aa, Mycobacterium
RKQVEEATPVREDL

SEQ ID NO: 563994 - protein, 7 aa, Mycobacterium
RKRAEEA

SEQ ID NO: 563995 - protein, 13 aa, Mycobacterium
RKRAEEAAARASR

SEQ ID NO: 563996 - protein, 12 aa, Mycobacterium
RKRAKERREVPG

SEQ ID NO: 563997 - protein, 16 aa, Mycobacterium
RKRAQPAGPSLSTRER

SEQ ID NO: 563998 - protein, 8 aa, Mycobacterium
RKRDADGA

SEQ ID NO: 563999 - protein, 8 aa, Mycobacterium
RKRDAEGA

SEQ ID NO: 564000 - protein, 8 aa, Mycobacterium
RKRDPRHG

SEQ ID NO: 564001 - protein, 9 aa, Mycobacterium
RKRDRGRRV

SEQ ID NO: 564002 - protein, 11 aa, Mycobacterium
RKRDRSEALAA

SEQ ID NO: 564003 - protein, 7 aa, Mycobacterium
RKREAID

SEQ ID NO: 564004 - protein, 8 aa, Mycobacterium
RKREAIDA

SEQ ID NO: 564005 - protein, 9 aa, Mycobacterium
RKREDRDRS

SEQ ID NO: 564006 - protein, 9 aa, Mycobacterium
RKREERDRS

SEQ ID NO: 564007 - protein, 10 aa, Mycobacterium
RKREKAATRE

SEQ ID NO: 564008 - protein, 11 aa, Mycobacterium
RKREKAATREL

SEQ ID NO: 564009 - protein, 5 aa, Mycobacterium
RKRES

SEQ ID NO: 564010 - protein, 17 aa, Mycobacterium
RKRGEAGSSGSSPWVGR

SEQ ID NO: 564011 - protein, 8 aa, Mycobacterium
RKRGRAPD

SEQ ID NO: 564012 - protein, 6 aa, Mycobacterium
RKRGRR

SEQ ID NO: 564013 - protein, 5 aa, Mycobacterium
RKRGS

SEQ ID NO: 564014 - protein, 6 aa, Mycobacterium
RKRGSR

SEQ ID NO: 564015 - protein, 18 aa, Mycobacterium
RKRGTAPRVEGLGRPRED

SEQ ID NO: 564016 - protein, 4 aa, Mycobacterium
RKRH

SEQ ID NO: 564017 - protein, 5 aa, Mycobacterium
RKRHP

SEQ ID NO: 564018 - protein, 8 aa, Mycobacterium
RKRHSPEQ

SEQ ID NO: 564019 - protein, 4 aa, Mycobacterium
RKRI

SEQ ID NO: 564020 - protein, 15 aa, Mycobacterium
RKRIEDALSAGDAEN

SEQ ID NO: 564021 - protein, 8 aa, Mycobacterium
RKRKEKAL

SEQ ID NO: 564022 - protein, 9 aa, Mycobacterium
RKRLDPARQ

SEQ ID NO: 564023 - protein, 8 aa, Mycobacterium
RKRNERRD

SEQ ID NO: 564024 - protein, 7 aa, Mycobacterium
RKRNTLG

SEQ ID NO: 564025 - protein, 32 aa, Mycobacterium
RKRPGSAAAEAAEKAAGKPAGDAEQAAEPEKT

SEQ ID NO: 564026 - protein, 27 aa, Mycobacterium
RKRPGTAAAQAAEAAEKAGRNSEGNQT

SEQ ID NO: 564027 - protein, 10 aa, Mycobacterium
RKRPPAGTPG

SEQ ID NO: 564028 - protein, 12 aa, Mycobacterium
RKRPRGRPPKVA

SEQ ID NO: 564029 - protein, 18 aa, Mycobacterium
RKRPRGRPRKDSGGNPAA

SEQ ID NO: 564030 - protein, 17 aa, Mycobacterium
RKRPRGRPRKDSKSPVA

SEQ ID NO: 564031 - protein, 11 aa, Mycobacterium
RKRPSDDVPEH

SEQ ID NO: 564032 - protein, 8 aa, Mycobacterium
RKRQAAAE

SEQ ID NO: 564033 - protein, 7 aa, Mycobacterium
RKRQAAQ

SEQ ID NO: 564034 - protein, 10 aa, Mycobacterium
RKRQEERAEM

SEQ ID NO: 564035 - protein, 9 aa, Mycobacterium
RKRQQPGDD

SEQ ID NO: 564036 - protein, 14 aa, Mycobacterium
RKRQRQPAEYPTEE

SEQ ID NO: 564037 - protein, 14 aa, Mycobacterium
RKRRAEEPLAATDE

SEQ ID NO: 564038 - protein, 7 aa, Mycobacterium
RKRREEL

SEQ ID NO: 564039 - protein, 8 aa, Mycobacterium
RKRRGDKP

SEQ ID NO: 564040 - protein, 10 aa, Mycobacterium
RKRRPDLDPG

SEQ ID NO: 564041 - protein, 6 aa, Mycobacterium
RKRRQP

SEQ ID NO: 564042 - protein, 8 aa, Mycobacterium
RKRSCPQG

SEQ ID NO: 564043 - protein, 9 aa, Mycobacterium
RKRSEERAE

SEQ ID NO: 564044 - protein, 10 aa, Mycobacterium
RKRSEERAEL

SEQ ID NO: 564045 - protein, 15 aa, Mycobacterium
RKRSLEGSPTVTLGT

SEQ ID NO: 564046 - protein, 7 aa, Mycobacterium
RKRSPSA

SEQ ID NO: 564047 - protein, 19 aa, Mycobacterium
RKRTREQDRRARIERERRQ

SEQ ID NO: 564048 - protein, 8 aa, Mycobacterium
RKRYRGRD

SEQ ID NO: 564049 - protein, 14 aa, Mycobacterium
RKSAGLPPHPSARQ

SEQ ID NO: 564050 - protein, 8 aa, Mycobacterium
RKSARRYR

SEQ ID NO: 564051 - protein, 44 aa, Mycobacterium
RKSATRKAAKSKGKKGKNAKKGKGPTQPKVRNPLGAAGLPGGFP

SEQ ID NO: 564052 - protein, 9 aa, Mycobacterium
RKSDRTRES

SEQ ID NO: 564053 - protein, 4 aa, Mycobacterium
RKSE

SEQ ID NO: 564054 - protein, 7 aa, Mycobacterium
RKSEARW

SEQ ID NO: 564055 - protein, 8 aa, Mycobacterium
RKSEPTDD

SEQ ID NO: 564056 - protein, 18 aa, Mycobacterium
RKSFGNRSAPTYSTTRED

SEQ ID NO: 564057 - protein, 8 aa, Mycobacterium
RKSGAPRH

SEQ ID NO: 564058 - protein, 7 aa, Mycobacterium
RKSGELP

SEQ ID NO: 564059 - protein, 7 aa, Mycobacterium
RKSGEPR

SEQ ID NO: 564060 - protein, 9 aa, Mycobacterium
RKSGKHYRT

SEQ ID NO: 564061 - protein, 8 aa, Mycobacterium
RKSGNYTV

SEQ ID NO: 564062 - protein, 9 aa, Mycobacterium
RKSGTEVDH

SEQ ID NO: 564063 - protein, 32 aa, Mycobacterium
RKSGTKKGAPVGSGGQRRRGLEGRGPTPPAHM

SEQ ID NO: 564064 - protein, 31 aa, Mycobacterium
RKSGTKKGTSVGSGGQRRRGLEGRGPTPPAH

SEQ ID NO: 564065 - protein, 8 aa, Mycobacterium
RKSGTPRN

SEQ ID NO: 564066 - protein, 4 aa, Mycobacterium
RKSI

SEQ ID NO: 564067 - protein, 5 aa, Mycobacterium
RKSIQ

SEQ ID NO: 564068 - protein, 5 aa, Mycobacterium
RKSIR

SEQ ID NO: 564069 - protein, 9 aa, Mycobacterium
RKSKDRRKI

SEQ ID NO: 564070 - protein, 9 aa, Mycobacterium
RKSKQDRDD

SEQ ID NO: 564071 - protein, 8 aa, Mycobacterium
RKSLSGSA

SEQ ID NO: 564072 - protein, 9 aa, Mycobacterium
RKSLTLDPQ

SEQ ID NO: 564073 - protein, 9 aa, Mycobacterium
RKSMSTGGV

SEQ ID NO: 564074 - protein, 32 aa, Mycobacterium
RKSNRKGGKNNKKGKKGSRGPTAPKLKGGFPG

SEQ ID NO: 564075 - protein, 9 aa, Mycobacterium
RKSPASVRQ

SEQ ID NO: 564076 - protein, 6 aa, Mycobacterium
RKSPDG

SEQ ID NO: 564077 - protein, 8 aa, Mycobacterium
RKSPEEQR

SEQ ID NO: 564078 - protein, 10 aa, Mycobacterium
RKSPETPLQR

SEQ ID NO: 564079 - protein, 8 aa, Mycobacterium
RKSPSISE

SEQ ID NO: 564080 - protein, 6 aa, Mycobacterium
RKSPTF

SEQ ID NO: 564081 - protein, 20 aa, Mycobacterium
RKSQHPPEVAEPSNGPPVPA

SEQ ID NO: 564082 - protein, 12 aa, Mycobacterium
RKSRKTGSEVDH

SEQ ID NO: 564083 - protein, 7 aa, Mycobacterium
RKSRSEM

SEQ ID NO: 564084 - protein, 8 aa, Mycobacterium
RKSSGLDV

SEQ ID NO: 564085 - protein, 9 aa, Mycobacterium
RKSVTLDPQ

SEQ ID NO: 564086 - protein, 12 aa, Mycobacterium
RKSWQDTGVAPY

SEQ ID NO: 564087 - protein, 9 aa, Mycobacterium
RKTAEPGAD

SEQ ID NO: 564088 - protein, 7 aa, Mycobacterium
RKTANTV

SEQ ID NO: 564089 - protein, 6 aa, Mycobacterium
RKTARD

SEQ ID NO: 564090 - protein, 6 aa, Mycobacterium
RKTARR

SEQ ID NO: 564091 - protein, 24 aa, Mycobacterium
RKTDSDAKESKIATKQTGRPARLA

SEQ ID NO: 564092 - protein, 7 aa, Mycobacterium
RKTETAA

SEQ ID NO: 564093 - protein, 8 aa, Mycobacterium
RKTGKTAV

SEQ ID NO: 564094 - protein, 9 aa, Mycobacterium
RKTGTTAEA

SEQ ID NO: 564095 - protein, 10 aa, Mycobacterium
RKTGVPDGTT

SEQ ID NO: 564096 - protein, 7 aa, Mycobacterium
RKTHRSR

SEQ ID NO: 564097 - protein, 6 aa, Mycobacterium
RKTKYV

SEQ ID NO: 564098 - protein, 9 aa, Mycobacterium
RKTLPGPNQ

SEQ ID NO: 564099 - protein, 7 aa, Mycobacterium
RKTLRDH

SEQ ID NO: 564100 - protein, 7 aa, Mycobacterium
RKTNQRI

SEQ ID NO: 564101 - protein, 8 aa, Mycobacterium
RKTPAADV

SEQ ID NO: 564102 - protein, 6 aa, Mycobacterium
RKTPEV

SEQ ID NO: 564103 - protein, 13 aa, Mycobacterium
RKTPGKTIVQIAA

SEQ ID NO: 564104 - protein, 5 aa, Mycobacterium
RKTPI

SEQ ID NO: 564105 - protein, 7 aa, Mycobacterium
RKTPYHH

SEQ ID NO: 564106 - protein, 20 aa, Mycobacterium
RKTQQSNRNALTRWAHTRQL

SEQ ID NO: 564107 - protein, 8 aa, Mycobacterium
RKTRDSDL

SEQ ID NO: 564108 - protein, 16 aa, Mycobacterium
RKTRGEPPRASDPTPV

SEQ ID NO: 564109 - protein, 9 aa, Mycobacterium
RKTSDDDLA

SEQ ID NO: 564110 - protein, 9 aa, Mycobacterium
RKTSDEDMA

SEQ ID NO: 564111 - protein, 11 aa, Mycobacterium
RKTSGEPTAGY

SEQ ID NO: 564112 - protein, 8 aa, Mycobacterium
RKTSSPVR

SEQ ID NO: 564113 - protein, 8 aa, Mycobacterium
RKTTDADL

SEQ ID NO: 564114 - protein, 8 aa, Mycobacterium
RKTTDEDM

SEQ ID NO: 564115 - protein, 7 aa, Mycobacterium
RKTTPDL

SEQ ID NO: 564116 - protein, 5 aa, Mycobacterium
RKTTV

SEQ ID NO: 564117 - protein, 5 aa, Mycobacterium
RKTVD

SEQ ID NO: 564118 - protein, 7 aa, Mycobacterium
RKTWTGT

SEQ ID NO: 564119 - protein, 9 aa, Mycobacterium
RKTYGRDSD

SEQ ID NO: 564120 - protein, 9 aa, Mycobacterium
RKTYGRTSD

SEQ ID NO: 564121 - protein, 13 aa, Mycobacterium
RKVAADAGIPDPT

SEQ ID NO: 564122 - protein, 12 aa, Mycobacterium
RKVAADSGIDNP

SEQ ID NO: 564123 - protein, 7 aa, Mycobacterium
RKVADGR

SEQ ID NO: 564124 - protein, 7 aa, Mycobacterium
RKVAEDV

SEQ ID NO: 564125 - protein, 12 aa, Mycobacterium
RKVAEQAGVTDP

SEQ ID NO: 564126 - protein, 5 aa, Mycobacterium
RKVDD

SEQ ID NO: 564127 - protein, 9 aa, Mycobacterium
RKVDPSEYE

SEQ ID NO: 564128 - protein, 5 aa, Mycobacterium
RKVGD

SEQ ID NO: 564129 - protein, 6 aa, Mycobacterium
RKVGDQ

SEQ ID NO: 564130 - protein, 10 aa, Mycobacterium
RKVGQASGHE

SEQ ID NO: 564131 - protein, 9 aa, Mycobacterium
RKVGQATGH

SEQ ID NO: 564132 - protein, 13 aa, Mycobacterium
RKVHYGDKTPVSL

SEQ ID NO: 564133 - protein, 10 aa, Mycobacterium
RKVKAGELTP

SEQ ID NO: 564134 - protein, 8 aa, Mycobacterium
RKVKGAEE

SEQ ID NO: 564135 - protein, 13 aa, Mycobacterium
RKVPNTGTPLPRA

SEQ ID NO: 564136 - protein, 8 aa, Mycobacterium
RKVPPHRQ

SEQ ID NO: 564137 - protein, 11 aa, Mycobacterium
RKVPPSQAKRG

SEQ ID NO: 564138 - protein, 15 aa, Mycobacterium
RKVPSPVAIGMPKVG

SEQ ID NO: 564139 - protein, 8 aa, Mycobacterium
RKVPTRSV

SEQ ID NO: 564140 - protein, 7 aa, Mycobacterium
RKVRDRA

SEQ ID NO: 564141 - protein, 13 aa, Mycobacterium
RKVSEAPLNSEER

SEQ ID NO: 564142 - protein, 15 aa, Mycobacterium
RKVYSTARAPFEDPR

SEQ ID NO: 564143 - protein, 11 aa, Mycobacterium
RKWGRDPGADA

SEQ ID NO: 564144 - protein, 8 aa, Mycobacterium
RKYAPAAR

SEQ ID NO: 564145 - protein, 18 aa, Mycobacterium
RKYDSSRRRADAEARQGR

SEQ ID NO: 564146 - protein, 16 aa, Mycobacterium
RKYGLDTEAGETMRPQ

SEQ ID NO: 564147 - protein, 5 aa, Mycobacterium
RKYPD

SEQ ID NO: 564148 - protein, 5 aa, Mycobacterium
RLAAE

SEQ ID NO: 564149 - protein, 22 aa, Mycobacterium
RLAAEGDDASAESSANAATQTI

SEQ ID NO: 564150 - protein, 5 aa, Mycobacterium
RLAAN

SEQ ID NO: 564151 - protein, 6 aa, Mycobacterium
RLAANG

SEQ ID NO: 564152 - protein, 9 aa, Mycobacterium
RLAAPNPEV

SEQ ID NO: 564153 - protein, 13 aa, Mycobacterium
RLADDADTTVSQA

SEQ ID NO: 564154 - protein, 8 aa, Mycobacterium
RLADEGIG

SEQ ID NO: 564155 - protein, 9 aa, Mycobacterium
RLADETGGH

SEQ ID NO: 564156 - protein, 6 aa, Mycobacterium
RLADGN

SEQ ID NO: 564157 - protein, 17 aa, Mycobacterium
RLADRKPRQLSGGQAQR

SEQ ID NO: 564158 - protein, 22 aa, Mycobacterium
RLADSEKALADSQTAIDATQQR

SEQ ID NO: 564159 - protein, 10 aa, Mycobacterium
RLADTAPDLA

SEQ ID NO: 564160 - protein, 4 aa, Mycobacterium
RLAE

SEQ ID NO: 564161 - protein, 14 aa, Mycobacterium
RLAEARDRAAAALD

SEQ ID NO: 564162 - protein, 11 aa, Mycobacterium
RLAEDESDRAE

SEQ ID NO: 564163 - protein, 10 aa, Mycobacterium
RLAEKARAAG

SEQ ID NO: 564164 - protein, 5 aa, Mycobacterium
RLAET

SEQ ID NO: 564165 - protein, 8 aa, Mycobacterium
RLAETNDA

SEQ ID NO: 564166 - protein, 8 aa, Mycobacterium
RLAETTGD

SEQ ID NO: 564167 - protein, 4 aa, Mycobacterium
RLAG

SEQ ID NO: 564168 - protein, 6 aa, Mycobacterium
RLAGDG

SEQ ID NO: 564169 - protein, 10 aa, Mycobacterium
RLAGEERAPM

SEQ ID NO: 564170 - protein, 11 aa, Mycobacterium
RLAGGRGEPAV

SEQ ID NO: 564171 - protein, 5 aa, Mycobacterium
RLAGN

SEQ ID NO: 564172 - protein, 9 aa, Mycobacterium
RLAGQPDPW

SEQ ID NO: 564173 - protein, 5 aa, Mycobacterium
RLAGR

SEQ ID NO: 564174 - protein, 6 aa, Mycobacterium
RLAGSD

SEQ ID NO: 564175 - protein, 4 aa, Mycobacterium
RLAN

SEQ ID NO: 564176 - protein, 8 aa, Mycobacterium
RLAPAERS

SEQ ID NO: 564177 - protein, 18 aa, Mycobacterium
RLAPAPALERQADQRSDE

SEQ ID NO: 564178 - protein, 31 aa, Mycobacterium
RLAPDTGLDGRPRGVGDAGVPDDRRSGGDAL

SEQ ID NO: 564179 - protein, 6 aa, Mycobacterium
RLAPEP

SEQ ID NO: 564180 - protein, 10 aa, Mycobacterium
RLAPGGAVQT

SEQ ID NO: 564181 - protein, 31 aa, Mycobacterium
RLAPGTGVKPASTGGGVGGGALAPPPANGID

SEQ ID NO: 564182 - protein, 6 aa, Mycobacterium
RLAPNS

SEQ ID NO: 564183 - protein, 8 aa, Mycobacterium
RLAPPEQS

SEQ ID NO: 564184 - protein, 8 aa, Mycobacterium
RLAPPQQA

SEQ ID NO: 564185 - protein, 11 aa, Mycobacterium
RLAPQEQRWPQ

SEQ ID NO: 564186 - protein, 41 aa, Mycobacterium
RLAPQRNQAESQHVPRNSSEQKRELEELDDGDVDDSDDPDL

SEQ ID NO: 564187 - protein, 18 aa, Mycobacterium
RLAPTSTVRGWEHLRMLV

SEQ ID NO: 564188 - protein, 18 aa, Mycobacterium
RLAPTSTVRGWERLDVLV

SEQ ID NO: 564189 - protein, 5 aa, Mycobacterium
RLAPY

SEQ ID NO: 564190 - protein, 10 aa, Mycobacterium
RLAPYKAPKT

SEQ ID NO: 564191 - protein, 7 aa, Mycobacterium
RLAQDGQ

SEQ ID NO: 564192 - protein, 17 aa, Mycobacterium
RLAQEESDRITTRLAAL

SEQ ID NO: 564193 - protein, 13 aa, Mycobacterium
RLAQERSSVSDAD

SEQ ID NO: 564194 - protein, 5 aa, Mycobacterium
RLAQP

SEQ ID NO: 564195 - protein, 13 aa, Mycobacterium
RLARQQRGQSEVP

SEQ ID NO: 564196 - protein, 12 aa, Mycobacterium
RLARRNDVEKAV

SEQ ID NO: 564197 - protein, 5 aa, Mycobacterium
RLASA

SEQ ID NO: 564198 - protein, 11 aa, Mycobacterium
RLASHQTGCNS

SEQ ID NO: 564199 - protein, 10 aa, Mycobacterium
RLASTHPAVG

SEQ ID NO: 564200 - protein, 6 aa, Mycobacterium
RLATAG

SEQ ID NO: 564201 - protein, 13 aa, Mycobacterium
RLATDGEKYFRER

SEQ ID NO: 564202 - protein, 5 aa, Mycobacterium
RLATR

SEQ ID NO: 564203 - protein, 7 aa, Mycobacterium
RLATSST

SEQ ID NO: 564204 - protein, 14 aa, Mycobacterium
RLDAAAEKIGRDPA

SEQ ID NO: 564205 - protein, 6 aa, Mycobacterium
RLDAEG

SEQ ID NO: 564206 - protein, 18 aa, Mycobacterium
RLDAGRPARGDDRGGPQF

SEQ ID NO: 564207 - protein, 14 aa, Mycobacterium
RLDAQTPESQLTTR

SEQ ID NO: 564208 - protein, 8 aa, Mycobacterium
RLDDATAR

SEQ ID NO: 564209 - protein, 6 aa, Mycobacterium
RLDDDP

SEQ ID NO: 564210 - protein, 5 aa, Mycobacterium
RLDDE

SEQ ID NO: 564211 - protein, 9 aa, Mycobacterium
RLDDEDAAQ

SEQ ID NO: 564212 - protein, 9 aa, Mycobacterium
RLDDESGRP

SEQ ID NO: 564213 - protein, 10 aa, Mycobacterium
RLDDKGNSVR

SEQ ID NO: 564214 - protein, 5 aa, Mycobacterium
RLDEA

SEQ ID NO: 564215 - protein, 12 aa, Mycobacterium
RLDEADDAVAGG

SEQ ID NO: 564216 - protein, 14 aa, Mycobacterium
RLDEGSHAAGTEPG

SEQ ID NO: 564217 - protein, 15 aa, Mycobacterium
RLDEGSHAEGSTADR

SEQ ID NO: 564218 - protein, 7 aa, Mycobacterium
RLDEGTL

SEQ ID NO: 564219 - protein, 11 aa, Mycobacterium
RLDEPAPAVRN

SEQ ID NO: 564220 - protein, 6 aa, Mycobacterium
RLDEPG

SEQ ID NO: 564221 - protein, 5 aa, Mycobacterium
RLDEV

SEQ ID NO: 564222 - protein, 4 aa, Mycobacterium
RLDG

SEQ ID NO: 564223 - protein, 7 aa, Mycobacterium
RLDGDGP

SEQ ID NO: 564224 - protein, 5 aa, Mycobacterium
RLDGG

SEQ ID NO: 564225 - protein, 6 aa, Mycobacterium
RLDGGA

SEQ ID NO: 564226 - protein, 8 aa, Mycobacterium
RLDGGGAR

SEQ ID NO: 564227 - protein, 6 aa, Mycobacterium
RLDGGP

SEQ ID NO: 564228 - protein, 16 aa, Mycobacterium
RLDGGTAAAGFGATST

SEQ ID NO: 564229 - protein, 7 aa, Mycobacterium
RLDGPDA

SEQ ID NO: 564230 - protein, 9 aa, Mycobacterium
RLDGPHAQD

SEQ ID NO: 564231 - protein, 7 aa, Mycobacterium
RLDGPHE

SEQ ID NO: 564232 - protein, 7 aa, Mycobacterium
RLDGSDL

SEQ ID NO: 564233 - protein, 15 aa, Mycobacterium
RLDGSELRYNREDPY

SEQ ID NO: 564234 - protein, 9 aa, Mycobacterium
RLDGSPLRY

SEQ ID NO: 564235 - protein, 8 aa, Mycobacterium
RLDGSPSD

SEQ ID NO: 564236 - protein, 7 aa, Mycobacterium
RLDGTGV

SEQ ID NO: 564237 - protein, 15 aa, Mycobacterium
RLDKPGGSLSGGQQQ

SEQ ID NO: 564238 - protein, 5 aa, Mycobacterium
RLDNQ

SEQ ID NO: 564239 - protein, 16 aa, Mycobacterium
RLDNRRAEGSEDRAEA

SEQ ID NO: 564240 - protein, 4 aa, Mycobacterium
RLDP

SEQ ID NO: 564241 - protein, 9 aa, Mycobacterium
RLDPAKPPH

SEQ ID NO: 564242 - protein, 5 aa, Mycobacterium
RLDPD

SEQ ID NO: 564243 - protein, 8 aa, Mycobacterium
RLDPDAKR

SEQ ID NO: 564244 - protein, 6 aa, Mycobacterium
RLDPED

SEQ ID NO: 564245 - protein, 7 aa, Mycobacterium
RLDPGAG

SEQ ID NO: 564246 - protein, 9 aa, Mycobacterium
RLDPGRPPH

SEQ ID NO: 564247 - protein, 9 aa, Mycobacterium
RLDPTRPPH

SEQ ID NO: 564248 - protein, 19 aa, Mycobacterium
RLDRGTSTDGRALDGRPEY

SEQ ID NO: 564249 - protein, 6 aa, Mycobacterium
RLDSDR

SEQ ID NO: 564250 - protein, 10 aa, Mycobacterium
RLDSSEGDLG

SEQ ID NO: 564251 - protein, 4 aa, Mycobacterium
RLDT

SEQ ID NO: 564252 - protein, 10 aa, Mycobacterium
RLDTDTRAQR

SEQ ID NO: 564253 - protein, 8 aa, Mycobacterium
RLDTSTRS

SEQ ID NO: 564254 - protein, 5 aa, Mycobacterium
RLDVT

SEQ ID NO: 564255 - protein, 8 aa, Mycobacterium
RLEAAGDD

SEQ ID NO: 564256 - protein, 12 aa, Mycobacterium
RLEAKDPGTAEE

SEQ ID NO: 564257 - protein, 5 aa, Mycobacterium
RLEDD

SEQ ID NO: 564258 - protein, 7 aa, Mycobacterium
RLEDKGV

SEQ ID NO: 564259 - protein, 5 aa, Mycobacterium
RLEED

SEQ ID NO: 564260 - protein, 5 aa, Mycobacterium
RLEEG

SEQ ID NO: 564261 - protein, 9 aa, Mycobacterium
RLEEGIEKG

SEQ ID NO: 564262 - protein, 7 aa, Mycobacterium
RLEGGDG

SEQ ID NO: 564263 - protein, 9 aa, Mycobacterium
RLEGKSSLG

SEQ ID NO: 564264 - protein, 17 aa, Mycobacterium
RLEGTAELATGPQIAGP

SEQ ID NO: 564265 - protein, 4 aa, Mycobacterium
RLEN

SEQ ID NO: 564266 - protein, 9 aa, Mycobacterium
RLEPGPGAR

SEQ ID NO: 564267 - protein, 12 aa, Mycobacterium
RLEPGQSVQLPD

SEQ ID NO: 564268 - protein, 7 aa, Mycobacterium
RLEPGQV

SEQ ID NO: 564269 - protein, 13 aa, Mycobacterium
RLEQQKAAAKLDR

SEQ ID NO: 564270 - protein, 4 aa, Mycobacterium
RLER

SEQ ID NO: 564271 - protein, 7 aa, Mycobacterium
RLERENG

SEQ ID NO: 564272 - protein, 17 aa, Mycobacterium
RLERGATRGDGRTGEDV

SEQ ID NO: 564273 - protein, 6 aa, Mycobacterium
RLERPD

SEQ ID NO: 564274 - protein, 6 aa, Mycobacterium
RLESDT

SEQ ID NO: 564275 - protein, 25 aa, Mycobacterium
RLESKKVSKTQAVTSNLNGSLADKV

SEQ ID NO: 564276 - protein, 27 aa, Mycobacterium
RLESKKVSKTQAVTSNLSGALAGKVED

SEQ ID NO: 564277 - protein, 27 aa, Mycobacterium
RLESKKVSKTQAVTSNLSGSLAGKVED

SEQ ID NO: 564278 - protein, 6 aa, Mycobacterium
RLETEG

SEQ ID NO: 564279 - protein, 4 aa, Mycobacterium
RLGA

SEQ ID NO: 564280 - protein, 7 aa, Mycobacterium
RLGADPA

SEQ ID NO: 564281 - protein, 6 aa, Mycobacterium
RLGAEA

SEQ ID NO: 564282 - protein, 12 aa, Mycobacterium
RLGAGAADGGMG

SEQ ID NO: 564283 - protein, 14 aa, Mycobacterium
RLGAPGKFGKIVLT

SEQ ID NO: 564284 - protein, 9 aa, Mycobacterium
RLGAPTRAT

SEQ ID NO: 564285 - protein, 11 aa, Mycobacterium
RLGARTTGYDV

SEQ ID NO: 564286 - protein, 6 aa, Mycobacterium
RLGASD

SEQ ID NO: 564287 - protein, 5 aa, Mycobacterium
RLGAT

SEQ ID NO: 564288 - protein, 6 aa, Mycobacterium
RLGATD

SEQ ID NO: 564289 - protein, 9 aa, Mycobacterium
RLGATDEAQ

SEQ ID NO: 564290 - protein, 10 aa, Mycobacterium
RLGATGPAFT

SEQ ID NO: 564291 - protein, 4 aa, Mycobacterium
RLGD

SEQ ID NO: 564292 - protein, 6 aa, Mycobacterium
RLGDGE

SEQ ID NO: 564293 - protein, 7 aa, Mycobacterium
RLGDPAE

SEQ ID NO: 564294 - protein, 7 aa, Mycobacterium
RLGDPAG

SEQ ID NO: 564295 - protein, 10 aa, Mycobacterium
RLGDPDPLQS

SEQ ID NO: 564296 - protein, 5 aa, Mycobacterium
RLGDR

SEQ ID NO: 564297 - protein, 7 aa, Mycobacterium
RLGEADD

SEQ ID NO: 564298 - protein, 8 aa, Mycobacterium
RLGEANPD

SEQ ID NO: 564299 - protein, 5 aa, Mycobacterium
RLGED

SEQ ID NO: 564300 - protein, 13 aa, Mycobacterium
RLGEGSGGPGSAI

SEQ ID NO: 564301 - protein, 13 aa, Mycobacterium
RLGEQTRTNSESV

SEQ ID NO: 564302 - protein, 8 aa, Mycobacterium
RLGETRDE

SEQ ID NO: 564303 - protein, 8 aa, Mycobacterium
RLGETRDQ

SEQ ID NO: 564304 - protein, 5 aa, Mycobacterium
RLGEV

SEQ ID NO: 564305 - protein, 19 aa, Mycobacterium
RLGGDDDAEALRREAGDGY

SEQ ID NO: 564306 - protein, 6 aa, Mycobacterium
RLGGDG

SEQ ID NO: 564307 - protein, 5 aa, Mycobacterium
RLGGE

SEQ ID NO: 564308 - protein, 11 aa, Mycobacterium
RLGGIDPDRAR

SEQ ID NO: 564309 - protein, 5 aa, Mycobacterium
RLGGL

SEQ ID NO: 564310 - protein, 11 aa, Mycobacterium
RLGGPAPQDPV

SEQ ID NO: 564311 - protein, 24 aa, Mycobacterium
RLGGPPAALRAEADDSVRDAARAA

SEQ ID NO: 564312 - protein, 24 aa, Mycobacterium
RLGGPQAALRAETDDGVRDAARTA

SEQ ID NO: 564313 - protein, 13 aa, Mycobacterium
RLGGSDEADHDRV

SEQ ID NO: 564314 - protein, 12 aa, Mycobacterium
RLGGSDEASHDE

SEQ ID NO: 564315 - protein, 12 aa, Mycobacterium
RLGGSDETDHDR

SEQ ID NO: 564316 - protein, 12 aa, Mycobacterium
RLGGSPALPTAA

SEQ ID NO: 564317 - protein, 15 aa, Mycobacterium
RLGKKSGVGFYEYKA

SEQ ID NO: 564318 - protein, 12 aa, Mycobacterium
RLGKKTGQGFYK

SEQ ID NO: 564319 - protein, 12 aa, Mycobacterium
RLGKKTGQGFYT

SEQ ID NO: 564320 - protein, 19 aa, Mycobacterium
RLGKNRPKRAAECAETENA

SEQ ID NO: 564321 - protein, 16 aa, Mycobacterium
RLGLSGTRSVLDGLSP

SEQ ID NO: 564322 - protein, 7 aa, Mycobacterium
RLGNEDR

SEQ ID NO: 564323 - protein, 17 aa, Mycobacterium
RLGNKAGNGFRTTDSEN

SEQ ID NO: 564324 - protein, 5 aa, Mycobacterium
RLGNR

SEQ ID NO: 564325 - protein, 6 aa, Mycobacterium
RLGNSA

SEQ ID NO: 564326 - protein, 21 aa, Mycobacterium
RLGPAEKAPRGAKKSVDGRRA

SEQ ID NO: 564327 - protein, 11 aa, Mycobacterium
RLGPARGAPTV

SEQ ID NO: 564328 - protein, 9 aa, Mycobacterium
RLGPDDALP

SEQ ID NO: 564329 - protein, 6 aa, Mycobacterium
RLGPDL

SEQ ID NO: 564330 - protein, 9 aa, Mycobacterium
RLGPEGRGQ

SEQ ID NO: 564331 - protein, 8 aa, Mycobacterium
RLGPGRKY

SEQ ID NO: 564332 - protein, 6 aa, Mycobacterium
RLGPGT

SEQ ID NO: 564333 - protein, 14 aa, Mycobacterium
RLGPKLDKRGRDRL

SEQ ID NO: 564334 - protein, 7 aa, Mycobacterium
RLGPLPE

SEQ ID NO: 564335 - protein, 8 aa, Mycobacterium
RLGPQDAL

SEQ ID NO: 564336 - protein, 8 aa, Mycobacterium
RLGQDAGD

SEQ ID NO: 564337 - protein, 5 aa, Mycobacterium
RLGQG

SEQ ID NO: 564338 - protein, 7 aa, Mycobacterium
RLGQHGD

SEQ ID NO: 564339 - protein, 4 aa, Mycobacterium
RLGR

SEQ ID NO: 564340 - protein, 11 aa, Mycobacterium
RLGREATEPMR

SEQ ID NO: 564341 - protein, 26 aa, Mycobacterium
RLGRGPRVRRRPVGRPPRNAAHRGRH

SEQ ID NO: 564342 - protein, 12 aa, Mycobacterium
RLGRPEDDYQAR

SEQ ID NO: 564343 - protein, 5 aa, Mycobacterium
RLGRQ

SEQ ID NO: 564344 - protein, 7 aa, Mycobacterium
RLGRQQR

SEQ ID NO: 564345 - protein, 6 aa, Mycobacterium
RLGRSG

SEQ ID NO: 564346 - protein, 10 aa, Mycobacterium
RLGRTPVDPS

SEQ ID NO: 564347 - protein, 10 aa, Mycobacterium
RLGSDTHPLP

SEQ ID NO: 564348 - protein, 5 aa, Mycobacterium
RLGSG

SEQ ID NO: 564349 - protein, 6 aa, Mycobacterium
RLGSGR

SEQ ID NO: 564350 - protein, 7 aa, Mycobacterium
RLGSGTA

SEQ ID NO: 564351 - protein, 12 aa, Mycobacterium
RLGSPGDAKRLP

SEQ ID NO: 564352 - protein, 4 aa, Mycobacterium
RLGT

SEQ ID NO: 564353 - protein, 6 aa, Mycobacterium
RLGTDE

SEQ ID NO: 564354 - protein, 11 aa, Mycobacterium
RLGTDTTSPEE

SEQ ID NO: 564355 - protein, 13 aa, Mycobacterium
RLGTGADPRVSTA

SEQ ID NO: 564356 - protein, 13 aa, Mycobacterium
RLGTGTDPRVSTA

SEQ ID NO: 564357 - protein, 12 aa, Mycobacterium
RLGTPSSDPPLE

SEQ ID NO: 564358 - protein, 5 aa, Mycobacterium
RLGVP

SEQ ID NO: 564359 - protein, 7 aa, Mycobacterium
RLGVSGS

SEQ ID NO: 564360 - protein, 7 aa, Mycobacterium
RLHPGTG

SEQ ID NO: 564361 - protein, 4 aa, Mycobacterium
RLKD

SEQ ID NO: 564362 - protein, 8 aa, Mycobacterium
RLKGKQTE

SEQ ID NO: 564363 - protein, 9 aa, Mycobacterium
RLKRGGTNL

SEQ ID NO: 564364 - protein, 9 aa, Mycobacterium
RLKSSAHQH

SEQ ID NO: 564365 - protein, 6 aa, Mycobacterium
RLKTGD

SEQ ID NO: 564366 - protein, 5 aa, Mycobacterium
RLNAP

SEQ ID NO: 564367 - protein, 16 aa, Mycobacterium
RLNGNQDADDDLPEMA

SEQ ID NO: 564368 - protein, 5 aa, Mycobacterium
RLNGQ

SEQ ID NO: 564369 - protein, 6 aa, Mycobacterium
RLNGQS

SEQ ID NO: 564370 - protein, 12 aa, Mycobacterium
RLNGSDRSMNHR

SEQ ID NO: 564371 - protein, 8 aa, Mycobacterium
RLNGSRNP

SEQ ID NO: 564372 - protein, 8 aa, Mycobacterium
RLNPATGS

SEQ ID NO: 564373 - protein, 11 aa, Mycobacterium
RLNPEGAGTAL

SEQ ID NO: 564374 - protein, 9 aa, Mycobacterium
RLNPNGSGI

SEQ ID NO: 564375 - protein, 8 aa, Mycobacterium
RLNPRDTA

SEQ ID NO: 564376 - protein, 11 aa, Mycobacterium
RLNPRDTAHNM

SEQ ID NO: 564377 - protein, 5 aa, Mycobacterium
RLNSG

SEQ ID NO: 564378 - protein, 5 aa, Mycobacterium
RLNSH

SEQ ID NO: 564379 - protein, 13 aa, Mycobacterium
RLPAAGDIAQTDA

SEQ ID NO: 564380 - protein, 5 aa, Mycobacterium
RLPAD

SEQ ID NO: 564381 - protein, 8 aa, Mycobacterium
RLPADTEL

SEQ ID NO: 564382 - protein, 9 aa, Mycobacterium
RLPAELNTA

SEQ ID NO: 564383 - protein, 9 aa, Mycobacterium
RLPAGDDGA

SEQ ID NO: 564384 - protein, 7 aa, Mycobacterium
RLPAGPG

SEQ ID NO: 564385 - protein, 6 aa, Mycobacterium
RLPANN

SEQ ID NO: 564386 - protein, 7 aa, Mycobacterium
RLPAPPL

SEQ ID NO: 564387 - protein, 6 aa, Mycobacterium
RLPART

SEQ ID NO: 564388 - protein, 14 aa, Mycobacterium
RLPASERDDADRDA

SEQ ID NO: 564389 - protein, 10 aa, Mycobacterium
RLPASTPDTW

SEQ ID NO: 564390 - protein, 4 aa, Mycobacterium
RLPD

SEQ ID NO: 564391 - protein, 5 aa, Mycobacterium
RLPDA

SEQ ID NO: 564392 - protein, 6 aa, Mycobacterium
RLPDDA

SEQ ID NO: 564393 - protein, 6 aa, Mycobacterium
RLPDDE

SEQ ID NO: 564394 - protein, 7 aa, Mycobacterium
RLPDEDT

SEQ ID NO: 564395 - protein, 7 aa, Mycobacterium
RLPDGEP

SEQ ID NO: 564396 - protein, 11 aa, Mycobacterium
RLPDGNAEQLG

SEQ ID NO: 564397 - protein, 7 aa, Mycobacterium
RLPDGTF

SEQ ID NO: 564398 - protein, 16 aa, Mycobacterium
RLPDGTYTAIGSEQAM

SEQ ID NO: 564399 - protein, 9 aa, Mycobacterium
RLPDGVTSN

SEQ ID NO: 564400 - protein, 9 aa, Mycobacterium
RLPDPDNPR

SEQ ID NO: 564401 - protein, 8 aa, Mycobacterium
RLPDPPPP

SEQ ID NO: 564402 - protein, 12 aa, Mycobacterium
RLPDRQDRTCGR

SEQ ID NO: 564403 - protein, 4 aa, Mycobacterium
RLPE

SEQ ID NO: 564404 - protein, 6 aa, Mycobacterium
RLPEAG

SEQ ID NO: 564405 - protein, 7 aa, Mycobacterium
RLPEAKS

SEQ ID NO: 564406 - protein, 5 aa, Mycobacterium
RLPED

SEQ ID NO: 564407 - protein, 8 aa, Mycobacterium
RLPEPSPA

SEQ ID NO: 564408 - protein, 5 aa, Mycobacterium
RLPER

SEQ ID NO: 564409 - protein, 10 aa, Mycobacterium
RLPESVSGAP

SEQ ID NO: 564410 - protein, 7 aa, Mycobacterium
RLPETET

SEQ ID NO: 564411 - protein, 6 aa, Mycobacterium
RLPGAT

SEQ ID NO: 564412 - protein, 11 aa, Mycobacterium
RLPGDGAGSAA

SEQ ID NO: 564413 - protein, 10 aa, Mycobacterium
RLPGDGPLSG

SEQ ID NO: 564414 - protein, 5 aa, Mycobacterium
RLPGG

SEQ ID NO: 564415 - protein, 19 aa, Mycobacterium
RLPGGAGPYEVPPPIPRQH

SEQ ID NO: 564416 - protein, 21 aa, Mycobacterium
RLPGGSAGKQIEGTGEQDGSV

SEQ ID NO: 564417 - protein, 21 aa, Mycobacterium
RLPGGSAGRHIDGTGTEDGSV

SEQ ID NO: 564418 - protein, 6 aa, Mycobacterium
RLPGKT

SEQ ID NO: 564419 - protein, 6 aa, Mycobacterium
RLPGPH

SEQ ID NO: 564420 - protein, 6 aa, Mycobacterium
RLPGSA

SEQ ID NO: 564421 - protein, 14 aa, Mycobacterium
RLPHGASLRGTSQL

SEQ ID NO: 564422 - protein, 15 aa, Mycobacterium
RLPKEERADSGQRVN

SEQ ID NO: 564423 - protein, 7 aa, Mycobacterium
RLPKPAP

SEQ ID NO: 564424 - protein, 12 aa, Mycobacterium
RLPKRSRLRATH

SEQ ID NO: 564425 - protein, 8 aa, Mycobacterium
RLPKSGAA

SEQ ID NO: 564426 - protein, 5 aa, Mycobacterium
RLPKT

SEQ ID NO: 564427 - protein, 14 aa, Mycobacterium
RLPKTGAVAGSNAA

SEQ ID NO: 564428 - protein, 8 aa, Mycobacterium
RLPKTGSY

SEQ ID NO: 564429 - protein, 9 aa, Mycobacterium
RLPKTNDYL

SEQ ID NO: 564430 - protein, 4 aa, Mycobacterium
RLPL

SEQ ID NO: 564431 - protein, 10 aa, Mycobacterium
RLPNPADPSH

SEQ ID NO: 564432 - protein, 7 aa, Mycobacterium
RLPNPQF

SEQ ID NO: 564433 - protein, 4 aa, Mycobacterium
RLPP

SEQ ID NO: 564434 - protein, 11 aa, Mycobacterium
RLPPAASEAEA

SEQ ID NO: 564435 - protein, 7 aa, Mycobacterium
RLPPADL

SEQ ID NO: 564436 - protein, 7 aa, Mycobacterium
RLPPAGG

SEQ ID NO: 564437 - protein, 7 aa, Mycobacterium
RLPPAPI

SEQ ID NO: 564438 - protein, 10 aa, Mycobacterium
RLPPGEPVTA

SEQ ID NO: 564439 - protein, 9 aa, Mycobacterium
RLPPGPTLP

SEQ ID NO: 564440 - protein, 7 aa, Mycobacterium
RLPPGQL

SEQ ID NO: 564441 - protein, 9 aa, Mycobacterium
RLPPPDLTT

SEQ ID NO: 564442 - protein, 7 aa, Mycobacterium
RLPPSTP

SEQ ID NO: 564443 - protein, 8 aa, Mycobacterium
RLPPTDLT

SEQ ID NO: 564444 - protein, 8 aa, Mycobacterium
RLPPTGGL

SEQ ID NO: 564445 - protein, 5 aa, Mycobacterium
RLPQD

SEQ ID NO: 564446 - protein, 7 aa, Mycobacterium
RLPQPDL

SEQ ID NO: 564447 - protein, 12 aa, Mycobacterium
RLPQRGPDHSEK

SEQ ID NO: 564448 - protein, 14 aa, Mycobacterium
RLPQRSGHSVLVVR

SEQ ID NO: 564449 - protein, 6 aa, Mycobacterium
RLPREQ

SEQ ID NO: 564450 - protein, 9 aa, Mycobacterium
RLPREQRRQ

SEQ ID NO: 564451 - protein, 11 aa, Mycobacterium
RLPRERDRSSH

SEQ ID NO: 564452 - protein, 9 aa, Mycobacterium
RLPRGEALA

SEQ ID NO: 564453 - protein, 10 aa, Mycobacterium
RLPRGGGSRR

SEQ ID NO: 564454 - protein, 7 aa, Mycobacterium
RLPRGQG

SEQ ID NO: 564455 - protein, 6 aa, Mycobacterium
RLPRGV

SEQ ID NO: 564456 - protein, 13 aa, Mycobacterium
RLPRPQVRQRAER

SEQ ID NO: 564457 - protein, 5 aa, Mycobacterium
RLPRR

SEQ ID NO: 564458 - protein, 5 aa, Mycobacterium
RLPRS

SEQ ID NO: 564459 - protein, 9 aa, Mycobacterium
RLPRSGMRE

SEQ ID NO: 564460 - protein, 8 aa, Mycobacterium
RLPRTGSY

SEQ ID NO: 564461 - protein, 7 aa, Mycobacterium
RLPSEAE

SEQ ID NO: 564462 - protein, 13 aa, Mycobacterium
RLPSMTGPPRLSS

SEQ ID NO: 564463 - protein, 6 aa, Mycobacterium
RLPSRT

SEQ ID NO: 564464 - protein, 5 aa, Mycobacterium
RLPST

SEQ ID NO: 564465 - protein, 7 aa, Mycobacterium
RLPTDPR

SEQ ID NO: 564466 - protein, 7 aa, Mycobacterium
RLPTEAE

SEQ ID NO: 564467 - protein, 10 aa, Mycobacterium
RLPTETNKAL

SEQ ID NO: 564468 - protein, 8 aa, Mycobacterium
RLPTPSYR

SEQ ID NO: 564469 - protein, 8 aa, Mycobacterium
RLPTSIES

SEQ ID NO: 564470 - protein, 12 aa, Mycobacterium
RLPTTYTAPEIP

SEQ ID NO: 564471 - protein, 4 aa, Mycobacterium
RLQA

SEQ ID NO: 564472 - protein, 6 aa, Mycobacterium
RLQAEA

SEQ ID NO: 564473 - protein, 9 aa, Mycobacterium
RLQASGPAI

SEQ ID NO: 564474 - protein, 7 aa, Mycobacterium
RLQASNV

SEQ ID NO: 564475 - protein, 8 aa, Mycobacterium
RLQDDKVS

SEQ ID NO: 564476 - protein, 10 aa, Mycobacterium
RLQDGEPHLA

SEQ ID NO: 564477 - protein, 16 aa, Mycobacterium
RLQDGEPHLAGTARPP

SEQ ID NO: 564478 - protein, 18 aa, Mycobacterium
RLQDGEPHLAGTARTPTV

SEQ ID NO: 564479 - protein, 7 aa, Mycobacterium
RLQEDSA

SEQ ID NO: 564480 - protein, 10 aa, Mycobacterium
RLQGKAKEMS

SEQ ID NO: 564481 - protein, 5 aa, Mycobacterium
RLQGN

SEQ ID NO: 564482 - protein, 4 aa, Mycobacterium
RLQP

SEQ ID NO: 564483 - protein, 7 aa, Mycobacterium
RLQPEQR

SEQ ID NO: 564484 - protein, 6 aa, Mycobacterium
RLQPGE

SEQ ID NO: 564485 - protein, 7 aa, Mycobacterium
RLQPPLA

SEQ ID NO: 564486 - protein, 7 aa, Mycobacterium
RLQPQDA

SEQ ID NO: 564487 - protein, 7 aa, Mycobacterium
RLQQNPD

SEQ ID NO: 564488 - protein, 10 aa, Mycobacterium
RLQSKSNEMS

SEQ ID NO: 564489 - protein, 8 aa, Mycobacterium
RLQTPDDV

SEQ ID NO: 564490 - protein, 5 aa, Mycobacterium
RLQTR

SEQ ID NO: 564491 - protein, 11 aa, Mycobacterium
RLRAAARGDLS

SEQ ID NO: 564492 - protein, 14 aa, Mycobacterium
RLRAEGSKQYVETR

SEQ ID NO: 564493 - protein, 5 aa, Mycobacterium
RLREG

SEQ ID NO: 564494 - protein, 9 aa, Mycobacterium
RLREPGDPF

SEQ ID NO: 564495 - protein, 7 aa, Mycobacterium
RLRESKE

SEQ ID NO: 564496 - protein, 5 aa, Mycobacterium
RLRGD

SEQ ID NO: 564497 - protein, 7 aa, Mycobacterium
RLRGEEP

SEQ ID NO: 564498 - protein, 6 aa, Mycobacterium
RLRGGG

SEQ ID NO: 564499 - protein, 5 aa, Mycobacterium
RLRGP

SEQ ID NO: 564500 - protein, 7 aa, Mycobacterium
RLRGPLT

SEQ ID NO: 564501 - protein, 8 aa, Mycobacterium
RLRGQAGA

SEQ ID NO: 564502 - protein, 8 aa, Mycobacterium
RLRGSGAL

SEQ ID NO: 564503 - protein, 7 aa, Mycobacterium
RLRGTPL

SEQ ID NO: 564504 - protein, 4 aa, Mycobacterium
RLRN

SEQ ID NO: 564505 - protein, 12 aa, Mycobacterium
RLRNPGQPAGEA

SEQ ID NO: 564506 - protein, 4 aa, Mycobacterium
RLRR

SEQ ID NO: 564507 - protein, 11 aa, Mycobacterium
RLRRGRDRRKV

SEQ ID NO: 564508 - protein, 21 aa, Mycobacterium
RLRRSKDRRKVHYGDKTPVSL

SEQ ID NO: 564509 - protein, 7 aa, Mycobacterium
RLRSGPI

SEQ ID NO: 564510 - protein, 15 aa, Mycobacterium
RLRSSAGELPVCADC

SEQ ID NO: 564511 - protein, 9 aa, Mycobacterium
RLRSSGTPC

SEQ ID NO: 564512 - protein, 15 aa, Mycobacterium
RLRSSNAGVSICADC

SEQ ID NO: 564513 - protein, 5 aa, Mycobacterium
RLRTA

SEQ ID NO: 564514 - protein, 10 aa, Mycobacterium
RLRTRPDEAE

SEQ ID NO: 564515 - protein, 5 aa, Mycobacterium
RLSAA

SEQ ID NO: 564516 - protein, 9 aa, Mycobacterium
RLSAEPHAS

SEQ ID NO: 564517 - protein, 12 aa, Mycobacterium
RLSARQADTVER

SEQ ID NO: 564518 - protein, 7 aa, Mycobacterium
RLSDAAR

SEQ ID NO: 564519 - protein, 20 aa, Mycobacterium
RLSDDAQREALREGAWQSGT

SEQ ID NO: 564520 - protein, 7 aa, Mycobacterium
RLSDDED

SEQ ID NO: 564521 - protein, 8 aa, Mycobacterium
RLSDDVPE

SEQ ID NO: 564522 - protein, 8 aa, Mycobacterium
RLSDEGAG

SEQ ID NO: 564523 - protein, 5 aa, Mycobacterium
RLSDP

SEQ ID NO: 564524 - protein, 9 aa, Mycobacterium
RLSDPDAAN

SEQ ID NO: 564525 - protein, 7 aa, Mycobacterium
RLSDPRP

SEQ ID NO: 564526 - protein, 12 aa, Mycobacterium
RLSDPVSKPESL

SEQ ID NO: 564527 - protein, 7 aa, Mycobacterium
RLSDQEL

SEQ ID NO: 564528 - protein, 10 aa, Mycobacterium
RLSDRDEADR

SEQ ID NO: 564529 - protein, 4 aa, Mycobacterium
RLSE

SEQ ID NO: 564530 - protein, 6 aa, Mycobacterium
RLSEAE

SEQ ID NO: 564531 - protein, 11 aa, Mycobacterium
RLSEGGDRAAV

SEQ ID NO: 564532 - protein, 5 aa, Mycobacterium
RLSEP

SEQ ID NO: 564533 - protein, 7 aa, Mycobacterium
RLSEQAG

SEQ ID NO: 564534 - protein, 7 aa, Mycobacterium
RLSGAEA

SEQ ID NO: 564535 - protein, 7 aa, Mycobacterium
RLSGAKP

SEQ ID NO: 564536 - protein, 6 aa, Mycobacterium
RLSGGQ

SEQ ID NO: 564537 - protein, 11 aa, Mycobacterium
RLSGGSRAAIS

SEQ ID NO: 564538 - protein, 8 aa, Mycobacterium
RLSGPRGD

SEQ ID NO: 564539 - protein, 60 aa, Mycobacterium
RLSGRPEEQRIQRPEERRQRPDRDQGVHGGGAVPEVGPGGGVEGPAAPHDDRRGQHQRRP

SEQ ID NO: 564540 - protein, 6 aa, Mycobacterium
RLSGSG

SEQ ID NO: 564541 - protein, 10 aa, Mycobacterium
RLSGSGFPGH

SEQ ID NO: 564542 - protein, 9 aa, Mycobacterium
RLSGTGRRT

SEQ ID NO: 564543 - protein, 6 aa, Mycobacterium
RLSGTK

SEQ ID NO: 564544 - protein, 9 aa, Mycobacterium
RLSNAEQTP

SEQ ID NO: 564545 - protein, 6 aa, Mycobacterium
RLSPAA

SEQ ID NO: 564546 - protein, 21 aa, Mycobacterium
RLSPATEDAVAQADGAAEASQ

SEQ ID NO: 564547 - protein, 5 aa, Mycobacterium
RLSPE

SEQ ID NO: 564548 - protein, 10 aa, Mycobacterium
RLSPGAADEL

SEQ ID NO: 564549 - protein, 10 aa, Mycobacterium
RLSPGERTRA

SEQ ID NO: 564550 - protein, 11 aa, Mycobacterium
RLSPGRAARTH

SEQ ID NO: 564551 - protein, 9 aa, Mycobacterium
RLSPKERSQ

SEQ ID NO: 564552 - protein, 12 aa, Mycobacterium
RLSPKGSGTEVT

SEQ ID NO: 564553 - protein, 6 aa, Mycobacterium
RLSPQS

SEQ ID NO: 564554 - protein, 5 aa, Mycobacterium
RLSPR

SEQ ID NO: 564555 - protein, 7 aa, Mycobacterium
RLSPRGR

SEQ ID NO: 564556 - protein, 6 aa, Mycobacterium
RLSQAP

SEQ ID NO: 564557 - protein, 9 aa, Mycobacterium
RLSQEAPDV

SEQ ID NO: 564558 - protein, 8 aa, Mycobacterium
RLSQNAVR

SEQ ID NO: 564559 - protein, 8 aa, Mycobacterium
RLSQPAQR

SEQ ID NO: 564560 - protein, 8 aa, Mycobacterium
RLSQRGSE

SEQ ID NO: 564561 - protein, 8 aa, Mycobacterium
RLSRAQTT

SEQ ID NO: 564562 - protein, 9 aa, Mycobacterium
RLSRASGTH

SEQ ID NO: 564563 - protein, 5 aa, Mycobacterium
RLSRD

SEQ ID NO: 564564 - protein, 6 aa, Mycobacterium
RLSRTT

SEQ ID NO: 564565 - protein, 4 aa, Mycobacterium
RLSS

SEQ ID NO: 564566 - protein, 6 aa, Mycobacterium
RLSSAS

SEQ ID NO: 564567 - protein, 6 aa, Mycobacterium
RLSSHS

SEQ ID NO: 564568 - protein, 10 aa, Mycobacterium
RLSSNNAQQE

SEQ ID NO: 564569 - protein, 6 aa, Mycobacterium
RLSSPV

SEQ ID NO: 564570 - protein, 13 aa, Mycobacterium
RLSSSGLDEPGDE

SEQ ID NO: 564571 - protein, 5 aa, Mycobacterium
RLSSY

SEQ ID NO: 564572 - protein, 18 aa, Mycobacterium
RLSSYDGRNRVNPPLREA

SEQ ID NO: 564573 - protein, 7 aa, Mycobacterium
RLSTGER

SEQ ID NO: 564574 - protein, 11 aa, Mycobacterium
RLSTPEGRAAI

SEQ ID NO: 564575 - protein, 6 aa, Mycobacterium
RLTAAD

SEQ ID NO: 564576 - protein, 9 aa, Mycobacterium
RLTAAENDV

SEQ ID NO: 564577 - protein, 7 aa, Mycobacterium
RLTADGQ

SEQ ID NO: 564578 - protein, 9 aa, Mycobacterium
RLTAEPGSR

SEQ ID NO: 564579 - protein, 12 aa, Mycobacterium
RLTAGASGREVG

SEQ ID NO: 564580 - protein, 12 aa, Mycobacterium
RLTAQETANGAG

SEQ ID NO: 564581 - protein, 10 aa, Mycobacterium
RLTDADAEAL

SEQ ID NO: 564582 - protein, 9 aa, Mycobacterium
RLTDADGNR

SEQ ID NO: 564583 - protein, 24 aa, Mycobacterium
RLTDARQEARAEAVKTEKRGTGTE

SEQ ID NO: 564584 - protein, 10 aa, Mycobacterium
RLTDESPSLS

SEQ ID NO: 564585 - protein, 11 aa, Mycobacterium
RLTDGARVGTG

SEQ ID NO: 564586 - protein, 12 aa, Mycobacterium
RLTDGSHAHGAD

SEQ ID NO: 564587 - protein, 13 aa, Mycobacterium
RLTEANDSPAGEA

SEQ ID NO: 564588 - protein, 6 aa, Mycobacterium
RLTEDH

SEQ ID NO: 564589 - protein, 7 aa, Mycobacterium
RLTEGAA

SEQ ID NO: 564590 - protein, 12 aa, Mycobacterium
RLTERPDGIRNP

SEQ ID NO: 564591 - protein, 20 aa, Mycobacterium
RLTERTDVDGPYLQPSKEWT

SEQ ID NO: 564592 - protein, 5 aa, Mycobacterium
RLTES

SEQ ID NO: 564593 - protein, 10 aa, Mycobacterium
RLTESRNSEV

SEQ ID NO: 564594 - protein, 10 aa, Mycobacterium
RLTESTRKAN

SEQ ID NO: 564595 - protein, 5 aa, Mycobacterium
RLTET

SEQ ID NO: 564596 - protein, 8 aa, Mycobacterium
RLTETRDE

SEQ ID NO: 564597 - protein, 12 aa, Mycobacterium
RLTGAGDEGFER

SEQ ID NO: 564598 - protein, 24 aa, Mycobacterium
RLTGEVPRADATQETLMRYMMKGR

SEQ ID NO: 564599 - protein, 7 aa, Mycobacterium
RLTGGGF

SEQ ID NO: 564600 - protein, 10 aa, Mycobacterium
RLTGGNRQGI

SEQ ID NO: 564601 - protein, 9 aa, Mycobacterium
RLTGKDAEL

SEQ ID NO: 564602 - protein, 10 aa, Mycobacterium
RLTGKDAELS

SEQ ID NO: 564603 - protein, 12 aa, Mycobacterium
RLTGKSKDEVNA

SEQ ID NO: 564604 - protein, 6 aa, Mycobacterium
RLTGNE

SEQ ID NO: 564605 - protein, 10 aa, Mycobacterium
RLTGPDPAHP

SEQ ID NO: 564606 - protein, 8 aa, Mycobacterium
RLTGSSDL

SEQ ID NO: 564607 - protein, 10 aa, Mycobacterium
RLTGSSGDRR

SEQ ID NO: 564608 - protein, 11 aa, Mycobacterium
RLTGTSADEVN

SEQ ID NO: 564609 - protein, 6 aa, Mycobacterium
RLTNDH

SEQ ID NO: 564610 - protein, 7 aa, Mycobacterium
RLTNKDD

SEQ ID NO: 564611 - protein, 4 aa, Mycobacterium
RLTP

SEQ ID NO: 564612 - protein, 16 aa, Mycobacterium
RLTPAAAPDWEYPPAE

SEQ ID NO: 564613 - protein, 8 aa, Mycobacterium
RLTPDNPF

SEQ ID NO: 564614 - protein, 5 aa, Mycobacterium
RLTPE

SEQ ID NO: 564615 - protein, 8 aa, Mycobacterium
RLTPEQKQ

SEQ ID NO: 564616 - protein, 10 aa, Mycobacterium
RLTPGGRAKL

SEQ ID NO: 564617 - protein, 20 aa, Mycobacterium
RLTPGTVLPPPTGVFPRYQN

SEQ ID NO: 564618 - protein, 5 aa, Mycobacterium
RLTPH

SEQ ID NO: 564619 - protein, 7 aa, Mycobacterium
RLTPQDE

SEQ ID NO: 564620 - protein, 7 aa, Mycobacterium
RLTPRNN

SEQ ID NO: 564621 - protein, 10 aa, Mycobacterium
RLTPRSNSRQ

SEQ ID NO: 564622 - protein, 10 aa, Mycobacterium
RLTPSSSKKP

SEQ ID NO: 564623 - protein, 6 aa, Mycobacterium
RLTPSV

SEQ ID NO: 564624 - protein, 10 aa, Mycobacterium
RLTPTESNTH

SEQ ID NO: 564625 - protein, 11 aa, Mycobacterium
RLTQSGSTQLT

SEQ ID NO: 564626 - protein, 11 aa, Mycobacterium
RLTRRGSTQLE

SEQ ID NO: 564627 - protein, 9 aa, Mycobacterium
RLTSASERH

SEQ ID NO: 564628 - protein, 6 aa, Mycobacterium
RLTSDE

SEQ ID NO: 564629 - protein, 6 aa, Mycobacterium
RLTSDP

SEQ ID NO: 564630 - protein, 12 aa, Mycobacterium
RLTSESARIGRP

SEQ ID NO: 564631 - protein, 12 aa, Mycobacterium
RLTSSGESAEFF

SEQ ID NO: 564632 - protein, 8 aa, Mycobacterium
RLTTAEDA

SEQ ID NO: 564633 - protein, 7 aa, Mycobacterium
RLTTRAP

SEQ ID NO: 564634 - protein, 4 aa, Mycobacterium
RLTV

SEQ ID NO: 564635 - protein, 5 aa, Mycobacterium
RLYAT

SEQ ID NO: 564636 - protein, 6 aa, Mycobacterium
RLYATN

SEQ ID NO: 564637 - protein, 4 aa, Mycobacterium
RLYG

SEQ ID NO: 564638 - protein, 12 aa, Mycobacterium
RMADQRDVLLGV

SEQ ID NO: 564639 - protein, 5 aa, Mycobacterium
RMAEG

SEQ ID NO: 564640 - protein, 8 aa, Mycobacterium
RMAERKSG

SEQ ID NO: 564641 - protein, 14 aa, Mycobacterium
RMAGEGLSASPSAN

SEQ ID NO: 564642 - protein, 9 aa, Mycobacterium
RMAGPGRAE

SEQ ID NO: 564643 - protein, 5 aa, Mycobacterium
RMAKE

SEQ ID NO: 564644 - protein, 4 aa, Mycobacterium
RMAP

SEQ ID NO: 564645 - protein, 8 aa, Mycobacterium
RMAPPDHA

SEQ ID NO: 564646 - protein, 6 aa, Mycobacterium
RMAPPE

SEQ ID NO: 564647 - protein, 13 aa, Mycobacterium
RMAQDSTYRPALP

SEQ ID NO: 564648 - protein, 5 aa, Mycobacterium
RMARD

SEQ ID NO: 564649 - protein, 10 aa, Mycobacterium
RMASAAQGRP

SEQ ID NO: 564650 - protein, 8 aa, Mycobacterium
RMASGGPR

SEQ ID NO: 564651 - protein, 28 aa, Mycobacterium
RMDAEEAAQKAARRSATPGIDTGNAEAP

SEQ ID NO: 564652 - protein, 6 aa, Mycobacterium
RMDDEE

SEQ ID NO: 564653 - protein, 10 aa, Mycobacterium
RMDPSGPTNY

SEQ ID NO: 564654 - protein, 15 aa, Mycobacterium
RMDRPGGGLSGGQQQ

SEQ ID NO: 564655 - protein, 24 aa, Mycobacterium
RMDSASGAEYHSATPDPVSPEAAR

SEQ ID NO: 564656 - protein, 25 aa, Mycobacterium
RMDSATGEAYAAAEPDPVAPASAGA

SEQ ID NO: 564657 - protein, 23 aa, Mycobacterium
RMDSTTGEAYAAAEADPVTPRAA

SEQ ID NO: 564658 - protein, 8 aa, Mycobacterium
RMDTGRPN

SEQ ID NO: 564659 - protein, 4 aa, Mycobacterium
RMES

SEQ ID NO: 564660 - protein, 8 aa, Mycobacterium
RMGDGDGV

SEQ ID NO: 564661 - protein, 6 aa, Mycobacterium
RMGDGE

SEQ ID NO: 564662 - protein, 8 aa, Mycobacterium
RMGDGEPV

SEQ ID NO: 564663 - protein, 7 aa, Mycobacterium
RMGEPEE

SEQ ID NO: 564664 - protein, 4 aa, Mycobacterium
RMGQ

SEQ ID NO: 564665 - protein, 17 aa, Mycobacterium
RMGSDPESSVVNSDQRS

SEQ ID NO: 564666 - protein, 16 aa, Mycobacterium
RMGSDPRSTVGTVTDA

SEQ ID NO: 564667 - protein, 4 aa, Mycobacterium
RMGT

SEQ ID NO: 564668 - protein, 12 aa, Mycobacterium
RMGTGPQNSVVD

SEQ ID NO: 564669 - protein, 7 aa, Mycobacterium
RMGTSGA

SEQ ID NO: 564670 - protein, 9 aa, Mycobacterium
RMKDASSTD

SEQ ID NO: 564671 - protein, 4 aa, Mycobacterium
RMKP

SEQ ID NO: 564672 - protein, 8 aa, Mycobacterium
RMPAEERA

SEQ ID NO: 564673 - protein, 7 aa, Mycobacterium
RMPAPDS

SEQ ID NO: 564674 - protein, 11 aa, Mycobacterium
RMPARRAASAV

SEQ ID NO: 564675 - protein, 22 aa, Mycobacterium
RMPASAAAATIPAPQALAGTSV

SEQ ID NO: 564676 - protein, 7 aa, Mycobacterium
RMPDAAG

SEQ ID NO: 564677 - protein, 16 aa, Mycobacterium
RMPDTAGDTGDGNRLA

SEQ ID NO: 564678 - protein, 10 aa, Mycobacterium
RMPGGESAQD

SEQ ID NO: 564679 - protein, 10 aa, Mycobacterium
RMPGGGTARR

SEQ ID NO: 564680 - protein, 9 aa, Mycobacterium
RMPKPKPLA

SEQ ID NO: 564681 - protein, 8 aa, Mycobacterium
RMPPRGLT

SEQ ID NO: 564682 - protein, 12 aa, Mycobacterium
RMPSQTPPSPPT

SEQ ID NO: 564683 - protein, 9 aa, Mycobacterium
RMPTPEERR

SEQ ID NO: 564684 - protein, 15 aa, Mycobacterium
RMQDGEPHLAGTARK

SEQ ID NO: 564685 - protein, 18 aa, Mycobacterium
RMQDGEPHLAGTARKPAL

SEQ ID NO: 564686 - protein, 13 aa, Mycobacterium
RMQRAQSDDEDPF

SEQ ID NO: 564687 - protein, 5 aa, Mycobacterium
RMRAE

SEQ ID NO: 564688 - protein, 7 aa, Mycobacterium
RMRDSRR

SEQ ID NO: 564689 - protein, 5 aa, Mycobacterium
RMSAE

SEQ ID NO: 564690 - protein, 5 aa, Mycobacterium
RMSAG

SEQ ID NO: 564691 - protein, 4 aa, Mycobacterium
RMSD

SEQ ID NO: 564692 - protein, 6 aa, Mycobacterium
RMSESQ

SEQ ID NO: 564693 - protein, 33 aa, Mycobacterium
RMSGPEAKTWEGHAGQPFDPNYHGPKDTLANVG

SEQ ID NO: 564694 - protein, 14 aa, Mycobacterium
RMSGRMGNDRVTTQ

SEQ ID NO: 564695 - protein, 4 aa, Mycobacterium
RMSQ

SEQ ID NO: 564696 - protein, 7 aa, Mycobacterium
RMSQPQV

SEQ ID NO: 564697 - protein, 7 aa, Mycobacterium
RMSTNGL

SEQ ID NO: 564698 - protein, 13 aa, Mycobacterium
RMSTSTAAAGGPM

SEQ ID NO: 564699 - protein, 4 aa, Mycobacterium
RMTA

SEQ ID NO: 564700 - protein, 6 aa, Mycobacterium
RMTDDE

SEQ ID NO: 564701 - protein, 9 aa, Mycobacterium
RMTGGGVTA

SEQ ID NO: 564702 - protein, 11 aa, Mycobacterium
RMTNPAESVSR

SEQ ID NO: 564703 - protein, 13 aa, Mycobacterium
RMTPKDPDSVQWP

SEQ ID NO: 564704 - protein, 5 aa, Mycobacterium
RMTPT

SEQ ID NO: 564705 - protein, 8 aa, Mycobacterium
RMTQDDGG

SEQ ID NO: 564706 - protein, 4 aa, Mycobacterium
RMTS

SEQ ID NO: 564707 - protein, 7 aa, Mycobacterium
RMTSPEE

SEQ ID NO: 564708 - protein, 11 aa, Mycobacterium
RMTTPADSVAR

SEQ ID NO: 564709 - protein, 4 aa, Mycobacterium
RMTV

SEQ ID NO: 564710 - protein, 4 aa, Mycobacterium
RNAA

SEQ ID NO: 564711 - protein, 8 aa, Mycobacterium
RNAAAAAA

SEQ ID NO: 564712 - protein, 7 aa, Mycobacterium
RNAAAPM

SEQ ID NO: 564713 - protein, 12 aa, Mycobacterium
RNAAASEVDQPV

SEQ ID NO: 564714 - protein, 6 aa, Mycobacterium
RNAADG

SEQ ID NO: 564715 - protein, 9 aa, Mycobacterium
RNAADSTAQ

SEQ ID NO: 564716 - protein, 15 aa, Mycobacterium
RNAADVPAKFKSEPW

SEQ ID NO: 564717 - protein, 7 aa, Mycobacterium
RNAAGDG

SEQ ID NO: 564718 - protein, 11 aa, Mycobacterium
RNAAKAALANN

SEQ ID NO: 564719 - protein, 8 aa, Mycobacterium
RNAALNPS

SEQ ID NO: 564720 - protein, 13 aa, Mycobacterium
RNAAPAAADGEAQ

SEQ ID NO: 564721 - protein, 29 aa, Mycobacterium
RNAAPDAELRATAKRAINDVRRGVVAVDA

SEQ ID NO: 564722 - protein, 9 aa, Mycobacterium
RNAAPPEYT

SEQ ID NO: 564723 - protein, 14 aa, Mycobacterium
RNAAPSPALRATAK

SEQ ID NO: 564724 - protein, 21 aa, Mycobacterium
RNAAQLPAATVSGATDTVDVG

SEQ ID NO: 564725 - protein, 5 aa, Mycobacterium
RNAAR

SEQ ID NO: 564726 - protein, 7 aa, Mycobacterium
RNAARRD

SEQ ID NO: 564727 - protein, 12 aa, Mycobacterium
RNAATRSGKQEY

SEQ ID NO: 564728 - protein, 6 aa, Mycobacterium
RNADDH

SEQ ID NO: 564729 - protein, 6 aa, Mycobacterium
RNADGR

SEQ ID NO: 564730 - protein, 7 aa, Mycobacterium
RNADKAA

SEQ ID NO: 564731 - protein, 23 aa, Mycobacterium
RNADKLAAAAEEITAQSGDGAGE

SEQ ID NO: 564732 - protein, 10 aa, Mycobacterium
RNADNSIGAL

SEQ ID NO: 564733 - protein, 9 aa, Mycobacterium
RNADPDDYT

SEQ ID NO: 564734 - protein, 9 aa, Mycobacterium
RNADSGHAS

SEQ ID NO: 564735 - protein, 4 aa, Mycobacterium
RNAE

SEQ ID NO: 564736 - protein, 9 aa, Mycobacterium
RNAEATHRA

SEQ ID NO: 564737 - protein, 7 aa, Mycobacterium
RNAEDTG

SEQ ID NO: 564738 - protein, 9 aa, Mycobacterium
RNAEESGGR

SEQ ID NO: 564739 - protein, 9 aa, Mycobacterium
RNAEETRGR

SEQ ID NO: 564740 - protein, 7 aa, Mycobacterium
RNAEGGF

SEQ ID NO: 564741 - protein, 10 aa, Mycobacterium
RNAEGGKKTQ

SEQ ID NO: 564742 - protein, 8 aa, Mycobacterium
RNAEGTGV

SEQ ID NO: 564743 - protein, 10 aa, Mycobacterium
RNAELSPGRA

SEQ ID NO: 564744 - protein, 6 aa, Mycobacterium
RNAEVT

SEQ ID NO: 564745 - protein, 15 aa, Mycobacterium
RNAFGNAGGARGVDQ

SEQ ID NO: 564746 - protein, 4 aa, Mycobacterium
RNAG

SEQ ID NO: 564747 - protein, 7 aa, Mycobacterium
RNAGASV

SEQ ID NO: 564748 - protein, 9 aa, Mycobacterium
RNAGDAEIK

SEQ ID NO: 564749 - protein, 9 aa, Mycobacterium
RNAGDTTGS

SEQ ID NO: 564750 - protein, 5 aa, Mycobacterium
RNAGG

SEQ ID NO: 564751 - protein, 8 aa, Mycobacterium
RNAGGPEL

SEQ ID NO: 564752 - protein, 9 aa, Mycobacterium
RNAGGRPVR

SEQ ID NO: 564753 - protein, 6 aa, Mycobacterium
RNAGSL

SEQ ID NO: 564754 - protein, 6 aa, Mycobacterium
RNANQV

SEQ ID NO: 564755 - protein, 10 aa, Mycobacterium
RNAPGSATVD

SEQ ID NO: 564756 - protein, 12 aa, Mycobacterium
RNAPTANPGYAT

SEQ ID NO: 564757 - protein, 6 aa, Mycobacterium
RNAPTT

SEQ ID NO: 564758 - protein, 9 aa, Mycobacterium
RNAQDTTAQ

SEQ ID NO: 564759 - protein, 9 aa, Mycobacterium
RNAQESQHV

SEQ ID NO: 564760 - protein, 9 aa, Mycobacterium
RNAQESTAQ

SEQ ID NO: 564761 - protein, 9 aa, Mycobacterium
RNAQQTQHV

SEQ ID NO: 564762 - protein, 10 aa, Mycobacterium
RNAQTNARLQ

SEQ ID NO: 564763 - protein, 12 aa, Mycobacterium
RNARAAKRAVKS

SEQ ID NO: 564764 - protein, 16 aa, Mycobacterium
RNARAAKRAVKSNGWG

SEQ ID NO: 564765 - protein, 7 aa, Mycobacterium
RNARDSY

SEQ ID NO: 564766 - protein, 5 aa, Mycobacterium
RNARG

SEQ ID NO: 564767 - protein, 6 aa, Mycobacterium
RNASGM

SEQ ID NO: 564768 - protein, 12 aa, Mycobacterium
RNASKTPEPVPR

SEQ ID NO: 564769 - protein, 10 aa, Mycobacterium
RNASSITHDY

SEQ ID NO: 564770 - protein, 8 aa, Mycobacterium
RNATDAEI

SEQ ID NO: 564771 - protein, 8 aa, Mycobacterium
RNATGVEG

SEQ ID NO: 564772 - protein, 7 aa, Mycobacterium
RNATKAN

SEQ ID NO: 564773 - protein, 8 aa, Mycobacterium
RNATPREA

SEQ ID NO: 564774 - protein, 8 aa, Mycobacterium
RNATSPDQ

SEQ ID NO: 564775 - protein, 5 aa, Mycobacterium
RNATT

SEQ ID NO: 564776 - protein, 5 aa, Mycobacterium
RNAVS

SEQ ID NO: 564777 - protein, 4 aa, Mycobacterium
RNCT

SEQ ID NO: 564778 - protein, 10 aa, Mycobacterium
RNDAAGTPAF

SEQ ID NO: 564779 - protein, 12 aa, Mycobacterium
RNDAVDPQPAID

SEQ ID NO: 564780 - protein, 8 aa, Mycobacterium
RNDDFQDK

SEQ ID NO: 564781 - protein, 8 aa, Mycobacterium
RNDDRNDR

SEQ ID NO: 564782 - protein, 5 aa, Mycobacterium
RNDDS

SEQ ID NO: 564783 - protein, 7 aa, Mycobacterium
RNDEPIR

SEQ ID NO: 564784 - protein, 12 aa, Mycobacterium
RNDESAAAPQTP

SEQ ID NO: 564785 - protein, 5 aa, Mycobacterium
RNDET

SEQ ID NO: 564786 - protein, 6 aa, Mycobacterium
RNDETV

SEQ ID NO: 564787 - protein, 5 aa, Mycobacterium
RNDFA

SEQ ID NO: 564788 - protein, 7 aa, Mycobacterium
RNDFPDA

SEQ ID NO: 564789 - protein, 13 aa, Mycobacterium
RNDFSQADQQRIA

SEQ ID NO: 564790 - protein, 8 aa, Mycobacterium
RNDGDVPE

SEQ ID NO: 564791 - protein, 7 aa, Mycobacterium
RNDGETI

SEQ ID NO: 564792 - protein, 6 aa, Mycobacterium
RNDGPG

SEQ ID NO: 564793 - protein, 5 aa, Mycobacterium
RNDGT

SEQ ID NO: 564794 - protein, 6 aa, Mycobacterium
RNDGTF

SEQ ID NO: 564795 - protein, 12 aa, Mycobacterium
RNDHRSGSLPTA

SEQ ID NO: 564796 - protein, 5 aa, Mycobacterium
RNDHS

SEQ ID NO: 564797 - protein, 17 aa, Mycobacterium
RNDKAGKADKSGKGTAY

SEQ ID NO: 564798 - protein, 5 aa, Mycobacterium
RNDNG

SEQ ID NO: 564799 - protein, 6 aa, Mycobacterium
RNDNND

SEQ ID NO: 564800 - protein, 14 aa, Mycobacterium
RNDNPSNPAPPEAH

SEQ ID NO: 564801 - protein, 6 aa, Mycobacterium
RNDPAF

SEQ ID NO: 564802 - protein, 5 aa, Mycobacterium
RNDPD

SEQ ID NO: 564803 - protein, 6 aa, Mycobacterium
RNDPEF

SEQ ID NO: 564804 - protein, 7 aa, Mycobacterium
RNDPEFS

SEQ ID NO: 564805 - protein, 6 aa, Mycobacterium
RNDPLP

SEQ ID NO: 564806 - protein, 10 aa, Mycobacterium
RNDPNLPADA

SEQ ID NO: 564807 - protein, 6 aa, Mycobacterium
RNDPRR

SEQ ID NO: 564808 - protein, 10 aa, Mycobacterium
RNDPSLMGTA

SEQ ID NO: 564809 - protein, 6 aa, Mycobacterium
RNDPSR

SEQ ID NO: 564810 - protein, 6 aa, Mycobacterium
RNDPTL

SEQ ID NO: 564811 - protein, 5 aa, Mycobacterium
RNDPW

SEQ ID NO: 564812 - protein, 12 aa, Mycobacterium
RNDQGVDPETYA

SEQ ID NO: 564813 - protein, 7 aa, Mycobacterium
RNDRAVK

SEQ ID NO: 564814 - protein, 6 aa, Mycobacterium
RNDREL

SEQ ID NO: 564815 - protein, 9 aa, Mycobacterium
RNDRGEPLE

SEQ ID NO: 564816 - protein, 7 aa, Mycobacterium
RNDRGPA

SEQ ID NO: 564817 - protein, 10 aa, Mycobacterium
RNDRTAAAAA

SEQ ID NO: 564818 - protein, 6 aa, Mycobacterium
RNDRTV

SEQ ID NO: 564819 - protein, 12 aa, Mycobacterium
RNDSGKPGTPLS

SEQ ID NO: 564820 - protein, 11 aa, Mycobacterium
RNDSGKPGVPL

SEQ ID NO: 564821 - protein, 14 aa, Mycobacterium
RNDSRTKAQRRADA

SEQ ID NO: 564822 - protein, 7 aa, Mycobacterium
RNDSSGA

SEQ ID NO: 564823 - protein, 7 aa, Mycobacterium
RNDSYGR

SEQ ID NO: 564824 - protein, 9 aa, Mycobacterium
RNDTDHPGK

SEQ ID NO: 564825 - protein, 9 aa, Mycobacterium
RNDTDHQGK

SEQ ID NO: 564826 - protein, 21 aa, Mycobacterium
RNDTPGRQGDYPNLATGPQRT

SEQ ID NO: 564827 - protein, 6 aa, Mycobacterium
RNDTTY

SEQ ID NO: 564828 - protein, 6 aa, Mycobacterium
RNEAAP

SEQ ID NO: 564829 - protein, 7 aa, Mycobacterium
RNEAAPY

SEQ ID NO: 564830 - protein, 9 aa, Mycobacterium
RNEADLDEV

SEQ ID NO: 564831 - protein, 9 aa, Mycobacterium
RNEAGKPMA

SEQ ID NO: 564832 - protein, 9 aa, Mycobacterium
RNEAGKPMH

SEQ ID NO: 564833 - protein, 7 aa, Mycobacterium
RNEAGPQ

SEQ ID NO: 564834 - protein, 8 aa, Mycobacterium
RNEAGPQV

SEQ ID NO: 564835 - protein, 8 aa, Mycobacterium
RNEAGTGG

SEQ ID NO: 564836 - protein, 12 aa, Mycobacterium
RNEAQIRELATL

SEQ ID NO: 564837 - protein, 6 aa, Mycobacterium
RNEDDP

SEQ ID NO: 564838 - protein, 8 aa, Mycobacterium
RNEDPACP

SEQ ID NO: 564839 - protein, 11 aa, Mycobacterium
RNEDPACPAGS

SEQ ID NO: 564840 - protein, 28 aa, Mycobacterium
RNEDPACPAGSYVGPKAIKNPDGSSNYV

SEQ ID NO: 564841 - protein, 9 aa, Mycobacterium
RNEETHQAT

SEQ ID NO: 564842 - protein, 12 aa, Mycobacterium
RNEGADSTHSPE

SEQ ID NO: 564843 - protein, 7 aa, Mycobacterium
RNEGKAP

SEQ ID NO: 564844 - protein, 12 aa, Mycobacterium
RNEGVDSTHSPE

SEQ ID NO: 564845 - protein, 5 aa, Mycobacterium
RNEIT

SEQ ID NO: 564846 - protein, 9 aa, Mycobacterium
RNEKNWSRE

SEQ ID NO: 564847 - protein, 7 aa, Mycobacterium
RNENPYP

SEQ ID NO: 564848 - protein, 4 aa, Mycobacterium
RNEP

SEQ ID NO: 564849 - protein, 6 aa, Mycobacterium
RNEPAS

SEQ ID NO: 564850 - protein, 10 aa, Mycobacterium
RNEPDDEERG

SEQ ID NO: 564851 - protein, 8 aa, Mycobacterium
RNEPDGRK

SEQ ID NO: 564852 - protein, 7 aa, Mycobacterium
RNEPGLQ

SEQ ID NO: 564853 - protein, 5 aa, Mycobacterium
RNEPH

SEQ ID NO: 564854 - protein, 7 aa, Mycobacterium
RNEPTKA

SEQ ID NO: 564855 - protein, 6 aa, Mycobacterium
RNEPTL

SEQ ID NO: 564856 - protein, 22 aa, Mycobacterium
RNEPTQTVGRGPLGGNPGGVVS

SEQ ID NO: 564857 - protein, 9 aa, Mycobacterium
RNEQPRTAH

SEQ ID NO: 564858 - protein, 27 aa, Mycobacterium
RNEQTAADGTGTLEPPGGPQTPELLSL

SEQ ID NO: 564859 - protein, 9 aa, Mycobacterium
RNERADTAG

SEQ ID NO: 564860 - protein, 10 aa, Mycobacterium
RNERARRRRP

SEQ ID NO: 564861 - protein, 12 aa, Mycobacterium
RNERLGSASPAA

SEQ ID NO: 564862 - protein, 6 aa, Mycobacterium
RNERPR

SEQ ID NO: 564863 - protein, 6 aa, Mycobacterium
RNESDP

SEQ ID NO: 564864 - protein, 8 aa, Mycobacterium
RNESDQPA

SEQ ID NO: 564865 - protein, 8 aa, Mycobacterium
RNESQEPA

SEQ ID NO: 564866 - protein, 4 aa, Mycobacterium
RNET

SEQ ID NO: 564867 - protein, 5 aa, Mycobacterium
RNETD

SEQ ID NO: 564868 - protein, 7 aa, Mycobacterium
RNEYEDE

SEQ ID NO: 564869 - protein, 10 aa, Mycobacterium
RNFSAGHDLG

SEQ ID NO: 564870 - protein, 35 aa, Mycobacterium
RNFSAGHDLGSEQALAERAPGPGQHPSFRSRGATL

SEQ ID NO: 564871 - protein, 8 aa, Mycobacterium
RNGAAHGG

SEQ ID NO: 564872 - protein, 15 aa, Mycobacterium
RNGADSSVRIGAGTP

SEQ ID NO: 564873 - protein, 15 aa, Mycobacterium
RNGAEALGSMGTDTP

SEQ ID NO: 564874 - protein, 8 aa, Mycobacterium
RNGAGKST

SEQ ID NO: 564875 - protein, 9 aa, Mycobacterium
RNGAGKTTS

SEQ ID NO: 564876 - protein, 9 aa, Mycobacterium
RNGAPAPRR

SEQ ID NO: 564877 - protein, 9 aa, Mycobacterium
RNGAQGKSY

SEQ ID NO: 564878 - protein, 7 aa, Mycobacterium
RNGAQRP

SEQ ID NO: 564879 - protein, 8 aa, Mycobacterium
RNGARGAD

SEQ ID NO: 564880 - protein, 5 aa, Mycobacterium
RNGAY

SEQ ID NO: 564881 - protein, 6 aa, Mycobacterium
RNGAYG

SEQ ID NO: 564882 - protein, 7 aa, Mycobacterium
RNGCTRD

SEQ ID NO: 564883 - protein, 4 aa, Mycobacterium
RNGD

SEQ ID NO: 564884 - protein, 7 aa, Mycobacterium
RNGDDDT

SEQ ID NO: 564885 - protein, 8 aa, Mycobacterium
RNGDGAAV

SEQ ID NO: 564886 - protein, 6 aa, Mycobacterium
RNGDGR

SEQ ID NO: 564887 - protein, 8 aa, Mycobacterium
RNGDPTGL

SEQ ID NO: 564888 - protein, 13 aa, Mycobacterium
RNGDRADRLRSYA

SEQ ID NO: 564889 - protein, 10 aa, Mycobacterium
RNGEDGPSVI

SEQ ID NO: 564890 - protein, 6 aa, Mycobacterium
RNGEDP

SEQ ID NO: 564891 - protein, 8 aa, Mycobacterium
RNGEKRWD

SEQ ID NO: 564892 - protein, 9 aa, Mycobacterium
RNGELTEQG

SEQ ID NO: 564893 - protein, 9 aa, Mycobacterium
RNGEPVPDA

SEQ ID NO: 564894 - protein, 13 aa, Mycobacterium
RNGEQFRCRGGYF

SEQ ID NO: 564895 - protein, 9 aa, Mycobacterium
RNGERKAFG

SEQ ID NO: 564896 - protein, 4 aa, Mycobacterium
RNGF

SEQ ID NO: 564897 - protein, 5 aa, Mycobacterium
RNGGA

SEQ ID NO: 564898 - protein, 11 aa, Mycobacterium
RNGGAMADPGS

SEQ ID NO: 564899 - protein, 5 aa, Mycobacterium
RNGGG

SEQ ID NO: 564900 - protein, 6 aa, Mycobacterium
RNGGGF

SEQ ID NO: 564901 - protein, 20 aa, Mycobacterium
RNGGGGLTPSDIAPARLSQQ

SEQ ID NO: 564902 - protein, 7 aa, Mycobacterium
RNGGGTM

SEQ ID NO: 564903 - protein, 14 aa, Mycobacterium
RNGGNRHVAGAPTA

SEQ ID NO: 564904 - protein, 9 aa, Mycobacterium
RNGGPKPLR

SEQ ID NO: 564905 - protein, 13 aa, Mycobacterium
RNGGQPRSTVVPS

SEQ ID NO: 564906 - protein, 13 aa, Mycobacterium
RNGGRRQTTVVPP

SEQ ID NO: 564907 - protein, 13 aa, Mycobacterium
RNGGRRTATAVPA

SEQ ID NO: 564908 - protein, 11 aa, Mycobacterium
RNGGSMADPGS

SEQ ID NO: 564909 - protein, 11 aa, Mycobacterium
RNGGTMADPGS

SEQ ID NO: 564910 - protein, 13 aa, Mycobacterium
RNGHDDDFNRGDS

SEQ ID NO: 564911 - protein, 28 aa, Mycobacterium
RNGHDDDYCRGDSAYDNYYGDPTLPNPN

SEQ ID NO: 564912 - protein, 6 aa, Mycobacterium
RNGHGG

SEQ ID NO: 564913 - protein, 6 aa, Mycobacterium
RNGHGI

SEQ ID NO: 564914 - protein, 9 aa, Mycobacterium
RNGHKPGTR

SEQ ID NO: 564915 - protein, 5 aa, Mycobacterium
RNGHR

SEQ ID NO: 564916 - protein, 5 aa, Mycobacterium
RNGHS

SEQ ID NO: 564917 - protein, 7 aa, Mycobacterium
RNGHTTS

SEQ ID NO: 564918 - protein, 12 aa, Mycobacterium
RNGIGGADVSSI

SEQ ID NO: 564919 - protein, 10 aa, Mycobacterium
RNGKGQKKLR

SEQ ID NO: 564920 - protein, 7 aa, Mycobacterium
RNGKTHP

SEQ ID NO: 564921 - protein, 6 aa, Mycobacterium
RNGMQP

SEQ ID NO: 564922 - protein, 12 aa, Mycobacterium
RNGNEVAVTTET

SEQ ID NO: 564923 - protein, 12 aa, Mycobacterium
RNGNQVSVTTET

SEQ ID NO: 564924 - protein, 13 aa, Mycobacterium
RNGNRGPGAGPQG

SEQ ID NO: 564925 - protein, 5 aa, Mycobacterium
RNGPA

SEQ ID NO: 564926 - protein, 8 aa, Mycobacterium
RNGPANQL

SEQ ID NO: 564927 - protein, 6 aa, Mycobacterium
RNGPAV

SEQ ID NO: 564928 - protein, 8 aa, Mycobacterium
RNGPDATT

SEQ ID NO: 564929 - protein, 6 aa, Mycobacterium
RNGPEM

SEQ ID NO: 564930 - protein, 10 aa, Mycobacterium
RNGPGDAVPK

SEQ ID NO: 564931 - protein, 12 aa, Mycobacterium
RNGPNPAAEVDP

SEQ ID NO: 564932 - protein, 12 aa, Mycobacterium
RNGPNPAEEVDP

SEQ ID NO: 564933 - protein, 10 aa, Mycobacterium
RNGPNPIGDL

SEQ ID NO: 564934 - protein, 8 aa, Mycobacterium
RNGPPFSP

SEQ ID NO: 564935 - protein, 7 aa, Mycobacterium
RNGPPYT

SEQ ID NO: 564936 - protein, 7 aa, Mycobacterium
RNGPSYD

SEQ ID NO: 564937 - protein, 8 aa, Mycobacterium
RNGPTRTC

SEQ ID NO: 564938 - protein, 5 aa, Mycobacterium
RNGPY

SEQ ID NO: 564939 - protein, 11 aa, Mycobacterium
RNGQRGRPSLQ

SEQ ID NO: 564940 - protein, 5 aa, Mycobacterium
RNGQS

SEQ ID NO: 564941 - protein, 12 aa, Mycobacterium
RNGQTDAAIGSA

SEQ ID NO: 564942 - protein, 11 aa, Mycobacterium
RNGQTDAAVGA

SEQ ID NO: 564943 - protein, 14 aa, Mycobacterium
RNGRPLAPAGIEGT

SEQ ID NO: 564944 - protein, 20 aa, Mycobacterium
RNGRYGKPGSARRAKVEANP

SEQ ID NO: 564945 - protein, 11 aa, Mycobacterium
RNGSIATRPVA

SEQ ID NO: 564946 - protein, 6 aa, Mycobacterium
RNGSLA

SEQ ID NO: 564947 - protein, 10 aa, Mycobacterium
RNGSQGKSYR

SEQ ID NO: 564948 - protein, 10 aa, Mycobacterium
RNGSRGKSYR

SEQ ID NO: 564949 - protein, 7 aa, Mycobacterium
RNGSYGQ

SEQ ID NO: 564950 - protein, 4 aa, Mycobacterium
RNGT

SEQ ID NO: 564951 - protein, 7 aa, Mycobacterium
RNGTRVV

SEQ ID NO: 564952 - protein, 8 aa, Mycobacterium
RNGTVEKT

SEQ ID NO: 564953 - protein, 5 aa, Mycobacterium
RNGVE

SEQ ID NO: 564954 - protein, 11 aa, Mycobacterium
RNGVGTALTTE

SEQ ID NO: 564955 - protein, 8 aa, Mycobacterium
RNGVSDHS

SEQ ID NO: 564956 - protein, 5 aa, Mycobacterium
RNGVT

SEQ ID NO: 564957 - protein, 10 aa, Mycobacterium
RNGYSATLQK

SEQ ID NO: 564958 - protein, 6 aa, Mycobacterium
RNGYVT

SEQ ID NO: 564959 - protein, 41 aa, Mycobacterium
RNHAEQTVGEAREEAARTIANAKREQESTIARAKAEADRLV

SEQ ID NO: 564960 - protein, 10 aa, Mycobacterium
RNHAGGDARQ

SEQ ID NO: 564961 - protein, 9 aa, Mycobacterium
RNHAGPNEH

SEQ ID NO: 564962 - protein, 10 aa, Mycobacterium
RNHKAAGASV

SEQ ID NO: 564963 - protein, 12 aa, Mycobacterium
RNHPHHSGKPVT

SEQ ID NO: 564964 - protein, 12 aa, Mycobacterium
RNHQTARAAAAT

SEQ ID NO: 564965 - protein, 7 aa, Mycobacterium
RNHTQAP

SEQ ID NO: 564966 - protein, 4 aa, Mycobacterium
RNHY

SEQ ID NO: 564967 - protein, 7 aa, Mycobacterium
RNIGAHP

SEQ ID NO: 564968 - protein, 4 aa, Mycobacterium
RNIH

SEQ ID NO: 564969 - protein, 7 aa, Mycobacterium
RNIRGSG

SEQ ID NO: 564970 - protein, 5 aa, Mycobacterium
RNITA

SEQ ID NO: 564971 - protein, 6 aa, Mycobacterium
RNITAG

SEQ ID NO: 564972 - protein, 16 aa, Mycobacterium
RNITTTGQIGDGREAA

SEQ ID NO: 564973 - protein, 5 aa, Mycobacterium
RNKAR

SEQ ID NO: 564974 - protein, 8 aa, Mycobacterium
RNKDFSQK

SEQ ID NO: 564975 - protein, 8 aa, Mycobacterium
RNKDFSQR

SEQ ID NO: 564976 - protein, 8 aa, Mycobacterium
RNKEGEWE

SEQ ID NO: 564977 - protein, 8 aa, Mycobacterium
RNKGLGEM

SEQ ID NO: 564978 - protein, 8 aa, Mycobacterium
RNKHADRL

SEQ ID NO: 564979 - protein, 6 aa, Mycobacterium
RNKKTL

SEQ ID NO: 564980 - protein, 9 aa, Mycobacterium
RNKKTLDEV

SEQ ID NO: 564981 - protein, 9 aa, Mycobacterium
RNKPHRPLE

SEQ ID NO: 564982 - protein, 6 aa, Mycobacterium
RNKPND

SEQ ID NO: 564983 - protein, 4 aa, Mycobacterium
RNKQ

SEQ ID NO: 564984 - protein, 7 aa, Mycobacterium
RNKRAVR

SEQ ID NO: 564985 - protein, 8 aa, Mycobacterium
RNKSEPVE

SEQ ID NO: 564986 - protein, 5 aa, Mycobacterium
RNKTR

SEQ ID NO: 564987 - protein, 4 aa, Mycobacterium
RNLA

SEQ ID NO: 564988 - protein, 10 aa, Mycobacterium
RNLAPTADGA

SEQ ID NO: 564989 - protein, 6 aa, Mycobacterium
RNLATT

SEQ ID NO: 564990 - protein, 4 aa, Mycobacterium
RNLG

SEQ ID NO: 564991 - protein, 18 aa, Mycobacterium
RNLGGGRGARQISADDSP

SEQ ID NO: 564992 - protein, 18 aa, Mycobacterium
RNLGGGRGARQISAEDSP

SEQ ID NO: 564993 - protein, 5 aa, Mycobacterium
RNLGP

SEQ ID NO: 564994 - protein, 4 aa, Mycobacterium
RNLP

SEQ ID NO: 564995 - protein, 5 aa, Mycobacterium
RNLRP

SEQ ID NO: 564996 - protein, 9 aa, Mycobacterium
RNLSAGRVQ

SEQ ID NO: 564997 - protein, 17 aa, Mycobacterium
RNLSSAKEAKVSRTTGA

SEQ ID NO: 564998 - protein, 13 aa, Mycobacterium
RNLTTEAAESVAQ

SEQ ID NO: 564999 - protein, 5 aa, Mycobacterium
RNNAG

SEQ ID NO: 565000 - protein, 7 aa, Mycobacterium
RNNDEAQ

SEQ ID NO: 565001 - protein, 10 aa, Mycobacterium
RNNEQPVGEP

SEQ ID NO: 565002 - protein, 9 aa, Mycobacterium
RNNGLTEQE

SEQ ID NO: 565003 - protein, 7 aa, Mycobacterium
RNNGRPG

SEQ ID NO: 565004 - protein, 12 aa, Mycobacterium
RNNGRPITETRA

SEQ ID NO: 565005 - protein, 7 aa, Mycobacterium
RNNHNPM

SEQ ID NO: 565006 - protein, 6 aa, Mycobacterium
RNNKAR

SEQ ID NO: 565007 - protein, 7 aa, Mycobacterium
RNNKQAA

SEQ ID NO: 565008 - protein, 14 aa, Mycobacterium
RNNPHDAKILLDPT

SEQ ID NO: 565009 - protein, 10 aa, Mycobacterium
RNNPSQLQST

SEQ ID NO: 565010 - protein, 9 aa, Mycobacterium
RNNRETGEA

SEQ ID NO: 565011 - protein, 6 aa, Mycobacterium
RNPAAS

SEQ ID NO: 565012 - protein, 7 aa, Mycobacterium
RNPADAE

SEQ ID NO: 565013 - protein, 9 aa, Mycobacterium
RNPAEAYGE

SEQ ID NO: 565014 - protein, 7 aa, Mycobacterium
RNPAEDA

SEQ ID NO: 565015 - protein, 5 aa, Mycobacterium
RNPAF

SEQ ID NO: 565016 - protein, 6 aa, Mycobacterium
RNPAGD

SEQ ID NO: 565017 - protein, 7 aa, Mycobacterium
RNPAGDR

SEQ ID NO: 565018 - protein, 6 aa, Mycobacterium
RNPAKL

SEQ ID NO: 565019 - protein, 10 aa, Mycobacterium
RNPANADRPY

SEQ ID NO: 565020 - protein, 8 aa, Mycobacterium
RNPANPDD

SEQ ID NO: 565021 - protein, 11 aa, Mycobacterium
RNPAPAATREG

SEQ ID NO: 565022 - protein, 8 aa, Mycobacterium
RNPAQAAR

SEQ ID NO: 565023 - protein, 12 aa, Mycobacterium
RNPATNHHTTED

SEQ ID NO: 565024 - protein, 7 aa, Mycobacterium
RNPATQL

SEQ ID NO: 565025 - protein, 4 aa, Mycobacterium
RNPD

SEQ ID NO: 565026 - protein, 10 aa, Mycobacterium
RNPDAAEQAQ

SEQ ID NO: 565027 - protein, 12 aa, Mycobacterium
RNPDAPPARARV

SEQ ID NO: 565028 - protein, 9 aa, Mycobacterium
RNPDDDLTA

SEQ ID NO: 565029 - protein, 8 aa, Mycobacterium
RNPDDQKA

SEQ ID NO: 565030 - protein, 8 aa, Mycobacterium
RNPDGQTI

SEQ ID NO: 565031 - protein, 7 aa, Mycobacterium
RNPDGSD

SEQ ID NO: 565032 - protein, 7 aa, Mycobacterium
RNPDKAA

SEQ ID NO: 565033 - protein, 6 aa, Mycobacterium
RNPDKL

SEQ ID NO: 565034 - protein, 17 aa, Mycobacterium
RNPDLQPSSRAELGPEQ

SEQ ID NO: 565035 - protein, 10 aa, Mycobacterium
RNPDPDEETI

SEQ ID NO: 565036 - protein, 9 aa, Mycobacterium
RNPDPQQWQ

SEQ ID NO: 565037 - protein, 6 aa, Mycobacterium
RNPDQL

SEQ ID NO: 565038 - protein, 7 aa, Mycobacterium
RNPDRLA

SEQ ID NO: 565039 - protein, 16 aa, Mycobacterium
RNPDRQLPSEGATRGA

SEQ ID NO: 565040 - protein, 14 aa, Mycobacterium
RNPDRRAGVTRDSS

SEQ ID NO: 565041 - protein, 10 aa, Mycobacterium
RNPDRRTGPE

SEQ ID NO: 565042 - protein, 6 aa, Mycobacterium
RNPEHE

SEQ ID NO: 565043 - protein, 6 aa, Mycobacterium
RNPENI

SEQ ID NO: 565044 - protein, 5 aa, Mycobacterium
RNPER

SEQ ID NO: 565045 - protein, 21 aa, Mycobacterium
RNPETKAPEMPRAALSETVTF

SEQ ID NO: 565046 - protein, 8 aa, Mycobacterium
RNPETRSV

SEQ ID NO: 565047 - protein, 4 aa, Mycobacterium
RNPF

SEQ ID NO: 565048 - protein, 6 aa, Mycobacterium
RNPFPA

SEQ ID NO: 565049 - protein, 4 aa, Mycobacterium
RNPG

SEQ ID NO: 565050 - protein, 6 aa, Mycobacterium
RNPGAL

SEQ ID NO: 565051 - protein, 12 aa, Mycobacterium
RNPGAQAAVGAE

SEQ ID NO: 565052 - protein, 7 aa, Mycobacterium
RNPGEAE

SEQ ID NO: 565053 - protein, 6 aa, Mycobacterium
RNPGGH

SEQ ID NO: 565054 - protein, 7 aa, Mycobacterium
RNPGKIS

SEQ ID NO: 565055 - protein, 7 aa, Mycobacterium
RNPGQRL

SEQ ID NO: 565056 - protein, 6 aa, Mycobacterium
RNPGRI

SEQ ID NO: 565057 - protein, 5 aa, Mycobacterium
RNPGV

SEQ ID NO: 565058 - protein, 6 aa, Mycobacterium
RNPGVT

SEQ ID NO: 565059 - protein, 15 aa, Mycobacterium
RNPHAPKRARSTEHP

SEQ ID NO: 565060 - protein, 13 aa, Mycobacterium
RNPKGGMGIPSPS

SEQ ID NO: 565061 - protein, 9 aa, Mycobacterium
RNPKHSDRM

SEQ ID NO: 565062 - protein, 9 aa, Mycobacterium
RNPKPGRPR

SEQ ID NO: 565063 - protein, 9 aa, Mycobacterium
RNPKPSDRM

SEQ ID NO: 565064 - protein, 9 aa, Mycobacterium
RNPKPSNRL

SEQ ID NO: 565065 - protein, 9 aa, Mycobacterium
RNPKQYLPP

SEQ ID NO: 565066 - protein, 6 aa, Mycobacterium
RNPKSH

SEQ ID NO: 565067 - protein, 22 aa, Mycobacterium
RNPLDGNPPAARDERAEHYAGD

SEQ ID NO: 565068 - protein, 9 aa, Mycobacterium
RNPLHSDPA

SEQ ID NO: 565069 - protein, 10 aa, Mycobacterium
RNPLHSDPTF

SEQ ID NO: 565070 - protein, 5 aa, Mycobacterium
RNPLP

SEQ ID NO: 565071 - protein, 31 aa, Mycobacterium
RNPLSPSPLDPPSVPPAPTADEDLSTKPAAQ

SEQ ID NO: 565072 - protein, 6 aa, Mycobacterium
RNPNPH

SEQ ID NO: 565073 - protein, 7 aa, Mycobacterium
RNPNPHV

SEQ ID NO: 565074 - protein, 12 aa, Mycobacterium
RNPNPQVGFGGG

SEQ ID NO: 565075 - protein, 4 aa, Mycobacterium
RNPP

SEQ ID NO: 565076 - protein, 9 aa, Mycobacterium
RNPPEFDPA

SEQ ID NO: 565077 - protein, 13 aa, Mycobacterium
RNPPPKPTPPLPI

SEQ ID NO: 565078 - protein, 16 aa, Mycobacterium
RNPQGTGVGKDAITSG

SEQ ID NO: 565079 - protein, 5 aa, Mycobacterium
RNPQR

SEQ ID NO: 565080 - protein, 13 aa, Mycobacterium
RNPQTQEQSTSNA

SEQ ID NO: 565081 - protein, 4 aa, Mycobacterium
RNPR

SEQ ID NO: 565082 - protein, 5 aa, Mycobacterium
RNPRD

SEQ ID NO: 565083 - protein, 13 aa, Mycobacterium
RNPRDGYQQPGHP

SEQ ID NO: 565084 - protein, 9 aa, Mycobacterium
RNPRPDVLP

SEQ ID NO: 565085 - protein, 9 aa, Mycobacterium
RNPRPGIRA

SEQ ID NO: 565086 - protein, 16 aa, Mycobacterium
RNPSGKILKRELRELE

SEQ ID NO: 565087 - protein, 22 aa, Mycobacterium
RNPSPESLDEAQSKIKEALAQL

SEQ ID NO: 565088 - protein, 6 aa, Mycobacterium
RNPSQF

SEQ ID NO: 565089 - protein, 7 aa, Mycobacterium
RNPSTQL

SEQ ID NO: 565090 - protein, 8 aa, Mycobacterium
RNPSTTNA

SEQ ID NO: 565091 - protein, 6 aa, Mycobacterium
RNPSVG

SEQ ID NO: 565092 - protein, 7 aa, Mycobacterium
RNPTAPP

SEQ ID NO: 565093 - protein, 12 aa, Mycobacterium
RNPTPVHTRVEI

SEQ ID NO: 565094 - protein, 11 aa, Mycobacterium
RNPVPRSVREG

SEQ ID NO: 565095 - protein, 14 aa, Mycobacterium
RNPYKHGRYTPGTR

SEQ ID NO: 565096 - protein, 5 aa, Mycobacterium
RNQAA

SEQ ID NO: 565097 - protein, 6 aa, Mycobacterium
RNQAEH

SEQ ID NO: 565098 - protein, 10 aa, Mycobacterium
RNQAKPGDFD

SEQ ID NO: 565099 - protein, 7 aa, Mycobacterium
RNQDTID

SEQ ID NO: 565100 - protein, 6 aa, Mycobacterium
RNQFGR

SEQ ID NO: 565101 - protein, 5 aa, Mycobacterium
RNQHG

SEQ ID NO: 565102 - protein, 4 aa, Mycobacterium
RNQL

SEQ ID NO: 565103 - protein, 13 aa, Mycobacterium
RNQNVEADGCGGQ

SEQ ID NO: 565104 - protein, 10 aa, Mycobacterium
RNQPDLDDVP

SEQ ID NO: 565105 - protein, 7 aa, Mycobacterium
RNQQAHV

SEQ ID NO: 565106 - protein, 7 aa, Mycobacterium
RNQRPAD

SEQ ID NO: 565107 - protein, 18 aa, Mycobacterium
RNQVRSGEARRISTDSSR

SEQ ID NO: 565108 - protein, 4 aa, Mycobacterium
RNRA

SEQ ID NO: 565109 - protein, 6 aa, Mycobacterium
RNRADE

SEQ ID NO: 565110 - protein, 6 aa, Mycobacterium
RNRAPI

SEQ ID NO: 565111 - protein, 13 aa, Mycobacterium
RNRARDAATDEAL

SEQ ID NO: 565112 - protein, 10 aa, Mycobacterium
RNRARELAQE

SEQ ID NO: 565113 - protein, 6 aa, Mycobacterium
RNRDAP

SEQ ID NO: 565114 - protein, 5 aa, Mycobacterium
RNRDG

SEQ ID NO: 565115 - protein, 11 aa, Mycobacterium
RNRDQASELRS

SEQ ID NO: 565116 - protein, 11 aa, Mycobacterium
RNRDQATELRS

SEQ ID NO: 565117 - protein, 10 aa, Mycobacterium
RNRDRATELR

SEQ ID NO: 565118 - protein, 11 aa, Mycobacterium
RNRDRATELRS

SEQ ID NO: 565119 - protein, 9 aa, Mycobacterium
RNRDTGAAL

SEQ ID NO: 565120 - protein, 15 aa, Mycobacterium
RNREASTDAEYAQKA

SEQ ID NO: 565121 - protein, 8 aa, Mycobacterium
RNREDGVT

SEQ ID NO: 565122 - protein, 7 aa, Mycobacterium
RNRELSR

SEQ ID NO: 565123 - protein, 11 aa, Mycobacterium
RNRELSSAEPS

SEQ ID NO: 565124 - protein, 7 aa, Mycobacterium
RNRENGV

SEQ ID NO: 565125 - protein, 5 aa, Mycobacterium
RNRET

SEQ ID NO: 565126 - protein, 4 aa, Mycobacterium
RNRF

SEQ ID NO: 565127 - protein, 12 aa, Mycobacterium
RNRGLDPRHTDT

SEQ ID NO: 565128 - protein, 20 aa, Mycobacterium
RNRGQIPQPNEYPPGSTGSP

SEQ ID NO: 565129 - protein, 5 aa, Mycobacterium
RNRHS

SEQ ID NO: 565130 - protein, 6 aa, Mycobacterium
RNRITG

SEQ ID NO: 565131 - protein, 6 aa, Mycobacterium
RNRITK

SEQ ID NO: 565132 - protein, 6 aa, Mycobacterium
RNRNPH

SEQ ID NO: 565133 - protein, 7 aa, Mycobacterium
RNRPGGV

SEQ ID NO: 565134 - protein, 6 aa, Mycobacterium
RNRPND

SEQ ID NO: 565135 - protein, 7 aa, Mycobacterium
RNRPNDT

SEQ ID NO: 565136 - protein, 12 aa, Mycobacterium
RNRPSRPGTIDR

SEQ ID NO: 565137 - protein, 18 aa, Mycobacterium
RNRPTTRPVPTQRIIESE

SEQ ID NO: 565138 - protein, 5 aa, Mycobacterium
RNRQQ

SEQ ID NO: 565139 - protein, 6 aa, Mycobacterium
RNRQQR

SEQ ID NO: 565140 - protein, 9 aa, Mycobacterium
RNRQTQAIS

SEQ ID NO: 565141 - protein, 8 aa, Mycobacterium
RNRQTQPF

SEQ ID NO: 565142 - protein, 4 aa, Mycobacterium
RNRR

SEQ ID NO: 565143 - protein, 11 aa, Mycobacterium
RNRRPYQTSDG

SEQ ID NO: 565144 - protein, 8 aa, Mycobacterium
RNRRSATD

SEQ ID NO: 565145 - protein, 7 aa, Mycobacterium
RNRSGKF

SEQ ID NO: 565146 - protein, 7 aa, Mycobacterium
RNRSGPT

SEQ ID NO: 565147 - protein, 12 aa, Mycobacterium
RNRSTRQQAAET

SEQ ID NO: 565148 - protein, 7 aa, Mycobacterium
RNRTARQ

SEQ ID NO: 565149 - protein, 20 aa, Mycobacterium
RNRTDLPYRAPDDEPAGADE

SEQ ID NO: 565150 - protein, 12 aa, Mycobacterium
RNRTGERGPAHF

SEQ ID NO: 565151 - protein, 6 aa, Mycobacterium
RNRTIA

SEQ ID NO: 565152 - protein, 5 aa, Mycobacterium
RNRTR

SEQ ID NO: 565153 - protein, 5 aa, Mycobacterium
RNRTS

SEQ ID NO: 565154 - protein, 6 aa, Mycobacterium
RNRTTG

SEQ ID NO: 565155 - protein, 6 aa, Mycobacterium
RNRVQT

SEQ ID NO: 565156 - protein, 5 aa, Mycobacterium
RNRWG

SEQ ID NO: 565157 - protein, 5 aa, Mycobacterium
RNRYP

SEQ ID NO: 565158 - protein, 7 aa, Mycobacterium
RNRYPRL

SEQ ID NO: 565159 - protein, 8 aa, Mycobacterium
RNSADYGR

SEQ ID NO: 565160 - protein, 5 aa, Mycobacterium
RNSAT

SEQ ID NO: 565161 - protein, 12 aa, Mycobacterium
RNSDDDPRFDND

SEQ ID NO: 565162 - protein, 10 aa, Mycobacterium
RNSDEKLAPI

SEQ ID NO: 565163 - protein, 7 aa, Mycobacterium
RNSDLAA

SEQ ID NO: 565164 - protein, 5 aa, Mycobacterium
RNSDQ

SEQ ID NO: 565165 - protein, 7 aa, Mycobacterium
RNSEQAR

SEQ ID NO: 565166 - protein, 6 aa, Mycobacterium
RNSGEV

SEQ ID NO: 565167 - protein, 10 aa, Mycobacterium
RNSGGDTARI

SEQ ID NO: 565168 - protein, 9 aa, Mycobacterium
RNSGGPPLA

SEQ ID NO: 565169 - protein, 15 aa, Mycobacterium
RNSGGPPLQLSQNGD

SEQ ID NO: 565170 - protein, 10 aa, Mycobacterium
RNSGNRPSIS

SEQ ID NO: 565171 - protein, 8 aa, Mycobacterium
RNSGTAQV

SEQ ID NO: 565172 - protein, 9 aa, Mycobacterium
RNSHPTEGD

SEQ ID NO: 565173 - protein, 7 aa, Mycobacterium
RNSIDEA

SEQ ID NO: 565174 - protein, 7 aa, Mycobacterium
RNSIDTA

SEQ ID NO: 565175 - protein, 12 aa, Mycobacterium
RNSIPADPNGAW

SEQ ID NO: 565176 - protein, 5 aa, Mycobacterium
RNSIR

SEQ ID NO: 565177 - protein, 4 aa, Mycobacterium
RNSL

SEQ ID NO: 565178 - protein, 14 aa, Mycobacterium
RNSLHRSKADESYQ

SEQ ID NO: 565179 - protein, 11 aa, Mycobacterium
RNSLRNNGNLS

SEQ ID NO: 565180 - protein, 6 aa, Mycobacterium
RNSPKQ

SEQ ID NO: 565181 - protein, 14 aa, Mycobacterium
RNSPLRLPEQEADF

SEQ ID NO: 565182 - protein, 6 aa, Mycobacterium
RNSPQQ

SEQ ID NO: 565183 - protein, 7 aa, Mycobacterium
RNSPRSV

SEQ ID NO: 565184 - protein, 10 aa, Mycobacterium
RNSQGDSTYL

SEQ ID NO: 565185 - protein, 6 aa, Mycobacterium
RNSRAI

SEQ ID NO: 565186 - protein, 7 aa, Mycobacterium
RNSRDQA

SEQ ID NO: 565187 - protein, 9 aa, Mycobacterium
RNSRGAKEM

SEQ ID NO: 565188 - protein, 11 aa, Mycobacterium
RNSTALSNKHG

SEQ ID NO: 565189 - protein, 13 aa, Mycobacterium
RNSTSPAPRPSKY

SEQ ID NO: 565190 - protein, 7 aa, Mycobacterium
RNSTTLS

SEQ ID NO: 565191 - protein, 13 aa, Mycobacterium
RNSTTLSNRDGVS

SEQ ID NO: 565192 - protein, 4 aa, Mycobacterium
RNSV

SEQ ID NO: 565193 - protein, 6 aa, Mycobacterium
RNSVGT

SEQ ID NO: 565194 - protein, 12 aa, Mycobacterium
RNSVTNARLQDS

SEQ ID NO: 565195 - protein, 6 aa, Mycobacterium
RNSYGN

SEQ ID NO: 565196 - protein, 5 aa, Mycobacterium
RNTAA

SEQ ID NO: 565197 - protein, 9 aa, Mycobacterium
RNTADHRQI

SEQ ID NO: 565198 - protein, 7 aa, Mycobacterium
RNTADRI

SEQ ID NO: 565199 - protein, 6 aa, Mycobacterium
RNTAGT

SEQ ID NO: 565200 - protein, 11 aa, Mycobacterium
RNTAGVEPGST

SEQ ID NO: 565201 - protein, 7 aa, Mycobacterium
RNTDHRP

SEQ ID NO: 565202 - protein, 7 aa, Mycobacterium
RNTELDR

SEQ ID NO: 565203 - protein, 12 aa, Mycobacterium
RNTETNARLADS

SEQ ID NO: 565204 - protein, 4 aa, Mycobacterium
RNTG

SEQ ID NO: 565205 - protein, 6 aa, Mycobacterium
RNTGGI

SEQ ID NO: 565206 - protein, 10 aa, Mycobacterium
RNTGNSNGGL

SEQ ID NO: 565207 - protein, 10 aa, Mycobacterium
RNTGPRDGDE

SEQ ID NO: 565208 - protein, 5 aa, Mycobacterium
RNTGR

SEQ ID NO: 565209 - protein, 8 aa, Mycobacterium
RNTGRREK

SEQ ID NO: 565210 - protein, 8 aa, Mycobacterium
RNTGTNLP

SEQ ID NO: 565211 - protein, 15 aa, Mycobacterium
RNTGVGDAQATGHDR

SEQ ID NO: 565212 - protein, 8 aa, Mycobacterium
RNTHDDDV

SEQ ID NO: 565213 - protein, 7 aa, Mycobacterium
RNTHTNS

SEQ ID NO: 565214 - protein, 4 aa, Mycobacterium
RNTK

SEQ ID NO: 565215 - protein, 10 aa, Mycobacterium
RNTKPPQRYA

SEQ ID NO: 565216 - protein, 7 aa, Mycobacterium
RNTLESA

SEQ ID NO: 565217 - protein, 17 aa, Mycobacterium
RNTLRRRRTELTDQPEK

SEQ ID NO: 565218 - protein, 6 aa, Mycobacterium
RNTNAL

SEQ ID NO: 565219 - protein, 4 aa, Mycobacterium
RNTP

SEQ ID NO: 565220 - protein, 6 aa, Mycobacterium
RNTPGV

SEQ ID NO: 565221 - protein, 8 aa, Mycobacterium
RNTPHPRP

SEQ ID NO: 565222 - protein, 13 aa, Mycobacterium
RNTPLRTESEGKQ

SEQ ID NO: 565223 - protein, 11 aa, Mycobacterium
RNTQDATQSDH

SEQ ID NO: 565224 - protein, 6 aa, Mycobacterium
RNTQDR

SEQ ID NO: 565225 - protein, 6 aa, Mycobacterium
RNTQDS

SEQ ID NO: 565226 - protein, 10 aa, Mycobacterium
RNTRDARAAG

SEQ ID NO: 565227 - protein, 9 aa, Mycobacterium
RNTRPPAAY

SEQ ID NO: 565228 - protein, 10 aa, Mycobacterium
RNTRPPAQYA

SEQ ID NO: 565229 - protein, 5 aa, Mycobacterium
RNTRQ

SEQ ID NO: 565230 - protein, 10 aa, Mycobacterium
RNTTDHRRDP

SEQ ID NO: 565231 - protein, 6 aa, Mycobacterium
RNTTLA

SEQ ID NO: 565232 - protein, 6 aa, Mycobacterium
RNTTPA

SEQ ID NO: 565233 - protein, 10 aa, Mycobacterium
RNTTRDEQGC

SEQ ID NO: 565234 - protein, 14 aa, Mycobacterium
RNTVGSGMTGKSSG

SEQ ID NO: 565235 - protein, 6 aa, Mycobacterium
RNTVQS

SEQ ID NO: 565236 - protein, 10 aa, Mycobacterium
RNTVQTARTD

SEQ ID NO: 565237 - protein, 7 aa, Mycobacterium
RNTYPGA

SEQ ID NO: 565238 - protein, 14 aa, Mycobacterium
RNVEDKATAANGIA

SEQ ID NO: 565239 - protein, 8 aa, Mycobacterium
RNVENDPR

SEQ ID NO: 565240 - protein, 4 aa, Mycobacterium
RNVG

SEQ ID NO: 565241 - protein, 5 aa, Mycobacterium
RNVGR

SEQ ID NO: 565242 - protein, 9 aa, Mycobacterium
RNVGTDGGL

SEQ ID NO: 565243 - protein, 8 aa, Mycobacterium
RNVKGPGV

SEQ ID NO: 565244 - protein, 9 aa, Mycobacterium
RNVKGRRVG

SEQ ID NO: 565245 - protein, 6 aa, Mycobacterium
RNVKSG

SEQ ID NO: 565246 - protein, 7 aa, Mycobacterium
RNVPAAA

SEQ ID NO: 565247 - protein, 12 aa, Mycobacterium
RNVPGRKTDVSD

SEQ ID NO: 565248 - protein, 6 aa, Mycobacterium
RNVPHT

SEQ ID NO: 565249 - protein, 7 aa, Mycobacterium
RNVRRDP

SEQ ID NO: 565250 - protein, 8 aa, Mycobacterium
RNVSRGAA

SEQ ID NO: 565251 - protein, 18 aa, Mycobacterium
RNVTPEAGPGFRDRLSAS

SEQ ID NO: 565252 - protein, 6 aa, Mycobacterium
RNWEPE

SEQ ID NO: 565253 - protein, 6 aa, Mycobacterium
RNYDGS

SEQ ID NO: 565254 - protein, 4 aa, Mycobacterium
RNYE

SEQ ID NO: 565255 - protein, 22 aa, Mycobacterium
RNYPEDTGPGAGCPPQHGITTA

SEQ ID NO: 565256 - protein, 9 aa, Mycobacterium
RNYPNPLPE

SEQ ID NO: 565257 - protein, 10 aa, Mycobacterium
RNYPVDERTR

SEQ ID NO: 565258 - protein, 11 aa, Mycobacterium
RNYQASGGERP

SEQ ID NO: 565259 - protein, 9 aa, Mycobacterium
RNYRAHQGK

SEQ ID NO: 565260 - protein, 10 aa, Mycobacterium
RNYRDTSHKP

SEQ ID NO: 565261 - protein, 5 aa, Mycobacterium
RNYSD

SEQ ID NO: 565262 - protein, 10 aa, Mycobacterium
RPAAARRPEH

SEQ ID NO: 565263 - protein, 14 aa, Mycobacterium
RPAADDDSRRARTY

SEQ ID NO: 565264 - protein, 8 aa, Mycobacterium
RPAADKRE

SEQ ID NO: 565265 - protein, 11 aa, Mycobacterium
RPAADPLPEPV

SEQ ID NO: 565266 - protein, 10 aa, Mycobacterium
RPAAEDLSTD

SEQ ID NO: 565267 - protein, 7 aa, Mycobacterium
RPAAEPI

SEQ ID NO: 565268 - protein, 8 aa, Mycobacterium
RPAAEPPD

SEQ ID NO: 565269 - protein, 7 aa, Mycobacterium
RPAAERR

SEQ ID NO: 565270 - protein, 9 aa, Mycobacterium
RPAAGAPLT

SEQ ID NO: 565271 - protein, 6 aa, Mycobacterium
RPAAGI

SEQ ID NO: 565272 - protein, 9 aa, Mycobacterium
RPAAGSATA

SEQ ID NO: 565273 - protein, 29 aa, Mycobacterium
RPAAKASQEPAAPAQAMSGAQRRAAEKEL

SEQ ID NO: 565274 - protein, 5 aa, Mycobacterium
RPAAL

SEQ ID NO: 565275 - protein, 8 aa, Mycobacterium
RPAAPDHV

SEQ ID NO: 565276 - protein, 7 aa, Mycobacterium
RPAAPEV

SEQ ID NO: 565277 - protein, 20 aa, Mycobacterium
RPAAPLKAPAGPKAARRRAT

SEQ ID NO: 565278 - protein, 14 aa, Mycobacterium
RPAAPRGANASVVT

SEQ ID NO: 565279 - protein, 19 aa, Mycobacterium
RPAARPPAATITFWDGWGE

SEQ ID NO: 565280 - protein, 19 aa, Mycobacterium
RPAARPPAETVTFWDGWGG

SEQ ID NO: 565281 - protein, 19 aa, Mycobacterium
RPAASASHPGQPDGRVIPS

SEQ ID NO: 565282 - protein, 15 aa, Mycobacterium
RPAASPDAVGEIRQR

SEQ ID NO: 565283 - protein, 18 aa, Mycobacterium
RPAATSYPAAPNASAPGV

SEQ ID NO: 565284 - protein, 11 aa, Mycobacterium
RPAATTNREPH

SEQ ID NO: 565285 - protein, 11 aa, Mycobacterium
RPAAVAPQERG

SEQ ID NO: 565286 - protein, 5 aa, Mycobacterium
RPAAY

SEQ ID NO: 565287 - protein, 4 aa, Mycobacterium
RPAD

SEQ ID NO: 565288 - protein, 8 aa, Mycobacterium
RPADAGPR

SEQ ID NO: 565289 - protein, 11 aa, Mycobacterium
RPADATGGVSA

SEQ ID NO: 565290 - protein, 20 aa, Mycobacterium
RPADDDQSSPEGSGPFTAAQ

SEQ ID NO: 565291 - protein, 7 aa, Mycobacterium
RPADELN

SEQ ID NO: 565292 - protein, 9 aa, Mycobacterium
RPADEPGSG

SEQ ID NO: 565293 - protein, 5 aa, Mycobacterium
RPADF

SEQ ID NO: 565294 - protein, 26 aa, Mycobacterium
RPADGTSGKDHYSPSASVQLDPSVTT

SEQ ID NO: 565295 - protein, 11 aa, Mycobacterium
RPADIGQTGQE

SEQ ID NO: 565296 - protein, 5 aa, Mycobacterium
RPADP

SEQ ID NO: 565297 - protein, 8 aa, Mycobacterium
RPADPRRQ

SEQ ID NO: 565298 - protein, 9 aa, Mycobacterium
RPADPSRIR

SEQ ID NO: 565299 - protein, 6 aa, Mycobacterium
RPADQR

SEQ ID NO: 565300 - protein, 12 aa, Mycobacterium
RPADRDWVELID

SEQ ID NO: 565301 - protein, 10 aa, Mycobacterium
RPADTTFSGE

SEQ ID NO: 565302 - protein, 7 aa, Mycobacterium
RPADTVR

SEQ ID NO: 565303 - protein, 6 aa, Mycobacterium
RPADYK

SEQ ID NO: 565304 - protein, 4 aa, Mycobacterium
RPAE

SEQ ID NO: 565305 - protein, 12 aa, Mycobacterium
RPAEDELASNRA

SEQ ID NO: 565306 - protein, 24 aa, Mycobacterium
RPAEELAEETSATAVRTYGLAEAW

SEQ ID NO: 565307 - protein, 6 aa, Mycobacterium
RPAEET

SEQ ID NO: 565308 - protein, 7 aa, Mycobacterium
RPAEGAP

SEQ ID NO: 565309 - protein, 13 aa, Mycobacterium
RPAEHGPNDPGGV

SEQ ID NO: 565310 - protein, 5 aa, Mycobacterium
RPAEL

SEQ ID NO: 565311 - protein, 11 aa, Mycobacterium
RPAEPGKQPPG

SEQ ID NO: 565312 - protein, 7 aa, Mycobacterium
RPAEPRA

SEQ ID NO: 565313 - protein, 7 aa, Mycobacterium
RPAERSE

SEQ ID NO: 565314 - protein, 12 aa, Mycobacterium
RPAETRVASPVT

SEQ ID NO: 565315 - protein, 5 aa, Mycobacterium
RPAEV

SEQ ID NO: 565316 - protein, 6 aa, Mycobacterium
RPAEVG

SEQ ID NO: 565317 - protein, 13 aa, Mycobacterium
RPAFDGASAGRRH

SEQ ID NO: 565318 - protein, 8 aa, Mycobacterium
RPAGASTV

SEQ ID NO: 565319 - protein, 20 aa, Mycobacterium
RPAGDDDGSAAGSGPYPAAQ

SEQ ID NO: 565320 - protein, 13 aa, Mycobacterium
RPAGDPPALPSGR

SEQ ID NO: 565321 - protein, 17 aa, Mycobacterium
RPAGDRVASTGGTASGP

SEQ ID NO: 565322 - protein, 9 aa, Mycobacterium
RPAGDTVTA

SEQ ID NO: 565323 - protein, 5 aa, Mycobacterium
RPAGE

SEQ ID NO: 565324 - protein, 20 aa, Mycobacterium
RPAGEDDGANGGSGPFPAAK

SEQ ID NO: 565325 - protein, 9 aa, Mycobacterium
RPAGEVNGQ

SEQ ID NO: 565326 - protein, 6 aa, Mycobacterium
RPAGGL

SEQ ID NO: 565327 - protein, 5 aa, Mycobacterium
RPAGI

SEQ ID NO: 565328 - protein, 8 aa, Mycobacterium
RPAGKYRS

SEQ ID NO: 565329 - protein, 5 aa, Mycobacterium
RPAGM

SEQ ID NO: 565330 - protein, 13 aa, Mycobacterium
RPAGPATRPALQY

SEQ ID NO: 565331 - protein, 8 aa, Mycobacterium
RPAGPDGC

SEQ ID NO: 565332 - protein, 9 aa, Mycobacterium
RPAGPPVEK

SEQ ID NO: 565333 - protein, 7 aa, Mycobacterium
RPAGPRL

SEQ ID NO: 565334 - protein, 6 aa, Mycobacterium
RPAGRA

SEQ ID NO: 565335 - protein, 8 aa, Mycobacterium
RPAGRTRE

SEQ ID NO: 565336 - protein, 6 aa, Mycobacterium
RPAGSA

SEQ ID NO: 565337 - protein, 7 aa, Mycobacterium
RPAGSEN

SEQ ID NO: 565338 - protein, 7 aa, Mycobacterium
RPAGSGE

SEQ ID NO: 565339 - protein, 9 aa, Mycobacterium
RPAGSRADT

SEQ ID NO: 565340 - protein, 11 aa, Mycobacterium
RPAGSSDTRNR

SEQ ID NO: 565341 - protein, 11 aa, Mycobacterium
RPAGSTAPSDE

SEQ ID NO: 565342 - protein, 19 aa, Mycobacterium
RPAGSTGYDDRHDASAGVA

SEQ ID NO: 565343 - protein, 10 aa, Mycobacterium
RPAGSVPPLT

SEQ ID NO: 565344 - protein, 11 aa, Mycobacterium
RPAGSVPPLTD

SEQ ID NO: 565345 - protein, 11 aa, Mycobacterium
RPAGTDDLTDE

SEQ ID NO: 565346 - protein, 17 aa, Mycobacterium
RPAGTDPSTHPSSDVVS

SEQ ID NO: 565347 - protein, 10 aa, Mycobacterium
RPAGTEEFTD

SEQ ID NO: 565348 - protein, 13 aa, Mycobacterium
RPAGTLSGGEAQR

SEQ ID NO: 565349 - protein, 8 aa, Mycobacterium
RPAGYFPA

SEQ ID NO: 565350 - protein, 7 aa, Mycobacterium
RPAGYTR

SEQ ID NO: 565351 - protein, 8 aa, Mycobacterium
RPAHAQHA

SEQ ID NO: 565352 - protein, 5 aa, Mycobacterium
RPAHY

SEQ ID NO: 565353 - protein, 6 aa, Mycobacterium
RPAHYT

SEQ ID NO: 565354 - protein, 5 aa, Mycobacterium
RPAIA

SEQ ID NO: 565355 - protein, 5 aa, Mycobacterium
RPAIS

SEQ ID NO: 565356 - protein, 4 aa, Mycobacterium
RPAK

SEQ ID NO: 565357 - protein, 8 aa, Mycobacterium
RPAKDRPR

SEQ ID NO: 565358 - protein, 14 aa, Mycobacterium
RPAKPAGKRKTANR

SEQ ID NO: 565359 - protein, 8 aa, Mycobacterium
RPAKRNAF

SEQ ID NO: 565360 - protein, 13 aa, Mycobacterium
RPALAEPAPPPVS

SEQ ID NO: 565361 - protein, 12 aa, Mycobacterium
RPALATADSGPA

SEQ ID NO: 565362 - protein, 12 aa, Mycobacterium
RPALATAESGPA

SEQ ID NO: 565363 - protein, 15 aa, Mycobacterium
RPALGAGEVRESYRE

SEQ ID NO: 565364 - protein, 15 aa, Mycobacterium
RPALGRGALKSGKAL

SEQ ID NO: 565365 - protein, 8 aa, Mycobacterium
RPALKDPT

SEQ ID NO: 565366 - protein, 6 aa, Mycobacterium
RPALPT

SEQ ID NO: 565367 - protein, 12 aa, Mycobacterium
RPALSPSRASDF

SEQ ID NO: 565368 - protein, 9 aa, Mycobacterium
RPALTGAAR

SEQ ID NO: 565369 - protein, 13 aa, Mycobacterium
RPAMPKRPADSHD

SEQ ID NO: 565370 - protein, 8 aa, Mycobacterium
RPANESPD

SEQ ID NO: 565371 - protein, 12 aa, Mycobacterium
RPANPAAGRRCR

SEQ ID NO: 565372 - protein, 8 aa, Mycobacterium
RPANQRPR

SEQ ID NO: 565373 - protein, 19 aa, Mycobacterium
RPANRSPSDAERAATANAV

SEQ ID NO: 565374 - protein, 19 aa, Mycobacterium
RPANTSPSDAERAATANAV

SEQ ID NO: 565375 - protein, 10 aa, Mycobacterium
RPAPAGADWP

SEQ ID NO: 565376 - protein, 8 aa, Mycobacterium
RPAPALES

SEQ ID NO: 565377 - protein, 7 aa, Mycobacterium
RPAPDAM

SEQ ID NO: 565378 - protein, 28 aa, Mycobacterium
RPAPDRPSPTSPAPRPAPDRMPARPMPD

SEQ ID NO: 565379 - protein, 10 aa, Mycobacterium
RPAPDSADTP

SEQ ID NO: 565380 - protein, 5 aa, Mycobacterium
RPAPE

SEQ ID NO: 565381 - protein, 18 aa, Mycobacterium
RPAPEDDSRSARNNRATY

SEQ ID NO: 565382 - protein, 14 aa, Mycobacterium
RPAPESGGCSCGPR

SEQ ID NO: 565383 - protein, 10 aa, Mycobacterium
RPAPGKTTAD

SEQ ID NO: 565384 - protein, 9 aa, Mycobacterium
RPAPGQLGT

SEQ ID NO: 565385 - protein, 30 aa, Mycobacterium
RPAPGRQRGIGAQRGPGRDVRRRGQAFEET

SEQ ID NO: 565386 - protein, 8 aa, Mycobacterium
RPAPGYPA

SEQ ID NO: 565387 - protein, 15 aa, Mycobacterium
RPAPGYPSCPEHTEK

SEQ ID NO: 565388 - protein, 6 aa, Mycobacterium
RPAPLS

SEQ ID NO: 565389 - protein, 53 aa, Mycobacterium
RPAPPEPKSAPERPPAPEPRPAPEPRRAPEPRPAPESRPAPVPEPVSAPGELN

SEQ ID NO: 565390 - protein, 9 aa, Mycobacterium
RPAPQPRAQ

SEQ ID NO: 565391 - protein, 6 aa, Mycobacterium
RPAPQT

SEQ ID NO: 565392 - protein, 24 aa, Mycobacterium
RPAPRSSAAHSIASSSALVGQSKS

SEQ ID NO: 565393 - protein, 11 aa, Mycobacterium
RPAPSARGQHN

SEQ ID NO: 565394 - protein, 8 aa, Mycobacterium
RPAPSPPT

SEQ ID NO: 565395 - protein, 6 aa, Mycobacterium
RPAPSR

SEQ ID NO: 565396 - protein, 13 aa, Mycobacterium
RPAPTYRSQRTVQ

SEQ ID NO: 565397 - protein, 7 aa, Mycobacterium
RPAPVAG

SEQ ID NO: 565398 - protein, 8 aa, Mycobacterium
RPAPVPGT

SEQ ID NO: 565399 - protein, 7 aa, Mycobacterium
RPAPYSV

SEQ ID NO: 565400 - protein, 4 aa, Mycobacterium
RPAQ

SEQ ID NO: 565401 - protein, 11 aa, Mycobacterium
RPAQAGGPPVY

SEQ ID NO: 565402 - protein, 7 aa, Mycobacterium
RPAQING

SEQ ID NO: 565403 - protein, 8 aa, Mycobacterium
RPAQLTTP

SEQ ID NO: 565404 - protein, 10 aa, Mycobacterium
RPAQPGHRQG

SEQ ID NO: 565405 - protein, 16 aa, Mycobacterium
RPAQQYPGGQAAIEKT

SEQ ID NO: 565406 - protein, 13 aa, Mycobacterium
RPAQRLENAASQI

SEQ ID NO: 565407 - protein, 8 aa, Mycobacterium
RPAQRNAL

SEQ ID NO: 565408 - protein, 13 aa, Mycobacterium
RPAQSRTSRDGKP

SEQ ID NO: 565409 - protein, 5 aa, Mycobacterium
RPAQV

SEQ ID NO: 565410 - protein, 6 aa, Mycobacterium
RPAQVS

SEQ ID NO: 565411 - protein, 4 aa, Mycobacterium
RPAR

SEQ ID NO: 565412 - protein, 15 aa, Mycobacterium
RPARANLAGELHTLT

SEQ ID NO: 565413 - protein, 25 aa, Mycobacterium
RPARARRTRPAGRVGRPGHPDPARH

SEQ ID NO: 565414 - protein, 18 aa, Mycobacterium
RPARDDAPEMTYRRSGDD

SEQ ID NO: 565415 - protein, 9 aa, Mycobacterium
RPAREATGQ

SEQ ID NO: 565416 - protein, 43 aa, Mycobacterium
RPARGRPPAPESEADDLDDDPYADDEPLASDEVPQALGDALRS

SEQ ID NO: 565417 - protein, 8 aa, Mycobacterium
RPARGRPV

SEQ ID NO: 565418 - protein, 7 aa, Mycobacterium
RPARGRS

SEQ ID NO: 565419 - protein, 12 aa, Mycobacterium
RPARGRSRTTTA

SEQ ID NO: 565420 - protein, 7 aa, Mycobacterium
RPARPPV

SEQ ID NO: 565421 - protein, 7 aa, Mycobacterium
RPARPVG

SEQ ID NO: 565422 - protein, 6 aa, Mycobacterium
RPARSR

SEQ ID NO: 565423 - protein, 9 aa, Mycobacterium
RPARTVRTA

SEQ ID NO: 565424 - protein, 16 aa, Mycobacterium
RPASADDSPPTGDGPF

SEQ ID NO: 565425 - protein, 8 aa, Mycobacterium
RPASADQV

SEQ ID NO: 565426 - protein, 16 aa, Mycobacterium
RPASAEDATPTGSGPF

SEQ ID NO: 565427 - protein, 14 aa, Mycobacterium
RPASAEEITAEMQL

SEQ ID NO: 565428 - protein, 8 aa, Mycobacterium
RPASASEI

SEQ ID NO: 565429 - protein, 7 aa, Mycobacterium
RPASEAE

SEQ ID NO: 565430 - protein, 9 aa, Mycobacterium
RPASEPDAG

SEQ ID NO: 565431 - protein, 9 aa, Mycobacterium
RPASPAAGD

SEQ ID NO: 565432 - protein, 6 aa, Mycobacterium
RPASPG

SEQ ID NO: 565433 - protein, 5 aa, Mycobacterium
RPASS

SEQ ID NO: 565434 - protein, 9 aa, Mycobacterium
RPASSGDTL

SEQ ID NO: 565435 - protein, 8 aa, Mycobacterium
RPASSKDT

SEQ ID NO: 565436 - protein, 8 aa, Mycobacterium
RPASSRDT

SEQ ID NO: 565437 - protein, 14 aa, Mycobacterium
RPATAGPPAHARSR

SEQ ID NO: 565438 - protein, 25 aa, Mycobacterium
RPATAGRRSPQSAGSRTRADSFAHN

SEQ ID NO: 565439 - protein, 7 aa, Mycobacterium
RPATARL

SEQ ID NO: 565440 - protein, 6 aa, Mycobacterium
RPATGA

SEQ ID NO: 565441 - protein, 7 aa, Mycobacterium
RPATIAS

SEQ ID NO: 565442 - protein, 5 aa, Mycobacterium
RPATL

SEQ ID NO: 565443 - protein, 6 aa, Mycobacterium
RPATLN

SEQ ID NO: 565444 - protein, 5 aa, Mycobacterium
RPATQ

SEQ ID NO: 565445 - protein, 35 aa, Mycobacterium
RPATSTDQTPVTGGLTDQPAQADPSQSGEQSGVGV

SEQ ID NO: 565446 - protein, 5 aa, Mycobacterium
RPATT

SEQ ID NO: 565447 - protein, 9 aa, Mycobacterium
RPATTPDGA

SEQ ID NO: 565448 - protein, 8 aa, Mycobacterium
RPATVPDA

SEQ ID NO: 565449 - protein, 15 aa, Mycobacterium
RPAVADPAEALQPRS

SEQ ID NO: 565450 - protein, 15 aa, Mycobacterium
RPAVAGTAVSARARA

SEQ ID NO: 565451 - protein, 11 aa, Mycobacterium
RPAVGDPDLGK

SEQ ID NO: 565452 - protein, 15 aa, Mycobacterium
RPAVRATDRDERDED

SEQ ID NO: 565453 - protein, 8 aa, Mycobacterium
RPAVSEQA

SEQ ID NO: 565454 - protein, 6 aa, Mycobacterium
RPAVSS

SEQ ID NO: 565455 - protein, 4 aa, Mycobacterium
RPAY

SEQ ID NO: 565456 - protein, 25 aa, Mycobacterium
RPAYDDAARSQISAARESTPSDSAA

SEQ ID NO: 565457 - protein, 6 aa, Mycobacterium
RPAYED

SEQ ID NO: 565458 - protein, 12 aa, Mycobacterium
RPAYRPRPRQPV

SEQ ID NO: 565459 - protein, 26 aa, Mycobacterium
RPAYSNADAARQVAEDHADAAVTSPL

SEQ ID NO: 565460 - protein, 9 aa, Mycobacterium
RPAYTQSAA

SEQ ID NO: 565461 - protein, 4 aa, Mycobacterium
RPCI

SEQ ID NO: 565462 - protein, 7 aa, Mycobacterium
RPCPTCQ

SEQ ID NO: 565463 - protein, 6 aa, Mycobacterium
RPCQHP

SEQ ID NO: 565464 - protein, 14 aa, Mycobacterium
RPCSGWSSRGGQVR

SEQ ID NO: 565465 - protein, 6 aa, Mycobacterium
RPCSTG

SEQ ID NO: 565466 - protein, 18 aa, Mycobacterium
RPDAAAGRRGKPRPSPVA

SEQ ID NO: 565467 - protein, 18 aa, Mycobacterium
RPDAAAGRRGRPSPSPVA

SEQ ID NO: 565468 - protein, 8 aa, Mycobacterium
RPDAANAM

SEQ ID NO: 565469 - protein, 11 aa, Mycobacterium
RPDAANGMNDT

SEQ ID NO: 565470 - protein, 7 aa, Mycobacterium
RPDAAPA

SEQ ID NO: 565471 - protein, 19 aa, Mycobacterium
RPDAASGRRGRPEPSPVAR

SEQ ID NO: 565472 - protein, 7 aa, Mycobacterium
RPDADAE

SEQ ID NO: 565473 - protein, 8 aa, Mycobacterium
RPDADGRF

SEQ ID NO: 565474 - protein, 8 aa, Mycobacterium
RPDADHDA

SEQ ID NO: 565475 - protein, 7 aa, Mycobacterium
RPDADLP

SEQ ID NO: 565476 - protein, 7 aa, Mycobacterium
RPDADPR

SEQ ID NO: 565477 - protein, 9 aa, Mycobacterium
RPDAGDGDL

SEQ ID NO: 565478 - protein, 10 aa, Mycobacterium
RPDAGSTGPT

SEQ ID NO: 565479 - protein, 10 aa, Mycobacterium
RPDAKGGSCE

SEQ ID NO: 565480 - protein, 14 aa, Mycobacterium
RPDANDRDHPRTGG

SEQ ID NO: 565481 - protein, 11 aa, Mycobacterium
RPDAPAPGQVE

SEQ ID NO: 565482 - protein, 10 aa, Mycobacterium
RPDAPAPRQV

SEQ ID NO: 565483 - protein, 18 aa, Mycobacterium
RPDAPAYNRHDTYVIDDL

SEQ ID NO: 565484 - protein, 7 aa, Mycobacterium
RPDAQGR

SEQ ID NO: 565485 - protein, 10 aa, Mycobacterium
RPDAQNSTTL

SEQ ID NO: 565486 - protein, 7 aa, Mycobacterium
RPDAQQV

SEQ ID NO: 565487 - protein, 6 aa, Mycobacterium
RPDAQR

SEQ ID NO: 565488 - protein, 18 aa, Mycobacterium
RPDARAGRGRASASSPVA

SEQ ID NO: 565489 - protein, 9 aa, Mycobacterium
RPDARNAVN

SEQ ID NO: 565490 - protein, 18 aa, Mycobacterium
RPDARNAVNGAVSTAVGD

SEQ ID NO: 565491 - protein, 5 aa, Mycobacterium
RPDAT

SEQ ID NO: 565492 - protein, 9 aa, Mycobacterium
RPDATAAAI

SEQ ID NO: 565493 - protein, 8 aa, Mycobacterium
RPDATRDA

SEQ ID NO: 565494 - protein, 7 aa, Mycobacterium
RPDCSAP

SEQ ID NO: 565495 - protein, 8 aa, Mycobacterium
RPDDAESA

SEQ ID NO: 565496 - protein, 6 aa, Mycobacterium
RPDDAP

SEQ ID NO: 565497 - protein, 11 aa, Mycobacterium
RPDDERRNRSL

SEQ ID NO: 565498 - protein, 11 aa, Mycobacterium
RPDDERRSRSL

SEQ ID NO: 565499 - protein, 6 aa, Mycobacterium
RPDDET

SEQ ID NO: 565500 - protein, 9 aa, Mycobacterium
RPDDETLGA

SEQ ID NO: 565501 - protein, 5 aa, Mycobacterium
RPDDF

SEQ ID NO: 565502 - protein, 9 aa, Mycobacterium
RPDDGQVEV

SEQ ID NO: 565503 - protein, 9 aa, Mycobacterium
RPDDNTEVE

SEQ ID NO: 565504 - protein, 6 aa, Mycobacterium
RPDDPN

SEQ ID NO: 565505 - protein, 8 aa, Mycobacterium
RPDDPTGL

SEQ ID NO: 565506 - protein, 5 aa, Mycobacterium
RPDDS

SEQ ID NO: 565507 - protein, 9 aa, Mycobacterium
RPDDSAMRE

SEQ ID NO: 565508 - protein, 9 aa, Mycobacterium
RPDDSGRVA

SEQ ID NO: 565509 - protein, 6 aa, Mycobacterium
RPDDTE

SEQ ID NO: 565510 - protein, 5 aa, Mycobacterium
RPDDV

SEQ ID NO: 565511 - protein, 6 aa, Mycobacterium
RPDDVD

SEQ ID NO: 565512 - protein, 12 aa, Mycobacterium
RPDDVGAAPDDA

SEQ ID NO: 565513 - protein, 5 aa, Mycobacterium
RPDDW

SEQ ID NO: 565514 - protein, 4 aa, Mycobacterium
RPDE

SEQ ID NO: 565515 - protein, 13 aa, Mycobacterium
RPDEHGPEDPGGV

SEQ ID NO: 565516 - protein, 6 aa, Mycobacterium
RPDEIG

SEQ ID NO: 565517 - protein, 21 aa, Mycobacterium
RPDEKLARASRRAAREREEQF

SEQ ID NO: 565518 - protein, 7 aa, Mycobacterium
RPDEKWG

SEQ ID NO: 565519 - protein, 5 aa, Mycobacterium
RPDEP

SEQ ID NO: 565520 - protein, 6 aa, Mycobacterium
RPDEQT

SEQ ID NO: 565521 - protein, 7 aa, Mycobacterium
RPDERAH

SEQ ID NO: 565522 - protein, 8 aa, Mycobacterium
RPDESEKK

SEQ ID NO: 565523 - protein, 7 aa, Mycobacterium
RPDGADP

SEQ ID NO: 565524 - protein, 10 aa, Mycobacterium
RPDGAHGDTS

SEQ ID NO: 565525 - protein, 29 aa, Mycobacterium
RPDGESLSPGVAPNTLTSSGRRDAYAGTP

SEQ ID NO: 565526 - protein, 7 aa, Mycobacterium
RPDGETI

SEQ ID NO: 565527 - protein, 8 aa, Mycobacterium
RPDGGDVL

SEQ ID NO: 565528 - protein, 11 aa, Mycobacterium
RPDGGQFPARE

SEQ ID NO: 565529 - protein, 11 aa, Mycobacterium
RPDGGRGADGW

SEQ ID NO: 565530 - protein, 10 aa, Mycobacterium
RPDGLGSNRN

SEQ ID NO: 565531 - protein, 6 aa, Mycobacterium
RPDGMS

SEQ ID NO: 565532 - protein, 8 aa, Mycobacterium
RPDGMTGS

SEQ ID NO: 565533 - protein, 6 aa, Mycobacterium
RPDGPE

SEQ ID NO: 565534 - protein, 8 aa, Mycobacterium
RPDGPRRA

SEQ ID NO: 565535 - protein, 7 aa, Mycobacterium
RPDGPVA

SEQ ID NO: 565536 - protein, 8 aa, Mycobacterium
RPDGQPRW

SEQ ID NO: 565537 - protein, 8 aa, Mycobacterium
RPDGRHDA

SEQ ID NO: 565538 - protein, 7 aa, Mycobacterium
RPDGRPH

SEQ ID NO: 565539 - protein, 9 aa, Mycobacterium
RPDGRPSEL

SEQ ID NO: 565540 - protein, 5 aa, Mycobacterium
RPDGS

SEQ ID NO: 565541 - protein, 9 aa, Mycobacterium
RPDGSADDQ

SEQ ID NO: 565542 - protein, 11 aa, Mycobacterium
RPDGSLDTATA

SEQ ID NO: 565543 - protein, 8 aa, Mycobacterium
RPDGSPHV

SEQ ID NO: 565544 - protein, 11 aa, Mycobacterium
RPDGSSGAISG

SEQ ID NO: 565545 - protein, 9 aa, Mycobacterium
RPDGTAPEV

SEQ ID NO: 565546 - protein, 7 aa, Mycobacterium
RPDGTAY

SEQ ID NO: 565547 - protein, 10 aa, Mycobacterium
RPDGTHGDTS

SEQ ID NO: 565548 - protein, 7 aa, Mycobacterium
RPDGTPY

SEQ ID NO: 565549 - protein, 10 aa, Mycobacterium
RPDGTQGWTE

SEQ ID NO: 565550 - protein, 18 aa, Mycobacterium
RPDGTRDVDSPAATAYGE

SEQ ID NO: 565551 - protein, 16 aa, Mycobacterium
RPDGTVVPDPPSPWPD

SEQ ID NO: 565552 - protein, 5 aa, Mycobacterium
RPDGV

SEQ ID NO: 565553 - protein, 6 aa, Mycobacterium
RPDGVP

SEQ ID NO: 565554 - protein, 9 aa, Mycobacterium
RPDGVSAEL

SEQ ID NO: 565555 - protein, 6 aa, Mycobacterium
RPDGVT

SEQ ID NO: 565556 - protein, 4 aa, Mycobacterium
RPDH

SEQ ID NO: 565557 - protein, 7 aa, Mycobacterium
RPDHPDN

SEQ ID NO: 565558 - protein, 16 aa, Mycobacterium
RPDHPGAVAASPETLD

SEQ ID NO: 565559 - protein, 4 aa, Mycobacterium
RPDI

SEQ ID NO: 565560 - protein, 6 aa, Mycobacterium
RPDIDG

SEQ ID NO: 565561 - protein, 5 aa, Mycobacterium
RPDIN

SEQ ID NO: 565562 - protein, 5 aa, Mycobacterium
RPDIQ

SEQ ID NO: 565563 - protein, 13 aa, Mycobacterium
RPDKDNPASSGFS

SEQ ID NO: 565564 - protein, 8 aa, Mycobacterium
RPDKIADG

SEQ ID NO: 565565 - protein, 7 aa, Mycobacterium
RPDKRNA

SEQ ID NO: 565566 - protein, 8 aa, Mycobacterium
RPDKRNAF

SEQ ID NO: 565567 - protein, 4 aa, Mycobacterium
RPDL

SEQ ID NO: 565568 - protein, 5 aa, Mycobacterium
RPDLA

SEQ ID NO: 565569 - protein, 9 aa, Mycobacterium
RPDLAPPQV

SEQ ID NO: 565570 - protein, 19 aa, Mycobacterium
RPDLAQNPELSDNAGRVAH

SEQ ID NO: 565571 - protein, 24 aa, Mycobacterium
RPDLATDPDLQTNAGRWARRDELD

SEQ ID NO: 565572 - protein, 5 aa, Mycobacterium
RPDLD

SEQ ID NO: 565573 - protein, 8 aa, Mycobacterium
RPDLGGKA

SEQ ID NO: 565574 - protein, 6 aa, Mycobacterium
RPDLKD

SEQ ID NO: 565575 - protein, 14 aa, Mycobacterium
RPDLPQPAAGDGSY

SEQ ID NO: 565576 - protein, 8 aa, Mycobacterium
RPDLPYDE

SEQ ID NO: 565577 - protein, 15 aa, Mycobacterium
RPDLQEQLREDNSKI

SEQ ID NO: 565578 - protein, 21 aa, Mycobacterium
RPDLRDDPRFASAAARREHHD

SEQ ID NO: 565579 - protein, 5 aa, Mycobacterium
RPDLS

SEQ ID NO: 565580 - protein, 7 aa, Mycobacterium
RPDMARP

SEQ ID NO: 565581 - protein, 4 aa, Mycobacterium
RPDN

SEQ ID NO: 565582 - protein, 13 aa, Mycobacterium
RPDNLDPNGGRPS

SEQ ID NO: 565583 - protein, 8 aa, Mycobacterium
RPDNPADI

SEQ ID NO: 565584 - protein, 11 aa, Mycobacterium
RPDNRGSNSNA

SEQ ID NO: 565585 - protein, 8 aa, Mycobacterium
RPDNRPQR

SEQ ID NO: 565586 - protein, 12 aa, Mycobacterium
RPDNRSAPSAGG

SEQ ID NO: 565587 - protein, 8 aa, Mycobacterium
RPDNRTSA

SEQ ID NO: 565588 - protein, 6 aa, Mycobacterium
RPDPAA

SEQ ID NO: 565589 - protein, 12 aa, Mycobacterium
RPDPDDPPPALT

SEQ ID NO: 565590 - protein, 13 aa, Mycobacterium
RPDPDGRRPIDDT

SEQ ID NO: 565591 - protein, 12 aa, Mycobacterium
RPDPERVKIAIA

SEQ ID NO: 565592 - protein, 12 aa, Mycobacterium
RPDPGMNGSGGR

SEQ ID NO: 565593 - protein, 8 aa, Mycobacterium
RPDPGQAR

SEQ ID NO: 565594 - protein, 7 aa, Mycobacterium
RPDPMAG

SEQ ID NO: 565595 - protein, 5 aa, Mycobacterium
RPDPR

SEQ ID NO: 565596 - protein, 17 aa, Mycobacterium
RPDPRGRQAGVQGSQQL

SEQ ID NO: 565597 - protein, 6 aa, Mycobacterium
RPDPRQ

SEQ ID NO: 565598 - protein, 6 aa, Mycobacterium
RPDPSD

SEQ ID NO: 565599 - protein, 7 aa, Mycobacterium
RPDPSMT

SEQ ID NO: 565600 - protein, 8 aa, Mycobacterium
RPDPSNPG

SEQ ID NO: 565601 - protein, 7 aa, Mycobacterium
RPDPTSF

SEQ ID NO: 565602 - protein, 25 aa, Mycobacterium
RPDPYKGKGIRYEGEQIRRKVGKTG

SEQ ID NO: 565603 - protein, 12 aa, Mycobacterium
RPDQDGTSSIEA

SEQ ID NO: 565604 - protein, 7 aa, Mycobacterium
RPDQGAR

SEQ ID NO: 565605 - protein, 10 aa, Mycobacterium
RPDQGRVSVG

SEQ ID NO: 565606 - protein, 20 aa, Mycobacterium
RPDQHGPSADVAAPPARRST

SEQ ID NO: 565607 - protein, 5 aa, Mycobacterium
RPDQL

SEQ ID NO: 565608 - protein, 8 aa, Mycobacterium
RPDQLSTE

SEQ ID NO: 565609 - protein, 14 aa, Mycobacterium
RPDQPATHDSGATV

SEQ ID NO: 565610 - protein, 7 aa, Mycobacterium
RPDQQRR

SEQ ID NO: 565611 - protein, 5 aa, Mycobacterium
RPDQR

SEQ ID NO: 565612 - protein, 10 aa, Mycobacterium
RPDQRNAQNR

SEQ ID NO: 565613 - protein, 5 aa, Mycobacterium
RPDRA

SEQ ID NO: 565614 - protein, 13 aa, Mycobacterium
RPDRAPERFGPRP

SEQ ID NO: 565615 - protein, 8 aa, Mycobacterium
RPDRDARS

SEQ ID NO: 565616 - protein, 8 aa, Mycobacterium
RPDRDHPL

SEQ ID NO: 565617 - protein, 15 aa, Mycobacterium
RPDRDSTAYRSGPPG

SEQ ID NO: 565618 - protein, 6 aa, Mycobacterium
RPDRGQ

SEQ ID NO: 565619 - protein, 5 aa, Mycobacterium
RPDRI

SEQ ID NO: 565620 - protein, 5 aa, Mycobacterium
RPDRL

SEQ ID NO: 565621 - protein, 14 aa, Mycobacterium
RPDRPGERGAKDQQ

SEQ ID NO: 565622 - protein, 9 aa, Mycobacterium
RPDRPPTGD

SEQ ID NO: 565623 - protein, 6 aa, Mycobacterium
RPDRPS

SEQ ID NO: 565624 - protein, 7 aa, Mycobacterium
RPDRPTR

SEQ ID NO: 565625 - protein, 8 aa, Mycobacterium
RPDRPVEP

SEQ ID NO: 565626 - protein, 17 aa, Mycobacterium
RPDRQLDEARAREHCGT

SEQ ID NO: 565627 - protein, 5 aa, Mycobacterium
RPDRR

SEQ ID NO: 565628 - protein, 5 aa, Mycobacterium
RPDRS

SEQ ID NO: 565629 - protein, 10 aa, Mycobacterium
RPDRTAPGHG

SEQ ID NO: 565630 - protein, 6 aa, Mycobacterium
RPDRTY

SEQ ID NO: 565631 - protein, 5 aa, Mycobacterium
RPDRV

SEQ ID NO: 565632 - protein, 6 aa, Mycobacterium
RPDRVD

SEQ ID NO: 565633 - protein, 8 aa, Mycobacterium
RPDSARAR

SEQ ID NO: 565634 - protein, 6 aa, Mycobacterium
RPDSGY

SEQ ID NO: 565635 - protein, 8 aa, Mycobacterium
RPDSLNSV

SEQ ID NO: 565636 - protein, 6 aa, Mycobacterium
RPDSLT

SEQ ID NO: 565637 - protein, 7 aa, Mycobacterium
RPDSPID

SEQ ID NO: 565638 - protein, 11 aa, Mycobacterium
RPDSPLPVDAA

SEQ ID NO: 565639 - protein, 21 aa, Mycobacterium
RPDSPYLPGDDATTDAARTLR

SEQ ID NO: 565640 - protein, 5 aa, Mycobacterium
RPDSR

SEQ ID NO: 565641 - protein, 12 aa, Mycobacterium
RPDSSLPVDAGT

SEQ ID NO: 565642 - protein, 6 aa, Mycobacterium
RPDSWD

SEQ ID NO: 565643 - protein, 6 aa, Mycobacterium
RPDTAE

SEQ ID NO: 565644 - protein, 15 aa, Mycobacterium
RPDTATDLGSPRGAS

SEQ ID NO: 565645 - protein, 7 aa, Mycobacterium
RPDTGEI

SEQ ID NO: 565646 - protein, 7 aa, Mycobacterium
RPDTGSG

SEQ ID NO: 565647 - protein, 6 aa, Mycobacterium
RPDTNV

SEQ ID NO: 565648 - protein, 5 aa, Mycobacterium
RPDTP

SEQ ID NO: 565649 - protein, 5 aa, Mycobacterium
RPDTV

SEQ ID NO: 565650 - protein, 14 aa, Mycobacterium
RPDTVGDGGSSEPI

SEQ ID NO: 565651 - protein, 4 aa, Mycobacterium
RPDV

SEQ ID NO: 565652 - protein, 11 aa, Mycobacterium
RPDVADEAAAY

SEQ ID NO: 565653 - protein, 11 aa, Mycobacterium
RPDVAGPADAN

SEQ ID NO: 565654 - protein, 5 aa, Mycobacterium
RPDVP

SEQ ID NO: 565655 - protein, 8 aa, Mycobacterium
RPDVRERD

SEQ ID NO: 565656 - protein, 7 aa, Mycobacterium
RPDVRRR

SEQ ID NO: 565657 - protein, 12 aa, Mycobacterium
RPDVTGEKFGTT

SEQ ID NO: 565658 - protein, 5 aa, Mycobacterium
RPDWP

SEQ ID NO: 565659 - protein, 14 aa, Mycobacterium
RPDWPQPAQSGGSY

SEQ ID NO: 565660 - protein, 9 aa, Mycobacterium
RPDWPTDER

SEQ ID NO: 565661 - protein, 4 aa, Mycobacterium
RPDY

SEQ ID NO: 565662 - protein, 12 aa, Mycobacterium
RPEAANAQTPGI

SEQ ID NO: 565663 - protein, 14 aa, Mycobacterium
RPEAANAVRPDDRD

SEQ ID NO: 565664 - protein, 12 aa, Mycobacterium
RPEAANGMNGTM

SEQ ID NO: 565665 - protein, 9 aa, Mycobacterium
RPEAARAAG

SEQ ID NO: 565666 - protein, 23 aa, Mycobacterium
RPEAEKGKLRPRAKQEPGIQMRG

SEQ ID NO: 565667 - protein, 8 aa, Mycobacterium
RPEAGNKF

SEQ ID NO: 565668 - protein, 11 aa, Mycobacterium
RPEAGSSIDPG

SEQ ID NO: 565669 - protein, 8 aa, Mycobacterium
RPEAGTSA

SEQ ID NO: 565670 - protein, 8 aa, Mycobacterium
RPEANGER

SEQ ID NO: 565671 - protein, 7 aa, Mycobacterium
RPEANIT

SEQ ID NO: 565672 - protein, 5 aa, Mycobacterium
RPEAQ

SEQ ID NO: 565673 - protein, 13 aa, Mycobacterium
RPEAQRRDCARRR

SEQ ID NO: 565674 - protein, 5 aa, Mycobacterium
RPEAR

SEQ ID NO: 565675 - protein, 6 aa, Mycobacterium
RPEARN

SEQ ID NO: 565676 - protein, 17 aa, Mycobacterium
RPEARNAINSSVSQAVG

SEQ ID NO: 565677 - protein, 9 aa, Mycobacterium
RPEARNALG

SEQ ID NO: 565678 - protein, 11 aa, Mycobacterium
RPEARNALNGA

SEQ ID NO: 565679 - protein, 9 aa, Mycobacterium
RPEARNALS

SEQ ID NO: 565680 - protein, 8 aa, Mycobacterium
RPEARNAV

SEQ ID NO: 565681 - protein, 14 aa, Mycobacterium
RPEARNAVNGPTAA

SEQ ID NO: 565682 - protein, 7 aa, Mycobacterium
RPEARNS

SEQ ID NO: 565683 - protein, 11 aa, Mycobacterium
RPEARNSLNKA

SEQ ID NO: 565684 - protein, 11 aa, Mycobacterium
RPEASNALDRT

SEQ ID NO: 565685 - protein, 7 aa, Mycobacterium
RPEATAA

SEQ ID NO: 565686 - protein, 9 aa, Mycobacterium
RPEATAAAF

SEQ ID NO: 565687 - protein, 9 aa, Mycobacterium
RPEATAEAF

SEQ ID NO: 565688 - protein, 10 aa, Mycobacterium
RPEATAETIT

SEQ ID NO: 565689 - protein, 9 aa, Mycobacterium
RPEATATTF

SEQ ID NO: 565690 - protein, 5 aa, Mycobacterium
RPEAV

SEQ ID NO: 565691 - protein, 12 aa, Mycobacterium
RPEDASAQRPAV

SEQ ID NO: 565692 - protein, 5 aa, Mycobacterium
RPEDE

SEQ ID NO: 565693 - protein, 35 aa, Mycobacterium
RPEDPEPLGDNDSQASRPADDPGEPGGPAPPEGEA

SEQ ID NO: 565694 - protein, 14 aa, Mycobacterium
RPEDRADYETRSRE

SEQ ID NO: 565695 - protein, 4 aa, Mycobacterium
RPEE

SEQ ID NO: 565696 - protein, 11 aa, Mycobacterium
RPEEDTYQTAE

SEQ ID NO: 565697 - protein, 13 aa, Mycobacterium
RPEEHAEQAPTDR

SEQ ID NO: 565698 - protein, 8 aa, Mycobacterium
RPEELTEH

SEQ ID NO: 565699 - protein, 6 aa, Mycobacterium
RPEESG

SEQ ID NO: 565700 - protein, 5 aa, Mycobacterium
RPEEV

SEQ ID NO: 565701 - protein, 6 aa, Mycobacterium
RPEEVT

SEQ ID NO: 565702 - protein, 8 aa, Mycobacterium
RPEEVTDM

SEQ ID NO: 565703 - protein, 6 aa, Mycobacterium
RPEFGQ

SEQ ID NO: 565704 - protein, 12 aa, Mycobacterium
RPEFKPRTLEPS

SEQ ID NO: 565705 - protein, 4 aa, Mycobacterium
RPEG

SEQ ID NO: 565706 - protein, 15 aa, Mycobacterium
RPEGAHPLPQPPPRL

SEQ ID NO: 565707 - protein, 9 aa, Mycobacterium
RPEGDELDT

SEQ ID NO: 565708 - protein, 18 aa, Mycobacterium
RPEGDSGFDRRHESSAAV

SEQ ID NO: 565709 - protein, 10 aa, Mycobacterium
RPEGEHAPET

SEQ ID NO: 565710 - protein, 8 aa, Mycobacterium
RPEGERAD

SEQ ID NO: 565711 - protein, 16 aa, Mycobacterium
RPEGGWSPNIYGGREN

SEQ ID NO: 565712 - protein, 16 aa, Mycobacterium
RPEGGWTPNQYGGREN

SEQ ID NO: 565713 - protein, 15 aa, Mycobacterium
RPEGNANADIPTGEV

SEQ ID NO: 565714 - protein, 13 aa, Mycobacterium
RPEGNANDEIATG

SEQ ID NO: 565715 - protein, 12 aa, Mycobacterium
RPEGNANPEIAT

SEQ ID NO: 565716 - protein, 14 aa, Mycobacterium
RPEGNANPEIATGD

SEQ ID NO: 565717 - protein, 13 aa, Mycobacterium
RPEGNENPEIPTG

SEQ ID NO: 565718 - protein, 9 aa, Mycobacterium
RPEGNNPMP

SEQ ID NO: 565719 - protein, 12 aa, Mycobacterium
RPEGPPEPQSEE

SEQ ID NO: 565720 - protein, 7 aa, Mycobacterium
RPEGPVT

SEQ ID NO: 565721 - protein, 5 aa, Mycobacterium
RPEGT

SEQ ID NO: 565722 - protein, 8 aa, Mycobacterium
RPEGVSAE

SEQ ID NO: 565723 - protein, 4 aa, Mycobacterium
RPEH

SEQ ID NO: 565724 - protein, 5 aa, Mycobacterium
RPEHA

SEQ ID NO: 565725 - protein, 18 aa, Mycobacterium
RPEHVPAAPRADQSYAEL

SEQ ID NO: 565726 - protein, 14 aa, Mycobacterium
RPEKGSGGAPQFAP

SEQ ID NO: 565727 - protein, 5 aa, Mycobacterium
RPEKM

SEQ ID NO: 565728 - protein, 8 aa, Mycobacterium
RPEKRNAL

SEQ ID NO: 565729 - protein, 12 aa, Mycobacterium
RPEKVGKDAGEL

SEQ ID NO: 565730 - protein, 6 aa, Mycobacterium
RPEKVS

SEQ ID NO: 565731 - protein, 4 aa, Mycobacterium
RPEL

SEQ ID NO: 565732 - protein, 9 aa, Mycobacterium
RPELATDER

SEQ ID NO: 565733 - protein, 9 aa, Mycobacterium
RPELDERGA

SEQ ID NO: 565734 - protein, 7 aa, Mycobacterium
RPELDSR

SEQ ID NO: 565735 - protein, 13 aa, Mycobacterium
RPELPPSSRDLST

SEQ ID NO: 565736 - protein, 13 aa, Mycobacterium
RPELRGTSAARDA

SEQ ID NO: 565737 - protein, 8 aa, Mycobacterium
RPELSSDA

SEQ ID NO: 565738 - protein, 5 aa, Mycobacterium
RPELT

SEQ ID NO: 565739 - protein, 7 aa, Mycobacterium
RPEMGRP

SEQ ID NO: 565740 - protein, 6 aa, Mycobacterium
RPENKR

SEQ ID NO: 565741 - protein, 13 aa, Mycobacterium
RPENVADRGAQQG

SEQ ID NO: 565742 - protein, 33 aa, Mycobacterium
RPEPARLGQGRSPLAPSRDADPSAPDAADQSQA

SEQ ID NO: 565743 - protein, 6 aa, Mycobacterium
RPEPDA

SEQ ID NO: 565744 - protein, 7 aa, Mycobacterium
RPEPDDL

SEQ ID NO: 565745 - protein, 21 aa, Mycobacterium
RPEPENADYQNRIEAGTGVPA

SEQ ID NO: 565746 - protein, 6 aa, Mycobacterium
RPEPFS

SEQ ID NO: 565747 - protein, 12 aa, Mycobacterium
RPEPGHKAAPSW

SEQ ID NO: 565748 - protein, 7 aa, Mycobacterium
RPEPGTI

SEQ ID NO: 565749 - protein, 19 aa, Mycobacterium
RPEPGYGRTSPVGSFEPNG

SEQ ID NO: 565750 - protein, 7 aa, Mycobacterium
RPEPHRR

SEQ ID NO: 565751 - protein, 7 aa, Mycobacterium
RPEPIST

SEQ ID NO: 565752 - protein, 10 aa, Mycobacterium
RPEPLPSAED

SEQ ID NO: 565753 - protein, 7 aa, Mycobacterium
RPEPQSR

SEQ ID NO: 565754 - protein, 10 aa, Mycobacterium
RPEPSPGPGE

SEQ ID NO: 565755 - protein, 5 aa, Mycobacterium
RPEPT

SEQ ID NO: 565756 - protein, 5 aa, Mycobacterium
RPEPV

SEQ ID NO: 565757 - protein, 12 aa, Mycobacterium
RPEQAPDESRAA

SEQ ID NO: 565758 - protein, 15 aa, Mycobacterium
RPEQGSGGAPQFAPR

SEQ ID NO: 565759 - protein, 18 aa, Mycobacterium
RPEQTAETFRSDGLRSGD

SEQ ID NO: 565760 - protein, 5 aa, Mycobacterium
RPEQV

SEQ ID NO: 565761 - protein, 13 aa, Mycobacterium
RPERAPRFARRRP

SEQ ID NO: 565762 - protein, 16 aa, Mycobacterium
RPERAVGVSNSVRAVL

SEQ ID NO: 565763 - protein, 5 aa, Mycobacterium
RPERF

SEQ ID NO: 565764 - protein, 6 aa, Mycobacterium
RPERFT

SEQ ID NO: 565765 - protein, 14 aa, Mycobacterium
RPERGAAGAPQFAP

SEQ ID NO: 565766 - protein, 17 aa, Mycobacterium
RPERGRDQFLGALLDFL

SEQ ID NO: 565767 - protein, 6 aa, Mycobacterium
RPERRH

SEQ ID NO: 565768 - protein, 6 aa, Mycobacterium
RPERRN

SEQ ID NO: 565769 - protein, 7 aa, Mycobacterium
RPERRNA

SEQ ID NO: 565770 - protein, 13 aa, Mycobacterium
RPERRNALDPQTV

SEQ ID NO: 565771 - protein, 5 aa, Mycobacterium
RPERT

SEQ ID NO: 565772 - protein, 6 aa, Mycobacterium
RPERYA

SEQ ID NO: 565773 - protein, 9 aa, Mycobacterium
RPESDRERL

SEQ ID NO: 565774 - protein, 7 aa, Mycobacterium
RPESDSN

SEQ ID NO: 565775 - protein, 12 aa, Mycobacterium
RPESLTARASTL

SEQ ID NO: 565776 - protein, 13 aa, Mycobacterium
RPESNAARLRASS

SEQ ID NO: 565777 - protein, 6 aa, Mycobacterium
RPESRA

SEQ ID NO: 565778 - protein, 8 aa, Mycobacterium
RPESRGSV

SEQ ID NO: 565779 - protein, 7 aa, Mycobacterium
RPESTDA

SEQ ID NO: 565780 - protein, 7 aa, Mycobacterium
RPESYGA

SEQ ID NO: 565781 - protein, 12 aa, Mycobacterium
RPETAASQRSLT

SEQ ID NO: 565782 - protein, 12 aa, Mycobacterium
RPETAASQRSMT

SEQ ID NO: 565783 - protein, 13 aa, Mycobacterium
RPETAASQRSQTV

SEQ ID NO: 565784 - protein, 7 aa, Mycobacterium
RPETDAD

SEQ ID NO: 565785 - protein, 6 aa, Mycobacterium
RPETDE

SEQ ID NO: 565786 - protein, 6 aa, Mycobacterium
RPETES

SEQ ID NO: 565787 - protein, 6 aa, Mycobacterium
RPETPI

SEQ ID NO: 565788 - protein, 5 aa, Mycobacterium
RPETQ

SEQ ID NO: 565789 - protein, 7 aa, Mycobacterium
RPETQAW

SEQ ID NO: 565790 - protein, 7 aa, Mycobacterium
RPETRNS

SEQ ID NO: 565791 - protein, 10 aa, Mycobacterium
RPETTKTTVT

SEQ ID NO: 565792 - protein, 9 aa, Mycobacterium
RPEVAPGDV

SEQ ID NO: 565793 - protein, 12 aa, Mycobacterium
RPEVGRTKDTTE

SEQ ID NO: 565794 - protein, 7 aa, Mycobacterium
RPEVRGQ

SEQ ID NO: 565795 - protein, 6 aa, Mycobacterium
RPEVSA

SEQ ID NO: 565796 - protein, 19 aa, Mycobacterium
RPEVSAYRRSPRAPAPGAS

SEQ ID NO: 565797 - protein, 8 aa, Mycobacterium
RPEVSGER

SEQ ID NO: 565798 - protein, 11 aa, Mycobacterium
RPEVSGETFGT

SEQ ID NO: 565799 - protein, 5 aa, Mycobacterium
RPEVT

SEQ ID NO: 565800 - protein, 20 aa, Mycobacterium
RPEWRDDPRFADARSRAANS

SEQ ID NO: 565801 - protein, 4 aa, Mycobacterium
RPEY

SEQ ID NO: 565802 - protein, 6 aa, Mycobacterium
RPEYPA

SEQ ID NO: 565803 - protein, 8 aa, Mycobacterium
RPEYRDRD

SEQ ID NO: 565804 - protein, 14 aa, Mycobacterium
RPEYRPAPLLGEHC

SEQ ID NO: 565805 - protein, 5 aa, Mycobacterium
RPFDR

SEQ ID NO: 565806 - protein, 8 aa, Mycobacterium
RPFEPPPT

SEQ ID NO: 565807 - protein, 12 aa, Mycobacterium
RPFPTKAEADAA

SEQ ID NO: 565808 - protein, 4 aa, Mycobacterium
RPFR

SEQ ID NO: 565809 - protein, 12 aa, Mycobacterium
RPFSGAAQTAQT

SEQ ID NO: 565810 - protein, 10 aa, Mycobacterium
RPFSQDPAAH

SEQ ID NO: 565811 - protein, 13 aa, Mycobacterium
RPFSSPSAGPTRL

SEQ ID NO: 565812 - protein, 4 aa, Mycobacterium
RPFT

SEQ ID NO: 565813 - protein, 6 aa, Mycobacterium
RPFTDQ

SEQ ID NO: 565814 - protein, 8 aa, Mycobacterium
RPFTPPPT

SEQ ID NO: 565815 - protein, 11 aa, Mycobacterium
RPGAAADGEAL

SEQ ID NO: 565816 - protein, 7 aa, Mycobacterium
RPGAAAE

SEQ ID NO: 565817 - protein, 8 aa, Mycobacterium
RPGAAQSR

SEQ ID NO: 565818 - protein, 8 aa, Mycobacterium
RPGAARDA

SEQ ID NO: 565819 - protein, 8 aa, Mycobacterium
RPGADATV

SEQ ID NO: 565820 - protein, 10 aa, Mycobacterium
RPGADETERI

SEQ ID NO: 565821 - protein, 9 aa, Mycobacterium
RPGADPDKG

SEQ ID NO: 565822 - protein, 11 aa, Mycobacterium
RPGAEPDPEEL

SEQ ID NO: 565823 - protein, 7 aa, Mycobacterium
RPGAGAA

SEQ ID NO: 565824 - protein, 19 aa, Mycobacterium
RPGAGPMSLTGQPNAMGGR

SEQ ID NO: 565825 - protein, 11 aa, Mycobacterium
RPGAGVDDLPP

SEQ ID NO: 565826 - protein, 10 aa, Mycobacterium
RPGAGVDGAG

SEQ ID NO: 565827 - protein, 6 aa, Mycobacterium
RPGAIT

SEQ ID NO: 565828 - protein, 9 aa, Mycobacterium
RPGALPAGR

SEQ ID NO: 565829 - protein, 7 aa, Mycobacterium
RPGANLD

SEQ ID NO: 565830 - protein, 16 aa, Mycobacterium
RPGANRSAIADERGIE

SEQ ID NO: 565831 - protein, 7 aa, Mycobacterium
RPGAPTR

SEQ ID NO: 565832 - protein, 8 aa, Mycobacterium
RPGAPTSD

SEQ ID NO: 565833 - protein, 14 aa, Mycobacterium
RPGARNAVNGPTAA

SEQ ID NO: 565834 - protein, 5 aa, Mycobacterium
RPGAS

SEQ ID NO: 565835 - protein, 8 aa, Mycobacterium
RPGATGAS

SEQ ID NO: 565836 - protein, 6 aa, Mycobacterium
RPGATI

SEQ ID NO: 565837 - protein, 6 aa, Mycobacterium
RPGATP

SEQ ID NO: 565838 - protein, 4 aa, Mycobacterium
RPGC

SEQ ID NO: 565839 - protein, 17 aa, Mycobacterium
RPGCDPDVQQIDLGRPP

SEQ ID NO: 565840 - protein, 7 aa, Mycobacterium
RPGCRPS

SEQ ID NO: 565841 - protein, 14 aa, Mycobacterium
RPGDDGSLPDTGSL

SEQ ID NO: 565842 - protein, 6 aa, Mycobacterium
RPGDED

SEQ ID NO: 565843 - protein, 6 aa, Mycobacterium
RPGDER

SEQ ID NO: 565844 - protein, 5 aa, Mycobacterium
RPGDG

SEQ ID NO: 565845 - protein, 6 aa, Mycobacterium
RPGDGI

SEQ ID NO: 565846 - protein, 5 aa, Mycobacterium
RPGDI

SEQ ID NO: 565847 - protein, 6 aa, Mycobacterium
RPGDKL

SEQ ID NO: 565848 - protein, 16 aa, Mycobacterium
RPGDKTDSASGSRPVF

SEQ ID NO: 565849 - protein, 5 aa, Mycobacterium
RPGDL

SEQ ID NO: 565850 - protein, 7 aa, Mycobacterium
RPGDPED

SEQ ID NO: 565851 - protein, 11 aa, Mycobacterium
RPGDPEESMGN

SEQ ID NO: 565852 - protein, 6 aa, Mycobacterium
RPGDPF

SEQ ID NO: 565853 - protein, 7 aa, Mycobacterium
RPGDPGV

SEQ ID NO: 565854 - protein, 8 aa, Mycobacterium
RPGDPNES

SEQ ID NO: 565855 - protein, 5 aa, Mycobacterium
RPGDR

SEQ ID NO: 565856 - protein, 11 aa, Mycobacterium
RPGDRLPTERE

SEQ ID NO: 565857 - protein, 15 aa, Mycobacterium
RPGDTGYDPDADPEM

SEQ ID NO: 565858 - protein, 19 aa, Mycobacterium
RPGDTPPFQRGGMGDHSAG

SEQ ID NO: 565859 - protein, 19 aa, Mycobacterium
RPGDTPPFQRGGMGDHTTG

SEQ ID NO: 565860 - protein, 5 aa, Mycobacterium
RPGDY

SEQ ID NO: 565861 - protein, 9 aa, Mycobacterium
RPGEAVAAG

SEQ ID NO: 565862 - protein, 11 aa, Mycobacterium
RPGEEFEGETH

SEQ ID NO: 565863 - protein, 14 aa, Mycobacterium
RPGEETEGETNRLG

SEQ ID NO: 565864 - protein, 6 aa, Mycobacterium
RPGEGA

SEQ ID NO: 565865 - protein, 8 aa, Mycobacterium
RPGEGVLP

SEQ ID NO: 565866 - protein, 13 aa, Mycobacterium
RPGEHGPEDPGGV

SEQ ID NO: 565867 - protein, 19 aa, Mycobacterium
RPGEIATTAEGFEASTKTG

SEQ ID NO: 565868 - protein, 8 aa, Mycobacterium
RPGEKAPL

SEQ ID NO: 565869 - protein, 15 aa, Mycobacterium
RPGEPAARLSGPPGE

SEQ ID NO: 565870 - protein, 7 aa, Mycobacterium
RPGEPEI

SEQ ID NO: 565871 - protein, 7 aa, Mycobacterium
RPGEPEV

SEQ ID NO: 565872 - protein, 10 aa, Mycobacterium
RPGEPLPADA

SEQ ID NO: 565873 - protein, 12 aa, Mycobacterium
RPGEPPTKESAQ

SEQ ID NO: 565874 - protein, 8 aa, Mycobacterium
RPGEPSWE

SEQ ID NO: 565875 - protein, 16 aa, Mycobacterium
RPGEPSWPSPFGPGRP

SEQ ID NO: 565876 - protein, 9 aa, Mycobacterium
RPGEPVAAG

SEQ ID NO: 565877 - protein, 9 aa, Mycobacterium
RPGEPVTAG

SEQ ID NO: 565878 - protein, 7 aa, Mycobacterium
RPGERAH

SEQ ID NO: 565879 - protein, 16 aa, Mycobacterium
RPGESDGSCNGGPSAG

SEQ ID NO: 565880 - protein, 18 aa, Mycobacterium
RPGESDGTCGKGDPAAGT

SEQ ID NO: 565881 - protein, 18 aa, Mycobacterium
RPGESDGTCGKGDPPAGH

SEQ ID NO: 565882 - protein, 6 aa, Mycobacterium
RPGESH

SEQ ID NO: 565883 - protein, 10 aa, Mycobacterium
RPGETLPAGS

SEQ ID NO: 565884 - protein, 19 aa, Mycobacterium
RPGETPPFQRGGMGDHSAG

SEQ ID NO: 565885 - protein, 6 aa, Mycobacterium
RPGETV

SEQ ID NO: 565886 - protein, 5 aa, Mycobacterium
RPGEV

SEQ ID NO: 565887 - protein, 7 aa, Mycobacterium
RPGEVDE

SEQ ID NO: 565888 - protein, 9 aa, Mycobacterium
RPGEVRPST

SEQ ID NO: 565889 - protein, 21 aa, Mycobacterium
RPGFDSPPQAAPVAPRGNMPD

SEQ ID NO: 565890 - protein, 7 aa, Mycobacterium
RPGFHPD

SEQ ID NO: 565891 - protein, 8 aa, Mycobacterium
RPGFHPDD

SEQ ID NO: 565892 - protein, 6 aa, Mycobacterium
RPGFTG

SEQ ID NO: 565893 - protein, 15 aa, Mycobacterium
RPGGADKAETPDTSL

SEQ ID NO: 565894 - protein, 17 aa, Mycobacterium
RPGGAHPARAGGDLQGP

SEQ ID NO: 565895 - protein, 8 aa, Mycobacterium
RPGGAPRW

SEQ ID NO: 565896 - protein, 7 aa, Mycobacterium
RPGGDAL

SEQ ID NO: 565897 - protein, 7 aa, Mycobacterium
RPGGDTA

SEQ ID NO: 565898 - protein, 6 aa, Mycobacterium
RPGGEA

SEQ ID NO: 565899 - protein, 14 aa, Mycobacterium
RPGGEAPANGHRSA

SEQ ID NO: 565900 - protein, 13 aa, Mycobacterium
RPGGGAKLARSAG

SEQ ID NO: 565901 - protein, 15 aa, Mycobacterium
RPGGGAKLARSAGAS

SEQ ID NO: 565902 - protein, 14 aa, Mycobacterium
RPGGGAKMARSAGA

SEQ ID NO: 565903 - protein, 12 aa, Mycobacterium
RPGGGSGEDKPE

SEQ ID NO: 565904 - protein, 11 aa, Mycobacterium
RPGGGSGGAYR

SEQ ID NO: 565905 - protein, 15 aa, Mycobacterium
RPGGGTILRWTAPLP

SEQ ID NO: 565906 - protein, 5 aa, Mycobacterium
RPGGH

SEQ ID NO: 565907 - protein, 18 aa, Mycobacterium
RPGGKGPQKVDRGQVAVT

SEQ ID NO: 565908 - protein, 5 aa, Mycobacterium
RPGGL

SEQ ID NO: 565909 - protein, 8 aa, Mycobacterium
RPGGNLSQ

SEQ ID NO: 565910 - protein, 8 aa, Mycobacterium
RPGGNRQR

SEQ ID NO: 565911 - protein, 5 aa, Mycobacterium
RPGGP

SEQ ID NO: 565912 - protein, 11 aa, Mycobacterium
RPGGPAFRPSE

SEQ ID NO: 565913 - protein, 7 aa, Mycobacterium
RPGGPEL

SEQ ID NO: 565914 - protein, 19 aa, Mycobacterium
RPGGPGGSGGARAAGSRRC

SEQ ID NO: 565915 - protein, 11 aa, Mycobacterium
RPGGPNDKPQL

SEQ ID NO: 565916 - protein, 7 aa, Mycobacterium
RPGGQTQ

SEQ ID NO: 565917 - protein, 5 aa, Mycobacterium
RPGGS

SEQ ID NO: 565918 - protein, 6 aa, Mycobacterium
RPGGSE

SEQ ID NO: 565919 - protein, 9 aa, Mycobacterium
RPGGSIPTA

SEQ ID NO: 565920 - protein, 12 aa, Mycobacterium
RPGGSVPSADLS

SEQ ID NO: 565921 - protein, 5 aa, Mycobacterium
RPGGV

SEQ ID NO: 565922 - protein, 11 aa, Mycobacterium
RPGHADERDAR

SEQ ID NO: 565923 - protein, 5 aa, Mycobacterium
RPGHE

SEQ ID NO: 565924 - protein, 6 aa, Mycobacterium
RPGHGE

SEQ ID NO: 565925 - protein, 13 aa, Mycobacterium
RPGHGSSAPYPEA

SEQ ID NO: 565926 - protein, 14 aa, Mycobacterium
RPGHGSSAPYPEAV

SEQ ID NO: 565927 - protein, 40 aa, Mycobacterium
RPGHGTQVSAGLEAGHTTRITGGMTGGQLEDPRGIRAGDA

SEQ ID NO: 565928 - protein, 7 aa, Mycobacterium
RPGHTEA

SEQ ID NO: 565929 - protein, 4 aa, Mycobacterium
RPGI

SEQ ID NO: 565930 - protein, 12 aa, Mycobacterium
RPGIGSSTPHEY

SEQ ID NO: 565931 - protein, 11 aa, Mycobacterium
RPGIGSSTPHQ

SEQ ID NO: 565932 - protein, 12 aa, Mycobacterium
RPGIGSSTPHQY

SEQ ID NO: 565933 - protein, 13 aa, Mycobacterium
RPGIGSSTPHQYG

SEQ ID NO: 565934 - protein, 5 aa, Mycobacterium
RPGIP

SEQ ID NO: 565935 - protein, 11 aa, Mycobacterium
RPGIPPTRPVH

SEQ ID NO: 565936 - protein, 7 aa, Mycobacterium
RPGITNE

SEQ ID NO: 565937 - protein, 4 aa, Mycobacterium
RPGK

SEQ ID NO: 565938 - protein, 11 aa, Mycobacterium
RPGKASPFNSA

SEQ ID NO: 565939 - protein, 7 aa, Mycobacterium
RPGKFGG

SEQ ID NO: 565940 - protein, 4 aa, Mycobacterium
RPGL

SEQ ID NO: 565941 - protein, 5 aa, Mycobacterium
RPGLA

SEQ ID NO: 565942 - protein, 6 aa, Mycobacterium
RPGLDD

SEQ ID NO: 565943 - protein, 16 aa, Mycobacterium
RPGLEPPAAPSSARAY

SEQ ID NO: 565944 - protein, 17 aa, Mycobacterium
RPGLEPPPTPSSSRAYE

SEQ ID NO: 565945 - protein, 19 aa, Mycobacterium
RPGLGASGARRRKGRDYDD

SEQ ID NO: 565946 - protein, 25 aa, Mycobacterium
RPGLKDPPFVPATPSAFGERETPKS

SEQ ID NO: 565947 - protein, 7 aa, Mycobacterium
RPGLPED

SEQ ID NO: 565948 - protein, 21 aa, Mycobacterium
RPGLPGDWPTGYDDATYPYTP

SEQ ID NO: 565949 - protein, 22 aa, Mycobacterium
RPGLPGDWPTGYDDPRSPYTPA

SEQ ID NO: 565950 - protein, 23 aa, Mycobacterium
RPGLPGEWPTGYDDATQQNTPAW

SEQ ID NO: 565951 - protein, 9 aa, Mycobacterium
RPGLSNSEL

SEQ ID NO: 565952 - protein, 10 aa, Mycobacterium
RPGLSPADRA

SEQ ID NO: 565953 - protein, 9 aa, Mycobacterium
RPGLTDADR

SEQ ID NO: 565954 - protein, 5 aa, Mycobacterium
RPGMG

SEQ ID NO: 565955 - protein, 6 aa, Mycobacterium
RPGNAA

SEQ ID NO: 565956 - protein, 7 aa, Mycobacterium
RPGNAAM

SEQ ID NO: 565957 - protein, 16 aa, Mycobacterium
RPGNAPLTAPGVPQPQ

SEQ ID NO: 565958 - protein, 12 aa, Mycobacterium
RPGNLGAETRRA

SEQ ID NO: 565959 - protein, 11 aa, Mycobacterium
RPGNPASHRGK

SEQ ID NO: 565960 - protein, 14 aa, Mycobacterium
RPGNQRRAAGQRER

SEQ ID NO: 565961 - protein, 4 aa, Mycobacterium
RPGP

SEQ ID NO: 565962 - protein, 8 aa, Mycobacterium
RPGPAGPA

SEQ ID NO: 565963 - protein, 11 aa, Mycobacterium
RPGPAPRLGEH

SEQ ID NO: 565964 - protein, 18 aa, Mycobacterium
RPGPARLRRRGTRTRRKH

SEQ ID NO: 565965 - protein, 23 aa, Mycobacterium
RPGPARPSDGDPYPVYSPEGLGA

SEQ ID NO: 565966 - protein, 11 aa, Mycobacterium
RPGPDAQTYRD

SEQ ID NO: 565967 - protein, 14 aa, Mycobacterium
RPGPDGPAPDPAGV

SEQ ID NO: 565968 - protein, 9 aa, Mycobacterium
RPGPDPDHG

SEQ ID NO: 565969 - protein, 6 aa, Mycobacterium
RPGPEL

SEQ ID NO: 565970 - protein, 6 aa, Mycobacterium
RPGPFN

SEQ ID NO: 565971 - protein, 7 aa, Mycobacterium
RPGPGRR

SEQ ID NO: 565972 - protein, 7 aa, Mycobacterium
RPGPIPL

SEQ ID NO: 565973 - protein, 13 aa, Mycobacterium
RPGPLRAAERRTT

SEQ ID NO: 565974 - protein, 11 aa, Mycobacterium
RPGPLRPAERR

SEQ ID NO: 565975 - protein, 13 aa, Mycobacterium
RPGPMDSSPLERV

SEQ ID NO: 565976 - protein, 9 aa, Mycobacterium
RPGPPNPAP

SEQ ID NO: 565977 - protein, 14 aa, Mycobacterium
RPGPPPAATGADRT

SEQ ID NO: 565978 - protein, 5 aa, Mycobacterium
RPGPQ

SEQ ID NO: 565979 - protein, 6 aa, Mycobacterium
RPGPQN

SEQ ID NO: 565980 - protein, 6 aa, Mycobacterium
RPGPTM

SEQ ID NO: 565981 - protein, 18 aa, Mycobacterium
RPGPTRAEAVPETPERAT

SEQ ID NO: 565982 - protein, 5 aa, Mycobacterium
RPGQA

SEQ ID NO: 565983 - protein, 7 aa, Mycobacterium
RPGQGPV

SEQ ID NO: 565984 - protein, 5 aa, Mycobacterium
RPGQL

SEQ ID NO: 565985 - protein, 9 aa, Mycobacterium
RPGQLNAPT

SEQ ID NO: 565986 - protein, 6 aa, Mycobacterium
RPGQPG

SEQ ID NO: 565987 - protein, 18 aa, Mycobacterium
RPGQRHHPSDNTDEPERA

SEQ ID NO: 565988 - protein, 16 aa, Mycobacterium
RPGQTFTRTDSGFPGA

SEQ ID NO: 565989 - protein, 18 aa, Mycobacterium
RPGQTHSTNDSRGGGSIK

SEQ ID NO: 565990 - protein, 6 aa, Mycobacterium
RPGQTI

SEQ ID NO: 565991 - protein, 14 aa, Mycobacterium
RPGQYARSHEAGRS

SEQ ID NO: 565992 - protein, 7 aa, Mycobacterium
RPGRAEV

SEQ ID NO: 565993 - protein, 8 aa, Mycobacterium
RPGRATSG

SEQ ID NO: 565994 - protein, 6 aa, Mycobacterium
RPGRFG

SEQ ID NO: 565995 - protein, 7 aa, Mycobacterium
RPGRFGS

SEQ ID NO: 565996 - protein, 21 aa, Mycobacterium
RPGRFGSADLPSASVDNERTS

SEQ ID NO: 565997 - protein, 14 aa, Mycobacterium
RPGRGANGELPPND

SEQ ID NO: 565998 - protein, 6 aa, Mycobacterium
RPGRGG

SEQ ID NO: 565999 - protein, 7 aa, Mycobacterium
RPGRGPK

SEQ ID NO: 566000 - protein, 6 aa, Mycobacterium
RPGRHG

SEQ ID NO: 566001 - protein, 6 aa, Mycobacterium
RPGRID

SEQ ID NO: 566002 - protein, 8 aa, Mycobacterium
RPGRKAAT

SEQ ID NO: 566003 - protein, 6 aa, Mycobacterium
RPGRNA

SEQ ID NO: 566004 - protein, 6 aa, Mycobacterium
RPGRPP

SEQ ID NO: 566005 - protein, 9 aa, Mycobacterium
RPGRRAQDA

SEQ ID NO: 566006 - protein, 8 aa, Mycobacterium
RPGRRTPK

SEQ ID NO: 566007 - protein, 7 aa, Mycobacterium
RPGRSAR

SEQ ID NO: 566008 - protein, 5 aa, Mycobacterium
RPGRT

SEQ ID NO: 566009 - protein, 5 aa, Mycobacterium
RPGRV

SEQ ID NO: 566010 - protein, 5 aa, Mycobacterium
RPGSA

SEQ ID NO: 566011 - protein, 8 aa, Mycobacterium
RPGSDPAV

SEQ ID NO: 566012 - protein, 7 aa, Mycobacterium
RPGSDVD

SEQ ID NO: 566013 - protein, 6 aa, Mycobacterium
RPGSDW

SEQ ID NO: 566014 - protein, 12 aa, Mycobacterium
RPGSGGRSRISD

SEQ ID NO: 566015 - protein, 7 aa, Mycobacterium
RPGSGLS

SEQ ID NO: 566016 - protein, 18 aa, Mycobacterium
RPGSGPFSLTGQPNAMGG

SEQ ID NO: 566017 - protein, 19 aa, Mycobacterium
RPGSGPFSLTGQPNAMGGR

SEQ ID NO: 566018 - protein, 9 aa, Mycobacterium
RPGSGREAT

SEQ ID NO: 566019 - protein, 9 aa, Mycobacterium
RPGSQTYGD

SEQ ID NO: 566020 - protein, 5 aa, Mycobacterium
RPGSR

SEQ ID NO: 566021 - protein, 8 aa, Mycobacterium
RPGSRNGE

SEQ ID NO: 566022 - protein, 9 aa, Mycobacterium
RPGSVGQRL

SEQ ID NO: 566023 - protein, 8 aa, Mycobacterium
RPGSVGRP

SEQ ID NO: 566024 - protein, 8 aa, Mycobacterium
RPGSVGSA

SEQ ID NO: 566025 - protein, 6 aa, Mycobacterium
RPGSWD

SEQ ID NO: 566026 - protein, 7 aa, Mycobacterium
RPGSWDG

SEQ ID NO: 566027 - protein, 10 aa, Mycobacterium
RPGTAAGDVK

SEQ ID NO: 566028 - protein, 14 aa, Mycobacterium
RPGTAARSHEAGRS

SEQ ID NO: 566029 - protein, 6 aa, Mycobacterium
RPGTEG

SEQ ID NO: 566030 - protein, 8 aa, Mycobacterium
RPGTGDQV

SEQ ID NO: 566031 - protein, 5 aa, Mycobacterium
RPGTL

SEQ ID NO: 566032 - protein, 6 aa, Mycobacterium
RPGTLT

SEQ ID NO: 566033 - protein, 13 aa, Mycobacterium
RPGTPAAKLPDQL

SEQ ID NO: 566034 - protein, 5 aa, Mycobacterium
RPGTR

SEQ ID NO: 566035 - protein, 6 aa, Mycobacterium
RPGTRG

SEQ ID NO: 566036 - protein, 11 aa, Mycobacterium
RPGTSSARDDI

SEQ ID NO: 566037 - protein, 8 aa, Mycobacterium
RPGTTAAD

SEQ ID NO: 566038 - protein, 6 aa, Mycobacterium
RPGTYN

SEQ ID NO: 566039 - protein, 13 aa, Mycobacterium
RPGVAAPADSNVS

SEQ ID NO: 566040 - protein, 5 aa, Mycobacterium
RPGVD

SEQ ID NO: 566041 - protein, 13 aa, Mycobacterium
RPGVEPARDGLQR

SEQ ID NO: 566042 - protein, 5 aa, Mycobacterium
RPGVG

SEQ ID NO: 566043 - protein, 9 aa, Mycobacterium
RPGVPAAQV

SEQ ID NO: 566044 - protein, 7 aa, Mycobacterium
RPGVPED

SEQ ID NO: 566045 - protein, 7 aa, Mycobacterium
RPGVSEQ

SEQ ID NO: 566046 - protein, 13 aa, Mycobacterium
RPGVSSGPAAPPE

SEQ ID NO: 566047 - protein, 6 aa, Mycobacterium
RPGVTA

SEQ ID NO: 566048 - protein, 13 aa, Mycobacterium
RPGVTAEQVDAAA

SEQ ID NO: 566049 - protein, 9 aa, Mycobacterium
RPGWQRERQ

SEQ ID NO: 566050 - protein, 6 aa, Mycobacterium
RPGYEP

SEQ ID NO: 566051 - protein, 13 aa, Mycobacterium
RPGYGASAPYPEA

SEQ ID NO: 566052 - protein, 12 aa, Mycobacterium
RPGYGRSTFQEG

SEQ ID NO: 566053 - protein, 8 aa, Mycobacterium
RPGYGSSA

SEQ ID NO: 566054 - protein, 12 aa, Mycobacterium
RPGYGSSAPYPE

SEQ ID NO: 566055 - protein, 20 aa, Mycobacterium
RPGYGSSAPYPEAMAQPEQR

SEQ ID NO: 566056 - protein, 7 aa, Mycobacterium
RPGYQPR

SEQ ID NO: 566057 - protein, 6 aa, Mycobacterium
RPHAGG

SEQ ID NO: 566058 - protein, 10 aa, Mycobacterium
RPHAPKGADW

SEQ ID NO: 566059 - protein, 11 aa, Mycobacterium
RPHAPPAPGGL

SEQ ID NO: 566060 - protein, 9 aa, Mycobacterium
RPHAPQGAD

SEQ ID NO: 566061 - protein, 9 aa, Mycobacterium
RPHAPTGAQ

SEQ ID NO: 566062 - protein, 9 aa, Mycobacterium
RPHAPTGDR

SEQ ID NO: 566063 - protein, 4 aa, Mycobacterium
RPHD

SEQ ID NO: 566064 - protein, 22 aa, Mycobacterium
RPHDGLRDPVTPGKALSPNEKY

SEQ ID NO: 566065 - protein, 8 aa, Mycobacterium
RPHDPSED

SEQ ID NO: 566066 - protein, 13 aa, Mycobacterium
RPHEPAYDPEPDA

SEQ ID NO: 566067 - protein, 4 aa, Mycobacterium
RPHG

SEQ ID NO: 566068 - protein, 10 aa, Mycobacterium
RPHGSPRNTV

SEQ ID NO: 566069 - protein, 7 aa, Mycobacterium
RPHGYDP

SEQ ID NO: 566070 - protein, 4 aa, Mycobacterium
RPHL

SEQ ID NO: 566071 - protein, 11 aa, Mycobacterium
RPHNSSELDEA

SEQ ID NO: 566072 - protein, 16 aa, Mycobacterium
RPHPADPAVAGGTSLN

SEQ ID NO: 566073 - protein, 6 aa, Mycobacterium
RPHPAR

SEQ ID NO: 566074 - protein, 7 aa, Mycobacterium
RPHPDAP

SEQ ID NO: 566075 - protein, 26 aa, Mycobacterium
RPHPEQRADAVGDRRPDDRGSLRAEE

SEQ ID NO: 566076 - protein, 14 aa, Mycobacterium
RPHPERPGTASPNR

SEQ ID NO: 566077 - protein, 12 aa, Mycobacterium
RPHPGQRTSASN

SEQ ID NO: 566078 - protein, 6 aa, Mycobacterium
RPHPRG

SEQ ID NO: 566079 - protein, 6 aa, Mycobacterium
RPHPSP

SEQ ID NO: 566080 - protein, 7 aa, Mycobacterium
RPHPTPL

SEQ ID NO: 566081 - protein, 4 aa, Mycobacterium
RPHQ

SEQ ID NO: 566082 - protein, 4 aa, Mycobacterium
RPHR

SEQ ID NO: 566083 - protein, 11 aa, Mycobacterium
RPHRGSSPASR

SEQ ID NO: 566084 - protein, 5 aa, Mycobacterium
RPHRH

SEQ ID NO: 566085 - protein, 12 aa, Mycobacterium
RPHRHSGGGDHA

SEQ ID NO: 566086 - protein, 5 aa, Mycobacterium
RPHRL

SEQ ID NO: 566087 - protein, 19 aa, Mycobacterium
RPHRPADGARRRDGHLVWD

SEQ ID NO: 566088 - protein, 7 aa, Mycobacterium
RPHRRPD

SEQ ID NO: 566089 - protein, 7 aa, Mycobacterium
RPHRTTG

SEQ ID NO: 566090 - protein, 16 aa, Mycobacterium
RPHRVGGSDLGESPTR

SEQ ID NO: 566091 - protein, 12 aa, Mycobacterium
RPHRVTHRRLTR

SEQ ID NO: 566092 - protein, 5 aa, Mycobacterium
RPHSA

SEQ ID NO: 566093 - protein, 7 aa, Mycobacterium
RPHSAEE

SEQ ID NO: 566094 - protein, 8 aa, Mycobacterium
RPHSAEEA

SEQ ID NO: 566095 - protein, 7 aa, Mycobacterium
RPHSDGT

SEQ ID NO: 566096 - protein, 6 aa, Mycobacterium
RPHSGT

SEQ ID NO: 566097 - protein, 5 aa, Mycobacterium
RPHTA

SEQ ID NO: 566098 - protein, 13 aa, Mycobacterium
RPHTDSSELPDDA

SEQ ID NO: 566099 - protein, 5 aa, Mycobacterium
RPHTE

SEQ ID NO: 566100 - protein, 17 aa, Mycobacterium
RPHTHPQHPGVDEEPDQ

SEQ ID NO: 566101 - protein, 4 aa, Mycobacterium
RPHV

SEQ ID NO: 566102 - protein, 4 aa, Mycobacterium
RPHW

SEQ ID NO: 566103 - protein, 9 aa, Mycobacterium
RPIAEKYSA

SEQ ID NO: 566104 - protein, 16 aa, Mycobacterium
RPIAPRKGAGRVTGRP

SEQ ID NO: 566105 - protein, 11 aa, Mycobacterium
RPIDGSGPARR

SEQ ID NO: 566106 - protein, 5 aa, Mycobacterium
RPIDI

SEQ ID NO: 566107 - protein, 20 aa, Mycobacterium
RPIDNSEPAQRDVLVITFAS

SEQ ID NO: 566108 - protein, 6 aa, Mycobacterium
RPIEDT

SEQ ID NO: 566109 - protein, 5 aa, Mycobacterium
RPIEE

SEQ ID NO: 566110 - protein, 9 aa, Mycobacterium
RPIETSSAE

SEQ ID NO: 566111 - protein, 13 aa, Mycobacterium
RPIGAGRSTRTVN

SEQ ID NO: 566112 - protein, 5 aa, Mycobacterium
RPIGD

SEQ ID NO: 566113 - protein, 16 aa, Mycobacterium
RPIGDSYANGYANSKW

SEQ ID NO: 566114 - protein, 5 aa, Mycobacterium
RPIGE

SEQ ID NO: 566115 - protein, 12 aa, Mycobacterium
RPIGRTPRSNLA

SEQ ID NO: 566116 - protein, 13 aa, Mycobacterium
RPIGRTPRSNLAT

SEQ ID NO: 566117 - protein, 7 aa, Mycobacterium
RPIKSPA

SEQ ID NO: 566118 - protein, 7 aa, Mycobacterium
RPIPGGP

SEQ ID NO: 566119 - protein, 6 aa, Mycobacterium
RPIPNC

SEQ ID NO: 566120 - protein, 15 aa, Mycobacterium
RPIQRRRDKRAEQSV

SEQ ID NO: 566121 - protein, 11 aa, Mycobacterium
RPIRESDATRH

SEQ ID NO: 566122 - protein, 13 aa, Mycobacterium
RPIRNREATPAVR

SEQ ID NO: 566123 - protein, 10 aa, Mycobacterium
RPIRSTDPAR

SEQ ID NO: 566124 - protein, 6 aa, Mycobacterium
RPITAQ

SEQ ID NO: 566125 - protein, 10 aa, Mycobacterium
RPITSGSGRI

SEQ ID NO: 566126 - protein, 9 aa, Mycobacterium
RPKAIRQTG

SEQ ID NO: 566127 - protein, 9 aa, Mycobacterium
RPKAKNAVN

SEQ ID NO: 566128 - protein, 10 aa, Mycobacterium
RPKAKNAVNA

SEQ ID NO: 566129 - protein, 12 aa, Mycobacterium
RPKAKNAVNSAV

SEQ ID NO: 566130 - protein, 8 aa, Mycobacterium
RPKASNGM

SEQ ID NO: 566131 - protein, 11 aa, Mycobacterium
RPKDDEGGGNA

SEQ ID NO: 566132 - protein, 11 aa, Mycobacterium
RPKDEVSDEEY

SEQ ID NO: 566133 - protein, 11 aa, Mycobacterium
RPKDEVSEEEY

SEQ ID NO: 566134 - protein, 30 aa, Mycobacterium
RPKDKPAVGRLTDGSKISESHTGRYPTTEE

SEQ ID NO: 566135 - protein, 5 aa, Mycobacterium
RPKFD

SEQ ID NO: 566136 - protein, 5 aa, Mycobacterium
RPKFR

SEQ ID NO: 566137 - protein, 12 aa, Mycobacterium
RPKGDEGGGNAV

SEQ ID NO: 566138 - protein, 10 aa, Mycobacterium
RPKGSSRDEI

SEQ ID NO: 566139 - protein, 19 aa, Mycobacterium
RPKIEERTTGEVMGESADK

SEQ ID NO: 566140 - protein, 12 aa, Mycobacterium
RPKIGPRRAEAQ

SEQ ID NO: 566141 - protein, 14 aa, Mycobacterium
RPKNPAASGAGPVR

SEQ ID NO: 566142 - protein, 15 aa, Mycobacterium
RPKNPRKLPDGVSQA

SEQ ID NO: 566143 - protein, 7 aa, Mycobacterium
RPKPGEL

SEQ ID NO: 566144 - protein, 14 aa, Mycobacterium
RPKPSSQPAAASLP

SEQ ID NO: 566145 - protein, 14 aa, Mycobacterium
RPKPSVLSELAAAC

SEQ ID NO: 566146 - protein, 11 aa, Mycobacterium
RPKPVQKPHPP

SEQ ID NO: 566147 - protein, 11 aa, Mycobacterium
RPKQGNSDPMS

SEQ ID NO: 566148 - protein, 10 aa, Mycobacterium
RPKQRNAQTR

SEQ ID NO: 566149 - protein, 6 aa, Mycobacterium
RPKQWR

SEQ ID NO: 566150 - protein, 19 aa, Mycobacterium
RPKRKTRTRTARTQPKEDP

SEQ ID NO: 566151 - protein, 8 aa, Mycobacterium
RPKRRPLD

SEQ ID NO: 566152 - protein, 19 aa, Mycobacterium
RPKRRVSTGGGIPGETPVE

SEQ ID NO: 566153 - protein, 9 aa, Mycobacterium
RPKSAADAE

SEQ ID NO: 566154 - protein, 10 aa, Mycobacterium
RPKSKNSLND

SEQ ID NO: 566155 - protein, 14 aa, Mycobacterium
RPKSLRDRLARDQP

SEQ ID NO: 566156 - protein, 9 aa, Mycobacterium
RPKSPADAE

SEQ ID NO: 566157 - protein, 10 aa, Mycobacterium
RPKSPADSEL

SEQ ID NO: 566158 - protein, 9 aa, Mycobacterium
RPKSSGRVR

SEQ ID NO: 566159 - protein, 7 aa, Mycobacterium
RPKTQSN

SEQ ID NO: 566160 - protein, 20 aa, Mycobacterium
RPKVGDLSRNSFPDPAGQDN

SEQ ID NO: 566161 - protein, 14 aa, Mycobacterium
RPKVTTAGASPAEL

SEQ ID NO: 566162 - protein, 8 aa, Mycobacterium
RPLAAGDR

SEQ ID NO: 566163 - protein, 6 aa, Mycobacterium
RPLAER

SEQ ID NO: 566164 - protein, 9 aa, Mycobacterium
RPLAPRGVR

SEQ ID NO: 566165 - protein, 10 aa, Mycobacterium
RPLAPVTTRE

SEQ ID NO: 566166 - protein, 9 aa, Mycobacterium
RPLASRGVR

SEQ ID NO: 566167 - protein, 11 aa, Mycobacterium
RPLASSDSRID

SEQ ID NO: 566168 - protein, 4 aa, Mycobacterium
RPLD

SEQ ID NO: 566169 - protein, 12 aa, Mycobacterium
RPLDDPELSPEH

SEQ ID NO: 566170 - protein, 16 aa, Mycobacterium
RPLDGGYANGYGNSKW

SEQ ID NO: 566171 - protein, 6 aa, Mycobacterium
RPLDKS

SEQ ID NO: 566172 - protein, 5 aa, Mycobacterium
RPLDP

SEQ ID NO: 566173 - protein, 4 aa, Mycobacterium
RPLE

SEQ ID NO: 566174 - protein, 14 aa, Mycobacterium
RPLEPTRGSSVQTA

SEQ ID NO: 566175 - protein, 5 aa, Mycobacterium
RPLGE

SEQ ID NO: 566176 - protein, 5 aa, Mycobacterium
RPLGF

SEQ ID NO: 566177 - protein, 9 aa, Mycobacterium
RPLGGDHQR

SEQ ID NO: 566178 - protein, 12 aa, Mycobacterium
RPLGGKDPGTLG

SEQ ID NO: 566179 - protein, 5 aa, Mycobacterium
RPLGN

SEQ ID NO: 566180 - protein, 7 aa, Mycobacterium
RPLGPLT

SEQ ID NO: 566181 - protein, 6 aa, Mycobacterium
RPLGPN

SEQ ID NO: 566182 - protein, 6 aa, Mycobacterium
RPLGPP

SEQ ID NO: 566183 - protein, 18 aa, Mycobacterium
RPLGSGEVHRSGGPTRRL

SEQ ID NO: 566184 - protein, 6 aa, Mycobacterium
RPLGTG

SEQ ID NO: 566185 - protein, 7 aa, Mycobacterium
RPLGTGD

SEQ ID NO: 566186 - protein, 5 aa, Mycobacterium
RPLGY

SEQ ID NO: 566187 - protein, 6 aa, Mycobacterium
RPLGYD

SEQ ID NO: 566188 - protein, 7 aa, Mycobacterium
RPLGYDD

SEQ ID NO: 566189 - protein, 9 aa, Mycobacterium
RPLGYDDST

SEQ ID NO: 566190 - protein, 4 aa, Mycobacterium
RPLI

SEQ ID NO: 566191 - protein, 39 aa, Mycobacterium
  misc_feature (16)..(19): Xaa can be any naturally occurring amino acid
RPLIGNGANAAAGSGXXXXVAGGAAGLFGNGGAGGAALV

SEQ ID NO: 566192 - protein, 5 aa, Mycobacterium
RPLPA

SEQ ID NO: 566193 - protein, 9 aa, Mycobacterium
RPLPANPGA

SEQ ID NO: 566194 - protein, 7 aa, Mycobacterium
RPLPDEL

SEQ ID NO: 566195 - protein, 11 aa, Mycobacterium
RPLPDSSDWEV

SEQ ID NO: 566196 - protein, 9 aa, Mycobacterium
RPLPEPPVD

SEQ ID NO: 566197 - protein, 5 aa, Mycobacterium
RPLPG

SEQ ID NO: 566198 - protein, 11 aa, Mycobacterium
RPLPGKAERGV

SEQ ID NO: 566199 - protein, 8 aa, Mycobacterium
RPLPHPRT

SEQ ID NO: 566200 - protein, 7 aa, Mycobacterium
RPLPKSG

SEQ ID NO: 566201 - protein, 12 aa, Mycobacterium
RPLPPRGTPDQL

SEQ ID NO: 566202 - protein, 11 aa, Mycobacterium
RPLPRSQDRGD

SEQ ID NO: 566203 - protein, 6 aa, Mycobacterium
RPLPST

SEQ ID NO: 566204 - protein, 6 aa, Mycobacterium
RPLPSV

SEQ ID NO: 566205 - protein, 5 aa, Mycobacterium
RPLPV

SEQ ID NO: 566206 - protein, 13 aa, Mycobacterium
RPLPYGSKGMERI

SEQ ID NO: 566207 - protein, 9 aa, Mycobacterium
RPLQPEADS

SEQ ID NO: 566208 - protein, 5 aa, Mycobacterium
RPLQR

SEQ ID NO: 566209 - protein, 23 aa, Mycobacterium
RPLRDDAGKARRSAVRDEVLARR

SEQ ID NO: 566210 - protein, 5 aa, Mycobacterium
RPLRG

SEQ ID NO: 566211 - protein, 20 aa, Mycobacterium
RPLRGTREVSRSPPCPCTGR

SEQ ID NO: 566212 - protein, 7 aa, Mycobacterium
RPLRPDN

SEQ ID NO: 566213 - protein, 24 aa, Mycobacterium
RPLSAEKVERPQTSYTAKEPDNSI

SEQ ID NO: 566214 - protein, 11 aa, Mycobacterium
RPLSARAQRDA

SEQ ID NO: 566215 - protein, 11 aa, Mycobacterium
RPLSARGNATF

SEQ ID NO: 566216 - protein, 8 aa, Mycobacterium
RPLSDPAS

SEQ ID NO: 566217 - protein, 24 aa, Mycobacterium
RPLSKDAVERPQTSYTAKEPDTSI

SEQ ID NO: 566218 - protein, 8 aa, Mycobacterium
RPLSPDRA

SEQ ID NO: 566219 - protein, 8 aa, Mycobacterium
RPLSPEQA

SEQ ID NO: 566220 - protein, 8 aa, Mycobacterium
RPLSRSRR

SEQ ID NO: 566221 - protein, 6 aa, Mycobacterium
RPLTAQ

SEQ ID NO: 566222 - protein, 11 aa, Mycobacterium
RPLTASYNGYG

SEQ ID NO: 566223 - protein, 11 aa, Mycobacterium
RPLTGDTLQES

SEQ ID NO: 566224 - protein, 6 aa, Mycobacterium
RPLTGL

SEQ ID NO: 566225 - protein, 6 aa, Mycobacterium
RPLTGV

SEQ ID NO: 566226 - protein, 6 aa, Mycobacterium
RPLTPP

SEQ ID NO: 566227 - protein, 7 aa, Mycobacterium
RPLTSPE

SEQ ID NO: 566228 - protein, 5 aa, Mycobacterium
RPLTT

SEQ ID NO: 566229 - protein, 9 aa, Mycobacterium
RPLTTAGTM

SEQ ID NO: 566230 - protein, 7 aa, Mycobacterium
RPMPDDL

SEQ ID NO: 566231 - protein, 14 aa, Mycobacterium
RPMSGTLDTDPAAP

SEQ ID NO: 566232 - protein, 6 aa, Mycobacterium
RPNAEA

SEQ ID NO: 566233 - protein, 5 aa, Mycobacterium
RPNAG

SEQ ID NO: 566234 - protein, 8 aa, Mycobacterium
RPNARENI

SEQ ID NO: 566235 - protein, 10 aa, Mycobacterium
RPNASTKAEL

SEQ ID NO: 566236 - protein, 9 aa, Mycobacterium
RPNATGAAP

SEQ ID NO: 566237 - protein, 138 aa, Mycobacterium
RPNEMGEPNPLKRPDASAAEHTPPSTMPQQEAKQPAAAPQPKPLRPSDGHGLPHSPTESKAPPVDKPATGEPVKPAGAQLGEARAPGAAARGEKELPAQAEHSEQINTPVSAPGPVDGSDLDPTPARPHTSRAAPASA

SEQ ID NO: 566238 - protein, 5 aa, Mycobacterium
RPNGA

SEQ ID NO: 566239 - protein, 7 aa, Mycobacterium
RPNGGAN

SEQ ID NO: 566240 - protein, 36 aa, Mycobacterium
RPNGGMTAAPKQETTRFGDDAGESDADMPEPSPAEL

SEQ ID NO: 566241 - protein, 18 aa, Mycobacterium
RPNGQSPPAPAPLAVVSA

SEQ ID NO: 566242 - protein, 6 aa, Mycobacterium
RPNGTS

SEQ ID NO: 566243 - protein, 8 aa, Mycobacterium
RPNHPDDW

SEQ ID NO: 566244 - protein, 5 aa, Mycobacterium
RPNIV

SEQ ID NO: 566245 - protein, 4 aa, Mycobacterium
RPNP

SEQ ID NO: 566246 - protein, 16 aa, Mycobacterium
RPNPGRTRTQLPLEVR

SEQ ID NO: 566247 - protein, 8 aa, Mycobacterium
RPNQRRKQ

SEQ ID NO: 566248 - protein, 6 aa, Mycobacterium
RPNRPH

SEQ ID NO: 566249 - protein, 9 aa, Mycobacterium
RPNRRAPGG

SEQ ID NO: 566250 - protein, 5 aa, Mycobacterium
RPNRT

SEQ ID NO: 566251 - protein, 23 aa, Mycobacterium
RPNRTGGGQTADPHTPASTTASP

SEQ ID NO: 566252 - protein, 8 aa, Mycobacterium
RPNSGAGQ

SEQ ID NO: 566253 - protein, 6 aa, Mycobacterium
RPNSNT

SEQ ID NO: 566254 - protein, 6 aa, Mycobacterium
RPNSPD

SEQ ID NO: 566255 - protein, 8 aa, Mycobacterium
RPNTAPTI

SEQ ID NO: 566256 - protein, 11 aa, Mycobacterium
RPNTGKSTLTN

SEQ ID NO: 566257 - protein, 8 aa, Mycobacterium
RPNTGSLR

SEQ ID NO: 566258 - protein, 19 aa, Mycobacterium
RPNTHQPPTQDTDETSPLG

SEQ ID NO: 566259 - protein, 5 aa, Mycobacterium
RPPAA

SEQ ID NO: 566260 - protein, 24 aa, Mycobacterium
RPPAARGPAAPRRSRAPAAATRRN

SEQ ID NO: 566261 - protein, 9 aa, Mycobacterium
RPPADTVPT

SEQ ID NO: 566262 - protein, 12 aa, Mycobacterium
RPPAEGVGEMTE

SEQ ID NO: 566263 - protein, 6 aa, Mycobacterium
RPPAEI

SEQ ID NO: 566264 - protein, 13 aa, Mycobacterium
RPPAGAGNDRANQ

SEQ ID NO: 566265 - protein, 13 aa, Mycobacterium
RPPAGAPSQSAAL

SEQ ID NO: 566266 - protein, 30 aa, Mycobacterium
RPPAGASADGPLLTDGDTIGLDSTTAAATV

SEQ ID NO: 566267 - protein, 14 aa, Mycobacterium
RPPAGPIAEGANDM

SEQ ID NO: 566268 - protein, 8 aa, Mycobacterium
RPPAGRVR

SEQ ID NO: 566269 - protein, 9 aa, Mycobacterium
RPPAGSPTQ

SEQ ID NO: 566270 - protein, 10 aa, Mycobacterium
RPPAGSPTRA

SEQ ID NO: 566271 - protein, 5 aa, Mycobacterium
RPPAL

SEQ ID NO: 566272 - protein, 9 aa, Mycobacterium
RPPANGDGV

SEQ ID NO: 566273 - protein, 8 aa, Mycobacterium
RPPAPDRV

SEQ ID NO: 566274 - protein, 14 aa, Mycobacterium
RPPASDGDAAATRQ

SEQ ID NO: 566275 - protein, 6 aa, Mycobacterium
RPPATI

SEQ ID NO: 566276 - protein, 13 aa, Mycobacterium
RPPATKSDETRRR

SEQ ID NO: 566277 - protein, 14 aa, Mycobacterium
RPPAVTAPDGATGR

SEQ ID NO: 566278 - protein, 4 aa, Mycobacterium
RPPD

SEQ ID NO: 566279 - protein, 8 aa, Mycobacterium
RPPDGVPE

SEQ ID NO: 566280 - protein, 7 aa, Mycobacterium
RPPDGYR

SEQ ID NO: 566281 - protein, 6 aa, Mycobacterium
RPPDLD

SEQ ID NO: 566282 - protein, 7 aa, Mycobacterium
RPPDSDR

SEQ ID NO: 566283 - protein, 13 aa, Mycobacterium
RPPDSRAPSTPWP

SEQ ID NO: 566284 - protein, 22 aa, Mycobacterium
RPPDSTQPATQPTTQPEVRATT

SEQ ID NO: 566285 - protein, 4 aa, Mycobacterium
RPPE

SEQ ID NO: 566286 - protein, 14 aa, Mycobacterium
RPPEAGVWHGEDFS

SEQ ID NO: 566287 - protein, 13 aa, Mycobacterium
RPPEARAASTPWP

SEQ ID NO: 566288 - protein, 6 aa, Mycobacterium
RPPEGD

SEQ ID NO: 566289 - protein, 6 aa, Mycobacterium
RPPEIR

SEQ ID NO: 566290 - protein, 8 aa, Mycobacterium
RPPEPKQI

SEQ ID NO: 566291 - protein, 23 aa, Mycobacterium
RPPESPCDPPGAACPSENGVPHG

SEQ ID NO: 566292 - protein, 13 aa, Mycobacterium
RPPETRAESTPWP

SEQ ID NO: 566293 - protein, 13 aa, Mycobacterium
RPPETRAPSTPWP

SEQ ID NO: 566294 - protein, 5 aa, Mycobacterium
RPPEY

SEQ ID NO: 566295 - protein, 5 aa, Mycobacterium
RPPFE

SEQ ID NO: 566296 - protein, 7 aa, Mycobacterium
RPPGADR

SEQ ID NO: 566297 - protein, 10 aa, Mycobacterium
RPPGAGLPAR

SEQ ID NO: 566298 - protein, 10 aa, Mycobacterium
RPPGAPKDHA

SEQ ID NO: 566299 - protein, 7 aa, Mycobacterium
RPPGDVA

SEQ ID NO: 566300 - protein, 9 aa, Mycobacterium
RPPGEGSDV

SEQ ID NO: 566301 - protein, 13 aa, Mycobacterium
RPPGGGKFGAYDD

SEQ ID NO: 566302 - protein, 9 aa, Mycobacterium
RPPGGRREL

SEQ ID NO: 566303 - protein, 7 aa, Mycobacterium
RPPGHEY

SEQ ID NO: 566304 - protein, 19 aa, Mycobacterium
RPPGHFDPDGRRDYLDRIG

SEQ ID NO: 566305 - protein, 8 aa, Mycobacterium
RPPGIPFD

SEQ ID NO: 566306 - protein, 7 aa, Mycobacterium
RPPGKSL

SEQ ID NO: 566307 - protein, 8 aa, Mycobacterium
RPPGPQED

SEQ ID NO: 566308 - protein, 15 aa, Mycobacterium
RPPGQPQPGLTAAPP

SEQ ID NO: 566309 - protein, 8 aa, Mycobacterium
RPPGQTKA

SEQ ID NO: 566310 - protein, 6 aa, Mycobacterium
RPPGRA

SEQ ID NO: 566311 - protein, 22 aa, Mycobacterium
RPPGRPAAHRAGSRAATGLDRR

SEQ ID NO: 566312 - protein, 9 aa, Mycobacterium
RPPGRVGRR

SEQ ID NO: 566313 - protein, 12 aa, Mycobacterium
RPPGRYQRSDGQ

SEQ ID NO: 566314 - protein, 7 aa, Mycobacterium
RPPGSAP

SEQ ID NO: 566315 - protein, 8 aa, Mycobacterium
RPPGSGPF

SEQ ID NO: 566316 - protein, 6 aa, Mycobacterium
RPPGTW

SEQ ID NO: 566317 - protein, 4 aa, Mycobacterium
RPPH

SEQ ID NO: 566318 - protein, 8 aa, Mycobacterium
RPPHQLET

SEQ ID NO: 566319 - protein, 12 aa, Mycobacterium
RPPHSDPAPPAV

SEQ ID NO: 566320 - protein, 4 aa, Mycobacterium
RPPI

SEQ ID NO: 566321 - protein, 12 aa, Mycobacterium
RPPIEKAQTTSY

SEQ ID NO: 566322 - protein, 12 aa, Mycobacterium
RPPIGGELAGQS

SEQ ID NO: 566323 - protein, 9 aa, Mycobacterium
RPPKEGSNA

SEQ ID NO: 566324 - protein, 4 aa, Mycobacterium
RPPL

SEQ ID NO: 566325 - protein, 6 aa, Mycobacterium
RPPLGD

SEQ ID NO: 566326 - protein, 14 aa, Mycobacterium
RPPLPRFPEDGQLR

SEQ ID NO: 566327 - protein, 6 aa, Mycobacterium
RPPLTR

SEQ ID NO: 566328 - protein, 6 aa, Mycobacterium
RPPLTV

SEQ ID NO: 566329 - protein, 7 aa, Mycobacterium
RPPMQPG

SEQ ID NO: 566330 - protein, 6 aa, Mycobacterium
RPPNFT

SEQ ID NO: 566331 - protein, 15 aa, Mycobacterium
RPPPAPSSGQFRTDD

SEQ ID NO: 566332 - protein, 12 aa, Mycobacterium
RPPPDSPTAGFA

SEQ ID NO: 566333 - protein, 25 aa, Mycobacterium
RPPPNSPASTYPKRGGSLADPVSGW

SEQ ID NO: 566334 - protein, 7 aa, Mycobacterium
RPPPPLT

SEQ ID NO: 566335 - protein, 7 aa, Mycobacterium
RPPPPPP

SEQ ID NO: 566336 - protein, 8 aa, Mycobacterium
RPPPPQRF

SEQ ID NO: 566337 - protein, 11 aa, Mycobacterium
RPPPPQRYPLS

SEQ ID NO: 566338 - protein, 7 aa, Mycobacterium
RPPPRPD

SEQ ID NO: 566339 - protein, 9 aa, Mycobacterium
RPPPTLGEH

SEQ ID NO: 566340 - protein, 6 aa, Mycobacterium
RPPPYP

SEQ ID NO: 566341 - protein, 4 aa, Mycobacterium
RPPQ

SEQ ID NO: 566342 - protein, 12 aa, Mycobacterium
RPPQFPSLTSSE

SEQ ID NO: 566343 - protein, 7 aa, Mycobacterium
RPPQGAP

SEQ ID NO: 566344 - protein, 15 aa, Mycobacterium
RPPQHPRPTSNDTMR

SEQ ID NO: 566345 - protein, 8 aa, Mycobacterium
RPPQPVKP

SEQ ID NO: 566346 - protein, 54 aa, Mycobacterium
RPPQTTPPTNDQQRSSTSRRSPPPGETTRTRTPPPRAPHPTPPTTSTACGASEP

SEQ ID NO: 566347 - protein, 4 aa, Mycobacterium
RPPR

SEQ ID NO: 566348 - protein, 5 aa, Mycobacterium
RPPRA

SEQ ID NO: 566349 - protein, 11 aa, Mycobacterium
RPPRASSDEHP

SEQ ID NO: 566350 - protein, 10 aa, Mycobacterium
RPPRDDDPSD

SEQ ID NO: 566351 - protein, 20 aa, Mycobacterium
RPPRITSDGGQSGQATAVAQ

SEQ ID NO: 566352 - protein, 14 aa, Mycobacterium
RPPRPESNGGGSSL

SEQ ID NO: 566353 - protein, 14 aa, Mycobacterium
RPPRPRPAERRASD

SEQ ID NO: 566354 - protein, 37 aa, Mycobacterium
RPPRPTFDADPQAAGEGRPPESGSAVVEDPDTAPPTA

SEQ ID NO: 566355 - protein, 26 aa, Mycobacterium
RPPRPVDTERPVRSITSGPRGYEGEG

SEQ ID NO: 566356 - protein, 7 aa, Mycobacterium
RPPRRGV

SEQ ID NO: 566357 - protein, 7 aa, Mycobacterium
RPPRSAY

SEQ ID NO: 566358 - protein, 10 aa, Mycobacterium
RPPRTEDGSG

SEQ ID NO: 566359 - protein, 10 aa, Mycobacterium
RPPRTPADRH

SEQ ID NO: 566360 - protein, 9 aa, Mycobacterium
RPPRVPPDR

SEQ ID NO: 566361 - protein, 4 aa, Mycobacterium
RPPS

SEQ ID NO: 566362 - protein, 7 aa, Mycobacterium
RPPSADP

SEQ ID NO: 566363 - protein, 10 aa, Mycobacterium
RPPSARAQRD

SEQ ID NO: 566364 - protein, 15 aa, Mycobacterium
RPPSFPPLSTQKEET

SEQ ID NO: 566365 - protein, 7 aa, Mycobacterium
RPPSFTS

SEQ ID NO: 566366 - protein, 7 aa, Mycobacterium
RPPSGPG

SEQ ID NO: 566367 - protein, 7 aa, Mycobacterium
RPPSHDY

SEQ ID NO: 566368 - protein, 10 aa, Mycobacterium
RPPSPTGNLQ

SEQ ID NO: 566369 - protein, 7 aa, Mycobacterium
RPPSTAI

SEQ ID NO: 566370 - protein, 7 aa, Mycobacterium
RPPSVDT

SEQ ID NO: 566371 - protein, 12 aa, Mycobacterium
RPPSWVKADPAS

SEQ ID NO: 566372 - protein, 8 aa, Mycobacterium
RPPTAEGV

SEQ ID NO: 566373 - protein, 9 aa, Mycobacterium
RPPTATPTG

SEQ ID NO: 566374 - protein, 7 aa, Mycobacterium
RPPTDDE

SEQ ID NO: 566375 - protein, 6 aa, Mycobacterium
RPPTDF

SEQ ID NO: 566376 - protein, 7 aa, Mycobacterium
RPPTEQS

SEQ ID NO: 566377 - protein, 6 aa, Mycobacterium
RPPTPV

SEQ ID NO: 566378 - protein, 6 aa, Mycobacterium
RPPTRV

SEQ ID NO: 566379 - protein, 18 aa, Mycobacterium
RPPTSPVNQHRRSTTSSK

SEQ ID NO: 566380 - protein, 5 aa, Mycobacterium
RPPVG

SEQ ID NO: 566381 - protein, 16 aa, Mycobacterium
RPPVHRNAGAGPSADG

SEQ ID NO: 566382 - protein, 5 aa, Mycobacterium
RPPVL

SEQ ID NO: 566383 - protein, 6 aa, Mycobacterium
RPPVPV

SEQ ID NO: 566384 - protein, 12 aa, Mycobacterium
RPPVQAPTQPAR

SEQ ID NO: 566385 - protein, 5 aa, Mycobacterium
RPPVS

SEQ ID NO: 566386 - protein, 5 aa, Mycobacterium
RPPVT

SEQ ID NO: 566387 - protein, 7 aa, Mycobacterium
RPPWPPL

SEQ ID NO: 566388 - protein, 6 aa, Mycobacterium
RPPYGH

SEQ ID NO: 566389 - protein, 11 aa, Mycobacterium
RPQAPEPTGDA

SEQ ID NO: 566390 - protein, 8 aa, Mycobacterium
RPQAQASI

SEQ ID NO: 566391 - protein, 9 aa, Mycobacterium
RPQARNALS

SEQ ID NO: 566392 - protein, 42 aa, Mycobacterium
RPQASGQPTESPAEVSEESSTESPVEAPAEAPAESPVETPAE

SEQ ID NO: 566393 - protein, 7 aa, Mycobacterium
RPQATAA

SEQ ID NO: 566394 - protein, 4 aa, Mycobacterium
RPQD

SEQ ID NO: 566395 - protein, 7 aa, Mycobacterium
RPQDGWT

SEQ ID NO: 566396 - protein, 6 aa, Mycobacterium
RPQDTA

SEQ ID NO: 566397 - protein, 10 aa, Mycobacterium
RPQDTEGQPA

SEQ ID NO: 566398 - protein, 13 aa, Mycobacterium
RPQEELDESSRAA

SEQ ID NO: 566399 - protein, 7 aa, Mycobacterium
RPQEGRA

SEQ ID NO: 566400 - protein, 18 aa, Mycobacterium
RPQEGRTATLSRTAKPDA

SEQ ID NO: 566401 - protein, 18 aa, Mycobacterium
RPQEGRTATLSRTSRPDA

SEQ ID NO: 566402 - protein, 19 aa, Mycobacterium
RPQEGTTATLSRTARPDAR

SEQ ID NO: 566403 - protein, 9 aa, Mycobacterium
RPQETAATL

SEQ ID NO: 566404 - protein, 5 aa, Mycobacterium
RPQFA

SEQ ID NO: 566405 - protein, 4 aa, Mycobacterium
RPQG

SEQ ID NO: 566406 - protein, 8 aa, Mycobacterium
RPQGGWTP

SEQ ID NO: 566407 - protein, 6 aa, Mycobacterium
RPQGQA

SEQ ID NO: 566408 - protein, 4 aa, Mycobacterium
RPQH

SEQ ID NO: 566409 - protein, 20 aa, Mycobacterium
RPQHDQAPPARQRATEDSLR

SEQ ID NO: 566410 - protein, 12 aa, Mycobacterium
RPQIQEPHYPVQ

SEQ ID NO: 566411 - protein, 8 aa, Mycobacterium
RPQKRNSF

SEQ ID NO: 566412 - protein, 7 aa, Mycobacterium
RPQLPTG

SEQ ID NO: 566413 - protein, 22 aa, Mycobacterium
RPQLQPEPGEPADTCADATAPK

SEQ ID NO: 566414 - protein, 5 aa, Mycobacterium
RPQNL

SEQ ID NO: 566415 - protein, 10 aa, Mycobacterium
RPQPAGRDWP

SEQ ID NO: 566416 - protein, 8 aa, Mycobacterium
RPQPDTLD

SEQ ID NO: 566417 - protein, 9 aa, Mycobacterium
RPQPEPGHG

SEQ ID NO: 566418 - protein, 10 aa, Mycobacterium
RPQPGAEPLR

SEQ ID NO: 566419 - protein, 7 aa, Mycobacterium
RPQPGIE

SEQ ID NO: 566420 - protein, 11 aa, Mycobacterium
RPQPGPPSSTV

SEQ ID NO: 566421 - protein, 12 aa, Mycobacterium
RPQPGQTEGGGP

SEQ ID NO: 566422 - protein, 7 aa, Mycobacterium
RPQPQGL

SEQ ID NO: 566423 - protein, 15 aa, Mycobacterium
RPQPRPQSSRVLPPG

SEQ ID NO: 566424 - protein, 8 aa, Mycobacterium
RPQQETQA

SEQ ID NO: 566425 - protein, 10 aa, Mycobacterium
RPQQSAGHSG

SEQ ID NO: 566426 - protein, 8 aa, Mycobacterium
RPQRAAPG

SEQ ID NO: 566427 - protein, 6 aa, Mycobacterium
RPQRDR

SEQ ID NO: 566428 - protein, 16 aa, Mycobacterium
RPQRRGAARGVYGIAG

SEQ ID NO: 566429 - protein, 8 aa, Mycobacterium
RPQRRGQQ

SEQ ID NO: 566430 - protein, 8 aa, Mycobacterium
RPQRRNAY

SEQ ID NO: 566431 - protein, 5 aa, Mycobacterium
RPQRV

SEQ ID NO: 566432 - protein, 4 aa, Mycobacterium
RPQS

SEQ ID NO: 566433 - protein, 7 aa, Mycobacterium
RPQSDIP

SEQ ID NO: 566434 - protein, 13 aa, Mycobacterium
RPQSKGKEVADQI

SEQ ID NO: 566435 - protein, 13 aa, Mycobacterium
RPQSKGQEVADSI

SEQ ID NO: 566436 - protein, 8 aa, Mycobacterium
RPQSREDL

SEQ ID NO: 566437 - protein, 8 aa, Mycobacterium
RPQSRNAL

SEQ ID NO: 566438 - protein, 5 aa, Mycobacterium
RPQST

SEQ ID NO: 566439 - protein, 4 aa, Mycobacterium
RPQT

SEQ ID NO: 566440 - protein, 6 aa, Mycobacterium
RPQTGA

SEQ ID NO: 566441 - protein, 6 aa, Mycobacterium
RPQTGT

SEQ ID NO: 566442 - protein, 5 aa, Mycobacterium
RPQTR

SEQ ID NO: 566443 - protein, 6 aa, Mycobacterium
RPQTRE

SEQ ID NO: 566444 - protein, 13 aa, Mycobacterium
RPQTVDENSRKRY

SEQ ID NO: 566445 - protein, 4 aa, Mycobacterium
RPQV

SEQ ID NO: 566446 - protein, 7 aa, Mycobacterium
RPQVSGE

SEQ ID NO: 566447 - protein, 5 aa, Mycobacterium
RPQVT

SEQ ID NO: 566448 - protein, 12 aa, Mycobacterium
RPQYRSDPSQNI

SEQ ID NO: 566449 - protein, 5 aa, Mycobacterium
RPRAA

SEQ ID NO: 566450 - protein, 8 aa, Mycobacterium
RPRAAHGV

SEQ ID NO: 566451 - protein, 9 aa, Mycobacterium
RPRADAPGE

SEQ ID NO: 566452 - protein, 7 aa, Mycobacterium
RPRADGG

SEQ ID NO: 566453 - protein, 8 aa, Mycobacterium
RPRAESSI

SEQ ID NO: 566454 - protein, 5 aa, Mycobacterium
RPRAG

SEQ ID NO: 566455 - protein, 7 aa, Mycobacterium
RPRAGKV

SEQ ID NO: 566456 - protein, 6 aa, Mycobacterium
RPRAGR

SEQ ID NO: 566457 - protein, 7 aa, Mycobacterium
RPRAGSS

SEQ ID NO: 566458 - protein, 9 aa, Mycobacterium
RPRANSADE

SEQ ID NO: 566459 - protein, 14 aa, Mycobacterium
RPRAQSRGTATQLP

SEQ ID NO: 566460 - protein, 15 aa, Mycobacterium
RPRAQSRGTATQLPQ

SEQ ID NO: 566461 - protein, 4 aa, Mycobacterium
RPRD

SEQ ID NO: 566462 - protein, 8 aa, Mycobacterium
RPRDDEPV

SEQ ID NO: 566463 - protein, 6 aa, Mycobacterium
RPRDEL

SEQ ID NO: 566464 - protein, 8 aa, Mycobacterium
RPRDELAR

SEQ ID NO: 566465 - protein, 9 aa, Mycobacterium
RPRDELARD

SEQ ID NO: 566466 - protein, 9 aa, Mycobacterium
RPRDELARE

SEQ ID NO: 566467 - protein, 9 aa, Mycobacterium
RPRDELPKA

SEQ ID NO: 566468 - protein, 8 aa, Mycobacterium
RPRDPAEK

SEQ ID NO: 566469 - protein, 7 aa, Mycobacterium
RPRDPAV

SEQ ID NO: 566470 - protein, 8 aa, Mycobacterium
RPRDRATA

SEQ ID NO: 566471 - protein, 13 aa, Mycobacterium
RPRDSPTASEGSV

SEQ ID NO: 566472 - protein, 5 aa, Mycobacterium
RPRDV

SEQ ID NO: 566473 - protein, 4 aa, Mycobacterium
RPRE

SEQ ID NO: 566474 - protein, 12 aa, Mycobacterium
RPREAARPPYGL

SEQ ID NO: 566475 - protein, 6 aa, Mycobacterium
RPREDS

SEQ ID NO: 566476 - protein, 5 aa, Mycobacterium
RPREE

SEQ ID NO: 566477 - protein, 5 aa, Mycobacterium
RPRER

SEQ ID NO: 566478 - protein, 6 aa, Mycobacterium
RPRERS

SEQ ID NO: 566479 - protein, 6 aa, Mycobacterium
RPRGAA

SEQ ID NO: 566480 - protein, 6 aa, Mycobacterium
RPRGAQ

SEQ ID NO: 566481 - protein, 26 aa, Mycobacterium
RPRGARVATPQQRRPYRPLRRPNSDS

SEQ ID NO: 566482 - protein, 27 aa, Mycobacterium
RPRGARVATPQQRRPYRPMPRPNSESL

SEQ ID NO: 566483 - protein, 5 aa, Mycobacterium
RPRGG

SEQ ID NO: 566484 - protein, 6 aa, Mycobacterium
RPRGGR

SEQ ID NO: 566485 - protein, 7 aa, Mycobacterium
RPRGGRP

SEQ ID NO: 566486 - protein, 5 aa, Mycobacterium
RPRGL

SEQ ID NO: 566487 - protein, 8 aa, Mycobacterium
RPRGNLSQ

SEQ ID NO: 566488 - protein, 8 aa, Mycobacterium
RPRGPGME

SEQ ID NO: 566489 - protein, 6 aa, Mycobacterium
RPRGPV

SEQ ID NO: 566490 - protein, 7 aa, Mycobacterium
RPRGRGE

SEQ ID NO: 566491 - protein, 12 aa, Mycobacterium
RPRGRHGPVRRR

SEQ ID NO: 566492 - protein, 12 aa, Mycobacterium
RPRGRPRKDGVA

SEQ ID NO: 566493 - protein, 15 aa, Mycobacterium
RPRGRRGTSRGTAKV

SEQ ID NO: 566494 - protein, 24 aa, Mycobacterium
RPRGRTPGRRRPVRDPRDRSHPCG

SEQ ID NO: 566495 - protein, 5 aa, Mycobacterium
RPRGS

SEQ ID NO: 566496 - protein, 7 aa, Mycobacterium
RPRGSTV

SEQ ID NO: 566497 - protein, 15 aa, Mycobacterium
RPRHRSGRRAHLTQH

SEQ ID NO: 566498 - protein, 5 aa, Mycobacterium
RPRIA

SEQ ID NO: 566499 - protein, 6 aa, Mycobacterium
RPRIER

SEQ ID NO: 566500 - protein, 21 aa, Mycobacterium
RPRKGDHGRGAEQDIRPAGQR

SEQ ID NO: 566501 - protein, 4 aa, Mycobacterium
RPRL

SEQ ID NO: 566502 - protein, 6 aa, Mycobacterium
RPRLDG

SEQ ID NO: 566503 - protein, 7 aa, Mycobacterium
RPRLTDE

SEQ ID NO: 566504 - protein, 4 aa, Mycobacterium
RPRM

SEQ ID NO: 566505 - protein, 7 aa, Mycobacterium
RPRNPDT

SEQ ID NO: 566506 - protein, 8 aa, Mycobacterium
RPRNPRSI

SEQ ID NO: 566507 - protein, 11 aa, Mycobacterium
RPRNPSDDLEE

SEQ ID NO: 566508 - protein, 7 aa, Mycobacterium
RPRNQSS

SEQ ID NO: 566509 - protein, 16 aa, Mycobacterium
RPRPAEAAQHRAEVVQ

SEQ ID NO: 566510 - protein, 13 aa, Mycobacterium
RPRPAFTPARPDE

SEQ ID NO: 566511 - protein, 7 aa, Mycobacterium
RPRPARP

SEQ ID NO: 566512 - protein, 6 aa, Mycobacterium
RPRPAW

SEQ ID NO: 566513 - protein, 10 aa, Mycobacterium
RPRPDAEPGT

SEQ ID NO: 566514 - protein, 6 aa, Mycobacterium
RPRPDR

SEQ ID NO: 566515 - protein, 11 aa, Mycobacterium
RPRPEPDGRVA

SEQ ID NO: 566516 - protein, 7 aa, Mycobacterium
RPRPERR

SEQ ID NO: 566517 - protein, 8 aa, Mycobacterium
RPRPFAPS

SEQ ID NO: 566518 - protein, 28 aa, Mycobacterium
RPRPFDRSGRDLETRQPLPKTARYPAGP

SEQ ID NO: 566519 - protein, 11 aa, Mycobacterium
RPRPGLTDADR

SEQ ID NO: 566520 - protein, 8 aa, Mycobacterium
RPRPHRPD

SEQ ID NO: 566521 - protein, 22 aa, Mycobacterium
RPRPLSRHRRADDLYTLNCEEP

SEQ ID NO: 566522 - protein, 7 aa, Mycobacterium
RPRPLTR

SEQ ID NO: 566523 - protein, 9 aa, Mycobacterium
RPRPNGPVQ

SEQ ID NO: 566524 - protein, 9 aa, Mycobacterium
RPRPRPLTR

SEQ ID NO: 566525 - protein, 8 aa, Mycobacterium
RPRPRRMT

SEQ ID NO: 566526 - protein, 19 aa, Mycobacterium
RPRPRRRQAIGGQDRHHAA

SEQ ID NO: 566527 - protein, 22 aa, Mycobacterium
RPRPSGQDHSAAPEGVEGEFDD

SEQ ID NO: 566528 - protein, 13 aa, Mycobacterium
RPRPVDGPGGKGE

SEQ ID NO: 566529 - protein, 15 aa, Mycobacterium
RPRPVPQRKEGTNDR

SEQ ID NO: 566530 - protein, 7 aa, Mycobacterium
RPRQAND

SEQ ID NO: 566531 - protein, 7 aa, Mycobacterium
RPRQIPG

SEQ ID NO: 566532 - protein, 9 aa, Mycobacterium
RPRQLSGGQ

SEQ ID NO: 566533 - protein, 11 aa, Mycobacterium
RPRQLTADEET

SEQ ID NO: 566534 - protein, 10 aa, Mycobacterium
RPRQPQGDDI

SEQ ID NO: 566535 - protein, 23 aa, Mycobacterium
RPRQRGAAGVNRARIGGLIGLIE

SEQ ID NO: 566536 - protein, 58 aa, Mycobacterium
RPRRAASNRASNNQRGNRSFDPRSRDRRPPRSSGPGRARPAQPESAEDSQDSAPRLSA

SEQ ID NO: 566537 - protein, 6 aa, Mycobacterium
RPRRAG

SEQ ID NO: 566538 - protein, 7 aa, Mycobacterium
RPRRAGV

SEQ ID NO: 566539 - protein, 9 aa, Mycobacterium
RPRRDYGRY

SEQ ID NO: 566540 - protein, 5 aa, Mycobacterium
RPRRH

SEQ ID NO: 566541 - protein, 25 aa, Mycobacterium
RPRRHQPDSAADDPEARDRRTPAQR

SEQ ID NO: 566542 - protein, 7 aa, Mycobacterium
RPRRPGS

SEQ ID NO: 566543 - protein, 10 aa, Mycobacterium
RPRRQEPTGC

SEQ ID NO: 566544 - protein, 25 aa, Mycobacterium
RPRRRGPQQRTSRPPTLYRPPSRPE

SEQ ID NO: 566545 - protein, 10 aa, Mycobacterium
RPRRRNAYTA

SEQ ID NO: 566546 - protein, 15 aa, Mycobacterium
RPRRRQTFRGRPEPG

SEQ ID NO: 566547 - protein, 15 aa, Mycobacterium
RPRRSLTGPPVPPEL

SEQ ID NO: 566548 - protein, 7 aa, Mycobacterium
RPRSAKQ

SEQ ID NO: 566549 - protein, 6 aa, Mycobacterium
RPRSDA

SEQ ID NO: 566550 - protein, 9 aa, Mycobacterium
RPRSDAEIR

SEQ ID NO: 566551 - protein, 7 aa, Mycobacterium
RPRSEQD

SEQ ID NO: 566552 - protein, 14 aa, Mycobacterium
RPRSNGCSYADSPH

SEQ ID NO: 566553 - protein, 10 aa, Mycobacterium
RPRSPQQSYR

SEQ ID NO: 566554 - protein, 7 aa, Mycobacterium
RPRSSKV

SEQ ID NO: 566555 - protein, 12 aa, Mycobacterium
RPRSTADERTTH

SEQ ID NO: 566556 - protein, 6 aa, Mycobacterium
RPRSVV

SEQ ID NO: 566557 - protein, 5 aa, Mycobacterium
RPRTD

SEQ ID NO: 566558 - protein, 19 aa, Mycobacterium
RPRTEPDAPEVIEAIEKVV

SEQ ID NO: 566559 - protein, 10 aa, Mycobacterium
RPRTGQDPAV

SEQ ID NO: 566560 - protein, 9 aa, Mycobacterium
RPRTKGMER

SEQ ID NO: 566561 - protein, 10 aa, Mycobacterium
RPRTLDETDR

SEQ ID NO: 566562 - protein, 8 aa, Mycobacterium
RPRTNEPP

SEQ ID NO: 566563 - protein, 12 aa, Mycobacterium
RPRTSEDKTFRH

SEQ ID NO: 566564 - protein, 9 aa, Mycobacterium
RPRTTPDDP

SEQ ID NO: 566565 - protein, 4 aa, Mycobacterium
RPRV

SEQ ID NO: 566566 - protein, 16 aa, Mycobacterium
RPRVDDAGPPAPPDDA

SEQ ID NO: 566567 - protein, 5 aa, Mycobacterium
RPRYD

SEQ ID NO: 566568 - protein, 4 aa, Mycobacterium
RPSA

SEQ ID NO: 566569 - protein, 8 aa, Mycobacterium
RPSAAAAA

SEQ ID NO: 566570 - protein, 59 aa, Mycobacterium
RPSAAAPKPEPKPEPKPEPKPEPKPEPKAEPAPAPEPPPAPAPAPSPAAETSSAPGELN

SEQ ID NO: 566571 - protein, 9 aa, Mycobacterium
RPSAAASAA

SEQ ID NO: 566572 - protein, 13 aa, Mycobacterium
RPSAADPAIPAQD

SEQ ID NO: 566573 - protein, 18 aa, Mycobacterium
RPSAAVAEPTHHEPDAGG

SEQ ID NO: 566574 - protein, 6 aa, Mycobacterium
RPSADS

SEQ ID NO: 566575 - protein, 5 aa, Mycobacterium
RPSAE

SEQ ID NO: 566576 - protein, 9 aa, Mycobacterium
RPSAGPGVP

SEQ ID NO: 566577 - protein, 25 aa, Mycobacterium
RPSARSPQSQDSATTHIGFRCAASP

SEQ ID NO: 566578 - protein, 11 aa, Mycobacterium
RPSATAVPPRR

SEQ ID NO: 566579 - protein, 6 aa, Mycobacterium
RPSATT

SEQ ID NO: 566580 - protein, 22 aa, Mycobacterium
RPSCPSQPSSTPRTTTENRSDA

SEQ ID NO: 566581 - protein, 4 aa, Mycobacterium
RPSD

SEQ ID NO: 566582 - protein, 6 aa, Mycobacterium
RPSDAE

SEQ ID NO: 566583 - protein, 12 aa, Mycobacterium
RPSDGAAGLPAP

SEQ ID NO: 566584 - protein, 10 aa, Mycobacterium
RPSDGQREIT

SEQ ID NO: 566585 - protein, 13 aa, Mycobacterium
RPSDKDSDKSPRV

SEQ ID NO: 566586 - protein, 8 aa, Mycobacterium
RPSDLAER

SEQ ID NO: 566587 - protein, 13 aa, Mycobacterium
RPSDLEGADANLH

SEQ ID NO: 566588 - protein, 4 aa, Mycobacterium
RPSE

SEQ ID NO: 566589 - protein, 5 aa, Mycobacterium
RPSEI

SEQ ID NO: 566590 - protein, 7 aa, Mycobacterium
RPSEIRS

SEQ ID NO: 566591 - protein, 4 aa, Mycobacterium
RPSF

SEQ ID NO: 566592 - protein, 6 aa, Mycobacterium
RPSFSN

SEQ ID NO: 566593 - protein, 6 aa, Mycobacterium
RPSGGG

SEQ ID NO: 566594 - protein, 9 aa, Mycobacterium
RPSGPLERD

SEQ ID NO: 566595 - protein, 12 aa, Mycobacterium
RPSGPRPTEPVD

SEQ ID NO: 566596 - protein, 9 aa, Mycobacterium
RPSGPTAEV

SEQ ID NO: 566597 - protein, 10 aa, Mycobacterium
RPSGPTQTGS

SEQ ID NO: 566598 - protein, 6 aa, Mycobacterium
RPSGQH

SEQ ID NO: 566599 - protein, 7 aa, Mycobacterium
RPSGRGA

SEQ ID NO: 566600 - protein, 6 aa, Mycobacterium
RPSGRH

SEQ ID NO: 566601 - protein, 7 aa, Mycobacterium
RPSGRLT

SEQ ID NO: 566602 - protein, 19 aa, Mycobacterium
RPSGTDPSSHPTSDEISEG

SEQ ID NO: 566603 - protein, 14 aa, Mycobacterium
RPSGTDPSTHPSSD

SEQ ID NO: 566604 - protein, 4 aa, Mycobacterium
RPSH

SEQ ID NO: 566605 - protein, 10 aa, Mycobacterium
RPSHASASGT

SEQ ID NO: 566606 - protein, 5 aa, Mycobacterium
RPSHG

SEQ ID NO: 566607 - protein, 4 aa, Mycobacterium
RPSI

SEQ ID NO: 566608 - protein, 9 aa, Mycobacterium
RPSKAAMEP

SEQ ID NO: 566609 - protein, 9 aa, Mycobacterium
RPSKEAYAD

SEQ ID NO: 566610 - protein, 14 aa, Mycobacterium
RPSKTFNEALTAAP

SEQ ID NO: 566611 - protein, 5 aa, Mycobacterium
RPSLG

SEQ ID NO: 566612 - protein, 9 aa, Mycobacterium
RPSLTRGGL

SEQ ID NO: 566613 - protein, 12 aa, Mycobacterium
RPSMDPTRRQRE

SEQ ID NO: 566614 - protein, 6 aa, Mycobacterium
RPSMSN

SEQ ID NO: 566615 - protein, 5 aa, Mycobacterium
RPSNA

SEQ ID NO: 566616 - protein, 6 aa, Mycobacterium
RPSNEI

SEQ ID NO: 566617 - protein, 8 aa, Mycobacterium
RPSNEIPD

SEQ ID NO: 566618 - protein, 26 aa, Mycobacterium
RPSNQTKVSFTTTAEAPLRDGGTYGV

SEQ ID NO: 566619 - protein, 4 aa, Mycobacterium
RPSP

SEQ ID NO: 566620 - protein, 9 aa, Mycobacterium
RPSPAEDQL

SEQ ID NO: 566621 - protein, 10 aa, Mycobacterium
RPSPGSTPTY

SEQ ID NO: 566622 - protein, 8 aa, Mycobacterium
RPSPGTIK

SEQ ID NO: 566623 - protein, 25 aa, Mycobacterium
RPSPIDPNDGSSPDDLIFSPKAHQV

SEQ ID NO: 566624 - protein, 6 aa, Mycobacterium
RPSPLY

SEQ ID NO: 566625 - protein, 17 aa, Mycobacterium
RPSPNDSQNIFLGWAYA

SEQ ID NO: 566626 - protein, 14 aa, Mycobacterium
RPSPSARGHKEGAA

SEQ ID NO: 566627 - protein, 12 aa, Mycobacterium
RPSPSARGHQRD

SEQ ID NO: 566628 - protein, 14 aa, Mycobacterium
RPSQTFNAALASVE

SEQ ID NO: 566629 - protein, 7 aa, Mycobacterium
RPSQTGA

SEQ ID NO: 566630 - protein, 5 aa, Mycobacterium
RPSQW

SEQ ID NO: 566631 - protein, 7 aa, Mycobacterium
RPSRADR

SEQ ID NO: 566632 - protein, 9 aa, Mycobacterium
RPSRDADPV

SEQ ID NO: 566633 - protein, 6 aa, Mycobacterium
RPSRDL

SEQ ID NO: 566634 - protein, 5 aa, Mycobacterium
RPSRE

SEQ ID NO: 566635 - protein, 6 aa, Mycobacterium
RPSREG

SEQ ID NO: 566636 - protein, 18 aa, Mycobacterium
RPSRGLPPVGSGLAPGVG

SEQ ID NO: 566637 - protein, 10 aa, Mycobacterium
RPSRGNASPL

SEQ ID NO: 566638 - protein, 6 aa, Mycobacterium
RPSRLK

SEQ ID NO: 566639 - protein, 8 aa, Mycobacterium
RPSRREPL

SEQ ID NO: 566640 - protein, 8 aa, Mycobacterium
RPSRRNAL

SEQ ID NO: 566641 - protein, 12 aa, Mycobacterium
RPSSASGRGQRR

SEQ ID NO: 566642 - protein, 20 aa, Mycobacterium
RPSSDAPKRPEQTPAGARRK

SEQ ID NO: 566643 - protein, 10 aa, Mycobacterium
RPSSGHASVA

SEQ ID NO: 566644 - protein, 11 aa, Mycobacterium
RPSSGRASVAG

SEQ ID NO: 566645 - protein, 6 aa, Mycobacterium
RPSSLH

SEQ ID NO: 566646 - protein, 10 aa, Mycobacterium
RPSSPPPGEL

SEQ ID NO: 566647 - protein, 14 aa, Mycobacterium
RPSSRDATSSRLER

SEQ ID NO: 566648 - protein, 6 aa, Mycobacterium
RPSSRG

SEQ ID NO: 566649 - protein, 10 aa, Mycobacterium
RPSSSPQPYG

SEQ ID NO: 566650 - protein, 8 aa, Mycobacterium
RPSSSRDT

SEQ ID NO: 566651 - protein, 14 aa, Mycobacterium
RPSSTFNEALESAR

SEQ ID NO: 566652 - protein, 7 aa, Mycobacterium
RPSSVGM

SEQ ID NO: 566653 - protein, 6 aa, Mycobacterium
RPSSVQ

SEQ ID NO: 566654 - protein, 15 aa, Mycobacterium
RPSTGDAASADVGVP

SEQ ID NO: 566655 - protein, 5 aa, Mycobacterium
RPSTQ

SEQ ID NO: 566656 - protein, 5 aa, Mycobacterium
RPSTT

SEQ ID NO: 566657 - protein, 19 aa, Mycobacterium
RPSTVPSSSGSTAPAPTPG

SEQ ID NO: 566658 - protein, 7 aa, Mycobacterium
RPSVGRN

SEQ ID NO: 566659 - protein, 5 aa, Mycobacterium
RPSVP

SEQ ID NO: 566660 - protein, 4 aa, Mycobacterium
RPSW

SEQ ID NO: 566661 - protein, 8 aa, Mycobacterium
RPSWGEPY

SEQ ID NO: 566662 - protein, 7 aa, Mycobacterium
RPSWPGG

SEQ ID NO: 566663 - protein, 5 aa, Mycobacterium
RPSWQ

SEQ ID NO: 566664 - protein, 6 aa, Mycobacterium
RPSWSR

SEQ ID NO: 566665 - protein, 11 aa, Mycobacterium
RPSWSRTYAPG

SEQ ID NO: 566666 - protein, 5 aa, Mycobacterium
RPSYG

SEQ ID NO: 566667 - protein, 14 aa, Mycobacterium
RPTAADPALAPEGR

SEQ ID NO: 566668 - protein, 12 aa, Mycobacterium
RPTADDDKPPKS

SEQ ID NO: 566669 - protein, 7 aa, Mycobacterium
RPTAEDH

SEQ ID NO: 566670 - protein, 12 aa, Mycobacterium
RPTAEQRRRYTG

SEQ ID NO: 566671 - protein, 14 aa, Mycobacterium
RPTAGDPALAPPGR

SEQ ID NO: 566672 - protein, 18 aa, Mycobacterium
RPTARDDAGLARGPGNLG

SEQ ID NO: 566673 - protein, 14 aa, Mycobacterium
RPTASDPALAPNGR

SEQ ID NO: 566674 - protein, 13 aa, Mycobacterium
RPTASDPTLAPTG

SEQ ID NO: 566675 - protein, 4 aa, Mycobacterium
RPTC

SEQ ID NO: 566676 - protein, 7 aa, Mycobacterium
RPTDAAD

SEQ ID NO: 566677 - protein, 7 aa, Mycobacterium
RPTDEKR

SEQ ID NO: 566678 - protein, 7 aa, Mycobacterium
RPTDGEI

SEQ ID NO: 566679 - protein, 9 aa, Mycobacterium
RPTDKTKPV

SEQ ID NO: 566680 - protein, 7 aa, Mycobacterium
RPTEGEI

SEQ ID NO: 566681 - protein, 5 aa, Mycobacterium
RPTEL

SEQ ID NO: 566682 - protein, 8 aa, Mycobacterium
RPTEQTRG

SEQ ID NO: 566683 - protein, 7 aa, Mycobacterium
RPTERYG

SEQ ID NO: 566684 - protein, 13 aa, Mycobacterium
RPTETARLIRDLL

SEQ ID NO: 566685 - protein, 7 aa, Mycobacterium
RPTETTR

SEQ ID NO: 566686 - protein, 5 aa, Mycobacterium
RPTFS

SEQ ID NO: 566687 - protein, 6 aa, Mycobacterium
RPTFSN

SEQ ID NO: 566688 - protein, 17 aa, Mycobacterium
RPTGANPAGPDTFGPNC

SEQ ID NO: 566689 - protein, 9 aa, Mycobacterium
RPTGEGSTL

SEQ ID NO: 566690 - protein, 16 aa, Mycobacterium
RPTGEPDADYDSYKHH

SEQ ID NO: 566691 - protein, 8 aa, Mycobacterium
RPTGPPWA

SEQ ID NO: 566692 - protein, 5 aa, Mycobacterium
RPTGQ

SEQ ID NO: 566693 - protein, 12 aa, Mycobacterium
RPTGRGAEREMA

SEQ ID NO: 566694 - protein, 12 aa, Mycobacterium
RPTGRGGERDMA

SEQ ID NO: 566695 - protein, 7 aa, Mycobacterium
RPTGRIG

SEQ ID NO: 566696 - protein, 8 aa, Mycobacterium
RPTGRPLA

SEQ ID NO: 566697 - protein, 20 aa, Mycobacterium
RPTGRTKADSMPEKQKEALG

SEQ ID NO: 566698 - protein, 7 aa, Mycobacterium
RPTGTVT

SEQ ID NO: 566699 - protein, 7 aa, Mycobacterium
RPTGWTG

SEQ ID NO: 566700 - protein, 4 aa, Mycobacterium
RPTH

SEQ ID NO: 566701 - protein, 16 aa, Mycobacterium
RPTHSSAETLAALASA

SEQ ID NO: 566702 - protein, 5 aa, Mycobacterium
RPTID

SEQ ID NO: 566703 - protein, 7 aa, Mycobacterium
RPTKADV

SEQ ID NO: 566704 - protein, 6 aa, Mycobacterium
RPTKST

SEQ ID NO: 566705 - protein, 6 aa, Mycobacterium
RPTLGF

SEQ ID NO: 566706 - protein, 9 aa, Mycobacterium
RPTLPDTTS

SEQ ID NO: 566707 - protein, 6 aa, Mycobacterium
RPTLSN

SEQ ID NO: 566708 - protein, 11 aa, Mycobacterium
RPTNGAGTAGF

SEQ ID NO: 566709 - protein, 8 aa, Mycobacterium
RPTNHGVE

SEQ ID NO: 566710 - protein, 6 aa, Mycobacterium
RPTNHT

SEQ ID NO: 566711 - protein, 8 aa, Mycobacterium
RPTNPASP

SEQ ID NO: 566712 - protein, 7 aa, Mycobacterium
RPTPAGL

SEQ ID NO: 566713 - protein, 6 aa, Mycobacterium
RPTPDN

SEQ ID NO: 566714 - protein, 8 aa, Mycobacterium
RPTPDPDR

SEQ ID NO: 566715 - protein, 5 aa, Mycobacterium
RPTPE

SEQ ID NO: 566716 - protein, 6 aa, Mycobacterium
RPTPEL

SEQ ID NO: 566717 - protein, 6 aa, Mycobacterium
RPTPGR

SEQ ID NO: 566718 - protein, 8 aa, Mycobacterium
RPTPPGPL

SEQ ID NO: 566719 - protein, 8 aa, Mycobacterium
RPTPVPGT

SEQ ID NO: 566720 - protein, 7 aa, Mycobacterium
RPTPYPV

SEQ ID NO: 566721 - protein, 6 aa, Mycobacterium
RPTQAA

SEQ ID NO: 566722 - protein, 12 aa, Mycobacterium
RPTQADFADRPR

SEQ ID NO: 566723 - protein, 8 aa, Mycobacterium
RPTQPGSY

SEQ ID NO: 566724 - protein, 8 aa, Mycobacterium
RPTQQAAA

SEQ ID NO: 566725 - protein, 5 aa, Mycobacterium
RPTQR

SEQ ID NO: 566726 - protein, 4 aa, Mycobacterium
RPTR

SEQ ID NO: 566727 - protein, 7 aa, Mycobacterium
RPTRAGA

SEQ ID NO: 566728 - protein, 6 aa, Mycobacterium
RPTRET

SEQ ID NO: 566729 - protein, 5 aa, Mycobacterium
RPTRG

SEQ ID NO: 566730 - protein, 14 aa, Mycobacterium
RPTRGDPALAPAGR

SEQ ID NO: 566731 - protein, 7 aa, Mycobacterium
RPTRHTR

SEQ ID NO: 566732 - protein, 9 aa, Mycobacterium
RPTRNGEPI

SEQ ID NO: 566733 - protein, 5 aa, Mycobacterium
RPTSA

SEQ ID NO: 566734 - protein, 7 aa, Mycobacterium
RPTSAKL

SEQ ID NO: 566735 - protein, 8 aa, Mycobacterium
RPTSDGAA

SEQ ID NO: 566736 - protein, 7 aa, Mycobacterium
RPTSEAE

SEQ ID NO: 566737 - protein, 6 aa, Mycobacterium
RPTSEF

SEQ ID NO: 566738 - protein, 13 aa, Mycobacterium
RPTSGTATIDGRT

SEQ ID NO: 566739 - protein, 12 aa, Mycobacterium
RPTSGTATIGGK

SEQ ID NO: 566740 - protein, 5 aa, Mycobacterium
RPTSR

SEQ ID NO: 566741 - protein, 22 aa, Mycobacterium
RPTSTASAYKEQESFPLEAYQL

SEQ ID NO: 566742 - protein, 10 aa, Mycobacterium
RPTSTETAIR

SEQ ID NO: 566743 - protein, 10 aa, Mycobacterium
RPTSTKTTVT

SEQ ID NO: 566744 - protein, 8 aa, Mycobacterium
RPTSTLNS

SEQ ID NO: 566745 - protein, 11 aa, Mycobacterium
RPTTADHRQIT

SEQ ID NO: 566746 - protein, 7 aa, Mycobacterium
RPTTAER

SEQ ID NO: 566747 - protein, 11 aa, Mycobacterium
RPTTGKAADVR

SEQ ID NO: 566748 - protein, 24 aa, Mycobacterium
RPTTKYETKAQEAGSAVTEFVWLK

SEQ ID NO: 566749 - protein, 7 aa, Mycobacterium
RPTTNAY

SEQ ID NO: 566750 - protein, 6 aa, Mycobacterium
RPTTPF

SEQ ID NO: 566751 - protein, 32 aa, Mycobacterium
RPTTSRPAEAPPAALPSDDDLDIPGPARSRAY

SEQ ID NO: 566752 - protein, 10 aa, Mycobacterium
RPTTTKTTVT

SEQ ID NO: 566753 - protein, 11 aa, Mycobacterium
RPTTTSLNGPI

SEQ ID NO: 566754 - protein, 16 aa, Mycobacterium
RPTTVDTAMAPAPAPQ

SEQ ID NO: 566755 - protein, 8 aa, Mycobacterium
RPTTVNPE

SEQ ID NO: 566756 - protein, 5 aa, Mycobacterium
RPTTW

SEQ ID NO: 566757 - protein, 4 aa, Mycobacterium
RPTV

SEQ ID NO: 566758 - protein, 11 aa, Mycobacterium
RPTVQGDGAYE

SEQ ID NO: 566759 - protein, 13 aa, Mycobacterium
RPTVRKSSARISA

SEQ ID NO: 566760 - protein, 9 aa, Mycobacterium
RPTWSGPPE

SEQ ID NO: 566761 - protein, 4 aa, Mycobacterium
RPTY

SEQ ID NO: 566762 - protein, 24 aa, Mycobacterium
RPTYDDAARSQIQAAQSAKPFDSA

SEQ ID NO: 566763 - protein, 24 aa, Mycobacterium
RPTYDDAARSQVSTAQSAVPSDAT

SEQ ID NO: 566764 - protein, 6 aa, Mycobacterium
RPTYSN

SEQ ID NO: 566765 - protein, 19 aa, Mycobacterium
RPVAAPQPSVSAPDGGPFG

SEQ ID NO: 566766 - protein, 5 aa, Mycobacterium
RPVAE

SEQ ID NO: 566767 - protein, 12 aa, Mycobacterium
RPVAPEDLGEAA

SEQ ID NO: 566768 - protein, 7 aa, Mycobacterium
RPVAPRG

SEQ ID NO: 566769 - protein, 16 aa, Mycobacterium
RPVAPRKGTGRVNGTP

SEQ ID NO: 566770 - protein, 15 aa, Mycobacterium
RPVASADAPTIGPTA

SEQ ID NO: 566771 - protein, 4 aa, Mycobacterium
RPVD

SEQ ID NO: 566772 - protein, 11 aa, Mycobacterium
RPVDAGGDESV

SEQ ID NO: 566773 - protein, 8 aa, Mycobacterium
RPVDGDGP

SEQ ID NO: 566774 - protein, 5 aa, Mycobacterium
RPVDQ

SEQ ID NO: 566775 - protein, 8 aa, Mycobacterium
RPVDRGDA

SEQ ID NO: 566776 - protein, 7 aa, Mycobacterium
RPVEDSP

SEQ ID NO: 566777 - protein, 8 aa, Mycobacterium
RPVESGAA

SEQ ID NO: 566778 - protein, 4 aa, Mycobacterium
RPVG

SEQ ID NO: 566779 - protein, 17 aa, Mycobacterium
RPVGGQGAGQGSGRTAR

SEQ ID NO: 566780 - protein, 34 aa, Mycobacterium
RPVGHRGADRHRPYSARSALQRRTDRGVDRGFGR

SEQ ID NO: 566781 - protein, 13 aa, Mycobacterium
RPVGSNSEDGLGS

SEQ ID NO: 566782 - protein, 8 aa, Mycobacterium
RPVGSRPP

SEQ ID NO: 566783 - protein, 9 aa, Mycobacterium
RPVHSGADA

SEQ ID NO: 566784 - protein, 8 aa, Mycobacterium
RPVKGRNG

SEQ ID NO: 566785 - protein, 5 aa, Mycobacterium
RPVKQ

SEQ ID NO: 566786 - protein, 10 aa, Mycobacterium
RPVLPRPDDG

SEQ ID NO: 566787 - protein, 4 aa, Mycobacterium
RPVN

SEQ ID NO: 566788 - protein, 5 aa, Mycobacterium
RPVNG

SEQ ID NO: 566789 - protein, 6 aa, Mycobacterium
RPVNPD

SEQ ID NO: 566790 - protein, 13 aa, Mycobacterium
RPVNVPTGSLPGW

SEQ ID NO: 566791 - protein, 23 aa, Mycobacterium
RPVPDDAEGPVPPTLFVSAHRPA

SEQ ID NO: 566792 - protein, 13 aa, Mycobacterium
RPVPDDLSDEAVR

SEQ ID NO: 566793 - protein, 7 aa, Mycobacterium
RPVPDGA

SEQ ID NO: 566794 - protein, 5 aa, Mycobacterium
RPVPE

SEQ ID NO: 566795 - protein, 10 aa, Mycobacterium
RPVPEPGTEA

SEQ ID NO: 566796 - protein, 6 aa, Mycobacterium
RPVPGE

SEQ ID NO: 566797 - protein, 9 aa, Mycobacterium
RPVPGPGSE

SEQ ID NO: 566798 - protein, 12 aa, Mycobacterium
RPVPGPPAGIGP

SEQ ID NO: 566799 - protein, 13 aa, Mycobacterium
RPVPGRVKIAIEA

SEQ ID NO: 566800 - protein, 5 aa, Mycobacterium
RPVPL

SEQ ID NO: 566801 - protein, 6 aa, Mycobacterium
RPVPNR

SEQ ID NO: 566802 - protein, 5 aa, Mycobacterium
RPVPQ

SEQ ID NO: 566803 - protein, 7 aa, Mycobacterium
RPVPQDL

SEQ ID NO: 566804 - protein, 6 aa, Mycobacterium
RPVPQF

SEQ ID NO: 566805 - protein, 5 aa, Mycobacterium
RPVPR

SEQ ID NO: 566806 - protein, 9 aa, Mycobacterium
RPVPTPGPH

SEQ ID NO: 566807 - protein, 8 aa, Mycobacterium
RPVQGEAP

SEQ ID NO: 566808 - protein, 9 aa, Mycobacterium
RPVQNRPTL

SEQ ID NO: 566809 - protein, 5 aa, Mycobacterium
RPVQP

SEQ ID NO: 566810 - protein, 9 aa, Mycobacterium
RPVQPGGRY

SEQ ID NO: 566811 - protein, 7 aa, Mycobacterium
RPVQPQN

SEQ ID NO: 566812 - protein, 4 aa, Mycobacterium
RPVR

SEQ ID NO: 566813 - protein, 7 aa, Mycobacterium
RPVRAGS

SEQ ID NO: 566814 - protein, 16 aa, Mycobacterium
RPVRGHEDDHDEVPGE

SEQ ID NO: 566815 - protein, 8 aa, Mycobacterium
RPVRPTDA

SEQ ID NO: 566816 - protein, 5 aa, Mycobacterium
RPVRR

SEQ ID NO: 566817 - protein, 4 aa, Mycobacterium
RPVS

SEQ ID NO: 566818 - protein, 17 aa, Mycobacterium
RPVSAAETREHAPAGNT

SEQ ID NO: 566819 - protein, 5 aa, Mycobacterium
RPVSE

SEQ ID NO: 566820 - protein, 6 aa, Mycobacterium
RPVSGR

SEQ ID NO: 566821 - protein, 7 aa, Mycobacterium
RPVSGRG

SEQ ID NO: 566822 - protein, 8 aa, Mycobacterium
RPVSKADY

SEQ ID NO: 566823 - protein, 16 aa, Mycobacterium
RPVSPDPTAPTAAGGA

SEQ ID NO: 566824 - protein, 6 aa, Mycobacterium
RPVSPE

SEQ ID NO: 566825 - protein, 10 aa, Mycobacterium
RPVSPGNDSE

SEQ ID NO: 566826 - protein, 10 aa, Mycobacterium
RPVSPGSDDE

SEQ ID NO: 566827 - protein, 11 aa, Mycobacterium
RPVSPQAQQRL

SEQ ID NO: 566828 - protein, 8 aa, Mycobacterium
RPVSPSAV

SEQ ID NO: 566829 - protein, 7 aa, Mycobacterium
RPVSRRE

SEQ ID NO: 566830 - protein, 12 aa, Mycobacterium
RPVSSDPDTGKK

SEQ ID NO: 566831 - protein, 14 aa, Mycobacterium
RPVSTTGEAGNQNT

SEQ ID NO: 566832 - protein, 12 aa, Mycobacterium
RPVTAPPPTYRG

SEQ ID NO: 566833 - protein, 5 aa, Mycobacterium
RPVTD

SEQ ID NO: 566834 - protein, 14 aa, Mycobacterium
RPVTGDDRGDLSAG

SEQ ID NO: 566835 - protein, 14 aa, Mycobacterium
RPVTGGDRAELSTG

SEQ ID NO: 566836 - protein, 7 aa, Mycobacterium
RPVTGGY

SEQ ID NO: 566837 - protein, 14 aa, Mycobacterium
RPVTGPNGKSAIAQ

SEQ ID NO: 566838 - protein, 11 aa, Mycobacterium
RPVTGPNSKTE

SEQ ID NO: 566839 - protein, 5 aa, Mycobacterium
RPVTP

SEQ ID NO: 566840 - protein, 8 aa, Mycobacterium
RPVTSTDT

SEQ ID NO: 566841 - protein, 6 aa, Mycobacterium
RPVTTA

SEQ ID NO: 566842 - protein, 17 aa, Mycobacterium
RPWAEGGATTANNGLGS

SEQ ID NO: 566843 - protein, 17 aa, Mycobacterium
RPWAKGGPTTADNGLGS

SEQ ID NO: 566844 - protein, 4 aa, Mycobacterium
RPWG

SEQ ID NO: 566845 - protein, 12 aa, Mycobacterium
RPWGGRKARCRG

SEQ ID NO: 566846 - protein, 12 aa, Mycobacterium
RPWGRNGRPRIA

SEQ ID NO: 566847 - protein, 4 aa, Mycobacterium
RPWP

SEQ ID NO: 566848 - protein, 4 aa, Mycobacterium
RPWR

SEQ ID NO: 566849 - protein, 21 aa, Mycobacterium
RPWSGDADPSPALGNLPGSVR

SEQ ID NO: 566850 - protein, 14 aa, Mycobacterium
RPWTERDRANLAGR

SEQ ID NO: 566851 - protein, 15 aa, Mycobacterium
RPWTERDRANLAGRT

SEQ ID NO: 566852 - protein, 4 aa, Mycobacterium
RPYA

SEQ ID NO: 566853 - protein, 6 aa, Mycobacterium
RPYAYR

SEQ ID NO: 566854 - protein, 4 aa, Mycobacterium
RPYD

SEQ ID NO: 566855 - protein, 11 aa, Mycobacterium
RPYDAGNHADD

SEQ ID NO: 566856 - protein, 6 aa, Mycobacterium
RPYDDT

SEQ ID NO: 566857 - protein, 4 aa, Mycobacterium
RPYE

SEQ ID NO: 566858 - protein, 6 aa, Mycobacterium
RPYGAA

SEQ ID NO: 566859 - protein, 6 aa, Mycobacterium
RPYGER

SEQ ID NO: 566860 - protein, 9 aa, Mycobacterium
RPYGERGAE

SEQ ID NO: 566861 - protein, 8 aa, Mycobacterium
RPYGESRP

SEQ ID NO: 566862 - protein, 7 aa, Mycobacterium
RPYGRSG

SEQ ID NO: 566863 - protein, 15 aa, Mycobacterium
RPYKKNDQATIESKN

SEQ ID NO: 566864 - protein, 4 aa, Mycobacterium
RPYP

SEQ ID NO: 566865 - protein, 29 aa, Mycobacterium
RPYPPDRYRPADSARVDPPGCLPDTPEVR

SEQ ID NO: 566866 - protein, 16 aa, Mycobacterium
RPYPQDRYTPAEGADV

SEQ ID NO: 566867 - protein, 16 aa, Mycobacterium
RPYPRDRYEPADADAV

SEQ ID NO: 566868 - protein, 6 aa, Mycobacterium
RPYPRG

SEQ ID NO: 566869 - protein, 8 aa, Mycobacterium
RPYPSGGS

SEQ ID NO: 566870 - protein, 4 aa, Mycobacterium
RPYQ

SEQ ID NO: 566871 - protein, 10 aa, Mycobacterium
RPYQEPGQRV

SEQ ID NO: 566872 - protein, 13 aa, Mycobacterium
RPYQGRPGGRVRD

SEQ ID NO: 566873 - protein, 5 aa, Mycobacterium
RPYRD

SEQ ID NO: 566874 - protein, 10 aa, Mycobacterium
RPYREPGQRV

SEQ ID NO: 566875 - protein, 11 aa, Mycobacterium
RPYSAQASGTV

SEQ ID NO: 566876 - protein, 5 aa, Mycobacterium
RPYSG

SEQ ID NO: 566877 - protein, 6 aa, Mycobacterium
RPYSGY

SEQ ID NO: 566878 - protein, 15 aa, Mycobacterium
RPYSSYTPDPATAGR

SEQ ID NO: 566879 - protein, 16 aa, Mycobacterium
RPYSSYTPDPATAGRS

SEQ ID NO: 566880 - protein, 16 aa, Mycobacterium
RPYSSYTPDPATGGRS

SEQ ID NO: 566881 - protein, 6 aa, Mycobacterium
RPYTGT

SEQ ID NO: 566882 - protein, 13 aa, Mycobacterium
RPYTREEAAYPLG

SEQ ID NO: 566883 - protein, 8 aa, Mycobacterium
RPYVGDEG

SEQ ID NO: 566884 - protein, 4 aa, Mycobacterium
RPYW

SEQ ID NO: 566885 - protein, 14 aa, Mycobacterium
RQAAADCNGVIVAG

SEQ ID NO: 566886 - protein, 17 aa, Mycobacterium
RQAAADIGRHSADTSRW

SEQ ID NO: 566887 - protein, 10 aa, Mycobacterium
RQAAAGTDRR

SEQ ID NO: 566888 - protein, 12 aa, Mycobacterium
RQAAAKAPVPVS

SEQ ID NO: 566889 - protein, 14 aa, Mycobacterium
RQAAAQPVTRTVIT

SEQ ID NO: 566890 - protein, 7 aa, Mycobacterium
RQAADAP

SEQ ID NO: 566891 - protein, 7 aa, Mycobacterium
RQAADDA

SEQ ID NO: 566892 - protein, 8 aa, Mycobacterium
RQAADDAI

SEQ ID NO: 566893 - protein, 7 aa, Mycobacterium
RQAADLS

SEQ ID NO: 566894 - protein, 6 aa, Mycobacterium
RQAAEA

SEQ ID NO: 566895 - protein, 9 aa, Mycobacterium
RQAAGLAGT

SEQ ID NO: 566896 - protein, 10 aa, Mycobacterium
RQAAGQIRSA

SEQ ID NO: 566897 - protein, 9 aa, Mycobacterium
RQAAGSTGR

SEQ ID NO: 566898 - protein, 8 aa, Mycobacterium
RQAAPGHA

SEQ ID NO: 566899 - protein, 9 aa, Mycobacterium
RQAAPPPWS

SEQ ID NO: 566900 - protein, 14 aa, Mycobacterium
RQAASAQLRNRATM

SEQ ID NO: 566901 - protein, 9 aa, Mycobacterium
RQAASEAAG

SEQ ID NO: 566902 - protein, 8 aa, Mycobacterium
RQAASSLG

SEQ ID NO: 566903 - protein, 15 aa, Mycobacterium
RQAATQARRRRIGLT

SEQ ID NO: 566904 - protein, 8 aa, Mycobacterium
RQAATYRK

SEQ ID NO: 566905 - protein, 6 aa, Mycobacterium
RQACRK

SEQ ID NO: 566906 - protein, 4 aa, Mycobacterium
RQAD

SEQ ID NO: 566907 - protein, 5 aa, Mycobacterium
RQADA

SEQ ID NO: 566908 - protein, 6 aa, Mycobacterium
RQADAR

SEQ ID NO: 566909 - protein, 5 aa, Mycobacterium
RQADE

SEQ ID NO: 566910 - protein, 7 aa, Mycobacterium
RQADNNF

SEQ ID NO: 566911 - protein, 8 aa, Mycobacterium
RQADPELA

SEQ ID NO: 566912 - protein, 8 aa, Mycobacterium
RQADPQLR

SEQ ID NO: 566913 - protein, 9 aa, Mycobacterium
RQADQRSDE

SEQ ID NO: 566914 - protein, 4 aa, Mycobacterium
RQAE

SEQ ID NO: 566915 - protein, 7 aa, Mycobacterium
RQAEDTG

SEQ ID NO: 566916 - protein, 6 aa, Mycobacterium
RQAEEV

SEQ ID NO: 566917 - protein, 11 aa, Mycobacterium
RQAEGNKPPVC

SEQ ID NO: 566918 - protein, 8 aa, Mycobacterium
RQAEGRSL

SEQ ID NO: 566919 - protein, 4 aa, Mycobacterium
RQAF

SEQ ID NO: 566920 - protein, 12 aa, Mycobacterium
RQAFSGAAGDQV

SEQ ID NO: 566921 - protein, 7 aa, Mycobacterium
RQAFTRA

SEQ ID NO: 566922 - protein, 4 aa, Mycobacterium
RQAG

SEQ ID NO: 566923 - protein, 15 aa, Mycobacterium
RQAGEGDHEHQETPG

SEQ ID NO: 566924 - protein, 10 aa, Mycobacterium
RQAGESPEEF

SEQ ID NO: 566925 - protein, 11 aa, Mycobacterium
RQAGGYHPLTD

SEQ ID NO: 566926 - protein, 17 aa, Mycobacterium
RQAGKQLGKPSTIDQTT

SEQ ID NO: 566927 - protein, 10 aa, Mycobacterium
RQAGRADSDW

SEQ ID NO: 566928 - protein, 5 aa, Mycobacterium
RQAHE

SEQ ID NO: 566929 - protein, 15 aa, Mycobacterium
RQAHNEQWDPLGASD

SEQ ID NO: 566930 - protein, 9 aa, Mycobacterium
RQAKPGEFD

SEQ ID NO: 566931 - protein, 26 aa, Mycobacterium
RQALRDNRARRAPRKDAPIEGAVAAG

SEQ ID NO: 566932 - protein, 11 aa, Mycobacterium
RQALTRGEIDD

SEQ ID NO: 566933 - protein, 4 aa, Mycobacterium
RQAM

SEQ ID NO: 566934 - protein, 7 aa, Mycobacterium
RQANGDY

SEQ ID NO: 566935 - protein, 13 aa, Mycobacterium
RQANPPKDKADRD

SEQ ID NO: 566936 - protein, 6 aa, Mycobacterium
RQANSR

SEQ ID NO: 566937 - protein, 6 aa, Mycobacterium
RQAPER

SEQ ID NO: 566938 - protein, 8 aa, Mycobacterium
RQAPGAGV

SEQ ID NO: 566939 - protein, 5 aa, Mycobacterium
RQAPL

SEQ ID NO: 566940 - protein, 7 aa, Mycobacterium
RQAPPSL

SEQ ID NO: 566941 - protein, 7 aa, Mycobacterium
RQAPQGR

SEQ ID NO: 566942 - protein, 6 aa, Mycobacterium
RQAPTG

SEQ ID NO: 566943 - protein, 10 aa, Mycobacterium
RQAQAHPAVP

SEQ ID NO: 566944 - protein, 6 aa, Mycobacterium
RQAQDE

SEQ ID NO: 566945 - protein, 19 aa, Mycobacterium
RQAQKADQDRRDAEAAAEM

SEQ ID NO: 566946 - protein, 6 aa, Mycobacterium
RQAQQA

SEQ ID NO: 566947 - protein, 8 aa, Mycobacterium
RQARADGR

SEQ ID NO: 566948 - protein, 10 aa, Mycobacterium
RQARADVSGP

SEQ ID NO: 566949 - protein, 14 aa, Mycobacterium
RQARDGDEPPGPLD

SEQ ID NO: 566950 - protein, 6 aa, Mycobacterium
RQAREL

SEQ ID NO: 566951 - protein, 5 aa, Mycobacterium
RQARG

SEQ ID NO: 566952 - protein, 9 aa, Mycobacterium
RQARGHGHS

SEQ ID NO: 566953 - protein, 6 aa, Mycobacterium
RQARNA

SEQ ID NO: 566954 - protein, 9 aa, Mycobacterium
RQARPGPAA

SEQ ID NO: 566955 - protein, 12 aa, Mycobacterium
RQARQSTDVGAP

SEQ ID NO: 566956 - protein, 10 aa, Mycobacterium
RQARRDASGP

SEQ ID NO: 566957 - protein, 13 aa, Mycobacterium
RQARRGDDHPDHA

SEQ ID NO: 566958 - protein, 7 aa, Mycobacterium
RQARSRG

SEQ ID NO: 566959 - protein, 4 aa, Mycobacterium
RQAS

SEQ ID NO: 566960 - protein, 17 aa, Mycobacterium
RQASEPGEAPVTVEVRR

SEQ ID NO: 566961 - protein, 9 aa, Mycobacterium
RQASGKGQV

SEQ ID NO: 566962 - protein, 8 aa, Mycobacterium
RQASLEDS

SEQ ID NO: 566963 - protein, 8 aa, Mycobacterium
RQASPGHA

SEQ ID NO: 566964 - protein, 14 aa, Mycobacterium
RQASPGHAFSPDTP

SEQ ID NO: 566965 - protein, 8 aa, Mycobacterium
RQASRPSG

SEQ ID NO: 566966 - protein, 12 aa, Mycobacterium
RQASTESPPLRP

SEQ ID NO: 566967 - protein, 4 aa, Mycobacterium
RQAT

SEQ ID NO: 566968 - protein, 9 aa, Mycobacterium
RQATAGQWQ

SEQ ID NO: 566969 - protein, 10 aa, Mycobacterium
RQATEASSVP

SEQ ID NO: 566970 - protein, 8 aa, Mycobacterium
RQATGAPG

SEQ ID NO: 566971 - protein, 7 aa, Mycobacterium
RQATGEA

SEQ ID NO: 566972 - protein, 13 aa, Mycobacterium
RQATNKGKALTEK

SEQ ID NO: 566973 - protein, 8 aa, Mycobacterium
RQATPGEF

SEQ ID NO: 566974 - protein, 24 aa, Mycobacterium
RQATVTPGAWTRPEESTKCEFWVS

SEQ ID NO: 566975 - protein, 8 aa, Mycobacterium
RQAVADGA

SEQ ID NO: 566976 - protein, 14 aa, Mycobacterium
RQAVANRRQAVTAL

SEQ ID NO: 566977 - protein, 4 aa, Mycobacterium
RQCP

SEQ ID NO: 566978 - protein, 10 aa, Mycobacterium
RQCQGGNEQI

SEQ ID NO: 566979 - protein, 17 aa, Mycobacterium
RQCSDATQRATAGHRIS

SEQ ID NO: 566980 - protein, 7 aa, Mycobacterium
RQCTPND

SEQ ID NO: 566981 - protein, 13 aa, Mycobacterium
RQDAGADGDASFG

SEQ ID NO: 566982 - protein, 17 aa, Mycobacterium
RQDCGGPPDSPTAAEDV

SEQ ID NO: 566983 - protein, 5 aa, Mycobacterium
RQDDT

SEQ ID NO: 566984 - protein, 5 aa, Mycobacterium
RQDDV

SEQ ID NO: 566985 - protein, 4 aa, Mycobacterium
RQDE

SEQ ID NO: 566986 - protein, 6 aa, Mycobacterium
RQDEDA

SEQ ID NO: 566987 - protein, 5 aa, Mycobacterium
RQDEI

SEQ ID NO: 566988 - protein, 23 aa, Mycobacterium
RQDEQMQKRTESGVIPPKTTHGQ

SEQ ID NO: 566989 - protein, 12 aa, Mycobacterium
RQDGDYSPQHNA

SEQ ID NO: 566990 - protein, 9 aa, Mycobacterium
RQDGKYPSR

SEQ ID NO: 566991 - protein, 12 aa, Mycobacterium
RQDGNPIRILVR

SEQ ID NO: 566992 - protein, 11 aa, Mycobacterium
RQDGQGDSRTL

SEQ ID NO: 566993 - protein, 4 aa, Mycobacterium
RQDH

SEQ ID NO: 566994 - protein, 6 aa, Mycobacterium
RQDHPH

SEQ ID NO: 566995 - protein, 10 aa, Mycobacterium
RQDHPRRRRP

SEQ ID NO: 566996 - protein, 9 aa, Mycobacterium
RQDHRSAAA

SEQ ID NO: 566997 - protein, 5 aa, Mycobacterium
RQDLP

SEQ ID NO: 566998 - protein, 8 aa, Mycobacterium
RQDLTGRP

SEQ ID NO: 566999 - protein, 9 aa, Mycobacterium
RQDNEEEGS

SEQ ID NO: 567000 - protein, 8 aa, Mycobacterium
RQDNPGRV

SEQ ID NO: 567001 - protein, 11 aa, Mycobacterium
RQDPGAPDGRG

SEQ ID NO: 567002 - protein, 13 aa, Mycobacterium
RQDRAADPAAGTP

SEQ ID NO: 567003 - protein, 8 aa, Mycobacterium
RQDRAPER

SEQ ID NO: 567004 - protein, 11 aa, Mycobacterium
RQDRQEPSERP

SEQ ID NO: 567005 - protein, 5 aa, Mycobacterium
RQDRV

SEQ ID NO: 567006 - protein, 10 aa, Mycobacterium
RQDSEEEGSL

SEQ ID NO: 567007 - protein, 7 aa, Mycobacterium
RQDSGGR

SEQ ID NO: 567008 - protein, 5 aa, Mycobacterium
RQDSP

SEQ ID NO: 567009 - protein, 10 aa, Mycobacterium
RQDSPARGSR

SEQ ID NO: 567010 - protein, 4 aa, Mycobacterium
RQDT

SEQ ID NO: 567011 - protein, 45 aa, Mycobacterium
RQEAAEAAADHQDAVKESADVRARADRMRQEADKLTEEADLPGDE

SEQ ID NO: 567012 - protein, 5 aa, Mycobacterium
RQEAD

SEQ ID NO: 567013 - protein, 6 aa, Mycobacterium
RQEAGA

SEQ ID NO: 567014 - protein, 5 aa, Mycobacterium
RQEAL

SEQ ID NO: 567015 - protein, 6 aa, Mycobacterium
RQEALD

SEQ ID NO: 567016 - protein, 4 aa, Mycobacterium
RQEC

SEQ ID NO: 567017 - protein, 7 aa, Mycobacterium
RQEDADA

SEQ ID NO: 567018 - protein, 8 aa, Mycobacterium
RQEDGSPI

SEQ ID NO: 567019 - protein, 6 aa, Mycobacterium
RQEEDG

SEQ ID NO: 567020 - protein, 7 aa, Mycobacterium
RQEEPGV

SEQ ID NO: 567021 - protein, 25 aa, Mycobacterium
RQEEQLTKRTASGEVPPEITSTHGQ

SEQ ID NO: 567022 - protein, 28 aa, Mycobacterium
RQEEQLTKRTAVAAETGAPPPPRTTHGQ

SEQ ID NO: 567023 - protein, 9 aa, Mycobacterium
RQEESGPLR

SEQ ID NO: 567024 - protein, 4 aa, Mycobacterium
RQEG

SEQ ID NO: 567025 - protein, 9 aa, Mycobacterium
RQEGAASYE

SEQ ID NO: 567026 - protein, 23 aa, Mycobacterium
RQEGAQVLTGGDARKVSEYPDGA

SEQ ID NO: 567027 - protein, 5 aa, Mycobacterium
RQEGW

SEQ ID NO: 567028 - protein, 8 aa, Mycobacterium
RQEHATTE

SEQ ID NO: 567029 - protein, 7 aa, Mycobacterium
RQEKSLP

SEQ ID NO: 567030 - protein, 9 aa, Mycobacterium
RQEKSLPHK

SEQ ID NO: 567031 - protein, 8 aa, Mycobacterium
RQELGSGV

SEQ ID NO: 567032 - protein, 16 aa, Mycobacterium
RQENWEDSPDGYPQTA

SEQ ID NO: 567033 - protein, 13 aa, Mycobacterium
RQEPAMRPDRVGN

SEQ ID NO: 567034 - protein, 12 aa, Mycobacterium
RQEPDEGRASLG

SEQ ID NO: 567035 - protein, 5 aa, Mycobacterium
RQEPY

SEQ ID NO: 567036 - protein, 9 aa, Mycobacterium
RQEQNRAIS

SEQ ID NO: 567037 - protein, 5 aa, Mycobacterium
RQEQV

SEQ ID NO: 567038 - protein, 11 aa, Mycobacterium
RQEQVTAEQPG

SEQ ID NO: 567039 - protein, 19 aa, Mycobacterium
RQEQWQDSPQGWPKHPTYS

SEQ ID NO: 567040 - protein, 4 aa, Mycobacterium
RQES

SEQ ID NO: 567041 - protein, 5 aa, Mycobacterium
RQESR

SEQ ID NO: 567042 - protein, 13 aa, Mycobacterium
RQESSKSTAYQYD

SEQ ID NO: 567043 - protein, 8 aa, Mycobacterium
RQESTDGV

SEQ ID NO: 567044 - protein, 7 aa, Mycobacterium
RQETRAR

SEQ ID NO: 567045 - protein, 17 aa, Mycobacterium
RQETWEDSPEGYPQSPA

SEQ ID NO: 567046 - protein, 17 aa, Mycobacterium
RQETWEDSPEGYPQTAP

SEQ ID NO: 567047 - protein, 11 aa, Mycobacterium
RQEVGDPYDPW

SEQ ID NO: 567048 - protein, 6 aa, Mycobacterium
RQFART

SEQ ID NO: 567049 - protein, 5 aa, Mycobacterium
RQFDP

SEQ ID NO: 567050 - protein, 28 aa, Mycobacterium
RQFEEQAAKAEAAGKTKDAEKARASAQQ

SEQ ID NO: 567051 - protein, 7 aa, Mycobacterium
RQFPEPD

SEQ ID NO: 567052 - protein, 7 aa, Mycobacterium
RQFPNPD

SEQ ID NO: 567053 - protein, 9 aa, Mycobacterium
RQFPSAAPA

SEQ ID NO: 567054 - protein, 9 aa, Mycobacterium
RQFPSTAPK

SEQ ID NO: 567055 - protein, 7 aa, Mycobacterium
RQFSGAA

SEQ ID NO: 567056 - protein, 5 aa, Mycobacterium
RQFST

SEQ ID NO: 567057 - protein, 4 aa, Mycobacterium
RQGA

SEQ ID NO: 567058 - protein, 38 aa, Mycobacterium
RQGAKPAGDADPYRDGGASGELSDRIEAGDTGDHDRSR

SEQ ID NO: 567059 - protein, 12 aa, Mycobacterium
RQGAQPKADRRE

SEQ ID NO: 567060 - protein, 9 aa, Mycobacterium
RQGAQSGGV

SEQ ID NO: 567061 - protein, 6 aa, Mycobacterium
RQGATE

SEQ ID NO: 567062 - protein, 5 aa, Mycobacterium
RQGCT

SEQ ID NO: 567063 - protein, 10 aa, Mycobacterium
RQGEELSAQQ

SEQ ID NO: 567064 - protein, 7 aa, Mycobacterium
RQGEFRP

SEQ ID NO: 567065 - protein, 11 aa, Mycobacterium
RQGEGGRSSGI

SEQ ID NO: 567066 - protein, 28 aa, Mycobacterium
RQGEPAGQPAISASEADAEAEPAEGPAS

SEQ ID NO: 567067 - protein, 7 aa, Mycobacterium
RQGERVQ

SEQ ID NO: 567068 - protein, 11 aa, Mycobacterium
RQGESGQAERA

SEQ ID NO: 567069 - protein, 6 aa, Mycobacterium
RQGFPR

SEQ ID NO: 567070 - protein, 11 aa, Mycobacterium
RQGGEPPDSIL

SEQ ID NO: 567071 - protein, 7 aa, Mycobacterium
RQGGGIR

SEQ ID NO: 567072 - protein, 11 aa, Mycobacterium
RQGGHPSQGGW

SEQ ID NO: 567073 - protein, 11 aa, Mycobacterium
RQGGPDAAERA

SEQ ID NO: 567074 - protein, 6 aa, Mycobacterium
RQGGPK

SEQ ID NO: 567075 - protein, 9 aa, Mycobacterium
RQGGSAELT

SEQ ID NO: 567076 - protein, 8 aa, Mycobacterium
RQGGSEPA

SEQ ID NO: 567077 - protein, 37 aa, Mycobacterium
RQGGSVPTTSAPVAPPPPPEPPAAAPAPVTSVPAADE

SEQ ID NO: 567078 - protein, 6 aa, Mycobacterium
RQGGTE

SEQ ID NO: 567079 - protein, 15 aa, Mycobacterium
RQGGVEEDRKPTAAR

SEQ ID NO: 567080 - protein, 12 aa, Mycobacterium
RQGHAEHKSSGI

SEQ ID NO: 567081 - protein, 12 aa, Mycobacterium
RQGHDAANTGAD

SEQ ID NO: 567082 - protein, 11 aa, Mycobacterium
RQGIDPDSGVS

SEQ ID NO: 567083 - protein, 16 aa, Mycobacterium
RQGIGTGISASDRATT

SEQ ID NO: 567084 - protein, 5 aa, Mycobacterium
RQGLD

SEQ ID NO: 567085 - protein, 7 aa, Mycobacterium
RQGLGNA

SEQ ID NO: 567086 - protein, 14 aa, Mycobacterium
RQGLPNDSEPSAGA

SEQ ID NO: 567087 - protein, 4 aa, Mycobacterium
RQGP

SEQ ID NO: 567088 - protein, 13 aa, Mycobacterium
RQGPEGAQAYPDT

SEQ ID NO: 567089 - protein, 7 aa, Mycobacterium
RQGPGGC

SEQ ID NO: 567090 - protein, 8 aa, Mycobacterium
RQGPTPLQ

SEQ ID NO: 567091 - protein, 10 aa, Mycobacterium
RQGQKRSPLP

SEQ ID NO: 567092 - protein, 6 aa, Mycobacterium
RQGQSV

SEQ ID NO: 567093 - protein, 7 aa, Mycobacterium
RQGQTKS

SEQ ID NO: 567094 - protein, 6 aa, Mycobacterium
RQGQVV

SEQ ID NO: 567095 - protein, 4 aa, Mycobacterium
RQGR

SEQ ID NO: 567096 - protein, 7 aa, Mycobacterium
RQGRDYV

SEQ ID NO: 567097 - protein, 5 aa, Mycobacterium
RQGRH

SEQ ID NO: 567098 - protein, 6 aa, Mycobacterium
RQGRHR

SEQ ID NO: 567099 - protein, 18 aa, Mycobacterium
RQGRQDQLDAAASEREYA

SEQ ID NO: 567100 - protein, 8 aa, Mycobacterium
RQGRRSAD

SEQ ID NO: 567101 - protein, 6 aa, Mycobacterium
RQGSAA

SEQ ID NO: 567102 - protein, 10 aa, Mycobacterium
RQGSAPAEEV

SEQ ID NO: 567103 - protein, 10 aa, Mycobacterium
RQGSGGKSYR

SEQ ID NO: 567104 - protein, 6 aa, Mycobacterium
RQGSGT

SEQ ID NO: 567105 - protein, 7 aa, Mycobacterium
RQGSMRD

SEQ ID NO: 567106 - protein, 7 aa, Mycobacterium
RQGSMRG

SEQ ID NO: 567107 - protein, 8 aa, Mycobacterium
RQGSRNPW

SEQ ID NO: 567108 - protein, 7 aa, Mycobacterium
RQGTAEE

SEQ ID NO: 567109 - protein, 6 aa, Mycobacterium
RQGTDA

SEQ ID NO: 567110 - protein, 6 aa, Mycobacterium
RQGTEA

SEQ ID NO: 567111 - protein, 5 aa, Mycobacterium
RQGTR

SEQ ID NO: 567112 - protein, 7 aa, Mycobacterium
RQGVGHS

SEQ ID NO: 567113 - protein, 10 aa, Mycobacterium
RQGVSEPLQT

SEQ ID NO: 567114 - protein, 4 aa, Mycobacterium
RQGW

SEQ ID NO: 567115 - protein, 17 aa, Mycobacterium
RQGYDYNEHGRAGNAHT

SEQ ID NO: 567116 - protein, 5 aa, Mycobacterium
RQGYG

SEQ ID NO: 567117 - protein, 8 aa, Mycobacterium
RQGYRENG

SEQ ID NO: 567118 - protein, 6 aa, Mycobacterium
RQHAGL

SEQ ID NO: 567119 - protein, 4 aa, Mycobacterium
RQHD

SEQ ID NO: 567120 - protein, 6 aa, Mycobacterium
RQHDRT

SEQ ID NO: 567121 - protein, 9 aa, Mycobacterium
RQHGARPTA

SEQ ID NO: 567122 - protein, 11 aa, Mycobacterium
RQHGGPDQYAD

SEQ ID NO: 567123 - protein, 17 aa, Mycobacterium
RQHGVPTVGEADSRAAA

SEQ ID NO: 567124 - protein, 11 aa, Mycobacterium
RQHPGELSGGM

SEQ ID NO: 567125 - protein, 5 aa, Mycobacterium
RQHPT

SEQ ID NO: 567126 - protein, 4 aa, Mycobacterium
RQHQ

SEQ ID NO: 567127 - protein, 12 aa, Mycobacterium
RQHRIPDHAPSR

SEQ ID NO: 567128 - protein, 12 aa, Mycobacterium
RQHRVPDHAPSR

SEQ ID NO: 567129 - protein, 5 aa, Mycobacterium
RQHSG

SEQ ID NO: 567130 - protein, 26 aa, Mycobacterium
RQHSGQAVGSPAMNAADDGCTRASSR

SEQ ID NO: 567131 - protein, 6 aa, Mycobacterium
RQHTST

SEQ ID NO: 567132 - protein, 6 aa, Mycobacterium
RQIAAG

SEQ ID NO: 567133 - protein, 17 aa, Mycobacterium
RQIESTTNNSVPGAPNR

SEQ ID NO: 567134 - protein, 7 aa, Mycobacterium
RQIGRSG

SEQ ID NO: 567135 - protein, 16 aa, Mycobacterium
RQINDGYANGYGNSKW

SEQ ID NO: 567136 - protein, 7 aa, Mycobacterium
RQIPAAD

SEQ ID NO: 567137 - protein, 6 aa, Mycobacterium
RQIPGD

SEQ ID NO: 567138 - protein, 6 aa, Mycobacterium
RQIQPG

SEQ ID NO: 567139 - protein, 4 aa, Mycobacterium
RQIT

SEQ ID NO: 567140 - protein, 7 aa, Mycobacterium
RQITGGK

SEQ ID NO: 567141 - protein, 7 aa, Mycobacterium
RQKAQAA

SEQ ID NO: 567142 - protein, 7 aa, Mycobacterium
RQKARAA

SEQ ID NO: 567143 - protein, 11 aa, Mycobacterium
RQKATAAKNLT

SEQ ID NO: 567144 - protein, 13 aa, Mycobacterium
RQKDAGELAPEQV

SEQ ID NO: 567145 - protein, 17 aa, Mycobacterium
RQKDGLSGYPSRAESEH

SEQ ID NO: 567146 - protein, 5 aa, Mycobacterium
RQKFS

SEQ ID NO: 567147 - protein, 4 aa, Mycobacterium
RQKG

SEQ ID NO: 567148 - protein, 15 aa, Mycobacterium
RQKGAGVRPSPNWPP

SEQ ID NO: 567149 - protein, 9 aa, Mycobacterium
RQKLTPDYE

SEQ ID NO: 567150 - protein, 12 aa, Mycobacterium
RQKPDPATYIGS

SEQ ID NO: 567151 - protein, 6 aa, Mycobacterium
RQKPYT

SEQ ID NO: 567152 - protein, 7 aa, Mycobacterium
RQKSGEV

SEQ ID NO: 567153 - protein, 15 aa, Mycobacterium
RQKSHRARARRRVAD

SEQ ID NO: 567154 - protein, 8 aa, Mycobacterium
RQKSSYPG

SEQ ID NO: 567155 - protein, 8 aa, Mycobacterium
RQKTEGAD

SEQ ID NO: 567156 - protein, 9 aa, Mycobacterium
RQKTQGMNE

SEQ ID NO: 567157 - protein, 8 aa, Mycobacterium
RQKYDTSS

SEQ ID NO: 567158 - protein, 8 aa, Mycobacterium
RQKYPREQ

SEQ ID NO: 567159 - protein, 4 aa, Mycobacterium
RQLA

SEQ ID NO: 567160 - protein, 10 aa, Mycobacterium
RQLAEEAQRQ

SEQ ID NO: 567161 - protein, 6 aa, Mycobacterium
RQLAGA

SEQ ID NO: 567162 - protein, 10 aa, Mycobacterium
RQLDDTTDMK

SEQ ID NO: 567163 - protein, 4 aa, Mycobacterium
RQLE

SEQ ID NO: 567164 - protein, 11 aa, Mycobacterium
RQLEESDDTVT

SEQ ID NO: 567165 - protein, 12 aa, Mycobacterium
RQLEQDRKDEIA

SEQ ID NO: 567166 - protein, 6 aa, Mycobacterium
RQLGED

SEQ ID NO: 567167 - protein, 10 aa, Mycobacterium
RQLGSSAQVA

SEQ ID NO: 567168 - protein, 6 aa, Mycobacterium
RQLGVD

SEQ ID NO: 567169 - protein, 7 aa, Mycobacterium
RQLNPQD

SEQ ID NO: 567170 - protein, 5 aa, Mycobacterium
RQLPD

SEQ ID NO: 567171 - protein, 6 aa, Mycobacterium
RQLPDG

SEQ ID NO: 567172 - protein, 12 aa, Mycobacterium
RQLPDPSRAEPG

SEQ ID NO: 567173 - protein, 14 aa, Mycobacterium
RQLPGELSGGQRQR

SEQ ID NO: 567174 - protein, 13 aa, Mycobacterium
RQLPQPTTNTDPD

SEQ ID NO: 567175 - protein, 12 aa, Mycobacterium
RQLPSEGATRGA

SEQ ID NO: 567176 - protein, 5 aa, Mycobacterium
RQLSE

SEQ ID NO: 567177 - protein, 11 aa, Mycobacterium
RQLSKSGPRQA

SEQ ID NO: 567178 - protein, 5 aa, Mycobacterium
RQLSN

SEQ ID NO: 567179 - protein, 6 aa, Mycobacterium
RQLSPR

SEQ ID NO: 567180 - protein, 5 aa, Mycobacterium
RQLSR

SEQ ID NO: 567181 - protein, 6 aa, Mycobacterium
RQLSTA

SEQ ID NO: 567182 - protein, 7 aa, Mycobacterium
RQLTDED

SEQ ID NO: 567183 - protein, 11 aa, Mycobacterium
RQLTPADGPTV

SEQ ID NO: 567184 - protein, 7 aa, Mycobacterium
RQLTTER

SEQ ID NO: 567185 - protein, 16 aa, Mycobacterium
RQMEEDNARKFKPGDG

SEQ ID NO: 567186 - protein, 4 aa, Mycobacterium
RQMS

SEQ ID NO: 567187 - protein, 8 aa, Mycobacterium
RQMSGGGT

SEQ ID NO: 567188 - protein, 6 aa, Mycobacterium
RQMSGP

SEQ ID NO: 567189 - protein, 7 aa, Mycobacterium
RQMTGGG

SEQ ID NO: 567190 - protein, 24 aa, Mycobacterium
RQNAATLQEAGQSHADRIAAAGGN

SEQ ID NO: 567191 - protein, 13 aa, Mycobacterium
RQNAGDKEYRPMA

SEQ ID NO: 567192 - protein, 6 aa, Mycobacterium
RQNDET

SEQ ID NO: 567193 - protein, 18 aa, Mycobacterium
RQNEKDRRLLDKSRYFDT

SEQ ID NO: 567194 - protein, 5 aa, Mycobacterium
RQNER

SEQ ID NO: 567195 - protein, 4 aa, Mycobacterium
RQNF

SEQ ID NO: 567196 - protein, 6 aa, Mycobacterium
RQNGGA

SEQ ID NO: 567197 - protein, 12 aa, Mycobacterium
RQNGPDNPARLS

SEQ ID NO: 567198 - protein, 5 aa, Mycobacterium
RQNGR

SEQ ID NO: 567199 - protein, 15 aa, Mycobacterium
RQNGSTTPSATGTTW

SEQ ID NO: 567200 - protein, 8 aa, Mycobacterium
RQNGVTTP

SEQ ID NO: 567201 - protein, 8 aa, Mycobacterium
RQNGYSTA

SEQ ID NO: 567202 - protein, 24 aa, Mycobacterium
RQNHRPERQEHQQQRGAQQQHQHQ

SEQ ID NO: 567203 - protein, 6 aa, Mycobacterium
RQNIDT

SEQ ID NO: 567204 - protein, 5 aa, Mycobacterium
RQNPD

SEQ ID NO: 567205 - protein, 9 aa, Mycobacterium
RQNPEGSRS

SEQ ID NO: 567206 - protein, 15 aa, Mycobacterium
RQNPHPSPVLPSSLL

SEQ ID NO: 567207 - protein, 5 aa, Mycobacterium
RQNPI

SEQ ID NO: 567208 - protein, 6 aa, Mycobacterium
RQNPPD

SEQ ID NO: 567209 - protein, 10 aa, Mycobacterium
RQNPYTTTPG

SEQ ID NO: 567210 - protein, 10 aa, Mycobacterium
RQNQADGDAF

SEQ ID NO: 567211 - protein, 20 aa, Mycobacterium
RQNRPAASRLAPAGPPGPVT

SEQ ID NO: 567212 - protein, 6 aa, Mycobacterium
RQNRRG

SEQ ID NO: 567213 - protein, 6 aa, Mycobacterium
RQNSDV

SEQ ID NO: 567214 - protein, 7 aa, Mycobacterium
RQNSDVH

SEQ ID NO: 567215 - protein, 14 aa, Mycobacterium
RQNSERPINDSAEV

SEQ ID NO: 567216 - protein, 9 aa, Mycobacterium
RQNSGKGQV

SEQ ID NO: 567217 - protein, 5 aa, Mycobacterium
RQPAA

SEQ ID NO: 567218 - protein, 10 aa, Mycobacterium
RQPAGRDDAT

SEQ ID NO: 567219 - protein, 9 aa, Mycobacterium
RQPAPTPEE

SEQ ID NO: 567220 - protein, 9 aa, Mycobacterium
RQPAQDAIS

SEQ ID NO: 567221 - protein, 5 aa, Mycobacterium
RQPAR

SEQ ID NO: 567222 - protein, 26 aa, Mycobacterium
RQPASAPRFSRTPAAQPRPARVAPRS

SEQ ID NO: 567223 - protein, 5 aa, Mycobacterium
RQPAT

SEQ ID NO: 567224 - protein, 4 aa, Mycobacterium
RQPD

SEQ ID NO: 567225 - protein, 8 aa, Mycobacterium
RQPDAGHN

SEQ ID NO: 567226 - protein, 9 aa, Mycobacterium
RQPDDGGQH

SEQ ID NO: 567227 - protein, 6 aa, Mycobacterium
RQPDEL

SEQ ID NO: 567228 - protein, 5 aa, Mycobacterium
RQPDG

SEQ ID NO: 567229 - protein, 8 aa, Mycobacterium
RQPDGVTI

SEQ ID NO: 567230 - protein, 6 aa, Mycobacterium
RQPDHA

SEQ ID NO: 567231 - protein, 7 aa, Mycobacterium
RQPDHDK

SEQ ID NO: 567232 - protein, 5 aa, Mycobacterium
RQPDN

SEQ ID NO: 567233 - protein, 8 aa, Mycobacterium
RQPDQWQT

SEQ ID NO: 567234 - protein, 6 aa, Mycobacterium
RQPDRV

SEQ ID NO: 567235 - protein, 6 aa, Mycobacterium
RQPDSA

SEQ ID NO: 567236 - protein, 5 aa, Mycobacterium
RQPDV

SEQ ID NO: 567237 - protein, 4 aa, Mycobacterium
RQPE

SEQ ID NO: 567238 - protein, 9 aa, Mycobacterium
RQPEDGGQH

SEQ ID NO: 567239 - protein, 5 aa, Mycobacterium
RQPEH

SEQ ID NO: 567240 - protein, 7 aa, Mycobacterium
RQPEIYG

SEQ ID NO: 567241 - protein, 5 aa, Mycobacterium
RQPEL

SEQ ID NO: 567242 - protein, 10 aa, Mycobacterium
RQPELAKGQP

SEQ ID NO: 567243 - protein, 6 aa, Mycobacterium
RQPEQL

SEQ ID NO: 567244 - protein, 8 aa, Mycobacterium
RQPEVYGS

SEQ ID NO: 567245 - protein, 7 aa, Mycobacterium
RQPFAST

SEQ ID NO: 567246 - protein, 16 aa, Mycobacterium
RQPGDDSAEPPQSAKT

SEQ ID NO: 567247 - protein, 8 aa, Mycobacterium
RQPGDSPH

SEQ ID NO: 567248 - protein, 6 aa, Mycobacterium
RQPGKD

SEQ ID NO: 567249 - protein, 6 aa, Mycobacterium
RQPGLT

SEQ ID NO: 567250 - protein, 8 aa, Mycobacterium
RQPGPAVS

SEQ ID NO: 567251 - protein, 11 aa, Mycobacterium
RQPGQRGRYPG

SEQ ID NO: 567252 - protein, 4 aa, Mycobacterium
RQPH

SEQ ID NO: 567253 - protein, 9 aa, Mycobacterium
RQPHPNSRR

SEQ ID NO: 567254 - protein, 10 aa, Mycobacterium
RQPHQREGHD

SEQ ID NO: 567255 - protein, 19 aa, Mycobacterium
RQPLGEPRPGLGRVGGPGH

SEQ ID NO: 567256 - protein, 22 aa, Mycobacterium
RQPLGQLGAGAGRVGGSGDVAD

SEQ ID NO: 567257 - protein, 6 aa, Mycobacterium
RQPNPH

SEQ ID NO: 567258 - protein, 7 aa, Mycobacterium
RQPNPQV

SEQ ID NO: 567259 - protein, 10 aa, Mycobacterium
RQPNSLVSDG

SEQ ID NO: 567260 - protein, 8 aa, Mycobacterium
RQPNTDDL

SEQ ID NO: 567261 - protein, 5 aa, Mycobacterium
RQPPE

SEQ ID NO: 567262 - protein, 5 aa, Mycobacterium
RQPPG

SEQ ID NO: 567263 - protein, 13 aa, Mycobacterium
RQPPGPATEATER

SEQ ID NO: 567264 - protein, 8 aa, Mycobacterium
RQPPLPVP

SEQ ID NO: 567265 - protein, 11 aa, Mycobacterium
RQPPPPPSGSH

SEQ ID NO: 567266 - protein, 12 aa, Mycobacterium
RQPPQTNEVGRS

SEQ ID NO: 567267 - protein, 4 aa, Mycobacterium
RQPQ

SEQ ID NO: 567268 - protein, 9 aa, Mycobacterium
RQPQASGPV

SEQ ID NO: 567269 - protein, 8 aa, Mycobacterium
RQPQPVTD

SEQ ID NO: 567270 - protein, 9 aa, Mycobacterium
RQPQSQALA

SEQ ID NO: 567271 - protein, 16 aa, Mycobacterium
RQPRAEDWAGLALSVF

SEQ ID NO: 567272 - protein, 8 aa, Mycobacterium
RQPRPGAP

SEQ ID NO: 567273 - protein, 6 aa, Mycobacterium
RQPRRP

SEQ ID NO: 567274 - protein, 5 aa, Mycobacterium
RQPSG

SEQ ID NO: 567275 - protein, 19 aa, Mycobacterium
RQPSGTDPSTHPSTDEVRE

SEQ ID NO: 567276 - protein, 6 aa, Mycobacterium
RQPSHP

SEQ ID NO: 567277 - protein, 5 aa, Mycobacterium
RQPSL

SEQ ID NO: 567278 - protein, 10 aa, Mycobacterium
RQPSYSANGY

SEQ ID NO: 567279 - protein, 6 aa, Mycobacterium
RQPTGA

SEQ ID NO: 567280 - protein, 5 aa, Mycobacterium
RQPTL

SEQ ID NO: 567281 - protein, 10 aa, Mycobacterium
RQPTLAPGET

SEQ ID NO: 567282 - protein, 6 aa, Mycobacterium
RQPTPQ

SEQ ID NO: 567283 - protein, 5 aa, Mycobacterium
RQPVR

SEQ ID NO: 567284 - protein, 5 aa, Mycobacterium
RQPYA

SEQ ID NO: 567285 - protein, 16 aa, Mycobacterium
RQPYDGGDYAVSLHRL

SEQ ID NO: 567286 - protein, 9 aa, Mycobacterium
RQQAGKPLT

SEQ ID NO: 567287 - protein, 6 aa, Mycobacterium
RQQAPA

SEQ ID NO: 567288 - protein, 9 aa, Mycobacterium
RQQAPVSSL

SEQ ID NO: 567289 - protein, 7 aa, Mycobacterium
RQQDARD

SEQ ID NO: 567290 - protein, 7 aa, Mycobacterium
RQQDGAS

SEQ ID NO: 567291 - protein, 8 aa, Mycobacterium
RQQDQDGA

SEQ ID NO: 567292 - protein, 5 aa, Mycobacterium
RQQEP

SEQ ID NO: 567293 - protein, 11 aa, Mycobacterium
RQQEVSSAQAV

SEQ ID NO: 567294 - protein, 11 aa, Mycobacterium
RQQFTGDEAHE

SEQ ID NO: 567295 - protein, 14 aa, Mycobacterium
RQQGEHRDGIPNRS

SEQ ID NO: 567296 - protein, 6 aa, Mycobacterium
RQQGKI

SEQ ID NO: 567297 - protein, 7 aa, Mycobacterium
RQQGPAA

SEQ ID NO: 567298 - protein, 5 aa, Mycobacterium
RQQGV

SEQ ID NO: 567299 - protein, 6 aa, Mycobacterium
RQQLGS

SEQ ID NO: 567300 - protein, 6 aa, Mycobacterium
RQQMSA

SEQ ID NO: 567301 - protein, 14 aa, Mycobacterium
RQQNEAAGEPEGAA

SEQ ID NO: 567302 - protein, 6 aa, Mycobacterium
RQQPAQ

SEQ ID NO: 567303 - protein, 34 aa, Mycobacterium
RQQPQRSAPAPPAAAPRRRGQRHGRRPARQRNRL

SEQ ID NO: 567304 - protein, 6 aa, Mycobacterium
RQQQEA

SEQ ID NO: 567305 - protein, 13 aa, Mycobacterium
RQQQSPTPGHTAS

SEQ ID NO: 567306 - protein, 20 aa, Mycobacterium
RQQRATDEARAQVAPAYADK

SEQ ID NO: 567307 - protein, 18 aa, Mycobacterium
RQQRSAAELTADQAEHAG

SEQ ID NO: 567308 - protein, 12 aa, Mycobacterium
RQQSEGKLPPDE

SEQ ID NO: 567309 - protein, 4 aa, Mycobacterium
RQQT

SEQ ID NO: 567310 - protein, 8 aa, Mycobacterium
RQQTGRNI

SEQ ID NO: 567311 - protein, 4 aa, Mycobacterium
RQRA

SEQ ID NO: 567312 - protein, 10 aa, Mycobacterium
RQRAEPSAPV

SEQ ID NO: 567313 - protein, 10 aa, Mycobacterium
RQRAGAESVR

SEQ ID NO: 567314 - protein, 12 aa, Mycobacterium
RQRAGGGPGAAQ

SEQ ID NO: 567315 - protein, 13 aa, Mycobacterium
RQRAGGGPGAGPL

SEQ ID NO: 567316 - protein, 12 aa, Mycobacterium
RQRAHGLDEKTP

SEQ ID NO: 567317 - protein, 8 aa, Mycobacterium
RQRAPQAY

SEQ ID NO: 567318 - protein, 12 aa, Mycobacterium
RQRARELAQRPT

SEQ ID NO: 567319 - protein, 8 aa, Mycobacterium
RQRARRSE

SEQ ID NO: 567320 - protein, 9 aa, Mycobacterium
RQRATKARI

SEQ ID NO: 567321 - protein, 7 aa, Mycobacterium
RQRCGSA

SEQ ID NO: 567322 - protein, 4 aa, Mycobacterium
RQRD

SEQ ID NO: 567323 - protein, 7 aa, Mycobacterium
RQRDDDA

SEQ ID NO: 567324 - protein, 10 aa, Mycobacterium
RQRDPARPTA

SEQ ID NO: 567325 - protein, 7 aa, Mycobacterium
RQRDRTQ

SEQ ID NO: 567326 - protein, 8 aa, Mycobacterium
RQRDSAAE

SEQ ID NO: 567327 - protein, 8 aa, Mycobacterium
RQRDTGVP

SEQ ID NO: 567328 - protein, 9 aa, Mycobacterium
RQREATEEV

SEQ ID NO: 567329 - protein, 8 aa, Mycobacterium
RQREDRDR

SEQ ID NO: 567330 - protein, 9 aa, Mycobacterium
RQREDRDRS

SEQ ID NO: 567331 - protein, 9 aa, Mycobacterium
RQREKAATL

SEQ ID NO: 567332 - protein, 6 aa, Mycobacterium
RQRELA

SEQ ID NO: 567333 - protein, 11 aa, Mycobacterium
RQRGAEAATVA

SEQ ID NO: 567334 - protein, 6 aa, Mycobacterium
RQRGEE

SEQ ID NO: 567335 - protein, 13 aa, Mycobacterium
RQRGGRQKRRDQH

SEQ ID NO: 567336 - protein, 7 aa, Mycobacterium
RQRGGSE

SEQ ID NO: 567337 - protein, 9 aa, Mycobacterium
RQRGNAHPG

SEQ ID NO: 567338 - protein, 6 aa, Mycobacterium
RQRGPI

SEQ ID NO: 567339 - protein, 8 aa, Mycobacterium
RQRGQAGQ

SEQ ID NO: 567340 - protein, 8 aa, Mycobacterium
RQRGRDQR

SEQ ID NO: 567341 - protein, 13 aa, Mycobacterium
RQRGRPEQGDRLR

SEQ ID NO: 567342 - protein, 7 aa, Mycobacterium
RQRHDDA

SEQ ID NO: 567343 - protein, 4 aa, Mycobacterium
RQRK

SEQ ID NO: 567344 - protein, 21 aa, Mycobacterium
RQRKASSTFPQIGAETSEGMF

SEQ ID NO: 567345 - protein, 10 aa, Mycobacterium
RQRLSPISGR

SEQ ID NO: 567346 - protein, 10 aa, Mycobacterium
RQRNTGEPQY

SEQ ID NO: 567347 - protein, 8 aa, Mycobacterium
RQRPADEP

SEQ ID NO: 567348 - protein, 7 aa, Mycobacterium
RQRPGDA

SEQ ID NO: 567349 - protein, 7 aa, Mycobacterium
RQRPGHR

SEQ ID NO: 567350 - protein, 8 aa, Mycobacterium
RQRPGQAG

SEQ ID NO: 567351 - protein, 18 aa, Mycobacterium
RQRPRGADKPATTAAPPL

SEQ ID NO: 567352 - protein, 9 aa, Mycobacterium
RQRPRPLSD

SEQ ID NO: 567353 - protein, 7 aa, Mycobacterium
RQRQDVG

SEQ ID NO: 567354 - protein, 10 aa, Mycobacterium
RQRQSPADAE

SEQ ID NO: 567355 - protein, 6 aa, Mycobacterium
RQRQTL

SEQ ID NO: 567356 - protein, 4 aa, Mycobacterium
RQRR

SEQ ID NO: 567357 - protein, 8 aa, Mycobacterium
RQRRDAGL

SEQ ID NO: 567358 - protein, 6 aa, Mycobacterium
RQRREA

SEQ ID NO: 567359 - protein, 8 aa, Mycobacterium
RQRREAGL

SEQ ID NO: 567360 - protein, 11 aa, Mycobacterium
RQRRERGGPAH

SEQ ID NO: 567361 - protein, 8 aa, Mycobacterium
RQRRGQAG

SEQ ID NO: 567362 - protein, 9 aa, Mycobacterium
RQRRGTTPQ

SEQ ID NO: 567363 - protein, 8 aa, Mycobacterium
RQRRPNEV

SEQ ID NO: 567364 - protein, 6 aa, Mycobacterium
RQRSAG

SEQ ID NO: 567365 - protein, 21 aa, Mycobacterium
RQRSAREPADSDFDNSAPDVQ

SEQ ID NO: 567366 - protein, 11 aa, Mycobacterium
RQRSATDERRV

SEQ ID NO: 567367 - protein, 9 aa, Mycobacterium
RQRSELASQ

SEQ ID NO: 567368 - protein, 5 aa, Mycobacterium
RQRSG

SEQ ID NO: 567369 - protein, 10 aa, Mycobacterium
RQRSPRPSTA

SEQ ID NO: 567370 - protein, 9 aa, Mycobacterium
RQRSPSPLT

SEQ ID NO: 567371 - protein, 16 aa, Mycobacterium
RQRSRSGVGAAPLQGR

SEQ ID NO: 567372 - protein, 5 aa, Mycobacterium
RQRSS

SEQ ID NO: 567373 - protein, 5 aa, Mycobacterium
RQRSY

SEQ ID NO: 567374 - protein, 10 aa, Mycobacterium
RQRTFAQSSK

SEQ ID NO: 567375 - protein, 51 aa, Mycobacterium
RQRTRAQDRARRVATERRQNHHARSTQPGGQPRSAAPPTPPQSEPQSHPPP

SEQ ID NO: 567376 - protein, 5 aa, Mycobacterium
RQRVD

SEQ ID NO: 567377 - protein, 14 aa, Mycobacterium
RQRVNSSGVAVKDD

SEQ ID NO: 567378 - protein, 6 aa, Mycobacterium
RQRYEA

SEQ ID NO: 567379 - protein, 4 aa, Mycobacterium
RQSA

SEQ ID NO: 567380 - protein, 9 aa, Mycobacterium
RQSAADHEA

SEQ ID NO: 567381 - protein, 9 aa, Mycobacterium
RQSALETEY

SEQ ID NO: 567382 - protein, 10 aa, Mycobacterium
RQSAPIGDRA

SEQ ID NO: 567383 - protein, 5 aa, Mycobacterium
RQSAQ

SEQ ID NO: 567384 - protein, 17 aa, Mycobacterium
RQSAQPDGVGRRPIFPA

SEQ ID NO: 567385 - protein, 5 aa, Mycobacterium
RQSAR

SEQ ID NO: 567386 - protein, 6 aa, Mycobacterium
RQSATQ

SEQ ID NO: 567387 - protein, 5 aa, Mycobacterium
RQSAV

SEQ ID NO: 567388 - protein, 4 aa, Mycobacterium
RQSD

SEQ ID NO: 567389 - protein, 7 aa, Mycobacterium
RQSDAKA

SEQ ID NO: 567390 - protein, 6 aa, Mycobacterium
RQSDAL

SEQ ID NO: 567391 - protein, 7 aa, Mycobacterium
RQSDALG

SEQ ID NO: 567392 - protein, 11 aa, Mycobacterium
RQSDASTERSN

SEQ ID NO: 567393 - protein, 7 aa, Mycobacterium
RQSDGSE

SEQ ID NO: 567394 - protein, 6 aa, Mycobacterium
RQSEHL

SEQ ID NO: 567395 - protein, 9 aa, Mycobacterium
RQSERAALT

SEQ ID NO: 567396 - protein, 9 aa, Mycobacterium
RQSERYGVP

SEQ ID NO: 567397 - protein, 7 aa, Mycobacterium
RQSGADA

SEQ ID NO: 567398 - protein, 9 aa, Mycobacterium
RQSGADGNC

SEQ ID NO: 567399 - protein, 7 aa, Mycobacterium
RQSGKGQ

SEQ ID NO: 567400 - protein, 6 aa, Mycobacterium
RQSGRM

SEQ ID NO: 567401 - protein, 6 aa, Mycobacterium
RQSGSG

SEQ ID NO: 567402 - protein, 7 aa, Mycobacterium
RQSGTDA

SEQ ID NO: 567403 - protein, 8 aa, Mycobacterium
RQSGTTTS

SEQ ID NO: 567404 - protein, 6 aa, Mycobacterium
RQSLDA

SEQ ID NO: 567405 - protein, 7 aa, Mycobacterium
RQSLDAS

SEQ ID NO: 567406 - protein, 12 aa, Mycobacterium
RQSLTDGRSFGH

SEQ ID NO: 567407 - protein, 15 aa, Mycobacterium
RQSMGDADTTAVSPA

SEQ ID NO: 567408 - protein, 7 aa, Mycobacterium
RQSPERE

SEQ ID NO: 567409 - protein, 8 aa, Mycobacterium
RQSPEVNN

SEQ ID NO: 567410 - protein, 6 aa, Mycobacterium
RQSPHN

SEQ ID NO: 567411 - protein, 6 aa, Mycobacterium
RQSPND

SEQ ID NO: 567412 - protein, 5 aa, Mycobacterium
RQSPR

SEQ ID NO: 567413 - protein, 10 aa, Mycobacterium
RQSPVAGEDA

SEQ ID NO: 567414 - protein, 4 aa, Mycobacterium
RQSR

SEQ ID NO: 567415 - protein, 8 aa, Mycobacterium
RQSRGENH

SEQ ID NO: 567416 - protein, 11 aa, Mycobacterium
RQSRIGATAEA

SEQ ID NO: 567417 - protein, 15 aa, Mycobacterium
RQSRQGDRKPITPGT

SEQ ID NO: 567418 - protein, 16 aa, Mycobacterium
RQSRRGRGAVPGRTHR

SEQ ID NO: 567419 - protein, 7 aa, Mycobacterium
RQSSRGI

SEQ ID NO: 567420 - protein, 9 aa, Mycobacterium
RQSSTGPVG

SEQ ID NO: 567421 - protein, 10 aa, Mycobacterium
RQSVSEPLQT

SEQ ID NO: 567422 - protein, 13 aa, Mycobacterium
RQSVSSGAVRERD

SEQ ID NO: 567423 - protein, 7 aa, Mycobacterium
RQTAAEA

SEQ ID NO: 567424 - protein, 17 aa, Mycobacterium
RQTAAPERNWFLEFLLR

SEQ ID NO: 567425 - protein, 9 aa, Mycobacterium
RQTADPEST

SEQ ID NO: 567426 - protein, 13 aa, Mycobacterium
RQTAGADPQSSLR

SEQ ID NO: 567427 - protein, 9 aa, Mycobacterium
RQTANGRSK

SEQ ID NO: 567428 - protein, 14 aa, Mycobacterium
RQTDAASPAFTTER

SEQ ID NO: 567429 - protein, 8 aa, Mycobacterium
RQTDADGN

SEQ ID NO: 567430 - protein, 8 aa, Mycobacterium
RQTDEDGN

SEQ ID NO: 567431 - protein, 33 aa, Mycobacterium
RQTDHANKLSTATAARARAEGAAAEAQRRQDDA

SEQ ID NO: 567432 - protein, 7 aa, Mycobacterium
RQTDHRP

SEQ ID NO: 567433 - protein, 6 aa, Mycobacterium
RQTDPV

SEQ ID NO: 567434 - protein, 7 aa, Mycobacterium
RQTDPYT

SEQ ID NO: 567435 - protein, 8 aa, Mycobacterium
RQTDTTVD

SEQ ID NO: 567436 - protein, 4 aa, Mycobacterium
RQTE

SEQ ID NO: 567437 - protein, 19 aa, Mycobacterium
RQTELDTAASKLGPRATAV

SEQ ID NO: 567438 - protein, 21 aa, Mycobacterium
RQTEPDATGISSHGWTGAQAE

SEQ ID NO: 567439 - protein, 8 aa, Mycobacterium
RQTGEWKD

SEQ ID NO: 567440 - protein, 6 aa, Mycobacterium
RQTGQK

SEQ ID NO: 567441 - protein, 9 aa, Mycobacterium
RQTGRGGGT

SEQ ID NO: 567442 - protein, 6 aa, Mycobacterium
RQTGVA

SEQ ID NO: 567443 - protein, 8 aa, Mycobacterium
RQTHGPAN

SEQ ID NO: 567444 - protein, 6 aa, Mycobacterium
RQTKTL

SEQ ID NO: 567445 - protein, 4 aa, Mycobacterium
RQTL

SEQ ID NO: 567446 - protein, 12 aa, Mycobacterium
RQTLSGKSLSPA

SEQ ID NO: 567447 - protein, 8 aa, Mycobacterium
RQTNAAAK

SEQ ID NO: 567448 - protein, 6 aa, Mycobacterium
RQTPAG

SEQ ID NO: 567449 - protein, 5 aa, Mycobacterium
RQTPE

SEQ ID NO: 567450 - protein, 7 aa, Mycobacterium
RQTPEPL

SEQ ID NO: 567451 - protein, 7 aa, Mycobacterium
RQTPGGR

SEQ ID NO: 567452 - protein, 7 aa, Mycobacterium
RQTPIEE

SEQ ID NO: 567453 - protein, 6 aa, Mycobacterium
RQTPRS

SEQ ID NO: 567454 - protein, 5 aa, Mycobacterium
RQTPS

SEQ ID NO: 567455 - protein, 19 aa, Mycobacterium
RQTQGPDARSALEQYWESS

SEQ ID NO: 567456 - protein, 8 aa, Mycobacterium
RQTRGNLP

SEQ ID NO: 567457 - protein, 9 aa, Mycobacterium
RQTRQAIEQ

SEQ ID NO: 567458 - protein, 16 aa, Mycobacterium
RQTSDGMAANAEHPSR

SEQ ID NO: 567459 - protein, 12 aa, Mycobacterium
RQTSEAVLPRFF

SEQ ID NO: 567460 - protein, 9 aa, Mycobacterium
RQTSGKGQV

SEQ ID NO: 567461 - protein, 8 aa, Mycobacterium
RQTTGGAG

SEQ ID NO: 567462 - protein, 7 aa, Mycobacterium
RQTTSAV

SEQ ID NO: 567463 - protein, 11 aa, Mycobacterium
RQTVRGAPEVG

SEQ ID NO: 567464 - protein, 4 aa, Mycobacterium
RQVA

SEQ ID NO: 567465 - protein, 11 aa, Mycobacterium
RQVAAGSPADV

SEQ ID NO: 567466 - protein, 6 aa, Mycobacterium
RQVAAR

SEQ ID NO: 567467 - protein, 9 aa, Mycobacterium
RQVAEETRR

SEQ ID NO: 567468 - protein, 9 aa, Mycobacterium
RQVAGEEVD

SEQ ID NO: 567469 - protein, 9 aa, Mycobacterium
RQVAPAGRR

SEQ ID NO: 567470 - protein, 24 aa, Mycobacterium
RQVAQRDDQQDHADGDRDGERQRP

SEQ ID NO: 567471 - protein, 18 aa, Mycobacterium
RQVDAARADLTDETAAAA

SEQ ID NO: 567472 - protein, 8 aa, Mycobacterium
RQVDEPNP

SEQ ID NO: 567473 - protein, 4 aa, Mycobacterium
RQVE

SEQ ID NO: 567474 - protein, 4 aa, Mycobacterium
RQVG

SEQ ID NO: 567475 - protein, 5 aa, Mycobacterium
RQVGG

SEQ ID NO: 567476 - protein, 6 aa, Mycobacterium
RQVGSD

SEQ ID NO: 567477 - protein, 20 aa, Mycobacterium
RQVPGISPQISQKDGMDHSD

SEQ ID NO: 567478 - protein, 10 aa, Mycobacterium
RQVPGPGTAR

SEQ ID NO: 567479 - protein, 6 aa, Mycobacterium
RQVPKG

SEQ ID NO: 567480 - protein, 10 aa, Mycobacterium
RQVPSQELGG

SEQ ID NO: 567481 - protein, 5 aa, Mycobacterium
RQVSA

SEQ ID NO: 567482 - protein, 10 aa, Mycobacterium
RQVSDADKAM

SEQ ID NO: 567483 - protein, 17 aa, Mycobacterium
RQVSDTAGDYQVEGAKT

SEQ ID NO: 567484 - protein, 7 aa, Mycobacterium
RQVSRKA

SEQ ID NO: 567485 - protein, 15 aa, Mycobacterium
RQVTEVKNTNEIRPD

SEQ ID NO: 567486 - protein, 9 aa, Mycobacterium
RQVTSTSAR

SEQ ID NO: 567487 - protein, 5 aa, Mycobacterium
RQWNG

SEQ ID NO: 567488 - protein, 7 aa, Mycobacterium
RQWPDRT

SEQ ID NO: 567489 - protein, 4 aa, Mycobacterium
RQYD

SEQ ID NO: 567490 - protein, 5 aa, Mycobacterium
RQYGD

SEQ ID NO: 567491 - protein, 7 aa, Mycobacterium
RQYGIEP

SEQ ID NO: 567492 - protein, 5 aa, Mycobacterium
RQYGR

SEQ ID NO: 567493 - protein, 7 aa, Mycobacterium
RQYGVEP

SEQ ID NO: 567494 - protein, 9 aa, Mycobacterium
RQYHSRTDR

SEQ ID NO: 567495 - protein, 5 aa, Mycobacterium
RQYNP

SEQ ID NO: 567496 - protein, 8 aa, Mycobacterium
RQYPTATV

SEQ ID NO: 567497 - protein, 9 aa, Mycobacterium
RQYRTDRDK

SEQ ID NO: 567498 - protein, 11 aa, Mycobacterium
RQYTDEHTDTR

SEQ ID NO: 567499 - protein, 13 aa, Mycobacterium
RQYTPDPVSEDDL

SEQ ID NO: 567500 - protein, 6 aa, Mycobacterium
RQYTRG

SEQ ID NO: 567501 - protein, 12 aa, Mycobacterium
RQYVDPNGHGAG

SEQ ID NO: 567502 - protein, 5 aa, Mycobacterium
RRAAA

SEQ ID NO: 567503 - protein, 7 aa, Mycobacterium
RRAAAAD

SEQ ID NO: 567504 - protein, 26 aa, Mycobacterium
RRAAAGVATGQQQSPRRRLPEPGGEQ

SEQ ID NO: 567505 - protein, 19 aa, Mycobacterium
RRAADQTEQRARRPPLNKD

SEQ ID NO: 567506 - protein, 9 aa, Mycobacterium
RRAADSEDE

SEQ ID NO: 567507 - protein, 20 aa, Mycobacterium
RRAAEAAAGIPASRRGRGLA

SEQ ID NO: 567508 - protein, 7 aa, Mycobacterium
RRAAEAG

SEQ ID NO: 567509 - protein, 9 aa, Mycobacterium
RRAAEGTDA

SEQ ID NO: 567510 - protein, 12 aa, Mycobacterium
RRAAESVGAELR

SEQ ID NO: 567511 - protein, 5 aa, Mycobacterium
RRAAG

SEQ ID NO: 567512 - protein, 14 aa, Mycobacterium
RRAAGAAARALGTA

SEQ ID NO: 567513 - protein, 13 aa, Mycobacterium
RRAAGAAARSLSG

SEQ ID NO: 567514 - protein, 8 aa, Mycobacterium
RRAAGDLN

SEQ ID NO: 567515 - protein, 7 aa, Mycobacterium
RRAAGTG

SEQ ID NO: 567516 - protein, 14 aa, Mycobacterium
RRAAGTSGSHQRIR

SEQ ID NO: 567517 - protein, 23 aa, Mycobacterium
RRAAKPGRNKSGRTARSRGRTGR

SEQ ID NO: 567518 - protein, 13 aa, Mycobacterium
RRAAKRAKEIESG

SEQ ID NO: 567519 - protein, 7 aa, Mycobacterium
RRAANDR

SEQ ID NO: 567520 - protein, 26 aa, Mycobacterium
RRAAPAAATRTASGSVAVPGARARVA

SEQ ID NO: 567521 - protein, 8 aa, Mycobacterium
RRAAPRDD

SEQ ID NO: 567522 - protein, 5 aa, Mycobacterium
RRAAQ

SEQ ID NO: 567523 - protein, 10 aa, Mycobacterium
RRAAQADGYP

SEQ ID NO: 567524 - protein, 13 aa, Mycobacterium
RRAAQRARSAVPD

SEQ ID NO: 567525 - protein, 11 aa, Mycobacterium
RRAAQTASGIA

SEQ ID NO: 567526 - protein, 19 aa, Mycobacterium
RRAARGDRERGEAGRCGSP

SEQ ID NO: 567527 - protein, 10 aa, Mycobacterium
RRAARKVSET

SEQ ID NO: 567528 - protein, 6 aa, Mycobacterium
RRAARN

SEQ ID NO: 567529 - protein, 7 aa, Mycobacterium
RRAASGY

SEQ ID NO: 567530 - protein, 10 aa, Mycobacterium
RRAASSERTL

SEQ ID NO: 567531 - protein, 5 aa, Mycobacterium
RRAAT

SEQ ID NO: 567532 - protein, 9 aa, Mycobacterium
RRAATEYAQ

SEQ ID NO: 567533 - protein, 6 aa, Mycobacterium
RRAATG

SEQ ID NO: 567534 - protein, 7 aa, Mycobacterium
RRAATGQ

SEQ ID NO: 567535 - protein, 8 aa, Mycobacterium
RRAATKAD

SEQ ID NO: 567536 - protein, 7 aa, Mycobacterium
RRAATQD

SEQ ID NO: 567537 - protein, 6 aa, Mycobacterium
RRACRK

SEQ ID NO: 567538 - protein, 9 aa, Mycobacterium
RRADAGVSD

SEQ ID NO: 567539 - protein, 7 aa, Mycobacterium
RRADASH

SEQ ID NO: 567540 - protein, 7 aa, Mycobacterium
RRADCDE

SEQ ID NO: 567541 - protein, 6 aa, Mycobacterium
RRADDA

SEQ ID NO: 567542 - protein, 7 aa, Mycobacterium
RRADDGR

SEQ ID NO: 567543 - protein, 5 aa, Mycobacterium
RRADF

SEQ ID NO: 567544 - protein, 6 aa, Mycobacterium
RRADGD

SEQ ID NO: 567545 - protein, 6 aa, Mycobacterium
RRADGS

SEQ ID NO: 567546 - protein, 5 aa, Mycobacterium
RRADP

SEQ ID NO: 567547 - protein, 6 aa, Mycobacterium
RRADPA

SEQ ID NO: 567548 - protein, 10 aa, Mycobacterium
RRADPDTRAE

SEQ ID NO: 567549 - protein, 8 aa, Mycobacterium
RRADPHDD

SEQ ID NO: 567550 - protein, 13 aa, Mycobacterium
RRADPRTKVPAGS

SEQ ID NO: 567551 - protein, 9 aa, Mycobacterium
RRADPTGEL

SEQ ID NO: 567552 - protein, 5 aa, Mycobacterium
RRADQ

SEQ ID NO: 567553 - protein, 6 aa, Mycobacterium
RRADQA

SEQ ID NO: 567554 - protein, 12 aa, Mycobacterium
RRADQPAEVLGP

SEQ ID NO: 567555 - protein, 9 aa, Mycobacterium
RRADSEMEN

SEQ ID NO: 567556 - protein, 7 aa, Mycobacterium
RRADTAF

SEQ ID NO: 567557 - protein, 8 aa, Mycobacterium
RRADTAYI

SEQ ID NO: 567558 - protein, 8 aa, Mycobacterium
RRAEAAQQ

SEQ ID NO: 567559 - protein, 9 aa, Mycobacterium
RRAEAARRS

SEQ ID NO: 567560 - protein, 12 aa, Mycobacterium
RRAEDAGRDPAT

SEQ ID NO: 567561 - protein, 11 aa, Mycobacterium
RRAEDQGDDKA

SEQ ID NO: 567562 - protein, 23 aa, Mycobacterium
RRAEDTGASVTVTADAGAAARGA

SEQ ID NO: 567563 - protein, 9 aa, Mycobacterium
RRAEEAGGE

SEQ ID NO: 567564 - protein, 18 aa, Mycobacterium
RRAEEPKTASAVDVSRAL

SEQ ID NO: 567565 - protein, 28 aa, Mycobacterium
RRAEGASGADGGRSAQRHGLGVGGDGPG

SEQ ID NO: 567566 - protein, 12 aa, Mycobacterium
RRAEGKVPADAP

SEQ ID NO: 567567 - protein, 6 aa, Mycobacterium
RRAEGL

SEQ ID NO: 567568 - protein, 14 aa, Mycobacterium
RRAEKAKEPDETQA

SEQ ID NO: 567569 - protein, 13 aa, Mycobacterium
RRAENAGGASRTS

SEQ ID NO: 567570 - protein, 7 aa, Mycobacterium
RRAENPH

SEQ ID NO: 567571 - protein, 6 aa, Mycobacterium
RRAEPC

SEQ ID NO: 567572 - protein, 7 aa, Mycobacterium
RRAEPDG

SEQ ID NO: 567573 - protein, 10 aa, Mycobacterium
RRAEPEDDTV

SEQ ID NO: 567574 - protein, 14 aa, Mycobacterium
RRAEPEGPALSPRE

SEQ ID NO: 567575 - protein, 8 aa, Mycobacterium
RRAEPKDD

SEQ ID NO: 567576 - protein, 13 aa, Mycobacterium
RRAEPLKETAAEV

SEQ ID NO: 567577 - protein, 8 aa, Mycobacterium
RRAEPQDD

SEQ ID NO: 567578 - protein, 8 aa, Mycobacterium
RRAEPRDD

SEQ ID NO: 567579 - protein, 12 aa, Mycobacterium
RRAEPRTAVPAG

SEQ ID NO: 567580 - protein, 7 aa, Mycobacterium
RRAEPTD

SEQ ID NO: 567581 - protein, 8 aa, Mycobacterium
RRAEPTDD

SEQ ID NO: 567582 - protein, 8 aa, Mycobacterium
RRAEPTED

SEQ ID NO: 567583 - protein, 6 aa, Mycobacterium
RRAEQA

SEQ ID NO: 567584 - protein, 8 aa, Mycobacterium
RRAERERL

SEQ ID NO: 567585 - protein, 6 aa, Mycobacterium
RRAERS

SEQ ID NO: 567586 - protein, 9 aa, Mycobacterium
RRAETENAD

SEQ ID NO: 567587 - protein, 12 aa, Mycobacterium
RRAETGSGDGAD

SEQ ID NO: 567588 - protein, 10 aa, Mycobacterium
RRAETRHGTK

SEQ ID NO: 567589 - protein, 5 aa, Mycobacterium
RRAEV

SEQ ID NO: 567590 - protein, 4 aa, Mycobacterium
RRAG

SEQ ID NO: 567591 - protein, 5 aa, Mycobacterium
RRAGA

SEQ ID NO: 567592 - protein, 6 aa, Mycobacterium
RRAGAG

SEQ ID NO: 567593 - protein, 16 aa, Mycobacterium
RRAGAHAAAAPAEQSS

SEQ ID NO: 567594 - protein, 8 aa, Mycobacterium
RRAGAQGV

SEQ ID NO: 567595 - protein, 9 aa, Mycobacterium
RRAGAQGVG

SEQ ID NO: 567596 - protein, 30 aa, Mycobacterium
RRAGARPAATVGKPSSAGRRVERRPIAPGA

SEQ ID NO: 567597 - protein, 6 aa, Mycobacterium
RRAGAT

SEQ ID NO: 567598 - protein, 7 aa, Mycobacterium
RRAGDAG

SEQ ID NO: 567599 - protein, 11 aa, Mycobacterium
RRAGDGDFGTN

SEQ ID NO: 567600 - protein, 10 aa, Mycobacterium
RRAGEAAARI

SEQ ID NO: 567601 - protein, 11 aa, Mycobacterium
RRAGEDVAAGT

SEQ ID NO: 567602 - protein, 8 aa, Mycobacterium
RRAGEGRE

SEQ ID NO: 567603 - protein, 7 aa, Mycobacterium
RRAGETA

SEQ ID NO: 567604 - protein, 6 aa, Mycobacterium
RRAGGD

SEQ ID NO: 567605 - protein, 6 aa, Mycobacterium
RRAGGN

SEQ ID NO: 567606 - protein, 9 aa, Mycobacterium
RRAGKRGPR

SEQ ID NO: 567607 - protein, 10 aa, Mycobacterium
RRAGKRRDAD

SEQ ID NO: 567608 - protein, 11 aa, Mycobacterium
RRAGKRREADT

SEQ ID NO: 567609 - protein, 8 aa, Mycobacterium
RRAGLDPD

SEQ ID NO: 567610 - protein, 8 aa, Mycobacterium
RRAGLDPP

SEQ ID NO: 567611 - protein, 7 aa, Mycobacterium
RRAGLST

SEQ ID NO: 567612 - protein, 8 aa, Mycobacterium
RRAGMGPP

SEQ ID NO: 567613 - protein, 8 aa, Mycobacterium
RRAGMTPP

SEQ ID NO: 567614 - protein, 8 aa, Mycobacterium
RRAGPAGG

SEQ ID NO: 567615 - protein, 6 aa, Mycobacterium
RRAGPE

SEQ ID NO: 567616 - protein, 7 aa, Mycobacterium
RRAGPEL

SEQ ID NO: 567617 - protein, 10 aa, Mycobacterium
RRAGPGDGVA

SEQ ID NO: 567618 - protein, 20 aa, Mycobacterium
RRAGPHHGARPVRRRGHGLR

SEQ ID NO: 567619 - protein, 8 aa, Mycobacterium
RRAGPQWS

SEQ ID NO: 567620 - protein, 11 aa, Mycobacterium
RRAGPRPPTGL

SEQ ID NO: 567621 - protein, 7 aa, Mycobacterium
RRAGQNP

SEQ ID NO: 567622 - protein, 8 aa, Mycobacterium
RRAGRRTG

SEQ ID NO: 567623 - protein, 9 aa, Mycobacterium
RRAGRTAGG

SEQ ID NO: 567624 - protein, 14 aa, Mycobacterium
RRAGSADSAIEPKS

SEQ ID NO: 567625 - protein, 5 aa, Mycobacterium
RRAGT

SEQ ID NO: 567626 - protein, 8 aa, Mycobacterium
RRAGTDPE

SEQ ID NO: 567627 - protein, 9 aa, Mycobacterium
RRAGTDSEI

SEQ ID NO: 567628 - protein, 7 aa, Mycobacterium
RRAGVAK

SEQ ID NO: 567629 - protein, 6 aa, Mycobacterium
RRAGVG

SEQ ID NO: 567630 - protein, 7 aa, Mycobacterium
RRAGVGK

SEQ ID NO: 567631 - protein, 6 aa, Mycobacterium
RRAGVS

SEQ ID NO: 567632 - protein, 7 aa, Mycobacterium
RRAGVSA

SEQ ID NO: 567633 - protein, 16 aa, Mycobacterium
RRAGVSGYVGDGSQRW

SEQ ID NO: 567634 - protein, 29 aa, Mycobacterium
RRAGVTAETGTHIDTTRTDGVGHAEPEEK

SEQ ID NO: 567635 - protein, 5 aa, Mycobacterium
RRAGY

SEQ ID NO: 567636 - protein, 16 aa, Mycobacterium
RRAGYRPARREGAREG

SEQ ID NO: 567637 - protein, 8 aa, Mycobacterium
RRAHEAGA

SEQ ID NO: 567638 - protein, 7 aa, Mycobacterium
RRAHEQA

SEQ ID NO: 567639 - protein, 7 aa, Mycobacterium
RRAHPES

SEQ ID NO: 567640 - protein, 7 aa, Mycobacterium
RRAHPGD

SEQ ID NO: 567641 - protein, 7 aa, Mycobacterium
RRAHPQD

SEQ ID NO: 567642 - protein, 5 aa, Mycobacterium
RRAHS

SEQ ID NO: 567643 - protein, 4 aa, Mycobacterium
RRAI

SEQ ID NO: 567644 - protein, 17 aa, Mycobacterium
RRAIREGDIRNDVDPDA

SEQ ID NO: 567645 - protein, 9 aa, Mycobacterium
RRAKDEGVD

SEQ ID NO: 567646 - protein, 9 aa, Mycobacterium
RRAKDRRKI

SEQ ID NO: 567647 - protein, 19 aa, Mycobacterium
RRAKERKHRKARMDQRTRE

SEQ ID NO: 567648 - protein, 9 aa, Mycobacterium
RRAKPEDDT

SEQ ID NO: 567649 - protein, 9 aa, Mycobacterium
RRAKPKDDL

SEQ ID NO: 567650 - protein, 7 aa, Mycobacterium
RRAKTRK

SEQ ID NO: 567651 - protein, 9 aa, Mycobacterium
RRAKTSKPV

SEQ ID NO: 567652 - protein, 6 aa, Mycobacterium
RRALGP

SEQ ID NO: 567653 - protein, 10 aa, Mycobacterium
RRALPAPDYT

SEQ ID NO: 567654 - protein, 13 aa, Mycobacterium
RRALPAPDYTTSA

SEQ ID NO: 567655 - protein, 26 aa, Mycobacterium
RRALPEPEITSTTRFREPSTDTERTV

SEQ ID NO: 567656 - protein, 13 aa, Mycobacterium
RRALPTPDYTTTE

SEQ ID NO: 567657 - protein, 14 aa, Mycobacterium
RRALPTPDYTTTTE

SEQ ID NO: 567658 - protein, 6 aa, Mycobacterium
RRALSR

SEQ ID NO: 567659 - protein, 4 aa, Mycobacterium
RRAM

SEQ ID NO: 567660 - protein, 6 aa, Mycobacterium
RRAMTD

SEQ ID NO: 567661 - protein, 12 aa, Mycobacterium
RRANAGKSRRAL

SEQ ID NO: 567662 - protein, 6 aa, Mycobacterium
RRANGC

SEQ ID NO: 567663 - protein, 8 aa, Mycobacterium
RRANPGDD

SEQ ID NO: 567664 - protein, 7 aa, Mycobacterium
RRANPRD

SEQ ID NO: 567665 - protein, 8 aa, Mycobacterium
RRANPRDD

SEQ ID NO: 567666 - protein, 9 aa, Mycobacterium
RRANPTDDA

SEQ ID NO: 567667 - protein, 4 aa, Mycobacterium
RRAP

SEQ ID NO: 567668 - protein, 5 aa, Mycobacterium
RRAPA

SEQ ID NO: 567669 - protein, 7 aa, Mycobacterium
RRAPAGA

SEQ ID NO: 567670 - protein, 9 aa, Mycobacterium
RRAPAGQGC

SEQ ID NO: 567671 - protein, 7 aa, Mycobacterium
RRAPAGV

SEQ ID NO: 567672 - protein, 5 aa, Mycobacterium
RRAPC

SEQ ID NO: 567673 - protein, 11 aa, Mycobacterium
RRAPDAAAQQA

SEQ ID NO: 567674 - protein, 10 aa, Mycobacterium
RRAPDDDADR

SEQ ID NO: 567675 - protein, 9 aa, Mycobacterium
RRAPDTDAQ

SEQ ID NO: 567676 - protein, 11 aa, Mycobacterium
RRAPEGQATGS

SEQ ID NO: 567677 - protein, 7 aa, Mycobacterium
RRAPGDD

SEQ ID NO: 567678 - protein, 7 aa, Mycobacterium
RRAPGQR

SEQ ID NO: 567679 - protein, 16 aa, Mycobacterium
RRAPGSVSGPDAPAHP

SEQ ID NO: 567680 - protein, 9 aa, Mycobacterium
RRAPGTAVQ

SEQ ID NO: 567681 - protein, 9 aa, Mycobacterium
RRAPHAADE

SEQ ID NO: 567682 - protein, 5 aa, Mycobacterium
RRAPI

SEQ ID NO: 567683 - protein, 5 aa, Mycobacterium
RRAPR

SEQ ID NO: 567684 - protein, 6 aa, Mycobacterium
RRAPSQ

SEQ ID NO: 567685 - protein, 4 aa, Mycobacterium
RRAQ

SEQ ID NO: 567686 - protein, 5 aa, Mycobacterium
RRAQA

SEQ ID NO: 567687 - protein, 15 aa, Mycobacterium
RRAQAEGRCRDDDPQ

SEQ ID NO: 567688 - protein, 10 aa, Mycobacterium
RRAQAPAAEI

SEQ ID NO: 567689 - protein, 9 aa, Mycobacterium
RRAQDVGGS

SEQ ID NO: 567690 - protein, 5 aa, Mycobacterium
RRAQE

SEQ ID NO: 567691 - protein, 18 aa, Mycobacterium
RRAQEQGYATELDPQHTA

SEQ ID NO: 567692 - protein, 10 aa, Mycobacterium
RRAQEQGYGA

SEQ ID NO: 567693 - protein, 18 aa, Mycobacterium
RRAQEQGYGAELNPEHTA

SEQ ID NO: 567694 - protein, 18 aa, Mycobacterium
RRAQEQGYGTELNPEHTA

SEQ ID NO: 567695 - protein, 15 aa, Mycobacterium
RRAQESGEHRPESLD

SEQ ID NO: 567696 - protein, 5 aa, Mycobacterium
RRAQG

SEQ ID NO: 567697 - protein, 10 aa, Mycobacterium
RRAQGLPATS

SEQ ID NO: 567698 - protein, 8 aa, Mycobacterium
RRAQPDWE

SEQ ID NO: 567699 - protein, 9 aa, Mycobacterium
RRAQPGWQP

SEQ ID NO: 567700 - protein, 10 aa, Mycobacterium
RRAQPGWQPR

SEQ ID NO: 567701 - protein, 6 aa, Mycobacterium
RRAQRH

SEQ ID NO: 567702 - protein, 8 aa, Mycobacterium
RRAQRPAA

SEQ ID NO: 567703 - protein, 14 aa, Mycobacterium
RRAQTRTQPPPNTI

SEQ ID NO: 567704 - protein, 12 aa, Mycobacterium
RRARAELSETEF

SEQ ID NO: 567705 - protein, 15 aa, Mycobacterium
RRARAGVADPNRPTG

SEQ ID NO: 567706 - protein, 5 aa, Mycobacterium
RRARD

SEQ ID NO: 567707 - protein, 8 aa, Mycobacterium
RRARDGGV

SEQ ID NO: 567708 - protein, 10 aa, Mycobacterium
RRARDGQPDI

SEQ ID NO: 567709 - protein, 7 aa, Mycobacterium
RRARDRG

SEQ ID NO: 567710 - protein, 11 aa, Mycobacterium
RRAREEAEELR

SEQ ID NO: 567711 - protein, 6 aa, Mycobacterium
RRAREL

SEQ ID NO: 567712 - protein, 8 aa, Mycobacterium
RRARETGA

SEQ ID NO: 567713 - protein, 5 aa, Mycobacterium
RRARG

SEQ ID NO: 567714 - protein, 31 aa, Mycobacterium
RRARGPAKRPAKKAARKSPAKKSAAKKTAKR

SEQ ID NO: 567715 - protein, 37 aa, Mycobacterium
RRARGPVKKKAAKKAAVKKTAAKKAAKKAPAKKAAKK

SEQ ID NO: 567716 - protein, 29 aa, Mycobacterium
RRARGPVKKKAPAKKAAKKAPAKKAAAKK

SEQ ID NO: 567717 - protein, 26 aa, Mycobacterium
RRARGPVKRAAKKTTRKSPAKKAVKR

SEQ ID NO: 567718 - protein, 35 aa, Mycobacterium
RRARGPVKRAKKAPAKAAKKAPAKKAPAKKAAKKA

SEQ ID NO: 567719 - protein, 26 aa, Mycobacterium
RRARGPVKRPAKKAARKKAPAKKAGK

SEQ ID NO: 567720 - protein, 26 aa, Mycobacterium
RRARGPVKRTAKKTTRKAPARKAVKR

SEQ ID NO: 567721 - protein, 6 aa, Mycobacterium
RRARGR

SEQ ID NO: 567722 - protein, 9 aa, Mycobacterium
RRARNGRTM

SEQ ID NO: 567723 - protein, 7 aa, Mycobacterium
RRARPDT

SEQ ID NO: 567724 - protein, 6 aa, Mycobacterium
RRARPI

SEQ ID NO: 567725 - protein, 11 aa, Mycobacterium
RRARPQPARDD

SEQ ID NO: 567726 - protein, 5 aa, Mycobacterium
RRARQ

SEQ ID NO: 567727 - protein, 5 aa, Mycobacterium
RRARR

SEQ ID NO: 567728 - protein, 16 aa, Mycobacterium
RRARRGADDFYRRDLW

SEQ ID NO: 567729 - protein, 9 aa, Mycobacterium
RRARRGRAQ

SEQ ID NO: 567730 - protein, 7 aa, Mycobacterium
RRARRKG

SEQ ID NO: 567731 - protein, 9 aa, Mycobacterium
RRARSKEDI

SEQ ID NO: 567732 - protein, 6 aa, Mycobacterium
RRARSQ

SEQ ID NO: 567733 - protein, 27 aa, Mycobacterium
RRARSRRRGPGRRQPRGVRAGAAGTHR

SEQ ID NO: 567734 - protein, 8 aa, Mycobacterium
RRARSTPR

SEQ ID NO: 567735 - protein, 6 aa, Mycobacterium
RRASEI

SEQ ID NO: 567736 - protein, 6 aa, Mycobacterium
RRASGD

SEQ ID NO: 567737 - protein, 10 aa, Mycobacterium
RRASGETPAR

SEQ ID NO: 567738 - protein, 13 aa, Mycobacterium
RRASKAPRSNPEA

SEQ ID NO: 567739 - protein, 12 aa, Mycobacterium
RRASPGGVPGAD

SEQ ID NO: 567740 - protein, 14 aa, Mycobacterium
RRASQASRSNPEAR

SEQ ID NO: 567741 - protein, 16 aa, Mycobacterium
RRASRGRASPSVTRSR

SEQ ID NO: 567742 - protein, 13 aa, Mycobacterium
RRATAGKSKRALA

SEQ ID NO: 567743 - protein, 36 aa, Mycobacterium
RRATAPPQQDAQAQVRPPVPPPTDLDEDDFYQFQRF

SEQ ID NO: 567744 - protein, 5 aa, Mycobacterium
RRATD

SEQ ID NO: 567745 - protein, 5 aa, Mycobacterium
RRATE

SEQ ID NO: 567746 - protein, 10 aa, Mycobacterium
RRATEAASQR

SEQ ID NO: 567747 - protein, 9 aa, Mycobacterium
RRATEKGVV

SEQ ID NO: 567748 - protein, 6 aa, Mycobacterium
RRATES

SEQ ID NO: 567749 - protein, 11 aa, Mycobacterium
RRATGGPAEQT

SEQ ID NO: 567750 - protein, 7 aa, Mycobacterium
RRATGRP

SEQ ID NO: 567751 - protein, 8 aa, Mycobacterium
RRATGRSV

SEQ ID NO: 567752 - protein, 9 aa, Mycobacterium
RRATPADDL

SEQ ID NO: 567753 - protein, 6 aa, Mycobacterium
RRATQD

SEQ ID NO: 567754 - protein, 7 aa, Mycobacterium
RRATRRE

SEQ ID NO: 567755 - protein, 10 aa, Mycobacterium
RRATSGHVDT

SEQ ID NO: 567756 - protein, 5 aa, Mycobacterium
RRATT

SEQ ID NO: 567757 - protein, 5 aa, Mycobacterium
RRAVG

SEQ ID NO: 567758 - protein, 12 aa, Mycobacterium
RRAVKDAGRPVE

SEQ ID NO: 567759 - protein, 13 aa, Mycobacterium
RRAVKDAGRPVER

SEQ ID NO: 567760 - protein, 12 aa, Mycobacterium
RRAVRAAASQAV

SEQ ID NO: 567761 - protein, 9 aa, Mycobacterium
RRAYADEAQ

SEQ ID NO: 567762 - protein, 8 aa, Mycobacterium
RRAYDDPG

SEQ ID NO: 567763 - protein, 5 aa, Mycobacterium
RRAYR

SEQ ID NO: 567764 - protein, 7 aa, Mycobacterium
RRCAPTD

SEQ ID NO: 567765 - protein, 6 aa, Mycobacterium
RRCGPG

SEQ ID NO: 567766 - protein, 4 aa, Mycobacterium
RRDA

SEQ ID NO: 567767 - protein, 5 aa, Mycobacterium
RRDAA

SEQ ID NO: 567768 - protein, 7 aa, Mycobacterium
RRDADDT

SEQ ID NO: 567769 - protein, 7 aa, Mycobacterium
RRDAEVE

SEQ ID NO: 567770 - protein, 6 aa, Mycobacterium
RRDAGR

SEQ ID NO: 567771 - protein, 15 aa, Mycobacterium
RRDAKGGVTITVRLT

SEQ ID NO: 567772 - protein, 8 aa, Mycobacterium
RRDAPQAK

SEQ ID NO: 567773 - protein, 10 aa, Mycobacterium
RRDARAPETL

SEQ ID NO: 567774 - protein, 9 aa, Mycobacterium
RRDARAPQL

SEQ ID NO: 567775 - protein, 6 aa, Mycobacterium
RRDARD

SEQ ID NO: 567776 - protein, 17 aa, Mycobacterium
RRDARSPQTKLESSGGL

SEQ ID NO: 567777 - protein, 11 aa, Mycobacterium
RRDATDLESAA

SEQ ID NO: 567778 - protein, 21 aa, Mycobacterium
RRDATTGGVARRGGRYRVGSN

SEQ ID NO: 567779 - protein, 5 aa, Mycobacterium
RRDAY

SEQ ID NO: 567780 - protein, 4 aa, Mycobacterium
RRDD

SEQ ID NO: 567781 - protein, 15 aa, Mycobacterium
RRDDAGHRGDPQAVP

SEQ ID NO: 567782 - protein, 17 aa, Mycobacterium
RRDDDAAFGHSSGPQSW

SEQ ID NO: 567783 - protein, 9 aa, Mycobacterium
RRDDDDALA

SEQ ID NO: 567784 - protein, 17 aa, Mycobacterium
RRDDDSAHDESSEASKA

SEQ ID NO: 567785 - protein, 15 aa, Mycobacterium
RRDDDTPALASGERT

SEQ ID NO: 567786 - protein, 6 aa, Mycobacterium
RRDDET

SEQ ID NO: 567787 - protein, 11 aa, Mycobacterium
RRDDFARRSGE

SEQ ID NO: 567788 - protein, 5 aa, Mycobacterium
RRDDG

SEQ ID NO: 567789 - protein, 6 aa, Mycobacterium
RRDDGR

SEQ ID NO: 567790 - protein, 5 aa, Mycobacterium
RRDDI

SEQ ID NO: 567791 - protein, 5 aa, Mycobacterium
RRDDL

SEQ ID NO: 567792 - protein, 8 aa, Mycobacterium
RRDDPGDD

SEQ ID NO: 567793 - protein, 8 aa, Mycobacterium
RRDDPLRQ

SEQ ID NO: 567794 - protein, 8 aa, Mycobacterium
RRDDQERL

SEQ ID NO: 567795 - protein, 6 aa, Mycobacterium
RRDDQV

SEQ ID NO: 567796 - protein, 13 aa, Mycobacterium
RRDDRRDGRSTAG

SEQ ID NO: 567797 - protein, 11 aa, Mycobacterium
RRDDRYREAAG

SEQ ID NO: 567798 - protein, 11 aa, Mycobacterium
RRDEFARRSGE

SEQ ID NO: 567799 - protein, 6 aa, Mycobacterium
RRDEGD

SEQ ID NO: 567800 - protein, 8 aa, Mycobacterium
RRDEHRGC

SEQ ID NO: 567801 - protein, 9 aa, Mycobacterium
RRDELARQK

SEQ ID NO: 567802 - protein, 15 aa, Mycobacterium
RRDEPMGDHGRRASD

SEQ ID NO: 567803 - protein, 7 aa, Mycobacterium
RRDERKA

SEQ ID NO: 567804 - protein, 8 aa, Mycobacterium
RRDERVPA

SEQ ID NO: 567805 - protein, 5 aa, Mycobacterium
RRDET

SEQ ID NO: 567806 - protein, 9 aa, Mycobacterium
RRDETGEGS

SEQ ID NO: 567807 - protein, 5 aa, Mycobacterium
RRDEV

SEQ ID NO: 567808 - protein, 12 aa, Mycobacterium
RRDEYGGDIDNR

SEQ ID NO: 567809 - protein, 8 aa, Mycobacterium
RRDFDDAD

SEQ ID NO: 567810 - protein, 6 aa, Mycobacterium
RRDGAE

SEQ ID NO: 567811 - protein, 7 aa, Mycobacterium
RRDGASV

SEQ ID NO: 567812 - protein, 10 aa, Mycobacterium
RRDGATVRPD

SEQ ID NO: 567813 - protein, 10 aa, Mycobacterium
RRDGDHPDAD

SEQ ID NO: 567814 - protein, 7 aa, Mycobacterium
RRDGDKL

SEQ ID NO: 567815 - protein, 8 aa, Mycobacterium
RRDGDKLS

SEQ ID NO: 567816 - protein, 15 aa, Mycobacterium
RRDGDRIKMSKVEFL

SEQ ID NO: 567817 - protein, 5 aa, Mycobacterium
RRDGE

SEQ ID NO: 567818 - protein, 6 aa, Mycobacterium
RRDGEA

SEQ ID NO: 567819 - protein, 6 aa, Mycobacterium
RRDGED

SEQ ID NO: 567820 - protein, 6 aa, Mycobacterium
RRDGEN

SEQ ID NO: 567821 - protein, 6 aa, Mycobacterium
RRDGGD

SEQ ID NO: 567822 - protein, 7 aa, Mycobacterium
RRDGGGL

SEQ ID NO: 567823 - protein, 9 aa, Mycobacterium
RRDGGTGVD

SEQ ID NO: 567824 - protein, 5 aa, Mycobacterium
RRDGI

SEQ ID NO: 567825 - protein, 11 aa, Mycobacterium
RRDGIDAASEI

SEQ ID NO: 567826 - protein, 14 aa, Mycobacterium
RRDGIDAASEIASK

SEQ ID NO: 567827 - protein, 6 aa, Mycobacterium
RRDGKP

SEQ ID NO: 567828 - protein, 7 aa, Mycobacterium
RRDGNGG

SEQ ID NO: 567829 - protein, 7 aa, Mycobacterium
RRDGPHD

SEQ ID NO: 567830 - protein, 26 aa, Mycobacterium
RRDGPQGGQHPRRQRECGGADHPCRR

SEQ ID NO: 567831 - protein, 17 aa, Mycobacterium
RRDGRDRQSSSHDALPG

SEQ ID NO: 567832 - protein, 15 aa, Mycobacterium
RRDGRGAPADVPPEA

SEQ ID NO: 567833 - protein, 7 aa, Mycobacterium
RRDGRIR

SEQ ID NO: 567834 - protein, 6 aa, Mycobacterium
RRDGRY

SEQ ID NO: 567835 - protein, 9 aa, Mycobacterium
RRDGSVQSS

SEQ ID NO: 567836 - protein, 7 aa, Mycobacterium
RRDGTEI

SEQ ID NO: 567837 - protein, 7 aa, Mycobacterium
RRDGYDP

SEQ ID NO: 567838 - protein, 10 aa, Mycobacterium
RRDHGNPPVI

SEQ ID NO: 567839 - protein, 4 aa, Mycobacterium
RRDI

SEQ ID NO: 567840 - protein, 5 aa, Mycobacterium
RRDIP

SEQ ID NO: 567841 - protein, 7 aa, Mycobacterium
RRDIPGQ

SEQ ID NO: 567842 - protein, 6 aa, Mycobacterium
RRDITD

SEQ ID NO: 567843 - protein, 7 aa, Mycobacterium
RRDKHSA

SEQ ID NO: 567844 - protein, 7 aa, Mycobacterium
RRDKIGK

SEQ ID NO: 567845 - protein, 13 aa, Mycobacterium
RRDKPDPSTYIGS

SEQ ID NO: 567846 - protein, 19 aa, Mycobacterium
RRDKPDPSTYIGSGKAQEL

SEQ ID NO: 567847 - protein, 10 aa, Mycobacterium
RRDKSGAGTR

SEQ ID NO: 567848 - protein, 7 aa, Mycobacterium
RRDKVAK

SEQ ID NO: 567849 - protein, 4 aa, Mycobacterium
RRDL

SEQ ID NO: 567850 - protein, 10 aa, Mycobacterium
RRDLESNAKE

SEQ ID NO: 567851 - protein, 5 aa, Mycobacterium
RRDLG

SEQ ID NO: 567852 - protein, 17 aa, Mycobacterium
RRDLGASAAELVGEARS

SEQ ID NO: 567853 - protein, 5 aa, Mycobacterium
RRDLP

SEQ ID NO: 567854 - protein, 4 aa, Mycobacterium
RRDN

SEQ ID NO: 567855 - protein, 17 aa, Mycobacterium
RRDNANGARAKSQTVRT

SEQ ID NO: 567856 - protein, 8 aa, Mycobacterium
RRDNDKAR

SEQ ID NO: 567857 - protein, 17 aa, Mycobacterium
RRDNPTGRVASLIWLER

SEQ ID NO: 567858 - protein, 7 aa, Mycobacterium
RRDPAAA

SEQ ID NO: 567859 - protein, 8 aa, Mycobacterium
RRDPAAAR

SEQ ID NO: 567860 - protein, 17 aa, Mycobacterium
RRDPAYAGVGSTDGTTH

SEQ ID NO: 567861 - protein, 7 aa, Mycobacterium
RRDPDDL

SEQ ID NO: 567862 - protein, 6 aa, Mycobacterium
RRDPDR

SEQ ID NO: 567863 - protein, 5 aa, Mycobacterium
RRDPE

SEQ ID NO: 567864 - protein, 8 aa, Mycobacterium
RRDPENAD

SEQ ID NO: 567865 - protein, 7 aa, Mycobacterium
RRDPETV

SEQ ID NO: 567866 - protein, 7 aa, Mycobacterium
RRDPGDD

SEQ ID NO: 567867 - protein, 5 aa, Mycobacterium
RRDPH

SEQ ID NO: 567868 - protein, 6 aa, Mycobacterium
RRDPLG

SEQ ID NO: 567869 - protein, 9 aa, Mycobacterium
RRDPNRPRA

SEQ ID NO: 567870 - protein, 15 aa, Mycobacterium
RRDPQAARAACSGRS

SEQ ID NO: 567871 - protein, 6 aa, Mycobacterium
RRDPRT

SEQ ID NO: 567872 - protein, 11 aa, Mycobacterium
RRDPSDATQQR

SEQ ID NO: 567873 - protein, 4 aa, Mycobacterium
RRDQ

SEQ ID NO: 567874 - protein, 16 aa, Mycobacterium
RRDQASQCSSGAATAR

SEQ ID NO: 567875 - protein, 10 aa, Mycobacterium
RRDQTGAGAQ

SEQ ID NO: 567876 - protein, 16 aa, Mycobacterium
RRDRAEEVEQQQRQEL

SEQ ID NO: 567877 - protein, 6 aa, Mycobacterium
RRDRAS

SEQ ID NO: 567878 - protein, 35 aa, Mycobacterium
RRDRCGAHTPPTNGCRPAPRPTCAPRCRSQAEQQT

SEQ ID NO: 567879 - protein, 5 aa, Mycobacterium
RRDRD

SEQ ID NO: 567880 - protein, 15 aa, Mycobacterium
RRDRDAVRATLSDGD

SEQ ID NO: 567881 - protein, 7 aa, Mycobacterium
RRDRDEW

SEQ ID NO: 567882 - protein, 5 aa, Mycobacterium
RRDRG

SEQ ID NO: 567883 - protein, 5 aa, Mycobacterium
RRDRH

SEQ ID NO: 567884 - protein, 16 aa, Mycobacterium
RRDRKGAHDTFDDGGY

SEQ ID NO: 567885 - protein, 7 aa, Mycobacterium
RRDRLSS

SEQ ID NO: 567886 - protein, 31 aa, Mycobacterium
RRDRRRDELSREAGAFAEPQQEPEDVGPVRD

SEQ ID NO: 567887 - protein, 26 aa, Mycobacterium
RRDRTLGRPHRQVGGGLERPGTQDPL

SEQ ID NO: 567888 - protein, 6 aa, Mycobacterium
RRDSAN

SEQ ID NO: 567889 - protein, 11 aa, Mycobacterium
RRDSANPVTPG

SEQ ID NO: 567890 - protein, 6 aa, Mycobacterium
RRDSDV

SEQ ID NO: 567891 - protein, 15 aa, Mycobacterium
RRDSGGGDSGPVDTR

SEQ ID NO: 567892 - protein, 9 aa, Mycobacterium
RRDSGPDDA

SEQ ID NO: 567893 - protein, 13 aa, Mycobacterium
RRDSGYQPGRRSA

SEQ ID NO: 567894 - protein, 14 aa, Mycobacterium
RRDSGYQPGRRSSA

SEQ ID NO: 567895 - protein, 9 aa, Mycobacterium
RRDSHPDDR

SEQ ID NO: 567896 - protein, 10 aa, Mycobacterium
RRDSPARGSR

SEQ ID NO: 567897 - protein, 5 aa, Mycobacterium
RRDSS

SEQ ID NO: 567898 - protein, 5 aa, Mycobacterium
RRDSW

SEQ ID NO: 567899 - protein, 7 aa, Mycobacterium
RRDTDRY

SEQ ID NO: 567900 - protein, 6 aa, Mycobacterium
RRDTEM

SEQ ID NO: 567901 - protein, 18 aa, Mycobacterium
RRDTGAENATPPPADTRP

SEQ ID NO: 567902 - protein, 8 aa, Mycobacterium
RRDTGGYG

SEQ ID NO: 567903 - protein, 16 aa, Mycobacterium
RRDTGTRASGPATDRR

SEQ ID NO: 567904 - protein, 6 aa, Mycobacterium
RRDTLG

SEQ ID NO: 567905 - protein, 7 aa, Mycobacterium
RRDTNGY

SEQ ID NO: 567906 - protein, 7 aa, Mycobacterium
RRDTRQA

SEQ ID NO: 567907 - protein, 16 aa, Mycobacterium
RRDTRREFTGAPTDDE

SEQ ID NO: 567908 - protein, 6 aa, Mycobacterium
RRDTTA

SEQ ID NO: 567909 - protein, 10 aa, Mycobacterium
RRDVDDGSLA

SEQ ID NO: 567910 - protein, 8 aa, Mycobacterium
RRDVSGRQ

SEQ ID NO: 567911 - protein, 7 aa, Mycobacterium
RRDVTGR

SEQ ID NO: 567912 - protein, 8 aa, Mycobacterium
RRDVTGRQ

SEQ ID NO: 567913 - protein, 7 aa, Mycobacterium
RREAAAE

SEQ ID NO: 567914 - protein, 9 aa, Mycobacterium
RREAASAFG

SEQ ID NO: 567915 - protein, 7 aa, Mycobacterium
RREAGQA

SEQ ID NO: 567916 - protein, 11 aa, Mycobacterium
RREARNGRPAE

SEQ ID NO: 567917 - protein, 11 aa, Mycobacterium
RREASDAMTGK

SEQ ID NO: 567918 - protein, 4 aa, Mycobacterium
RRED

SEQ ID NO: 567919 - protein, 22 aa, Mycobacterium
RREDAGEKLGSPIPVPPKYKPA

SEQ ID NO: 567920 - protein, 5 aa, Mycobacterium
RREDG

SEQ ID NO: 567921 - protein, 7 aa, Mycobacterium
RREDPLR

SEQ ID NO: 567922 - protein, 7 aa, Mycobacterium
RREDPRD

SEQ ID NO: 567923 - protein, 8 aa, Mycobacterium
RREDPRDD

SEQ ID NO: 567924 - protein, 6 aa, Mycobacterium
RREDQA

SEQ ID NO: 567925 - protein, 10 aa, Mycobacterium
RREDRRASLT

SEQ ID NO: 567926 - protein, 7 aa, Mycobacterium
RREDRVK

SEQ ID NO: 567927 - protein, 8 aa, Mycobacterium
RREDTAEL

SEQ ID NO: 567928 - protein, 25 aa, Mycobacterium
RREDTGRYNPAPTNQGGDGPVPVPP

SEQ ID NO: 567929 - protein, 8 aa, Mycobacterium
RREDTRNT

SEQ ID NO: 567930 - protein, 13 aa, Mycobacterium
RREEALDSGKEAI

SEQ ID NO: 567931 - protein, 13 aa, Mycobacterium
RREEALEAGKDAI

SEQ ID NO: 567932 - protein, 16 aa, Mycobacterium
RREEALEAGKDAMARE

SEQ ID NO: 567933 - protein, 12 aa, Mycobacterium
RREEALEAGKEA

SEQ ID NO: 567934 - protein, 13 aa, Mycobacterium
RREEALEAGKEAM

SEQ ID NO: 567935 - protein, 16 aa, Mycobacterium
RREEALESGKDAIARE

SEQ ID NO: 567936 - protein, 13 aa, Mycobacterium
RREEALETGKEAM

SEQ ID NO: 567937 - protein, 6 aa, Mycobacterium
RREEDA

SEQ ID NO: 567938 - protein, 23 aa, Mycobacterium
RREEDAHRSGAPIESEYRYEDLV

SEQ ID NO: 567939 - protein, 6 aa, Mycobacterium
RREEDV

SEQ ID NO: 567940 - protein, 8 aa, Mycobacterium
RREEEGYP

SEQ ID NO: 567941 - protein, 13 aa, Mycobacterium
RREEGRTRSDAPL

SEQ ID NO: 567942 - protein, 10 aa, Mycobacterium
RREEKGSDVN

SEQ ID NO: 567943 - protein, 5 aa, Mycobacterium
RREEL

SEQ ID NO: 567944 - protein, 10 aa, Mycobacterium
RREEPLKATA

SEQ ID NO: 567945 - protein, 7 aa, Mycobacterium
RREERQA

SEQ ID NO: 567946 - protein, 12 aa, Mycobacterium
RREEYARKSGEA

SEQ ID NO: 567947 - protein, 4 aa, Mycobacterium
RREF

SEQ ID NO: 567948 - protein, 6 aa, Mycobacterium
RREFDG

SEQ ID NO: 567949 - protein, 10 aa, Mycobacterium
RREFQENGER

SEQ ID NO: 567950 - protein, 4 aa, Mycobacterium
RREG

SEQ ID NO: 567951 - protein, 8 aa, Mycobacterium
RREGAREG

SEQ ID NO: 567952 - protein, 5 aa, Mycobacterium
RREGD

SEQ ID NO: 567953 - protein, 7 aa, Mycobacterium
RREGEAA

SEQ ID NO: 567954 - protein, 9 aa, Mycobacterium
RREGEDKTR

SEQ ID NO: 567955 - protein, 6 aa, Mycobacterium
RREGKR

SEQ ID NO: 567956 - protein, 37 aa, Mycobacterium
RREGNSKEKAARISNAAAAQGKSSVGRRGGQSGSYDD

SEQ ID NO: 567957 - protein, 6 aa, Mycobacterium
RREGQD

SEQ ID NO: 567958 - protein, 9 aa, Mycobacterium
RREGTESEL

SEQ ID NO: 567959 - protein, 9 aa, Mycobacterium
RREHDEAAA

SEQ ID NO: 567960 - protein, 7 aa, Mycobacterium
RREHDGS

SEQ ID NO: 567961 - protein, 9 aa, Mycobacterium
RREHGSTGD

SEQ ID NO: 567962 - protein, 8 aa, Mycobacterium
RREHPDGD

SEQ ID NO: 567963 - protein, 7 aa, Mycobacterium
RREHPDR

SEQ ID NO: 567964 - protein, 8 aa, Mycobacterium
RREHPDSK

SEQ ID NO: 567965 - protein, 8 aa, Mycobacterium
RREHRASQ

SEQ ID NO: 567966 - protein, 5 aa, Mycobacterium
RREIP

SEQ ID NO: 567967 - protein, 6 aa, Mycobacterium
RREKDD

SEQ ID NO: 567968 - protein, 6 aa, Mycobacterium
RRELDS

SEQ ID NO: 567969 - protein, 5 aa, Mycobacterium
RRELP

SEQ ID NO: 567970 - protein, 8 aa, Mycobacterium
RRELPPGL

SEQ ID NO: 567971 - protein, 5 aa, Mycobacterium
RRENL

SEQ ID NO: 567972 - protein, 12 aa, Mycobacterium
RRENRDPDADDI

SEQ ID NO: 567973 - protein, 4 aa, Mycobacterium
RREP

SEQ ID NO: 567974 - protein, 20 aa, Mycobacterium
RREPAPRPVRQAASNPDGVA

SEQ ID NO: 567975 - protein, 15 aa, Mycobacterium
RREPASEEGGEETVT

SEQ ID NO: 567976 - protein, 11 aa, Mycobacterium
RREPDPDDRRK

SEQ ID NO: 567977 - protein, 11 aa, Mycobacterium
RREPDPQDRRK

SEQ ID NO: 567978 - protein, 6 aa, Mycobacterium
RREPDR

SEQ ID NO: 567979 - protein, 10 aa, Mycobacterium
RREPDVEDRR

SEQ ID NO: 567980 - protein, 5 aa, Mycobacterium
RREPE

SEQ ID NO: 567981 - protein, 5 aa, Mycobacterium
RREPG

SEQ ID NO: 567982 - protein, 6 aa, Mycobacterium
RREPGA

SEQ ID NO: 567983 - protein, 11 aa, Mycobacterium
RREPGEAARQR

SEQ ID NO: 567984 - protein, 5 aa, Mycobacterium
RREPH

SEQ ID NO: 567985 - protein, 5 aa, Mycobacterium
RREPP

SEQ ID NO: 567986 - protein, 7 aa, Mycobacterium
RREPQEI

SEQ ID NO: 567987 - protein, 6 aa, Mycobacterium
RREPRA

SEQ ID NO: 567988 - protein, 7 aa, Mycobacterium
RREPRDL

SEQ ID NO: 567989 - protein, 7 aa, Mycobacterium
RREPRPY

SEQ ID NO: 567990 - protein, 8 aa, Mycobacterium
RREPRPYP

SEQ ID NO: 567991 - protein, 7 aa, Mycobacterium
RREPSDN

SEQ ID NO: 567992 - protein, 5 aa, Mycobacterium
RREPV

SEQ ID NO: 567993 - protein, 5 aa, Mycobacterium
RREQI

SEQ ID NO: 567994 - protein, 11 aa, Mycobacterium
RREQLSGDEAH

SEQ ID NO: 567995 - protein, 8 aa, Mycobacterium
RREQLTDD

SEQ ID NO: 567996 - protein, 8 aa, Mycobacterium
RREQPRED

SEQ ID NO: 567997 - protein, 11 aa, Mycobacterium
RRERDETATQA

SEQ ID NO: 567998 - protein, 7 aa, Mycobacterium
RREREPL

SEQ ID NO: 567999 - protein, 19 aa, Mycobacterium
RREREPLPRRPIVEHALPD

SEQ ID NO: 568000 - protein, 6 aa, Mycobacterium
RRERGS

SEQ ID NO: 568001 - protein, 6 aa, Mycobacterium
RRERHR

SEQ ID NO: 568002 - protein, 7 aa, Mycobacterium
RRERPRE

SEQ ID NO: 568003 - protein, 5 aa, Mycobacterium
RRERQ

SEQ ID NO: 568004 - protein, 7 aa, Mycobacterium
RRERQPL

SEQ ID NO: 568005 - protein, 8 aa, Mycobacterium
RRERRSRS

SEQ ID NO: 568006 - protein, 8 aa, Mycobacterium
RRERSGKH

SEQ ID NO: 568007 - protein, 6 aa, Mycobacterium
RRERTG

SEQ ID NO: 568008 - protein, 10 aa, Mycobacterium
RRESARPGKE

SEQ ID NO: 568009 - protein, 6 aa, Mycobacterium
RRESDA

SEQ ID NO: 568010 - protein, 18 aa, Mycobacterium
RRESDALAASAAREGTAP

SEQ ID NO: 568011 - protein, 21 aa, Mycobacterium
RRESDALASAAAREAQISGTQ

SEQ ID NO: 568012 - protein, 6 aa, Mycobacterium
RRESEA

SEQ ID NO: 568013 - protein, 16 aa, Mycobacterium
RRESEALAAAAAREGS

SEQ ID NO: 568014 - protein, 11 aa, Mycobacterium
RRESESVARPS

SEQ ID NO: 568015 - protein, 6 aa, Mycobacterium
RRESGV

SEQ ID NO: 568016 - protein, 11 aa, Mycobacterium
RRESPNAGGRH

SEQ ID NO: 568017 - protein, 7 aa, Mycobacterium
RRESQDL

SEQ ID NO: 568018 - protein, 11 aa, Mycobacterium
RRESQRTGREY

SEQ ID NO: 568019 - protein, 7 aa, Mycobacterium
RRESRER

SEQ ID NO: 568020 - protein, 12 aa, Mycobacterium
RRESSLGHPSIT

SEQ ID NO: 568021 - protein, 24 aa, Mycobacterium
RRESSRRAGSSSLARTATGAATSL

SEQ ID NO: 568022 - protein, 5 aa, Mycobacterium
RRETA

SEQ ID NO: 568023 - protein, 8 aa, Mycobacterium
RRETGTRL

SEQ ID NO: 568024 - protein, 7 aa, Mycobacterium
RRETRER

SEQ ID NO: 568025 - protein, 26 aa, Mycobacterium
RRETSHRKPGAIRSESVNDQPTLNSR

SEQ ID NO: 568026 - protein, 7 aa, Mycobacterium
RREVAQE

SEQ ID NO: 568027 - protein, 5 aa, Mycobacterium
RREVG

SEQ ID NO: 568028 - protein, 5 aa, Mycobacterium
RRFDP

SEQ ID NO: 568029 - protein, 6 aa, Mycobacterium
RRFGGE

SEQ ID NO: 568030 - protein, 9 aa, Mycobacterium
RRFGGPGTR

SEQ ID NO: 568031 - protein, 9 aa, Mycobacterium
RRFGGTPAL

SEQ ID NO: 568032 - protein, 10 aa, Mycobacterium
RRFPDAGEPW

SEQ ID NO: 568033 - protein, 12 aa, Mycobacterium
RRFPDHGNTPRT

SEQ ID NO: 568034 - protein, 12 aa, Mycobacterium
RRFPEHGNRPRT

SEQ ID NO: 568035 - protein, 16 aa, Mycobacterium
RRFPPGAVLGALLRAA

SEQ ID NO: 568036 - protein, 14 aa, Mycobacterium
RRFPPTDRLSPELE

SEQ ID NO: 568037 - protein, 7 aa, Mycobacterium
RRFQGRT

SEQ ID NO: 568038 - protein, 13 aa, Mycobacterium
RRFRSPSGEVTDG

SEQ ID NO: 568039 - protein, 21 aa, Mycobacterium
RRFSESETHAVPPPPARAEPR

SEQ ID NO: 568040 - protein, 10 aa, Mycobacterium
RRFSTTTRDS

SEQ ID NO: 568041 - protein, 4 aa, Mycobacterium
RRFT

SEQ ID NO: 568042 - protein, 13 aa, Mycobacterium
RRFTPTDRQAEEL

SEQ ID NO: 568043 - protein, 7 aa, Mycobacterium
RRFTSSK

SEQ ID NO: 568044 - protein, 10 aa, Mycobacterium
RRGAAEVNRD

SEQ ID NO: 568045 - protein, 6 aa, Mycobacterium
RRGADT

SEQ ID NO: 568046 - protein, 5 aa, Mycobacterium
RRGAE

SEQ ID NO: 568047 - protein, 6 aa, Mycobacterium
RRGAEL

SEQ ID NO: 568048 - protein, 14 aa, Mycobacterium
RRGAELSNAILVTS

SEQ ID NO: 568049 - protein, 6 aa, Mycobacterium
RRGAEM

SEQ ID NO: 568050 - protein, 8 aa, Mycobacterium
RRGAETAV

SEQ ID NO: 568051 - protein, 8 aa, Mycobacterium
RRGAGPAE

SEQ ID NO: 568052 - protein, 7 aa, Mycobacterium
RRGAGPL

SEQ ID NO: 568053 - protein, 6 aa, Mycobacterium
RRGAPG

SEQ ID NO: 568054 - protein, 9 aa, Mycobacterium
RRGAPQANT

SEQ ID NO: 568055 - protein, 15 aa, Mycobacterium
RRGARATLRALVGAD

SEQ ID NO: 568056 - protein, 10 aa, Mycobacterium
RRGARHTRRI

SEQ ID NO: 568057 - protein, 8 aa, Mycobacterium
RRGARTAE

SEQ ID NO: 568058 - protein, 9 aa, Mycobacterium
RRGARYSAA

SEQ ID NO: 568059 - protein, 9 aa, Mycobacterium
RRGASAEEA

SEQ ID NO: 568060 - protein, 6 aa, Mycobacterium
RRGATR

SEQ ID NO: 568061 - protein, 13 aa, Mycobacterium
RRGDAIERIRYFP

SEQ ID NO: 568062 - protein, 12 aa, Mycobacterium
RRGDDDEARRVA

SEQ ID NO: 568063 - protein, 9 aa, Mycobacterium
RRGDDDSIE

SEQ ID NO: 568064 - protein, 16 aa, Mycobacterium
RRGDERLGQGGVPADR

SEQ ID NO: 568065 - protein, 16 aa, Mycobacterium
RRGDERLGRGGVPTDR

SEQ ID NO: 568066 - protein, 12 aa, Mycobacterium
RRGDETHSIATT

SEQ ID NO: 568067 - protein, 5 aa, Mycobacterium
RRGDG

SEQ ID NO: 568068 - protein, 12 aa, Mycobacterium
RRGDGGRPHTGP

SEQ ID NO: 568069 - protein, 14 aa, Mycobacterium
RRGDGRDQQLRDPV

SEQ ID NO: 568070 - protein, 7 aa, Mycobacterium
RRGDHNH

SEQ ID NO: 568071 - protein, 22 aa, Mycobacterium
RRGDKRALAETVQRNAKEALQQ

SEQ ID NO: 568072 - protein, 6 aa, Mycobacterium
RRGDLD

SEQ ID NO: 568073 - protein, 7 aa, Mycobacterium
RRGDNGL

SEQ ID NO: 568074 - protein, 12 aa, Mycobacterium
RRGDPGQTAVGD

SEQ ID NO: 568075 - protein, 7 aa, Mycobacterium
RRGDPQA

SEQ ID NO: 568076 - protein, 8 aa, Mycobacterium
RRGDQAGY

SEQ ID NO: 568077 - protein, 5 aa, Mycobacterium
RRGDR

SEQ ID NO: 568078 - protein, 11 aa, Mycobacterium
RRGDRAAGAAE

SEQ ID NO: 568079 - protein, 8 aa, Mycobacterium
RRGDRDEA

SEQ ID NO: 568080 - protein, 15 aa, Mycobacterium
RRGDRLSHPAPATVG

SEQ ID NO: 568081 - protein, 14 aa, Mycobacterium
RRGDRSGRARPRQV

SEQ ID NO: 568082 - protein, 9 aa, Mycobacterium
RRGDSDQEA

SEQ ID NO: 568083 - protein, 17 aa, Mycobacterium
RRGDSPSLTARLRGGRQ

SEQ ID NO: 568084 - protein, 5 aa, Mycobacterium
RRGDT

SEQ ID NO: 568085 - protein, 6 aa, Mycobacterium
RRGDTS

SEQ ID NO: 568086 - protein, 14 aa, Mycobacterium
RRGDVRPDVTASDL

SEQ ID NO: 568087 - protein, 4 aa, Mycobacterium
RRGE

SEQ ID NO: 568088 - protein, 6 aa, Mycobacterium
RRGEDL

SEQ ID NO: 568089 - protein, 12 aa, Mycobacterium
RRGEDQRAAASC

SEQ ID NO: 568090 - protein, 5 aa, Mycobacterium
RRGEG

SEQ ID NO: 568091 - protein, 6 aa, Mycobacterium
RRGEGI

SEQ ID NO: 568092 - protein, 5 aa, Mycobacterium
RRGEN

SEQ ID NO: 568093 - protein, 9 aa, Mycobacterium
RRGEPLENA

SEQ ID NO: 568094 - protein, 8 aa, Mycobacterium
RRGEPSPL

SEQ ID NO: 568095 - protein, 6 aa, Mycobacterium
RRGEPV

SEQ ID NO: 568096 - protein, 12 aa, Mycobacterium
RRGERKRATSGW

SEQ ID NO: 568097 - protein, 6 aa, Mycobacterium
RRGERR

SEQ ID NO: 568098 - protein, 5 aa, Mycobacterium
RRGFD

SEQ ID NO: 568099 - protein, 5 aa, Mycobacterium
RRGGA

SEQ ID NO: 568100 - protein, 13 aa, Mycobacterium
RRGGAAAEPTPHR

SEQ ID NO: 568101 - protein, 6 aa, Mycobacterium
RRGGAE

SEQ ID NO: 568102 - protein, 6 aa, Mycobacterium
RRGGDF

SEQ ID NO: 568103 - protein, 7 aa, Mycobacterium
RRGGDGV

SEQ ID NO: 568104 - protein, 6 aa, Mycobacterium
RRGGDK

SEQ ID NO: 568105 - protein, 10 aa, Mycobacterium
RRGGELTARD

SEQ ID NO: 568106 - protein, 5 aa, Mycobacterium
RRGGG

SEQ ID NO: 568107 - protein, 10 aa, Mycobacterium
RRGGGPGPAI

SEQ ID NO: 568108 - protein, 14 aa, Mycobacterium
RRGGHPTPMSSTKA

SEQ ID NO: 568109 - protein, 15 aa, Mycobacterium
RRGGHPTPMSSTKAS

SEQ ID NO: 568110 - protein, 15 aa, Mycobacterium
RRGGPGDKGRVGRPR

SEQ ID NO: 568111 - protein, 13 aa, Mycobacterium
RRGGPGRGKRGDV

SEQ ID NO: 568112 - protein, 8 aa, Mycobacterium
RRGGQTTI

SEQ ID NO: 568113 - protein, 11 aa, Mycobacterium
RRGGRRHGADV

SEQ ID NO: 568114 - protein, 8 aa, Mycobacterium
RRGGRTVE

SEQ ID NO: 568115 - protein, 5 aa, Mycobacterium
RRGGS

SEQ ID NO: 568116 - protein, 6 aa, Mycobacterium
RRGGSL

SEQ ID NO: 568117 - protein, 7 aa, Mycobacterium
RRGGSTT

SEQ ID NO: 568118 - protein, 6 aa, Mycobacterium
RRGGTE

SEQ ID NO: 568119 - protein, 6 aa, Mycobacterium
RRGGTF

SEQ ID NO: 568120 - protein, 6 aa, Mycobacterium
RRGGTH

SEQ ID NO: 568121 - protein, 6 aa, Mycobacterium
RRGGTI

SEQ ID NO: 568122 - protein, 11 aa, Mycobacterium
RRGGTVGAQGR

SEQ ID NO: 568123 - protein, 12 aa, Mycobacterium
RRGGVPAEAGRE

SEQ ID NO: 568124 - protein, 6 aa, Mycobacterium
RRGGVR

SEQ ID NO: 568125 - protein, 10 aa, Mycobacterium
RRGGVSRAPF

SEQ ID NO: 568126 - protein, 6 aa, Mycobacterium
RRGGVT

SEQ ID NO: 568127 - protein, 4 aa, Mycobacterium
RRGH

SEQ ID NO: 568128 - protein, 10 aa, Mycobacterium
RRGHETRVRD

SEQ ID NO: 568129 - protein, 13 aa, Mycobacterium
RRGHGLGTAGTAA

SEQ ID NO: 568130 - protein, 15 aa, Mycobacterium
RRGHGRSGQVDDGHD

SEQ ID NO: 568131 - protein, 14 aa, Mycobacterium
RRGHPGVRAEPPVD

SEQ ID NO: 568132 - protein, 20 aa, Mycobacterium
RRGHPMTPTASGIELIKDWT

SEQ ID NO: 568133 - protein, 5 aa, Mycobacterium
RRGIP

SEQ ID NO: 568134 - protein, 5 aa, Mycobacterium
RRGIT

SEQ ID NO: 568135 - protein, 6 aa, Mycobacterium
RRGITR

SEQ ID NO: 568136 - protein, 6 aa, Mycobacterium
RRGKTH

SEQ ID NO: 568137 - protein, 5 aa, Mycobacterium
RRGLA

SEQ ID NO: 568138 - protein, 7 aa, Mycobacterium
RRGLADA

SEQ ID NO: 568139 - protein, 7 aa, Mycobacterium
RRGLNRK

SEQ ID NO: 568140 - protein, 7 aa, Mycobacterium
RRGLPGP

SEQ ID NO: 568141 - protein, 11 aa, Mycobacterium
RRGLRSNGSEF

SEQ ID NO: 568142 - protein, 11 aa, Mycobacterium
RRGLRSSKRYR

SEQ ID NO: 568143 - protein, 6 aa, Mycobacterium
RRGMPP

SEQ ID NO: 568144 - protein, 6 aa, Mycobacterium
RRGNAA

SEQ ID NO: 568145 - protein, 10 aa, Mycobacterium
RRGNRGHGTA

SEQ ID NO: 568146 - protein, 7 aa, Mycobacterium
RRGPAAA

SEQ ID NO: 568147 - protein, 8 aa, Mycobacterium
RRGPAASA

SEQ ID NO: 568148 - protein, 6 aa, Mycobacterium
RRGPAH

SEQ ID NO: 568149 - protein, 7 aa, Mycobacterium
RRGPAHS

SEQ ID NO: 568150 - protein, 5 aa, Mycobacterium
RRGPD

SEQ ID NO: 568151 - protein, 10 aa, Mycobacterium
RRGPDAPGAA

SEQ ID NO: 568152 - protein, 11 aa, Mycobacterium
RRGPDAPGAEE

SEQ ID NO: 568153 - protein, 7 aa, Mycobacterium
RRGPEHS

SEQ ID NO: 568154 - protein, 5 aa, Mycobacterium
RRGPF

SEQ ID NO: 568155 - protein, 5 aa, Mycobacterium
RRGPG

SEQ ID NO: 568156 - protein, 8 aa, Mycobacterium
RRGPGGEH

SEQ ID NO: 568157 - protein, 7 aa, Mycobacterium
RRGPGGK

SEQ ID NO: 568158 - protein, 9 aa, Mycobacterium
RRGPGGSDT

SEQ ID NO: 568159 - protein, 9 aa, Mycobacterium
RRGPGRVPA

SEQ ID NO: 568160 - protein, 5 aa, Mycobacterium
RRGPL

SEQ ID NO: 568161 - protein, 8 aa, Mycobacterium
RRGPLGAP

SEQ ID NO: 568162 - protein, 6 aa, Mycobacterium
RRGPLP

SEQ ID NO: 568163 - protein, 15 aa, Mycobacterium
RRGPLPGDGAADNMR

SEQ ID NO: 568164 - protein, 8 aa, Mycobacterium
RRGPLTES

SEQ ID NO: 568165 - protein, 5 aa, Mycobacterium
RRGPN

SEQ ID NO: 568166 - protein, 6 aa, Mycobacterium
RRGPSA

SEQ ID NO: 568167 - protein, 9 aa, Mycobacterium
RRGPSGVGA

SEQ ID NO: 568168 - protein, 8 aa, Mycobacterium
RRGPVTDP

SEQ ID NO: 568169 - protein, 14 aa, Mycobacterium
RRGPWRQRSATPLT

SEQ ID NO: 568170 - protein, 11 aa, Mycobacterium
RRGQAAPADDD

SEQ ID NO: 568171 - protein, 6 aa, Mycobacterium
RRGQAR

SEQ ID NO: 568172 - protein, 10 aa, Mycobacterium
RRGQEAGRYR

SEQ ID NO: 568173 - protein, 5 aa, Mycobacterium
RRGQP

SEQ ID NO: 568174 - protein, 8 aa, Mycobacterium
RRGQPRDD

SEQ ID NO: 568175 - protein, 25 aa, Mycobacterium
RRGQPRNPSPDREPVPLVESSVPWQ

SEQ ID NO: 568176 - protein, 9 aa, Mycobacterium
RRGQPTPAP

SEQ ID NO: 568177 - protein, 12 aa, Mycobacterium
RRGQQPDAGRAE

SEQ ID NO: 568178 - protein, 5 aa, Mycobacterium
RRGQR

SEQ ID NO: 568179 - protein, 6 aa, Mycobacterium
RRGQSY

SEQ ID NO: 568180 - protein, 10 aa, Mycobacterium
RRGRAAQPGW

SEQ ID NO: 568181 - protein, 7 aa, Mycobacterium
RRGRADP

SEQ ID NO: 568182 - protein, 17 aa, Mycobacterium
RRGRARSVTGVGAAGGW

SEQ ID NO: 568183 - protein, 13 aa, Mycobacterium
RRGRASSGGLGAD

SEQ ID NO: 568184 - protein, 5 aa, Mycobacterium
RRGRD

SEQ ID NO: 568185 - protein, 7 aa, Mycobacterium
RRGRERY

SEQ ID NO: 568186 - protein, 14 aa, Mycobacterium
RRGRGERKRPPTGW

SEQ ID NO: 568187 - protein, 6 aa, Mycobacterium
RRGRGG

SEQ ID NO: 568188 - protein, 8 aa, Mycobacterium
RRGRGREE

SEQ ID NO: 568189 - protein, 8 aa, Mycobacterium
RRGRHGRV

SEQ ID NO: 568190 - protein, 8 aa, Mycobacterium
RRGRLGNV

SEQ ID NO: 568191 - protein, 9 aa, Mycobacterium
RRGRLGNVE

SEQ ID NO: 568192 - protein, 8 aa, Mycobacterium
RRGRPAEV

SEQ ID NO: 568193 - protein, 8 aa, Mycobacterium
RRGRPDEV

SEQ ID NO: 568194 - protein, 9 aa, Mycobacterium
RRGRPLTDD

SEQ ID NO: 568195 - protein, 16 aa, Mycobacterium
RRGRRGDFAGPKGKTA

SEQ ID NO: 568196 - protein, 91 aa, Mycobacterium
RRGRRRGHRRAQRAAGPPAAGAEHHTEPAADARTESRADTRSDTSSAPTPATQPGEKKPGPGRGSRAGAAKPTPKDQPKQRKNRPRRPPDR

SEQ ID NO: 568197 - protein, 46 aa, Mycobacterium
RRGRRRGRGAARSAENHTDKAESTDPNPAPTKGRRPRLPRRGRPDR

SEQ ID NO: 568198 - protein, 13 aa, Mycobacterium
RRGRSGTIGLAIT

SEQ ID NO: 568199 - protein, 5 aa, Mycobacterium
RRGRT

SEQ ID NO: 568200 - protein, 18 aa, Mycobacterium
RRGRTGSLQPTFFTPHER

SEQ ID NO: 568201 - protein, 7 aa, Mycobacterium
RRGSERT

SEQ ID NO: 568202 - protein, 12 aa, Mycobacterium
RRGSEYGVGTGD

SEQ ID NO: 568203 - protein, 5 aa, Mycobacterium
RRGSG

SEQ ID NO: 568204 - protein, 36 aa, Mycobacterium
RRGSGDISTEDALTADETARAIASGQQIADEEVDAG

SEQ ID NO: 568205 - protein, 8 aa, Mycobacterium
RRGSGKSI

SEQ ID NO: 568206 - protein, 15 aa, Mycobacterium
RRGSGPALDNDTVRQ

SEQ ID NO: 568207 - protein, 6 aa, Mycobacterium
RRGSLT

SEQ ID NO: 568208 - protein, 7 aa, Mycobacterium
RRGSRQL

SEQ ID NO: 568209 - protein, 7 aa, Mycobacterium
RRGSRWS

SEQ ID NO: 568210 - protein, 12 aa, Mycobacterium
RRGSSATFSSET

SEQ ID NO: 568211 - protein, 14 aa, Mycobacterium
RRGSSDSAIDPTSL

SEQ ID NO: 568212 - protein, 6 aa, Mycobacterium
RRGSSN

SEQ ID NO: 568213 - protein, 6 aa, Mycobacterium
RRGSTA

SEQ ID NO: 568214 - protein, 11 aa, Mycobacterium
RRGSTATFSSE

SEQ ID NO: 568215 - protein, 14 aa, Mycobacterium
RRGSTATSSSETIT

SEQ ID NO: 568216 - protein, 5 aa, Mycobacterium
RRGSV

SEQ ID NO: 568217 - protein, 9 aa, Mycobacterium
RRGSYGETS

SEQ ID NO: 568218 - protein, 5 aa, Mycobacterium
RRGTD

SEQ ID NO: 568219 - protein, 7 aa, Mycobacterium
RRGTDKL

SEQ ID NO: 568220 - protein, 6 aa, Mycobacterium
RRGTEA

SEQ ID NO: 568221 - protein, 9 aa, Mycobacterium
RRGTGPDEA

SEQ ID NO: 568222 - protein, 5 aa, Mycobacterium
RRGTP

SEQ ID NO: 568223 - protein, 9 aa, Mycobacterium
RRGTPDEQA

SEQ ID NO: 568224 - protein, 10 aa, Mycobacterium
RRGTPDSAEP

SEQ ID NO: 568225 - protein, 9 aa, Mycobacterium
RRGTPEEQA

SEQ ID NO: 568226 - protein, 9 aa, Mycobacterium
RRGVAGDTL

SEQ ID NO: 568227 - protein, 19 aa, Mycobacterium
RRGVGTDGLTSSTDVDLQP

SEQ ID NO: 568228 - protein, 5 aa, Mycobacterium
RRGVP

SEQ ID NO: 568229 - protein, 11 aa, Mycobacterium
RRGVRREQLSD

SEQ ID NO: 568230 - protein, 14 aa, Mycobacterium
RRGVRSASYPAGRH

SEQ ID NO: 568231 - protein, 8 aa, Mycobacterium
RRGVSAAG

SEQ ID NO: 568232 - protein, 5 aa, Mycobacterium
RRGWA

SEQ ID NO: 568233 - protein, 12 aa, Mycobacterium
RRGWPGPPRVHE

SEQ ID NO: 568234 - protein, 5 aa, Mycobacterium
RRGYA

SEQ ID NO: 568235 - protein, 13 aa, Mycobacterium
RRHAENAAAASDA

SEQ ID NO: 568236 - protein, 12 aa, Mycobacterium
RRHAKSVEEDAA

SEQ ID NO: 568237 - protein, 7 aa, Mycobacterium
RRHATGE

SEQ ID NO: 568238 - protein, 4 aa, Mycobacterium
RRHD

SEQ ID NO: 568239 - protein, 5 aa, Mycobacterium
RRHDP

SEQ ID NO: 568240 - protein, 7 aa, Mycobacterium
RRHEAAA

SEQ ID NO: 568241 - protein, 11 aa, Mycobacterium
RRHEAADQRRV

SEQ ID NO: 568242 - protein, 9 aa, Mycobacterium
RRHEATRDR

SEQ ID NO: 568243 - protein, 12 aa, Mycobacterium
RRHEDTSNVQTH

SEQ ID NO: 568244 - protein, 5 aa, Mycobacterium
RRHGD

SEQ ID NO: 568245 - protein, 9 aa, Mycobacterium
RRHGDRGSL

SEQ ID NO: 568246 - protein, 9 aa, Mycobacterium
RRHGGDQGA

SEQ ID NO: 568247 - protein, 6 aa, Mycobacterium
RRHGGH

SEQ ID NO: 568248 - protein, 7 aa, Mycobacterium
RRHGGRS

SEQ ID NO: 568249 - protein, 72 aa, Mycobacterium
RRHGGVRRGQDPHRRRLRGTGARGDPAQGPAAAQAGRAVAGRPGPAVGGDPHRRDRRAGLTPAHPGDHPPAR

SEQ ID NO: 568250 - protein, 7 aa, Mycobacterium
RRHGKTS

SEQ ID NO: 568251 - protein, 8 aa, Mycobacterium
RRHGRPPH

SEQ ID NO: 568252 - protein, 6 aa, Mycobacterium
RRHGSG

SEQ ID NO: 568253 - protein, 13 aa, Mycobacterium
RRHKQGRRTAREN

SEQ ID NO: 568254 - protein, 5 aa, Mycobacterium
RRHPD

SEQ ID NO: 568255 - protein, 6 aa, Mycobacterium
RRHPDG

SEQ ID NO: 568256 - protein, 9 aa, Mycobacterium
RRHPDRPYE

SEQ ID NO: 568257 - protein, 27 aa, Mycobacterium
RRHPGRRGRRRRPAGPAGRIRPAGPRR

SEQ ID NO: 568258 - protein, 5 aa, Mycobacterium
RRHPN

SEQ ID NO: 568259 - protein, 5 aa, Mycobacterium
RRHPS

SEQ ID NO: 568260 - protein, 15 aa, Mycobacterium
RRHQPGGTLSGGEQQ

SEQ ID NO: 568261 - protein, 10 aa, Mycobacterium
RRHRDGATLP

SEQ ID NO: 568262 - protein, 8 aa, Mycobacterium
RRHRNGAA

SEQ ID NO: 568263 - protein, 23 aa, Mycobacterium
RRHRPRTAANSALASSAWRTFVQ

SEQ ID NO: 568264 - protein, 16 aa, Mycobacterium
RRHRQARGGLAGDGGV

SEQ ID NO: 568265 - protein, 9 aa, Mycobacterium
RRHRRQPPL

SEQ ID NO: 568266 - protein, 16 aa, Mycobacterium
RRHSANHGEIGPDTKV

SEQ ID NO: 568267 - protein, 45 aa, Mycobacterium
RRHSRPAVTEPRDEADGRDTADAEDAEDAVETPSAERDDEALSLS

SEQ ID NO: 568268 - protein, 4 aa, Mycobacterium
RRHT

SEQ ID NO: 568269 - protein, 8 aa, Mycobacterium
RRHTGPTT

SEQ ID NO: 568270 - protein, 10 aa, Mycobacterium
RRHTSQSASR

SEQ ID NO: 568271 - protein, 9 aa, Mycobacterium
RRHTTRSAA

SEQ ID NO: 568272 - protein, 9 aa, Mycobacterium
RRIAAGPGQ

SEQ ID NO: 568273 - protein, 11 aa, Mycobacterium
RRIADEEVDSG

SEQ ID NO: 568274 - protein, 4 aa, Mycobacterium
RRID

SEQ ID NO: 568275 - protein, 39 aa, Mycobacterium
RRIDPDTGQVRENPSEPAPSGPATDEFAGETEEEAGKAA

SEQ ID NO: 568276 - protein, 38 aa, Mycobacterium
RRIDPETGEVREPAATPQGSAPASAAPETGGDSDEVTE

SEQ ID NO: 568277 - protein, 6 aa, Mycobacterium
RRIDPT

SEQ ID NO: 568278 - protein, 9 aa, Mycobacterium
RRIGAEGQG

SEQ ID NO: 568279 - protein, 13 aa, Mycobacterium
RRIGAGRHPEADW

SEQ ID NO: 568280 - protein, 28 aa, Mycobacterium
RRIKGSDQTADIGTSKLDYSPDSNRNTL

SEQ ID NO: 568281 - protein, 7 aa, Mycobacterium
RRINAED

SEQ ID NO: 568282 - protein, 4 aa, Mycobacterium
RRIP

SEQ ID NO: 568283 - protein, 10 aa, Mycobacterium
RRIPDTPVGP

SEQ ID NO: 568284 - protein, 18 aa, Mycobacterium
RRIPGSHGHRAAKAKLTR

SEQ ID NO: 568285 - protein, 18 aa, Mycobacterium
RRIPTGARSGAERYGPGR

SEQ ID NO: 568286 - protein, 13 aa, Mycobacterium
RRIPTGLGREPGE

SEQ ID NO: 568287 - protein, 13 aa, Mycobacterium
RRIPTGLGTEPGE

SEQ ID NO: 568288 - protein, 7 aa, Mycobacterium
RRIPTRD

SEQ ID NO: 568289 - protein, 4 aa, Mycobacterium
RRIT

SEQ ID NO: 568290 - protein, 11 aa, Mycobacterium
RRITGDARAAG

SEQ ID NO: 568291 - protein, 13 aa, Mycobacterium
RRKAAKKLATEVT

SEQ ID NO: 568292 - protein, 13 aa, Mycobacterium
RRKARASSAGARL

SEQ ID NO: 568293 - protein, 14 aa, Mycobacterium
RRKARRARGPLSLV

SEQ ID NO: 568294 - protein, 14 aa, Mycobacterium
RRKARRTKGPLSLV

SEQ ID NO: 568295 - protein, 7 aa, Mycobacterium
RRKATFD

SEQ ID NO: 568296 - protein, 10 aa, Mycobacterium
RRKDDPLSAL

SEQ ID NO: 568297 - protein, 9 aa, Mycobacterium
RRKGSVTVS

SEQ ID NO: 568298 - protein, 10 aa, Mycobacterium
RRKKKDTRGH

SEQ ID NO: 568299 - protein, 10 aa, Mycobacterium
RRKKPSDDLT

SEQ ID NO: 568300 - protein, 9 aa, Mycobacterium
RRKLPEPPG

SEQ ID NO: 568301 - protein, 7 aa, Mycobacterium
RRKNHQI

SEQ ID NO: 568302 - protein, 9 aa, Mycobacterium
RRKNRPAKP

SEQ ID NO: 568303 - protein, 8 aa, Mycobacterium
RRKPEAYA

SEQ ID NO: 568304 - protein, 9 aa, Mycobacterium
RRKPGAGEV

SEQ ID NO: 568305 - protein, 5 aa, Mycobacterium
RRKPL

SEQ ID NO: 568306 - protein, 6 aa, Mycobacterium
RRKPMG

SEQ ID NO: 568307 - protein, 6 aa, Mycobacterium
RRKPPS

SEQ ID NO: 568308 - protein, 6 aa, Mycobacterium
RRKPRM

SEQ ID NO: 568309 - protein, 11 aa, Mycobacterium
RRKQSGKPSNL

SEQ ID NO: 568310 - protein, 14 aa, Mycobacterium
RRKRRHRSRPGGVA

SEQ ID NO: 568311 - protein, 6 aa, Mycobacterium
RRKRRP

SEQ ID NO: 568312 - protein, 9 aa, Mycobacterium
RRKRRTVRD

SEQ ID NO: 568313 - protein, 8 aa, Mycobacterium
RRKSGNYT

SEQ ID NO: 568314 - protein, 9 aa, Mycobacterium
RRKSKGWSA

SEQ ID NO: 568315 - protein, 8 aa, Mycobacterium
RRKSPKDD

SEQ ID NO: 568316 - protein, 9 aa, Mycobacterium
RRKSPPTAG

SEQ ID NO: 568317 - protein, 7 aa, Mycobacterium
RRKTARN

SEQ ID NO: 568318 - protein, 6 aa, Mycobacterium
RRKTRR

SEQ ID NO: 568319 - protein, 7 aa, Mycobacterium
RRKTSGV

SEQ ID NO: 568320 - protein, 7 aa, Mycobacterium
RRKTSRN

SEQ ID NO: 568321 - protein, 4 aa, Mycobacterium
RRLA

SEQ ID NO: 568322 - protein, 6 aa, Mycobacterium
RRLAQK

SEQ ID NO: 568323 - protein, 4 aa, Mycobacterium
RRLD

SEQ ID NO: 568324 - protein, 5 aa, Mycobacterium
RRLDD

SEQ ID NO: 568325 - protein, 6 aa, Mycobacterium
RRLDDA

SEQ ID NO: 568326 - protein, 8 aa, Mycobacterium
RRLDEAQP

SEQ ID NO: 568327 - protein, 11 aa, Mycobacterium
RRLDQDERDIA

SEQ ID NO: 568328 - protein, 8 aa, Mycobacterium
RRLEGDGI

SEQ ID NO: 568329 - protein, 5 aa, Mycobacterium
RRLEP

SEQ ID NO: 568330 - protein, 13 aa, Mycobacterium
RRLERERKMAEKR

SEQ ID NO: 568331 - protein, 4 aa, Mycobacterium
RRLG

SEQ ID NO: 568332 - protein, 8 aa, Mycobacterium
RRLGETAA

SEQ ID NO: 568333 - protein, 9 aa, Mycobacterium
RRLGETAEQ

SEQ ID NO: 568334 - protein, 6 aa, Mycobacterium
RRLGRR

SEQ ID NO: 568335 - protein, 6 aa, Mycobacterium
RRLKEN

SEQ ID NO: 568336 - protein, 7 aa, Mycobacterium
RRLKENE

SEQ ID NO: 568337 - protein, 7 aa, Mycobacterium
RRLKQKT

SEQ ID NO: 568338 - protein, 6 aa, Mycobacterium
RRLNQK

SEQ ID NO: 568339 - protein, 4 aa, Mycobacterium
RRLP

SEQ ID NO: 568340 - protein, 6 aa, Mycobacterium
RRLPEG

SEQ ID NO: 568341 - protein, 20 aa, Mycobacterium
RRLPGQATAEYSADHTSSIR

SEQ ID NO: 568342 - protein, 10 aa, Mycobacterium
RRLPGSSPAR

SEQ ID NO: 568343 - protein, 5 aa, Mycobacterium
RRLPT

SEQ ID NO: 568344 - protein, 8 aa, Mycobacterium
RRLPTPGV

SEQ ID NO: 568345 - protein, 4 aa, Mycobacterium
RRLR

SEQ ID NO: 568346 - protein, 7 aa, Mycobacterium
RRLRAEG

SEQ ID NO: 568347 - protein, 7 aa, Mycobacterium
RRLRGGA

SEQ ID NO: 568348 - protein, 15 aa, Mycobacterium
RRLRGGRSRRDPDTI

SEQ ID NO: 568349 - protein, 12 aa, Mycobacterium
RRLRNKSVKSSL

SEQ ID NO: 568350 - protein, 11 aa, Mycobacterium
RRLRTGPDGEL

SEQ ID NO: 568351 - protein, 5 aa, Mycobacterium
RRLSA

SEQ ID NO: 568352 - protein, 6 aa, Mycobacterium
RRLSDD

SEQ ID NO: 568353 - protein, 9 aa, Mycobacterium
RRLSEEHGG

SEQ ID NO: 568354 - protein, 6 aa, Mycobacterium
RRLSGK

SEQ ID NO: 568355 - protein, 9 aa, Mycobacterium
RRLSGTAGP

SEQ ID NO: 568356 - protein, 9 aa, Mycobacterium
RRLSPEDRR

SEQ ID NO: 568357 - protein, 11 aa, Mycobacterium
RRLSPGAVRAG

SEQ ID NO: 568358 - protein, 9 aa, Mycobacterium
RRLSQSGEN

SEQ ID NO: 568359 - protein, 7 aa, Mycobacterium
RRLSRNG

SEQ ID NO: 568360 - protein, 8 aa, Mycobacterium
RRLSRTGD

SEQ ID NO: 568361 - protein, 6 aa, Mycobacterium
RRLSTY

SEQ ID NO: 568362 - protein, 4 aa, Mycobacterium
RRLT

SEQ ID NO: 568363 - protein, 11 aa, Mycobacterium
RRLTATADGLD

SEQ ID NO: 568364 - protein, 5 aa, Mycobacterium
RRLTG

SEQ ID NO: 568365 - protein, 5 aa, Mycobacterium
RRLTP

SEQ ID NO: 568366 - protein, 9 aa, Mycobacterium
RRLTPGPTV

SEQ ID NO: 568367 - protein, 16 aa, Mycobacterium
RRLTPSAEILAHDLGQ

SEQ ID NO: 568368 - protein, 16 aa, Mycobacterium
RRLTPSAEVLAHDLGQ

SEQ ID NO: 568369 - protein, 16 aa, Mycobacterium
RRLTPSPAVLAHDLGQ

SEQ ID NO: 568370 - protein, 8 aa, Mycobacterium
RRLTQNGE

SEQ ID NO: 568371 - protein, 5 aa, Mycobacterium
RRMAD

SEQ ID NO: 568372 - protein, 5 aa, Mycobacterium
RRMAP

SEQ ID NO: 568373 - protein, 10 aa, Mycobacterium
RRMDDAGQYC

SEQ ID NO: 568374 - protein, 12 aa, Mycobacterium
RRMDNDEARERV

SEQ ID NO: 568375 - protein, 4 aa, Mycobacterium
RRMG

SEQ ID NO: 568376 - protein, 11 aa, Mycobacterium
RRMGPQRNPGM

SEQ ID NO: 568377 - protein, 9 aa, Mycobacterium
RRMGRPDEY

SEQ ID NO: 568378 - protein, 8 aa, Mycobacterium
RRMGSKSP

SEQ ID NO: 568379 - protein, 6 aa, Mycobacterium
RRMPDG

SEQ ID NO: 568380 - protein, 8 aa, Mycobacterium
RRMSDGER

SEQ ID NO: 568381 - protein, 76 aa, Mycobacterium
RRMSRQPVRGEHTGDTVTGTSKTSFDPHRRKDHPTMPKPTRIARTDNTADDAESGSAQPKAGTGKSRRGRLAAGAT

SEQ ID NO: 568382 - protein, 4 aa, Mycobacterium
RRNA

SEQ ID NO: 568383 - protein, 8 aa, Mycobacterium
RRNAAGTA

SEQ ID NO: 568384 - protein, 9 aa, Mycobacterium
RRNAALNPR

SEQ ID NO: 568385 - protein, 19 aa, Mycobacterium
RRNACPSGGARRISADDSP

SEQ ID NO: 568386 - protein, 6 aa, Mycobacterium
RRNADA

SEQ ID NO: 568387 - protein, 8 aa, Mycobacterium
RRNAEGSN

SEQ ID NO: 568388 - protein, 8 aa, Mycobacterium
RRNAEKGC

SEQ ID NO: 568389 - protein, 10 aa, Mycobacterium
RRNAKPGDFD

SEQ ID NO: 568390 - protein, 5 aa, Mycobacterium
RRNAY

SEQ ID NO: 568391 - protein, 6 aa, Mycobacterium
RRNDAR

SEQ ID NO: 568392 - protein, 5 aa, Mycobacterium
RRNDL

SEQ ID NO: 568393 - protein, 5 aa, Mycobacterium
RRNDP

SEQ ID NO: 568394 - protein, 9 aa, Mycobacterium
RRNDPTAYR

SEQ ID NO: 568395 - protein, 5 aa, Mycobacterium
RRNDQ

SEQ ID NO: 568396 - protein, 24 aa, Mycobacterium
RRNDRRQAARRPRQQQSYEYGSCR

SEQ ID NO: 568397 - protein, 8 aa, Mycobacterium
RRNEAASS

SEQ ID NO: 568398 - protein, 14 aa, Mycobacterium
RRNEAGDTLSDDDL

SEQ ID NO: 568399 - protein, 6 aa, Mycobacterium
RRNEIA

SEQ ID NO: 568400 - protein, 6 aa, Mycobacterium
RRNEPA

SEQ ID NO: 568401 - protein, 7 aa, Mycobacterium
RRNEPGI

SEQ ID NO: 568402 - protein, 12 aa, Mycobacterium
RRNESYGPIVEL

SEQ ID NO: 568403 - protein, 4 aa, Mycobacterium
RRNG

SEQ ID NO: 568404 - protein, 10 aa, Mycobacterium
RRNGADADRI

SEQ ID NO: 568405 - protein, 8 aa, Mycobacterium
RRNGADAP

SEQ ID NO: 568406 - protein, 9 aa, Mycobacterium
RRNGADRPV

SEQ ID NO: 568407 - protein, 6 aa, Mycobacterium
RRNGDK

SEQ ID NO: 568408 - protein, 7 aa, Mycobacterium
RRNGDKL

SEQ ID NO: 568409 - protein, 8 aa, Mycobacterium
RRNGDKLS

SEQ ID NO: 568410 - protein, 6 aa, Mycobacterium
RRNGEQ

SEQ ID NO: 568411 - protein, 6 aa, Mycobacterium
RRNGGD

SEQ ID NO: 568412 - protein, 8 aa, Mycobacterium
RRNGGRQE

SEQ ID NO: 568413 - protein, 6 aa, Mycobacterium
RRNGKV

SEQ ID NO: 568414 - protein, 6 aa, Mycobacterium
RRNGLS

SEQ ID NO: 568415 - protein, 9 aa, Mycobacterium
RRNGLTNDE

SEQ ID NO: 568416 - protein, 9 aa, Mycobacterium
RRNGRAAGG

SEQ ID NO: 568417 - protein, 11 aa, Mycobacterium
RRNGRLPTAGY

SEQ ID NO: 568418 - protein, 6 aa, Mycobacterium
RRNGRS

SEQ ID NO: 568419 - protein, 5 aa, Mycobacterium
RRNGV

SEQ ID NO: 568420 - protein, 7 aa, Mycobacterium
RRNGYVT

SEQ ID NO: 568421 - protein, 4 aa, Mycobacterium
RRNK

SEQ ID NO: 568422 - protein, 5 aa, Mycobacterium
RRNLG

SEQ ID NO: 568423 - protein, 6 aa, Mycobacterium
RRNLTA

SEQ ID NO: 568424 - protein, 5 aa, Mycobacterium
RRNND

SEQ ID NO: 568425 - protein, 10 aa, Mycobacterium
RRNNRTEDSP

SEQ ID NO: 568426 - protein, 8 aa, Mycobacterium
RRNNTPAR

SEQ ID NO: 568427 - protein, 4 aa, Mycobacterium
RRNP

SEQ ID NO: 568428 - protein, 9 aa, Mycobacterium
RRNPDAHAD

SEQ ID NO: 568429 - protein, 7 aa, Mycobacterium
RRNPDLD

SEQ ID NO: 568430 - protein, 6 aa, Mycobacterium
RRNPNS

SEQ ID NO: 568431 - protein, 7 aa, Mycobacterium
RRNPTDI

SEQ ID NO: 568432 - protein, 5 aa, Mycobacterium
RRNQQ

SEQ ID NO: 568433 - protein, 9 aa, Mycobacterium
RRNRDSGPV

SEQ ID NO: 568434 - protein, 13 aa, Mycobacterium
RRNRELADENRRL

SEQ ID NO: 568435 - protein, 5 aa, Mycobacterium
RRNRF

SEQ ID NO: 568436 - protein, 13 aa, Mycobacterium
RRNRGARGDRAAE

SEQ ID NO: 568437 - protein, 9 aa, Mycobacterium
RRNRQATHN

SEQ ID NO: 568438 - protein, 10 aa, Mycobacterium
RRNRRNARVN

SEQ ID NO: 568439 - protein, 17 aa, Mycobacterium
RRNRSTFPGWASPDDTL

SEQ ID NO: 568440 - protein, 8 aa, Mycobacterium
RRNRTSQA

SEQ ID NO: 568441 - protein, 4 aa, Mycobacterium
RRNS

SEQ ID NO: 568442 - protein, 6 aa, Mycobacterium
RRNSAT

SEQ ID NO: 568443 - protein, 5 aa, Mycobacterium
RRNSI

SEQ ID NO: 568444 - protein, 10 aa, Mycobacterium
RRNSRYEGAH

SEQ ID NO: 568445 - protein, 10 aa, Mycobacterium
RRNTAASELE

SEQ ID NO: 568446 - protein, 11 aa, Mycobacterium
RRNTAASEVEQ

SEQ ID NO: 568447 - protein, 14 aa, Mycobacterium
RRNTADHRQITEAA

SEQ ID NO: 568448 - protein, 7 aa, Mycobacterium
RRNTGQG

SEQ ID NO: 568449 - protein, 5 aa, Mycobacterium
RRNTP

SEQ ID NO: 568450 - protein, 5 aa, Mycobacterium
RRNTY

SEQ ID NO: 568451 - protein, 6 aa, Mycobacterium
RRNTYQ

SEQ ID NO: 568452 - protein, 5 aa, Mycobacterium
RRPAA

SEQ ID NO: 568453 - protein, 9 aa, Mycobacterium
RRPAAEEVA

SEQ ID NO: 568454 - protein, 11 aa, Mycobacterium
RRPAAEHLSTT

SEQ ID NO: 568455 - protein, 13 aa, Mycobacterium
RRPADLTAARSGF

SEQ ID NO: 568456 - protein, 8 aa, Mycobacterium
RRPADSGD

SEQ ID NO: 568457 - protein, 7 aa, Mycobacterium
RRPAELS

SEQ ID NO: 568458 - protein, 7 aa, Mycobacterium
RRPAEPN

SEQ ID NO: 568459 - protein, 9 aa, Mycobacterium
RRPAEQSLT

SEQ ID NO: 568460 - protein, 5 aa, Mycobacterium
RRPAF

SEQ ID NO: 568461 - protein, 26 aa, Mycobacterium
RRPAGDPIDTADDPAPYEDSAERRTG

SEQ ID NO: 568462 - protein, 6 aa, Mycobacterium
RRPAGQ

SEQ ID NO: 568463 - protein, 12 aa, Mycobacterium
RRPAGSELAPPD

SEQ ID NO: 568464 - protein, 8 aa, Mycobacterium
RRPAGSGD

SEQ ID NO: 568465 - protein, 5 aa, Mycobacterium
RRPAL

SEQ ID NO: 568466 - protein, 6 aa, Mycobacterium
RRPAPA

SEQ ID NO: 568467 - protein, 16 aa, Mycobacterium
RRPAPAVSGETPPAPS

SEQ ID NO: 568468 - protein, 9 aa, Mycobacterium
RRPAPGPGE

SEQ ID NO: 568469 - protein, 24 aa, Mycobacterium
RRPAPGRTAPISSRAGTRPCPTPF

SEQ ID NO: 568470 - protein, 9 aa, Mycobacterium
RRPAPSPPT

SEQ ID NO: 568471 - protein, 8 aa, Mycobacterium
RRPAQADI

SEQ ID NO: 568472 - protein, 32 aa, Mycobacterium
RRPARPAAGRVQPHARPPAPGAQRDSPHHRAG

SEQ ID NO: 568473 - protein, 10 aa, Mycobacterium
RRPARTGDDG

SEQ ID NO: 568474 - protein, 11 aa, Mycobacterium
RRPARTRADGT

SEQ ID NO: 568475 - protein, 7 aa, Mycobacterium
RRPASAG

SEQ ID NO: 568476 - protein, 8 aa, Mycobacterium
RRPATDRL

SEQ ID NO: 568477 - protein, 7 aa, Mycobacterium
RRPATGH

SEQ ID NO: 568478 - protein, 6 aa, Mycobacterium
RRPATQ

SEQ ID NO: 568479 - protein, 4 aa, Mycobacterium
RRPC

SEQ ID NO: 568480 - protein, 4 aa, Mycobacterium
RRPD

SEQ ID NO: 568481 - protein, 9 aa, Mycobacterium
RRPDAGGDT

SEQ ID NO: 568482 - protein, 6 aa, Mycobacterium
RRPDAR

SEQ ID NO: 568483 - protein, 13 aa, Mycobacterium
RRPDASTPAGAGH

SEQ ID NO: 568484 - protein, 14 aa, Mycobacterium
RRPDASTPAGSGYA

SEQ ID NO: 568485 - protein, 5 aa, Mycobacterium
RRPDD

SEQ ID NO: 568486 - protein, 14 aa, Mycobacterium
RRPDDEGDSDGTAQ

SEQ ID NO: 568487 - protein, 13 aa, Mycobacterium
RRPDDHPSLSDLG

SEQ ID NO: 568488 - protein, 5 aa, Mycobacterium
RRPDE

SEQ ID NO: 568489 - protein, 12 aa, Mycobacterium
RRPDEQLGRAGR

SEQ ID NO: 568490 - protein, 10 aa, Mycobacterium
RRPDETDRRR

SEQ ID NO: 568491 - protein, 5 aa, Mycobacterium
RRPDG

SEQ ID NO: 568492 - protein, 7 aa, Mycobacterium
RRPDGAT

SEQ ID NO: 568493 - protein, 7 aa, Mycobacterium
RRPDGDF

SEQ ID NO: 568494 - protein, 7 aa, Mycobacterium
RRPDGGL

SEQ ID NO: 568495 - protein, 10 aa, Mycobacterium
RRPDGSLQHP

SEQ ID NO: 568496 - protein, 10 aa, Mycobacterium
RRPDGTLQHP

SEQ ID NO: 568497 - protein, 11 aa, Mycobacterium
RRPDGTLQHPP

SEQ ID NO: 568498 - protein, 8 aa, Mycobacterium
RRPDLDPE

SEQ ID NO: 568499 - protein, 9 aa, Mycobacterium
RRPDPDGAA

SEQ ID NO: 568500 - protein, 9 aa, Mycobacterium
RRPDPDGDR

SEQ ID NO: 568501 - protein, 10 aa, Mycobacterium
RRPDPEDKRR

SEQ ID NO: 568502 - protein, 9 aa, Mycobacterium
RRPDPEDVA

SEQ ID NO: 568503 - protein, 8 aa, Mycobacterium
RRPDPHGD

SEQ ID NO: 568504 - protein, 5 aa, Mycobacterium
RRPDQ

SEQ ID NO: 568505 - protein, 43 aa, Mycobacterium
RRPDRATTGGSQRPRRDNRSAPRTSGPNRARSAQPRPDRVDPR

SEQ ID NO: 568506 - protein, 13 aa, Mycobacterium
RRPDRLATEPGVA

SEQ ID NO: 568507 - protein, 6 aa, Mycobacterium
RRPDRS

SEQ ID NO: 568508 - protein, 7 aa, Mycobacterium
RRPDSEG

SEQ ID NO: 568509 - protein, 11 aa, Mycobacterium
RRPDSESASDA

SEQ ID NO: 568510 - protein, 10 aa, Mycobacterium
RRPDTPADAR

SEQ ID NO: 568511 - protein, 6 aa, Mycobacterium
RRPEAS

SEQ ID NO: 568512 - protein, 5 aa, Mycobacterium
RRPEE

SEQ ID NO: 568513 - protein, 7 aa, Mycobacterium
RRPEEGG

SEQ ID NO: 568514 - protein, 7 aa, Mycobacterium
RRPEELG

SEQ ID NO: 568515 - protein, 6 aa, Mycobacterium
RRPEEV

SEQ ID NO: 568516 - protein, 23 aa, Mycobacterium
RRPEGPPVAADDDLAADDAAGRA

SEQ ID NO: 568517 - protein, 11 aa, Mycobacterium
RRPEGSVPPLT

SEQ ID NO: 568518 - protein, 10 aa, Mycobacterium
RRPENGAAPA

SEQ ID NO: 568519 - protein, 16 aa, Mycobacterium
RRPEPAPRLGEHTKRY

SEQ ID NO: 568520 - protein, 7 aa, Mycobacterium
RRPEPGL

SEQ ID NO: 568521 - protein, 5 aa, Mycobacterium
RRPER

SEQ ID NO: 568522 - protein, 10 aa, Mycobacterium
RRPETPADAQ

SEQ ID NO: 568523 - protein, 21 aa, Mycobacterium
RRPFAPSQAATTATRTDRGYR

SEQ ID NO: 568524 - protein, 4 aa, Mycobacterium
RRPG

SEQ ID NO: 568525 - protein, 11 aa, Mycobacterium
RRPGAAAETAV

SEQ ID NO: 568526 - protein, 24 aa, Mycobacterium
RRPGAGPGSEPESAPASESSSARR

SEQ ID NO: 568527 - protein, 9 aa, Mycobacterium
RRPGAPKIS

SEQ ID NO: 568528 - protein, 10 aa, Mycobacterium
RRPGAPKISH

SEQ ID NO: 568529 - protein, 17 aa, Mycobacterium
RRPGAPPSATPSSSRRY

SEQ ID NO: 568530 - protein, 18 aa, Mycobacterium
RRPGATPSGTPSSARPYE

SEQ ID NO: 568531 - protein, 17 aa, Mycobacterium
RRPGATPSSAPSSARAY

SEQ ID NO: 568532 - protein, 8 aa, Mycobacterium
RRPGDAPY

SEQ ID NO: 568533 - protein, 8 aa, Mycobacterium
RRPGDPAR

SEQ ID NO: 568534 - protein, 7 aa, Mycobacterium
RRPGDVV

SEQ ID NO: 568535 - protein, 7 aa, Mycobacterium
RRPGEHT

SEQ ID NO: 568536 - protein, 7 aa, Mycobacterium
RRPGEPV

SEQ ID NO: 568537 - protein, 10 aa, Mycobacterium
RRPGEPVAAG

SEQ ID NO: 568538 - protein, 7 aa, Mycobacterium
RRPGETS

SEQ ID NO: 568539 - protein, 9 aa, Mycobacterium
RRPGGPGVI

SEQ ID NO: 568540 - protein, 9 aa, Mycobacterium
RRPGHTEAS

SEQ ID NO: 568541 - protein, 9 aa, Mycobacterium
RRPGKAATG

SEQ ID NO: 568542 - protein, 5 aa, Mycobacterium
RRPGL

SEQ ID NO: 568543 - protein, 5 aa, Mycobacterium
RRPGM

SEQ ID NO: 568544 - protein, 7 aa, Mycobacterium
RRPGPVG

SEQ ID NO: 568545 - protein, 5 aa, Mycobacterium
RRPGR

SEQ ID NO: 568546 - protein, 28 aa, Mycobacterium
RRPGRRGGRPGDLGGHTRRAGVTAGSTR

SEQ ID NO: 568547 - protein, 6 aa, Mycobacterium
RRPGST

SEQ ID NO: 568548 - protein, 6 aa, Mycobacterium
RRPGTD

SEQ ID NO: 568549 - protein, 7 aa, Mycobacterium
RRPGTFT

SEQ ID NO: 568550 - protein, 6 aa, Mycobacterium
RRPGTG

SEQ ID NO: 568551 - protein, 5 aa, Mycobacterium
RRPGW

SEQ ID NO: 568552 - protein, 7 aa, Mycobacterium
RRPHGQH

SEQ ID NO: 568553 - protein, 11 aa, Mycobacterium
RRPHPGRRRPG

SEQ ID NO: 568554 - protein, 6 aa, Mycobacterium
RRPHPI

SEQ ID NO: 568555 - protein, 8 aa, Mycobacterium
RRPHPQGD

SEQ ID NO: 568556 - protein, 9 aa, Mycobacterium
RRPHPRSRR

SEQ ID NO: 568557 - protein, 6 aa, Mycobacterium
RRPHPW

SEQ ID NO: 568558 - protein, 4 aa, Mycobacterium
RRPI

SEQ ID NO: 568559 - protein, 5 aa, Mycobacterium
RRPIE

SEQ ID NO: 568560 - protein, 8 aa, Mycobacterium
RRPIPLPP

SEQ ID NO: 568561 - protein, 10 aa, Mycobacterium
RRPISRPEDC

SEQ ID NO: 568562 - protein, 18 aa, Mycobacterium
RRPKDRKAQIARASAEAF

SEQ ID NO: 568563 - protein, 9 aa, Mycobacterium
RRPKRRPLD

SEQ ID NO: 568564 - protein, 12 aa, Mycobacterium
RRPKSSQALAQR

SEQ ID NO: 568565 - protein, 5 aa, Mycobacterium
RRPKV

SEQ ID NO: 568566 - protein, 9 aa, Mycobacterium
RRPKVSYGA

SEQ ID NO: 568567 - protein, 4 aa, Mycobacterium
RRPL

SEQ ID NO: 568568 - protein, 7 aa, Mycobacterium
RRPLEEA

SEQ ID NO: 568569 - protein, 12 aa, Mycobacterium
RRPLPPRGKQHS

SEQ ID NO: 568570 - protein, 10 aa, Mycobacterium
RRPLPPYSEG

SEQ ID NO: 568571 - protein, 11 aa, Mycobacterium
RRPLPTANGSW

SEQ ID NO: 568572 - protein, 12 aa, Mycobacterium
RRPLPTDGNGSW

SEQ ID NO: 568573 - protein, 13 aa, Mycobacterium
RRPLRGPAPPPRQ

SEQ ID NO: 568574 - protein, 5 aa, Mycobacterium
RRPLS

SEQ ID NO: 568575 - protein, 5 aa, Mycobacterium
RRPLT

SEQ ID NO: 568576 - protein, 14 aa, Mycobacterium
RRPLTSPDADLSEL

SEQ ID NO: 568577 - protein, 17 aa, Mycobacterium
RRPMSDAERAGYDAPFP

SEQ ID NO: 568578 - protein, 10 aa, Mycobacterium
RRPNAPKISH

SEQ ID NO: 568579 - protein, 11 aa, Mycobacterium
RRPNPGGGYGA

SEQ ID NO: 568580 - protein, 6 aa, Mycobacterium
RRPNPL

SEQ ID NO: 568581 - protein, 9 aa, Mycobacterium
RRPNQPAFD

SEQ ID NO: 568582 - protein, 9 aa, Mycobacterium
RRPNTDDLG

SEQ ID NO: 568583 - protein, 4 aa, Mycobacterium
RRPP

SEQ ID NO: 568584 - protein, 6 aa, Mycobacterium
RRPPAA

SEQ ID NO: 568585 - protein, 8 aa, Mycobacterium
RRPPAGIN

SEQ ID NO: 568586 - protein, 9 aa, Mycobacterium
RRPPAPPHP

SEQ ID NO: 568587 - protein, 12 aa, Mycobacterium
RRPPDTATRSRL

SEQ ID NO: 568588 - protein, 6 aa, Mycobacterium
RRPPEE

SEQ ID NO: 568589 - protein, 9 aa, Mycobacterium
RRPPPQEGV

SEQ ID NO: 568590 - protein, 7 aa, Mycobacterium
RRPPPST

SEQ ID NO: 568591 - protein, 6 aa, Mycobacterium
RRPPRG

SEQ ID NO: 568592 - protein, 8 aa, Mycobacterium
RRPPRHTT

SEQ ID NO: 568593 - protein, 8 aa, Mycobacterium
RRPPSPPT

SEQ ID NO: 568594 - protein, 19 aa, Mycobacterium
RRPPSRACDENPLSTLRAG

SEQ ID NO: 568595 - protein, 5 aa, Mycobacterium
RRPPT

SEQ ID NO: 568596 - protein, 6 aa, Mycobacterium
RRPPVT

SEQ ID NO: 568597 - protein, 4 aa, Mycobacterium
RRPQ

SEQ ID NO: 568598 - protein, 6 aa, Mycobacterium
RRPQAH

SEQ ID NO: 568599 - protein, 14 aa, Mycobacterium
RRPQEELDENSRAA

SEQ ID NO: 568600 - protein, 6 aa, Mycobacterium
RRPQRR

SEQ ID NO: 568601 - protein, 4 aa, Mycobacterium
RRPR

SEQ ID NO: 568602 - protein, 6 aa, Mycobacterium
RRPRAD

SEQ ID NO: 568603 - protein, 6 aa, Mycobacterium
RRPREL

SEQ ID NO: 568604 - protein, 5 aa, Mycobacterium
RRPRF

SEQ ID NO: 568605 - protein, 5 aa, Mycobacterium
RRPRG

SEQ ID NO: 568606 - protein, 8 aa, Mycobacterium
RRPRGEPR

SEQ ID NO: 568607 - protein, 14 aa, Mycobacterium
RRPRLGVDTDERTI

SEQ ID NO: 568608 - protein, 16 aa, Mycobacterium
RRPRPAPETAGEAGEG

SEQ ID NO: 568609 - protein, 6 aa, Mycobacterium
RRPRPE

SEQ ID NO: 568610 - protein, 16 aa, Mycobacterium
RRPRPEPETAGEAGDG

SEQ ID NO: 568611 - protein, 8 aa, Mycobacterium
RRPRRHRR

SEQ ID NO: 568612 - protein, 22 aa, Mycobacterium
RRPRRRQIDDTADATQSKSALA

SEQ ID NO: 568613 - protein, 7 aa, Mycobacterium
RRPRSTW

SEQ ID NO: 568614 - protein, 5 aa, Mycobacterium
RRPRT

SEQ ID NO: 568615 - protein, 6 aa, Mycobacterium
RRPSAA

SEQ ID NO: 568616 - protein, 6 aa, Mycobacterium
RRPSDY

SEQ ID NO: 568617 - protein, 5 aa, Mycobacterium
RRPSI

SEQ ID NO: 568618 - protein, 6 aa, Mycobacterium
RRPSPL

SEQ ID NO: 568619 - protein, 10 aa, Mycobacterium
RRPSPPPALD

SEQ ID NO: 568620 - protein, 6 aa, Mycobacterium
RRPSRD

SEQ ID NO: 568621 - protein, 8 aa, Mycobacterium
RRPSTAAD

SEQ ID NO: 568622 - protein, 6 aa, Mycobacterium
RRPSTG

SEQ ID NO: 568623 - protein, 17 aa, Mycobacterium
RRPSTTARRTNRRRKVS

SEQ ID NO: 568624 - protein, 5 aa, Mycobacterium
RRPSV

SEQ ID NO: 568625 - protein, 4 aa, Mycobacterium
RRPT

SEQ ID NO: 568626 - protein, 5 aa, Mycobacterium
RRPTA

SEQ ID NO: 568627 - protein, 7 aa, Mycobacterium
RRPTALE

SEQ ID NO: 568628 - protein, 8 aa, Mycobacterium
RRPTALER

SEQ ID NO: 568629 - protein, 7 aa, Mycobacterium
RRPTATE

SEQ ID NO: 568630 - protein, 7 aa, Mycobacterium
RRPTDSE

SEQ ID NO: 568631 - protein, 8 aa, Mycobacterium
RRPTDSGD

SEQ ID NO: 568632 - protein, 8 aa, Mycobacterium
RRPTEPRA

SEQ ID NO: 568633 - protein, 12 aa, Mycobacterium
RRPTGATALSAD

SEQ ID NO: 568634 - protein, 8 aa, Mycobacterium
RRPTGGDV

SEQ ID NO: 568635 - protein, 9 aa, Mycobacterium
RRPTGPPWA

SEQ ID NO: 568636 - protein, 10 aa, Mycobacterium
RRPTGRDQTR

SEQ ID NO: 568637 - protein, 10 aa, Mycobacterium
RRPTGRNDAA

SEQ ID NO: 568638 - protein, 20 aa, Mycobacterium
RRPTGTDPQTHPTTDETHEG

SEQ ID NO: 568639 - protein, 19 aa, Mycobacterium
RRPTGTDPRSHPSSDQISE

SEQ ID NO: 568640 - protein, 12 aa, Mycobacterium
RRPTGVASPLGE

SEQ ID NO: 568641 - protein, 12 aa, Mycobacterium
RRPTKDADANAV

SEQ ID NO: 568642 - protein, 10 aa, Mycobacterium
RRPTKSPNQL

SEQ ID NO: 568643 - protein, 10 aa, Mycobacterium
RRPTKSPPQL

SEQ ID NO: 568644 - protein, 10 aa, Mycobacterium
RRPTKSPSQV

SEQ ID NO: 568645 - protein, 5 aa, Mycobacterium
RRPTL

SEQ ID NO: 568646 - protein, 11 aa, Mycobacterium
RRPTLSGDDPL

SEQ ID NO: 568647 - protein, 6 aa, Mycobacterium
RRPTPH

SEQ ID NO: 568648 - protein, 7 aa, Mycobacterium
RRPTREA

SEQ ID NO: 568649 - protein, 17 aa, Mycobacterium
RRPTSNSLPSGHSASAA

SEQ ID NO: 568650 - protein, 5 aa, Mycobacterium
RRPTY

SEQ ID NO: 568651 - protein, 6 aa, Mycobacterium
RRPTYA

SEQ ID NO: 568652 - protein, 15 aa, Mycobacterium
RRPVAPRKGAGRVNG

SEQ ID NO: 568653 - protein, 14 aa, Mycobacterium
RRPVGAAPVAPGGI

SEQ ID NO: 568654 - protein, 5 aa, Mycobacterium
RRPVH

SEQ ID NO: 568655 - protein, 18 aa, Mycobacterium
RRPVKADSRRFKTRIPCF

SEQ ID NO: 568656 - protein, 13 aa, Mycobacterium
RRPVPGGGPYNTA

SEQ ID NO: 568657 - protein, 6 aa, Mycobacterium
RRPVPP

SEQ ID NO: 568658 - protein, 7 aa, Mycobacterium
RRPVPRG

SEQ ID NO: 568659 - protein, 5 aa, Mycobacterium
RRPVS

SEQ ID NO: 568660 - protein, 6 aa, Mycobacterium
RRPVSD

SEQ ID NO: 568661 - protein, 10 aa, Mycobacterium
RRPVTEGEVA

SEQ ID NO: 568662 - protein, 6 aa, Mycobacterium
RRPVVG

SEQ ID NO: 568663 - protein, 15 aa, Mycobacterium
RRQAAAAESTDGAPE

SEQ ID NO: 568664 - protein, 9 aa, Mycobacterium
RRQAAPEAA

SEQ ID NO: 568665 - protein, 23 aa, Mycobacterium
RRQAASITTDRAEITRNKSVRSL

SEQ ID NO: 568666 - protein, 12 aa, Mycobacterium
RRQAASPLPASQ

SEQ ID NO: 568667 - protein, 9 aa, Mycobacterium
RRQADGTLL

SEQ ID NO: 568668 - protein, 7 aa, Mycobacterium
RRQAEEL

SEQ ID NO: 568669 - protein, 10 aa, Mycobacterium
RRQAHRPEVR

SEQ ID NO: 568670 - protein, 7 aa, Mycobacterium
RRQAQAG

SEQ ID NO: 568671 - protein, 7 aa, Mycobacterium
RRQAREL

SEQ ID NO: 568672 - protein, 5 aa, Mycobacterium
RRQAT

SEQ ID NO: 568673 - protein, 47 aa, Mycobacterium
RRQDGAGTEEARPAQASRSAQESQPSQASRPAMSGAQRRAAEKEVAS

SEQ ID NO: 568674 - protein, 5 aa, Mycobacterium
RRQDP

SEQ ID NO: 568675 - protein, 13 aa, Mycobacterium
RRQDSMELSCWAR

SEQ ID NO: 568676 - protein, 13 aa, Mycobacterium
RRQEKPREDFNSF

SEQ ID NO: 568677 - protein, 8 aa, Mycobacterium
RRQESAFE

SEQ ID NO: 568678 - protein, 8 aa, Mycobacterium
RRQFTAGA

SEQ ID NO: 568679 - protein, 4 aa, Mycobacterium
RRQG

SEQ ID NO: 568680 - protein, 7 aa, Mycobacterium
RRQGAGV

SEQ ID NO: 568681 - protein, 8 aa, Mycobacterium
RRQGEFAA

SEQ ID NO: 568682 - protein, 7 aa, Mycobacterium
RRQGETA

SEQ ID NO: 568683 - protein, 5 aa, Mycobacterium
RRQGG

SEQ ID NO: 568684 - protein, 17 aa, Mycobacterium
RRQGLGDIPRRSARRHP

SEQ ID NO: 568685 - protein, 6 aa, Mycobacterium
RRQGQH

SEQ ID NO: 568686 - protein, 7 aa, Mycobacterium
RRQGSGT

SEQ ID NO: 568687 - protein, 6 aa, Mycobacterium
RRQGTP

SEQ ID NO: 568688 - protein, 5 aa, Mycobacterium
RRQGV

SEQ ID NO: 568689 - protein, 8 aa, Mycobacterium
RRQHGDGE

SEQ ID NO: 568690 - protein, 24 aa, Mycobacterium
RRQHNSPDTPPKTAEPRAQGTGLA

SEQ ID NO: 568691 - protein, 11 aa, Mycobacterium
RRQKSLPDKPV

SEQ ID NO: 568692 - protein, 4 aa, Mycobacterium
RRQL

SEQ ID NO: 568693 - protein, 19 aa, Mycobacterium
RRQLGDGGRLEDDAHRNAG

SEQ ID NO: 568694 - protein, 8 aa, Mycobacterium
RRQNPQDD

SEQ ID NO: 568695 - protein, 7 aa, Mycobacterium
RRQNRDR

SEQ ID NO: 568696 - protein, 4 aa, Mycobacterium
RRQP

SEQ ID NO: 568697 - protein, 13 aa, Mycobacterium
RRQPDDPERLPLG

SEQ ID NO: 568698 - protein, 6 aa, Mycobacterium
RRQPDE

SEQ ID NO: 568699 - protein, 8 aa, Mycobacterium
RRQPDQVL

SEQ ID NO: 568700 - protein, 8 aa, Mycobacterium
RRQPGDIP

SEQ ID NO: 568701 - protein, 8 aa, Mycobacterium
RRQPGDVP

SEQ ID NO: 568702 - protein, 15 aa, Mycobacterium
RRQPPAVSLGPGDDA

SEQ ID NO: 568703 - protein, 20 aa, Mycobacterium
RRQPPPARRWTPGRALRRLL

SEQ ID NO: 568704 - protein, 9 aa, Mycobacterium
RRQPPSVSV

SEQ ID NO: 568705 - protein, 15 aa, Mycobacterium
RRQPPTEEGGEETVT

SEQ ID NO: 568706 - protein, 8 aa, Mycobacterium
RRQPSDVP

SEQ ID NO: 568707 - protein, 8 aa, Mycobacterium
RRQPSPPT

SEQ ID NO: 568708 - protein, 6 aa, Mycobacterium
RRQQQR

SEQ ID NO: 568709 - protein, 12 aa, Mycobacterium
RRQRDALTRSEQ

SEQ ID NO: 568710 - protein, 10 aa, Mycobacterium
RRQRIRTGNA

SEQ ID NO: 568711 - protein, 12 aa, Mycobacterium
RRQRQLRGQSEV

SEQ ID NO: 568712 - protein, 7 aa, Mycobacterium
RRQRREQ

SEQ ID NO: 568713 - protein, 8 aa, Mycobacterium
RRQRTGVA

SEQ ID NO: 568714 - protein, 8 aa, Mycobacterium
RRQSGGAV

SEQ ID NO: 568715 - protein, 6 aa, Mycobacterium
RRQSQR

SEQ ID NO: 568716 - protein, 8 aa, Mycobacterium
RRQTGQTH

SEQ ID NO: 568717 - protein, 24 aa, Mycobacterium
RRQTHPFGPGRGRAGGPSGSTAPC

SEQ ID NO: 568718 - protein, 5 aa, Mycobacterium
RRQTP

SEQ ID NO: 568719 - protein, 32 aa, Mycobacterium
RRQTREQDRADRINAERRERAELNAEQQRQRQ

SEQ ID NO: 568720 - protein, 10 aa, Mycobacterium
RRQTSKSVGS

SEQ ID NO: 568721 - protein, 7 aa, Mycobacterium
RRQTSLE

SEQ ID NO: 568722 - protein, 7 aa, Mycobacterium
RRQTTDI

SEQ ID NO: 568723 - protein, 11 aa, Mycobacterium
RRQVEERREGL

SEQ ID NO: 568724 - protein, 5 aa, Mycobacterium
RRRAA

SEQ ID NO: 568725 - protein, 6 aa, Mycobacterium
RRRAAA

SEQ ID NO: 568726 - protein, 14 aa, Mycobacterium
RRRAAARPAGPPSH

SEQ ID NO: 568727 - protein, 10 aa, Mycobacterium
RRRAAETGAT

SEQ ID NO: 568728 - protein, 14 aa, Mycobacterium
RRRADAKRPGNRTD

SEQ ID NO: 568729 - protein, 9 aa, Mycobacterium
RRRADGSIE

SEQ ID NO: 568730 - protein, 10 aa, Mycobacterium
RRRADGSYEE

SEQ ID NO: 568731 - protein, 11 aa, Mycobacterium
RRRADQSGGSL

SEQ ID NO: 568732 - protein, 11 aa, Mycobacterium
RRRADRERERA

SEQ ID NO: 568733 - protein, 11 aa, Mycobacterium
RRRADRSGPPL

SEQ ID NO: 568734 - protein, 5 aa, Mycobacterium
RRRAG

SEQ ID NO: 568735 - protein, 7 aa, Mycobacterium
RRRAHDG

SEQ ID NO: 568736 - protein, 14 aa, Mycobacterium
RRRAPGLTPEELPP

SEQ ID NO: 568737 - protein, 6 aa, Mycobacterium
RRRAPK

SEQ ID NO: 568738 - protein, 6 aa, Mycobacterium
RRRAPR

SEQ ID NO: 568739 - protein, 12 aa, Mycobacterium
RRRAPSDPTVST

SEQ ID NO: 568740 - protein, 5 aa, Mycobacterium
RRRAR

SEQ ID NO: 568741 - protein, 8 aa, Mycobacterium
RRRARAGS

SEQ ID NO: 568742 - protein, 9 aa, Mycobacterium
RRRARGGVA

SEQ ID NO: 568743 - protein, 9 aa, Mycobacterium
RRRARKGTL

SEQ ID NO: 568744 - protein, 10 aa, Mycobacterium
RRRARRRGRV

SEQ ID NO: 568745 - protein, 11 aa, Mycobacterium
RRRASEAIADG

SEQ ID NO: 568746 - protein, 5 aa, Mycobacterium
RRRAV

SEQ ID NO: 568747 - protein, 5 aa, Mycobacterium
RRRCP

SEQ ID NO: 568748 - protein, 5 aa, Mycobacterium
RRRDA

SEQ ID NO: 568749 - protein, 8 aa, Mycobacterium
RRRDAADI

SEQ ID NO: 568750 - protein, 7 aa, Mycobacterium
RRRDAEL

SEQ ID NO: 568751 - protein, 10 aa, Mycobacterium
RRRDAGLPYS

SEQ ID NO: 568752 - protein, 14 aa, Mycobacterium
RRRDAGLPYSRNAS

SEQ ID NO: 568753 - protein, 14 aa, Mycobacterium
RRRDAGLPYSSQAS

SEQ ID NO: 568754 - protein, 7 aa, Mycobacterium
RRRDAGT

SEQ ID NO: 568755 - protein, 7 aa, Mycobacterium
RRRDAVD

SEQ ID NO: 568756 - protein, 5 aa, Mycobacterium
RRRDE

SEQ ID NO: 568757 - protein, 8 aa, Mycobacterium
RRRDEALA

SEQ ID NO: 568758 - protein, 7 aa, Mycobacterium
RRRDEES

SEQ ID NO: 568759 - protein, 16 aa, Mycobacterium
RRRDEVEEAASSITGQ

SEQ ID NO: 568760 - protein, 13 aa, Mycobacterium
RRRDGAPPPGPLK

SEQ ID NO: 568761 - protein, 10 aa, Mycobacterium
RRRDGDVDAG

SEQ ID NO: 568762 - protein, 9 aa, Mycobacterium
RRRDGTAVD

SEQ ID NO: 568763 - protein, 9 aa, Mycobacterium
RRRDPEGAL

SEQ ID NO: 568764 - protein, 7 aa, Mycobacterium
RRRDPFD

SEQ ID NO: 568765 - protein, 8 aa, Mycobacterium
RRRDPFDD

SEQ ID NO: 568766 - protein, 16 aa, Mycobacterium
RRRDPFDDPGLDPDRL

SEQ ID NO: 568767 - protein, 17 aa, Mycobacterium
RRRDPFDDPGLDPGTLD

SEQ ID NO: 568768 - protein, 18 aa, Mycobacterium
RRRDPFDEPGLDPDQLDQ

SEQ ID NO: 568769 - protein, 8 aa, Mycobacterium
RRRDPGED

SEQ ID NO: 568770 - protein, 14 aa, Mycobacterium
RRRDPGLSESELTT

SEQ ID NO: 568771 - protein, 12 aa, Mycobacterium
RRRDRETGDNFD

SEQ ID NO: 568772 - protein, 9 aa, Mycobacterium
RRRDTGSMT

SEQ ID NO: 568773 - protein, 4 aa, Mycobacterium
RRRE

SEQ ID NO: 568774 - protein, 6 aa, Mycobacterium
RRREAA

SEQ ID NO: 568775 - protein, 7 aa, Mycobacterium
RRREAAA

SEQ ID NO: 568776 - protein, 7 aa, Mycobacterium
RRREAGT

SEQ ID NO: 568777 - protein, 9 aa, Mycobacterium
RRREAQARC

SEQ ID NO: 568778 - protein, 12 aa, Mycobacterium
RRREDARARRDW

SEQ ID NO: 568779 - protein, 9 aa, Mycobacterium
RRREDGSIE

SEQ ID NO: 568780 - protein, 6 aa, Mycobacterium
RRREEP

SEQ ID NO: 568781 - protein, 14 aa, Mycobacterium
RRREGADGPEQVGE

SEQ ID NO: 568782 - protein, 6 aa, Mycobacterium
RRREGD

SEQ ID NO: 568783 - protein, 5 aa, Mycobacterium
RRREI

SEQ ID NO: 568784 - protein, 9 aa, Mycobacterium
RRREITGGK

SEQ ID NO: 568785 - protein, 11 aa, Mycobacterium
RRREKAATREL

SEQ ID NO: 568786 - protein, 9 aa, Mycobacterium
RRRELTGGK

SEQ ID NO: 568787 - protein, 5 aa, Mycobacterium
RRREN

SEQ ID NO: 568788 - protein, 8 aa, Mycobacterium
RRREPATL

SEQ ID NO: 568789 - protein, 9 aa, Mycobacterium
RRREPGDDT

SEQ ID NO: 568790 - protein, 7 aa, Mycobacterium
RRREPLE

SEQ ID NO: 568791 - protein, 8 aa, Mycobacterium
RRREPRDD

SEQ ID NO: 568792 - protein, 7 aa, Mycobacterium
RRREPRE

SEQ ID NO: 568793 - protein, 7 aa, Mycobacterium
RRREPRG

SEQ ID NO: 568794 - protein, 8 aa, Mycobacterium
RRREPRND

SEQ ID NO: 568795 - protein, 5 aa, Mycobacterium
RRRER

SEQ ID NO: 568796 - protein, 7 aa, Mycobacterium
RRRERPN

SEQ ID NO: 568797 - protein, 6 aa, Mycobacterium
RRRERR

SEQ ID NO: 568798 - protein, 5 aa, Mycobacterium
RRRES

SEQ ID NO: 568799 - protein, 12 aa, Mycobacterium
RRRESIDDGIAR

SEQ ID NO: 568800 - protein, 9 aa, Mycobacterium
RRRESQARC

SEQ ID NO: 568801 - protein, 5 aa, Mycobacterium
RRRET

SEQ ID NO: 568802 - protein, 9 aa, Mycobacterium
RRRETDPNT

SEQ ID NO: 568803 - protein, 6 aa, Mycobacterium
RRRGAV

SEQ ID NO: 568804 - protein, 22 aa, Mycobacterium
RRRGCRGATDNSGGSSRPQRGI

SEQ ID NO: 568805 - protein, 16 aa, Mycobacterium
RRRGDVAPPPPAGAPA

SEQ ID NO: 568806 - protein, 5 aa, Mycobacterium
RRRGE

SEQ ID NO: 568807 - protein, 7 aa, Mycobacterium
RRRGEGI

SEQ ID NO: 568808 - protein, 6 aa, Mycobacterium
RRRGFG

SEQ ID NO: 568809 - protein, 5 aa, Mycobacterium
RRRGG

SEQ ID NO: 568810 - protein, 5 aa, Mycobacterium
RRRGH

SEQ ID NO: 568811 - protein, 5 aa, Mycobacterium
RRRGI

SEQ ID NO: 568812 - protein, 8 aa, Mycobacterium
RRRGPGRI

SEQ ID NO: 568813 - protein, 17 aa, Mycobacterium
RRRGRGNAEPTADQRVR

SEQ ID NO: 568814 - protein, 10 aa, Mycobacterium
RRRGRSARGI

SEQ ID NO: 568815 - protein, 35 aa, Mycobacterium
RRRGRTDSLPRPDGGRQTASTGRNDQQHGRRNPRR

SEQ ID NO: 568816 - protein, 6 aa, Mycobacterium
RRRGSA

SEQ ID NO: 568817 - protein, 7 aa, Mycobacterium
RRRGSGP

SEQ ID NO: 568818 - protein, 8 aa, Mycobacterium
RRRGSQPT

SEQ ID NO: 568819 - protein, 7 aa, Mycobacterium
RRRGTAD

SEQ ID NO: 568820 - protein, 8 aa, Mycobacterium
RRRGTASG

SEQ ID NO: 568821 - protein, 5 aa, Mycobacterium
RRRGW

SEQ ID NO: 568822 - protein, 4 aa, Mycobacterium
RRRH

SEQ ID NO: 568823 - protein, 8 aa, Mycobacterium
RRRHGDRF

SEQ ID NO: 568824 - protein, 21 aa, Mycobacterium
RRRHPRARAGWDRAQGRIPAD

SEQ ID NO: 568825 - protein, 13 aa, Mycobacterium
RRRHPRRNELGRS

SEQ ID NO: 568826 - protein, 6 aa, Mycobacterium
RRRHRA

SEQ ID NO: 568827 - protein, 9 aa, Mycobacterium
RRRHRPDAN

SEQ ID NO: 568828 - protein, 19 aa, Mycobacterium
RRRHSSVTNRGVRPDADGR

SEQ ID NO: 568829 - protein, 5 aa, Mycobacterium
RRRIG

SEQ ID NO: 568830 - protein, 5 aa, Mycobacterium
RRRIK

SEQ ID NO: 568831 - protein, 6 aa, Mycobacterium
RRRKEP

SEQ ID NO: 568832 - protein, 10 aa, Mycobacterium
RRRLDGDGIS

SEQ ID NO: 568833 - protein, 4 aa, Mycobacterium
RRRM

SEQ ID NO: 568834 - protein, 18 aa, Mycobacterium
RRRNAAERADGPRGNDPP

SEQ ID NO: 568835 - protein, 14 aa, Mycobacterium
RRRNEVRAGAPARV

SEQ ID NO: 568836 - protein, 7 aa, Mycobacterium
RRRNPDG

SEQ ID NO: 568837 - protein, 8 aa, Mycobacterium
RRRNPQDD

SEQ ID NO: 568838 - protein, 8 aa, Mycobacterium
RRRNPRDD

SEQ ID NO: 568839 - protein, 8 aa, Mycobacterium
RRRNPRGD

SEQ ID NO: 568840 - protein, 11 aa, Mycobacterium
RRRNRQARQPR

SEQ ID NO: 568841 - protein, 11 aa, Mycobacterium
RRRNSAAGLAQ

SEQ ID NO: 568842 - protein, 9 aa, Mycobacterium
RRRNVSDDL

SEQ ID NO: 568843 - protein, 5 aa, Mycobacterium
RRRPA

SEQ ID NO: 568844 - protein, 11 aa, Mycobacterium
RRRPAGRSPDD

SEQ ID NO: 568845 - protein, 15 aa, Mycobacterium
RRRPAPETAGEAGDG

SEQ ID NO: 568846 - protein, 8 aa, Mycobacterium
RRRPARAH

SEQ ID NO: 568847 - protein, 9 aa, Mycobacterium
RRRPDGDEL

SEQ ID NO: 568848 - protein, 9 aa, Mycobacterium
RRRPDGTYE

SEQ ID NO: 568849 - protein, 8 aa, Mycobacterium
RRRPDRVS

SEQ ID NO: 568850 - protein, 9 aa, Mycobacterium
RRRPEAGLD

SEQ ID NO: 568851 - protein, 13 aa, Mycobacterium
RRRPEQGPGSKAE

SEQ ID NO: 568852 - protein, 15 aa, Mycobacterium
RRRPESRWRRQPGDV

SEQ ID NO: 568853 - protein, 8 aa, Mycobacterium
RRRPEVDP

SEQ ID NO: 568854 - protein, 20 aa, Mycobacterium
RRRPGEWTPPAERAARRQAE

SEQ ID NO: 568855 - protein, 22 aa, Mycobacterium
RRRPGTGATGRRLDRKASLTAQ

SEQ ID NO: 568856 - protein, 18 aa, Mycobacterium
RRRPKGPPSGAAESDRAG

SEQ ID NO: 568857 - protein, 20 aa, Mycobacterium
RRRPKGPPSGSAQADQEGVA

SEQ ID NO: 568858 - protein, 16 aa, Mycobacterium
RRRPKGPPSGSSAADI

SEQ ID NO: 568859 - protein, 5 aa, Mycobacterium
RRRPL

SEQ ID NO: 568860 - protein, 5 aa, Mycobacterium
RRRPP

SEQ ID NO: 568861 - protein, 7 aa, Mycobacterium
RRRPPGF

SEQ ID NO: 568862 - protein, 6 aa, Mycobacterium
RRRPPR

SEQ ID NO: 568863 - protein, 9 aa, Mycobacterium
RRRPPSDDV

SEQ ID NO: 568864 - protein, 11 aa, Mycobacterium
RRRPRNPEGLK

SEQ ID NO: 568865 - protein, 8 aa, Mycobacterium
RRRPRPGY

SEQ ID NO: 568866 - protein, 9 aa, Mycobacterium
RRRPRPLDD

SEQ ID NO: 568867 - protein, 29 aa, Mycobacterium
RRRPRRGGSPQPESRGAVAATQPNSPRHT

SEQ ID NO: 568868 - protein, 6 aa, Mycobacterium
RRRPRS

SEQ ID NO: 568869 - protein, 9 aa, Mycobacterium
RRRPSDDVP

SEQ ID NO: 568870 - protein, 6 aa, Mycobacterium
RRRPSE

SEQ ID NO: 568871 - protein, 18 aa, Mycobacterium
RRRPTGPPSGSAAADRAG

SEQ ID NO: 568872 - protein, 18 aa, Mycobacterium
RRRPTGPPSGSAATDRAG

SEQ ID NO: 568873 - protein, 16 aa, Mycobacterium
RRRPTPPKPQVHGGQE

SEQ ID NO: 568874 - protein, 18 aa, Mycobacterium
RRRPTSNSFPSGHSASAA

SEQ ID NO: 568875 - protein, 17 aa, Mycobacterium
RRRPTSNSLPSGHSASA

SEQ ID NO: 568876 - protein, 4 aa, Mycobacterium
RRRQ

SEQ ID NO: 568877 - protein, 7 aa, Mycobacterium
RRRQAGL

SEQ ID NO: 568878 - protein, 7 aa, Mycobacterium
RRRQGAE

SEQ ID NO: 568879 - protein, 6 aa, Mycobacterium
RRRQPC

SEQ ID NO: 568880 - protein, 9 aa, Mycobacterium
RRRQPERGA

SEQ ID NO: 568881 - protein, 8 aa, Mycobacterium
RRRQPRED

SEQ ID NO: 568882 - protein, 7 aa, Mycobacterium
RRRQPRN

SEQ ID NO: 568883 - protein, 14 aa, Mycobacterium
RRRQQPELSPEDRI

SEQ ID NO: 568884 - protein, 11 aa, Mycobacterium
RRRQRGHGSPA

SEQ ID NO: 568885 - protein, 7 aa, Mycobacterium
RRRQRPL

SEQ ID NO: 568886 - protein, 12 aa, Mycobacterium
RRRQSALASQPS

SEQ ID NO: 568887 - protein, 5 aa, Mycobacterium
RRRRA

SEQ ID NO: 568888 - protein, 23 aa, Mycobacterium
RRRRAAGTRAGGARGRTSASPVR

SEQ ID NO: 568889 - protein, 9 aa, Mycobacterium
RRRRAHTGQ

SEQ ID NO: 568890 - protein, 9 aa, Mycobacterium
RRRRARAGE

SEQ ID NO: 568891 - protein, 8 aa, Mycobacterium
RRRRDAAM

SEQ ID NO: 568892 - protein, 16 aa, Mycobacterium
RRRRDPVQFVDGQGVS

SEQ ID NO: 568893 - protein, 12 aa, Mycobacterium
RRRRESASVRPE

SEQ ID NO: 568894 - protein, 10 aa, Mycobacterium
RRRRGAESTA

SEQ ID NO: 568895 - protein, 10 aa, Mycobacterium
RRRRGPETTA

SEQ ID NO: 568896 - protein, 16 aa, Mycobacterium
RRRRGRPAGSEDDGDV

SEQ ID NO: 568897 - protein, 11 aa, Mycobacterium
RRRRGRPRRID

SEQ ID NO: 568898 - protein, 16 aa, Mycobacterium
RRRRPAPETAGEAGDG

SEQ ID NO: 568899 - protein, 6 aa, Mycobacterium
RRRRPD

SEQ ID NO: 568900 - protein, 7 aa, Mycobacterium
RRRRPDA

SEQ ID NO: 568901 - protein, 6 aa, Mycobacterium
RRRRPQ

SEQ ID NO: 568902 - protein, 9 aa, Mycobacterium
RRRRPTEDL

SEQ ID NO: 568903 - protein, 5 aa, Mycobacterium
RRRRQ

SEQ ID NO: 568904 - protein, 8 aa, Mycobacterium
RRRRQAGL

SEQ ID NO: 568905 - protein, 8 aa, Mycobacterium
RRRRQGAL

SEQ ID NO: 568906 - protein, 9 aa, Mycobacterium
RRRRQSGLG

SEQ ID NO: 568907 - protein, 8 aa, Mycobacterium
RRRRQTGL

SEQ ID NO: 568908 - protein, 6 aa, Mycobacterium
RRRRRP

SEQ ID NO: 568909 - protein, 17 aa, Mycobacterium
RRRRRRPTRRPGHRRRS

SEQ ID NO: 568910 - protein, 7 aa, Mycobacterium
RRRRSRA

SEQ ID NO: 568911 - protein, 10 aa, Mycobacterium
RRRRSRAGEI

SEQ ID NO: 568912 - protein, 10 aa, Mycobacterium
RRRRSRAGSI

SEQ ID NO: 568913 - protein, 6 aa, Mycobacterium
RRRSAE

SEQ ID NO: 568914 - protein, 8 aa, Mycobacterium
RRRSDDGT

SEQ ID NO: 568915 - protein, 9 aa, Mycobacterium
RRRSEARSQ

SEQ ID NO: 568916 - protein, 11 aa, Mycobacterium
RRRSEGRTTKE

SEQ ID NO: 568917 - protein, 10 aa, Mycobacterium
RRRSEKSRTA

SEQ ID NO: 568918 - protein, 8 aa, Mycobacterium
RRRSGGQL

SEQ ID NO: 568919 - protein, 15 aa, Mycobacterium
RRRSGIDKRPSAEPV

SEQ ID NO: 568920 - protein, 10 aa, Mycobacterium
RRRSGQTTRT

SEQ ID NO: 568921 - protein, 12 aa, Mycobacterium
RRRSKERGHHPD

SEQ ID NO: 568922 - protein, 10 aa, Mycobacterium
RRRSKPSEDI

SEQ ID NO: 568923 - protein, 6 aa, Mycobacterium
RRRSLT

SEQ ID NO: 568924 - protein, 6 aa, Mycobacterium
RRRSPL

SEQ ID NO: 568925 - protein, 9 aa, Mycobacterium
RRRSPRPED

SEQ ID NO: 568926 - protein, 9 aa, Mycobacterium
RRRSRPTED

SEQ ID NO: 568927 - protein, 7 aa, Mycobacterium
RRRSSDI

SEQ ID NO: 568928 - protein, 8 aa, Mycobacterium
RRRSSGAV

SEQ ID NO: 568929 - protein, 9 aa, Mycobacterium
RRRSSQLRR

SEQ ID NO: 568930 - protein, 9 aa, Mycobacterium
RRRTAEDSA

SEQ ID NO: 568931 - protein, 10 aa, Mycobacterium
RRRTAEDTGL

SEQ ID NO: 568932 - protein, 8 aa, Mycobacterium
RRRTEADM

SEQ ID NO: 568933 - protein, 7 aa, Mycobacterium
RRRTEQG

SEQ ID NO: 568934 - protein, 8 aa, Mycobacterium
RRRTERER

SEQ ID NO: 568935 - protein, 25 aa, Mycobacterium
RRRTERERLQAQPPPDVIDHTWKPP

SEQ ID NO: 568936 - protein, 8 aa, Mycobacterium
RRRTGDGF

SEQ ID NO: 568937 - protein, 6 aa, Mycobacterium
RRRTGE

SEQ ID NO: 568938 - protein, 8 aa, Mycobacterium
RRRTGEGA

SEQ ID NO: 568939 - protein, 8 aa, Mycobacterium
RRRTGEGQ

SEQ ID NO: 568940 - protein, 7 aa, Mycobacterium
RRRTGQG

SEQ ID NO: 568941 - protein, 8 aa, Mycobacterium
RRRTGQGT

SEQ ID NO: 568942 - protein, 12 aa, Mycobacterium
RRRTGQVGTPET

SEQ ID NO: 568943 - protein, 13 aa, Mycobacterium
RRRTPEITHLQGI

SEQ ID NO: 568944 - protein, 8 aa, Mycobacterium
RRRTPGED

SEQ ID NO: 568945 - protein, 9 aa, Mycobacterium
RRRTPPKEL

SEQ ID NO: 568946 - protein, 7 aa, Mycobacterium
RRRTPRA

SEQ ID NO: 568947 - protein, 23 aa, Mycobacterium
RRRTRAQDRAARAATERRHNRDA

SEQ ID NO: 568948 - protein, 13 aa, Mycobacterium
RRRTRAQERAQRI

SEQ ID NO: 568949 - protein, 13 aa, Mycobacterium
RRRTRATRAYRLP

SEQ ID NO: 568950 - protein, 44 aa, Mycobacterium
RRRTSTQNHRNRRGCRRPGPHPAGRRGDPAPRRPVTADPGDPAH

SEQ ID NO: 568951 - protein, 7 aa, Mycobacterium
RRRTTAT

SEQ ID NO: 568952 - protein, 8 aa, Mycobacterium
RRRTTESV

SEQ ID NO: 568953 - protein, 6 aa, Mycobacterium
RRRVPR

SEQ ID NO: 568954 - protein, 30 aa, Mycobacterium
RRRVSTGVSRRSVGAQRALGRAGNTMSPAE

SEQ ID NO: 568955 - protein, 29 aa, Mycobacterium
RRRVTTGVRRSSVGAQRALGRRGNSMSAA

SEQ ID NO: 568956 - protein, 4 aa, Mycobacterium
RRRY

SEQ ID NO: 568957 - protein, 7 aa, Mycobacterium
RRRYGAA

SEQ ID NO: 568958 - protein, 14 aa, Mycobacterium
RRRYSGDQPNEGQW

SEQ ID NO: 568959 - protein, 13 aa, Mycobacterium
RRRYTRAGAYGAS

SEQ ID NO: 568960 - protein, 5 aa, Mycobacterium
RRSAA

SEQ ID NO: 568961 - protein, 15 aa, Mycobacterium
RRSAAVHPDDEADER

SEQ ID NO: 568962 - protein, 9 aa, Mycobacterium
RRSAEAFPR

SEQ ID NO: 568963 - protein, 10 aa, Mycobacterium
RRSAEDFPRS

SEQ ID NO: 568964 - protein, 8 aa, Mycobacterium
RRSAGAHP

SEQ ID NO: 568965 - protein, 9 aa, Mycobacterium
RRSAPDGDE

SEQ ID NO: 568966 - protein, 11 aa, Mycobacterium
RRSAPPSGTPL

SEQ ID NO: 568967 - protein, 26 aa, Mycobacterium
RRSAQRDARRDDRRDGPEPDSGSDDA

SEQ ID NO: 568968 - protein, 5 aa, Mycobacterium
RRSAR

SEQ ID NO: 568969 - protein, 28 aa, Mycobacterium
RRSARSRNVVGSTDESGAPEQSVPDEVN

SEQ ID NO: 568970 - protein, 12 aa, Mycobacterium
RRSASEIRPETA

SEQ ID NO: 568971 - protein, 10 aa, Mycobacterium
RRSDARTELT

SEQ ID NO: 568972 - protein, 6 aa, Mycobacterium
RRSDEG

SEQ ID NO: 568973 - protein, 20 aa, Mycobacterium
RRSDGIDANGDGDAGVVTGP

SEQ ID NO: 568974 - protein, 17 aa, Mycobacterium
RRSDGPPRIIVRPNGDR

SEQ ID NO: 568975 - protein, 7 aa, Mycobacterium
RRSDHAT

SEQ ID NO: 568976 - protein, 12 aa, Mycobacterium
RRSDHDPSKAKR

SEQ ID NO: 568977 - protein, 7 aa, Mycobacterium
RRSDNGV

SEQ ID NO: 568978 - protein, 5 aa, Mycobacterium
RRSDP

SEQ ID NO: 568979 - protein, 8 aa, Mycobacterium
RRSDPDLD

SEQ ID NO: 568980 - protein, 15 aa, Mycobacterium
RRSDTASDRRRSGDA

SEQ ID NO: 568981 - protein, 9 aa, Mycobacterium
RRSDTTTYC

SEQ ID NO: 568982 - protein, 6 aa, Mycobacterium
RRSDVP

SEQ ID NO: 568983 - protein, 5 aa, Mycobacterium
RRSEA

SEQ ID NO: 568984 - protein, 8 aa, Mycobacterium
RRSEAAER

SEQ ID NO: 568985 - protein, 10 aa, Mycobacterium
RRSEPADDTV

SEQ ID NO: 568986 - protein, 14 aa, Mycobacterium
RRSEPEAPPACGGQ

SEQ ID NO: 568987 - protein, 14 aa, Mycobacterium
RRSEQPDDQPDVTP

SEQ ID NO: 568988 - protein, 9 aa, Mycobacterium
RRSERPPGH

SEQ ID NO: 568989 - protein, 10 aa, Mycobacterium
RRSESLADGS

SEQ ID NO: 568990 - protein, 12 aa, Mycobacterium
RRSFDETGWSTD

SEQ ID NO: 568991 - protein, 5 aa, Mycobacterium
RRSGA

SEQ ID NO: 568992 - protein, 15 aa, Mycobacterium
RRSGAAAPVAQTVSR

SEQ ID NO: 568993 - protein, 6 aa, Mycobacterium
RRSGAD

SEQ ID NO: 568994 - protein, 22 aa, Mycobacterium
RRSGADDARRDDAERSDEEEWR

SEQ ID NO: 568995 - protein, 20 aa, Mycobacterium
RRSGDADGLQTQAAREIDAT

SEQ ID NO: 568996 - protein, 21 aa, Mycobacterium
RRSGDPAQQQVAEQVAAQNYT

SEQ ID NO: 568997 - protein, 5 aa, Mycobacterium
RRSGE

SEQ ID NO: 568998 - protein, 10 aa, Mycobacterium
RRSGEVSGQD

SEQ ID NO: 568999 - protein, 16 aa, Mycobacterium
RRSGGDTARTKACPKM

SEQ ID NO: 569000 - protein, 6 aa, Mycobacterium
RRSGGR

SEQ ID NO: 569001 - protein, 10 aa, Mycobacterium
RRSGKPYRTP

SEQ ID NO: 569002 - protein, 22 aa, Mycobacterium
RRSGKRASESGHPAVRGPSGRT

SEQ ID NO: 569003 - protein, 6 aa, Mycobacterium
RRSGLT

SEQ ID NO: 569004 - protein, 7 aa, Mycobacterium
RRSGNDA

SEQ ID NO: 569005 - protein, 8 aa, Mycobacterium
RRSGNDAD

SEQ ID NO: 569006 - protein, 10 aa, Mycobacterium
RRSGPGPART

SEQ ID NO: 569007 - protein, 5 aa, Mycobacterium
RRSGQ

SEQ ID NO: 569008 - protein, 5 aa, Mycobacterium
RRSGR

SEQ ID NO: 569009 - protein, 12 aa, Mycobacterium
RRSGRATRGSQP

SEQ ID NO: 569010 - protein, 8 aa, Mycobacterium
RRSGRIGT

SEQ ID NO: 569011 - protein, 10 aa, Mycobacterium
RRSGRSATEI

SEQ ID NO: 569012 - protein, 6 aa, Mycobacterium
RRSGTD

SEQ ID NO: 569013 - protein, 12 aa, Mycobacterium
RRSGTISDRPAG

SEQ ID NO: 569014 - protein, 7 aa, Mycobacterium
RRSGTVY

SEQ ID NO: 569015 - protein, 10 aa, Mycobacterium
RRSGVDPMET

SEQ ID NO: 569016 - protein, 14 aa, Mycobacterium
RRSGVDPRRLHNRA

SEQ ID NO: 569017 - protein, 7 aa, Mycobacterium
RRSGVGR

SEQ ID NO: 569018 - protein, 13 aa, Mycobacterium
RRSGVRRDNTGYD

SEQ ID NO: 569019 - protein, 9 aa, Mycobacterium
RRSGVTAED

SEQ ID NO: 569020 - protein, 16 aa, Mycobacterium
RRSGYGAAATRVLSQL

SEQ ID NO: 569021 - protein, 7 aa, Mycobacterium
RRSHPEQ

SEQ ID NO: 569022 - protein, 8 aa, Mycobacterium
RRSHPGDD

SEQ ID NO: 569023 - protein, 7 aa, Mycobacterium
RRSHSRN

SEQ ID NO: 569024 - protein, 4 aa, Mycobacterium
RRSI

SEQ ID NO: 569025 - protein, 18 aa, Mycobacterium
RRSIDGLPALDSDHPGPP

SEQ ID NO: 569026 - protein, 6 aa, Mycobacterium
RRSITS

SEQ ID NO: 569027 - protein, 6 aa, Mycobacterium
RRSKAR

SEQ ID NO: 569028 - protein, 5 aa, Mycobacterium
RRSKN

SEQ ID NO: 569029 - protein, 16 aa, Mycobacterium
RRSLGAASTEATDTST

SEQ ID NO: 569030 - protein, 9 aa, Mycobacterium
RRSLPGDPY

SEQ ID NO: 569031 - protein, 11 aa, Mycobacterium
RRSLSPSAEPT

SEQ ID NO: 569032 - protein, 15 aa, Mycobacterium
RRSMQGNRSRDTAPE

SEQ ID NO: 569033 - protein, 11 aa, Mycobacterium
RRSNPRDLTGG

SEQ ID NO: 569034 - protein, 9 aa, Mycobacterium
RRSNYGAER

SEQ ID NO: 569035 - protein, 6 aa, Mycobacterium
RRSPAQ

SEQ ID NO: 569036 - protein, 7 aa, Mycobacterium
RRSPEQI

SEQ ID NO: 569037 - protein, 6 aa, Mycobacterium
RRSPES

SEQ ID NO: 569038 - protein, 6 aa, Mycobacterium
RRSPHS

SEQ ID NO: 569039 - protein, 8 aa, Mycobacterium
RRSPHYKD

SEQ ID NO: 569040 - protein, 5 aa, Mycobacterium
RRSPK

SEQ ID NO: 569041 - protein, 9 aa, Mycobacterium
RRSPLAAAA

SEQ ID NO: 569042 - protein, 8 aa, Mycobacterium
RRSPNPPL

SEQ ID NO: 569043 - protein, 7 aa, Mycobacterium
RRSPSEY

SEQ ID NO: 569044 - protein, 8 aa, Mycobacterium
RRSPTNRG

SEQ ID NO: 569045 - protein, 8 aa, Mycobacterium
RRSQPGDD

SEQ ID NO: 569046 - protein, 8 aa, Mycobacterium
RRSQTAAR

SEQ ID NO: 569047 - protein, 14 aa, Mycobacterium
RRSQVGGTLSGGEQ

SEQ ID NO: 569048 - protein, 12 aa, Mycobacterium
RRSREAVTARDK

SEQ ID NO: 569049 - protein, 6 aa, Mycobacterium
RRSRGD

SEQ ID NO: 569050 - protein, 9 aa, Mycobacterium
RRSRKNPNL

SEQ ID NO: 569051 - protein, 6 aa, Mycobacterium
RRSRPC

SEQ ID NO: 569052 - protein, 6 aa, Mycobacterium
RRSRPD

SEQ ID NO: 569053 - protein, 8 aa, Mycobacterium
RRSRPGED

SEQ ID NO: 569054 - protein, 7 aa, Mycobacterium
RRSRRGG

SEQ ID NO: 569055 - protein, 17 aa, Mycobacterium
RRSRRGGRGSVIPADRA

SEQ ID NO: 569056 - protein, 17 aa, Mycobacterium
RRSRRGGRGSVVSAGGA

SEQ ID NO: 569057 - protein, 22 aa, Mycobacterium
RRSRRRRKATTRPVTDKAQAIP

SEQ ID NO: 569058 - protein, 7 aa, Mycobacterium
RRSRRRW

SEQ ID NO: 569059 - protein, 18 aa, Mycobacterium
RRSSATAVGAHPSAQRSA

SEQ ID NO: 569060 - protein, 7 aa, Mycobacterium
RRSSDDV

SEQ ID NO: 569061 - protein, 7 aa, Mycobacterium
RRSSGDI

SEQ ID NO: 569062 - protein, 6 aa, Mycobacterium
RRSSGR

SEQ ID NO: 569063 - protein, 9 aa, Mycobacterium
RRSSRGEHV

SEQ ID NO: 569064 - protein, 11 aa, Mycobacterium
RRSSRKLSPEL

SEQ ID NO: 569065 - protein, 20 aa, Mycobacterium
RRSSRKLSPELSRPFEPPPS

SEQ ID NO: 569066 - protein, 9 aa, Mycobacterium
RRSSYTSGT

SEQ ID NO: 569067 - protein, 4 aa, Mycobacterium
RRST

SEQ ID NO: 569068 - protein, 8 aa, Mycobacterium
RRSTAEEQ

SEQ ID NO: 569069 - protein, 7 aa, Mycobacterium
RRSTAGD

SEQ ID NO: 569070 - protein, 15 aa, Mycobacterium
RRSTAPGPVTGNVAD

SEQ ID NO: 569071 - protein, 6 aa, Mycobacterium
RRSTAR

SEQ ID NO: 569072 - protein, 5 aa, Mycobacterium
RRSTG

SEQ ID NO: 569073 - protein, 7 aa, Mycobacterium
RRSTGAK

SEQ ID NO: 569074 - protein, 6 aa, Mycobacterium
RRSTGG

SEQ ID NO: 569075 - protein, 7 aa, Mycobacterium
RRSTGMP

SEQ ID NO: 569076 - protein, 7 aa, Mycobacterium
RRSTHEA

SEQ ID NO: 569077 - protein, 8 aa, Mycobacterium
RRSTPRSV

SEQ ID NO: 569078 - protein, 8 aa, Mycobacterium
RRSTRAQA

SEQ ID NO: 569079 - protein, 21 aa, Mycobacterium
RRSTTDRALAARAGAPDVPDT

SEQ ID NO: 569080 - protein, 13 aa, Mycobacterium
RRSTYAETAERTR

SEQ ID NO: 569081 - protein, 12 aa, Mycobacterium
RRSVGAKTFQAR

SEQ ID NO: 569082 - protein, 14 aa, Mycobacterium
RRSVPRHIRAQHDC

SEQ ID NO: 569083 - protein, 9 aa, Mycobacterium
RRSWGTGDL

SEQ ID NO: 569084 - protein, 13 aa, Mycobacterium
RRTAAAALTGDGG

SEQ ID NO: 569085 - protein, 7 aa, Mycobacterium
RRTAANY

SEQ ID NO: 569086 - protein, 5 aa, Mycobacterium
RRTAD

SEQ ID NO: 569087 - protein, 8 aa, Mycobacterium
RRTADAQA

SEQ ID NO: 569088 - protein, 13 aa, Mycobacterium
RRTADGEPEGGWT

SEQ ID NO: 569089 - protein, 11 aa, Mycobacterium
RRTAGHRGPGR

SEQ ID NO: 569090 - protein, 11 aa, Mycobacterium
RRTAGQSGRTA

SEQ ID NO: 569091 - protein, 7 aa, Mycobacterium
RRTALTD

SEQ ID NO: 569092 - protein, 8 aa, Mycobacterium
RRTATADK

SEQ ID NO: 569093 - protein, 8 aa, Mycobacterium
RRTATADR

SEQ ID NO: 569094 - protein, 8 aa, Mycobacterium
RRTATAER

SEQ ID NO: 569095 - protein, 4 aa, Mycobacterium
RRTD

SEQ ID NO: 569096 - protein, 10 aa, Mycobacterium
RRTDDRPSAP

SEQ ID NO: 569097 - protein, 7 aa, Mycobacterium
RRTDESH

SEQ ID NO: 569098 - protein, 6 aa, Mycobacterium
RRTDGE

SEQ ID NO: 569099 - protein, 6 aa, Mycobacterium
RRTDGR

SEQ ID NO: 569100 - protein, 10 aa, Mycobacterium
RRTDGTSYAQ

SEQ ID NO: 569101 - protein, 5 aa, Mycobacterium
RRTDP

SEQ ID NO: 569102 - protein, 9 aa, Mycobacterium
RRTDPEDDT

SEQ ID NO: 569103 - protein, 8 aa, Mycobacterium
RRTDPQDD

SEQ ID NO: 569104 - protein, 7 aa, Mycobacterium
RRTDPRV

SEQ ID NO: 569105 - protein, 12 aa, Mycobacterium
RRTDPSGPPLAD

SEQ ID NO: 569106 - protein, 22 aa, Mycobacterium
RRTDQPTGGHRSSTPPAASTVN

SEQ ID NO: 569107 - protein, 12 aa, Mycobacterium
RRTDRFGGDTVR

SEQ ID NO: 569108 - protein, 9 aa, Mycobacterium
RRTEASATD

SEQ ID NO: 569109 - protein, 7 aa, Mycobacterium
RRTEERR

SEQ ID NO: 569110 - protein, 6 aa, Mycobacterium
RRTELP

SEQ ID NO: 569111 - protein, 6 aa, Mycobacterium
RRTENH

SEQ ID NO: 569112 - protein, 6 aa, Mycobacterium
RRTEPE

SEQ ID NO: 569113 - protein, 5 aa, Mycobacterium
RRTEQ

SEQ ID NO: 569114 - protein, 7 aa, Mycobacterium
RRTERER

SEQ ID NO: 569115 - protein, 6 aa, Mycobacterium
RRTERK

SEQ ID NO: 569116 - protein, 7 aa, Mycobacterium
RRTETAR

SEQ ID NO: 569117 - protein, 8 aa, Mycobacterium
RRTETRSY

SEQ ID NO: 569118 - protein, 5 aa, Mycobacterium
RRTEV

SEQ ID NO: 569119 - protein, 19 aa, Mycobacterium
RRTEVSKTIGKARMASGGT

SEQ ID NO: 569120 - protein, 7 aa, Mycobacterium
RRTEVSQ

SEQ ID NO: 569121 - protein, 8 aa, Mycobacterium
RRTEVSQA

SEQ ID NO: 569122 - protein, 9 aa, Mycobacterium
RRTGAADDP

SEQ ID NO: 569123 - protein, 10 aa, Mycobacterium
RRTGAAPTSQ

SEQ ID NO: 569124 - protein, 6 aa, Mycobacterium
RRTGDA

SEQ ID NO: 569125 - protein, 5 aa, Mycobacterium
RRTGE

SEQ ID NO: 569126 - protein, 11 aa, Mycobacterium
RRTGEDRWATT

SEQ ID NO: 569127 - protein, 17 aa, Mycobacterium
RRTGEGWTLTGSSGAMP

SEQ ID NO: 569128 - protein, 9 aa, Mycobacterium
RRTGEKRKL

SEQ ID NO: 569129 - protein, 6 aa, Mycobacterium
RRTGEV

SEQ ID NO: 569130 - protein, 7 aa, Mycobacterium
RRTGGLD

SEQ ID NO: 569131 - protein, 9 aa, Mycobacterium
RRTGGSDAG

SEQ ID NO: 569132 - protein, 9 aa, Mycobacterium
RRTGKRYAT

SEQ ID NO: 569133 - protein, 8 aa, Mycobacterium
RRTGRTAT

SEQ ID NO: 569134 - protein, 11 aa, Mycobacterium
RRTGRTTSPHL

SEQ ID NO: 569135 - protein, 5 aa, Mycobacterium
RRTGS

SEQ ID NO: 569136 - protein, 28 aa, Mycobacterium
RRTGSRRRRGGRRTAGADPFGRPLGGGL

SEQ ID NO: 569137 - protein, 6 aa, Mycobacterium
RRTGTP

SEQ ID NO: 569138 - protein, 16 aa, Mycobacterium
RRTGTPTPDATRHDLW

SEQ ID NO: 569139 - protein, 4 aa, Mycobacterium
RRTH

SEQ ID NO: 569140 - protein, 7 aa, Mycobacterium
RRTHEDR

SEQ ID NO: 569141 - protein, 6 aa, Mycobacterium
RRTHEH

SEQ ID NO: 569142 - protein, 7 aa, Mycobacterium
RRTHEQA

SEQ ID NO: 569143 - protein, 7 aa, Mycobacterium
RRTHERA

SEQ ID NO: 569144 - protein, 10 aa, Mycobacterium
RRTHGGEELS

SEQ ID NO: 569145 - protein, 8 aa, Mycobacterium
RRTHPGTT

SEQ ID NO: 569146 - protein, 4 aa, Mycobacterium
RRTI

SEQ ID NO: 569147 - protein, 13 aa, Mycobacterium
RRTKDNSTSTRLT

SEQ ID NO: 569148 - protein, 8 aa, Mycobacterium
RRTKSDRI

SEQ ID NO: 569149 - protein, 4 aa, Mycobacterium
RRTL

SEQ ID NO: 569150 - protein, 6 aa, Mycobacterium
RRTLPG

SEQ ID NO: 569151 - protein, 13 aa, Mycobacterium
RRTNAGQRPPRVP

SEQ ID NO: 569152 - protein, 6 aa, Mycobacterium
RRTNDN

SEQ ID NO: 569153 - protein, 9 aa, Mycobacterium
RRTNGTTNG

SEQ ID NO: 569154 - protein, 10 aa, Mycobacterium
RRTNNPEGRE

SEQ ID NO: 569155 - protein, 7 aa, Mycobacterium
RRTNPSW

SEQ ID NO: 569156 - protein, 7 aa, Mycobacterium
RRTNQVA

SEQ ID NO: 569157 - protein, 9 aa, Mycobacterium
RRTPANQAH

SEQ ID NO: 569158 - protein, 16 aa, Mycobacterium
RRTPASEEGGEETVTV

SEQ ID NO: 569159 - protein, 18 aa, Mycobacterium
RRTPASGDANSVSVAETS

SEQ ID NO: 569160 - protein, 9 aa, Mycobacterium
RRTPDDPEI

SEQ ID NO: 569161 - protein, 11 aa, Mycobacterium
RRTPDEAAASR

SEQ ID NO: 569162 - protein, 6 aa, Mycobacterium
RRTPDG

SEQ ID NO: 569163 - protein, 10 aa, Mycobacterium
RRTPEAPAVV

SEQ ID NO: 569164 - protein, 6 aa, Mycobacterium
RRTPGA

SEQ ID NO: 569165 - protein, 7 aa, Mycobacterium
RRTPGGL

SEQ ID NO: 569166 - protein, 13 aa, Mycobacterium
RRTPGLDEQARQE

SEQ ID NO: 569167 - protein, 11 aa, Mycobacterium
RRTPGQSTRTA

SEQ ID NO: 569168 - protein, 6 aa, Mycobacterium
RRTPGR

SEQ ID NO: 569169 - protein, 9 aa, Mycobacterium
RRTPGRRSP

SEQ ID NO: 569170 - protein, 5 aa, Mycobacterium
RRTPL

SEQ ID NO: 569171 - protein, 10 aa, Mycobacterium
RRTPNDEARE

SEQ ID NO: 569172 - protein, 10 aa, Mycobacterium
RRTPNTITTP

SEQ ID NO: 569173 - protein, 7 aa, Mycobacterium
RRTPPAP

SEQ ID NO: 569174 - protein, 8 aa, Mycobacterium
RRTPPAQR

SEQ ID NO: 569175 - protein, 7 aa, Mycobacterium
RRTPPEA

SEQ ID NO: 569176 - protein, 8 aa, Mycobacterium
RRTPPPPL

SEQ ID NO: 569177 - protein, 5 aa, Mycobacterium
RRTPR

SEQ ID NO: 569178 - protein, 17 aa, Mycobacterium
RRTPSGTVLGPNERITE

SEQ ID NO: 569179 - protein, 12 aa, Mycobacterium
RRTPSNQAHVTN

SEQ ID NO: 569180 - protein, 11 aa, Mycobacterium
RRTPSVSPGEL

SEQ ID NO: 569181 - protein, 10 aa, Mycobacterium
RRTPTVSPGE

SEQ ID NO: 569182 - protein, 7 aa, Mycobacterium
RRTPVQA

SEQ ID NO: 569183 - protein, 7 aa, Mycobacterium
RRTQAAG

SEQ ID NO: 569184 - protein, 10 aa, Mycobacterium
RRTQARRGPG

SEQ ID NO: 569185 - protein, 13 aa, Mycobacterium
RRTQEELEEGKRR

SEQ ID NO: 569186 - protein, 6 aa, Mycobacterium
RRTQGT

SEQ ID NO: 569187 - protein, 10 aa, Mycobacterium
RRTQRSDGSW

SEQ ID NO: 569188 - protein, 8 aa, Mycobacterium
RRTQSALG

SEQ ID NO: 569189 - protein, 4 aa, Mycobacterium
RRTR

SEQ ID NO: 569190 - protein, 11 aa, Mycobacterium
RRTRAAEEARR

SEQ ID NO: 569191 - protein, 19 aa, Mycobacterium
RRTRAGDAHAAGQKPRTGV

SEQ ID NO: 569192 - protein, 19 aa, Mycobacterium
RRTRAGDAYAAGQRSPGVG

SEQ ID NO: 569193 - protein, 15 aa, Mycobacterium
RRTRAGLKDPKRPSG

SEQ ID NO: 569194 - protein, 10 aa, Mycobacterium
RRTRAQDRAH

SEQ ID NO: 569195 - protein, 7 aa, Mycobacterium
RRTRAQQ

SEQ ID NO: 569196 - protein, 10 aa, Mycobacterium
RRTRASARSR

SEQ ID NO: 569197 - protein, 5 aa, Mycobacterium
RRTRE

SEQ ID NO: 569198 - protein, 31 aa, Mycobacterium
RRTRGTDGEAASRAGVQAAKTALGERGSPPW

SEQ ID NO: 569199 - protein, 5 aa, Mycobacterium
RRTRL

SEQ ID NO: 569200 - protein, 14 aa, Mycobacterium
RRTRPYRPQTNGKV

SEQ ID NO: 569201 - protein, 6 aa, Mycobacterium
RRTRQA

SEQ ID NO: 569202 - protein, 11 aa, Mycobacterium
RRTRQQDRARR

SEQ ID NO: 569203 - protein, 13 aa, Mycobacterium
RRTRRGAAGARTA

SEQ ID NO: 569204 - protein, 12 aa, Mycobacterium
RRTRTRAQNRAT

SEQ ID NO: 569205 - protein, 4 aa, Mycobacterium
RRTS

SEQ ID NO: 569206 - protein, 12 aa, Mycobacterium
RRTSAGSTRTAD

SEQ ID NO: 569207 - protein, 9 aa, Mycobacterium
RRTSDEDLA

SEQ ID NO: 569208 - protein, 15 aa, Mycobacterium
RRTSETPALVVIVAA

SEQ ID NO: 569209 - protein, 9 aa, Mycobacterium
RRTSGTPVQ

SEQ ID NO: 569210 - protein, 5 aa, Mycobacterium
RRTSI

SEQ ID NO: 569211 - protein, 5 aa, Mycobacterium
RRTSL

SEQ ID NO: 569212 - protein, 10 aa, Mycobacterium
RRTSNEEARE

SEQ ID NO: 569213 - protein, 6 aa, Mycobacterium
RRTSPQ

SEQ ID NO: 569214 - protein, 9 aa, Mycobacterium
RRTSTRQAR

SEQ ID NO: 569215 - protein, 7 aa, Mycobacterium
RRTTGHG

SEQ ID NO: 569216 - protein, 7 aa, Mycobacterium
RRTTLPG

SEQ ID NO: 569217 - protein, 10 aa, Mycobacterium
RRTTNAEGRE

SEQ ID NO: 569218 - protein, 9 aa, Mycobacterium
RRTTRAADG

SEQ ID NO: 569219 - protein, 11 aa, Mycobacterium
RRTTRDSSLSA

SEQ ID NO: 569220 - protein, 11 aa, Mycobacterium
RRTTRPTVRGD

SEQ ID NO: 569221 - protein, 6 aa, Mycobacterium
RRTTRS

SEQ ID NO: 569222 - protein, 10 aa, Mycobacterium
RRTTRVDDSG

SEQ ID NO: 569223 - protein, 8 aa, Mycobacterium
RRTTSPEN

SEQ ID NO: 569224 - protein, 9 aa, Mycobacterium
RRTTSPENA

SEQ ID NO: 569225 - protein, 22 aa, Mycobacterium
RRTTVQPGPLGAELEGASRPTH

SEQ ID NO: 569226 - protein, 5 aa, Mycobacterium
RRTVE

SEQ ID NO: 569227 - protein, 4 aa, Mycobacterium
RRTY

SEQ ID NO: 569228 - protein, 5 aa, Mycobacterium
RRTYT

SEQ ID NO: 569229 - protein, 15 aa, Mycobacterium
RRVAEETRRFTQRAR

SEQ ID NO: 569230 - protein, 10 aa, Mycobacterium
RRVAESRRRA

SEQ ID NO: 569231 - protein, 22 aa, Mycobacterium
RRVDAADREGAAVIQSSGGTYT

SEQ ID NO: 569232 - protein, 6 aa, Mycobacterium
RRVDAQ

SEQ ID NO: 569233 - protein, 8 aa, Mycobacterium
RRVDGARE

SEQ ID NO: 569234 - protein, 14 aa, Mycobacterium
RRVDGAREAISDSI

SEQ ID NO: 569235 - protein, 4 aa, Mycobacterium
RRVE

SEQ ID NO: 569236 - protein, 8 aa, Mycobacterium
RRVEGREV

SEQ ID NO: 569237 - protein, 12 aa, Mycobacterium
RRVEMGNDSRAY

SEQ ID NO: 569238 - protein, 14 aa, Mycobacterium
RRVERDKDHAGKGR

SEQ ID NO: 569239 - protein, 9 aa, Mycobacterium
RRVGADADA

SEQ ID NO: 569240 - protein, 9 aa, Mycobacterium
RRVGASERT

SEQ ID NO: 569241 - protein, 5 aa, Mycobacterium
RRVGD

SEQ ID NO: 569242 - protein, 29 aa, Mycobacterium
RRVGGRKRGRAATTTTRGRGAIDREQSAA

SEQ ID NO: 569243 - protein, 29 aa, Mycobacterium
RRVGGRRRGRAVAGTGRGRAAIDREQSAA

SEQ ID NO: 569244 - protein, 26 aa, Mycobacterium
RRVGGRRRGRSGSGRGRGAIDREQSA

SEQ ID NO: 569245 - protein, 20 aa, Mycobacterium
RRVGGSAKERATPRGRSDST

SEQ ID NO: 569246 - protein, 6 aa, Mycobacterium
RRVGKR

SEQ ID NO: 569247 - protein, 9 aa, Mycobacterium
RRVKGSDEL

SEQ ID NO: 569248 - protein, 6 aa, Mycobacterium
RRVKPG

SEQ ID NO: 569249 - protein, 4 aa, Mycobacterium
RRVN

SEQ ID NO: 569250 - protein, 8 aa, Mycobacterium
RRVPEAAT

SEQ ID NO: 569251 - protein, 33 aa, Mycobacterium
RRVPTPEHQQAAPPTAPRPGAMPPWDSTPVTGI

SEQ ID NO: 569252 - protein, 18 aa, Mycobacterium
RRVPTSHSLPSGHSSSAA

SEQ ID NO: 569253 - protein, 14 aa, Mycobacterium
RRVRDGDVPTSSGW

SEQ ID NO: 569254 - protein, 10 aa, Mycobacterium
RRVREGELTP

SEQ ID NO: 569255 - protein, 7 aa, Mycobacterium
RRVREPD

SEQ ID NO: 569256 - protein, 29 aa, Mycobacterium
RRVSTGVRRRSVGAQRALGRAGNALSPAE

SEQ ID NO: 569257 - protein, 11 aa, Mycobacterium
RRVTTDPTKRH

SEQ ID NO: 569258 - protein, 17 aa, Mycobacterium
RRVTTRRAAPVATAEQD

SEQ ID NO: 569259 - protein, 9 aa, Mycobacterium
RRWGGDNTD

SEQ ID NO: 569260 - protein, 13 aa, Mycobacterium
RRWPDDPARHSYE

SEQ ID NO: 569261 - protein, 5 aa, Mycobacterium
RRWPE

SEQ ID NO: 569262 - protein, 7 aa, Mycobacterium
RRWSTAD

SEQ ID NO: 569263 - protein, 5 aa, Mycobacterium
RRWTT

SEQ ID NO: 569264 - protein, 8 aa, Mycobacterium
RRYADDEF

SEQ ID NO: 569265 - protein, 9 aa, Mycobacterium
RRYAEQRDR

SEQ ID NO: 569266 - protein, 5 aa, Mycobacterium
RRYAG

SEQ ID NO: 569267 - protein, 6 aa, Mycobacterium
RRYAGD

SEQ ID NO: 569268 - protein, 6 aa, Mycobacterium
RRYARD

SEQ ID NO: 569269 - protein, 18 aa, Mycobacterium
RRYARERARAEGLADRDK

SEQ ID NO: 569270 - protein, 6 aa, Mycobacterium
RRYDGT

SEQ ID NO: 569271 - protein, 9 aa, Mycobacterium
RRYEDRPPR

SEQ ID NO: 569272 - protein, 4 aa, Mycobacterium
RRYG

SEQ ID NO: 569273 - protein, 6 aa, Mycobacterium
RRYGAK

SEQ ID NO: 569274 - protein, 14 aa, Mycobacterium
RRYGDTRLEMASVI

SEQ ID NO: 569275 - protein, 13 aa, Mycobacterium
RRYGDTRVELAEV

SEQ ID NO: 569276 - protein, 5 aa, Mycobacterium
RRYGE

SEQ ID NO: 569277 - protein, 7 aa, Mycobacterium
RRYGERA

SEQ ID NO: 569278 - protein, 9 aa, Mycobacterium
RRYGGTPST

SEQ ID NO: 569279 - protein, 6 aa, Mycobacterium
RRYPDK

SEQ ID NO: 569280 - protein, 5 aa, Mycobacterium
RRYPN

SEQ ID NO: 569281 - protein, 6 aa, Mycobacterium
RRYQER

SEQ ID NO: 569282 - protein, 6 aa, Mycobacterium
RRYQGR

SEQ ID NO: 569283 - protein, 6 aa, Mycobacterium
RRYRAD

SEQ ID NO: 569284 - protein, 8 aa, Mycobacterium
RRYRDDDE

SEQ ID NO: 569285 - protein, 8 aa, Mycobacterium
RRYRDEAP

SEQ ID NO: 569286 - protein, 5 aa, Mycobacterium
RRYRE

SEQ ID NO: 569287 - protein, 9 aa, Mycobacterium
RRYREGSSA

SEQ ID NO: 569288 - protein, 9 aa, Mycobacterium
RRYRQGSSA

SEQ ID NO: 569289 - protein, 23 aa, Mycobacterium
RRYSGRGNPALTEEGRRQADAAA

SEQ ID NO: 569290 - protein, 4 aa, Mycobacterium
RRYT

SEQ ID NO: 569291 - protein, 11 aa, Mycobacterium
RRYTGHSSRGA

SEQ ID NO: 569292 - protein, 12 aa, Mycobacterium
RRYTGRSSRGAE

SEQ ID NO: 569293 - protein, 11 aa, Mycobacterium
RRYTGRSTRGA

SEQ ID NO: 569294 - protein, 6 aa, Mycobacterium
RRYTPG

SEQ ID NO: 569295 - protein, 6 aa, Mycobacterium
RSAAAA

SEQ ID NO: 569296 - protein, 7 aa, Mycobacterium
RSAAAEE

SEQ ID NO: 569297 - protein, 11 aa, Mycobacterium
RSAAAELASRG

SEQ ID NO: 569298 - protein, 9 aa, Mycobacterium
RSAAAGAPC

SEQ ID NO: 569299 - protein, 11 aa, Mycobacterium
RSAAAGDPCGT

SEQ ID NO: 569300 - protein, 26 aa, Mycobacterium
RSAAAGLPAPADRRGKKRTRQDPDLE

SEQ ID NO: 569301 - protein, 14 aa, Mycobacterium
RSAAAKDGTGAPTQ

SEQ ID NO: 569302 - protein, 9 aa, Mycobacterium
RSAAANAAS

SEQ ID NO: 569303 - protein, 9 aa, Mycobacterium
RSAAATEQE

SEQ ID NO: 569304 - protein, 26 aa, Mycobacterium
RSAAATLDVPSAQRRRGRGPVDGDVD

SEQ ID NO: 569305 - protein, 17 aa, Mycobacterium
RSAADDDPRPTENVASE

SEQ ID NO: 569306 - protein, 7 aa, Mycobacterium
RSAADER

SEQ ID NO: 569307 - protein, 8 aa, Mycobacterium
RSAADGAA

SEQ ID NO: 569308 - protein, 8 aa, Mycobacterium
RSAADKRE

SEQ ID NO: 569309 - protein, 6 aa, Mycobacterium
RSAADR

SEQ ID NO: 569310 - protein, 10 aa, Mycobacterium
RSAADTAFDR

SEQ ID NO: 569311 - protein, 7 aa, Mycobacterium
RSAADTL

SEQ ID NO: 569312 - protein, 13 aa, Mycobacterium
RSAAEYAKRAEAV

SEQ ID NO: 569313 - protein, 5 aa, Mycobacterium
RSAAG

SEQ ID NO: 569314 - protein, 23 aa, Mycobacterium
RSAAGTAADQAPAGTLDETNPYV

SEQ ID NO: 569315 - protein, 45 aa, Mycobacterium
RSAAGTTERTGRATALTGPSTAATRATAEATGSCATGTATTAGAA

SEQ ID NO: 569316 - protein, 7 aa, Mycobacterium
RSAAGVE

SEQ ID NO: 569317 - protein, 13 aa, Mycobacterium
RSAAKEPETEGGK

SEQ ID NO: 569318 - protein, 7 aa, Mycobacterium
RSAAPAV

SEQ ID NO: 569319 - protein, 10 aa, Mycobacterium
RSAAPDGLDA

SEQ ID NO: 569320 - protein, 5 aa, Mycobacterium
RSAAQ

SEQ ID NO: 569321 - protein, 5 aa, Mycobacterium
RSAAR

SEQ ID NO: 569322 - protein, 7 aa, Mycobacterium
RSAARPA

SEQ ID NO: 569323 - protein, 11 aa, Mycobacterium
RSAARQLGADY

SEQ ID NO: 569324 - protein, 11 aa, Mycobacterium
RSAARQSRRPH

SEQ ID NO: 569325 - protein, 30 aa, Mycobacterium
RSAASAERAQTCTPGYYNREGKADNKTRQG

SEQ ID NO: 569326 - protein, 8 aa, Mycobacterium
RSAASPQI

SEQ ID NO: 569327 - protein, 11 aa, Mycobacterium
RSAASSEEWRG

SEQ ID NO: 569328 - protein, 16 aa, Mycobacterium
RSAASTAGAHPSARRS

SEQ ID NO: 569329 - protein, 17 aa, Mycobacterium
RSAASTAGAHPSARRSA

SEQ ID NO: 569330 - protein, 7 aa, Mycobacterium
RSAATVT

SEQ ID NO: 569331 - protein, 11 aa, Mycobacterium
RSADALAAQAA

SEQ ID NO: 569332 - protein, 8 aa, Mycobacterium
RSADARTL

SEQ ID NO: 569333 - protein, 7 aa, Mycobacterium
RSADDDL

SEQ ID NO: 569334 - protein, 12 aa, Mycobacterium
RSADELSTVSPA

SEQ ID NO: 569335 - protein, 7 aa, Mycobacterium
RSADFSE

SEQ ID NO: 569336 - protein, 13 aa, Mycobacterium
RSADGSNTAHSEH

SEQ ID NO: 569337 - protein, 8 aa, Mycobacterium
RSADGVPN

SEQ ID NO: 569338 - protein, 10 aa, Mycobacterium
RSADPTSRRN

SEQ ID NO: 569339 - protein, 7 aa, Mycobacterium
RSADPTV

SEQ ID NO: 569340 - protein, 5 aa, Mycobacterium
RSADQ

SEQ ID NO: 569341 - protein, 18 aa, Mycobacterium
RSADQAAAHARAAAQPSH

SEQ ID NO: 569342 - protein, 9 aa, Mycobacterium
RSADSDGRC

SEQ ID NO: 569343 - protein, 10 aa, Mycobacterium
RSADSGAGVL

SEQ ID NO: 569344 - protein, 27 aa, Mycobacterium
RSADSKASSAHANSRPSEAGEQAGAPF

SEQ ID NO: 569345 - protein, 13 aa, Mycobacterium
RSADTHGLDPDDA

SEQ ID NO: 569346 - protein, 10 aa, Mycobacterium
RSAEEIPPER

SEQ ID NO: 569347 - protein, 7 aa, Mycobacterium
RSAEGKK

SEQ ID NO: 569348 - protein, 9 aa, Mycobacterium
RSAEGQARE

SEQ ID NO: 569349 - protein, 8 aa, Mycobacterium
RSAEGSAH

SEQ ID NO: 569350 - protein, 18 aa, Mycobacterium
RSAEGVDAARTAGYDATA

SEQ ID NO: 569351 - protein, 6 aa, Mycobacterium
RSAEIE

SEQ ID NO: 569352 - protein, 6 aa, Mycobacterium
RSAEKI

SEQ ID NO: 569353 - protein, 12 aa, Mycobacterium
RSAEKRSAIAGL

SEQ ID NO: 569354 - protein, 11 aa, Mycobacterium
RSAELPEGSTS

SEQ ID NO: 569355 - protein, 27 aa, Mycobacterium
RSAELTAATTERLRRQKQAGRLRDDVP

SEQ ID NO: 569356 - protein, 5 aa, Mycobacterium
RSAEP

SEQ ID NO: 569357 - protein, 8 aa, Mycobacterium
RSAEPDAH

SEQ ID NO: 569358 - protein, 8 aa, Mycobacterium
RSAEPFGG

SEQ ID NO: 569359 - protein, 7 aa, Mycobacterium
RSAEPTA

SEQ ID NO: 569360 - protein, 6 aa, Mycobacterium
RSAEQR

SEQ ID NO: 569361 - protein, 7 aa, Mycobacterium
RSAERGA

SEQ ID NO: 569362 - protein, 7 aa, Mycobacterium
RSAERGM

SEQ ID NO: 569363 - protein, 6 aa, Mycobacterium
RSAERR

SEQ ID NO: 569364 - protein, 8 aa, Mycobacterium
RSAERRHL

SEQ ID NO: 569365 - protein, 9 aa, Mycobacterium
RSAERSAQA

SEQ ID NO: 569366 - protein, 10 aa, Mycobacterium
RSAESDPPLT

SEQ ID NO: 569367 - protein, 7 aa, Mycobacterium
RSAETEL

SEQ ID NO: 569368 - protein, 4 aa, Mycobacterium
RSAF

SEQ ID NO: 569369 - protein, 7 aa, Mycobacterium
RSAGAAG

SEQ ID NO: 569370 - protein, 46 aa, Mycobacterium
RSAGAIQRPGANNRRAPCSSTGLADRVDRGSLQPSGLRHGHVLLDH

SEQ ID NO: 569371 - protein, 10 aa, Mycobacterium
RSAGARPRVD

SEQ ID NO: 569372 - protein, 7 aa, Mycobacterium
RSAGAVG

SEQ ID NO: 569373 - protein, 10 aa, Mycobacterium
RSAGDDTALT

SEQ ID NO: 569374 - protein, 14 aa, Mycobacterium
RSAGDGSGGGPARP

SEQ ID NO: 569375 - protein, 15 aa, Mycobacterium
RSAGDGTTGNSTGKI

SEQ ID NO: 569376 - protein, 8 aa, Mycobacterium
RSAGEAGG

SEQ ID NO: 569377 - protein, 7 aa, Mycobacterium
RSAGETA

SEQ ID NO: 569378 - protein, 10 aa, Mycobacterium
RSAGGLPASG

SEQ ID NO: 569379 - protein, 6 aa, Mycobacterium
RSAGGR

SEQ ID NO: 569380 - protein, 18 aa, Mycobacterium
RSAGHDVTARNRAHAHDD

SEQ ID NO: 569381 - protein, 5 aa, Mycobacterium
RSAGI

SEQ ID NO: 569382 - protein, 7 aa, Mycobacterium
RSAGISR

SEQ ID NO: 569383 - protein, 21 aa, Mycobacterium
RSAGLADANSAEFDPDTPSPV

SEQ ID NO: 569384 - protein, 21 aa, Mycobacterium
RSAGLDQANSAEFDPDTPDPV

SEQ ID NO: 569385 - protein, 8 aa, Mycobacterium
RSAGLSLE

SEQ ID NO: 569386 - protein, 21 aa, Mycobacterium
RSAGLTEANSAEFDPDTPDPV

SEQ ID NO: 569387 - protein, 8 aa, Mycobacterium
RSAGQVRS

SEQ ID NO: 569388 - protein, 5 aa, Mycobacterium
RSAGR

SEQ ID NO: 569389 - protein, 17 aa, Mycobacterium
RSAGRAFDSSRLSESQS

SEQ ID NO: 569390 - protein, 7 aa, Mycobacterium
RSAGREL

SEQ ID NO: 569391 - protein, 26 aa, Mycobacterium
RSAGRQADAAGGTATPGSGQVQPSAA

SEQ ID NO: 569392 - protein, 17 aa, Mycobacterium
RSAGSERAAAYQDGGAA

SEQ ID NO: 569393 - protein, 6 aa, Mycobacterium
RSAGSI

SEQ ID NO: 569394 - protein, 10 aa, Mycobacterium
RSAGSPPMTP

SEQ ID NO: 569395 - protein, 7 aa, Mycobacterium
RSAGSSV

SEQ ID NO: 569396 - protein, 11 aa, Mycobacterium
RSAGTEPADQL

SEQ ID NO: 569397 - protein, 11 aa, Mycobacterium
RSAGTQPADRV

SEQ ID NO: 569398 - protein, 8 aa, Mycobacterium
RSAGVSGE

SEQ ID NO: 569399 - protein, 8 aa, Mycobacterium
RSAGYTDV

SEQ ID NO: 569400 - protein, 4 aa, Mycobacterium
RSAH

SEQ ID NO: 569401 - protein, 9 aa, Mycobacterium
RSAHGAGGG

SEQ ID NO: 569402 - protein, 8 aa, Mycobacterium
RSAHGASA

SEQ ID NO: 569403 - protein, 7 aa, Mycobacterium
RSAHGDS

SEQ ID NO: 569404 - protein, 5 aa, Mycobacterium
RSAHL

SEQ ID NO: 569405 - protein, 6 aa, Mycobacterium
RSAHRD

SEQ ID NO: 569406 - protein, 8 aa, Mycobacterium
RSAHSSVD

SEQ ID NO: 569407 - protein, 4 aa, Mycobacterium
RSAI

SEQ ID NO: 569408 - protein, 6 aa, Mycobacterium
RSAIDK

SEQ ID NO: 569409 - protein, 5 aa, Mycobacterium
RSAIG

SEQ ID NO: 569410 - protein, 13 aa, Mycobacterium
RSAIPAPDRPGAY

SEQ ID NO: 569411 - protein, 8 aa, Mycobacterium
RSAIPDLP

SEQ ID NO: 569412 - protein, 10 aa, Mycobacterium
RSAKAEKDRR

SEQ ID NO: 569413 - protein, 10 aa, Mycobacterium
RSAKAEQDRC

SEQ ID NO: 569414 - protein, 8 aa, Mycobacterium
RSAKERPR

SEQ ID NO: 569415 - protein, 9 aa, Mycobacterium
RSAKPGSPV

SEQ ID NO: 569416 - protein, 10 aa, Mycobacterium
RSAKPGSPVC

SEQ ID NO: 569417 - protein, 6 aa, Mycobacterium
RSAKPI

SEQ ID NO: 569418 - protein, 42 aa, Mycobacterium
RSAKPPPDGPPGGGLSSESAPENGSANADAKTRYQAIPITLQ

SEQ ID NO: 569419 - protein, 9 aa, Mycobacterium
RSAKRAVKS

SEQ ID NO: 569420 - protein, 8 aa, Mycobacterium
RSAKSGFT

SEQ ID NO: 569421 - protein, 5 aa, Mycobacterium
RSALA

SEQ ID NO: 569422 - protein, 11 aa, Mycobacterium
RSALAQTETFG

SEQ ID NO: 569423 - protein, 6 aa, Mycobacterium
RSALGA

SEQ ID NO: 569424 - protein, 11 aa, Mycobacterium
RSALGGSSGLR

SEQ ID NO: 569425 - protein, 7 aa, Mycobacterium
RSALQNA

SEQ ID NO: 569426 - protein, 8 aa, Mycobacterium
RSALSGSG

SEQ ID NO: 569427 - protein, 6 aa, Mycobacterium
RSAMSR

SEQ ID NO: 569428 - protein, 9 aa, Mycobacterium
RSAMTEHSA

SEQ ID NO: 569429 - protein, 8 aa, Mycobacterium
RSANERPR

SEQ ID NO: 569430 - protein, 7 aa, Mycobacterium
RSANGLE

SEQ ID NO: 569431 - protein, 14 aa, Mycobacterium
RSANIERDHSGAGI

SEQ ID NO: 569432 - protein, 13 aa, Mycobacterium
RSANPEITHLMGV

SEQ ID NO: 569433 - protein, 9 aa, Mycobacterium
RSANPERIA

SEQ ID NO: 569434 - protein, 13 aa, Mycobacterium
RSANSSAAGATTG

SEQ ID NO: 569435 - protein, 20 aa, Mycobacterium
RSANSSPTDAERAATANTVG

SEQ ID NO: 569436 - protein, 11 aa, Mycobacterium
RSAPAGEGLPV

SEQ ID NO: 569437 - protein, 8 aa, Mycobacterium
RSAPAGPL

SEQ ID NO: 569438 - protein, 7 aa, Mycobacterium
RSAPALA

SEQ ID NO: 569439 - protein, 6 aa, Mycobacterium
RSAPDD

SEQ ID NO: 569440 - protein, 12 aa, Mycobacterium
RSAPDGAHVQAG

SEQ ID NO: 569441 - protein, 12 aa, Mycobacterium
RSAPDSPQRVAG

SEQ ID NO: 569442 - protein, 10 aa, Mycobacterium
RSAPDSPRRA

SEQ ID NO: 569443 - protein, 13 aa, Mycobacterium
RSAPEGSGIKPGD

SEQ ID NO: 569444 - protein, 7 aa, Mycobacterium
RSAPESA

SEQ ID NO: 569445 - protein, 113 aa, Mycobacterium
RSAPGAPNPAQAPTSAEPKAGPPERTSPPTDQQPQSGSPTPGPQPKPGSGDSPLPKSPTESKTPVENKPATGESTKPASGENVTPNRSQADESATGRRPVSSSCPAEPALPAE

SEQ ID NO: 569446 - protein, 6 aa, Mycobacterium
RSAPGQ

SEQ ID NO: 569447 - protein, 17 aa, Mycobacterium
RSAPKLPNIAGPNVAAP

SEQ ID NO: 569448 - protein, 18 aa, Mycobacterium
RSAPKLPNIAGPNVAAPG

SEQ ID NO: 569449 - protein, 18 aa, Mycobacterium
RSAPKLPNIAGPNVAGPG

SEQ ID NO: 569450 - protein, 8 aa, Mycobacterium
RSAPKPEA

SEQ ID NO: 569451 - protein, 7 aa, Mycobacterium
RSAPLGR

SEQ ID NO: 569452 - protein, 9 aa, Mycobacterium
RSAPLGRAD

SEQ ID NO: 569453 - protein, 8 aa, Mycobacterium
RSAPNDQA

SEQ ID NO: 569454 - protein, 20 aa, Mycobacterium
RSAPPASAPTRRPARRRKAT

SEQ ID NO: 569455 - protein, 13 aa, Mycobacterium
RSAPPDCPGTANP

SEQ ID NO: 569456 - protein, 8 aa, Mycobacterium
RSAPPIVD

SEQ ID NO: 569457 - protein, 7 aa, Mycobacterium
RSAPQDA

SEQ ID NO: 569458 - protein, 8 aa, Mycobacterium
RSAPSDNV

SEQ ID NO: 569459 - protein, 10 aa, Mycobacterium
RSAPSTRSSE

SEQ ID NO: 569460 - protein, 7 aa, Mycobacterium
RSAPTFD

SEQ ID NO: 569461 - protein, 17 aa, Mycobacterium
RSAPTTVGAHPSAQRSA

SEQ ID NO: 569462 - protein, 13 aa, Mycobacterium
RSAPVRPSSSLPA

SEQ ID NO: 569463 - protein, 5 aa, Mycobacterium
RSAQG

SEQ ID NO: 569464 - protein, 9 aa, Mycobacterium
RSAQGTGLA

SEQ ID NO: 569465 - protein, 7 aa, Mycobacterium
RSAQKSF

SEQ ID NO: 569466 - protein, 5 aa, Mycobacterium
RSAQL

SEQ ID NO: 569467 - protein, 6 aa, Mycobacterium
RSAQLG

SEQ ID NO: 569468 - protein, 19 aa, Mycobacterium
RSAQRANPYLTDTRPELNS

SEQ ID NO: 569469 - protein, 6 aa, Mycobacterium
RSAQRL

SEQ ID NO: 569470 - protein, 23 aa, Mycobacterium
RSAQRRGIKPRDPAKPRAPRPPV

SEQ ID NO: 569471 - protein, 24 aa, Mycobacterium
RSAQRRGVKPRGPAKSLAPQPARE

SEQ ID NO: 569472 - protein, 12 aa, Mycobacterium
RSAQRRPAEQLS

SEQ ID NO: 569473 - protein, 7 aa, Mycobacterium
RSAQRRQ

SEQ ID NO: 569474 - protein, 6 aa, Mycobacterium
RSAQTR

SEQ ID NO: 569475 - protein, 8 aa, Mycobacterium
RSARAALD

SEQ ID NO: 569476 - protein, 23 aa, Mycobacterium
RSARAAPAAEAGLAASGAPAAEA

SEQ ID NO: 569477 - protein, 17 aa, Mycobacterium
RSARGVENGWTQASEMG

SEQ ID NO: 569478 - protein, 10 aa, Mycobacterium
RSARKLSPEL

SEQ ID NO: 569479 - protein, 12 aa, Mycobacterium
RSARKTLDPDAP

SEQ ID NO: 569480 - protein, 5 aa, Mycobacterium
RSARL

SEQ ID NO: 569481 - protein, 10 aa, Mycobacterium
RSARRGRADA

SEQ ID NO: 569482 - protein, 8 aa, Mycobacterium
RSARTLGN

SEQ ID NO: 569483 - protein, 5 aa, Mycobacterium
RSARY

SEQ ID NO: 569484 - protein, 8 aa, Mycobacterium
RSASAEDR

SEQ ID NO: 569485 - protein, 7 aa, Mycobacterium
RSASEHG

SEQ ID NO: 569486 - protein, 6 aa, Mycobacterium
RSASGF

SEQ ID NO: 569487 - protein, 10 aa, Mycobacterium
RSASKVHTNA

SEQ ID NO: 569488 - protein, 6 aa, Mycobacterium
RSASKW

SEQ ID NO: 569489 - protein, 5 aa, Mycobacterium
RSASL

SEQ ID NO: 569490 - protein, 8 aa, Mycobacterium
RSASQAAL

SEQ ID NO: 569491 - protein, 9 aa, Mycobacterium
RSASRELPT

SEQ ID NO: 569492 - protein, 7 aa, Mycobacterium
RSASRPL

SEQ ID NO: 569493 - protein, 10 aa, Mycobacterium
RSASSAGAQV

SEQ ID NO: 569494 - protein, 25 aa, Mycobacterium
RSASSKLGAHSRHEAVSKARRLRQI

SEQ ID NO: 569495 - protein, 15 aa, Mycobacterium
RSASTALEEGRRTEP

SEQ ID NO: 569496 - protein, 14 aa, Mycobacterium
RSASTAQSNAFGPE

SEQ ID NO: 569497 - protein, 11 aa, Mycobacterium
RSASTASEPAA

SEQ ID NO: 569498 - protein, 9 aa, Mycobacterium
RSASTGAEM

SEQ ID NO: 569499 - protein, 5 aa, Mycobacterium
RSASW

SEQ ID NO: 569500 - protein, 8 aa, Mycobacterium
RSATERPN

SEQ ID NO: 569501 - protein, 16 aa, Mycobacterium
RSATGEVSAATGEASA

SEQ ID NO: 569502 - protein, 13 aa, Mycobacterium
RSATGISSPYYKS

SEQ ID NO: 569503 - protein, 6 aa, Mycobacterium
RSATLP

SEQ ID NO: 569504 - protein, 5 aa, Mycobacterium
RSATR

SEQ ID NO: 569505 - protein, 10 aa, Mycobacterium
RSATRDLTPE

SEQ ID NO: 569506 - protein, 7 aa, Mycobacterium
RSATSAR

SEQ ID NO: 569507 - protein, 7 aa, Mycobacterium
RSATSRA

SEQ ID NO: 569508 - protein, 5 aa, Mycobacterium
RSATT

SEQ ID NO: 569509 - protein, 10 aa, Mycobacterium
RSATTGEPAA

SEQ ID NO: 569510 - protein, 21 aa, Mycobacterium
RSAVDERSTDVKLTDSGTALR

SEQ ID NO: 569511 - protein, 8 aa, Mycobacterium
RSAVDNPP

SEQ ID NO: 569512 - protein, 6 aa, Mycobacterium
RSAVGD

SEQ ID NO: 569513 - protein, 7 aa, Mycobacterium
RSAVGQL

SEQ ID NO: 569514 - protein, 5 aa, Mycobacterium
RSAVR

SEQ ID NO: 569515 - protein, 10 aa, Mycobacterium
RSAVTDSERE

SEQ ID NO: 569516 - protein, 22 aa, Mycobacterium
RSAVTDSEREIRYDPDAKPGVS

SEQ ID NO: 569517 - protein, 22 aa, Mycobacterium
RSAVTDSEREIRYDPEAKPGVS

SEQ ID NO: 569518 - protein, 5 aa, Mycobacterium
RSAWD

SEQ ID NO: 569519 - protein, 6 aa, Mycobacterium
RSAYEG

SEQ ID NO: 569520 - protein, 7 aa, Mycobacterium
RSCAEQT

SEQ ID NO: 569521 - protein, 8 aa, Mycobacterium
RSCRRDGS

SEQ ID NO: 569522 - protein, 9 aa, Mycobacterium
RSCSQDNGV

SEQ ID NO: 569523 - protein, 5 aa, Mycobacterium
RSDAA

SEQ ID NO: 569524 - protein, 10 aa, Mycobacterium
RSDAAGRPMP

SEQ ID NO: 569525 - protein, 8 aa, Mycobacterium
RSDADERG

SEQ ID NO: 569526 - protein, 6 aa, Mycobacterium
RSDAET

SEQ ID NO: 569527 - protein, 5 aa, Mycobacterium
RSDAG

SEQ ID NO: 569528 - protein, 8 aa, Mycobacterium
RSDAGQQV

SEQ ID NO: 569529 - protein, 19 aa, Mycobacterium
RSDASRYPAEFSGGQKQRI

SEQ ID NO: 569530 - protein, 7 aa, Mycobacterium
RSDASVQ

SEQ ID NO: 569531 - protein, 6 aa, Mycobacterium
RSDATL

SEQ ID NO: 569532 - protein, 9 aa, Mycobacterium
RSDATQDSL

SEQ ID NO: 569533 - protein, 4 aa, Mycobacterium
RSDC

SEQ ID NO: 569534 - protein, 10 aa, Mycobacterium
RSDDARDRLD

SEQ ID NO: 569535 - protein, 9 aa, Mycobacterium
RSDDEARAR

SEQ ID NO: 569536 - protein, 11 aa, Mycobacterium
RSDDGKRVERF

SEQ ID NO: 569537 - protein, 8 aa, Mycobacterium
RSDDGSPP

SEQ ID NO: 569538 - protein, 8 aa, Mycobacterium
RSDDPQIA

SEQ ID NO: 569539 - protein, 7 aa, Mycobacterium
RSDDQSR

SEQ ID NO: 569540 - protein, 6 aa, Mycobacterium
RSDDQV

SEQ ID NO: 569541 - protein, 9 aa, Mycobacterium
RSDDTGDRA

SEQ ID NO: 569542 - protein, 10 aa, Mycobacterium
RSDDTGVTGY

SEQ ID NO: 569543 - protein, 6 aa, Mycobacterium
RSDEAD

SEQ ID NO: 569544 - protein, 9 aa, Mycobacterium
RSDEADVDK

SEQ ID NO: 569545 - protein, 10 aa, Mycobacterium
RSDEADVDKA

SEQ ID NO: 569546 - protein, 7 aa, Mycobacterium
RSDEDAW

SEQ ID NO: 569547 - protein, 8 aa, Mycobacterium
RSDEGGLG

SEQ ID NO: 569548 - protein, 7 aa, Mycobacterium
RSDEGRA

SEQ ID NO: 569549 - protein, 7 aa, Mycobacterium
RSDEIGS

SEQ ID NO: 569550 - protein, 7 aa, Mycobacterium
RSDEKLK

SEQ ID NO: 569551 - protein, 6 aa, Mycobacterium
RSDEPE

SEQ ID NO: 569552 - protein, 7 aa, Mycobacterium
RSDEPIP

SEQ ID NO: 569553 - protein, 6 aa, Mycobacterium
RSDEQV

SEQ ID NO: 569554 - protein, 6 aa, Mycobacterium
RSDFDG

SEQ ID NO: 569555 - protein, 7 aa, Mycobacterium
RSDGASA

SEQ ID NO: 569556 - protein, 11 aa, Mycobacterium
RSDGDESDAEV

SEQ ID NO: 569557 - protein, 9 aa, Mycobacterium
RSDGDHRDL

SEQ ID NO: 569558 - protein, 14 aa, Mycobacterium
RSDGDTAAAAREVS

SEQ ID NO: 569559 - protein, 7 aa, Mycobacterium
RSDGGAV

SEQ ID NO: 569560 - protein, 7 aa, Mycobacterium
RSDGGEA

SEQ ID NO: 569561 - protein, 9 aa, Mycobacterium
RSDGGPEWP

SEQ ID NO: 569562 - protein, 11 aa, Mycobacterium
RSDGNGWEQAE

SEQ ID NO: 569563 - protein, 17 aa, Mycobacterium
RSDGRQGASGLTPQQAD

SEQ ID NO: 569564 - protein, 8 aa, Mycobacterium
RSDGSGDT

SEQ ID NO: 569565 - protein, 14 aa, Mycobacterium
RSDGSPEGTASARQ

SEQ ID NO: 569566 - protein, 8 aa, Mycobacterium
RSDGSTRT

SEQ ID NO: 569567 - protein, 6 aa, Mycobacterium
RSDGTP

SEQ ID NO: 569568 - protein, 4 aa, Mycobacterium
RSDH

SEQ ID NO: 569569 - protein, 12 aa, Mycobacterium
RSDKPADRADYT

SEQ ID NO: 569570 - protein, 9 aa, Mycobacterium
RSDKPGRME

SEQ ID NO: 569571 - protein, 9 aa, Mycobacterium
RSDKPRSAQ

SEQ ID NO: 569572 - protein, 10 aa, Mycobacterium
RSDKPSRIED

SEQ ID NO: 569573 - protein, 8 aa, Mycobacterium
RSDKPTRI

SEQ ID NO: 569574 - protein, 9 aa, Mycobacterium
RSDKPTRIE

SEQ ID NO: 569575 - protein, 6 aa, Mycobacterium
RSDKTV

SEQ ID NO: 569576 - protein, 5 aa, Mycobacterium
RSDKW

SEQ ID NO: 569577 - protein, 4 aa, Mycobacterium
RSDL

SEQ ID NO: 569578 - protein, 14 aa, Mycobacterium
RSDLAGDGRPADAI

SEQ ID NO: 569579 - protein, 8 aa, Mycobacterium
RSDLGQHE

SEQ ID NO: 569580 - protein, 10 aa, Mycobacterium
RSDLGRTEQR

SEQ ID NO: 569581 - protein, 13 aa, Mycobacterium
RSDLNDPKTIEGV

SEQ ID NO: 569582 - protein, 12 aa, Mycobacterium
RSDLNDPKTIER

SEQ ID NO: 569583 - protein, 11 aa, Mycobacterium
RSDLNDPSTIT

SEQ ID NO: 569584 - protein, 22 aa, Mycobacterium
RSDLSADPLPGRPPDPPPCGTQ

SEQ ID NO: 569585 - protein, 7 aa, Mycobacterium
RSDNAQH

SEQ ID NO: 569586 - protein, 9 aa, Mycobacterium
RSDNDDRWP

SEQ ID NO: 569587 - protein, 8 aa, Mycobacterium
RSDNEPGG

SEQ ID NO: 569588 - protein, 4 aa, Mycobacterium
RSDP

SEQ ID NO: 569589 - protein, 7 aa, Mycobacterium
RSDPAET

SEQ ID NO: 569590 - protein, 7 aa, Mycobacterium
RSDPALA

SEQ ID NO: 569591 - protein, 6 aa, Mycobacterium
RSDPAR

SEQ ID NO: 569592 - protein, 18 aa, Mycobacterium
RSDPASGYARDKRSGLTG

SEQ ID NO: 569593 - protein, 12 aa, Mycobacterium
RSDPAVHKVVIV

SEQ ID NO: 569594 - protein, 7 aa, Mycobacterium
RSDPDAV

SEQ ID NO: 569595 - protein, 7 aa, Mycobacterium
RSDPDIE

SEQ ID NO: 569596 - protein, 15 aa, Mycobacterium
RSDPEFAYSDRERDG

SEQ ID NO: 569597 - protein, 16 aa, Mycobacterium
RSDPEFAYSDRERDGL

SEQ ID NO: 569598 - protein, 7 aa, Mycobacterium
RSDPELE

SEQ ID NO: 569599 - protein, 10 aa, Mycobacterium
RSDPGAGGTL

SEQ ID NO: 569600 - protein, 11 aa, Mycobacterium
RSDPGSSTPFT

SEQ ID NO: 569601 - protein, 5 aa, Mycobacterium
RSDPL

SEQ ID NO: 569602 - protein, 16 aa, Mycobacterium
RSDPPRRASVNELGGT

SEQ ID NO: 569603 - protein, 11 aa, Mycobacterium
RSDPPTDGEIA

SEQ ID NO: 569604 - protein, 6 aa, Mycobacterium
RSDPQA

SEQ ID NO: 569605 - protein, 6 aa, Mycobacterium
RSDPRH

SEQ ID NO: 569606 - protein, 12 aa, Mycobacterium
RSDPSTRSRCTH

SEQ ID NO: 569607 - protein, 6 aa, Mycobacterium
RSDPSV

SEQ ID NO: 569608 - protein, 8 aa, Mycobacterium
RSDPTETA

SEQ ID NO: 569609 - protein, 10 aa, Mycobacterium
RSDPVEDPEA

SEQ ID NO: 569610 - protein, 6 aa, Mycobacterium
RSDQAL

SEQ ID NO: 569611 - protein, 19 aa, Mycobacterium
RSDQKAQEELWRRSGELVS

SEQ ID NO: 569612 - protein, 5 aa, Mycobacterium
RSDQL

SEQ ID NO: 569613 - protein, 14 aa, Mycobacterium
RSDQSLSLSEDPPV

SEQ ID NO: 569614 - protein, 11 aa, Mycobacterium
RSDQSTGDALA

SEQ ID NO: 569615 - protein, 4 aa, Mycobacterium
RSDR

SEQ ID NO: 569616 - protein, 6 aa, Mycobacterium
RSDRAD

SEQ ID NO: 569617 - protein, 5 aa, Mycobacterium
RSDRD

SEQ ID NO: 569618 - protein, 8 aa, Mycobacterium
RSDRDPAW

SEQ ID NO: 569619 - protein, 6 aa, Mycobacterium
RSDRDS

SEQ ID NO: 569620 - protein, 12 aa, Mycobacterium
RSDRERRVPITS

SEQ ID NO: 569621 - protein, 6 aa, Mycobacterium
RSDRES

SEQ ID NO: 569622 - protein, 10 aa, Mycobacterium
RSDRGGRPIT

SEQ ID NO: 569623 - protein, 8 aa, Mycobacterium
RSDRPQSH

SEQ ID NO: 569624 - protein, 22 aa, Mycobacterium
RSDRVGAAERKAARRQRRERDD

SEQ ID NO: 569625 - protein, 7 aa, Mycobacterium
RSDRVGT

SEQ ID NO: 569626 - protein, 9 aa, Mycobacterium
RSDSDMPSF

SEQ ID NO: 569627 - protein, 9 aa, Mycobacterium
RSDSGASPF

SEQ ID NO: 569628 - protein, 12 aa, Mycobacterium
RSDSGLTPAEQE

SEQ ID NO: 569629 - protein, 7 aa, Mycobacterium
RSDSLGR

SEQ ID NO: 569630 - protein, 8 aa, Mycobacterium
RSDSPALK

SEQ ID NO: 569631 - protein, 8 aa, Mycobacterium
RSDSPDLS

SEQ ID NO: 569632 - protein, 7 aa, Mycobacterium
RSDSQDV

SEQ ID NO: 569633 - protein, 18 aa, Mycobacterium
RSDSSDKVQALDAGADDY

SEQ ID NO: 569634 - protein, 10 aa, Mycobacterium
RSDSTLNRGG

SEQ ID NO: 569635 - protein, 4 aa, Mycobacterium
RSDT

SEQ ID NO: 569636 - protein, 11 aa, Mycobacterium
RSDTAADENPH

SEQ ID NO: 569637 - protein, 9 aa, Mycobacterium
RSDTDHEGR

SEQ ID NO: 569638 - protein, 7 aa, Mycobacterium
RSDTDHV

SEQ ID NO: 569639 - protein, 8 aa, Mycobacterium
RSDTDRDW

SEQ ID NO: 569640 - protein, 15 aa, Mycobacterium
RSDTETRTVTWHWSR

SEQ ID NO: 569641 - protein, 5 aa, Mycobacterium
RSDTK

SEQ ID NO: 569642 - protein, 8 aa, Mycobacterium
RSDTLQRG

SEQ ID NO: 569643 - protein, 7 aa, Mycobacterium
RSDTPRD

SEQ ID NO: 569644 - protein, 6 aa, Mycobacterium
RSDTQV

SEQ ID NO: 569645 - protein, 10 aa, Mycobacterium
RSDTSRAGGK

SEQ ID NO: 569646 - protein, 7 aa, Mycobacterium
RSDTTGT

SEQ ID NO: 569647 - protein, 5 aa, Mycobacterium
RSDVR

SEQ ID NO: 569648 - protein, 6 aa, Mycobacterium
RSDWPA

SEQ ID NO: 569649 - protein, 4 aa, Mycobacterium
RSDY

SEQ ID NO: 569650 - protein, 8 aa, Mycobacterium
RSDYPDSA

SEQ ID NO: 569651 - protein, 20 aa, Mycobacterium
RSEAAAATIGGLGGEPLRGD

SEQ ID NO: 569652 - protein, 10 aa, Mycobacterium
RSEAATRANA

SEQ ID NO: 569653 - protein, 12 aa, Mycobacterium
RSEAATRKLAGT

SEQ ID NO: 569654 - protein, 10 aa, Mycobacterium
RSEADDDAVR

SEQ ID NO: 569655 - protein, 7 aa, Mycobacterium
RSEAELT

SEQ ID NO: 569656 - protein, 13 aa, Mycobacterium
RSEAEQLKPGPAT

SEQ ID NO: 569657 - protein, 9 aa, Mycobacterium
RSEAGRRVA

SEQ ID NO: 569658 - protein, 40 aa, Mycobacterium
RSEAPRGDEWRPAPEFEPPADVDTPADRTTYMGSDEGGWS

SEQ ID NO: 569659 - protein, 6 aa, Mycobacterium
RSEARL

SEQ ID NO: 569660 - protein, 7 aa, Mycobacterium
RSEARPE

SEQ ID NO: 569661 - protein, 7 aa, Mycobacterium
RSEARRG

SEQ ID NO: 569662 - protein, 7 aa, Mycobacterium
RSEATGA

SEQ ID NO: 569663 - protein, 6 aa, Mycobacterium
RSEDEF

SEQ ID NO: 569664 - protein, 6 aa, Mycobacterium
RSEDGA

SEQ ID NO: 569665 - protein, 7 aa, Mycobacterium
RSEDGRA

SEQ ID NO: 569666 - protein, 6 aa, Mycobacterium
RSEDRV

SEQ ID NO: 569667 - protein, 13 aa, Mycobacterium
RSEDSPLKKTAMK

SEQ ID NO: 569668 - protein, 5 aa, Mycobacterium
RSEDV

SEQ ID NO: 569669 - protein, 4 aa, Mycobacterium
RSEE

SEQ ID NO: 569670 - protein, 5 aa, Mycobacterium
RSEEE

SEQ ID NO: 569671 - protein, 6 aa, Mycobacterium
RSEELR

SEQ ID NO: 569672 - protein, 7 aa, Mycobacterium
RSEEPMG

SEQ ID NO: 569673 - protein, 5 aa, Mycobacterium
RSEES

SEQ ID NO: 569674 - protein, 5 aa, Mycobacterium
RSEET

SEQ ID NO: 569675 - protein, 19 aa, Mycobacterium
RSEFGAGHQPPVPARRDDE

SEQ ID NO: 569676 - protein, 7 aa, Mycobacterium
RSEFPPA

SEQ ID NO: 569677 - protein, 7 aa, Mycobacterium
RSEGANA

SEQ ID NO: 569678 - protein, 10 aa, Mycobacterium
RSEGERGITS

SEQ ID NO: 569679 - protein, 8 aa, Mycobacterium
RSEGGDTH

SEQ ID NO: 569680 - protein, 7 aa, Mycobacterium
RSEGGQA

SEQ ID NO: 569681 - protein, 5 aa, Mycobacterium
RSEGI

SEQ ID NO: 569682 - protein, 7 aa, Mycobacterium
RSEGRRC

SEQ ID NO: 569683 - protein, 8 aa, Mycobacterium
RSEGYGGT

SEQ ID NO: 569684 - protein, 4 aa, Mycobacterium
RSEH

SEQ ID NO: 569685 - protein, 9 aa, Mycobacterium
RSEHQARAE

SEQ ID NO: 569686 - protein, 5 aa, Mycobacterium
RSEHR

SEQ ID NO: 569687 - protein, 4 aa, Mycobacterium
RSEI

SEQ ID NO: 569688 - protein, 6 aa, Mycobacterium
RSEIGG

SEQ ID NO: 569689 - protein, 4 aa, Mycobacterium
RSEK

SEQ ID NO: 569690 - protein, 5 aa, Mycobacterium
RSEKA

SEQ ID NO: 569691 - protein, 13 aa, Mycobacterium
RSEKTAPKGPGLT

SEQ ID NO: 569692 - protein, 4 aa, Mycobacterium
RSEL

SEQ ID NO: 569693 - protein, 10 aa, Mycobacterium
RSELASTRTA

SEQ ID NO: 569694 - protein, 5 aa, Mycobacterium
RSELE

SEQ ID NO: 569695 - protein, 8 aa, Mycobacterium
RSELGASQ

SEQ ID NO: 569696 - protein, 13 aa, Mycobacterium
RSELNNGKHRTIS

SEQ ID NO: 569697 - protein, 5 aa, Mycobacterium
RSELP

SEQ ID NO: 569698 - protein, 6 aa, Mycobacterium
RSELPP

SEQ ID NO: 569699 - protein, 6 aa, Mycobacterium
RSEMDS

SEQ ID NO: 569700 - protein, 5 aa, Mycobacterium
RSENK

SEQ ID NO: 569701 - protein, 12 aa, Mycobacterium
RSENLDDGGIKA

SEQ ID NO: 569702 - protein, 9 aa, Mycobacterium
RSENLTSTG

SEQ ID NO: 569703 - protein, 9 aa, Mycobacterium
RSENPPSEE

SEQ ID NO: 569704 - protein, 7 aa, Mycobacterium
RSEPAPT

SEQ ID NO: 569705 - protein, 6 aa, Mycobacterium
RSEPER

SEQ ID NO: 569706 - protein, 23 aa, Mycobacterium
RSEPGQGSDPSLSPEGVEQARRL

SEQ ID NO: 569707 - protein, 11 aa, Mycobacterium
RSEPGQGSDPV

SEQ ID NO: 569708 - protein, 6 aa, Mycobacterium
RSEPGR

SEQ ID NO: 569709 - protein, 7 aa, Mycobacterium
RSEPLDD

SEQ ID NO: 569710 - protein, 5 aa, Mycobacterium
RSEPW

SEQ ID NO: 569711 - protein, 4 aa, Mycobacterium
RSEQ

SEQ ID NO: 569712 - protein, 5 aa, Mycobacterium
RSEQA

SEQ ID NO: 569713 - protein, 7 aa, Mycobacterium
RSEQDGD

SEQ ID NO: 569714 - protein, 7 aa, Mycobacterium
RSEQDSA

SEQ ID NO: 569715 - protein, 8 aa, Mycobacterium
RSEQRDGV

SEQ ID NO: 569716 - protein, 9 aa, Mycobacterium
RSEQSAPLG

SEQ ID NO: 569717 - protein, 23 aa, Mycobacterium
RSEQSTPLGPSLDTTTAPSTAKS

SEQ ID NO: 569718 - protein, 13 aa, Mycobacterium
RSERDRGETPAAV

SEQ ID NO: 569719 - protein, 5 aa, Mycobacterium
RSERN

SEQ ID NO: 569720 - protein, 7 aa, Mycobacterium
RSERSPI

SEQ ID NO: 569721 - protein, 8 aa, Mycobacterium
RSESADAY

SEQ ID NO: 569722 - protein, 9 aa, Mycobacterium
RSESDHSGK

SEQ ID NO: 569723 - protein, 7 aa, Mycobacterium
RSESDMA

SEQ ID NO: 569724 - protein, 6 aa, Mycobacterium
RSESEC

SEQ ID NO: 569725 - protein, 10 aa, Mycobacterium
RSESGVGAGD

SEQ ID NO: 569726 - protein, 9 aa, Mycobacterium
RSESKTTAV

SEQ ID NO: 569727 - protein, 5 aa, Mycobacterium
RSESL

SEQ ID NO: 569728 - protein, 6 aa, Mycobacterium
RSESTV

SEQ ID NO: 569729 - protein, 6 aa, Mycobacterium
RSESVS

SEQ ID NO: 569730 - protein, 4 aa, Mycobacterium
RSET

SEQ ID NO: 569731 - protein, 10 aa, Mycobacterium
RSETDGDGRP

SEQ ID NO: 569732 - protein, 7 aa, Mycobacterium
RSETGRR

SEQ ID NO: 569733 - protein, 5 aa, Mycobacterium
RSETS

SEQ ID NO: 569734 - protein, 6 aa, Mycobacterium
RSETSE

SEQ ID NO: 569735 - protein, 13 aa, Mycobacterium
RSETTDEHLGPEG

SEQ ID NO: 569736 - protein, 11 aa, Mycobacterium
RSEVDADDVAA

SEQ ID NO: 569737 - protein, 6 aa, Mycobacterium
RSEVGD

SEQ ID NO: 569738 - protein, 6 aa, Mycobacterium
RSEWEN

SEQ ID NO: 569739 - protein, 4 aa, Mycobacterium
RSEY

SEQ ID NO: 569740 - protein, 14 aa, Mycobacterium
RSEYEAARAAERTA

SEQ ID NO: 569741 - protein, 6 aa, Mycobacterium
RSEYGR

SEQ ID NO: 569742 - protein, 5 aa, Mycobacterium
RSEYP

SEQ ID NO: 569743 - protein, 13 aa, Mycobacterium
RSFAGGRTSEYRG

SEQ ID NO: 569744 - protein, 5 aa, Mycobacterium
RSFAP

SEQ ID NO: 569745 - protein, 4 aa, Mycobacterium
RSFD

SEQ ID NO: 569746 - protein, 5 aa, Mycobacterium
RSFDG

SEQ ID NO: 569747 - protein, 7 aa, Mycobacterium
RSFDPAK

SEQ ID NO: 569748 - protein, 11 aa, Mycobacterium
RSFEQADTEEW

SEQ ID NO: 569749 - protein, 11 aa, Mycobacterium
RSFEQADTNEW

SEQ ID NO: 569750 - protein, 11 aa, Mycobacterium
RSFETREGEKR

SEQ ID NO: 569751 - protein, 13 aa, Mycobacterium
RSFGETTTALEKT

SEQ ID NO: 569752 - protein, 8 aa, Mycobacterium
RSFGSDPA

SEQ ID NO: 569753 - protein, 13 aa, Mycobacterium
RSFGSDPDKVTAY

SEQ ID NO: 569754 - protein, 11 aa, Mycobacterium
RSFSASVTDTE

SEQ ID NO: 569755 - protein, 8 aa, Mycobacterium
RSFTGSQA

SEQ ID NO: 569756 - protein, 6 aa, Mycobacterium
RSGAAA

SEQ ID NO: 569757 - protein, 11 aa, Mycobacterium
RSGAADRRSHT

SEQ ID NO: 569758 - protein, 10 aa, Mycobacterium
RSGAAQRTRP

SEQ ID NO: 569759 - protein, 9 aa, Mycobacterium
RSGAATEVA

SEQ ID NO: 569760 - protein, 16 aa, Mycobacterium
RSGADTAAASVPGAVG

SEQ ID NO: 569761 - protein, 10 aa, Mycobacterium
RSGAEAAAVG

SEQ ID NO: 569762 - protein, 8 aa, Mycobacterium
RSGAEAPD

SEQ ID NO: 569763 - protein, 11 aa, Mycobacterium
RSGAERRDPDL

SEQ ID NO: 569764 - protein, 9 aa, Mycobacterium
RSGAGAPLE

SEQ ID NO: 569765 - protein, 7 aa, Mycobacterium
RSGAGTV

SEQ ID NO: 569766 - protein, 9 aa, Mycobacterium
RSGAKAGSV

SEQ ID NO: 569767 - protein, 6 aa, Mycobacterium
RSGAKD

SEQ ID NO: 569768 - protein, 8 aa, Mycobacterium
RSGAPGQA

SEQ ID NO: 569769 - protein, 9 aa, Mycobacterium
RSGAPRISP

SEQ ID NO: 569770 - protein, 8 aa, Mycobacterium
RSGAPSNI

SEQ ID NO: 569771 - protein, 7 aa, Mycobacterium
RSGAPTH

SEQ ID NO: 569772 - protein, 8 aa, Mycobacterium
RSGAPTNI

SEQ ID NO: 569773 - protein, 9 aa, Mycobacterium
RSGAQAAEI

SEQ ID NO: 569774 - protein, 11 aa, Mycobacterium
RSGARGDAGTR

SEQ ID NO: 569775 - protein, 6 aa, Mycobacterium
RSGARR

SEQ ID NO: 569776 - protein, 5 aa, Mycobacterium
RSGAS

SEQ ID NO: 569777 - protein, 7 aa, Mycobacterium
RSGASAY

SEQ ID NO: 569778 - protein, 13 aa, Mycobacterium
RSGASRPQSDRLG

SEQ ID NO: 569779 - protein, 5 aa, Mycobacterium
RSGAT

SEQ ID NO: 569780 - protein, 7 aa, Mycobacterium
RSGATER

SEQ ID NO: 569781 - protein, 6 aa, Mycobacterium
RSGATS

SEQ ID NO: 569782 - protein, 9 aa, Mycobacterium
RSGATTELA

SEQ ID NO: 569783 - protein, 5 aa, Mycobacterium
RSGAY

SEQ ID NO: 569784 - protein, 6 aa, Mycobacterium
RSGCQE

SEQ ID NO: 569785 - protein, 9 aa, Mycobacterium
RSGCTDADR

SEQ ID NO: 569786 - protein, 4 aa, Mycobacterium
RSGD

SEQ ID NO: 569787 - protein, 8 aa, Mycobacterium
RSGDADAT

SEQ ID NO: 569788 - protein, 11 aa, Mycobacterium
RSGDAEGAREA

SEQ ID NO: 569789 - protein, 9 aa, Mycobacterium
RSGDAITPG

SEQ ID NO: 569790 - protein, 5 aa, Mycobacterium
RSGDD

SEQ ID NO: 569791 - protein, 7 aa, Mycobacterium
RSGDDAT

SEQ ID NO: 569792 - protein, 7 aa, Mycobacterium
RSGDDTL

SEQ ID NO: 569793 - protein, 6 aa, Mycobacterium
RSGDDV

SEQ ID NO: 569794 - protein, 5 aa, Mycobacterium
RSGDE

SEQ ID NO: 569795 - protein, 8 aa, Mycobacterium
RSGDEDDL

SEQ ID NO: 569796 - protein, 7 aa, Mycobacterium
RSGDEPI

SEQ ID NO: 569797 - protein, 5 aa, Mycobacterium
RSGDF

SEQ ID NO: 569798 - protein, 31 aa, Mycobacterium
RSGDGWHADNTDVDGVSGALAGAGIDPAGQS

SEQ ID NO: 569799 - protein, 11 aa, Mycobacterium
RSGDKGGNANV

SEQ ID NO: 569800 - protein, 7 aa, Mycobacterium
RSGDKTE

SEQ ID NO: 569801 - protein, 7 aa, Mycobacterium
RSGDLDP

SEQ ID NO: 569802 - protein, 12 aa, Mycobacterium
RSGDPKPPTRGA

SEQ ID NO: 569803 - protein, 7 aa, Mycobacterium
RSGDPQA

SEQ ID NO: 569804 - protein, 6 aa, Mycobacterium
RSGDPR

SEQ ID NO: 569805 - protein, 5 aa, Mycobacterium
RSGDQ

SEQ ID NO: 569806 - protein, 13 aa, Mycobacterium
RSGDQPGLRRQRD

SEQ ID NO: 569807 - protein, 9 aa, Mycobacterium
RSGDRAAMT

SEQ ID NO: 569808 - protein, 12 aa, Mycobacterium
RSGDRAGGSAEI

SEQ ID NO: 569809 - protein, 6 aa, Mycobacterium
RSGDRG

SEQ ID NO: 569810 - protein, 7 aa, Mycobacterium
RSGDRLD

SEQ ID NO: 569811 - protein, 10 aa, Mycobacterium
RSGDRLDRNE

SEQ ID NO: 569812 - protein, 11 aa, Mycobacterium
RSGDRVDRNEI

SEQ ID NO: 569813 - protein, 10 aa, Mycobacterium
RSGDTPAQRR

SEQ ID NO: 569814 - protein, 9 aa, Mycobacterium
RSGDTPPAV

SEQ ID NO: 569815 - protein, 10 aa, Mycobacterium
RSGDTPPNQR

SEQ ID NO: 569816 - protein, 10 aa, Mycobacterium
RSGDTPPTER

SEQ ID NO: 569817 - protein, 11 aa, Mycobacterium
RSGDTTPSKRR

SEQ ID NO: 569818 - protein, 10 aa, Mycobacterium
RSGDVAPESV

SEQ ID NO: 569819 - protein, 5 aa, Mycobacterium
RSGEA

SEQ ID NO: 569820 - protein, 7 aa, Mycobacterium
RSGEATR

SEQ ID NO: 569821 - protein, 8 aa, Mycobacterium
RSGEDDEL

SEQ ID NO: 569822 - protein, 10 aa, Mycobacterium
RSGEDDESVQ

SEQ ID NO: 569823 - protein, 7 aa, Mycobacterium
RSGEDTV

SEQ ID NO: 569824 - protein, 7 aa, Mycobacterium
RSGEENE

SEQ ID NO: 569825 - protein, 6 aa, Mycobacterium
RSGEFR

SEQ ID NO: 569826 - protein, 18 aa, Mycobacterium
RSGEGPASTSAAPPAGWP

SEQ ID NO: 569827 - protein, 7 aa, Mycobacterium
RSGEGYQ

SEQ ID NO: 569828 - protein, 5 aa, Mycobacterium
RSGEH

SEQ ID NO: 569829 - protein, 11 aa, Mycobacterium
RSGEMDDRAAD

SEQ ID NO: 569830 - protein, 14 aa, Mycobacterium
RSGEPAAAASGPRA

SEQ ID NO: 569831 - protein, 11 aa, Mycobacterium
RSGEPIAPTRG

SEQ ID NO: 569832 - protein, 9 aa, Mycobacterium
RSGEPVPDA

SEQ ID NO: 569833 - protein, 9 aa, Mycobacterium
RSGERAASE

SEQ ID NO: 569834 - protein, 18 aa, Mycobacterium
RSGERAASEVMTTETLTV

SEQ ID NO: 569835 - protein, 11 aa, Mycobacterium
RSGERARRREA

SEQ ID NO: 569836 - protein, 8 aa, Mycobacterium
RSGESAAV

SEQ ID NO: 569837 - protein, 5 aa, Mycobacterium
RSGET

SEQ ID NO: 569838 - protein, 8 aa, Mycobacterium
RSGETAAV

SEQ ID NO: 569839 - protein, 10 aa, Mycobacterium
RSGETDAVTG

SEQ ID NO: 569840 - protein, 8 aa, Mycobacterium
RSGETDEL

SEQ ID NO: 569841 - protein, 5 aa, Mycobacterium
RSGEV

SEQ ID NO: 569842 - protein, 9 aa, Mycobacterium
RSGEVAGDL

SEQ ID NO: 569843 - protein, 8 aa, Mycobacterium
RSGEVPGR

SEQ ID NO: 569844 - protein, 14 aa, Mycobacterium
RSGEVTTATDSITS

SEQ ID NO: 569845 - protein, 13 aa, Mycobacterium
RSGEWTGATGERI

SEQ ID NO: 569846 - protein, 10 aa, Mycobacterium
RSGFEGEPGV

SEQ ID NO: 569847 - protein, 6 aa, Mycobacterium
RSGFGG

SEQ ID NO: 569848 - protein, 8 aa, Mycobacterium
RSGGAAQP

SEQ ID NO: 569849 - protein, 6 aa, Mycobacterium
RSGGAP

SEQ ID NO: 569850 - protein, 15 aa, Mycobacterium
RSGGDEYADDNDSYG

SEQ ID NO: 569851 - protein, 6 aa, Mycobacterium
RSGGDR

SEQ ID NO: 569852 - protein, 12 aa, Mycobacterium
RSGGDTGGGVSA

SEQ ID NO: 569853 - protein, 14 aa, Mycobacterium
RSGGEPARVGGPDP

SEQ ID NO: 569854 - protein, 6 aa, Mycobacterium
RSGGEV

SEQ ID NO: 569855 - protein, 18 aa, Mycobacterium
RSGGGGLTPSDLAPARLT

SEQ ID NO: 569856 - protein, 22 aa, Mycobacterium
RSGGGGLTPSDVAPARLSQQQI

SEQ ID NO: 569857 - protein, 9 aa, Mycobacterium
RSGGGSPHI

SEQ ID NO: 569858 - protein, 25 aa, Mycobacterium
RSGGGSPHITAPKPTMEFTPEERRA

SEQ ID NO: 569859 - protein, 18 aa, Mycobacterium
RSGGGSPHITAPKPTMQF

SEQ ID NO: 569860 - protein, 8 aa, Mycobacterium
RSGGGVSA

SEQ ID NO: 569861 - protein, 7 aa, Mycobacterium
RSGGIEN

SEQ ID NO: 569862 - protein, 7 aa, Mycobacterium
RSGGNAL

SEQ ID NO: 569863 - protein, 15 aa, Mycobacterium
RSGGPEAAARKARYT

SEQ ID NO: 569864 - protein, 7 aa, Mycobacterium
RSGGPFA

SEQ ID NO: 569865 - protein, 8 aa, Mycobacterium
RSGGPKAV

SEQ ID NO: 569866 - protein, 8 aa, Mycobacterium
RSGGPQFA

SEQ ID NO: 569867 - protein, 8 aa, Mycobacterium
RSGGPSAV

SEQ ID NO: 569868 - protein, 5 aa, Mycobacterium
RSGGS

SEQ ID NO: 569869 - protein, 19 aa, Mycobacterium
RSGGSPQSSPVTGGVDGEG

SEQ ID NO: 569870 - protein, 4 aa, Mycobacterium
RSGH

SEQ ID NO: 569871 - protein, 7 aa, Mycobacterium
RSGHAAR

SEQ ID NO: 569872 - protein, 6 aa, Mycobacterium
RSGHDA

SEQ ID NO: 569873 - protein, 12 aa, Mycobacterium
RSGHTERGRDGC

SEQ ID NO: 569874 - protein, 5 aa, Mycobacterium
RSGIG

SEQ ID NO: 569875 - protein, 6 aa, Mycobacterium
RSGITG

SEQ ID NO: 569876 - protein, 7 aa, Mycobacterium
RSGKCTR

SEQ ID NO: 569877 - protein, 9 aa, Mycobacterium
RSGKGQKKL

SEQ ID NO: 569878 - protein, 10 aa, Mycobacterium
RSGKGQKKLR

SEQ ID NO: 569879 - protein, 16 aa, Mycobacterium
RSGKKNGPLKNSRTGS

SEQ ID NO: 569880 - protein, 13 aa, Mycobacterium
RSGKQRAADAATS

SEQ ID NO: 569881 - protein, 7 aa, Mycobacterium
RSGLDAA

SEQ ID NO: 569882 - protein, 12 aa, Mycobacterium
RSGLEPARALPG

SEQ ID NO: 569883 - protein, 12 aa, Mycobacterium
RSGLPDHAGDKL

SEQ ID NO: 569884 - protein, 8 aa, Mycobacterium
RSGLPKGT

SEQ ID NO: 569885 - protein, 9 aa, Mycobacterium
RSGLPKVPT

SEQ ID NO: 569886 - protein, 6 aa, Mycobacterium
RSGLPP

SEQ ID NO: 569887 - protein, 7 aa, Mycobacterium
RSGLRTD

SEQ ID NO: 569888 - protein, 6 aa, Mycobacterium
RSGLSA

SEQ ID NO: 569889 - protein, 11 aa, Mycobacterium
RSGLTEEVRRS

SEQ ID NO: 569890 - protein, 6 aa, Mycobacterium
RSGLTG

SEQ ID NO: 569891 - protein, 4 aa, Mycobacterium
RSGM

SEQ ID NO: 569892 - protein, 10 aa, Mycobacterium
RSGMSGRPWG

SEQ ID NO: 569893 - protein, 5 aa, Mycobacterium
RSGNA

SEQ ID NO: 569894 - protein, 11 aa, Mycobacterium
RSGNADELREE

SEQ ID NO: 569895 - protein, 5 aa, Mycobacterium
RSGNF

SEQ ID NO: 569896 - protein, 6 aa, Mycobacterium
RSGNGS

SEQ ID NO: 569897 - protein, 7 aa, Mycobacterium
RSGNLGR

SEQ ID NO: 569898 - protein, 6 aa, Mycobacterium
RSGNRK

SEQ ID NO: 569899 - protein, 10 aa, Mycobacterium
RSGNRTNPSV

SEQ ID NO: 569900 - protein, 6 aa, Mycobacterium
RSGNSL

SEQ ID NO: 569901 - protein, 13 aa, Mycobacterium
RSGNSPESVATTE

SEQ ID NO: 569902 - protein, 8 aa, Mycobacterium
RSGNVDPK

SEQ ID NO: 569903 - protein, 4 aa, Mycobacterium
RSGP

SEQ ID NO: 569904 - protein, 6 aa, Mycobacterium
RSGPAA

SEQ ID NO: 569905 - protein, 7 aa, Mycobacterium
RSGPARA

SEQ ID NO: 569906 - protein, 8 aa, Mycobacterium
RSGPAYTT

SEQ ID NO: 569907 - protein, 11 aa, Mycobacterium
RSGPDAAGADE

SEQ ID NO: 569908 - protein, 6 aa, Mycobacterium
RSGPDD

SEQ ID NO: 569909 - protein, 6 aa, Mycobacterium
RSGPDR

SEQ ID NO: 569910 - protein, 8 aa, Mycobacterium
RSGPDRAI

SEQ ID NO: 569911 - protein, 6 aa, Mycobacterium
RSGPDV

SEQ ID NO: 569912 - protein, 6 aa, Mycobacterium
RSGPEN

SEQ ID NO: 569913 - protein, 5 aa, Mycobacterium
RSGPG

SEQ ID NO: 569914 - protein, 13 aa, Mycobacterium
RSGPLPAVPAEDG

SEQ ID NO: 569915 - protein, 16 aa, Mycobacterium
RSGPLRSGAINPASRQ

SEQ ID NO: 569916 - protein, 8 aa, Mycobacterium
RSGPPGPV

SEQ ID NO: 569917 - protein, 8 aa, Mycobacterium
RSGPRLSG

SEQ ID NO: 569918 - protein, 5 aa, Mycobacterium
RSGPV

SEQ ID NO: 569919 - protein, 14 aa, Mycobacterium
RSGQDRYGEPAPQS

SEQ ID NO: 569920 - protein, 6 aa, Mycobacterium
RSGQGQ

SEQ ID NO: 569921 - protein, 6 aa, Mycobacterium
RSGQGV

SEQ ID NO: 569922 - protein, 9 aa, Mycobacterium
RSGQLDPEF

SEQ ID NO: 569923 - protein, 8 aa, Mycobacterium
RSGQLGGY

SEQ ID NO: 569924 - protein, 16 aa, Mycobacterium
RSGQLGTVSATGGGIV

SEQ ID NO: 569925 - protein, 11 aa, Mycobacterium
RSGQPPTPTAE

SEQ ID NO: 569926 - protein, 15 aa, Mycobacterium
RSGQPVALPATGTSF

SEQ ID NO: 569927 - protein, 13 aa, Mycobacterium
RSGQQTPPADETL

SEQ ID NO: 569928 - protein, 13 aa, Mycobacterium
RSGQTPAPSRGGS

SEQ ID NO: 569929 - protein, 4 aa, Mycobacterium
RSGR

SEQ ID NO: 569930 - protein, 5 aa, Mycobacterium
RSGRA

SEQ ID NO: 569931 - protein, 6 aa, Mycobacterium
RSGRAH

SEQ ID NO: 569932 - protein, 13 aa, Mycobacterium
RSGRAVAADAATS

SEQ ID NO: 569933 - protein, 13 aa, Mycobacterium
RSGRCDRAGAERG

SEQ ID NO: 569934 - protein, 9 aa, Mycobacterium
RSGRCSRDE

SEQ ID NO: 569935 - protein, 12 aa, Mycobacterium
RSGRDTETVSAH

SEQ ID NO: 569936 - protein, 6 aa, Mycobacterium
RSGREA

SEQ ID NO: 569937 - protein, 7 aa, Mycobacterium
RSGRGNV

SEQ ID NO: 569938 - protein, 8 aa, Mycobacterium
RSGRGTTA

SEQ ID NO: 569939 - protein, 5 aa, Mycobacterium
RSGRI

SEQ ID NO: 569940 - protein, 7 aa, Mycobacterium
RSGRIRT

SEQ ID NO: 569941 - protein, 10 aa, Mycobacterium
RSGRISATSS

SEQ ID NO: 569942 - protein, 7 aa, Mycobacterium
RSGRITQ

SEQ ID NO: 569943 - protein, 5 aa, Mycobacterium
RSGRK

SEQ ID NO: 569944 - protein, 6 aa, Mycobacterium
RSGRKR

SEQ ID NO: 569945 - protein, 9 aa, Mycobacterium
RSGRLGDQD

SEQ ID NO: 569946 - protein, 6 aa, Mycobacterium
RSGRLK

SEQ ID NO: 569947 - protein, 7 aa, Mycobacterium
RSGRLKG

SEQ ID NO: 569948 - protein, 9 aa, Mycobacterium
RSGRMNDDD

SEQ ID NO: 569949 - protein, 9 aa, Mycobacterium
RSGRMSDED

SEQ ID NO: 569950 - protein, 5 aa, Mycobacterium
RSGRP

SEQ ID NO: 569951 - protein, 7 aa, Mycobacterium
RSGRPGA

SEQ ID NO: 569952 - protein, 5 aa, Mycobacterium
RSGRQ

SEQ ID NO: 569953 - protein, 9 aa, Mycobacterium
RSGRQADAL

SEQ ID NO: 569954 - protein, 6 aa, Mycobacterium
RSGRQG

SEQ ID NO: 569955 - protein, 7 aa, Mycobacterium
RSGRQQG

SEQ ID NO: 569956 - protein, 5 aa, Mycobacterium
RSGRR

SEQ ID NO: 569957 - protein, 31 aa, Mycobacterium
RSGRRFDGGSGLGMSRRGTRQTQSKNGCRRG

SEQ ID NO: 569958 - protein, 13 aa, Mycobacterium
RSGRRQGRVGQGV

SEQ ID NO: 569959 - protein, 6 aa, Mycobacterium
RSGRRT

SEQ ID NO: 569960 - protein, 8 aa, Mycobacterium
RSGRSIDN

SEQ ID NO: 569961 - protein, 19 aa, Mycobacterium
RSGRSRDSPSREERKEATR

SEQ ID NO: 569962 - protein, 14 aa, Mycobacterium
RSGRSVAADAATSV

SEQ ID NO: 569963 - protein, 7 aa, Mycobacterium
RSGRSVD

SEQ ID NO: 569964 - protein, 7 aa, Mycobacterium
RSGRSVR

SEQ ID NO: 569965 - protein, 13 aa, Mycobacterium
RSGRTARAGASGD

SEQ ID NO: 569966 - protein, 13 aa, Mycobacterium
RSGRTARAGGTGD

SEQ ID NO: 569967 - protein, 13 aa, Mycobacterium
RSGRTARAGNEGT

SEQ ID NO: 569968 - protein, 13 aa, Mycobacterium
RSGRTARAGSAGD

SEQ ID NO: 569969 - protein, 13 aa, Mycobacterium
RSGRTARAGSDGD

SEQ ID NO: 569970 - protein, 10 aa, Mycobacterium
RSGRTGAAWQ

SEQ ID NO: 569971 - protein, 10 aa, Mycobacterium
RSGRVGRAEA

SEQ ID NO: 569972 - protein, 11 aa, Mycobacterium
RSGSAAAYGAG

SEQ ID NO: 569973 - protein, 10 aa, Mycobacterium
RSGSAEALRE

SEQ ID NO: 569974 - protein, 7 aa, Mycobacterium
RSGSAPA

SEQ ID NO: 569975 - protein, 9 aa, Mycobacterium
RSGSGGPSY

SEQ ID NO: 569976 - protein, 8 aa, Mycobacterium
RSGSGGRL

SEQ ID NO: 569977 - protein, 14 aa, Mycobacterium
RSGSLGKPKSEPVE

SEQ ID NO: 569978 - protein, 12 aa, Mycobacterium
RSGSNVDSALDS

SEQ ID NO: 569979 - protein, 5 aa, Mycobacterium
RSGSP

SEQ ID NO: 569980 - protein, 5 aa, Mycobacterium
RSGSS

SEQ ID NO: 569981 - protein, 9 aa, Mycobacterium
RSGSSPPEH

SEQ ID NO: 569982 - protein, 9 aa, Mycobacterium
RSGSTTIST

SEQ ID NO: 569983 - protein, 10 aa, Mycobacterium
RSGSTTISTK

SEQ ID NO: 569984 - protein, 10 aa, Mycobacterium
RSGSTTVSTK

SEQ ID NO: 569985 - protein, 10 aa, Mycobacterium
RSGSTTVSTQ

SEQ ID NO: 569986 - protein, 10 aa, Mycobacterium
RSGSTTVSTR

SEQ ID NO: 569987 - protein, 7 aa, Mycobacterium
RSGSVDA

SEQ ID NO: 569988 - protein, 31 aa, Mycobacterium
RSGSVSCEQGSEYAGGDGDRVGLAEDDTTKF

SEQ ID NO: 569989 - protein, 8 aa, Mycobacterium
RSGTAATI

SEQ ID NO: 569990 - protein, 8 aa, Mycobacterium
RSGTARNS

SEQ ID NO: 569991 - protein, 10 aa, Mycobacterium
RSGTCDRDDL

SEQ ID NO: 569992 - protein, 5 aa, Mycobacterium
RSGTF

SEQ ID NO: 569993 - protein, 8 aa, Mycobacterium
RSGTGCSA

SEQ ID NO: 569994 - protein, 9 aa, Mycobacterium
RSGTGGADI

SEQ ID NO: 569995 - protein, 8 aa, Mycobacterium
RSGTGKTT

SEQ ID NO: 569996 - protein, 10 aa, Mycobacterium
RSGTIGPREP

SEQ ID NO: 569997 - protein, 18 aa, Mycobacterium
RSGTLAKPVRQAAASGEP

SEQ ID NO: 569998 - protein, 6 aa, Mycobacterium
RSGTLG

SEQ ID NO: 569999 - protein, 16 aa, Mycobacterium
RSGTPAQPVREATASG

SEQ ID NO: 570000 - protein, 8 aa, Mycobacterium
RSGTPDIG

SEQ ID NO: 570001 - protein, 13 aa, Mycobacterium
RSGTPRSYKDAAE

SEQ ID NO: 570002 - protein, 11 aa, Mycobacterium
RSGTRIPTGAT

SEQ ID NO: 570003 - protein, 7 aa, Mycobacterium
RSGTSAI

SEQ ID NO: 570004 - protein, 7 aa, Mycobacterium
RSGTSAV

SEQ ID NO: 570005 - protein, 7 aa, Mycobacterium
RSGTVNV

SEQ ID NO: 570006 - protein, 5 aa, Mycobacterium
RSGVA

SEQ ID NO: 570007 - protein, 8 aa, Mycobacterium
RSGVAAGH

SEQ ID NO: 570008 - protein, 6 aa, Mycobacterium
RSGVDE

SEQ ID NO: 570009 - protein, 32 aa, Mycobacterium
RSGVDEDFGRGKSAYDRYYGDPTNKPNPNLGA

SEQ ID NO: 570010 - protein, 15 aa, Mycobacterium
RSGVDEDYHRGESAY

SEQ ID NO: 570011 - protein, 15 aa, Mycobacterium
RSGVDPRRLHRRAVS

SEQ ID NO: 570012 - protein, 31 aa, Mycobacterium
RSGVDTDYHRGESAYDRYYGDPTNKPNPNLG

SEQ ID NO: 570013 - protein, 9 aa, Mycobacterium
RSGVEDGEA

SEQ ID NO: 570014 - protein, 10 aa, Mycobacterium
RSGVGRPRTG

SEQ ID NO: 570015 - protein, 9 aa, Mycobacterium
RSGVPESER

SEQ ID NO: 570016 - protein, 17 aa, Mycobacterium
RSGVPRPNEQPAGSVEE

SEQ ID NO: 570017 - protein, 5 aa, Mycobacterium
RSGVR

SEQ ID NO: 570018 - protein, 4 aa, Mycobacterium
RSGY

SEQ ID NO: 570019 - protein, 7 aa, Mycobacterium
RSGYGRE

SEQ ID NO: 570020 - protein, 6 aa, Mycobacterium
RSGYSP

SEQ ID NO: 570021 - protein, 9 aa, Mycobacterium
RSHEEGHQE

SEQ ID NO: 570022 - protein, 5 aa, Mycobacterium
RSHEG

SEQ ID NO: 570023 - protein, 6 aa, Mycobacterium
RSHEPG

SEQ ID NO: 570024 - protein, 15 aa, Mycobacterium
RSHGDKRTRAQTPVQ

SEQ ID NO: 570025 - protein, 6 aa, Mycobacterium
RSHGGD

SEQ ID NO: 570026 - protein, 5 aa, Mycobacterium
RSHGT

SEQ ID NO: 570027 - protein, 6 aa, Mycobacterium
RSHLSA

SEQ ID NO: 570028 - protein, 6 aa, Mycobacterium
RSHNRS

SEQ ID NO: 570029 - protein, 5 aa, Mycobacterium
RSHPA

SEQ ID NO: 570030 - protein, 6 aa, Mycobacterium
RSHPAL

SEQ ID NO: 570031 - protein, 6 aa, Mycobacterium
RSHPDG

SEQ ID NO: 570032 - protein, 19 aa, Mycobacterium
RSHPDVASAHGYSAERLEN

SEQ ID NO: 570033 - protein, 7 aa, Mycobacterium
RSHPGTL

SEQ ID NO: 570034 - protein, 5 aa, Mycobacterium
RSHPH

SEQ ID NO: 570035 - protein, 7 aa, Mycobacterium
RSHPPRS

SEQ ID NO: 570036 - protein, 7 aa, Mycobacterium
RSHPSAA

SEQ ID NO: 570037 - protein, 6 aa, Mycobacterium
RSHQPV

SEQ ID NO: 570038 - protein, 14 aa, Mycobacterium
RSHQRAVAAQDAGK

SEQ ID NO: 570039 - protein, 12 aa, Mycobacterium
RSHRRTAAALGE

SEQ ID NO: 570040 - protein, 8 aa, Mycobacterium
RSHSDQAA

SEQ ID NO: 570041 - protein, 13 aa, Mycobacterium
RSHSGGAGEPGPI

SEQ ID NO: 570042 - protein, 10 aa, Mycobacterium
RSHSRTYSTR

SEQ ID NO: 570043 - protein, 7 aa, Mycobacterium
RSHTHKP

SEQ ID NO: 570044 - protein, 7 aa, Mycobacterium
RSHTPQQ

SEQ ID NO: 570045 - protein, 22 aa, Mycobacterium
RSHTPSLSTRAGTATALPGTIG

SEQ ID NO: 570046 - protein, 29 aa, Mycobacterium
RSIAAKNRRAAELKARQQKRRNARAQGRR

SEQ ID NO: 570047 - protein, 8 aa, Mycobacterium
RSIAEQGH

SEQ ID NO: 570048 - protein, 7 aa, Mycobacterium
RSIAQQG

SEQ ID NO: 570049 - protein, 5 aa, Mycobacterium
RSIAS

SEQ ID NO: 570050 - protein, 10 aa, Mycobacterium
RSIDGPGGGI

SEQ ID NO: 570051 - protein, 18 aa, Mycobacterium
RSIDPGPVGSGGTTALPP

SEQ ID NO: 570052 - protein, 5 aa, Mycobacterium
RSIEN

SEQ ID NO: 570053 - protein, 22 aa, Mycobacterium
RSIESAVASAEKADRANADHVP

SEQ ID NO: 570054 - protein, 5 aa, Mycobacterium
RSIGE

SEQ ID NO: 570055 - protein, 10 aa, Mycobacterium
RSIGSTTDGS

SEQ ID NO: 570056 - protein, 6 aa, Mycobacterium
RSIKPE

SEQ ID NO: 570057 - protein, 9 aa, Mycobacterium
RSINSETDR

SEQ ID NO: 570058 - protein, 5 aa, Mycobacterium
RSIPE

SEQ ID NO: 570059 - protein, 13 aa, Mycobacterium
RSIPPDASYEPKW

SEQ ID NO: 570060 - protein, 7 aa, Mycobacterium
RSIPPSI

SEQ ID NO: 570061 - protein, 5 aa, Mycobacterium
RSIRG

SEQ ID NO: 570062 - protein, 14 aa, Mycobacterium
RSISDGETLSVGGT

SEQ ID NO: 570063 - protein, 5 aa, Mycobacterium
RSISG

SEQ ID NO: 570064 - protein, 16 aa, Mycobacterium
RSISTSFAKRGHDASA

SEQ ID NO: 570065 - protein, 4 aa, Mycobacterium
RSIT

SEQ ID NO: 570066 - protein, 18 aa, Mycobacterium
RSITGKISRKDLKDRLDN

SEQ ID NO: 570067 - protein, 17 aa, Mycobacterium
RSITQDADGVTVQSDGM

SEQ ID NO: 570068 - protein, 9 aa, Mycobacterium
RSKAAGEQA

SEQ ID NO: 570069 - protein, 7 aa, Mycobacterium
RSKAAGV

SEQ ID NO: 570070 - protein, 9 aa, Mycobacterium
RSKADLDET

SEQ ID NO: 570071 - protein, 10 aa, Mycobacterium
RSKAEAGDTD

SEQ ID NO: 570072 - protein, 13 aa, Mycobacterium
RSKAEELKPGPAT

SEQ ID NO: 570073 - protein, 7 aa, Mycobacterium
RSKALGE

SEQ ID NO: 570074 - protein, 8 aa, Mycobacterium
RSKALGQA

SEQ ID NO: 570075 - protein, 8 aa, Mycobacterium
RSKAPGDK

SEQ ID NO: 570076 - protein, 9 aa, Mycobacterium
RSKAPTSDL

SEQ ID NO: 570077 - protein, 13 aa, Mycobacterium
RSKDDSDGGGNKV

SEQ ID NO: 570078 - protein, 7 aa, Mycobacterium
RSKDGSL

SEQ ID NO: 570079 - protein, 4 aa, Mycobacterium
RSKE

SEQ ID NO: 570080 - protein, 19 aa, Mycobacterium
RSKEEGAPLSGKREFDTPD

SEQ ID NO: 570081 - protein, 9 aa, Mycobacterium
RSKENTRRV

SEQ ID NO: 570082 - protein, 4 aa, Mycobacterium
RSKF

SEQ ID NO: 570083 - protein, 6 aa, Mycobacterium
RSKGEY

SEQ ID NO: 570084 - protein, 8 aa, Mycobacterium
RSKGGAHS

SEQ ID NO: 570085 - protein, 7 aa, Mycobacterium
RSKGLAG

SEQ ID NO: 570086 - protein, 8 aa, Mycobacterium
RSKGSDAL

SEQ ID NO: 570087 - protein, 7 aa, Mycobacterium
RSKGWQD

SEQ ID NO: 570088 - protein, 6 aa, Mycobacterium
RSKKAF

SEQ ID NO: 570089 - protein, 8 aa, Mycobacterium
RSKPGQIS

SEQ ID NO: 570090 - protein, 9 aa, Mycobacterium
RSKPPEHGP

SEQ ID NO: 570091 - protein, 11 aa, Mycobacterium
RSKPRSPEGLK

SEQ ID NO: 570092 - protein, 5 aa, Mycobacterium
RSKPS

SEQ ID NO: 570093 - protein, 17 aa, Mycobacterium
RSKRAAGSSAAAGHRTG

SEQ ID NO: 570094 - protein, 12 aa, Mycobacterium
RSKSASYQSCTP

SEQ ID NO: 570095 - protein, 7 aa, Mycobacterium
RSKSNVE

SEQ ID NO: 570096 - protein, 7 aa, Mycobacterium
RSKSNVQ

SEQ ID NO: 570097 - protein, 5 aa, Mycobacterium
RSKTS

SEQ ID NO: 570098 - protein, 9 aa, Mycobacterium
RSKTTAVAA

SEQ ID NO: 570099 - protein, 7 aa, Mycobacterium
RSKVPAA

SEQ ID NO: 570100 - protein, 8 aa, Mycobacterium
RSKYKSGE

SEQ ID NO: 570101 - protein, 4 aa, Mycobacterium
RSLD

SEQ ID NO: 570102 - protein, 6 aa, Mycobacterium
RSLDAG

SEQ ID NO: 570103 - protein, 7 aa, Mycobacterium
RSLDEGK

SEQ ID NO: 570104 - protein, 22 aa, Mycobacterium
RSLDGDIGSDGSTPQVRASNAD

SEQ ID NO: 570105 - protein, 11 aa, Mycobacterium
RSLEAAPAERL

SEQ ID NO: 570106 - protein, 8 aa, Mycobacterium
RSLEDGRA

SEQ ID NO: 570107 - protein, 10 aa, Mycobacterium
RSLENRSGRA

SEQ ID NO: 570108 - protein, 5 aa, Mycobacterium
RSLGA

SEQ ID NO: 570109 - protein, 10 aa, Mycobacterium
RSLGDPSHDP

SEQ ID NO: 570110 - protein, 7 aa, Mycobacterium
RSLGDPV

SEQ ID NO: 570111 - protein, 6 aa, Mycobacterium
RSLGPS

SEQ ID NO: 570112 - protein, 5 aa, Mycobacterium
RSLHR

SEQ ID NO: 570113 - protein, 4 aa, Mycobacterium
RSLP

SEQ ID NO: 570114 - protein, 7 aa, Mycobacterium
RSLPEDE

SEQ ID NO: 570115 - protein, 8 aa, Mycobacterium
RSLPGDID

SEQ ID NO: 570116 - protein, 8 aa, Mycobacterium
RSLPNKPV

SEQ ID NO: 570117 - protein, 8 aa, Mycobacterium
RSLPPSIP

SEQ ID NO: 570118 - protein, 9 aa, Mycobacterium
RSLPRRDRG

SEQ ID NO: 570119 - protein, 5 aa, Mycobacterium
RSLPS

SEQ ID NO: 570120 - protein, 13 aa, Mycobacterium
RSLQGDKKARSVR

SEQ ID NO: 570121 - protein, 7 aa, Mycobacterium
RSLRDAA

SEQ ID NO: 570122 - protein, 8 aa, Mycobacterium
RSLRNGRT

SEQ ID NO: 570123 - protein, 8 aa, Mycobacterium
RSLRPDNT

SEQ ID NO: 570124 - protein, 14 aa, Mycobacterium
RSLRSDEEIEEADR

SEQ ID NO: 570125 - protein, 8 aa, Mycobacterium
RSLSGERL

SEQ ID NO: 570126 - protein, 6 aa, Mycobacterium
RSLSGG

SEQ ID NO: 570127 - protein, 12 aa, Mycobacterium
RSLSRRNHGRSR

SEQ ID NO: 570128 - protein, 6 aa, Mycobacterium
RSLTGE

SEQ ID NO: 570129 - protein, 4 aa, Mycobacterium
RSMD

SEQ ID NO: 570130 - protein, 7 aa, Mycobacterium
RSMEESR

SEQ ID NO: 570131 - protein, 19 aa, Mycobacterium
RSMGDGSEYTSGPGIAEAE

SEQ ID NO: 570132 - protein, 20 aa, Mycobacterium
RSMGDGSEYTSGPGIAEAED

SEQ ID NO: 570133 - protein, 5 aa, Mycobacterium
RSMGK

SEQ ID NO: 570134 - protein, 6 aa, Mycobacterium
RSMGKE

SEQ ID NO: 570135 - protein, 12 aa, Mycobacterium
RSMGTRTKDLED

SEQ ID NO: 570136 - protein, 11 aa, Mycobacterium
RSMKESGTPIA

SEQ ID NO: 570137 - protein, 19 aa, Mycobacterium
RSMKGSTAKTVMTGSRSPA

SEQ ID NO: 570138 - protein, 5 aa, Mycobacterium
RSMKQ

SEQ ID NO: 570139 - protein, 10 aa, Mycobacterium
RSMPATDHAG

SEQ ID NO: 570140 - protein, 6 aa, Mycobacterium
RSMQES

SEQ ID NO: 570141 - protein, 7 aa, Mycobacterium
RSMSEPQ

SEQ ID NO: 570142 - protein, 8 aa, Mycobacterium
RSMSEPQL

SEQ ID NO: 570143 - protein, 4 aa, Mycobacterium
RSMT

SEQ ID NO: 570144 - protein, 6 aa, Mycobacterium
RSMTPQ

SEQ ID NO: 570145 - protein, 6 aa, Mycobacterium
RSNARD

SEQ ID NO: 570146 - protein, 9 aa, Mycobacterium
RSNATPRTV

SEQ ID NO: 570147 - protein, 10 aa, Mycobacterium
RSNDAAAQVD

SEQ ID NO: 570148 - protein, 6 aa, Mycobacterium
RSNDGA

SEQ ID NO: 570149 - protein, 8 aa, Mycobacterium
RSNDPDGE

SEQ ID NO: 570150 - protein, 7 aa, Mycobacterium
RSNERDD

SEQ ID NO: 570151 - protein, 6 aa, Mycobacterium
RSNERL

SEQ ID NO: 570152 - protein, 7 aa, Mycobacterium
RSNGDPL

SEQ ID NO: 570153 - protein, 7 aa, Mycobacterium
RSNGDRP

SEQ ID NO: 570154 - protein, 10 aa, Mycobacterium
RSNGERAAPD

SEQ ID NO: 570155 - protein, 5 aa, Mycobacterium
RSNGL

SEQ ID NO: 570156 - protein, 13 aa, Mycobacterium
RSNGQSATGTSRL

SEQ ID NO: 570157 - protein, 5 aa, Mycobacterium
RSNGS

SEQ ID NO: 570158 - protein, 7 aa, Mycobacterium
RSNGVPV

SEQ ID NO: 570159 - protein, 10 aa, Mycobacterium
RSNHGTCANQ

SEQ ID NO: 570160 - protein, 22 aa, Mycobacterium
RSNHGTCANQKPIVDEGQRVEA

SEQ ID NO: 570161 - protein, 12 aa, Mycobacterium
RSNHGTCANQRP

SEQ ID NO: 570162 - protein, 14 aa, Mycobacterium
RSNHGTCANQSPIV

SEQ ID NO: 570163 - protein, 4 aa, Mycobacterium
RSNL

SEQ ID NO: 570164 - protein, 5 aa, Mycobacterium
RSNLT

SEQ ID NO: 570165 - protein, 6 aa, Mycobacterium
RSNNAQ

SEQ ID NO: 570166 - protein, 17 aa, Mycobacterium
RSNPDPHRARPAPRDGA

SEQ ID NO: 570167 - protein, 9 aa, Mycobacterium
RSNPLPRSR

SEQ ID NO: 570168 - protein, 9 aa, Mycobacterium
RSNPPALDG

SEQ ID NO: 570169 - protein, 8 aa, Mycobacterium
RSNPRPDH

SEQ ID NO: 570170 - protein, 6 aa, Mycobacterium
RSNPVL

SEQ ID NO: 570171 - protein, 9 aa, Mycobacterium
RSNPVPRSR

SEQ ID NO: 570172 - protein, 8 aa, Mycobacterium
RSNQRDGR

SEQ ID NO: 570173 - protein, 24 aa, Mycobacterium
RSNRDRQRDNEGQDAADEQPQHAH

SEQ ID NO: 570174 - protein, 16 aa, Mycobacterium
RSNRGVAGIDGTVSTA

SEQ ID NO: 570175 - protein, 5 aa, Mycobacterium
RSNRH

SEQ ID NO: 570176 - protein, 6 aa, Mycobacterium
RSNRHT

SEQ ID NO: 570177 - protein, 13 aa, Mycobacterium
RSNRTAEVAGRSD

SEQ ID NO: 570178 - protein, 6 aa, Mycobacterium
RSNRTL

SEQ ID NO: 570179 - protein, 6 aa, Mycobacterium
RSNRVR

SEQ ID NO: 570180 - protein, 24 aa, Mycobacterium
RSNSEAESSAHRFPAPAPPRWSTG

SEQ ID NO: 570181 - protein, 11 aa, Mycobacterium
RSNSEVDPADV

SEQ ID NO: 570182 - protein, 4 aa, Mycobacterium
RSNT

SEQ ID NO: 570183 - protein, 5 aa, Mycobacterium
RSNTI

SEQ ID NO: 570184 - protein, 4 aa, Mycobacterium
RSNV

SEQ ID NO: 570185 - protein, 7 aa, Mycobacterium
RSNYEGR

SEQ ID NO: 570186 - protein, 6 aa, Mycobacterium
RSNYFD

SEQ ID NO: 570187 - protein, 17 aa, Mycobacterium
RSPAAAKKLASRARGRL

SEQ ID NO: 570188 - protein, 9 aa, Mycobacterium
RSPAAPLAG

SEQ ID NO: 570189 - protein, 10 aa, Mycobacterium
RSPAARRRAY

SEQ ID NO: 570190 - protein, 8 aa, Mycobacterium
RSPAATLG

SEQ ID NO: 570191 - protein, 7 aa, Mycobacterium
RSPADKQ

SEQ ID NO: 570192 - protein, 6 aa, Mycobacterium
RSPADY

SEQ ID NO: 570193 - protein, 10 aa, Mycobacterium
RSPAELDDAE

SEQ ID NO: 570194 - protein, 10 aa, Mycobacterium
RSPAEPGRAT

SEQ ID NO: 570195 - protein, 8 aa, Mycobacterium
RSPAEQRA

SEQ ID NO: 570196 - protein, 20 aa, Mycobacterium
RSPAEVAKAAAGVPVGPSGR

SEQ ID NO: 570197 - protein, 5 aa, Mycobacterium
RSPAG

SEQ ID NO: 570198 - protein, 9 aa, Mycobacterium
RSPAGKADY

SEQ ID NO: 570199 - protein, 7 aa, Mycobacterium
RSPAGKE

SEQ ID NO: 570200 - protein, 19 aa, Mycobacterium
RSPAGKPDYRWAKATVAPQ

SEQ ID NO: 570201 - protein, 23 aa, Mycobacterium
RSPAGSPRRAQAQGHLAGLDFDL

SEQ ID NO: 570202 - protein, 6 aa, Mycobacterium
RSPAHA

SEQ ID NO: 570203 - protein, 24 aa, Mycobacterium
RSPAKDPNAKPTARRPVTEVLEMR

SEQ ID NO: 570204 - protein, 11 aa, Mycobacterium
RSPAKSGAESA

SEQ ID NO: 570205 - protein, 24 aa, Mycobacterium
RSPANDQHVERTARRPVTEVLEFR

SEQ ID NO: 570206 - protein, 6 aa, Mycobacterium
RSPARA

SEQ ID NO: 570207 - protein, 16 aa, Mycobacterium
RSPARITSAAPTLGQH

SEQ ID NO: 570208 - protein, 9 aa, Mycobacterium
RSPARPSRV

SEQ ID NO: 570209 - protein, 6 aa, Mycobacterium
RSPASI

SEQ ID NO: 570210 - protein, 26 aa, Mycobacterium
RSPASSPEQRVAAQSELNRQPRDASA

SEQ ID NO: 570211 - protein, 27 aa, Mycobacterium
RSPASTPERRAAAQDELARQPRDASAV

SEQ ID NO: 570212 - protein, 7 aa, Mycobacterium
RSPATEE

SEQ ID NO: 570213 - protein, 8 aa, Mycobacterium
RSPATGDV

SEQ ID NO: 570214 - protein, 7 aa, Mycobacterium
RSPCGTT

SEQ ID NO: 570215 - protein, 5 aa, Mycobacterium
RSPCT

SEQ ID NO: 570216 - protein, 30 aa, Mycobacterium
RSPDAAKKLASRARGRLQAAPAAQPRSTAG

SEQ ID NO: 570217 - protein, 7 aa, Mycobacterium
RSPDADA

SEQ ID NO: 570218 - protein, 6 aa, Mycobacterium
RSPDAE

SEQ ID NO: 570219 - protein, 9 aa, Mycobacterium
RSPDAPAVT

SEQ ID NO: 570220 - protein, 5 aa, Mycobacterium
RSPDD

SEQ ID NO: 570221 - protein, 6 aa, Mycobacterium
RSPDEY

SEQ ID NO: 570222 - protein, 7 aa, Mycobacterium
RSPDGPT

SEQ ID NO: 570223 - protein, 21 aa, Mycobacterium
RSPDGSRYAKKGGADLAGERD

SEQ ID NO: 570224 - protein, 10 aa, Mycobacterium
RSPDPNDGRR

SEQ ID NO: 570225 - protein, 7 aa, Mycobacterium
RSPDPRV

SEQ ID NO: 570226 - protein, 10 aa, Mycobacterium
RSPDPSDGRY

SEQ ID NO: 570227 - protein, 16 aa, Mycobacterium
RSPDRQLPSEGATRGA

SEQ ID NO: 570228 - protein, 9 aa, Mycobacterium
RSPDSVAAT

SEQ ID NO: 570229 - protein, 7 aa, Mycobacterium
RSPDTAT

SEQ ID NO: 570230 - protein, 7 aa, Mycobacterium
RSPDVHK

SEQ ID NO: 570231 - protein, 7 aa, Mycobacterium
RSPEAAR

SEQ ID NO: 570232 - protein, 8 aa, Mycobacterium
RSPEAQTA

SEQ ID NO: 570233 - protein, 9 aa, Mycobacterium
RSPEDSPTV

SEQ ID NO: 570234 - protein, 8 aa, Mycobacterium
RSPEGGVK

SEQ ID NO: 570235 - protein, 7 aa, Mycobacterium
RSPEGKQ

SEQ ID NO: 570236 - protein, 9 aa, Mycobacterium
RSPEPAQPW

SEQ ID NO: 570237 - protein, 5 aa, Mycobacterium
RSPEQ

SEQ ID NO: 570238 - protein, 12 aa, Mycobacterium
RSPEQIRDLADL

SEQ ID NO: 570239 - protein, 7 aa, Mycobacterium
RSPERFR

SEQ ID NO: 570240 - protein, 6 aa, Mycobacterium
RSPESI

SEQ ID NO: 570241 - protein, 7 aa, Mycobacterium
RSPETVA

SEQ ID NO: 570242 - protein, 5 aa, Mycobacterium
RSPEV

SEQ ID NO: 570243 - protein, 9 aa, Mycobacterium
RSPEWTGAE

SEQ ID NO: 570244 - protein, 4 aa, Mycobacterium
RSPF

SEQ ID NO: 570245 - protein, 11 aa, Mycobacterium
RSPGAGLPPRV

SEQ ID NO: 570246 - protein, 15 aa, Mycobacterium
RSPGFRSTGRLAGDG

SEQ ID NO: 570247 - protein, 13 aa, Mycobacterium
RSPGGGSSEPGGN

SEQ ID NO: 570248 - protein, 6 aa, Mycobacterium
RSPGGL

SEQ ID NO: 570249 - protein, 13 aa, Mycobacterium
RSPGGTRTPDPRS

SEQ ID NO: 570250 - protein, 6 aa, Mycobacterium
RSPGGW

SEQ ID NO: 570251 - protein, 19 aa, Mycobacterium
RSPGPRKGGLGSGIAGDSV

SEQ ID NO: 570252 - protein, 9 aa, Mycobacterium
RSPGQKGVD

SEQ ID NO: 570253 - protein, 7 aa, Mycobacterium
RSPGRAA

SEQ ID NO: 570254 - protein, 6 aa, Mycobacterium
RSPGRE

SEQ ID NO: 570255 - protein, 6 aa, Mycobacterium
RSPGRM

SEQ ID NO: 570256 - protein, 16 aa, Mycobacterium
RSPGSGLSVQPQRGTD

SEQ ID NO: 570257 - protein, 8 aa, Mycobacterium
RSPGTGLG

SEQ ID NO: 570258 - protein, 20 aa, Mycobacterium
RSPGYNGPPPPTSEATRALQ

SEQ ID NO: 570259 - protein, 12 aa, Mycobacterium
RSPHAAAAHDRA

SEQ ID NO: 570260 - protein, 4 aa, Mycobacterium
RSPI

SEQ ID NO: 570261 - protein, 6 aa, Mycobacterium
RSPIAP

SEQ ID NO: 570262 - protein, 20 aa, Mycobacterium
RSPITKTEREQALGYDTATG

SEQ ID NO: 570263 - protein, 4 aa, Mycobacterium
RSPK

SEQ ID NO: 570264 - protein, 9 aa, Mycobacterium
RSPLAAGGF

SEQ ID NO: 570265 - protein, 9 aa, Mycobacterium
RSPLDGLPG

SEQ ID NO: 570266 - protein, 5 aa, Mycobacterium
RSPLP

SEQ ID NO: 570267 - protein, 7 aa, Mycobacterium
RSPLQTN

SEQ ID NO: 570268 - protein, 15 aa, Mycobacterium
RSPLRGIDTESDEAL

SEQ ID NO: 570269 - protein, 6 aa, Mycobacterium
RSPMAD

SEQ ID NO: 570270 - protein, 14 aa, Mycobacterium
RSPMTGERDIRSED

SEQ ID NO: 570271 - protein, 6 aa, Mycobacterium
RSPNPH

SEQ ID NO: 570272 - protein, 9 aa, Mycobacterium
RSPNTMDRT

SEQ ID NO: 570273 - protein, 7 aa, Mycobacterium
RSPNTVK

SEQ ID NO: 570274 - protein, 10 aa, Mycobacterium
RSPPPLGPRD

SEQ ID NO: 570275 - protein, 13 aa, Mycobacterium
RSPQAGIGKPEPL

SEQ ID NO: 570276 - protein, 9 aa, Mycobacterium
RSPQAGTPA

SEQ ID NO: 570277 - protein, 5 aa, Mycobacterium
RSPQD

SEQ ID NO: 570278 - protein, 7 aa, Mycobacterium
RSPQGEE

SEQ ID NO: 570279 - protein, 5 aa, Mycobacterium
RSPQL

SEQ ID NO: 570280 - protein, 4 aa, Mycobacterium
RSPR

SEQ ID NO: 570281 - protein, 12 aa, Mycobacterium
RSPRAAVLESFG

SEQ ID NO: 570282 - protein, 7 aa, Mycobacterium
RSPRGAT

SEQ ID NO: 570283 - protein, 6 aa, Mycobacterium
RSPRGG

SEQ ID NO: 570284 - protein, 5 aa, Mycobacterium
RSPRI

SEQ ID NO: 570285 - protein, 13 aa, Mycobacterium
RSPRNQGAGANRN

SEQ ID NO: 570286 - protein, 7 aa, Mycobacterium
RSPRPDA

SEQ ID NO: 570287 - protein, 7 aa, Mycobacterium
RSPRPTL

SEQ ID NO: 570288 - protein, 12 aa, Mycobacterium
RSPRRTLGNAAG

SEQ ID NO: 570289 - protein, 13 aa, Mycobacterium
RSPRSGELEESAE

SEQ ID NO: 570290 - protein, 15 aa, Mycobacterium
RSPSAGDPTASNVRH

SEQ ID NO: 570291 - protein, 7 aa, Mycobacterium
RSPSDQL

SEQ ID NO: 570292 - protein, 5 aa, Mycobacterium
RSPSE

SEQ ID NO: 570293 - protein, 6 aa, Mycobacterium
RSPSEV

SEQ ID NO: 570294 - protein, 5 aa, Mycobacterium
RSPSG

SEQ ID NO: 570295 - protein, 18 aa, Mycobacterium
RSPSGKADYRWAREQAVS

SEQ ID NO: 570296 - protein, 6 aa, Mycobacterium
RSPSHD

SEQ ID NO: 570297 - protein, 11 aa, Mycobacterium
RSPSIAPESAC

SEQ ID NO: 570298 - protein, 12 aa, Mycobacterium
RSPSTDPKDKRM

SEQ ID NO: 570299 - protein, 6 aa, Mycobacterium
RSPSVA

SEQ ID NO: 570300 - protein, 8 aa, Mycobacterium
RSPTADTV

SEQ ID NO: 570301 - protein, 13 aa, Mycobacterium
RSPTAIPVTFRPA

SEQ ID NO: 570302 - protein, 5 aa, Mycobacterium
RSPTG

SEQ ID NO: 570303 - protein, 9 aa, Mycobacterium
RSPTKALGA

SEQ ID NO: 570304 - protein, 7 aa, Mycobacterium
RSPTPIT

SEQ ID NO: 570305 - protein, 6 aa, Mycobacterium
RSPTSL

SEQ ID NO: 570306 - protein, 12 aa, Mycobacterium
RSPTSVPVLFDP

SEQ ID NO: 570307 - protein, 16 aa, Mycobacterium
RSPTTQRAAPSSSEQL

SEQ ID NO: 570308 - protein, 18 aa, Mycobacterium
RSPVAPRKGAGRVAGRPT

SEQ ID NO: 570309 - protein, 10 aa, Mycobacterium
RSPVATGNTV

SEQ ID NO: 570310 - protein, 21 aa, Mycobacterium
RSPVHPDVETQDRAIDGPAGP

SEQ ID NO: 570311 - protein, 6 aa, Mycobacterium
RSPVSG

SEQ ID NO: 570312 - protein, 6 aa, Mycobacterium
RSPWPQ

SEQ ID NO: 570313 - protein, 6 aa, Mycobacterium
RSQAAA

SEQ ID NO: 570314 - protein, 7 aa, Mycobacterium
RSQAEAR

SEQ ID NO: 570315 - protein, 46 aa, Mycobacterium
RSQAKQSPAPVRGGTAANAARRVAQQPRAAVRSQPGATRPDPRDPT

SEQ ID NO: 570316 - protein, 47 aa, Mycobacterium
RSQAKTPAKVPGRGHPGSKAPRRATQQPPDAPSAEPAAARPDPRDPT

SEQ ID NO: 570317 - protein, 8 aa, Mycobacterium
RSQARGRP

SEQ ID NO: 570318 - protein, 9 aa, Mycobacterium
RSQARPSGN

SEQ ID NO: 570319 - protein, 11 aa, Mycobacterium
RSQARRGRARR

SEQ ID NO: 570320 - protein, 8 aa, Mycobacterium
RSQATDDL

SEQ ID NO: 570321 - protein, 7 aa, Mycobacterium
RSQATEI

SEQ ID NO: 570322 - protein, 8 aa, Mycobacterium
RSQAVNPK

SEQ ID NO: 570323 - protein, 9 aa, Mycobacterium
RSQDDPDGL

SEQ ID NO: 570324 - protein, 8 aa, Mycobacterium
RSQDERDR

SEQ ID NO: 570325 - protein, 6 aa, Mycobacterium
RSQDNL

SEQ ID NO: 570326 - protein, 7 aa, Mycobacterium
RSQDNLD

SEQ ID NO: 570327 - protein, 8 aa, Mycobacterium
RSQDNPAG

SEQ ID NO: 570328 - protein, 6 aa, Mycobacterium
RSQDTF

SEQ ID NO: 570329 - protein, 4 aa, Mycobacterium
RSQE

SEQ ID NO: 570330 - protein, 5 aa, Mycobacterium
RSQEA

SEQ ID NO: 570331 - protein, 6 aa, Mycobacterium
RSQEET

SEQ ID NO: 570332 - protein, 12 aa, Mycobacterium
RSQEKAAAAWSG

SEQ ID NO: 570333 - protein, 11 aa, Mycobacterium
RSQEKAAEAWS

SEQ ID NO: 570334 - protein, 4 aa, Mycobacterium
RSQG

SEQ ID NO: 570335 - protein, 5 aa, Mycobacterium
RSQGC

SEQ ID NO: 570336 - protein, 8 aa, Mycobacterium
RSQGGDVS

SEQ ID NO: 570337 - protein, 12 aa, Mycobacterium
RSQGGTRRYSAD

SEQ ID NO: 570338 - protein, 7 aa, Mycobacterium
RSQGPEH

SEQ ID NO: 570339 - protein, 7 aa, Mycobacterium
RSQGSTI

SEQ ID NO: 570340 - protein, 5 aa, Mycobacterium
RSQHP

SEQ ID NO: 570341 - protein, 10 aa, Mycobacterium
RSQHPGRRGR

SEQ ID NO: 570342 - protein, 12 aa, Mycobacterium
RSQHPGWPAPVG

SEQ ID NO: 570343 - protein, 9 aa, Mycobacterium
RSQHRPTGN

SEQ ID NO: 570344 - protein, 9 aa, Mycobacterium
RSQIDPANR

SEQ ID NO: 570345 - protein, 24 aa, Mycobacterium
RSQLDAAGADAGDRLAAPESPEAR

SEQ ID NO: 570346 - protein, 6 aa, Mycobacterium
RSQLDG

SEQ ID NO: 570347 - protein, 5 aa, Mycobacterium
RSQLP

SEQ ID NO: 570348 - protein, 6 aa, Mycobacterium
RSQMDE

SEQ ID NO: 570349 - protein, 10 aa, Mycobacterium
RSQPDAESVR

SEQ ID NO: 570350 - protein, 7 aa, Mycobacterium
RSQPGED

SEQ ID NO: 570351 - protein, 8 aa, Mycobacterium
RSQPGTFG

SEQ ID NO: 570352 - protein, 12 aa, Mycobacterium
RSQPNPKARQAI

SEQ ID NO: 570353 - protein, 11 aa, Mycobacterium
RSQPNPKSRQA

SEQ ID NO: 570354 - protein, 8 aa, Mycobacterium
RSQPRPKS

SEQ ID NO: 570355 - protein, 12 aa, Mycobacterium
RSQQKAAAAWSG

SEQ ID NO: 570356 - protein, 11 aa, Mycobacterium
RSQQKAAEAWS

SEQ ID NO: 570357 - protein, 8 aa, Mycobacterium
RSQQNSLR

SEQ ID NO: 570358 - protein, 4 aa, Mycobacterium
RSQR

SEQ ID NO: 570359 - protein, 8 aa, Mycobacterium
RSQRDDPA

SEQ ID NO: 570360 - protein, 9 aa, Mycobacterium
RSQRDDPDA

SEQ ID NO: 570361 - protein, 9 aa, Mycobacterium
RSQRDLQPD

SEQ ID NO: 570362 - protein, 15 aa, Mycobacterium
RSQRGPAAESPDSDL

SEQ ID NO: 570363 - protein, 6 aa, Mycobacterium
RSQRHD

SEQ ID NO: 570364 - protein, 8 aa, Mycobacterium
RSQRRPTG

SEQ ID NO: 570365 - protein, 6 aa, Mycobacterium
RSQRRR

SEQ ID NO: 570366 - protein, 10 aa, Mycobacterium
RSQRSDSKVT

SEQ ID NO: 570367 - protein, 11 aa, Mycobacterium
RSQTDDSGGTM

SEQ ID NO: 570368 - protein, 12 aa, Mycobacterium
RSQTGGDANYVG

SEQ ID NO: 570369 - protein, 9 aa, Mycobacterium
RSQTKTAAV

SEQ ID NO: 570370 - protein, 5 aa, Mycobacterium
RSQTP

SEQ ID NO: 570371 - protein, 7 aa, Mycobacterium
RSQTPYT

SEQ ID NO: 570372 - protein, 4 aa, Mycobacterium
RSQV

SEQ ID NO: 570373 - protein, 5 aa, Mycobacterium
RSQVG

SEQ ID NO: 570374 - protein, 6 aa, Mycobacterium
RSQVRP

SEQ ID NO: 570375 - protein, 12 aa, Mycobacterium
RSQVSGADESTM

SEQ ID NO: 570376 - protein, 14 aa, Mycobacterium
RSRAATDCADADVN

SEQ ID NO: 570377 - protein, 14 aa, Mycobacterium
RSRADADGTPSSLA

SEQ ID NO: 570378 - protein, 7 aa, Mycobacterium
RSRADLE

SEQ ID NO: 570379 - protein, 18 aa, Mycobacterium
RSRADTFGPDHAPVRGDE

SEQ ID NO: 570380 - protein, 5 aa, Mycobacterium
RSRAE

SEQ ID NO: 570381 - protein, 13 aa, Mycobacterium
RSRAEELKPGPAT

SEQ ID NO: 570382 - protein, 6 aa, Mycobacterium
RSRAKE

SEQ ID NO: 570383 - protein, 15 aa, Mycobacterium
RSRALPPGAAPEQGL

SEQ ID NO: 570384 - protein, 7 aa, Mycobacterium
RSRARRH

SEQ ID NO: 570385 - protein, 6 aa, Mycobacterium
RSRDAL

SEQ ID NO: 570386 - protein, 9 aa, Mycobacterium
RSRDALDSA

SEQ ID NO: 570387 - protein, 7 aa, Mycobacterium
RSRDATL

SEQ ID NO: 570388 - protein, 7 aa, Mycobacterium
RSRDDGL

SEQ ID NO: 570389 - protein, 7 aa, Mycobacterium
RSRDELS

SEQ ID NO: 570390 - protein, 10 aa, Mycobacterium
RSRDRARRRA

SEQ ID NO: 570391 - protein, 9 aa, Mycobacterium
RSRDTNAPY

SEQ ID NO: 570392 - protein, 6 aa, Mycobacterium
RSREAV

SEQ ID NO: 570393 - protein, 11 aa, Mycobacterium
RSREAVAARDK

SEQ ID NO: 570394 - protein, 7 aa, Mycobacterium
RSREERD

SEQ ID NO: 570395 - protein, 5 aa, Mycobacterium
RSREL

SEQ ID NO: 570396 - protein, 9 aa, Mycobacterium
RSRENARGL

SEQ ID NO: 570397 - protein, 10 aa, Mycobacterium
RSREQAAQIA

SEQ ID NO: 570398 - protein, 12 aa, Mycobacterium
RSREQAAQIGSY

SEQ ID NO: 570399 - protein, 7 aa, Mycobacterium
RSREQAR

SEQ ID NO: 570400 - protein, 11 aa, Mycobacterium
RSRERGDHPDL

SEQ ID NO: 570401 - protein, 15 aa, Mycobacterium
RSRERGYAADEAEQE

SEQ ID NO: 570402 - protein, 13 aa, Mycobacterium
RSRFGPVSAAPGA

SEQ ID NO: 570403 - protein, 14 aa, Mycobacterium
RSRGDGASRPDGKW

SEQ ID NO: 570404 - protein, 9 aa, Mycobacterium
RSRGDRQRD

SEQ ID NO: 570405 - protein, 5 aa, Mycobacterium
RSRGE

SEQ ID NO: 570406 - protein, 8 aa, Mycobacterium
RSRGGAHT

SEQ ID NO: 570407 - protein, 8 aa, Mycobacterium
RSRGGEHS

SEQ ID NO: 570408 - protein, 10 aa, Mycobacterium
RSRGGGGHPM

SEQ ID NO: 570409 - protein, 6 aa, Mycobacterium
RSRGGT

SEQ ID NO: 570410 - protein, 10 aa, Mycobacterium
RSRGGTAARV

SEQ ID NO: 570411 - protein, 13 aa, Mycobacterium
RSRGGTTIGQSAE

SEQ ID NO: 570412 - protein, 7 aa, Mycobacterium
RSRGHAL

SEQ ID NO: 570413 - protein, 23 aa, Mycobacterium
RSRGITGETIHPDGGFGLRDGHD

SEQ ID NO: 570414 - protein, 20 aa, Mycobacterium
RSRGITGGNAHPDGGFGMGA

SEQ ID NO: 570415 - protein, 10 aa, Mycobacterium
RSRGLDTETQ

SEQ ID NO: 570416 - protein, 7 aa, Mycobacterium
RSRGLRV

SEQ ID NO: 570417 - protein, 6 aa, Mycobacterium
RSRGRG

SEQ ID NO: 570418 - protein, 5 aa, Mycobacterium
RSRGS

SEQ ID NO: 570419 - protein, 6 aa, Mycobacterium
RSRGSS

SEQ ID NO: 570420 - protein, 7 aa, Mycobacterium
RSRGTGH

SEQ ID NO: 570421 - protein, 9 aa, Mycobacterium
RSRGVPPAL

SEQ ID NO: 570422 - protein, 7 aa, Mycobacterium
RSRHGDS

SEQ ID NO: 570423 - protein, 6 aa, Mycobacterium
RSRHGV

SEQ ID NO: 570424 - protein, 9 aa, Mycobacterium
RSRHPGAAD

SEQ ID NO: 570425 - protein, 5 aa, Mycobacterium
RSRHQ

SEQ ID NO: 570426 - protein, 9 aa, Mycobacterium
RSRHRRPAG

SEQ ID NO: 570427 - protein, 14 aa, Mycobacterium
RSRKAKFSENVNLM

SEQ ID NO: 570428 - protein, 11 aa, Mycobacterium
RSRKFTRDDEE

SEQ ID NO: 570429 - protein, 9 aa, Mycobacterium
RSRKGRRES

SEQ ID NO: 570430 - protein, 9 aa, Mycobacterium
RSRKVAEGR

SEQ ID NO: 570431 - protein, 7 aa, Mycobacterium
RSRLDGQ

SEQ ID NO: 570432 - protein, 8 aa, Mycobacterium
RSRLPADN

SEQ ID NO: 570433 - protein, 6 aa, Mycobacterium
RSRLRT

SEQ ID NO: 570434 - protein, 10 aa, Mycobacterium
RSRNGQLATL

SEQ ID NO: 570435 - protein, 7 aa, Mycobacterium
RSRNGVE

SEQ ID NO: 570436 - protein, 7 aa, Mycobacterium
RSRNSTD

SEQ ID NO: 570437 - protein, 6 aa, Mycobacterium
RSRPAF

SEQ ID NO: 570438 - protein, 19 aa, Mycobacterium
RSRPALRDQAAGAITGARY

SEQ ID NO: 570439 - protein, 14 aa, Mycobacterium
RSRPALRDQAAGAL

SEQ ID NO: 570440 - protein, 23 aa, Mycobacterium
RSRPDGPAGGRAVAGTAPSAGPL

SEQ ID NO: 570441 - protein, 11 aa, Mycobacterium
RSRPDGPGSMT

SEQ ID NO: 570442 - protein, 7 aa, Mycobacterium
RSRPDRA

SEQ ID NO: 570443 - protein, 8 aa, Mycobacterium
RSRPDRAI

SEQ ID NO: 570444 - protein, 8 aa, Mycobacterium
RSRPDTKD

SEQ ID NO: 570445 - protein, 7 aa, Mycobacterium
RSRPESF

SEQ ID NO: 570446 - protein, 6 aa, Mycobacterium
RSRPGA

SEQ ID NO: 570447 - protein, 8 aa, Mycobacterium
RSRPGADR

SEQ ID NO: 570448 - protein, 10 aa, Mycobacterium
RSRPGAGTAV

SEQ ID NO: 570449 - protein, 10 aa, Mycobacterium
RSRPGQAFAA

SEQ ID NO: 570450 - protein, 20 aa, Mycobacterium
RSRPGSGTTVTATIPLHQGG

SEQ ID NO: 570451 - protein, 11 aa, Mycobacterium
RSRPGSPDDSM

SEQ ID NO: 570452 - protein, 10 aa, Mycobacterium
RSRPPPASHA

SEQ ID NO: 570453 - protein, 12 aa, Mycobacterium
RSRPPPASRPTL

SEQ ID NO: 570454 - protein, 12 aa, Mycobacterium
RSRPPRDRAPRD

SEQ ID NO: 570455 - protein, 7 aa, Mycobacterium
RSRPPRY

SEQ ID NO: 570456 - protein, 11 aa, Mycobacterium
RSRPTAGRAPV

SEQ ID NO: 570457 - protein, 8 aa, Mycobacterium
RSRPTDTV

SEQ ID NO: 570458 - protein, 28 aa, Mycobacterium
RSRPTRGDSAGPAAPKRPTRARVLPDTG

SEQ ID NO: 570459 - protein, 11 aa, Mycobacterium
RSRPTTLNEDE

SEQ ID NO: 570460 - protein, 14 aa, Mycobacterium
RSRQAALDAKRGIA

SEQ ID NO: 570461 - protein, 10 aa, Mycobacterium
RSRQGGPGSM

SEQ ID NO: 570462 - protein, 7 aa, Mycobacterium
RSRQQAA

SEQ ID NO: 570463 - protein, 6 aa, Mycobacterium
RSRQQR

SEQ ID NO: 570464 - protein, 6 aa, Mycobacterium
RSRQSL

SEQ ID NO: 570465 - protein, 13 aa, Mycobacterium
RSRRAKNVAATAQ

SEQ ID NO: 570466 - protein, 16 aa, Mycobacterium
RSRRATAPLVAAHAGS

SEQ ID NO: 570467 - protein, 8 aa, Mycobacterium
RSRREAGA

SEQ ID NO: 570468 - protein, 10 aa, Mycobacterium
RSRRELPAAD

SEQ ID NO: 570469 - protein, 11 aa, Mycobacterium
RSRRGGGHPMP

SEQ ID NO: 570470 - protein, 10 aa, Mycobacterium
RSRRGGQFDP

SEQ ID NO: 570471 - protein, 12 aa, Mycobacterium
RSRRGGRGSVVP

SEQ ID NO: 570472 - protein, 13 aa, Mycobacterium
RSRRGPSGLRGGH

SEQ ID NO: 570473 - protein, 13 aa, Mycobacterium
RSRRGRDVTAEYP

SEQ ID NO: 570474 - protein, 7 aa, Mycobacterium
RSRRGRL

SEQ ID NO: 570475 - protein, 9 aa, Mycobacterium
RSRRHPRGD

SEQ ID NO: 570476 - protein, 24 aa, Mycobacterium
RSRRKASCGPHRQECSHDSSTLRP

SEQ ID NO: 570477 - protein, 9 aa, Mycobacterium
RSRRPGRSM

SEQ ID NO: 570478 - protein, 11 aa, Mycobacterium
RSRRPISAADE

SEQ ID NO: 570479 - protein, 18 aa, Mycobacterium
RSRRQSLAAGNPLAQASP

SEQ ID NO: 570480 - protein, 20 aa, Mycobacterium
RSRRRAKRAQKAAVKGQDLA

SEQ ID NO: 570481 - protein, 7 aa, Mycobacterium
RSRRRGE

SEQ ID NO: 570482 - protein, 13 aa, Mycobacterium
RSRRRGRQPDLSS

SEQ ID NO: 570483 - protein, 32 aa, Mycobacterium
RSRRRNPAAGPAARPAARCTAGNRSETGRSRQ

SEQ ID NO: 570484 - protein, 13 aa, Mycobacterium
RSRRRRRQPVRFP

SEQ ID NO: 570485 - protein, 13 aa, Mycobacterium
RSRRRTVVSEQAT

SEQ ID NO: 570486 - protein, 5 aa, Mycobacterium
RSRRS

SEQ ID NO: 570487 - protein, 15 aa, Mycobacterium
RSRRSALSDAQRQTW

SEQ ID NO: 570488 - protein, 8 aa, Mycobacterium
RSRRSATD

SEQ ID NO: 570489 - protein, 6 aa, Mycobacterium
RSRRSL

SEQ ID NO: 570490 - protein, 23 aa, Mycobacterium
RSRRSPGGGAGAEPWSATDVGPR

SEQ ID NO: 570491 - protein, 10 aa, Mycobacterium
RSRSGGQFDP

SEQ ID NO: 570492 - protein, 15 aa, Mycobacterium
RSRSGTGNTREERAM

SEQ ID NO: 570493 - protein, 47 aa, Mycobacterium
RSRSHASTACRTAEGSSNGSTTIPSAPVNRTASSLSTPTPNPERTID

SEQ ID NO: 570494 - protein, 10 aa, Mycobacterium
RSRSKAARKV

SEQ ID NO: 570495 - protein, 6 aa, Mycobacterium
RSRSLG

SEQ ID NO: 570496 - protein, 16 aa, Mycobacterium
RSRSRRVDRDPGSGDD

SEQ ID NO: 570497 - protein, 5 aa, Mycobacterium
RSRSS

SEQ ID NO: 570498 - protein, 7 aa, Mycobacterium
RSRSTLE

SEQ ID NO: 570499 - protein, 6 aa, Mycobacterium
RSRSVR

SEQ ID NO: 570500 - protein, 4 aa, Mycobacterium
RSRT

SEQ ID NO: 570501 - protein, 10 aa, Mycobacterium
RSRTDATETA

SEQ ID NO: 570502 - protein, 8 aa, Mycobacterium
RSRTGGSI

SEQ ID NO: 570503 - protein, 9 aa, Mycobacterium
RSRTRADAG

SEQ ID NO: 570504 - protein, 9 aa, Mycobacterium
RSRTRPGDD

SEQ ID NO: 570505 - protein, 8 aa, Mycobacterium
RSRTTGLR

SEQ ID NO: 570506 - protein, 7 aa, Mycobacterium
RSRTTQE

SEQ ID NO: 570507 - protein, 7 aa, Mycobacterium
RSRTTRE

SEQ ID NO: 570508 - protein, 9 aa, Mycobacterium
RSRTYPDTE

SEQ ID NO: 570509 - protein, 4 aa, Mycobacterium
RSRV

SEQ ID NO: 570510 - protein, 6 aa, Mycobacterium
RSRVGG

SEQ ID NO: 570511 - protein, 22 aa, Mycobacterium
RSRVKRRDHKSAVGLQPHKRTG

SEQ ID NO: 570512 - protein, 13 aa, Mycobacterium
RSRVVSGAPLALA

SEQ ID NO: 570513 - protein, 5 aa, Mycobacterium
RSRYG

SEQ ID NO: 570514 - protein, 9 aa, Mycobacterium
RSRYGDSPA

SEQ ID NO: 570515 - protein, 9 aa, Mycobacterium
RSSAAERAA

SEQ ID NO: 570516 - protein, 8 aa, Mycobacterium
RSSAAPVE

SEQ ID NO: 570517 - protein, 9 aa, Mycobacterium
RSSADRGTK

SEQ ID NO: 570518 - protein, 8 aa, Mycobacterium
RSSAEGQL

SEQ ID NO: 570519 - protein, 11 aa, Mycobacterium
RSSAGTGTAEA

SEQ ID NO: 570520 - protein, 11 aa, Mycobacterium
RSSANPDGRLP

SEQ ID NO: 570521 - protein, 5 aa, Mycobacterium
RSSAP

SEQ ID NO: 570522 - protein, 18 aa, Mycobacterium
RSSAQRYADAELYAAARI

SEQ ID NO: 570523 - protein, 8 aa, Mycobacterium
RSSASDDL

SEQ ID NO: 570524 - protein, 19 aa, Mycobacterium
RSSATAEDLPTASFAGQQE

SEQ ID NO: 570525 - protein, 10 aa, Mycobacterium
RSSATEPSAN

SEQ ID NO: 570526 - protein, 12 aa, Mycobacterium
RSSCPAQANGDR

SEQ ID NO: 570527 - protein, 14 aa, Mycobacterium
RSSDAADADGPANL

SEQ ID NO: 570528 - protein, 6 aa, Mycobacterium
RSSDEY

SEQ ID NO: 570529 - protein, 8 aa, Mycobacterium
RSSDGDAI

SEQ ID NO: 570530 - protein, 11 aa, Mycobacterium
RSSDKGRLTQA

SEQ ID NO: 570531 - protein, 5 aa, Mycobacterium
RSSDN

SEQ ID NO: 570532 - protein, 7 aa, Mycobacterium
RSSDTAE

SEQ ID NO: 570533 - protein, 8 aa, Mycobacterium
RSSDTAEL

SEQ ID NO: 570534 - protein, 10 aa, Mycobacterium
RSSDTAELSY

SEQ ID NO: 570535 - protein, 16 aa, Mycobacterium
RSSDTDARTAIWTWSR

SEQ ID NO: 570536 - protein, 10 aa, Mycobacterium
RSSDTEAERQ

SEQ ID NO: 570537 - protein, 12 aa, Mycobacterium
RSSDTGPAPEAV

SEQ ID NO: 570538 - protein, 8 aa, Mycobacterium
RSSEADID

SEQ ID NO: 570539 - protein, 10 aa, Mycobacterium
RSSEAREKYD

SEQ ID NO: 570540 - protein, 22 aa, Mycobacterium
RSSELGSLSPLAETFGKNMGWL

SEQ ID NO: 570541 - protein, 15 aa, Mycobacterium
RSSELHGSPDQGALN

SEQ ID NO: 570542 - protein, 10 aa, Mycobacterium
RSSENANTRT

SEQ ID NO: 570543 - protein, 5 aa, Mycobacterium
RSSER

SEQ ID NO: 570544 - protein, 6 aa, Mycobacterium
RSSERG

SEQ ID NO: 570545 - protein, 7 aa, Mycobacterium
RSSESGR

SEQ ID NO: 570546 - protein, 11 aa, Mycobacterium
RSSETDGMRRG

SEQ ID NO: 570547 - protein, 5 aa, Mycobacterium
RSSEV

SEQ ID NO: 570548 - protein, 8 aa, Mycobacterium
RSSFSGTE

SEQ ID NO: 570549 - protein, 5 aa, Mycobacterium
RSSGA

SEQ ID NO: 570550 - protein, 9 aa, Mycobacterium
RSSGDQYDV

SEQ ID NO: 570551 - protein, 9 aa, Mycobacterium
RSSGEDSGA

SEQ ID NO: 570552 - protein, 8 aa, Mycobacterium
RSSGEVSM

SEQ ID NO: 570553 - protein, 5 aa, Mycobacterium
RSSGG

SEQ ID NO: 570554 - protein, 8 aa, Mycobacterium
RSSGGLTD

SEQ ID NO: 570555 - protein, 10 aa, Mycobacterium
RSSGGNGSGR

SEQ ID NO: 570556 - protein, 16 aa, Mycobacterium
RSSGLAAGVTEAGLSR

SEQ ID NO: 570557 - protein, 9 aa, Mycobacterium
RSSGNPVET

SEQ ID NO: 570558 - protein, 9 aa, Mycobacterium
RSSGPRLSG

SEQ ID NO: 570559 - protein, 6 aa, Mycobacterium
RSSGQV

SEQ ID NO: 570560 - protein, 9 aa, Mycobacterium
RSSGSSGSI

SEQ ID NO: 570561 - protein, 5 aa, Mycobacterium
RSSHA

SEQ ID NO: 570562 - protein, 9 aa, Mycobacterium
RSSHAAGGG

SEQ ID NO: 570563 - protein, 5 aa, Mycobacterium
RSSHQ

SEQ ID NO: 570564 - protein, 12 aa, Mycobacterium
RSSHTDSGPSDV

SEQ ID NO: 570565 - protein, 5 aa, Mycobacterium
RSSIR

SEQ ID NO: 570566 - protein, 12 aa, Mycobacterium
RSSKGAGPNSNG

SEQ ID NO: 570567 - protein, 8 aa, Mycobacterium
RSSKGDDV

SEQ ID NO: 570568 - protein, 9 aa, Mycobacterium
RSSKIGGRP

SEQ ID NO: 570569 - protein, 9 aa, Mycobacterium
RSSKPERVA

SEQ ID NO: 570570 - protein, 9 aa, Mycobacterium
RSSKQSHDK

SEQ ID NO: 570571 - protein, 9 aa, Mycobacterium
RSSKTHGAS

SEQ ID NO: 570572 - protein, 4 aa, Mycobacterium
RSSL

SEQ ID NO: 570573 - protein, 17 aa, Mycobacterium
RSSLGGAATTEAPWDDA

SEQ ID NO: 570574 - protein, 7 aa, Mycobacterium
RSSLQAG

SEQ ID NO: 570575 - protein, 5 aa, Mycobacterium
RSSLR

SEQ ID NO: 570576 - protein, 9 aa, Mycobacterium
RSSLTRTES

SEQ ID NO: 570577 - protein, 6 aa, Mycobacterium
RSSLTT

SEQ ID NO: 570578 - protein, 8 aa, Mycobacterium
RSSNGQPL

SEQ ID NO: 570579 - protein, 8 aa, Mycobacterium
RSSPAELG

SEQ ID NO: 570580 - protein, 5 aa, Mycobacterium
RSSPD

SEQ ID NO: 570581 - protein, 7 aa, Mycobacterium
RSSPDDL

SEQ ID NO: 570582 - protein, 8 aa, Mycobacterium
RSSPNGGK

SEQ ID NO: 570583 - protein, 9 aa, Mycobacterium
RSSPPAPTH

SEQ ID NO: 570584 - protein, 11 aa, Mycobacterium
RSSPSSAGPLA

SEQ ID NO: 570585 - protein, 10 aa, Mycobacterium
RSSPSSAGSL

SEQ ID NO: 570586 - protein, 12 aa, Mycobacterium
RSSPVGKQTPSA

SEQ ID NO: 570587 - protein, 10 aa, Mycobacterium
RSSQDLGDLQ

SEQ ID NO: 570588 - protein, 10 aa, Mycobacterium
RSSQPDLPAH

SEQ ID NO: 570589 - protein, 4 aa, Mycobacterium
RSSR

SEQ ID NO: 570590 - protein, 14 aa, Mycobacterium
RSSRALAEASERVR

SEQ ID NO: 570591 - protein, 7 aa, Mycobacterium
RSSRDMT

SEQ ID NO: 570592 - protein, 6 aa, Mycobacterium
RSSREH

SEQ ID NO: 570593 - protein, 16 aa, Mycobacterium
RSSREVARRGPGQVPA

SEQ ID NO: 570594 - protein, 15 aa, Mycobacterium
RSSRGPDRVHTAPAP

SEQ ID NO: 570595 - protein, 5 aa, Mycobacterium
RSSRI

SEQ ID NO: 570596 - protein, 7 aa, Mycobacterium
RSSRPTI

SEQ ID NO: 570597 - protein, 10 aa, Mycobacterium
RSSRRYPRSK

SEQ ID NO: 570598 - protein, 9 aa, Mycobacterium
RSSSADIEK

SEQ ID NO: 570599 - protein, 7 aa, Mycobacterium
RSSSDVP

SEQ ID NO: 570600 - protein, 8 aa, Mycobacterium
RSSSGRVP

SEQ ID NO: 570601 - protein, 8 aa, Mycobacterium
RSSSPALA

SEQ ID NO: 570602 - protein, 9 aa, Mycobacterium
RSSSPERIR

SEQ ID NO: 570603 - protein, 9 aa, Mycobacterium
RSSSPSSTC

SEQ ID NO: 570604 - protein, 8 aa, Mycobacterium
RSSSQYAA

SEQ ID NO: 570605 - protein, 12 aa, Mycobacterium
RSSSVGKQTPSA

SEQ ID NO: 570606 - protein, 6 aa, Mycobacterium
RSSTAA

SEQ ID NO: 570607 - protein, 10 aa, Mycobacterium
RSSTAERMNP

SEQ ID NO: 570608 - protein, 8 aa, Mycobacterium
RSSTDGTR

SEQ ID NO: 570609 - protein, 10 aa, Mycobacterium
RSSTENPGPR

SEQ ID NO: 570610 - protein, 11 aa, Mycobacterium
RSSTGERENPY

SEQ ID NO: 570611 - protein, 8 aa, Mycobacterium
RSSTSPVT

SEQ ID NO: 570612 - protein, 7 aa, Mycobacterium
RSSTTSY

SEQ ID NO: 570613 - protein, 7 aa, Mycobacterium
RSSVDDA

SEQ ID NO: 570614 - protein, 9 aa, Mycobacterium
RSSVQEGDV

SEQ ID NO: 570615 - protein, 5 aa, Mycobacterium
RSSVT

SEQ ID NO: 570616 - protein, 6 aa, Mycobacterium
RSSVTR

SEQ ID NO: 570617 - protein, 4 aa, Mycobacterium
RSSW

SEQ ID NO: 570618 - protein, 7 aa, Mycobacterium
RSSWSRT

SEQ ID NO: 570619 - protein, 6 aa, Mycobacterium
RSTAAA

SEQ ID NO: 570620 - protein, 7 aa, Mycobacterium
RSTAEVD

SEQ ID NO: 570621 - protein, 8 aa, Mycobacterium
RSTAGTGY

SEQ ID NO: 570622 - protein, 16 aa, Mycobacterium
RSTALAETKQAIGHAT

SEQ ID NO: 570623 - protein, 14 aa, Mycobacterium
RSTAPAAAPEPSRW

SEQ ID NO: 570624 - protein, 7 aa, Mycobacterium
RSTAPGN

SEQ ID NO: 570625 - protein, 8 aa, Mycobacterium
RSTAPKTT

SEQ ID NO: 570626 - protein, 14 aa, Mycobacterium
RSTARTAGRGRPAT

SEQ ID NO: 570627 - protein, 9 aa, Mycobacterium
RSTATSTRT

SEQ ID NO: 570628 - protein, 6 aa, Mycobacterium
RSTAYR

SEQ ID NO: 570629 - protein, 10 aa, Mycobacterium
RSTDALAGQA

SEQ ID NO: 570630 - protein, 6 aa, Mycobacterium
RSTDAQ

SEQ ID NO: 570631 - protein, 7 aa, Mycobacterium
RSTDDTA

SEQ ID NO: 570632 - protein, 6 aa, Mycobacterium
RSTDDV

SEQ ID NO: 570633 - protein, 14 aa, Mycobacterium
RSTDGQSPVTDDDI

SEQ ID NO: 570634 - protein, 8 aa, Mycobacterium
RSTDPAAP

SEQ ID NO: 570635 - protein, 9 aa, Mycobacterium
RSTDPDISA

SEQ ID NO: 570636 - protein, 19 aa, Mycobacterium
RSTDRSGHRHAPGPLRAGR

SEQ ID NO: 570637 - protein, 10 aa, Mycobacterium
RSTDRSSREA

SEQ ID NO: 570638 - protein, 10 aa, Mycobacterium
RSTEAREKYD

SEQ ID NO: 570639 - protein, 7 aa, Mycobacterium
RSTEELA

SEQ ID NO: 570640 - protein, 17 aa, Mycobacterium
RSTEELPDSDYRKTNPR

SEQ ID NO: 570641 - protein, 17 aa, Mycobacterium
RSTEGLPDSDYRKTNPR

SEQ ID NO: 570642 - protein, 5 aa, Mycobacterium
RSTEL

SEQ ID NO: 570643 - protein, 7 aa, Mycobacterium
RSTEPAH

SEQ ID NO: 570644 - protein, 9 aa, Mycobacterium
RSTEQSPYA

SEQ ID NO: 570645 - protein, 5 aa, Mycobacterium
RSTER

SEQ ID NO: 570646 - protein, 6 aa, Mycobacterium
RSTETH

SEQ ID NO: 570647 - protein, 11 aa, Mycobacterium
RSTETPKGQPA

SEQ ID NO: 570648 - protein, 12 aa, Mycobacterium
RSTFAESADRTR

SEQ ID NO: 570649 - protein, 5 aa, Mycobacterium
RSTFE

SEQ ID NO: 570650 - protein, 6 aa, Mycobacterium
RSTGAA

SEQ ID NO: 570651 - protein, 11 aa, Mycobacterium
RSTGADPAPEL

SEQ ID NO: 570652 - protein, 7 aa, Mycobacterium
RSTGAEV

SEQ ID NO: 570653 - protein, 6 aa, Mycobacterium
RSTGAK

SEQ ID NO: 570654 - protein, 10 aa, Mycobacterium
RSTGAVPTDT

SEQ ID NO: 570655 - protein, 8 aa, Mycobacterium
RSTGDGGL

SEQ ID NO: 570656 - protein, 9 aa, Mycobacterium
RSTGDRAIP

SEQ ID NO: 570657 - protein, 9 aa, Mycobacterium
RSTGEKHTI

SEQ ID NO: 570658 - protein, 7 aa, Mycobacterium
RSTGGAA

SEQ ID NO: 570659 - protein, 5 aa, Mycobacterium
RSTGI

SEQ ID NO: 570660 - protein, 8 aa, Mycobacterium
RSTGNAPY

SEQ ID NO: 570661 - protein, 7 aa, Mycobacterium
RSTGNSV

SEQ ID NO: 570662 - protein, 10 aa, Mycobacterium
RSTGQRCGPV

SEQ ID NO: 570663 - protein, 29 aa, Mycobacterium
RSTGRDMSAKYKETSTGGLATAVPVNVVE

SEQ ID NO: 570664 - protein, 8 aa, Mycobacterium
RSTGRVRS

SEQ ID NO: 570665 - protein, 14 aa, Mycobacterium
RSTGSDVTGRFLEE

SEQ ID NO: 570666 - protein, 8 aa, Mycobacterium
RSTGSIDP

SEQ ID NO: 570667 - protein, 6 aa, Mycobacterium
RSTGTR

SEQ ID NO: 570668 - protein, 18 aa, Mycobacterium
RSTGTSGVPSVARRDSMT

SEQ ID NO: 570669 - protein, 7 aa, Mycobacterium
RSTGVSP

SEQ ID NO: 570670 - protein, 9 aa, Mycobacterium
RSTHAGDVA

SEQ ID NO: 570671 - protein, 11 aa, Mycobacterium
RSTISDGQQAT

SEQ ID NO: 570672 - protein, 36 aa, Mycobacterium
RSTKEAEGQKGAAAGAAGAERAPVSAAGSKPTQQRS

SEQ ID NO: 570673 - protein, 6 aa, Mycobacterium
RSTLEE

SEQ ID NO: 570674 - protein, 6 aa, Mycobacterium
RSTLPG

SEQ ID NO: 570675 - protein, 12 aa, Mycobacterium
RSTLPRDLTERG

SEQ ID NO: 570676 - protein, 6 aa, Mycobacterium
RSTLQA

SEQ ID NO: 570677 - protein, 14 aa, Mycobacterium
RSTNRAGGLEGGMT

SEQ ID NO: 570678 - protein, 19 aa, Mycobacterium
RSTNRAGGLEGGMTNGQPL

SEQ ID NO: 570679 - protein, 5 aa, Mycobacterium
RSTPA

SEQ ID NO: 570680 - protein, 19 aa, Mycobacterium
RSTPAGPDGEPDWTPYREG

SEQ ID NO: 570681 - protein, 10 aa, Mycobacterium
RSTPKGPEVI

SEQ ID NO: 570682 - protein, 5 aa, Mycobacterium
RSTPL

SEQ ID NO: 570683 - protein, 12 aa, Mycobacterium
RSTPQPSRAADA

SEQ ID NO: 570684 - protein, 8 aa, Mycobacterium
RSTPRAGD

SEQ ID NO: 570685 - protein, 7 aa, Mycobacterium
RSTPRVG

SEQ ID NO: 570686 - protein, 11 aa, Mycobacterium
RSTPSRPYSPR

SEQ ID NO: 570687 - protein, 14 aa, Mycobacterium
RSTQLGRDETLEDT

SEQ ID NO: 570688 - protein, 14 aa, Mycobacterium
RSTQLGRDETLGDT

SEQ ID NO: 570689 - protein, 15 aa, Mycobacterium
RSTQLGREETLEDTG

SEQ ID NO: 570690 - protein, 14 aa, Mycobacterium
RSTQLGREETLPDT

SEQ ID NO: 570691 - protein, 4 aa, Mycobacterium
RSTR

SEQ ID NO: 570692 - protein, 5 aa, Mycobacterium
RSTRA

SEQ ID NO: 570693 - protein, 6 aa, Mycobacterium
RSTRAA

SEQ ID NO: 570694 - protein, 7 aa, Mycobacterium
RSTRAGV

SEQ ID NO: 570695 - protein, 6 aa, Mycobacterium
RSTRDF

SEQ ID NO: 570696 - protein, 8 aa, Mycobacterium
RSTRDGNQ

SEQ ID NO: 570697 - protein, 10 aa, Mycobacterium
RSTRDGVATS

SEQ ID NO: 570698 - protein, 6 aa, Mycobacterium
RSTRIG

SEQ ID NO: 570699 - protein, 12 aa, Mycobacterium
RSTRPATDTERE

SEQ ID NO: 570700 - protein, 6 aa, Mycobacterium
RSTRPY

SEQ ID NO: 570701 - protein, 5 aa, Mycobacterium
RSTRQ

SEQ ID NO: 570702 - protein, 12 aa, Mycobacterium
RSTRRPDPRIAS

SEQ ID NO: 570703 - protein, 9 aa, Mycobacterium
RSTSDLPAE

SEQ ID NO: 570704 - protein, 10 aa, Mycobacterium
RSTSELPGEL

SEQ ID NO: 570705 - protein, 11 aa, Mycobacterium
RSTSGGSHQPV

SEQ ID NO: 570706 - protein, 7 aa, Mycobacterium
RSTSLTR

SEQ ID NO: 570707 - protein, 10 aa, Mycobacterium
RSTSPRRTDV

SEQ ID NO: 570708 - protein, 8 aa, Mycobacterium
RSTSSHGW

SEQ ID NO: 570709 - protein, 19 aa, Mycobacterium
RSTSSSSLDDHTSDKYRQQ

SEQ ID NO: 570710 - protein, 6 aa, Mycobacterium
RSTSVR

SEQ ID NO: 570711 - protein, 4 aa, Mycobacterium
RSTT

SEQ ID NO: 570712 - protein, 6 aa, Mycobacterium
RSTTDL

SEQ ID NO: 570713 - protein, 12 aa, Mycobacterium
RSTTDPTGLRTN

SEQ ID NO: 570714 - protein, 7 aa, Mycobacterium
RSTTGLG

SEQ ID NO: 570715 - protein, 5 aa, Mycobacterium
RSTTL

SEQ ID NO: 570716 - protein, 7 aa, Mycobacterium
RSTTTER

SEQ ID NO: 570717 - protein, 7 aa, Mycobacterium
RSTVAQQ

SEQ ID NO: 570718 - protein, 5 aa, Mycobacterium
RSTVP

SEQ ID NO: 570719 - protein, 7 aa, Mycobacterium
RSTYPRI

SEQ ID NO: 570720 - protein, 7 aa, Mycobacterium
RSTYTSV

SEQ ID NO: 570721 - protein, 4 aa, Mycobacterium
RSVA

SEQ ID NO: 570722 - protein, 8 aa, Mycobacterium
RSVAAGGR

SEQ ID NO: 570723 - protein, 8 aa, Mycobacterium
RSVADNET

SEQ ID NO: 570724 - protein, 6 aa, Mycobacterium
RSVAER

SEQ ID NO: 570725 - protein, 5 aa, Mycobacterium
RSVAP

SEQ ID NO: 570726 - protein, 9 aa, Mycobacterium
RSVAPGQLR

SEQ ID NO: 570727 - protein, 4 aa, Mycobacterium
RSVD

SEQ ID NO: 570728 - protein, 9 aa, Mycobacterium
RSVDDPPFD

SEQ ID NO: 570729 - protein, 13 aa, Mycobacterium
RSVDERVERLIAS

SEQ ID NO: 570730 - protein, 9 aa, Mycobacterium
RSVDPTTLE

SEQ ID NO: 570731 - protein, 13 aa, Mycobacterium
RSVEEGKPPPDMD

SEQ ID NO: 570732 - protein, 6 aa, Mycobacterium
RSVEQA

SEQ ID NO: 570733 - protein, 7 aa, Mycobacterium
RSVEQRR

SEQ ID NO: 570734 - protein, 4 aa, Mycobacterium
RSVG

SEQ ID NO: 570735 - protein, 20 aa, Mycobacterium
RSVGAQRALGRAGSSMSPAE

SEQ ID NO: 570736 - protein, 10 aa, Mycobacterium
RSVGDERATD

SEQ ID NO: 570737 - protein, 5 aa, Mycobacterium
RSVGE

SEQ ID NO: 570738 - protein, 7 aa, Mycobacterium
RSVGEVR

SEQ ID NO: 570739 - protein, 10 aa, Mycobacterium
RSVGGAAERL

SEQ ID NO: 570740 - protein, 5 aa, Mycobacterium
RSVGQ

SEQ ID NO: 570741 - protein, 15 aa, Mycobacterium
RSVHPGHKRRTPARH

SEQ ID NO: 570742 - protein, 10 aa, Mycobacterium
RSVKPTGSAA

SEQ ID NO: 570743 - protein, 7 aa, Mycobacterium
RSVKTDE

SEQ ID NO: 570744 - protein, 15 aa, Mycobacterium
RSVNEGFSGGEKKRH

SEQ ID NO: 570745 - protein, 4 aa, Mycobacterium
RSVP

SEQ ID NO: 570746 - protein, 5 aa, Mycobacterium
RSVPA

SEQ ID NO: 570747 - protein, 12 aa, Mycobacterium
RSVPDMSKSPHL

SEQ ID NO: 570748 - protein, 19 aa, Mycobacterium
RSVPGTLRKGDPTDKTGTT

SEQ ID NO: 570749 - protein, 5 aa, Mycobacterium
RSVPL

SEQ ID NO: 570750 - protein, 8 aa, Mycobacterium
RSVPNADV

SEQ ID NO: 570751 - protein, 14 aa, Mycobacterium
RSVPPPPAPEVPSP

SEQ ID NO: 570752 - protein, 5 aa, Mycobacterium
RSVPS

SEQ ID NO: 570753 - protein, 14 aa, Mycobacterium
RSVPSAKVHRLDTS

SEQ ID NO: 570754 - protein, 6 aa, Mycobacterium
RSVPTA

SEQ ID NO: 570755 - protein, 19 aa, Mycobacterium
RSVPVGSDGDEGSCPVGGQ

SEQ ID NO: 570756 - protein, 4 aa, Mycobacterium
RSVQ

SEQ ID NO: 570757 - protein, 18 aa, Mycobacterium
RSVQPGYEGLSRTPAPVA

SEQ ID NO: 570758 - protein, 6 aa, Mycobacterium
RSVRPA

SEQ ID NO: 570759 - protein, 12 aa, Mycobacterium
RSVRTEGAALDP

SEQ ID NO: 570760 - protein, 6 aa, Mycobacterium
RSVSIT

SEQ ID NO: 570761 - protein, 7 aa, Mycobacterium
RSVSPGW

SEQ ID NO: 570762 - protein, 7 aa, Mycobacterium
RSVSQQV

SEQ ID NO: 570763 - protein, 12 aa, Mycobacterium
RSVSREFGHGRE

SEQ ID NO: 570764 - protein, 4 aa, Mycobacterium
RSVT

SEQ ID NO: 570765 - protein, 5 aa, Mycobacterium
RSVTA

SEQ ID NO: 570766 - protein, 68 aa, Mycobacterium
RSVTAAEGDALARRAAESGQGHDDSEKFRGRADERTYRPVSGSTPGRTNRKDKTMAKGHHRSATTGRY

SEQ ID NO: 570767 - protein, 5 aa, Mycobacterium
RSVTE

SEQ ID NO: 570768 - protein, 7 aa, Mycobacterium
RSVTESG

SEQ ID NO: 570769 - protein, 7 aa, Mycobacterium
RSVTGKD

SEQ ID NO: 570770 - protein, 10 aa, Mycobacterium
RSVTQAKGIT

SEQ ID NO: 570771 - protein, 5 aa, Mycobacterium
RSVTS

SEQ ID NO: 570772 - protein, 7 aa, Mycobacterium
RSVTSTT

SEQ ID NO: 570773 - protein, 7 aa, Mycobacterium
RSWANPA

SEQ ID NO: 570774 - protein, 13 aa, Mycobacterium
RSWENGVGDQTDS

SEQ ID NO: 570775 - protein, 4 aa, Mycobacterium
RSWG

SEQ ID NO: 570776 - protein, 4 aa, Mycobacterium
RSWP

SEQ ID NO: 570777 - protein, 14 aa, Mycobacterium
RSWPAGDAVDPATR

SEQ ID NO: 570778 - protein, 7 aa, Mycobacterium
RSWPRER

SEQ ID NO: 570779 - protein, 10 aa, Mycobacterium
RSWPRERTRA

SEQ ID NO: 570780 - protein, 5 aa, Mycobacterium
RSWQT

SEQ ID NO: 570781 - protein, 4 aa, Mycobacterium
RSWT

SEQ ID NO: 570782 - protein, 7 aa, Mycobacterium
RSWTNPT

SEQ ID NO: 570783 - protein, 18 aa, Mycobacterium
RSYADDRNRPDLRGTSRM

SEQ ID NO: 570784 - protein, 8 aa, Mycobacterium
RSYAGPER

SEQ ID NO: 570785 - protein, 11 aa, Mycobacterium
RSYARPDPTHT

SEQ ID NO: 570786 - protein, 7 aa, Mycobacterium
RSYDADS

SEQ ID NO: 570787 - protein, 12 aa, Mycobacterium
RSYDGAKAYSQS

SEQ ID NO: 570788 - protein, 7 aa, Mycobacterium
RSYDNTD

SEQ ID NO: 570789 - protein, 11 aa, Mycobacterium
RSYDPERVHRP

SEQ ID NO: 570790 - protein, 4 aa, Mycobacterium
RSYE

SEQ ID NO: 570791 - protein, 22 aa, Mycobacterium
RSYEPSPSVRAGQATALPGTIG

SEQ ID NO: 570792 - protein, 5 aa, Mycobacterium
RSYGG

SEQ ID NO: 570793 - protein, 6 aa, Mycobacterium
RSYPRG

SEQ ID NO: 570794 - protein, 5 aa, Mycobacterium
RSYRD

SEQ ID NO: 570795 - protein, 12 aa, Mycobacterium
RSYRDEKPQESR

SEQ ID NO: 570796 - protein, 14 aa, Mycobacterium
RSYRPTPPDDPAYR

SEQ ID NO: 570797 - protein, 10 aa, Mycobacterium
RSYRTRRTRV

SEQ ID NO: 570798 - protein, 11 aa, Mycobacterium
RSYSDDEAAGL

SEQ ID NO: 570799 - protein, 15 aa, Mycobacterium
RSYTDRKIPIVICDP

SEQ ID NO: 570800 - protein, 21 aa, Mycobacterium
RSYTEGASRWDADDERPPAGE

SEQ ID NO: 570801 - protein, 7 aa, Mycobacterium
RSYTRKP

SEQ ID NO: 570802 - protein, 10 aa, Mycobacterium
RSYTSQGPSR

SEQ ID NO: 570803 - protein, 8 aa, Mycobacterium
RTAAAGYS

SEQ ID NO: 570804 - protein, 15 aa, Mycobacterium
RTAAASELTGLPSVP

SEQ ID NO: 570805 - protein, 11 aa, Mycobacterium
RTAAASVGSVT

SEQ ID NO: 570806 - protein, 5 aa, Mycobacterium
RTAAD

SEQ ID NO: 570807 - protein, 7 aa, Mycobacterium
RTAADNV

SEQ ID NO: 570808 - protein, 5 aa, Mycobacterium
RTAAE

SEQ ID NO: 570809 - protein, 6 aa, Mycobacterium
RTAAEQ

SEQ ID NO: 570810 - protein, 10 aa, Mycobacterium
RTAAERLKSD

SEQ ID NO: 570811 - protein, 12 aa, Mycobacterium
RTAAESATLPRP

SEQ ID NO: 570812 - protein, 10 aa, Mycobacterium
RTAAGQGKFR

SEQ ID NO: 570813 - protein, 9 aa, Mycobacterium
RTAANHNPR

SEQ ID NO: 570814 - protein, 10 aa, Mycobacterium
RTAANSLPRR

SEQ ID NO: 570815 - protein, 15 aa, Mycobacterium
RTAAPGQRWAPPPTA

SEQ ID NO: 570816 - protein, 8 aa, Mycobacterium
RTAAPTSD

SEQ ID NO: 570817 - protein, 6 aa, Mycobacterium
RTAARA

SEQ ID NO: 570818 - protein, 14 aa, Mycobacterium
RTAARLDEDVEKAG

SEQ ID NO: 570819 - protein, 6 aa, Mycobacterium
RTAARR

SEQ ID NO: 570820 - protein, 17 aa, Mycobacterium
RTAARRGAGAGPHSESG

SEQ ID NO: 570821 - protein, 11 aa, Mycobacterium
RTAASDNGRDP

SEQ ID NO: 570822 - protein, 11 aa, Mycobacterium
RTAASEWTAEG

SEQ ID NO: 570823 - protein, 10 aa, Mycobacterium
RTAASGAEAL

SEQ ID NO: 570824 - protein, 5 aa, Mycobacterium
RTAAT

SEQ ID NO: 570825 - protein, 6 aa, Mycobacterium
RTAATA

SEQ ID NO: 570826 - protein, 9 aa, Mycobacterium
RTAATEHPV

SEQ ID NO: 570827 - protein, 17 aa, Mycobacterium
RTAATKVNRSAMIAARG

SEQ ID NO: 570828 - protein, 14 aa, Mycobacterium
RTACGAPSTELGPV

SEQ ID NO: 570829 - protein, 19 aa, Mycobacterium
RTADADTGRNARPTNEQLQ

SEQ ID NO: 570830 - protein, 14 aa, Mycobacterium
RTADASMDPVRGQG

SEQ ID NO: 570831 - protein, 9 aa, Mycobacterium
RTADDTDPF

SEQ ID NO: 570832 - protein, 11 aa, Mycobacterium
RTADESTPAWP

SEQ ID NO: 570833 - protein, 10 aa, Mycobacterium
RTADGELPMP

SEQ ID NO: 570834 - protein, 15 aa, Mycobacterium
RTADGIGVGPDGSGV

SEQ ID NO: 570835 - protein, 6 aa, Mycobacterium
RTADGV

SEQ ID NO: 570836 - protein, 8 aa, Mycobacterium
RTADGYGS

SEQ ID NO: 570837 - protein, 10 aa, Mycobacterium
RTADNKESAI

SEQ ID NO: 570838 - protein, 5 aa, Mycobacterium
RTADP

SEQ ID NO: 570839 - protein, 9 aa, Mycobacterium
RTADPNDAR

SEQ ID NO: 570840 - protein, 12 aa, Mycobacterium
RTADPSARRIAD

SEQ ID NO: 570841 - protein, 9 aa, Mycobacterium
RTADRDVAD

SEQ ID NO: 570842 - protein, 19 aa, Mycobacterium
RTADRVPGEPGRRLTSREI

SEQ ID NO: 570843 - protein, 5 aa, Mycobacterium
RTADS

SEQ ID NO: 570844 - protein, 7 aa, Mycobacterium
RTADSED

SEQ ID NO: 570845 - protein, 19 aa, Mycobacterium
RTADSGAGSGDAPAFTVDQ

SEQ ID NO: 570846 - protein, 7 aa, Mycobacterium
RTADSNY

SEQ ID NO: 570847 - protein, 8 aa, Mycobacterium
RTADSSGR

SEQ ID NO: 570848 - protein, 8 aa, Mycobacterium
RTADSSSR

SEQ ID NO: 570849 - protein, 8 aa, Mycobacterium
RTAEASKE

SEQ ID NO: 570850 - protein, 11 aa, Mycobacterium
RTAEDAARAGL

SEQ ID NO: 570851 - protein, 12 aa, Mycobacterium
RTAEDAGRDPAT

SEQ ID NO: 570852 - protein, 11 aa, Mycobacterium
RTAEDTHGPTG

SEQ ID NO: 570853 - protein, 23 aa, Mycobacterium
RTAEEFRRTESRSASRLDDTGKQ

SEQ ID NO: 570854 - protein, 17 aa, Mycobacterium
RTAEERANAVRGRADSL

SEQ ID NO: 570855 - protein, 10 aa, Mycobacterium
RTAEGKSKAE

SEQ ID NO: 570856 - protein, 18 aa, Mycobacterium
RTAEGTPERPYTGPVPDD

SEQ ID NO: 570857 - protein, 5 aa, Mycobacterium
RTAEL

SEQ ID NO: 570858 - protein, 7 aa, Mycobacterium
RTAENSA

SEQ ID NO: 570859 - protein, 7 aa, Mycobacterium
RTAEQAG

SEQ ID NO: 570860 - protein, 7 aa, Mycobacterium
RTAERDE

SEQ ID NO: 570861 - protein, 10 aa, Mycobacterium
RTAERTRVSY

SEQ ID NO: 570862 - protein, 11 aa, Mycobacterium
RTAETDGGGDI

SEQ ID NO: 570863 - protein, 7 aa, Mycobacterium
RTAETDV

SEQ ID NO: 570864 - protein, 5 aa, Mycobacterium
RTAEV

SEQ ID NO: 570865 - protein, 15 aa, Mycobacterium
RTAEYPDYRGYAGQV

SEQ ID NO: 570866 - protein, 7 aa, Mycobacterium
RTAFPDQ

SEQ ID NO: 570867 - protein, 14 aa, Mycobacterium
RTAGADPNDLGRDD

SEQ ID NO: 570868 - protein, 10 aa, Mycobacterium
RTAGAPDAVG

SEQ ID NO: 570869 - protein, 10 aa, Mycobacterium
RTAGDDRTTV

SEQ ID NO: 570870 - protein, 9 aa, Mycobacterium
RTAGDPSTL

SEQ ID NO: 570871 - protein, 8 aa, Mycobacterium
RTAGESLN

SEQ ID NO: 570872 - protein, 12 aa, Mycobacterium
RTAGGGVSGDDV

SEQ ID NO: 570873 - protein, 18 aa, Mycobacterium
RTAGGKGYASRTPASRRY

SEQ ID NO: 570874 - protein, 18 aa, Mycobacterium
RTAGGKGYASRTSVSRRY

SEQ ID NO: 570875 - protein, 11 aa, Mycobacterium
RTAGKDPVRRG

SEQ ID NO: 570876 - protein, 7 aa, Mycobacterium
RTAGKIE

SEQ ID NO: 570877 - protein, 6 aa, Mycobacterium
RTAGKV

SEQ ID NO: 570878 - protein, 8 aa, Mycobacterium
RTAGPDNL

SEQ ID NO: 570879 - protein, 13 aa, Mycobacterium
RTAGPTQVARRDT

SEQ ID NO: 570880 - protein, 12 aa, Mycobacterium
RTAGQAAASNAV

SEQ ID NO: 570881 - protein, 6 aa, Mycobacterium
RTAGRG

SEQ ID NO: 570882 - protein, 8 aa, Mycobacterium
RTAGSGAD

SEQ ID NO: 570883 - protein, 7 aa, Mycobacterium
RTAGSRV

SEQ ID NO: 570884 - protein, 16 aa, Mycobacterium
RTAGTARTSRTQHPRP

SEQ ID NO: 570885 - protein, 5 aa, Mycobacterium
RTAGV

SEQ ID NO: 570886 - protein, 10 aa, Mycobacterium
RTAGVPDGTT

SEQ ID NO: 570887 - protein, 12 aa, Mycobacterium
RTAGWKKKSRGR

SEQ ID NO: 570888 - protein, 4 aa, Mycobacterium
RTAH

SEQ ID NO: 570889 - protein, 5 aa, Mycobacterium
RTAHA

SEQ ID NO: 570890 - protein, 12 aa, Mycobacterium
RTAHGDEDHSGP

SEQ ID NO: 570891 - protein, 13 aa, Mycobacterium
RTAHGDEEDRTGP

SEQ ID NO: 570892 - protein, 13 aa, Mycobacterium
RTAHGDQDTSGPL

SEQ ID NO: 570893 - protein, 12 aa, Mycobacterium
RTAHGEEDHSGP

SEQ ID NO: 570894 - protein, 6 aa, Mycobacterium
RTAIGR

SEQ ID NO: 570895 - protein, 7 aa, Mycobacterium
RTAKFDS

SEQ ID NO: 570896 - protein, 13 aa, Mycobacterium
RTAKPTKVARRDT

SEQ ID NO: 570897 - protein, 5 aa, Mycobacterium
RTALD

SEQ ID NO: 570898 - protein, 7 aa, Mycobacterium
RTALDAD

SEQ ID NO: 570899 - protein, 5 aa, Mycobacterium
RTALQ

SEQ ID NO: 570900 - protein, 14 aa, Mycobacterium
RTALRSAGGPFGNH

SEQ ID NO: 570901 - protein, 5 aa, Mycobacterium
RTAMN

SEQ ID NO: 570902 - protein, 4 aa, Mycobacterium
RTAN

SEQ ID NO: 570903 - protein, 16 aa, Mycobacterium
RTANAGQGFQGFWRPT

SEQ ID NO: 570904 - protein, 8 aa, Mycobacterium
RTANDGKI

SEQ ID NO: 570905 - protein, 13 aa, Mycobacterium
RTANEDGTFKTDE

SEQ ID NO: 570906 - protein, 9 aa, Mycobacterium
RTANQDAFT

SEQ ID NO: 570907 - protein, 6 aa, Mycobacterium
RTANRK

SEQ ID NO: 570908 - protein, 5 aa, Mycobacterium
RTANT

SEQ ID NO: 570909 - protein, 5 aa, Mycobacterium
RTAPA

SEQ ID NO: 570910 - protein, 9 aa, Mycobacterium
RTAPAGARL

SEQ ID NO: 570911 - protein, 9 aa, Mycobacterium
RTAPALEAA

SEQ ID NO: 570912 - protein, 7 aa, Mycobacterium
RTAPARA

SEQ ID NO: 570913 - protein, 17 aa, Mycobacterium
RTAPFSEEAAKSPAAQK

SEQ ID NO: 570914 - protein, 10 aa, Mycobacterium
RTAPGQEPEL

SEQ ID NO: 570915 - protein, 9 aa, Mycobacterium
RTAPPEASS

SEQ ID NO: 570916 - protein, 9 aa, Mycobacterium
RTAPPEPAS

SEQ ID NO: 570917 - protein, 6 aa, Mycobacterium
RTAPPV

SEQ ID NO: 570918 - protein, 11 aa, Mycobacterium
RTAPQRRGQGI

SEQ ID NO: 570919 - protein, 6 aa, Mycobacterium
RTAPSV

SEQ ID NO: 570920 - protein, 5 aa, Mycobacterium
RTAPT

SEQ ID NO: 570921 - protein, 7 aa, Mycobacterium
RTAPTEV

SEQ ID NO: 570922 - protein, 15 aa, Mycobacterium
RTAPTPQGPWSPEQP

SEQ ID NO: 570923 - protein, 14 aa, Mycobacterium
RTAPVKDAVQPGRR

SEQ ID NO: 570924 - protein, 4 aa, Mycobacterium
RTAQ

SEQ ID NO: 570925 - protein, 6 aa, Mycobacterium
RTAQAT

SEQ ID NO: 570926 - protein, 6 aa, Mycobacterium
RTAQGP

SEQ ID NO: 570927 - protein, 8 aa, Mycobacterium
RTAQPGGL

SEQ ID NO: 570928 - protein, 17 aa, Mycobacterium
RTAQREWEARGPKGRAK

SEQ ID NO: 570929 - protein, 5 aa, Mycobacterium
RTAQV

SEQ ID NO: 570930 - protein, 6 aa, Mycobacterium
RTAQVE

SEQ ID NO: 570931 - protein, 6 aa, Mycobacterium
RTARAQ

SEQ ID NO: 570932 - protein, 8 aa, Mycobacterium
RTARDNAL

SEQ ID NO: 570933 - protein, 11 aa, Mycobacterium
RTARDRPTAPV

SEQ ID NO: 570934 - protein, 15 aa, Mycobacterium
RTAREARIGATLSER

SEQ ID NO: 570935 - protein, 9 aa, Mycobacterium
RTAREEATV

SEQ ID NO: 570936 - protein, 7 aa, Mycobacterium
RTARPGF

SEQ ID NO: 570937 - protein, 14 aa, Mycobacterium
RTARQPDSVARQRD

SEQ ID NO: 570938 - protein, 5 aa, Mycobacterium
RTARR

SEQ ID NO: 570939 - protein, 13 aa, Mycobacterium
RTARRGATDGRDA

SEQ ID NO: 570940 - protein, 9 aa, Mycobacterium
RTARSRRAP

SEQ ID NO: 570941 - protein, 8 aa, Mycobacterium
RTARTDPD

SEQ ID NO: 570942 - protein, 4 aa, Mycobacterium
RTAS

SEQ ID NO: 570943 - protein, 10 aa, Mycobacterium
RTASAAPDLA

SEQ ID NO: 570944 - protein, 19 aa, Mycobacterium
RTASADAIPGAGFTPGNEN

SEQ ID NO: 570945 - protein, 31 aa, Mycobacterium
RTASANATKSSSSGCVGSGPACRTSSQPRGA

SEQ ID NO: 570946 - protein, 9 aa, Mycobacterium
RTASDQRAD

SEQ ID NO: 570947 - protein, 10 aa, Mycobacterium
RTASGETGAL

SEQ ID NO: 570948 - protein, 7 aa, Mycobacterium
RTASGRI

SEQ ID NO: 570949 - protein, 6 aa, Mycobacterium
RTASGV

SEQ ID NO: 570950 - protein, 8 aa, Mycobacterium
RTASKAHS

SEQ ID NO: 570951 - protein, 7 aa, Mycobacterium
RTASLDS

SEQ ID NO: 570952 - protein, 8 aa, Mycobacterium
RTASPACD

SEQ ID NO: 570953 - protein, 6 aa, Mycobacterium
RTASPY

SEQ ID NO: 570954 - protein, 12 aa, Mycobacterium
RTASQRYSGTAD

SEQ ID NO: 570955 - protein, 7 aa, Mycobacterium
RTASRAP

SEQ ID NO: 570956 - protein, 6 aa, Mycobacterium
RTASRQ

SEQ ID NO: 570957 - protein, 12 aa, Mycobacterium
RTASRRPAAEGA

SEQ ID NO: 570958 - protein, 10 aa, Mycobacterium
RTASSGRPGG

SEQ ID NO: 570959 - protein, 5 aa, Mycobacterium
RTAST

SEQ ID NO: 570960 - protein, 16 aa, Mycobacterium
RTASTAYQDMVVLRKP

SEQ ID NO: 570961 - protein, 10 aa, Mycobacterium
RTASTDPGAV

SEQ ID NO: 570962 - protein, 5 aa, Mycobacterium
RTASV

SEQ ID NO: 570963 - protein, 5 aa, Mycobacterium
RTASW

SEQ ID NO: 570964 - protein, 5 aa, Mycobacterium
RTATA

SEQ ID NO: 570965 - protein, 12 aa, Mycobacterium
RTATADTRAGAA

SEQ ID NO: 570966 - protein, 8 aa, Mycobacterium
RTATAGND

SEQ ID NO: 570967 - protein, 5 aa, Mycobacterium
RTATD

SEQ ID NO: 570968 - protein, 6 aa, Mycobacterium
RTATED

SEQ ID NO: 570969 - protein, 5 aa, Mycobacterium
RTATF

SEQ ID NO: 570970 - protein, 5 aa, Mycobacterium
RTATG

SEQ ID NO: 570971 - protein, 17 aa, Mycobacterium
RTATGKGASRRARRDGR

SEQ ID NO: 570972 - protein, 16 aa, Mycobacterium
RTATHPAGVGNSSGHL

SEQ ID NO: 570973 - protein, 8 aa, Mycobacterium
RTATKDVE

SEQ ID NO: 570974 - protein, 9 aa, Mycobacterium
RTATPDEVA

SEQ ID NO: 570975 - protein, 8 aa, Mycobacterium
RTATRETA

SEQ ID NO: 570976 - protein, 9 aa, Mycobacterium
RTATRRPPR

SEQ ID NO: 570977 - protein, 7 aa, Mycobacterium
RTATSIP

SEQ ID NO: 570978 - protein, 7 aa, Mycobacterium
RTATSRV

SEQ ID NO: 570979 - protein, 6 aa, Mycobacterium
RTATTS

SEQ ID NO: 570980 - protein, 13 aa, Mycobacterium
RTATVNGAMAALG

SEQ ID NO: 570981 - protein, 12 aa, Mycobacterium
RTATVSAAEPLT

SEQ ID NO: 570982 - protein, 11 aa, Mycobacterium
RTAVPAAESPD

SEQ ID NO: 570983 - protein, 5 aa, Mycobacterium
RTAVT

SEQ ID NO: 570984 - protein, 8 aa, Mycobacterium
RTAYDDPG

SEQ ID NO: 570985 - protein, 8 aa, Mycobacterium
RTAYDSPA

SEQ ID NO: 570986 - protein, 11 aa, Mycobacterium
RTAYQDVPTPA

SEQ ID NO: 570987 - protein, 8 aa, Mycobacterium
RTCGTGRL

SEQ ID NO: 570988 - protein, 14 aa, Mycobacterium
RTCQGRPDRRSGTR

SEQ ID NO: 570989 - protein, 10 aa, Mycobacterium
RTCRPEEAAD

SEQ ID NO: 570990 - protein, 9 aa, Mycobacterium
RTDAAGRKL

SEQ ID NO: 570991 - protein, 17 aa, Mycobacterium
RTDADGRVLTESGEAIP

SEQ ID NO: 570992 - protein, 6 aa, Mycobacterium
RTDADS

SEQ ID NO: 570993 - protein, 11 aa, Mycobacterium
RTDAGKNDKRA

SEQ ID NO: 570994 - protein, 8 aa, Mycobacterium
RTDAGSGW

SEQ ID NO: 570995 - protein, 7 aa, Mycobacterium
RTDAGTY

SEQ ID NO: 570996 - protein, 8 aa, Mycobacterium
RTDAPGIT

SEQ ID NO: 570997 - protein, 8 aa, Mycobacterium
RTDAPQEW

SEQ ID NO: 570998 - protein, 6 aa, Mycobacterium
RTDAPV

SEQ ID NO: 570999 - protein, 10 aa, Mycobacterium
RTDAQPRPLP

SEQ ID NO: 571000 - protein, 5 aa, Mycobacterium
RTDAV

SEQ ID NO: 571001 - protein, 14 aa, Mycobacterium
RTDCTAGKRPAAGP

SEQ ID NO: 571002 - protein, 4 aa, Mycobacterium
RTDD

SEQ ID NO: 571003 - protein, 8 aa, Mycobacterium
RTDDDPHI

SEQ ID NO: 571004 - protein, 12 aa, Mycobacterium
RTDDEDGLPTPA

SEQ ID NO: 571005 - protein, 15 aa, Mycobacterium
RTDDEPVGAAPTTEQ

SEQ ID NO: 571006 - protein, 5 aa, Mycobacterium
RTDDG

SEQ ID NO: 571007 - protein, 11 aa, Mycobacterium
RTDDGWRSRSL

SEQ ID NO: 571008 - protein, 17 aa, Mycobacterium
RTDDNAGTDRPTTWRTG

SEQ ID NO: 571009 - protein, 11 aa, Mycobacterium
RTDDPATRQTG

SEQ ID NO: 571010 - protein, 8 aa, Mycobacterium
RTDDPQGR

SEQ ID NO: 571011 - protein, 11 aa, Mycobacterium
RTDDRRGLPTA

SEQ ID NO: 571012 - protein, 6 aa, Mycobacterium
RTDDTP

SEQ ID NO: 571013 - protein, 5 aa, Mycobacterium
RTDED

SEQ ID NO: 571014 - protein, 8 aa, Mycobacterium
RTDEDTPL

SEQ ID NO: 571015 - protein, 9 aa, Mycobacterium
RTDEEARAR

SEQ ID NO: 571016 - protein, 8 aa, Mycobacterium
RTDEGAEF

SEQ ID NO: 571017 - protein, 8 aa, Mycobacterium
RTDEGAQF

SEQ ID NO: 571018 - protein, 12 aa, Mycobacterium
RTDEGSDKPHRN

SEQ ID NO: 571019 - protein, 7 aa, Mycobacterium
RTDEHSE

SEQ ID NO: 571020 - protein, 5 aa, Mycobacterium
RTDEK

SEQ ID NO: 571021 - protein, 6 aa, Mycobacterium
RTDEKL

SEQ ID NO: 571022 - protein, 7 aa, Mycobacterium
RTDEKLR

SEQ ID NO: 571023 - protein, 10 aa, Mycobacterium
RTDELDSTHT

SEQ ID NO: 571024 - protein, 6 aa, Mycobacterium
RTDEPH

SEQ ID NO: 571025 - protein, 7 aa, Mycobacterium
RTDEQLR

SEQ ID NO: 571026 - protein, 6 aa, Mycobacterium
RTDEQV

SEQ ID NO: 571027 - protein, 7 aa, Mycobacterium
RTDERQA

SEQ ID NO: 571028 - protein, 5 aa, Mycobacterium
RTDES

SEQ ID NO: 571029 - protein, 11 aa, Mycobacterium
RTDESGKELTR

SEQ ID NO: 571030 - protein, 6 aa, Mycobacterium
RTDFDP

SEQ ID NO: 571031 - protein, 8 aa, Mycobacterium
RTDFPGGD

SEQ ID NO: 571032 - protein, 8 aa, Mycobacterium
RTDFPGGN

SEQ ID NO: 571033 - protein, 5 aa, Mycobacterium
RTDGA

SEQ ID NO: 571034 - protein, 7 aa, Mycobacterium
RTDGAPA

SEQ ID NO: 571035 - protein, 12 aa, Mycobacterium
RTDGATVCDEGD

SEQ ID NO: 571036 - protein, 8 aa, Mycobacterium
RTDGFAPA

SEQ ID NO: 571037 - protein, 7 aa, Mycobacterium
RTDGGYA

SEQ ID NO: 571038 - protein, 6 aa, Mycobacterium
RTDGHP

SEQ ID NO: 571039 - protein, 6 aa, Mycobacterium
RTDGKD

SEQ ID NO: 571040 - protein, 6 aa, Mycobacterium
RTDGLD

SEQ ID NO: 571041 - protein, 8 aa, Mycobacterium
RTDGRPVA

SEQ ID NO: 571042 - protein, 12 aa, Mycobacterium
RTDGRQPPERGS

SEQ ID NO: 571043 - protein, 9 aa, Mycobacterium
RTDGTRNAG

SEQ ID NO: 571044 - protein, 7 aa, Mycobacterium
RTDGYDP

SEQ ID NO: 571045 - protein, 5 aa, Mycobacterium
RTDHP

SEQ ID NO: 571046 - protein, 4 aa, Mycobacterium
RTDI

SEQ ID NO: 571047 - protein, 14 aa, Mycobacterium
RTDKDAAEVVRETG

SEQ ID NO: 571048 - protein, 10 aa, Mycobacterium
RTDLHGGSGR

SEQ ID NO: 571049 - protein, 10 aa, Mycobacterium
RTDLSASDLD

SEQ ID NO: 571050 - protein, 7 aa, Mycobacterium
RTDLSPP

SEQ ID NO: 571051 - protein, 6 aa, Mycobacterium
RTDNTS

SEQ ID NO: 571052 - protein, 4 aa, Mycobacterium
RTDP

SEQ ID NO: 571053 - protein, 13 aa, Mycobacterium
RTDPAAAANVRAA

SEQ ID NO: 571054 - protein, 8 aa, Mycobacterium
RTDPAGRT

SEQ ID NO: 571055 - protein, 10 aa, Mycobacterium
RTDPDAAKHA

SEQ ID NO: 571056 - protein, 11 aa, Mycobacterium
RTDPDAKKHKG

SEQ ID NO: 571057 - protein, 10 aa, Mycobacterium
RTDPDAPKHQ

SEQ ID NO: 571058 - protein, 7 aa, Mycobacterium
RTDPDLA

SEQ ID NO: 571059 - protein, 8 aa, Mycobacterium
RTDPDSAE

SEQ ID NO: 571060 - protein, 10 aa, Mycobacterium
RTDPDVPKHA

SEQ ID NO: 571061 - protein, 10 aa, Mycobacterium
RTDPEAGKHR

SEQ ID NO: 571062 - protein, 10 aa, Mycobacterium
RTDPEASKHR

SEQ ID NO: 571063 - protein, 7 aa, Mycobacterium
RTDPEEA

SEQ ID NO: 571064 - protein, 6 aa, Mycobacterium
RTDPEF

SEQ ID NO: 571065 - protein, 7 aa, Mycobacterium
RTDPEFA

SEQ ID NO: 571066 - protein, 6 aa, Mycobacterium
RTDPEL

SEQ ID NO: 571067 - protein, 7 aa, Mycobacterium
RTDPELA

SEQ ID NO: 571068 - protein, 11 aa, Mycobacterium
RTDPKVPTDGS

SEQ ID NO: 571069 - protein, 10 aa, Mycobacterium
RTDPQDSEDP

SEQ ID NO: 571070 - protein, 6 aa, Mycobacterium
RTDPQR

SEQ ID NO: 571071 - protein, 8 aa, Mycobacterium
RTDPQSNV

SEQ ID NO: 571072 - protein, 6 aa, Mycobacterium
RTDPRP

SEQ ID NO: 571073 - protein, 8 aa, Mycobacterium
RTDPRSHA

SEQ ID NO: 571074 - protein, 6 aa, Mycobacterium
RTDPRT

SEQ ID NO: 571075 - protein, 6 aa, Mycobacterium
RTDPRV

SEQ ID NO: 571076 - protein, 10 aa, Mycobacterium
RTDPSAPKHN

SEQ ID NO: 571077 - protein, 11 aa, Mycobacterium
RTDPSAPKHNG

SEQ ID NO: 571078 - protein, 10 aa, Mycobacterium
RTDPSAPKHQ

SEQ ID NO: 571079 - protein, 11 aa, Mycobacterium
RTDPSAPKHSG

SEQ ID NO: 571080 - protein, 15 aa, Mycobacterium
RTDPSDGDPLPVADD

SEQ ID NO: 571081 - protein, 15 aa, Mycobacterium
RTDPTGLTAGTTTDL

SEQ ID NO: 571082 - protein, 7 aa, Mycobacterium
RTDPTRI

SEQ ID NO: 571083 - protein, 8 aa, Mycobacterium
RTDQPGRL

SEQ ID NO: 571084 - protein, 10 aa, Mycobacterium
RTDQTTADAL

SEQ ID NO: 571085 - protein, 5 aa, Mycobacterium
RTDRA

SEQ ID NO: 571086 - protein, 9 aa, Mycobacterium
RTDRAGKLD

SEQ ID NO: 571087 - protein, 7 aa, Mycobacterium
RTDRASE

SEQ ID NO: 571088 - protein, 9 aa, Mycobacterium
RTDRDIVDG

SEQ ID NO: 571089 - protein, 11 aa, Mycobacterium
RTDRDLRDGRK

SEQ ID NO: 571090 - protein, 5 aa, Mycobacterium
RTDRE

SEQ ID NO: 571091 - protein, 8 aa, Mycobacterium
RTDRERAT

SEQ ID NO: 571092 - protein, 7 aa, Mycobacterium
RTDRGER

SEQ ID NO: 571093 - protein, 5 aa, Mycobacterium
RTDRI

SEQ ID NO: 571094 - protein, 5 aa, Mycobacterium
RTDRP

SEQ ID NO: 571095 - protein, 18 aa, Mycobacterium
RTDSADKVEALDAGADDY

SEQ ID NO: 571096 - protein, 8 aa, Mycobacterium
RTDSDDGK

SEQ ID NO: 571097 - protein, 7 aa, Mycobacterium
RTDSDLA

SEQ ID NO: 571098 - protein, 20 aa, Mycobacterium
RTDSGTLSGTLDSASAADLG

SEQ ID NO: 571099 - protein, 10 aa, Mycobacterium
RTDSGTSSLA

SEQ ID NO: 571100 - protein, 13 aa, Mycobacterium
RTDSGVSISGAEP

SEQ ID NO: 571101 - protein, 8 aa, Mycobacterium
RTDSNDSR

SEQ ID NO: 571102 - protein, 9 aa, Mycobacterium
RTDSPFPGL

SEQ ID NO: 571103 - protein, 14 aa, Mycobacterium
RTDSSGKVPTRAAT

SEQ ID NO: 571104 - protein, 4 aa, Mycobacterium
RTDT

SEQ ID NO: 571105 - protein, 8 aa, Mycobacterium
RTDTARPL

SEQ ID NO: 571106 - protein, 13 aa, Mycobacterium
RTDTARPLGHAAR

SEQ ID NO: 571107 - protein, 6 aa, Mycobacterium
RTDTER

SEQ ID NO: 571108 - protein, 11 aa, Mycobacterium
RTDTGAEAKRR

SEQ ID NO: 571109 - protein, 18 aa, Mycobacterium
RTDTGKGASRRARRDGQV

SEQ ID NO: 571110 - protein, 5 aa, Mycobacterium
RTDTH

SEQ ID NO: 571111 - protein, 4 aa, Mycobacterium
RTDV

SEQ ID NO: 571112 - protein, 7 aa, Mycobacterium
RTDVASR

SEQ ID NO: 571113 - protein, 10 aa, Mycobacterium
RTDVASVADG

SEQ ID NO: 571114 - protein, 4 aa, Mycobacterium
RTDW

SEQ ID NO: 571115 - protein, 8 aa, Mycobacterium
RTEAAASG

SEQ ID NO: 571116 - protein, 17 aa, Mycobacterium
RTEAAREEADLRESGGD

SEQ ID NO: 571117 - protein, 5 aa, Mycobacterium
RTEAD

SEQ ID NO: 571118 - protein, 10 aa, Mycobacterium
RTEAFDEAGA

SEQ ID NO: 571119 - protein, 15 aa, Mycobacterium
RTEAGKPMKASADGM

SEQ ID NO: 571120 - protein, 9 aa, Mycobacterium
RTEAGREIR

SEQ ID NO: 571121 - protein, 9 aa, Mycobacterium
RTEAGRPNV

SEQ ID NO: 571122 - protein, 6 aa, Mycobacterium
RTEALE

SEQ ID NO: 571123 - protein, 9 aa, Mycobacterium
RTEAPEAAA

SEQ ID NO: 571124 - protein, 5 aa, Mycobacterium
RTEAQ

SEQ ID NO: 571125 - protein, 7 aa, Mycobacterium
RTEARAD

SEQ ID NO: 571126 - protein, 9 aa, Mycobacterium
RTEARQRNL

SEQ ID NO: 571127 - protein, 7 aa, Mycobacterium
RTEASGA

SEQ ID NO: 571128 - protein, 6 aa, Mycobacterium
RTEASL

SEQ ID NO: 571129 - protein, 9 aa, Mycobacterium
RTEAVDPAL

SEQ ID NO: 571130 - protein, 4 aa, Mycobacterium
RTED

SEQ ID NO: 571131 - protein, 9 aa, Mycobacterium
RTEDAGRAG

SEQ ID NO: 571132 - protein, 7 aa, Mycobacterium
RTEDARV

SEQ ID NO: 571133 - protein, 11 aa, Mycobacterium
RTEDEADAGGN

SEQ ID NO: 571134 - protein, 11 aa, Mycobacterium
RTEDKRGRRKT

SEQ ID NO: 571135 - protein, 10 aa, Mycobacterium
RTEDNQYDQR

SEQ ID NO: 571136 - protein, 5 aa, Mycobacterium
RTEDR

SEQ ID NO: 571137 - protein, 7 aa, Mycobacterium
RTEDRRI

SEQ ID NO: 571138 - protein, 5 aa, Mycobacterium
RTEDV

SEQ ID NO: 571139 - protein, 8 aa, Mycobacterium
RTEEDAAA

SEQ ID NO: 571140 - protein, 5 aa, Mycobacterium
RTEEE

SEQ ID NO: 571141 - protein, 11 aa, Mycobacterium
RTEEEADAGGN

SEQ ID NO: 571142 - protein, 9 aa, Mycobacterium
RTEEEGKQD

SEQ ID NO: 571143 - protein, 9 aa, Mycobacterium
RTEEGARRA

SEQ ID NO: 571144 - protein, 9 aa, Mycobacterium
RTEEGTELR

SEQ ID NO: 571145 - protein, 18 aa, Mycobacterium
RTEEIGTGGDPNAVGPDR

SEQ ID NO: 571146 - protein, 7 aa, Mycobacterium
RTEERQA

SEQ ID NO: 571147 - protein, 5 aa, Mycobacterium
RTEES

SEQ ID NO: 571148 - protein, 10 aa, Mycobacterium
RTEETDGVVG

SEQ ID NO: 571149 - protein, 4 aa, Mycobacterium
RTEF

SEQ ID NO: 571150 - protein, 5 aa, Mycobacterium
RTEFA

SEQ ID NO: 571151 - protein, 5 aa, Mycobacterium
RTEGA

SEQ ID NO: 571152 - protein, 13 aa, Mycobacterium
RTEGFAPKTQHEA

SEQ ID NO: 571153 - protein, 6 aa, Mycobacterium
RTEKSP

SEQ ID NO: 571154 - protein, 4 aa, Mycobacterium
RTEL

SEQ ID NO: 571155 - protein, 13 aa, Mycobacterium
RTELARSSGSIDH

SEQ ID NO: 571156 - protein, 13 aa, Mycobacterium
RTELARTAESPQQ

SEQ ID NO: 571157 - protein, 6 aa, Mycobacterium
RTELGD

SEQ ID NO: 571158 - protein, 6 aa, Mycobacterium
RTELPK

SEQ ID NO: 571159 - protein, 4 aa, Mycobacterium
RTEN

SEQ ID NO: 571160 - protein, 11 aa, Mycobacterium
RTENARLAAGR

SEQ ID NO: 571161 - protein, 7 aa, Mycobacterium
RTENPQE

SEQ ID NO: 571162 - protein, 5 aa, Mycobacterium
RTEPA

SEQ ID NO: 571163 - protein, 63 aa, Mycobacterium
RTEPAATPSRPRSTQPRRSRPQGSGRPGRSGHGAQSEGAAAARGGAHRGGRGRRPRRSNESSA

SEQ ID NO: 571164 - protein, 6 aa, Mycobacterium
RTEPAT

SEQ ID NO: 571165 - protein, 5 aa, Mycobacterium
RTEPD

SEQ ID NO: 571166 - protein, 12 aa, Mycobacterium
RTEPDPSSAHAS

SEQ ID NO: 571167 - protein, 7 aa, Mycobacterium
RTEPDSA

SEQ ID NO: 571168 - protein, 5 aa, Mycobacterium
RTEPE

SEQ ID NO: 571169 - protein, 5 aa, Mycobacterium
RTEPG

SEQ ID NO: 571170 - protein, 17 aa, Mycobacterium
RTEPGNPAESTDESHRQ

SEQ ID NO: 571171 - protein, 7 aa, Mycobacterium
RTEPGVE

SEQ ID NO: 571172 - protein, 15 aa, Mycobacterium
RTEPGWDDRKPERPR

SEQ ID NO: 571173 - protein, 22 aa, Mycobacterium
RTEPLDYTGRDRVNPQAGRDAA

SEQ ID NO: 571174 - protein, 6 aa, Mycobacterium
RTEPLE

SEQ ID NO: 571175 - protein, 10 aa, Mycobacterium
RTEPPHEGAR

SEQ ID NO: 571176 - protein, 11 aa, Mycobacterium
RTEPPHPGSRY

SEQ ID NO: 571177 - protein, 11 aa, Mycobacterium
RTEPPHPGTRY

SEQ ID NO: 571178 - protein, 10 aa, Mycobacterium
RTEPPHQGAR

SEQ ID NO: 571179 - protein, 13 aa, Mycobacterium
RTEPPVRAAGSAQ

SEQ ID NO: 571180 - protein, 14 aa, Mycobacterium
RTEQPQRSPESLAE

SEQ ID NO: 571181 - protein, 19 aa, Mycobacterium
RTEQYKPPADAKLNQPEDV

SEQ ID NO: 571182 - protein, 9 aa, Mycobacterium
RTERDARPV

SEQ ID NO: 571183 - protein, 7 aa, Mycobacterium
RTEREAG

SEQ ID NO: 571184 - protein, 11 aa, Mycobacterium
RTERGAGGEVQ

SEQ ID NO: 571185 - protein, 9 aa, Mycobacterium
RTERPAGAG

SEQ ID NO: 571186 - protein, 15 aa, Mycobacterium
RTERRPTVPGVAQAA

SEQ ID NO: 571187 - protein, 6 aa, Mycobacterium
RTERSL

SEQ ID NO: 571188 - protein, 8 aa, Mycobacterium
RTERSQER

SEQ ID NO: 571189 - protein, 13 aa, Mycobacterium
RTERTKAVNEPTW

SEQ ID NO: 571190 - protein, 8 aa, Mycobacterium
RTESAAKA

SEQ ID NO: 571191 - protein, 7 aa, Mycobacterium
RTESADR

SEQ ID NO: 571192 - protein, 11 aa, Mycobacterium
RTESALNEPRL

SEQ ID NO: 571193 - protein, 10 aa, Mycobacterium
RTESAQRYNT

SEQ ID NO: 571194 - protein, 17 aa, Mycobacterium
RTESGQRTTAATAQDTR

SEQ ID NO: 571195 - protein, 13 aa, Mycobacterium
RTESKAQALRDRG

SEQ ID NO: 571196 - protein, 10 aa, Mycobacterium
RTESNAEAGT

SEQ ID NO: 571197 - protein, 6 aa, Mycobacterium
RTESQL

SEQ ID NO: 571198 - protein, 8 aa, Mycobacterium
RTESQLEG

SEQ ID NO: 571199 - protein, 7 aa, Mycobacterium
RTESQLR

SEQ ID NO: 571200 - protein, 17 aa, Mycobacterium
RTESRGGHTRDDHPNMD

SEQ ID NO: 571201 - protein, 7 aa, Mycobacterium
RTETGRR

SEQ ID NO: 571202 - protein, 9 aa, Mycobacterium
RTETPGESA

SEQ ID NO: 571203 - protein, 10 aa, Mycobacterium
RTETSDDDDF

SEQ ID NO: 571204 - protein, 8 aa, Mycobacterium
RTETTQSR

SEQ ID NO: 571205 - protein, 5 aa, Mycobacterium
RTETV

SEQ ID NO: 571206 - protein, 12 aa, Mycobacterium
RTETVDGGGYPV

SEQ ID NO: 571207 - protein, 8 aa, Mycobacterium
RTEVSREI

SEQ ID NO: 571208 - protein, 8 aa, Mycobacterium
RTEYENGA

SEQ ID NO: 571209 - protein, 11 aa, Mycobacterium
RTEYPSSGEKP

SEQ ID NO: 571210 - protein, 9 aa, Mycobacterium
RTFESQGAR

SEQ ID NO: 571211 - protein, 4 aa, Mycobacterium
RTFG

SEQ ID NO: 571212 - protein, 11 aa, Mycobacterium
RTFPSVNPATG

SEQ ID NO: 571213 - protein, 5 aa, Mycobacterium
RTFQG

SEQ ID NO: 571214 - protein, 7 aa, Mycobacterium
RTFRDTD

SEQ ID NO: 571215 - protein, 11 aa, Mycobacterium
RTFRPAPRRPV

SEQ ID NO: 571216 - protein, 6 aa, Mycobacterium
RTFSGG

SEQ ID NO: 571217 - protein, 5 aa, Mycobacterium
RTGAA

SEQ ID NO: 571218 - protein, 6 aa, Mycobacterium
RTGAAI

SEQ ID NO: 571219 - protein, 9 aa, Mycobacterium
RTGADHGSH

SEQ ID NO: 571220 - protein, 10 aa, Mycobacterium
RTGADNAAQP

SEQ ID NO: 571221 - protein, 7 aa, Mycobacterium
RTGAEAL

SEQ ID NO: 571222 - protein, 12 aa, Mycobacterium
RTGAEALEATRQ

SEQ ID NO: 571223 - protein, 11 aa, Mycobacterium
RTGAEHDPGTR

SEQ ID NO: 571224 - protein, 5 aa, Mycobacterium
RTGAG

SEQ ID NO: 571225 - protein, 10 aa, Mycobacterium
RTGAGGQAVQ

SEQ ID NO: 571226 - protein, 6 aa, Mycobacterium
RTGAPA

SEQ ID NO: 571227 - protein, 16 aa, Mycobacterium
RTGAPGAENGTPPPAP

SEQ ID NO: 571228 - protein, 7 aa, Mycobacterium
RTGAPVT

SEQ ID NO: 571229 - protein, 9 aa, Mycobacterium
RTGAPYAST

SEQ ID NO: 571230 - protein, 8 aa, Mycobacterium
RTGAQAVH

SEQ ID NO: 571231 - protein, 7 aa, Mycobacterium
RTGARGL

SEQ ID NO: 571232 - protein, 7 aa, Mycobacterium
RTGARPQ

SEQ ID NO: 571233 - protein, 10 aa, Mycobacterium
RTGARRDGPR

SEQ ID NO: 571234 - protein, 11 aa, Mycobacterium
RTGASGATGVD

SEQ ID NO: 571235 - protein, 15 aa, Mycobacterium
RTGASSRVDSTALNG

SEQ ID NO: 571236 - protein, 8 aa, Mycobacterium
RTGATSYQ

SEQ ID NO: 571237 - protein, 8 aa, Mycobacterium
RTGATTEE

SEQ ID NO: 571238 - protein, 7 aa, Mycobacterium
RTGCQER

SEQ ID NO: 571239 - protein, 11 aa, Mycobacterium
RTGDADELREE

SEQ ID NO: 571240 - protein, 6 aa, Mycobacterium
RTGDAE

SEQ ID NO: 571241 - protein, 14 aa, Mycobacterium
RTGDASQVSADAVE

SEQ ID NO: 571242 - protein, 8 aa, Mycobacterium
RTGDAVEV

SEQ ID NO: 571243 - protein, 10 aa, Mycobacterium
RTGDCAGAAE

SEQ ID NO: 571244 - protein, 7 aa, Mycobacterium
RTGDDTV

SEQ ID NO: 571245 - protein, 11 aa, Mycobacterium
RTGDEADPWTN

SEQ ID NO: 571246 - protein, 9 aa, Mycobacterium
RTGDEGSLS

SEQ ID NO: 571247 - protein, 6 aa, Mycobacterium
RTGDEL

SEQ ID NO: 571248 - protein, 8 aa, Mycobacterium
RTGDEPEQ

SEQ ID NO: 571249 - protein, 10 aa, Mycobacterium
RTGDERLSQC

SEQ ID NO: 571250 - protein, 14 aa, Mycobacterium
RTGDFDDDDQPARL

SEQ ID NO: 571251 - protein, 9 aa, Mycobacterium
RTGDGADLA

SEQ ID NO: 571252 - protein, 9 aa, Mycobacterium
RTGDGAERV

SEQ ID NO: 571253 - protein, 14 aa, Mycobacterium
RTGDGANADPRAPI

SEQ ID NO: 571254 - protein, 7 aa, Mycobacterium
RTGDGID

SEQ ID NO: 571255 - protein, 7 aa, Mycobacterium
RTGDGLD

SEQ ID NO: 571256 - protein, 7 aa, Mycobacterium
RTGDGVD

SEQ ID NO: 571257 - protein, 5 aa, Mycobacterium
RTGDL

SEQ ID NO: 571258 - protein, 10 aa, Mycobacterium
RTGDPAPGSR

SEQ ID NO: 571259 - protein, 8 aa, Mycobacterium
RTGDPDGL

SEQ ID NO: 571260 - protein, 7 aa, Mycobacterium
RTGDPLA

SEQ ID NO: 571261 - protein, 9 aa, Mycobacterium
RTGDPLEPR

SEQ ID NO: 571262 - protein, 14 aa, Mycobacterium
RTGDQRDGGQTAGG

SEQ ID NO: 571263 - protein, 14 aa, Mycobacterium
RTGDQRDRDQAAGG

SEQ ID NO: 571264 - protein, 6 aa, Mycobacterium
RTGDRA

SEQ ID NO: 571265 - protein, 24 aa, Mycobacterium
RTGDRARWTPDGRLEPVTAGEPRL

SEQ ID NO: 571266 - protein, 7 aa, Mycobacterium
RTGDRID

SEQ ID NO: 571267 - protein, 9 aa, Mycobacterium
RTGDRRMSE

SEQ ID NO: 571268 - protein, 9 aa, Mycobacterium
RTGDRRMSQ

SEQ ID NO: 571269 - protein, 5 aa, Mycobacterium
RTGDS

SEQ ID NO: 571270 - protein, 6 aa, Mycobacterium
RTGDTG

SEQ ID NO: 571271 - protein, 8 aa, Mycobacterium
RTGDTHQV

SEQ ID NO: 571272 - protein, 5 aa, Mycobacterium
RTGDW

SEQ ID NO: 571273 - protein, 6 aa, Mycobacterium
RTGEDG

SEQ ID NO: 571274 - protein, 8 aa, Mycobacterium
RTGEEPDQ

SEQ ID NO: 571275 - protein, 6 aa, Mycobacterium
RTGEGD

SEQ ID NO: 571276 - protein, 8 aa, Mycobacterium
RTGEGGQG

SEQ ID NO: 571277 - protein, 6 aa, Mycobacterium
RTGEGI

SEQ ID NO: 571278 - protein, 8 aa, Mycobacterium
RTGEGRHG

SEQ ID NO: 571279 - protein, 10 aa, Mycobacterium
RTGEHSSTEM

SEQ ID NO: 571280 - protein, 6 aa, Mycobacterium
RTGELP

SEQ ID NO: 571281 - protein, 8 aa, Mycobacterium
RTGEPIAR

SEQ ID NO: 571282 - protein, 13 aa, Mycobacterium
RTGEPSDTPLPVR

SEQ ID NO: 571283 - protein, 20 aa, Mycobacterium
RTGEPSPRNADVAAEAERRG

SEQ ID NO: 571284 - protein, 5 aa, Mycobacterium
RTGER

SEQ ID NO: 571285 - protein, 10 aa, Mycobacterium
RTGERQYGNQ

SEQ ID NO: 571286 - protein, 7 aa, Mycobacterium
RTGERSL

SEQ ID NO: 571287 - protein, 7 aa, Mycobacterium
RTGERTV

SEQ ID NO: 571288 - protein, 8 aa, Mycobacterium
RTGERYPD

SEQ ID NO: 571289 - protein, 7 aa, Mycobacterium
RTGESLD

SEQ ID NO: 571290 - protein, 9 aa, Mycobacterium
RTGESPGEL

SEQ ID NO: 571291 - protein, 15 aa, Mycobacterium
RTGETAVNNVVRERG

SEQ ID NO: 571292 - protein, 14 aa, Mycobacterium
RTGETGDAERPTAW

SEQ ID NO: 571293 - protein, 16 aa, Mycobacterium
RTGEVGADAGADTSAV

SEQ ID NO: 571294 - protein, 5 aa, Mycobacterium
RTGFD

SEQ ID NO: 571295 - protein, 8 aa, Mycobacterium
RTGFDPEA

SEQ ID NO: 571296 - protein, 8 aa, Mycobacterium
RTGFNDSE

SEQ ID NO: 571297 - protein, 21 aa, Mycobacterium
RTGGAALGTGTAAGTDAESTV

SEQ ID NO: 571298 - protein, 11 aa, Mycobacterium
RTGGAVSTAQR

SEQ ID NO: 571299 - protein, 10 aa, Mycobacterium
RTGGDGPPLR

SEQ ID NO: 571300 - protein, 6 aa, Mycobacterium
RTGGDK

SEQ ID NO: 571301 - protein, 13 aa, Mycobacterium
RTGGDSIVVTAAA

SEQ ID NO: 571302 - protein, 7 aa, Mycobacterium
RTGGGEV

SEQ ID NO: 571303 - protein, 7 aa, Mycobacterium
RTGGGSH

SEQ ID NO: 571304 - protein, 7 aa, Mycobacterium
RTGGHAY

SEQ ID NO: 571305 - protein, 9 aa, Mycobacterium
RTGGHTPGH

SEQ ID NO: 571306 - protein, 10 aa, Mycobacterium
RTGGLYPTGN

SEQ ID NO: 571307 - protein, 9 aa, Mycobacterium
RTGGPGAGG

SEQ ID NO: 571308 - protein, 10 aa, Mycobacterium
RTGGPGPSGI

SEQ ID NO: 571309 - protein, 6 aa, Mycobacterium
RTGGRY

SEQ ID NO: 571310 - protein, 8 aa, Mycobacterium
RTGGTAGI

SEQ ID NO: 571311 - protein, 9 aa, Mycobacterium
RTGGTLTDA

SEQ ID NO: 571312 - protein, 7 aa, Mycobacterium
RTGGVAG

SEQ ID NO: 571313 - protein, 4 aa, Mycobacterium
RTGH

SEQ ID NO: 571314 - protein, 6 aa, Mycobacterium
RTGHDA

SEQ ID NO: 571315 - protein, 5 aa, Mycobacterium
RTGHR

SEQ ID NO: 571316 - protein, 7 aa, Mycobacterium
RTGIAGV

SEQ ID NO: 571317 - protein, 9 aa, Mycobacterium
RTGIDAPTE

SEQ ID NO: 571318 - protein, 16 aa, Mycobacterium
RTGIDPDDLRRSPEYA

SEQ ID NO: 571319 - protein, 7 aa, Mycobacterium
RTGIGGA

SEQ ID NO: 571320 - protein, 10 aa, Mycobacterium
RTGIGSRDKH

SEQ ID NO: 571321 - protein, 6 aa, Mycobacterium
RTGIPA

SEQ ID NO: 571322 - protein, 6 aa, Mycobacterium
RTGIPD

SEQ ID NO: 571323 - protein, 7 aa, Mycobacterium
RTGIPRA

SEQ ID NO: 571324 - protein, 10 aa, Mycobacterium
RTGIPREGGH

SEQ ID NO: 571325 - protein, 6 aa, Mycobacterium
RTGIPT

SEQ ID NO: 571326 - protein, 5 aa, Mycobacterium
RTGKP

SEQ ID NO: 571327 - protein, 13 aa, Mycobacterium
RTGKPLTRSSAGG

SEQ ID NO: 571328 - protein, 11 aa, Mycobacterium
RTGKRYDDEIT

SEQ ID NO: 571329 - protein, 8 aa, Mycobacterium
RTGKVGGQ

SEQ ID NO: 571330 - protein, 5 aa, Mycobacterium
RTGKY

SEQ ID NO: 571331 - protein, 9 aa, Mycobacterium
RTGLGSGGQ

SEQ ID NO: 571332 - protein, 7 aa, Mycobacterium
RTGLPTD

SEQ ID NO: 571333 - protein, 13 aa, Mycobacterium
RTGLSDVDGDSWR

SEQ ID NO: 571334 - protein, 4 aa, Mycobacterium
RTGM

SEQ ID NO: 571335 - protein, 6 aa, Mycobacterium
RTGMGG

SEQ ID NO: 571336 - protein, 6 aa, Mycobacterium
RTGNDA

SEQ ID NO: 571337 - protein, 12 aa, Mycobacterium
RTGNHGPGAVPQ

SEQ ID NO: 571338 - protein, 9 aa, Mycobacterium
RTGNNLEPT

SEQ ID NO: 571339 - protein, 12 aa, Mycobacterium
RTGNPKEPTRGA

SEQ ID NO: 571340 - protein, 10 aa, Mycobacterium
RTGNPTRQSL

SEQ ID NO: 571341 - protein, 9 aa, Mycobacterium
RTGNPTRSV

SEQ ID NO: 571342 - protein, 7 aa, Mycobacterium
RTGNRQL

SEQ ID NO: 571343 - protein, 11 aa, Mycobacterium
RTGNTEAPTDV

SEQ ID NO: 571344 - protein, 12 aa, Mycobacterium
RTGPAPSSKTRE

SEQ ID NO: 571345 - protein, 11 aa, Mycobacterium
RTGPDGADPRH

SEQ ID NO: 571346 - protein, 7 aa, Mycobacterium
RTGPDPF

SEQ ID NO: 571347 - protein, 5 aa, Mycobacterium
RTGPE

SEQ ID NO: 571348 - protein, 13 aa, Mycobacterium
RTGPETSTGPLGT

SEQ ID NO: 571349 - protein, 8 aa, Mycobacterium
RTGPGDPS

SEQ ID NO: 571350 - protein, 5 aa, Mycobacterium
RTGPH

SEQ ID NO: 571351 - protein, 5 aa, Mycobacterium
RTGPR

SEQ ID NO: 571352 - protein, 9 aa, Mycobacterium
RTGPSGRKP

SEQ ID NO: 571353 - protein, 15 aa, Mycobacterium
RTGQAEDTYAYPGPE

SEQ ID NO: 571354 - protein, 25 aa, Mycobacterium
RTGQDQYQSARRLTEGEQEPTPRPL

SEQ ID NO: 571355 - protein, 11 aa, Mycobacterium
RTGQEHDPGSR

SEQ ID NO: 571356 - protein, 11 aa, Mycobacterium
RTGQEHDPGTR

SEQ ID NO: 571357 - protein, 8 aa, Mycobacterium
RTGQGAKL

SEQ ID NO: 571358 - protein, 7 aa, Mycobacterium
RTGQGGR

SEQ ID NO: 571359 - protein, 21 aa, Mycobacterium
RTGQGPMVTPAPGADPAAHAE

SEQ ID NO: 571360 - protein, 8 aa, Mycobacterium
RTGQGQEV

SEQ ID NO: 571361 - protein, 5 aa, Mycobacterium
RTGQR

SEQ ID NO: 571362 - protein, 6 aa, Mycobacterium
RTGQRY

SEQ ID NO: 571363 - protein, 8 aa, Mycobacterium
RTGQRYPD

SEQ ID NO: 571364 - protein, 5 aa, Mycobacterium
RTGQS

SEQ ID NO: 571365 - protein, 5 aa, Mycobacterium
RTGQT

SEQ ID NO: 571366 - protein, 6 aa, Mycobacterium
RTGQTD

SEQ ID NO: 571367 - protein, 5 aa, Mycobacterium
RTGQV

SEQ ID NO: 571368 - protein, 5 aa, Mycobacterium
RTGQY

SEQ ID NO: 571369 - protein, 11 aa, Mycobacterium
RTGRAASAGRV

SEQ ID NO: 571370 - protein, 10 aa, Mycobacterium
RTGRAGRPGA

SEQ ID NO: 571371 - protein, 7 aa, Mycobacterium
RTGRDFP

SEQ ID NO: 571372 - protein, 6 aa, Mycobacterium
RTGREN

SEQ ID NO: 571373 - protein, 7 aa, Mycobacterium
RTGRGAR

SEQ ID NO: 571374 - protein, 6 aa, Mycobacterium
RTGRGV

SEQ ID NO: 571375 - protein, 16 aa, Mycobacterium
RTGRKGQGSRKGQDGD

SEQ ID NO: 571376 - protein, 13 aa, Mycobacterium
RTGRLSWSARFWQ

SEQ ID NO: 571377 - protein, 16 aa, Mycobacterium
RTGRPPARVSGPDPVP

SEQ ID NO: 571378 - protein, 6 aa, Mycobacterium
RTGRPY

SEQ ID NO: 571379 - protein, 5 aa, Mycobacterium
RTGRR

SEQ ID NO: 571380 - protein, 10 aa, Mycobacterium
RTGRRPSSSR

SEQ ID NO: 571381 - protein, 14 aa, Mycobacterium
RTGRSHAREQGDDQ

SEQ ID NO: 571382 - protein, 7 aa, Mycobacterium
RTGRSYG

SEQ ID NO: 571383 - protein, 8 aa, Mycobacterium
RTGRTATV

SEQ ID NO: 571384 - protein, 5 aa, Mycobacterium
RTGRV

SEQ ID NO: 571385 - protein, 6 aa, Mycobacterium
RTGRVT

SEQ ID NO: 571386 - protein, 12 aa, Mycobacterium
RTGSALGRSTRL

SEQ ID NO: 571387 - protein, 9 aa, Mycobacterium
RTGSDGNTF

SEQ ID NO: 571388 - protein, 8 aa, Mycobacterium
RTGSEERY

SEQ ID NO: 571389 - protein, 5 aa, Mycobacterium
RTGSG

SEQ ID NO: 571390 - protein, 8 aa, Mycobacterium
RTGSGGEL

SEQ ID NO: 571391 - protein, 19 aa, Mycobacterium
RTGSGPMSLTGQPNAMGGR

SEQ ID NO: 571392 - protein, 12 aa, Mycobacterium
RTGSHGAGDLSP

SEQ ID NO: 571393 - protein, 5 aa, Mycobacterium
RTGSL

SEQ ID NO: 571394 - protein, 18 aa, Mycobacterium
RTGSLNKAQSVPNQDGTY

SEQ ID NO: 571395 - protein, 5 aa, Mycobacterium
RTGSR

SEQ ID NO: 571396 - protein, 7 aa, Mycobacterium
RTGSRPQ

SEQ ID NO: 571397 - protein, 6 aa, Mycobacterium
RTGSRR

SEQ ID NO: 571398 - protein, 9 aa, Mycobacterium
RTGSWGGAA

SEQ ID NO: 571399 - protein, 7 aa, Mycobacterium
RTGSYGQ

SEQ ID NO: 571400 - protein, 30 aa, Mycobacterium
RTGTAELADPVRAGGAVSENATDTPRRRRR

SEQ ID NO: 571401 - protein, 7 aa, Mycobacterium
RTGTDGR

SEQ ID NO: 571402 - protein, 6 aa, Mycobacterium
RTGTEA

SEQ ID NO: 571403 - protein, 6 aa, Mycobacterium
RTGTGD

SEQ ID NO: 571404 - protein, 10 aa, Mycobacterium
RTGTGHRGET

SEQ ID NO: 571405 - protein, 15 aa, Mycobacterium
RTGTKVESISDDGSA

SEQ ID NO: 571406 - protein, 16 aa, Mycobacterium
RTGTKVESITDNGSEV

SEQ ID NO: 571407 - protein, 8 aa, Mycobacterium
RTGTLTTA

SEQ ID NO: 571408 - protein, 11 aa, Mycobacterium
RTGTPAPQDLR

SEQ ID NO: 571409 - protein, 8 aa, Mycobacterium
RTGTPGAP

SEQ ID NO: 571410 - protein, 10 aa, Mycobacterium
RTGTPTPAAI

SEQ ID NO: 571411 - protein, 6 aa, Mycobacterium
RTGTPV

SEQ ID NO: 571412 - protein, 11 aa, Mycobacterium
RTGTRPRLTDE

SEQ ID NO: 571413 - protein, 18 aa, Mycobacterium
RTGTSGGVGAASANIAGK

SEQ ID NO: 571414 - protein, 6 aa, Mycobacterium
RTGTTA

SEQ ID NO: 571415 - protein, 16 aa, Mycobacterium
RTGTTARSGRSGGRPA

SEQ ID NO: 571416 - protein, 9 aa, Mycobacterium
RTGTTGSHF

SEQ ID NO: 571417 - protein, 12 aa, Mycobacterium
RTGTVANSHTPL

SEQ ID NO: 571418 - protein, 12 aa, Mycobacterium
RTGTVPNSHTPL

SEQ ID NO: 571419 - protein, 12 aa, Mycobacterium
RTGTVPNSHTPV

SEQ ID NO: 571420 - protein, 7 aa, Mycobacterium
RTGTVYT

SEQ ID NO: 571421 - protein, 7 aa, Mycobacterium
RTGVDPD

SEQ ID NO: 571422 - protein, 17 aa, Mycobacterium
RTGVDPEELRRSPEYGE

SEQ ID NO: 571423 - protein, 12 aa, Mycobacterium
RTGVDRGAEAPP

SEQ ID NO: 571424 - protein, 14 aa, Mycobacterium
RTGVDRGPQAPPDP

SEQ ID NO: 571425 - protein, 18 aa, Mycobacterium
RTGVDSDFGRGDSAYDRY

SEQ ID NO: 571426 - protein, 12 aa, Mycobacterium
RTGVERGAEAPP

SEQ ID NO: 571427 - protein, 9 aa, Mycobacterium
RTGVGGGAG

SEQ ID NO: 571428 - protein, 19 aa, Mycobacterium
RTGVGKRGQPVAFAEGIHV

SEQ ID NO: 571429 - protein, 18 aa, Mycobacterium
RTGVNPLERDAGLSDGGY

SEQ ID NO: 571430 - protein, 16 aa, Mycobacterium
RTGVPGDGWPRYTSDA

SEQ ID NO: 571431 - protein, 15 aa, Mycobacterium
RTGVPGEDWPRYNAT

SEQ ID NO: 571432 - protein, 18 aa, Mycobacterium
RTGYDSQQTEEHVSAGRP

SEQ ID NO: 571433 - protein, 18 aa, Mycobacterium
RTGYDSQQTQEHVGPGRP

SEQ ID NO: 571434 - protein, 20 aa, Mycobacterium
RTGYHQAGTTRMSTSPEGGV

SEQ ID NO: 571435 - protein, 4 aa, Mycobacterium
RTHA

SEQ ID NO: 571436 - protein, 4 aa, Mycobacterium
RTHG

SEQ ID NO: 571437 - protein, 20 aa, Mycobacterium
RTHGKSGIRANSVAPGAVET

SEQ ID NO: 571438 - protein, 20 aa, Mycobacterium
RTHGPRTTGFQGSAFEVERR

SEQ ID NO: 571439 - protein, 9 aa, Mycobacterium
RTHGSESVI

SEQ ID NO: 571440 - protein, 6 aa, Mycobacterium
RTHGSK

SEQ ID NO: 571441 - protein, 12 aa, Mycobacterium
RTHGSSSSIGAA

SEQ ID NO: 571442 - protein, 17 aa, Mycobacterium
RTHGTSSSIGAGATVGP

SEQ ID NO: 571443 - protein, 4 aa, Mycobacterium
RTHP

SEQ ID NO: 571444 - protein, 9 aa, Mycobacterium
RTHPFPQSA

SEQ ID NO: 571445 - protein, 7 aa, Mycobacterium
RTHPGRD

SEQ ID NO: 571446 - protein, 14 aa, Mycobacterium
RTHPGRLTEAADTR

SEQ ID NO: 571447 - protein, 12 aa, Mycobacterium
RTHQAPPVPGAA

SEQ ID NO: 571448 - protein, 12 aa, Mycobacterium
RTHQAPPVPGPV

SEQ ID NO: 571449 - protein, 5 aa, Mycobacterium
RTHRA

SEQ ID NO: 571450 - protein, 5 aa, Mycobacterium
RTHRD

SEQ ID NO: 571451 - protein, 6 aa, Mycobacterium
RTHRED

SEQ ID NO: 571452 - protein, 12 aa, Mycobacterium
RTHREDADERAH

SEQ ID NO: 571453 - protein, 6 aa, Mycobacterium
RTHRPV

SEQ ID NO: 571454 - protein, 15 aa, Mycobacterium
RTHRRAHQPPGRRRP

SEQ ID NO: 571455 - protein, 7 aa, Mycobacterium
RTHRREY

SEQ ID NO: 571456 - protein, 10 aa, Mycobacterium
RTHRSGTTDS

SEQ ID NO: 571457 - protein, 7 aa, Mycobacterium
RTHSDGR

SEQ ID NO: 571458 - protein, 4 aa, Mycobacterium
RTHT

SEQ ID NO: 571459 - protein, 9 aa, Mycobacterium
RTHTTRPRE

SEQ ID NO: 571460 - protein, 4 aa, Mycobacterium
RTIA

SEQ ID NO: 571461 - protein, 6 aa, Mycobacterium
RTIAES

SEQ ID NO: 571462 - protein, 5 aa, Mycobacterium
RTIAS

SEQ ID NO: 571463 - protein, 11 aa, Mycobacterium
RTIATQGAEIS

SEQ ID NO: 571464 - protein, 4 aa, Mycobacterium
RTID

SEQ ID NO: 571465 - protein, 17 aa, Mycobacterium
RTIDTPLTETTGRRGGI

SEQ ID NO: 571466 - protein, 4 aa, Mycobacterium
RTIE

SEQ ID NO: 571467 - protein, 8 aa, Mycobacterium
RTIEDETL

SEQ ID NO: 571468 - protein, 10 aa, Mycobacterium
RTIEGKPSAT

SEQ ID NO: 571469 - protein, 5 aa, Mycobacterium
RTIER

SEQ ID NO: 571470 - protein, 11 aa, Mycobacterium
RTINAQQKDLD

SEQ ID NO: 571471 - protein, 9 aa, Mycobacterium
RTINGSYAE

SEQ ID NO: 571472 - protein, 4 aa, Mycobacterium
RTIP

SEQ ID NO: 571473 - protein, 6 aa, Mycobacterium
RTIPGA

SEQ ID NO: 571474 - protein, 10 aa, Mycobacterium
RTIPKTTSDW

SEQ ID NO: 571475 - protein, 10 aa, Mycobacterium
RTIPRADQGT

SEQ ID NO: 571476 - protein, 14 aa, Mycobacterium
RTIQEETGVKPPWA

SEQ ID NO: 571477 - protein, 10 aa, Mycobacterium
RTIRDETGAN

SEQ ID NO: 571478 - protein, 13 aa, Mycobacterium
RTIRYDQDNRRLQ

SEQ ID NO: 571479 - protein, 21 aa, Mycobacterium
RTISEAGQAMASTEGNVTGMF

SEQ ID NO: 571480 - protein, 4 aa, Mycobacterium
RTIT

SEQ ID NO: 571481 - protein, 10 aa, Mycobacterium
RTITPDGDDA

SEQ ID NO: 571482 - protein, 10 aa, Mycobacterium
RTITSAGRFG

SEQ ID NO: 571483 - protein, 9 aa, Mycobacterium
RTKAGKTHR

SEQ ID NO: 571484 - protein, 7 aa, Mycobacterium
RTKALRG

SEQ ID NO: 571485 - protein, 5 aa, Mycobacterium
RTKAN

SEQ ID NO: 571486 - protein, 17 aa, Mycobacterium
RTKAPRRRTGSGRTAPV

SEQ ID NO: 571487 - protein, 11 aa, Mycobacterium
RTKARDDGRPL

SEQ ID NO: 571488 - protein, 30 aa, Mycobacterium
RTKDEGAPLSGKAEFDTPDFTAKGADGNPL

SEQ ID NO: 571489 - protein, 16 aa, Mycobacterium
RTKDGKISQRNFGGHT

SEQ ID NO: 571490 - protein, 7 aa, Mycobacterium
RTKDRKN

SEQ ID NO: 571491 - protein, 9 aa, Mycobacterium
RTKDRKNGA

SEQ ID NO: 571492 - protein, 9 aa, Mycobacterium
RTKDRTGVE

SEQ ID NO: 571493 - protein, 9 aa, Mycobacterium
RTKDVRTDP

SEQ ID NO: 571494 - protein, 11 aa, Mycobacterium
RTKEPGSQGEP

SEQ ID NO: 571495 - protein, 4 aa, Mycobacterium
RTKG

SEQ ID NO: 571496 - protein, 6 aa, Mycobacterium
RTKGVD

SEQ ID NO: 571497 - protein, 12 aa, Mycobacterium
RTKGVSAENAAA

SEQ ID NO: 571498 - protein, 11 aa, Mycobacterium
RTKKGKAAYSR

SEQ ID NO: 571499 - protein, 9 aa, Mycobacterium
RTKLADQVA

SEQ ID NO: 571500 - protein, 5 aa, Mycobacterium
RTKNA

SEQ ID NO: 571501 - protein, 5 aa, Mycobacterium
RTKNN

SEQ ID NO: 571502 - protein, 11 aa, Mycobacterium
RTKPDDEDAES

SEQ ID NO: 571503 - protein, 10 aa, Mycobacterium
RTKPDDTAES

SEQ ID NO: 571504 - protein, 10 aa, Mycobacterium
RTKPEDEAES

SEQ ID NO: 571505 - protein, 17 aa, Mycobacterium
RTKPGTEKIPVPDTQYG

SEQ ID NO: 571506 - protein, 8 aa, Mycobacterium
RTKPPRYF

SEQ ID NO: 571507 - protein, 10 aa, Mycobacterium
RTKPQTAAVG

SEQ ID NO: 571508 - protein, 10 aa, Mycobacterium
RTKPRSPEGL

SEQ ID NO: 571509 - protein, 11 aa, Mycobacterium
RTKPRSPEGLK

SEQ ID NO: 571510 - protein, 5 aa, Mycobacterium
RTKQG

SEQ ID NO: 571511 - protein, 20 aa, Mycobacterium
RTKRAQREARRAVGGADDLA

SEQ ID NO: 571512 - protein, 6 aa, Mycobacterium
RTKRSL

SEQ ID NO: 571513 - protein, 5 aa, Mycobacterium
RTKSA

SEQ ID NO: 571514 - protein, 18 aa, Mycobacterium
RTKSGPRRYAVAYEVVFT

SEQ ID NO: 571515 - protein, 8 aa, Mycobacterium
RTKSPIQQ

SEQ ID NO: 571516 - protein, 7 aa, Mycobacterium
RTKTAIQ

SEQ ID NO: 571517 - protein, 9 aa, Mycobacterium
RTKTDTPSY

SEQ ID NO: 571518 - protein, 6 aa, Mycobacterium
RTKTEA

SEQ ID NO: 571519 - protein, 8 aa, Mycobacterium
RTKTGATV

SEQ ID NO: 571520 - protein, 22 aa, Mycobacterium
RTKTGTGEAIRARPGLQARRRT

SEQ ID NO: 571521 - protein, 9 aa, Mycobacterium
RTKTKDEAL

SEQ ID NO: 571522 - protein, 7 aa, Mycobacterium
RTKTPIQ

SEQ ID NO: 571523 - protein, 7 aa, Mycobacterium
RTKTRGA

SEQ ID NO: 571524 - protein, 6 aa, Mycobacterium
RTKTVE

SEQ ID NO: 571525 - protein, 8 aa, Mycobacterium
RTKVGGEG

SEQ ID NO: 571526 - protein, 14 aa, Mycobacterium
RTKVPSPRRIAERG

SEQ ID NO: 571527 - protein, 6 aa, Mycobacterium
RTLADG

SEQ ID NO: 571528 - protein, 16 aa, Mycobacterium
RTLAENGVAPSATRRE

SEQ ID NO: 571529 - protein, 19 aa, Mycobacterium
RTLAGQPGHVPAPPSRAEQ

SEQ ID NO: 571530 - protein, 8 aa, Mycobacterium
RTLAPAGR

SEQ ID NO: 571531 - protein, 8 aa, Mycobacterium
RTLAPSSV

SEQ ID NO: 571532 - protein, 13 aa, Mycobacterium
RTLDDPAAAAERA

SEQ ID NO: 571533 - protein, 10 aa, Mycobacterium
RTLDGAEEAG

SEQ ID NO: 571534 - protein, 7 aa, Mycobacterium
RTLDTAG

SEQ ID NO: 571535 - protein, 7 aa, Mycobacterium
RTLEQRG

SEQ ID NO: 571536 - protein, 7 aa, Mycobacterium
RTLETRE

SEQ ID NO: 571537 - protein, 18 aa, Mycobacterium
RTLETREATYYSRSRDEQ

SEQ ID NO: 571538 - protein, 18 aa, Mycobacterium
RTLETREATYYSRSRGEQ

SEQ ID NO: 571539 - protein, 11 aa, Mycobacterium
RTLGDYPRPSV

SEQ ID NO: 571540 - protein, 20 aa, Mycobacterium
RTLGSESVPLDATAAGAGKV

SEQ ID NO: 571541 - protein, 18 aa, Mycobacterium
RTLKTREATYYSRSRGEQ

SEQ ID NO: 571542 - protein, 5 aa, Mycobacterium
RTLNG

SEQ ID NO: 571543 - protein, 5 aa, Mycobacterium
RTLNS

SEQ ID NO: 571544 - protein, 4 aa, Mycobacterium
RTLP

SEQ ID NO: 571545 - protein, 5 aa, Mycobacterium
RTLPE

SEQ ID NO: 571546 - protein, 6 aa, Mycobacterium
RTLPEE

SEQ ID NO: 571547 - protein, 9 aa, Mycobacterium
RTLPEPSQP

SEQ ID NO: 571548 - protein, 12 aa, Mycobacterium
RTLPGAEGFPEE

SEQ ID NO: 571549 - protein, 12 aa, Mycobacterium
RTLPGAESFPEE

SEQ ID NO: 571550 - protein, 14 aa, Mycobacterium
RTLPGRAVPGDGTI

SEQ ID NO: 571551 - protein, 7 aa, Mycobacterium
RTLPPEV

SEQ ID NO: 571552 - protein, 8 aa, Mycobacterium
RTLPRPGR

SEQ ID NO: 571553 - protein, 8 aa, Mycobacterium
RTLPSDTT

SEQ ID NO: 571554 - protein, 7 aa, Mycobacterium
RTLPSER

SEQ ID NO: 571555 - protein, 7 aa, Mycobacterium
RTLPTDT

SEQ ID NO: 571556 - protein, 8 aa, Mycobacterium
RTLQPDRE

SEQ ID NO: 571557 - protein, 11 aa, Mycobacterium
RTLQSGPDISH

SEQ ID NO: 571558 - protein, 7 aa, Mycobacterium
RTLQTRE

SEQ ID NO: 571559 - protein, 20 aa, Mycobacterium
RTLREAADGHAQRLGGVGET

SEQ ID NO: 571560 - protein, 11 aa, Mycobacterium
RTLRPNSYPTR

SEQ ID NO: 571561 - protein, 10 aa, Mycobacterium
RTLSDAQRSH

SEQ ID NO: 571562 - protein, 11 aa, Mycobacterium
RTLSGHDEAAE

SEQ ID NO: 571563 - protein, 9 aa, Mycobacterium
RTLSPADAL

SEQ ID NO: 571564 - protein, 49 aa, Mycobacterium
RTLSRGQHRSGRRGPHDPVGRARRSRRTRGRAKGLKGDVSHDVEPERAA

SEQ ID NO: 571565 - protein, 5 aa, Mycobacterium
RTLTD

SEQ ID NO: 571566 - protein, 10 aa, Mycobacterium
RTLTPDGDDA

SEQ ID NO: 571567 - protein, 9 aa, Mycobacterium
RTLTPDSLR

SEQ ID NO: 571568 - protein, 4 aa, Mycobacterium
RTMD

SEQ ID NO: 571569 - protein, 8 aa, Mycobacterium
RTMKDEKG

SEQ ID NO: 571570 - protein, 13 aa, Mycobacterium
RTMPAPGAGIVER

SEQ ID NO: 571571 - protein, 5 aa, Mycobacterium
RTMTQ

SEQ ID NO: 571572 - protein, 15 aa, Mycobacterium
RTNAATAIGADGTLT

SEQ ID NO: 571573 - protein, 10 aa, Mycobacterium
RTNAGLNPDA

SEQ ID NO: 571574 - protein, 10 aa, Mycobacterium
RTNANGSKGF

SEQ ID NO: 571575 - protein, 9 aa, Mycobacterium
RTNANHTEG

SEQ ID NO: 571576 - protein, 5 aa, Mycobacterium
RTNDA

SEQ ID NO: 571577 - protein, 9 aa, Mycobacterium
RTNDKGDVD

SEQ ID NO: 571578 - protein, 7 aa, Mycobacterium
RTNDTGF

SEQ ID NO: 571579 - protein, 6 aa, Mycobacterium
RTNEAD

SEQ ID NO: 571580 - protein, 19 aa, Mycobacterium
RTNERARLRNQATKSSLRT

SEQ ID NO: 571581 - protein, 18 aa, Mycobacterium
RTNERRRLRNQSVKSSLR

SEQ ID NO: 571582 - protein, 11 aa, Mycobacterium
RTNGGKVGGQF

SEQ ID NO: 571583 - protein, 9 aa, Mycobacterium
RTNGNALQP

SEQ ID NO: 571584 - protein, 6 aa, Mycobacterium
RTNGVR

SEQ ID NO: 571585 - protein, 7 aa, Mycobacterium
RTNKARL

SEQ ID NO: 571586 - protein, 22 aa, Mycobacterium
RTNKGARSAGADGTAPRSVGAA

SEQ ID NO: 571587 - protein, 4 aa, Mycobacterium
RTNL

SEQ ID NO: 571588 - protein, 7 aa, Mycobacterium
RTNNGLG

SEQ ID NO: 571589 - protein, 8 aa, Mycobacterium
RTNPFGDS

SEQ ID NO: 571590 - protein, 6 aa, Mycobacterium
RTNPSQ

SEQ ID NO: 571591 - protein, 5 aa, Mycobacterium
RTNPV

SEQ ID NO: 571592 - protein, 12 aa, Mycobacterium
RTNQTVSTAAGT

SEQ ID NO: 571593 - protein, 5 aa, Mycobacterium
RTNRA

SEQ ID NO: 571594 - protein, 7 aa, Mycobacterium
RTNRAEL

SEQ ID NO: 571595 - protein, 11 aa, Mycobacterium
RTNRRGENTTV

SEQ ID NO: 571596 - protein, 11 aa, Mycobacterium
RTNRRGEPGTV

SEQ ID NO: 571597 - protein, 6 aa, Mycobacterium
RTNRSN

SEQ ID NO: 571598 - protein, 6 aa, Mycobacterium
RTNRTN

SEQ ID NO: 571599 - protein, 7 aa, Mycobacterium
RTNRTNQ

SEQ ID NO: 571600 - protein, 11 aa, Mycobacterium
RTNSPDGRPIR

SEQ ID NO: 571601 - protein, 15 aa, Mycobacterium
RTNSPELGSLPTTEP

SEQ ID NO: 571602 - protein, 5 aa, Mycobacterium
RTNTV

SEQ ID NO: 571603 - protein, 4 aa, Mycobacterium
RTPA

SEQ ID NO: 571604 - protein, 19 aa, Mycobacterium
RTPAAAATDVADLAAPIVS

SEQ ID NO: 571605 - protein, 5 aa, Mycobacterium
RTPAD

SEQ ID NO: 571606 - protein, 6 aa, Mycobacterium
RTPADG

SEQ ID NO: 571607 - protein, 9 aa, Mycobacterium
RTPADTPLQ

SEQ ID NO: 571608 - protein, 9 aa, Mycobacterium
RTPAELTTP

SEQ ID NO: 571609 - protein, 6 aa, Mycobacterium
RTPAEY

SEQ ID NO: 571610 - protein, 18 aa, Mycobacterium
RTPAGDASERGQTPTTRG

SEQ ID NO: 571611 - protein, 9 aa, Mycobacterium
RTPAGLAAQ

SEQ ID NO: 571612 - protein, 14 aa, Mycobacterium
RTPAGRAGAADDIA

SEQ ID NO: 571613 - protein, 5 aa, Mycobacterium
RTPAL

SEQ ID NO: 571614 - protein, 5 aa, Mycobacterium
RTPAM

SEQ ID NO: 571615 - protein, 6 aa, Mycobacterium
RTPAMA

SEQ ID NO: 571616 - protein, 9 aa, Mycobacterium
RTPANQPLP

SEQ ID NO: 571617 - protein, 9 aa, Mycobacterium
RTPAPDRKA

SEQ ID NO: 571618 - protein, 13 aa, Mycobacterium
RTPAPGAAASVPA

SEQ ID NO: 571619 - protein, 9 aa, Mycobacterium
RTPAPPGGW

SEQ ID NO: 571620 - protein, 9 aa, Mycobacterium
RTPAQPPKI

SEQ ID NO: 571621 - protein, 13 aa, Mycobacterium
RTPATLREGARRA

SEQ ID NO: 571622 - protein, 5 aa, Mycobacterium
RTPDA

SEQ ID NO: 571623 - protein, 8 aa, Mycobacterium
RTPDAQRA

SEQ ID NO: 571624 - protein, 8 aa, Mycobacterium
RTPDELRD

SEQ ID NO: 571625 - protein, 5 aa, Mycobacterium
RTPDG

SEQ ID NO: 571626 - protein, 7 aa, Mycobacterium
RTPDGAR

SEQ ID NO: 571627 - protein, 8 aa, Mycobacterium
RTPDGARS

SEQ ID NO: 571628 - protein, 9 aa, Mycobacterium
RTPDGLGGG

SEQ ID NO: 571629 - protein, 7 aa, Mycobacterium
RTPDGSR

SEQ ID NO: 571630 - protein, 8 aa, Mycobacterium
RTPDGTAT

SEQ ID NO: 571631 - protein, 7 aa, Mycobacterium
RTPDGVR

SEQ ID NO: 571632 - protein, 7 aa, Mycobacterium
RTPDPEV

SEQ ID NO: 571633 - protein, 5 aa, Mycobacterium
RTPDR

SEQ ID NO: 571634 - protein, 10 aa, Mycobacterium
RTPDRAESAK

SEQ ID NO: 571635 - protein, 14 aa, Mycobacterium
RTPDTPAGSLGPLP

SEQ ID NO: 571636 - protein, 16 aa, Mycobacterium
RTPDTPPGSLGPLPPG

SEQ ID NO: 571637 - protein, 6 aa, Mycobacterium
RTPDVT

SEQ ID NO: 571638 - protein, 7 aa, Mycobacterium
RTPDYRG

SEQ ID NO: 571639 - protein, 5 aa, Mycobacterium
RTPEA

SEQ ID NO: 571640 - protein, 8 aa, Mycobacterium
RTPEAAAE

SEQ ID NO: 571641 - protein, 12 aa, Mycobacterium
RTPEAPSAEALG

SEQ ID NO: 571642 - protein, 27 aa, Mycobacterium
RTPEAQSETETAESEQQSAPEPQSESL

SEQ ID NO: 571643 - protein, 16 aa, Mycobacterium
RTPEATRKLASRARRR

SEQ ID NO: 571644 - protein, 11 aa, Mycobacterium
RTPEDNVAARQ

SEQ ID NO: 571645 - protein, 9 aa, Mycobacterium
RTPEDRRRS

SEQ ID NO: 571646 - protein, 19 aa, Mycobacterium
RTPEESLDHPQTAHEGRAA

SEQ ID NO: 571647 - protein, 7 aa, Mycobacterium
RTPEGSR

SEQ ID NO: 571648 - protein, 8 aa, Mycobacterium
RTPEGTVE

SEQ ID NO: 571649 - protein, 9 aa, Mycobacterium
RTPEKLSGV

SEQ ID NO: 571650 - protein, 10 aa, Mycobacterium
RTPEPDPGFG

SEQ ID NO: 571651 - protein, 11 aa, Mycobacterium
RTPEQAGTFGN

SEQ ID NO: 571652 - protein, 9 aa, Mycobacterium
RTPEQDGYS

SEQ ID NO: 571653 - protein, 7 aa, Mycobacterium
RTPERGM

SEQ ID NO: 571654 - protein, 7 aa, Mycobacterium
RTPERLD

SEQ ID NO: 571655 - protein, 17 aa, Mycobacterium
RTPESARKLASRARRRI

SEQ ID NO: 571656 - protein, 10 aa, Mycobacterium
RTPESLAATR

SEQ ID NO: 571657 - protein, 9 aa, Mycobacterium
RTPESQDPR

SEQ ID NO: 571658 - protein, 8 aa, Mycobacterium
RTPETGSV

SEQ ID NO: 571659 - protein, 17 aa, Mycobacterium
RTPETHQSAGLNPGGIE

SEQ ID NO: 571660 - protein, 8 aa, Mycobacterium
RTPFHDPD

SEQ ID NO: 571661 - protein, 13 aa, Mycobacterium
RTPFHDPDRRASL

SEQ ID NO: 571662 - protein, 9 aa, Mycobacterium
RTPFHDPGR

SEQ ID NO: 571663 - protein, 4 aa, Mycobacterium
RTPG

SEQ ID NO: 571664 - protein, 7 aa, Mycobacterium
RTPGAEV

SEQ ID NO: 571665 - protein, 10 aa, Mycobacterium
RTPGAQAEVG

SEQ ID NO: 571666 - protein, 10 aa, Mycobacterium
RTPGAVSPDG

SEQ ID NO: 571667 - protein, 6 aa, Mycobacterium
RTPGDC

SEQ ID NO: 571668 - protein, 6 aa, Mycobacterium
RTPGDL

SEQ ID NO: 571669 - protein, 10 aa, Mycobacterium
RTPGDPNALY

SEQ ID NO: 571670 - protein, 8 aa, Mycobacterium
RTPGDTQT

SEQ ID NO: 571671 - protein, 8 aa, Mycobacterium
RTPGGAQT

SEQ ID NO: 571672 - protein, 12 aa, Mycobacterium
RTPGGRQGRRPS

SEQ ID NO: 571673 - protein, 14 aa, Mycobacterium
RTPGGSSGGSGAAV

SEQ ID NO: 571674 - protein, 17 aa, Mycobacterium
RTPGKDPARAEHKAAEF

SEQ ID NO: 571675 - protein, 18 aa, Mycobacterium
RTPGKDPARAERKGAEFG

SEQ ID NO: 571676 - protein, 13 aa, Mycobacterium
RTPGLEADAKRQG

SEQ ID NO: 571677 - protein, 13 aa, Mycobacterium
RTPGLEADAQRQG

SEQ ID NO: 571678 - protein, 6 aa, Mycobacterium
RTPGND

SEQ ID NO: 571679 - protein, 5 aa, Mycobacterium
RTPGP

SEQ ID NO: 571680 - protein, 11 aa, Mycobacterium
RTPGPLAPSAA

SEQ ID NO: 571681 - protein, 7 aa, Mycobacterium
RTPGPPG

SEQ ID NO: 571682 - protein, 18 aa, Mycobacterium
RTPGRDDERSATKAAEFG

SEQ ID NO: 571683 - protein, 6 aa, Mycobacterium
RTPGRS

SEQ ID NO: 571684 - protein, 6 aa, Mycobacterium
RTPGSD

SEQ ID NO: 571685 - protein, 7 aa, Mycobacterium
RTPGSDF

SEQ ID NO: 571686 - protein, 7 aa, Mycobacterium
RTPGSDI

SEQ ID NO: 571687 - protein, 7 aa, Mycobacterium
RTPGSDV

SEQ ID NO: 571688 - protein, 8 aa, Mycobacterium
RTPGSDVE

SEQ ID NO: 571689 - protein, 6 aa, Mycobacterium
RTPGVE

SEQ ID NO: 571690 - protein, 6 aa, Mycobacterium
RTPGYD

SEQ ID NO: 571691 - protein, 7 aa, Mycobacterium
RTPHREA

SEQ ID NO: 571692 - protein, 8 aa, Mycobacterium
RTPIDDPA

SEQ ID NO: 571693 - protein, 5 aa, Mycobacterium
RTPIG

SEQ ID NO: 571694 - protein, 13 aa, Mycobacterium
RTPIGTARKGTLA

SEQ ID NO: 571695 - protein, 5 aa, Mycobacterium
RTPIR

SEQ ID NO: 571696 - protein, 5 aa, Mycobacterium
RTPIT

SEQ ID NO: 571697 - protein, 4 aa, Mycobacterium
RTPK

SEQ ID NO: 571698 - protein, 4 aa, Mycobacterium
RTPL

SEQ ID NO: 571699 - protein, 6 aa, Mycobacterium
RTPLSS

SEQ ID NO: 571700 - protein, 5 aa, Mycobacterium
RTPLT

SEQ ID NO: 571701 - protein, 4 aa, Mycobacterium
RTPM

SEQ ID NO: 571702 - protein, 12 aa, Mycobacterium
RTPNGTQETHDR

SEQ ID NO: 571703 - protein, 6 aa, Mycobacterium
RTPNPH

SEQ ID NO: 571704 - protein, 36 aa, Mycobacterium
RTPNTITATTTVTATAANAIRTRQDPGAAHATSTTC

SEQ ID NO: 571705 - protein, 7 aa, Mycobacterium
RTPPAGA

SEQ ID NO: 571706 - protein, 11 aa, Mycobacterium
RTPPDPQWPGG

SEQ ID NO: 571707 - protein, 17 aa, Mycobacterium
RTPPDPSADASGPPTYV

SEQ ID NO: 571708 - protein, 7 aa, Mycobacterium
RTPPDYA

SEQ ID NO: 571709 - protein, 6 aa, Mycobacterium
RTPPGL

SEQ ID NO: 571710 - protein, 7 aa, Mycobacterium
RTPPKTL

SEQ ID NO: 571711 - protein, 10 aa, Mycobacterium
RTPPPPPTAA

SEQ ID NO: 571712 - protein, 5 aa, Mycobacterium
RTPPQ

SEQ ID NO: 571713 - protein, 47 aa, Mycobacterium
RTPPRRRRQGRPIRAREQSQHRHEDMSSGNPISDLGDHEGAGHRDRD

SEQ ID NO: 571714 - protein, 7 aa, Mycobacterium
RTPPRTL

SEQ ID NO: 571715 - protein, 9 aa, Mycobacterium
RTPPWDRAT

SEQ ID NO: 571716 - protein, 8 aa, Mycobacterium
RTPPWNRA

SEQ ID NO: 571717 - protein, 7 aa, Mycobacterium
RTPPWPN

SEQ ID NO: 571718 - protein, 9 aa, Mycobacterium
RTPPYATAT

SEQ ID NO: 571719 - protein, 10 aa, Mycobacterium
RTPPYNTATS

SEQ ID NO: 571720 - protein, 4 aa, Mycobacterium
RTPQ

SEQ ID NO: 571721 - protein, 5 aa, Mycobacterium
RTPQD

SEQ ID NO: 571722 - protein, 7 aa, Mycobacterium
RTPQGAE

SEQ ID NO: 571723 - protein, 8 aa, Mycobacterium
RTPQGRID

SEQ ID NO: 571724 - protein, 10 aa, Mycobacterium
RTPQGTRLTE

SEQ ID NO: 571725 - protein, 10 aa, Mycobacterium
RTPQGTTLTE

SEQ ID NO: 571726 - protein, 5 aa, Mycobacterium
RTPQL

SEQ ID NO: 571727 - protein, 5 aa, Mycobacterium
RTPQQ

SEQ ID NO: 571728 - protein, 4 aa, Mycobacterium
RTPR

SEQ ID NO: 571729 - protein, 5 aa, Mycobacterium
RTPRG

SEQ ID NO: 571730 - protein, 7 aa, Mycobacterium
RTPRGAT

SEQ ID NO: 571731 - protein, 11 aa, Mycobacterium
RTPRGRAPGAN

SEQ ID NO: 571732 - protein, 9 aa, Mycobacterium
RTPRGRVAT

SEQ ID NO: 571733 - protein, 7 aa, Mycobacterium
RTPRLNG

SEQ ID NO: 571734 - protein, 5 aa, Mycobacterium
RTPRP

SEQ ID NO: 571735 - protein, 8 aa, Mycobacterium
RTPRPNPR

SEQ ID NO: 571736 - protein, 13 aa, Mycobacterium
RTPRRPRPWRASP

SEQ ID NO: 571737 - protein, 6 aa, Mycobacterium
RTPRSA

SEQ ID NO: 571738 - protein, 13 aa, Mycobacterium
RTPRTDSAVGPFR

SEQ ID NO: 571739 - protein, 6 aa, Mycobacterium
RTPRTI

SEQ ID NO: 571740 - protein, 15 aa, Mycobacterium
RTPSAGRTPTQPTVR

SEQ ID NO: 571741 - protein, 6 aa, Mycobacterium
RTPSAR

SEQ ID NO: 571742 - protein, 13 aa, Mycobacterium
RTPSASTLIHDDQ

SEQ ID NO: 571743 - protein, 9 aa, Mycobacterium
RTPSDAPLS

SEQ ID NO: 571744 - protein, 7 aa, Mycobacterium
RTPSDHP

SEQ ID NO: 571745 - protein, 7 aa, Mycobacterium
RTPSDID

SEQ ID NO: 571746 - protein, 8 aa, Mycobacterium
RTPSDTAL

SEQ ID NO: 571747 - protein, 9 aa, Mycobacterium
RTPSERTER

SEQ ID NO: 571748 - protein, 8 aa, Mycobacterium
RTPSGDTL

SEQ ID NO: 571749 - protein, 11 aa, Mycobacterium
RTPSKLDRTEW

SEQ ID NO: 571750 - protein, 10 aa, Mycobacterium
RTPSKTAPLV

SEQ ID NO: 571751 - protein, 5 aa, Mycobacterium
RTPSQ

SEQ ID NO: 571752 - protein, 5 aa, Mycobacterium
RTPSR

SEQ ID NO: 571753 - protein, 13 aa, Mycobacterium
RTPSRGADPTATL

SEQ ID NO: 571754 - protein, 6 aa, Mycobacterium
RTPSRT

SEQ ID NO: 571755 - protein, 7 aa, Mycobacterium
RTPSVTE

SEQ ID NO: 571756 - protein, 21 aa, Mycobacterium
RTPTDDLRATDDGGQGPRGIA

SEQ ID NO: 571757 - protein, 7 aa, Mycobacterium
RTPTDGR

SEQ ID NO: 571758 - protein, 7 aa, Mycobacterium
RTPTDTT

SEQ ID NO: 571759 - protein, 7 aa, Mycobacterium
RTPTEGR

SEQ ID NO: 571760 - protein, 5 aa, Mycobacterium
RTPTG

SEQ ID NO: 571761 - protein, 6 aa, Mycobacterium
RTPTGA

SEQ ID NO: 571762 - protein, 8 aa, Mycobacterium
RTPTGART

SEQ ID NO: 571763 - protein, 6 aa, Mycobacterium
RTPTGD

SEQ ID NO: 571764 - protein, 12 aa, Mycobacterium
RTPTGDQVTIVP

SEQ ID NO: 571765 - protein, 6 aa, Mycobacterium
RTPTGE

SEQ ID NO: 571766 - protein, 8 aa, Mycobacterium
RTPTKTAA

SEQ ID NO: 571767 - protein, 8 aa, Mycobacterium
RTPTPDFP

SEQ ID NO: 571768 - protein, 9 aa, Mycobacterium
RTPTVSPGE

SEQ ID NO: 571769 - protein, 7 aa, Mycobacterium
RTPVASQ

SEQ ID NO: 571770 - protein, 7 aa, Mycobacterium
RTPVGDA

SEQ ID NO: 571771 - protein, 13 aa, Mycobacterium
RTPVGRAATEPMR

SEQ ID NO: 571772 - protein, 9 aa, Mycobacterium
RTPVPAKNR

SEQ ID NO: 571773 - protein, 6 aa, Mycobacterium
RTPVSG

SEQ ID NO: 571774 - protein, 6 aa, Mycobacterium
RTPVST

SEQ ID NO: 571775 - protein, 10 aa, Mycobacterium
RTPVTGGAKG

SEQ ID NO: 571776 - protein, 4 aa, Mycobacterium
RTPW

SEQ ID NO: 571777 - protein, 17 aa, Mycobacterium
RTPYKRSFESDNATDRE

SEQ ID NO: 571778 - protein, 6 aa, Mycobacterium
RTQAAR

SEQ ID NO: 571779 - protein, 5 aa, Mycobacterium
RTQAD

SEQ ID NO: 571780 - protein, 8 aa, Mycobacterium
RTQAEGGW

SEQ ID NO: 571781 - protein, 8 aa, Mycobacterium
RTQDDIDA

SEQ ID NO: 571782 - protein, 5 aa, Mycobacterium
RTQGL

SEQ ID NO: 571783 - protein, 8 aa, Mycobacterium
RTQGLRRE

SEQ ID NO: 571784 - protein, 5 aa, Mycobacterium
RTQHP

SEQ ID NO: 571785 - protein, 4 aa, Mycobacterium
RTQL

SEQ ID NO: 571786 - protein, 5 aa, Mycobacterium
RTQLE

SEQ ID NO: 571787 - protein, 6 aa, Mycobacterium
RTQNEL

SEQ ID NO: 571788 - protein, 6 aa, Mycobacterium
RTQPEF

SEQ ID NO: 571789 - protein, 6 aa, Mycobacterium
RTQPEL

SEQ ID NO: 571790 - protein, 8 aa, Mycobacterium
RTQPPDEL

SEQ ID NO: 571791 - protein, 14 aa, Mycobacterium
RTQPRPEASQELLP

SEQ ID NO: 571792 - protein, 8 aa, Mycobacterium
RTQPRRRP

SEQ ID NO: 571793 - protein, 6 aa, Mycobacterium
RTQPTW

SEQ ID NO: 571794 - protein, 6 aa, Mycobacterium
RTQRAG

SEQ ID NO: 571795 - protein, 6 aa, Mycobacterium
RTQREQ

SEQ ID NO: 571796 - protein, 5 aa, Mycobacterium
RTQRG

SEQ ID NO: 571797 - protein, 9 aa, Mycobacterium
RTQRPPPFP

SEQ ID NO: 571798 - protein, 6 aa, Mycobacterium
RTQRPT

SEQ ID NO: 571799 - protein, 8 aa, Mycobacterium
RTQSPHAR

SEQ ID NO: 571800 - protein, 7 aa, Mycobacterium
RTQSPTK

SEQ ID NO: 571801 - protein, 7 aa, Mycobacterium
RTQSQIA

SEQ ID NO: 571802 - protein, 7 aa, Mycobacterium
RTQSQLD

SEQ ID NO: 571803 - protein, 9 aa, Mycobacterium
RTQSQLDEV

SEQ ID NO: 571804 - protein, 7 aa, Mycobacterium
RTQSRLD

SEQ ID NO: 571805 - protein, 4 aa, Mycobacterium
RTQT

SEQ ID NO: 571806 - protein, 7 aa, Mycobacterium
RTQTPMA

SEQ ID NO: 571807 - protein, 6 aa, Mycobacterium
RTQTRD

SEQ ID NO: 571808 - protein, 8 aa, Mycobacterium
RTQVRGAT

SEQ ID NO: 571809 - protein, 8 aa, Mycobacterium
RTRAADYP

SEQ ID NO: 571810 - protein, 10 aa, Mycobacterium
RTRAAEGARR

SEQ ID NO: 571811 - protein, 10 aa, Mycobacterium
RTRAARTRRT

SEQ ID NO: 571812 - protein, 5 aa, Mycobacterium
RTRAE

SEQ ID NO: 571813 - protein, 9 aa, Mycobacterium
RTRAEDRAA

SEQ ID NO: 571814 - protein, 9 aa, Mycobacterium
RTRAELETQ

SEQ ID NO: 571815 - protein, 21 aa, Mycobacterium
RTRAERGRDARAQRLSQQRQR

SEQ ID NO: 571816 - protein, 17 aa, Mycobacterium
RTRAGDAHAAGLRPGGI

SEQ ID NO: 571817 - protein, 14 aa, Mycobacterium
RTRAGDAHADGQTV

SEQ ID NO: 571818 - protein, 10 aa, Mycobacterium
RTRAGEPGDL

SEQ ID NO: 571819 - protein, 10 aa, Mycobacterium
RTRAKGASQW

SEQ ID NO: 571820 - protein, 12 aa, Mycobacterium
RTRAQNRAQRIA

SEQ ID NO: 571821 - protein, 52 aa, Mycobacterium
RTRAQNRAQRIATERHRNRQARLTTPPAVPTSASPPGTAPSGPAPPDDEPPP

SEQ ID NO: 571822 - protein, 6 aa, Mycobacterium
RTRASC

SEQ ID NO: 571823 - protein, 12 aa, Mycobacterium
RTRATADSPQVV

SEQ ID NO: 571824 - protein, 9 aa, Mycobacterium
RTRDDEHSY

SEQ ID NO: 571825 - protein, 7 aa, Mycobacterium
RTRDEVD

SEQ ID NO: 571826 - protein, 10 aa, Mycobacterium
RTRDLSNEAT

SEQ ID NO: 571827 - protein, 6 aa, Mycobacterium
RTRDNQ

SEQ ID NO: 571828 - protein, 8 aa, Mycobacterium
RTRDPDGA

SEQ ID NO: 571829 - protein, 5 aa, Mycobacterium
RTRDQ

SEQ ID NO: 571830 - protein, 8 aa, Mycobacterium
RTRDQARR

SEQ ID NO: 571831 - protein, 7 aa, Mycobacterium
RTRDRIG

SEQ ID NO: 571832 - protein, 16 aa, Mycobacterium
RTRDRRPELLDAPERP

SEQ ID NO: 571833 - protein, 14 aa, Mycobacterium
RTRDSLRDNGNLSS

SEQ ID NO: 571834 - protein, 14 aa, Mycobacterium
RTREAAEDGATAGR

SEQ ID NO: 571835 - protein, 10 aa, Mycobacterium
RTREATPPVI

SEQ ID NO: 571836 - protein, 6 aa, Mycobacterium
RTREEF

SEQ ID NO: 571837 - protein, 11 aa, Mycobacterium
RTREELEEGQR

SEQ ID NO: 571838 - protein, 13 aa, Mycobacterium
RTRELASAQPAAV

SEQ ID NO: 571839 - protein, 6 aa, Mycobacterium
RTRENL

SEQ ID NO: 571840 - protein, 5 aa, Mycobacterium
RTREQ

SEQ ID NO: 571841 - protein, 18 aa, Mycobacterium
RTREQARRHVGRSGEATS

SEQ ID NO: 571842 - protein, 7 aa, Mycobacterium
RTRERRP

SEQ ID NO: 571843 - protein, 12 aa, Mycobacterium
RTRERRPDLAPP

SEQ ID NO: 571844 - protein, 12 aa, Mycobacterium
RTRERRPELAPP

SEQ ID NO: 571845 - protein, 10 aa, Mycobacterium
RTRETSRTPV

SEQ ID NO: 571846 - protein, 6 aa, Mycobacterium
RTREYR

SEQ ID NO: 571847 - protein, 19 aa, Mycobacterium
RTRFQQSAARSTDVTGAEH

SEQ ID NO: 571848 - protein, 7 aa, Mycobacterium
RTRGGGD

SEQ ID NO: 571849 - protein, 7 aa, Mycobacterium
RTRGPFT

SEQ ID NO: 571850 - protein, 13 aa, Mycobacterium
RTRGPFTTEQTAA

SEQ ID NO: 571851 - protein, 8 aa, Mycobacterium
RTRGPNES

SEQ ID NO: 571852 - protein, 9 aa, Mycobacterium
RTRGRADTY

SEQ ID NO: 571853 - protein, 6 aa, Mycobacterium
RTRGRP

SEQ ID NO: 571854 - protein, 9 aa, Mycobacterium
RTRGSGYEG

SEQ ID NO: 571855 - protein, 6 aa, Mycobacterium
RTRKAG

SEQ ID NO: 571856 - protein, 10 aa, Mycobacterium
RTRKITGTRK

SEQ ID NO: 571857 - protein, 10 aa, Mycobacterium
RTRKLASAKA

SEQ ID NO: 571858 - protein, 11 aa, Mycobacterium
RTRKRPDGRTE

SEQ ID NO: 571859 - protein, 5 aa, Mycobacterium
RTRLD

SEQ ID NO: 571860 - protein, 6 aa, Mycobacterium
RTRLDS

SEQ ID NO: 571861 - protein, 8 aa, Mycobacterium
RTRLGDPP

SEQ ID NO: 571862 - protein, 9 aa, Mycobacterium
RTRLTADGQ

SEQ ID NO: 571863 - protein, 14 aa, Mycobacterium
RTRNATGDVHDYGD

SEQ ID NO: 571864 - protein, 6 aa, Mycobacterium
RTRNRI

SEQ ID NO: 571865 - protein, 7 aa, Mycobacterium
RTRNRPK

SEQ ID NO: 571866 - protein, 11 aa, Mycobacterium
RTRPADSDTKA

SEQ ID NO: 571867 - protein, 7 aa, Mycobacterium
RTRPADV

SEQ ID NO: 571868 - protein, 7 aa, Mycobacterium
RTRPDAP

SEQ ID NO: 571869 - protein, 5 aa, Mycobacterium
RTRPE

SEQ ID NO: 571870 - protein, 6 aa, Mycobacterium
RTRPEH

SEQ ID NO: 571871 - protein, 8 aa, Mycobacterium
RTRPGPPV

SEQ ID NO: 571872 - protein, 8 aa, Mycobacterium
RTRPNDAD

SEQ ID NO: 571873 - protein, 12 aa, Mycobacterium
RTRPNDADTAAL

SEQ ID NO: 571874 - protein, 7 aa, Mycobacterium
RTRPPAV

SEQ ID NO: 571875 - protein, 5 aa, Mycobacterium
RTRPQ

SEQ ID NO: 571876 - protein, 10 aa, Mycobacterium
RTRPSDVTVD

SEQ ID NO: 571877 - protein, 6 aa, Mycobacterium
RTRPTV

SEQ ID NO: 571878 - protein, 5 aa, Mycobacterium
RTRPV

SEQ ID NO: 571879 - protein, 7 aa, Mycobacterium
RTRQEDW

SEQ ID NO: 571880 - protein, 5 aa, Mycobacterium
RTRRE

SEQ ID NO: 571881 - protein, 5 aa, Mycobacterium
RTRRG

SEQ ID NO: 571882 - protein, 7 aa, Mycobacterium
RTRRGHK

SEQ ID NO: 571883 - protein, 6 aa, Mycobacterium
RTRRGQ

SEQ ID NO: 571884 - protein, 6 aa, Mycobacterium
RTRRGR

SEQ ID NO: 571885 - protein, 10 aa, Mycobacterium
RTRRPPPAPE

SEQ ID NO: 571886 - protein, 9 aa, Mycobacterium
RTRRPPPFP

SEQ ID NO: 571887 - protein, 5 aa, Mycobacterium
RTRRQ

SEQ ID NO: 571888 - protein, 5 aa, Mycobacterium
RTRSD

SEQ ID NO: 571889 - protein, 15 aa, Mycobacterium
RTRSDIAPGNRQPLP

SEQ ID NO: 571890 - protein, 8 aa, Mycobacterium
RTRSEAEV

SEQ ID NO: 571891 - protein, 6 aa, Mycobacterium
RTRSED

SEQ ID NO: 571892 - protein, 12 aa, Mycobacterium
RTRSGLEETHDE

SEQ ID NO: 571893 - protein, 7 aa, Mycobacterium
RTRSGSA

SEQ ID NO: 571894 - protein, 5 aa, Mycobacterium
RTRSK

SEQ ID NO: 571895 - protein, 19 aa, Mycobacterium
RTRSNGQGYDFTPAGPPRF

SEQ ID NO: 571896 - protein, 6 aa, Mycobacterium
RTRSQE

SEQ ID NO: 571897 - protein, 8 aa, Mycobacterium
RTRSQLDE

SEQ ID NO: 571898 - protein, 18 aa, Mycobacterium
RTRSSAGADGAPTPEGLH

SEQ ID NO: 571899 - protein, 8 aa, Mycobacterium
RTRSSSDD

SEQ ID NO: 571900 - protein, 8 aa, Mycobacterium
RTRTERDE

SEQ ID NO: 571901 - protein, 5 aa, Mycobacterium
RTRTG

SEQ ID NO: 571902 - protein, 5 aa, Mycobacterium
RTRTK

SEQ ID NO: 571903 - protein, 5 aa, Mycobacterium
RTRTP

SEQ ID NO: 571904 - protein, 6 aa, Mycobacterium
RTRTPL

SEQ ID NO: 571905 - protein, 9 aa, Mycobacterium
RTRTQPSAT

SEQ ID NO: 571906 - protein, 10 aa, Mycobacterium
RTRTSDDSEF

SEQ ID NO: 571907 - protein, 13 aa, Mycobacterium
RTRTSFGKTIGEH

SEQ ID NO: 571908 - protein, 8 aa, Mycobacterium
RTRTSGVS

SEQ ID NO: 571909 - protein, 9 aa, Mycobacterium
RTRTTPRSI

SEQ ID NO: 571910 - protein, 7 aa, Mycobacterium
RTRVPGP

SEQ ID NO: 571911 - protein, 4 aa, Mycobacterium
RTSA

SEQ ID NO: 571912 - protein, 10 aa, Mycobacterium
RTSAADRARV

SEQ ID NO: 571913 - protein, 6 aa, Mycobacterium
RTSAAS

SEQ ID NO: 571914 - protein, 8 aa, Mycobacterium
RTSADRGT

SEQ ID NO: 571915 - protein, 8 aa, Mycobacterium
RTSAGFTA

SEQ ID NO: 571916 - protein, 7 aa, Mycobacterium
RTSAKPI

SEQ ID NO: 571917 - protein, 13 aa, Mycobacterium
RTSAKWAASEDFS

SEQ ID NO: 571918 - protein, 8 aa, Mycobacterium
RTSANGEY

SEQ ID NO: 571919 - protein, 11 aa, Mycobacterium
RTSAPPAPRGV

SEQ ID NO: 571920 - protein, 11 aa, Mycobacterium
RTSARAVGSDI

SEQ ID NO: 571921 - protein, 14 aa, Mycobacterium
RTSARYSEAERTAA

SEQ ID NO: 571922 - protein, 26 aa, Mycobacterium
RTSASGEAATAASRAMEATEHGDPDA

SEQ ID NO: 571923 - protein, 5 aa, Mycobacterium
RTSAT

SEQ ID NO: 571924 - protein, 7 aa, Mycobacterium
RTSATYY

SEQ ID NO: 571925 - protein, 9 aa, Mycobacterium
RTSAVDPAA

SEQ ID NO: 571926 - protein, 11 aa, Mycobacterium
RTSDAAIPTRH

SEQ ID NO: 571927 - protein, 7 aa, Mycobacterium
RTSDADM

SEQ ID NO: 571928 - protein, 14 aa, Mycobacterium
RTSDAIPDRSEYGA

SEQ ID NO: 571929 - protein, 8 aa, Mycobacterium
RTSDDDMA

SEQ ID NO: 571930 - protein, 7 aa, Mycobacterium
RTSDEDM

SEQ ID NO: 571931 - protein, 8 aa, Mycobacterium
RTSDEDMA

SEQ ID NO: 571932 - protein, 15 aa, Mycobacterium
RTSDEMRQDLGVPFA

SEQ ID NO: 571933 - protein, 10 aa, Mycobacterium
RTSDGDADVD

SEQ ID NO: 571934 - protein, 11 aa, Mycobacterium
RTSDGDSPTTA

SEQ ID NO: 571935 - protein, 8 aa, Mycobacterium
RTSDGSVR

SEQ ID NO: 571936 - protein, 6 aa, Mycobacterium
RTSDPD

SEQ ID NO: 571937 - protein, 7 aa, Mycobacterium
RTSDPDV

SEQ ID NO: 571938 - protein, 8 aa, Mycobacterium
RTSDPGAR

SEQ ID NO: 571939 - protein, 7 aa, Mycobacterium
RTSDPQV

SEQ ID NO: 571940 - protein, 22 aa, Mycobacterium
RTSDPVRELPDGGTLPVTADDT

SEQ ID NO: 571941 - protein, 8 aa, Mycobacterium
RTSDSIEK

SEQ ID NO: 571942 - protein, 15 aa, Mycobacterium
RTSDTPEGALGPLPE

SEQ ID NO: 571943 - protein, 6 aa, Mycobacterium
RTSDVP

SEQ ID NO: 571944 - protein, 4 aa, Mycobacterium
RTSE

SEQ ID NO: 571945 - protein, 9 aa, Mycobacterium
RTSEDPALG

SEQ ID NO: 571946 - protein, 18 aa, Mycobacterium
RTSEERVNSVRGKADSLR

SEQ ID NO: 571947 - protein, 15 aa, Mycobacterium
RTSEGAAGAAPEADL

SEQ ID NO: 571948 - protein, 5 aa, Mycobacterium
RTSEL

SEQ ID NO: 571949 - protein, 23 aa, Mycobacterium
RTSEPFSPNDNPTEFITSDTYGE

SEQ ID NO: 571950 - protein, 8 aa, Mycobacterium
RTSEPGTR

SEQ ID NO: 571951 - protein, 5 aa, Mycobacterium
RTSEQ

SEQ ID NO: 571952 - protein, 6 aa, Mycobacterium
RTSERA

SEQ ID NO: 571953 - protein, 20 aa, Mycobacterium
RTSETSLTRPGQPARSLEEH

SEQ ID NO: 571954 - protein, 7 aa, Mycobacterium
RTSEYGG

SEQ ID NO: 571955 - protein, 9 aa, Mycobacterium
RTSEYRATE

SEQ ID NO: 571956 - protein, 5 aa, Mycobacterium
RTSFG

SEQ ID NO: 571957 - protein, 4 aa, Mycobacterium
RTSG

SEQ ID NO: 571958 - protein, 7 aa, Mycobacterium
RTSGAIE

SEQ ID NO: 571959 - protein, 10 aa, Mycobacterium
RTSGAPTDTI

SEQ ID NO: 571960 - protein, 10 aa, Mycobacterium
RTSGDERTRV

SEQ ID NO: 571961 - protein, 9 aa, Mycobacterium
RTSGDKAAG

SEQ ID NO: 571962 - protein, 7 aa, Mycobacterium
RTSGDKG

SEQ ID NO: 571963 - protein, 11 aa, Mycobacterium
RTSGDTTDKDG

SEQ ID NO: 571964 - protein, 11 aa, Mycobacterium
RTSGEVADTSG

SEQ ID NO: 571965 - protein, 16 aa, Mycobacterium
RTSGGPGEQIEVSGRA

SEQ ID NO: 571966 - protein, 9 aa, Mycobacterium
RTSGHGAQD

SEQ ID NO: 571967 - protein, 7 aa, Mycobacterium
RTSGISR

SEQ ID NO: 571968 - protein, 9 aa, Mycobacterium
RTSGLGDQA

SEQ ID NO: 571969 - protein, 9 aa, Mycobacterium
RTSGLGGEE

SEQ ID NO: 571970 - protein, 7 aa, Mycobacterium
RTSGRLN

SEQ ID NO: 571971 - protein, 8 aa, Mycobacterium
RTSGVPEG

SEQ ID NO: 571972 - protein, 4 aa, Mycobacterium
RTSH

SEQ ID NO: 571973 - protein, 7 aa, Mycobacterium
RTSIKAA

SEQ ID NO: 571974 - protein, 8 aa, Mycobacterium
RTSKTGVE

SEQ ID NO: 571975 - protein, 5 aa, Mycobacterium
RTSLR

SEQ ID NO: 571976 - protein, 23 aa, Mycobacterium
RTSLSDEPKPPPQKQPKLPPPPT

SEQ ID NO: 571977 - protein, 23 aa, Mycobacterium
RTSLSDEPKPPPQKQPKLPPPST

SEQ ID NO: 571978 - protein, 22 aa, Mycobacterium
RTSLSGEPKPPPQKQPKLPPPN

SEQ ID NO: 571979 - protein, 6 aa, Mycobacterium
RTSPAL

SEQ ID NO: 571980 - protein, 7 aa, Mycobacterium
RTSPARA

SEQ ID NO: 571981 - protein, 8 aa, Mycobacterium
RTSPDRHR

SEQ ID NO: 571982 - protein, 7 aa, Mycobacterium
RTSPGRR

SEQ ID NO: 571983 - protein, 14 aa, Mycobacterium
RTSPLTRGRPDGFR

SEQ ID NO: 571984 - protein, 10 aa, Mycobacterium
RTSPPDPEHR

SEQ ID NO: 571985 - protein, 6 aa, Mycobacterium
RTSPPY

SEQ ID NO: 571986 - protein, 7 aa, Mycobacterium
RTSPPYV

SEQ ID NO: 571987 - protein, 8 aa, Mycobacterium
RTSQGSGL

SEQ ID NO: 571988 - protein, 6 aa, Mycobacterium
RTSQRA

SEQ ID NO: 571989 - protein, 10 aa, Mycobacterium
RTSRGGSELY

SEQ ID NO: 571990 - protein, 8 aa, Mycobacterium
RTSRHAGE

SEQ ID NO: 571991 - protein, 5 aa, Mycobacterium
RTSRI

SEQ ID NO: 571992 - protein, 9 aa, Mycobacterium
RTSRNRPSR

SEQ ID NO: 571993 - protein, 12 aa, Mycobacterium
RTSRSARGPVPV

SEQ ID NO: 571994 - protein, 20 aa, Mycobacterium
RTSRSSAEQAARQAQAQAQA

SEQ ID NO: 571995 - protein, 20 aa, Mycobacterium
RTSSAIAERTSHDPDSGGHF

SEQ ID NO: 571996 - protein, 8 aa, Mycobacterium
RTSSAPAA

SEQ ID NO: 571997 - protein, 8 aa, Mycobacterium
RTSSAPAE

SEQ ID NO: 571998 - protein, 8 aa, Mycobacterium
RTSSAYAK

SEQ ID NO: 571999 - protein, 5 aa, Mycobacterium
RTSSP

SEQ ID NO: 572000 - protein, 11 aa, Mycobacterium
RTSSRSGPAYH

SEQ ID NO: 572001 - protein, 6 aa, Mycobacterium
RTSSTV

SEQ ID NO: 572002 - protein, 4 aa, Mycobacterium
RTST

SEQ ID NO: 572003 - protein, 5 aa, Mycobacterium
RTSTA

SEQ ID NO: 572004 - protein, 7 aa, Mycobacterium
RTSTDHA

SEQ ID NO: 572005 - protein, 11 aa, Mycobacterium
RTSTELDDGAS

SEQ ID NO: 572006 - protein, 5 aa, Mycobacterium
RTSTL

SEQ ID NO: 572007 - protein, 9 aa, Mycobacterium
RTSTPNTVR

SEQ ID NO: 572008 - protein, 17 aa, Mycobacterium
RTSTQPERDARAAGASW

SEQ ID NO: 572009 - protein, 4 aa, Mycobacterium
RTSV

SEQ ID NO: 572010 - protein, 7 aa, Mycobacterium
RTSVDDR

SEQ ID NO: 572011 - protein, 6 aa, Mycobacterium
RTSVGK

SEQ ID NO: 572012 - protein, 7 aa, Mycobacterium
RTSVGKY

SEQ ID NO: 572013 - protein, 8 aa, Mycobacterium
RTSVGKYD

SEQ ID NO: 572014 - protein, 15 aa, Mycobacterium
RTSVGKYDKKAIRAR

SEQ ID NO: 572015 - protein, 5 aa, Mycobacterium
RTSWS

SEQ ID NO: 572016 - protein, 10 aa, Mycobacterium
RTTADQRQIT

SEQ ID NO: 572017 - protein, 5 aa, Mycobacterium
RTTAG

SEQ ID NO: 572018 - protein, 10 aa, Mycobacterium
RTTAHAAPTI

SEQ ID NO: 572019 - protein, 6 aa, Mycobacterium
RTTAHP

SEQ ID NO: 572020 - protein, 10 aa, Mycobacterium
RTTAPRSNQY

SEQ ID NO: 572021 - protein, 5 aa, Mycobacterium
RTTAR

SEQ ID NO: 572022 - protein, 6 aa, Mycobacterium
RTTARS

SEQ ID NO: 572023 - protein, 9 aa, Mycobacterium
RTTATRDGE

SEQ ID NO: 572024 - protein, 12 aa, Mycobacterium
RTTAVTNPALVS

SEQ ID NO: 572025 - protein, 7 aa, Mycobacterium
RTTDENR

SEQ ID NO: 572026 - protein, 11 aa, Mycobacterium
RTTDFTEQAAD

SEQ ID NO: 572027 - protein, 9 aa, Mycobacterium
RTTDGDGPL

SEQ ID NO: 572028 - protein, 6 aa, Mycobacterium
RTTDPD

SEQ ID NO: 572029 - protein, 7 aa, Mycobacterium
RTTDRSE

SEQ ID NO: 572030 - protein, 8 aa, Mycobacterium
RTTDRTGV

SEQ ID NO: 572031 - protein, 6 aa, Mycobacterium
RTTDST

SEQ ID NO: 572032 - protein, 6 aa, Mycobacterium
RTTEGL

SEQ ID NO: 572033 - protein, 9 aa, Mycobacterium
RTTEGTTNG

SEQ ID NO: 572034 - protein, 5 aa, Mycobacterium
RTTEL

SEQ ID NO: 572035 - protein, 11 aa, Mycobacterium
RTTEPKVGTYA

SEQ ID NO: 572036 - protein, 9 aa, Mycobacterium
RTTEQDGYS

SEQ ID NO: 572037 - protein, 15 aa, Mycobacterium
RTTEVPSIEPAKDGY

SEQ ID NO: 572038 - protein, 4 aa, Mycobacterium
RTTF

SEQ ID NO: 572039 - protein, 7 aa, Mycobacterium
RTTFPGI

SEQ ID NO: 572040 - protein, 8 aa, Mycobacterium
RTTGADTA

SEQ ID NO: 572041 - protein, 9 aa, Mycobacterium
RTTGAGDVS

SEQ ID NO: 572042 - protein, 11 aa, Mycobacterium
RTTGAPPARPR

SEQ ID NO: 572043 - protein, 8 aa, Mycobacterium
RTTGDAGL

SEQ ID NO: 572044 - protein, 7 aa, Mycobacterium
RTTGDLA

SEQ ID NO: 572045 - protein, 9 aa, Mycobacterium
RTTGEGREG

SEQ ID NO: 572046 - protein, 11 aa, Mycobacterium
RTTGERADTAG

SEQ ID NO: 572047 - protein, 10 aa, Mycobacterium
RTTGETHRNE

SEQ ID NO: 572048 - protein, 5 aa, Mycobacterium
RTTGG

SEQ ID NO: 572049 - protein, 5 aa, Mycobacterium
RTTGH

SEQ ID NO: 572050 - protein, 7 aa, Mycobacterium
RTTGKTL

SEQ ID NO: 572051 - protein, 9 aa, Mycobacterium
RTTGNRRVG

SEQ ID NO: 572052 - protein, 14 aa, Mycobacterium
RTTGPDAQMLYAAF

SEQ ID NO: 572053 - protein, 11 aa, Mycobacterium
RTTGPDAVAPY

SEQ ID NO: 572054 - protein, 6 aa, Mycobacterium
RTTGPW

SEQ ID NO: 572055 - protein, 8 aa, Mycobacterium
RTTGRAAE

SEQ ID NO: 572056 - protein, 6 aa, Mycobacterium
RTTGTA

SEQ ID NO: 572057 - protein, 7 aa, Mycobacterium
RTTGTSL

SEQ ID NO: 572058 - protein, 6 aa, Mycobacterium
RTTHSA

SEQ ID NO: 572059 - protein, 15 aa, Mycobacterium
RTTIPEPADTASKDL

SEQ ID NO: 572060 - protein, 16 aa, Mycobacterium
RTTNAGQGFHGFYRPT

SEQ ID NO: 572061 - protein, 10 aa, Mycobacterium
RTTNCPNPGC

SEQ ID NO: 572062 - protein, 6 aa, Mycobacterium
RTTNPN

SEQ ID NO: 572063 - protein, 14 aa, Mycobacterium
RTTPAAHAHDEVKQ

SEQ ID NO: 572064 - protein, 5 aa, Mycobacterium
RTTPG

SEQ ID NO: 572065 - protein, 8 aa, Mycobacterium
RTTPHQSA

SEQ ID NO: 572066 - protein, 19 aa, Mycobacterium
RTTPPKPGLTRSEENGVSI

SEQ ID NO: 572067 - protein, 10 aa, Mycobacterium
RTTPRKGDLR

SEQ ID NO: 572068 - protein, 6 aa, Mycobacterium
RTTPRS

SEQ ID NO: 572069 - protein, 7 aa, Mycobacterium
RTTPSGA

SEQ ID NO: 572070 - protein, 13 aa, Mycobacterium
RTTPYSTPQEREA

SEQ ID NO: 572071 - protein, 9 aa, Mycobacterium
RTTQAGTAW

SEQ ID NO: 572072 - protein, 11 aa, Mycobacterium
RTTQAPATAKV

SEQ ID NO: 572073 - protein, 6 aa, Mycobacterium
RTTQAT

SEQ ID NO: 572074 - protein, 16 aa, Mycobacterium
RTTQLGREETLEDTGQ

SEQ ID NO: 572075 - protein, 10 aa, Mycobacterium
RTTQRADGTW

SEQ ID NO: 572076 - protein, 4 aa, Mycobacterium
RTTR

SEQ ID NO: 572077 - protein, 8 aa, Mycobacterium
RTTRADYL

SEQ ID NO: 572078 - protein, 10 aa, Mycobacterium
RTTRDHRTKG

SEQ ID NO: 572079 - protein, 16 aa, Mycobacterium
RTTRERTTRTEKFSDC

SEQ ID NO: 572080 - protein, 7 aa, Mycobacterium
RTTRLEP

SEQ ID NO: 572081 - protein, 10 aa, Mycobacterium
RTTRLKAGTS

SEQ ID NO: 572082 - protein, 4 aa, Mycobacterium
RTTS

SEQ ID NO: 572083 - protein, 5 aa, Mycobacterium
RTTSD

SEQ ID NO: 572084 - protein, 11 aa, Mycobacterium
RTTSEACPESM

SEQ ID NO: 572085 - protein, 15 aa, Mycobacterium
RTTSGGAALKNDSPI

SEQ ID NO: 572086 - protein, 13 aa, Mycobacterium
RTTSLGRASTPVW

SEQ ID NO: 572087 - protein, 10 aa, Mycobacterium
RTTSTTPARA

SEQ ID NO: 572088 - protein, 10 aa, Mycobacterium
RTTSVCDGDA

SEQ ID NO: 572089 - protein, 6 aa, Mycobacterium
RTTSVG

SEQ ID NO: 572090 - protein, 4 aa, Mycobacterium
RTTT

SEQ ID NO: 572091 - protein, 10 aa, Mycobacterium
RTTTGDTRAG

SEQ ID NO: 572092 - protein, 6 aa, Mycobacterium
RTTTGP

SEQ ID NO: 572093 - protein, 10 aa, Mycobacterium
RTTTNGNTVM

SEQ ID NO: 572094 - protein, 8 aa, Mycobacterium
RTTTPDKV

SEQ ID NO: 572095 - protein, 17 aa, Mycobacterium
RTTTRPRLDRESESDTA

SEQ ID NO: 572096 - protein, 6 aa, Mycobacterium
RTTTRT

SEQ ID NO: 572097 - protein, 12 aa, Mycobacterium
RTTTTEDAEGEV

SEQ ID NO: 572098 - protein, 13 aa, Mycobacterium
RTTVNPQAQLPVP

SEQ ID NO: 572099 - protein, 5 aa, Mycobacterium
RTTVP

SEQ ID NO: 572100 - protein, 5 aa, Mycobacterium
RTTVR

SEQ ID NO: 572101 - protein, 8 aa, Mycobacterium
RTVADPDS

SEQ ID NO: 572102 - protein, 17 aa, Mycobacterium
RTVAPRKGSGRVAAKPG

SEQ ID NO: 572103 - protein, 11 aa, Mycobacterium
RTVAPTELPDL

SEQ ID NO: 572104 - protein, 17 aa, Mycobacterium
RTVASGPARETITTETV

SEQ ID NO: 572105 - protein, 13 aa, Mycobacterium
RTVASGRAVETVT

SEQ ID NO: 572106 - protein, 21 aa, Mycobacterium
RTVATPTSAATAADEPPPRAF

SEQ ID NO: 572107 - protein, 5 aa, Mycobacterium
RTVDP

SEQ ID NO: 572108 - protein, 5 aa, Mycobacterium
RTVDQ

SEQ ID NO: 572109 - protein, 10 aa, Mycobacterium
RTVDSDEDLG

SEQ ID NO: 572110 - protein, 4 aa, Mycobacterium
RTVE

SEQ ID NO: 572111 - protein, 13 aa, Mycobacterium
RTVEAASGEPFGA

SEQ ID NO: 572112 - protein, 7 aa, Mycobacterium
RTVESGS

SEQ ID NO: 572113 - protein, 4 aa, Mycobacterium
RTVG

SEQ ID NO: 572114 - protein, 23 aa, Mycobacterium
RTVGESGGTPRRLENPKMKNEDA

SEQ ID NO: 572115 - protein, 9 aa, Mycobacterium
RTVGNADRA

SEQ ID NO: 572116 - protein, 11 aa, Mycobacterium
RTVGPNGEKGK

SEQ ID NO: 572117 - protein, 7 aa, Mycobacterium
RTVGSSV

SEQ ID NO: 572118 - protein, 6 aa, Mycobacterium
RTVHGA

SEQ ID NO: 572119 - protein, 10 aa, Mycobacterium
RTVNKGRPVE

SEQ ID NO: 572120 - protein, 4 aa, Mycobacterium
RTVP

SEQ ID NO: 572121 - protein, 9 aa, Mycobacterium
RTVPATRAR

SEQ ID NO: 572122 - protein, 14 aa, Mycobacterium
RTVPEGSTPTTSGW

SEQ ID NO: 572123 - protein, 6 aa, Mycobacterium
RTVPEP

SEQ ID NO: 572124 - protein, 37 aa, Mycobacterium
RTVPEQSPDDTRPNQQQPQQNQPQEGQHQQQQQQKAK

SEQ ID NO: 572125 - protein, 6 aa, Mycobacterium
RTVPGN

SEQ ID NO: 572126 - protein, 14 aa, Mycobacterium
RTVPKGEQPTPSGW

SEQ ID NO: 572127 - protein, 10 aa, Mycobacterium
RTVPRADRGT

SEQ ID NO: 572128 - protein, 10 aa, Mycobacterium
RTVPRSDRGT

SEQ ID NO: 572129 - protein, 6 aa, Mycobacterium
RTVPTG

SEQ ID NO: 572130 - protein, 4 aa, Mycobacterium
RTVR

SEQ ID NO: 572131 - protein, 5 aa, Mycobacterium
RTVRD

SEQ ID NO: 572132 - protein, 6 aa, Mycobacterium
RTVRDS

SEQ ID NO: 572133 - protein, 7 aa, Mycobacterium
RTVRSGT

SEQ ID NO: 572134 - protein, 4 aa, Mycobacterium
RTVS

SEQ ID NO: 572135 - protein, 11 aa, Mycobacterium
RTVSEQRPPFR

SEQ ID NO: 572136 - protein, 12 aa, Mycobacterium
RTVSESSNESAG

SEQ ID NO: 572137 - protein, 6 aa, Mycobacterium
RTVSGT

SEQ ID NO: 572138 - protein, 5 aa, Mycobacterium
RTVTA

SEQ ID NO: 572139 - protein, 6 aa, Mycobacterium
RTVTAG

SEQ ID NO: 572140 - protein, 14 aa, Mycobacterium
RTVTDSNPLTSRSS

SEQ ID NO: 572141 - protein, 6 aa, Mycobacterium
RTVTGD

SEQ ID NO: 572142 - protein, 8 aa, Mycobacterium
RTVTPSTT

SEQ ID NO: 572143 - protein, 10 aa, Mycobacterium
RTVTQQPGET

SEQ ID NO: 572144 - protein, 5 aa, Mycobacterium
RTVTT

SEQ ID NO: 572145 - protein, 5 aa, Mycobacterium
RTVVP

SEQ ID NO: 572146 - protein, 7 aa, Mycobacterium
RTVYDRP

SEQ ID NO: 572147 - protein, 5 aa, Mycobacterium
RTVYP

SEQ ID NO: 572148 - protein, 5 aa, Mycobacterium
RTWGD

SEQ ID NO: 572149 - protein, 4 aa, Mycobacterium
RTWP

SEQ ID NO: 572150 - protein, 14 aa, Mycobacterium
RTWPAGKKQVPGGA

SEQ ID NO: 572151 - protein, 6 aa, Mycobacterium
RTWPEK

SEQ ID NO: 572152 - protein, 14 aa, Mycobacterium
RTWQPDSPPITQSA

SEQ ID NO: 572153 - protein, 13 aa, Mycobacterium
RTWQPESPPNIAA

SEQ ID NO: 572154 - protein, 4 aa, Mycobacterium
RTYA

SEQ ID NO: 572155 - protein, 8 aa, Mycobacterium
RTYAPGRE

SEQ ID NO: 572156 - protein, 10 aa, Mycobacterium
RTYDEPDPEL

SEQ ID NO: 572157 - protein, 6 aa, Mycobacterium
RTYDSS

SEQ ID NO: 572158 - protein, 4 aa, Mycobacterium
RTYE

SEQ ID NO: 572159 - protein, 17 aa, Mycobacterium
RTYEPPATVSPLTSWRT

SEQ ID NO: 572160 - protein, 7 aa, Mycobacterium
RTYGDGN

SEQ ID NO: 572161 - protein, 7 aa, Mycobacterium
RTYGSDG

SEQ ID NO: 572162 - protein, 4 aa, Mycobacterium
RTYI

SEQ ID NO: 572163 - protein, 6 aa, Mycobacterium
RTYPEQ

SEQ ID NO: 572164 - protein, 10 aa, Mycobacterium
RTYPGAGASI

SEQ ID NO: 572165 - protein, 7 aa, Mycobacterium
RTYPGSA

SEQ ID NO: 572166 - protein, 4 aa, Mycobacterium
RTYR

SEQ ID NO: 572167 - protein, 5 aa, Mycobacterium
RTYRD

SEQ ID NO: 572168 - protein, 6 aa, Mycobacterium
RTYSAD

SEQ ID NO: 572169 - protein, 5 aa, Mycobacterium
RTYTA

SEQ ID NO: 572170 - protein, 5 aa, Mycobacterium
RTYTP

SEQ ID NO: 572171 - protein, 6 aa, Mycobacterium
RTYTPQ

SEQ ID NO: 572172 - protein, 5 aa, Mycobacterium
RTYTS

SEQ ID NO: 572173 - protein, 4 aa, Mycobacterium
RVAA

SEQ ID NO: 572174 - protein, 15 aa, Mycobacterium
RVAAATRKELADQRD

SEQ ID NO: 572175 - protein, 9 aa, Mycobacterium
RVAADNPDK

SEQ ID NO: 572176 - protein, 11 aa, Mycobacterium
RVAAGDTLTRT

SEQ ID NO: 572177 - protein, 12 aa, Mycobacterium
RVAAKGARTISF

SEQ ID NO: 572178 - protein, 17 aa, Mycobacterium
RVAATRGRVTSQSHRKI

SEQ ID NO: 572179 - protein, 4 aa, Mycobacterium
RVAD

SEQ ID NO: 572180 - protein, 8 aa, Mycobacterium
RVADDGDL

SEQ ID NO: 572181 - protein, 8 aa, Mycobacterium
RVADGQRL

SEQ ID NO: 572182 - protein, 9 aa, Mycobacterium
RVADGQSLS

SEQ ID NO: 572183 - protein, 17 aa, Mycobacterium
RVADPGPGASRNRQQTR

SEQ ID NO: 572184 - protein, 12 aa, Mycobacterium
RVADSGEREELS

SEQ ID NO: 572185 - protein, 11 aa, Mycobacterium
RVAENPLSGPA

SEQ ID NO: 572186 - protein, 22 aa, Mycobacterium
RVAEPPKSAGLPGTEGQHRTDF

SEQ ID NO: 572187 - protein, 9 aa, Mycobacterium
RVAGAADAQ

SEQ ID NO: 572188 - protein, 10 aa, Mycobacterium
RVAGAADAQE

SEQ ID NO: 572189 - protein, 10 aa, Mycobacterium
RVAGDDGTYV

SEQ ID NO: 572190 - protein, 12 aa, Mycobacterium
RVAGESAPAGWT

SEQ ID NO: 572191 - protein, 9 aa, Mycobacterium
RVAGGGSIV

SEQ ID NO: 572192 - protein, 16 aa, Mycobacterium
RVAGGLRAGGLSAGDR

SEQ ID NO: 572193 - protein, 7 aa, Mycobacterium
RVAGGND

SEQ ID NO: 572194 - protein, 7 aa, Mycobacterium
RVAGGPD

SEQ ID NO: 572195 - protein, 14 aa, Mycobacterium
RVAGGSSTAEPPLN

SEQ ID NO: 572196 - protein, 9 aa, Mycobacterium
RVAKETGGH

SEQ ID NO: 572197 - protein, 4 aa, Mycobacterium
RVAP

SEQ ID NO: 572198 - protein, 9 aa, Mycobacterium
RVAPAGQQV

SEQ ID NO: 572199 - protein, 6 aa, Mycobacterium
RVAPEE

SEQ ID NO: 572200 - protein, 7 aa, Mycobacterium
RVAPGRP

SEQ ID NO: 572201 - protein, 6 aa, Mycobacterium
RVAPSG

SEQ ID NO: 572202 - protein, 7 aa, Mycobacterium
RVAPTPV

SEQ ID NO: 572203 - protein, 15 aa, Mycobacterium
RVAQSGSAHGCPGRP

SEQ ID NO: 572204 - protein, 9 aa, Mycobacterium
RVARDGEPL

SEQ ID NO: 572205 - protein, 9 aa, Mycobacterium
RVARDTGGH

SEQ ID NO: 572206 - protein, 9 aa, Mycobacterium
RVARETGGH

SEQ ID NO: 572207 - protein, 8 aa, Mycobacterium
RVARGENP

SEQ ID NO: 572208 - protein, 6 aa, Mycobacterium
RVARGS

SEQ ID NO: 572209 - protein, 15 aa, Mycobacterium
RVASGDADSPDAAET

SEQ ID NO: 572210 - protein, 8 aa, Mycobacterium
RVASQPGD

SEQ ID NO: 572211 - protein, 8 aa, Mycobacterium
RVASSEEI

SEQ ID NO: 572212 - protein, 4 aa, Mycobacterium
RVAT

SEQ ID NO: 572213 - protein, 16 aa, Mycobacterium
RVATADPADIQGPEDL

SEQ ID NO: 572214 - protein, 15 aa, Mycobacterium
RVATGNDHGGGDTLA

SEQ ID NO: 572215 - protein, 22 aa, Mycobacterium
RVATPEEAAAAEAKVFATRYAR

SEQ ID NO: 572216 - protein, 9 aa, Mycobacterium
RVDAGARSR

SEQ ID NO: 572217 - protein, 13 aa, Mycobacterium
RVDASEEDSGVTS

SEQ ID NO: 572218 - protein, 6 aa, Mycobacterium
RVDATT

SEQ ID NO: 572219 - protein, 8 aa, Mycobacterium
RVDDAGPA

SEQ ID NO: 572220 - protein, 5 aa, Mycobacterium
RVDDD

SEQ ID NO: 572221 - protein, 14 aa, Mycobacterium
RVDDDDADSGAKIH

SEQ ID NO: 572222 - protein, 9 aa, Mycobacterium
RVDDDGRPV

SEQ ID NO: 572223 - protein, 6 aa, Mycobacterium
RVDDEE

SEQ ID NO: 572224 - protein, 8 aa, Mycobacterium
RVDDQGVR

SEQ ID NO: 572225 - protein, 4 aa, Mycobacterium
RVDE

SEQ ID NO: 572226 - protein, 8 aa, Mycobacterium
RVDEGHGG

SEQ ID NO: 572227 - protein, 5 aa, Mycobacterium
RVDEV

SEQ ID NO: 572228 - protein, 16 aa, Mycobacterium
RVDGAREAVTGSIDPA

SEQ ID NO: 572229 - protein, 12 aa, Mycobacterium
RVDGDDEHARQK

SEQ ID NO: 572230 - protein, 8 aa, Mycobacterium
RVDGDPSG

SEQ ID NO: 572231 - protein, 14 aa, Mycobacterium
RVDGDRGLVTVLDS

SEQ ID NO: 572232 - protein, 6 aa, Mycobacterium
RVDGEP

SEQ ID NO: 572233 - protein, 12 aa, Mycobacterium
RVDGEPLSDVDT

SEQ ID NO: 572234 - protein, 6 aa, Mycobacterium
RVDGEQ

SEQ ID NO: 572235 - protein, 8 aa, Mycobacterium
RVDGERGS

SEQ ID NO: 572236 - protein, 6 aa, Mycobacterium
RVDGHG

SEQ ID NO: 572237 - protein, 5 aa, Mycobacterium
RVDGP

SEQ ID NO: 572238 - protein, 10 aa, Mycobacterium
RVDGTGARYS

SEQ ID NO: 572239 - protein, 6 aa, Mycobacterium
RVDPAR

SEQ ID NO: 572240 - protein, 6 aa, Mycobacterium
RVDPDA

SEQ ID NO: 572241 - protein, 5 aa, Mycobacterium
RVDPE

SEQ ID NO: 572242 - protein, 7 aa, Mycobacterium
RVDPKSD

SEQ ID NO: 572243 - protein, 15 aa, Mycobacterium
RVDPNKDADGLHPTN

SEQ ID NO: 572244 - protein, 6 aa, Mycobacterium
RVDPRS

SEQ ID NO: 572245 - protein, 8 aa, Mycobacterium
RVDQGRAR

SEQ ID NO: 572246 - protein, 7 aa, Mycobacterium
RVDQHGE

SEQ ID NO: 572247 - protein, 6 aa, Mycobacterium
RVDREA

SEQ ID NO: 572248 - protein, 10 aa, Mycobacterium
RVDRRGRHRH

SEQ ID NO: 572249 - protein, 12 aa, Mycobacterium
RVDSEPSASSVD

SEQ ID NO: 572250 - protein, 9 aa, Mycobacterium
RVDSGRTDL

SEQ ID NO: 572251 - protein, 9 aa, Mycobacterium
RVDSVEPSI

SEQ ID NO: 572252 - protein, 6 aa, Mycobacterium
RVDTEN

SEQ ID NO: 572253 - protein, 5 aa, Mycobacterium
RVDTR

SEQ ID NO: 572254 - protein, 16 aa, Mycobacterium
RVDTTAPEQQSTDRHT

SEQ ID NO: 572255 - protein, 6 aa, Mycobacterium
RVEADN

SEQ ID NO: 572256 - protein, 13 aa, Mycobacterium
RVEADPSINGEPY

SEQ ID NO: 572257 - protein, 7 aa, Mycobacterium
RVEADQR

SEQ ID NO: 572258 - protein, 7 aa, Mycobacterium
RVEAGAQ

SEQ ID NO: 572259 - protein, 8 aa, Mycobacterium
RVEAGAQS

SEQ ID NO: 572260 - protein, 13 aa, Mycobacterium
RVEAQEVAGEHGN

SEQ ID NO: 572261 - protein, 13 aa, Mycobacterium
RVECGGRRADAPG

SEQ ID NO: 572262 - protein, 6 aa, Mycobacterium
RVEDPD

SEQ ID NO: 572263 - protein, 10 aa, Mycobacterium
RVEDTNQERL

SEQ ID NO: 572264 - protein, 7 aa, Mycobacterium
RVEEEDG

SEQ ID NO: 572265 - protein, 10 aa, Mycobacterium
RVEEGGAPEL

SEQ ID NO: 572266 - protein, 8 aa, Mycobacterium
RVEESRAR

SEQ ID NO: 572267 - protein, 8 aa, Mycobacterium
RVEGDTSV

SEQ ID NO: 572268 - protein, 11 aa, Mycobacterium
RVEGQETDPPA

SEQ ID NO: 572269 - protein, 6 aa, Mycobacterium
RVEGRS

SEQ ID NO: 572270 - protein, 7 aa, Mycobacterium
RVEHQPE

SEQ ID NO: 572271 - protein, 7 aa, Mycobacterium
RVENDGV

SEQ ID NO: 572272 - protein, 6 aa, Mycobacterium
RVENGP

SEQ ID NO: 572273 - protein, 6 aa, Mycobacterium
RVEPGE

SEQ ID NO: 572274 - protein, 7 aa, Mycobacterium
RVEPGGA

SEQ ID NO: 572275 - protein, 10 aa, Mycobacterium
RVEPQGSEAA

SEQ ID NO: 572276 - protein, 10 aa, Mycobacterium
RVEPRGSEAA

SEQ ID NO: 572277 - protein, 6 aa, Mycobacterium
RVEPRN

SEQ ID NO: 572278 - protein, 13 aa, Mycobacterium
RVEQAAPDAARTR

SEQ ID NO: 572279 - protein, 5 aa, Mycobacterium
RVEQP

SEQ ID NO: 572280 - protein, 10 aa, Mycobacterium
RVEQRPAATE

SEQ ID NO: 572281 - protein, 6 aa, Mycobacterium
RVEQTA

SEQ ID NO: 572282 - protein, 12 aa, Mycobacterium
RVERADGPAAAM

SEQ ID NO: 572283 - protein, 7 aa, Mycobacterium
RVERARR

SEQ ID NO: 572284 - protein, 6 aa, Mycobacterium
RVERDR

SEQ ID NO: 572285 - protein, 4 aa, Mycobacterium
RVES

SEQ ID NO: 572286 - protein, 10 aa, Mycobacterium
RVESDEWVPQ

SEQ ID NO: 572287 - protein, 19 aa, Mycobacterium
RVESDHGTTIGDGAEEAVR

SEQ ID NO: 572288 - protein, 5 aa, Mycobacterium
RVESG

SEQ ID NO: 572289 - protein, 6 aa, Mycobacterium
RVESGR

SEQ ID NO: 572290 - protein, 8 aa, Mycobacterium
RVESNGNF

SEQ ID NO: 572291 - protein, 8 aa, Mycobacterium
RVESSPRD

SEQ ID NO: 572292 - protein, 11 aa, Mycobacterium
RVESTGGARSR

SEQ ID NO: 572293 - protein, 4 aa, Mycobacterium
RVET

SEQ ID NO: 572294 - protein, 10 aa, Mycobacterium
RVETNSEERM

SEQ ID NO: 572295 - protein, 6 aa, Mycobacterium
RVGAAG

SEQ ID NO: 572296 - protein, 5 aa, Mycobacterium
RVGAE

SEQ ID NO: 572297 - protein, 8 aa, Mycobacterium
RVGAGIAG

SEQ ID NO: 572298 - protein, 5 aa, Mycobacterium
RVGAQ

SEQ ID NO: 572299 - protein, 10 aa, Mycobacterium
RVGAQDQDTV

SEQ ID NO: 572300 - protein, 8 aa, Mycobacterium
RVGASQRT

SEQ ID NO: 572301 - protein, 15 aa, Mycobacterium
RVGDGDSGPNTGGMG

SEQ ID NO: 572302 - protein, 15 aa, Mycobacterium
RVGDNDSGPNTGGMG

SEQ ID NO: 572303 - protein, 11 aa, Mycobacterium
RVGDPDNPART

SEQ ID NO: 572304 - protein, 14 aa, Mycobacterium
RVGEDGEEGFSDGT

SEQ ID NO: 572305 - protein, 8 aa, Mycobacterium
RVGEEGKG

SEQ ID NO: 572306 - protein, 8 aa, Mycobacterium
RVGEENGG

SEQ ID NO: 572307 - protein, 15 aa, Mycobacterium
RVGEGDTGPNTGGMG

SEQ ID NO: 572308 - protein, 6 aa, Mycobacterium
RVGEPS

SEQ ID NO: 572309 - protein, 5 aa, Mycobacterium
RVGGA

SEQ ID NO: 572310 - protein, 6 aa, Mycobacterium
RVGGAD

SEQ ID NO: 572311 - protein, 6 aa, Mycobacterium
RVGGAT

SEQ ID NO: 572312 - protein, 9 aa, Mycobacterium
RVGGDGPAL

SEQ ID NO: 572313 - protein, 14 aa, Mycobacterium
RVGGDLSEAGARAE

SEQ ID NO: 572314 - protein, 13 aa, Mycobacterium
RVGGGDPAGNPTL

SEQ ID NO: 572315 - protein, 13 aa, Mycobacterium
RVGGGDPGGNPTL

SEQ ID NO: 572316 - protein, 7 aa, Mycobacterium
RVGGGSG

SEQ ID NO: 572317 - protein, 33 aa, Mycobacterium
RVGGHGSQHGRCGSDNTIAGRGPGRGVGGHRGP

SEQ ID NO: 572318 - protein, 19 aa, Mycobacterium
RVGGPPAALRAETDDGIRR

SEQ ID NO: 572319 - protein, 20 aa, Mycobacterium
RVGGPPAALRAETDDTVRYT

SEQ ID NO: 572320 - protein, 8 aa, Mycobacterium
RVGGQPMD

SEQ ID NO: 572321 - protein, 6 aa, Mycobacterium
RVGGQT

SEQ ID NO: 572322 - protein, 11 aa, Mycobacterium
RVGGSAAGGAL

SEQ ID NO: 572323 - protein, 7 aa, Mycobacterium
RVGGVSA

SEQ ID NO: 572324 - protein, 6 aa, Mycobacterium
RVGHGL

SEQ ID NO: 572325 - protein, 11 aa, Mycobacterium
RVGHPDAARQV

SEQ ID NO: 572326 - protein, 12 aa, Mycobacterium
RVGHPDAARQVA

SEQ ID NO: 572327 - protein, 10 aa, Mycobacterium
RVGKQEARRR

SEQ ID NO: 572328 - protein, 9 aa, Mycobacterium
RVGNQGAYG

SEQ ID NO: 572329 - protein, 6 aa, Mycobacterium
RVGPDG

SEQ ID NO: 572330 - protein, 9 aa, Mycobacterium
RVGPDTEPE

SEQ ID NO: 572331 - protein, 5 aa, Mycobacterium
RVGPG

SEQ ID NO: 572332 - protein, 7 aa, Mycobacterium
RVGPHGR

SEQ ID NO: 572333 - protein, 120 aa, Mycobacterium
RVGPKEAPELAANANPHGPRSAVTPPHPATATSPTTSSGGVSTANSPSAASASTPSASSPMSSSGGPPSTGGASSGSPSASTSPASGSPSTASPTTSGAAGAQPSNASPAGAAKAQPSPI

SEQ ID NO: 572334 - protein, 14 aa, Mycobacterium
RVGPPQPSDRQLDE

SEQ ID NO: 572335 - protein, 23 aa, Mycobacterium
RVGPQGRRSWSRPDSGKALNGIS

SEQ ID NO: 572336 - protein, 12 aa, Mycobacterium
RVGPQRGPLTGG

SEQ ID NO: 572337 - protein, 6 aa, Mycobacterium
RVGPTG

SEQ ID NO: 572338 - protein, 8 aa, Mycobacterium
RVGQAEQI

SEQ ID NO: 572339 - protein, 8 aa, Mycobacterium
RVGRDDGQ

SEQ ID NO: 572340 - protein, 8 aa, Mycobacterium
RVGRGGNK

SEQ ID NO: 572341 - protein, 8 aa, Mycobacterium
RVGRRAAR

SEQ ID NO: 572342 - protein, 19 aa, Mycobacterium
RVGRSHPEPDTAARSGDSA

SEQ ID NO: 572343 - protein, 7 aa, Mycobacterium
RVGRTEG

SEQ ID NO: 572344 - protein, 7 aa, Mycobacterium
RVGSDGV

SEQ ID NO: 572345 - protein, 21 aa, Mycobacterium
RVGSGEWPVDDNPLRGAPHTA

SEQ ID NO: 572346 - protein, 8 aa, Mycobacterium
RVGSGQWP

SEQ ID NO: 572347 - protein, 5 aa, Mycobacterium
RVGSR

SEQ ID NO: 572348 - protein, 11 aa, Mycobacterium
RVGTASGRRLR

SEQ ID NO: 572349 - protein, 6 aa, Mycobacterium
RVGTDD

SEQ ID NO: 572350 - protein, 10 aa, Mycobacterium
RVGTSRTPVR

SEQ ID NO: 572351 - protein, 5 aa, Mycobacterium
RVGTT

SEQ ID NO: 572352 - protein, 5 aa, Mycobacterium
RVGVD

SEQ ID NO: 572353 - protein, 8 aa, Mycobacterium
RVGVDGGA

SEQ ID NO: 572354 - protein, 10 aa, Mycobacterium
RVGVEGGDSL

SEQ ID NO: 572355 - protein, 16 aa, Mycobacterium
RVHPRDDAEGARTAAA

SEQ ID NO: 572356 - protein, 8 aa, Mycobacterium
RVKAASAE

SEQ ID NO: 572357 - protein, 9 aa, Mycobacterium
RVKDKERSI

SEQ ID NO: 572358 - protein, 9 aa, Mycobacterium
RVKDREASI

SEQ ID NO: 572359 - protein, 8 aa, Mycobacterium
RVKDREGS

SEQ ID NO: 572360 - protein, 9 aa, Mycobacterium
RVKEKEPSI

SEQ ID NO: 572361 - protein, 7 aa, Mycobacterium
RVKGNAP

SEQ ID NO: 572362 - protein, 9 aa, Mycobacterium
RVKGPDEDA

SEQ ID NO: 572363 - protein, 12 aa, Mycobacterium
RVKGRTYPNPPV

SEQ ID NO: 572364 - protein, 9 aa, Mycobacterium
RVKPTGTPC

SEQ ID NO: 572365 - protein, 6 aa, Mycobacterium
RVKRDD

SEQ ID NO: 572366 - protein, 25 aa, Mycobacterium
RVKTADEGIDGRTKFPETADTDFPR

SEQ ID NO: 572367 - protein, 10 aa, Mycobacterium
RVLDGNPGAH

SEQ ID NO: 572368 - protein, 12 aa, Mycobacterium
RVLPNDGEAVGE

SEQ ID NO: 572369 - protein, 7 aa, Mycobacterium
RVMTSKE

SEQ ID NO: 572370 - protein, 6 aa, Mycobacterium
RVNAGE

SEQ ID NO: 572371 - protein, 5 aa, Mycobacterium
RVNEI

SEQ ID NO: 572372 - protein, 8 aa, Mycobacterium
RVNGKRNG

SEQ ID NO: 572373 - protein, 6 aa, Mycobacterium
RVNPAK

SEQ ID NO: 572374 - protein, 7 aa, Mycobacterium
RVNPDKL

SEQ ID NO: 572375 - protein, 8 aa, Mycobacterium
RVNPEKLR

SEQ ID NO: 572376 - protein, 7 aa, Mycobacterium
RVNPESV

SEQ ID NO: 572377 - protein, 6 aa, Mycobacterium
RVNPLD

SEQ ID NO: 572378 - protein, 7 aa, Mycobacterium
RVNPSGR

SEQ ID NO: 572379 - protein, 6 aa, Mycobacterium
RVNSDR

SEQ ID NO: 572380 - protein, 8 aa, Mycobacterium
RVNSGAVT

SEQ ID NO: 572381 - protein, 17 aa, Mycobacterium
RVNSTTDAAAPPIPADT

SEQ ID NO: 572382 - protein, 4 aa, Mycobacterium
RVNT

SEQ ID NO: 572383 - protein, 6 aa, Mycobacterium
RVPAAA

SEQ ID NO: 572384 - protein, 8 aa, Mycobacterium
RVPAAHPD

SEQ ID NO: 572385 - protein, 10 aa, Mycobacterium
RVPADLTGTS

SEQ ID NO: 572386 - protein, 12 aa, Mycobacterium
RVPAEASPVAQA

SEQ ID NO: 572387 - protein, 9 aa, Mycobacterium
RVPAGEDRD

SEQ ID NO: 572388 - protein, 8 aa, Mycobacterium
RVPAGEPG

SEQ ID NO: 572389 - protein, 7 aa, Mycobacterium
RVPANKR

SEQ ID NO: 572390 - protein, 35 aa, Mycobacterium
RVPAPEDEKPAVETTDKPSEPVDDVSQAVAAVNAL

SEQ ID NO: 572391 - protein, 9 aa, Mycobacterium
RVPARSGRQ

SEQ ID NO: 572392 - protein, 12 aa, Mycobacterium
RVPARSGRQHEQ

SEQ ID NO: 572393 - protein, 6 aa, Mycobacterium
RVPDAQ

SEQ ID NO: 572394 - protein, 5 aa, Mycobacterium
RVPDE

SEQ ID NO: 572395 - protein, 17 aa, Mycobacterium
RVPDGAADDPDKAAADY

SEQ ID NO: 572396 - protein, 11 aa, Mycobacterium
RVPDGEPGERA

SEQ ID NO: 572397 - protein, 9 aa, Mycobacterium
RVPDHAPTR

SEQ ID NO: 572398 - protein, 20 aa, Mycobacterium
RVPDRPPPRVPPCPGPTGER

SEQ ID NO: 572399 - protein, 5 aa, Mycobacterium
RVPEA

SEQ ID NO: 572400 - protein, 11 aa, Mycobacterium
RVPEDLRDQAK

SEQ ID NO: 572401 - protein, 5 aa, Mycobacterium
RVPEE

SEQ ID NO: 572402 - protein, 6 aa, Mycobacterium
RVPEPT

SEQ ID NO: 572403 - protein, 6 aa, Mycobacterium
RVPESA

SEQ ID NO: 572404 - protein, 6 aa, Mycobacterium
RVPETD

SEQ ID NO: 572405 - protein, 5 aa, Mycobacterium
RVPFD

SEQ ID NO: 572406 - protein, 6 aa, Mycobacterium
RVPGAA

SEQ ID NO: 572407 - protein, 8 aa, Mycobacterium
RVPGAPKY

SEQ ID NO: 572408 - protein, 9 aa, Mycobacterium
RVPGAPKYR

SEQ ID NO: 572409 - protein, 10 aa, Mycobacterium
RVPGEREREH

SEQ ID NO: 572410 - protein, 5 aa, Mycobacterium
RVPGG

SEQ ID NO: 572411 - protein, 6 aa, Mycobacterium
RVPGGG

SEQ ID NO: 572412 - protein, 8 aa, Mycobacterium
RVPGPDGR

SEQ ID NO: 572413 - protein, 5 aa, Mycobacterium
RVPGR

SEQ ID NO: 572414 - protein, 5 aa, Mycobacterium
RVPHT

SEQ ID NO: 572415 - protein, 10 aa, Mycobacterium
RVPKGTSDGR

SEQ ID NO: 572416 - protein, 9 aa, Mycobacterium
RVPKNDARL

SEQ ID NO: 572417 - protein, 8 aa, Mycobacterium
RVPKNDPR

SEQ ID NO: 572418 - protein, 10 aa, Mycobacterium
RVPKPSEDPR

SEQ ID NO: 572419 - protein, 9 aa, Mycobacterium
RVPKSGSYF

SEQ ID NO: 572420 - protein, 7 aa, Mycobacterium
RVPKTDA

SEQ ID NO: 572421 - protein, 8 aa, Mycobacterium
RVPKTDPR

SEQ ID NO: 572422 - protein, 7 aa, Mycobacterium
RVPNGDR

SEQ ID NO: 572423 - protein, 8 aa, Mycobacterium
RVPNRKGF

SEQ ID NO: 572424 - protein, 9 aa, Mycobacterium
RVPNRKGFG

SEQ ID NO: 572425 - protein, 4 aa, Mycobacterium
RVPP

SEQ ID NO: 572426 - protein, 10 aa, Mycobacterium
RVPPAAKDNR

SEQ ID NO: 572427 - protein, 8 aa, Mycobacterium
RVPPEEDR

SEQ ID NO: 572428 - protein, 5 aa, Mycobacterium
RVPPF

SEQ ID NO: 572429 - protein, 5 aa, Mycobacterium
RVPPG

SEQ ID NO: 572430 - protein, 7 aa, Mycobacterium
RVPPGGR

SEQ ID NO: 572431 - protein, 7 aa, Mycobacterium
RVPPHKR

SEQ ID NO: 572432 - protein, 8 aa, Mycobacterium
RVPPPGPL

SEQ ID NO: 572433 - protein, 8 aa, Mycobacterium
RVPPPGTL

SEQ ID NO: 572434 - protein, 25 aa, Mycobacterium
RVPPPPEPAPAPVPEPAPAAPGELN

SEQ ID NO: 572435 - protein, 9 aa, Mycobacterium
RVPPSGDEI

SEQ ID NO: 572436 - protein, 7 aa, Mycobacterium
RVPPTRA

SEQ ID NO: 572437 - protein, 15 aa, Mycobacterium
RVPQAANTWSSTART

SEQ ID NO: 572438 - protein, 12 aa, Mycobacterium
RVPQPDDTLEPG

SEQ ID NO: 572439 - protein, 6 aa, Mycobacterium
RVPQTW

SEQ ID NO: 572440 - protein, 13 aa, Mycobacterium
RVPSDREKEQLRR

SEQ ID NO: 572441 - protein, 13 aa, Mycobacterium
RVPSDREREQLSR

SEQ ID NO: 572442 - protein, 12 aa, Mycobacterium
RVPSERERDQLR

SEQ ID NO: 572443 - protein, 12 aa, Mycobacterium
RVPSEREREQLR

SEQ ID NO: 572444 - protein, 6 aa, Mycobacterium
RVPSGD

SEQ ID NO: 572445 - protein, 17 aa, Mycobacterium
RVPTEAQPWPRGGAPRR

SEQ ID NO: 572446 - protein, 17 aa, Mycobacterium
RVPTSTPEDDLFAGVET

SEQ ID NO: 572447 - protein, 5 aa, Mycobacterium
RVQAG

SEQ ID NO: 572448 - protein, 7 aa, Mycobacterium
RVQEAGA

SEQ ID NO: 572449 - protein, 21 aa, Mycobacterium
RVQEGDDVLGPDGEPPITAKG

SEQ ID NO: 572450 - protein, 7 aa, Mycobacterium
RVQGDGT

SEQ ID NO: 572451 - protein, 13 aa, Mycobacterium
RVQGGRGPRESKY

SEQ ID NO: 572452 - protein, 6 aa, Mycobacterium
RVQGPA

SEQ ID NO: 572453 - protein, 5 aa, Mycobacterium
RVQPG

SEQ ID NO: 572454 - protein, 6 aa, Mycobacterium
RVQPGD

SEQ ID NO: 572455 - protein, 8 aa, Mycobacterium
RVQPGGKL

SEQ ID NO: 572456 - protein, 15 aa, Mycobacterium
RVQPPSVTVGPGDDA

SEQ ID NO: 572457 - protein, 7 aa, Mycobacterium
RVQRADS

SEQ ID NO: 572458 - protein, 8 aa, Mycobacterium
RVQSGDLD

SEQ ID NO: 572459 - protein, 8 aa, Mycobacterium
RVQSGRDT

SEQ ID NO: 572460 - protein, 5 aa, Mycobacterium
RVRAA

SEQ ID NO: 572461 - protein, 5 aa, Mycobacterium
RVRAG

SEQ ID NO: 572462 - protein, 8 aa, Mycobacterium
RVRAGRDP

SEQ ID NO: 572463 - protein, 10 aa, Mycobacterium
RVRAQAPDDF

SEQ ID NO: 572464 - protein, 9 aa, Mycobacterium
RVRATTTAD

SEQ ID NO: 572465 - protein, 6 aa, Mycobacterium
RVRDAA

SEQ ID NO: 572466 - protein, 21 aa, Mycobacterium
RVRDAGLTTAGRRGPNGRLPV

SEQ ID NO: 572467 - protein, 31 aa, Mycobacterium
RVREGAKHAGDPDPYRVGGAEDTDGDTDGDE

SEQ ID NO: 572468 - protein, 10 aa, Mycobacterium
RVRESDEGFD

SEQ ID NO: 572469 - protein, 13 aa, Mycobacterium
RVRGPATDTDADT

SEQ ID NO: 572470 - protein, 8 aa, Mycobacterium
RVRGPQRE

SEQ ID NO: 572471 - protein, 14 aa, Mycobacterium
RVRGTSTIAGSTAT

SEQ ID NO: 572472 - protein, 6 aa, Mycobacterium
RVRNDP

SEQ ID NO: 572473 - protein, 7 aa, Mycobacterium
RVRNNES

SEQ ID NO: 572474 - protein, 4 aa, Mycobacterium
RVRP

SEQ ID NO: 572475 - protein, 18 aa, Mycobacterium
RVRPATDRSQEPAPLTQA

SEQ ID NO: 572476 - protein, 8 aa, Mycobacterium
RVRPAYED

SEQ ID NO: 572477 - protein, 6 aa, Mycobacterium
RVRPDD

SEQ ID NO: 572478 - protein, 12 aa, Mycobacterium
RVRPDTDRAGDV

SEQ ID NO: 572479 - protein, 11 aa, Mycobacterium
RVRPGDRAPWV

SEQ ID NO: 572480 - protein, 7 aa, Mycobacterium
RVRPGSD

SEQ ID NO: 572481 - protein, 8 aa, Mycobacterium
RVRPGSDS

SEQ ID NO: 572482 - protein, 6 aa, Mycobacterium
RVRPGV

SEQ ID NO: 572483 - protein, 10 aa, Mycobacterium
RVRPTDAAAV

SEQ ID NO: 572484 - protein, 5 aa, Mycobacterium
RVRQS

SEQ ID NO: 572485 - protein, 9 aa, Mycobacterium
RVRRGQVDG

SEQ ID NO: 572486 - protein, 13 aa, Mycobacterium
RVRRSTRKFSPEL

SEQ ID NO: 572487 - protein, 8 aa, Mycobacterium
RVRSGDKA

SEQ ID NO: 572488 - protein, 18 aa, Mycobacterium
RVRSNRGVAGIDGTVSTA

SEQ ID NO: 572489 - protein, 5 aa, Mycobacterium
RVRSP

SEQ ID NO: 572490 - protein, 9 aa, Mycobacterium
RVRSPQDAA

SEQ ID NO: 572491 - protein, 8 aa, Mycobacterium
RVRSSEPV

SEQ ID NO: 572492 - protein, 4 aa, Mycobacterium
RVRT

SEQ ID NO: 572493 - protein, 17 aa, Mycobacterium
RVRTDLGPTLTTTPEQT

SEQ ID NO: 572494 - protein, 9 aa, Mycobacterium
RVRTEATGY

SEQ ID NO: 572495 - protein, 9 aa, Mycobacterium
RVSADNPVE

SEQ ID NO: 572496 - protein, 5 aa, Mycobacterium
RVSAE

SEQ ID NO: 572497 - protein, 8 aa, Mycobacterium
RVSAGKDP

SEQ ID NO: 572498 - protein, 6 aa, Mycobacterium
RVSAGQ

SEQ ID NO: 572499 - protein, 7 aa, Mycobacterium
RVSAGQT

SEQ ID NO: 572500 - protein, 9 aa, Mycobacterium
RVSAPPDPL

SEQ ID NO: 572501 - protein, 36 aa, Mycobacterium
RVSASESDVEYPSTRRRPEAAGEQVGVSGLRQPISS

SEQ ID NO: 572502 - protein, 10 aa, Mycobacterium
RVSDAEQSNT

SEQ ID NO: 572503 - protein, 17 aa, Mycobacterium
RVSDDGDTLTVTPPSWR

SEQ ID NO: 572504 - protein, 11 aa, Mycobacterium
RVSDPDARRTI

SEQ ID NO: 572505 - protein, 10 aa, Mycobacterium
RVSDSGEGRW

SEQ ID NO: 572506 - protein, 7 aa, Mycobacterium
RVSENAG

SEQ ID NO: 572507 - protein, 10 aa, Mycobacterium
RVSEPPSPLP

SEQ ID NO: 572508 - protein, 6 aa, Mycobacterium
RVSESP

SEQ ID NO: 572509 - protein, 5 aa, Mycobacterium
RVSGD

SEQ ID NO: 572510 - protein, 7 aa, Mycobacterium
RVSGDGE

SEQ ID NO: 572511 - protein, 10 aa, Mycobacterium
RVSGDGTPGL

SEQ ID NO: 572512 - protein, 10 aa, Mycobacterium
RVSGDTSAGH

SEQ ID NO: 572513 - protein, 9 aa, Mycobacterium
RVSGEKVRE

SEQ ID NO: 572514 - protein, 10 aa, Mycobacterium
RVSGEPQQIP

SEQ ID NO: 572515 - protein, 6 aa, Mycobacterium
RVSGGD

SEQ ID NO: 572516 - protein, 8 aa, Mycobacterium
RVSGPAPW

SEQ ID NO: 572517 - protein, 6 aa, Mycobacterium
RVSGPT

SEQ ID NO: 572518 - protein, 10 aa, Mycobacterium
RVSGRPANPE

SEQ ID NO: 572519 - protein, 10 aa, Mycobacterium
RVSGRPANRE

SEQ ID NO: 572520 - protein, 28 aa, Mycobacterium
RVSGRRRGRGSSGSGRGRASIDREQSAA

SEQ ID NO: 572521 - protein, 7 aa, Mycobacterium
RVSGTTL

SEQ ID NO: 572522 - protein, 6 aa, Mycobacterium
RVSKAN

SEQ ID NO: 572523 - protein, 9 aa, Mycobacterium
RVSKNDTRL

SEQ ID NO: 572524 - protein, 4 aa, Mycobacterium
RVSN

SEQ ID NO: 572525 - protein, 5 aa, Mycobacterium
RVSNA

SEQ ID NO: 572526 - protein, 7 aa, Mycobacterium
RVSNGDL

SEQ ID NO: 572527 - protein, 9 aa, Mycobacterium
RVSPDSHRP

SEQ ID NO: 572528 - protein, 9 aa, Mycobacterium
RVSPESKTL

SEQ ID NO: 572529 - protein, 12 aa, Mycobacterium
RVSPGDGALRDP

SEQ ID NO: 572530 - protein, 10 aa, Mycobacterium
RVSPGDGAWR

SEQ ID NO: 572531 - protein, 6 aa, Mycobacterium
RVSPKD

SEQ ID NO: 572532 - protein, 7 aa, Mycobacterium
RVSPKDV

SEQ ID NO: 572533 - protein, 6 aa, Mycobacterium
RVSPKT

SEQ ID NO: 572534 - protein, 7 aa, Mycobacterium
RVSPPAI

SEQ ID NO: 572535 - protein, 8 aa, Mycobacterium
RVSPPDLA

SEQ ID NO: 572536 - protein, 8 aa, Mycobacterium
RVSPPESL

SEQ ID NO: 572537 - protein, 6 aa, Mycobacterium
RVSPRD

SEQ ID NO: 572538 - protein, 10 aa, Mycobacterium
RVSPTDAGSY

SEQ ID NO: 572539 - protein, 5 aa, Mycobacterium
RVSPY

SEQ ID NO: 572540 - protein, 9 aa, Mycobacterium
RVSQDEDLE

SEQ ID NO: 572541 - protein, 15 aa, Mycobacterium
RVSQEVSGKTSKIAN

SEQ ID NO: 572542 - protein, 4 aa, Mycobacterium
RVSR

SEQ ID NO: 572543 - protein, 5 aa, Mycobacterium
RVSRK

SEQ ID NO: 572544 - protein, 6 aa, Mycobacterium
RVSRSE

SEQ ID NO: 572545 - protein, 6 aa, Mycobacterium
RVSRTD

SEQ ID NO: 572546 - protein, 6 aa, Mycobacterium
RVSSGE

SEQ ID NO: 572547 - protein, 10 aa, Mycobacterium
RVSSKKRDDL

SEQ ID NO: 572548 - protein, 9 aa, Mycobacterium
RVSSPDDTT

SEQ ID NO: 572549 - protein, 19 aa, Mycobacterium
RVSSSGHGPMVVGKQSECS

SEQ ID NO: 572550 - protein, 19 aa, Mycobacterium
RVSSSSPSPKFAVRVVSSR

SEQ ID NO: 572551 - protein, 4 aa, Mycobacterium
RVST

SEQ ID NO: 572552 - protein, 5 aa, Mycobacterium
RVSTA

SEQ ID NO: 572553 - protein, 7 aa, Mycobacterium
RVSTESG

SEQ ID NO: 572554 - protein, 6 aa, Mycobacterium
RVSTGD

SEQ ID NO: 572555 - protein, 12 aa, Mycobacterium
RVSTGDEDSYSL

SEQ ID NO: 572556 - protein, 14 aa, Mycobacterium
RVSTGNDHGGGDTL

SEQ ID NO: 572557 - protein, 8 aa, Mycobacterium
RVSTPEEQ

SEQ ID NO: 572558 - protein, 11 aa, Mycobacterium
RVSTRKAPYRN

SEQ ID NO: 572559 - protein, 5 aa, Mycobacterium
RVSTT

SEQ ID NO: 572560 - protein, 9 aa, Mycobacterium
RVSTYSGGM

SEQ ID NO: 572561 - protein, 10 aa, Mycobacterium
RVTAAGDPGL

SEQ ID NO: 572562 - protein, 5 aa, Mycobacterium
RVTAE

SEQ ID NO: 572563 - protein, 7 aa, Mycobacterium
RVTAGEL

SEQ ID NO: 572564 - protein, 6 aa, Mycobacterium
RVTAPA

SEQ ID NO: 572565 - protein, 7 aa, Mycobacterium
RVTDEEL

SEQ ID NO: 572566 - protein, 5 aa, Mycobacterium
RVTDI

SEQ ID NO: 572567 - protein, 14 aa, Mycobacterium
RVTDPATNGSGAGT

SEQ ID NO: 572568 - protein, 20 aa, Mycobacterium
RVTDPDVEGTGSGDASPAPV

SEQ ID NO: 572569 - protein, 17 aa, Mycobacterium
RVTDSDDEIPLRPEERT

SEQ ID NO: 572570 - protein, 4 aa, Mycobacterium
RVTE

SEQ ID NO: 572571 - protein, 13 aa, Mycobacterium
RVTEAASPSAPTV

SEQ ID NO: 572572 - protein, 14 aa, Mycobacterium
RVTETPSKRGRPAA

SEQ ID NO: 572573 - protein, 12 aa, Mycobacterium
RVTGDRDREQLR

SEQ ID NO: 572574 - protein, 11 aa, Mycobacterium
RVTGGEPESVD

SEQ ID NO: 572575 - protein, 12 aa, Mycobacterium
RVTGIRGNRDDV

SEQ ID NO: 572576 - protein, 13 aa, Mycobacterium
RVTGPAELPDDRV

SEQ ID NO: 572577 - protein, 11 aa, Mycobacterium
RVTGPAPGTWY

SEQ ID NO: 572578 - protein, 11 aa, Mycobacterium
RVTGRNPATVR

SEQ ID NO: 572579 - protein, 10 aa, Mycobacterium
RVTGSTLTGT

SEQ ID NO: 572580 - protein, 4 aa, Mycobacterium
RVTP

SEQ ID NO: 572581 - protein, 7 aa, Mycobacterium
RVTPAPE

SEQ ID NO: 572582 - protein, 7 aa, Mycobacterium
RVTPDAN

SEQ ID NO: 572583 - protein, 8 aa, Mycobacterium
RVTPDDAD

SEQ ID NO: 572584 - protein, 9 aa, Mycobacterium
RVTPESKTL

SEQ ID NO: 572585 - protein, 6 aa, Mycobacterium
RVTPGQ

SEQ ID NO: 572586 - protein, 6 aa, Mycobacterium
RVTPID

SEQ ID NO: 572587 - protein, 6 aa, Mycobacterium
RVTPQP

SEQ ID NO: 572588 - protein, 5 aa, Mycobacterium
RVTPS

SEQ ID NO: 572589 - protein, 7 aa, Mycobacterium
RVTPSSA

SEQ ID NO: 572590 - protein, 11 aa, Mycobacterium
RVTQKRRTELP

SEQ ID NO: 572591 - protein, 5 aa, Mycobacterium
RVTRD

SEQ ID NO: 572592 - protein, 5 aa, Mycobacterium
RVTRG

SEQ ID NO: 572593 - protein, 5 aa, Mycobacterium
RVTSR

SEQ ID NO: 572594 - protein, 21 aa, Mycobacterium
RVTSSGTGGSASEADVRAAMA

SEQ ID NO: 572595 - protein, 4 aa, Mycobacterium
RVTT

SEQ ID NO: 572596 - protein, 8 aa, Mycobacterium
RVTTGRAS

SEQ ID NO: 572597 - protein, 7 aa, Mycobacterium
RVTTPDG

SEQ ID NO: 572598 - protein, 5 aa, Mycobacterium
RVVPR

SEQ ID NO: 572599 - protein, 20 aa, Mycobacterium
RVVSGSPRRRPVKRARTTGQ

SEQ ID NO: 572600 - protein, 5 aa, Mycobacterium
RVVTD

SEQ ID NO: 572601 - protein, 7 aa, Mycobacterium
RVVTEGD

SEQ ID NO: 572602 - protein, 5 aa, Mycobacterium
RVVTG

SEQ ID NO: 572603 - protein, 12 aa, Mycobacterium
RVYRNADSGYAS

SEQ ID NO: 572604 - protein, 4 aa, Mycobacterium
RWAG

SEQ ID NO: 572605 - protein, 5 aa, Mycobacterium
RWAPA

SEQ ID NO: 572606 - protein, 11 aa, Mycobacterium
RWAPGYAEAGA

SEQ ID NO: 572607 - protein, 11 aa, Mycobacterium
RWAPPYAEAGA

SEQ ID NO: 572608 - protein, 9 aa, Mycobacterium
RWDDGGKGI

SEQ ID NO: 572609 - protein, 5 aa, Mycobacterium
RWDEN

SEQ ID NO: 572610 - protein, 13 aa, Mycobacterium
RWDPDSPDYRRPA

SEQ ID NO: 572611 - protein, 6 aa, Mycobacterium
RWDPGK

SEQ ID NO: 572612 - protein, 5 aa, Mycobacterium
RWDSD

SEQ ID NO: 572613 - protein, 6 aa, Mycobacterium
RWDSDT

SEQ ID NO: 572614 - protein, 4 aa, Mycobacterium
RWEG

SEQ ID NO: 572615 - protein, 7 aa, Mycobacterium
RWEGSPD

SEQ ID NO: 572616 - protein, 9 aa, Mycobacterium
RWEGSSGAR

SEQ ID NO: 572617 - protein, 16 aa, Mycobacterium
RWEPGSKALATRAASG

SEQ ID NO: 572618 - protein, 5 aa, Mycobacterium
RWEQD

SEQ ID NO: 572619 - protein, 4 aa, Mycobacterium
RWGA

SEQ ID NO: 572620 - protein, 5 aa, Mycobacterium
RWGET

SEQ ID NO: 572621 - protein, 4 aa, Mycobacterium
RWGS

SEQ ID NO: 572622 - protein, 5 aa, Mycobacterium
RWGSE

SEQ ID NO: 572623 - protein, 9 aa, Mycobacterium
RWGSQDQLG

SEQ ID NO: 572624 - protein, 6 aa, Mycobacterium
RWKGVS

SEQ ID NO: 572625 - protein, 4 aa, Mycobacterium
RWNT

SEQ ID NO: 572626 - protein, 5 aa, Mycobacterium
RWPDG

SEQ ID NO: 572627 - protein, 5 aa, Mycobacterium
RWPDR

SEQ ID NO: 572628 - protein, 4 aa, Mycobacterium
RWPE

SEQ ID NO: 572629 - protein, 10 aa, Mycobacterium
RWPEGGVEYA

SEQ ID NO: 572630 - protein, 9 aa, Mycobacterium
RWPEPEPVD

SEQ ID NO: 572631 - protein, 4 aa, Mycobacterium
RWPH

SEQ ID NO: 572632 - protein, 6 aa, Mycobacterium
RWPHTP

SEQ ID NO: 572633 - protein, 5 aa, Mycobacterium
RWPNG

SEQ ID NO: 572634 - protein, 6 aa, Mycobacterium
RWPNGV

SEQ ID NO: 572635 - protein, 10 aa, Mycobacterium
RWPNPPAGVA

SEQ ID NO: 572636 - protein, 18 aa, Mycobacterium
RWPPATRPVREGVQQPPI

SEQ ID NO: 572637 - protein, 5 aa, Mycobacterium
RWPPL

SEQ ID NO: 572638 - protein, 7 aa, Mycobacterium
RWPQAGS

SEQ ID NO: 572639 - protein, 6 aa, Mycobacterium
RWPRAG

SEQ ID NO: 572640 - protein, 7 aa, Mycobacterium
RWPSAYS

SEQ ID NO: 572641 - protein, 5 aa, Mycobacterium
RWPSL

SEQ ID NO: 572642 - protein, 10 aa, Mycobacterium
RWQEGSATEA

SEQ ID NO: 572643 - protein, 7 aa, Mycobacterium
RWQGKAG

SEQ ID NO: 572644 - protein, 8 aa, Mycobacterium
RWQGKPGR

SEQ ID NO: 572645 - protein, 10 aa, Mycobacterium
RWQSRPAERR

SEQ ID NO: 572646 - protein, 6 aa, Mycobacterium
RWQTPA

SEQ ID NO: 572647 - protein, 5 aa, Mycobacterium
RWRAG

SEQ ID NO: 572648 - protein, 14 aa, Mycobacterium
RWRDSGMADTTPLH

SEQ ID NO: 572649 - protein, 16 aa, Mycobacterium
RWRDSGMAGTEQRGRR

SEQ ID NO: 572650 - protein, 15 aa, Mycobacterium
RWRDSGMPGTPGRRR

SEQ ID NO: 572651 - protein, 11 aa, Mycobacterium
RWRGEGPRYRK

SEQ ID NO: 572652 - protein, 12 aa, Mycobacterium
RWRGRPKNQDAY

SEQ ID NO: 572653 - protein, 5 aa, Mycobacterium
RWRTD

SEQ ID NO: 572654 - protein, 11 aa, Mycobacterium
RWSDGRGDNIF

SEQ ID NO: 572655 - protein, 31 aa, Mycobacterium
RWSGAGADAAASFASATTAAIDDAADRAGRL

SEQ ID NO: 572656 - protein, 17 aa, Mycobacterium
RWSGEEPDHELGRRRAR

SEQ ID NO: 572657 - protein, 6 aa, Mycobacterium
RWSGTV

SEQ ID NO: 572658 - protein, 8 aa, Mycobacterium
RWSPESGS

SEQ ID NO: 572659 - protein, 6 aa, Mycobacterium
RWSPQT

SEQ ID NO: 572660 - protein, 13 aa, Mycobacterium
RWSPRAPPPPPGW

SEQ ID NO: 572661 - protein, 7 aa, Mycobacterium
RWSPTGK

SEQ ID NO: 572662 - protein, 16 aa, Mycobacterium
RWSPTWNDEQRAEGYA

SEQ ID NO: 572663 - protein, 5 aa, Mycobacterium
RWSSQ

SEQ ID NO: 572664 - protein, 14 aa, Mycobacterium
RWSTPGAFAASAPA

SEQ ID NO: 572665 - protein, 12 aa, Mycobacterium
RWTDGDWRGRPV

SEQ ID NO: 572666 - protein, 5 aa, Mycobacterium
RWTPG

SEQ ID NO: 572667 - protein, 11 aa, Mycobacterium
RWTPPAGGAKW

SEQ ID NO: 572668 - protein, 16 aa, Mycobacterium
RWTPQWTDEQRAAGYA

SEQ ID NO: 572669 - protein, 6 aa, Mycobacterium
RWTQPQ

SEQ ID NO: 572670 - protein, 5 aa, Mycobacterium
RYAAA

SEQ ID NO: 572671 - protein, 6 aa, Mycobacterium
RYAASG

SEQ ID NO: 572672 - protein, 7 aa, Mycobacterium
RYADEAA

SEQ ID NO: 572673 - protein, 5 aa, Mycobacterium
RYAEA

SEQ ID NO: 572674 - protein, 6 aa, Mycobacterium
RYAEGP

SEQ ID NO: 572675 - protein, 19 aa, Mycobacterium
RYAEPGPREFSASFQTFCG

SEQ ID NO: 572676 - protein, 7 aa, Mycobacterium
RYAEREH

SEQ ID NO: 572677 - protein, 7 aa, Mycobacterium
RYAETEH

SEQ ID NO: 572678 - protein, 11 aa, Mycobacterium
RYAGADRPALD

SEQ ID NO: 572679 - protein, 6 aa, Mycobacterium
RYAGDE

SEQ ID NO: 572680 - protein, 8 aa, Mycobacterium
RYAGPARS

SEQ ID NO: 572681 - protein, 17 aa, Mycobacterium
RYAGSKKIGTTGRGIGP

SEQ ID NO: 572682 - protein, 10 aa, Mycobacterium
RYAGTDHRGS

SEQ ID NO: 572683 - protein, 7 aa, Mycobacterium
RYAGTRP

SEQ ID NO: 572684 - protein, 8 aa, Mycobacterium
RYAGTRPD

SEQ ID NO: 572685 - protein, 6 aa, Mycobacterium
RYANDG

SEQ ID NO: 572686 - protein, 8 aa, Mycobacterium
RYANPDAT

SEQ ID NO: 572687 - protein, 7 aa, Mycobacterium
RYANPDV

SEQ ID NO: 572688 - protein, 10 aa, Mycobacterium
RYAPAARRSV

SEQ ID NO: 572689 - protein, 5 aa, Mycobacterium
RYAPH

SEQ ID NO: 572690 - protein, 10 aa, Mycobacterium
RYAQQAGISP

SEQ ID NO: 572691 - protein, 11 aa, Mycobacterium
RYAQTPNQGVG

SEQ ID NO: 572692 - protein, 10 aa, Mycobacterium
RYARAKAEHE

SEQ ID NO: 572693 - protein, 12 aa, Mycobacterium
RYARGGEKTPEG

SEQ ID NO: 572694 - protein, 8 aa, Mycobacterium
RYASESSD

SEQ ID NO: 572695 - protein, 8 aa, Mycobacterium
RYASGAAR

SEQ ID NO: 572696 - protein, 34 aa, Mycobacterium
RYATAQGSAELDAESPEGRSVEAEYDERRRAAAE

SEQ ID NO: 572697 - protein, 10 aa, Mycobacterium
RYATDGADLP

SEQ ID NO: 572698 - protein, 8 aa, Mycobacterium
RYATDPGR

SEQ ID NO: 572699 - protein, 4 aa, Mycobacterium
RYDA

SEQ ID NO: 572700 - protein, 9 aa, Mycobacterium
RYDAGGGGV

SEQ ID NO: 572701 - protein, 6 aa, Mycobacterium
RYDEAT

SEQ ID NO: 572702 - protein, 6 aa, Mycobacterium
RYDGDE

SEQ ID NO: 572703 - protein, 6 aa, Mycobacterium
RYDGPG

SEQ ID NO: 572704 - protein, 15 aa, Mycobacterium
RYDGPLTEPPADKAD

SEQ ID NO: 572705 - protein, 11 aa, Mycobacterium
RYDGPPGTVSD

SEQ ID NO: 572706 - protein, 7 aa, Mycobacterium
RYDHGAP

SEQ ID NO: 572707 - protein, 6 aa, Mycobacterium
RYDPAE

SEQ ID NO: 572708 - protein, 6 aa, Mycobacterium
RYDPGN

SEQ ID NO: 572709 - protein, 8 aa, Mycobacterium
RYDPGTPL

SEQ ID NO: 572710 - protein, 9 aa, Mycobacterium
RYDPSPDVR

SEQ ID NO: 572711 - protein, 11 aa, Mycobacterium
RYDSGERADME

SEQ ID NO: 572712 - protein, 11 aa, Mycobacterium
RYDSGERTDME

SEQ ID NO: 572713 - protein, 16 aa, Mycobacterium
RYDTPEPTIGPDEPPP

SEQ ID NO: 572714 - protein, 22 aa, Mycobacterium
RYDTRTRSLPTPTTFSRGPNSP

SEQ ID NO: 572715 - protein, 5 aa, Mycobacterium
RYDTT

SEQ ID NO: 572716 - protein, 9 aa, Mycobacterium
RYEAARQGA

SEQ ID NO: 572717 - protein, 14 aa, Mycobacterium
RYEAATSKTQGLIF

SEQ ID NO: 572718 - protein, 6 aa, Mycobacterium
RYEASG

SEQ ID NO: 572719 - protein, 7 aa, Mycobacterium
RYEASGE

SEQ ID NO: 572720 - protein, 4 aa, Mycobacterium
RYED

SEQ ID NO: 572721 - protein, 128 aa, Mycobacterium
RYEDSDDDDEDASDSDDSDDSDSDSDDDQSGRPAAKRRRRGRRGRGRGRGEQNGDEPSDADGDSDGDAETEKARSDDSEDDNGEDDNGDDDGAGGDAGTRRRRRRRRRKSGSDDDNGSGGSPDDPPNT

SEQ ID NO: 572722 - protein, 4 aa, Mycobacterium
RYEE

SEQ ID NO: 572723 - protein, 22 aa, Mycobacterium
RYEEPGSGMNRAARRASGTRNR

SEQ ID NO: 572724 - protein, 7 aa, Mycobacterium
RYEGGST

SEQ ID NO: 572725 - protein, 9 aa, Mycobacterium
RYEKPRQED

SEQ ID NO: 572726 - protein, 6 aa, Mycobacterium
RYELPG

SEQ ID NO: 572727 - protein, 12 aa, Mycobacterium
RYEPADSSSVDL

SEQ ID NO: 572728 - protein, 12 aa, Mycobacterium
RYEPATGGAPLS

SEQ ID NO: 572729 - protein, 9 aa, Mycobacterium
RYEPPSPVQ

SEQ ID NO: 572730 - protein, 6 aa, Mycobacterium
RYEPSS

SEQ ID NO: 572731 - protein, 8 aa, Mycobacterium
RYEPTGPH

SEQ ID NO: 572732 - protein, 6 aa, Mycobacterium
RYERTE

SEQ ID NO: 572733 - protein, 5 aa, Mycobacterium
RYESA

SEQ ID NO: 572734 - protein, 6 aa, Mycobacterium
RYESAK

SEQ ID NO: 572735 - protein, 13 aa, Mycobacterium
RYESTDAGDSYTR

SEQ ID NO: 572736 - protein, 5 aa, Mycobacterium
RYGAA

SEQ ID NO: 572737 - protein, 13 aa, Mycobacterium
RYGAQGGDWGSAV

SEQ ID NO: 572738 - protein, 6 aa, Mycobacterium
RYGATA

SEQ ID NO: 572739 - protein, 7 aa, Mycobacterium
RYGDDPA

SEQ ID NO: 572740 - protein, 6 aa, Mycobacterium
RYGDDS

SEQ ID NO: 572741 - protein, 6 aa, Mycobacterium
RYGDES

SEQ ID NO: 572742 - protein, 6 aa, Mycobacterium
RYGDGE

SEQ ID NO: 572743 - protein, 9 aa, Mycobacterium
RYGDGQLAG

SEQ ID NO: 572744 - protein, 13 aa, Mycobacterium
RYGDPADANTAET

SEQ ID NO: 572745 - protein, 9 aa, Mycobacterium
RYGDRDDDG

SEQ ID NO: 572746 - protein, 13 aa, Mycobacterium
RYGDSDSDSGEGF

SEQ ID NO: 572747 - protein, 8 aa, Mycobacterium
RYGDTQRH

SEQ ID NO: 572748 - protein, 4 aa, Mycobacterium
RYGE

SEQ ID NO: 572749 - protein, 9 aa, Mycobacterium
RYGEGEDEV

SEQ ID NO: 572750 - protein, 5 aa, Mycobacterium
RYGES

SEQ ID NO: 572751 - protein, 17 aa, Mycobacterium
RYGFTPPGHRQGRGTDE

SEQ ID NO: 572752 - protein, 9 aa, Mycobacterium
RYGGAGEHD

SEQ ID NO: 572753 - protein, 6 aa, Mycobacterium
RYGGAQ

SEQ ID NO: 572754 - protein, 9 aa, Mycobacterium
RYGGDEASL

SEQ ID NO: 572755 - protein, 11 aa, Mycobacterium
RYGGDGTQVPA

SEQ ID NO: 572756 - protein, 11 aa, Mycobacterium
RYGGGAQGLAR

SEQ ID NO: 572757 - protein, 5 aa, Mycobacterium
RYGGH

SEQ ID NO: 572758 - protein, 11 aa, Mycobacterium
RYGGPSPSLSL

SEQ ID NO: 572759 - protein, 8 aa, Mycobacterium
RYGGQEAP

SEQ ID NO: 572760 - protein, 7 aa, Mycobacterium
RYGGRDA

SEQ ID NO: 572761 - protein, 12 aa, Mycobacterium
RYGKRKAGAAAD

SEQ ID NO: 572762 - protein, 14 aa, Mycobacterium
RYGKRKGAAADNTD

SEQ ID NO: 572763 - protein, 5 aa, Mycobacterium
RYGKT

SEQ ID NO: 572764 - protein, 4 aa, Mycobacterium
RYGN

SEQ ID NO: 572765 - protein, 11 aa, Mycobacterium
RYGNPADAHTS

SEQ ID NO: 572766 - protein, 6 aa, Mycobacterium
RYGPGF

SEQ ID NO: 572767 - protein, 11 aa, Mycobacterium
RYGPQRSASIE

SEQ ID NO: 572768 - protein, 7 aa, Mycobacterium
RYGPRPT

SEQ ID NO: 572769 - protein, 7 aa, Mycobacterium
RYGPSAV

SEQ ID NO: 572770 - protein, 5 aa, Mycobacterium
RYGPT

SEQ ID NO: 572771 - protein, 6 aa, Mycobacterium
RYGQDA

SEQ ID NO: 572772 - protein, 11 aa, Mycobacterium
RYGQGRDEVTA

SEQ ID NO: 572773 - protein, 7 aa, Mycobacterium
RYGQPRD

SEQ ID NO: 572774 - protein, 6 aa, Mycobacterium
RYGQVP

SEQ ID NO: 572775 - protein, 9 aa, Mycobacterium
RYGSDKPDL

SEQ ID NO: 572776 - protein, 8 aa, Mycobacterium
RYGSPRKD

SEQ ID NO: 572777 - protein, 6 aa, Mycobacterium
RYGTPE

SEQ ID NO: 572778 - protein, 16 aa, Mycobacterium
RYGTPLPSSQQRSDPV

SEQ ID NO: 572779 - protein, 11 aa, Mycobacterium
RYHGETGEVSA

SEQ ID NO: 572780 - protein, 5 aa, Mycobacterium
RYHPQ

SEQ ID NO: 572781 - protein, 4 aa, Mycobacterium
RYKH

SEQ ID NO: 572782 - protein, 10 aa, Mycobacterium
RYKKGQPALA

SEQ ID NO: 572783 - protein, 9 aa, Mycobacterium
RYKRRTDQK

SEQ ID NO: 572784 - protein, 19 aa, Mycobacterium
RYLGGGAATTVGATAVGPS

SEQ ID NO: 572785 - protein, 6 aa, Mycobacterium
RYLPEE

SEQ ID NO: 572786 - protein, 13 aa, Mycobacterium
RYMPGGSQTGGPR

SEQ ID NO: 572787 - protein, 14 aa, Mycobacterium
RYMPGGSQTGGPRL

SEQ ID NO: 572788 - protein, 4 aa, Mycobacterium
RYMQ

SEQ ID NO: 572789 - protein, 20 aa, Mycobacterium
RYNAARNRRAPQGYTDGAPL

SEQ ID NO: 572790 - protein, 15 aa, Mycobacterium
RYNDNPYAQFFFEKR

SEQ ID NO: 572791 - protein, 6 aa, Mycobacterium
RYNGRG

SEQ ID NO: 572792 - protein, 5 aa, Mycobacterium
RYNLR

SEQ ID NO: 572793 - protein, 15 aa, Mycobacterium
RYNQARRSGGFTAWP

SEQ ID NO: 572794 - protein, 13 aa, Mycobacterium
RYNSSRGPSYSSY

SEQ ID NO: 572795 - protein, 6 aa, Mycobacterium
RYPADA

SEQ ID NO: 572796 - protein, 7 aa, Mycobacterium
RYPADED

SEQ ID NO: 572797 - protein, 6 aa, Mycobacterium
RYPADL

SEQ ID NO: 572798 - protein, 9 aa, Mycobacterium
RYPAGGIAQ

SEQ ID NO: 572799 - protein, 6 aa, Mycobacterium
RYPAGQ

SEQ ID NO: 572800 - protein, 15 aa, Mycobacterium
RYPAKGGRAITVGRI

SEQ ID NO: 572801 - protein, 14 aa, Mycobacterium
RYPAQLSGGEQQRV

SEQ ID NO: 572802 - protein, 4 aa, Mycobacterium
RYPD

SEQ ID NO: 572803 - protein, 6 aa, Mycobacterium
RYPDAE

SEQ ID NO: 572804 - protein, 9 aa, Mycobacterium
RYPDAESAV

SEQ ID NO: 572805 - protein, 10 aa, Mycobacterium
RYPDDPETQE

SEQ ID NO: 572806 - protein, 6 aa, Mycobacterium
RYPDER

SEQ ID NO: 572807 - protein, 7 aa, Mycobacterium
RYPDGLA

SEQ ID NO: 572808 - protein, 13 aa, Mycobacterium
RYPEAAKYTPGAI

SEQ ID NO: 572809 - protein, 6 aa, Mycobacterium
RYPEER

SEQ ID NO: 572810 - protein, 11 aa, Mycobacterium
RYPEGGVSASA

SEQ ID NO: 572811 - protein, 7 aa, Mycobacterium
RYPEKRS

SEQ ID NO: 572812 - protein, 10 aa, Mycobacterium
RYPERGPHAQ

SEQ ID NO: 572813 - protein, 9 aa, Mycobacterium
RYPGAARDE

SEQ ID NO: 572814 - protein, 11 aa, Mycobacterium
RYPGADRPAVD

SEQ ID NO: 572815 - protein, 6 aa, Mycobacterium
RYPGDA

SEQ ID NO: 572816 - protein, 11 aa, Mycobacterium
RYPGDDGRRQP

SEQ ID NO: 572817 - protein, 7 aa, Mycobacterium
RYPGDVT

SEQ ID NO: 572818 - protein, 6 aa, Mycobacterium
RYPGEY

SEQ ID NO: 572819 - protein, 7 aa, Mycobacterium
RYPLDRG

SEQ ID NO: 572820 - protein, 7 aa, Mycobacterium
RYPLTRG

SEQ ID NO: 572821 - protein, 4 aa, Mycobacterium
RYPN

SEQ ID NO: 572822 - protein, 6 aa, Mycobacterium
RYPNPV

SEQ ID NO: 572823 - protein, 13 aa, Mycobacterium
RYPNQLSGGQQQR

SEQ ID NO: 572824 - protein, 9 aa, Mycobacterium
RYPPDGVSA

SEQ ID NO: 572825 - protein, 5 aa, Mycobacterium
RYPPG

SEQ ID NO: 572826 - protein, 12 aa, Mycobacterium
RYPPHPERLEGP

SEQ ID NO: 572827 - protein, 4 aa, Mycobacterium
RYPQ

SEQ ID NO: 572828 - protein, 4 aa, Mycobacterium
RYPR

SEQ ID NO: 572829 - protein, 9 aa, Mycobacterium
RYPSGADAV

SEQ ID NO: 572830 - protein, 5 aa, Mycobacterium
RYPSR

SEQ ID NO: 572831 - protein, 33 aa, Mycobacterium
RYPSSKRCGPPESVSQRQDQTGENLTRHRLLFN

SEQ ID NO: 572832 - protein, 10 aa, Mycobacterium
RYPSTTPESA

SEQ ID NO: 572833 - protein, 4 aa, Mycobacterium
RYPT

SEQ ID NO: 572834 - protein, 12 aa, Mycobacterium
RYQEGEEPAEDA

SEQ ID NO: 572835 - protein, 5 aa, Mycobacterium
RYQQA

SEQ ID NO: 572836 - protein, 12 aa, Mycobacterium
RYQQKNKTCKKC

SEQ ID NO: 572837 - protein, 14 aa, Mycobacterium
RYQRPGVAEQAQQT

SEQ ID NO: 572838 - protein, 22 aa, Mycobacterium
RYQRTAATPDAQPGSRNGYRPV

SEQ ID NO: 572839 - protein, 15 aa, Mycobacterium
RYQRTASCADARAGM

SEQ ID NO: 572840 - protein, 27 aa, Mycobacterium
RYQRTDGRATHRNGHRPKTVSTTAGDV

SEQ ID NO: 572841 - protein, 5 aa, Mycobacterium
RYQTP

SEQ ID NO: 572842 - protein, 10 aa, Mycobacterium
RYRAEDAAEA

SEQ ID NO: 572843 - protein, 7 aa, Mycobacterium
RYRAGDD

SEQ ID NO: 572844 - protein, 6 aa, Mycobacterium
RYRAGS

SEQ ID NO: 572845 - protein, 8 aa, Mycobacterium
RYRAPASA

SEQ ID NO: 572846 - protein, 12 aa, Mycobacterium
RYRAPDTPAEQT

SEQ ID NO: 572847 - protein, 9 aa, Mycobacterium
RYRAPSSAV

SEQ ID NO: 572848 - protein, 21 aa, Mycobacterium
RYRDDGGKPQTAATLNGTLGT

SEQ ID NO: 572849 - protein, 12 aa, Mycobacterium
RYRDESAARGGP

SEQ ID NO: 572850 - protein, 5 aa, Mycobacterium
RYRDF

SEQ ID NO: 572851 - protein, 5 aa, Mycobacterium
RYRDS

SEQ ID NO: 572852 - protein, 7 aa, Mycobacterium
RYRDTAS

SEQ ID NO: 572853 - protein, 5 aa, Mycobacterium
RYREE

SEQ ID NO: 572854 - protein, 8 aa, Mycobacterium
RYREGSSA

SEQ ID NO: 572855 - protein, 14 aa, Mycobacterium
RYRERSKRASADTL

SEQ ID NO: 572856 - protein, 11 aa, Mycobacterium
RYRETGGTPRT

SEQ ID NO: 572857 - protein, 5 aa, Mycobacterium
RYRGD

SEQ ID NO: 572858 - protein, 11 aa, Mycobacterium
RYRNDPQRTAE

SEQ ID NO: 572859 - protein, 10 aa, Mycobacterium
RYRPAGAPEF

SEQ ID NO: 572860 - protein, 13 aa, Mycobacterium
RYRPEPETDDLEA

SEQ ID NO: 572861 - protein, 9 aa, Mycobacterium
RYRPGDPPL

SEQ ID NO: 572862 - protein, 4 aa, Mycobacterium
RYRR

SEQ ID NO: 572863 - protein, 7 aa, Mycobacterium
RYRRDDG

SEQ ID NO: 572864 - protein, 7 aa, Mycobacterium
RYRRPNS

SEQ ID NO: 572865 - protein, 200 aa, Mycobacterium
RYRRPQDDARGGPDPQGAPDPRGGYPPEQGGYPPQQGYPPRQPEQGGYPEQGGYPPQPGYQDQGGYQGQAGYPDQGQGGYPPQPGYQDQRGYPDQGQGGYPQSYEQRPPAPGGYGGGQGYEQGYRQGGYGPPAGQPGGGPQGYGGGYADYGRGPARQDEGGYAPPEQRPAYPEQGGGYDQGYQQGGGYGRQDYGSPEYTQ

SEQ ID NO: 572866 - protein, 5 aa, Mycobacterium
RYRSN

SEQ ID NO: 572867 - protein, 5 aa, Mycobacterium
RYRSS

SEQ ID NO: 572868 - protein, 19 aa, Mycobacterium
RYRTEDVPEDAAPARATEL

SEQ ID NO: 572869 - protein, 9 aa, Mycobacterium
RYRTQSRRA

SEQ ID NO: 572870 - protein, 8 aa, Mycobacterium
RYSAPREV

SEQ ID NO: 572871 - protein, 25 aa, Mycobacterium
RYSATTPAEWGSTALTAAKDAGGLD

SEQ ID NO: 572872 - protein, 4 aa, Mycobacterium
RYSD

SEQ ID NO: 572873 - protein, 11 aa, Mycobacterium
RYSDDEPAGAL

SEQ ID NO: 572874 - protein, 5 aa, Mycobacterium
RYSDG

SEQ ID NO: 572875 - protein, 11 aa, Mycobacterium
RYSEKADKKRY

SEQ ID NO: 572876 - protein, 7 aa, Mycobacterium
RYSERER

SEQ ID NO: 572877 - protein, 12 aa, Mycobacterium
RYSGEQPNDGKW

SEQ ID NO: 572878 - protein, 8 aa, Mycobacterium
RYSGPDAV

SEQ ID NO: 572879 - protein, 12 aa, Mycobacterium
RYSGRGNPALTE

SEQ ID NO: 572880 - protein, 12 aa, Mycobacterium
RYSGRGNPELTE

SEQ ID NO: 572881 - protein, 24 aa, Mycobacterium
RYSGRGNPELTELGSRQAGAAAKY

SEQ ID NO: 572882 - protein, 9 aa, Mycobacterium
RYSISSDTQ

SEQ ID NO: 572883 - protein, 8 aa, Mycobacterium
RYSPTDPL

SEQ ID NO: 572884 - protein, 8 aa, Mycobacterium
RYSQAARR

SEQ ID NO: 572885 - protein, 10 aa, Mycobacterium
RYSRTDTVGT

SEQ ID NO: 572886 - protein, 18 aa, Mycobacterium
RYSSQGPPAVDAVSPPSA

SEQ ID NO: 572887 - protein, 7 aa, Mycobacterium
RYSSTTI

SEQ ID NO: 572888 - protein, 5 aa, Mycobacterium
RYSTP

SEQ ID NO: 572889 - protein, 16 aa, Mycobacterium
RYSTSMKRSARILRFE

SEQ ID NO: 572890 - protein, 4 aa, Mycobacterium
RYSV

SEQ ID NO: 572891 - protein, 7 aa, Mycobacterium
RYSVPPE

SEQ ID NO: 572892 - protein, 4 aa, Mycobacterium
RYTA

SEQ ID NO: 572893 - protein, 14 aa, Mycobacterium
RYTAATSKTAGLIA

SEQ ID NO: 572894 - protein, 14 aa, Mycobacterium
RYTAATTKTSGLIF

SEQ ID NO: 572895 - protein, 9 aa, Mycobacterium
RYTAEEPEI

SEQ ID NO: 572896 - protein, 9 aa, Mycobacterium
RYTAEQPEV

SEQ ID NO: 572897 - protein, 11 aa, Mycobacterium
RYTEPHREADT

SEQ ID NO: 572898 - protein, 7 aa, Mycobacterium
RYTETER

SEQ ID NO: 572899 - protein, 6 aa, Mycobacterium
RYTETN

SEQ ID NO: 572900 - protein, 12 aa, Mycobacterium
RYTGDNGEVSAR

SEQ ID NO: 572901 - protein, 10 aa, Mycobacterium
RYTGPGGEAK

SEQ ID NO: 572902 - protein, 7 aa, Mycobacterium
RYTGPHD

SEQ ID NO: 572903 - protein, 14 aa, Mycobacterium
RYTGWDADGGYAEY

SEQ ID NO: 572904 - protein, 4 aa, Mycobacterium
RYTP

SEQ ID NO: 572905 - protein, 7 aa, Mycobacterium
RYTPARS

SEQ ID NO: 572906 - protein, 6 aa, Mycobacterium
RYTPDL

SEQ ID NO: 572907 - protein, 8 aa, Mycobacterium
RYTPLGES

SEQ ID NO: 572908 - protein, 10 aa, Mycobacterium
RYTPQPDGSL

SEQ ID NO: 572909 - protein, 12 aa, Mycobacterium
RYTPRHSRRPEV

SEQ ID NO: 572910 - protein, 6 aa, Mycobacterium
RYTQGE

SEQ ID NO: 572911 - protein, 7 aa, Mycobacterium
RYTQPAG

SEQ ID NO: 572912 - protein, 24 aa, Mycobacterium
RYTQPTGSVEVNAKRNGASAWAGV

SEQ ID NO: 572913 - protein, 9 aa, Mycobacterium
RYTRAKTEH

SEQ ID NO: 572914 - protein, 9 aa, Mycobacterium
RYTSQGPSR

SEQ ID NO: 572915 - protein, 13 aa, Mycobacterium
RYTSSRGPSYSSY

SEQ ID NO: 572916 - protein, 11 aa, Mycobacterium
RYTSTGPALDR

SEQ ID NO: 572917 - protein, 5 aa, Mycobacterium
RYVPD

SEQ ID NO: 572918 - protein, 5 aa, Mycobacterium
SAAAA

SEQ ID NO: 572919 - protein, 6 aa, Mycobacterium
SAAAAA

SEQ ID NO: 572920 - protein, 7 aa, Mycobacterium
SAAAAAA

SEQ ID NO: 572921 - protein, 7 aa, Mycobacterium
SAAAAAG

SEQ ID NO: 572922 - protein, 10 aa, Mycobacterium
SAAAAAQARA

SEQ ID NO: 572923 - protein, 13 aa, Mycobacterium
SAAAADATGLRAG

SEQ ID NO: 572924 - protein, 11 aa, Mycobacterium
SAAAADTARIG

SEQ ID NO: 572925 - protein, 10 aa, Mycobacterium
SAAAAELAAS

SEQ ID NO: 572926 - protein, 6 aa, Mycobacterium
SAAAAG

SEQ ID NO: 572927 - protein, 14 aa, Mycobacterium
SAAAAGQARAAAAL

SEQ ID NO: 572928 - protein, 36 aa, Mycobacterium
SAAAAGQARAAAALDTARRAAESAAGVPAARRGRGL

SEQ ID NO: 572929 - protein, 13 aa, Mycobacterium
SAAAAIAEDGGVE

SEQ ID NO: 572930 - protein, 13 aa, Mycobacterium
SAAAALAEDGGVE

SEQ ID NO: 572931 - protein, 11 aa, Mycobacterium
SAAAALPGSAL

SEQ ID NO: 572932 - protein, 17 aa, Mycobacterium
SAAAALPGTTLPSPAEI

SEQ ID NO: 572933 - protein, 7 aa, Mycobacterium
SAAAAPA

SEQ ID NO: 572934 - protein, 9 aa, Mycobacterium
SAAAAPTSG

SEQ ID NO: 572935 - protein, 6 aa, Mycobacterium
SAAAAQ

SEQ ID NO: 572936 - protein, 14 aa, Mycobacterium
SAAAAQLASPAQAL

SEQ ID NO: 572937 - protein, 6 aa, Mycobacterium
SAAAAR

SEQ ID NO: 572938 - protein, 9 aa, Mycobacterium
SAAAASAAA

SEQ ID NO: 572939 - protein, 8 aa, Mycobacterium
SAAAASQR

SEQ ID NO: 572940 - protein, 10 aa, Mycobacterium
SAAAATAAPY

SEQ ID NO: 572941 - protein, 12 aa, Mycobacterium
SAAADFDDDPGI

SEQ ID NO: 572942 - protein, 9 aa, Mycobacterium
SAAADKELK

SEQ ID NO: 572943 - protein, 11 aa, Mycobacterium
SAAADVDDPRG

SEQ ID NO: 572944 - protein, 15 aa, Mycobacterium
SAAAEATVSEDIGGA

SEQ ID NO: 572945 - protein, 7 aa, Mycobacterium
SAAAEGA

SEQ ID NO: 572946 - protein, 9 aa, Mycobacterium
SAAAEGDDN

SEQ ID NO: 572947 - protein, 13 aa, Mycobacterium
SAAAELLDPRIVA

SEQ ID NO: 572948 - protein, 11 aa, Mycobacterium
SAAAELSSAAA

SEQ ID NO: 572949 - protein, 17 aa, Mycobacterium
SAAAEPLGEAADASGAI

SEQ ID NO: 572950 - protein, 12 aa, Mycobacterium
SAAAEQVAATDA

SEQ ID NO: 572951 - protein, 7 aa, Mycobacterium
SAAAETV

SEQ ID NO: 572952 - protein, 7 aa, Mycobacterium
SAAAGAR

SEQ ID NO: 572953 - protein, 9 aa, Mycobacterium
SAAAGGAEV

SEQ ID NO: 572954 - protein, 11 aa, Mycobacterium
SAAAGGDAANV

SEQ ID NO: 572955 - protein, 13 aa, Mycobacterium
SAAAGGGARPPRI

SEQ ID NO: 572956 - protein, 15 aa, Mycobacterium
SAAAGRGTAFVCCPS

SEQ ID NO: 572957 - protein, 14 aa, Mycobacterium
SAAAGSYASAEAAN

SEQ ID NO: 572958 - protein, 7 aa, Mycobacterium
SAAAHER

SEQ ID NO: 572959 - protein, 10 aa, Mycobacterium
SAAAKDAATM

SEQ ID NO: 572960 - protein, 9 aa, Mycobacterium
SAAAKDLAA

SEQ ID NO: 572961 - protein, 8 aa, Mycobacterium
SAAAKGKE

SEQ ID NO: 572962 - protein, 13 aa, Mycobacterium
SAAALADAGLERA

SEQ ID NO: 572963 - protein, 11 aa, Mycobacterium
SAAALGDDPDT

SEQ ID NO: 572964 - protein, 5 aa, Mycobacterium
SAAAM

SEQ ID NO: 572965 - protein, 8 aa, Mycobacterium
SAAANAAS

SEQ ID NO: 572966 - protein, 7 aa, Mycobacterium
SAAAPNQ

SEQ ID NO: 572967 - protein, 10 aa, Mycobacterium
SAAAPPLQDG

SEQ ID NO: 572968 - protein, 7 aa, Mycobacterium
SAAAPYA

SEQ ID NO: 572969 - protein, 10 aa, Mycobacterium
SAAAQRAQSG

SEQ ID NO: 572970 - protein, 22 aa, Mycobacterium
SAAARAVKGDVEQSLKQFVELY

SEQ ID NO: 572971 - protein, 22 aa, Mycobacterium
SAAARAVKGDVQKSLQNFVELY

SEQ ID NO: 572972 - protein, 22 aa, Mycobacterium
SAAARDGATQIGAARDDAVGQV

SEQ ID NO: 572973 - protein, 7 aa, Mycobacterium
SAAARKG

SEQ ID NO: 572974 - protein, 10 aa, Mycobacterium
SAAARKQALE

SEQ ID NO: 572975 - protein, 14 aa, Mycobacterium
SAAARNSAQPINDA

SEQ ID NO: 572976 - protein, 9 aa, Mycobacterium
SAAARQDGV

SEQ ID NO: 572977 - protein, 14 aa, Mycobacterium
SAAARSARRGAATV

SEQ ID NO: 572978 - protein, 8 aa, Mycobacterium
SAAARTIS

SEQ ID NO: 572979 - protein, 7 aa, Mycobacterium
SAAARTP

SEQ ID NO: 572980 - protein, 5 aa, Mycobacterium
SAAAS

SEQ ID NO: 572981 - protein, 9 aa, Mycobacterium
SAAASRARR

SEQ ID NO: 572982 - protein, 13 aa, Mycobacterium
SAAASSLGAGAAA

SEQ ID NO: 572983 - protein, 9 aa, Mycobacterium
SAAASTGAA

SEQ ID NO: 572984 - protein, 8 aa, Mycobacterium
SAAASTLT

SEQ ID NO: 572985 - protein, 9 aa, Mycobacterium
SAAASVDRV

SEQ ID NO: 572986 - protein, 19 aa, Mycobacterium
SAAASYRNTDKRGGANGGR

SEQ ID NO: 572987 - protein, 7 aa, Mycobacterium
SAAATAA

SEQ ID NO: 572988 - protein, 7 aa, Mycobacterium
SAAATAP

SEQ ID NO: 572989 - protein, 7 aa, Mycobacterium
SAAATDA

SEQ ID NO: 572990 - protein, 7 aa, Mycobacterium
SAAATDL

SEQ ID NO: 572991 - protein, 7 aa, Mycobacterium
SAAATDV

SEQ ID NO: 572992 - protein, 7 aa, Mycobacterium
SAAATKV

SEQ ID NO: 572993 - protein, 7 aa, Mycobacterium
SAAATPL

SEQ ID NO: 572994 - protein, 9 aa, Mycobacterium
SAAATSTDT

SEQ ID NO: 572995 - protein, 12 aa, Mycobacterium
SAAATTASPSYR

SEQ ID NO: 572996 - protein, 9 aa, Mycobacterium
SAAATVPAN

SEQ ID NO: 572997 - protein, 6 aa, Mycobacterium
SAAAYE

SEQ ID NO: 572998 - protein, 5 aa, Mycobacterium
SAADA

SEQ ID NO: 572999 - protein, 37 aa, Mycobacterium
SAADAAAAGVQATRDAIAARGRASYVGEAARGVEDPG

SEQ ID NO: 573000 - protein, 7 aa, Mycobacterium
SAADAAR

SEQ ID NO: 573001 - protein, 6 aa, Mycobacterium
SAADAD

SEQ ID NO: 573002 - protein, 11 aa, Mycobacterium
SAADAEAQRPA

SEQ ID NO: 573003 - protein, 9 aa, Mycobacterium
SAADAPSRR

SEQ ID NO: 573004 - protein, 9 aa, Mycobacterium
SAADAYRSG

SEQ ID NO: 573005 - protein, 9 aa, Mycobacterium
SAADDAART

SEQ ID NO: 573006 - protein, 8 aa, Mycobacterium
SAADDPYT

SEQ ID NO: 573007 - protein, 6 aa, Mycobacterium
SAADDT

SEQ ID NO: 573008 - protein, 8 aa, Mycobacterium
SAADEDSA

SEQ ID NO: 573009 - protein, 8 aa, Mycobacterium
SAADGKLG

SEQ ID NO: 573010 - protein, 5 aa, Mycobacterium
SAADL

SEQ ID NO: 573011 - protein, 13 aa, Mycobacterium
SAADLGSGEPIPT

SEQ ID NO: 573012 - protein, 7 aa, Mycobacterium
SAADNAG

SEQ ID NO: 573013 - protein, 16 aa, Mycobacterium
SAADNSVDATASRDFA

SEQ ID NO: 573014 - protein, 5 aa, Mycobacterium
SAADP

SEQ ID NO: 573015 - protein, 15 aa, Mycobacterium
SAADPGVGIPPQAAV

SEQ ID NO: 573016 - protein, 7 aa, Mycobacterium
SAADPSV

SEQ ID NO: 573017 - protein, 6 aa, Mycobacterium
SAADQN

SEQ ID NO: 573018 - protein, 9 aa, Mycobacterium
SAADQRPAE

SEQ ID NO: 573019 - protein, 6 aa, Mycobacterium
SAADRA

SEQ ID NO: 573020 - protein, 9 aa, Mycobacterium
SAADRADPV

SEQ ID NO: 573021 - protein, 8 aa, Mycobacterium
SAADRARG

SEQ ID NO: 573022 - protein, 21 aa, Mycobacterium
SAADRGGDLSEEHRSDTAPKL

SEQ ID NO: 573023 - protein, 9 aa, Mycobacterium
SAADRNAGA

SEQ ID NO: 573024 - protein, 39 aa, Mycobacterium
SAADRQDVRPHDDASAKPLSEQLGAQQQSPAAQGPQGLG

SEQ ID NO: 573025 - protein, 5 aa, Mycobacterium
SAADS

SEQ ID NO: 573026 - protein, 8 aa, Mycobacterium
SAADSSSL

SEQ ID NO: 573027 - protein, 8 aa, Mycobacterium
SAADTESA

SEQ ID NO: 573028 - protein, 12 aa, Mycobacterium
SAADVSYKDTGS

SEQ ID NO: 573029 - protein, 8 aa, Mycobacterium
SAADYGRP

SEQ ID NO: 573030 - protein, 10 aa, Mycobacterium
SAAEADDPAV

SEQ ID NO: 573031 - protein, 8 aa, Mycobacterium
SAAEADPD

SEQ ID NO: 573032 - protein, 9 aa, Mycobacterium
SAAEAEGVS

SEQ ID NO: 573033 - protein, 12 aa, Mycobacterium
SAAEAEKAFTGE

SEQ ID NO: 573034 - protein, 7 aa, Mycobacterium
SAAEAGA

SEQ ID NO: 573035 - protein, 9 aa, Mycobacterium
SAAEAGART

SEQ ID NO: 573036 - protein, 9 aa, Mycobacterium
SAAEAGLAD

SEQ ID NO: 573037 - protein, 15 aa, Mycobacterium
SAAEALAETASRVGG

SEQ ID NO: 573038 - protein, 12 aa, Mycobacterium
SAAEATATPDFG

SEQ ID NO: 573039 - protein, 11 aa, Mycobacterium
SAAEDAAHQQG

SEQ ID NO: 573040 - protein, 9 aa, Mycobacterium
SAAEDDTQA

SEQ ID NO: 573041 - protein, 8 aa, Mycobacterium
SAAEDPDL

SEQ ID NO: 573042 - protein, 5 aa, Mycobacterium
SAAEG

SEQ ID NO: 573043 - protein, 9 aa, Mycobacterium
SAAEGAVGH

SEQ ID NO: 573044 - protein, 11 aa, Mycobacterium
SAAEGDTADRA

SEQ ID NO: 573045 - protein, 8 aa, Mycobacterium
SAAEGETI

SEQ ID NO: 573046 - protein, 11 aa, Mycobacterium
SAAEGVARSPL

SEQ ID NO: 573047 - protein, 11 aa, Mycobacterium
SAAEGVTRSPL

SEQ ID NO: 573048 - protein, 24 aa, Mycobacterium
SAAEPGEAGRHSSDIGDPAHPTEP

SEQ ID NO: 573049 - protein, 15 aa, Mycobacterium
SAAEPGEAGRHSSNA

SEQ ID NO: 573050 - protein, 6 aa, Mycobacterium
SAAEQF

SEQ ID NO: 573051 - protein, 13 aa, Mycobacterium
SAAEQPEAHHEEA

SEQ ID NO: 573052 - protein, 5 aa, Mycobacterium
SAAER

SEQ ID NO: 573053 - protein, 7 aa, Mycobacterium
SAAERDE

SEQ ID NO: 573054 - protein, 9 aa, Mycobacterium
SAAESFGSV

SEQ ID NO: 573055 - protein, 15 aa, Mycobacterium
SAAESLAETASRVGG

SEQ ID NO: 573056 - protein, 5 aa, Mycobacterium
SAAET

SEQ ID NO: 573057 - protein, 8 aa, Mycobacterium
SAAETAIR

SEQ ID NO: 573058 - protein, 17 aa, Mycobacterium
SAAETARADAAPATAAE

SEQ ID NO: 573059 - protein, 13 aa, Mycobacterium
SAAETGSRDRYRR

SEQ ID NO: 573060 - protein, 8 aa, Mycobacterium
SAAETRQR

SEQ ID NO: 573061 - protein, 27 aa, Mycobacterium
SAAETYEATDDASAARVDGVEVPATAP

SEQ ID NO: 573062 - protein, 12 aa, Mycobacterium
SAAEVSDRLTDA

SEQ ID NO: 573063 - protein, 7 aa, Mycobacterium
SAAFQRQ

SEQ ID NO: 573064 - protein, 5 aa, Mycobacterium
SAAGA

SEQ ID NO: 573065 - protein, 8 aa, Mycobacterium
SAAGAASL

SEQ ID NO: 573066 - protein, 9 aa, Mycobacterium
SAAGAATRQ

SEQ ID NO: 573067 - protein, 19 aa, Mycobacterium
SAAGAAYAAAEAANAAPLG

SEQ ID NO: 573068 - protein, 7 aa, Mycobacterium
SAAGADA

SEQ ID NO: 573069 - protein, 8 aa, Mycobacterium
SAAGAQQL

SEQ ID NO: 573070 - protein, 20 aa, Mycobacterium
SAAGASSPGTSPASTSAESS

SEQ ID NO: 573071 - protein, 8 aa, Mycobacterium
SAAGATEG

SEQ ID NO: 573072 - protein, 16 aa, Mycobacterium
SAAGAYSGAEAANVSP

SEQ ID NO: 573073 - protein, 5 aa, Mycobacterium
SAAGD

SEQ ID NO: 573074 - protein, 14 aa, Mycobacterium
SAAGDLMASSGDPM

SEQ ID NO: 573075 - protein, 6 aa, Mycobacterium
SAAGDV

SEQ ID NO: 573076 - protein, 11 aa, Mycobacterium
SAAGEATGDSE

SEQ ID NO: 573077 - protein, 6 aa, Mycobacterium
SAAGEI

SEQ ID NO: 573078 - protein, 5 aa, Mycobacterium
SAAGG

SEQ ID NO: 573079 - protein, 8 aa, Mycobacterium
SAAGGLGT

SEQ ID NO: 573080 - protein, 9 aa, Mycobacterium
SAAGGPPGA

SEQ ID NO: 573081 - protein, 6 aa, Mycobacterium
SAAGGR

SEQ ID NO: 573082 - protein, 8 aa, Mycobacterium
SAAGGRAT

SEQ ID NO: 573083 - protein, 8 aa, Mycobacterium
SAAGGTDA

SEQ ID NO: 573084 - protein, 14 aa, Mycobacterium
SAAGGTGNGADVRS

SEQ ID NO: 573085 - protein, 8 aa, Mycobacterium
SAAGGVPA

SEQ ID NO: 573086 - protein, 13 aa, Mycobacterium
SAAGGVSTPSNQD

SEQ ID NO: 573087 - protein, 7 aa, Mycobacterium
SAAGGYE

SEQ ID NO: 573088 - protein, 8 aa, Mycobacterium
SAAGISGP

SEQ ID NO: 573089 - protein, 8 aa, Mycobacterium
SAAGISRG

SEQ ID NO: 573090 - protein, 5 aa, Mycobacterium
SAAGK

SEQ ID NO: 573091 - protein, 10 aa, Mycobacterium
SAAGKAGFPG

SEQ ID NO: 573092 - protein, 8 aa, Mycobacterium
SAAGLSSP

SEQ ID NO: 573093 - protein, 9 aa, Mycobacterium
SAAGMDPEQ

SEQ ID NO: 573094 - protein, 8 aa, Mycobacterium
SAAGMDQE

SEQ ID NO: 573095 - protein, 8 aa, Mycobacterium
SAAGMDRE

SEQ ID NO: 573096 - protein, 24 aa, Mycobacterium
SAAGNGNAVVTPSGAGIHEVDVKI

SEQ ID NO: 573097 - protein, 9 aa, Mycobacterium
SAAGNRGRQ

SEQ ID NO: 573098 - protein, 11 aa, Mycobacterium
SAAGNSPIPYN

SEQ ID NO: 573099 - protein, 10 aa, Mycobacterium
SAAGPEAVPA

SEQ ID NO: 573100 - protein, 16 aa, Mycobacterium
SAAGPEAVPAAALGEG

SEQ ID NO: 573101 - protein, 18 aa, Mycobacterium
SAAGPEAVPAAALGEGGL

SEQ ID NO: 573102 - protein, 33 aa, Mycobacterium
SAAGPGRRPVTGDNAAEKGGAHRIESAKAGKLT

SEQ ID NO: 573103 - protein, 8 aa, Mycobacterium
SAAGPHAV

SEQ ID NO: 573104 - protein, 27 aa, Mycobacterium
SAAGPTGAIANGDGESVGLPNPYQEDA

SEQ ID NO: 573105 - protein, 21 aa, Mycobacterium
SAAGQNGASRQGHYSASKGGV

SEQ ID NO: 573106 - protein, 20 aa, Mycobacterium
SAAGQRGAPAQGHYSATKGG

SEQ ID NO: 573107 - protein, 5 aa, Mycobacterium
SAAGR

SEQ ID NO: 573108 - protein, 8 aa, Mycobacterium
SAAGSDDT

SEQ ID NO: 573109 - protein, 19 aa, Mycobacterium
SAAGSFRRTDKRGGANGGR

SEQ ID NO: 573110 - protein, 6 aa, Mycobacterium
SAAGSR

SEQ ID NO: 573111 - protein, 15 aa, Mycobacterium
SAAGSSVGKGESLRD

SEQ ID NO: 573112 - protein, 19 aa, Mycobacterium
SAAGSYRNTDKRGGANGGR

SEQ ID NO: 573113 - protein, 23 aa, Mycobacterium
SAAGTAGDATFGGYASAKEAIRG

SEQ ID NO: 573114 - protein, 12 aa, Mycobacterium
SAAGTDWTSGEY

SEQ ID NO: 573115 - protein, 16 aa, Mycobacterium
SAAGTEAVPAAALGEG

SEQ ID NO: 573116 - protein, 8 aa, Mycobacterium
SAAGTLAT

SEQ ID NO: 573117 - protein, 10 aa, Mycobacterium
SAAGTQDDSG

SEQ ID NO: 573118 - protein, 6 aa, Mycobacterium
SAAGVD

SEQ ID NO: 573119 - protein, 11 aa, Mycobacterium
SAAGVSAPNAT

SEQ ID NO: 573120 - protein, 8 aa, Mycobacterium
SAAGVSRG

SEQ ID NO: 573121 - protein, 7 aa, Mycobacterium
SAAGVTP

SEQ ID NO: 573122 - protein, 6 aa, Mycobacterium
SAAGWD

SEQ ID NO: 573123 - protein, 6 aa, Mycobacterium
SAAHGG

SEQ ID NO: 573124 - protein, 8 aa, Mycobacterium
SAAHRRET

SEQ ID NO: 573125 - protein, 6 aa, Mycobacterium
SAAHSR

SEQ ID NO: 573126 - protein, 5 aa, Mycobacterium
SAAIA

SEQ ID NO: 573127 - protein, 7 aa, Mycobacterium
SAAISYA

SEQ ID NO: 573128 - protein, 13 aa, Mycobacterium
SAAKAEATSIASQ

SEQ ID NO: 573129 - protein, 10 aa, Mycobacterium
SAAKAEQREL

SEQ ID NO: 573130 - protein, 14 aa, Mycobacterium
SAAKEYAEKRYPHK

SEQ ID NO: 573131 - protein, 9 aa, Mycobacterium
SAAKGGLAI

SEQ ID NO: 573132 - protein, 8 aa, Mycobacterium
SAAKRPGL

SEQ ID NO: 573133 - protein, 13 aa, Mycobacterium
SAAKRSIEPPMSD

SEQ ID NO: 573134 - protein, 10 aa, Mycobacterium
SAAKSVGADE

SEQ ID NO: 573135 - protein, 20 aa, Mycobacterium
SAAKVAAANSGYAANETNSA

SEQ ID NO: 573136 - protein, 13 aa, Mycobacterium
SAAKVRSTFDDAT

SEQ ID NO: 573137 - protein, 12 aa, Mycobacterium
SAAKWTRSPGRG

SEQ ID NO: 573138 - protein, 12 aa, Mycobacterium
SAALDEDAAPTV

SEQ ID NO: 573139 - protein, 13 aa, Mycobacterium
SAALGKPKSDEVE

SEQ ID NO: 573140 - protein, 14 aa, Mycobacterium
SAALPDDCDQDSRE

SEQ ID NO: 573141 - protein, 5 aa, Mycobacterium
SAAMP

SEQ ID NO: 573142 - protein, 16 aa, Mycobacterium
SAAMRAAQKADPPSAE

SEQ ID NO: 573143 - protein, 17 aa, Mycobacterium
SAAMRAAQSADPPSAEL

SEQ ID NO: 573144 - protein, 12 aa, Mycobacterium
SAANAAAATPTT

SEQ ID NO: 573145 - protein, 14 aa, Mycobacterium
SAANAAAAVPTTGL

SEQ ID NO: 573146 - protein, 11 aa, Mycobacterium
SAANAAATVPT

SEQ ID NO: 573147 - protein, 8 aa, Mycobacterium
SAANAGID

SEQ ID NO: 573148 - protein, 6 aa, Mycobacterium
SAANAI

SEQ ID NO: 573149 - protein, 14 aa, Mycobacterium
SAANALAANSTTSL

SEQ ID NO: 573150 - protein, 8 aa, Mycobacterium
SAANARAV

SEQ ID NO: 573151 - protein, 6 aa, Mycobacterium
SAANDL

SEQ ID NO: 573152 - protein, 8 aa, Mycobacterium
SAANGGLR

SEQ ID NO: 573153 - protein, 9 aa, Mycobacterium
SAANGTTLG

SEQ ID NO: 573154 - protein, 6 aa, Mycobacterium
SAANPE

SEQ ID NO: 573155 - protein, 6 aa, Mycobacterium
SAANPR

SEQ ID NO: 573156 - protein, 7 aa, Mycobacterium
SAANPTV

SEQ ID NO: 573157 - protein, 13 aa, Mycobacterium
SAANRNELPARTP

SEQ ID NO: 573158 - protein, 7 aa, Mycobacterium
SAANRRF

SEQ ID NO: 573159 - protein, 10 aa, Mycobacterium
SAANSLGAGE

SEQ ID NO: 573160 - protein, 10 aa, Mycobacterium
SAANTATESV

SEQ ID NO: 573161 - protein, 6 aa, Mycobacterium
SAANVD

SEQ ID NO: 573162 - protein, 7 aa, Mycobacterium
SAAPAAA

SEQ ID NO: 573163 - protein, 7 aa, Mycobacterium
SAAPADQ

SEQ ID NO: 573164 - protein, 44 aa, Mycobacterium
SAAPAGSPPTTPAEWQSASGTGGGPGGGFAPGSGGFGNSGATGE

SEQ ID NO: 573165 - protein, 8 aa, Mycobacterium
SAAPAPPI

SEQ ID NO: 573166 - protein, 6 aa, Mycobacterium
SAAPAT

SEQ ID NO: 573167 - protein, 13 aa, Mycobacterium
SAAPDATAAPGNL

SEQ ID NO: 573168 - protein, 8 aa, Mycobacterium
SAAPDSAE

SEQ ID NO: 573169 - protein, 11 aa, Mycobacterium
SAAPDTGEQDL

SEQ ID NO: 573170 - protein, 6 aa, Mycobacterium
SAAPEI

SEQ ID NO: 573171 - protein, 11 aa, Mycobacterium
SAAPERANPVD

SEQ ID NO: 573172 - protein, 6 aa, Mycobacterium
SAAPGD

SEQ ID NO: 573173 - protein, 8 aa, Mycobacterium
SAAPGDSA

SEQ ID NO: 573174 - protein, 15 aa, Mycobacterium
SAAPGIEEVRGDTYR

SEQ ID NO: 573175 - protein, 5 aa, Mycobacterium
SAAPL

SEQ ID NO: 573176 - protein, 8 aa, Mycobacterium
SAAPLDGT

SEQ ID NO: 573177 - protein, 12 aa, Mycobacterium
SAAPNRVDNAPG

SEQ ID NO: 573178 - protein, 6 aa, Mycobacterium
SAAPPD

SEQ ID NO: 573179 - protein, 12 aa, Mycobacterium
SAAPPQYKQDSY

SEQ ID NO: 573180 - protein, 9 aa, Mycobacterium
SAAPQLGSA

SEQ ID NO: 573181 - protein, 21 aa, Mycobacterium
SAAPQRPPRVAGGSDGDRPLD

SEQ ID NO: 573182 - protein, 8 aa, Mycobacterium
SAAPSARD

SEQ ID NO: 573183 - protein, 10 aa, Mycobacterium
SAAPSSRCAN

SEQ ID NO: 573184 - protein, 22 aa, Mycobacterium
SAAPTNSAGAAGTRGPAGAAGA

SEQ ID NO: 573185 - protein, 9 aa, Mycobacterium
SAAPTPNIA

SEQ ID NO: 573186 - protein, 10 aa, Mycobacterium
SAAPTPSPMS

SEQ ID NO: 573187 - protein, 8 aa, Mycobacterium
SAAPTREN

SEQ ID NO: 573188 - protein, 7 aa, Mycobacterium
SAAPTVS

SEQ ID NO: 573189 - protein, 7 aa, Mycobacterium
SAAPVPN

SEQ ID NO: 573190 - protein, 5 aa, Mycobacterium
SAAPY

SEQ ID NO: 573191 - protein, 16 aa, Mycobacterium
SAAQADGDIPSSTEAK

SEQ ID NO: 573192 - protein, 7 aa, Mycobacterium
SAAQDDA

SEQ ID NO: 573193 - protein, 8 aa, Mycobacterium
SAAQDPDV

SEQ ID NO: 573194 - protein, 13 aa, Mycobacterium
SAAQELSRATEPA

SEQ ID NO: 573195 - protein, 26 aa, Mycobacterium
SAAQGWPAQYADAANSSYTPTGGATK

SEQ ID NO: 573196 - protein, 8 aa, Mycobacterium
SAAQHGPV

SEQ ID NO: 573197 - protein, 5 aa, Mycobacterium
SAAQM

SEQ ID NO: 573198 - protein, 5 aa, Mycobacterium
SAAQN

SEQ ID NO: 573199 - protein, 15 aa, Mycobacterium
SAAQPGAAGRHQGGG

SEQ ID NO: 573200 - protein, 21 aa, Mycobacterium
SAAQPGAAGRQAEKPGVQCSS

SEQ ID NO: 573201 - protein, 16 aa, Mycobacterium
SAAQPGAAGRQAEKPV

SEQ ID NO: 573202 - protein, 10 aa, Mycobacterium
SAAQRCPDRP

SEQ ID NO: 573203 - protein, 9 aa, Mycobacterium
SAAQREAAD

SEQ ID NO: 573204 - protein, 7 aa, Mycobacterium
SAAQRGH

SEQ ID NO: 573205 - protein, 9 aa, Mycobacterium
SAAQRRRAE

SEQ ID NO: 573206 - protein, 9 aa, Mycobacterium
SAAQTGATE

SEQ ID NO: 573207 - protein, 16 aa, Mycobacterium
SAAQVAAGDAASLGSA

SEQ ID NO: 573208 - protein, 25 aa, Mycobacterium
SAARAARDAIAAASGARRSKSDPLR

SEQ ID NO: 573209 - protein, 8 aa, Mycobacterium
SAARAGDE

SEQ ID NO: 573210 - protein, 10 aa, Mycobacterium
SAARARGGRT

SEQ ID NO: 573211 - protein, 10 aa, Mycobacterium
SAARDAGNRD

SEQ ID NO: 573212 - protein, 8 aa, Mycobacterium
SAARDVAN

SEQ ID NO: 573213 - protein, 8 aa, Mycobacterium
SAARDVSN

SEQ ID NO: 573214 - protein, 10 aa, Mycobacterium
SAAREAAPDP

SEQ ID NO: 573215 - protein, 15 aa, Mycobacterium
SAARENARGAREVTS

SEQ ID NO: 573216 - protein, 9 aa, Mycobacterium
SAARERASD

SEQ ID NO: 573217 - protein, 13 aa, Mycobacterium
SAARGEAAPGSDI

SEQ ID NO: 573218 - protein, 10 aa, Mycobacterium
SAARGGNGVE

SEQ ID NO: 573219 - protein, 8 aa, Mycobacterium
SAARNGIS

SEQ ID NO: 573220 - protein, 9 aa, Mycobacterium
SAARNSPDH

SEQ ID NO: 573221 - protein, 29 aa, Mycobacterium
SAARPGAAGRHHESRGDRKRGAAGRGESP

SEQ ID NO: 573222 - protein, 5 aa, Mycobacterium
SAARQ

SEQ ID NO: 573223 - protein, 6 aa, Mycobacterium
SAARQE

SEQ ID NO: 573224 - protein, 9 aa, Mycobacterium
SAARQSRRA

SEQ ID NO: 573225 - protein, 8 aa, Mycobacterium
SAARQWKR

SEQ ID NO: 573226 - protein, 9 aa, Mycobacterium
SAARRAGPL

SEQ ID NO: 573227 - protein, 14 aa, Mycobacterium
SAARRGAPEDAGAL

SEQ ID NO: 573228 - protein, 15 aa, Mycobacterium
SAARRGRAQPGRDDK

SEQ ID NO: 573229 - protein, 9 aa, Mycobacterium
SAARRRETY

SEQ ID NO: 573230 - protein, 12 aa, Mycobacterium
SAARRRPADARA

SEQ ID NO: 573231 - protein, 7 aa, Mycobacterium
SAARSDA

SEQ ID NO: 573232 - protein, 7 aa, Mycobacterium
SAARSLT

SEQ ID NO: 573233 - protein, 9 aa, Mycobacterium
SAARSVNPG

SEQ ID NO: 573234 - protein, 5 aa, Mycobacterium
SAARV

SEQ ID NO: 573235 - protein, 4 aa, Mycobacterium
SAAS

SEQ ID NO: 573236 - protein, 5 aa, Mycobacterium
SAASA

SEQ ID NO: 573237 - protein, 12 aa, Mycobacterium
SAASAATGTPLV

SEQ ID NO: 573238 - protein, 14 aa, Mycobacterium
SAASAPGAAPGISP

SEQ ID NO: 573239 - protein, 18 aa, Mycobacterium
SAASARRRVADAGGRARI

SEQ ID NO: 573240 - protein, 12 aa, Mycobacterium
SAASASPSWAGQ

SEQ ID NO: 573241 - protein, 9 aa, Mycobacterium
SAASDAIGQ

SEQ ID NO: 573242 - protein, 12 aa, Mycobacterium
SAASDTYKKNSY

SEQ ID NO: 573243 - protein, 16 aa, Mycobacterium
SAASEGARQSRSAKQQ

SEQ ID NO: 573244 - protein, 10 aa, Mycobacterium
SAASESDSAE

SEQ ID NO: 573245 - protein, 6 aa, Mycobacterium
SAASET

SEQ ID NO: 573246 - protein, 8 aa, Mycobacterium
SAASEVAG

SEQ ID NO: 573247 - protein, 7 aa, Mycobacterium
SAASGGR

SEQ ID NO: 573248 - protein, 8 aa, Mycobacterium
SAASGLGA

SEQ ID NO: 573249 - protein, 5 aa, Mycobacterium
SAASI

SEQ ID NO: 573250 - protein, 5 aa, Mycobacterium
SAASL

SEQ ID NO: 573251 - protein, 5 aa, Mycobacterium
SAASP

SEQ ID NO: 573252 - protein, 13 aa, Mycobacterium
SAASPGEPGHDHS

SEQ ID NO: 573253 - protein, 12 aa, Mycobacterium
SAASPLPAAESG

SEQ ID NO: 573254 - protein, 14 aa, Mycobacterium
SAASPYREDDPLSP

SEQ ID NO: 573255 - protein, 9 aa, Mycobacterium
SAASQGGAS

SEQ ID NO: 573256 - protein, 9 aa, Mycobacterium
SAASRETEE

SEQ ID NO: 573257 - protein, 9 aa, Mycobacterium
SAASRRTTH

SEQ ID NO: 573258 - protein, 6 aa, Mycobacterium
SAASSA

SEQ ID NO: 573259 - protein, 7 aa, Mycobacterium
SAASSAL

SEQ ID NO: 573260 - protein, 13 aa, Mycobacterium
SAASSERDRMPSL

SEQ ID NO: 573261 - protein, 12 aa, Mycobacterium
SAASSKESRAAE

SEQ ID NO: 573262 - protein, 7 aa, Mycobacterium
SAASSLT

SEQ ID NO: 573263 - protein, 7 aa, Mycobacterium
SAASSSL

SEQ ID NO: 573264 - protein, 6 aa, Mycobacterium
SAASSV

SEQ ID NO: 573265 - protein, 7 aa, Mycobacterium
SAASTDF

SEQ ID NO: 573266 - protein, 8 aa, Mycobacterium
SAASTEPV

SEQ ID NO: 573267 - protein, 9 aa, Mycobacterium
SAASVTRRP

SEQ ID NO: 573268 - protein, 18 aa, Mycobacterium
SAASYRNTDKRGGANGAR

SEQ ID NO: 573269 - protein, 4 aa, Mycobacterium
SAAT

SEQ ID NO: 573270 - protein, 8 aa, Mycobacterium
SAATAAKL

SEQ ID NO: 573271 - protein, 15 aa, Mycobacterium
SAATAERAKTCTPGY

SEQ ID NO: 573272 - protein, 11 aa, Mycobacterium
SAATAKHVAER

SEQ ID NO: 573273 - protein, 10 aa, Mycobacterium
SAATAQDALD

SEQ ID NO: 573274 - protein, 5 aa, Mycobacterium
SAATD

SEQ ID NO: 573275 - protein, 6 aa, Mycobacterium
SAATDQ

SEQ ID NO: 573276 - protein, 7 aa, Mycobacterium
SAATDYA

SEQ ID NO: 573277 - protein, 7 aa, Mycobacterium
SAATEAG

SEQ ID NO: 573278 - protein, 12 aa, Mycobacterium
SAATEEDLDDAQ

SEQ ID NO: 573279 - protein, 7 aa, Mycobacterium
SAATEEV

SEQ ID NO: 573280 - protein, 12 aa, Mycobacterium
SAATELDGDPGI

SEQ ID NO: 573281 - protein, 7 aa, Mycobacterium
SAATEVD

SEQ ID NO: 573282 - protein, 5 aa, Mycobacterium
SAATF

SEQ ID NO: 573283 - protein, 12 aa, Mycobacterium
SAATGAGRQAPR

SEQ ID NO: 573284 - protein, 8 aa, Mycobacterium
SAATGEQF

SEQ ID NO: 573285 - protein, 6 aa, Mycobacterium
SAATGG

SEQ ID NO: 573286 - protein, 8 aa, Mycobacterium
SAATGGAG

SEQ ID NO: 573287 - protein, 9 aa, Mycobacterium
SAATGGAGL

SEQ ID NO: 573288 - protein, 8 aa, Mycobacterium
SAATGLDT

SEQ ID NO: 573289 - protein, 9 aa, Mycobacterium
SAATGLGRG

SEQ ID NO: 573290 - protein, 8 aa, Mycobacterium
SAATGRMT

SEQ ID NO: 573291 - protein, 9 aa, Mycobacterium
SAATHRENA

SEQ ID NO: 573292 - protein, 6 aa, Mycobacterium
SAATIT

SEQ ID NO: 573293 - protein, 19 aa, Mycobacterium
SAATLPAREPDAGGAVTPE

SEQ ID NO: 573294 - protein, 7 aa, Mycobacterium
SAATPAL

SEQ ID NO: 573295 - protein, 8 aa, Mycobacterium
SAATPAYG

SEQ ID NO: 573296 - protein, 8 aa, Mycobacterium
SAATPEGL

SEQ ID NO: 573297 - protein, 6 aa, Mycobacterium
SAATPI

SEQ ID NO: 573298 - protein, 9 aa, Mycobacterium
SAATPQGKA

SEQ ID NO: 573299 - protein, 12 aa, Mycobacterium
SAATQPPGRGRA

SEQ ID NO: 573300 - protein, 9 aa, Mycobacterium
SAATQRRLA

SEQ ID NO: 573301 - protein, 5 aa, Mycobacterium
SAATR

SEQ ID NO: 573302 - protein, 6 aa, Mycobacterium
SAATRD

SEQ ID NO: 573303 - protein, 6 aa, Mycobacterium
SAATRE

SEQ ID NO: 573304 - protein, 11 aa, Mycobacterium
SAATSDAAEIG

SEQ ID NO: 573305 - protein, 20 aa, Mycobacterium
SAATSHRDAGGEGQQDHQGL

SEQ ID NO: 573306 - protein, 8 aa, Mycobacterium
SAATSQPY

SEQ ID NO: 573307 - protein, 7 aa, Mycobacterium
SAATSYE

SEQ ID NO: 573308 - protein, 8 aa, Mycobacterium
SAATTAAS

SEQ ID NO: 573309 - protein, 8 aa, Mycobacterium
SAATTPTL

SEQ ID NO: 573310 - protein, 7 aa, Mycobacterium
SAATTVP

SEQ ID NO: 573311 - protein, 9 aa, Mycobacterium
SAATVSPAE

SEQ ID NO: 573312 - protein, 7 aa, Mycobacterium
SAAVATN

SEQ ID NO: 573313 - protein, 8 aa, Mycobacterium
SAAVENAA

SEQ ID NO: 573314 - protein, 9 aa, Mycobacterium
SAAVEPATH

SEQ ID NO: 573315 - protein, 9 aa, Mycobacterium
SAAVGPGDD

SEQ ID NO: 573316 - protein, 8 aa, Mycobacterium
SAAVPNGR

SEQ ID NO: 573317 - protein, 7 aa, Mycobacterium
SAAVRAG

SEQ ID NO: 573318 - protein, 6 aa, Mycobacterium
SAAWTP

SEQ ID NO: 573319 - protein, 8 aa, Mycobacterium
SAAYGGAS

SEQ ID NO: 573320 - protein, 8 aa, Mycobacterium
SAAYKQSQ

SEQ ID NO: 573321 - protein, 8 aa, Mycobacterium
SAAYNRGA

SEQ ID NO: 573322 - protein, 5 aa, Mycobacterium
SACAR

SEQ ID NO: 573323 - protein, 4 aa, Mycobacterium
SACG

SEQ ID NO: 573324 - protein, 12 aa, Mycobacterium
SACGASAVTPDR

SEQ ID NO: 573325 - protein, 7 aa, Mycobacterium
SACGSTG

SEQ ID NO: 573326 - protein, 9 aa, Mycobacterium
SACHAGEDT

SEQ ID NO: 573327 - protein, 13 aa, Mycobacterium
SACPTGTTPAPRP

SEQ ID NO: 573328 - protein, 28 aa, Mycobacterium
SACRDEPKNARKDVTRTTAKCNVLRPAV

SEQ ID NO: 573329 - protein, 7 aa, Mycobacterium
SACSTNP

SEQ ID NO: 573330 - protein, 7 aa, Mycobacterium
SACTDGG

SEQ ID NO: 573331 - protein, 8 aa, Mycobacterium
SACTDGGH

SEQ ID NO: 573332 - protein, 5 aa, Mycobacterium
SADAA

SEQ ID NO: 573333 - protein, 10 aa, Mycobacterium
SADAAEDDLR

SEQ ID NO: 573334 - protein, 11 aa, Mycobacterium
SADAAGTRPWR

SEQ ID NO: 573335 - protein, 10 aa, Mycobacterium
SADADDGADL

SEQ ID NO: 573336 - protein, 8 aa, Mycobacterium
SADADEMA

SEQ ID NO: 573337 - protein, 9 aa, Mycobacterium
SADADLEEQ

SEQ ID NO: 573338 - protein, 8 aa, Mycobacterium
SADAEAAA

SEQ ID NO: 573339 - protein, 7 aa, Mycobacterium
SADAEER

SEQ ID NO: 573340 - protein, 8 aa, Mycobacterium
SADAGAIG

SEQ ID NO: 573341 - protein, 9 aa, Mycobacterium
SADAGQLRE

SEQ ID NO: 573342 - protein, 6 aa, Mycobacterium
SADAGV

SEQ ID NO: 573343 - protein, 8 aa, Mycobacterium
SADAPALD

SEQ ID NO: 573344 - protein, 8 aa, Mycobacterium
SADAPDGF

SEQ ID NO: 573345 - protein, 47 aa, Mycobacterium
SADAQAAAARAQRDEARSASISRKEELAAEAEELAANSTQWKAAGDR

SEQ ID NO: 573346 - protein, 7 aa, Mycobacterium
SADAQAT

SEQ ID NO: 573347 - protein, 8 aa, Mycobacterium
SADAREGL

SEQ ID NO: 573348 - protein, 8 aa, Mycobacterium
SADAREGV

SEQ ID NO: 573349 - protein, 12 aa, Mycobacterium
SADARTVAEQTG

SEQ ID NO: 573350 - protein, 11 aa, Mycobacterium
SADASSTPPRT

SEQ ID NO: 573351 - protein, 8 aa, Mycobacterium
SADATPEV

SEQ ID NO: 573352 - protein, 10 aa, Mycobacterium
SADDAGDREA

SEQ ID NO: 573353 - protein, 6 aa, Mycobacterium
SADDAR

SEQ ID NO: 573354 - protein, 32 aa, Mycobacterium
SADDEGMSNTETTPTETRCEGGPCPLDDAGRP

SEQ ID NO: 573355 - protein, 7 aa, Mycobacterium
SADDGAD

SEQ ID NO: 573356 - protein, 14 aa, Mycobacterium
SADDGPRPGTTYEK

SEQ ID NO: 573357 - protein, 8 aa, Mycobacterium
SADDGQAY

SEQ ID NO: 573358 - protein, 9 aa, Mycobacterium
SADDLDGET

SEQ ID NO: 573359 - protein, 7 aa, Mycobacterium
SADDLPR

SEQ ID NO: 573360 - protein, 8 aa, Mycobacterium
SADDLPRG

SEQ ID NO: 573361 - protein, 8 aa, Mycobacterium
SADDLQSV

SEQ ID NO: 573362 - protein, 8 aa, Mycobacterium
SADDPATD

SEQ ID NO: 573363 - protein, 9 aa, Mycobacterium
SADDQLRAA

SEQ ID NO: 573364 - protein, 8 aa, Mycobacterium
SADDQTGV

SEQ ID NO: 573365 - protein, 5 aa, Mycobacterium
SADDR

SEQ ID NO: 573366 - protein, 9 aa, Mycobacterium
SADDSGREA

SEQ ID NO: 573367 - protein, 5 aa, Mycobacterium
SADDT

SEQ ID NO: 573368 - protein, 11 aa, Mycobacterium
SADDTIPADER

SEQ ID NO: 573369 - protein, 14 aa, Mycobacterium
SADDVERPSCSPYG

SEQ ID NO: 573370 - protein, 8 aa, Mycobacterium
SADDVSDL

SEQ ID NO: 573371 - protein, 5 aa, Mycobacterium
SADDY

SEQ ID NO: 573372 - protein, 8 aa, Mycobacterium
SADEAREG

SEQ ID NO: 573373 - protein, 6 aa, Mycobacterium
SADEDR

SEQ ID NO: 573374 - protein, 13 aa, Mycobacterium
SADEGPGTQPASL

SEQ ID NO: 573375 - protein, 8 aa, Mycobacterium
SADEKDAA

SEQ ID NO: 573376 - protein, 7 aa, Mycobacterium
SADEKEA

SEQ ID NO: 573377 - protein, 10 aa, Mycobacterium
SADEKNLDRW

SEQ ID NO: 573378 - protein, 8 aa, Mycobacterium
SADELAAT

SEQ ID NO: 573379 - protein, 6 aa, Mycobacterium
SADELR

SEQ ID NO: 573380 - protein, 9 aa, Mycobacterium
SADEPGPDD

SEQ ID NO: 573381 - protein, 7 aa, Mycobacterium
SADEPIA

SEQ ID NO: 573382 - protein, 9 aa, Mycobacterium
SADEVTAAL

SEQ ID NO: 573383 - protein, 6 aa, Mycobacterium
SADEYE

SEQ ID NO: 573384 - protein, 22 aa, Mycobacterium
SADGAANTVDLGSPAARAIWVV

SEQ ID NO: 573385 - protein, 9 aa, Mycobacterium
SADGAPVTT

SEQ ID NO: 573386 - protein, 6 aa, Mycobacterium
SADGAQ

SEQ ID NO: 573387 - protein, 9 aa, Mycobacterium
SADGATRTV

SEQ ID NO: 573388 - protein, 10 aa, Mycobacterium
SADGDAEGAL

SEQ ID NO: 573389 - protein, 9 aa, Mycobacterium
SADGDEYRL

SEQ ID NO: 573390 - protein, 9 aa, Mycobacterium
SADGEVDEI

SEQ ID NO: 573391 - protein, 8 aa, Mycobacterium
SADGFDPA

SEQ ID NO: 573392 - protein, 5 aa, Mycobacterium
SADGG

SEQ ID NO: 573393 - protein, 9 aa, Mycobacterium
SADGGDYDR

SEQ ID NO: 573394 - protein, 15 aa, Mycobacterium
SADGHTTNPPARYTE

SEQ ID NO: 573395 - protein, 8 aa, Mycobacterium
SADGKEIA

SEQ ID NO: 573396 - protein, 10 aa, Mycobacterium
SADGKRRQVR

SEQ ID NO: 573397 - protein, 9 aa, Mycobacterium
SADGLSPRE

SEQ ID NO: 573398 - protein, 9 aa, Mycobacterium
SADGLTPRE

SEQ ID NO: 573399 - protein, 9 aa, Mycobacterium
SADGLTPRK

SEQ ID NO: 573400 - protein, 9 aa, Mycobacterium
SADGLTPRQ

SEQ ID NO: 573401 - protein, 17 aa, Mycobacterium
SADGPEMGGEAAETIDA

SEQ ID NO: 573402 - protein, 7 aa, Mycobacterium
SADGRCK

SEQ ID NO: 573403 - protein, 10 aa, Mycobacterium
SADGRPAGIG

SEQ ID NO: 573404 - protein, 10 aa, Mycobacterium
SADGRPEGIG

SEQ ID NO: 573405 - protein, 9 aa, Mycobacterium
SADGRTSTL

SEQ ID NO: 573406 - protein, 8 aa, Mycobacterium
SADGRYNI

SEQ ID NO: 573407 - protein, 5 aa, Mycobacterium
SADGS

SEQ ID NO: 573408 - protein, 11 aa, Mycobacterium
SADGSELARGK

SEQ ID NO: 573409 - protein, 6 aa, Mycobacterium
SADGSR

SEQ ID NO: 573410 - protein, 12 aa, Mycobacterium
SADGSRTAHTEN

SEQ ID NO: 573411 - protein, 7 aa, Mycobacterium
SADGSTV

SEQ ID NO: 573412 - protein, 6 aa, Mycobacterium
SADGTA

SEQ ID NO: 573413 - protein, 8 aa, Mycobacterium
SADGTAEV

SEQ ID NO: 573414 - protein, 7 aa, Mycobacterium
SADGTAI

SEQ ID NO: 573415 - protein, 11 aa, Mycobacterium
SADGTEVARGK

SEQ ID NO: 573416 - protein, 8 aa, Mycobacterium
SADGTITE

SEQ ID NO: 573417 - protein, 9 aa, Mycobacterium
SADGTSAGV

SEQ ID NO: 573418 - protein, 7 aa, Mycobacterium
SADGTSV

SEQ ID NO: 573419 - protein, 6 aa, Mycobacterium
SADGTT

SEQ ID NO: 573420 - protein, 5 aa, Mycobacterium
SADGV

SEQ ID NO: 573421 - protein, 16 aa, Mycobacterium
SADGVADAERRDDLES

SEQ ID NO: 573422 - protein, 7 aa, Mycobacterium
SADGVPA

SEQ ID NO: 573423 - protein, 15 aa, Mycobacterium
SADGVTDEVRRDDLE

SEQ ID NO: 573424 - protein, 17 aa, Mycobacterium
SADGYPAGQPSAGIRAG

SEQ ID NO: 573425 - protein, 18 aa, Mycobacterium
SADGYPDGQPSAGIRPGD

SEQ ID NO: 573426 - protein, 4 aa, Mycobacterium
SADH

SEQ ID NO: 573427 - protein, 7 aa, Mycobacterium
SADIDDQ

SEQ ID NO: 573428 - protein, 6 aa, Mycobacterium
SADIGG

SEQ ID NO: 573429 - protein, 16 aa, Mycobacterium
SADIQASTHEPVSGLH

SEQ ID NO: 573430 - protein, 12 aa, Mycobacterium
SADKGAVRDVGR

SEQ ID NO: 573431 - protein, 8 aa, Mycobacterium
SADKHGLG

SEQ ID NO: 573432 - protein, 14 aa, Mycobacterium
SADKSKATPPRATW

SEQ ID NO: 573433 - protein, 4 aa, Mycobacterium
SADL

SEQ ID NO: 573434 - protein, 12 aa, Mycobacterium
SADLAKGHPQAH

SEQ ID NO: 573435 - protein, 13 aa, Mycobacterium
SADLAKGHPRAQL

SEQ ID NO: 573436 - protein, 19 aa, Mycobacterium
SADLAKGHPRAQQRDDALS

SEQ ID NO: 573437 - protein, 22 aa, Mycobacterium
SADLPTSGLPGLTSSPTGPLPA

SEQ ID NO: 573438 - protein, 6 aa, Mycobacterium
SADMGT

SEQ ID NO: 573439 - protein, 7 aa, Mycobacterium
SADMPDA

SEQ ID NO: 573440 - protein, 8 aa, Mycobacterium
SADNADRI

SEQ ID NO: 573441 - protein, 4 aa, Mycobacterium
SADP

SEQ ID NO: 573442 - protein, 7 aa, Mycobacterium
SADPAAG

SEQ ID NO: 573443 - protein, 9 aa, Mycobacterium
SADPAALGA

SEQ ID NO: 573444 - protein, 7 aa, Mycobacterium
SADPAER

SEQ ID NO: 573445 - protein, 6 aa, Mycobacterium
SADPAH

SEQ ID NO: 573446 - protein, 10 aa, Mycobacterium
SADPAQATNQ

SEQ ID NO: 573447 - protein, 9 aa, Mycobacterium
SADPDASTF

SEQ ID NO: 573448 - protein, 10 aa, Mycobacterium
SADPDDYDDD

SEQ ID NO: 573449 - protein, 21 aa, Mycobacterium
SADPDEAVSYGEGDTGNPPQF

SEQ ID NO: 573450 - protein, 8 aa, Mycobacterium
SADPDEMD

SEQ ID NO: 573451 - protein, 6 aa, Mycobacterium
SADPDL

SEQ ID NO: 573452 - protein, 10 aa, Mycobacterium
SADPDRRSMP

SEQ ID NO: 573453 - protein, 9 aa, Mycobacterium
SADPEADAQ

SEQ ID NO: 573454 - protein, 16 aa, Mycobacterium
SADPEGQLGHGSRTRF

SEQ ID NO: 573455 - protein, 15 aa, Mycobacterium
SADPEGQLGPGARAR

SEQ ID NO: 573456 - protein, 9 aa, Mycobacterium
SADPEVEEG

SEQ ID NO: 573457 - protein, 7 aa, Mycobacterium
SADPGAA

SEQ ID NO: 573458 - protein, 7 aa, Mycobacterium
SADPGAG

SEQ ID NO: 573459 - protein, 8 aa, Mycobacterium
SADPGDDV

SEQ ID NO: 573460 - protein, 8 aa, Mycobacterium
SADPGDGV

SEQ ID NO: 573461 - protein, 11 aa, Mycobacterium
SADPGDSGEEQ

SEQ ID NO: 573462 - protein, 7 aa, Mycobacterium
SADPGPV

SEQ ID NO: 573463 - protein, 8 aa, Mycobacterium
SADPGPVD

SEQ ID NO: 573464 - protein, 19 aa, Mycobacterium
SADPHAGAPPPLIMGQATS

SEQ ID NO: 573465 - protein, 7 aa, Mycobacterium
SADPHAK

SEQ ID NO: 573466 - protein, 8 aa, Mycobacterium
SADPHAKP

SEQ ID NO: 573467 - protein, 8 aa, Mycobacterium
SADPHDTT

SEQ ID NO: 573468 - protein, 7 aa, Mycobacterium
SADPIPT

SEQ ID NO: 573469 - protein, 9 aa, Mycobacterium
SADPITDAD

SEQ ID NO: 573470 - protein, 11 aa, Mycobacterium
SADPKATGAAR

SEQ ID NO: 573471 - protein, 6 aa, Mycobacterium
SADPLD

SEQ ID NO: 573472 - protein, 6 aa, Mycobacterium
SADPMS

SEQ ID NO: 573473 - protein, 9 aa, Mycobacterium
SADPPEGVR

SEQ ID NO: 573474 - protein, 7 aa, Mycobacterium
SADPQIS

SEQ ID NO: 573475 - protein, 7 aa, Mycobacterium
SADPQKW

SEQ ID NO: 573476 - protein, 8 aa, Mycobacterium
SADPQMPA

SEQ ID NO: 573477 - protein, 16 aa, Mycobacterium
SADPQTAGLPAQDPPL

SEQ ID NO: 573478 - protein, 10 aa, Mycobacterium
SADPRDAAAR

SEQ ID NO: 573479 - protein, 8 aa, Mycobacterium
SADPRRGG

SEQ ID NO: 573480 - protein, 9 aa, Mycobacterium
SADPSDTEV

SEQ ID NO: 573481 - protein, 9 aa, Mycobacterium
SADPSGYRD

SEQ ID NO: 573482 - protein, 10 aa, Mycobacterium
SADPSGYRDR

SEQ ID NO: 573483 - protein, 17 aa, Mycobacterium
SADPSWTLPATEPDLEG

SEQ ID NO: 573484 - protein, 5 aa, Mycobacterium
SADPT

SEQ ID NO: 573485 - protein, 8 aa, Mycobacterium
SADPTREE

SEQ ID NO: 573486 - protein, 12 aa, Mycobacterium
SADPTRPIARGV

SEQ ID NO: 573487 - protein, 8 aa, Mycobacterium
SADPVAGA

SEQ ID NO: 573488 - protein, 10 aa, Mycobacterium
SADPVDKQAK

SEQ ID NO: 573489 - protein, 14 aa, Mycobacterium
SADPVDKQAQFADK

SEQ ID NO: 573490 - protein, 5 aa, Mycobacterium
SADPY

SEQ ID NO: 573491 - protein, 7 aa, Mycobacterium
SADQAAR

SEQ ID NO: 573492 - protein, 33 aa, Mycobacterium
SADQADSADPVDSVDQTGIDEIGGHTGMAGMGG

SEQ ID NO: 573493 - protein, 21 aa, Mycobacterium
SADQANTAALEPDNEDVPDTG

SEQ ID NO: 573494 - protein, 8 aa, Mycobacterium
SADQIGDA

SEQ ID NO: 573495 - protein, 6 aa, Mycobacterium
SADQRG

SEQ ID NO: 573496 - protein, 9 aa, Mycobacterium
SADQTGEDH

SEQ ID NO: 573497 - protein, 16 aa, Mycobacterium
SADQVSATELAGEPIT

SEQ ID NO: 573498 - protein, 4 aa, Mycobacterium
SADR

SEQ ID NO: 573499 - protein, 8 aa, Mycobacterium
SADRARRR

SEQ ID NO: 573500 - protein, 6 aa, Mycobacterium
SADRAS

SEQ ID NO: 573501 - protein, 7 aa, Mycobacterium
SADRASE

SEQ ID NO: 573502 - protein, 6 aa, Mycobacterium
SADRDD

SEQ ID NO: 573503 - protein, 8 aa, Mycobacterium
SADRFGNA

SEQ ID NO: 573504 - protein, 6 aa, Mycobacterium
SADRLD

SEQ ID NO: 573505 - protein, 31 aa, Mycobacterium
SADRPAASPEPTAEPGSTANPERRERLRSSR

SEQ ID NO: 573506 - protein, 19 aa, Mycobacterium
SADRPAPGDEVAAAGRAVG

SEQ ID NO: 573507 - protein, 9 aa, Mycobacterium
SADRPGSDD

SEQ ID NO: 573508 - protein, 7 aa, Mycobacterium
SADRPTA

SEQ ID NO: 573509 - protein, 10 aa, Mycobacterium
SADRQAPAPL

SEQ ID NO: 573510 - protein, 7 aa, Mycobacterium
SADRRSA

SEQ ID NO: 573511 - protein, 14 aa, Mycobacterium
SADRRSALARAGGG

SEQ ID NO: 573512 - protein, 31 aa, Mycobacterium
SADRRTALARSGGGIVAESDPDAEVAETTTK

SEQ ID NO: 573513 - protein, 18 aa, Mycobacterium
SADRSHSAAATSPHTTSA

SEQ ID NO: 573514 - protein, 8 aa, Mycobacterium
SADRSPRR

SEQ ID NO: 573515 - protein, 16 aa, Mycobacterium
SADRYRDADERAAGRV

SEQ ID NO: 573516 - protein, 16 aa, Mycobacterium
SADSAEDRVFTPRRYQ

SEQ ID NO: 573517 - protein, 9 aa, Mycobacterium
SADSAGVAA

SEQ ID NO: 573518 - protein, 9 aa, Mycobacterium
SADSAQRAA

SEQ ID NO: 573519 - protein, 6 aa, Mycobacterium
SADSDD

SEQ ID NO: 573520 - protein, 7 aa, Mycobacterium
SADSGDA

SEQ ID NO: 573521 - protein, 16 aa, Mycobacterium
SADSGTAASKLGLPQG

SEQ ID NO: 573522 - protein, 7 aa, Mycobacterium
SADSGTS

SEQ ID NO: 573523 - protein, 9 aa, Mycobacterium
SADSPPAVV

SEQ ID NO: 573524 - protein, 32 aa, Mycobacterium
SADSPTADGRSSYAKTKGYADRAARRLQDAGA

SEQ ID NO: 573525 - protein, 7 aa, Mycobacterium
SADSRAI

SEQ ID NO: 573526 - protein, 10 aa, Mycobacterium
SADSRGRFPG

SEQ ID NO: 573527 - protein, 16 aa, Mycobacterium
SADSSVNSAPQRSEEV

SEQ ID NO: 573528 - protein, 6 aa, Mycobacterium
SADSVA

SEQ ID NO: 573529 - protein, 9 aa, Mycobacterium
SADSVRPGD

SEQ ID NO: 573530 - protein, 4 aa, Mycobacterium
SADT

SEQ ID NO: 573531 - protein, 14 aa, Mycobacterium
SADTASPASTPQPA

SEQ ID NO: 573532 - protein, 8 aa, Mycobacterium
SADTDAEN

SEQ ID NO: 573533 - protein, 8 aa, Mycobacterium
SADTDLTT

SEQ ID NO: 573534 - protein, 9 aa, Mycobacterium
SADTEREEI

SEQ ID NO: 573535 - protein, 8 aa, Mycobacterium
SADTPANL

SEQ ID NO: 573536 - protein, 8 aa, Mycobacterium
SADTQGLP

SEQ ID NO: 573537 - protein, 5 aa, Mycobacterium
SADTR

SEQ ID NO: 573538 - protein, 26 aa, Mycobacterium
SADTSGGPPDAGVAGDEGQVPGPVSA

SEQ ID NO: 573539 - protein, 8 aa, Mycobacterium
SADTTRAL

SEQ ID NO: 573540 - protein, 5 aa, Mycobacterium
SADTV

SEQ ID NO: 573541 - protein, 4 aa, Mycobacterium
SADV

SEQ ID NO: 573542 - protein, 5 aa, Mycobacterium
SADVD

SEQ ID NO: 573543 - protein, 6 aa, Mycobacterium
SADVPE

SEQ ID NO: 573544 - protein, 8 aa, Mycobacterium
SADVRPGD

SEQ ID NO: 573545 - protein, 6 aa, Mycobacterium
SADVSE

SEQ ID NO: 573546 - protein, 11 aa, Mycobacterium
SADWAQDAAPR

SEQ ID NO: 573547 - protein, 13 aa, Mycobacterium
SADWGGPTAVQDT

SEQ ID NO: 573548 - protein, 12 aa, Mycobacterium
SADWKDDGHTDI

SEQ ID NO: 573549 - protein, 6 aa, Mycobacterium
SADWTE

SEQ ID NO: 573550 - protein, 15 aa, Mycobacterium
SADYAATEVLNTAAM

SEQ ID NO: 573551 - protein, 6 aa, Mycobacterium
SAEAAA

SEQ ID NO: 573552 - protein, 13 aa, Mycobacterium
SAEAAAKGKGYSE

SEQ ID NO: 573553 - protein, 6 aa, Mycobacterium
SAEAAD

SEQ ID NO: 573554 - protein, 10 aa, Mycobacterium
SAEAANASQN

SEQ ID NO: 573555 - protein, 10 aa, Mycobacterium
SAEAANVSSF

SEQ ID NO: 573556 - protein, 6 aa, Mycobacterium
SAEAAT

SEQ ID NO: 573557 - protein, 12 aa, Mycobacterium
SAEADLAYPRGA

SEQ ID NO: 573558 - protein, 6 aa, Mycobacterium
SAEAGI

SEQ ID NO: 573559 - protein, 8 aa, Mycobacterium
SAEAGLDG

SEQ ID NO: 573560 - protein, 5 aa, Mycobacterium
SAEAH

SEQ ID NO: 573561 - protein, 9 aa, Mycobacterium
SAEAKNRAL

SEQ ID NO: 573562 - protein, 10 aa, Mycobacterium
SAEALTAQAS

SEQ ID NO: 573563 - protein, 5 aa, Mycobacterium
SAEAP

SEQ ID NO: 573564 - protein, 9 aa, Mycobacterium
SAEAREKYD

SEQ ID NO: 573565 - protein, 7 aa, Mycobacterium
SAEARGA

SEQ ID NO: 573566 - protein, 11 aa, Mycobacterium
SAEARQGERRE

SEQ ID NO: 573567 - protein, 7 aa, Mycobacterium
SAEATVE

SEQ ID NO: 573568 - protein, 8 aa, Mycobacterium
SAECAEDM

SEQ ID NO: 573569 - protein, 8 aa, Mycobacterium
SAECRSGE

SEQ ID NO: 573570 - protein, 4 aa, Mycobacterium
SAED

SEQ ID NO: 573571 - protein, 5 aa, Mycobacterium
SAEDA

SEQ ID NO: 573572 - protein, 10 aa, Mycobacterium
SAEDEALDTI

SEQ ID NO: 573573 - protein, 31 aa, Mycobacterium
SAEDPEVRRNAQDPYSLSPDRPAEPEVGRQR

SEQ ID NO: 573574 - protein, 11 aa, Mycobacterium
SAEDPSEREFG

SEQ ID NO: 573575 - protein, 7 aa, Mycobacterium
SAEDRQT

SEQ ID NO: 573576 - protein, 42 aa, Mycobacterium
SAEDSGTASSMSSSSSSGASGDYAPPDSGKPVVSSNSGVPCV

SEQ ID NO: 573577 - protein, 7 aa, Mycobacterium
SAEDYSR

SEQ ID NO: 573578 - protein, 8 aa, Mycobacterium
SAEEAEQL

SEQ ID NO: 573579 - protein, 6 aa, Mycobacterium
SAEEDL

SEQ ID NO: 573580 - protein, 8 aa, Mycobacterium
SAEEGKAM

SEQ ID NO: 573581 - protein, 14 aa, Mycobacterium
SAEEHSEQEFGPSG

SEQ ID NO: 573582 - protein, 5 aa, Mycobacterium
SAEEL

SEQ ID NO: 573583 - protein, 17 aa, Mycobacterium
SAEEPLETGPVAPPPGN

SEQ ID NO: 573584 - protein, 6 aa, Mycobacterium
SAEERG

SEQ ID NO: 573585 - protein, 8 aa, Mycobacterium
SAEERRDL

SEQ ID NO: 573586 - protein, 9 aa, Mycobacterium
SAEERRRLT

SEQ ID NO: 573587 - protein, 5 aa, Mycobacterium
SAEES

SEQ ID NO: 573588 - protein, 7 aa, Mycobacterium
SAEESER

SEQ ID NO: 573589 - protein, 8 aa, Mycobacterium
SAEESGGR

SEQ ID NO: 573590 - protein, 13 aa, Mycobacterium
SAEEVANGAGLRP

SEQ ID NO: 573591 - protein, 7 aa, Mycobacterium
SAEFDDS

SEQ ID NO: 573592 - protein, 5 aa, Mycobacterium
SAEFP

SEQ ID NO: 573593 - protein, 5 aa, Mycobacterium
SAEFT

SEQ ID NO: 573594 - protein, 5 aa, Mycobacterium
SAEGA

SEQ ID NO: 573595 - protein, 14 aa, Mycobacterium
SAEGAKKISQAAKD

SEQ ID NO: 573596 - protein, 10 aa, Mycobacterium
SAEGDREGAV

SEQ ID NO: 573597 - protein, 14 aa, Mycobacterium
SAEGKEAPEDGYAG

SEQ ID NO: 573598 - protein, 5 aa, Mycobacterium
SAEGM

SEQ ID NO: 573599 - protein, 5 aa, Mycobacterium
SAEGP

SEQ ID NO: 573600 - protein, 6 aa, Mycobacterium
SAEGQA

SEQ ID NO: 573601 - protein, 6 aa, Mycobacterium
SAEGQQ

SEQ ID NO: 573602 - protein, 8 aa, Mycobacterium
SAEGQSDS

SEQ ID NO: 573603 - protein, 5 aa, Mycobacterium
SAEGV

SEQ ID NO: 573604 - protein, 16 aa, Mycobacterium
SAEGVDCPDPVHPIVR

SEQ ID NO: 573605 - protein, 10 aa, Mycobacterium
SAEGVTRGSR

SEQ ID NO: 573606 - protein, 12 aa, Mycobacterium
SAEHGAADDRRF

SEQ ID NO: 573607 - protein, 11 aa, Mycobacterium
SAEHHSESTET

SEQ ID NO: 573608 - protein, 9 aa, Mycobacterium
SAEHTDSGV

SEQ ID NO: 573609 - protein, 7 aa, Mycobacterium
SAEHVDA

SEQ ID NO: 573610 - protein, 9 aa, Mycobacterium
SAEIRGDAV

SEQ ID NO: 573611 - protein, 7 aa, Mycobacterium
SAEISKR

SEQ ID NO: 573612 - protein, 8 aa, Mycobacterium
SAEISTGP

SEQ ID NO: 573613 - protein, 4 aa, Mycobacterium
SAEK

SEQ ID NO: 573614 - protein, 25 aa, Mycobacterium
SAEKAGADAGPLCGRPETGVRATTD

SEQ ID NO: 573615 - protein, 6 aa, Mycobacterium
SAEKAI

SEQ ID NO: 573616 - protein, 10 aa, Mycobacterium
SAEKALRDQG

SEQ ID NO: 573617 - protein, 7 aa, Mycobacterium
SAEKAPE

SEQ ID NO: 573618 - protein, 6 aa, Mycobacterium
SAEKEI

SEQ ID NO: 573619 - protein, 9 aa, Mycobacterium
SAEKIGQDA

SEQ ID NO: 573620 - protein, 7 aa, Mycobacterium
SAEKSWA

SEQ ID NO: 573621 - protein, 9 aa, Mycobacterium
SAEKTVTRH

SEQ ID NO: 573622 - protein, 12 aa, Mycobacterium
SAELAGADPDVS

SEQ ID NO: 573623 - protein, 7 aa, Mycobacterium
SAELAKY

SEQ ID NO: 573624 - protein, 39 aa, Mycobacterium
SAELDQARRDANAAQLEAASAQAAQQAADEAAERERHTA

SEQ ID NO: 573625 - protein, 6 aa, Mycobacterium
SAELGE

SEQ ID NO: 573626 - protein, 6 aa, Mycobacterium
SAELRR

SEQ ID NO: 573627 - protein, 9 aa, Mycobacterium
SAELSGSGV

SEQ ID NO: 573628 - protein, 9 aa, Mycobacterium
SAELTDTRR

SEQ ID NO: 573629 - protein, 9 aa, Mycobacterium
SAENAAAQN

SEQ ID NO: 573630 - protein, 11 aa, Mycobacterium
SAENKQAGESS

SEQ ID NO: 573631 - protein, 10 aa, Mycobacterium
SAENRQPASL

SEQ ID NO: 573632 - protein, 6 aa, Mycobacterium
SAEPDA

SEQ ID NO: 573633 - protein, 7 aa, Mycobacterium
SAEPDDA

SEQ ID NO: 573634 - protein, 8 aa, Mycobacterium
SAEPDTGL

SEQ ID NO: 573635 - protein, 7 aa, Mycobacterium
SAEPEDT

SEQ ID NO: 573636 - protein, 8 aa, Mycobacterium
SAEPEGRG

SEQ ID NO: 573637 - protein, 13 aa, Mycobacterium
SAEPGAGAAGGIG

SEQ ID NO: 573638 - protein, 7 aa, Mycobacterium
SAEPGCG

SEQ ID NO: 573639 - protein, 10 aa, Mycobacterium
SAEPGELRSG

SEQ ID NO: 573640 - protein, 8 aa, Mycobacterium
SAEPIPDA

SEQ ID NO: 573641 - protein, 14 aa, Mycobacterium
SAEPLRGETEVDAA

SEQ ID NO: 573642 - protein, 7 aa, Mycobacterium
SAEPLSD

SEQ ID NO: 573643 - protein, 9 aa, Mycobacterium
SAEPMSGAA

SEQ ID NO: 573644 - protein, 9 aa, Mycobacterium
SAEPMSGEA

SEQ ID NO: 573645 - protein, 8 aa, Mycobacterium
SAEPPPSW

SEQ ID NO: 573646 - protein, 8 aa, Mycobacterium
SAEPQRRP

SEQ ID NO: 573647 - protein, 9 aa, Mycobacterium
SAEPTANGG

SEQ ID NO: 573648 - protein, 9 aa, Mycobacterium
SAEPTARGG

SEQ ID NO: 573649 - protein, 8 aa, Mycobacterium
SAEPTEHG

SEQ ID NO: 573650 - protein, 6 aa, Mycobacterium
SAEPTL

SEQ ID NO: 573651 - protein, 8 aa, Mycobacterium
SAEPTRAA

SEQ ID NO: 573652 - protein, 8 aa, Mycobacterium
SAEPTREN

SEQ ID NO: 573653 - protein, 5 aa, Mycobacterium
SAEPV

SEQ ID NO: 573654 - protein, 11 aa, Mycobacterium
SAEPVGKDGLP

SEQ ID NO: 573655 - protein, 26 aa, Mycobacterium
SAEPVSPEGTPIPNRVEPGKRPRSTM

SEQ ID NO: 573656 - protein, 4 aa, Mycobacterium
SAEQ

SEQ ID NO: 573657 - protein, 18 aa, Mycobacterium
SAEQAAAARKGDADDPKV

SEQ ID NO: 573658 - protein, 8 aa, Mycobacterium
SAEQAAAH

SEQ ID NO: 573659 - protein, 6 aa, Mycobacterium
SAEQAK

SEQ ID NO: 573660 - protein, 7 aa, Mycobacterium
SAEQAKW

SEQ ID NO: 573661 - protein, 6 aa, Mycobacterium
SAEQFA

SEQ ID NO: 573662 - protein, 7 aa, Mycobacterium
SAEQFAP

SEQ ID NO: 573663 - protein, 8 aa, Mycobacterium
SAEQKDAA

SEQ ID NO: 573664 - protein, 11 aa, Mycobacterium
SAEQKRSIGDP

SEQ ID NO: 573665 - protein, 5 aa, Mycobacterium
SAEQL

SEQ ID NO: 573666 - protein, 23 aa, Mycobacterium
SAEQLRRDGLGTTTAQMRAGSPA

SEQ ID NO: 573667 - protein, 18 aa, Mycobacterium
SAEQQERARGKADAAYRR

SEQ ID NO: 573668 - protein, 12 aa, Mycobacterium
SAEQRDKLAEQF

SEQ ID NO: 573669 - protein, 6 aa, Mycobacterium
SAEQRE

SEQ ID NO: 573670 - protein, 6 aa, Mycobacterium
SAEQSQ

SEQ ID NO: 573671 - protein, 10 aa, Mycobacterium
SAEQTRQDAA

SEQ ID NO: 573672 - protein, 13 aa, Mycobacterium
SAEQVPGESYEHG

SEQ ID NO: 573673 - protein, 5 aa, Mycobacterium
SAEQW

SEQ ID NO: 573674 - protein, 8 aa, Mycobacterium
SAERAGIA

SEQ ID NO: 573675 - protein, 10 aa, Mycobacterium
SAERAGRDPL

SEQ ID NO: 573676 - protein, 7 aa, Mycobacterium
SAERARR

SEQ ID NO: 573677 - protein, 7 aa, Mycobacterium
SAERASE

SEQ ID NO: 573678 - protein, 9 aa, Mycobacterium
SAERATTEL

SEQ ID NO: 573679 - protein, 5 aa, Mycobacterium
SAERD

SEQ ID NO: 573680 - protein, 12 aa, Mycobacterium
SAERDHAMAPGT

SEQ ID NO: 573681 - protein, 12 aa, Mycobacterium
SAERDPAGCSDN

SEQ ID NO: 573682 - protein, 12 aa, Mycobacterium
SAERDPAGCTDD

SEQ ID NO: 573683 - protein, 12 aa, Mycobacterium
SAERDPARCSDE

SEQ ID NO: 573684 - protein, 10 aa, Mycobacterium
SAERDSALPA

SEQ ID NO: 573685 - protein, 6 aa, Mycobacterium
SAERED

SEQ ID NO: 573686 - protein, 5 aa, Mycobacterium
SAERI

SEQ ID NO: 573687 - protein, 30 aa, Mycobacterium
SAERIPRRPRAGRGAAARAKPADPCAPKAT

SEQ ID NO: 573688 - protein, 12 aa, Mycobacterium
SAERNPGGCSDD

SEQ ID NO: 573689 - protein, 9 aa, Mycobacterium
SAERPGRDD

SEQ ID NO: 573690 - protein, 9 aa, Mycobacterium
SAERPHDQE

SEQ ID NO: 573691 - protein, 10 aa, Mycobacterium
SAERPRRAGV

SEQ ID NO: 573692 - protein, 22 aa, Mycobacterium
SAERQHADRVAAEQAAAVDTGV

SEQ ID NO: 573693 - protein, 6 aa, Mycobacterium
SAERRQ

SEQ ID NO: 573694 - protein, 8 aa, Mycobacterium
SAERSAQA

SEQ ID NO: 573695 - protein, 12 aa, Mycobacterium
SAERSPAGCSDE

SEQ ID NO: 573696 - protein, 6 aa, Mycobacterium
SAERTA

SEQ ID NO: 573697 - protein, 8 aa, Mycobacterium
SAERVAPV

SEQ ID NO: 573698 - protein, 4 aa, Mycobacterium
SAES

SEQ ID NO: 573699 - protein, 6 aa, Mycobacterium
SAESDA

SEQ ID NO: 573700 - protein, 13 aa, Mycobacterium
SAESEKPSRVGEL

SEQ ID NO: 573701 - protein, 10 aa, Mycobacterium
SAESGDRRSA

SEQ ID NO: 573702 - protein, 8 aa, Mycobacterium
SAESGLGA

SEQ ID NO: 573703 - protein, 8 aa, Mycobacterium
SAESGLTG

SEQ ID NO: 573704 - protein, 16 aa, Mycobacterium
SAESHQKAARATKDGL

SEQ ID NO: 573705 - protein, 6 aa, Mycobacterium
SAESLE

SEQ ID NO: 573706 - protein, 7 aa, Mycobacterium
SAESQSF

SEQ ID NO: 573707 - protein, 7 aa, Mycobacterium
SAESSWP

SEQ ID NO: 573708 - protein, 7 aa, Mycobacterium
SAESTAW

SEQ ID NO: 573709 - protein, 6 aa, Mycobacterium
SAESTW

SEQ ID NO: 573710 - protein, 16 aa, Mycobacterium
SAESVARKTLDANDRG

SEQ ID NO: 573711 - protein, 13 aa, Mycobacterium
SAETASGNDALTG

SEQ ID NO: 573712 - protein, 6 aa, Mycobacterium
SAETAV

SEQ ID NO: 573713 - protein, 7 aa, Mycobacterium
SAETDRL

SEQ ID NO: 573714 - protein, 11 aa, Mycobacterium
SAETDSLATEL

SEQ ID NO: 573715 - protein, 15 aa, Mycobacterium
SAETHRHHRGGDLGR

SEQ ID NO: 573716 - protein, 12 aa, Mycobacterium
SAETIEKGNRYA

SEQ ID NO: 573717 - protein, 8 aa, Mycobacterium
SAETKAVE

SEQ ID NO: 573718 - protein, 7 aa, Mycobacterium
SAETLGG

SEQ ID NO: 573719 - protein, 6 aa, Mycobacterium
SAETRE

SEQ ID NO: 573720 - protein, 9 aa, Mycobacterium
SAETTKALG

SEQ ID NO: 573721 - protein, 14 aa, Mycobacterium
SAETVESAITAGAQ

SEQ ID NO: 573722 - protein, 7 aa, Mycobacterium
SAEVERA

SEQ ID NO: 573723 - protein, 7 aa, Mycobacterium
SAEVRDA

SEQ ID NO: 573724 - protein, 5 aa, Mycobacterium
SAEVT

SEQ ID NO: 573725 - protein, 4 aa, Mycobacterium
SAFA

SEQ ID NO: 573726 - protein, 6 aa, Mycobacterium
SAFAAK

SEQ ID NO: 573727 - protein, 18 aa, Mycobacterium
SAFASSGEASVSERTHAH

SEQ ID NO: 573728 - protein, 7 aa, Mycobacterium
SAFEETV

SEQ ID NO: 573729 - protein, 10 aa, Mycobacterium
SAFEPAEEPS

SEQ ID NO: 573730 - protein, 7 aa, Mycobacterium
SAFERSR

SEQ ID NO: 573731 - protein, 10 aa, Mycobacterium
SAFGDTGPWS

SEQ ID NO: 573732 - protein, 9 aa, Mycobacterium
SAFGGDPDN

SEQ ID NO: 573733 - protein, 6 aa, Mycobacterium
SAFGGG

SEQ ID NO: 573734 - protein, 10 aa, Mycobacterium
SAFGNRGPWS

SEQ ID NO: 573735 - protein, 11 aa, Mycobacterium
SAFGNRGPWST

SEQ ID NO: 573736 - protein, 9 aa, Mycobacterium
SAFGPTGPW

SEQ ID NO: 573737 - protein, 5 aa, Mycobacterium
SAFPA

SEQ ID NO: 573738 - protein, 5 aa, Mycobacterium
SAFPD

SEQ ID NO: 573739 - protein, 7 aa, Mycobacterium
SAFPDGL

SEQ ID NO: 573740 - protein, 5 aa, Mycobacterium
SAFPP

SEQ ID NO: 573741 - protein, 7 aa, Mycobacterium
SAFPSGG

SEQ ID NO: 573742 - protein, 8 aa, Mycobacterium
SAFRKDPD

SEQ ID NO: 573743 - protein, 5 aa, Mycobacterium
SAFSA

SEQ ID NO: 573744 - protein, 11 aa, Mycobacterium
SAFSGKPRREY

SEQ ID NO: 573745 - protein, 17 aa, Mycobacterium
SAFSPAYTGRLSTAPVP

SEQ ID NO: 573746 - protein, 8 aa, Mycobacterium
SAFSQSER

SEQ ID NO: 573747 - protein, 6 aa, Mycobacterium
SAFSSL

SEQ ID NO: 573748 - protein, 8 aa, Mycobacterium
SAFTGGPY

SEQ ID NO: 573749 - protein, 15 aa, Mycobacterium
SAGAAPTVAAGAGAL

SEQ ID NO: 573750 - protein, 8 aa, Mycobacterium
SAGADDGK

SEQ ID NO: 573751 - protein, 9 aa, Mycobacterium
SAGADDVSQ

SEQ ID NO: 573752 - protein, 16 aa, Mycobacterium
SAGADGLVQPGQTGPY

SEQ ID NO: 573753 - protein, 8 aa, Mycobacterium
SAGADGPF

SEQ ID NO: 573754 - protein, 11 aa, Mycobacterium
SAGADPDPEEL

SEQ ID NO: 573755 - protein, 5 aa, Mycobacterium
SAGAE

SEQ ID NO: 573756 - protein, 9 aa, Mycobacterium
SAGAEFRPD

SEQ ID NO: 573757 - protein, 7 aa, Mycobacterium
SAGAEPE

SEQ ID NO: 573758 - protein, 18 aa, Mycobacterium
SAGAGARNRGRPESAELA

SEQ ID NO: 573759 - protein, 46 aa, Mycobacterium
SAGAGGAGGIGGAGGAGTDGSAGGIGADGGAGGHGGVGGAGGANNA

SEQ ID NO: 573760 - protein, 9 aa, Mycobacterium
SAGAGLTSA

SEQ ID NO: 573761 - protein, 14 aa, Mycobacterium
SAGAGPDAEPAQQQ

SEQ ID NO: 573762 - protein, 13 aa, Mycobacterium
SAGAGQAASSVHP

SEQ ID NO: 573763 - protein, 11 aa, Mycobacterium
SAGAGQALDPA

SEQ ID NO: 573764 - protein, 7 aa, Mycobacterium
SAGAGTD

SEQ ID NO: 573765 - protein, 9 aa, Mycobacterium
SAGAGVAGV

SEQ ID NO: 573766 - protein, 14 aa, Mycobacterium
SAGAGYRLTGTRTQ

SEQ ID NO: 573767 - protein, 5 aa, Mycobacterium
SAGAI

SEQ ID NO: 573768 - protein, 35 aa, Mycobacterium
SAGAKEALGRGASEVGTSTTTGDGGMTPEERGQSK

SEQ ID NO: 573769 - protein, 19 aa, Mycobacterium
SAGAKFGTPEYPQSGCGLG

SEQ ID NO: 573770 - protein, 6 aa, Mycobacterium
SAGAKV

SEQ ID NO: 573771 - protein, 5 aa, Mycobacterium
SAGAL

SEQ ID NO: 573772 - protein, 7 aa, Mycobacterium
SAGANVQ

SEQ ID NO: 573773 - protein, 13 aa, Mycobacterium
SAGAPETQATSAP

SEQ ID NO: 573774 - protein, 12 aa, Mycobacterium
SAGAPFDTPAAT

SEQ ID NO: 573775 - protein, 7 aa, Mycobacterium
SAGAPLS

SEQ ID NO: 573776 - protein, 10 aa, Mycobacterium
SAGAPPDEFN

SEQ ID NO: 573777 - protein, 11 aa, Mycobacterium
SAGAPPVTSGG

SEQ ID NO: 573778 - protein, 5 aa, Mycobacterium
SAGAQ

SEQ ID NO: 573779 - protein, 6 aa, Mycobacterium
SAGARE

SEQ ID NO: 573780 - protein, 6 aa, Mycobacterium
SAGARF

SEQ ID NO: 573781 - protein, 8 aa, Mycobacterium
SAGARGRL

SEQ ID NO: 573782 - protein, 10 aa, Mycobacterium
SAGARIQDTA

SEQ ID NO: 573783 - protein, 7 aa, Mycobacterium
SAGARRR

SEQ ID NO: 573784 - protein, 5 aa, Mycobacterium
SAGAS

SEQ ID NO: 573785 - protein, 7 aa, Mycobacterium
SAGASAG

SEQ ID NO: 573786 - protein, 6 aa, Mycobacterium
SAGASE

SEQ ID NO: 573787 - protein, 18 aa, Mycobacterium
SAGASYAAAEAASANPLQ

SEQ ID NO: 573788 - protein, 5 aa, Mycobacterium
SAGAT

SEQ ID NO: 573789 - protein, 13 aa, Mycobacterium
SAGATGDFRPSPS

SEQ ID NO: 573790 - protein, 100 aa, Mycobacterium
SAGATGGAGDGGRGGTGGLGGVGTSTNGGAAGGTGGRGGLSGGVGGTDGAGGDGGQGGSGGAVGTGATAGAGGAGGAGAAATSGGPGYGGGGGGGGGGAR

SEQ ID NO: 573791 - protein, 7 aa, Mycobacterium
SAGATHD

SEQ ID NO: 573792 - protein, 7 aa, Mycobacterium
SAGATLT

SEQ ID NO: 573793 - protein, 6 aa, Mycobacterium
SAGATQ

SEQ ID NO: 573794 - protein, 6 aa, Mycobacterium
SAGATS

SEQ ID NO: 573795 - protein, 5 aa, Mycobacterium
SAGCP

SEQ ID NO: 573796 - protein, 6 aa, Mycobacterium
SAGDAG

SEQ ID NO: 573797 - protein, 9 aa, Mycobacterium
SAGDAGRST

SEQ ID NO: 573798 - protein, 16 aa, Mycobacterium
SAGDALKKQGDEKSPP

SEQ ID NO: 573799 - protein, 17 aa, Mycobacterium
SAGDDDTKNGPLLNSRT

SEQ ID NO: 573800 - protein, 6 aa, Mycobacterium
SAGDDP

SEQ ID NO: 573801 - protein, 8 aa, Mycobacterium
SAGDDRAD

SEQ ID NO: 573802 - protein, 9 aa, Mycobacterium
SAGDGLRAN

SEQ ID NO: 573803 - protein, 9 aa, Mycobacterium
SAGDGTAVT

SEQ ID NO: 573804 - protein, 7 aa, Mycobacterium
SAGDKKI

SEQ ID NO: 573805 - protein, 17 aa, Mycobacterium
SAGDLTKGIGHDTTTGM

SEQ ID NO: 573806 - protein, 5 aa, Mycobacterium
SAGDP

SEQ ID NO: 573807 - protein, 10 aa, Mycobacterium
SAGDPEKVDE

SEQ ID NO: 573808 - protein, 11 aa, Mycobacterium
SAGDPSEREFG

SEQ ID NO: 573809 - protein, 8 aa, Mycobacterium
SAGDPVET

SEQ ID NO: 573810 - protein, 7 aa, Mycobacterium
SAGDPVR

SEQ ID NO: 573811 - protein, 5 aa, Mycobacterium
SAGDR

SEQ ID NO: 573812 - protein, 12 aa, Mycobacterium
SAGDRGAKSIAE

SEQ ID NO: 573813 - protein, 10 aa, Mycobacterium
SAGDSAERLA

SEQ ID NO: 573814 - protein, 5 aa, Mycobacterium
SAGDT

SEQ ID NO: 573815 - protein, 9 aa, Mycobacterium
SAGDTDEAI

SEQ ID NO: 573816 - protein, 6 aa, Mycobacterium
SAGDTG

SEQ ID NO: 573817 - protein, 11 aa, Mycobacterium
SAGDVADRATG

SEQ ID NO: 573818 - protein, 13 aa, Mycobacterium
SAGDVDHDAERAD

SEQ ID NO: 573819 - protein, 19 aa, Mycobacterium
SAGDVETVAAGAESDGNPV

SEQ ID NO: 573820 - protein, 5 aa, Mycobacterium
SAGEA

SEQ ID NO: 573821 - protein, 7 aa, Mycobacterium
SAGEAAL

SEQ ID NO: 573822 - protein, 6 aa, Mycobacterium
SAGEAG

SEQ ID NO: 573823 - protein, 9 aa, Mycobacterium
SAGEAGRLE

SEQ ID NO: 573824 - protein, 6 aa, Mycobacterium
SAGEAM

SEQ ID NO: 573825 - protein, 9 aa, Mycobacterium
SAGEDEAAN

SEQ ID NO: 573826 - protein, 9 aa, Mycobacterium
SAGEGLTRP

SEQ ID NO: 573827 - protein, 14 aa, Mycobacterium
SAGEIDADGPATPF

SEQ ID NO: 573828 - protein, 5 aa, Mycobacterium
SAGEL

SEQ ID NO: 573829 - protein, 6 aa, Mycobacterium
SAGELS

SEQ ID NO: 573830 - protein, 6 aa, Mycobacterium
SAGELT

SEQ ID NO: 573831 - protein, 5 aa, Mycobacterium
SAGEM

SEQ ID NO: 573832 - protein, 5 aa, Mycobacterium
SAGEN

SEQ ID NO: 573833 - protein, 13 aa, Mycobacterium
SAGENPPGEEAAT

SEQ ID NO: 573834 - protein, 14 aa, Mycobacterium
SAGEPISPLQATRQ

SEQ ID NO: 573835 - protein, 6 aa, Mycobacterium
SAGEPV

SEQ ID NO: 573836 - protein, 6 aa, Mycobacterium
SAGEPY

SEQ ID NO: 573837 - protein, 7 aa, Mycobacterium
SAGEQAD

SEQ ID NO: 573838 - protein, 8 aa, Mycobacterium
SAGEQNSY

SEQ ID NO: 573839 - protein, 5 aa, Mycobacterium
SAGER

SEQ ID NO: 573840 - protein, 9 aa, Mycobacterium
SAGERRGAF

SEQ ID NO: 573841 - protein, 9 aa, Mycobacterium
SAGESTRDA

SEQ ID NO: 573842 - protein, 9 aa, Mycobacterium
SAGEVTRTG

SEQ ID NO: 573843 - protein, 4 aa, Mycobacterium
SAGF

SEQ ID NO: 573844 - protein, 16 aa, Mycobacterium
SAGFPGTLPNPYRERS

SEQ ID NO: 573845 - protein, 7 aa, Mycobacterium
SAGFSGD

SEQ ID NO: 573846 - protein, 6 aa, Mycobacterium
SAGFTA

SEQ ID NO: 573847 - protein, 9 aa, Mycobacterium
SAGGAAKPW

SEQ ID NO: 573848 - protein, 16 aa, Mycobacterium
SAGGAAYADAEAASAQ

SEQ ID NO: 573849 - protein, 27 aa, Mycobacterium
SAGGAGGVGGAGFNDGGDGGAGGSGGL

SEQ ID NO: 573850 - protein, 8 aa, Mycobacterium
SAGGATDN

SEQ ID NO: 573851 - protein, 8 aa, Mycobacterium
SAGGATKH

SEQ ID NO: 573852 - protein, 8 aa, Mycobacterium
SAGGATRN

SEQ ID NO: 573853 - protein, 17 aa, Mycobacterium
SAGGAYAAAEAANTGPL

SEQ ID NO: 573854 - protein, 8 aa, Mycobacterium
SAGGDEVS

SEQ ID NO: 573855 - protein, 7 aa, Mycobacterium
SAGGDPW

SEQ ID NO: 573856 - protein, 8 aa, Mycobacterium
SAGGDTVR

SEQ ID NO: 573857 - protein, 6 aa, Mycobacterium
SAGGEA

SEQ ID NO: 573858 - protein, 9 aa, Mycobacterium
SAGGERGIG

SEQ ID NO: 573859 - protein, 9 aa, Mycobacterium
SAGGETPER

SEQ ID NO: 573860 - protein, 14 aa, Mycobacterium
SAGGGAAADPGPQE

SEQ ID NO: 573861 - protein, 16 aa, Mycobacterium
SAGGGGYGAAETANVQ

SEQ ID NO: 573862 - protein, 7 aa, Mycobacterium
SAGGGLS

SEQ ID NO: 573863 - protein, 13 aa, Mycobacterium
SAGGGPAEPVKKE

SEQ ID NO: 573864 - protein, 16 aa, Mycobacterium
SAGGGPASLAAEKAPE

SEQ ID NO: 573865 - protein, 7 aa, Mycobacterium
SAGGGQI

SEQ ID NO: 573866 - protein, 6 aa, Mycobacterium
SAGGGR

SEQ ID NO: 573867 - protein, 21 aa, Mycobacterium
SAGGGVYSREQKSIPISDEAR

SEQ ID NO: 573868 - protein, 8 aa, Mycobacterium
SAGGIPDA

SEQ ID NO: 573869 - protein, 13 aa, Mycobacterium
SAGGISKGVPTGF

SEQ ID NO: 573870 - protein, 13 aa, Mycobacterium
SAGGKAVANTDNI

SEQ ID NO: 573871 - protein, 6 aa, Mycobacterium
SAGGKM

SEQ ID NO: 573872 - protein, 7 aa, Mycobacterium
SAGGLPP

SEQ ID NO: 573873 - protein, 5 aa, Mycobacterium
SAGGM

SEQ ID NO: 573874 - protein, 11 aa, Mycobacterium
SAGGNVKEMAN

SEQ ID NO: 573875 - protein, 6 aa, Mycobacterium
SAGGPI

SEQ ID NO: 573876 - protein, 11 aa, Mycobacterium
SAGGSETIGPL

SEQ ID NO: 573877 - protein, 7 aa, Mycobacterium
SAGGSGH

SEQ ID NO: 573878 - protein, 11 aa, Mycobacterium
SAGGSQTIGPI

SEQ ID NO: 573879 - protein, 11 aa, Mycobacterium
SAGGSSGGSAA

SEQ ID NO: 573880 - protein, 9 aa, Mycobacterium
SAGGTHDDW

SEQ ID NO: 573881 - protein, 7 aa, Mycobacterium
SAGGTTL

SEQ ID NO: 573882 - protein, 9 aa, Mycobacterium
SAGGVEGDE

SEQ ID NO: 573883 - protein, 17 aa, Mycobacterium
SAGGVFSDTDGADEQAA

SEQ ID NO: 573884 - protein, 18 aa, Mycobacterium
SAGGVGPWAGEPPDDPRY

SEQ ID NO: 573885 - protein, 11 aa, Mycobacterium
SAGGVGTTYPA

SEQ ID NO: 573886 - protein, 10 aa, Mycobacterium
SAGGVKGDEF

SEQ ID NO: 573887 - protein, 8 aa, Mycobacterium
SAGGVREA

SEQ ID NO: 573888 - protein, 4 aa, Mycobacterium
SAGH

SEQ ID NO: 573889 - protein, 7 aa, Mycobacterium
SAGHAEA

SEQ ID NO: 573890 - protein, 15 aa, Mycobacterium
SAGHAERCGTESGTE

SEQ ID NO: 573891 - protein, 9 aa, Mycobacterium
SAGHEDKPV

SEQ ID NO: 573892 - protein, 21 aa, Mycobacterium
SAGHPDDLAQGNGAPHSHARR

SEQ ID NO: 573893 - protein, 11 aa, Mycobacterium
SAGHPPAPIRE

SEQ ID NO: 573894 - protein, 8 aa, Mycobacterium
SAGHPPGD

SEQ ID NO: 573895 - protein, 5 aa, Mycobacterium
SAGHS

SEQ ID NO: 573896 - protein, 9 aa, Mycobacterium
SAGHSAHTN

SEQ ID NO: 573897 - protein, 7 aa, Mycobacterium
SAGHTGA

SEQ ID NO: 573898 - protein, 21 aa, Mycobacterium
SAGIDGHPRTAHGKSSEIPWR

SEQ ID NO: 573899 - protein, 5 aa, Mycobacterium
SAGIG

SEQ ID NO: 573900 - protein, 7 aa, Mycobacterium
SAGIGRR

SEQ ID NO: 573901 - protein, 7 aa, Mycobacterium
SAGKAAL

SEQ ID NO: 573902 - protein, 6 aa, Mycobacterium
SAGKAI

SEQ ID NO: 573903 - protein, 7 aa, Mycobacterium
SAGKAIN

SEQ ID NO: 573904 - protein, 8 aa, Mycobacterium
SAGKPVIT

SEQ ID NO: 573905 - protein, 5 aa, Mycobacterium
SAGKR

SEQ ID NO: 573906 - protein, 16 aa, Mycobacterium
SAGKRDTGPGEGQGRT

SEQ ID NO: 573907 - protein, 14 aa, Mycobacterium
SAGKRHAQADKTGM

SEQ ID NO: 573908 - protein, 6 aa, Mycobacterium
SAGKVG

SEQ ID NO: 573909 - protein, 6 aa, Mycobacterium
SAGKYA

SEQ ID NO: 573910 - protein, 9 aa, Mycobacterium
SAGKYGRKH

SEQ ID NO: 573911 - protein, 5 aa, Mycobacterium
SAGLD

SEQ ID NO: 573912 - protein, 13 aa, Mycobacterium
SAGLDAENADDIE

SEQ ID NO: 573913 - protein, 5 aa, Mycobacterium
SAGLE

SEQ ID NO: 573914 - protein, 5 aa, Mycobacterium
SAGLG

SEQ ID NO: 573915 - protein, 6 aa, Mycobacterium
SAGLGA

SEQ ID NO: 573916 - protein, 8 aa, Mycobacterium
SAGLGDRL

SEQ ID NO: 573917 - protein, 13 aa, Mycobacterium
SAGLGEAASLGSL

SEQ ID NO: 573918 - protein, 20 aa, Mycobacterium
SAGLGEANTVGGLSVPPGWT

SEQ ID NO: 573919 - protein, 10 aa, Mycobacterium
SAGLGNATTV

SEQ ID NO: 573920 - protein, 13 aa, Mycobacterium
SAGLGRTVTAADT

SEQ ID NO: 573921 - protein, 8 aa, Mycobacterium
SAGLGTDD

SEQ ID NO: 573922 - protein, 20 aa, Mycobacterium
SAGLKATPGNGHYSASKHGL

SEQ ID NO: 573923 - protein, 21 aa, Mycobacterium
SAGLKATPGNGHYSASKHGLT

SEQ ID NO: 573924 - protein, 5 aa, Mycobacterium
SAGLL

SEQ ID NO: 573925 - protein, 5 aa, Mycobacterium
SAGLN

SEQ ID NO: 573926 - protein, 12 aa, Mycobacterium
SAGLPETGHVDR

SEQ ID NO: 573927 - protein, 9 aa, Mycobacterium
SAGLSDDDA

SEQ ID NO: 573928 - protein, 8 aa, Mycobacterium
SAGLSEEK

SEQ ID NO: 573929 - protein, 5 aa, Mycobacterium
SAGLT

SEQ ID NO: 573930 - protein, 6 aa, Mycobacterium
SAGLTA

SEQ ID NO: 573931 - protein, 18 aa, Mycobacterium
SAGLTTIPGTEEAAHGIP

SEQ ID NO: 573932 - protein, 5 aa, Mycobacterium
SAGLV

SEQ ID NO: 573933 - protein, 46 aa, Mycobacterium
SAGMAGSSAADPQGPPSSEPNTAAAEPAAAPVPTGGGGAHPGGQGI

SEQ ID NO: 573934 - protein, 8 aa, Mycobacterium
SAGMDSAT

SEQ ID NO: 573935 - protein, 7 aa, Mycobacterium
SAGMGEA

SEQ ID NO: 573936 - protein, 12 aa, Mycobacterium
SAGMGGAATVGG

SEQ ID NO: 573937 - protein, 7 aa, Mycobacterium
SAGMGRQ

SEQ ID NO: 573938 - protein, 4 aa, Mycobacterium
SAGN

SEQ ID NO: 573939 - protein, 8 aa, Mycobacterium
SAGNAAPL

SEQ ID NO: 573940 - protein, 8 aa, Mycobacterium
SAGNFGQP

SEQ ID NO: 573941 - protein, 6 aa, Mycobacterium
SAGNGR

SEQ ID NO: 573942 - protein, 10 aa, Mycobacterium
SAGNPELDPD

SEQ ID NO: 573943 - protein, 10 aa, Mycobacterium
SAGNRGKKSI

SEQ ID NO: 573944 - protein, 19 aa, Mycobacterium
SAGPASDTHHSDEGGTLDA

SEQ ID NO: 573945 - protein, 8 aa, Mycobacterium
SAGPATEV

SEQ ID NO: 573946 - protein, 6 aa, Mycobacterium
SAGPAW

SEQ ID NO: 573947 - protein, 5 aa, Mycobacterium
SAGPC

SEQ ID NO: 573948 - protein, 8 aa, Mycobacterium
SAGPDKFH

SEQ ID NO: 573949 - protein, 7 aa, Mycobacterium
SAGPDRV

SEQ ID NO: 573950 - protein, 8 aa, Mycobacterium
SAGPEAVG

SEQ ID NO: 573951 - protein, 7 aa, Mycobacterium
SAGPEIG

SEQ ID NO: 573952 - protein, 11 aa, Mycobacterium
SAGPGAGLDPT

SEQ ID NO: 573953 - protein, 9 aa, Mycobacterium
SAGPGPGPL

SEQ ID NO: 573954 - protein, 19 aa, Mycobacterium
SAGPGRTGLVGSNGSGKST

SEQ ID NO: 573955 - protein, 17 aa, Mycobacterium
SAGPKLPPIGDVTGPGV

SEQ ID NO: 573956 - protein, 12 aa, Mycobacterium
SAGPKSQAPRHN

SEQ ID NO: 573957 - protein, 9 aa, Mycobacterium
SAGPLDETG

SEQ ID NO: 573958 - protein, 6 aa, Mycobacterium
SAGPQW

SEQ ID NO: 573959 - protein, 7 aa, Mycobacterium
SAGPRGR

SEQ ID NO: 573960 - protein, 7 aa, Mycobacterium
SAGPSEP

SEQ ID NO: 573961 - protein, 7 aa, Mycobacterium
SAGPSFP

SEQ ID NO: 573962 - protein, 14 aa, Mycobacterium
SAGPVDLDSGTVSP

SEQ ID NO: 573963 - protein, 13 aa, Mycobacterium
SAGPVDVPAGTVS

SEQ ID NO: 573964 - protein, 10 aa, Mycobacterium
SAGPVGSADR

SEQ ID NO: 573965 - protein, 7 aa, Mycobacterium
SAGPVRD

SEQ ID NO: 573966 - protein, 16 aa, Mycobacterium
SAGQADGSDAGPAEQQ

SEQ ID NO: 573967 - protein, 12 aa, Mycobacterium
SAGQAEQTARQA

SEQ ID NO: 573968 - protein, 11 aa, Mycobacterium
SAGQDARQDNH

SEQ ID NO: 573969 - protein, 7 aa, Mycobacterium
SAGQETT

SEQ ID NO: 573970 - protein, 25 aa, Mycobacterium
SAGQGAGGKHRVQRASQRPLSDSRL

SEQ ID NO: 573971 - protein, 20 aa, Mycobacterium
SAGQGDQFGQQGKLRPDLDP

SEQ ID NO: 573972 - protein, 7 aa, Mycobacterium
SAGQGRR

SEQ ID NO: 573973 - protein, 7 aa, Mycobacterium
SAGQITG

SEQ ID NO: 573974 - protein, 25 aa, Mycobacterium
SAGQKHRSQPAAARSQASRLSSPRK

SEQ ID NO: 573975 - protein, 5 aa, Mycobacterium
SAGQL

SEQ ID NO: 573976 - protein, 9 aa, Mycobacterium
SAGQLRANE

SEQ ID NO: 573977 - protein, 16 aa, Mycobacterium
SAGQPSAGAPAPVRDA

SEQ ID NO: 573978 - protein, 15 aa, Mycobacterium
SAGQPSAGAPEPVRA

SEQ ID NO: 573979 - protein, 14 aa, Mycobacterium
SAGQPSAGAPTAVR

SEQ ID NO: 573980 - protein, 9 aa, Mycobacterium
SAGQPTSLD

SEQ ID NO: 573981 - protein, 9 aa, Mycobacterium
SAGQQHGPA

SEQ ID NO: 573982 - protein, 7 aa, Mycobacterium
SAGQRDA

SEQ ID NO: 573983 - protein, 7 aa, Mycobacterium
SAGQREA

SEQ ID NO: 573984 - protein, 12 aa, Mycobacterium
SAGQSGDFRPNA

SEQ ID NO: 573985 - protein, 13 aa, Mycobacterium
SAGQTGDFRPTQS

SEQ ID NO: 573986 - protein, 8 aa, Mycobacterium
SAGQTLAS

SEQ ID NO: 573987 - protein, 6 aa, Mycobacterium
SAGQVT

SEQ ID NO: 573988 - protein, 5 aa, Mycobacterium
SAGQW

SEQ ID NO: 573989 - protein, 4 aa, Mycobacterium
SAGR

SEQ ID NO: 573990 - protein, 5 aa, Mycobacterium
SAGRA

SEQ ID NO: 573991 - protein, 7 aa, Mycobacterium
SAGRAAP

SEQ ID NO: 573992 - protein, 6 aa, Mycobacterium
SAGRAF

SEQ ID NO: 573993 - protein, 9 aa, Mycobacterium
SAGRAGSIG

SEQ ID NO: 573994 - protein, 9 aa, Mycobacterium
SAGRAGSLH

SEQ ID NO: 573995 - protein, 6 aa, Mycobacterium
SAGRDL

SEQ ID NO: 573996 - protein, 7 aa, Mycobacterium
SAGRDLP

SEQ ID NO: 573997 - protein, 13 aa, Mycobacterium
SAGRGEGGDDVAG

SEQ ID NO: 573998 - protein, 8 aa, Mycobacterium
SAGRGGSI

SEQ ID NO: 573999 - protein, 6 aa, Mycobacterium
SAGRHP

SEQ ID NO: 574000 - protein, 7 aa, Mycobacterium
SAGRNNP

SEQ ID NO: 574001 - protein, 9 aa, Mycobacterium
SAGRPDDAR

SEQ ID NO: 574002 - protein, 8 aa, Mycobacterium
SAGRPEGP

SEQ ID NO: 574003 - protein, 8 aa, Mycobacterium
SAGRPRYD

SEQ ID NO: 574004 - protein, 22 aa, Mycobacterium
SAGRPSPGTAAYGAAKAGLESL

SEQ ID NO: 574005 - protein, 9 aa, Mycobacterium
SAGRPTAPI

SEQ ID NO: 574006 - protein, 12 aa, Mycobacterium
SAGRQESSTEVG

SEQ ID NO: 574007 - protein, 8 aa, Mycobacterium
SAGRQRNI

SEQ ID NO: 574008 - protein, 9 aa, Mycobacterium
SAGRRATQA

SEQ ID NO: 574009 - protein, 7 aa, Mycobacterium
SAGRRAY

SEQ ID NO: 574010 - protein, 13 aa, Mycobacterium
SAGRSGDFRPNPS

SEQ ID NO: 574011 - protein, 14 aa, Mycobacterium
SAGRSGVTRGSGST

SEQ ID NO: 574012 - protein, 12 aa, Mycobacterium
SAGRTVRPIGSS

SEQ ID NO: 574013 - protein, 14 aa, Mycobacterium
SAGRVSPSAPRKGT

SEQ ID NO: 574014 - protein, 5 aa, Mycobacterium
SAGRY

SEQ ID NO: 574015 - protein, 17 aa, Mycobacterium
SAGRYAAADDHAAARVG

SEQ ID NO: 574016 - protein, 7 aa, Mycobacterium
SAGSACA

SEQ ID NO: 574017 - protein, 16 aa, Mycobacterium
SAGSALSAAAGTAPEI

SEQ ID NO: 574018 - protein, 15 aa, Mycobacterium
SAGSAMGAPPSAQLA

SEQ ID NO: 574019 - protein, 9 aa, Mycobacterium
SAGSDEVSA

SEQ ID NO: 574020 - protein, 7 aa, Mycobacterium
SAGSDPQ

SEQ ID NO: 574021 - protein, 6 aa, Mycobacterium
SAGSDV

SEQ ID NO: 574022 - protein, 15 aa, Mycobacterium
SAGSEFVPQPDPAPA

SEQ ID NO: 574023 - protein, 6 aa, Mycobacterium
SAGSET

SEQ ID NO: 574024 - protein, 5 aa, Mycobacterium
SAGSG

SEQ ID NO: 574025 - protein, 15 aa, Mycobacterium
SAGSGESRYPKEPRA

SEQ ID NO: 574026 - protein, 15 aa, Mycobacterium
SAGSGGVGGAGGTGG

SEQ ID NO: 574027 - protein, 6 aa, Mycobacterium
SAGSGL

SEQ ID NO: 574028 - protein, 7 aa, Mycobacterium
SAGSGLD

SEQ ID NO: 574029 - protein, 12 aa, Mycobacterium
SAGSGSAPLSPE

SEQ ID NO: 574030 - protein, 16 aa, Mycobacterium
SAGSHEKAARATKDGL

SEQ ID NO: 574031 - protein, 6 aa, Mycobacterium
SAGSLP

SEQ ID NO: 574032 - protein, 8 aa, Mycobacterium
SAGSLRPS

SEQ ID NO: 574033 - protein, 10 aa, Mycobacterium
SAGSPEVDPD

SEQ ID NO: 574034 - protein, 8 aa, Mycobacterium
SAGSQAPA

SEQ ID NO: 574035 - protein, 7 aa, Mycobacterium
SAGSQIE

SEQ ID NO: 574036 - protein, 7 aa, Mycobacterium
SAGSREA

SEQ ID NO: 574037 - protein, 9 aa, Mycobacterium
SAGSRESME

SEQ ID NO: 574038 - protein, 10 aa, Mycobacterium
SAGSRFDSGV

SEQ ID NO: 574039 - protein, 24 aa, Mycobacterium
SAGSRYVGGAAPLPSTDDGFRSAG

SEQ ID NO: 574040 - protein, 7 aa, Mycobacterium
SAGSSIP

SEQ ID NO: 574041 - protein, 6 aa, Mycobacterium
SAGSSL

SEQ ID NO: 574042 - protein, 7 aa, Mycobacterium
SAGSSWS

SEQ ID NO: 574043 - protein, 26 aa, Mycobacterium
SAGSTGRPKGIRRPLNPGGAGLSNLS

SEQ ID NO: 574044 - protein, 19 aa, Mycobacterium
SAGSVGKTISGATLTGQGN

SEQ ID NO: 574045 - protein, 12 aa, Mycobacterium
SAGSWDGPSAAA

SEQ ID NO: 574046 - protein, 5 aa, Mycobacterium
SAGSY

SEQ ID NO: 574047 - protein, 14 aa, Mycobacterium
SAGSYAATETAETI

SEQ ID NO: 574048 - protein, 4 aa, Mycobacterium
SAGT

SEQ ID NO: 574049 - protein, 15 aa, Mycobacterium
SAGTAGTPGTPVSTA

SEQ ID NO: 574050 - protein, 10 aa, Mycobacterium
SAGTDEQKAA

SEQ ID NO: 574051 - protein, 13 aa, Mycobacterium
SAGTEPADQVNPA

SEQ ID NO: 574052 - protein, 56 aa, Mycobacterium
SAGTGGNGGIGGGGGGGGSVGANGATTGVFSSSSDCSGPGPQPNPGSPGDPGTSVA

SEQ ID NO: 574053 - protein, 7 aa, Mycobacterium
SAGTGKT

SEQ ID NO: 574054 - protein, 5 aa, Mycobacterium
SAGTH

SEQ ID NO: 574055 - protein, 5 aa, Mycobacterium
SAGTM

SEQ ID NO: 574056 - protein, 7 aa, Mycobacterium
SAGTPLQ

SEQ ID NO: 574057 - protein, 13 aa, Mycobacterium
SAGTPRAQARRTA

SEQ ID NO: 574058 - protein, 18 aa, Mycobacterium
SAGTPVFPAEDDNRGLGL

SEQ ID NO: 574059 - protein, 6 aa, Mycobacterium
SAGTQF

SEQ ID NO: 574060 - protein, 7 aa, Mycobacterium
SAGTRWA

SEQ ID NO: 574061 - protein, 8 aa, Mycobacterium
SAGTRYGH

SEQ ID NO: 574062 - protein, 8 aa, Mycobacterium
SAGTSTVT

SEQ ID NO: 574063 - protein, 16 aa, Mycobacterium
SAGTTATRRHRRERAN

SEQ ID NO: 574064 - protein, 13 aa, Mycobacterium
SAGTTDPEKRSRE

SEQ ID NO: 574065 - protein, 6 aa, Mycobacterium
SAGTVN

SEQ ID NO: 574066 - protein, 8 aa, Mycobacterium
SAGVDPDD

SEQ ID NO: 574067 - protein, 18 aa, Mycobacterium
SAGVEVGAKDAKMGQEGA

SEQ ID NO: 574068 - protein, 11 aa, Mycobacterium
SAGVGNAASIG

SEQ ID NO: 574069 - protein, 5 aa, Mycobacterium
SAGVH

SEQ ID NO: 574070 - protein, 9 aa, Mycobacterium
SAGVNGQFR

SEQ ID NO: 574071 - protein, 7 aa, Mycobacterium
SAGVPAG

SEQ ID NO: 574072 - protein, 11 aa, Mycobacterium
SAGVQAHTPKY

SEQ ID NO: 574073 - protein, 12 aa, Mycobacterium
SAGVQANNPRYS

SEQ ID NO: 574074 - protein, 18 aa, Mycobacterium
SAGVQARNPKYSSYLPSK

SEQ ID NO: 574075 - protein, 37 aa, Mycobacterium
SAGVQKAADKAGKDIKKAVDTAAARAEKAAARTEKVG

SEQ ID NO: 574076 - protein, 7 aa, Mycobacterium
SAGVSAG

SEQ ID NO: 574077 - protein, 7 aa, Mycobacterium
SAGVSSG

SEQ ID NO: 574078 - protein, 17 aa, Mycobacterium
SAGVTDEDLARLRRVLH

SEQ ID NO: 574079 - protein, 7 aa, Mycobacterium
SAGVTPN

SEQ ID NO: 574080 - protein, 4 aa, Mycobacterium
SAGW

SEQ ID NO: 574081 - protein, 5 aa, Mycobacterium
SAGWA

SEQ ID NO: 574082 - protein, 4 aa, Mycobacterium
SAGY

SEQ ID NO: 574083 - protein, 7 aa, Mycobacterium
SAGYEDV

SEQ ID NO: 574084 - protein, 5 aa, Mycobacterium
SAGYP

SEQ ID NO: 574085 - protein, 5 aa, Mycobacterium
SAGYR

SEQ ID NO: 574086 - protein, 4 aa, Mycobacterium
SAHA

SEQ ID NO: 574087 - protein, 8 aa, Mycobacterium
SAHAAGSR

SEQ ID NO: 574088 - protein, 11 aa, Mycobacterium
SAHAATPEQQQ

SEQ ID NO: 574089 - protein, 7 aa, Mycobacterium
SAHAEPA

SEQ ID NO: 574090 - protein, 7 aa, Mycobacterium
SAHAEPY

SEQ ID NO: 574091 - protein, 7 aa, Mycobacterium
SAHAGAR

SEQ ID NO: 574092 - protein, 6 aa, Mycobacterium
SAHAGG

SEQ ID NO: 574093 - protein, 6 aa, Mycobacterium
SAHAPT

SEQ ID NO: 574094 - protein, 5 aa, Mycobacterium
SAHAT

SEQ ID NO: 574095 - protein, 4 aa, Mycobacterium
SAHD

SEQ ID NO: 574096 - protein, 7 aa, Mycobacterium
SAHDGGD

SEQ ID NO: 574097 - protein, 8 aa, Mycobacterium
SAHDGLNP

SEQ ID NO: 574098 - protein, 15 aa, Mycobacterium
SAHDHRRDAPAEGNP

SEQ ID NO: 574099 - protein, 9 aa, Mycobacterium
SAHEHGDTI

SEQ ID NO: 574100 - protein, 5 aa, Mycobacterium
SAHES

SEQ ID NO: 574101 - protein, 8 aa, Mycobacterium
SAHGGEEN

SEQ ID NO: 574102 - protein, 8 aa, Mycobacterium
SAHGGPEN

SEQ ID NO: 574103 - protein, 8 aa, Mycobacterium
SAHGINAP

SEQ ID NO: 574104 - protein, 11 aa, Mycobacterium
SAHGINAPAGN

SEQ ID NO: 574105 - protein, 10 aa, Mycobacterium
SAHGINAPTQ

SEQ ID NO: 574106 - protein, 7 aa, Mycobacterium
SAHGPID

SEQ ID NO: 574107 - protein, 7 aa, Mycobacterium
SAHGQTA

SEQ ID NO: 574108 - protein, 10 aa, Mycobacterium
SAHGTNAASA

SEQ ID NO: 574109 - protein, 5 aa, Mycobacterium
SAHLK

SEQ ID NO: 574110 - protein, 7 aa, Mycobacterium
SAHNDTI

SEQ ID NO: 574111 - protein, 7 aa, Mycobacterium
SAHNDTL

SEQ ID NO: 574112 - protein, 4 aa, Mycobacterium
SAHP

SEQ ID NO: 574113 - protein, 7 aa, Mycobacterium
SAHPAPA

SEQ ID NO: 574114 - protein, 12 aa, Mycobacterium
SAHPATDAERES

SEQ ID NO: 574115 - protein, 5 aa, Mycobacterium
SAHPD

SEQ ID NO: 574116 - protein, 16 aa, Mycobacterium
SAHPQAGALQSHDPPL

SEQ ID NO: 574117 - protein, 10 aa, Mycobacterium
SAHPQAGEGP

SEQ ID NO: 574118 - protein, 8 aa, Mycobacterium
SAHPTDGR

SEQ ID NO: 574119 - protein, 9 aa, Mycobacterium
SAHPTGNGG

SEQ ID NO: 574120 - protein, 5 aa, Mycobacterium
SAHQA

SEQ ID NO: 574121 - protein, 7 aa, Mycobacterium
SAHQGPL

SEQ ID NO: 574122 - protein, 8 aa, Mycobacterium
SAHQNQGH

SEQ ID NO: 574123 - protein, 19 aa, Mycobacterium
SAHQSSTVLTTGEDGRPHQ

SEQ ID NO: 574124 - protein, 5 aa, Mycobacterium
SAHRA

SEQ ID NO: 574125 - protein, 12 aa, Mycobacterium
SAHRDERAFRDP

SEQ ID NO: 574126 - protein, 10 aa, Mycobacterium
SAHRPRPNSL

SEQ ID NO: 574127 - protein, 8 aa, Mycobacterium
SAHRREYR

SEQ ID NO: 574128 - protein, 12 aa, Mycobacterium
SAHSGKFSSDRA

SEQ ID NO: 574129 - protein, 8 aa, Mycobacterium
SAHSRNRT

SEQ ID NO: 574130 - protein, 7 aa, Mycobacterium
SAHSSVD

SEQ ID NO: 574131 - protein, 9 aa, Mycobacterium
SAHSTVDRA

SEQ ID NO: 574132 - protein, 11 aa, Mycobacterium
SAHSTVDRDDA

SEQ ID NO: 574133 - protein, 6 aa, Mycobacterium
SAHTDA

SEQ ID NO: 574134 - protein, 5 aa, Mycobacterium
SAHTE

SEQ ID NO: 574135 - protein, 7 aa, Mycobacterium
SAHTEGE

SEQ ID NO: 574136 - protein, 18 aa, Mycobacterium
SAHTGPRRALETIRRKLQ

SEQ ID NO: 574137 - protein, 5 aa, Mycobacterium
SAHTR

SEQ ID NO: 574138 - protein, 9 aa, Mycobacterium
SAHTTGRGM

SEQ ID NO: 574139 - protein, 9 aa, Mycobacterium
SAIAANEAQ

SEQ ID NO: 574140 - protein, 7 aa, Mycobacterium
SAIAATE

SEQ ID NO: 574141 - protein, 15 aa, Mycobacterium
SAIADAKKALEGTDI

SEQ ID NO: 574142 - protein, 8 aa, Mycobacterium
SAIAGPDG

SEQ ID NO: 574143 - protein, 9 aa, Mycobacterium
SAIASGPVS

SEQ ID NO: 574144 - protein, 10 aa, Mycobacterium
SAIATDPTAV

SEQ ID NO: 574145 - protein, 4 aa, Mycobacterium
SAID

SEQ ID NO: 574146 - protein, 7 aa, Mycobacterium
SAIDPPS

SEQ ID NO: 574147 - protein, 6 aa, Mycobacterium
SAIDQN

SEQ ID NO: 574148 - protein, 4 aa, Mycobacterium
SAIE

SEQ ID NO: 574149 - protein, 14 aa, Mycobacterium
SAIEQAKGRAAAAG

SEQ ID NO: 574150 - protein, 5 aa, Mycobacterium
SAIGA

SEQ ID NO: 574151 - protein, 6 aa, Mycobacterium
SAIGEA

SEQ ID NO: 574152 - protein, 5 aa, Mycobacterium
SAIGG

SEQ ID NO: 574153 - protein, 7 aa, Mycobacterium
SAIGKRG

SEQ ID NO: 574154 - protein, 8 aa, Mycobacterium
SAIGPEGL

SEQ ID NO: 574155 - protein, 10 aa, Mycobacterium
SAIGSSGNRA

SEQ ID NO: 574156 - protein, 11 aa, Mycobacterium
SAIGTATNNVA

SEQ ID NO: 574157 - protein, 48 aa, Mycobacterium
SAIHTAPEADRDPSIGRGAGARATGRAAGPSGRTCDRSPGLRGTRGHR

SEQ ID NO: 574158 - protein, 21 aa, Mycobacterium
SAINNDGRDKSSFAAPGMRGQ

SEQ ID NO: 574159 - protein, 11 aa, Mycobacterium
SAINPRPSAEA

SEQ ID NO: 574160 - protein, 6 aa, Mycobacterium
SAIPAD

SEQ ID NO: 574161 - protein, 5 aa, Mycobacterium
SAIPD

SEQ ID NO: 574162 - protein, 52 aa, Mycobacterium
SAIPRNAARPITPPGQQNAARCPPSRTNPPADPTNPLPTHAPSRGQQESRSL

SEQ ID NO: 574163 - protein, 7 aa, Mycobacterium
SAIPTPL

SEQ ID NO: 574164 - protein, 5 aa, Mycobacterium
SAIPW

SEQ ID NO: 574165 - protein, 8 aa, Mycobacterium
SAIQPGTG

SEQ ID NO: 574166 - protein, 12 aa, Mycobacterium
SAIRAKGNGGAP

SEQ ID NO: 574167 - protein, 6 aa, Mycobacterium
SAIRGG

SEQ ID NO: 574168 - protein, 7 aa, Mycobacterium
SAIRQGD

SEQ ID NO: 574169 - protein, 12 aa, Mycobacterium
SAISAEQRGYRQ

SEQ ID NO: 574170 - protein, 5 aa, Mycobacterium
SAISG

SEQ ID NO: 574171 - protein, 7 aa, Mycobacterium
SAISGGS

SEQ ID NO: 574172 - protein, 6 aa, Mycobacterium
SAISGL

SEQ ID NO: 574173 - protein, 13 aa, Mycobacterium
SAISKAAGRSRVT

SEQ ID NO: 574174 - protein, 14 aa, Mycobacterium
SAISQGGLAPGDAL

SEQ ID NO: 574175 - protein, 9 aa, Mycobacterium
SAITDAGGH

SEQ ID NO: 574176 - protein, 7 aa, Mycobacterium
SAITEYP

SEQ ID NO: 574177 - protein, 6 aa, Mycobacterium
SAITPK

SEQ ID NO: 574178 - protein, 8 aa, Mycobacterium
SAIYDGSP

SEQ ID NO: 574179 - protein, 6 aa, Mycobacterium
SAKAAR

SEQ ID NO: 574180 - protein, 12 aa, Mycobacterium
SAKAATLSRRDD

SEQ ID NO: 574181 - protein, 8 aa, Mycobacterium
SAKADAVA

SEQ ID NO: 574182 - protein, 7 aa, Mycobacterium
SAKAGEV

SEQ ID NO: 574183 - protein, 7 aa, Mycobacterium
SAKAGLD

SEQ ID NO: 574184 - protein, 5 aa, Mycobacterium
SAKAI

SEQ ID NO: 574185 - protein, 7 aa, Mycobacterium
SAKAQTS

SEQ ID NO: 574186 - protein, 20 aa, Mycobacterium
SAKASGTPKVTNWGTGTPRR

SEQ ID NO: 574187 - protein, 7 aa, Mycobacterium
SAKDIES

SEQ ID NO: 574188 - protein, 10 aa, Mycobacterium
SAKDPESVQW

SEQ ID NO: 574189 - protein, 11 aa, Mycobacterium
SAKEGADIEYS

SEQ ID NO: 574190 - protein, 7 aa, Mycobacterium
SAKERPR

SEQ ID NO: 574191 - protein, 10 aa, Mycobacterium
SAKGDRAGAV

SEQ ID NO: 574192 - protein, 10 aa, Mycobacterium
SAKGESPGRW

SEQ ID NO: 574193 - protein, 10 aa, Mycobacterium
SAKGESPGTW

SEQ ID NO: 574194 - protein, 14 aa, Mycobacterium
SAKGLSVKPDPSMG

SEQ ID NO: 574195 - protein, 10 aa, Mycobacterium
SAKGRRTEHF

SEQ ID NO: 574196 - protein, 5 aa, Mycobacterium
SAKGT

SEQ ID NO: 574197 - protein, 9 aa, Mycobacterium
SAKKMSRRM

SEQ ID NO: 574198 - protein, 8 aa, Mycobacterium
SAKKNEPD

SEQ ID NO: 574199 - protein, 8 aa, Mycobacterium
SAKKSEPE

SEQ ID NO: 574200 - protein, 8 aa, Mycobacterium
SAKLGREH

SEQ ID NO: 574201 - protein, 10 aa, Mycobacterium
SAKLPGRRGL

SEQ ID NO: 574202 - protein, 10 aa, Mycobacterium
SAKLQTPGTA

SEQ ID NO: 574203 - protein, 5 aa, Mycobacterium
SAKLT

SEQ ID NO: 574204 - protein, 6 aa, Mycobacterium
SAKNVT

SEQ ID NO: 574205 - protein, 4 aa, Mycobacterium
SAKP

SEQ ID NO: 574206 - protein, 7 aa, Mycobacterium
SAKPDEL

SEQ ID NO: 574207 - protein, 5 aa, Mycobacterium
SAKPK

SEQ ID NO: 574208 - protein, 6 aa, Mycobacterium
SAKPLT

SEQ ID NO: 574209 - protein, 7 aa, Mycobacterium
SAKPLTG

SEQ ID NO: 574210 - protein, 7 aa, Mycobacterium
SAKPNFG

SEQ ID NO: 574211 - protein, 15 aa, Mycobacterium
SAKPNFGHTQAAAGA

SEQ ID NO: 574212 - protein, 8 aa, Mycobacterium
SAKPPEPY

SEQ ID NO: 574213 - protein, 16 aa, Mycobacterium
SAKPRRDFGPDGRSDV

SEQ ID NO: 574214 - protein, 7 aa, Mycobacterium
SAKQGLD

SEQ ID NO: 574215 - protein, 13 aa, Mycobacterium
SAKQGRAAAELAT

SEQ ID NO: 574216 - protein, 17 aa, Mycobacterium
SAKREYEASISRAKSEC

SEQ ID NO: 574217 - protein, 9 aa, Mycobacterium
SAKRGGGAD

SEQ ID NO: 574218 - protein, 8 aa, Mycobacterium
SAKRRGAK

SEQ ID NO: 574219 - protein, 6 aa, Mycobacterium
SAKSDR

SEQ ID NO: 574220 - protein, 8 aa, Mycobacterium
SAKSGRAV

SEQ ID NO: 574221 - protein, 5 aa, Mycobacterium
SAKSI

SEQ ID NO: 574222 - protein, 11 aa, Mycobacterium
SAKSRLAPGAA

SEQ ID NO: 574223 - protein, 15 aa, Mycobacterium
SAKTAPLAGNSIATD

SEQ ID NO: 574224 - protein, 6 aa, Mycobacterium
SAKTHG

SEQ ID NO: 574225 - protein, 7 aa, Mycobacterium
SAKTIPD

SEQ ID NO: 574226 - protein, 7 aa, Mycobacterium
SAKTSGV

SEQ ID NO: 574227 - protein, 11 aa, Mycobacterium
SAKTTLTDQVG

SEQ ID NO: 574228 - protein, 21 aa, Mycobacterium
SAKVGSAHRGVSGSDDLISPA

SEQ ID NO: 574229 - protein, 6 aa, Mycobacterium
SAKVNS

SEQ ID NO: 574230 - protein, 8 aa, Mycobacterium
SAKVSEPQ

SEQ ID NO: 574231 - protein, 6 aa, Mycobacterium
SAKYDP

SEQ ID NO: 574232 - protein, 11 aa, Mycobacterium
SAKYDSATTRS

SEQ ID NO: 574233 - protein, 8 aa, Mycobacterium
SAKYPTSS

SEQ ID NO: 574234 - protein, 6 aa, Mycobacterium
SALAAP

SEQ ID NO: 574235 - protein, 7 aa, Mycobacterium
SALAEAA

SEQ ID NO: 574236 - protein, 18 aa, Mycobacterium
SALAEQAGMQGRAAAAAY

SEQ ID NO: 574237 - protein, 8 aa, Mycobacterium
SALAGQAR

SEQ ID NO: 574238 - protein, 8 aa, Mycobacterium
SALAKRPP

SEQ ID NO: 574239 - protein, 16 aa, Mycobacterium
SALDEAGDYRLSNDQP

SEQ ID NO: 574240 - protein, 17 aa, Mycobacterium
SALDEPIDSNAEYRDRQ

SEQ ID NO: 574241 - protein, 10 aa, Mycobacterium
SALDGAQADR

SEQ ID NO: 574242 - protein, 9 aa, Mycobacterium
SALDPGKLP

SEQ ID NO: 574243 - protein, 9 aa, Mycobacterium
SALDQTARH

SEQ ID NO: 574244 - protein, 7 aa, Mycobacterium
SALENGA

SEQ ID NO: 574245 - protein, 13 aa, Mycobacterium
SALESAPARWSDE

SEQ ID NO: 574246 - protein, 12 aa, Mycobacterium
SALESKLARQAE

SEQ ID NO: 574247 - protein, 9 aa, Mycobacterium
SALGAQPAT

SEQ ID NO: 574248 - protein, 11 aa, Mycobacterium
SALGEGGEDGA

SEQ ID NO: 574249 - protein, 6 aa, Mycobacterium
SALGER

SEQ ID NO: 574250 - protein, 15 aa, Mycobacterium
SALGGSGSRRGAGTI

SEQ ID NO: 574251 - protein, 16 aa, Mycobacterium
SALGGSGSRRGAGTIS

SEQ ID NO: 574252 - protein, 7 aa, Mycobacterium
SALGGTP

SEQ ID NO: 574253 - protein, 6 aa, Mycobacterium
SALGPD

SEQ ID NO: 574254 - protein, 13 aa, Mycobacterium
SALGPHPSARRSA

SEQ ID NO: 574255 - protein, 16 aa, Mycobacterium
SALGPRGDEATKGGYD

SEQ ID NO: 574256 - protein, 16 aa, Mycobacterium
SALGPRGEEAAKGGYD

SEQ ID NO: 574257 - protein, 16 aa, Mycobacterium
SALGPRGGEAEKGGYD

SEQ ID NO: 574258 - protein, 16 aa, Mycobacterium
SALGPRGPESDKGGYD

SEQ ID NO: 574259 - protein, 6 aa, Mycobacterium
SALGTK

SEQ ID NO: 574260 - protein, 7 aa, Mycobacterium
SALGTKE

SEQ ID NO: 574261 - protein, 8 aa, Mycobacterium
SALGTTAN

SEQ ID NO: 574262 - protein, 5 aa, Mycobacterium
SALNG

SEQ ID NO: 574263 - protein, 6 aa, Mycobacterium
SALNGA

SEQ ID NO: 574264 - protein, 9 aa, Mycobacterium
SALPASDKQ

SEQ ID NO: 574265 - protein, 8 aa, Mycobacterium
SALPDAPT

SEQ ID NO: 574266 - protein, 7 aa, Mycobacterium
SALPDGD

SEQ ID NO: 574267 - protein, 14 aa, Mycobacterium
SALPDPGDLPAERA

SEQ ID NO: 574268 - protein, 18 aa, Mycobacterium
SALPEDTGGEDAPQGHGR

SEQ ID NO: 574269 - protein, 9 aa, Mycobacterium
SALPGNPAV

SEQ ID NO: 574270 - protein, 7 aa, Mycobacterium
SALPGQP

SEQ ID NO: 574271 - protein, 8 aa, Mycobacterium
SALPGRRR

SEQ ID NO: 574272 - protein, 6 aa, Mycobacterium
SALPGT

SEQ ID NO: 574273 - protein, 6 aa, Mycobacterium
SALPGY

SEQ ID NO: 574274 - protein, 7 aa, Mycobacterium
SALPKSN

SEQ ID NO: 574275 - protein, 28 aa, Mycobacterium
SALPNGPKVSAGGSLSPRGDWRAPSDMS

SEQ ID NO: 574276 - protein, 28 aa, Mycobacterium
SALPNGPKVSHGGALSPRGDWRAPSDMS

SEQ ID NO: 574277 - protein, 14 aa, Mycobacterium
SALPPGAGQPPALP

SEQ ID NO: 574278 - protein, 13 aa, Mycobacterium
SALPRPGTSEGRQ

SEQ ID NO: 574279 - protein, 15 aa, Mycobacterium
SALPTDTTGSADDGA

SEQ ID NO: 574280 - protein, 17 aa, Mycobacterium
SALPTETPGSATDGAAE

SEQ ID NO: 574281 - protein, 17 aa, Mycobacterium
SALPTKDQVASYEALID

SEQ ID NO: 574282 - protein, 12 aa, Mycobacterium
SALQEKVRRAED

SEQ ID NO: 574283 - protein, 7 aa, Mycobacterium
SALQGKQ

SEQ ID NO: 574284 - protein, 31 aa, Mycobacterium
SALQGTSAVADPSGHTAFDASGQSAADASSH

SEQ ID NO: 574285 - protein, 7 aa, Mycobacterium
SALRDSA

SEQ ID NO: 574286 - protein, 7 aa, Mycobacterium
SALRGRQ

SEQ ID NO: 574287 - protein, 9 aa, Mycobacterium
SALRPSAAA

SEQ ID NO: 574288 - protein, 7 aa, Mycobacterium
SALRSAA

SEQ ID NO: 574289 - protein, 15 aa, Mycobacterium
SALSAANTAAAVPTT

SEQ ID NO: 574290 - protein, 12 aa, Mycobacterium
SALSDDPDLRHN

SEQ ID NO: 574291 - protein, 12 aa, Mycobacterium
SALSESAPDAVS

SEQ ID NO: 574292 - protein, 14 aa, Mycobacterium
SALSGGTLTNTTTL

SEQ ID NO: 574293 - protein, 10 aa, Mycobacterium
SALSGPPLTT

SEQ ID NO: 574294 - protein, 9 aa, Mycobacterium
SALSGSAGL

SEQ ID NO: 574295 - protein, 11 aa, Mycobacterium
SALSPGDRDGL

SEQ ID NO: 574296 - protein, 9 aa, Mycobacterium
SALSPTDRE

SEQ ID NO: 574297 - protein, 12 aa, Mycobacterium
SALSSDGHPRRG

SEQ ID NO: 574298 - protein, 8 aa, Mycobacterium
SALSSNAL

SEQ ID NO: 574299 - protein, 8 aa, Mycobacterium
SALSSPAE

SEQ ID NO: 574300 - protein, 11 aa, Mycobacterium
SALSSRDRIGQ

SEQ ID NO: 574301 - protein, 7 aa, Mycobacterium
SALTADA

SEQ ID NO: 574302 - protein, 7 aa, Mycobacterium
SALTEES

SEQ ID NO: 574303 - protein, 11 aa, Mycobacterium
SALTGSAPISD

SEQ ID NO: 574304 - protein, 14 aa, Mycobacterium
SALTGSSWQGPASA

SEQ ID NO: 574305 - protein, 8 aa, Mycobacterium
SALTKRPP

SEQ ID NO: 574306 - protein, 6 aa, Mycobacterium
SALTPD

SEQ ID NO: 574307 - protein, 8 aa, Mycobacterium
SALTPEET

SEQ ID NO: 574308 - protein, 11 aa, Mycobacterium
SALTQQSVAPT

SEQ ID NO: 574309 - protein, 11 aa, Mycobacterium
SALTSAEPSDV

SEQ ID NO: 574310 - protein, 9 aa, Mycobacterium
SALTSSGRI

SEQ ID NO: 574311 - protein, 9 aa, Mycobacterium
SAMASRDTV

SEQ ID NO: 574312 - protein, 5 aa, Mycobacterium
SAMGD

SEQ ID NO: 574313 - protein, 5 aa, Mycobacterium
SAMGG

SEQ ID NO: 574314 - protein, 6 aa, Mycobacterium
SAMPDA

SEQ ID NO: 574315 - protein, 16 aa, Mycobacterium
SAMPDNAAVTFPKGPG

SEQ ID NO: 574316 - protein, 18 aa, Mycobacterium
SAMPGNGEVAFPEPPGSG

SEQ ID NO: 574317 - protein, 27 aa, Mycobacterium
SAMPNGPKVSHGGALSPRGDWRAPSDM

SEQ ID NO: 574318 - protein, 13 aa, Mycobacterium
SAMPNITSGNTNA

SEQ ID NO: 574319 - protein, 5 aa, Mycobacterium
SAMQS

SEQ ID NO: 574320 - protein, 7 aa, Mycobacterium
SAMVGGP

SEQ ID NO: 574321 - protein, 8 aa, Mycobacterium
SANAAGTL

SEQ ID NO: 574322 - protein, 6 aa, Mycobacterium
SANAAP

SEQ ID NO: 574323 - protein, 12 aa, Mycobacterium
SANADPDTFTDP

SEQ ID NO: 574324 - protein, 20 aa, Mycobacterium
SANAGAARTAVTTPASYAAS

SEQ ID NO: 574325 - protein, 8 aa, Mycobacterium
SANAGPDL

SEQ ID NO: 574326 - protein, 8 aa, Mycobacterium
SANATAAA

SEQ ID NO: 574327 - protein, 6 aa, Mycobacterium
SANATN

SEQ ID NO: 574328 - protein, 6 aa, Mycobacterium
SANATY

SEQ ID NO: 574329 - protein, 12 aa, Mycobacterium
SANAYGHAEADA

SEQ ID NO: 574330 - protein, 8 aa, Mycobacterium
SANDELRT

SEQ ID NO: 574331 - protein, 8 aa, Mycobacterium
SANDPGST

SEQ ID NO: 574332 - protein, 4 aa, Mycobacterium
SANE

SEQ ID NO: 574333 - protein, 8 aa, Mycobacterium
SANEEAAE

SEQ ID NO: 574334 - protein, 10 aa, Mycobacterium
SANEEQETER

SEQ ID NO: 574335 - protein, 11 aa, Mycobacterium
SANEEVNPGNS

SEQ ID NO: 574336 - protein, 7 aa, Mycobacterium
SANFAAG

SEQ ID NO: 574337 - protein, 5 aa, Mycobacterium
SANFP

SEQ ID NO: 574338 - protein, 14 aa, Mycobacterium
SANFPDRDSTSAMD

SEQ ID NO: 574339 - protein, 8 aa, Mycobacterium
SANGATPT

SEQ ID NO: 574340 - protein, 6 aa, Mycobacterium
SANGDE

SEQ ID NO: 574341 - protein, 6 aa, Mycobacterium
SANGDT

SEQ ID NO: 574342 - protein, 10 aa, Mycobacterium
SANGEQAGDD

SEQ ID NO: 574343 - protein, 5 aa, Mycobacterium
SANGI

SEQ ID NO: 574344 - protein, 9 aa, Mycobacterium
SANGIGTAR

SEQ ID NO: 574345 - protein, 7 aa, Mycobacterium
SANGKAR

SEQ ID NO: 574346 - protein, 6 aa, Mycobacterium
SANGQD

SEQ ID NO: 574347 - protein, 10 aa, Mycobacterium
SANGSDPGRD

SEQ ID NO: 574348 - protein, 13 aa, Mycobacterium
SANGSGNRSSAVT

SEQ ID NO: 574349 - protein, 8 aa, Mycobacterium
SANGSTEN

SEQ ID NO: 574350 - protein, 12 aa, Mycobacterium
SANHDETRWEDA

SEQ ID NO: 574351 - protein, 12 aa, Mycobacterium
SANHPPVPNGLG

SEQ ID NO: 574352 - protein, 8 aa, Mycobacterium
SANIGGYN

SEQ ID NO: 574353 - protein, 6 aa, Mycobacterium
SANIGS

SEQ ID NO: 574354 - protein, 12 aa, Mycobacterium
SANIPSDPETVA

SEQ ID NO: 574355 - protein, 20 aa, Mycobacterium
SANISAAPADTIDGANRGRQ

SEQ ID NO: 574356 - protein, 20 aa, Mycobacterium
SANISGRTAAVDAGEARDQL

SEQ ID NO: 574357 - protein, 22 aa, Mycobacterium
SANKFSDSAREKITAAGGSINE

SEQ ID NO: 574358 - protein, 5 aa, Mycobacterium
SANKP

SEQ ID NO: 574359 - protein, 13 aa, Mycobacterium
SANLAGRDAVGAL

SEQ ID NO: 574360 - protein, 8 aa, Mycobacterium
SANLGSAN

SEQ ID NO: 574361 - protein, 9 aa, Mycobacterium
SANLNPERR

SEQ ID NO: 574362 - protein, 7 aa, Mycobacterium
SANPADV

SEQ ID NO: 574363 - protein, 7 aa, Mycobacterium
SANPASL

SEQ ID NO: 574364 - protein, 6 aa, Mycobacterium
SANPDD

SEQ ID NO: 574365 - protein, 10 aa, Mycobacterium
SANPDRPSHG

SEQ ID NO: 574366 - protein, 8 aa, Mycobacterium
SANPGAVP

SEQ ID NO: 574367 - protein, 7 aa, Mycobacterium
SANPGLG

SEQ ID NO: 574368 - protein, 6 aa, Mycobacterium
SANPLD

SEQ ID NO: 574369 - protein, 14 aa, Mycobacterium
SANPLKRNQPLPPE

SEQ ID NO: 574370 - protein, 6 aa, Mycobacterium
SANPQY

SEQ ID NO: 574371 - protein, 14 aa, Mycobacterium
SANPTITDQPRGSE

SEQ ID NO: 574372 - protein, 6 aa, Mycobacterium
SANPTV

SEQ ID NO: 574373 - protein, 6 aa, Mycobacterium
SANRAE

SEQ ID NO: 574374 - protein, 7 aa, Mycobacterium
SANRDAS

SEQ ID NO: 574375 - protein, 13 aa, Mycobacterium
SANRDDAKFPNAD

SEQ ID NO: 574376 - protein, 13 aa, Mycobacterium
SANRDDARYTDPD

SEQ ID NO: 574377 - protein, 13 aa, Mycobacterium
SANRDDRHFDDPD

SEQ ID NO: 574378 - protein, 6 aa, Mycobacterium
SANRDE

SEQ ID NO: 574379 - protein, 15 aa, Mycobacterium
SANRDEDIFGPTSEQ

SEQ ID NO: 574380 - protein, 11 aa, Mycobacterium
SANRDEEQFPE

SEQ ID NO: 574381 - protein, 12 aa, Mycobacterium
SANRDEKHFADP

SEQ ID NO: 574382 - protein, 12 aa, Mycobacterium
SANRDEKRWERS

SEQ ID NO: 574383 - protein, 12 aa, Mycobacterium
SANRDENRWERP

SEQ ID NO: 574384 - protein, 15 aa, Mycobacterium
SANRDERAFDDPDEY

SEQ ID NO: 574385 - protein, 11 aa, Mycobacterium
SANRDERAWTD

SEQ ID NO: 574386 - protein, 13 aa, Mycobacterium
SANRDERKFDDPD

SEQ ID NO: 574387 - protein, 8 aa, Mycobacterium
SANRDERV

SEQ ID NO: 574388 - protein, 9 aa, Mycobacterium
SANRDETHF

SEQ ID NO: 574389 - protein, 14 aa, Mycobacterium
SANRDETRFSEPDR

SEQ ID NO: 574390 - protein, 6 aa, Mycobacterium
SANRDN

SEQ ID NO: 574391 - protein, 12 aa, Mycobacterium
SANRDPDAFTDA

SEQ ID NO: 574392 - protein, 12 aa, Mycobacterium
SANRDPEAWTAP

SEQ ID NO: 574393 - protein, 15 aa, Mycobacterium
SANRDPEAYPPDPDE

SEQ ID NO: 574394 - protein, 13 aa, Mycobacterium
SANRDPRRFADPD

SEQ ID NO: 574395 - protein, 11 aa, Mycobacterium
SANRERQAQIT

SEQ ID NO: 574396 - protein, 9 aa, Mycobacterium
SANRPTPEL

SEQ ID NO: 574397 - protein, 4 aa, Mycobacterium
SANS

SEQ ID NO: 574398 - protein, 9 aa, Mycobacterium
SANSAIRTS

SEQ ID NO: 574399 - protein, 11 aa, Mycobacterium
SANTDPRKRAA

SEQ ID NO: 574400 - protein, 5 aa, Mycobacterium
SANVR

SEQ ID NO: 574401 - protein, 21 aa, Mycobacterium
SANVSGQPAAVDAGEARRQLG

SEQ ID NO: 574402 - protein, 8 aa, Mycobacterium
SANYTTDG

SEQ ID NO: 574403 - protein, 6 aa, Mycobacterium
SAPAAD

SEQ ID NO: 574404 - protein, 5 aa, Mycobacterium
SAPAD

SEQ ID NO: 574405 - protein, 10 aa, Mycobacterium
SAPADSTVAT

SEQ ID NO: 574406 - protein, 6 aa, Mycobacterium
SAPADT

SEQ ID NO: 574407 - protein, 6 aa, Mycobacterium
SAPADV

SEQ ID NO: 574408 - protein, 7 aa, Mycobacterium
SAPAEEL

SEQ ID NO: 574409 - protein, 8 aa, Mycobacterium
SAPAEVPD

SEQ ID NO: 574410 - protein, 5 aa, Mycobacterium
SAPAF

SEQ ID NO: 574411 - protein, 10 aa, Mycobacterium
SAPAGAGKTH

SEQ ID NO: 574412 - protein, 12 aa, Mycobacterium
SAPAGAGKTTSL

SEQ ID NO: 574413 - protein, 14 aa, Mycobacterium
SAPAGAHVKAGDRV

SEQ ID NO: 574414 - protein, 12 aa, Mycobacterium
SAPAGASVAAGD

SEQ ID NO: 574415 - protein, 18 aa, Mycobacterium
SAPAGDDQPPHCLVTDVS

SEQ ID NO: 574416 - protein, 20 aa, Mycobacterium
SAPAGDVTGVTGTSGSGKTT

SEQ ID NO: 574417 - protein, 6 aa, Mycobacterium
SAPAGP

SEQ ID NO: 574418 - protein, 15 aa, Mycobacterium
SAPAGSGSSRPRPAT

SEQ ID NO: 574419 - protein, 8 aa, Mycobacterium
SAPAHAPL

SEQ ID NO: 574420 - protein, 5 aa, Mycobacterium
SAPAI

SEQ ID NO: 574421 - protein, 5 aa, Mycobacterium
SAPAK

SEQ ID NO: 574422 - protein, 6 aa, Mycobacterium
SAPALR

SEQ ID NO: 574423 - protein, 7 aa, Mycobacterium
SAPAMTG

SEQ ID NO: 574424 - protein, 18 aa, Mycobacterium
SAPAPEYPEGDTRGERMG

SEQ ID NO: 574425 - protein, 20 aa, Mycobacterium
SAPAPNVAPRPVHPAPVGRR

SEQ ID NO: 574426 - protein, 8 aa, Mycobacterium
SAPAPSNG

SEQ ID NO: 574427 - protein, 17 aa, Mycobacterium
SAPAPVATDQTAGGEKR

SEQ ID NO: 574428 - protein, 6 aa, Mycobacterium
SAPAQS

SEQ ID NO: 574429 - protein, 13 aa, Mycobacterium
SAPAQSSTQDSIN

SEQ ID NO: 574430 - protein, 7 aa, Mycobacterium
SAPARGQ

SEQ ID NO: 574431 - protein, 8 aa, Mycobacterium
SAPARQPY

SEQ ID NO: 574432 - protein, 8 aa, Mycobacterium
SAPARSGF

SEQ ID NO: 574433 - protein, 8 aa, Mycobacterium
SAPARTGK

SEQ ID NO: 574434 - protein, 13 aa, Mycobacterium
SAPASLQTPPPRP

SEQ ID NO: 574435 - protein, 6 aa, Mycobacterium
SAPATT

SEQ ID NO: 574436 - protein, 5 aa, Mycobacterium
SAPAV

SEQ ID NO: 574437 - protein, 5 aa, Mycobacterium
SAPDA

SEQ ID NO: 574438 - protein, 9 aa, Mycobacterium
SAPDADQQA

SEQ ID NO: 574439 - protein, 8 aa, Mycobacterium
SAPDAETQ

SEQ ID NO: 574440 - protein, 25 aa, Mycobacterium
SAPDAGDSVPGESTGAEADDPARRA

SEQ ID NO: 574441 - protein, 9 aa, Mycobacterium
SAPDAHTVA

SEQ ID NO: 574442 - protein, 9 aa, Mycobacterium
SAPDDDPHI

SEQ ID NO: 574443 - protein, 9 aa, Mycobacterium
SAPDDPFDP

SEQ ID NO: 574444 - protein, 5 aa, Mycobacterium
SAPDG

SEQ ID NO: 574445 - protein, 13 aa, Mycobacterium
SAPDGQAQPTTTA

SEQ ID NO: 574446 - protein, 15 aa, Mycobacterium
SAPDIAGQGIADPTA

SEQ ID NO: 574447 - protein, 6 aa, Mycobacterium
SAPDNA

SEQ ID NO: 574448 - protein, 8 aa, Mycobacterium
SAPDNPNY

SEQ ID NO: 574449 - protein, 6 aa, Mycobacterium
SAPDNQ

SEQ ID NO: 574450 - protein, 6 aa, Mycobacterium
SAPDPA

SEQ ID NO: 574451 - protein, 10 aa, Mycobacterium
SAPDPELPPP

SEQ ID NO: 574452 - protein, 7 aa, Mycobacterium
SAPDPVP

SEQ ID NO: 574453 - protein, 9 aa, Mycobacterium
SAPDQTPLR

SEQ ID NO: 574454 - protein, 5 aa, Mycobacterium
SAPDR

SEQ ID NO: 574455 - protein, 17 aa, Mycobacterium
SAPDRPATEQVAKNMST

SEQ ID NO: 574456 - protein, 9 aa, Mycobacterium
SAPDSDPHI

SEQ ID NO: 574457 - protein, 10 aa, Mycobacterium
SAPDSPAGRR

SEQ ID NO: 574458 - protein, 26 aa, Mycobacterium
SAPDSPPISYTADDGQTYTATNISSY

SEQ ID NO: 574459 - protein, 8 aa, Mycobacterium
SAPDTGEL

SEQ ID NO: 574460 - protein, 6 aa, Mycobacterium
SAPDTP

SEQ ID NO: 574461 - protein, 10 aa, Mycobacterium
SAPDVAKPST

SEQ ID NO: 574462 - protein, 14 aa, Mycobacterium
SAPEAAPGGLLDTP

SEQ ID NO: 574463 - protein, 15 aa, Mycobacterium
SAPEARAEILEPVPL

SEQ ID NO: 574464 - protein, 8 aa, Mycobacterium
SAPEARQA

SEQ ID NO: 574465 - protein, 6 aa, Mycobacterium
SAPEAS

SEQ ID NO: 574466 - protein, 5 aa, Mycobacterium
SAPED

SEQ ID NO: 574467 - protein, 6 aa, Mycobacterium
SAPEDD

SEQ ID NO: 574468 - protein, 8 aa, Mycobacterium
SAPEDDER

SEQ ID NO: 574469 - protein, 6 aa, Mycobacterium
SAPEDF

SEQ ID NO: 574470 - protein, 7 aa, Mycobacterium
SAPEDPD

SEQ ID NO: 574471 - protein, 6 aa, Mycobacterium
SAPEEH

SEQ ID NO: 574472 - protein, 6 aa, Mycobacterium
SAPEFD

SEQ ID NO: 574473 - protein, 12 aa, Mycobacterium
SAPEGAHVGPGD

SEQ ID NO: 574474 - protein, 8 aa, Mycobacterium
SAPEGGAQ

SEQ ID NO: 574475 - protein, 8 aa, Mycobacterium
SAPEGGDA

SEQ ID NO: 574476 - protein, 5 aa, Mycobacterium
SAPEI

SEQ ID NO: 574477 - protein, 7 aa, Mycobacterium
SAPEIGA

SEQ ID NO: 574478 - protein, 6 aa, Mycobacterium
SAPELP

SEQ ID NO: 574479 - protein, 9 aa, Mycobacterium
SAPEPDAHG

SEQ ID NO: 574480 - protein, 9 aa, Mycobacterium
SAPEPVATG

SEQ ID NO: 574481 - protein, 13 aa, Mycobacterium
SAPERPGQNASNP

SEQ ID NO: 574482 - protein, 13 aa, Mycobacterium
SAPESASGTPEQV

SEQ ID NO: 574483 - protein, 21 aa, Mycobacterium
SAPESFPEPEASPDSTRGGAT

SEQ ID NO: 574484 - protein, 12 aa, Mycobacterium
SAPETPAEDPVG

SEQ ID NO: 574485 - protein, 8 aa, Mycobacterium
SAPEVSNT

SEQ ID NO: 574486 - protein, 4 aa, Mycobacterium
SAPF

SEQ ID NO: 574487 - protein, 15 aa, Mycobacterium
SAPFGGVGRSGMGAY

SEQ ID NO: 574488 - protein, 18 aa, Mycobacterium
SAPFPEPAEIRGTSTNVT

SEQ ID NO: 574489 - protein, 19 aa, Mycobacterium
SAPFTPESTRAHTGVEPET

SEQ ID NO: 574490 - protein, 8 aa, Mycobacterium
SAPGAESV

SEQ ID NO: 574491 - protein, 8 aa, Mycobacterium
SAPGAVSG

SEQ ID NO: 574492 - protein, 7 aa, Mycobacterium
SAPGDGR

SEQ ID NO: 574493 - protein, 12 aa, Mycobacterium
SAPGEDGDIPEE

SEQ ID NO: 574494 - protein, 10 aa, Mycobacterium
SAPGGDYRPD

SEQ ID NO: 574495 - protein, 6 aa, Mycobacterium
SAPGLA

SEQ ID NO: 574496 - protein, 6 aa, Mycobacterium
SAPGLD

SEQ ID NO: 574497 - protein, 6 aa, Mycobacterium
SAPGLG

SEQ ID NO: 574498 - protein, 9 aa, Mycobacterium
SAPGPDIDG

SEQ ID NO: 574499 - protein, 12 aa, Mycobacterium
SAPGPDPNGGLD

SEQ ID NO: 574500 - protein, 13 aa, Mycobacterium
SAPGPGTDHQRAE

SEQ ID NO: 574501 - protein, 7 aa, Mycobacterium
SAPGPKV

SEQ ID NO: 574502 - protein, 10 aa, Mycobacterium
SAPGPRELTT

SEQ ID NO: 574503 - protein, 9 aa, Mycobacterium
SAPGPTTVV

SEQ ID NO: 574504 - protein, 18 aa, Mycobacterium
SAPGQELNGYSPRGDNTC

SEQ ID NO: 574505 - protein, 7 aa, Mycobacterium
SAPGREY

SEQ ID NO: 574506 - protein, 9 aa, Mycobacterium
SAPGSEKEV

SEQ ID NO: 574507 - protein, 9 aa, Mycobacterium
SAPGSGAPW

SEQ ID NO: 574508 - protein, 6 aa, Mycobacterium
SAPGSQ

SEQ ID NO: 574509 - protein, 7 aa, Mycobacterium
SAPGSQV

SEQ ID NO: 574510 - protein, 16 aa, Mycobacterium
SAPGSRAAIEGPTGTL

SEQ ID NO: 574511 - protein, 24 aa, Mycobacterium
SAPGSRASSVGRATLHGPKGWKLN

SEQ ID NO: 574512 - protein, 7 aa, Mycobacterium
SAPGSRI

SEQ ID NO: 574513 - protein, 8 aa, Mycobacterium
SAPGSRIA

SEQ ID NO: 574514 - protein, 22 aa, Mycobacterium
SAPGSRLASEALPDMSPQESQR

SEQ ID NO: 574515 - protein, 23 aa, Mycobacterium
SAPGSTEPAPTPLPRPAEGVPPI

SEQ ID NO: 574516 - protein, 8 aa, Mycobacterium
SAPGSTVA

SEQ ID NO: 574517 - protein, 9 aa, Mycobacterium
SAPGTGPVT

SEQ ID NO: 574518 - protein, 24 aa, Mycobacterium
SAPGTLRTGSRGCCSKEDAGDARR

SEQ ID NO: 574519 - protein, 7 aa, Mycobacterium
SAPGTTD

SEQ ID NO: 574520 - protein, 5 aa, Mycobacterium
SAPGV

SEQ ID NO: 574521 - protein, 6 aa, Mycobacterium
SAPGVD

SEQ ID NO: 574522 - protein, 5 aa, Mycobacterium
SAPHA

SEQ ID NO: 574523 - protein, 6 aa, Mycobacterium
SAPHGT

SEQ ID NO: 574524 - protein, 6 aa, Mycobacterium
SAPHPD

SEQ ID NO: 574525 - protein, 6 aa, Mycobacterium
SAPHPQ

SEQ ID NO: 574526 - protein, 20 aa, Mycobacterium
SAPHRTGRHRGLPPASHAAH

SEQ ID NO: 574527 - protein, 6 aa, Mycobacterium
SAPHTV

SEQ ID NO: 574528 - protein, 7 aa, Mycobacterium
SAPIDPT

SEQ ID NO: 574529 - protein, 9 aa, Mycobacterium
SAPISDENK

SEQ ID NO: 574530 - protein, 5 aa, Mycobacterium
SAPKL

SEQ ID NO: 574531 - protein, 9 aa, Mycobacterium
SAPKLPNIA

SEQ ID NO: 574532 - protein, 9 aa, Mycobacterium
SAPKPGDLK

SEQ ID NO: 574533 - protein, 24 aa, Mycobacterium
SAPKSPDRRRKASGWTATSHRYED

SEQ ID NO: 574534 - protein, 93 aa, Mycobacterium
SAPLASSAPAQSPAAPPSSAPAPTTPAGAAPTAGTGAGGGLSTSGGPAPVAGAPAGAAPPAAPPVPLAPPTSPAPPAPPPTGAPGAAPAGLGA

SEQ ID NO: 574535 - protein, 14 aa, Mycobacterium
SAPLATKDRRGRPV

SEQ ID NO: 574536 - protein, 7 aa, Mycobacterium
SAPLDPR

SEQ ID NO: 574537 - protein, 7 aa, Mycobacterium
SAPLGDA

SEQ ID NO: 574538 - protein, 8 aa, Mycobacterium
SAPLGPVP

SEQ ID NO: 574539 - protein, 6 aa, Mycobacterium
SAPLGQ

SEQ ID NO: 574540 - protein, 10 aa, Mycobacterium
SAPLGQVPPE

SEQ ID NO: 574541 - protein, 19 aa, Mycobacterium
SAPLGSVGGQAGLAAAGNA

SEQ ID NO: 574542 - protein, 6 aa, Mycobacterium
SAPLPQ

SEQ ID NO: 574543 - protein, 9 aa, Mycobacterium
SAPLPSDMP

SEQ ID NO: 574544 - protein, 7 aa, Mycobacterium
SAPLREA

SEQ ID NO: 574545 - protein, 5 aa, Mycobacterium
SAPLS

SEQ ID NO: 574546 - protein, 7 aa, Mycobacterium
SAPMSPE

SEQ ID NO: 574547 - protein, 9 aa, Mycobacterium
SAPNATALA

SEQ ID NO: 574548 - protein, 17 aa, Mycobacterium
SAPNPEETGGGTEFPRS

SEQ ID NO: 574549 - protein, 9 aa, Mycobacterium
SAPNPGEVQ

SEQ ID NO: 574550 - protein, 17 aa, Mycobacterium
SAPNPPEAAGGTEFPRS

SEQ ID NO: 574551 - protein, 10 aa, Mycobacterium
SAPNRIGPAP

SEQ ID NO: 574552 - protein, 9 aa, Mycobacterium
SAPNSGKEV

SEQ ID NO: 574553 - protein, 9 aa, Mycobacterium
SAPNVAKAQ

SEQ ID NO: 574554 - protein, 9 aa, Mycobacterium
SAPPAAGDV

SEQ ID NO: 574555 - protein, 8 aa, Mycobacterium
SAPPAEEV

SEQ ID NO: 574556 - protein, 5 aa, Mycobacterium
SAPPD

SEQ ID NO: 574557 - protein, 14 aa, Mycobacterium
SAPPDSAAVPAPAR

SEQ ID NO: 574558 - protein, 9 aa, Mycobacterium
SAPPESAGF

SEQ ID NO: 574559 - protein, 9 aa, Mycobacterium
SAPPETTGF

SEQ ID NO: 574560 - protein, 19 aa, Mycobacterium
SAPPHPAPQQAAPQQSEEV

SEQ ID NO: 574561 - protein, 6 aa, Mycobacterium
SAPPIA

SEQ ID NO: 574562 - protein, 5 aa, Mycobacterium
SAPPL

SEQ ID NO: 574563 - protein, 7 aa, Mycobacterium
SAPPLTS

SEQ ID NO: 574564 - protein, 7 aa, Mycobacterium
SAPPLTT

SEQ ID NO: 574565 - protein, 13 aa, Mycobacterium
SAPPPAGKADEHG

SEQ ID NO: 574566 - protein, 13 aa, Mycobacterium
SAPPPAGRADEYG

SEQ ID NO: 574567 - protein, 8 aa, Mycobacterium
SAPPPATR

SEQ ID NO: 574568 - protein, 13 aa, Mycobacterium
SAPPPDGRADEFG

SEQ ID NO: 574569 - protein, 20 aa, Mycobacterium
SAPPPSVSSRRSPSRVRSGR

SEQ ID NO: 574570 - protein, 24 aa, Mycobacterium
SAPPVDDVPPVTPRRSLAEVLEVD

SEQ ID NO: 574571 - protein, 6 aa, Mycobacterium
SAPQAR

SEQ ID NO: 574572 - protein, 5 aa, Mycobacterium
SAPQL

SEQ ID NO: 574573 - protein, 8 aa, Mycobacterium
SAPQPATA

SEQ ID NO: 574574 - protein, 6 aa, Mycobacterium
SAPQSL

SEQ ID NO: 574575 - protein, 8 aa, Mycobacterium
SAPQTADT

SEQ ID NO: 574576 - protein, 8 aa, Mycobacterium
SAPQTPVI

SEQ ID NO: 574577 - protein, 9 aa, Mycobacterium
SAPQVQDQR

SEQ ID NO: 574578 - protein, 4 aa, Mycobacterium
SAPR

SEQ ID NO: 574579 - protein, 7 aa, Mycobacterium
SAPRAAE

SEQ ID NO: 574580 - protein, 14 aa, Mycobacterium
SAPRARDAENAARA

SEQ ID NO: 574581 - protein, 13 aa, Mycobacterium
SAPRDRDKNAARI

SEQ ID NO: 574582 - protein, 6 aa, Mycobacterium
SAPREI

SEQ ID NO: 574583 - protein, 6 aa, Mycobacterium
SAPREL

SEQ ID NO: 574584 - protein, 8 aa, Mycobacterium
SAPRGADG

SEQ ID NO: 574585 - protein, 5 aa, Mycobacterium
SAPRL

SEQ ID NO: 574586 - protein, 8 aa, Mycobacterium
SAPRLGVD

SEQ ID NO: 574587 - protein, 8 aa, Mycobacterium
SAPRPAGA

SEQ ID NO: 574588 - protein, 6 aa, Mycobacterium
SAPRQA

SEQ ID NO: 574589 - protein, 18 aa, Mycobacterium
SAPRQQPDATDSDTEPMS

SEQ ID NO: 574590 - protein, 9 aa, Mycobacterium
SAPRRDDAL

SEQ ID NO: 574591 - protein, 16 aa, Mycobacterium
SAPRRGGGRARPGLRG

SEQ ID NO: 574592 - protein, 6 aa, Mycobacterium
SAPRSR

SEQ ID NO: 574593 - protein, 8 aa, Mycobacterium
SAPRSSSV

SEQ ID NO: 574594 - protein, 12 aa, Mycobacterium
SAPSADTDDVTA

SEQ ID NO: 574595 - protein, 11 aa, Mycobacterium
SAPSARGSQHN

SEQ ID NO: 574596 - protein, 9 aa, Mycobacterium
SAPSASSLE

SEQ ID NO: 574597 - protein, 15 aa, Mycobacterium
SAPSAVGTADSAPAG

SEQ ID NO: 574598 - protein, 7 aa, Mycobacterium
SAPSDPV

SEQ ID NO: 574599 - protein, 12 aa, Mycobacterium
SAPSERKGRNGV

SEQ ID NO: 574600 - protein, 6 aa, Mycobacterium
SAPSGV

SEQ ID NO: 574601 - protein, 5 aa, Mycobacterium
SAPSP

SEQ ID NO: 574602 - protein, 16 aa, Mycobacterium
SAPSPGPAPGFAEQTD

SEQ ID NO: 574603 - protein, 7 aa, Mycobacterium
SAPSPPV

SEQ ID NO: 574604 - protein, 9 aa, Mycobacterium
SAPSQRARR

SEQ ID NO: 574605 - protein, 15 aa, Mycobacterium
SAPSSRNEIGRRILR

SEQ ID NO: 574606 - protein, 6 aa, Mycobacterium
SAPSTR

SEQ ID NO: 574607 - protein, 13 aa, Mycobacterium
SAPSVGGAVSGPG

SEQ ID NO: 574608 - protein, 6 aa, Mycobacterium
SAPSWE

SEQ ID NO: 574609 - protein, 4 aa, Mycobacterium
SAPT

SEQ ID NO: 574610 - protein, 13 aa, Mycobacterium
SAPTAAEMRHGVS

SEQ ID NO: 574611 - protein, 7 aa, Mycobacterium
SAPTADL

SEQ ID NO: 574612 - protein, 10 aa, Mycobacterium
SAPTATTVTS

SEQ ID NO: 574613 - protein, 6 aa, Mycobacterium
SAPTDG

SEQ ID NO: 574614 - protein, 7 aa, Mycobacterium
SAPTDGV

SEQ ID NO: 574615 - protein, 5 aa, Mycobacterium
SAPTE

SEQ ID NO: 574616 - protein, 6 aa, Mycobacterium
SAPTEA

SEQ ID NO: 574617 - protein, 7 aa, Mycobacterium
SAPTEAA

SEQ ID NO: 574618 - protein, 6 aa, Mycobacterium
SAPTES

SEQ ID NO: 574619 - protein, 7 aa, Mycobacterium
SAPTESD

SEQ ID NO: 574620 - protein, 6 aa, Mycobacterium
SAPTGP

SEQ ID NO: 574621 - protein, 5 aa, Mycobacterium
SAPTR

SEQ ID NO: 574622 - protein, 13 aa, Mycobacterium
SAPTRGPEPAPDL

SEQ ID NO: 574623 - protein, 6 aa, Mycobacterium
SAPTVA

SEQ ID NO: 574624 - protein, 8 aa, Mycobacterium
SAPTVPEQ

SEQ ID NO: 574625 - protein, 6 aa, Mycobacterium
SAPVEE

SEQ ID NO: 574626 - protein, 14 aa, Mycobacterium
SAPVGSMSGGQRQS

SEQ ID NO: 574627 - protein, 7 aa, Mycobacterium
SAPVPGT

SEQ ID NO: 574628 - protein, 9 aa, Mycobacterium
SAPVRANSD

SEQ ID NO: 574629 - protein, 8 aa, Mycobacterium
SAPVRDGR

SEQ ID NO: 574630 - protein, 9 aa, Mycobacterium
SAPVRDGRG

SEQ ID NO: 574631 - protein, 10 aa, Mycobacterium
SAPVRDGRGT

SEQ ID NO: 574632 - protein, 7 aa, Mycobacterium
SAPVRDR

SEQ ID NO: 574633 - protein, 10 aa, Mycobacterium
SAPVRDSRGQ

SEQ ID NO: 574634 - protein, 7 aa, Mycobacterium
SAPVSTT

SEQ ID NO: 574635 - protein, 5 aa, Mycobacterium
SAPVT

SEQ ID NO: 574636 - protein, 4 aa, Mycobacterium
SAPW

SEQ ID NO: 574637 - protein, 9 aa, Mycobacterium
SAPWARPGE

SEQ ID NO: 574638 - protein, 6 aa, Mycobacterium
SAPYAS

SEQ ID NO: 574639 - protein, 4 aa, Mycobacterium
SAQA

SEQ ID NO: 574640 - protein, 6 aa, Mycobacterium
SAQAAS

SEQ ID NO: 574641 - protein, 8 aa, Mycobacterium
SAQADRPL

SEQ ID NO: 574642 - protein, 5 aa, Mycobacterium
SAQAE

SEQ ID NO: 574643 - protein, 10 aa, Mycobacterium
SAQAEALSPR

SEQ ID NO: 574644 - protein, 7 aa, Mycobacterium
SAQAEES

SEQ ID NO: 574645 - protein, 11 aa, Mycobacterium
SAQAEKFDPAG

SEQ ID NO: 574646 - protein, 9 aa, Mycobacterium
SAQAESPGR

SEQ ID NO: 574647 - protein, 5 aa, Mycobacterium
SAQAG

SEQ ID NO: 574648 - protein, 11 aa, Mycobacterium
SAQAGAGSVGG

SEQ ID NO: 574649 - protein, 5 aa, Mycobacterium
SAQAI

SEQ ID NO: 574650 - protein, 18 aa, Mycobacterium
SAQAKIRASKATAQAAAY

SEQ ID NO: 574651 - protein, 20 aa, Mycobacterium
SAQAPASSTAESPAPEPPAA

SEQ ID NO: 574652 - protein, 15 aa, Mycobacterium
SAQATDELIAAGVTT

SEQ ID NO: 574653 - protein, 4 aa, Mycobacterium
SAQD

SEQ ID NO: 574654 - protein, 14 aa, Mycobacterium
SAQDFAEDPARYDI

SEQ ID NO: 574655 - protein, 13 aa, Mycobacterium
SAQDIERLRAEGV

SEQ ID NO: 574656 - protein, 11 aa, Mycobacterium
SAQDPSEREFG

SEQ ID NO: 574657 - protein, 7 aa, Mycobacterium
SAQDRAD

SEQ ID NO: 574658 - protein, 8 aa, Mycobacterium
SAQDTETL

SEQ ID NO: 574659 - protein, 6 aa, Mycobacterium
SAQDVR

SEQ ID NO: 574660 - protein, 4 aa, Mycobacterium
SAQE

SEQ ID NO: 574661 - protein, 11 aa, Mycobacterium
SAQEGAQGHEA

SEQ ID NO: 574662 - protein, 6 aa, Mycobacterium
SAQEKR

SEQ ID NO: 574663 - protein, 12 aa, Mycobacterium
SAQELEARTVGR

SEQ ID NO: 574664 - protein, 9 aa, Mycobacterium
SAQFPGADL

SEQ ID NO: 574665 - protein, 19 aa, Mycobacterium
SAQFPRPAPRPSYSALGGR

SEQ ID NO: 574666 - protein, 4 aa, Mycobacterium
SAQG

SEQ ID NO: 574667 - protein, 6 aa, Mycobacterium
SAQGAQ

SEQ ID NO: 574668 - protein, 10 aa, Mycobacterium
SAQGDDGAPV

SEQ ID NO: 574669 - protein, 8 aa, Mycobacterium
SAQGGERH

SEQ ID NO: 574670 - protein, 6 aa, Mycobacterium
SAQGGK

SEQ ID NO: 574671 - protein, 16 aa, Mycobacterium
SAQGHVEAEANGNGAL

SEQ ID NO: 574672 - protein, 20 aa, Mycobacterium
SAQGNRDGAHFQGTSAQDQA

SEQ ID NO: 574673 - protein, 7 aa, Mycobacterium
SAQGRDQ

SEQ ID NO: 574674 - protein, 8 aa, Mycobacterium
SAQGSEHA

SEQ ID NO: 574675 - protein, 8 aa, Mycobacterium
SAQGTQAK

SEQ ID NO: 574676 - protein, 6 aa, Mycobacterium
SAQHPD

SEQ ID NO: 574677 - protein, 6 aa, Mycobacterium
SAQHPG

SEQ ID NO: 574678 - protein, 13 aa, Mycobacterium
SAQHRERYLTAKG

SEQ ID NO: 574679 - protein, 7 aa, Mycobacterium
SAQHTPT

SEQ ID NO: 574680 - protein, 4 aa, Mycobacterium
SAQI

SEQ ID NO: 574681 - protein, 7 aa, Mycobacterium
SAQIEAG

SEQ ID NO: 574682 - protein, 20 aa, Mycobacterium
SAQMPGGLSGAQSGTPAPLR

SEQ ID NO: 574683 - protein, 5 aa, Mycobacterium
SAQMT

SEQ ID NO: 574684 - protein, 14 aa, Mycobacterium
SAQNGTEQQLNDSF

SEQ ID NO: 574685 - protein, 9 aa, Mycobacterium
SAQNPGLAA

SEQ ID NO: 574686 - protein, 10 aa, Mycobacterium
SAQPDANEAD

SEQ ID NO: 574687 - protein, 11 aa, Mycobacterium
SAQPEGAVGSE

SEQ ID NO: 574688 - protein, 6 aa, Mycobacterium
SAQPEQ

SEQ ID NO: 574689 - protein, 8 aa, Mycobacterium
SAQPGPDG

SEQ ID NO: 574690 - protein, 8 aa, Mycobacterium
SAQPHSHE

SEQ ID NO: 574691 - protein, 9 aa, Mycobacterium
SAQPNPDLR

SEQ ID NO: 574692 - protein, 9 aa, Mycobacterium
SAQPQAPDR

SEQ ID NO: 574693 - protein, 8 aa, Mycobacterium
SAQPSAAL

SEQ ID NO: 574694 - protein, 9 aa, Mycobacterium
SAQQAADAE

SEQ ID NO: 574695 - protein, 9 aa, Mycobacterium
SAQQAQQIA

SEQ ID NO: 574696 - protein, 6 aa, Mycobacterium
SAQQAR

SEQ ID NO: 574697 - protein, 7 aa, Mycobacterium
SAQQDGR

SEQ ID NO: 574698 - protein, 7 aa, Mycobacterium
SAQQINE

SEQ ID NO: 574699 - protein, 8 aa, Mycobacterium
SAQQSAGS

SEQ ID NO: 574700 - protein, 4 aa, Mycobacterium
SAQR

SEQ ID NO: 574701 - protein, 15 aa, Mycobacterium
SAQRAAAIATTSEEV

SEQ ID NO: 574702 - protein, 5 aa, Mycobacterium
SAQRG

SEQ ID NO: 574703 - protein, 6 aa, Mycobacterium
SAQRGT

SEQ ID NO: 574704 - protein, 12 aa, Mycobacterium
SAQRSDPGLSES

SEQ ID NO: 574705 - protein, 12 aa, Mycobacterium
SAQRSSTTRRDA

SEQ ID NO: 574706 - protein, 5 aa, Mycobacterium
SAQRT

SEQ ID NO: 574707 - protein, 12 aa, Mycobacterium
SAQRTLRESRAR

SEQ ID NO: 574708 - protein, 4 aa, Mycobacterium
SAQS

SEQ ID NO: 574709 - protein, 10 aa, Mycobacterium
SAQSAGPAPS

SEQ ID NO: 574710 - protein, 9 aa, Mycobacterium
SAQSKQELI

SEQ ID NO: 574711 - protein, 13 aa, Mycobacterium
SAQSPEPIRGAQE

SEQ ID NO: 574712 - protein, 9 aa, Mycobacterium
SAQSPGAIR

SEQ ID NO: 574713 - protein, 10 aa, Mycobacterium
SAQSPTEVEQ

SEQ ID NO: 574714 - protein, 9 aa, Mycobacterium
SAQSYDVDQ

SEQ ID NO: 574715 - protein, 25 aa, Mycobacterium
SAQTASPNTVRHKSSTVAEARPRGR

SEQ ID NO: 574716 - protein, 11 aa, Mycobacterium
SAQTPEQAARE

SEQ ID NO: 574717 - protein, 8 aa, Mycobacterium
SAQTQVEQ

SEQ ID NO: 574718 - protein, 9 aa, Mycobacterium
SAQTQVEQQ

SEQ ID NO: 574719 - protein, 14 aa, Mycobacterium
SAQTSIAAGATDAL

SEQ ID NO: 574720 - protein, 14 aa, Mycobacterium
SAQTTFADNDLPQS

SEQ ID NO: 574721 - protein, 12 aa, Mycobacterium
SAQTTGSPATHP

SEQ ID NO: 574722 - protein, 7 aa, Mycobacterium
SAQVDPA

SEQ ID NO: 574723 - protein, 8 aa, Mycobacterium
SAQVGGKA

SEQ ID NO: 574724 - protein, 19 aa, Mycobacterium
SAQVTDTDDELPLRPEELT

SEQ ID NO: 574725 - protein, 8 aa, Mycobacterium
SAQWGRRG

SEQ ID NO: 574726 - protein, 25 aa, Mycobacterium
SAQYSADKAAEDRAREQRRLEAGFN

SEQ ID NO: 574727 - protein, 5 aa, Mycobacterium
SARAA

SEQ ID NO: 574728 - protein, 12 aa, Mycobacterium
SARAAANPTPRI

SEQ ID NO: 574729 - protein, 8 aa, Mycobacterium
SARAAARE

SEQ ID NO: 574730 - protein, 6 aa, Mycobacterium
SARAAD

SEQ ID NO: 574731 - protein, 13 aa, Mycobacterium
SARAAETRSDDPL

SEQ ID NO: 574732 - protein, 12 aa, Mycobacterium
SARAATSPTPRI

SEQ ID NO: 574733 - protein, 25 aa, Mycobacterium
SARADGGEVIDGDRRHPQGREQPSA

SEQ ID NO: 574734 - protein, 9 aa, Mycobacterium
SARAERRAI

SEQ ID NO: 574735 - protein, 26 aa, Mycobacterium
SARAGAAPAGTAAQRATEAPAETAAR

SEQ ID NO: 574736 - protein, 7 aa, Mycobacterium
SARAGLD

SEQ ID NO: 574737 - protein, 24 aa, Mycobacterium
SARAGREQGRREAGSVARFLGCAR

SEQ ID NO: 574738 - protein, 9 aa, Mycobacterium
SARANPELR

SEQ ID NO: 574739 - protein, 7 aa, Mycobacterium
SARAPGL

SEQ ID NO: 574740 - protein, 7 aa, Mycobacterium
SARAQAL

SEQ ID NO: 574741 - protein, 6 aa, Mycobacterium
SARAQG

SEQ ID NO: 574742 - protein, 8 aa, Mycobacterium
SARARREV

SEQ ID NO: 574743 - protein, 27 aa, Mycobacterium
SARARRSAEGAKARSRAASKAKGLGTN

SEQ ID NO: 574744 - protein, 7 aa, Mycobacterium
SARASQT

SEQ ID NO: 574745 - protein, 15 aa, Mycobacterium
SARAVGASASAKAVA

SEQ ID NO: 574746 - protein, 7 aa, Mycobacterium
SARCPAD

SEQ ID NO: 574747 - protein, 13 aa, Mycobacterium
SARDAGGLPPTAR

SEQ ID NO: 574748 - protein, 6 aa, Mycobacterium
SARDAT

SEQ ID NO: 574749 - protein, 5 aa, Mycobacterium
SARDD

SEQ ID NO: 574750 - protein, 7 aa, Mycobacterium
SARDEGL

SEQ ID NO: 574751 - protein, 16 aa, Mycobacterium
SARDGGEPAPVRRATP

SEQ ID NO: 574752 - protein, 7 aa, Mycobacterium
SARDGLD

SEQ ID NO: 574753 - protein, 10 aa, Mycobacterium
SARDGLDGRT

SEQ ID NO: 574754 - protein, 5 aa, Mycobacterium
SARDL

SEQ ID NO: 574755 - protein, 12 aa, Mycobacterium
SARDQAEAAKWG

SEQ ID NO: 574756 - protein, 11 aa, Mycobacterium
SARDREANEAD

SEQ ID NO: 574757 - protein, 7 aa, Mycobacterium
SARDSWG

SEQ ID NO: 574758 - protein, 6 aa, Mycobacterium
SAREAG

SEQ ID NO: 574759 - protein, 7 aa, Mycobacterium
SAREERD

SEQ ID NO: 574760 - protein, 8 aa, Mycobacterium
SARELTGC

SEQ ID NO: 574761 - protein, 5 aa, Mycobacterium
SAREM

SEQ ID NO: 574762 - protein, 6 aa, Mycobacterium
SAREPR

SEQ ID NO: 574763 - protein, 30 aa, Mycobacterium
SAREPRPYREPMSAGAAARRLRGRAQAGEL

SEQ ID NO: 574764 - protein, 5 aa, Mycobacterium
SAREQ

SEQ ID NO: 574765 - protein, 10 aa, Mycobacterium
SARERRRSGV

SEQ ID NO: 574766 - protein, 12 aa, Mycobacterium
SARESHGGEGRI

SEQ ID NO: 574767 - protein, 27 aa, Mycobacterium
SARFRNETDVPDPEQVADHATSDQVDT

SEQ ID NO: 574768 - protein, 7 aa, Mycobacterium
SARGAQI

SEQ ID NO: 574769 - protein, 10 aa, Mycobacterium
SARGDGRSLK

SEQ ID NO: 574770 - protein, 7 aa, Mycobacterium
SARGDHN

SEQ ID NO: 574771 - protein, 6 aa, Mycobacterium
SARGDQ

SEQ ID NO: 574772 - protein, 10 aa, Mycobacterium
SARGDSGGSV

SEQ ID NO: 574773 - protein, 9 aa, Mycobacterium
SARGEFDGS

SEQ ID NO: 574774 - protein, 10 aa, Mycobacterium
SARGEGRSLK

SEQ ID NO: 574775 - protein, 9 aa, Mycobacterium
SARGEPDDE

SEQ ID NO: 574776 - protein, 5 aa, Mycobacterium
SARGG

SEQ ID NO: 574777 - protein, 8 aa, Mycobacterium
SARGHPGK

SEQ ID NO: 574778 - protein, 6 aa, Mycobacterium
SARGLD

SEQ ID NO: 574779 - protein, 5 aa, Mycobacterium
SARGP

SEQ ID NO: 574780 - protein, 8 aa, Mycobacterium
SARGPDDI

SEQ ID NO: 574781 - protein, 8 aa, Mycobacterium
SARGPEDI

SEQ ID NO: 574782 - protein, 8 aa, Mycobacterium
SARGPEGI

SEQ ID NO: 574783 - protein, 11 aa, Mycobacterium
SARGRKAHDEV

SEQ ID NO: 574784 - protein, 7 aa, Mycobacterium
SARGRQI

SEQ ID NO: 574785 - protein, 8 aa, Mycobacterium
SARGSRLA

SEQ ID NO: 574786 - protein, 15 aa, Mycobacterium
SARGTTDSGGALQAT

SEQ ID NO: 574787 - protein, 7 aa, Mycobacterium
SARGTVE

SEQ ID NO: 574788 - protein, 10 aa, Mycobacterium
SARGYGGDGA

SEQ ID NO: 574789 - protein, 11 aa, Mycobacterium
SARHADPERAI

SEQ ID NO: 574790 - protein, 6 aa, Mycobacterium
SARHAG

SEQ ID NO: 574791 - protein, 6 aa, Mycobacterium
SARHIT

SEQ ID NO: 574792 - protein, 14 aa, Mycobacterium
SARHPATEPAITGS

SEQ ID NO: 574793 - protein, 21 aa, Mycobacterium
SARIEARSDPWDPETEPSEAE

SEQ ID NO: 574794 - protein, 9 aa, Mycobacterium
SARIPGEGV

SEQ ID NO: 574795 - protein, 5 aa, Mycobacterium
SARIT

SEQ ID NO: 574796 - protein, 6 aa, Mycobacterium
SARKLG

SEQ ID NO: 574797 - protein, 11 aa, Mycobacterium
SARKSAGTADV

SEQ ID NO: 574798 - protein, 6 aa, Mycobacterium
SARKSL

SEQ ID NO: 574799 - protein, 6 aa, Mycobacterium
SARKTG

SEQ ID NO: 574800 - protein, 29 aa, Mycobacterium
SARKTGSGGGPPGADGFTHRTNSTKRGAY

SEQ ID NO: 574801 - protein, 5 aa, Mycobacterium
SARLG

SEQ ID NO: 574802 - protein, 6 aa, Mycobacterium
SARLPK

SEQ ID NO: 574803 - protein, 9 aa, Mycobacterium
SARLSRGGA

SEQ ID NO: 574804 - protein, 4 aa, Mycobacterium
SARN

SEQ ID NO: 574805 - protein, 8 aa, Mycobacterium
SARNNNAS

SEQ ID NO: 574806 - protein, 9 aa, Mycobacterium
SARNPAGPA

SEQ ID NO: 574807 - protein, 20 aa, Mycobacterium
SARNQGSSLPAHTEAPGYRL

SEQ ID NO: 574808 - protein, 5 aa, Mycobacterium
SARNV

SEQ ID NO: 574809 - protein, 6 aa, Mycobacterium
SARNVR

SEQ ID NO: 574810 - protein, 8 aa, Mycobacterium
SARPASPL

SEQ ID NO: 574811 - protein, 5 aa, Mycobacterium
SARPD

SEQ ID NO: 574812 - protein, 7 aa, Mycobacterium
SARPDGE

SEQ ID NO: 574813 - protein, 9 aa, Mycobacterium
SARPDPGTI

SEQ ID NO: 574814 - protein, 8 aa, Mycobacterium
SARPDTII

SEQ ID NO: 574815 - protein, 6 aa, Mycobacterium
SARPEV

SEQ ID NO: 574816 - protein, 13 aa, Mycobacterium
SARPPDGDAAAAA

SEQ ID NO: 574817 - protein, 10 aa, Mycobacterium
SARPPHESPV

SEQ ID NO: 574818 - protein, 7 aa, Mycobacterium
SARPPRY

SEQ ID NO: 574819 - protein, 42 aa, Mycobacterium
SARPQDSGDTATAAVPGTATEAPPTADTTDTDTVPAAADAPV

SEQ ID NO: 574820 - protein, 10 aa, Mycobacterium
SARPQHESPV

SEQ ID NO: 574821 - protein, 4 aa, Mycobacterium
SARQ

SEQ ID NO: 574822 - protein, 12 aa, Mycobacterium
SARQERGDAARN

SEQ ID NO: 574823 - protein, 8 aa, Mycobacterium
SARQFATR

SEQ ID NO: 574824 - protein, 6 aa, Mycobacterium
SARQRD

SEQ ID NO: 574825 - protein, 22 aa, Mycobacterium
SARQRGTPASTVGRTASDAASW

SEQ ID NO: 574826 - protein, 6 aa, Mycobacterium
SARQRS

SEQ ID NO: 574827 - protein, 5 aa, Mycobacterium
SARRA

SEQ ID NO: 574828 - protein, 6 aa, Mycobacterium
SARRAD

SEQ ID NO: 574829 - protein, 7 aa, Mycobacterium
SARRADE

SEQ ID NO: 574830 - protein, 6 aa, Mycobacterium
SARRCG

SEQ ID NO: 574831 - protein, 5 aa, Mycobacterium
SARRD

SEQ ID NO: 574832 - protein, 18 aa, Mycobacterium
SARRDAQPVRVQIDPLHV

SEQ ID NO: 574833 - protein, 10 aa, Mycobacterium
SARRDQVRAT

SEQ ID NO: 574834 - protein, 9 aa, Mycobacterium
SARRDVAGT

SEQ ID NO: 574835 - protein, 12 aa, Mycobacterium
SARREAASAFGD

SEQ ID NO: 574836 - protein, 7 aa, Mycobacterium
SARREAQ

SEQ ID NO: 574837 - protein, 9 aa, Mycobacterium
SARREEEES

SEQ ID NO: 574838 - protein, 24 aa, Mycobacterium
SARRGLPTWPPQRDNRPMRPAAPG

SEQ ID NO: 574839 - protein, 14 aa, Mycobacterium
SARRGTAPASAPAR

SEQ ID NO: 574840 - protein, 14 aa, Mycobacterium
SARRGTDPDTAPAR

SEQ ID NO: 574841 - protein, 8 aa, Mycobacterium
SARRHRED

SEQ ID NO: 574842 - protein, 6 aa, Mycobacterium
SARRPV

SEQ ID NO: 574843 - protein, 6 aa, Mycobacterium
SARRQA

SEQ ID NO: 574844 - protein, 7 aa, Mycobacterium
SARRQAR

SEQ ID NO: 574845 - protein, 6 aa, Mycobacterium
SARRQE

SEQ ID NO: 574846 - protein, 12 aa, Mycobacterium
SARRSARKWDRE

SEQ ID NO: 574847 - protein, 6 aa, Mycobacterium
SARRSE

SEQ ID NO: 574848 - protein, 5 aa, Mycobacterium
SARSA

SEQ ID NO: 574849 - protein, 7 aa, Mycobacterium
SARSAGG

SEQ ID NO: 574850 - protein, 21 aa, Mycobacterium
SARSFTGSQAGVITTGKHGSA

SEQ ID NO: 574851 - protein, 16 aa, Mycobacterium
SARSHDKAARATKDGL

SEQ ID NO: 574852 - protein, 16 aa, Mycobacterium
SARSLSNEEAVGVTQG

SEQ ID NO: 574853 - protein, 6 aa, Mycobacterium
SARSTR

SEQ ID NO: 574854 - protein, 5 aa, Mycobacterium
SARSV

SEQ ID NO: 574855 - protein, 6 aa, Mycobacterium
SARSVP

SEQ ID NO: 574856 - protein, 6 aa, Mycobacterium
SARSWA

SEQ ID NO: 574857 - protein, 4 aa, Mycobacterium
SART

SEQ ID NO: 574858 - protein, 11 aa, Mycobacterium
SARTAANPTPR

SEQ ID NO: 574859 - protein, 7 aa, Mycobacterium
SARTATA

SEQ ID NO: 574860 - protein, 11 aa, Mycobacterium
SARTAVPTSVT

SEQ ID NO: 574861 - protein, 21 aa, Mycobacterium
SARTAYENRAGSSLGVTKPDG

SEQ ID NO: 574862 - protein, 24 aa, Mycobacterium
SARTCGAGSGATGAGGAGGGTSTG

SEQ ID NO: 574863 - protein, 17 aa, Mycobacterium
SARTDNPYGRTTAEQDE

SEQ ID NO: 574864 - protein, 5 aa, Mycobacterium
SARTE

SEQ ID NO: 574865 - protein, 9 aa, Mycobacterium
SARTEADRA

SEQ ID NO: 574866 - protein, 9 aa, Mycobacterium
SARTEEMER

SEQ ID NO: 574867 - protein, 10 aa, Mycobacterium
SARTGATRRE

SEQ ID NO: 574868 - protein, 8 aa, Mycobacterium
SARTGEFR

SEQ ID NO: 574869 - protein, 7 aa, Mycobacterium
SARTHPD

SEQ ID NO: 574870 - protein, 6 aa, Mycobacterium
SARTIS

SEQ ID NO: 574871 - protein, 7 aa, Mycobacterium
SARTMRA

SEQ ID NO: 574872 - protein, 9 aa, Mycobacterium
SARTNYDPA

SEQ ID NO: 574873 - protein, 10 aa, Mycobacterium
SARTPANGWS

SEQ ID NO: 574874 - protein, 14 aa, Mycobacterium
SARTPIENLGRGAH

SEQ ID NO: 574875 - protein, 6 aa, Mycobacterium
SARTQS

SEQ ID NO: 574876 - protein, 15 aa, Mycobacterium
SARTRGSPNAGSTNV

SEQ ID NO: 574877 - protein, 20 aa, Mycobacterium
SARTRPASDAAAASEKGQKF

SEQ ID NO: 574878 - protein, 17 aa, Mycobacterium
SARTTNIDDPTDPRLNG

SEQ ID NO: 574879 - protein, 10 aa, Mycobacterium
SARVAGAESF

SEQ ID NO: 574880 - protein, 8 aa, Mycobacterium
SARVASPA

SEQ ID NO: 574881 - protein, 6 aa, Mycobacterium
SARVPD

SEQ ID NO: 574882 - protein, 7 aa, Mycobacterium
SARVSAA

SEQ ID NO: 574883 - protein, 5 aa, Mycobacterium
SARWD

SEQ ID NO: 574884 - protein, 8 aa, Mycobacterium
SARYDEPA

SEQ ID NO: 574885 - protein, 6 aa, Mycobacterium
SARYEA

SEQ ID NO: 574886 - protein, 10 aa, Mycobacterium
SASAAASQVA

SEQ ID NO: 574887 - protein, 16 aa, Mycobacterium
SASAADPAAPTAAGGT

SEQ ID NO: 574888 - protein, 24 aa, Mycobacterium
SASAADPSNVPGPLPATRTAGQAG

SEQ ID NO: 574889 - protein, 8 aa, Mycobacterium
SASAAPSH

SEQ ID NO: 574890 - protein, 14 aa, Mycobacterium
SASADEKLTQIGTT

SEQ ID NO: 574891 - protein, 12 aa, Mycobacterium
SASADSTERDHL

SEQ ID NO: 574892 - protein, 16 aa, Mycobacterium
SASAEGAEPRSLGPST

SEQ ID NO: 574893 - protein, 6 aa, Mycobacterium
SASAER

SEQ ID NO: 574894 - protein, 7 aa, Mycobacterium
SASAGDR

SEQ ID NO: 574895 - protein, 8 aa, Mycobacterium
SASAGSTL

SEQ ID NO: 574896 - protein, 7 aa, Mycobacterium
SASAHPD

SEQ ID NO: 574897 - protein, 13 aa, Mycobacterium
SASAIAGTRPIDT

SEQ ID NO: 574898 - protein, 11 aa, Mycobacterium
SASAKDKSSER

SEQ ID NO: 574899 - protein, 12 aa, Mycobacterium
SASAKKSPITPF

SEQ ID NO: 574900 - protein, 12 aa, Mycobacterium
SASAKLGAPNRA

SEQ ID NO: 574901 - protein, 9 aa, Mycobacterium
SASAKPRVR

SEQ ID NO: 574902 - protein, 8 aa, Mycobacterium
SASANGGY

SEQ ID NO: 574903 - protein, 9 aa, Mycobacterium
SASANGGYA

SEQ ID NO: 574904 - protein, 8 aa, Mycobacterium
SASAPFSD

SEQ ID NO: 574905 - protein, 10 aa, Mycobacterium
SASAQGMLSP

SEQ ID NO: 574906 - protein, 22 aa, Mycobacterium
SASAQLGGGTYSKVPYSASKAS

SEQ ID NO: 574907 - protein, 9 aa, Mycobacterium
SASAQNMLS

SEQ ID NO: 574908 - protein, 11 aa, Mycobacterium
SASARDTPPFT

SEQ ID NO: 574909 - protein, 8 aa, Mycobacterium
SASARTGY

SEQ ID NO: 574910 - protein, 10 aa, Mycobacterium
SASASGGYAE

SEQ ID NO: 574911 - protein, 11 aa, Mycobacterium
SASATAVGGDG

SEQ ID NO: 574912 - protein, 10 aa, Mycobacterium
SASATGGTVT

SEQ ID NO: 574913 - protein, 12 aa, Mycobacterium
SASAVSQRTSRA

SEQ ID NO: 574914 - protein, 8 aa, Mycobacterium
SASDAAER

SEQ ID NO: 574915 - protein, 14 aa, Mycobacterium
SASDADGVRETAER

SEQ ID NO: 574916 - protein, 9 aa, Mycobacterium
SASDEPDRY

SEQ ID NO: 574917 - protein, 6 aa, Mycobacterium
SASDET

SEQ ID NO: 574918 - protein, 14 aa, Mycobacterium
SASDGGAGGAGGNA

SEQ ID NO: 574919 - protein, 7 aa, Mycobacterium
SASDGVW

SEQ ID NO: 574920 - protein, 8 aa, Mycobacterium
SASDLDEP

SEQ ID NO: 574921 - protein, 9 aa, Mycobacterium
SASDLDEPA

SEQ ID NO: 574922 - protein, 7 aa, Mycobacterium
SASDLND

SEQ ID NO: 574923 - protein, 10 aa, Mycobacterium
SASDPLPDNG

SEQ ID NO: 574924 - protein, 5 aa, Mycobacterium
SASDR

SEQ ID NO: 574925 - protein, 15 aa, Mycobacterium
SASDRRKDAPAEGTP

SEQ ID NO: 574926 - protein, 15 aa, Mycobacterium
SASDRRKDAPGEGRP

SEQ ID NO: 574927 - protein, 15 aa, Mycobacterium
SASDRRKDAPGEGTP

SEQ ID NO: 574928 - protein, 15 aa, Mycobacterium
SASDRRKDPPSEGRP

SEQ ID NO: 574929 - protein, 8 aa, Mycobacterium
SASDTESA

SEQ ID NO: 574930 - protein, 7 aa, Mycobacterium
SASDTTA

SEQ ID NO: 574931 - protein, 10 aa, Mycobacterium
SASEAEDAVQ

SEQ ID NO: 574932 - protein, 6 aa, Mycobacterium
SASEAK

SEQ ID NO: 574933 - protein, 20 aa, Mycobacterium
SASEDNQTRMSASEDNQAQI

SEQ ID NO: 574934 - protein, 9 aa, Mycobacterium
SASEEIGGA

SEQ ID NO: 574935 - protein, 7 aa, Mycobacterium
SASEGRL

SEQ ID NO: 574936 - protein, 9 aa, Mycobacterium
SASEIEETI

SEQ ID NO: 574937 - protein, 6 aa, Mycobacterium
SASEIG

SEQ ID NO: 574938 - protein, 6 aa, Mycobacterium
SASELH

SEQ ID NO: 574939 - protein, 7 aa, Mycobacterium
SASELPS

SEQ ID NO: 574940 - protein, 8 aa, Mycobacterium
SASESALP

SEQ ID NO: 574941 - protein, 6 aa, Mycobacterium
SASESQ

SEQ ID NO: 574942 - protein, 4 aa, Mycobacterium
SASF

SEQ ID NO: 574943 - protein, 5 aa, Mycobacterium
SASFP

SEQ ID NO: 574944 - protein, 7 aa, Mycobacterium
SASFTPS

SEQ ID NO: 574945 - protein, 4 aa, Mycobacterium
SASG

SEQ ID NO: 574946 - protein, 5 aa, Mycobacterium
SASGA

SEQ ID NO: 574947 - protein, 11 aa, Mycobacterium
SASGAAAVPSV

SEQ ID NO: 574948 - protein, 10 aa, Mycobacterium
SASGAEVAEG

SEQ ID NO: 574949 - protein, 8 aa, Mycobacterium
SASGAKLD

SEQ ID NO: 574950 - protein, 13 aa, Mycobacterium
SASGAPIAPGDDG

SEQ ID NO: 574951 - protein, 15 aa, Mycobacterium
SASGAYASAEAQSAP

SEQ ID NO: 574952 - protein, 6 aa, Mycobacterium
SASGFT

SEQ ID NO: 574953 - protein, 8 aa, Mycobacterium
SASGGPLV

SEQ ID NO: 574954 - protein, 16 aa, Mycobacterium
SASGGVFSRLREAFTG

SEQ ID NO: 574955 - protein, 6 aa, Mycobacterium
SASGIS

SEQ ID NO: 574956 - protein, 8 aa, Mycobacterium
SASGKSTI

SEQ ID NO: 574957 - protein, 8 aa, Mycobacterium
SASGKSTV

SEQ ID NO: 574958 - protein, 8 aa, Mycobacterium
SASGLATG

SEQ ID NO: 574959 - protein, 6 aa, Mycobacterium
SASGLY

SEQ ID NO: 574960 - protein, 7 aa, Mycobacterium
SASGPDR

SEQ ID NO: 574961 - protein, 9 aa, Mycobacterium
SASGPQALS

SEQ ID NO: 574962 - protein, 8 aa, Mycobacterium
SASGQLDD

SEQ ID NO: 574963 - protein, 6 aa, Mycobacterium
SASGRL

SEQ ID NO: 574964 - protein, 7 aa, Mycobacterium
SASGRTP

SEQ ID NO: 574965 - protein, 7 aa, Mycobacterium
SASGRTY

SEQ ID NO: 574966 - protein, 9 aa, Mycobacterium
SASGSSTGL

SEQ ID NO: 574967 - protein, 16 aa, Mycobacterium
SASGSSVAKGESLRDT

SEQ ID NO: 574968 - protein, 15 aa, Mycobacterium
SASGSSVSKGESLRD

SEQ ID NO: 574969 - protein, 7 aa, Mycobacterium
SASGVPV

SEQ ID NO: 574970 - protein, 6 aa, Mycobacterium
SASGVQ

SEQ ID NO: 574971 - protein, 5 aa, Mycobacterium
SASGW

SEQ ID NO: 574972 - protein, 15 aa, Mycobacterium
SASHDRRQDRGTETL

SEQ ID NO: 574973 - protein, 8 aa, Mycobacterium
SASHEESA

SEQ ID NO: 574974 - protein, 5 aa, Mycobacterium
SASHK

SEQ ID NO: 574975 - protein, 5 aa, Mycobacterium
SASIS

SEQ ID NO: 574976 - protein, 7 aa, Mycobacterium
SASISGP

SEQ ID NO: 574977 - protein, 5 aa, Mycobacterium
SASKA

SEQ ID NO: 574978 - protein, 9 aa, Mycobacterium
SASKATGQV

SEQ ID NO: 574979 - protein, 11 aa, Mycobacterium
SASKAVTAPVA

SEQ ID NO: 574980 - protein, 6 aa, Mycobacterium
SASKAW

SEQ ID NO: 574981 - protein, 14 aa, Mycobacterium
SASKQPAVSPKTWS

SEQ ID NO: 574982 - protein, 15 aa, Mycobacterium
SASKQPAVSPKTWSG

SEQ ID NO: 574983 - protein, 9 aa, Mycobacterium
SASKSELAQ

SEQ ID NO: 574984 - protein, 8 aa, Mycobacterium
SASKSLAQ

SEQ ID NO: 574985 - protein, 4 aa, Mycobacterium
SASL

SEQ ID NO: 574986 - protein, 5 aa, Mycobacterium
SASLA

SEQ ID NO: 574987 - protein, 7 aa, Mycobacterium
SASLAQD

SEQ ID NO: 574988 - protein, 5 aa, Mycobacterium
SASLG

SEQ ID NO: 574989 - protein, 6 aa, Mycobacterium
SASLGS

SEQ ID NO: 574990 - protein, 6 aa, Mycobacterium
SASLRS

SEQ ID NO: 574991 - protein, 11 aa, Mycobacterium
SASLSGSLSAE

SEQ ID NO: 574992 - protein, 8 aa, Mycobacterium
SASNPLYD

SEQ ID NO: 574993 - protein, 8 aa, Mycobacterium
SASPARTA

SEQ ID NO: 574994 - protein, 6 aa, Mycobacterium
SASPDR

SEQ ID NO: 574995 - protein, 10 aa, Mycobacterium
SASPDTEVTE

SEQ ID NO: 574996 - protein, 13 aa, Mycobacterium
SASPEHTPEPFDA

SEQ ID NO: 574997 - protein, 6 aa, Mycobacterium
SASPEI

SEQ ID NO: 574998 - protein, 7 aa, Mycobacterium
SASPERA

SEQ ID NO: 574999 - protein, 5 aa, Mycobacterium
SASPG

SEQ ID NO: 575000 - protein, 6 aa, Mycobacterium
SASPGF

SEQ ID NO: 575001 - protein, 16 aa, Mycobacterium
SASPKRERAKDATGGL

SEQ ID NO: 575002 - protein, 6 aa, Mycobacterium
SASPRM

SEQ ID NO: 575003 - protein, 16 aa, Mycobacterium
SASPSVRSHTPLPACR

SEQ ID NO: 575004 - protein, 15 aa, Mycobacterium
SASQAAQASVARWRH

SEQ ID NO: 575005 - protein, 19 aa, Mycobacterium
SASQDAEIDRNASLRTSAT

SEQ ID NO: 575006 - protein, 11 aa, Mycobacterium
SASQDAEIQRN

SEQ ID NO: 575007 - protein, 7 aa, Mycobacterium
SASQDVA

SEQ ID NO: 575008 - protein, 7 aa, Mycobacterium
SASQFTR

SEQ ID NO: 575009 - protein, 8 aa, Mycobacterium
SASQGDLA

SEQ ID NO: 575010 - protein, 16 aa, Mycobacterium
SASQGDSAATPPAAEV

SEQ ID NO: 575011 - protein, 6 aa, Mycobacterium
SASQRA

SEQ ID NO: 575012 - protein, 8 aa, Mycobacterium
SASRAPEL

SEQ ID NO: 575013 - protein, 7 aa, Mycobacterium
SASRDDL

SEQ ID NO: 575014 - protein, 7 aa, Mycobacterium
SASRDGL

SEQ ID NO: 575015 - protein, 5 aa, Mycobacterium
SASRF

SEQ ID NO: 575016 - protein, 5 aa, Mycobacterium
SASRG

SEQ ID NO: 575017 - protein, 14 aa, Mycobacterium
SASRHDGCVDDDGR

SEQ ID NO: 575018 - protein, 8 aa, Mycobacterium
SASRPADT

SEQ ID NO: 575019 - protein, 11 aa, Mycobacterium
SASRQAGRQPA

SEQ ID NO: 575020 - protein, 6 aa, Mycobacterium
SASRQG

SEQ ID NO: 575021 - protein, 6 aa, Mycobacterium
SASRQV

SEQ ID NO: 575022 - protein, 6 aa, Mycobacterium
SASRRN

SEQ ID NO: 575023 - protein, 10 aa, Mycobacterium
SASRRRSPGQ

SEQ ID NO: 575024 - protein, 17 aa, Mycobacterium
SASRSPQVSSDAPPSVQ

SEQ ID NO: 575025 - protein, 17 aa, Mycobacterium
SASRSPQVSTDAPPSVQ

SEQ ID NO: 575026 - protein, 6 aa, Mycobacterium
SASRTG

SEQ ID NO: 575027 - protein, 14 aa, Mycobacterium
SASSAINAAPDREA

SEQ ID NO: 575028 - protein, 11 aa, Mycobacterium
SASSANLGPGF

SEQ ID NO: 575029 - protein, 17 aa, Mycobacterium
SASSASYAGAEASNAAQ

SEQ ID NO: 575030 - protein, 15 aa, Mycobacterium
SASSEASELRQIVTV

SEQ ID NO: 575031 - protein, 10 aa, Mycobacterium
SASSFTGGGY

SEQ ID NO: 575032 - protein, 5 aa, Mycobacterium
SASSG

SEQ ID NO: 575033 - protein, 5 aa, Mycobacterium
SASSL

SEQ ID NO: 575034 - protein, 9 aa, Mycobacterium
SASSLTSAD

SEQ ID NO: 575035 - protein, 9 aa, Mycobacterium
SASSPPGNA

SEQ ID NO: 575036 - protein, 6 aa, Mycobacterium
SASSRF

SEQ ID NO: 575037 - protein, 9 aa, Mycobacterium
SASSRMSAD

SEQ ID NO: 575038 - protein, 8 aa, Mycobacterium
SASSTLGT

SEQ ID NO: 575039 - protein, 8 aa, Mycobacterium
SASSTVEA

SEQ ID NO: 575040 - protein, 7 aa, Mycobacterium
SASSVGK

SEQ ID NO: 575041 - protein, 7 aa, Mycobacterium
SASTAGF

SEQ ID NO: 575042 - protein, 9 aa, Mycobacterium
SASTAGFST

SEQ ID NO: 575043 - protein, 7 aa, Mycobacterium
SASTDDR

SEQ ID NO: 575044 - protein, 6 aa, Mycobacterium
SASTDI

SEQ ID NO: 575045 - protein, 8 aa, Mycobacterium
SASTDSVD

SEQ ID NO: 575046 - protein, 9 aa, Mycobacterium
SASTESTVV

SEQ ID NO: 575047 - protein, 7 aa, Mycobacterium
SASTMRP

SEQ ID NO: 575048 - protein, 9 aa, Mycobacterium
SASTPGIGG

SEQ ID NO: 575049 - protein, 5 aa, Mycobacterium
SASTS

SEQ ID NO: 575050 - protein, 37 aa, Mycobacterium
SASTSIPPSDAPIASRPGRHSPTGRDRFRHPEHQLWT

SEQ ID NO: 575051 - protein, 9 aa, Mycobacterium
SASTSRGKA

SEQ ID NO: 575052 - protein, 7 aa, Mycobacterium
SASTTAV

SEQ ID NO: 575053 - protein, 13 aa, Mycobacterium
SASVSNSVSGTMG

SEQ ID NO: 575054 - protein, 7 aa, Mycobacterium
SASWDGE

SEQ ID NO: 575055 - protein, 4 aa, Mycobacterium
SASY

SEQ ID NO: 575056 - protein, 13 aa, Mycobacterium
SASYSPRSGGRAA

SEQ ID NO: 575057 - protein, 7 aa, Mycobacterium
SATAAEE

SEQ ID NO: 575058 - protein, 11 aa, Mycobacterium
SATAANQQSQI

SEQ ID NO: 575059 - protein, 7 aa, Mycobacterium
SATAATL

SEQ ID NO: 575060 - protein, 11 aa, Mycobacterium
SATADFPPATL

SEQ ID NO: 575061 - protein, 12 aa, Mycobacterium
SATADGAPTDAM

SEQ ID NO: 575062 - protein, 9 aa, Mycobacterium
SATADGDGV

SEQ ID NO: 575063 - protein, 11 aa, Mycobacterium
SATAEAHGTAQ

SEQ ID NO: 575064 - protein, 8 aa, Mycobacterium
SATAEGDL

SEQ ID NO: 575065 - protein, 6 aa, Mycobacterium
SATAEL

SEQ ID NO: 575066 - protein, 8 aa, Mycobacterium
SATAESIS

SEQ ID NO: 575067 - protein, 9 aa, Mycobacterium
SATAGAPAH

SEQ ID NO: 575068 - protein, 6 aa, Mycobacterium
SATAGF

SEQ ID NO: 575069 - protein, 14 aa, Mycobacterium
SATAGFSASAGRQP

SEQ ID NO: 575070 - protein, 17 aa, Mycobacterium
SATAGPSRAWDAGPDGR

SEQ ID NO: 575071 - protein, 16 aa, Mycobacterium
SATAGSAGNGGAGGAA

SEQ ID NO: 575072 - protein, 22 aa, Mycobacterium
SATALDGRGAFQDTSGRNGSLD

SEQ ID NO: 575073 - protein, 8 aa, Mycobacterium
SATAPEGT

SEQ ID NO: 575074 - protein, 6 aa, Mycobacterium
SATAPV

SEQ ID NO: 575075 - protein, 10 aa, Mycobacterium
SATAQGRAEL

SEQ ID NO: 575076 - protein, 8 aa, Mycobacterium
SATARTRR

SEQ ID NO: 575077 - protein, 6 aa, Mycobacterium
SATARV

SEQ ID NO: 575078 - protein, 5 aa, Mycobacterium
SATAT

SEQ ID NO: 575079 - protein, 15 aa, Mycobacterium
SATATAEREVAPPRR

SEQ ID NO: 575080 - protein, 8 aa, Mycobacterium
SATATAGI

SEQ ID NO: 575081 - protein, 12 aa, Mycobacterium
SATATPPPTDHE

SEQ ID NO: 575082 - protein, 6 aa, Mycobacterium
SATATS

SEQ ID NO: 575083 - protein, 6 aa, Mycobacterium
SATAVG

SEQ ID NO: 575084 - protein, 22 aa, Mycobacterium
SATAVQAAAAAAAEQGLSTASF

SEQ ID NO: 575085 - protein, 9 aa, Mycobacterium
SATCTGADR

SEQ ID NO: 575086 - protein, 8 aa, Mycobacterium
SATDAESA

SEQ ID NO: 575087 - protein, 10 aa, Mycobacterium
SATDAVADAY

SEQ ID NO: 575088 - protein, 6 aa, Mycobacterium
SATDDR

SEQ ID NO: 575089 - protein, 24 aa, Mycobacterium
SATDGKLSGVAGSEDAEEVDPTVA

SEQ ID NO: 575090 - protein, 7 aa, Mycobacterium
SATDLPF

SEQ ID NO: 575091 - protein, 8 aa, Mycobacterium
SATDLQSV

SEQ ID NO: 575092 - protein, 7 aa, Mycobacterium
SATDLTA

SEQ ID NO: 575093 - protein, 15 aa, Mycobacterium
SATDRRRDAPADGTP

SEQ ID NO: 575094 - protein, 9 aa, Mycobacterium
SATDTLGSE

SEQ ID NO: 575095 - protein, 6 aa, Mycobacterium
SATEAG

SEQ ID NO: 575096 - protein, 11 aa, Mycobacterium
SATEAMPAEAS

SEQ ID NO: 575097 - protein, 7 aa, Mycobacterium
SATEDVA

SEQ ID NO: 575098 - protein, 7 aa, Mycobacterium
SATEEDG

SEQ ID NO: 575099 - protein, 7 aa, Mycobacterium
SATEGVA

SEQ ID NO: 575100 - protein, 8 aa, Mycobacterium
SATEGVPR

SEQ ID NO: 575101 - protein, 23 aa, Mycobacterium
SATEHDNAAGATTAATPTLAGAA

SEQ ID NO: 575102 - protein, 9 aa, Mycobacterium
SATEQPGYR

SEQ ID NO: 575103 - protein, 5 aa, Mycobacterium
SATER

SEQ ID NO: 575104 - protein, 8 aa, Mycobacterium
SATERTRR

SEQ ID NO: 575105 - protein, 8 aa, Mycobacterium
SATESEDV

SEQ ID NO: 575106 - protein, 7 aa, Mycobacterium
SATETDW

SEQ ID NO: 575107 - protein, 8 aa, Mycobacterium
SATFAYPG

SEQ ID NO: 575108 - protein, 5 aa, Mycobacterium
SATGA

SEQ ID NO: 575109 - protein, 13 aa, Mycobacterium
SATGAAVQGHPAE

SEQ ID NO: 575110 - protein, 6 aa, Mycobacterium
SATGAG

SEQ ID NO: 575111 - protein, 8 aa, Mycobacterium
SATGGGVA

SEQ ID NO: 575112 - protein, 9 aa, Mycobacterium
SATGHELGP

SEQ ID NO: 575113 - protein, 42 aa, Mycobacterium
SATGIPVSETQAGKGSLRYDHPQSVGAVGSTGTTAANALASE

SEQ ID NO: 575114 - protein, 23 aa, Mycobacterium
SATGKPVIAGDSGGAPEAVQHNK

SEQ ID NO: 575115 - protein, 7 aa, Mycobacterium
SATGPAK

SEQ ID NO: 575116 - protein, 17 aa, Mycobacterium
SATGPVDDVVAALVRAL

SEQ ID NO: 575117 - protein, 12 aa, Mycobacterium
SATGQEEFPRTD

SEQ ID NO: 575118 - protein, 8 aa, Mycobacterium
SATGQPAH

SEQ ID NO: 575119 - protein, 6 aa, Mycobacterium
SATGRG

SEQ ID NO: 575120 - protein, 8 aa, Mycobacterium
SATGRGAA

SEQ ID NO: 575121 - protein, 7 aa, Mycobacterium
SATGRQS

SEQ ID NO: 575122 - protein, 6 aa, Mycobacterium
SATGRW

SEQ ID NO: 575123 - protein, 6 aa, Mycobacterium
SATGSE

SEQ ID NO: 575124 - protein, 9 aa, Mycobacterium
SATGTAAGA

SEQ ID NO: 575125 - protein, 7 aa, Mycobacterium
SATGYGP

SEQ ID NO: 575126 - protein, 8 aa, Mycobacterium
SATGYGPE

SEQ ID NO: 575127 - protein, 4 aa, Mycobacterium
SATH

SEQ ID NO: 575128 - protein, 12 aa, Mycobacterium
SATHRRPCSGCS

SEQ ID NO: 575129 - protein, 4 aa, Mycobacterium
SATI

SEQ ID NO: 575130 - protein, 5 aa, Mycobacterium
SATIG

SEQ ID NO: 575131 - protein, 9 aa, Mycobacterium
SATINSGGE

SEQ ID NO: 575132 - protein, 17 aa, Mycobacterium
SATIPHSGGRVAGSSNE

SEQ ID NO: 575133 - protein, 5 aa, Mycobacterium
SATIR

SEQ ID NO: 575134 - protein, 8 aa, Mycobacterium
SATKAGIA

SEQ ID NO: 575135 - protein, 9 aa, Mycobacterium
SATKALSGH

SEQ ID NO: 575136 - protein, 8 aa, Mycobacterium
SATKDGNT

SEQ ID NO: 575137 - protein, 5 aa, Mycobacterium
SATKG

SEQ ID NO: 575138 - protein, 6 aa, Mycobacterium
SATKLT

SEQ ID NO: 575139 - protein, 10 aa, Mycobacterium
SATKPTDPFD

SEQ ID NO: 575140 - protein, 8 aa, Mycobacterium
SATKSNGI

SEQ ID NO: 575141 - protein, 10 aa, Mycobacterium
SATLNGKPID

SEQ ID NO: 575142 - protein, 14 aa, Mycobacterium
SATLPPASAAPPQW

SEQ ID NO: 575143 - protein, 10 aa, Mycobacterium
SATLRGDTRG

SEQ ID NO: 575144 - protein, 5 aa, Mycobacterium
SATLT

SEQ ID NO: 575145 - protein, 9 aa, Mycobacterium
SATNDDEGR

SEQ ID NO: 575146 - protein, 10 aa, Mycobacterium
SATNGEAAQR

SEQ ID NO: 575147 - protein, 12 aa, Mycobacterium
SATNKLRTDEGQ

SEQ ID NO: 575148 - protein, 7 aa, Mycobacterium
SATNLAR

SEQ ID NO: 575149 - protein, 5 aa, Mycobacterium
SATNN

SEQ ID NO: 575150 - protein, 5 aa, Mycobacterium
SATNV

SEQ ID NO: 575151 - protein, 7 aa, Mycobacterium
SATPARE

SEQ ID NO: 575152 - protein, 7 aa, Mycobacterium
SATPDAT

SEQ ID NO: 575153 - protein, 9 aa, Mycobacterium
SATPDDSAE

SEQ ID NO: 575154 - protein, 16 aa, Mycobacterium
SATPDLHDSHRGAGTW

SEQ ID NO: 575155 - protein, 7 aa, Mycobacterium
SATPDSV

SEQ ID NO: 575156 - protein, 11 aa, Mycobacterium
SATPEGVSDEQ

SEQ ID NO: 575157 - protein, 13 aa, Mycobacterium
SATPESSTKNRIR

SEQ ID NO: 575158 - protein, 5 aa, Mycobacterium
SATPG

SEQ ID NO: 575159 - protein, 9 aa, Mycobacterium
SATPGLSPL

SEQ ID NO: 575160 - protein, 11 aa, Mycobacterium
SATPGLSTRPA

SEQ ID NO: 575161 - protein, 12 aa, Mycobacterium
SATPGPVSDYTG

SEQ ID NO: 575162 - protein, 10 aa, Mycobacterium
SATPGRADGR

SEQ ID NO: 575163 - protein, 6 aa, Mycobacterium
SATPIY

SEQ ID NO: 575164 - protein, 7 aa, Mycobacterium
SATPIYD

SEQ ID NO: 575165 - protein, 8 aa, Mycobacterium
SATPNDPV

SEQ ID NO: 575166 - protein, 9 aa, Mycobacterium
SATPPGGGV

SEQ ID NO: 575167 - protein, 9 aa, Mycobacterium
SATPPGSGV

SEQ ID NO: 575168 - protein, 7 aa, Mycobacterium
SATPPVA

SEQ ID NO: 575169 - protein, 9 aa, Mycobacterium
SATPQDAGR

SEQ ID NO: 575170 - protein, 7 aa, Mycobacterium
SATPSGA

SEQ ID NO: 575171 - protein, 10 aa, Mycobacterium
SATPTDDSRT

SEQ ID NO: 575172 - protein, 13 aa, Mycobacterium
SATPTDDSVTRQD

SEQ ID NO: 575173 - protein, 21 aa, Mycobacterium
SATPTSPRRQAENCRGKADLG

SEQ ID NO: 575174 - protein, 5 aa, Mycobacterium
SATPV

SEQ ID NO: 575175 - protein, 10 aa, Mycobacterium
SATPVDDKKA

SEQ ID NO: 575176 - protein, 9 aa, Mycobacterium
SATPVPAAS

SEQ ID NO: 575177 - protein, 6 aa, Mycobacterium
SATQDH

SEQ ID NO: 575178 - protein, 5 aa, Mycobacterium
SATQG

SEQ ID NO: 575179 - protein, 6 aa, Mycobacterium
SATQRA

SEQ ID NO: 575180 - protein, 6 aa, Mycobacterium
SATQYP

SEQ ID NO: 575181 - protein, 11 aa, Mycobacterium
SATRAAAAGGV

SEQ ID NO: 575182 - protein, 7 aa, Mycobacterium
SATRAKL

SEQ ID NO: 575183 - protein, 6 aa, Mycobacterium
SATRDD

SEQ ID NO: 575184 - protein, 12 aa, Mycobacterium
SATRDGETTDLG

SEQ ID NO: 575185 - protein, 8 aa, Mycobacterium
SATRGDDA

SEQ ID NO: 575186 - protein, 7 aa, Mycobacterium
SATRGDG

SEQ ID NO: 575187 - protein, 13 aa, Mycobacterium
SATRGEDLPAPAI

SEQ ID NO: 575188 - protein, 9 aa, Mycobacterium
SATRGRRQV

SEQ ID NO: 575189 - protein, 5 aa, Mycobacterium
SATRL

SEQ ID NO: 575190 - protein, 5 aa, Mycobacterium
SATRP

SEQ ID NO: 575191 - protein, 11 aa, Mycobacterium
SATRRKAAKRL

SEQ ID NO: 575192 - protein, 19 aa, Mycobacterium
SATRRVDDSYANGYGNSKW

SEQ ID NO: 575193 - protein, 10 aa, Mycobacterium
SATRSLPAAP

SEQ ID NO: 575194 - protein, 7 aa, Mycobacterium
SATRSPL

SEQ ID NO: 575195 - protein, 6 aa, Mycobacterium
SATRSV

SEQ ID NO: 575196 - protein, 6 aa, Mycobacterium
SATRVA

SEQ ID NO: 575197 - protein, 5 aa, Mycobacterium
SATSA

SEQ ID NO: 575198 - protein, 8 aa, Mycobacterium
SATSAAQH

SEQ ID NO: 575199 - protein, 5 aa, Mycobacterium
SATSD

SEQ ID NO: 575200 - protein, 8 aa, Mycobacterium
SATSGDVT

SEQ ID NO: 575201 - protein, 8 aa, Mycobacterium
SATSGEQL

SEQ ID NO: 575202 - protein, 8 aa, Mycobacterium
SATSGGKK

SEQ ID NO: 575203 - protein, 8 aa, Mycobacterium
SATSGTQL

SEQ ID NO: 575204 - protein, 14 aa, Mycobacterium
SATSLGRDRSFQGS

SEQ ID NO: 575205 - protein, 6 aa, Mycobacterium
SATSMR

SEQ ID NO: 575206 - protein, 8 aa, Mycobacterium
SATSMRNG

SEQ ID NO: 575207 - protein, 8 aa, Mycobacterium
SATSMRSG

SEQ ID NO: 575208 - protein, 7 aa, Mycobacterium
SATSMRT

SEQ ID NO: 575209 - protein, 9 aa, Mycobacterium
SATSNAGGL

SEQ ID NO: 575210 - protein, 11 aa, Mycobacterium
SATSNGDANDA

SEQ ID NO: 575211 - protein, 9 aa, Mycobacterium
SATSPSETV

SEQ ID NO: 575212 - protein, 6 aa, Mycobacterium
SATSSA

SEQ ID NO: 575213 - protein, 4 aa, Mycobacterium
SATT

SEQ ID NO: 575214 - protein, 6 aa, Mycobacterium
SATTAR

SEQ ID NO: 575215 - protein, 9 aa, Mycobacterium
SATTDASPM

SEQ ID NO: 575216 - protein, 8 aa, Mycobacterium
SATTDEEG

SEQ ID NO: 575217 - protein, 7 aa, Mycobacterium
SATTDRI

SEQ ID NO: 575218 - protein, 8 aa, Mycobacterium
SATTEELT

SEQ ID NO: 575219 - protein, 6 aa, Mycobacterium
SATTGV

SEQ ID NO: 575220 - protein, 5 aa, Mycobacterium
SATTH

SEQ ID NO: 575221 - protein, 6 aa, Mycobacterium
SATTQA

SEQ ID NO: 575222 - protein, 10 aa, Mycobacterium
SATTRAGGNM

SEQ ID NO: 575223 - protein, 6 aa, Mycobacterium
SATTRE

SEQ ID NO: 575224 - protein, 6 aa, Mycobacterium
SATTVD

SEQ ID NO: 575225 - protein, 4 aa, Mycobacterium
SATV

SEQ ID NO: 575226 - protein, 6 aa, Mycobacterium
SATVET

SEQ ID NO: 575227 - protein, 8 aa, Mycobacterium
SATVGGAA

SEQ ID NO: 575228 - protein, 10 aa, Mycobacterium
SATVSNAEEF

SEQ ID NO: 575229 - protein, 8 aa, Mycobacterium
SATVTHPA

SEQ ID NO: 575230 - protein, 12 aa, Mycobacterium
SATVTRSRDGRA

SEQ ID NO: 575231 - protein, 4 aa, Mycobacterium
SATY

SEQ ID NO: 575232 - protein, 5 aa, Mycobacterium
SATYE

SEQ ID NO: 575233 - protein, 6 aa, Mycobacterium
SATYPG

SEQ ID NO: 575234 - protein, 8 aa, Mycobacterium
SAVAEPAS

SEQ ID NO: 575235 - protein, 5 aa, Mycobacterium
SAVAG

SEQ ID NO: 575236 - protein, 12 aa, Mycobacterium
SAVAGIDSEAGR

SEQ ID NO: 575237 - protein, 10 aa, Mycobacterium
SAVAGTDGAP

SEQ ID NO: 575238 - protein, 5 aa, Mycobacterium
SAVAP

SEQ ID NO: 575239 - protein, 14 aa, Mycobacterium
SAVAQSARVPVLVV

SEQ ID NO: 575240 - protein, 6 aa, Mycobacterium
SAVASA

SEQ ID NO: 575241 - protein, 11 aa, Mycobacterium
SAVDDTSEQQY

SEQ ID NO: 575242 - protein, 8 aa, Mycobacterium
SAVDGDNA

SEQ ID NO: 575243 - protein, 6 aa, Mycobacterium
SAVDNK

SEQ ID NO: 575244 - protein, 6 aa, Mycobacterium
SAVDNP

SEQ ID NO: 575245 - protein, 11 aa, Mycobacterium
SAVDPEHRTVT

SEQ ID NO: 575246 - protein, 8 aa, Mycobacterium
SAVDSGVD

SEQ ID NO: 575247 - protein, 7 aa, Mycobacterium
SAVDTGG

SEQ ID NO: 575248 - protein, 8 aa, Mycobacterium
SAVEEAEQ

SEQ ID NO: 575249 - protein, 8 aa, Mycobacterium
SAVEPDSM

SEQ ID NO: 575250 - protein, 4 aa, Mycobacterium
SAVG

SEQ ID NO: 575251 - protein, 12 aa, Mycobacterium
SAVGAQPTGIET

SEQ ID NO: 575252 - protein, 6 aa, Mycobacterium
SAVGAS

SEQ ID NO: 575253 - protein, 7 aa, Mycobacterium
SAVGATY

SEQ ID NO: 575254 - protein, 5 aa, Mycobacterium
SAVGD

SEQ ID NO: 575255 - protein, 22 aa, Mycobacterium
SAVGGSGGNGGHGGTSTLNGQQ

SEQ ID NO: 575256 - protein, 8 aa, Mycobacterium
SAVGPDAA

SEQ ID NO: 575257 - protein, 6 aa, Mycobacterium
SAVGRD

SEQ ID NO: 575258 - protein, 7 aa, Mycobacterium
SAVGSQR

SEQ ID NO: 575259 - protein, 13 aa, Mycobacterium
SAVKERKGSVQSP

SEQ ID NO: 575260 - protein, 5 aa, Mycobacterium
SAVKG

SEQ ID NO: 575261 - protein, 4 aa, Mycobacterium
SAVM

SEQ ID NO: 575262 - protein, 23 aa, Mycobacterium
SAVNDRNDYAGPGTGYRPSGARW

SEQ ID NO: 575263 - protein, 7 aa, Mycobacterium
SAVNGLT

SEQ ID NO: 575264 - protein, 22 aa, Mycobacterium
SAVNQDGASSGLTVPNGGAQQR

SEQ ID NO: 575265 - protein, 21 aa, Mycobacterium
SAVNQDGASSGQTVPNGPAQQ

SEQ ID NO: 575266 - protein, 21 aa, Mycobacterium
SAVNQDGASSGVTVPNGPAQQ

SEQ ID NO: 575267 - protein, 12 aa, Mycobacterium
SAVNQDGRSNGL

SEQ ID NO: 575268 - protein, 22 aa, Mycobacterium
SAVNQDGRSNGLTAPNAPSQRD

SEQ ID NO: 575269 - protein, 19 aa, Mycobacterium
SAVNQDGRSNGVTAPNTAA

SEQ ID NO: 575270 - protein, 4 aa, Mycobacterium
SAVP

SEQ ID NO: 575271 - protein, 5 aa, Mycobacterium
SAVPD

SEQ ID NO: 575272 - protein, 19 aa, Mycobacterium
SAVPDGVSPTEVPAPMPPE

SEQ ID NO: 575273 - protein, 10 aa, Mycobacterium
SAVPDVAAGD

SEQ ID NO: 575274 - protein, 13 aa, Mycobacterium
SAVPERSGGGKIR

SEQ ID NO: 575275 - protein, 7 aa, Mycobacterium
SAVPGAA

SEQ ID NO: 575276 - protein, 12 aa, Mycobacterium
SAVPNYPAEDGV

SEQ ID NO: 575277 - protein, 6 aa, Mycobacterium
SAVPQQ

SEQ ID NO: 575278 - protein, 7 aa, Mycobacterium
SAVPQTA

SEQ ID NO: 575279 - protein, 6 aa, Mycobacterium
SAVPST

SEQ ID NO: 575280 - protein, 16 aa, Mycobacterium
SAVPTAEKADRGNPGH

SEQ ID NO: 575281 - protein, 7 aa, Mycobacterium
SAVPTTF

SEQ ID NO: 575282 - protein, 5 aa, Mycobacterium
SAVQA

SEQ ID NO: 575283 - protein, 14 aa, Mycobacterium
SAVRSAAGTDLTTP

SEQ ID NO: 575284 - protein, 12 aa, Mycobacterium
SAVRSSSDGQVS

SEQ ID NO: 575285 - protein, 25 aa, Mycobacterium
SAVSAQSAAAVAPTTSVAPAAADQV

SEQ ID NO: 575286 - protein, 6 aa, Mycobacterium
SAVSEE

SEQ ID NO: 575287 - protein, 5 aa, Mycobacterium
SAVSG

SEQ ID NO: 575288 - protein, 6 aa, Mycobacterium
SAVSGA

SEQ ID NO: 575289 - protein, 5 aa, Mycobacterium
SAVSQ

SEQ ID NO: 575290 - protein, 19 aa, Mycobacterium
SAVSQSQRPGHRAPSTPLQ

SEQ ID NO: 575291 - protein, 5 aa, Mycobacterium
SAVSS

SEQ ID NO: 575292 - protein, 11 aa, Mycobacterium
SAVSSKASDIG

SEQ ID NO: 575293 - protein, 8 aa, Mycobacterium
SAVSTANV

SEQ ID NO: 575294 - protein, 14 aa, Mycobacterium
SAVSTASRAAAGPT

SEQ ID NO: 575295 - protein, 6 aa, Mycobacterium
SAVTDR

SEQ ID NO: 575296 - protein, 5 aa, Mycobacterium
SAVTE

SEQ ID NO: 575297 - protein, 12 aa, Mycobacterium
SAVTEAEIREHL

SEQ ID NO: 575298 - protein, 9 aa, Mycobacterium
SAVTEGDEL

SEQ ID NO: 575299 - protein, 9 aa, Mycobacterium
SAVTEVPPE

SEQ ID NO: 575300 - protein, 19 aa, Mycobacterium
SAVTNRKQLSDKISEHRRQ

SEQ ID NO: 575301 - protein, 8 aa, Mycobacterium
SAVTPRLT

SEQ ID NO: 575302 - protein, 6 aa, Mycobacterium
SAVTQR

SEQ ID NO: 575303 - protein, 6 aa, Mycobacterium
SAVTSE

SEQ ID NO: 575304 - protein, 8 aa, Mycobacterium
SAVTSEVR

SEQ ID NO: 575305 - protein, 13 aa, Mycobacterium
SAWDRATGRLPAD

SEQ ID NO: 575306 - protein, 9 aa, Mycobacterium
SAWETADST

SEQ ID NO: 575307 - protein, 10 aa, Mycobacterium
SAWGGNPEKD

SEQ ID NO: 575308 - protein, 16 aa, Mycobacterium
SAWGTSEWHRARVLEA

SEQ ID NO: 575309 - protein, 13 aa, Mycobacterium
SAWPERSAPNTAD

SEQ ID NO: 575310 - protein, 10 aa, Mycobacterium
SAWPGKLEPT

SEQ ID NO: 575311 - protein, 14 aa, Mycobacterium
SAWPGSDDSAFDSD

SEQ ID NO: 575312 - protein, 16 aa, Mycobacterium
SAWRPDPGRGGDRDAP

SEQ ID NO: 575313 - protein, 11 aa, Mycobacterium
SAYADQAEARG

SEQ ID NO: 575314 - protein, 13 aa, Mycobacterium
SAYADQAEARGAW

SEQ ID NO: 575315 - protein, 14 aa, Mycobacterium
SAYAEAAETRGAWD

SEQ ID NO: 575316 - protein, 6 aa, Mycobacterium
SAYAGA

SEQ ID NO: 575317 - protein, 207 aa, Mycobacterium
SAYAGDGGYGGDGGTGATGGTGSDGGAGGAGGAGGLYGNGGNGGTGGTGGDGGTGATGGTGGTGGNGGDSTGNSLSSLPGNGGDGGDGGTGGTGGTGGSGGDGGAAGAGGTYGQSGTNGTGGAAGSGGEGGAGGTGGDGGSGGVTYDSDYNPGPPYGTSGQSGATGATGATGQAGMAGTTPGTGTPGPGGDGGDGTGGNGGNGGPGF

SEQ ID NO: 575318 - protein, 18 aa, Mycobacterium
SAYAGGATLDEQTARGHD

SEQ ID NO: 575319 - protein, 7 aa, Mycobacterium
SAYAGGV

SEQ ID NO: 575320 - protein, 14 aa, Mycobacterium
SAYANAAEARGTWD

SEQ ID NO: 575321 - protein, 5 aa, Mycobacterium
SAYAS

SEQ ID NO: 575322 - protein, 9 aa, Mycobacterium
SAYATKGAR

SEQ ID NO: 575323 - protein, 4 aa, Mycobacterium
SAYD

SEQ ID NO: 575324 - protein, 10 aa, Mycobacterium
SAYDNETRHS

SEQ ID NO: 575325 - protein, 5 aa, Mycobacterium
SAYES

SEQ ID NO: 575326 - protein, 9 aa, Mycobacterium
SAYESGGAR

SEQ ID NO: 575327 - protein, 6 aa, Mycobacterium
SAYGES

SEQ ID NO: 575328 - protein, 6 aa, Mycobacterium
SAYGQS

SEQ ID NO: 575329 - protein, 7 aa, Mycobacterium
SAYGTGD

SEQ ID NO: 575330 - protein, 11 aa, Mycobacterium
SAYGTGDARAA

SEQ ID NO: 575331 - protein, 7 aa, Mycobacterium
SAYHSAA

SEQ ID NO: 575332 - protein, 11 aa, Mycobacterium
SAYKSQRKPLQ

SEQ ID NO: 575333 - protein, 7 aa, Mycobacterium
SAYNDPQ

SEQ ID NO: 575334 - protein, 6 aa, Mycobacterium
SAYNDT

SEQ ID NO: 575335 - protein, 6 aa, Mycobacterium
SAYPAE

SEQ ID NO: 575336 - protein, 6 aa, Mycobacterium
SAYPAT

SEQ ID NO: 575337 - protein, 20 aa, Mycobacterium
SAYPDGVADHDRPLASRGIR

SEQ ID NO: 575338 - protein, 6 aa, Mycobacterium
SAYPDT

SEQ ID NO: 575339 - protein, 13 aa, Mycobacterium
SAYPPGVDDHQRP

SEQ ID NO: 575340 - protein, 7 aa, Mycobacterium
SAYPTTE

SEQ ID NO: 575341 - protein, 24 aa, Mycobacterium
SAYQEQKNAPEPSVVVPLDGKVTT

SEQ ID NO: 575342 - protein, 7 aa, Mycobacterium
SAYQPPW

SEQ ID NO: 575343 - protein, 7 aa, Mycobacterium
SAYQQAA

SEQ ID NO: 575344 - protein, 6 aa, Mycobacterium
SAYRDG

SEQ ID NO: 575345 - protein, 10 aa, Mycobacterium
SAYRDRDNSK

SEQ ID NO: 575346 - protein, 14 aa, Mycobacterium
SAYRGPVPDMPEPV

SEQ ID NO: 575347 - protein, 13 aa, Mycobacterium
SAYRNSREGRDAQ

SEQ ID NO: 575348 - protein, 5 aa, Mycobacterium
SAYSG

SEQ ID NO: 575349 - protein, 6 aa, Mycobacterium
SAYSGV

SEQ ID NO: 575350 - protein, 11 aa, Mycobacterium
SAYTATEDQQQ

SEQ ID NO: 575351 - protein, 13 aa, Mycobacterium
SCAAPGVPAESGS

SEQ ID NO: 575352 - protein, 6 aa, Mycobacterium
SCADDA

SEQ ID NO: 575353 - protein, 6 aa, Mycobacterium
SCADKR

SEQ ID NO: 575354 - protein, 7 aa, Mycobacterium
SCADSSS

SEQ ID NO: 575355 - protein, 5 aa, Mycobacterium
SCAGA

SEQ ID NO: 575356 - protein, 5 aa, Mycobacterium
SCAGH

SEQ ID NO: 575357 - protein, 6 aa, Mycobacterium
SCAPGV

SEQ ID NO: 575358 - protein, 18 aa, Mycobacterium
SCATAQDCTGRVTSDQGW

SEQ ID NO: 575359 - protein, 7 aa, Mycobacterium
SCATGHD

SEQ ID NO: 575360 - protein, 6 aa, Mycobacterium
SCDGDS

SEQ ID NO: 575361 - protein, 10 aa, Mycobacterium
SCDSKSAQEL

SEQ ID NO: 575362 - protein, 7 aa, Mycobacterium
SCEAAGQ

SEQ ID NO: 575363 - protein, 7 aa, Mycobacterium
SCEEAGQ

SEQ ID NO: 575364 - protein, 7 aa, Mycobacterium
SCEEPGQ

SEQ ID NO: 575365 - protein, 7 aa, Mycobacterium
SCESGGN

SEQ ID NO: 575366 - protein, 4 aa, Mycobacterium
SCGD

SEQ ID NO: 575367 - protein, 5 aa, Mycobacterium
SCGDG

SEQ ID NO: 575368 - protein, 7 aa, Mycobacterium
SCGGSGW

SEQ ID NO: 575369 - protein, 13 aa, Mycobacterium
SCGRGEYRRCSSN

SEQ ID NO: 575370 - protein, 7 aa, Mycobacterium
SCGSDDL

SEQ ID NO: 575371 - protein, 9 aa, Mycobacterium
SCGTKPEAP

SEQ ID NO: 575372 - protein, 11 aa, Mycobacterium
SCGTNSNATRI

SEQ ID NO: 575373 - protein, 5 aa, Mycobacterium
SCNGR

SEQ ID NO: 575374 - protein, 6 aa, Mycobacterium
SCNPTG

SEQ ID NO: 575375 - protein, 10 aa, Mycobacterium
SCNSSKCNAE

SEQ ID NO: 575376 - protein, 4 aa, Mycobacterium
SCPE

SEQ ID NO: 575377 - protein, 13 aa, Mycobacterium
SCPGAPLARAEGR

SEQ ID NO: 575378 - protein, 6 aa, Mycobacterium
SCPGKS

SEQ ID NO: 575379 - protein, 13 aa, Mycobacterium
SCPKKNEISDRVS

SEQ ID NO: 575380 - protein, 13 aa, Mycobacterium
SCPKNNGRVTVRR

SEQ ID NO: 575381 - protein, 6 aa, Mycobacterium
SCPPEN

SEQ ID NO: 575382 - protein, 6 aa, Mycobacterium
SCPPGP

SEQ ID NO: 575383 - protein, 6 aa, Mycobacterium
SCPPGR

SEQ ID NO: 575384 - protein, 5 aa, Mycobacterium
SCPPQ

SEQ ID NO: 575385 - protein, 4 aa, Mycobacterium
SCPQ

SEQ ID NO: 575386 - protein, 6 aa, Mycobacterium
SCPQCS

SEQ ID NO: 575387 - protein, 7 aa, Mycobacterium
SCQDRQA

SEQ ID NO: 575388 - protein, 8 aa, Mycobacterium
SCQSDDAR

SEQ ID NO: 575389 - protein, 7 aa, Mycobacterium
SCRQETG

SEQ ID NO: 575390 - protein, 15 aa, Mycobacterium
SCRSSAEKGGASFYE

SEQ ID NO: 575391 - protein, 20 aa, Mycobacterium
SCSGNDSLMSESTMRRTSRT

SEQ ID NO: 575392 - protein, 7 aa, Mycobacterium
SCSHEGP

SEQ ID NO: 575393 - protein, 11 aa, Mycobacterium
SCSRGDGPVGS

SEQ ID NO: 575394 - protein, 8 aa, Mycobacterium
SCTDEQAR

SEQ ID NO: 575395 - protein, 12 aa, Mycobacterium
SCTHQGPKFHDP

SEQ ID NO: 575396 - protein, 5 aa, Mycobacterium
SCTNG

SEQ ID NO: 575397 - protein, 8 aa, Mycobacterium
SCTPDPAR

SEQ ID NO: 575398 - protein, 5 aa, Mycobacterium
SCTPE

SEQ ID NO: 575399 - protein, 6 aa, Mycobacterium
SCTPGE

SEQ ID NO: 575400 - protein, 8 aa, Mycobacterium
SCTPRNPL

SEQ ID NO: 575401 - protein, 13 aa, Mycobacterium
SCTRPDAQAKSFG

SEQ ID NO: 575402 - protein, 10 aa, Mycobacterium
SCTSAGTSCG

SEQ ID NO: 575403 - protein, 13 aa, Mycobacterium
SCVSGADALPGAA

SEQ ID NO: 575404 - protein, 6 aa, Mycobacterium
SDAAAA

SEQ ID NO: 575405 - protein, 17 aa, Mycobacterium
SDAAAANRGIGGTGAWD

SEQ ID NO: 575406 - protein, 12 aa, Mycobacterium
SDAAAGKKSRKT

SEQ ID NO: 575407 - protein, 6 aa, Mycobacterium
SDAAAI

SEQ ID NO: 575408 - protein, 8 aa, Mycobacterium
SDAAASLA

SEQ ID NO: 575409 - protein, 11 aa, Mycobacterium
SDAAAYDAASE

SEQ ID NO: 575410 - protein, 9 aa, Mycobacterium
SDAADGHDR

SEQ ID NO: 575411 - protein, 6 aa, Mycobacterium
SDAAEC

SEQ ID NO: 575412 - protein, 9 aa, Mycobacterium
SDAAEDQQR

SEQ ID NO: 575413 - protein, 12 aa, Mycobacterium
SDAAGAPNGVAT

SEQ ID NO: 575414 - protein, 7 aa, Mycobacterium
SDAAGRS

SEQ ID NO: 575415 - protein, 6 aa, Mycobacterium
SDAAMA

SEQ ID NO: 575416 - protein, 10 aa, Mycobacterium
SDAANPAAHR

SEQ ID NO: 575417 - protein, 14 aa, Mycobacterium
SDAAQAAMATEEDT

SEQ ID NO: 575418 - protein, 13 aa, Mycobacterium
SDAAQARAAAESL

SEQ ID NO: 575419 - protein, 12 aa, Mycobacterium
SDAAQQQETAAL

SEQ ID NO: 575420 - protein, 13 aa, Mycobacterium
SDAARRAETPVRE

SEQ ID NO: 575421 - protein, 6 aa, Mycobacterium
SDAART

SEQ ID NO: 575422 - protein, 10 aa, Mycobacterium
SDAATGTPEQ

SEQ ID NO: 575423 - protein, 7 aa, Mycobacterium
SDAATTR

SEQ ID NO: 575424 - protein, 8 aa, Mycobacterium
SDAAVPDR

SEQ ID NO: 575425 - protein, 5 aa, Mycobacterium
SDADA

SEQ ID NO: 575426 - protein, 7 aa, Mycobacterium
SDADAAN

SEQ ID NO: 575427 - protein, 8 aa, Mycobacterium
SDADADEV

SEQ ID NO: 575428 - protein, 13 aa, Mycobacterium
SDADADSPHVSEA

SEQ ID NO: 575429 - protein, 18 aa, Mycobacterium
SDADAPALEEPLEKSDVR

SEQ ID NO: 575430 - protein, 7 aa, Mycobacterium
SDADARA

SEQ ID NO: 575431 - protein, 8 aa, Mycobacterium
SDADDGVA

SEQ ID NO: 575432 - protein, 7 aa, Mycobacterium
SDADEAE

SEQ ID NO: 575433 - protein, 16 aa, Mycobacterium
SDADEAGDDETGTPEL

SEQ ID NO: 575434 - protein, 7 aa, Mycobacterium
SDADEHG

SEQ ID NO: 575435 - protein, 8 aa, Mycobacterium
SDADERGM

SEQ ID NO: 575436 - protein, 14 aa, Mycobacterium
SDADESGKVPGTDL

SEQ ID NO: 575437 - protein, 38 aa, Mycobacterium
SDADESRDVDSPTKPMPARQPKPPKTSSPNSAVPAPAI

SEQ ID NO: 575438 - protein, 5 aa, Mycobacterium
SDADG

SEQ ID NO: 575439 - protein, 11 aa, Mycobacterium
SDADGTSVPAG

SEQ ID NO: 575440 - protein, 11 aa, Mycobacterium
SDADHRDSARP

SEQ ID NO: 575441 - protein, 14 aa, Mycobacterium
SDADHRDSARPELQ

SEQ ID NO: 575442 - protein, 5 aa, Mycobacterium
SDADI

SEQ ID NO: 575443 - protein, 18 aa, Mycobacterium
SDADKTGWVSAAESTYYP

SEQ ID NO: 575444 - protein, 5 aa, Mycobacterium
SDADL

SEQ ID NO: 575445 - protein, 14 aa, Mycobacterium
SDADLDVPGAPRSL

SEQ ID NO: 575446 - protein, 6 aa, Mycobacterium
SDADLP

SEQ ID NO: 575447 - protein, 12 aa, Mycobacterium
SDADLRAKTDEF

SEQ ID NO: 575448 - protein, 5 aa, Mycobacterium
SDADN

SEQ ID NO: 575449 - protein, 10 aa, Mycobacterium
SDADPAGGNR

SEQ ID NO: 575450 - protein, 10 aa, Mycobacterium
SDADPGRRHR

SEQ ID NO: 575451 - protein, 19 aa, Mycobacterium
SDADQDGPPLRSTPSQRSG

SEQ ID NO: 575452 - protein, 8 aa, Mycobacterium
SDADQPPL

SEQ ID NO: 575453 - protein, 9 aa, Mycobacterium
SDADRARLT

SEQ ID NO: 575454 - protein, 8 aa, Mycobacterium
SDADRDEE

SEQ ID NO: 575455 - protein, 6 aa, Mycobacterium
SDADRM

SEQ ID NO: 575456 - protein, 14 aa, Mycobacterium
SDADVRTAYGRQAA

SEQ ID NO: 575457 - protein, 4 aa, Mycobacterium
SDAE

SEQ ID NO: 575458 - protein, 6 aa, Mycobacterium
SDAEAA

SEQ ID NO: 575459 - protein, 8 aa, Mycobacterium
SDAEAAPM

SEQ ID NO: 575460 - protein, 7 aa, Mycobacterium
SDAEDAA

SEQ ID NO: 575461 - protein, 8 aa, Mycobacterium
SDAEDFTD

SEQ ID NO: 575462 - protein, 9 aa, Mycobacterium
SDAEEAAYQ

SEQ ID NO: 575463 - protein, 7 aa, Mycobacterium
SDAEEKL

SEQ ID NO: 575464 - protein, 8 aa, Mycobacterium
SDAEEPRT

SEQ ID NO: 575465 - protein, 10 aa, Mycobacterium
SDAEGAEGAP

SEQ ID NO: 575466 - protein, 9 aa, Mycobacterium
SDAEGNTVA

SEQ ID NO: 575467 - protein, 15 aa, Mycobacterium
SDAELQAKTGEFKGR

SEQ ID NO: 575468 - protein, 7 aa, Mycobacterium
SDAELTP

SEQ ID NO: 575469 - protein, 7 aa, Mycobacterium
SDAEPGR

SEQ ID NO: 575470 - protein, 14 aa, Mycobacterium
SDAEPLTSAFGPRT

SEQ ID NO: 575471 - protein, 8 aa, Mycobacterium
SDAEQAAA

SEQ ID NO: 575472 - protein, 6 aa, Mycobacterium
SDAEQL

SEQ ID NO: 575473 - protein, 7 aa, Mycobacterium
SDAERCA

SEQ ID NO: 575474 - protein, 9 aa, Mycobacterium
SDAERDALT

SEQ ID NO: 575475 - protein, 21 aa, Mycobacterium
SDAESQDLASSIETLRRNAGD

SEQ ID NO: 575476 - protein, 6 aa, Mycobacterium
SDAEVN

SEQ ID NO: 575477 - protein, 5 aa, Mycobacterium
SDAFA

SEQ ID NO: 575478 - protein, 6 aa, Mycobacterium
SDAFHS

SEQ ID NO: 575479 - protein, 7 aa, Mycobacterium
SDAFTGA

SEQ ID NO: 575480 - protein, 5 aa, Mycobacterium
SDAGA

SEQ ID NO: 575481 - protein, 8 aa, Mycobacterium
SDAGATAV

SEQ ID NO: 575482 - protein, 8 aa, Mycobacterium
SDAGCTNR

SEQ ID NO: 575483 - protein, 8 aa, Mycobacterium
SDAGDLGP

SEQ ID NO: 575484 - protein, 8 aa, Mycobacterium
SDAGDPYG

SEQ ID NO: 575485 - protein, 12 aa, Mycobacterium
SDAGDRDANEAD

SEQ ID NO: 575486 - protein, 6 aa, Mycobacterium
SDAGEQ

SEQ ID NO: 575487 - protein, 15 aa, Mycobacterium
SDAGESPEQAARRGG

SEQ ID NO: 575488 - protein, 14 aa, Mycobacterium
SDAGEVRLDPSGSG

SEQ ID NO: 575489 - protein, 15 aa, Mycobacterium
SDAGGAAGSTGGGRV

SEQ ID NO: 575490 - protein, 7 aa, Mycobacterium
SDAGGDS

SEQ ID NO: 575491 - protein, 17 aa, Mycobacterium
SDAGGQPAGLGARDTLR

SEQ ID NO: 575492 - protein, 9 aa, Mycobacterium
SDAGHGDSI

SEQ ID NO: 575493 - protein, 6 aa, Mycobacterium
SDAGIS

SEQ ID NO: 575494 - protein, 6 aa, Mycobacterium
SDAGKS

SEQ ID NO: 575495 - protein, 5 aa, Mycobacterium
SDAGL

SEQ ID NO: 575496 - protein, 8 aa, Mycobacterium
SDAGQQRL

SEQ ID NO: 575497 - protein, 8 aa, Mycobacterium
SDAGQRRL

SEQ ID NO: 575498 - protein, 10 aa, Mycobacterium
SDAGRGNAEP

SEQ ID NO: 575499 - protein, 6 aa, Mycobacterium
SDAGRI

SEQ ID NO: 575500 - protein, 8 aa, Mycobacterium
SDAGRQKL

SEQ ID NO: 575501 - protein, 18 aa, Mycobacterium
SDAGRVGSAGESIYAGAK

SEQ ID NO: 575502 - protein, 19 aa, Mycobacterium
SDAGRVGSAGESIYAGAKG

SEQ ID NO: 575503 - protein, 11 aa, Mycobacterium
SDAGSHAPPWP

SEQ ID NO: 575504 - protein, 9 aa, Mycobacterium
SDAGSQGGF

SEQ ID NO: 575505 - protein, 8 aa, Mycobacterium
SDAGSTVE

SEQ ID NO: 575506 - protein, 21 aa, Mycobacterium
SDAGTAGSDRRGRNAPGETRV

SEQ ID NO: 575507 - protein, 7 aa, Mycobacterium
SDAGVDP

SEQ ID NO: 575508 - protein, 31 aa, Mycobacterium
SDAHGGGSNPTHGGAISSTRKEDATDWGPFG

SEQ ID NO: 575509 - protein, 18 aa, Mycobacterium
SDAHNKANIGRDTETSVA

SEQ ID NO: 575510 - protein, 6 aa, Mycobacterium
SDAIDT

SEQ ID NO: 575511 - protein, 4 aa, Mycobacterium
SDAK

SEQ ID NO: 575512 - protein, 21 aa, Mycobacterium
SDAKAGKDAAELAGLPDPTGV

SEQ ID NO: 575513 - protein, 9 aa, Mycobacterium
SDAKDGADL

SEQ ID NO: 575514 - protein, 21 aa, Mycobacterium
SDAKLPDDVRPGNPASVQGRP

SEQ ID NO: 575515 - protein, 15 aa, Mycobacterium
SDAKPAERRIPIRRA

SEQ ID NO: 575516 - protein, 9 aa, Mycobacterium
SDAKQAITA

SEQ ID NO: 575517 - protein, 10 aa, Mycobacterium
SDAKSQADRM

SEQ ID NO: 575518 - protein, 28 aa, Mycobacterium
SDAKTASNSESENPAIDSPEPKSHAPLT

SEQ ID NO: 575519 - protein, 9 aa, Mycobacterium
SDALGRAAE

SEQ ID NO: 575520 - protein, 9 aa, Mycobacterium
SDALGRAAQ

SEQ ID NO: 575521 - protein, 7 aa, Mycobacterium
SDALGSA

SEQ ID NO: 575522 - protein, 14 aa, Mycobacterium
SDALPLTARDPRRV

SEQ ID NO: 575523 - protein, 6 aa, Mycobacterium
SDALRG

SEQ ID NO: 575524 - protein, 5 aa, Mycobacterium
SDANE

SEQ ID NO: 575525 - protein, 5 aa, Mycobacterium
SDANG

SEQ ID NO: 575526 - protein, 6 aa, Mycobacterium
SDANYG

SEQ ID NO: 575527 - protein, 8 aa, Mycobacterium
SDAPAASW

SEQ ID NO: 575528 - protein, 11 aa, Mycobacterium
SDAPADFKADS

SEQ ID NO: 575529 - protein, 7 aa, Mycobacterium
SDAPAEL

SEQ ID NO: 575530 - protein, 7 aa, Mycobacterium
SDAPATL

SEQ ID NO: 575531 - protein, 8 aa, Mycobacterium
SDAPAVPA

SEQ ID NO: 575532 - protein, 6 aa, Mycobacterium
SDAPDG

SEQ ID NO: 575533 - protein, 7 aa, Mycobacterium
SDAPDYS

SEQ ID NO: 575534 - protein, 6 aa, Mycobacterium
SDAPEG

SEQ ID NO: 575535 - protein, 16 aa, Mycobacterium
SDAPEQPGAPREPRVN

SEQ ID NO: 575536 - protein, 10 aa, Mycobacterium
SDAPGDAASE

SEQ ID NO: 575537 - protein, 13 aa, Mycobacterium
SDAPGRDREEVEA

SEQ ID NO: 575538 - protein, 7 aa, Mycobacterium
SDAPGVA

SEQ ID NO: 575539 - protein, 10 aa, Mycobacterium
SDAPLDETGC

SEQ ID NO: 575540 - protein, 7 aa, Mycobacterium
SDAPPAL

SEQ ID NO: 575541 - protein, 9 aa, Mycobacterium
SDAPQQSAL

SEQ ID NO: 575542 - protein, 9 aa, Mycobacterium
SDAPRDDAA

SEQ ID NO: 575543 - protein, 7 aa, Mycobacterium
SDAPRSI

SEQ ID NO: 575544 - protein, 9 aa, Mycobacterium
SDAPTNEQA

SEQ ID NO: 575545 - protein, 7 aa, Mycobacterium
SDAPTVE

SEQ ID NO: 575546 - protein, 5 aa, Mycobacterium
SDAPV

SEQ ID NO: 575547 - protein, 7 aa, Mycobacterium
SDAPVTG

SEQ ID NO: 575548 - protein, 8 aa, Mycobacterium
SDAPVTGL

SEQ ID NO: 575549 - protein, 7 aa, Mycobacterium
SDAPVTP

SEQ ID NO: 575550 - protein, 9 aa, Mycobacterium
SDAQAEAKA

SEQ ID NO: 575551 - protein, 7 aa, Mycobacterium
SDAQGAR

SEQ ID NO: 575552 - protein, 8 aa, Mycobacterium
SDAQRDGD

SEQ ID NO: 575553 - protein, 8 aa, Mycobacterium
SDAQRDGN

SEQ ID NO: 575554 - protein, 17 aa, Mycobacterium
SDAQRRARWEAEVPEPP

SEQ ID NO: 575555 - protein, 8 aa, Mycobacterium
SDAQRSGD

SEQ ID NO: 575556 - protein, 9 aa, Mycobacterium
SDAQSARSV

SEQ ID NO: 575557 - protein, 6 aa, Mycobacterium
SDAQVR

SEQ ID NO: 575558 - protein, 4 aa, Mycobacterium
SDAR

SEQ ID NO: 575559 - protein, 7 aa, Mycobacterium
SDARAKA

SEQ ID NO: 575560 - protein, 9 aa, Mycobacterium
SDARAQAEA

SEQ ID NO: 575561 - protein, 6 aa, Mycobacterium
SDARHT

SEQ ID NO: 575562 - protein, 9 aa, Mycobacterium
SDARPLGAV

SEQ ID NO: 575563 - protein, 8 aa, Mycobacterium
SDARQQLP

SEQ ID NO: 575564 - protein, 8 aa, Mycobacterium
SDARRDGD

SEQ ID NO: 575565 - protein, 9 aa, Mycobacterium
SDARRDGDP

SEQ ID NO: 575566 - protein, 6 aa, Mycobacterium
SDASAN

SEQ ID NO: 575567 - protein, 5 aa, Mycobacterium
SDASD

SEQ ID NO: 575568 - protein, 10 aa, Mycobacterium
SDASFSDGVD

SEQ ID NO: 575569 - protein, 15 aa, Mycobacterium
SDASHAKSNGQSPRA

SEQ ID NO: 575570 - protein, 14 aa, Mycobacterium
SDASHSKAAGLTPR

SEQ ID NO: 575571 - protein, 13 aa, Mycobacterium
SDASHSKANGACA

SEQ ID NO: 575572 - protein, 6 aa, Mycobacterium
SDASKQ

SEQ ID NO: 575573 - protein, 19 aa, Mycobacterium
SDASNTPAVRLPSPAKGID

SEQ ID NO: 575574 - protein, 6 aa, Mycobacterium
SDASQQ

SEQ ID NO: 575575 - protein, 8 aa, Mycobacterium
SDASRNRR

SEQ ID NO: 575576 - protein, 14 aa, Mycobacterium
SDASRRWTIKAVRN

SEQ ID NO: 575577 - protein, 18 aa, Mycobacterium
SDASRYPAEFSGGQKQRI

SEQ ID NO: 575578 - protein, 7 aa, Mycobacterium
SDASYAD

SEQ ID NO: 575579 - protein, 4 aa, Mycobacterium
SDAT

SEQ ID NO: 575580 - protein, 7 aa, Mycobacterium
SDATADQ

SEQ ID NO: 575581 - protein, 8 aa, Mycobacterium
SDATDTAL

SEQ ID NO: 575582 - protein, 6 aa, Mycobacterium
SDATED

SEQ ID NO: 575583 - protein, 8 aa, Mycobacterium
SDATGGAV

SEQ ID NO: 575584 - protein, 7 aa, Mycobacterium
SDATGRA

SEQ ID NO: 575585 - protein, 5 aa, Mycobacterium
SDATH

SEQ ID NO: 575586 - protein, 5 aa, Mycobacterium
SDATL

SEQ ID NO: 575587 - protein, 7 aa, Mycobacterium
SDATLNR

SEQ ID NO: 575588 - protein, 9 aa, Mycobacterium
SDATPASTA

SEQ ID NO: 575589 - protein, 18 aa, Mycobacterium
SDATPPGRQDSVARTHTV

SEQ ID NO: 575590 - protein, 21 aa, Mycobacterium
SDATPSRREFQRTPGLNGPAV

SEQ ID NO: 575591 - protein, 21 aa, Mycobacterium
SDATPSRREFQRTPGLNGQAV

SEQ ID NO: 575592 - protein, 8 aa, Mycobacterium
SDATPTLS

SEQ ID NO: 575593 - protein, 21 aa, Mycobacterium
SDATQSRREFQRTPGLNGPAV

SEQ ID NO: 575594 - protein, 6 aa, Mycobacterium
SDATRA

SEQ ID NO: 575595 - protein, 6 aa, Mycobacterium
SDATSV

SEQ ID NO: 575596 - protein, 6 aa, Mycobacterium
SDATTA

SEQ ID NO: 575597 - protein, 9 aa, Mycobacterium
SDATYEQTR

SEQ ID NO: 575598 - protein, 7 aa, Mycobacterium
SDAVDDE

SEQ ID NO: 575599 - protein, 8 aa, Mycobacterium
SDAVETAR

SEQ ID NO: 575600 - protein, 12 aa, Mycobacterium
SDAVPSAEGLDG

SEQ ID NO: 575601 - protein, 8 aa, Mycobacterium
SDAVRPES

SEQ ID NO: 575602 - protein, 7 aa, Mycobacterium
SDAVTGE

SEQ ID NO: 575603 - protein, 19 aa, Mycobacterium
SDAVTRAKAVSAAKATVGR

SEQ ID NO: 575604 - protein, 14 aa, Mycobacterium
SDAVTSDAAPPDAI

SEQ ID NO: 575605 - protein, 4 aa, Mycobacterium
SDAY

SEQ ID NO: 575606 - protein, 8 aa, Mycobacterium
SDAYQRKH

SEQ ID NO: 575607 - protein, 21 aa, Mycobacterium
SDCKQDGAFGPGTPITDPTGA

SEQ ID NO: 575608 - protein, 9 aa, Mycobacterium
SDCTEQESQ

SEQ ID NO: 575609 - protein, 6 aa, Mycobacterium
SDDAAE

SEQ ID NO: 575610 - protein, 21 aa, Mycobacterium
SDDAAGSAPLDVPADAEGPEV

SEQ ID NO: 575611 - protein, 6 aa, Mycobacterium
SDDAAW

SEQ ID NO: 575612 - protein, 5 aa, Mycobacterium
SDDAD

SEQ ID NO: 575613 - protein, 6 aa, Mycobacterium
SDDADA

SEQ ID NO: 575614 - protein, 13 aa, Mycobacterium
SDDADAQAHPERL

SEQ ID NO: 575615 - protein, 28 aa, Mycobacterium
SDDADKNGGDGPGGHDRSASRPDAGRGV

SEQ ID NO: 575616 - protein, 11 aa, Mycobacterium
SDDADSLAHPE

SEQ ID NO: 575617 - protein, 9 aa, Mycobacterium
SDDADSTSS

SEQ ID NO: 575618 - protein, 11 aa, Mycobacterium
SDDAEDAARTL

SEQ ID NO: 575619 - protein, 11 aa, Mycobacterium
SDDAEGTLGAS

SEQ ID NO: 575620 - protein, 14 aa, Mycobacterium
SDDAELQRGTTMEE

SEQ ID NO: 575621 - protein, 5 aa, Mycobacterium
SDDAG

SEQ ID NO: 575622 - protein, 7 aa, Mycobacterium
SDDAGDV

SEQ ID NO: 575623 - protein, 19 aa, Mycobacterium
SDDAPDDVQERLSDKHSQY

SEQ ID NO: 575624 - protein, 11 aa, Mycobacterium
SDDAPDTGALA

SEQ ID NO: 575625 - protein, 6 aa, Mycobacterium
SDDARP

SEQ ID NO: 575626 - protein, 26 aa, Mycobacterium
SDDATQKQARSTMSVTPQEAQRTPVE

SEQ ID NO: 575627 - protein, 5 aa, Mycobacterium
SDDAV

SEQ ID NO: 575628 - protein, 4 aa, Mycobacterium
SDDD

SEQ ID NO: 575629 - protein, 7 aa, Mycobacterium
SDDDAVT

SEQ ID NO: 575630 - protein, 10 aa, Mycobacterium
SDDDDRAQLD

SEQ ID NO: 575631 - protein, 9 aa, Mycobacterium
SDDDDRARL

SEQ ID NO: 575632 - protein, 12 aa, Mycobacterium
SDDDGPTGPTMR

SEQ ID NO: 575633 - protein, 7 aa, Mycobacterium
SDDDLTA

SEQ ID NO: 575634 - protein, 5 aa, Mycobacterium
SDDDM

SEQ ID NO: 575635 - protein, 6 aa, Mycobacterium
SDDDNW

SEQ ID NO: 575636 - protein, 7 aa, Mycobacterium
SDDDPGT

SEQ ID NO: 575637 - protein, 7 aa, Mycobacterium
SDDDRAA

SEQ ID NO: 575638 - protein, 6 aa, Mycobacterium
SDDDVA

SEQ ID NO: 575639 - protein, 8 aa, Mycobacterium
SDDDVADL

SEQ ID NO: 575640 - protein, 9 aa, Mycobacterium
SDDDWDRLD

SEQ ID NO: 575641 - protein, 7 aa, Mycobacterium
SDDDYRV

SEQ ID NO: 575642 - protein, 5 aa, Mycobacterium
SDDEF

SEQ ID NO: 575643 - protein, 6 aa, Mycobacterium
SDDELG

SEQ ID NO: 575644 - protein, 14 aa, Mycobacterium
SDDELTDKLRESKE

SEQ ID NO: 575645 - protein, 8 aa, Mycobacterium
SDDEPMSG

SEQ ID NO: 575646 - protein, 6 aa, Mycobacterium
SDDEPV

SEQ ID NO: 575647 - protein, 9 aa, Mycobacterium
SDDERLADE

SEQ ID NO: 575648 - protein, 7 aa, Mycobacterium
SDDERPQ

SEQ ID NO: 575649 - protein, 7 aa, Mycobacterium
SDDERVG

SEQ ID NO: 575650 - protein, 5 aa, Mycobacterium
SDDES

SEQ ID NO: 575651 - protein, 13 aa, Mycobacterium
SDDEVRELLATPT

SEQ ID NO: 575652 - protein, 13 aa, Mycobacterium
SDDEVRETLASPT

SEQ ID NO: 575653 - protein, 9 aa, Mycobacterium
SDDFDGTPW

SEQ ID NO: 575654 - protein, 7 aa, Mycobacterium
SDDFEED

SEQ ID NO: 575655 - protein, 7 aa, Mycobacterium
SDDFPRA

SEQ ID NO: 575656 - protein, 4 aa, Mycobacterium
SDDG

SEQ ID NO: 575657 - protein, 9 aa, Mycobacterium
SDDGAGETF

SEQ ID NO: 575658 - protein, 7 aa, Mycobacterium
SDDGDLR

SEQ ID NO: 575659 - protein, 9 aa, Mycobacterium
SDDGDRATA

SEQ ID NO: 575660 - protein, 9 aa, Mycobacterium
SDDGDRDTF

SEQ ID NO: 575661 - protein, 10 aa, Mycobacterium
SDDGEGETYA

SEQ ID NO: 575662 - protein, 26 aa, Mycobacterium
SDDGESVEDVSYDGQGCSISQAATSV

SEQ ID NO: 575663 - protein, 8 aa, Mycobacterium
SDDGETVA

SEQ ID NO: 575664 - protein, 9 aa, Mycobacterium
SDDGETVTD

SEQ ID NO: 575665 - protein, 9 aa, Mycobacterium
SDDGGPLSR

SEQ ID NO: 575666 - protein, 11 aa, Mycobacterium
SDDGGSSGRIR

SEQ ID NO: 575667 - protein, 8 aa, Mycobacterium
SDDGGTAY

SEQ ID NO: 575668 - protein, 8 aa, Mycobacterium
SDDGNVEK

SEQ ID NO: 575669 - protein, 9 aa, Mycobacterium
SDDGPRPGA

SEQ ID NO: 575670 - protein, 7 aa, Mycobacterium
SDDGQRV

SEQ ID NO: 575671 - protein, 7 aa, Mycobacterium
SDDGRSF

SEQ ID NO: 575672 - protein, 8 aa, Mycobacterium
SDDGSTAR

SEQ ID NO: 575673 - protein, 19 aa, Mycobacterium
SDDGTAGTGSDAAAVSPTR

SEQ ID NO: 575674 - protein, 10 aa, Mycobacterium
SDDGTGDPAK

SEQ ID NO: 575675 - protein, 10 aa, Mycobacterium
SDDGTPRVDA

SEQ ID NO: 575676 - protein, 9 aa, Mycobacterium
SDDGVPGDP

SEQ ID NO: 575677 - protein, 6 aa, Mycobacterium
SDDHGD

SEQ ID NO: 575678 - protein, 6 aa, Mycobacterium
SDDHGV

SEQ ID NO: 575679 - protein, 14 aa, Mycobacterium
SDDHTVSAAPYGSA

SEQ ID NO: 575680 - protein, 15 aa, Mycobacterium
SDDIEVGDTSGAVQG

SEQ ID NO: 575681 - protein, 8 aa, Mycobacterium
SDDKTALD

SEQ ID NO: 575682 - protein, 4 aa, Mycobacterium
SDDL

SEQ ID NO: 575683 - protein, 10 aa, Mycobacterium
SDDLGGGSLT

SEQ ID NO: 575684 - protein, 5 aa, Mycobacterium
SDDLK

SEQ ID NO: 575685 - protein, 9 aa, Mycobacterium
SDDLKARTL

SEQ ID NO: 575686 - protein, 5 aa, Mycobacterium
SDDLP

SEQ ID NO: 575687 - protein, 9 aa, Mycobacterium
SDDNPHQVP

SEQ ID NO: 575688 - protein, 4 aa, Mycobacterium
SDDP

SEQ ID NO: 575689 - protein, 8 aa, Mycobacterium
SDDPAARD

SEQ ID NO: 575690 - protein, 16 aa, Mycobacterium
SDDPADTDRPDAWQTD

SEQ ID NO: 575691 - protein, 7 aa, Mycobacterium
SDDPAEQ

SEQ ID NO: 575692 - protein, 7 aa, Mycobacterium
SDDPAWQ

SEQ ID NO: 575693 - protein, 8 aa, Mycobacterium
SDDPDARD

SEQ ID NO: 575694 - protein, 7 aa, Mycobacterium
SDDPDGT

SEQ ID NO: 575695 - protein, 8 aa, Mycobacterium
SDDPDYPR

SEQ ID NO: 575696 - protein, 11 aa, Mycobacterium
SDDPEQSRALT

SEQ ID NO: 575697 - protein, 6 aa, Mycobacterium
SDDPES

SEQ ID NO: 575698 - protein, 16 aa, Mycobacterium
SDDPGATPVDVSEDNR

SEQ ID NO: 575699 - protein, 10 aa, Mycobacterium
SDDPGSSSRI

SEQ ID NO: 575700 - protein, 6 aa, Mycobacterium
SDDPGV

SEQ ID NO: 575701 - protein, 6 aa, Mycobacterium
SDDPQR

SEQ ID NO: 575702 - protein, 9 aa, Mycobacterium
SDDPRDTEV

SEQ ID NO: 575703 - protein, 6 aa, Mycobacterium
SDDPRI

SEQ ID NO: 575704 - protein, 8 aa, Mycobacterium
SDDPSYPR

SEQ ID NO: 575705 - protein, 12 aa, Mycobacterium
SDDPTADVAEGR

SEQ ID NO: 575706 - protein, 8 aa, Mycobacterium
SDDPTDDA

SEQ ID NO: 575707 - protein, 7 aa, Mycobacterium
SDDPVAE

SEQ ID NO: 575708 - protein, 7 aa, Mycobacterium
SDDPVQH

SEQ ID NO: 575709 - protein, 8 aa, Mycobacterium
SDDPWPQE

SEQ ID NO: 575710 - protein, 5 aa, Mycobacterium
SDDPY

SEQ ID NO: 575711 - protein, 6 aa, Mycobacterium
SDDPYR

SEQ ID NO: 575712 - protein, 4 aa, Mycobacterium
SDDQ

SEQ ID NO: 575713 - protein, 12 aa, Mycobacterium
SDDQAPYSPDPA

SEQ ID NO: 575714 - protein, 10 aa, Mycobacterium
SDDQDPSTPA

SEQ ID NO: 575715 - protein, 9 aa, Mycobacterium
SDDQDPSVP

SEQ ID NO: 575716 - protein, 8 aa, Mycobacterium
SDDQRSTA

SEQ ID NO: 575717 - protein, 4 aa, Mycobacterium
SDDR

SEQ ID NO: 575718 - protein, 6 aa, Mycobacterium
SDDRAT

SEQ ID NO: 575719 - protein, 5 aa, Mycobacterium
SDDRC

SEQ ID NO: 575720 - protein, 13 aa, Mycobacterium
SDDRGAAGADDTE

SEQ ID NO: 575721 - protein, 13 aa, Mycobacterium
SDDRGAAGAQDAE

SEQ ID NO: 575722 - protein, 6 aa, Mycobacterium
SDDRGR

SEQ ID NO: 575723 - protein, 8 aa, Mycobacterium
SDDRGRPC

SEQ ID NO: 575724 - protein, 17 aa, Mycobacterium
SDDRKRGVAGRSGSSPV

SEQ ID NO: 575725 - protein, 12 aa, Mycobacterium
SDDRLTAPEGSR

SEQ ID NO: 575726 - protein, 19 aa, Mycobacterium
SDDRRQAAHARDGELSASG

SEQ ID NO: 575727 - protein, 6 aa, Mycobacterium
SDDRRS

SEQ ID NO: 575728 - protein, 5 aa, Mycobacterium
SDDSA

SEQ ID NO: 575729 - protein, 9 aa, Mycobacterium
SDDSAARLA

SEQ ID NO: 575730 - protein, 13 aa, Mycobacterium
SDDSDADPGDKAA

SEQ ID NO: 575731 - protein, 13 aa, Mycobacterium
SDDSDADPSDKAA

SEQ ID NO: 575732 - protein, 16 aa, Mycobacterium
SDDSEFKRGSTSEDQL

SEQ ID NO: 575733 - protein, 6 aa, Mycobacterium
SDDSFG

SEQ ID NO: 575734 - protein, 8 aa, Mycobacterium
SDDSLPDL

SEQ ID NO: 575735 - protein, 6 aa, Mycobacterium
SDDSLR

SEQ ID NO: 575736 - protein, 6 aa, Mycobacterium
SDDSNA

SEQ ID NO: 575737 - protein, 8 aa, Mycobacterium
SDDSRPEV

SEQ ID NO: 575738 - protein, 10 aa, Mycobacterium
SDDSSIPECA

SEQ ID NO: 575739 - protein, 6 aa, Mycobacterium
SDDTAQ

SEQ ID NO: 575740 - protein, 7 aa, Mycobacterium
SDDTARV

SEQ ID NO: 575741 - protein, 7 aa, Mycobacterium
SDDTFEG

SEQ ID NO: 575742 - protein, 8 aa, Mycobacterium
SDDTKPAV

SEQ ID NO: 575743 - protein, 6 aa, Mycobacterium
SDDTVG

SEQ ID NO: 575744 - protein, 4 aa, Mycobacterium
SDDV

SEQ ID NO: 575745 - protein, 18 aa, Mycobacterium
SDDVDPQSRDLPRPHPDD

SEQ ID NO: 575746 - protein, 8 aa, Mycobacterium
SDDVDRET

SEQ ID NO: 575747 - protein, 9 aa, Mycobacterium
SDDVGGTWR

SEQ ID NO: 575748 - protein, 28 aa, Mycobacterium
SDDVQTGHDDDLSTVGAGGSDAASGTRL

SEQ ID NO: 575749 - protein, 9 aa, Mycobacterium
SDDVRAKRV

SEQ ID NO: 575750 - protein, 12 aa, Mycobacterium
SDDVVGPEASRD

SEQ ID NO: 575751 - protein, 4 aa, Mycobacterium
SDDW

SEQ ID NO: 575752 - protein, 4 aa, Mycobacterium
SDDY

SEQ ID NO: 575753 - protein, 5 aa, Mycobacterium
SDDYF

SEQ ID NO: 575754 - protein, 8 aa, Mycobacterium
SDEAAPAR

SEQ ID NO: 575755 - protein, 7 aa, Mycobacterium
SDEADID

SEQ ID NO: 575756 - protein, 9 aa, Mycobacterium
SDEADPAAA

SEQ ID NO: 575757 - protein, 9 aa, Mycobacterium
SDEADVDKA

SEQ ID NO: 575758 - protein, 6 aa, Mycobacterium
SDEAGS

SEQ ID NO: 575759 - protein, 9 aa, Mycobacterium
SDEAGTQYS

SEQ ID NO: 575760 - protein, 8 aa, Mycobacterium
SDEAQGRR

SEQ ID NO: 575761 - protein, 9 aa, Mycobacterium
SDEARDTVE

SEQ ID NO: 575762 - protein, 6 aa, Mycobacterium
SDEARH

SEQ ID NO: 575763 - protein, 14 aa, Mycobacterium
SDEATSGLDPATTK

SEQ ID NO: 575764 - protein, 9 aa, Mycobacterium
SDEDAADLT

SEQ ID NO: 575765 - protein, 15 aa, Mycobacterium
SDEDAPIEPTTADDP

SEQ ID NO: 575766 - protein, 17 aa, Mycobacterium
SDEDDTDEGPPRMARHN

SEQ ID NO: 575767 - protein, 8 aa, Mycobacterium
SDEDFPAA

SEQ ID NO: 575768 - protein, 19 aa, Mycobacterium
SDEDGAEAGSSYNKRRGDK

SEQ ID NO: 575769 - protein, 17 aa, Mycobacterium
SDEDGNEVVTFAFQPVD

SEQ ID NO: 575770 - protein, 9 aa, Mycobacterium
SDEDRQAGM

SEQ ID NO: 575771 - protein, 17 aa, Mycobacterium
SDEDYAPPTQGRLSPEL

SEQ ID NO: 575772 - protein, 16 aa, Mycobacterium
SDEEGARREEERGDRY

SEQ ID NO: 575773 - protein, 32 aa, Mycobacterium
SDEEGARREQERGNRYPGWNRGSARAAHADAE

SEQ ID NO: 575774 - protein, 9 aa, Mycobacterium
SDEESARAM

SEQ ID NO: 575775 - protein, 8 aa, Mycobacterium
SDEETPAD

SEQ ID NO: 575776 - protein, 7 aa, Mycobacterium
SDEEVKA

SEQ ID NO: 575777 - protein, 4 aa, Mycobacterium
SDEF

SEQ ID NO: 575778 - protein, 6 aa, Mycobacterium
SDEFTK

SEQ ID NO: 575779 - protein, 4 aa, Mycobacterium
SDEG

SEQ ID NO: 575780 - protein, 20 aa, Mycobacterium
SDEGATPQERQSAYTRAQRE

SEQ ID NO: 575781 - protein, 17 aa, Mycobacterium
SDEGDSGQGPPRMARHR

SEQ ID NO: 575782 - protein, 9 aa, Mycobacterium
SDEGERYRH

SEQ ID NO: 575783 - protein, 7 aa, Mycobacterium
SDEGGHP

SEQ ID NO: 575784 - protein, 18 aa, Mycobacterium
SDEGKADLKNLGGVSAAT

SEQ ID NO: 575785 - protein, 9 aa, Mycobacterium
SDEGKPELK

SEQ ID NO: 575786 - protein, 9 aa, Mycobacterium
SDEGKPQLK

SEQ ID NO: 575787 - protein, 14 aa, Mycobacterium
SDEGLTTVAPNENV

SEQ ID NO: 575788 - protein, 5 aa, Mycobacterium
SDEGM

SEQ ID NO: 575789 - protein, 7 aa, Mycobacterium
SDEGRKL

SEQ ID NO: 575790 - protein, 26 aa, Mycobacterium
SDEGRPGEAVTASADGHATVRTARGV

SEQ ID NO: 575791 - protein, 7 aa, Mycobacterium
SDEGTAE

SEQ ID NO: 575792 - protein, 5 aa, Mycobacterium
SDEHG

SEQ ID NO: 575793 - protein, 6 aa, Mycobacterium
SDEHQM

SEQ ID NO: 575794 - protein, 5 aa, Mycobacterium
SDEHS

SEQ ID NO: 575795 - protein, 8 aa, Mycobacterium
SDEIPEHG

SEQ ID NO: 575796 - protein, 8 aa, Mycobacterium
SDEIQRAR

SEQ ID NO: 575797 - protein, 7 aa, Mycobacterium
SDEKERA

SEQ ID NO: 575798 - protein, 9 aa, Mycobacterium
SDEKTTAMG

SEQ ID NO: 575799 - protein, 9 aa, Mycobacterium
SDEKTTRLG

SEQ ID NO: 575800 - protein, 5 aa, Mycobacterium
SDELG

SEQ ID NO: 575801 - protein, 9 aa, Mycobacterium
SDELGAGSL

SEQ ID NO: 575802 - protein, 9 aa, Mycobacterium
SDELKARTL

SEQ ID NO: 575803 - protein, 7 aa, Mycobacterium
SDELPSV

SEQ ID NO: 575804 - protein, 12 aa, Mycobacterium
SDELTQAGVAAG

SEQ ID NO: 575805 - protein, 7 aa, Mycobacterium
SDEMPTP

SEQ ID NO: 575806 - protein, 10 aa, Mycobacterium
SDENGAPLEP

SEQ ID NO: 575807 - protein, 5 aa, Mycobacterium
SDENL

SEQ ID NO: 575808 - protein, 14 aa, Mycobacterium
SDENTDIPCHLVSW

SEQ ID NO: 575809 - protein, 4 aa, Mycobacterium
SDEP

SEQ ID NO: 575810 - protein, 5 aa, Mycobacterium
SDEPA

SEQ ID NO: 575811 - protein, 23 aa, Mycobacterium
SDEPERRGGQPQLVGGQPAQPFA

SEQ ID NO: 575812 - protein, 5 aa, Mycobacterium
SDEPF

SEQ ID NO: 575813 - protein, 16 aa, Mycobacterium
SDEPGRARTVAAGQPG

SEQ ID NO: 575814 - protein, 14 aa, Mycobacterium
SDEPHREAAAGVAD

SEQ ID NO: 575815 - protein, 5 aa, Mycobacterium
SDEPL

SEQ ID NO: 575816 - protein, 13 aa, Mycobacterium
SDEPLDVTPSPDD

SEQ ID NO: 575817 - protein, 7 aa, Mycobacterium
SDEPNRD

SEQ ID NO: 575818 - protein, 7 aa, Mycobacterium
SDEPPVS

SEQ ID NO: 575819 - protein, 5 aa, Mycobacterium
SDEPR

SEQ ID NO: 575820 - protein, 8 aa, Mycobacterium
SDEPREWG

SEQ ID NO: 575821 - protein, 5 aa, Mycobacterium
SDEPS

SEQ ID NO: 575822 - protein, 5 aa, Mycobacterium
SDEPT

SEQ ID NO: 575823 - protein, 7 aa, Mycobacterium
SDEPTLR

SEQ ID NO: 575824 - protein, 7 aa, Mycobacterium
SDEPVAE

SEQ ID NO: 575825 - protein, 4 aa, Mycobacterium
SDEQ

SEQ ID NO: 575826 - protein, 6 aa, Mycobacterium
SDEQAR

SEQ ID NO: 575827 - protein, 7 aa, Mycobacterium
SDEQELG

SEQ ID NO: 575828 - protein, 8 aa, Mycobacterium
SDEQELGG

SEQ ID NO: 575829 - protein, 9 aa, Mycobacterium
SDEQERAKL

SEQ ID NO: 575830 - protein, 5 aa, Mycobacterium
SDEQK

SEQ ID NO: 575831 - protein, 6 aa, Mycobacterium
SDEQQD

SEQ ID NO: 575832 - protein, 7 aa, Mycobacterium
SDEQQRL

SEQ ID NO: 575833 - protein, 10 aa, Mycobacterium
SDEQRASGYA

SEQ ID NO: 575834 - protein, 7 aa, Mycobacterium
SDEQRPQ

SEQ ID NO: 575835 - protein, 6 aa, Mycobacterium
SDEQRQ

SEQ ID NO: 575836 - protein, 6 aa, Mycobacterium
SDERAP

SEQ ID NO: 575837 - protein, 7 aa, Mycobacterium
SDERDDV

SEQ ID NO: 575838 - protein, 6 aa, Mycobacterium
SDERED

SEQ ID NO: 575839 - protein, 12 aa, Mycobacterium
SDERGGAGAEDA

SEQ ID NO: 575840 - protein, 13 aa, Mycobacterium
SDERGGAGGEDAS

SEQ ID NO: 575841 - protein, 12 aa, Mycobacterium
SDERGHTSTEDA

SEQ ID NO: 575842 - protein, 12 aa, Mycobacterium
SDERGQAGRDDA

SEQ ID NO: 575843 - protein, 13 aa, Mycobacterium
SDERGRAGSEDAE

SEQ ID NO: 575844 - protein, 8 aa, Mycobacterium
SDERGTNM

SEQ ID NO: 575845 - protein, 7 aa, Mycobacterium
SDERQRV

SEQ ID NO: 575846 - protein, 10 aa, Mycobacterium
SDERSPAGTA

SEQ ID NO: 575847 - protein, 6 aa, Mycobacterium
SDERTA

SEQ ID NO: 575848 - protein, 10 aa, Mycobacterium
SDESAAQVTP

SEQ ID NO: 575849 - protein, 8 aa, Mycobacterium
SDESASGF

SEQ ID NO: 575850 - protein, 6 aa, Mycobacterium
SDESED

SEQ ID NO: 575851 - protein, 7 aa, Mycobacterium
SDESGRI

SEQ ID NO: 575852 - protein, 11 aa, Mycobacterium
SDESIRPGTTV

SEQ ID NO: 575853 - protein, 5 aa, Mycobacterium
SDESR

SEQ ID NO: 575854 - protein, 7 aa, Mycobacterium
SDESSIA

SEQ ID NO: 575855 - protein, 8 aa, Mycobacterium
SDESTKDL

SEQ ID NO: 575856 - protein, 5 aa, Mycobacterium
SDETA

SEQ ID NO: 575857 - protein, 12 aa, Mycobacterium
SDETARGGFGPF

SEQ ID NO: 575858 - protein, 12 aa, Mycobacterium
SDETQKALRGSG

SEQ ID NO: 575859 - protein, 5 aa, Mycobacterium
SDETT

SEQ ID NO: 575860 - protein, 13 aa, Mycobacterium
SDEVDRLGRDGGA

SEQ ID NO: 575861 - protein, 9 aa, Mycobacterium
SDEVSEDER

SEQ ID NO: 575862 - protein, 13 aa, Mycobacterium
SDEVTAPRSYPGA

SEQ ID NO: 575863 - protein, 7 aa, Mycobacterium
SDEYEPI

SEQ ID NO: 575864 - protein, 9 aa, Mycobacterium
SDEYRTRTA

SEQ ID NO: 575865 - protein, 6 aa, Mycobacterium
SDFAGR

SEQ ID NO: 575866 - protein, 6 aa, Mycobacterium
SDFATA

SEQ ID NO: 575867 - protein, 7 aa, Mycobacterium
SDFDDDE

SEQ ID NO: 575868 - protein, 10 aa, Mycobacterium
SDFDTSDEYQ

SEQ ID NO: 575869 - protein, 8 aa, Mycobacterium
SDFDVTDN

SEQ ID NO: 575870 - protein, 10 aa, Mycobacterium
SDFEAAESNP

SEQ ID NO: 575871 - protein, 6 aa, Mycobacterium
SDFESA

SEQ ID NO: 575872 - protein, 30 aa, Mycobacterium
SDFGGRASVADEIAASNAAVASRRSDPRLH

SEQ ID NO: 575873 - protein, 6 aa, Mycobacterium
SDFNDL

SEQ ID NO: 575874 - protein, 5 aa, Mycobacterium
SDFPP

SEQ ID NO: 575875 - protein, 6 aa, Mycobacterium
SDFSAA

SEQ ID NO: 575876 - protein, 5 aa, Mycobacterium
SDFSG

SEQ ID NO: 575877 - protein, 18 aa, Mycobacterium
SDGAAALGDSADGNAFDE

SEQ ID NO: 575878 - protein, 9 aa, Mycobacterium
SDGAARGRL

SEQ ID NO: 575879 - protein, 18 aa, Mycobacterium
SDGAAVAVSSSDSVTGTA

SEQ ID NO: 575880 - protein, 5 aa, Mycobacterium
SDGAD

SEQ ID NO: 575881 - protein, 7 aa, Mycobacterium
SDGADCP

SEQ ID NO: 575882 - protein, 18 aa, Mycobacterium
SDGADGEAGGAGNRGSAN

SEQ ID NO: 575883 - protein, 11 aa, Mycobacterium
SDGADGSTEVP

SEQ ID NO: 575884 - protein, 6 aa, Mycobacterium
SDGADM

SEQ ID NO: 575885 - protein, 6 aa, Mycobacterium
SDGAEF

SEQ ID NO: 575886 - protein, 6 aa, Mycobacterium
SDGAFD

SEQ ID NO: 575887 - protein, 6 aa, Mycobacterium
SDGAGA

SEQ ID NO: 575888 - protein, 6 aa, Mycobacterium
SDGAGT

SEQ ID NO: 575889 - protein, 15 aa, Mycobacterium
SDGAGTAAGKQEALE

SEQ ID NO: 575890 - protein, 7 aa, Mycobacterium
SDGAGVR

SEQ ID NO: 575891 - protein, 5 aa, Mycobacterium
SDGAP

SEQ ID NO: 575892 - protein, 10 aa, Mycobacterium
SDGAPALKPG

SEQ ID NO: 575893 - protein, 11 aa, Mycobacterium
SDGAPAPEPPR

SEQ ID NO: 575894 - protein, 8 aa, Mycobacterium
SDGAPAPV

SEQ ID NO: 575895 - protein, 6 aa, Mycobacterium
SDGAPV

SEQ ID NO: 575896 - protein, 6 aa, Mycobacterium
SDGAQL

SEQ ID NO: 575897 - protein, 5 aa, Mycobacterium
SDGAR

SEQ ID NO: 575898 - protein, 15 aa, Mycobacterium
SDGASSVRLVNQTAY

SEQ ID NO: 575899 - protein, 17 aa, Mycobacterium
SDGASSVRLVNQTAYLA

SEQ ID NO: 575900 - protein, 5 aa, Mycobacterium
SDGAT

SEQ ID NO: 575901 - protein, 7 aa, Mycobacterium
SDGATIN

SEQ ID NO: 575902 - protein, 12 aa, Mycobacterium
SDGAYADASNQD

SEQ ID NO: 575903 - protein, 12 aa, Mycobacterium
SDGAYAQASNQD

SEQ ID NO: 575904 - protein, 9 aa, Mycobacterium
SDGDAADLE

SEQ ID NO: 575905 - protein, 9 aa, Mycobacterium
SDGDAESFG

SEQ ID NO: 575906 - protein, 7 aa, Mycobacterium
SDGDERV

SEQ ID NO: 575907 - protein, 14 aa, Mycobacterium
SDGDGDGLADGASS

SEQ ID NO: 575908 - protein, 7 aa, Mycobacterium
SDGDKIT

SEQ ID NO: 575909 - protein, 8 aa, Mycobacterium
SDGDKPAN

SEQ ID NO: 575910 - protein, 5 aa, Mycobacterium
SDGDL

SEQ ID NO: 575911 - protein, 5 aa, Mycobacterium
SDGDR

SEQ ID NO: 575912 - protein, 6 aa, Mycobacterium
SDGDSE

SEQ ID NO: 575913 - protein, 9 aa, Mycobacterium
SDGDTPSLE

SEQ ID NO: 575914 - protein, 7 aa, Mycobacterium
SDGDVDR

SEQ ID NO: 575915 - protein, 4 aa, Mycobacterium
SDGE

SEQ ID NO: 575916 - protein, 9 aa, Mycobacterium
SDGEAPATL

SEQ ID NO: 575917 - protein, 5 aa, Mycobacterium
SDGED

SEQ ID NO: 575918 - protein, 11 aa, Mycobacterium
SDGEEAGQDPD

SEQ ID NO: 575919 - protein, 7 aa, Mycobacterium
SDGEFGA

SEQ ID NO: 575920 - protein, 5 aa, Mycobacterium
SDGEK

SEQ ID NO: 575921 - protein, 6 aa, Mycobacterium
SDGEPV

SEQ ID NO: 575922 - protein, 9 aa, Mycobacterium
SDGETARRR

SEQ ID NO: 575923 - protein, 7 aa, Mycobacterium
SDGETEL

SEQ ID NO: 575924 - protein, 7 aa, Mycobacterium
SDGETTA

SEQ ID NO: 575925 - protein, 8 aa, Mycobacterium
SDGETTAF

SEQ ID NO: 575926 - protein, 5 aa, Mycobacterium
SDGEV

SEQ ID NO: 575927 - protein, 14 aa, Mycobacterium
SDGEVIASGPTPGF

SEQ ID NO: 575928 - protein, 9 aa, Mycobacterium
SDGEVTDEL

SEQ ID NO: 575929 - protein, 4 aa, Mycobacterium
SDGF

SEQ ID NO: 575930 - protein, 6 aa, Mycobacterium
SDGFGP

SEQ ID NO: 575931 - protein, 11 aa, Mycobacterium
SDGGAAQPDVS

SEQ ID NO: 575932 - protein, 13 aa, Mycobacterium
SDGGAAQPGATLS

SEQ ID NO: 575933 - protein, 7 aa, Mycobacterium
SDGGALT

SEQ ID NO: 575934 - protein, 7 aa, Mycobacterium
SDGGDLD

SEQ ID NO: 575935 - protein, 8 aa, Mycobacterium
SDGGDPVE

SEQ ID NO: 575936 - protein, 12 aa, Mycobacterium
SDGGECTPAETG

SEQ ID NO: 575937 - protein, 5 aa, Mycobacterium
SDGGF

SEQ ID NO: 575938 - protein, 5 aa, Mycobacterium
SDGGG

SEQ ID NO: 575939 - protein, 21 aa, Mycobacterium
SDGGGESIRGPWNQGQGPWPE

SEQ ID NO: 575940 - protein, 5 aa, Mycobacterium
SDGGI

SEQ ID NO: 575941 - protein, 6 aa, Mycobacterium
SDGGLG

SEQ ID NO: 575942 - protein, 9 aa, Mycobacterium
SDGGLGAGE

SEQ ID NO: 575943 - protein, 7 aa, Mycobacterium
SDGGRDI

SEQ ID NO: 575944 - protein, 7 aa, Mycobacterium
SDGGRYC

SEQ ID NO: 575945 - protein, 10 aa, Mycobacterium
SDGGRYLDTS

SEQ ID NO: 575946 - protein, 6 aa, Mycobacterium
SDGGTA

SEQ ID NO: 575947 - protein, 7 aa, Mycobacterium
SDGGTAV

SEQ ID NO: 575948 - protein, 7 aa, Mycobacterium
SDGHPVS

SEQ ID NO: 575949 - protein, 5 aa, Mycobacterium
SDGHR

SEQ ID NO: 575950 - protein, 20 aa, Mycobacterium
SDGHSHANAGASTSEALDRV

SEQ ID NO: 575951 - protein, 5 aa, Mycobacterium
SDGIG

SEQ ID NO: 575952 - protein, 7 aa, Mycobacterium
SDGIGGA

SEQ ID NO: 575953 - protein, 6 aa, Mycobacterium
SDGIGS

SEQ ID NO: 575954 - protein, 5 aa, Mycobacterium
SDGIR

SEQ ID NO: 575955 - protein, 6 aa, Mycobacterium
SDGIRP

SEQ ID NO: 575956 - protein, 6 aa, Mycobacterium
SDGKDV

SEQ ID NO: 575957 - protein, 8 aa, Mycobacterium
SDGKFGNP

SEQ ID NO: 575958 - protein, 10 aa, Mycobacterium
SDGKIERETT

SEQ ID NO: 575959 - protein, 9 aa, Mycobacterium
SDGKPARVG

SEQ ID NO: 575960 - protein, 9 aa, Mycobacterium
SDGKPMSAA

SEQ ID NO: 575961 - protein, 9 aa, Mycobacterium
SDGKPMSAQ

SEQ ID NO: 575962 - protein, 8 aa, Mycobacterium
SDGKPREV

SEQ ID NO: 575963 - protein, 8 aa, Mycobacterium
SDGKPTRI

SEQ ID NO: 575964 - protein, 29 aa, Mycobacterium
SDGKPTRVGYRKDDETGKNVRIAKSNGKD

SEQ ID NO: 575965 - protein, 5 aa, Mycobacterium
SDGKR

SEQ ID NO: 575966 - protein, 6 aa, Mycobacterium
SDGKTM

SEQ ID NO: 575967 - protein, 5 aa, Mycobacterium
SDGLG

SEQ ID NO: 575968 - protein, 9 aa, Mycobacterium
SDGLGSGEW

SEQ ID NO: 575969 - protein, 9 aa, Mycobacterium
SDGLRQAAN

SEQ ID NO: 575970 - protein, 5 aa, Mycobacterium
SDGLS

SEQ ID NO: 575971 - protein, 8 aa, Mycobacterium
SDGLTELP

SEQ ID NO: 575972 - protein, 7 aa, Mycobacterium
SDGNAAY

SEQ ID NO: 575973 - protein, 17 aa, Mycobacterium
SDGNAFGHTGGARGVDQ

SEQ ID NO: 575974 - protein, 7 aa, Mycobacterium
SDGNLRS

SEQ ID NO: 575975 - protein, 8 aa, Mycobacterium
SDGNPAYI

SEQ ID NO: 575976 - protein, 8 aa, Mycobacterium
SDGNPTRI

SEQ ID NO: 575977 - protein, 11 aa, Mycobacterium
SDGPAAAPTTV

SEQ ID NO: 575978 - protein, 7 aa, Mycobacterium
SDGPAAL

SEQ ID NO: 575979 - protein, 8 aa, Mycobacterium
SDGPADAL

SEQ ID NO: 575980 - protein, 16 aa, Mycobacterium
SDGPASVRLVNETSYL

SEQ ID NO: 575981 - protein, 5 aa, Mycobacterium
SDGPC

SEQ ID NO: 575982 - protein, 9 aa, Mycobacterium
SDGPCAGKP

SEQ ID NO: 575983 - protein, 7 aa, Mycobacterium
SDGPDDA

SEQ ID NO: 575984 - protein, 7 aa, Mycobacterium
SDGPDQL

SEQ ID NO: 575985 - protein, 14 aa, Mycobacterium
SDGPEYSEDEEGEA

SEQ ID NO: 575986 - protein, 11 aa, Mycobacterium
SDGPGEGADAA

SEQ ID NO: 575987 - protein, 7 aa, Mycobacterium
SDGPPLR

SEQ ID NO: 575988 - protein, 8 aa, Mycobacterium
SDGPPPDW

SEQ ID NO: 575989 - protein, 8 aa, Mycobacterium
SDGPWDSA

SEQ ID NO: 575990 - protein, 4 aa, Mycobacterium
SDGQ

SEQ ID NO: 575991 - protein, 14 aa, Mycobacterium
SDGQKMSKSLRNYP

SEQ ID NO: 575992 - protein, 8 aa, Mycobacterium
SDGQPTRI

SEQ ID NO: 575993 - protein, 6 aa, Mycobacterium
SDGQTL

SEQ ID NO: 575994 - protein, 5 aa, Mycobacterium
SDGRI

SEQ ID NO: 575995 - protein, 9 aa, Mycobacterium
SDGRIDPGR

SEQ ID NO: 575996 - protein, 5 aa, Mycobacterium
SDGRL

SEQ ID NO: 575997 - protein, 8 aa, Mycobacterium
SDGRPHAL

SEQ ID NO: 575998 - protein, 6 aa, Mycobacterium
SDGRQV

SEQ ID NO: 575999 - protein, 5 aa, Mycobacterium
SDGRR

SEQ ID NO: 576000 - protein, 7 aa, Mycobacterium
SDGRSGS

SEQ ID NO: 576001 - protein, 10 aa, Mycobacterium
SDGRSLPAES

SEQ ID NO: 576002 - protein, 7 aa, Mycobacterium
SDGRSLR

SEQ ID NO: 576003 - protein, 7 aa, Mycobacterium
SDGRTAP

SEQ ID NO: 576004 - protein, 8 aa, Mycobacterium
SDGRTRTR

SEQ ID NO: 576005 - protein, 16 aa, Mycobacterium
SDGRVDGADAALGAAQ

SEQ ID NO: 576006 - protein, 4 aa, Mycobacterium
SDGS

SEQ ID NO: 576007 - protein, 9 aa, Mycobacterium
SDGSAADAV

SEQ ID NO: 576008 - protein, 8 aa, Mycobacterium
SDGSATVA

SEQ ID NO: 576009 - protein, 9 aa, Mycobacterium
SDGSAVAGA

SEQ ID NO: 576010 - protein, 9 aa, Mycobacterium
SDGSDDPAL

SEQ ID NO: 576011 - protein, 11 aa, Mycobacterium
SDGSDEGSEPD

SEQ ID NO: 576012 - protein, 10 aa, Mycobacterium
SDGSEAGYTY

SEQ ID NO: 576013 - protein, 10 aa, Mycobacterium
SDGSEANYTY

SEQ ID NO: 576014 - protein, 10 aa, Mycobacterium
SDGSEGNYTY

SEQ ID NO: 576015 - protein, 13 aa, Mycobacterium
SDGSESALEHGSK

SEQ ID NO: 576016 - protein, 9 aa, Mycobacterium
SDGSGDEKE

SEQ ID NO: 576017 - protein, 9 aa, Mycobacterium
SDGSLAAEQ

SEQ ID NO: 576018 - protein, 8 aa, Mycobacterium
SDGSLDPR

SEQ ID NO: 576019 - protein, 8 aa, Mycobacterium
SDGSLDRP

SEQ ID NO: 576020 - protein, 8 aa, Mycobacterium
SDGSLGGY

SEQ ID NO: 576021 - protein, 10 aa, Mycobacterium
SDGSNPGDDV

SEQ ID NO: 576022 - protein, 15 aa, Mycobacterium
SDGSPPPQSDSSTDA

SEQ ID NO: 576023 - protein, 15 aa, Mycobacterium
SDGSPQRQSDSSTDA

SEQ ID NO: 576024 - protein, 8 aa, Mycobacterium
SDGSQDAG

SEQ ID NO: 576025 - protein, 9 aa, Mycobacterium
SDGSRQGNV

SEQ ID NO: 576026 - protein, 8 aa, Mycobacterium
SDGSSSPL

SEQ ID NO: 576027 - protein, 9 aa, Mycobacterium
SDGSTETAS

SEQ ID NO: 576028 - protein, 17 aa, Mycobacterium
SDGSTGDPEADDQPQEE

SEQ ID NO: 576029 - protein, 7 aa, Mycobacterium
SDGSTID

SEQ ID NO: 576030 - protein, 7 aa, Mycobacterium
SDGSTLR

SEQ ID NO: 576031 - protein, 16 aa, Mycobacterium
SDGSTNIVPAGDPDDV

SEQ ID NO: 576032 - protein, 7 aa, Mycobacterium
SDGSTVD

SEQ ID NO: 576033 - protein, 8 aa, Mycobacterium
SDGSTVTG

SEQ ID NO: 576034 - protein, 7 aa, Mycobacterium
SDGTASG

SEQ ID NO: 576035 - protein, 6 aa, Mycobacterium
SDGTAT

SEQ ID NO: 576036 - protein, 10 aa, Mycobacterium
SDGTDAVDGG

SEQ ID NO: 576037 - protein, 10 aa, Mycobacterium
SDGTEDNYTY

SEQ ID NO: 576038 - protein, 9 aa, Mycobacterium
SDGTFEDGQ

SEQ ID NO: 576039 - protein, 8 aa, Mycobacterium
SDGTHNDG

SEQ ID NO: 576040 - protein, 9 aa, Mycobacterium
SDGTLSEAD

SEQ ID NO: 576041 - protein, 9 aa, Mycobacterium
SDGTPADIG

SEQ ID NO: 576042 - protein, 17 aa, Mycobacterium
SDGTPGTDEFATRAEQA

SEQ ID NO: 576043 - protein, 7 aa, Mycobacterium
SDGTQAL

SEQ ID NO: 576044 - protein, 25 aa, Mycobacterium
SDGTSGQYIGGPEAKTALLQLESSS

SEQ ID NO: 576045 - protein, 6 aa, Mycobacterium
SDGTSQ

SEQ ID NO: 576046 - protein, 7 aa, Mycobacterium
SDGTTTA

SEQ ID NO: 576047 - protein, 5 aa, Mycobacterium
SDGTV

SEQ ID NO: 576048 - protein, 10 aa, Mycobacterium
SDGTVGANKN

SEQ ID NO: 576049 - protein, 6 aa, Mycobacterium
SDGTVN

SEQ ID NO: 576050 - protein, 5 aa, Mycobacterium
SDGTY

SEQ ID NO: 576051 - protein, 11 aa, Mycobacterium
SDGTYAEPEEV

SEQ ID NO: 576052 - protein, 7 aa, Mycobacterium
SDGTYRD

SEQ ID NO: 576053 - protein, 12 aa, Mycobacterium
SDGVAAGSSWGN

SEQ ID NO: 576054 - protein, 14 aa, Mycobacterium
SDGVAASASGELYS

SEQ ID NO: 576055 - protein, 8 aa, Mycobacterium
SDGVDRET

SEQ ID NO: 576056 - protein, 5 aa, Mycobacterium
SDGVG

SEQ ID NO: 576057 - protein, 12 aa, Mycobacterium
SDGVIGRAPAMH

SEQ ID NO: 576058 - protein, 7 aa, Mycobacterium
SDGVRGG

SEQ ID NO: 576059 - protein, 15 aa, Mycobacterium
SDGVRGGISTEESLT

SEQ ID NO: 576060 - protein, 15 aa, Mycobacterium
SDGVSINSERTATLT

SEQ ID NO: 576061 - protein, 7 aa, Mycobacterium
SDGVYGA

SEQ ID NO: 576062 - protein, 4 aa, Mycobacterium
SDGW

SEQ ID NO: 576063 - protein, 15 aa, Mycobacterium
SDGWRDTDARLAVWP

SEQ ID NO: 576064 - protein, 4 aa, Mycobacterium
SDGY

SEQ ID NO: 576065 - protein, 11 aa, Mycobacterium
SDGYQAVGSGS

SEQ ID NO: 576066 - protein, 5 aa, Mycobacterium
SDHAE

SEQ ID NO: 576067 - protein, 6 aa, Mycobacterium
SDHAGA

SEQ ID NO: 576068 - protein, 12 aa, Mycobacterium
SDHDPDGPLPSV

SEQ ID NO: 576069 - protein, 4 aa, Mycobacterium
SDHE

SEQ ID NO: 576070 - protein, 7 aa, Mycobacterium
SDHEGQD

SEQ ID NO: 576071 - protein, 5 aa, Mycobacterium
SDHGD

SEQ ID NO: 576072 - protein, 5 aa, Mycobacterium
SDHGE

SEQ ID NO: 576073 - protein, 12 aa, Mycobacterium
SDHGGGSQKKGH

SEQ ID NO: 576074 - protein, 7 aa, Mycobacterium
SDHGPTM

SEQ ID NO: 576075 - protein, 5 aa, Mycobacterium
SDHGR

SEQ ID NO: 576076 - protein, 5 aa, Mycobacterium
SDHGV

SEQ ID NO: 576077 - protein, 9 aa, Mycobacterium
SDHKARETA

SEQ ID NO: 576078 - protein, 10 aa, Mycobacterium
SDHPAEAARD

SEQ ID NO: 576079 - protein, 10 aa, Mycobacterium
SDHPDARSAC

SEQ ID NO: 576080 - protein, 9 aa, Mycobacterium
SDHPDLPAH

SEQ ID NO: 576081 - protein, 10 aa, Mycobacterium
SDHPDRDTRY

SEQ ID NO: 576082 - protein, 6 aa, Mycobacterium
SDHPGY

SEQ ID NO: 576083 - protein, 8 aa, Mycobacterium
SDHPRPQG

SEQ ID NO: 576084 - protein, 17 aa, Mycobacterium
SDHQMAAQDRRSQSAEL

SEQ ID NO: 576085 - protein, 5 aa, Mycobacterium
SDHRI

SEQ ID NO: 576086 - protein, 33 aa, Mycobacterium
SDHRQRAGSSSDGGKPDTSEVPEPSDEAKETAA

SEQ ID NO: 576087 - protein, 18 aa, Mycobacterium
SDHSISGRGRHPLPSGRD

SEQ ID NO: 576088 - protein, 8 aa, Mycobacterium
SDHTPTST

SEQ ID NO: 576089 - protein, 7 aa, Mycobacterium
SDHTSVP

SEQ ID NO: 576090 - protein, 20 aa, Mycobacterium
SDIAAEQSALSNAWQGDTGL

SEQ ID NO: 576091 - protein, 11 aa, Mycobacterium
SDIAGSGPVGA

SEQ ID NO: 576092 - protein, 20 aa, Mycobacterium
SDIASEQATLSNAWQGDTGM

SEQ ID NO: 576093 - protein, 6 aa, Mycobacterium
SDIASI

SEQ ID NO: 576094 - protein, 4 aa, Mycobacterium
SDID

SEQ ID NO: 576095 - protein, 14 aa, Mycobacterium
SDIDARETGLTPGV

SEQ ID NO: 576096 - protein, 8 aa, Mycobacterium
SDIDDDPY

SEQ ID NO: 576097 - protein, 5 aa, Mycobacterium
SDIDR

SEQ ID NO: 576098 - protein, 9 aa, Mycobacterium
SDIEGRTSY

SEQ ID NO: 576099 - protein, 5 aa, Mycobacterium
SDIGR

SEQ ID NO: 576100 - protein, 15 aa, Mycobacterium
SDIGRPKAQSAKDSV

SEQ ID NO: 576101 - protein, 14 aa, Mycobacterium
SDIGRSKAQSARDS

SEQ ID NO: 576102 - protein, 15 aa, Mycobacterium
SDIGRSKAQSARDSI

SEQ ID NO: 576103 - protein, 24 aa, Mycobacterium
SDIPAAEIDGSGELPATGSFSGTG

SEQ ID NO: 576104 - protein, 8 aa, Mycobacterium
SDIPDDPA

SEQ ID NO: 576105 - protein, 8 aa, Mycobacterium
SDIPDQSG

SEQ ID NO: 576106 - protein, 10 aa, Mycobacterium
SDIPGKESRV

SEQ ID NO: 576107 - protein, 11 aa, Mycobacterium
SDIPSTAPMTS

SEQ ID NO: 576108 - protein, 6 aa, Mycobacterium
SDIQES

SEQ ID NO: 576109 - protein, 4 aa, Mycobacterium
SDIR

SEQ ID NO: 576110 - protein, 9 aa, Mycobacterium
SDIRNTPEL

SEQ ID NO: 576111 - protein, 5 aa, Mycobacterium
SDISE

SEQ ID NO: 576112 - protein, 20 aa, Mycobacterium
SDISRVSAGSAGVDTAEGAQ

SEQ ID NO: 576113 - protein, 8 aa, Mycobacterium
SDISSTDM

SEQ ID NO: 576114 - protein, 6 aa, Mycobacterium
SDITAA

SEQ ID NO: 576115 - protein, 6 aa, Mycobacterium
SDITSA

SEQ ID NO: 576116 - protein, 8 aa, Mycobacterium
SDKAEAEA

SEQ ID NO: 576117 - protein, 8 aa, Mycobacterium
SDKAEAER

SEQ ID NO: 576118 - protein, 8 aa, Mycobacterium
SDKASYNP

SEQ ID NO: 576119 - protein, 10 aa, Mycobacterium
SDKDGPDSEF

SEQ ID NO: 576120 - protein, 9 aa, Mycobacterium
SDKDGPDSV

SEQ ID NO: 576121 - protein, 7 aa, Mycobacterium
SDKEATR

SEQ ID NO: 576122 - protein, 13 aa, Mycobacterium
SDKEVECDGGTSI

SEQ ID NO: 576123 - protein, 9 aa, Mycobacterium
SDKGFDGET

SEQ ID NO: 576124 - protein, 19 aa, Mycobacterium
SDKGLDAAEGDPNYADQDH

SEQ ID NO: 576125 - protein, 19 aa, Mycobacterium
SDKGLDAAESDPDYADQEH

SEQ ID NO: 576126 - protein, 6 aa, Mycobacterium
SDKGMR

SEQ ID NO: 576127 - protein, 10 aa, Mycobacterium
SDKGQGQAAA

SEQ ID NO: 576128 - protein, 8 aa, Mycobacterium
SDKKRLKR

SEQ ID NO: 576129 - protein, 13 aa, Mycobacterium
SDKLDGSGPDSYH

SEQ ID NO: 576130 - protein, 11 aa, Mycobacterium
SDKPATTDAQA

SEQ ID NO: 576131 - protein, 5 aa, Mycobacterium
SDKPG

SEQ ID NO: 576132 - protein, 8 aa, Mycobacterium
SDKPGALG

SEQ ID NO: 576133 - protein, 8 aa, Mycobacterium
SDKPGSAM

SEQ ID NO: 576134 - protein, 12 aa, Mycobacterium
SDKPMRRTDPRG

SEQ ID NO: 576135 - protein, 8 aa, Mycobacterium
SDKPNTRW

SEQ ID NO: 576136 - protein, 7 aa, Mycobacterium
SDKPRQP

SEQ ID NO: 576137 - protein, 9 aa, Mycobacterium
SDKPSTTGW

SEQ ID NO: 576138 - protein, 8 aa, Mycobacterium
SDKQATLA

SEQ ID NO: 576139 - protein, 8 aa, Mycobacterium
SDKQRLKR

SEQ ID NO: 576140 - protein, 9 aa, Mycobacterium
SDKRGEQAP

SEQ ID NO: 576141 - protein, 17 aa, Mycobacterium
SDKTGKDAVHKPDALRS

SEQ ID NO: 576142 - protein, 17 aa, Mycobacterium
SDKVTSSPAFRSSAKTK

SEQ ID NO: 576143 - protein, 4 aa, Mycobacterium
SDLA

SEQ ID NO: 576144 - protein, 7 aa, Mycobacterium
SDLAEGC

SEQ ID NO: 576145 - protein, 6 aa, Mycobacterium
SDLAET

SEQ ID NO: 576146 - protein, 8 aa, Mycobacterium
SDLAGAAT

SEQ ID NO: 576147 - protein, 18 aa, Mycobacterium
SDLAGAATSVAERVGGAG

SEQ ID NO: 576148 - protein, 15 aa, Mycobacterium
SDLAGDGKPADAVER

SEQ ID NO: 576149 - protein, 16 aa, Mycobacterium
SDLAGDGRPADSVERR

SEQ ID NO: 576150 - protein, 8 aa, Mycobacterium
SDLAGEID

SEQ ID NO: 576151 - protein, 14 aa, Mycobacterium
SDLAKGGPVHGQAE

SEQ ID NO: 576152 - protein, 14 aa, Mycobacterium
SDLAKGGPVHSQAD

SEQ ID NO: 576153 - protein, 8 aa, Mycobacterium
SDLAKGPM

SEQ ID NO: 576154 - protein, 7 aa, Mycobacterium
SDLAPGV

SEQ ID NO: 576155 - protein, 11 aa, Mycobacterium
SDLARRGRGTP

SEQ ID NO: 576156 - protein, 6 aa, Mycobacterium
SDLASI

SEQ ID NO: 576157 - protein, 10 aa, Mycobacterium
SDLDADTARE

SEQ ID NO: 576158 - protein, 6 aa, Mycobacterium
SDLDAP

SEQ ID NO: 576159 - protein, 6 aa, Mycobacterium
SDLDRT

SEQ ID NO: 576160 - protein, 10 aa, Mycobacterium
SDLDSAADAC

SEQ ID NO: 576161 - protein, 6 aa, Mycobacterium
SDLEED

SEQ ID NO: 576162 - protein, 7 aa, Mycobacterium
SDLEESG

SEQ ID NO: 576163 - protein, 27 aa, Mycobacterium
SDLEGGADPRRSGLGEVRSTRRTARRV

SEQ ID NO: 576164 - protein, 9 aa, Mycobacterium
SDLEKPGKF

SEQ ID NO: 576165 - protein, 8 aa, Mycobacterium
SDLEKSKA

SEQ ID NO: 576166 - protein, 9 aa, Mycobacterium
SDLEPGLAA

SEQ ID NO: 576167 - protein, 7 aa, Mycobacterium
SDLEPSL

SEQ ID NO: 576168 - protein, 9 aa, Mycobacterium
SDLESGADK

SEQ ID NO: 576169 - protein, 8 aa, Mycobacterium
SDLESSDF

SEQ ID NO: 576170 - protein, 5 aa, Mycobacterium
SDLGA

SEQ ID NO: 576171 - protein, 7 aa, Mycobacterium
SDLGAGR

SEQ ID NO: 576172 - protein, 20 aa, Mycobacterium
SDLGGQAWQGAASASMTTAA

SEQ ID NO: 576173 - protein, 18 aa, Mycobacterium
SDLGKKVEEGVRARLHDK

SEQ ID NO: 576174 - protein, 6 aa, Mycobacterium
SDLGPG

SEQ ID NO: 576175 - protein, 10 aa, Mycobacterium
SDLGPRDGAD

SEQ ID NO: 576176 - protein, 6 aa, Mycobacterium
SDLGPT

SEQ ID NO: 576177 - protein, 16 aa, Mycobacterium
SDLGREQAASAADALA

SEQ ID NO: 576178 - protein, 30 aa, Mycobacterium
SDLGTAASSFSSVTSGLAGQAWQGPASQAM

SEQ ID NO: 576179 - protein, 5 aa, Mycobacterium
SDLNE

SEQ ID NO: 576180 - protein, 5 aa, Mycobacterium
SDLPA

SEQ ID NO: 576181 - protein, 8 aa, Mycobacterium
SDLPADPE

SEQ ID NO: 576182 - protein, 5 aa, Mycobacterium
SDLPD

SEQ ID NO: 576183 - protein, 9 aa, Mycobacterium
SDLPDGGTG

SEQ ID NO: 576184 - protein, 7 aa, Mycobacterium
SDLPDQE

SEQ ID NO: 576185 - protein, 13 aa, Mycobacterium
SDLPENERQRIAE

SEQ ID NO: 576186 - protein, 8 aa, Mycobacterium
SDLPGGDK

SEQ ID NO: 576187 - protein, 6 aa, Mycobacterium
SDLPKN

SEQ ID NO: 576188 - protein, 8 aa, Mycobacterium
SDLPPGIQ

SEQ ID NO: 576189 - protein, 8 aa, Mycobacterium
SDLPPQPV

SEQ ID NO: 576190 - protein, 19 aa, Mycobacterium
SDLPSRPKIVPTANDARER

SEQ ID NO: 576191 - protein, 4 aa, Mycobacterium
SDLQ

SEQ ID NO: 576192 - protein, 11 aa, Mycobacterium
SDLQGSGSYRA

SEQ ID NO: 576193 - protein, 16 aa, Mycobacterium
SDLQTRTCAAAEEPPP

SEQ ID NO: 576194 - protein, 4 aa, Mycobacterium
SDLR

SEQ ID NO: 576195 - protein, 6 aa, Mycobacterium
SDLRGP

SEQ ID NO: 576196 - protein, 39 aa, Mycobacterium
SDLRPPTVAPPAVPSAPTGPVSGAPVASPSSSPSAGGSM

SEQ ID NO: 576197 - protein, 5 aa, Mycobacterium
SDLSA

SEQ ID NO: 576198 - protein, 11 aa, Mycobacterium
SDLSDNEAELR

SEQ ID NO: 576199 - protein, 9 aa, Mycobacterium
SDLSDPAEN

SEQ ID NO: 576200 - protein, 12 aa, Mycobacterium
SDLSEDSDDLAR

SEQ ID NO: 576201 - protein, 10 aa, Mycobacterium
SDLSGGQRQR

SEQ ID NO: 576202 - protein, 8 aa, Mycobacterium
SDLSTRPG

SEQ ID NO: 576203 - protein, 9 aa, Mycobacterium
SDLSTYNED

SEQ ID NO: 576204 - protein, 4 aa, Mycobacterium
SDLT

SEQ ID NO: 576205 - protein, 5 aa, Mycobacterium
SDLTA

SEQ ID NO: 576206 - protein, 25 aa, Mycobacterium
SDLTGSRVTAAEGKRLAAKRRNTVD

SEQ ID NO: 576207 - protein, 6 aa, Mycobacterium
SDLTNI
